United States Patent 11,254,933 (CRISPR/CAS TRANSCRIPTIONAL MODULATION) - sequence listing, part 16

SEQ ID NO: 693404 - DNA, 20 bp, mouse
ggagcacatagtttttggat

SEQ ID NO: 693405 - DNA, 20 bp, mouse
gacacttgtttaggatacct

SEQ ID NO: 693406 - DNA, 20 bp, mouse
gcctagcaacacccactagg

SEQ ID NO: 693407 - DNA, 20 bp, mouse
gatccaggccggctaggcgg

SEQ ID NO: 693408 - DNA, 20 bp, mouse
gactgaaggcgccgcctagt

SEQ ID NO: 693409 - DNA, 20 bp, mouse
gtgaaagctggatcaaaact

SEQ ID NO: 693410 - DNA, 20 bp, mouse
gcggagggcggggccagatg

SEQ ID NO: 693411 - DNA, 20 bp, mouse
gccctccgcccccgcctagc

SEQ ID NO: 693412 - DNA, 20 bp, mouse
gttactccctttcttttctg

SEQ ID NO: 693413 - DNA, 20 bp, mouse
gactccctgagcacaccttg

SEQ ID NO: 693414 - DNA, 20 bp, mouse
ggcgtgaccagggtgtttag

SEQ ID NO: 693415 - DNA, 20 bp, mouse
gttggttggaatgagactga

SEQ ID NO: 693416 - DNA, 20 bp, mouse
gcagagctgccctaccccca

SEQ ID NO: 693417 - DNA, 20 bp, mouse
ggcgggaggtccaccaatcc

SEQ ID NO: 693418 - DNA, 20 bp, mouse
gcgagacaagctggcgtcgg

SEQ ID NO: 693419 - DNA, 20 bp, mouse
gtgaggaggtggggtttcgt

SEQ ID NO: 693420 - DNA, 20 bp, mouse
gggctggggcggagtctcgc

SEQ ID NO: 693421 - DNA, 20 bp, mouse
ggggcggaacgcccagctgg

SEQ ID NO: 693422 - DNA, 20 bp, mouse
gagctggagggggaaaccaa

SEQ ID NO: 693423 - DNA, 20 bp, mouse
ggagcgagacaagctggcgt

SEQ ID NO: 693424 - DNA, 20 bp, mouse
gccagccggcgttggggtct

SEQ ID NO: 693425 - DNA, 20 bp, mouse
gctgccctacccccacggtt

SEQ ID NO: 693426 - DNA, 20 bp, mouse
gacaccctgactagagggcg

SEQ ID NO: 693427 - DNA, 20 bp, mouse
gcagagggaagttggggttg

SEQ ID NO: 693428 - DNA, 20 bp, mouse
ggactgacaccctgactaga

SEQ ID NO: 693429 - DNA, 20 bp, mouse
gagagggcggggaagccaga

SEQ ID NO: 693430 - DNA, 20 bp, mouse
gtcaccgaaaccacgccctc

SEQ ID NO: 693431 - DNA, 20 bp, mouse
gcacacgaaggcccacgcac

SEQ ID NO: 693432 - DNA, 20 bp, mouse
ggggggggaggtcaggaatt

SEQ ID NO: 693433 - DNA, 20 bp, mouse
ggcttccccgccctctagtc

SEQ ID NO: 693434 - DNA, 20 bp, mouse
ggaaatgagaaatctcctca

SEQ ID NO: 693435 - DNA, 20 bp, mouse
ggggcatgaatgaacaggag

SEQ ID NO: 693436 - DNA, 20 bp, mouse
ggagctgcggaagaacgcag

SEQ ID NO: 693437 - DNA, 20 bp, mouse
gcgggcgctgaagaagagca

SEQ ID NO: 693438 - DNA, 20 bp, mouse
gcagctccgtggaacggagc

SEQ ID NO: 693439 - DNA, 20 bp, mouse
gcccgctcggggacttctct

SEQ ID NO: 693440 - DNA, 20 bp, mouse
gggagctggctgccagccat

SEQ ID NO: 693441 - DNA, 20 bp, mouse
gggtcgagagtgttgctggt

SEQ ID NO: 693442 - DNA, 20 bp, mouse
gcgacagcgacggagagtct

SEQ ID NO: 693443 - DNA, 20 bp, mouse
gtggaggtcgagagtgttgc

SEQ ID NO: 693444 - DNA, 20 bp, mouse
gtcctagtgccgtcgccagc

SEQ ID NO: 693445 - DNA, 20 bp, mouse
gggcagccagctccgttcca

SEQ ID NO: 693446 - DNA, 20 bp, mouse
gggtgggctctgcaccgtgg

SEQ ID NO: 693447 - DNA, 20 bp, mouse
ggagaccttgagccctgcgg

SEQ ID NO: 693448 - DNA, 20 bp, mouse
gaaggtctggggcctctcgt

SEQ ID NO: 693449 - DNA, 20 bp, mouse
gggtgcagagcccacccccg

SEQ ID NO: 693450 - DNA, 20 bp, mouse
gcagggctcaaggtctcccg

SEQ ID NO: 693451 - DNA, 20 bp, mouse
gggggcgggacctcgggggt

SEQ ID NO: 693452 - DNA, 20 bp, mouse
gccagcctccgcagggctca

SEQ ID NO: 693453 - DNA, 20 bp, mouse
gactggcgggtgtacgtcac

SEQ ID NO: 693454 - DNA, 20 bp, mouse
ggggctctgcaccgtggggg

SEQ ID NO: 693455 - DNA, 20 bp, mouse
ggccccctccagcctccgca

SEQ ID NO: 693456 - DNA, 20 bp, mouse
ggaccagaggtccctgaagg

SEQ ID NO: 693457 - DNA, 20 bp, mouse
gacagagggaagtaatctgc

SEQ ID NO: 693458 - DNA, 20 bp, mouse
gcttcctcccgggataatta

SEQ ID NO: 693459 - DNA, 20 bp, mouse
gcgaagtcgcacacccacag

SEQ ID NO: 693460 - DNA, 20 bp, mouse
gcgctaggcaacactcacca

SEQ ID NO: 693461 - DNA, 20 bp, mouse
ggcctagcggtctctgagaa

SEQ ID NO: 693462 - DNA, 20 bp, mouse
ggcgcggagtcgggaggctc

SEQ ID NO: 693463 - DNA, 20 bp, mouse
gcctgctgcggtctgagcta

SEQ ID NO: 693464 - DNA, 20 bp, mouse
gtgggaggcgcggagtcggg

SEQ ID NO: 693465 - DNA, 20 bp, mouse
gttaccctaattatcccggg

SEQ ID NO: 693466 - DNA, 20 bp, mouse
gtagtgaaggtgcagttctg

SEQ ID NO: 693467 - DNA, 20 bp, mouse
gcccaggctactcagtcaag

SEQ ID NO: 693468 - DNA, 20 bp, mouse
ggggtctgtaagtgcccact

SEQ ID NO: 693469 - DNA, 20 bp, mouse
ggtgctctctgcatccaagt

SEQ ID NO: 693470 - DNA, 20 bp, mouse
gccggtactggggatgggta

SEQ ID NO: 693471 - DNA, 20 bp, mouse
gctaggccggtactggggat

SEQ ID NO: 693472 - DNA, 20 bp, mouse
gcagatagtaagggtagtct

SEQ ID NO: 693473 - DNA, 20 bp, mouse
gtggctctaggccggtactg

SEQ ID NO: 693474 - DNA, 20 bp, mouse
gaggtggccacaaacctcgg

SEQ ID NO: 693475 - DNA, 20 bp, mouse
ggcagatgccgccgagtcgg

SEQ ID NO: 693476 - DNA, 20 bp, mouse
gtagaggcggccacttcgta

SEQ ID NO: 693477 - DNA, 20 bp, mouse
gggggcgggtccctacgaag

SEQ ID NO: 693478 - DNA, 20 bp, mouse
ggaccccgcctccaaggtag

SEQ ID NO: 693479 - DNA, 20 bp, mouse
gccgcagcccgcctgctagg

SEQ ID NO: 693480 - DNA, 20 bp, mouse
ggccgcctctaccttggagg

SEQ ID NO: 693481 - DNA, 20 bp, mouse
ggctcaggaccccgcctcca

SEQ ID NO: 693482 - DNA, 20 bp, mouse
gcccgcctccaaggtagagg

SEQ ID NO: 693483 - DNA, 20 bp, mouse
gaatcaacgccgagcggagt

SEQ ID NO: 693484 - DNA, 20 bp, mouse
gggacccgccccccggccgt

SEQ ID NO: 693485 - DNA, 20 bp, mouse
gtgctaggcggcgattccca

SEQ ID NO: 693486 - DNA, 20 bp, mouse
gcagccaatcagcgccgggg

SEQ ID NO: 693487 - DNA, 20 bp, mouse
gcccctgcgaggtattgcat

SEQ ID NO: 693488 - DNA, 20 bp, mouse
gttggccccgtgccactcgt

SEQ ID NO: 693489 - DNA, 20 bp, mouse
gggacgcggagcccgcaccg

SEQ ID NO: 693490 - DNA, 20 bp, mouse
gcacgtgcacacgcccgccc

SEQ ID NO: 693491 - DNA, 20 bp, mouse
ggagcccgcaccgcggccac

SEQ ID NO: 693492 - DNA, 20 bp, mouse
gcgtcctccgggacatcccc

SEQ ID NO: 693493 - DNA, 20 bp, mouse
gcgggccggctcgcgcctgg

SEQ ID NO: 693494 - DNA, 20 bp, mouse
gaacgcccccaggcgcgagc

SEQ ID NO: 693495 - DNA, 20 bp, mouse
ggcggcccacgagtggcacg

SEQ ID NO: 693496 - DNA, 20 bp, mouse
gtccccaagctgaaaaggag

SEQ ID NO: 693497 - DNA, 20 bp, mouse
gacagagcgggccagactga

SEQ ID NO: 693498 - DNA, 20 bp, mouse
gtggggaaagcgagcgtgcg

SEQ ID NO: 693499 - DNA, 20 bp, mouse
ggggtggcggcattctgcat

SEQ ID NO: 693500 - DNA, 20 bp, mouse
gattggacaggaggtgttag

SEQ ID NO: 693501 - DNA, 20 bp, mouse
gcgcgagcacctccttacac

SEQ ID NO: 693502 - DNA, 20 bp, mouse
gtaacaatgccagtgtaagg

SEQ ID NO: 693503 - DNA, 20 bp, mouse
ggtggagagagagctgatgg

SEQ ID NO: 693504 - DNA, 20 bp, mouse
gaatagtcaggagtagctgt

SEQ ID NO: 693505 - DNA, 20 bp, mouse
gaacacctcctgtccaatca

SEQ ID NO: 693506 - DNA, 20 bp, mouse
ggatggggcagcaaccgtgt

SEQ ID NO: 693507 - DNA, 20 bp, mouse
gcgggcgtggtgcaacccgt

SEQ ID NO: 693508 - DNA, 20 bp, mouse
gcctctgcccggtgcaccca

SEQ ID NO: 693509 - DNA, 20 bp, mouse
ggggtcacgatgctccaaca

SEQ ID NO: 693510 - DNA, 20 bp, mouse
gcggttgctgccccatccga

SEQ ID NO: 693511 - DNA, 20 bp, mouse
ggggagagaccactgctgcg

SEQ ID NO: 693512 - DNA, 20 bp, mouse
ggcgccccgccgctccccgc

SEQ ID NO: 693513 - DNA, 20 bp, mouse
ggctgcgcgggggggattcc

SEQ ID NO: 693514 - DNA, 20 bp, mouse
gccacctgagccgcgggcgt

SEQ ID NO: 693515 - DNA, 20 bp, mouse
ggggactggccctacctgtc

SEQ ID NO: 693516 - DNA, 20 bp, mouse
gggtgggctcggtggaagag

SEQ ID NO: 693517 - DNA, 20 bp, mouse
gacgccgagggtgggctcgg

SEQ ID NO: 693518 - DNA, 20 bp, mouse
ggcaagccccaggacgccga

SEQ ID NO: 693519 - DNA, 20 bp, mouse
gtggctgggcggtctgtgag

SEQ ID NO: 693520 - DNA, 20 bp, mouse
ggcccaccctcggcgtcctg

SEQ ID NO: 693521 - DNA, 20 bp, mouse
gcactctgctggagttcagt

SEQ ID NO: 693522 - DNA, 20 bp, mouse
gggcgagcgcacaaggatcc

SEQ ID NO: 693523 - DNA, 20 bp, mouse
gcggccgctctgggcgagag

SEQ ID NO: 693524 - DNA, 20 bp, mouse
gggagggcgcaggtggtcgc

SEQ ID NO: 693525 - DNA, 20 bp, mouse
gcggggtaggagccggtatc

SEQ ID NO: 693526 - DNA, 20 bp, mouse
ggcggcatgtgtggaactta

SEQ ID NO: 693527 - DNA, 20 bp, mouse
gcggggggaaactctgacat

SEQ ID NO: 693528 - DNA, 20 bp, mouse
gggagggaggggcgcatagg

SEQ ID NO: 693529 - DNA, 20 bp, mouse
gccgcccgaactgagcctgt

SEQ ID NO: 693530 - DNA, 20 bp, mouse
gtgggaggggggggtgcacg

SEQ ID NO: 693531 - DNA, 20 bp, mouse
gcccccctcccagagaaacc

SEQ ID NO: 693532 - DNA, 20 bp, mouse
gctaggagggaggggcgcat

SEQ ID NO: 693533 - DNA, 20 bp, mouse
ggcgcctggcctaggaggga

SEQ ID NO: 693534 - DNA, 20 bp, mouse
gggagcaggggattgcattt

SEQ ID NO: 693535 - DNA, 20 bp, mouse
gctgaataattcatgagagg

SEQ ID NO: 693536 - DNA, 20 bp, mouse
gtcctcccgcaggtcctggc

SEQ ID NO: 693537 - DNA, 20 bp, mouse
gagagcgagagcggctgaag

SEQ ID NO: 693538 - DNA, 20 bp, mouse
gcccgcccgtgtgccgagga

SEQ ID NO: 693539 - DNA, 20 bp, mouse
ggggtcctaggcccagaggg

SEQ ID NO: 693540 - DNA, 20 bp, mouse
gggcctaggacccaagtgcg

SEQ ID NO: 693541 - DNA, 20 bp, mouse
gtccccagcggggcgtgcag

SEQ ID NO: 693542 - DNA, 20 bp, mouse
gcaggctgggagagacgaga

SEQ ID NO: 693543 - DNA, 20 bp, mouse
gtgggcccgcccgtgtgccg

SEQ ID NO: 693544 - DNA, 20 bp, mouse
gtccactgcacgccccgctg

SEQ ID NO: 693545 - DNA, 20 bp, mouse
gcgcggcgccggatccccag

SEQ ID NO: 693546 - DNA, 20 bp, mouse
gggccaaccagccaactcgg

SEQ ID NO: 693547 - DNA, 20 bp, mouse
gagaggaaggctgtagcacc

SEQ ID NO: 693548 - DNA, 20 bp, mouse
gagggtagagtgtctcgcgt

SEQ ID NO: 693549 - DNA, 20 bp, mouse
gttacaacgaactgctagga

SEQ ID NO: 693550 - DNA, 20 bp, mouse
gtaagtgcaccctgtgaggc

SEQ ID NO: 693551 - DNA, 20 bp, mouse
gtgtagcaccaggccagctt

SEQ ID NO: 693552 - DNA, 20 bp, mouse
gcaactcgggggtggggcca

SEQ ID NO: 693553 - DNA, 20 bp, mouse
gtggggccaaggcctgggcg

SEQ ID NO: 693554 - DNA, 20 bp, mouse
gtacacacaagagcccaagc

SEQ ID NO: 693555 - DNA, 20 bp, mouse
gaggcatggacaccaagcag

SEQ ID NO: 693556 - DNA, 20 bp, mouse
ggctgggcaggtaagatcac

SEQ ID NO: 693557 - DNA, 20 bp, mouse
gatcctagagctaggactgg

SEQ ID NO: 693558 - DNA, 20 bp, mouse
gaggccaacatgaactaaac

SEQ ID NO: 693559 - DNA, 20 bp, mouse
ggggaaatgaaggatcatca

SEQ ID NO: 693560 - DNA, 20 bp, mouse
gccagccagaatctaatcag

SEQ ID NO: 693561 - DNA, 20 bp, mouse
gaacccccagtcctagctct

SEQ ID NO: 693562 - DNA, 20 bp, mouse
ggatgcctgggcactgactc

SEQ ID NO: 693563 - DNA, 20 bp, mouse
gtcaaaagataaaggtattg

SEQ ID NO: 693564 - DNA, 20 bp, mouse
gattaagagatcctagagct

SEQ ID NO: 693565 - DNA, 20 bp, mouse
gctttccactgattagattc

SEQ ID NO: 693566 - DNA, 20 bp, mouse
gaccaggattgacacttggg

SEQ ID NO: 693567 - DNA, 20 bp, mouse
gggagagaggggtcttgagg

SEQ ID NO: 693568 - DNA, 20 bp, mouse
gtctgagaattggggagcct

SEQ ID NO: 693569 - DNA, 20 bp, mouse
gtggaaacaggcttggtatg

SEQ ID NO: 693570 - DNA, 20 bp, mouse
gacatccagcaagaagctcc

SEQ ID NO: 693571 - DNA, 20 bp, mouse
gggtcaaagtctgagaattg

SEQ ID NO: 693572 - DNA, 20 bp, mouse
gcaagaccaggattgacact

SEQ ID NO: 693573 - DNA, 20 bp, mouse
gcccacccaagtgtcaatcc

SEQ ID NO: 693574 - DNA, 20 bp, mouse
gaggcagctgatcagtaggc

SEQ ID NO: 693575 - DNA, 20 bp, mouse
ggcttggtatggggagagag

SEQ ID NO: 693576 - DNA, 20 bp, mouse
gagccctaggacatgctgga

SEQ ID NO: 693577 - DNA, 20 bp, mouse
ggggcagaacgagacactta

SEQ ID NO: 693578 - DNA, 20 bp, mouse
gcggaaagagggaccgtggg

SEQ ID NO: 693579 - DNA, 20 bp, mouse
ggtagcaggtggcagtgttc

SEQ ID NO: 693580 - DNA, 20 bp, mouse
gctccatccagcatgtccta

SEQ ID NO: 693581 - DNA, 20 bp, mouse
gttgcggaaagagggaccgt

SEQ ID NO: 693582 - DNA, 20 bp, mouse
gtgctggatggagtttaaac

SEQ ID NO: 693583 - DNA, 20 bp, mouse
gcctgggatcaaagttagat

SEQ ID NO: 693584 - DNA, 20 bp, mouse
gtgcgaggacctggtttcgg

SEQ ID NO: 693585 - DNA, 20 bp, mouse
gttcggaggttgcggaaaga

SEQ ID NO: 693586 - DNA, 20 bp, mouse
gggctctagcgacgtggcac

SEQ ID NO: 693587 - DNA, 20 bp, mouse
gtctagcgacgtggcacggg

SEQ ID NO: 693588 - DNA, 20 bp, mouse
gctagagccgagcgacatga

SEQ ID NO: 693589 - DNA, 20 bp, mouse
gcgggcgcgcggcgtgtgcg

SEQ ID NO: 693590 - DNA, 20 bp, mouse
ggacgccgaacgccatcccc

SEQ ID NO: 693591 - DNA, 20 bp, mouse
gggagcttcgacaggacctg

SEQ ID NO: 693592 - DNA, 20 bp, mouse
gaggacctggggatggcgtt

SEQ ID NO: 693593 - DNA, 20 bp, mouse
ggcgtcgccttcatgtcgct

SEQ ID NO: 693594 - DNA, 20 bp, mouse
gccggatgtgagaatcgcgg

SEQ ID NO: 693595 - DNA, 20 bp, mouse
gtcgctcggctctagcgacg

SEQ ID NO: 693596 - DNA, 20 bp, mouse
gtcacgcggccgtgggatca

SEQ ID NO: 693597 - DNA, 20 bp, mouse
gacccacactggacctagga

SEQ ID NO: 693598 - DNA, 20 bp, mouse
gggcattcggggctcgcgag

SEQ ID NO: 693599 - DNA, 20 bp, mouse
gccgtgggatcagggttccc

SEQ ID NO: 693600 - DNA, 20 bp, mouse
gcgcaggaagcgggcattcg

SEQ ID NO: 693601 - DNA, 20 bp, mouse
gaagacgacaggacaatgtc

SEQ ID NO: 693602 - DNA, 20 bp, mouse
gtgaccgggccacaaacgcg

SEQ ID NO: 693603 - DNA, 20 bp, mouse
gcgtttgtggcccggtcacg

SEQ ID NO: 693604 - DNA, 20 bp, mouse
gtggatcggcaacttcactg

SEQ ID NO: 693605 - DNA, 20 bp, mouse
ggtgcagcgccgcgcgtttg

SEQ ID NO: 693606 - DNA, 20 bp, mouse
gcgtgaggagctcgagtgat

SEQ ID NO: 693607 - DNA, 20 bp, mouse
gggcccgacaccaggctaga

SEQ ID NO: 693608 - DNA, 20 bp, mouse
gagggcacctccgttcctat

SEQ ID NO: 693609 - DNA, 20 bp, mouse
gagagcgggacagagatccc

SEQ ID NO: 693610 - DNA, 20 bp, mouse
gaacggaggtgccctggcgg

SEQ ID NO: 693611 - DNA, 20 bp, mouse
gtaaacagcggcccgacacc

SEQ ID NO: 693612 - DNA, 20 bp, mouse
gcacggtccgctcttcctat

SEQ ID NO: 693613 - DNA, 20 bp, mouse
gccagcggcaagtgctgatt

SEQ ID NO: 693614 - DNA, 20 bp, mouse
gtgatctggcgcagaaccca

SEQ ID NO: 693615 - DNA, 20 bp, mouse
gctccagccaataggaacgg

SEQ ID NO: 693616 - DNA, 20 bp, mouse
gaggcctgagggtcccgcga

SEQ ID NO: 693617 - DNA, 20 bp, mouse
gccggaaatggtgccggggt

SEQ ID NO: 693618 - DNA, 20 bp, mouse
gcagtcccgtgcgccggaaa

SEQ ID NO: 693619 - DNA, 20 bp, mouse
gagatgcggaagtgacgcaa

SEQ ID NO: 693620 - DNA, 20 bp, mouse
gcccgcgagggtagccacag

SEQ ID NO: 693621 - DNA, 20 bp, mouse
gctgccgggcgaagtgcaga

SEQ ID NO: 693622 - DNA, 20 bp, mouse
gaccctcggccgaaagagac

SEQ ID NO: 693623 - DNA, 20 bp, mouse
gctccactgctgcgtagatg

SEQ ID NO: 693624 - DNA, 20 bp, mouse
gtccgcgaccaaacccaccc

SEQ ID NO: 693625 - DNA, 20 bp, mouse
ggacgcgcagtcccgtgcgc

SEQ ID NO: 693626 - DNA, 20 bp, mouse
gtgggaggggcggaccggtt

SEQ ID NO: 693627 - DNA, 20 bp, mouse
gctggggaattgttgaggta

SEQ ID NO: 693628 - DNA, 20 bp, mouse
ggggcggaccggtttggagg

SEQ ID NO: 693629 - DNA, 20 bp, mouse
gaggccttgggggcatatgt

SEQ ID NO: 693630 - DNA, 20 bp, mouse
gccttgggggcatatgtggg

SEQ ID NO: 693631 - DNA, 20 bp, mouse
gccccgccctccgagcgcgg

SEQ ID NO: 693632 - DNA, 20 bp, mouse
gggggcctaggagcgaggca

SEQ ID NO: 693633 - DNA, 20 bp, mouse
gatgccctggggaattgttg

SEQ ID NO: 693634 - DNA, 20 bp, mouse
ggaggcggggcctaggagcg

SEQ ID NO: 693635 - DNA, 20 bp, mouse
gaggagcctccgcgctcgga

SEQ ID NO: 693636 - DNA, 20 bp, mouse
ggctagaagtaggtgagggt

SEQ ID NO: 693637 - DNA, 20 bp, mouse
gtctgccgggcggtgccttc

SEQ ID NO: 693638 - DNA, 20 bp, mouse
gctcccctgaaggcaccgcc

SEQ ID NO: 693639 - DNA, 20 bp, mouse
gtgtcagccggtgaccccag

SEQ ID NO: 693640 - DNA, 20 bp, mouse
gcctctgctagaagtaggtg

SEQ ID NO: 693641 - DNA, 20 bp, mouse
gcgtccggctaggagggtta

SEQ ID NO: 693642 - DNA, 20 bp, mouse
gacttctagcagaggaggta

SEQ ID NO: 693643 - DNA, 20 bp, mouse
gtaaggcttgggataggtat

SEQ ID NO: 693644 - DNA, 20 bp, mouse
gcttgggataggtattggag

SEQ ID NO: 693645 - DNA, 20 bp, mouse
gaaaggttaactcacttgaa

SEQ ID NO: 693646 - DNA, 20 bp, mouse
ggagcaagacatcctctcta

SEQ ID NO: 693647 - DNA, 20 bp, mouse
gcagctctccccagagcgga

SEQ ID NO: 693648 - DNA, 20 bp, mouse
ggggacagcagaagtggtat

SEQ ID NO: 693649 - DNA, 20 bp, mouse
ggcgctggacggttgagttg

SEQ ID NO: 693650 - DNA, 20 bp, mouse
ggccgcccaatccggagggg

SEQ ID NO: 693651 - DNA, 20 bp, mouse
gtggggagagctgcgctgga

SEQ ID NO: 693652 - DNA, 20 bp, mouse
ggcgacggccgcgtcactgg

SEQ ID NO: 693653 - DNA, 20 bp, mouse
ggtggtataggcataaggga

SEQ ID NO: 693654 - DNA, 20 bp, mouse
gagaagtggtataggcataa

SEQ ID NO: 693655 - DNA, 20 bp, mouse
ggaagcgaaaacaccactcc

SEQ ID NO: 693656 - DNA, 20 bp, mouse
gccaccccctacactggttt

SEQ ID NO: 693657 - DNA, 20 bp, mouse
gccactgcctaaaccagtgt

SEQ ID NO: 693658 - DNA, 20 bp, mouse
gagggaacaggggccttctt

SEQ ID NO: 693659 - DNA, 20 bp, mouse
ggcagccggcaggccacaga

SEQ ID NO: 693660 - DNA, 20 bp, mouse
gtgggtgtgtgagtggaatc

SEQ ID NO: 693661 - DNA, 20 bp, mouse
gaaggcccctgttcccttgg

SEQ ID NO: 693662 - DNA, 20 bp, mouse
gtgcccggactagacctaga

SEQ ID NO: 693663 - DNA, 20 bp, mouse
gctggggaagagatactggc

SEQ ID NO: 693664 - DNA, 20 bp, mouse
gtctgccccaccccctacac

SEQ ID NO: 693665 - DNA, 20 bp, mouse
gtcaccgtctaggtctagtc

SEQ ID NO: 693666 - DNA, 20 bp, mouse
gaccctcagtgcagcatgga

SEQ ID NO: 693667 - DNA, 20 bp, mouse
gaggctttctccatagatgt

SEQ ID NO: 693668 - DNA, 20 bp, mouse
gctatgcagtccaagcagaa

SEQ ID NO: 693669 - DNA, 20 bp, mouse
gtacactttgggcactaccc

SEQ ID NO: 693670 - DNA, 20 bp, mouse
gcctactgagagaatcggat

SEQ ID NO: 693671 - DNA, 20 bp, mouse
gcattcacagcccacatcta

SEQ ID NO: 693672 - DNA, 20 bp, mouse
gaagttctcgagatcataag

SEQ ID NO: 693673 - DNA, 20 bp, mouse
gtacagcctactgagagaat

SEQ ID NO: 693674 - DNA, 20 bp, mouse
ggatggtgtagagtacactt

SEQ ID NO: 693675 - DNA, 20 bp, mouse
ggagagaatcggatgggcga

SEQ ID NO: 693676 - DNA, 20 bp, mouse
gagagaggctgaaatgtcgt

SEQ ID NO: 693677 - DNA, 20 bp, mouse
gcaactggagcgtgcggtta

SEQ ID NO: 693678 - DNA, 20 bp, mouse
gcacgactgcagagaggtca

SEQ ID NO: 693679 - DNA, 20 bp, mouse
gcagtcgtggcgcgtggagt

SEQ ID NO: 693680 - DNA, 20 bp, mouse
gagtatccgcgggccgggga

SEQ ID NO: 693681 - DNA, 20 bp, mouse
ggcccgcggatactgacgtc

SEQ ID NO: 693682 - DNA, 20 bp, mouse
gctggagcgtgcggttaagg

SEQ ID NO: 693683 - DNA, 20 bp, mouse
gcgtggcgcgtggagtgggg

SEQ ID NO: 693684 - DNA, 20 bp, mouse
ggagcgaaggctgccttggc

SEQ ID NO: 693685 - DNA, 20 bp, mouse
gacgcgccacgactgcagag

SEQ ID NO: 693686 - DNA, 20 bp, mouse
ggcccaggaagaaggatggt

SEQ ID NO: 693687 - DNA, 20 bp, mouse
ggggtcagggcctggttccg

SEQ ID NO: 693688 - DNA, 20 bp, mouse
gccgccacggcctgtgaggc

SEQ ID NO: 693689 - DNA, 20 bp, mouse
gccgccggcctcacaggccg

SEQ ID NO: 693690 - DNA, 20 bp, mouse
gggaaaacccggtgcggata

SEQ ID NO: 693691 - DNA, 20 bp, mouse
gctctggggtggacggtcag

SEQ ID NO: 693692 - DNA, 20 bp, mouse
gcggcgcgcaaagcccggag

SEQ ID NO: 693693 - DNA, 20 bp, mouse
gctccctggaaaacccggtg

SEQ ID NO: 693694 - DNA, 20 bp, mouse
ggagtctgagccgcggaacc

SEQ ID NO: 693695 - DNA, 20 bp, mouse
gcggctcagactcccgctcc

SEQ ID NO: 693696 - DNA, 20 bp, mouse
gtgcgcactagtacgaagga

SEQ ID NO: 693697 - DNA, 20 bp, mouse
gagggcggggcagttctggc

SEQ ID NO: 693698 - DNA, 20 bp, mouse
gggcggagcctcgatcacag

SEQ ID NO: 693699 - DNA, 20 bp, mouse
gggagagggcggggcagttc

SEQ ID NO: 693700 - DNA, 20 bp, mouse
gggaacccaagggataggta

SEQ ID NO: 693701 - DNA, 20 bp, mouse
ggagaagttttgcagtaaga

SEQ ID NO: 693702 - DNA, 20 bp, mouse
ggccctctccactgtgatcg

SEQ ID NO: 693703 - DNA, 20 bp, mouse
gggagtgcagcggtctggaa

SEQ ID NO: 693704 - DNA, 20 bp, mouse
gcgggctagtcggtctgtgg

SEQ ID NO: 693705 - DNA, 20 bp, mouse
gtcggcccactaaacttacg

SEQ ID NO: 693706 - DNA, 20 bp, mouse
gaagggctttacctcctcag

SEQ ID NO: 693707 - DNA, 20 bp, mouse
ggggaggtgtagcaatatgg

SEQ ID NO: 693708 - DNA, 20 bp, mouse
ggaggtaaagcccttccccg

SEQ ID NO: 693709 - DNA, 20 bp, mouse
gtaaagcccttccccgaggt

SEQ ID NO: 693710 - DNA, 20 bp, mouse
ggaggcctgggagagtccaa

SEQ ID NO: 693711 - DNA, 20 bp, mouse
gaggcagagtctaaggaaca

SEQ ID NO: 693712 - DNA, 20 bp, mouse
ggaggaggaagtcttagctg

SEQ ID NO: 693713 - DNA, 20 bp, mouse
gtgaagcagtcccaccctct

SEQ ID NO: 693714 - DNA, 20 bp, mouse
gaaggaagtcaccaccgctg

SEQ ID NO: 693715 - DNA, 20 bp, mouse
gacagagcagcaaataacaa

SEQ ID NO: 693716 - DNA, 20 bp, mouse
ggctctggatagaatctcaa

SEQ ID NO: 693717 - DNA, 20 bp, mouse
gggatcccgggtctcccctg

SEQ ID NO: 693718 - DNA, 20 bp, mouse
gcgagcacggcaccccgcag

SEQ ID NO: 693719 - DNA, 20 bp, mouse
ggggtgccgtgctcgccttg

SEQ ID NO: 693720 - DNA, 20 bp, mouse
gtgagtctctagtagaccct

SEQ ID NO: 693721 - DNA, 20 bp, mouse
ggcaccccgcaggggagacc

SEQ ID NO: 693722 - DNA, 20 bp, mouse
gcgggatcccagcctcagag

SEQ ID NO: 693723 - DNA, 20 bp, mouse
gtgtgcgcgccgctcgctcc

SEQ ID NO: 693724 - DNA, 20 bp, mouse
ggcggggcaacgcgcgttcc

SEQ ID NO: 693725 - DNA, 20 bp, mouse
gggtctgcagagcacagccg

SEQ ID NO: 693726 - DNA, 20 bp, mouse
gtatcagggagggtgggtgt

SEQ ID NO: 693727 - DNA, 20 bp, mouse
gcaacaaccagaatcttcta

SEQ ID NO: 693728 - DNA, 20 bp, mouse
gttattgcttacatcttatg

SEQ ID NO: 693729 - DNA, 20 bp, mouse
ggttctctttaaagaggaaa

SEQ ID NO: 693730 - DNA, 20 bp, mouse
gattgttgttctctttaaag

SEQ ID NO: 693731 - DNA, 20 bp, mouse
ggacatcctgtgttctaagt

SEQ ID NO: 693732 - DNA, 20 bp, mouse
gaagagaacaacaattgcct

SEQ ID NO: 693733 - DNA, 20 bp, mouse
gtggggaacgacggtgataa

SEQ ID NO: 693734 - DNA, 20 bp, mouse
gactgcgaatcaaggttata

SEQ ID NO: 693735 - DNA, 20 bp, mouse
gaaaaactccggactggcgc

SEQ ID NO: 693736 - DNA, 20 bp, mouse
gcacccgggagtgggcacga

SEQ ID NO: 693737 - DNA, 20 bp, mouse
ggggcccgcccccttccttc

SEQ ID NO: 693738 - DNA, 20 bp, mouse
gcacgagggagcctgaagga

SEQ ID NO: 693739 - DNA, 20 bp, mouse
gaaccacagttggtgtggtg

SEQ ID NO: 693740 - DNA, 20 bp, mouse
ggggccgcaccctgttctcc

SEQ ID NO: 693741 - DNA, 20 bp, mouse
gttaccgagtcacccgggag

SEQ ID NO: 693742 - DNA, 20 bp, mouse
gccccccaccacaccaactg

SEQ ID NO: 693743 - DNA, 20 bp, mouse
gcagtagcagatggggacat

SEQ ID NO: 693744 - DNA, 20 bp, mouse
ggctttggggaccgctggga

SEQ ID NO: 693745 - DNA, 20 bp, mouse
gacaggttaccgagtcaccc

SEQ ID NO: 693746 - DNA, 20 bp, mouse
gcagcacggtagtggacctg

SEQ ID NO: 693747 - DNA, 20 bp, mouse
gaggaagtgtctgtgctgac

SEQ ID NO: 693748 - DNA, 20 bp, mouse
gcaaccgcacagcacggtag

SEQ ID NO: 693749 - DNA, 20 bp, mouse
gagatgaggggccacacctg

SEQ ID NO: 693750 - DNA, 20 bp, mouse
gtcccgaggagatatgtaaa

SEQ ID NO: 693751 - DNA, 20 bp, mouse
ggtaaaaggtagggagatga

SEQ ID NO: 693752 - DNA, 20 bp, mouse
gaggccaacaaggaagaagc

SEQ ID NO: 693753 - DNA, 20 bp, mouse
gagctggagagcaggggtct

SEQ ID NO: 693754 - DNA, 20 bp, mouse
gaggcccctgggttagcatt

SEQ ID NO: 693755 - DNA, 20 bp, mouse
gggggtctcgggtaaagctc

SEQ ID NO: 693756 - DNA, 20 bp, mouse
gagaaagtccaagggtgtcc

SEQ ID NO: 693757 - DNA, 20 bp, mouse
gcacccagctgcaggtgatc

SEQ ID NO: 693758 - DNA, 20 bp, mouse
gtctcacaggttagcttcct

SEQ ID NO: 693759 - DNA, 20 bp, mouse
gctggtaagggcttctaagg

SEQ ID NO: 693760 - DNA, 20 bp, mouse
ggagggacggatgctggtaa

SEQ ID NO: 693761 - DNA, 20 bp, mouse
gagcccgatcacctgcagct

SEQ ID NO: 693762 - DNA, 20 bp, mouse
gtctaaggaggctcgaggaa

SEQ ID NO: 693763 - DNA, 20 bp, mouse
gtccgggtagagaatgaatg

SEQ ID NO: 693764 - DNA, 20 bp, mouse
gatgctggtaagggcttcta

SEQ ID NO: 693765 - DNA, 20 bp, mouse
gctgcaggtgatcgggctca

SEQ ID NO: 693766 - DNA, 20 bp, mouse
gaagcgacgaagacggtagg

SEQ ID NO: 693767 - DNA, 20 bp, mouse
ggggcggtgtccctacccgc

SEQ ID NO: 693768 - DNA, 20 bp, mouse
gggaaccccgagtgattgtg

SEQ ID NO: 693769 - DNA, 20 bp, mouse
ggcaaatgaagcgacgaaga

SEQ ID NO: 693770 - DNA, 20 bp, mouse
ggggcgggccgtgtaagggg

SEQ ID NO: 693771 - DNA, 20 bp, mouse
gtggcccgggtgagtgtgta

SEQ ID NO: 693772 - DNA, 20 bp, mouse
gcccgcggctcccgcgggta

SEQ ID NO: 693773 - DNA, 20 bp, mouse
gacgaagacggtaggagggg

SEQ ID NO: 693774 - DNA, 20 bp, mouse
gcgtgccgattggattgagg

SEQ ID NO: 693775 - DNA, 20 bp, mouse
ggaggggcgggacttggcga

SEQ ID NO: 693776 - DNA, 20 bp, mouse
gtgaacccaagactagaggt

SEQ ID NO: 693777 - DNA, 20 bp, mouse
gcacacccacctctagtctt

SEQ ID NO: 693778 - DNA, 20 bp, mouse
gagcccccattctggtgagt

SEQ ID NO: 693779 - DNA, 20 bp, mouse
gggcagaagcccaaccccta

SEQ ID NO: 693780 - DNA, 20 bp, mouse
ggctaggggagcccccattc

SEQ ID NO: 693781 - DNA, 20 bp, mouse
gaacaaggtaatggtggcta

SEQ ID NO: 693782 - DNA, 20 bp, mouse
gtagaggtgggtgtggaaca

SEQ ID NO: 693783 - DNA, 20 bp, mouse
gcactgcttcgggttgtggg

SEQ ID NO: 693784 - DNA, 20 bp, mouse
gaacccctaaggcggagctc

SEQ ID NO: 693785 - DNA, 20 bp, mouse
ggagttggtaaagtatgatg

SEQ ID NO: 693786 - DNA, 20 bp, mouse
gggcaccccggcaccaaggt

SEQ ID NO: 693787 - DNA, 20 bp, mouse
gcaggtttgcttccttgcgt

SEQ ID NO: 693788 - DNA, 20 bp, mouse
gaccccggcaccaaggtggg

SEQ ID NO: 693789 - DNA, 20 bp, mouse
gcagacacacattcacctac

SEQ ID NO: 693790 - DNA, 20 bp, mouse
gtccaaacaaggatactgta

SEQ ID NO: 693791 - DNA, 20 bp, mouse
gtcaggaagttgattcgatt

SEQ ID NO: 693792 - DNA, 20 bp, mouse
gaggaggcaccccggcacca

SEQ ID NO: 693793 - DNA, 20 bp, mouse
gtcctcccaccttggtgccg

SEQ ID NO: 693794 - DNA, 20 bp, mouse
gtaacatacaaccccttctg

SEQ ID NO: 693795 - DNA, 20 bp, mouse
gttgcttccttgcgtgggta

SEQ ID NO: 693796 - DNA, 20 bp, mouse
gcaggcaatcagaataattt

SEQ ID NO: 693797 - DNA, 20 bp, mouse
gttaaaattgttcatgcaaa

SEQ ID NO: 693798 - DNA, 20 bp, mouse
gatctgtttcactttgtgta

SEQ ID NO: 693799 - DNA, 20 bp, mouse
gttattgatgcataagagtc

SEQ ID NO: 693800 - DNA, 20 bp, mouse
gaaacttttcttacgggaag

SEQ ID NO: 693801 - DNA, 20 bp, mouse
gttgagtttcgttacagaca

SEQ ID NO: 693802 - DNA, 20 bp, mouse
gattgttatcaaagcattcc

SEQ ID NO: 693803 - DNA, 20 bp, mouse
gtttcacagttctgaaacta

SEQ ID NO: 693804 - DNA, 20 bp, mouse
gtttaagacatgtaaagtga

SEQ ID NO: 693805 - DNA, 20 bp, mouse
ggggctctgttagataaaag

SEQ ID NO: 693806 - DNA, 20 bp, mouse
gagatggagtcacaaagctc

SEQ ID NO: 693807 - DNA, 20 bp, mouse
gaaaaacttaaggaatttgg

SEQ ID NO: 693808 - DNA, 20 bp, mouse
ggactgcagatatctaaaac

SEQ ID NO: 693809 - DNA, 20 bp, mouse
gtatagtcaaatagtctata

SEQ ID NO: 693810 - DNA, 20 bp, mouse
ggcaggtcctaagtctcaat

SEQ ID NO: 693811 - DNA, 20 bp, mouse
gtaatgtcctattgagactt

SEQ ID NO: 693812 - DNA, 20 bp, mouse
gattttttttctggggaaga

SEQ ID NO: 693813 - DNA, 20 bp, mouse
gataatgacataaaaactta

SEQ ID NO: 693814 - DNA, 20 bp, mouse
gcttgggaaacagaactcca

SEQ ID NO: 693815 - DNA, 20 bp, mouse
gaaagctctggacatttccc

SEQ ID NO: 693816 - DNA, 20 bp, mouse
gagggaaagacggtatccaa

SEQ ID NO: 693817 - DNA, 20 bp, mouse
gtgtcccgaggaatgtcatt

SEQ ID NO: 693818 - DNA, 20 bp, mouse
gctacaacaagggataccct

SEQ ID NO: 693819 - DNA, 20 bp, mouse
gcaacaagggataccctagg

SEQ ID NO: 693820 - DNA, 20 bp, mouse
gtaggaggcggagggaaaga

SEQ ID NO: 693821 - DNA, 20 bp, mouse
gacgactgttatactcaggc

SEQ ID NO: 693822 - DNA, 20 bp, mouse
gaagaggagcttctgcggta

SEQ ID NO: 693823 - DNA, 20 bp, mouse
gccgcagaagctcctcttag

SEQ ID NO: 693824 - DNA, 20 bp, mouse
gtgggcgtgggcatgggaac

SEQ ID NO: 693825 - DNA, 20 bp, mouse
ggggataccctaggaggcgg

SEQ ID NO: 693826 - DNA, 20 bp, mouse
gaaagttagggaccctgata

SEQ ID NO: 693827 - DNA, 20 bp, mouse
gcctggtgctctgccagtcc

SEQ ID NO: 693828 - DNA, 20 bp, mouse
ggcttcgggaactcaaagtt

SEQ ID NO: 693829 - DNA, 20 bp, mouse
gggcagggcacgtggggctg

SEQ ID NO: 693830 - DNA, 20 bp, mouse
gggaatgcattctccaggac

SEQ ID NO: 693831 - DNA, 20 bp, mouse
gaggcgcacccatcaaaacg

SEQ ID NO: 693832 - DNA, 20 bp, mouse
gacaaatacaccacgagatg

SEQ ID NO: 693833 - DNA, 20 bp, mouse
gcccccccccccagcatata

SEQ ID NO: 693834 - DNA, 20 bp, mouse
gaatacaccacgagatgtgg

SEQ ID NO: 693835 - DNA, 20 bp, mouse
ggggtgaagtgaacctgcta

SEQ ID NO: 693836 - DNA, 20 bp, mouse
gaacttggaagaccccactt

SEQ ID NO: 693837 - DNA, 20 bp, mouse
gcttcgcctgaactgcagta

SEQ ID NO: 693838 - DNA, 20 bp, mouse
gctgcagttcaggcgaagga

SEQ ID NO: 693839 - DNA, 20 bp, mouse
gagttcaggcgaaggagggg

SEQ ID NO: 693840 - DNA, 20 bp, mouse
gaccaaccctactgcagttc

SEQ ID NO: 693841 - DNA, 20 bp, mouse
gggtatctacggggtagatt

SEQ ID NO: 693842 - DNA, 20 bp, mouse
ggggtttctgggtatctacg

SEQ ID NO: 693843 - DNA, 20 bp, mouse
gttgctcttacattgtgcga

SEQ ID NO: 693844 - DNA, 20 bp, mouse
ggctgtgtcaggatttgatc

SEQ ID NO: 693845 - DNA, 20 bp, mouse
gagtagggttggttccgctt

SEQ ID NO: 693846 - DNA, 20 bp, mouse
gaagcgaggcgtcagggcac

SEQ ID NO: 693847 - DNA, 20 bp, mouse
gttgctggaatgcagttgga

SEQ ID NO: 693848 - DNA, 20 bp, mouse
gcgcggctcccaatcaccgg

SEQ ID NO: 693849 - DNA, 20 bp, mouse
gcagccactcccagtcttgc

SEQ ID NO: 693850 - DNA, 20 bp, mouse
ggaagtgcggcgtgaagttg

SEQ ID NO: 693851 - DNA, 20 bp, mouse
ggacgcacccaggcctgcgc

SEQ ID NO: 693852 - DNA, 20 bp, mouse
gagggctgctcgaggaagtg

SEQ ID NO: 693853 - DNA, 20 bp, mouse
ggcgcgcggctcccaatcac

SEQ ID NO: 693854 - DNA, 20 bp, mouse
gcacccaggcctgcgccggg

SEQ ID NO: 693855 - DNA, 20 bp, mouse
gtcctccgccgccggtgatt

SEQ ID NO: 693856 - DNA, 20 bp, mouse
gaccgccccggcggctaagg

SEQ ID NO: 693857 - DNA, 20 bp, mouse
gagcgcgcacggggtctacg

SEQ ID NO: 693858 - DNA, 20 bp, mouse
gtctacgcggtcgacgtcgg

SEQ ID NO: 693859 - DNA, 20 bp, mouse
ggggtctacgcggtcgacgt

SEQ ID NO: 693860 - DNA, 20 bp, mouse
gcgaccgcagggaaagagga

SEQ ID NO: 693861 - DNA, 20 bp, mouse
gccggcggctaagggggccg

SEQ ID NO: 693862 - DNA, 20 bp, mouse
gtcgagcgggagacggagag

SEQ ID NO: 693863 - DNA, 20 bp, mouse
ggcccccttagccgccgggg

SEQ ID NO: 693864 - DNA, 20 bp, mouse
gaacagcgccaccgccccgg

SEQ ID NO: 693865 - DNA, 20 bp, mouse
gtcccgctcgagagtgaagg

SEQ ID NO: 693866 - DNA, 20 bp, mouse
gaccctcttggccaagctgt

SEQ ID NO: 693867 - DNA, 20 bp, mouse
gctggcggggcacgcttggg

SEQ ID NO: 693868 - DNA, 20 bp, mouse
ggggctggcggggcacgctt

SEQ ID NO: 693869 - DNA, 20 bp, mouse
ggccccctcccgtgcgaggc

SEQ ID NO: 693870 - DNA, 20 bp, mouse
gtcccccggagatggttaag

SEQ ID NO: 693871 - DNA, 20 bp, mouse
gcacgcttgggcgggtgtct

SEQ ID NO: 693872 - DNA, 20 bp, mouse
ggccccgccagcccacagct

SEQ ID NO: 693873 - DNA, 20 bp, mouse
gtgcgaggctggagtcctga

SEQ ID NO: 693874 - DNA, 20 bp, mouse
gcaggggagggtgtctgtct

SEQ ID NO: 693875 - DNA, 20 bp, mouse
gaaaggtagtgaatgcgcgt

SEQ ID NO: 693876 - DNA, 20 bp, mouse
gtctgccggggcagccccaa

SEQ ID NO: 693877 - DNA, 20 bp, mouse
gggagcagcagggtcatggt

SEQ ID NO: 693878 - DNA, 20 bp, mouse
gggtaggagcttggggaagc

SEQ ID NO: 693879 - DNA, 20 bp, mouse
ggctgccccggcagaggccc

SEQ ID NO: 693880 - DNA, 20 bp, mouse
ggtctgaaacgctccccttg

SEQ ID NO: 693881 - DNA, 20 bp, mouse
gctagaggcagaggattttg

SEQ ID NO: 693882 - DNA, 20 bp, mouse
gtcagcgggccagctgtcca

SEQ ID NO: 693883 - DNA, 20 bp, mouse
gcagcggaggaaagcctggc

SEQ ID NO: 693884 - DNA, 20 bp, mouse
gccctaaggagaaatcttat

SEQ ID NO: 693885 - DNA, 20 bp, mouse
ggggtcatggtaggagcttg

SEQ ID NO: 693886 - DNA, 20 bp, mouse
gtagcggggcgcttcccagt

SEQ ID NO: 693887 - DNA, 20 bp, mouse
gggcgcgcggtcccgtggag

SEQ ID NO: 693888 - DNA, 20 bp, mouse
gagggaaagcccagcggccc

SEQ ID NO: 693889 - DNA, 20 bp, mouse
ggcgcttcccagtgggacga

SEQ ID NO: 693890 - DNA, 20 bp, mouse
ggcgcgggcgacagggggtg

SEQ ID NO: 693891 - DNA, 20 bp, mouse
ggtcccgtggagcggcgtag

SEQ ID NO: 693892 - DNA, 20 bp, mouse
ggccccgctacgccgctcca

SEQ ID NO: 693893 - DNA, 20 bp, mouse
ggtaactgggtgccgaggca

SEQ ID NO: 693894 - DNA, 20 bp, mouse
ggcgccgcacttgtcgatcc

SEQ ID NO: 693895 - DNA, 20 bp, mouse
ggcgccaggatcgacaagtg

SEQ ID NO: 693896 - DNA, 20 bp, mouse
gtcccagccgcggcccctcc

SEQ ID NO: 693897 - DNA, 20 bp, mouse
gagcgcgcgtgtcgggactg

SEQ ID NO: 693898 - DNA, 20 bp, mouse
ggaggagcctggaggggccg

SEQ ID NO: 693899 - DNA, 20 bp, mouse
ggccccccgcggaggtgccc

SEQ ID NO: 693900 - DNA, 20 bp, mouse
ggacctgggcacctccgcgg

SEQ ID NO: 693901 - DNA, 20 bp, mouse
gaggatgccaggaggcgctg

SEQ ID NO: 693902 - DNA, 20 bp, mouse
ggcagcgcggggaggtggtg

SEQ ID NO: 693903 - DNA, 20 bp, mouse
gcggccgtgagcgcgcgtgt

SEQ ID NO: 693904 - DNA, 20 bp, mouse
gggaatgtgagtcagggcct

SEQ ID NO: 693905 - DNA, 20 bp, mouse
gcattcccgaggagcctgga

SEQ ID NO: 693906 - DNA, 20 bp, mouse
gccggctcagtgatgatcaa

SEQ ID NO: 693907 - DNA, 20 bp, mouse
gccccggaggagttagagcg

SEQ ID NO: 693908 - DNA, 20 bp, mouse
gtggtcctggaggaccgctg

SEQ ID NO: 693909 - DNA, 20 bp, mouse
gagtctgggaagcgctcaag

SEQ ID NO: 693910 - DNA, 20 bp, mouse
gcgctcgtctcgctgctccc

SEQ ID NO: 693911 - DNA, 20 bp, mouse
gccagctggggtgtgaggac

SEQ ID NO: 693912 - DNA, 20 bp, mouse
ggagcagcgagacgagcgaa

SEQ ID NO: 693913 - DNA, 20 bp, mouse
ggaagcgctcaagagggcct

SEQ ID NO: 693914 - DNA, 20 bp, mouse
gacgccctccctgtaagcgt

SEQ ID NO: 693915 - DNA, 20 bp, mouse
gtgagccggatctggagtct

SEQ ID NO: 693916 - DNA, 20 bp, mouse
gcgtgcgcatggcggtgaga

SEQ ID NO: 693917 - DNA, 20 bp, mouse
gggtgcccgaggcatcgctg

SEQ ID NO: 693918 - DNA, 20 bp, mouse
ggcggtgagagggcggactt

SEQ ID NO: 693919 - DNA, 20 bp, mouse
gcacgcgccaattttccgat

SEQ ID NO: 693920 - DNA, 20 bp, mouse
gcggagagaagtggtgcccg

SEQ ID NO: 693921 - DNA, 20 bp, mouse
ggccaatggcgtcccgagga

SEQ ID NO: 693922 - DNA, 20 bp, mouse
gttccgattggcagagtgac

SEQ ID NO: 693923 - DNA, 20 bp, mouse
ggcatcgctgaggatcgccg

SEQ ID NO: 693924 - DNA, 20 bp, mouse
ggcgatcctcagcgatgcct

SEQ ID NO: 693925 - DNA, 20 bp, mouse
gcccgaggaaggtgtgtctc

SEQ ID NO: 693926 - DNA, 20 bp, mouse
gccgtcccgcccgatctata

SEQ ID NO: 693927 - DNA, 20 bp, mouse
gtatagggcaaataagctca

SEQ ID NO: 693928 - DNA, 20 bp, mouse
gccagctcccgggagcctga

SEQ ID NO: 693929 - DNA, 20 bp, mouse
ggagcctgagggaaccaccc

SEQ ID NO: 693930 - DNA, 20 bp, mouse
gaggctcctagaagtacgta

SEQ ID NO: 693931 - DNA, 20 bp, mouse
ggctaaggaaggtcggacct

SEQ ID NO: 693932 - DNA, 20 bp, mouse
gggacctgggtggttccctc

SEQ ID NO: 693933 - DNA, 20 bp, mouse
gtcgcctccggtcggccctg

SEQ ID NO: 693934 - DNA, 20 bp, mouse
gctcaaaacaaatcgtagag

SEQ ID NO: 693935 - DNA, 20 bp, mouse
gggagatctgcttccaccta

SEQ ID NO: 693936 - DNA, 20 bp, mouse
gagaacagatgtaactgcaa

SEQ ID NO: 693937 - DNA, 20 bp, mouse
gaggcggggacaagtgtggc

SEQ ID NO: 693938 - DNA, 20 bp, mouse
gtgcggccgcggtcccggaa

SEQ ID NO: 693939 - DNA, 20 bp, mouse
gtgtagccgaaaaggaatcg

SEQ ID NO: 693940 - DNA, 20 bp, mouse
gctacccgaactcagccgag

SEQ ID NO: 693941 - DNA, 20 bp, mouse
gagaggccggatgtagccga

SEQ ID NO: 693942 - DNA, 20 bp, mouse
gaacgcagggagagacgcca

SEQ ID NO: 693943 - DNA, 20 bp, mouse
gcaaccgattgtagccgaaa

SEQ ID NO: 693944 - DNA, 20 bp, mouse
gtgcaatggccgactgagag

SEQ ID NO: 693945 - DNA, 20 bp, mouse
gcggttggctctcttgaact

SEQ ID NO: 693946 - DNA, 20 bp, mouse
gggcttccaagtgaacgcga

SEQ ID NO: 693947 - DNA, 20 bp, mouse
ggggagaaatcactcgcgac

SEQ ID NO: 693948 - DNA, 20 bp, mouse
gccggaggaaggctcggcgc

SEQ ID NO: 693949 - DNA, 20 bp, mouse
gagaaatcactcgcgaccgg

SEQ ID NO: 693950 - DNA, 20 bp, mouse
gtcgccacacacactgactt

SEQ ID NO: 693951 - DNA, 20 bp, mouse
gggtttcatcgtttggtcag

SEQ ID NO: 693952 - DNA, 20 bp, mouse
gctaacagtcagccgaacag

SEQ ID NO: 693953 - DNA, 20 bp, mouse
gtacgtgtcaagtgtcaacg

SEQ ID NO: 693954 - DNA, 20 bp, mouse
ggcaaagctggggaggcaat

SEQ ID NO: 693955 - DNA, 20 bp, mouse
gccaagtgaacgcgagggtt

SEQ ID NO: 693956 - DNA, 20 bp, mouse
gcgcgcgtggcctttgtcct

SEQ ID NO: 693957 - DNA, 20 bp, mouse
gcagtctgtagccatttgag

SEQ ID NO: 693958 - DNA, 20 bp, mouse
gtgggggcgggcaggaccaa

SEQ ID NO: 693959 - DNA, 20 bp, mouse
ggcctagggcgcatgcgcta

SEQ ID NO: 693960 - DNA, 20 bp, mouse
ggccacgtgcgttgaccaaa

SEQ ID NO: 693961 - DNA, 20 bp, mouse
gtgggctaggttggactgtg

SEQ ID NO: 693962 - DNA, 20 bp, mouse
gaatggcgacttcaaccctt

SEQ ID NO: 693963 - DNA, 20 bp, mouse
gggttgaagtcgccattgtg

SEQ ID NO: 693964 - DNA, 20 bp, mouse
gggccacgcgcggctccctt

SEQ ID NO: 693965 - DNA, 20 bp, mouse
ggcaaacccttgcttacaaa

SEQ ID NO: 693966 - DNA, 20 bp, mouse
gagctagcgccagtgctcga

SEQ ID NO: 693967 - DNA, 20 bp, mouse
gcgagcgccagatcccggat

SEQ ID NO: 693968 - DNA, 20 bp, mouse
gcgcctgcgccctcgagcac

SEQ ID NO: 693969 - DNA, 20 bp, mouse
ggggatctggcgctcgagcg

SEQ ID NO: 693970 - DNA, 20 bp, mouse
gcaactgcccgcctcgcggc

SEQ ID NO: 693971 - DNA, 20 bp, mouse
gctgggctcacgcactagac

SEQ ID NO: 693972 - DNA, 20 bp, mouse
gggcgggccaatccgggatc

SEQ ID NO: 693973 - DNA, 20 bp, mouse
ggcactggcggggaggaaaa

SEQ ID NO: 693974 - DNA, 20 bp, mouse
ggggcaatggagacctctat

SEQ ID NO: 693975 - DNA, 20 bp, mouse
gcctcgcggcgggccaatcc

SEQ ID NO: 693976 - DNA, 20 bp, mouse
gaggctgacctcgtctggaa

SEQ ID NO: 693977 - DNA, 20 bp, mouse
gtggactccctcagcgaaga

SEQ ID NO: 693978 - DNA, 20 bp, mouse
gtctggagggaggcgagcga

SEQ ID NO: 693979 - DNA, 20 bp, mouse
gtgagggagtccacgacctg

SEQ ID NO: 693980 - DNA, 20 bp, mouse
ggcgcgaggctgacctcgtc

SEQ ID NO: 693981 - DNA, 20 bp, mouse
gaaggccaccacagtgtcaa

SEQ ID NO: 693982 - DNA, 20 bp, mouse
gtacgggctctggcgagcgt

SEQ ID NO: 693983 - DNA, 20 bp, mouse
gtctcgcgatatctggaggg

SEQ ID NO: 693984 - DNA, 20 bp, mouse
ggccgcttccgcccgctgaa

SEQ ID NO: 693985 - DNA, 20 bp, mouse
ggcggcttcccttccagacg

SEQ ID NO: 693986 - DNA, 20 bp, mouse
gggagagcggcgttactggg

SEQ ID NO: 693987 - DNA, 20 bp, mouse
gcatgcctgcgccgaactca

SEQ ID NO: 693988 - DNA, 20 bp, mouse
gtgggcgtgtcctccggtgg

SEQ ID NO: 693989 - DNA, 20 bp, mouse
gcaggcatgagctggtggtc

SEQ ID NO: 693990 - DNA, 20 bp, mouse
ggcgccgaactcaaggtctg

SEQ ID NO: 693991 - DNA, 20 bp, mouse
ggcccggcccccaagtacgg

SEQ ID NO: 693992 - DNA, 20 bp, mouse
ggggaggtgagggagcacgt

SEQ ID NO: 693993 - DNA, 20 bp, mouse
gtggcctgaccaacggagag

SEQ ID NO: 693994 - DNA, 20 bp, mouse
gttagcgtgggcgtgtcctc

SEQ ID NO: 693995 - DNA, 20 bp, mouse
gcgtgggcacggaccatctg

SEQ ID NO: 693996 - DNA, 20 bp, mouse
gagggcagaaaccatagctg

SEQ ID NO: 693997 - DNA, 20 bp, mouse
gatgaaaataagaataatta

SEQ ID NO: 693998 - DNA, 20 bp, mouse
gtctcttttagccgcagcta

SEQ ID NO: 693999 - DNA, 20 bp, mouse
gaaacgcgtgctttaaaaca

SEQ ID NO: 694000 - DNA, 20 bp, mouse
gaatttttacttttccagac

SEQ ID NO: 694001 - DNA, 20 bp, mouse
gattattcttattttcattt

SEQ ID NO: 694002 - DNA, 20 bp, mouse
gtaattttaatttttgattt

SEQ ID NO: 694003 - DNA, 20 bp, mouse
gaatttttgattttggagac

SEQ ID NO: 694004 - DNA, 20 bp, mouse
gaatttttactttttcacac

SEQ ID NO: 694005 - DNA, 20 bp, mouse
gatgaaaaggagaataatta

SEQ ID NO: 694006 - DNA, 20 bp, mouse
gggggaggagtggtggccag

SEQ ID NO: 694007 - DNA, 20 bp, mouse
gagtccgaagacaaggagga

SEQ ID NO: 694008 - DNA, 20 bp, mouse
ggggcttgagtccgaagaca

SEQ ID NO: 694009 - DNA, 20 bp, mouse
gcctctcaggaacacctgag

SEQ ID NO: 694010 - DNA, 20 bp, mouse
gtggggagcttggaccagat

SEQ ID NO: 694011 - DNA, 20 bp, mouse
ggactcaagccccgaggagg

SEQ ID NO: 694012 - DNA, 20 bp, mouse
ggggtcatctgccgggtagt

SEQ ID NO: 694013 - DNA, 20 bp, mouse
gcccgaggaggtggggagct

SEQ ID NO: 694014 - DNA, 20 bp, mouse
ggcacgcgaggacttactag

SEQ ID NO: 694015 - DNA, 20 bp, mouse
ggtggtggccagcggaggac

SEQ ID NO: 694016 - DNA, 20 bp, mouse
ggggtcacgacccttcttgg

SEQ ID NO: 694017 - DNA, 20 bp, mouse
gtgccggcgcgcagccactg

SEQ ID NO: 694018 - DNA, 20 bp, mouse
gagggcagctgtccaggggt

SEQ ID NO: 694019 - DNA, 20 bp, mouse
gagagccggccggtcctcag

SEQ ID NO: 694020 - DNA, 20 bp, mouse
gagacccagtccagctgggg

SEQ ID NO: 694021 - DNA, 20 bp, mouse
gtgaaagagggcagctgtcc

SEQ ID NO: 694022 - DNA, 20 bp, mouse
ggccaagaccccatctccac

SEQ ID NO: 694023 - DNA, 20 bp, mouse
gcccagcatcggaaatgggg

SEQ ID NO: 694024 - DNA, 20 bp, mouse
ggcgcgcagccactgaggac

SEQ ID NO: 694025 - DNA, 20 bp, mouse
ggacttagagcctccaagaa

SEQ ID NO: 694026 - DNA, 20 bp, mouse
gccgaagaaacaggatattt

SEQ ID NO: 694027 - DNA, 20 bp, mouse
gggtgtgacctgcgtgactc

SEQ ID NO: 694028 - DNA, 20 bp, mouse
gaggccggggctgtcacagc

SEQ ID NO: 694029 - DNA, 20 bp, mouse
gctgcccagcccgaagaaac

SEQ ID NO: 694030 - DNA, 20 bp, mouse
gaagcaggatacagatgtga

SEQ ID NO: 694031 - DNA, 20 bp, mouse
ggaaacaggatatttgggag

SEQ ID NO: 694032 - DNA, 20 bp, mouse
gcatcaattggctgaggccg

SEQ ID NO: 694033 - DNA, 20 bp, mouse
gagggggcgatgtaaaggac

SEQ ID NO: 694034 - DNA, 20 bp, mouse
gctggctggtggcgttcctg

SEQ ID NO: 694035 - DNA, 20 bp, mouse
gctgcatggctgcacatggg

SEQ ID NO: 694036 - DNA, 20 bp, mouse
ggggcggccggtggatgtgg

SEQ ID NO: 694037 - DNA, 20 bp, mouse
gaatgggaaggcccgagagt

SEQ ID NO: 694038 - DNA, 20 bp, mouse
gaaggggcggccggtggatg

SEQ ID NO: 694039 - DNA, 20 bp, mouse
gggatgtggcggcgcccaat

SEQ ID NO: 694040 - DNA, 20 bp, mouse
gtgggcgccgccacatccac

SEQ ID NO: 694041 - DNA, 20 bp, mouse
ggcccgagggcccgctgaat

SEQ ID NO: 694042 - DNA, 20 bp, mouse
gacgctccacgcagcccatt

SEQ ID NO: 694043 - DNA, 20 bp, mouse
gggcccctttaatggggcgg

SEQ ID NO: 694044 - DNA, 20 bp, mouse
gggccctcgggcccctttaa

SEQ ID NO: 694045 - DNA, 20 bp, mouse
gcttccgccgccccattaaa

SEQ ID NO: 694046 - DNA, 20 bp, mouse
gtgaaaggggcgtggctacg

SEQ ID NO: 694047 - DNA, 20 bp, mouse
gggcgcggtcaacctgaaag

SEQ ID NO: 694048 - DNA, 20 bp, mouse
gagaacaagagcaactctca

SEQ ID NO: 694049 - DNA, 20 bp, mouse
gggcgctccgcactacagac

SEQ ID NO: 694050 - DNA, 20 bp, mouse
gggccacactgcagctcagg

SEQ ID NO: 694051 - DNA, 20 bp, mouse
gtgtctcggggtcaggcgga

SEQ ID NO: 694052 - DNA, 20 bp, mouse
gtgtggccggcgccttaagg

SEQ ID NO: 694053 - DNA, 20 bp, mouse
gtggctccgaaatgctggag

SEQ ID NO: 694054 - DNA, 20 bp, mouse
gacggctgaccatgtccgaa

SEQ ID NO: 694055 - DNA, 20 bp, mouse
gtctccacgcccgacaaggg

SEQ ID NO: 694056 - DNA, 20 bp, mouse
gcctttgaggaggcaggtga

SEQ ID NO: 694057 - DNA, 20 bp, mouse
gcgcctgcgcaagacagcga

SEQ ID NO: 694058 - DNA, 20 bp, mouse
ggctcccagcccgcccctct

SEQ ID NO: 694059 - DNA, 20 bp, mouse
gggctctggcggggtcaagt

SEQ ID NO: 694060 - DNA, 20 bp, mouse
ggcactgcccaatccgcgcg

SEQ ID NO: 694061 - DNA, 20 bp, mouse
gacgcctcctcgcgcggatt

SEQ ID NO: 694062 - DNA, 20 bp, mouse
gattgggcagtgctccgaga

SEQ ID NO: 694063 - DNA, 20 bp, mouse
ggcgtagcggtgcgtaagtg

SEQ ID NO: 694064 - DNA, 20 bp, mouse
gacagcgaggggcgtgaccc

SEQ ID NO: 694065 - DNA, 20 bp, mouse
gccctccagcctcccgcttc

SEQ ID NO: 694066 - DNA, 20 bp, mouse
gccggcgcccttaaccaaga

SEQ ID NO: 694067 - DNA, 20 bp, mouse
gaagtgccctgctaaagagg

SEQ ID NO: 694068 - DNA, 20 bp, mouse
gtggttaagggcgccgggat

SEQ ID NO: 694069 - DNA, 20 bp, mouse
gaggaagaagagttcgtttc

SEQ ID NO: 694070 - DNA, 20 bp, mouse
gtgacaggcggctaaagtga

SEQ ID NO: 694071 - DNA, 20 bp, mouse
gtggctgagggaagtaccat

SEQ ID NO: 694072 - DNA, 20 bp, mouse
gaggaggctgtgagacaatc

SEQ ID NO: 694073 - DNA, 20 bp, mouse
gttccggcggcggctctcgc

SEQ ID NO: 694074 - DNA, 20 bp, mouse
gctctcgcgggattggctgt

SEQ ID NO: 694075 - DNA, 20 bp, mouse
ggacgctgtttcagccatct

SEQ ID NO: 694076 - DNA, 20 bp, mouse
gcgcgcgcgcggggagaaaa

SEQ ID NO: 694077 - DNA, 20 bp, mouse
gcgcgcgcgcggtaggacgg

SEQ ID NO: 694078 - DNA, 20 bp, mouse
gtagcccgcaggttcgaaaa

SEQ ID NO: 694079 - DNA, 20 bp, mouse
gcccgggaggcgagcgattt

SEQ ID NO: 694080 - DNA, 20 bp, mouse
ggcgagcgatttggggaagt

SEQ ID NO: 694081 - DNA, 20 bp, mouse
gcggcgggagagagcccggg

SEQ ID NO: 694082 - DNA, 20 bp, mouse
gttcgaaaatggtgctgcgc

SEQ ID NO: 694083 - DNA, 20 bp, mouse
gacggcggcgggagagagcc

SEQ ID NO: 694084 - DNA, 20 bp, mouse
gtgaagagagcgttgtccct

SEQ ID NO: 694085 - DNA, 20 bp, mouse
gcgcgcgcatcccaggcaac

SEQ ID NO: 694086 - DNA, 20 bp, mouse
ggacccgggggcgtggacag

SEQ ID NO: 694087 - DNA, 20 bp, mouse
ggcgtcgtgcgcagagcgag

SEQ ID NO: 694088 - DNA, 20 bp, mouse
ggaagcgggcgcttgtagag

SEQ ID NO: 694089 - DNA, 20 bp, mouse
ggcgcagagcgaggggctcc

SEQ ID NO: 694090 - DNA, 20 bp, mouse
gggcgcttgtagagcggcgg

SEQ ID NO: 694091 - DNA, 20 bp, mouse
gagcctctgtccacgccccc

SEQ ID NO: 694092 - DNA, 20 bp, mouse
gagcgctttaaacttcgcga

SEQ ID NO: 694093 - DNA, 20 bp, mouse
ggaaaggaggcgtaggtctg

SEQ ID NO: 694094 - DNA, 20 bp, mouse
gtctgcgcacgacgcgcctc

SEQ ID NO: 694095 - DNA, 20 bp, mouse
gaagcgctagacaggagtga

SEQ ID NO: 694096 - DNA, 20 bp, mouse
gagagtgcgcggaggtgagt

SEQ ID NO: 694097 - DNA, 20 bp, mouse
gcggtcggggtcagagtgcg

SEQ ID NO: 694098 - DNA, 20 bp, mouse
ggaggccgagggagacgccg

SEQ ID NO: 694099 - DNA, 20 bp, mouse
ggaggtgagtcggtgtgttg

SEQ ID NO: 694100 - DNA, 20 bp, mouse
gagcccgctgctagcgcctt

SEQ ID NO: 694101 - DNA, 20 bp, mouse
gaccttaacgcgcatgtcgg

SEQ ID NO: 694102 - DNA, 20 bp, mouse
ggcgctagcagcgggctcag

SEQ ID NO: 694103 - DNA, 20 bp, mouse
gcggcgggagagagagcgtt

SEQ ID NO: 694104 - DNA, 20 bp, mouse
gtcggcctcagcagacgctc

SEQ ID NO: 694105 - DNA, 20 bp, mouse
gggccaaaggcgctagcagc

SEQ ID NO: 694106 - DNA, 20 bp, mouse
gtaggcccgcccacaatatt

SEQ ID NO: 694107 - DNA, 20 bp, mouse
ggtcaatcatccatattcgg

SEQ ID NO: 694108 - DNA, 20 bp, mouse
ggtgggccaagacacagctg

SEQ ID NO: 694109 - DNA, 20 bp, mouse
ggggcggattggttcgtatg

SEQ ID NO: 694110 - DNA, 20 bp, mouse
gtggcccacgtccatcacag

SEQ ID NO: 694111 - DNA, 20 bp, mouse
gatccagcggcggggaattc

SEQ ID NO: 694112 - DNA, 20 bp, mouse
gttgcccctgtgatggacgt

SEQ ID NO: 694113 - DNA, 20 bp, mouse
ggggaattcgggtccggatt

SEQ ID NO: 694114 - DNA, 20 bp, mouse
gaacggattgcaggtgtctg

SEQ ID NO: 694115 - DNA, 20 bp, mouse
ggcctctaggagcctggctc

SEQ ID NO: 694116 - DNA, 20 bp, mouse
gaccttcttaagggccctct

SEQ ID NO: 694117 - DNA, 20 bp, mouse
ggaagcataagacctctaaa

SEQ ID NO: 694118 - DNA, 20 bp, mouse
gcctgcaatagcagaagtcg

SEQ ID NO: 694119 - DNA, 20 bp, mouse
gttgaaggggacccgtctgt

SEQ ID NO: 694120 - DNA, 20 bp, mouse
ggacaactgcaggccatgtc

SEQ ID NO: 694121 - DNA, 20 bp, mouse
ggctaggcaacgagttttga

SEQ ID NO: 694122 - DNA, 20 bp, mouse
gactgcttcggtcacaaaag

SEQ ID NO: 694123 - DNA, 20 bp, mouse
gacacagagaacttgttgct

SEQ ID NO: 694124 - DNA, 20 bp, mouse
ggctgggccctcaccagaca

SEQ ID NO: 694125 - DNA, 20 bp, mouse
gggacatgcaatttatctga

SEQ ID NO: 694126 - DNA, 20 bp, mouse
ggcgctcagtccagccgcta

SEQ ID NO: 694127 - DNA, 20 bp, mouse
gcgtctgcaaggagacgtgg

SEQ ID NO: 694128 - DNA, 20 bp, mouse
ggtggccccaagcccttgta

SEQ ID NO: 694129 - DNA, 20 bp, mouse
gagaggcccgggactgacgc

SEQ ID NO: 694130 - DNA, 20 bp, mouse
gagggactctcgggatttgg

SEQ ID NO: 694131 - DNA, 20 bp, mouse
gggactgacgccggttgaac

SEQ ID NO: 694132 - DNA, 20 bp, mouse
ggacgtggcaggtgtcactg

SEQ ID NO: 694133 - DNA, 20 bp, mouse
ggactcaaacgcagaggccc

SEQ ID NO: 694134 - DNA, 20 bp, mouse
ggacgccggttgaacgggtc

SEQ ID NO: 694135 - DNA, 20 bp, mouse
gcccaagcgcgggcttccgt

SEQ ID NO: 694136 - DNA, 20 bp, mouse
gtgcgcgggcgggacaaaat

SEQ ID NO: 694137 - DNA, 20 bp, mouse
gaggaccaagtctcctgggg

SEQ ID NO: 694138 - DNA, 20 bp, mouse
ggggtcactcggacagacgc

SEQ ID NO: 694139 - DNA, 20 bp, mouse
gtgtccgagtgacccacccc

SEQ ID NO: 694140 - DNA, 20 bp, mouse
gtctcctggggtgggtcact

SEQ ID NO: 694141 - DNA, 20 bp, mouse
ggacgaggaccaagtctcct

SEQ ID NO: 694142 - DNA, 20 bp, mouse
gggaacaactcctacactga

SEQ ID NO: 694143 - DNA, 20 bp, mouse
gggcgggacaaaattggccc

SEQ ID NO: 694144 - DNA, 20 bp, mouse
gtacactgtgcgcgcacccg

SEQ ID NO: 694145 - DNA, 20 bp, mouse
gaggggttcgagttcagaag

SEQ ID NO: 694146 - DNA, 20 bp, mouse
ggcgccaccgccgaacactg

SEQ ID NO: 694147 - DNA, 20 bp, mouse
gactggcccggaaggaagta

SEQ ID NO: 694148 - DNA, 20 bp, mouse
gagcggccggacgagcacag

SEQ ID NO: 694149 - DNA, 20 bp, mouse
gactgcggctcgcagcgcga

SEQ ID NO: 694150 - DNA, 20 bp, mouse
gccggacgagcacaggggtg

SEQ ID NO: 694151 - DNA, 20 bp, mouse
gtgcgagccgcagtgttcgg

SEQ ID NO: 694152 - DNA, 20 bp, mouse
gagcccgctctgccagccct

SEQ ID NO: 694153 - DNA, 20 bp, mouse
ggagccgcagtgttcggcgg

SEQ ID NO: 694154 - DNA, 20 bp, mouse
gcagctcggacttgaagcga

SEQ ID NO: 694155 - DNA, 20 bp, mouse
gcgctcgcgagctggcacac

SEQ ID NO: 694156 - DNA, 20 bp, mouse
gataaagcgagcgttcagaa

SEQ ID NO: 694157 - DNA, 20 bp, mouse
gagggacccgtctactgcct

SEQ ID NO: 694158 - DNA, 20 bp, mouse
gtgaacgctcgctttatcag

SEQ ID NO: 694159 - DNA, 20 bp, mouse
gggttgtcaccaagcactgg

SEQ ID NO: 694160 - DNA, 20 bp, mouse
gaaagtcaaaaggagaccat

SEQ ID NO: 694161 - DNA, 20 bp, mouse
gtatcaggggtgggcagaca

SEQ ID NO: 694162 - DNA, 20 bp, mouse
gggaggctccccaaaagcaa

SEQ ID NO: 694163 - DNA, 20 bp, mouse
gacagtcagaggccctctgt

SEQ ID NO: 694164 - DNA, 20 bp, mouse
gaagcgagcgttcagaaagg

SEQ ID NO: 694165 - DNA, 20 bp, mouse
ggagggagagcagtaagaag

SEQ ID NO: 694166 - DNA, 20 bp, mouse
gcaggggaagcagtggccaa

SEQ ID NO: 694167 - DNA, 20 bp, mouse
gccagcaagagcagtgactt

SEQ ID NO: 694168 - DNA, 20 bp, mouse
gagggagcaccaaccaccaa

SEQ ID NO: 694169 - DNA, 20 bp, mouse
gccaacagaggaagagtcca

SEQ ID NO: 694170 - DNA, 20 bp, mouse
gcgcccccatagtctggcag

SEQ ID NO: 694171 - DNA, 20 bp, mouse
gtagtccatggtgaatgcag

SEQ ID NO: 694172 - DNA, 20 bp, mouse
gaagatgcaggagtagtcca

SEQ ID NO: 694173 - DNA, 20 bp, mouse
gtgcctctgccagactatgg

SEQ ID NO: 694174 - DNA, 20 bp, mouse
ggcttcccctgcattcacca

SEQ ID NO: 694175 - DNA, 20 bp, mouse
gccaccccgcccccatagtc

SEQ ID NO: 694176 - DNA, 20 bp, mouse
ggggccgttgggcagttaca

SEQ ID NO: 694177 - DNA, 20 bp, mouse
gcggccctgctcagatgccg

SEQ ID NO: 694178 - DNA, 20 bp, mouse
gtgagccgatcaagatggag

SEQ ID NO: 694179 - DNA, 20 bp, mouse
gtgggcagttacacggcgga

SEQ ID NO: 694180 - DNA, 20 bp, mouse
gccgttgggcagttacacgg

SEQ ID NO: 694181 - DNA, 20 bp, mouse
gttacacggcggagggcgga

SEQ ID NO: 694182 - DNA, 20 bp, mouse
gtgctccgcggcatctgagc

SEQ ID NO: 694183 - DNA, 20 bp, mouse
ggcgcgagccctgtgctccg

SEQ ID NO: 694184 - DNA, 20 bp, mouse
ggcagccgcgtcccggaagc

SEQ ID NO: 694185 - DNA, 20 bp, mouse
gcccggaagccggggaagag

SEQ ID NO: 694186 - DNA, 20 bp, mouse
gactggagctgcgaggtggt

SEQ ID NO: 694187 - DNA, 20 bp, mouse
gacaatgggccattatggag

SEQ ID NO: 694188 - DNA, 20 bp, mouse
gagccctgaaaacctttcgg

SEQ ID NO: 694189 - DNA, 20 bp, mouse
gccagagggggactgacaag

SEQ ID NO: 694190 - DNA, 20 bp, mouse
gtcaaggtggtcattctctc

SEQ ID NO: 694191 - DNA, 20 bp, mouse
gaaaaatctctgttcccaga

SEQ ID NO: 694192 - DNA, 20 bp, mouse
ggggtgtctgtagacctggg

SEQ ID NO: 694193 - DNA, 20 bp, mouse
gtaaagcctgggaacaattg

SEQ ID NO: 694194 - DNA, 20 bp, mouse
gaggagccacaattgttccc

SEQ ID NO: 694195 - DNA, 20 bp, mouse
gttgtgttagcatgcaaagg

SEQ ID NO: 694196 - DNA, 20 bp, mouse
gggtgccagcagactgtcaa

SEQ ID NO: 694197 - DNA, 20 bp, mouse
ggcaccagggaacagcgagg

SEQ ID NO: 694198 - DNA, 20 bp, mouse
gtgcctgagtctgagatctt

SEQ ID NO: 694199 - DNA, 20 bp, mouse
gcggtggcccggactgtcgc

SEQ ID NO: 694200 - DNA, 20 bp, mouse
gggtccgcctcgctgttccc

SEQ ID NO: 694201 - DNA, 20 bp, mouse
ggcgcctcctagtgagcgga

SEQ ID NO: 694202 - DNA, 20 bp, mouse
ggcgctgggctgatgaatac

SEQ ID NO: 694203 - DNA, 20 bp, mouse
gggactgtcgcaggctgggg

SEQ ID NO: 694204 - DNA, 20 bp, mouse
gtcactaggaggcgctgcgg

SEQ ID NO: 694205 - DNA, 20 bp, mouse
gagcggacggaaactgcaga

SEQ ID NO: 694206 - DNA, 20 bp, mouse
ggggacacaaggcacttata

SEQ ID NO: 694207 - DNA, 20 bp, mouse
gctagaagctagcaccgcgt

SEQ ID NO: 694208 - DNA, 20 bp, mouse
ggggcgtggtaagagtggga

SEQ ID NO: 694209 - DNA, 20 bp, mouse
gaaagccaagagttggtctt

SEQ ID NO: 694210 - DNA, 20 bp, mouse
gtctagctgcctcctatcct

SEQ ID NO: 694211 - DNA, 20 bp, mouse
gggcgcctcgggttcttcat

SEQ ID NO: 694212 - DNA, 20 bp, mouse
gttctagcgcccaggatagg

SEQ ID NO: 694213 - DNA, 20 bp, mouse
ggagaggcggagtcactgcc

SEQ ID NO: 694214 - DNA, 20 bp, mouse
gcgccccgaccggaagaagc

SEQ ID NO: 694215 - DNA, 20 bp, mouse
gtgccggccaccacttacaa

SEQ ID NO: 694216 - DNA, 20 bp, mouse
gaaagggcggggtccaccac

SEQ ID NO: 694217 - DNA, 20 bp, mouse
ggggtgaaacgtgggtgcga

SEQ ID NO: 694218 - DNA, 20 bp, mouse
ggaggggactgggtgaaacg

SEQ ID NO: 694219 - DNA, 20 bp, mouse
ggtgaaacctcaccctgtgg

SEQ ID NO: 694220 - DNA, 20 bp, mouse
gaacgtgggtgcgatggaaa

SEQ ID NO: 694221 - DNA, 20 bp, mouse
gtccacatttggtgccaagg

SEQ ID NO: 694222 - DNA, 20 bp, mouse
gcagctggccgagcagtcat

SEQ ID NO: 694223 - DNA, 20 bp, mouse
ggtgggtgcgatggaaaggg

SEQ ID NO: 694224 - DNA, 20 bp, mouse
gtaggtgaaacctcaccctg

SEQ ID NO: 694225 - DNA, 20 bp, mouse
gcggggtccaccacagggtg

SEQ ID NO: 694226 - DNA, 20 bp, mouse
gcacccgcctccggtacacc

SEQ ID NO: 694227 - DNA, 20 bp, mouse
gaggccaggtgtaccggagg

SEQ ID NO: 694228 - DNA, 20 bp, mouse
gcaaagacgcggtccttccg

SEQ ID NO: 694229 - DNA, 20 bp, mouse
gagctgcaggccaggtgtac

SEQ ID NO: 694230 - DNA, 20 bp, mouse
gtgcaggccaggtgtaccgg

SEQ ID NO: 694231 - DNA, 20 bp, mouse
gctcccctgcggacgtgcag

SEQ ID NO: 694232 - DNA, 20 bp, mouse
gggaggcgggtgcgtgagcg

SEQ ID NO: 694233 - DNA, 20 bp, mouse
gtgtccacgcgagcctcggg

SEQ ID NO: 694234 - DNA, 20 bp, mouse
ggccccgggcagtgtggctc

SEQ ID NO: 694235 - DNA, 20 bp, mouse
gcgccgctgcacgtccgcag

SEQ ID NO: 694236 - DNA, 20 bp, mouse
gtccctgaggcggggctccg

SEQ ID NO: 694237 - DNA, 20 bp, mouse
gctgaggcggggctccgcgg

SEQ ID NO: 694238 - DNA, 20 bp, mouse
gccgcggcggccaatgaggc

SEQ ID NO: 694239 - DNA, 20 bp, mouse
gtggagaactacaggctcgg

SEQ ID NO: 694240 - DNA, 20 bp, mouse
ggcctcctgggatgaagcgg

SEQ ID NO: 694241 - DNA, 20 bp, mouse
gccaatgaggcgggaccacg

SEQ ID NO: 694242 - DNA, 20 bp, mouse
gcaggagcaggcgggagagt

SEQ ID NO: 694243 - DNA, 20 bp, mouse
gagagtgggtgctgttttag

SEQ ID NO: 694244 - DNA, 20 bp, mouse
gcactgtgggggggccccaa

SEQ ID NO: 694245 - DNA, 20 bp, mouse
gggctccgcggcggccaatg

SEQ ID NO: 694246 - DNA, 20 bp, mouse
gaacggacccgacttccttc

SEQ ID NO: 694247 - DNA, 20 bp, mouse
gaatatgtaggtactctatg

SEQ ID NO: 694248 - DNA, 20 bp, mouse
ggctcacagtggaagagctc

SEQ ID NO: 694249 - DNA, 20 bp, mouse
gaaaacaaacgtaagctgag

SEQ ID NO: 694250 - DNA, 20 bp, mouse
gatccagccagaaggaagtc

SEQ ID NO: 694251 - DNA, 20 bp, mouse
gggaactcttagggccatgt

SEQ ID NO: 694252 - DNA, 20 bp, mouse
gaaccttgcagctgactcca

SEQ ID NO: 694253 - DNA, 20 bp, mouse
gtggaacatatccagccaga

SEQ ID NO: 694254 - DNA, 20 bp, mouse
gagagacacggggaactctt

SEQ ID NO: 694255 - DNA, 20 bp, mouse
gagggccatgtgggatttga

SEQ ID NO: 694256 - DNA, 20 bp, mouse
ggctgcgcatgcgtcgtagg

SEQ ID NO: 694257 - DNA, 20 bp, mouse
gggaccgcccagcgcaggga

SEQ ID NO: 694258 - DNA, 20 bp, mouse
ggcgagagagagggcaacga

SEQ ID NO: 694259 - DNA, 20 bp, mouse
ggcctcccgcgagaacgcag

SEQ ID NO: 694260 - DNA, 20 bp, mouse
gcggccgcctccggggtgga

SEQ ID NO: 694261 - DNA, 20 bp, mouse
gacgaggggaagggtcgaag

SEQ ID NO: 694262 - DNA, 20 bp, mouse
ggcggctgcgcatgcgtcgt

SEQ ID NO: 694263 - DNA, 20 bp, mouse
gcggccggagcatctcgctc

SEQ ID NO: 694264 - DNA, 20 bp, mouse
gtcttccgaggcgagagaga

SEQ ID NO: 694265 - DNA, 20 bp, mouse
gcacttggcgacactcggct

SEQ ID NO: 694266 - DNA, 20 bp, mouse
ggggctcttcgggattggaa

SEQ ID NO: 694267 - DNA, 20 bp, mouse
gtacctctgtgcctccggga

SEQ ID NO: 694268 - DNA, 20 bp, mouse
ggggcaggacccggaagtga

SEQ ID NO: 694269 - DNA, 20 bp, mouse
ggcgcggggctcttcgggat

SEQ ID NO: 694270 - DNA, 20 bp, mouse
ggaagagccccgcgcacaga

SEQ ID NO: 694271 - DNA, 20 bp, mouse
gccaggaggcacaaccctca

SEQ ID NO: 694272 - DNA, 20 bp, mouse
gagctctgaagaagtagcct

SEQ ID NO: 694273 - DNA, 20 bp, mouse
gtcccgacgtgcttcgagat

SEQ ID NO: 694274 - DNA, 20 bp, mouse
gccaggctgcacagccctct

SEQ ID NO: 694275 - DNA, 20 bp, mouse
gtcccagctctccgatgaca

SEQ ID NO: 694276 - DNA, 20 bp, mouse
ggggccccacgcaaactctt

SEQ ID NO: 694277 - DNA, 20 bp, mouse
gcgggcgggcggacgcttaa

SEQ ID NO: 694278 - DNA, 20 bp, mouse
gcaaatagaaacgtcccctc

SEQ ID NO: 694279 - DNA, 20 bp, mouse
gggacggtgaggaacaacga

SEQ ID NO: 694280 - DNA, 20 bp, mouse
gaacgtcccctcaggagacg

SEQ ID NO: 694281 - DNA, 20 bp, mouse
gtggctgcgtgaaggaggcg

SEQ ID NO: 694282 - DNA, 20 bp, mouse
gtagcagcctcgtctcctga

SEQ ID NO: 694283 - DNA, 20 bp, mouse
gtaggcagctcgcacagagg

SEQ ID NO: 694284 - DNA, 20 bp, mouse
gctccccggggatggaaaca

SEQ ID NO: 694285 - DNA, 20 bp, mouse
ggctaccgaagagtttgcgt

SEQ ID NO: 694286 - DNA, 20 bp, mouse
gtacacgataatgggtcaca

SEQ ID NO: 694287 - DNA, 20 bp, mouse
gtcagctaacactcccaaga

SEQ ID NO: 694288 - DNA, 20 bp, mouse
ggctgttcttacacgataat

SEQ ID NO: 694289 - DNA, 20 bp, mouse
ggataaccaaggcatctgca

SEQ ID NO: 694290 - DNA, 20 bp, mouse
ggcgacctcgagaacagtga

SEQ ID NO: 694291 - DNA, 20 bp, mouse
gttgggagtgttagctgaca

SEQ ID NO: 694292 - DNA, 20 bp, mouse
ggataacttcctggagtatt

SEQ ID NO: 694293 - DNA, 20 bp, mouse
gaccacaggttacaatgtgg

SEQ ID NO: 694294 - DNA, 20 bp, mouse
gcaaggcatctgcaaggcat

SEQ ID NO: 694295 - DNA, 20 bp, mouse
gtgattgctcaagataacca

SEQ ID NO: 694296 - DNA, 20 bp, mouse
gcagtgggcggggcattcaa

SEQ ID NO: 694297 - DNA, 20 bp, mouse
gcgctagtgactcgcagcgg

SEQ ID NO: 694298 - DNA, 20 bp, mouse
gggcaggtgtcaggaataga

SEQ ID NO: 694299 - DNA, 20 bp, mouse
ggatccggctgtttgagcct

SEQ ID NO: 694300 - DNA, 20 bp, mouse
ggcgcgctagtgactcgcag

SEQ ID NO: 694301 - DNA, 20 bp, mouse
gaggtggggtggagaccgac

SEQ ID NO: 694302 - DNA, 20 bp, mouse
gctccccaggctcaaacagc

SEQ ID NO: 694303 - DNA, 20 bp, mouse
gttcaggcccgaggcttctg

SEQ ID NO: 694304 - DNA, 20 bp, mouse
gaccgactggacagtgggcg

SEQ ID NO: 694305 - DNA, 20 bp, mouse
gcacctgccctggaggtatg

SEQ ID NO: 694306 - DNA, 20 bp, mouse
gcttgcgcggcgcttgtctt

SEQ ID NO: 694307 - DNA, 20 bp, mouse
gcgcgcaagcgcacccacgg

SEQ ID NO: 694308 - DNA, 20 bp, mouse
gcctgggcgcgtcagctgag

SEQ ID NO: 694309 - DNA, 20 bp, mouse
gcagctgggcgtcgggtgga

SEQ ID NO: 694310 - DNA, 20 bp, mouse
ggtaaggcgtccacccgtgg

SEQ ID NO: 694311 - DNA, 20 bp, mouse
gcgtcacgcagtttccactc

SEQ ID NO: 694312 - DNA, 20 bp, mouse
ggggcagcgccccctgttgg

SEQ ID NO: 694313 - DNA, 20 bp, mouse
gtggacaagccgccaccaac

SEQ ID NO: 694314 - DNA, 20 bp, mouse
ggacgcccagctgtcgcggc

SEQ ID NO: 694315 - DNA, 20 bp, mouse
gcgccgcgcaagcgcaccca

SEQ ID NO: 694316 - DNA, 20 bp, mouse
ggcaaagctggtcaggggga

SEQ ID NO: 694317 - DNA, 20 bp, mouse
gctcaagggcgggagaatct

SEQ ID NO: 694318 - DNA, 20 bp, mouse
gactagcgagaagccaatcg

SEQ ID NO: 694319 - DNA, 20 bp, mouse
gacctcctcgccggagggcg

SEQ ID NO: 694320 - DNA, 20 bp, mouse
gcagctttgcctctcaaggg

SEQ ID NO: 694321 - DNA, 20 bp, mouse
gtcccagaatgcactgttac

SEQ ID NO: 694322 - DNA, 20 bp, mouse
gaatgcactgttacgggcgt

SEQ ID NO: 694323 - DNA, 20 bp, mouse
gatctcggagacctcctcgc

SEQ ID NO: 694324 - DNA, 20 bp, mouse
ggcccgtaacagtgcattct

SEQ ID NO: 694325 - DNA, 20 bp, mouse
gtagtcattgccccgccctc

SEQ ID NO: 694326 - DNA, 20 bp, mouse
ggagaggggaccagagtaag

SEQ ID NO: 694327 - DNA, 20 bp, mouse
gcggggcgggtcccacgtag

SEQ ID NO: 694328 - DNA, 20 bp, mouse
gaggggacgggcccaaaggg

SEQ ID NO: 694329 - DNA, 20 bp, mouse
gtgagggcggggccgtgaga

SEQ ID NO: 694330 - DNA, 20 bp, mouse
ggaggccggggcgggacata

SEQ ID NO: 694331 - DNA, 20 bp, mouse
gagagtaagcggccaaagga

SEQ ID NO: 694332 - DNA, 20 bp, mouse
gacccggcgaaaagtctctt

SEQ ID NO: 694333 - DNA, 20 bp, mouse
ggagccagaggcagtgctcg

SEQ ID NO: 694334 - DNA, 20 bp, mouse
gaggagagtgcgcgccctgg

SEQ ID NO: 694335 - DNA, 20 bp, mouse
gaggaggggacgggcccaaa

SEQ ID NO: 694336 - DNA, 20 bp, mouse
gcagcccgggcgccacagca

SEQ ID NO: 694337 - DNA, 20 bp, mouse
gcgaggtgctgcccgaagga

SEQ ID NO: 694338 - DNA, 20 bp, mouse
ggggctgaagatgctgcgaa

SEQ ID NO: 694339 - DNA, 20 bp, mouse
gaagacggagcgtctcgcgg

SEQ ID NO: 694340 - DNA, 20 bp, mouse
gatgccctgctgtggcgccc

SEQ ID NO: 694341 - DNA, 20 bp, mouse
ggcagggcatggtttctatt

SEQ ID NO: 694342 - DNA, 20 bp, mouse
ggcgctagtcgtagtcccgt

SEQ ID NO: 694343 - DNA, 20 bp, mouse
ggactagcgcagttccaagg

SEQ ID NO: 694344 - DNA, 20 bp, mouse
gccgctggccggccaagcag

SEQ ID NO: 694345 - DNA, 20 bp, mouse
gactgtggggctgcgacgga

SEQ ID NO: 694346 - DNA, 20 bp, mouse
gtaacacgctgctgccatcc

SEQ ID NO: 694347 - DNA, 20 bp, mouse
gtgagaagggggaataacga

SEQ ID NO: 694348 - DNA, 20 bp, mouse
ggggttgaggaaattgatga

SEQ ID NO: 694349 - DNA, 20 bp, mouse
gtcagtctcctccgtgctaa

SEQ ID NO: 694350 - DNA, 20 bp, mouse
gtcataaactaaaacaagag

SEQ ID NO: 694351 - DNA, 20 bp, mouse
gagagcacagcgctgctgct

SEQ ID NO: 694352 - DNA, 20 bp, mouse
ggggcttttcaattcctgga

SEQ ID NO: 694353 - DNA, 20 bp, mouse
gcatccgtctcaaagactca

SEQ ID NO: 694354 - DNA, 20 bp, mouse
ggcatagccccctactgcac

SEQ ID NO: 694355 - DNA, 20 bp, mouse
ggttaatccagccttcatcc

SEQ ID NO: 694356 - DNA, 20 bp, mouse
gggaggggcgggtacaactc

SEQ ID NO: 694357 - DNA, 20 bp, mouse
gggcgggtacaactctggac

SEQ ID NO: 694358 - DNA, 20 bp, mouse
ggaacacgtgacagacagcg

SEQ ID NO: 694359 - DNA, 20 bp, mouse
gtggagagggacactgaaaa

SEQ ID NO: 694360 - DNA, 20 bp, mouse
gtctgtcacgtgttcctgga

SEQ ID NO: 694361 - DNA, 20 bp, mouse
gacaacctccgggttctcct

SEQ ID NO: 694362 - DNA, 20 bp, mouse
gctctggaccggaaagactc

SEQ ID NO: 694363 - DNA, 20 bp, mouse
gtcacgtgttcctggagggg

SEQ ID NO: 694364 - DNA, 20 bp, mouse
gaaatgactgtaattgactg

SEQ ID NO: 694365 - DNA, 20 bp, mouse
gcagcgagaaagcgtaacgc

SEQ ID NO: 694366 - DNA, 20 bp, mouse
ggggagactccgcccttgtg

SEQ ID NO: 694367 - DNA, 20 bp, mouse
gacccagctggaccctccct

SEQ ID NO: 694368 - DNA, 20 bp, mouse
gtgtgggtgtgggcccaggg

SEQ ID NO: 694369 - DNA, 20 bp, mouse
gggccctgggggaccttgga

SEQ ID NO: 694370 - DNA, 20 bp, mouse
gcaagggcggagtctcccta

SEQ ID NO: 694371 - DNA, 20 bp, mouse
gctccagctggctcagtcca

SEQ ID NO: 694372 - DNA, 20 bp, mouse
gctccaaggccataagactc

SEQ ID NO: 694373 - DNA, 20 bp, mouse
gaaaacctgggacaaaggtt

SEQ ID NO: 694374 - DNA, 20 bp, mouse
ggccataagactcaggaccc

SEQ ID NO: 694375 - DNA, 20 bp, mouse
gcaagcggagcacacattta

SEQ ID NO: 694376 - DNA, 20 bp, mouse
gggccgccggggatagggga

SEQ ID NO: 694377 - DNA, 20 bp, mouse
gagccctcccctatccccgg

SEQ ID NO: 694378 - DNA, 20 bp, mouse
gtatccccggcggccagcaa

SEQ ID NO: 694379 - DNA, 20 bp, mouse
ggagtgaacgggtctgtgtt

SEQ ID NO: 694380 - DNA, 20 bp, mouse
gcccggcggccagcaagggt

SEQ ID NO: 694381 - DNA, 20 bp, mouse
ggaacgggtctgtgtttgga

SEQ ID NO: 694382 - DNA, 20 bp, mouse
ggggtagtagaatcctattc

SEQ ID NO: 694383 - DNA, 20 bp, mouse
gggcgggacccaggcttaag

SEQ ID NO: 694384 - DNA, 20 bp, mouse
gcgttcactcagctgcccag

SEQ ID NO: 694385 - DNA, 20 bp, mouse
gtgtaattgccgtcacttgc

SEQ ID NO: 694386 - DNA, 20 bp, mouse
gtggcccaagcaactcgggc

SEQ ID NO: 694387 - DNA, 20 bp, mouse
gagctcccggggcagatggg

SEQ ID NO: 694388 - DNA, 20 bp, mouse
gagcctggcccaagcaactc

SEQ ID NO: 694389 - DNA, 20 bp, mouse
gtggacgctgctgaaggctc

SEQ ID NO: 694390 - DNA, 20 bp, mouse
gggggaagggtatgcaagtc

SEQ ID NO: 694391 - DNA, 20 bp, mouse
ggccccgggagctgcttatc

SEQ ID NO: 694392 - DNA, 20 bp, mouse
gagcagctcccggggcagat

SEQ ID NO: 694393 - DNA, 20 bp, mouse
gtgcttgggccaggctttga

SEQ ID NO: 694394 - DNA, 20 bp, mouse
gtacctgataagcagctccc

SEQ ID NO: 694395 - DNA, 20 bp, mouse
gcagatgggaggcagcaaga

SEQ ID NO: 694396 - DNA, 20 bp, mouse
ggagccttgctgtctgctga

SEQ ID NO: 694397 - DNA, 20 bp, mouse
gcctgcacgagctggatgaa

SEQ ID NO: 694398 - DNA, 20 bp, mouse
ggggaagcagccagtaggca

SEQ ID NO: 694399 - DNA, 20 bp, mouse
gaggaatgctgattctagcg

SEQ ID NO: 694400 - DNA, 20 bp, mouse
ggggacatttctggctctac

SEQ ID NO: 694401 - DNA, 20 bp, mouse
gggcacttggcagcccctcc

SEQ ID NO: 694402 - DNA, 20 bp, mouse
gcgagctggatgaatggcag

SEQ ID NO: 694403 - DNA, 20 bp, mouse
gctgccttgtctgccgggag

SEQ ID NO: 694404 - DNA, 20 bp, mouse
ggaaagcaccgggacatttc

SEQ ID NO: 694405 - DNA, 20 bp, mouse
gtgaatggcagcgggagtcc

SEQ ID NO: 694406 - DNA, 20 bp, mouse
gggaagcggggtgtccctag

SEQ ID NO: 694407 - DNA, 20 bp, mouse
gacttcacagtcatcctcta

SEQ ID NO: 694408 - DNA, 20 bp, mouse
gtccaatagactgacgatga

SEQ ID NO: 694409 - DNA, 20 bp, mouse
gtgacgatgaaggatcgaga

SEQ ID NO: 694410 - DNA, 20 bp, mouse
gacgttcgttcgttagtcgt

SEQ ID NO: 694411 - DNA, 20 bp, mouse
gatgactgtgaagtggctgg

SEQ ID NO: 694412 - DNA, 20 bp, mouse
gtcccggtttgtggtcacgt

SEQ ID NO: 694413 - DNA, 20 bp, mouse
ggttaagtccagaatccctg

SEQ ID NO: 694414 - DNA, 20 bp, mouse
gaaaggcaaggcaatggggc

SEQ ID NO: 694415 - DNA, 20 bp, mouse
gaccgggagccagagatctc

SEQ ID NO: 694416 - DNA, 20 bp, mouse
gccccgggaggcgcgcgcaa

SEQ ID NO: 694417 - DNA, 20 bp, mouse
gaatggggaagcaagggctg

SEQ ID NO: 694418 - DNA, 20 bp, mouse
gctcgaggacgcagcgttga

SEQ ID NO: 694419 - DNA, 20 bp, mouse
ggctgaaagcttttctgttt

SEQ ID NO: 694420 - DNA, 20 bp, mouse
ggcctcccgggggtgcagcc

SEQ ID NO: 694421 - DNA, 20 bp, mouse
gaggagccgggctgcacccc

SEQ ID NO: 694422 - DNA, 20 bp, mouse
gaaggccagaggtgaggccc

SEQ ID NO: 694423 - DNA, 20 bp, mouse
gtggagcgccggccaggtgt

SEQ ID NO: 694424 - DNA, 20 bp, mouse
ggacaaaggctggatgaatg

SEQ ID NO: 694425 - DNA, 20 bp, mouse
ggctccttcaaaccacgacg

SEQ ID NO: 694426 - DNA, 20 bp, mouse
gtactccggcgagttacctg

SEQ ID NO: 694427 - DNA, 20 bp, mouse
gcgggccgcaggtaactcgc

SEQ ID NO: 694428 - DNA, 20 bp, mouse
gccggagaggccacgtgatc

SEQ ID NO: 694429 - DNA, 20 bp, mouse
gcgccggagtaggcagggat

SEQ ID NO: 694430 - DNA, 20 bp, mouse
gacggcccagggaaccccgc

SEQ ID NO: 694431 - DNA, 20 bp, mouse
gcccgcccgcggtgcccttt

SEQ ID NO: 694432 - DNA, 20 bp, mouse
ggtaactcgccggagtaggc

SEQ ID NO: 694433 - DNA, 20 bp, mouse
gccggactgcagcaagaggt

SEQ ID NO: 694434 - DNA, 20 bp, mouse
gccccaaagggcaccgcggg

SEQ ID NO: 694435 - DNA, 20 bp, mouse
gccctcccgcggggttccct

SEQ ID NO: 694436 - DNA, 20 bp, mouse
ggcggcgcctgcgtacccgg

SEQ ID NO: 694437 - DNA, 20 bp, mouse
gtgggcggggcctgaaccta

SEQ ID NO: 694438 - DNA, 20 bp, mouse
gcgaagactaggaactggtg

SEQ ID NO: 694439 - DNA, 20 bp, mouse
ggccctatgctaatatccga

SEQ ID NO: 694440 - DNA, 20 bp, mouse
ggcggcggcgcctgcgtacc

SEQ ID NO: 694441 - DNA, 20 bp, mouse
gtacccggaggacagcgggc

SEQ ID NO: 694442 - DNA, 20 bp, mouse
gaggagcgaagactaggaac

SEQ ID NO: 694443 - DNA, 20 bp, mouse
gcacccttgcatcacgaagg

SEQ ID NO: 694444 - DNA, 20 bp, mouse
gcgcgtgcgcggcctcctgt

SEQ ID NO: 694445 - DNA, 20 bp, mouse
gtgcgtacccggaggacagc

SEQ ID NO: 694446 - DNA, 20 bp, mouse
gccagcccaagagacttcaa

SEQ ID NO: 694447 - DNA, 20 bp, mouse
gacagaatcgagctggggtg

SEQ ID NO: 694448 - DNA, 20 bp, mouse
gcaagagacttcaatggaat

SEQ ID NO: 694449 - DNA, 20 bp, mouse
gtggaataggacactccggc

SEQ ID NO: 694450 - DNA, 20 bp, mouse
gtcaatggaataggacactc

SEQ ID NO: 694451 - DNA, 20 bp, mouse
gggggaccttgcatgcccgc

SEQ ID NO: 694452 - DNA, 20 bp, mouse
gttcctactccacaggaggt

SEQ ID NO: 694453 - DNA, 20 bp, mouse
gacactccggcgggcatgca

SEQ ID NO: 694454 - DNA, 20 bp, mouse
gaagtgacagaatcgagctg

SEQ ID NO: 694455 - DNA, 20 bp, mouse
gcacagctctatgaaccgac

SEQ ID NO: 694456 - DNA, 20 bp, mouse
gtgacgtaggagagctgcga

SEQ ID NO: 694457 - DNA, 20 bp, mouse
ggtgtctacgggtatgacgt

SEQ ID NO: 694458 - DNA, 20 bp, mouse
gctaagtgaggtgagaggtt

SEQ ID NO: 694459 - DNA, 20 bp, mouse
gggccacatgggcgtgtcta

SEQ ID NO: 694460 - DNA, 20 bp, mouse
gctaacatcttgccatcctt

SEQ ID NO: 694461 - DNA, 20 bp, mouse
gcctagtgggcgggccacat

SEQ ID NO: 694462 - DNA, 20 bp, mouse
ggagagctgcgagggtggcc

SEQ ID NO: 694463 - DNA, 20 bp, mouse
ggggctatggcctagtgggc

SEQ ID NO: 694464 - DNA, 20 bp, mouse
gctgaagtcgcagacttttc

SEQ ID NO: 694465 - DNA, 20 bp, mouse
gggcggggctatggcctagt

SEQ ID NO: 694466 - DNA, 20 bp, mouse
ggggccgctgcccaatcagg

SEQ ID NO: 694467 - DNA, 20 bp, mouse
gcgaacgcctgcccggagca

SEQ ID NO: 694468 - DNA, 20 bp, mouse
gcaggagcgcctctgattgg

SEQ ID NO: 694469 - DNA, 20 bp, mouse
gcgcctgcccggagcacggt

SEQ ID NO: 694470 - DNA, 20 bp, mouse
gcgctgcccaatcaggaggg

SEQ ID NO: 694471 - DNA, 20 bp, mouse
ggcagcggccccccaatcag

SEQ ID NO: 694472 - DNA, 20 bp, mouse
gggggggccgctgcccaatc

SEQ ID NO: 694473 - DNA, 20 bp, mouse
ggcttctcaggggtgtgtga

SEQ ID NO: 694474 - DNA, 20 bp, mouse
gaataataagggggaagctg

SEQ ID NO: 694475 - DNA, 20 bp, mouse
ggcccaggagcgcctctgat

SEQ ID NO: 694476 - DNA, 20 bp, mouse
gccaactcacgagccaggaa

SEQ ID NO: 694477 - DNA, 20 bp, mouse
gggagcctgaagaggaatgt

SEQ ID NO: 694478 - DNA, 20 bp, mouse
gtggcagcgagtcgggtgag

SEQ ID NO: 694479 - DNA, 20 bp, mouse
gagacccgacattcctcttc

SEQ ID NO: 694480 - DNA, 20 bp, mouse
gctaaggctcgcccagtcct

SEQ ID NO: 694481 - DNA, 20 bp, mouse
gaggactcggggttcacttg

SEQ ID NO: 694482 - DNA, 20 bp, mouse
gcccggggcgggtttccccc

SEQ ID NO: 694483 - DNA, 20 bp, mouse
gcgtgagttggcagcgagtc

SEQ ID NO: 694484 - DNA, 20 bp, mouse
gctcactggaggtcgttgtt

SEQ ID NO: 694485 - DNA, 20 bp, mouse
gctcttcaggctcctggcac

SEQ ID NO: 694486 - DNA, 20 bp, mouse
gagggtgggactacattgta

SEQ ID NO: 694487 - DNA, 20 bp, mouse
gtgggtgggactacactgta

SEQ ID NO: 694488 - DNA, 20 bp, mouse
gtagtcccacccattccgaa

SEQ ID NO: 694489 - DNA, 20 bp, mouse
gaagcagctggtaccacctc

SEQ ID NO: 694490 - DNA, 20 bp, mouse
gagggagctcaaagtccgac

SEQ ID NO: 694491 - DNA, 20 bp, mouse
gggagtgtttccattcggaa

SEQ ID NO: 694492 - DNA, 20 bp, mouse
gtgatccctaagaggcacaa

SEQ ID NO: 694493 - DNA, 20 bp, mouse
gagggggtgctctggtgaca

SEQ ID NO: 694494 - DNA, 20 bp, mouse
ggagtcacgccccttttata

SEQ ID NO: 694495 - DNA, 20 bp, mouse
ggctgaccaccctataaaag

SEQ ID NO: 694496 - DNA, 20 bp, mouse
gtggaccagagggtcaagat

SEQ ID NO: 694497 - DNA, 20 bp, mouse
gaccagagggtcaagatggg

SEQ ID NO: 694498 - DNA, 20 bp, mouse
gcctccgtgattggaccaga

SEQ ID NO: 694499 - DNA, 20 bp, mouse
ggcagctgctcctcccacgt

SEQ ID NO: 694500 - DNA, 20 bp, mouse
gtgactggtcacggagagaa

SEQ ID NO: 694501 - DNA, 20 bp, mouse
gttggatggcgggaaaaggg

SEQ ID NO: 694502 - DNA, 20 bp, mouse
ggggttggatggcgggaaaa

SEQ ID NO: 694503 - DNA, 20 bp, mouse
gtcaagatgggagggttgga

SEQ ID NO: 694504 - DNA, 20 bp, mouse
gctgctcccgcctcttaagt

SEQ ID NO: 694505 - DNA, 20 bp, mouse
gctgccccaacaggcagggg

SEQ ID NO: 694506 - DNA, 20 bp, mouse
gcccagagaggggcttgctc

SEQ ID NO: 694507 - DNA, 20 bp, mouse
gccgaccctgaaagaatcta

SEQ ID NO: 694508 - DNA, 20 bp, mouse
ggcgcccgactcttcctcac

SEQ ID NO: 694509 - DNA, 20 bp, mouse
gcggacccgcctctgcgctg

SEQ ID NO: 694510 - DNA, 20 bp, mouse
gccgaccgcgcgatgacacc

SEQ ID NO: 694511 - DNA, 20 bp, mouse
ggatcccagtgaggaagagt

SEQ ID NO: 694512 - DNA, 20 bp, mouse
gcgagggagcgggatccggt

SEQ ID NO: 694513 - DNA, 20 bp, mouse
ggccctcaggaaagatcccc

SEQ ID NO: 694514 - DNA, 20 bp, mouse
gacggccggagagggaggtg

SEQ ID NO: 694515 - DNA, 20 bp, mouse
gagggcgcggacgagggagc

SEQ ID NO: 694516 - DNA, 20 bp, mouse
gggcgtgcccaggtgaaaag

SEQ ID NO: 694517 - DNA, 20 bp, mouse
gatgccctcaaggcctcatc

SEQ ID NO: 694518 - DNA, 20 bp, mouse
ggggcggggtcaacccgatg

SEQ ID NO: 694519 - DNA, 20 bp, mouse
ggtgcccaggtgaaaagggg

SEQ ID NO: 694520 - DNA, 20 bp, mouse
gcggaagtctccgccaccag

SEQ ID NO: 694521 - DNA, 20 bp, mouse
gcacctgggcacgcccctgg

SEQ ID NO: 694522 - DNA, 20 bp, mouse
gagtctgggcataaggccag

SEQ ID NO: 694523 - DNA, 20 bp, mouse
gtgggagtggtcccagactt

SEQ ID NO: 694524 - DNA, 20 bp, mouse
gtggcataaatgtcaacaga

SEQ ID NO: 694525 - DNA, 20 bp, mouse
gtcaacccgatgaggccttg

SEQ ID NO: 694526 - DNA, 20 bp, mouse
gggttagaaggctgcggcca

SEQ ID NO: 694527 - DNA, 20 bp, mouse
ggaactgcaggacccttttc

SEQ ID NO: 694528 - DNA, 20 bp, mouse
gtgtgaggggcggggttaga

SEQ ID NO: 694529 - DNA, 20 bp, mouse
gctaagttggacgagtctga

SEQ ID NO: 694530 - DNA, 20 bp, mouse
gaaggctgcggccagggctg

SEQ ID NO: 694531 - DNA, 20 bp, mouse
gcctgcagttcctgctaagt

SEQ ID NO: 694532 - DNA, 20 bp, mouse
ggtaacccgcccctagacgg

SEQ ID NO: 694533 - DNA, 20 bp, mouse
gttggctgcgtcagtgtgag

SEQ ID NO: 694534 - DNA, 20 bp, mouse
gtggatctgtgacaggaact

SEQ ID NO: 694535 - DNA, 20 bp, mouse
gaattggctgcctccgtcta

SEQ ID NO: 694536 - DNA, 20 bp, mouse
ggcaaaaaatgggttagcac

SEQ ID NO: 694537 - DNA, 20 bp, mouse
gtgaaggggagtggatataa

SEQ ID NO: 694538 - DNA, 20 bp, mouse
gggggagtggatataaaggg

SEQ ID NO: 694539 - DNA, 20 bp, mouse
gaatcgccctctgggagaga

SEQ ID NO: 694540 - DNA, 20 bp, mouse
gcaagcctggtgttcccctt

SEQ ID NO: 694541 - DNA, 20 bp, mouse
gtgggttagcacaggattgg

SEQ ID NO: 694542 - DNA, 20 bp, mouse
gtgctgcagaggcaaaaaat

SEQ ID NO: 694543 - DNA, 20 bp, mouse
ggggcgattctggaacgctg

SEQ ID NO: 694544 - DNA, 20 bp, mouse
gatgtaggatatcagcacta

SEQ ID NO: 694545 - DNA, 20 bp, mouse
ggcgttccagaatcgccctc

SEQ ID NO: 694546 - DNA, 20 bp, mouse
gtggctgccttgtgaggtat

SEQ ID NO: 694547 - DNA, 20 bp, mouse
ggggccggggcgacgacgag

SEQ ID NO: 694548 - DNA, 20 bp, mouse
gttacaagaggcaatctgat

SEQ ID NO: 694549 - DNA, 20 bp, mouse
ggcgcgccgcgacttcccat

SEQ ID NO: 694550 - DNA, 20 bp, mouse
gccccagcccatacctcaca

SEQ ID NO: 694551 - DNA, 20 bp, mouse
gtggaaggcggcgggcggaa

SEQ ID NO: 694552 - DNA, 20 bp, mouse
ggaaatgctcgcgagagcca

SEQ ID NO: 694553 - DNA, 20 bp, mouse
gggaggcgcagagagccaat

SEQ ID NO: 694554 - DNA, 20 bp, mouse
gccaggggcggagtggaagg

SEQ ID NO: 694555 - DNA, 20 bp, mouse
gatcagaggccccatgtgag

SEQ ID NO: 694556 - DNA, 20 bp, mouse
ggaggaaagcggaaagttag

SEQ ID NO: 694557 - DNA, 20 bp, mouse
gggcagccacgcagccaatg

SEQ ID NO: 694558 - DNA, 20 bp, mouse
gcgaaagtccgagaccgtca

SEQ ID NO: 694559 - DNA, 20 bp, mouse
gaaagttagaggcgggactt

SEQ ID NO: 694560 - DNA, 20 bp, mouse
ggaggcgggacttgggagta

SEQ ID NO: 694561 - DNA, 20 bp, mouse
gtggctgcgtggctgcccaa

SEQ ID NO: 694562 - DNA, 20 bp, mouse
gggcgcgcatgccagcgtct

SEQ ID NO: 694563 - DNA, 20 bp, mouse
ggtgccaaccaaatagtcgc

SEQ ID NO: 694564 - DNA, 20 bp, mouse
ggccacgccctccagttgct

SEQ ID NO: 694565 - DNA, 20 bp, mouse
gcgcttcccgggagcccatt

SEQ ID NO: 694566 - DNA, 20 bp, mouse
ggggcgttgcacagaagtag

SEQ ID NO: 694567 - DNA, 20 bp, mouse
gggaagcggaattcagggag

SEQ ID NO: 694568 - DNA, 20 bp, mouse
gtaggagtgaagtttgctga

SEQ ID NO: 694569 - DNA, 20 bp, mouse
ggcggaccgctgggtggagg

SEQ ID NO: 694570 - DNA, 20 bp, mouse
gccaataggaagcggaattc

SEQ ID NO: 694571 - DNA, 20 bp, mouse
gacggcggaccgctgggtgg

SEQ ID NO: 694572 - DNA, 20 bp, mouse
gaggcgcagagacagatacg

SEQ ID NO: 694573 - DNA, 20 bp, mouse
ggggtccacggcggaccgct

SEQ ID NO: 694574 - DNA, 20 bp, mouse
gtccacggcggaccgctggg

SEQ ID NO: 694575 - DNA, 20 bp, mouse
gcaacgccccctccacccag

SEQ ID NO: 694576 - DNA, 20 bp, mouse
ggagacgtacttggggtcca

SEQ ID NO: 694577 - DNA, 20 bp, mouse
gcacactaggttcctggctg

SEQ ID NO: 694578 - DNA, 20 bp, mouse
gcagcctcgctatgcttcta

SEQ ID NO: 694579 - DNA, 20 bp, mouse
gcgcacacgcgagagcttgt

SEQ ID NO: 694580 - DNA, 20 bp, mouse
gatggggcgggactccgtgt

SEQ ID NO: 694581 - DNA, 20 bp, mouse
gggaacctagtgtgcagaag

SEQ ID NO: 694582 - DNA, 20 bp, mouse
ggctgaggatgactgggaga

SEQ ID NO: 694583 - DNA, 20 bp, mouse
ggggcgggactccgtgtggg

SEQ ID NO: 694584 - DNA, 20 bp, mouse
gtagccccagctcactccca

SEQ ID NO: 694585 - DNA, 20 bp, mouse
gccggcgcaaagcagaagag

SEQ ID NO: 694586 - DNA, 20 bp, mouse
gtctccgcgaagggtagata

SEQ ID NO: 694587 - DNA, 20 bp, mouse
gtctcctggagatggattgg

SEQ ID NO: 694588 - DNA, 20 bp, mouse
ggctaggatctctccgcgaa

SEQ ID NO: 694589 - DNA, 20 bp, mouse
ggaagggtagatatggatct

SEQ ID NO: 694590 - DNA, 20 bp, mouse
gcagcccccaatccatctcc

SEQ ID NO: 694591 - DNA, 20 bp, mouse
gggagccccacccccgggga

SEQ ID NO: 694592 - DNA, 20 bp, mouse
gctgcagggcggtccctccc

SEQ ID NO: 694593 - DNA, 20 bp, mouse
gtgggcgggaccgctaaatc

SEQ ID NO: 694594 - DNA, 20 bp, mouse
gggagggagtcccaaacgtc

SEQ ID NO: 694595 - DNA, 20 bp, mouse
gcatctctggcatagaactg

SEQ ID NO: 694596 - DNA, 20 bp, mouse
ggggctcctgagattcaaga

SEQ ID NO: 694597 - DNA, 20 bp, mouse
gtctgccgcccaacaggtga

SEQ ID NO: 694598 - DNA, 20 bp, mouse
ggactcgcagcttagggata

SEQ ID NO: 694599 - DNA, 20 bp, mouse
gcccaataggccccccagat

SEQ ID NO: 694600 - DNA, 20 bp, mouse
gaacacttcacacaggacta

SEQ ID NO: 694601 - DNA, 20 bp, mouse
gctgctgtcgccaggactgg

SEQ ID NO: 694602 - DNA, 20 bp, mouse
gacccagcaggctgcgtcct

SEQ ID NO: 694603 - DNA, 20 bp, mouse
gcctagccctcttgaatctc

SEQ ID NO: 694604 - DNA, 20 bp, mouse
gcccgcctctgccgcccaac

SEQ ID NO: 694605 - DNA, 20 bp, mouse
gcgctggaatgcggtcttcc

SEQ ID NO: 694606 - DNA, 20 bp, mouse
gggcgggcctcggggctctt

SEQ ID NO: 694607 - DNA, 20 bp, mouse
gcctcggggctcttggggat

SEQ ID NO: 694608 - DNA, 20 bp, mouse
gaccccgcggcacaatgggc

SEQ ID NO: 694609 - DNA, 20 bp, mouse
gcactccgctactgtggggt

SEQ ID NO: 694610 - DNA, 20 bp, mouse
ggcaaggctcgtaagcgctc

SEQ ID NO: 694611 - DNA, 20 bp, mouse
ggccgcgctcggactccttc

SEQ ID NO: 694612 - DNA, 20 bp, mouse
gccagccaaccccacagtag

SEQ ID NO: 694613 - DNA, 20 bp, mouse
gcaggcactccgctactgtg

SEQ ID NO: 694614 - DNA, 20 bp, mouse
gacccgaaggagtccgagcg

SEQ ID NO: 694615 - DNA, 20 bp, mouse
gagctcggcagaattcggta

SEQ ID NO: 694616 - DNA, 20 bp, mouse
gcccgcgttagcccctacgg

SEQ ID NO: 694617 - DNA, 20 bp, mouse
gacccatgatgtcactgtcg

SEQ ID NO: 694618 - DNA, 20 bp, mouse
gagtggtcgaggaggggcca

SEQ ID NO: 694619 - DNA, 20 bp, mouse
gaccactcccactctctctc

SEQ ID NO: 694620 - DNA, 20 bp, mouse
gagagtgggagtggtcgagg

SEQ ID NO: 694621 - DNA, 20 bp, mouse
gtctctcagggcccccccgt

SEQ ID NO: 694622 - DNA, 20 bp, mouse
gcggcggctccgagggggtg

SEQ ID NO: 694623 - DNA, 20 bp, mouse
gaaaagggcgagcacggcac

SEQ ID NO: 694624 - DNA, 20 bp, mouse
gggggctaacgcgggcgcgg

SEQ ID NO: 694625 - DNA, 20 bp, mouse
ggcgcccgcgttagccccta

SEQ ID NO: 694626 - DNA, 20 bp, mouse
ggggacttggcaaagggcaa

SEQ ID NO: 694627 - DNA, 20 bp, mouse
gggacaggagccagtcagac

SEQ ID NO: 694628 - DNA, 20 bp, mouse
gtacccagggcaggaggcac

SEQ ID NO: 694629 - DNA, 20 bp, mouse
ggtaagcaggcaccaggtgg

SEQ ID NO: 694630 - DNA, 20 bp, mouse
gcctccgcccccagtctgac

SEQ ID NO: 694631 - DNA, 20 bp, mouse
ggggaaggaaggaatttatg

SEQ ID NO: 694632 - DNA, 20 bp, mouse
gagggcaggaggcacaggag

SEQ ID NO: 694633 - DNA, 20 bp, mouse
gggcaggcaacacttaaaag

SEQ ID NO: 694634 - DNA, 20 bp, mouse
gaaggaaggaatttatgggg

SEQ ID NO: 694635 - DNA, 20 bp, mouse
ggagccagtcagactggggg

SEQ ID NO: 694636 - DNA, 20 bp, mouse
gaggccgtgtgtgcatgctc

SEQ ID NO: 694637 - DNA, 20 bp, mouse
gccacagtgagtactgagtg

SEQ ID NO: 694638 - DNA, 20 bp, mouse
gaggtgagcaagttcctaca

SEQ ID NO: 694639 - DNA, 20 bp, mouse
gccccctgaacattggccta

SEQ ID NO: 694640 - DNA, 20 bp, mouse
gccaccaggtagaacttgca

SEQ ID NO: 694641 - DNA, 20 bp, mouse
gcataagctggctctatatg

SEQ ID NO: 694642 - DNA, 20 bp, mouse
gtactgagtgtggttggcaa

SEQ ID NO: 694643 - DNA, 20 bp, mouse
gagcagctcctctgatggcg

SEQ ID NO: 694644 - DNA, 20 bp, mouse
gcctatgggagggaaacaga

SEQ ID NO: 694645 - DNA, 20 bp, mouse
gatccagaacacaccaggtg

SEQ ID NO: 694646 - DNA, 20 bp, mouse
gctcccaaaagcgaaaggaa

SEQ ID NO: 694647 - DNA, 20 bp, mouse
ggggcagcggctgggaccct

SEQ ID NO: 694648 - DNA, 20 bp, mouse
gccactcggcgaggcggcga

SEQ ID NO: 694649 - DNA, 20 bp, mouse
ggggctactgccacagtctc

SEQ ID NO: 694650 - DNA, 20 bp, mouse
gcccgcgcgcgcggaatagc

SEQ ID NO: 694651 - DNA, 20 bp, mouse
gttgggagacgggcggtgat

SEQ ID NO: 694652 - DNA, 20 bp, mouse
gcggctgggaccctgggcct

SEQ ID NO: 694653 - DNA, 20 bp, mouse
ggaggaacgccctaaagcgg

SEQ ID NO: 694654 - DNA, 20 bp, mouse
gagcccaccgctgctaagaa

SEQ ID NO: 694655 - DNA, 20 bp, mouse
gccaaaagcgaaaggaaggg

SEQ ID NO: 694656 - DNA, 20 bp, mouse
ggggtcgcagagaagggccc

SEQ ID NO: 694657 - DNA, 20 bp, mouse
gagcgcgaggccggcgtggg

SEQ ID NO: 694658 - DNA, 20 bp, mouse
ggagggccggagggaaccgg

SEQ ID NO: 694659 - DNA, 20 bp, mouse
gcctgcagacagcctaacgc

SEQ ID NO: 694660 - DNA, 20 bp, mouse
ggctgcagggtcgcagagaa

SEQ ID NO: 694661 - DNA, 20 bp, mouse
ggcggatccacgctgctccc

SEQ ID NO: 694662 - DNA, 20 bp, mouse
gcgcaccgaggcagtaggag

SEQ ID NO: 694663 - DNA, 20 bp, mouse
ggtgggaggagagcgcgctc

SEQ ID NO: 694664 - DNA, 20 bp, mouse
gaggtccagctagaaaggca

SEQ ID NO: 694665 - DNA, 20 bp, mouse
gtgggcataacgcccgaacc

SEQ ID NO: 694666 - DNA, 20 bp, mouse
gtaggggcgcaggagaccca

SEQ ID NO: 694667 - DNA, 20 bp, mouse
gtctcccagagtggtcgcaa

SEQ ID NO: 694668 - DNA, 20 bp, mouse
gagagtggtcgcaaaggcat

SEQ ID NO: 694669 - DNA, 20 bp, mouse
gcactctgggagaagtcgca

SEQ ID NO: 694670 - DNA, 20 bp, mouse
gaacctagaggggaacaaga

SEQ ID NO: 694671 - DNA, 20 bp, mouse
gcgcaaaggcataggggcgc

SEQ ID NO: 694672 - DNA, 20 bp, mouse
ggagacgtggagccaatggg

SEQ ID NO: 694673 - DNA, 20 bp, mouse
gcaaggctggagcgtgtggt

SEQ ID NO: 694674 - DNA, 20 bp, mouse
gaggcagcgatccatcagtt

SEQ ID NO: 694675 - DNA, 20 bp, mouse
gtgggtggactccgggtcaa

SEQ ID NO: 694676 - DNA, 20 bp, mouse
gaccctgccgattgtgacgt

SEQ ID NO: 694677 - DNA, 20 bp, mouse
gtaggctgatgctagggaaa

SEQ ID NO: 694678 - DNA, 20 bp, mouse
ggaccctcatttaacgtcag

SEQ ID NO: 694679 - DNA, 20 bp, mouse
gagacagccagatcagggtg

SEQ ID NO: 694680 - DNA, 20 bp, mouse
gaggcacagggagggtgtcc

SEQ ID NO: 694681 - DNA, 20 bp, mouse
gtggagctactaccgaataa

SEQ ID NO: 694682 - DNA, 20 bp, mouse
gacgttaaatgagggtcttc

SEQ ID NO: 694683 - DNA, 20 bp, mouse
gtgtgcctggtaagggattc

SEQ ID NO: 694684 - DNA, 20 bp, mouse
gcatcagcctacgtcacaat

SEQ ID NO: 694685 - DNA, 20 bp, mouse
gaatcaaaataacatcgtta

SEQ ID NO: 694686 - DNA, 20 bp, mouse
ggtgcccctccgtggctcgg

SEQ ID NO: 694687 - DNA, 20 bp, mouse
gcggcctccgagccacggag

SEQ ID NO: 694688 - DNA, 20 bp, mouse
gaagagccttccttctgcag

SEQ ID NO: 694689 - DNA, 20 bp, mouse
ggggaccagtaaaggttaag

SEQ ID NO: 694690 - DNA, 20 bp, mouse
gtgcctctggagggaaacta

SEQ ID NO: 694691 - DNA, 20 bp, mouse
gccccgcggcctccgagcca

SEQ ID NO: 694692 - DNA, 20 bp, mouse
ggaggggcaccggtaccttc

SEQ ID NO: 694693 - DNA, 20 bp, mouse
gccggtgcccctccgtggct

SEQ ID NO: 694694 - DNA, 20 bp, mouse
gtcagaggcacgtgcgaagt

SEQ ID NO: 694695 - DNA, 20 bp, mouse
ggagggggcggtgtcgtgag

SEQ ID NO: 694696 - DNA, 20 bp, mouse
gaaaacaagccggggctctg

SEQ ID NO: 694697 - DNA, 20 bp, mouse
ggcccgccaatcctcagact

SEQ ID NO: 694698 - DNA, 20 bp, mouse
ggcgcccggaaaacaagccg

SEQ ID NO: 694699 - DNA, 20 bp, mouse
gggctcaggccgcctcgctc

SEQ ID NO: 694700 - DNA, 20 bp, mouse
ggtgaagctgcggaagggga

SEQ ID NO: 694701 - DNA, 20 bp, mouse
ggaaacaaagggaaccggtg

SEQ ID NO: 694702 - DNA, 20 bp, mouse
gcagacagttgtgagcccgg

SEQ ID NO: 694703 - DNA, 20 bp, mouse
gtcccgggagcgctgcgggg

SEQ ID NO: 694704 - DNA, 20 bp, mouse
gagacccggcagcttctcca

SEQ ID NO: 694705 - DNA, 20 bp, mouse
ggctagccgagtctgaggat

SEQ ID NO: 694706 - DNA, 20 bp, mouse
gggcgccgcagatgatgggg

SEQ ID NO: 694707 - DNA, 20 bp, mouse
gagacctctgagggcgttga

SEQ ID NO: 694708 - DNA, 20 bp, mouse
gaatgggcgccgcagatgat

SEQ ID NO: 694709 - DNA, 20 bp, mouse
gtggtcggcggccatccccg

SEQ ID NO: 694710 - DNA, 20 bp, mouse
gagggtaaacaagaggtgat

SEQ ID NO: 694711 - DNA, 20 bp, mouse
gcacacacgtccccattggt

SEQ ID NO: 694712 - DNA, 20 bp, mouse
ggggatggccgccgaccaat

SEQ ID NO: 694713 - DNA, 20 bp, mouse
gcctctgagggcgttgaggg

SEQ ID NO: 694714 - DNA, 20 bp, mouse
ggcgcccattggctaacggt

SEQ ID NO: 694715 - DNA, 20 bp, mouse
gaatggggacgtgtgtgctc

SEQ ID NO: 694716 - DNA, 20 bp, mouse
ggggccgcggagaaatcaaa

SEQ ID NO: 694717 - DNA, 20 bp, mouse
gcaccccacgccgtgctcgc

SEQ ID NO: 694718 - DNA, 20 bp, mouse
ggagccggcgagcacggcgt

SEQ ID NO: 694719 - DNA, 20 bp, mouse
gcgacccgggcgcagcaggc

SEQ ID NO: 694720 - DNA, 20 bp, mouse
gcgcctcggggcggcccagt

SEQ ID NO: 694721 - DNA, 20 bp, mouse
ggggaggagacacgccaggc

SEQ ID NO: 694722 - DNA, 20 bp, mouse
ggcgtggggtgtgcgggtcg

SEQ ID NO: 694723 - DNA, 20 bp, mouse
gacgctgcaaggttccccaa

SEQ ID NO: 694724 - DNA, 20 bp, mouse
ggattgggcgcgaggtgcgg

SEQ ID NO: 694725 - DNA, 20 bp, mouse
gaaagccccttcctagactg

SEQ ID NO: 694726 - DNA, 20 bp, mouse
ggcgagacgcgaaacctgaa

SEQ ID NO: 694727 - DNA, 20 bp, mouse
ggcggcgcccacgtggggaa

SEQ ID NO: 694728 - DNA, 20 bp, mouse
ggtctcgcggcgcccacgtg

SEQ ID NO: 694729 - DNA, 20 bp, mouse
ggggagatcatgtaacccag

SEQ ID NO: 694730 - DNA, 20 bp, mouse
gatgtaacccaggggacggt

SEQ ID NO: 694731 - DNA, 20 bp, mouse
gacaaggtggggaccgcgga

SEQ ID NO: 694732 - DNA, 20 bp, mouse
gtggaagttcgggacaaggt

SEQ ID NO: 694733 - DNA, 20 bp, mouse
gctccaacttagttcaactt

SEQ ID NO: 694734 - DNA, 20 bp, mouse
gagggcaggtccggagccga

SEQ ID NO: 694735 - DNA, 20 bp, mouse
gcgggacaaggtggggaccg

SEQ ID NO: 694736 - DNA, 20 bp, mouse
gctccccagcggcttcctgt

SEQ ID NO: 694737 - DNA, 20 bp, mouse
ggctggggagggcgctcaca

SEQ ID NO: 694738 - DNA, 20 bp, mouse
ggggaggtaacctgccgcca

SEQ ID NO: 694739 - DNA, 20 bp, mouse
gcccctacaggaagccgctg

SEQ ID NO: 694740 - DNA, 20 bp, mouse
gttgttgttagtactggcgg

SEQ ID NO: 694741 - DNA, 20 bp, mouse
gctacgggaagcgggagggg

SEQ ID NO: 694742 - DNA, 20 bp, mouse
gcgggtggaggggtgcagga

SEQ ID NO: 694743 - DNA, 20 bp, mouse
gccgccgtgcgaacctggta

SEQ ID NO: 694744 - DNA, 20 bp, mouse
ggcttcctgtaggggagcag

SEQ ID NO: 694745 - DNA, 20 bp, mouse
ggtgcggccggacaccgcga

SEQ ID NO: 694746 - DNA, 20 bp, mouse
gaacctagggagccagccta

SEQ ID NO: 694747 - DNA, 20 bp, mouse
gatccccagccaaggggagg

SEQ ID NO: 694748 - DNA, 20 bp, mouse
gagccagcctagggagttta

SEQ ID NO: 694749 - DNA, 20 bp, mouse
gagaggggagcggagatcgt

SEQ ID NO: 694750 - DNA, 20 bp, mouse
gcggggcgaggatcccaggg

SEQ ID NO: 694751 - DNA, 20 bp, mouse
gcttggccgaggccgatcgg

SEQ ID NO: 694752 - DNA, 20 bp, mouse
gagcggagatcgtgggaagg

SEQ ID NO: 694753 - DNA, 20 bp, mouse
gttcctggctccatgaacct

SEQ ID NO: 694754 - DNA, 20 bp, mouse
ggggcggggcgaggatccca

SEQ ID NO: 694755 - DNA, 20 bp, mouse
gcacgccggtgtctctaggc

SEQ ID NO: 694756 - DNA, 20 bp, mouse
ggggtgcggagcatcccgga

SEQ ID NO: 694757 - DNA, 20 bp, mouse
gagcggcgcgggaatcggat

SEQ ID NO: 694758 - DNA, 20 bp, mouse
gtgcccacgtggaaccatga

SEQ ID NO: 694759 - DNA, 20 bp, mouse
gccaggagcggcgcgggaat

SEQ ID NO: 694760 - DNA, 20 bp, mouse
gaaaggctgaaagtttgggg

SEQ ID NO: 694761 - DNA, 20 bp, mouse
gcgcgggaatcggattggac

SEQ ID NO: 694762 - DNA, 20 bp, mouse
ggtagcttgctccggagact

SEQ ID NO: 694763 - DNA, 20 bp, mouse
gacaaaagagtagcttgctc

SEQ ID NO: 694764 - DNA, 20 bp, mouse
gcgggtccaagctcctccct

SEQ ID NO: 694765 - DNA, 20 bp, mouse
gttaatctggccgccagctc

SEQ ID NO: 694766 - DNA, 20 bp, mouse
gaggccgcaagctgcgtagg

SEQ ID NO: 694767 - DNA, 20 bp, mouse
gtggaggccgcaagctgcgt

SEQ ID NO: 694768 - DNA, 20 bp, mouse
gagtcagtgggcattagtag

SEQ ID NO: 694769 - DNA, 20 bp, mouse
gagtgaggcacagcaagcga

SEQ ID NO: 694770 - DNA, 20 bp, mouse
gttggggaagaagagtagcg

SEQ ID NO: 694771 - DNA, 20 bp, mouse
gctccctcctacgcagcttg

SEQ ID NO: 694772 - DNA, 20 bp, mouse
gaggtggtctgaggagagtc

SEQ ID NO: 694773 - DNA, 20 bp, mouse
gaattcctagtgctaagact

SEQ ID NO: 694774 - DNA, 20 bp, mouse
gaagagtagcgggggtgatt

SEQ ID NO: 694775 - DNA, 20 bp, mouse
gtcttccccaagggtgacaa

SEQ ID NO: 694776 - DNA, 20 bp, mouse
gaggaggatcaccgagtccg

SEQ ID NO: 694777 - DNA, 20 bp, mouse
ggggccagagaatgcttgta

SEQ ID NO: 694778 - DNA, 20 bp, mouse
gggaaagccctccccattca

SEQ ID NO: 694779 - DNA, 20 bp, mouse
gataaacaataagccatagg

SEQ ID NO: 694780 - DNA, 20 bp, mouse
gcagtctccaccccctgaat

SEQ ID NO: 694781 - DNA, 20 bp, mouse
gaacagacgtgtctaatctg

SEQ ID NO: 694782 - DNA, 20 bp, mouse
gagagaatgcttgtagggtg

SEQ ID NO: 694783 - DNA, 20 bp, mouse
gaggatcaccgagtccgtgg

SEQ ID NO: 694784 - DNA, 20 bp, mouse
gggcataaacaataagccat

SEQ ID NO: 694785 - DNA, 20 bp, mouse
gacaaacacctccacggact

SEQ ID NO: 694786 - DNA, 20 bp, mouse
gccccatgcctggagagtca

SEQ ID NO: 694787 - DNA, 20 bp, mouse
gcaaactcttagtcattctg

SEQ ID NO: 694788 - DNA, 20 bp, mouse
gtccctgactctccaggcat

SEQ ID NO: 694789 - DNA, 20 bp, mouse
gtcaaaatacgctctggtga

SEQ ID NO: 694790 - DNA, 20 bp, mouse
gggtaagatgacacctccca

SEQ ID NO: 694791 - DNA, 20 bp, mouse
gcaaaacagtaggtttttag

SEQ ID NO: 694792 - DNA, 20 bp, mouse
gtgcacggctcacctgccat

SEQ ID NO: 694793 - DNA, 20 bp, mouse
gtgaatgttgtgtaggtctc

SEQ ID NO: 694794 - DNA, 20 bp, mouse
gctctgcttgtcttcttcaa

SEQ ID NO: 694795 - DNA, 20 bp, mouse
gcacaatgttccaaaacagt

SEQ ID NO: 694796 - DNA, 20 bp, mouse
gaggaggatcaccgagtccg

SEQ ID NO: 694797 - DNA, 20 bp, mouse
ggggccagagaatgcttgta

SEQ ID NO: 694798 - DNA, 20 bp, mouse
gggaaagccctccccattca

SEQ ID NO: 694799 - DNA, 20 bp, mouse
gataaacaataagccatagg

SEQ ID NO: 694800 - DNA, 20 bp, mouse
gcagtctccaccccctgaat

SEQ ID NO: 694801 - DNA, 20 bp, mouse
gaacagacgtgtctaatctg

SEQ ID NO: 694802 - DNA, 20 bp, mouse
gagagaatgcttgtagggtg

SEQ ID NO: 694803 - DNA, 20 bp, mouse
gaggatcaccgagtccgtgg

SEQ ID NO: 694804 - DNA, 20 bp, mouse
gggcataaacaataagccat

SEQ ID NO: 694805 - DNA, 20 bp, mouse
gacaaacacctccacggact

SEQ ID NO: 694806 - DNA, 20 bp, mouse
ggctgggcgcttgggaagag

SEQ ID NO: 694807 - DNA, 20 bp, mouse
gggaccgagaggaacggagg

SEQ ID NO: 694808 - DNA, 20 bp, mouse
ggaggcggggagatccctct

SEQ ID NO: 694809 - DNA, 20 bp, mouse
gccggcctctacggcataat

SEQ ID NO: 694810 - DNA, 20 bp, mouse
gctcgcccggggggctccga

SEQ ID NO: 694811 - DNA, 20 bp, mouse
ggagccgcccctggccagtc

SEQ ID NO: 694812 - DNA, 20 bp, mouse
gccgaagggattggaccgag

SEQ ID NO: 694813 - DNA, 20 bp, mouse
ggcgacgcgcagctttgcga

SEQ ID NO: 694814 - DNA, 20 bp, mouse
gattggaccgagaggaacgg

SEQ ID NO: 694815 - DNA, 20 bp, mouse
gcctgcgcggatgctcgccc

SEQ ID NO: 694816 - DNA, 20 bp, mouse
gtcacggggtggctatggat

SEQ ID NO: 694817 - DNA, 20 bp, mouse
gccctggctacggttctctg

SEQ ID NO: 694818 - DNA, 20 bp, mouse
ggtgaggcggaccctggcta

SEQ ID NO: 694819 - DNA, 20 bp, mouse
gccgcctcacggggtggcta

SEQ ID NO: 694820 - DNA, 20 bp, mouse
gcaccccgtgaggcggaccc

SEQ ID NO: 694821 - DNA, 20 bp, mouse
ggcgagaggtgtgcctcgga

SEQ ID NO: 694822 - DNA, 20 bp, mouse
ggcctaagggggcggtgaat

SEQ ID NO: 694823 - DNA, 20 bp, mouse
gcggagccaaaggcctaagg

SEQ ID NO: 694824 - DNA, 20 bp, mouse
ggggcggtgaattggttgac

SEQ ID NO: 694825 - DNA, 20 bp, mouse
gagccaaaggcctaaggggg

SEQ ID NO: 694826 - DNA, 20 bp, mouse
gtcggcgcgcgcagtctcct

SEQ ID NO: 694827 - DNA, 20 bp, mouse
ggccgccgaccgaggggcgt

SEQ ID NO: 694828 - DNA, 20 bp, mouse
ggtgcggggtgcacgcgggg

SEQ ID NO: 694829 - DNA, 20 bp, mouse
gcgcgccgacgcccctcggt

SEQ ID NO: 694830 - DNA, 20 bp, mouse
ggtgtggcccaggttcagag

SEQ ID NO: 694831 - DNA, 20 bp, mouse
gcggccggaggatggggtcc

SEQ ID NO: 694832 - DNA, 20 bp, mouse
gtgagactcggggcggcggc

SEQ ID NO: 694833 - DNA, 20 bp, mouse
gcgcgcgtccgcctgagact

SEQ ID NO: 694834 - DNA, 20 bp, mouse
gccctcccccggcccgtcgg

SEQ ID NO: 694835 - DNA, 20 bp, mouse
gggggtgcggggtgcacgcg

SEQ ID NO: 694836 - DNA, 20 bp, mouse
gagcggggatcacacccagg

SEQ ID NO: 694837 - DNA, 20 bp, mouse
gggcgcccgtacgactccca

SEQ ID NO: 694838 - DNA, 20 bp, mouse
ggctcctgcacaaccagtct

SEQ ID NO: 694839 - DNA, 20 bp, mouse
gacaaccagtctgggaggag

SEQ ID NO: 694840 - DNA, 20 bp, mouse
ggcccgtacgactcccacgg

SEQ ID NO: 694841 - DNA, 20 bp, mouse
gcgggcgctggggcatgcgc

SEQ ID NO: 694842 - DNA, 20 bp, mouse
ggggtgtgatccccgctctc

SEQ ID NO: 694843 - DNA, 20 bp, mouse
gctggctgcgcacgtcgggg

SEQ ID NO: 694844 - DNA, 20 bp, mouse
gtacgactcccacggaggtt

SEQ ID NO: 694845 - DNA, 20 bp, mouse
gtaacaagtccaaacctccg

SEQ ID NO: 694846 - DNA, 20 bp, mouse
gtgtgggcctcgctcgaatg

SEQ ID NO: 694847 - DNA, 20 bp, mouse
ggggcctcgctcgaatgggg

SEQ ID NO: 694848 - DNA, 20 bp, mouse
gaaaggagacccgcagctaa

SEQ ID NO: 694849 - DNA, 20 bp, mouse
ggcagtgatgcgccaggtgt

SEQ ID NO: 694850 - DNA, 20 bp, mouse
gctgccacagtgaagatgaa

SEQ ID NO: 694851 - DNA, 20 bp, mouse
gtctcctccccattcgagcg

SEQ ID NO: 694852 - DNA, 20 bp, mouse
gagggaggaacgggtacttt

SEQ ID NO: 694853 - DNA, 20 bp, mouse
gcgcgcagcgagttccacag

SEQ ID NO: 694854 - DNA, 20 bp, mouse
ggccactcggcgaacgcaag

SEQ ID NO: 694855 - DNA, 20 bp, mouse
gacagaaaagggagcgctta

SEQ ID NO: 694856 - DNA, 20 bp, mouse
gcagacaaatagatccaggt

SEQ ID NO: 694857 - DNA, 20 bp, mouse
gaggaaggcgctgcatgatt

SEQ ID NO: 694858 - DNA, 20 bp, mouse
gacccccgggcgagcagaac

SEQ ID NO: 694859 - DNA, 20 bp, mouse
gtacaagctgggggcgtaag

SEQ ID NO: 694860 - DNA, 20 bp, mouse
gcccccgaggccaaaccccc

SEQ ID NO: 694861 - DNA, 20 bp, mouse
ggtaaggggggcgggtaaag

SEQ ID NO: 694862 - DNA, 20 bp, mouse
gtaacacgtatctgtgttcg

SEQ ID NO: 694863 - DNA, 20 bp, mouse
gtgcatgattaggacctaag

SEQ ID NO: 694864 - DNA, 20 bp, mouse
gtcgcccgggggtttggcct

SEQ ID NO: 694865 - DNA, 20 bp, mouse
gcgagaagacacgagaagtg

SEQ ID NO: 694866 - DNA, 20 bp, mouse
gccagcgcgccagtgagcga

SEQ ID NO: 694867 - DNA, 20 bp, mouse
gtgggagaggatcgggtcaa

SEQ ID NO: 694868 - DNA, 20 bp, mouse
gaggatcgggtcaacggttt

SEQ ID NO: 694869 - DNA, 20 bp, mouse
gctcgcgccaaggagctctc

SEQ ID NO: 694870 - DNA, 20 bp, mouse
gaaggagctctcgggttcgt

SEQ ID NO: 694871 - DNA, 20 bp, mouse
ggcgaagagccgaagagctc

SEQ ID NO: 694872 - DNA, 20 bp, mouse
gtggccgaagaggagcgaac

SEQ ID NO: 694873 - DNA, 20 bp, mouse
gacgtccggctctttgggag

SEQ ID NO: 694874 - DNA, 20 bp, mouse
gggagcgaaccggagctctt

SEQ ID NO: 694875 - DNA, 20 bp, mouse
gcgatcctctcccaaagagc

SEQ ID NO: 694876 - DNA, 20 bp, mouse
ggcgcggcctcgctcccgat

SEQ ID NO: 694877 - DNA, 20 bp, mouse
ggaaacaaggggtggagcgc

SEQ ID NO: 694878 - DNA, 20 bp, mouse
gggcccgacaccagccaatc

SEQ ID NO: 694879 - DNA, 20 bp, mouse
gcctccgggctgattcattc

SEQ ID NO: 694880 - DNA, 20 bp, mouse
ggcccggggagagaaacaag

SEQ ID NO: 694881 - DNA, 20 bp, mouse
ggccccgccccgcggaacca

SEQ ID NO: 694882 - DNA, 20 bp, mouse
ggaggctgcgggagtccgaa

SEQ ID NO: 694883 - DNA, 20 bp, mouse
gtcgctgagggcttgatctg

SEQ ID NO: 694884 - DNA, 20 bp, mouse
gggcggggcctgcttccctt

SEQ ID NO: 694885 - DNA, 20 bp, mouse
gagaagcagcagcggcagaa

SEQ ID NO: 694886 - DNA, 20 bp, mouse
gcaggaggatacaacccccg

SEQ ID NO: 694887 - DNA, 20 bp, mouse
gtgggccgcgccattttgta

SEQ ID NO: 694888 - DNA, 20 bp, mouse
gccagccactgggccggaag

SEQ ID NO: 694889 - DNA, 20 bp, mouse
gaggttctcggttaaaggat

SEQ ID NO: 694890 - DNA, 20 bp, mouse
gcccccgtggtgtgtgccta

SEQ ID NO: 694891 - DNA, 20 bp, mouse
gcggtctgggcgcacccacc

SEQ ID NO: 694892 - DNA, 20 bp, mouse
gtccccaggttctcggttaa

SEQ ID NO: 694893 - DNA, 20 bp, mouse
gagggcagcatttcctcccc

SEQ ID NO: 694894 - DNA, 20 bp, mouse
gactgggccggaagtggcta

SEQ ID NO: 694895 - DNA, 20 bp, mouse
gtgcgcccagaccgccgcgg

SEQ ID NO: 694896 - DNA, 20 bp, mouse
ggacgctagaagcgaaaagt

SEQ ID NO: 694897 - DNA, 20 bp, mouse
ggccaatgccatctcgaact

SEQ ID NO: 694898 - DNA, 20 bp, mouse
gactcggctaagaggaaagt

SEQ ID NO: 694899 - DNA, 20 bp, mouse
gccagcggacatgacgtccc

SEQ ID NO: 694900 - DNA, 20 bp, mouse
gcatagaaagcgggaggtgg

SEQ ID NO: 694901 - DNA, 20 bp, mouse
gagggggcaagagaaactct

SEQ ID NO: 694902 - DNA, 20 bp, mouse
gaaagtcgggtcatagaaag

SEQ ID NO: 694903 - DNA, 20 bp, mouse
gagatggcattggccattgg

SEQ ID NO: 694904 - DNA, 20 bp, mouse
gtggcattggccattggcgg

SEQ ID NO: 694905 - DNA, 20 bp, mouse
ggtaggaagtccgccgccaa

SEQ ID NO: 694906 - DNA, 20 bp, mouse
gcgggcgtaagagaacgaga

SEQ ID NO: 694907 - DNA, 20 bp, mouse
gcgggctccaagggtgtcag

SEQ ID NO: 694908 - DNA, 20 bp, mouse
gccagtgtcgcgagaaccag

SEQ ID NO: 694909 - DNA, 20 bp, mouse
gaacagcctgcactaggcac

SEQ ID NO: 694910 - DNA, 20 bp, mouse
gcgcgacactggggctgagt

SEQ ID NO: 694911 - DNA, 20 bp, mouse
gggacaggggtgaagagcta

SEQ ID NO: 694912 - DNA, 20 bp, mouse
gcacccttggagcccgaatc

SEQ ID NO: 694913 - DNA, 20 bp, mouse
gaattcccggcggcggttgg

SEQ ID NO: 694914 - DNA, 20 bp, mouse
gggtgagaggacggtcatgg

SEQ ID NO: 694915 - DNA, 20 bp, mouse
gcccggtgagaggacggtca

SEQ ID NO: 694916 - DNA, 20 bp, mouse
gcgtggaaaagacaggggcg

SEQ ID NO: 694917 - DNA, 20 bp, mouse
gggaacagcgctttgatgga

SEQ ID NO: 694918 - DNA, 20 bp, mouse
gtggccaatggacttggagg

SEQ ID NO: 694919 - DNA, 20 bp, mouse
gaggcggaacagcgctttga

SEQ ID NO: 694920 - DNA, 20 bp, mouse
ggtgggcgtggaaaagacag

SEQ ID NO: 694921 - DNA, 20 bp, mouse
gccgcctcctccaagtccat

SEQ ID NO: 694922 - DNA, 20 bp, mouse
gatggggcagaggcggactg

SEQ ID NO: 694923 - DNA, 20 bp, mouse
gaaggggtcgtttgacccgc

SEQ ID NO: 694924 - DNA, 20 bp, mouse
ggattggccaatggacttgg

SEQ ID NO: 694925 - DNA, 20 bp, mouse
gccggaaatggagacagtag

SEQ ID NO: 694926 - DNA, 20 bp, mouse
gggaagttagaggatatcga

SEQ ID NO: 694927 - DNA, 20 bp, mouse
ggcatggaagtggacagaga

SEQ ID NO: 694928 - DNA, 20 bp, mouse
gtatggagaagggaagttag

SEQ ID NO: 694929 - DNA, 20 bp, mouse
ggatatcgacggcatggaag

SEQ ID NO: 694930 - DNA, 20 bp, mouse
gggaccgcctcttcccagag

SEQ ID NO: 694931 - DNA, 20 bp, mouse
gtagaaggaggaccagacta

SEQ ID NO: 694932 - DNA, 20 bp, mouse
gcgcctcttcccagagggga

SEQ ID NO: 694933 - DNA, 20 bp, mouse
gaaggagaagaggaattgat

SEQ ID NO: 694934 - DNA, 20 bp, mouse
gttagaggatatcgacggca

SEQ ID NO: 694935 - DNA, 20 bp, mouse
gtcggtgctcggctaggcgg

SEQ ID NO: 694936 - DNA, 20 bp, mouse
gaaggggaggaactgagcaa

SEQ ID NO: 694937 - DNA, 20 bp, mouse
ggagaggtgtggagagacta

SEQ ID NO: 694938 - DNA, 20 bp, mouse
ggactaaggtagctaagggg

SEQ ID NO: 694939 - DNA, 20 bp, mouse
gagcgccaaacgtcagacgg

SEQ ID NO: 694940 - DNA, 20 bp, mouse
ggagagcgccaaacgtcaga

SEQ ID NO: 694941 - DNA, 20 bp, mouse
gacacagtaaagatatggag

SEQ ID NO: 694942 - DNA, 20 bp, mouse
gtggttaatccggagagaaa

SEQ ID NO: 694943 - DNA, 20 bp, mouse
gggacagtgccacagagagt

SEQ ID NO: 694944 - DNA, 20 bp, mouse
gcttctggtgacacagactc

SEQ ID NO: 694945 - DNA, 20 bp, mouse
gggaccggaagtgtgcaacg

SEQ ID NO: 694946 - DNA, 20 bp, mouse
gaagacttggtgctcaccgg

SEQ ID NO: 694947 - DNA, 20 bp, mouse
gaggaaaagcatctgcattg

SEQ ID NO: 694948 - DNA, 20 bp, mouse
gaaagcatctgcattgaggt

SEQ ID NO: 694949 - DNA, 20 bp, mouse
ggggcagctgtggactcccc

SEQ ID NO: 694950 - DNA, 20 bp, mouse
ggcccccacccaacaggaaa

SEQ ID NO: 694951 - DNA, 20 bp, mouse
gtggttctcagactcgactg

SEQ ID NO: 694952 - DNA, 20 bp, mouse
gaggtgggctgatcaagact

SEQ ID NO: 694953 - DNA, 20 bp, mouse
gccaaggcatataccatctg

SEQ ID NO: 694954 - DNA, 20 bp, mouse
gcggagtatttagaagtcta

SEQ ID NO: 694955 - DNA, 20 bp, mouse
ggggagaagtaggggtttct

SEQ ID NO: 694956 - DNA, 20 bp, mouse
gagggcctttgtattccttt

SEQ ID NO: 694957 - DNA, 20 bp, mouse
gcatcaaaagggataggtgg

SEQ ID NO: 694958 - DNA, 20 bp, mouse
gttcctaagagaagtgtggg

SEQ ID NO: 694959 - DNA, 20 bp, mouse
gtaggacagcgcagaaggga

SEQ ID NO: 694960 - DNA, 20 bp, mouse
gtcttcccaaaggaatacaa

SEQ ID NO: 694961 - DNA, 20 bp, mouse
gaaaggccctgtgatggtga

SEQ ID NO: 694962 - DNA, 20 bp, mouse
gtgatgctggcagtacaggc

SEQ ID NO: 694963 - DNA, 20 bp, mouse
gtgtcagggcacattcacag

SEQ ID NO: 694964 - DNA, 20 bp, mouse
gctggtaggacagcgcagaa

SEQ ID NO: 694965 - DNA, 20 bp, mouse
gtgggatttacgtactgtca

SEQ ID NO: 694966 - DNA, 20 bp, mouse
gtcaagctccgatcaggctc

SEQ ID NO: 694967 - DNA, 20 bp, mouse
ggggaggtggagattagtgg

SEQ ID NO: 694968 - DNA, 20 bp, mouse
gcaggcaagctccgggactg

SEQ ID NO: 694969 - DNA, 20 bp, mouse
gtccctgtcaagctccgatc

SEQ ID NO: 694970 - DNA, 20 bp, mouse
gtgacagggagagactgggg

SEQ ID NO: 694971 - DNA, 20 bp, mouse
gtggagagaggagactttct

SEQ ID NO: 694972 - DNA, 20 bp, mouse
ggagggccctaagggaagct

SEQ ID NO: 694973 - DNA, 20 bp, mouse
ggtggagattagtggaggag

SEQ ID NO: 694974 - DNA, 20 bp, mouse
gcgggggctggggaccaccg

SEQ ID NO: 694975 - DNA, 20 bp, mouse
gaggatctgacaatcctcgg

SEQ ID NO: 694976 - DNA, 20 bp, mouse
ggacccggaacatccaccaa

SEQ ID NO: 694977 - DNA, 20 bp, mouse
gggcgggactgagactcagc

SEQ ID NO: 694978 - DNA, 20 bp, mouse
ggtcccgcctcctaactcca

SEQ ID NO: 694979 - DNA, 20 bp, mouse
gtgcctggacaataaaccaa

SEQ ID NO: 694980 - DNA, 20 bp, mouse
ggtccaggcatgcccgggac

SEQ ID NO: 694981 - DNA, 20 bp, mouse
gtagttcttctgccggtccc

SEQ ID NO: 694982 - DNA, 20 bp, mouse
ggaagagaagcgcttaggcg

SEQ ID NO: 694983 - DNA, 20 bp, mouse
gtggcagaagagaagcgctt

SEQ ID NO: 694984 - DNA, 20 bp, mouse
gaaacccaatccctggagtt

SEQ ID NO: 694985 - DNA, 20 bp, mouse
gtgccggtcccgggcatgcc

SEQ ID NO: 694986 - DNA, 20 bp, mouse
ggggccgccgtcccggaagt

SEQ ID NO: 694987 - DNA, 20 bp, mouse
gcctacacccggaatctcaa

SEQ ID NO: 694988 - DNA, 20 bp, mouse
ggaggcgctcgtttgcgaca

SEQ ID NO: 694989 - DNA, 20 bp, mouse
gcgcgcccggccgacttcgc

SEQ ID NO: 694990 - DNA, 20 bp, mouse
gtagaaggcggggtctactt

SEQ ID NO: 694991 - DNA, 20 bp, mouse
gtagaccccgccttctagat

SEQ ID NO: 694992 - DNA, 20 bp, mouse
gcgtgcgaggcggtgacaat

SEQ ID NO: 694993 - DNA, 20 bp, mouse
gggcgggcgaaaggagcgag

SEQ ID NO: 694994 - DNA, 20 bp, mouse
gcccggccgacttcgcgggg

SEQ ID NO: 694995 - DNA, 20 bp, mouse
gtcgcaaacgagcgcctccg

SEQ ID NO: 694996 - DNA, 20 bp, mouse
ggtggagcccgcccctgggg

SEQ ID NO: 694997 - DNA, 20 bp, mouse
gactgagggcgtgtgaccga

SEQ ID NO: 694998 - DNA, 20 bp, mouse
gcgggtggagcccgcccctg

SEQ ID NO: 694999 - DNA, 20 bp, mouse
gagggtggggatcggggcgg

SEQ ID NO: 695000 - DNA, 20 bp, mouse
gggcaggtcgcgaggaaaga

SEQ ID NO: 695001 - DNA, 20 bp, mouse
gctggagagggtggggatcg

SEQ ID NO: 695002 - DNA, 20 bp, mouse
gtaactaagggcaggtcgcg

SEQ ID NO: 695003 - DNA, 20 bp, mouse
gggggcgggctccacccggg

SEQ ID NO: 695004 - DNA, 20 bp, mouse
gaggtaaggatgacctggag

SEQ ID NO: 695005 - DNA, 20 bp, mouse
ggcaggtaccctagcaataa

SEQ ID NO: 695006 - DNA, 20 bp, mouse
gtctctgggtcaggctgaac

SEQ ID NO: 695007 - DNA, 20 bp, mouse
gcgagggcggggtcgcgctg

SEQ ID NO: 695008 - DNA, 20 bp, mouse
gtcgcggcccggctgacgcc

SEQ ID NO: 695009 - DNA, 20 bp, mouse
ggggcgtggcatccgagggc

SEQ ID NO: 695010 - DNA, 20 bp, mouse
ggggtcgcgctgcggggtgc

SEQ ID NO: 695011 - DNA, 20 bp, mouse
gagcgtcgcgcgcagcccac

SEQ ID NO: 695012 - DNA, 20 bp, mouse
gcggcccggctgacgccagg

SEQ ID NO: 695013 - DNA, 20 bp, mouse
gactgggattcgtagttctc

SEQ ID NO: 695014 - DNA, 20 bp, mouse
gcagcctgggcttcatatta

SEQ ID NO: 695015 - DNA, 20 bp, mouse
ggtgacatcaaatcaggcag

SEQ ID NO: 695016 - DNA, 20 bp, mouse
ggtcgacgccatcttgaatg

SEQ ID NO: 695017 - DNA, 20 bp, mouse
gtggaagagccgctcacctg

SEQ ID NO: 695018 - DNA, 20 bp, mouse
ggagcgagcaaaccagcctc

SEQ ID NO: 695019 - DNA, 20 bp, mouse
gcacgtatgcctcaggtgag

SEQ ID NO: 695020 - DNA, 20 bp, mouse
ggaagtgggcgtgacaggga

SEQ ID NO: 695021 - DNA, 20 bp, mouse
gggaggaagtgggcgtgaca

SEQ ID NO: 695022 - DNA, 20 bp, mouse
gggagctcgcgagcgggctg

SEQ ID NO: 695023 - DNA, 20 bp, mouse
gcttccagccacattcaaga

SEQ ID NO: 695024 - DNA, 20 bp, mouse
ggcgcccccgaaagcgtccg

SEQ ID NO: 695025 - DNA, 20 bp, mouse
gaaagacccacgtatgcctc

SEQ ID NO: 695026 - DNA, 20 bp, mouse
ggccccgcgggcacaggctt

SEQ ID NO: 695027 - DNA, 20 bp, mouse
gcggaagtcagaggagggtc

SEQ ID NO: 695028 - DNA, 20 bp, mouse
gcggaaacggcagcgtctta

SEQ ID NO: 695029 - DNA, 20 bp, mouse
gactgcgcctgcgcccgggg

SEQ ID NO: 695030 - DNA, 20 bp, mouse
ggtgtgtcgccggacctcag

SEQ ID NO: 695031 - DNA, 20 bp, mouse
gcctcccggccctgctgtca

SEQ ID NO: 695032 - DNA, 20 bp, mouse
gcagacttgacgtgtgtcgc

SEQ ID NO: 695033 - DNA, 20 bp, mouse
ggaacgctgggctcgggctg

SEQ ID NO: 695034 - DNA, 20 bp, mouse
gcgcactgcgcctgcgcccg

SEQ ID NO: 695035 - DNA, 20 bp, mouse
gggcacaggcttaggaacgc

SEQ ID NO: 695036 - DNA, 20 bp, mouse
gcctcccctgctggactcta

SEQ ID NO: 695037 - DNA, 20 bp, mouse
gcctggtcctggccagttaa

SEQ ID NO: 695038 - DNA, 20 bp, mouse
ggcgagaccctcagcagcga

SEQ ID NO: 695039 - DNA, 20 bp, mouse
gtcctggccagttaatggat

SEQ ID NO: 695040 - DNA, 20 bp, mouse
gtctgggaggcggttcggga

SEQ ID NO: 695041 - DNA, 20 bp, mouse
ggccggaatggtccaatcgc

SEQ ID NO: 695042 - DNA, 20 bp, mouse
ggcgtcccctagagtccagc

SEQ ID NO: 695043 - DNA, 20 bp, mouse
ggcacgcctacctccatccc

SEQ ID NO: 695044 - DNA, 20 bp, mouse
gcagaggccttcgctgctga

SEQ ID NO: 695045 - DNA, 20 bp, mouse
ggtaggcgtgcctcccctgc

SEQ ID NO: 695046 - DNA, 20 bp, mouse
gtgccccgggacagatctct

SEQ ID NO: 695047 - DNA, 20 bp, mouse
gcccaggccgggccgagcta

SEQ ID NO: 695048 - DNA, 20 bp, mouse
gtgcgcagctgggtggtgat

SEQ ID NO: 695049 - DNA, 20 bp, mouse
gcagctgggtggtgatgggc

SEQ ID NO: 695050 - DNA, 20 bp, mouse
gcgcccagagatctgtcccg

SEQ ID NO: 695051 - DNA, 20 bp, mouse
gagggagactgggcctaatc

SEQ ID NO: 695052 - DNA, 20 bp, mouse
gcgcacggggtgtaagagcg

SEQ ID NO: 695053 - DNA, 20 bp, mouse
gcgaggcccggagcccgcaa

SEQ ID NO: 695054 - DNA, 20 bp, mouse
ggcctcgcgcctgcgcagct

SEQ ID NO: 695055 - DNA, 20 bp, mouse
ggtccgctggctagcgctgt

SEQ ID NO: 695056 - DNA, 20 bp, mouse
ggatgaggcaggcggatcgg

SEQ ID NO: 695057 - DNA, 20 bp, mouse
gtcgcctgagaactggaggg

SEQ ID NO: 695058 - DNA, 20 bp, mouse
gggcctcgcctgagaactgg

SEQ ID NO: 695059 - DNA, 20 bp, mouse
ggcgaggccacaggtttgtt

SEQ ID NO: 695060 - DNA, 20 bp, mouse
gtaccctccctccagttctc

SEQ ID NO: 695061 - DNA, 20 bp, mouse
gtgggtcttgccttaacgat

SEQ ID NO: 695062 - DNA, 20 bp, mouse
gaagctacgctacttggtga

SEQ ID NO: 695063 - DNA, 20 bp, mouse
gccgccctaggacggaaaaa

SEQ ID NO: 695064 - DNA, 20 bp, mouse
gtgtggcctcgcctgagaac

SEQ ID NO: 695065 - DNA, 20 bp, mouse
gtcttctcgcgagattgttc

SEQ ID NO: 695066 - DNA, 20 bp, mouse
gaagttaactcgtggaagtg

SEQ ID NO: 695067 - DNA, 20 bp, mouse
ggagaagcgaccaatgggaa

SEQ ID NO: 695068 - DNA, 20 bp, mouse
gagaggaacgaccccgtgta

SEQ ID NO: 695069 - DNA, 20 bp, mouse
gccaatgggaatggatagtg

SEQ ID NO: 695070 - DNA, 20 bp, mouse
gatgaattctcatgtcgtaa

SEQ ID NO: 695071 - DNA, 20 bp, mouse
gtgaaggaaggcgggagttg

SEQ ID NO: 695072 - DNA, 20 bp, mouse
gagggaatatgacattagtt

SEQ ID NO: 695073 - DNA, 20 bp, mouse
ggttgaggataaccttgctg

SEQ ID NO: 695074 - DNA, 20 bp, mouse
gttcttgccaatagtaaaca

SEQ ID NO: 695075 - DNA, 20 bp, mouse
ggcaatattaagttaactcg

SEQ ID NO: 695076 - DNA, 20 bp, mouse
gggcagggagtagcacccat

SEQ ID NO: 695077 - DNA, 20 bp, mouse
ggaaaaggtgtgatgtgtgt

SEQ ID NO: 695078 - DNA, 20 bp, mouse
gtccgcgggaccggagtcgg

SEQ ID NO: 695079 - DNA, 20 bp, mouse
gcggaagcggaagtagatac

SEQ ID NO: 695080 - DNA, 20 bp, mouse
gggaaagagatgaccctggt

SEQ ID NO: 695081 - DNA, 20 bp, mouse
gtgaactcaagtaggtgaaa

SEQ ID NO: 695082 - DNA, 20 bp, mouse
gggtgggagattgttacatt

SEQ ID NO: 695083 - DNA, 20 bp, mouse
gccaaggccttcagtgctgt

SEQ ID NO: 695084 - DNA, 20 bp, mouse
gcacccgcattcaggcgtaa

SEQ ID NO: 695085 - DNA, 20 bp, mouse
ggaccctggtgggcgggtag

SEQ ID NO: 695086 - DNA, 20 bp, mouse
gctgcggcttgtggcatccc

SEQ ID NO: 695087 - DNA, 20 bp, mouse
gactggcttccggacgtctt

SEQ ID NO: 695088 - DNA, 20 bp, mouse
gcaaagggaactgcggcttg

SEQ ID NO: 695089 - DNA, 20 bp, mouse
ggtccaggtcgagctgtcgg

SEQ ID NO: 695090 - DNA, 20 bp, mouse
gggggagctgcgcaagatcc

SEQ ID NO: 695091 - DNA, 20 bp, mouse
gcctcgggccttccgtttcc

SEQ ID NO: 695092 - DNA, 20 bp, mouse
gtctcccgggttgttggagt

SEQ ID NO: 695093 - DNA, 20 bp, mouse
ggtacctactccaacaaccc

SEQ ID NO: 695094 - DNA, 20 bp, mouse
gccaacaaaccaaagacgtc

SEQ ID NO: 695095 - DNA, 20 bp, mouse
gtagtcgctttccggtcaaa

SEQ ID NO: 695096 - DNA, 20 bp, mouse
gtggctatgccagaattggg

SEQ ID NO: 695097 - DNA, 20 bp, mouse
gccggagccctgagcaaaat

SEQ ID NO: 695098 - DNA, 20 bp, mouse
gcacctccacctcccaattc

SEQ ID NO: 695099 - DNA, 20 bp, mouse
gccattggacaacagggaac

SEQ ID NO: 695100 - DNA, 20 bp, mouse
gtgggacgatctggggttcg

SEQ ID NO: 695101 - DNA, 20 bp, mouse
gcgcatgcgcaataggtacg

SEQ ID NO: 695102 - DNA, 20 bp, mouse
ggcggcgcgcgcagttctac

SEQ ID NO: 695103 - DNA, 20 bp, mouse
gaactcgggcgtgccctaga

SEQ ID NO: 695104 - DNA, 20 bp, mouse
gttgcgcatgcgcccgtcta

SEQ ID NO: 695105 - DNA, 20 bp, mouse
gccgagttggccctagcacg

SEQ ID NO: 695106 - DNA, 20 bp, mouse
gccaccgcctggagctccat

SEQ ID NO: 695107 - DNA, 20 bp, mouse
gccgggtgcccgtgccatcg

SEQ ID NO: 695108 - DNA, 20 bp, mouse
gtggggaagccccagaagga

SEQ ID NO: 695109 - DNA, 20 bp, mouse
gctcacacggggcggtgcga

SEQ ID NO: 695110 - DNA, 20 bp, mouse
gcagccgccagcgtccgcga

SEQ ID NO: 695111 - DNA, 20 bp, mouse
ggccccagccgggactggat

SEQ ID NO: 695112 - DNA, 20 bp, mouse
ggaggcgcggggccccagcc

SEQ ID NO: 695113 - DNA, 20 bp, mouse
ggcggggccccagccgggac

SEQ ID NO: 695114 - DNA, 20 bp, mouse
gccagcgtccgcgatggcac

SEQ ID NO: 695115 - DNA, 20 bp, mouse
gccggactcggcctcacacg

SEQ ID NO: 695116 - DNA, 20 bp, mouse
gcacaagcgcgcgggcccgt

SEQ ID NO: 695117 - DNA, 20 bp, mouse
gaggcgcacgagatgaaaag

SEQ ID NO: 695118 - DNA, 20 bp, mouse
gggcgactagcgggacgctc

SEQ ID NO: 695119 - DNA, 20 bp, mouse
gggcgccgggcatccttaga

SEQ ID NO: 695120 - DNA, 20 bp, mouse
gccgtgggaccccgcgagat

SEQ ID NO: 695121 - DNA, 20 bp, mouse
gcgtgcagagcagccatcta

SEQ ID NO: 695122 - DNA, 20 bp, mouse
gaggggtgaagccagtgcac

SEQ ID NO: 695123 - DNA, 20 bp, mouse
gtccagcccagggcactcgg

SEQ ID NO: 695124 - DNA, 20 bp, mouse
ggggctcggcgtggcgctgg

SEQ ID NO: 695125 - DNA, 20 bp, mouse
gaccggcctgcagtcctcgg

SEQ ID NO: 695126 - DNA, 20 bp, mouse
gatgccgggcaggaccaacc

SEQ ID NO: 695127 - DNA, 20 bp, mouse
gcatccaggcgcaggctcgg

SEQ ID NO: 695128 - DNA, 20 bp, mouse
gtgggcgtggctagagatcg

SEQ ID NO: 695129 - DNA, 20 bp, mouse
ggggccgctggggccggtac

SEQ ID NO: 695130 - DNA, 20 bp, mouse
gctaatctccactgcgatgc

SEQ ID NO: 695131 - DNA, 20 bp, mouse
ggtcctgcccggcatcgcag

SEQ ID NO: 695132 - DNA, 20 bp, mouse
gaggctcgggggcgtggtgt

SEQ ID NO: 695133 - DNA, 20 bp, mouse
gtagagatcgggggccgctg

SEQ ID NO: 695134 - DNA, 20 bp, mouse
gcggtggagaatccttgtaa

SEQ ID NO: 695135 - DNA, 20 bp, mouse
gagaactgttacgacttgta

SEQ ID NO: 695136 - DNA, 20 bp, mouse
gaacaagtcacatagagggt

SEQ ID NO: 695137 - DNA, 20 bp, mouse
gtgcttaacaagtcacatag

SEQ ID NO: 695138 - DNA, 20 bp, mouse
gcccgccccccaaatgcgat

SEQ ID NO: 695139 - DNA, 20 bp, mouse
gacttaggggctaacactca

SEQ ID NO: 695140 - DNA, 20 bp, mouse
gggaaccaatcgcatttggg

SEQ ID NO: 695141 - DNA, 20 bp, mouse
gtctagaagaaagacgaaga

SEQ ID NO: 695142 - DNA, 20 bp, mouse
gaaaaggaaccaatcgcatt

SEQ ID NO: 695143 - DNA, 20 bp, mouse
gtgtggggtgatggcaagtt

SEQ ID NO: 695144 - DNA, 20 bp, mouse
ggctcagagggactcacaga

SEQ ID NO: 695145 - DNA, 20 bp, mouse
gtctttcaatgattgagaac

SEQ ID NO: 695146 - DNA, 20 bp, mouse
gcggggacccaggagcgcac

SEQ ID NO: 695147 - DNA, 20 bp, mouse
gggacccaggagcgcacggg

SEQ ID NO: 695148 - DNA, 20 bp, mouse
gaacccccggcggccggcag

SEQ ID NO: 695149 - DNA, 20 bp, mouse
gcgcctctgccggccgccgg

SEQ ID NO: 695150 - DNA, 20 bp, mouse
gcgtgcagaaggccggcggt

SEQ ID NO: 695151 - DNA, 20 bp, mouse
gggaacgcctccccgccggg

SEQ ID NO: 695152 - DNA, 20 bp, mouse
ggccgccgggggttatgaat

SEQ ID NO: 695153 - DNA, 20 bp, mouse
gccgccgcccgtgcgctcct

SEQ ID NO: 695154 - DNA, 20 bp, mouse
gtctggggcccgtctggtcc

SEQ ID NO: 695155 - DNA, 20 bp, mouse
gaggtcagcgctgtcgtgtc

SEQ ID NO: 695156 - DNA, 20 bp, mouse
gaagctctgggataaaactg

SEQ ID NO: 695157 - DNA, 20 bp, mouse
gcacgtgagcattcccgttc

SEQ ID NO: 695158 - DNA, 20 bp, mouse
ggcgccccctgctggacagg

SEQ ID NO: 695159 - DNA, 20 bp, mouse
ggcgcactgcgcatgcgaag

SEQ ID NO: 695160 - DNA, 20 bp, mouse
gcaagcatttgggtcaggcg

SEQ ID NO: 695161 - DNA, 20 bp, mouse
gagccaggcgcaccaagctc

SEQ ID NO: 695162 - DNA, 20 bp, mouse
gaggatcactcactagttcc

SEQ ID NO: 695163 - DNA, 20 bp, mouse
ggcagggtaaactacaaaga

SEQ ID NO: 695164 - DNA, 20 bp, mouse
gatactgccaaattgccctg

SEQ ID NO: 695165 - DNA, 20 bp, mouse
gtgtggaaaaggcaagcatt

SEQ ID NO: 695166 - DNA, 20 bp, mouse
gcacagccaccagtgaggta

SEQ ID NO: 695167 - DNA, 20 bp, mouse
gggtgaagacagattgatca

SEQ ID NO: 695168 - DNA, 20 bp, mouse
gggctctggaagattaataa

SEQ ID NO: 695169 - DNA, 20 bp, mouse
gaagtccttggttgcaaggt

SEQ ID NO: 695170 - DNA, 20 bp, mouse
gagccaatcagagctggcgg

SEQ ID NO: 695171 - DNA, 20 bp, mouse
ggggcaccatacctcactgg

SEQ ID NO: 695172 - DNA, 20 bp, mouse
gcacccccgccagctctgat

SEQ ID NO: 695173 - DNA, 20 bp, mouse
gggctcctggctaggaggca

SEQ ID NO: 695174 - DNA, 20 bp, mouse
gccagcgaaagaggttgcaa

SEQ ID NO: 695175 - DNA, 20 bp, mouse
gaacggtaccccagcgaaag

SEQ ID NO: 695176 - DNA, 20 bp, mouse
ggggccgcgcaacgcgtcct

SEQ ID NO: 695177 - DNA, 20 bp, mouse
gcggactgggtgggttttga

SEQ ID NO: 695178 - DNA, 20 bp, mouse
gaggggaggggcttacgggg

SEQ ID NO: 695179 - DNA, 20 bp, mouse
ggaaacccggaaagggggtc

SEQ ID NO: 695180 - DNA, 20 bp, mouse
gcatccggggacgatagtga

SEQ ID NO: 695181 - DNA, 20 bp, mouse
gctaggggattgtttagaca

SEQ ID NO: 695182 - DNA, 20 bp, mouse
gggtgcagatacaagcctgt

SEQ ID NO: 695183 - DNA, 20 bp, mouse
gggggcggggactccggcag

SEQ ID NO: 695184 - DNA, 20 bp, mouse
ggtggaacgagcatgcggac

SEQ ID NO: 695185 - DNA, 20 bp, mouse
gtacaagcctgttgggtggg

SEQ ID NO: 695186 - DNA, 20 bp, mouse
gcggacgcgtccgaaggcac

SEQ ID NO: 695187 - DNA, 20 bp, mouse
gtccgaaggcacaggcggag

SEQ ID NO: 695188 - DNA, 20 bp, mouse
gggcggaacttgccgaagat

SEQ ID NO: 695189 - DNA, 20 bp, mouse
gtggcccttctcacaatcac

SEQ ID NO: 695190 - DNA, 20 bp, mouse
gcgctcggcagacgcaggtt

SEQ ID NO: 695191 - DNA, 20 bp, mouse
gtagctgcaaataaagggcg

SEQ ID NO: 695192 - DNA, 20 bp, mouse
ggaacttgccgaagatgggc

SEQ ID NO: 695193 - DNA, 20 bp, mouse
ggcggtgggctctgccctcc

SEQ ID NO: 695194 - DNA, 20 bp, mouse
ggggctgagtagatgcttag

SEQ ID NO: 695195 - DNA, 20 bp, mouse
ggccgaagatgggccggaaa

SEQ ID NO: 695196 - DNA, 20 bp, mouse
gcagcttggaaaaggtgctt

SEQ ID NO: 695197 - DNA, 20 bp, mouse
gaggataagaaatagtgagg

SEQ ID NO: 695198 - DNA, 20 bp, mouse
gcgggctcgtgattcatcac

SEQ ID NO: 695199 - DNA, 20 bp, mouse
gctcctcccctccccttgtc

SEQ ID NO: 695200 - DNA, 20 bp, mouse
gaatagtgaggaggctaagg

SEQ ID NO: 695201 - DNA, 20 bp, mouse
gcccctcctgacaaggggag

SEQ ID NO: 695202 - DNA, 20 bp, mouse
gtgctttgcgtgttgactgg

SEQ ID NO: 695203 - DNA, 20 bp, mouse
ggggaggaggatagacctgc

SEQ ID NO: 695204 - DNA, 20 bp, mouse
ggaaagattggaggatgctg

SEQ ID NO: 695205 - DNA, 20 bp, mouse
gataaggataagaaatagtg

SEQ ID NO: 695206 - DNA, 20 bp, mouse
gagagtcagcagcgcagacg

SEQ ID NO: 695207 - DNA, 20 bp, mouse
ggccgcgcctggccacggtg

SEQ ID NO: 695208 - DNA, 20 bp, mouse
gctgcgctgctgactctctg

SEQ ID NO: 695209 - DNA, 20 bp, mouse
gaacgtggatgcaaagttcc

SEQ ID NO: 695210 - DNA, 20 bp, mouse
gccccgcagcgtcctcaccg

SEQ ID NO: 695211 - DNA, 20 bp, mouse
gcgcgccggcctcctccctg

SEQ ID NO: 695212 - DNA, 20 bp, mouse
gcggacagtcgagtggatgg

SEQ ID NO: 695213 - DNA, 20 bp, mouse
gccgctgcgctcccggagga

SEQ ID NO: 695214 - DNA, 20 bp, mouse
ggcacggacagtcgagtgga

SEQ ID NO: 695215 - DNA, 20 bp, mouse
gtgtagtggagcagttgacc

SEQ ID NO: 695216 - DNA, 20 bp, mouse
gacacctcaagacactgact

SEQ ID NO: 695217 - DNA, 20 bp, mouse
ggaggctgggtcgagctgtg

SEQ ID NO: 695218 - DNA, 20 bp, mouse
gccagcctccttgtacgcta

SEQ ID NO: 695219 - DNA, 20 bp, mouse
ggatagagatgagacttaag

SEQ ID NO: 695220 - DNA, 20 bp, mouse
gagtgtcttgaggtgtatga

SEQ ID NO: 695221 - DNA, 20 bp, mouse
gggagccatagcgtacaagg

SEQ ID NO: 695222 - DNA, 20 bp, mouse
gtagcacacagcctggaacc

SEQ ID NO: 695223 - DNA, 20 bp, mouse
ggacactagccaagaatcct

SEQ ID NO: 695224 - DNA, 20 bp, mouse
gtcatctctatctgcttcat

SEQ ID NO: 695225 - DNA, 20 bp, mouse
gaaagtgaacactttttaag

SEQ ID NO: 695226 - DNA, 20 bp, mouse
gaggaccagtcaatcgtctc

SEQ ID NO: 695227 - DNA, 20 bp, mouse
gtcggggcggggcaaggctt

SEQ ID NO: 695228 - DNA, 20 bp, mouse
ggcaactgggtctgcgaggt

SEQ ID NO: 695229 - DNA, 20 bp, mouse
gcccaaaacaaagtcagatc

SEQ ID NO: 695230 - DNA, 20 bp, mouse
gccgccccgagacgattgac

SEQ ID NO: 695231 - DNA, 20 bp, mouse
gcatctcgtgcgtaagatcc

SEQ ID NO: 695232 - DNA, 20 bp, mouse
gttagcagcaccagcatcct

SEQ ID NO: 695233 - DNA, 20 bp, mouse
gactgggtctgcgaggtggg

SEQ ID NO: 695234 - DNA, 20 bp, mouse
gacaagccctaggctgaagg

SEQ ID NO: 695235 - DNA, 20 bp, mouse
gccgttccgacagaacccag

SEQ ID NO: 695236 - DNA, 20 bp, mouse
ggaagagcaggagatcttgg

SEQ ID NO: 695237 - DNA, 20 bp, mouse
gggaccgaggagcccggtgg

SEQ ID NO: 695238 - DNA, 20 bp, mouse
gcggctctgcgcgtctctgg

SEQ ID NO: 695239 - DNA, 20 bp, mouse
gggccagcgccaggcggggt

SEQ ID NO: 695240 - DNA, 20 bp, mouse
gcctgccgggaggcccccag

SEQ ID NO: 695241 - DNA, 20 bp, mouse
ggctgcgcccggcctggaag

SEQ ID NO: 695242 - DNA, 20 bp, mouse
gcgcctgcgtcctggggcta

SEQ ID NO: 695243 - DNA, 20 bp, mouse
gccggaagagcaggagatct

SEQ ID NO: 695244 - DNA, 20 bp, mouse
gggaaactgcctgttatcat

SEQ ID NO: 695245 - DNA, 20 bp, mouse
gagggcctgtagctcgcaca

SEQ ID NO: 695246 - DNA, 20 bp, mouse
gcaggtgtgtgttttcgcta

SEQ ID NO: 695247 - DNA, 20 bp, mouse
gcgcgtgcgcactctgaggg

SEQ ID NO: 695248 - DNA, 20 bp, mouse
gcgtgcgcgtgcgcactctg

SEQ ID NO: 695249 - DNA, 20 bp, mouse
ggcgccacctaggaaagtgt

SEQ ID NO: 695250 - DNA, 20 bp, mouse
ggaggcgcggggcgtggccg

SEQ ID NO: 695251 - DNA, 20 bp, mouse
gctctgagggtggatcacct

SEQ ID NO: 695252 - DNA, 20 bp, mouse
gcctgggctgcggtcttcgc

SEQ ID NO: 695253 - DNA, 20 bp, mouse
gttctctgacagcgccacct

SEQ ID NO: 695254 - DNA, 20 bp, mouse
ggggtggatcacctgggctg

SEQ ID NO: 695255 - DNA, 20 bp, mouse
gcggccacgcccctgcgccg

SEQ ID NO: 695256 - DNA, 20 bp, mouse
gggtgagcctcgcgctccca

SEQ ID NO: 695257 - DNA, 20 bp, mouse
gagggcgcccgtccaatcag

SEQ ID NO: 695258 - DNA, 20 bp, mouse
gcgaaggctcccagcccgtt

SEQ ID NO: 695259 - DNA, 20 bp, mouse
ggggctcgctctgaggaacg

SEQ ID NO: 695260 - DNA, 20 bp, mouse
gagcgcgtgcgcgagtgaca

SEQ ID NO: 695261 - DNA, 20 bp, mouse
gccaacgtgcggtacctctc

SEQ ID NO: 695262 - DNA, 20 bp, mouse
ggggctggagctcgctccga

SEQ ID NO: 695263 - DNA, 20 bp, mouse
gtccaatcagagggccgaac

SEQ ID NO: 695264 - DNA, 20 bp, mouse
gagtgacagggctcgctctg

SEQ ID NO: 695265 - DNA, 20 bp, mouse
gcaagcgcctctccgattgg

SEQ ID NO: 695266 - DNA, 20 bp, mouse
gcggacgcgcgccccccttc

SEQ ID NO: 695267 - DNA, 20 bp, mouse
gtgaccctccgtcccggggt

SEQ ID NO: 695268 - DNA, 20 bp, mouse
gttaaaagatcccggaattg

SEQ ID NO: 695269 - DNA, 20 bp, mouse
ggctgcgtgaccctccgtcc

SEQ ID NO: 695270 - DNA, 20 bp, mouse
gcgaagccaaggccgagcgc

SEQ ID NO: 695271 - DNA, 20 bp, mouse
gctcggccttggcttcggga

SEQ ID NO: 695272 - DNA, 20 bp, mouse
ggtgccccaccccgggacgg

SEQ ID NO: 695273 - DNA, 20 bp, mouse
ggccgcgccccgccccgatc

SEQ ID NO: 695274 - DNA, 20 bp, mouse
ggagtcacgcccgatcgggg

SEQ ID NO: 695275 - DNA, 20 bp, mouse
gagggtgccccaccccggga

SEQ ID NO: 695276 - DNA, 20 bp, mouse
gggcccagccagaagattga

SEQ ID NO: 695277 - DNA, 20 bp, mouse
gagggtagcctcccctagaa

SEQ ID NO: 695278 - DNA, 20 bp, mouse
gcaatgaggtcaggggactg

SEQ ID NO: 695279 - DNA, 20 bp, mouse
ggcctcccctagaaaggctg

SEQ ID NO: 695280 - DNA, 20 bp, mouse
ggagccctgggccagcaatg

SEQ ID NO: 695281 - DNA, 20 bp, mouse
gtggcaatcatcagggttgg

SEQ ID NO: 695282 - DNA, 20 bp, mouse
gtccgggcgggcagaggtgt

SEQ ID NO: 695283 - DNA, 20 bp, mouse
ggggccatgtggcaatcatc

SEQ ID NO: 695284 - DNA, 20 bp, mouse
ggcccagggctccaatcaga

SEQ ID NO: 695285 - DNA, 20 bp, mouse
ggcctggcagttctggataa

SEQ ID NO: 695286 - DNA, 20 bp, mouse
gcaaagggctggagaatctg

SEQ ID NO: 695287 - DNA, 20 bp, mouse
ggtgagtattccaacttcta

SEQ ID NO: 695288 - DNA, 20 bp, mouse
ggtgtctgagaatgtccctt

SEQ ID NO: 695289 - DNA, 20 bp, mouse
gttagtcgatcttctggggt

SEQ ID NO: 695290 - DNA, 20 bp, mouse
gaagagttagtcgatcttct

SEQ ID NO: 695291 - DNA, 20 bp, mouse
gtaccggctcacgtagaaaa

SEQ ID NO: 695292 - DNA, 20 bp, mouse
gagacacactatgcaaagac

SEQ ID NO: 695293 - DNA, 20 bp, mouse
ggggagacaccaggaatgaa

SEQ ID NO: 695294 - DNA, 20 bp, mouse
gaagcaacagtgttccatac

SEQ ID NO: 695295 - DNA, 20 bp, mouse
gaatggggggtgatcttagt

SEQ ID NO: 695296 - DNA, 20 bp, mouse
gccaccaatcggactcaaga

SEQ ID NO: 695297 - DNA, 20 bp, mouse
ggagggcctggcagtccgaa

SEQ ID NO: 695298 - DNA, 20 bp, mouse
gccaccgggcgtggagagaa

SEQ ID NO: 695299 - DNA, 20 bp, mouse
gcgtacggtgagtcactcat

SEQ ID NO: 695300 - DNA, 20 bp, mouse
ggaaaccaaggcctcctctt

SEQ ID NO: 695301 - DNA, 20 bp, mouse
gaagccgggcgccgcccacc

SEQ ID NO: 695302 - DNA, 20 bp, mouse
gagaggtgaaagccaccaat

SEQ ID NO: 695303 - DNA, 20 bp, mouse
gagtctcctgggccaaccag

SEQ ID NO: 695304 - DNA, 20 bp, mouse
gcaagaaggaggaaagttcg

SEQ ID NO: 695305 - DNA, 20 bp, mouse
gcatgccttgctgcccaatt

SEQ ID NO: 695306 - DNA, 20 bp, mouse
gagtagcggactgaagagtt

SEQ ID NO: 695307 - DNA, 20 bp, mouse
ggtgttccaggtcctgttga

SEQ ID NO: 695308 - DNA, 20 bp, mouse
gctgaggagcaagggcttca

SEQ ID NO: 695309 - DNA, 20 bp, mouse
gcctagtaaagtcaggaaaa

SEQ ID NO: 695310 - DNA, 20 bp, mouse
gtgtagaagtgttttgagca

SEQ ID NO: 695311 - DNA, 20 bp, mouse
gagtcaggaaaatggagggc

SEQ ID NO: 695312 - DNA, 20 bp, mouse
gacaccatcctagtaaagtc

SEQ ID NO: 695313 - DNA, 20 bp, mouse
gccaggtcctgttgagggta

SEQ ID NO: 695314 - DNA, 20 bp, mouse
ggggggggatctcactttag

SEQ ID NO: 695315 - DNA, 20 bp, mouse
gtttactaggatggtgttcc

SEQ ID NO: 695316 - DNA, 20 bp, mouse
ggggaacttaggaacaaatg

SEQ ID NO: 695317 - DNA, 20 bp, mouse
gaaggggaggagaaatcctc

SEQ ID NO: 695318 - DNA, 20 bp, mouse
gaggaacaaatggggtatgg

SEQ ID NO: 695319 - DNA, 20 bp, mouse
gggaggggaaaggctgactg

SEQ ID NO: 695320 - DNA, 20 bp, mouse
gccaccagccgtcaagaaag

SEQ ID NO: 695321 - DNA, 20 bp, mouse
gagcaactggcaaatggcac

SEQ ID NO: 695322 - DNA, 20 bp, mouse
gccctcttgctgggtcagaa

SEQ ID NO: 695323 - DNA, 20 bp, mouse
gggagaaatcctctgggatg

SEQ ID NO: 695324 - DNA, 20 bp, mouse
ggccgaatgtcaggagtaaa

SEQ ID NO: 695325 - DNA, 20 bp, mouse
gtgttcctaagttcccatgc

SEQ ID NO: 695326 - DNA, 20 bp, mouse
ggagaatcaaaaatgaacag

SEQ ID NO: 695327 - DNA, 20 bp, mouse
ggtcagaggcttggtgacag

SEQ ID NO: 695328 - DNA, 20 bp, mouse
gtgacaggaagcagctgtga

SEQ ID NO: 695329 - DNA, 20 bp, mouse
ggaagcagctgtgagggagt

SEQ ID NO: 695330 - DNA, 20 bp, mouse
ggtacactgcaaggtgtagt

SEQ ID NO: 695331 - DNA, 20 bp, mouse
gtggagcttgaagctacagg

SEQ ID NO: 695332 - DNA, 20 bp, mouse
gttgagaagcctaagagtgt

SEQ ID NO: 695333 - DNA, 20 bp, mouse
gaaattgtgtcaatggtgac

SEQ ID NO: 695334 - DNA, 20 bp, mouse
gacagcaacacaatgcacta

SEQ ID NO: 695335 - DNA, 20 bp, mouse
ggcaagctaaagaaaacagt

SEQ ID NO: 695336 - DNA, 20 bp, mouse
gaatacaggccaaatacgga

SEQ ID NO: 695337 - DNA, 20 bp, mouse
gagaacatatgaggcaacat

SEQ ID NO: 695338 - DNA, 20 bp, mouse
gaatgaatacaggccaaata

SEQ ID NO: 695339 - DNA, 20 bp, mouse
gagcaggtagactttgccct

SEQ ID NO: 695340 - DNA, 20 bp, mouse
gcttgtaaacagcagcgagc

SEQ ID NO: 695341 - DNA, 20 bp, mouse
gtcacaactatttattccta

SEQ ID NO: 695342 - DNA, 20 bp, mouse
gtctaagtacctttggaacg

SEQ ID NO: 695343 - DNA, 20 bp, mouse
ggatgaacttagagagcatg

SEQ ID NO: 695344 - DNA, 20 bp, mouse
gcagcataaataatgaatac

SEQ ID NO: 695345 - DNA, 20 bp, mouse
ggatatgaaaatacattgtt

SEQ ID NO: 695346 - DNA, 20 bp, mouse
gaccagcggtggatgttcta

SEQ ID NO: 695347 - DNA, 20 bp, mouse
gtacccacatcataaatgga

SEQ ID NO: 695348 - DNA, 20 bp, mouse
gtccacccctgacattcaag

SEQ ID NO: 695349 - DNA, 20 bp, mouse
gaacatccaccgctggttcc

SEQ ID NO: 695350 - DNA, 20 bp, mouse
ggtgaagaaatcagtggcaa

SEQ ID NO: 695351 - DNA, 20 bp, mouse
gtctgtcggttgggattaga

SEQ ID NO: 695352 - DNA, 20 bp, mouse
gtcagcagatcagggccttg

SEQ ID NO: 695353 - DNA, 20 bp, mouse
gccctgacattcaagaggac

SEQ ID NO: 695354 - DNA, 20 bp, mouse
gcacccttccatttatgatg

SEQ ID NO: 695355 - DNA, 20 bp, mouse
gaaactgcagtgcatggatg

SEQ ID NO: 695356 - DNA, 20 bp, mouse
ggctctccgaagaccccgag

SEQ ID NO: 695357 - DNA, 20 bp, mouse
gcctcgctccggaacccaag

SEQ ID NO: 695358 - DNA, 20 bp, mouse
ggcttgcagctcaaccacac

SEQ ID NO: 695359 - DNA, 20 bp, mouse
ggggtgggacaaggggagac

SEQ ID NO: 695360 - DNA, 20 bp, mouse
ggaggggctgagtcactccc

SEQ ID NO: 695361 - DNA, 20 bp, mouse
gaccacaccgggtgggacaa

SEQ ID NO: 695362 - DNA, 20 bp, mouse
gcagctcaaccacaccgggt

SEQ ID NO: 695363 - DNA, 20 bp, mouse
gcgggcacgagcggagactg

SEQ ID NO: 695364 - DNA, 20 bp, mouse
gctggtgcggtctgccgctt

SEQ ID NO: 695365 - DNA, 20 bp, mouse
gtgtgtgcagccagacgccg

SEQ ID NO: 695366 - DNA, 20 bp, mouse
gtggctgctggagtcgcctg

SEQ ID NO: 695367 - DNA, 20 bp, mouse
gggccagcacacgggagcta

SEQ ID NO: 695368 - DNA, 20 bp, mouse
gcctacgcaggccacacccc

SEQ ID NO: 695369 - DNA, 20 bp, mouse
ggcacacgggagctacggtc

SEQ ID NO: 695370 - DNA, 20 bp, mouse
gccagcagccaagtggacgc

SEQ ID NO: 695371 - DNA, 20 bp, mouse
gcctgcgggtgaggctggac

SEQ ID NO: 695372 - DNA, 20 bp, mouse
ggtgctggccagcgtccact

SEQ ID NO: 695373 - DNA, 20 bp, mouse
ggggtgaggctggaccggtg

SEQ ID NO: 695374 - DNA, 20 bp, mouse
gacaggaaggttgggaccca

SEQ ID NO: 695375 - DNA, 20 bp, mouse
gctggagtcgcctgcgggtg

SEQ ID NO: 695376 - DNA, 20 bp, mouse
gcctgggagaactacagcac

SEQ ID NO: 695377 - DNA, 20 bp, mouse
gctaaatgaaataatggagg

SEQ ID NO: 695378 - DNA, 20 bp, mouse
ggggaatagaaccggggcag

SEQ ID NO: 695379 - DNA, 20 bp, mouse
gaaagctgagaacaggtgct

SEQ ID NO: 695380 - DNA, 20 bp, mouse
gggaagagataaaagggata

SEQ ID NO: 695381 - DNA, 20 bp, mouse
gggcatagggaatagaaccg

SEQ ID NO: 695382 - DNA, 20 bp, mouse
gtccttgcctctacagagaa

SEQ ID NO: 695383 - DNA, 20 bp, mouse
ggaggccgttctgaccatgg

SEQ ID NO: 695384 - DNA, 20 bp, mouse
gatggtgtgtagagcgtgag

SEQ ID NO: 695385 - DNA, 20 bp, mouse
gtgccattattccaagcccc

SEQ ID NO: 695386 - DNA, 20 bp, mouse
gtcaccctggagcccatcga

SEQ ID NO: 695387 - DNA, 20 bp, mouse
gtgagcaagcagatcccaat

SEQ ID NO: 695388 - DNA, 20 bp, mouse
gtgcacacagggaccttcga

SEQ ID NO: 695389 - DNA, 20 bp, mouse
gaaggtccctgtgtgcactc

SEQ ID NO: 695390 - DNA, 20 bp, mouse
gagctctgctgtctccccga

SEQ ID NO: 695391 - DNA, 20 bp, mouse
ggggatctgcttgctcaccc

SEQ ID NO: 695392 - DNA, 20 bp, mouse
gggaccttcgatgggctcca

SEQ ID NO: 695393 - DNA, 20 bp, mouse
gtggagagagagacctaggc

SEQ ID NO: 695394 - DNA, 20 bp, mouse
gaaagaactgggccaaggat

SEQ ID NO: 695395 - DNA, 20 bp, mouse
gtgtgtgcactcaggaggtc

SEQ ID NO: 695396 - DNA, 20 bp, mouse
gcacccaggctggtcatcca

SEQ ID NO: 695397 - DNA, 20 bp, mouse
gaaactccgagaccccgaaa

SEQ ID NO: 695398 - DNA, 20 bp, mouse
ggggtctcggagtttcctac

SEQ ID NO: 695399 - DNA, 20 bp, mouse
gtgcggagacccaggctccc

SEQ ID NO: 695400 - DNA, 20 bp, mouse
ggcaggggtgtggactgatc

SEQ ID NO: 695401 - DNA, 20 bp, mouse
gcgagctgccccttcggcgc

SEQ ID NO: 695402 - DNA, 20 bp, mouse
ggagtcgcgagcttcggcgg

SEQ ID NO: 695403 - DNA, 20 bp, mouse
gcaggcggatccaggtactg

SEQ ID NO: 695404 - DNA, 20 bp, mouse
gaaagcgagtgacccgggcc

SEQ ID NO: 695405 - DNA, 20 bp, mouse
ggggtcactcgctttcgcgg

SEQ ID NO: 695406 - DNA, 20 bp, mouse
ggctctggagcagtgcccaa

SEQ ID NO: 695407 - DNA, 20 bp, mouse
gaacctgcgcgggtggaggt

SEQ ID NO: 695408 - DNA, 20 bp, mouse
ggccagacaaggaatgtaga

SEQ ID NO: 695409 - DNA, 20 bp, mouse
gtgatggggcggagaccctt

SEQ ID NO: 695410 - DNA, 20 bp, mouse
ggcaagcctgctggaggtta

SEQ ID NO: 695411 - DNA, 20 bp, mouse
gccacccgcgcaggttaagt

SEQ ID NO: 695412 - DNA, 20 bp, mouse
gactaggcatagagggaggt

SEQ ID NO: 695413 - DNA, 20 bp, mouse
ggaaatgctgctttgtgatg

SEQ ID NO: 695414 - DNA, 20 bp, mouse
gtgggtgttgggtcttacta

SEQ ID NO: 695415 - DNA, 20 bp, mouse
gtcccccacttcaacgtagg

SEQ ID NO: 695416 - DNA, 20 bp, mouse
ggacctggaaaagacctgta

SEQ ID NO: 695417 - DNA, 20 bp, mouse
gaatatggacatccatcggt

SEQ ID NO: 695418 - DNA, 20 bp, mouse
gaaagctaaggcaggcaatg

SEQ ID NO: 695419 - DNA, 20 bp, mouse
gaggctgccacttatgtctc

SEQ ID NO: 695420 - DNA, 20 bp, mouse
gaagcatggaggccggttgg

SEQ ID NO: 695421 - DNA, 20 bp, mouse
gtgggctgtgcagccgtcaa

SEQ ID NO: 695422 - DNA, 20 bp, mouse
gacacaaagggacaagtcat

SEQ ID NO: 695423 - DNA, 20 bp, mouse
gcaagtgccagagacataag

SEQ ID NO: 695424 - DNA, 20 bp, mouse
gcaatgtgggctcagaccgg

SEQ ID NO: 695425 - DNA, 20 bp, mouse
gtggaagcatggaggccggt

SEQ ID NO: 695426 - DNA, 20 bp, mouse
ggtggccctgatgtggataa

SEQ ID NO: 695427 - DNA, 20 bp, mouse
ggtggtaacacagcacccgt

SEQ ID NO: 695428 - DNA, 20 bp, mouse
ggcagacatttcagacacac

SEQ ID NO: 695429 - DNA, 20 bp, mouse
ggaagcacaagggttaataa

SEQ ID NO: 695430 - DNA, 20 bp, mouse
gactttcagagcggagccca

SEQ ID NO: 695431 - DNA, 20 bp, mouse
gccagctcactcagagctaa

SEQ ID NO: 695432 - DNA, 20 bp, mouse
gtttattttgagtcgtctgc

SEQ ID NO: 695433 - DNA, 20 bp, mouse
ggatacaactaatatcgttc

SEQ ID NO: 695434 - DNA, 20 bp, mouse
gattctgggaattataacta

SEQ ID NO: 695435 - DNA, 20 bp, mouse
gtatcaccgattcttaattc

SEQ ID NO: 695436 - DNA, 20 bp, mouse
ggagaaagtaggctggaatc

SEQ ID NO: 695437 - DNA, 20 bp, mouse
gatactgaggaggggcgttc

SEQ ID NO: 695438 - DNA, 20 bp, mouse
gggaacagaatactgaggag

SEQ ID NO: 695439 - DNA, 20 bp, mouse
ggaaaaggaacagaatactg

SEQ ID NO: 695440 - DNA, 20 bp, mouse
ggatgcacccagcaggaaat

SEQ ID NO: 695441 - DNA, 20 bp, mouse
gatggcctagagatccagat

SEQ ID NO: 695442 - DNA, 20 bp, mouse
gagtttgaatccttaagaaa

SEQ ID NO: 695443 - DNA, 20 bp, mouse
ggtatcctatctggatctct

SEQ ID NO: 695444 - DNA, 20 bp, mouse
gttaaggattcaaacttgtt

SEQ ID NO: 695445 - DNA, 20 bp, mouse
gatggtacaggtatcctatc

SEQ ID NO: 695446 - DNA, 20 bp, mouse
gagcacgcgcgcaagggcca

SEQ ID NO: 695447 - DNA, 20 bp, mouse
gaaatggccgctaacagtca

SEQ ID NO: 695448 - DNA, 20 bp, mouse
gcgcgcgcaagggccagggg

SEQ ID NO: 695449 - DNA, 20 bp, mouse
gccctgccggaagccagctg

SEQ ID NO: 695450 - DNA, 20 bp, mouse
gggcgggagcacgcgcgcaa

SEQ ID NO: 695451 - DNA, 20 bp, mouse
gccgctaacagtcaaggtaa

SEQ ID NO: 695452 - DNA, 20 bp, mouse
gtattgaagctccctgggga

SEQ ID NO: 695453 - DNA, 20 bp, mouse
gaggactgtaggtgtttgag

SEQ ID NO: 695454 - DNA, 20 bp, mouse
gacaaaggtgattccacccc

SEQ ID NO: 695455 - DNA, 20 bp, mouse
gactgttagcggccatttcg

SEQ ID NO: 695456 - DNA, 20 bp, mouse
ggagttgaaaacaataatta

SEQ ID NO: 695457 - DNA, 20 bp, mouse
ggtcctgttgggatttgttc

SEQ ID NO: 695458 - DNA, 20 bp, mouse
gtaggttgtacacattcttc

SEQ ID NO: 695459 - DNA, 20 bp, mouse
gacaaatcccaacaggacag

SEQ ID NO: 695460 - DNA, 20 bp, mouse
gagacttaaaataacactgt

SEQ ID NO: 695461 - DNA, 20 bp, mouse
gagccagaacaaatcccaac

SEQ ID NO: 695462 - DNA, 20 bp, mouse
ggttctggctagggctcagt

SEQ ID NO: 695463 - DNA, 20 bp, mouse
ggaaataaggttgtagtcaa

SEQ ID NO: 695464 - DNA, 20 bp, mouse
gttcaactcctctgtcctgt

SEQ ID NO: 695465 - DNA, 20 bp, mouse
gtgttgtgtgattttcgctt

SEQ ID NO: 695466 - DNA, 20 bp, mouse
gtggtccaggttcaactcgg

SEQ ID NO: 695467 - DNA, 20 bp, mouse
gtcagtggatgaccctcagt

SEQ ID NO: 695468 - DNA, 20 bp, mouse
ggggacatcagttccctgaa

SEQ ID NO: 695469 - DNA, 20 bp, mouse
gacagcccccgagttgaacc

SEQ ID NO: 695470 - DNA, 20 bp, mouse
gagtctgaatcagcccactg

SEQ ID NO: 695471 - DNA, 20 bp, mouse
gcaaggatgcagtggaaggg

SEQ ID NO: 695472 - DNA, 20 bp, mouse
gtataccttgtcaagagccc

SEQ ID NO: 695473 - DNA, 20 bp, mouse
gctcccctgggctcttgaca

SEQ ID NO: 695474 - DNA, 20 bp, mouse
gagtgcaggccaccagccag

SEQ ID NO: 695475 - DNA, 20 bp, mouse
gccacaccacaggctgggaa

SEQ ID NO: 695476 - DNA, 20 bp, mouse
gcgccactggatccactctg

SEQ ID NO: 695477 - DNA, 20 bp, mouse
ggatccagtggcgtactaac

SEQ ID NO: 695478 - DNA, 20 bp, mouse
gtggatccactctgaggcaa

SEQ ID NO: 695479 - DNA, 20 bp, mouse
gttacctgttagtacgccac

SEQ ID NO: 695480 - DNA, 20 bp, mouse
gctcgaaccaccccaaagat

SEQ ID NO: 695481 - DNA, 20 bp, mouse
gactgctagctaactcaaga

SEQ ID NO: 695482 - DNA, 20 bp, mouse
ggatcggaagagtttaaaac

SEQ ID NO: 695483 - DNA, 20 bp, mouse
ggcaggacaggcatgtaaag

SEQ ID NO: 695484 - DNA, 20 bp, mouse
gacacaaaacaaagcaggac

SEQ ID NO: 695485 - DNA, 20 bp, mouse
gtaaactcttccgatctttg

SEQ ID NO: 695486 - DNA, 20 bp, mouse
gggggcgcctgaggcggaag

SEQ ID NO: 695487 - DNA, 20 bp, mouse
ggcaaagtgctgttgaagga

SEQ ID NO: 695488 - DNA, 20 bp, mouse
gtggctacagcagagcgctg

SEQ ID NO: 695489 - DNA, 20 bp, mouse
ggctgcgcctagcccacaat

SEQ ID NO: 695490 - DNA, 20 bp, mouse
gtgctgttgaaggagggata

SEQ ID NO: 695491 - DNA, 20 bp, mouse
gtgttgaaggagggatatgg

SEQ ID NO: 695492 - DNA, 20 bp, mouse
gtacccaaacagtccccgta

SEQ ID NO: 695493 - DNA, 20 bp, mouse
gatgtgcaaagtgctgttga

SEQ ID NO: 695494 - DNA, 20 bp, mouse
gttgagtgacgcaaatggag

SEQ ID NO: 695495 - DNA, 20 bp, mouse
gcagagcgctggggcgcctg

SEQ ID NO: 695496 - DNA, 20 bp, mouse
gcaagtgaagagaatggtca

SEQ ID NO: 695497 - DNA, 20 bp, mouse
gtagcccaaagatacaccga

SEQ ID NO: 695498 - DNA, 20 bp, mouse
gatctccctcggtgtatctt

SEQ ID NO: 695499 - DNA, 20 bp, mouse
gctgaatgggacttacttct

SEQ ID NO: 695500 - DNA, 20 bp, mouse
gggagattgtgcaagcgtca

SEQ ID NO: 695501 - DNA, 20 bp, mouse
gtccaaagtgcaagctgaat

SEQ ID NO: 695502 - DNA, 20 bp, mouse
gtcccattcagcttgcactt

SEQ ID NO: 695503 - DNA, 20 bp, mouse
gttgcacaatctcctaacaa

SEQ ID NO: 695504 - DNA, 20 bp, mouse
gaaaagtggccggccggtgg

SEQ ID NO: 695505 - DNA, 20 bp, mouse
gacttgatccaagaaccaac

SEQ ID NO: 695506 - DNA, 20 bp, mouse
gaagaacgggagcccaagat

SEQ ID NO: 695507 - DNA, 20 bp, mouse
gcacccacggcacgcacgtc

SEQ ID NO: 695508 - DNA, 20 bp, mouse
ggtaccaggcgaggcccttg

SEQ ID NO: 695509 - DNA, 20 bp, mouse
gctccccaagggagaagaac

SEQ ID NO: 695510 - DNA, 20 bp, mouse
ggtgagcgcggggaccccca

SEQ ID NO: 695511 - DNA, 20 bp, mouse
gcgctcagaagtacccatgg

SEQ ID NO: 695512 - DNA, 20 bp, mouse
gcaccccgacgtgcgtgccg

SEQ ID NO: 695513 - DNA, 20 bp, mouse
gggtcaaggcaaataaatac

SEQ ID NO: 695514 - DNA, 20 bp, mouse
gggctcccgttcttctccct

SEQ ID NO: 695515 - DNA, 20 bp, mouse
ggtagctgcggtcaaaaaag

SEQ ID NO: 695516 - DNA, 20 bp, mouse
gaaccccactgttatagctg

SEQ ID NO: 695517 - DNA, 20 bp, mouse
gctccccagctataacagtg

SEQ ID NO: 695518 - DNA, 20 bp, mouse
ggcagagggtaggtaagcaa

SEQ ID NO: 695519 - DNA, 20 bp, mouse
ggtggagcccagtcctccgg

SEQ ID NO: 695520 - DNA, 20 bp, mouse
gtgccatagcccaagaaatg

SEQ ID NO: 695521 - DNA, 20 bp, mouse
gagggtaggtaagcaatgga

SEQ ID NO: 695522 - DNA, 20 bp, mouse
gaggaaggcagattctttca

SEQ ID NO: 695523 - DNA, 20 bp, mouse
gagacctctgctagtctatt

SEQ ID NO: 695524 - DNA, 20 bp, mouse
gagacctaatagactagcag

SEQ ID NO: 695525 - DNA, 20 bp, mouse
ggtaatgtgacctatctcat

SEQ ID NO: 695526 - DNA, 20 bp, mouse
gcggcccgccaggtagccct

SEQ ID NO: 695527 - DNA, 20 bp, mouse
ggtagccctgggcaggtaga

SEQ ID NO: 695528 - DNA, 20 bp, mouse
gtccctgcgggccaatgggg

SEQ ID NO: 695529 - DNA, 20 bp, mouse
gccgccaggtagccctgggc

SEQ ID NO: 695530 - DNA, 20 bp, mouse
gcgtgcccaccaggtgtgcc

SEQ ID NO: 695531 - DNA, 20 bp, mouse
ggggtccctgcgggccaatg

SEQ ID NO: 695532 - DNA, 20 bp, mouse
gactgtcaggaccacctcct

SEQ ID NO: 695533 - DNA, 20 bp, mouse
gagcagccgggcacacctgg

SEQ ID NO: 695534 - DNA, 20 bp, mouse
gacaagagtcactagggcgg

SEQ ID NO: 695535 - DNA, 20 bp, mouse
gccggctcccgagatgttag

SEQ ID NO: 695536 - DNA, 20 bp, mouse
ggggatgaggaaaaagacgt

SEQ ID NO: 695537 - DNA, 20 bp, mouse
gaccgggccagaaggggtct

SEQ ID NO: 695538 - DNA, 20 bp, mouse
gcctccctcaagcggaatcg

SEQ ID NO: 695539 - DNA, 20 bp, mouse
ggtcaagcctagaccccttc

SEQ ID NO: 695540 - DNA, 20 bp, mouse
gaggctggtcagaacagatc

SEQ ID NO: 695541 - DNA, 20 bp, mouse
gctagcagctccaacggtca

SEQ ID NO: 695542 - DNA, 20 bp, mouse
ggaacagacgagctccgcgt

SEQ ID NO: 695543 - DNA, 20 bp, mouse
gcaaatcggggagaggacat

SEQ ID NO: 695544 - DNA, 20 bp, mouse
gtaggcttgaccttgaccgt

SEQ ID NO: 695545 - DNA, 20 bp, mouse
ggccgccctggtgctttgga

SEQ ID NO: 695546 - DNA, 20 bp, mouse
ggacctatggcctatatctg

SEQ ID NO: 695547 - DNA, 20 bp, mouse
gcacacttatttcatgagta

SEQ ID NO: 695548 - DNA, 20 bp, mouse
gtcaacgataaaaatcagag

SEQ ID NO: 695549 - DNA, 20 bp, mouse
gtagggttaagtcaccataa

SEQ ID NO: 695550 - DNA, 20 bp, mouse
gttacagagagctttgccct

SEQ ID NO: 695551 - DNA, 20 bp, mouse
gctatggcctatatctgagg

SEQ ID NO: 695552 - DNA, 20 bp, mouse
gtgtgcgcgcgcattacatg

SEQ ID NO: 695553 - DNA, 20 bp, mouse
gcattagtgagtccaaccaa

SEQ ID NO: 695554 - DNA, 20 bp, mouse
gaagaatccccttataaaat

SEQ ID NO: 695555 - DNA, 20 bp, mouse
gatcgttgaccattgctctc

SEQ ID NO: 695556 - DNA, 20 bp, mouse
gtcatctgcaacacagtctg

SEQ ID NO: 695557 - DNA, 20 bp, mouse
gtgtgtgtccatatgtggtt

SEQ ID NO: 695558 - DNA, 20 bp, mouse
gggacacctcagtctacgaa

SEQ ID NO: 695559 - DNA, 20 bp, mouse
gttaacaatccctctgatgc

SEQ ID NO: 695560 - DNA, 20 bp, mouse
gtcttgtcccatacacatag

SEQ ID NO: 695561 - DNA, 20 bp, mouse
ggaactatccattatgatct

SEQ ID NO: 695562 - DNA, 20 bp, mouse
gttggagagatgatcttaag

SEQ ID NO: 695563 - DNA, 20 bp, mouse
gcactataacccagcatcag

SEQ ID NO: 695564 - DNA, 20 bp, mouse
ggtattatcctctatgtgta

SEQ ID NO: 695565 - DNA, 20 bp, mouse
ggttatggagttagtagcaa

SEQ ID NO: 695566 - DNA, 20 bp, mouse
ggggtgaagggcactgtgcg

SEQ ID NO: 695567 - DNA, 20 bp, mouse
gtacaaagaaaagtacgcga

SEQ ID NO: 695568 - DNA, 20 bp, mouse
gtgcgtggcggccctgcgtg

SEQ ID NO: 695569 - DNA, 20 bp, mouse
gtgaagggcactgtgcgtgg

SEQ ID NO: 695570 - DNA, 20 bp, mouse
gcttggtgacattgggtgaa

SEQ ID NO: 695571 - DNA, 20 bp, mouse
gatgaggtgacgcagaagca

SEQ ID NO: 695572 - DNA, 20 bp, mouse
gaaacattgctcctcacgca

SEQ ID NO: 695573 - DNA, 20 bp, mouse
gcaatgtttgctgttcactc

SEQ ID NO: 695574 - DNA, 20 bp, mouse
gcaccaagcaaagtgaccgc

SEQ ID NO: 695575 - DNA, 20 bp, mouse
gagccagcggtcactttgct

SEQ ID NO: 695576 - DNA, 20 bp, mouse
ggtagattcaaagaaagcat

SEQ ID NO: 695577 - DNA, 20 bp, mouse
gctgtagttgaaggcagagt

SEQ ID NO: 695578 - DNA, 20 bp, mouse
gcaaaggggcctggcatgtg

SEQ ID NO: 695579 - DNA, 20 bp, mouse
gcatgggaagagaaaccaaa

SEQ ID NO: 695580 - DNA, 20 bp, mouse
gaggcagccagttctaaggt

SEQ ID NO: 695581 - DNA, 20 bp, mouse
gcctggcatgtgaggcggtt

SEQ ID NO: 695582 - DNA, 20 bp, mouse
gctttctttgaatctactgc

SEQ ID NO: 695583 - DNA, 20 bp, mouse
gtccacatcacagtatgaat

SEQ ID NO: 695584 - DNA, 20 bp, mouse
gtttaatcgctgctctccgg

SEQ ID NO: 695585 - DNA, 20 bp, mouse
gagtgtcagccatcattacc

SEQ ID NO: 695586 - DNA, 20 bp, mouse
gctcccgtcgcctacgtcag

SEQ ID NO: 695587 - DNA, 20 bp, mouse
gatcccccggccatactgaa

SEQ ID NO: 695588 - DNA, 20 bp, mouse
gaggcgacgggagggctgtg

SEQ ID NO: 695589 - DNA, 20 bp, mouse
gcgccgctgacgtaggcgac

SEQ ID NO: 695590 - DNA, 20 bp, mouse
gatggcaccaacaggaccgc

SEQ ID NO: 695591 - DNA, 20 bp, mouse
ggcggcgcccgcggtcctgt

SEQ ID NO: 695592 - DNA, 20 bp, mouse
gcgtacttatggggaagggg

SEQ ID NO: 695593 - DNA, 20 bp, mouse
ggccgggggatgctctactt

SEQ ID NO: 695594 - DNA, 20 bp, mouse
ggcactcccgcaaagggctg

SEQ ID NO: 695595 - DNA, 20 bp, mouse
gggatgctctacttgggttg

SEQ ID NO: 695596 - DNA, 20 bp, mouse
gaggcctactgcacagacag

SEQ ID NO: 695597 - DNA, 20 bp, mouse
ggtagagcagaaaactgtga

SEQ ID NO: 695598 - DNA, 20 bp, mouse
gatgcagaaaagacaaaacg

SEQ ID NO: 695599 - DNA, 20 bp, mouse
gtaggtttccgtgttctgaa

SEQ ID NO: 695600 - DNA, 20 bp, mouse
gagaacacggaaacctagat

SEQ ID NO: 695601 - DNA, 20 bp, mouse
ggcttcaaatcagatatcag

SEQ ID NO: 695602 - DNA, 20 bp, mouse
gaggaaagtggattttaagg

SEQ ID NO: 695603 - DNA, 20 bp, mouse
gtggagaggtggaagaatac

SEQ ID NO: 695604 - DNA, 20 bp, mouse
gtacacccccaggactgcac

SEQ ID NO: 695605 - DNA, 20 bp, mouse
gcactggcccgcagtcctga

SEQ ID NO: 695606 - DNA, 20 bp, mouse
gactgtaggagtgaccaatg

SEQ ID NO: 695607 - DNA, 20 bp, mouse
ggccctgaccatgtgactgt

SEQ ID NO: 695608 - DNA, 20 bp, mouse
gatacagggtctggtcatga

SEQ ID NO: 695609 - DNA, 20 bp, mouse
gaagtccagtgatcattgcc

SEQ ID NO: 695610 - DNA, 20 bp, mouse
gacaatgaggcaaatccata

SEQ ID NO: 695611 - DNA, 20 bp, mouse
ggtggaggagacaattatct

SEQ ID NO: 695612 - DNA, 20 bp, mouse
gaatccataaggaataatgg

SEQ ID NO: 695613 - DNA, 20 bp, mouse
gtcctacagtcacatggtca

SEQ ID NO: 695614 - DNA, 20 bp, mouse
gggtcatgaaggaaatgatc

SEQ ID NO: 695615 - DNA, 20 bp, mouse
gagcttttgacagtcaaaac

SEQ ID NO: 695616 - DNA, 20 bp, mouse
ggggtctgaaggtgccaccc

SEQ ID NO: 695617 - DNA, 20 bp, mouse
gcgtggcgaggggcggtacc

SEQ ID NO: 695618 - DNA, 20 bp, mouse
ggaaacgtgacgtcccagtc

SEQ ID NO: 695619 - DNA, 20 bp, mouse
gcctcccttagtgacagctg

SEQ ID NO: 695620 - DNA, 20 bp, mouse
gagcccaaggcgcacaagtc

SEQ ID NO: 695621 - DNA, 20 bp, mouse
gacaagtccgggcgtggcga

SEQ ID NO: 695622 - DNA, 20 bp, mouse
gcggcaggacagtgggacca

SEQ ID NO: 695623 - DNA, 20 bp, mouse
ggtgtcgggcagccaatagg

SEQ ID NO: 695624 - DNA, 20 bp, mouse
ggaggggcggtaccaggctg

SEQ ID NO: 695625 - DNA, 20 bp, mouse
ggctgaggcgcgcctcctat

SEQ ID NO: 695626 - DNA, 20 bp, mouse
gctagggcaggactgagaag

SEQ ID NO: 695627 - DNA, 20 bp, mouse
gctgagaagtggggtgactt

SEQ ID NO: 695628 - DNA, 20 bp, mouse
gccaggacggccacagagtg

SEQ ID NO: 695629 - DNA, 20 bp, mouse
gggtgaatgaccacactctg

SEQ ID NO: 695630 - DNA, 20 bp, mouse
gcacagagcttggtaaatga

SEQ ID NO: 695631 - DNA, 20 bp, mouse
gccttactgggactggtagt

SEQ ID NO: 695632 - DNA, 20 bp, mouse
gtgaaggctgaggagagctt

SEQ ID NO: 695633 - DNA, 20 bp, mouse
ggctgaggagagcttaggga

SEQ ID NO: 695634 - DNA, 20 bp, mouse
gggactggtagtgggattgt

SEQ ID NO: 695635 - DNA, 20 bp, mouse
gtaaacactcccaactgcca

SEQ ID NO: 695636 - DNA, 20 bp, mouse
ggccactgggttagcggagt

SEQ ID NO: 695637 - DNA, 20 bp, mouse
ggcctgagcaaatcacaagg

SEQ ID NO: 695638 - DNA, 20 bp, mouse
ggtggcctgagcaaatcaca

SEQ ID NO: 695639 - DNA, 20 bp, mouse
gacctactccgctaacccag

SEQ ID NO: 695640 - DNA, 20 bp, mouse
gccccccccccatgctctaa

SEQ ID NO: 695641 - DNA, 20 bp, mouse
gaaggaagtcagcggggcct

SEQ ID NO: 695642 - DNA, 20 bp, mouse
ggcaactgcagcctcaaact

SEQ ID NO: 695643 - DNA, 20 bp, mouse
ggctcaggccactgggttag

SEQ ID NO: 695644 - DNA, 20 bp, mouse
gacttcctttagagcatggg

SEQ ID NO: 695645 - DNA, 20 bp, mouse
gactgcagcctcaaactggg

SEQ ID NO: 695646 - DNA, 20 bp, mouse
gcgttgctagaagcttagag

SEQ ID NO: 695647 - DNA, 20 bp, mouse
gtgccaatggagcccagact

SEQ ID NO: 695648 - DNA, 20 bp, mouse
ggtcccttcccttgcttcca

SEQ ID NO: 695649 - DNA, 20 bp, mouse
gcattcctgaagcaaccaat

SEQ ID NO: 695650 - DNA, 20 bp, mouse
gaacctgcaaagtttaattc

SEQ ID NO: 695651 - DNA, 20 bp, mouse
gtaacgaacaccataatcag

SEQ ID NO: 695652 - DNA, 20 bp, mouse
gaatctgagattccaggcac

SEQ ID NO: 695653 - DNA, 20 bp, mouse
gaaatgctgactaaccctaa

SEQ ID NO: 695654 - DNA, 20 bp, mouse
gtccctgaattaaactttgc

SEQ ID NO: 695655 - DNA, 20 bp, mouse
gagcaacgggatttatatcc

SEQ ID NO: 695656 - DNA, 20 bp, mouse
gcagccctactgtgtggggg

SEQ ID NO: 695657 - DNA, 20 bp, mouse
ggtcaaagctactacaacag

SEQ ID NO: 695658 - DNA, 20 bp, mouse
ggctgtaaccgcttccgccc

SEQ ID NO: 695659 - DNA, 20 bp, mouse
gaggatccacgttacacttc

SEQ ID NO: 695660 - DNA, 20 bp, mouse
gagcccccccccacacagta

SEQ ID NO: 695661 - DNA, 20 bp, mouse
gatgccagcccgggcggaag

SEQ ID NO: 695662 - DNA, 20 bp, mouse
gcaacagcggatgccagccc

SEQ ID NO: 695663 - DNA, 20 bp, mouse
gtgtaacgtggatcctcttg

SEQ ID NO: 695664 - DNA, 20 bp, mouse
gctgcgcagccctactgtgt

SEQ ID NO: 695665 - DNA, 20 bp, mouse
ggacgcatgcgcttcggatg

SEQ ID NO: 695666 - DNA, 20 bp, mouse
gccgcggcgcgagctcccat

SEQ ID NO: 695667 - DNA, 20 bp, mouse
gccctcgcggggcctgaaag

SEQ ID NO: 695668 - DNA, 20 bp, mouse
gccactccccggagagactc

SEQ ID NO: 695669 - DNA, 20 bp, mouse
gtcgcgaactaggggagcgt

SEQ ID NO: 695670 - DNA, 20 bp, mouse
ggggcctgaaagtggtctcc

SEQ ID NO: 695671 - DNA, 20 bp, mouse
gcagagacgcgccccctcgc

SEQ ID NO: 695672 - DNA, 20 bp, mouse
gagtagcctgagtctctccg

SEQ ID NO: 695673 - DNA, 20 bp, mouse
gccgcggggcagcgcacgcc

SEQ ID NO: 695674 - DNA, 20 bp, mouse
gcacgccaggctcgcgaact

SEQ ID NO: 695675 - DNA, 20 bp, mouse
ggctaaggcggaggtcccaa

SEQ ID NO: 695676 - DNA, 20 bp, mouse
gaagccaggggtactcctga

SEQ ID NO: 695677 - DNA, 20 bp, mouse
gcggaggaaggggaccgctt

SEQ ID NO: 695678 - DNA, 20 bp, mouse
gcctagggtgggcggaggaa

SEQ ID NO: 695679 - DNA, 20 bp, mouse
gaggatgcggagccgggaac

SEQ ID NO: 695680 - DNA, 20 bp, mouse
gcccgggtggcggggaactc

SEQ ID NO: 695681 - DNA, 20 bp, mouse
gagagcgcctgcaccaatca

SEQ ID NO: 695682 - DNA, 20 bp, mouse
gactgtggaaacccgggtgg

SEQ ID NO: 695683 - DNA, 20 bp, mouse
ggggtggcggggaactcggg

SEQ ID NO: 695684 - DNA, 20 bp, mouse
gcggggaactcgggaggatg

SEQ ID NO: 695685 - DNA, 20 bp, mouse
gggtactggctagctagtga

SEQ ID NO: 695686 - DNA, 20 bp, mouse
ggggcttgccccaccctcga

SEQ ID NO: 695687 - DNA, 20 bp, mouse
gggagggcggtgtcgcgaag

SEQ ID NO: 695688 - DNA, 20 bp, mouse
ggccccaggccctcgagggt

SEQ ID NO: 695689 - DNA, 20 bp, mouse
gcccgggcagccaatagatg

SEQ ID NO: 695690 - DNA, 20 bp, mouse
ggcggcgcctccacatctat

SEQ ID NO: 695691 - DNA, 20 bp, mouse
gtcagcgcggttataaggga

SEQ ID NO: 695692 - DNA, 20 bp, mouse
ggggcagccaatagatgtgg

SEQ ID NO: 695693 - DNA, 20 bp, mouse
gggggggggcagtgccccgg

SEQ ID NO: 695694 - DNA, 20 bp, mouse
gcgggtgtgcctgggcgcag

SEQ ID NO: 695695 - DNA, 20 bp, mouse
gacgcccggcactgcccccg

SEQ ID NO: 695696 - DNA, 20 bp, mouse
gcaagctgccctggtatcaa

SEQ ID NO: 695697 - DNA, 20 bp, mouse
gaggggcggagtcacgcatc

SEQ ID NO: 695698 - DNA, 20 bp, mouse
gagcctgaggtcaccgtggg

SEQ ID NO: 695699 - DNA, 20 bp, mouse
gtatcaagggctggcgggag

SEQ ID NO: 695700 - DNA, 20 bp, mouse
gccgcctaggtcacgggtca

SEQ ID NO: 695701 - DNA, 20 bp, mouse
gcgcctcccacggtgacctc

SEQ ID NO: 695702 - DNA, 20 bp, mouse
gccgccagcccttgatacca

SEQ ID NO: 695703 - DNA, 20 bp, mouse
gaggaccaacctggggtaga

SEQ ID NO: 695704 - DNA, 20 bp, mouse
gccagagtggtgcgcggggt

SEQ ID NO: 695705 - DNA, 20 bp, mouse
gtaggccccgcctaggtcac

SEQ ID NO: 695706 - DNA, 20 bp, mouse
gcgccaaagcgcttgacagg

SEQ ID NO: 695707 - DNA, 20 bp, mouse
ggggtgggggagacgcacaa

SEQ ID NO: 695708 - DNA, 20 bp, mouse
ggacccgcaacaggttattc

SEQ ID NO: 695709 - DNA, 20 bp, mouse
gcccaggcgccggccaacca

SEQ ID NO: 695710 - DNA, 20 bp, mouse
ggtcgcaaagcggcgctttg

SEQ ID NO: 695711 - DNA, 20 bp, mouse
ggccacggcaaacccgacgg

SEQ ID NO: 695712 - DNA, 20 bp, mouse
gggcgccggccaaccagggg

SEQ ID NO: 695713 - DNA, 20 bp, mouse
ggagcgccaaagcgcttgac

SEQ ID NO: 695714 - DNA, 20 bp, mouse
gaggccgcacctccaggcct

SEQ ID NO: 695715 - DNA, 20 bp, mouse
ggccggccaaccaggggcgg

SEQ ID NO: 695716 - DNA, 20 bp, mouse
gtctgcgcgcgctaactcgc

SEQ ID NO: 695717 - DNA, 20 bp, mouse
gacacgcgaacgtcgccctc

SEQ ID NO: 695718 - DNA, 20 bp, mouse
gtggtggcgagattcggaag

SEQ ID NO: 695719 - DNA, 20 bp, mouse
ggaggtacactgaccctctg

SEQ ID NO: 695720 - DNA, 20 bp, mouse
gtgtctaggccgaacaattc

SEQ ID NO: 695721 - DNA, 20 bp, mouse
gtccgaatctcgccaccaga

SEQ ID NO: 695722 - DNA, 20 bp, mouse
gacccgccggaagtgatctc

SEQ ID NO: 695723 - DNA, 20 bp, mouse
gggcagggtcctgaattgtt

SEQ ID NO: 695724 - DNA, 20 bp, mouse
gggcgagattcggaaggggg

SEQ ID NO: 695725 - DNA, 20 bp, mouse
ggccctctggtggcgagatt

SEQ ID NO: 695726 - DNA, 20 bp, mouse
gtggggaggcggtcccagtg

SEQ ID NO: 695727 - DNA, 20 bp, mouse
gcggaacagtcgagaggcgt

SEQ ID NO: 695728 - DNA, 20 bp, mouse
ggggtgctggatagtacgga

SEQ ID NO: 695729 - DNA, 20 bp, mouse
gggtcccagtggggcgggta

SEQ ID NO: 695730 - DNA, 20 bp, mouse
gggtggacccagggtaggga

SEQ ID NO: 695731 - DNA, 20 bp, mouse
gaagaaaacggggtggtctc

SEQ ID NO: 695732 - DNA, 20 bp, mouse
ggctccgggcacatctaggg

SEQ ID NO: 695733 - DNA, 20 bp, mouse
ggaagggtgtggggcggttc

SEQ ID NO: 695734 - DNA, 20 bp, mouse
ggggcgggtgctggatagta

SEQ ID NO: 695735 - DNA, 20 bp, mouse
gctaaaagaatcactagggt

SEQ ID NO: 695736 - DNA, 20 bp, mouse
gtggctgtgaactctatggg

SEQ ID NO: 695737 - DNA, 20 bp, mouse
gcggcgcggcggtgcgagac

SEQ ID NO: 695738 - DNA, 20 bp, mouse
gtgcaagtgggtgttggagg

SEQ ID NO: 695739 - DNA, 20 bp, mouse
gtccgcaacaccagcgtcgt

SEQ ID NO: 695740 - DNA, 20 bp, mouse
gcagccttggcctgtagact

SEQ ID NO: 695741 - DNA, 20 bp, mouse
gggcggtcactgatggattg

SEQ ID NO: 695742 - DNA, 20 bp, mouse
gggcaggagctactactgat

SEQ ID NO: 695743 - DNA, 20 bp, mouse
gcgactgccccagagagacg

SEQ ID NO: 695744 - DNA, 20 bp, mouse
ggacccacggggtgcacagc

SEQ ID NO: 695745 - DNA, 20 bp, mouse
gctacaggccaaggctgcta

SEQ ID NO: 695746 - DNA, 20 bp, mouse
gtccgagcctgggtatccca

SEQ ID NO: 695747 - DNA, 20 bp, mouse
gtgtgcatttggggagaccg

SEQ ID NO: 695748 - DNA, 20 bp, mouse
ggtgcctagtgtgtgcattt

SEQ ID NO: 695749 - DNA, 20 bp, mouse
gcatttggggagaccgtggc

SEQ ID NO: 695750 - DNA, 20 bp, mouse
gacaactatgagtaggtgcc

SEQ ID NO: 695751 - DNA, 20 bp, mouse
gctggctccagggtgaccct

SEQ ID NO: 695752 - DNA, 20 bp, mouse
ggccagaattagaagctcaa

SEQ ID NO: 695753 - DNA, 20 bp, mouse
gtcacgaagctgtcgccacc

SEQ ID NO: 695754 - DNA, 20 bp, mouse
gagcaggagggcggacttcc

SEQ ID NO: 695755 - DNA, 20 bp, mouse
gctccccaaatgcacacact

SEQ ID NO: 695756 - DNA, 20 bp, mouse
gtgggcggagcctctgaaaa

SEQ ID NO: 695757 - DNA, 20 bp, mouse
gtggccccaaagcggagggt

SEQ ID NO: 695758 - DNA, 20 bp, mouse
gtaggcggggcctatggagg

SEQ ID NO: 695759 - DNA, 20 bp, mouse
gccccaaagcggagggtagg

SEQ ID NO: 695760 - DNA, 20 bp, mouse
gagcaggattggccccaaag

SEQ ID NO: 695761 - DNA, 20 bp, mouse
gggattggccccaaagcgga

SEQ ID NO: 695762 - DNA, 20 bp, mouse
ggcgcagagcggcgcacagc

SEQ ID NO: 695763 - DNA, 20 bp, mouse
gtaacccgcacctccgggag

SEQ ID NO: 695764 - DNA, 20 bp, mouse
ggacgagttgcctctcccgg

SEQ ID NO: 695765 - DNA, 20 bp, mouse
ggaggtgcgggttatccgga

SEQ ID NO: 695766 - DNA, 20 bp, mouse
gtggatgggtccacaggggt

SEQ ID NO: 695767 - DNA, 20 bp, mouse
gggaacaaggccgaagctgg

SEQ ID NO: 695768 - DNA, 20 bp, mouse
gtccacggcgcaaagctccc

SEQ ID NO: 695769 - DNA, 20 bp, mouse
gagcaggtggatgggtccac

SEQ ID NO: 695770 - DNA, 20 bp, mouse
gctgcggacgcaggatgctg

SEQ ID NO: 695771 - DNA, 20 bp, mouse
gcagggcaagacatgcgctt

SEQ ID NO: 695772 - DNA, 20 bp, mouse
gatgctgcggacctgagagc

SEQ ID NO: 695773 - DNA, 20 bp, mouse
gcatgtcttgccctgctctc

SEQ ID NO: 695774 - DNA, 20 bp, mouse
ggcagacagaatcagctggt

SEQ ID NO: 695775 - DNA, 20 bp, mouse
gaggccattcgaacagggag

SEQ ID NO: 695776 - DNA, 20 bp, mouse
gggcacctatgaatcctggg

SEQ ID NO: 695777 - DNA, 20 bp, mouse
gaggtccctttgagaagagg

SEQ ID NO: 695778 - DNA, 20 bp, mouse
gccttgccccctcttctcaa

SEQ ID NO: 695779 - DNA, 20 bp, mouse
gcttctcaaagggacctccc

SEQ ID NO: 695780 - DNA, 20 bp, mouse
gaaacaccagcgaaccatag

SEQ ID NO: 695781 - DNA, 20 bp, mouse
gtccacaaaggctttgttgt

SEQ ID NO: 695782 - DNA, 20 bp, mouse
ggtagactgcacaaaatcca

SEQ ID NO: 695783 - DNA, 20 bp, mouse
gagtcggcacctatgaatcc

SEQ ID NO: 695784 - DNA, 20 bp, mouse
ggagaagagggggcaaggcc

SEQ ID NO: 695785 - DNA, 20 bp, mouse
gggtgttcacaagtactcat

SEQ ID NO: 695786 - DNA, 20 bp, mouse
gcagcaccacggagggtggg

SEQ ID NO: 695787 - DNA, 20 bp, mouse
gcccaagtcagcaccacgga

SEQ ID NO: 695788 - DNA, 20 bp, mouse
ggggcggtgcctgggaaagg

SEQ ID NO: 695789 - DNA, 20 bp, mouse
gctacctgtgggttggggat

SEQ ID NO: 695790 - DNA, 20 bp, mouse
gctggccacccactgggcca

SEQ ID NO: 695791 - DNA, 20 bp, mouse
gagcactttggtggccccta

SEQ ID NO: 695792 - DNA, 20 bp, mouse
gagtcagcaccacggagggt

SEQ ID NO: 695793 - DNA, 20 bp, mouse
ggggcggtgtatttacagtg

SEQ ID NO: 695794 - DNA, 20 bp, mouse
ggggacgctgcaacctgcaa

SEQ ID NO: 695795 - DNA, 20 bp, mouse
gggagactcaagccaggtga

SEQ ID NO: 695796 - DNA, 20 bp, mouse
gaggcccgtcgcgggaagat

SEQ ID NO: 695797 - DNA, 20 bp, mouse
gcgcggcatgccggggaggt

SEQ ID NO: 695798 - DNA, 20 bp, mouse
ggccgtggaccatagggaca

SEQ ID NO: 695799 - DNA, 20 bp, mouse
gtgggaggggaggcccgtcg

SEQ ID NO: 695800 - DNA, 20 bp, mouse
gctccccggcatgccgcgac

SEQ ID NO: 695801 - DNA, 20 bp, mouse
gccgagggctggcccagccg

SEQ ID NO: 695802 - DNA, 20 bp, mouse
gaccctgtccctatggtcca

SEQ ID NO: 695803 - DNA, 20 bp, mouse
gcatggagcaaggatcgccg

SEQ ID NO: 695804 - DNA, 20 bp, mouse
gcccccggcctctgcagact

SEQ ID NO: 695805 - DNA, 20 bp, mouse
gccgagaggccaagcgccag

SEQ ID NO: 695806 - DNA, 20 bp, mouse
ggctccgcgggcggtcgcgc

SEQ ID NO: 695807 - DNA, 20 bp, mouse
gcccctgctgctctcggccg

SEQ ID NO: 695808 - DNA, 20 bp, mouse
gtgagaagcgcggtgggggg

SEQ ID NO: 695809 - DNA, 20 bp, mouse
gggaaacaatctggaaacta

SEQ ID NO: 695810 - DNA, 20 bp, mouse
ggcgccgtcgcccgcacctc

SEQ ID NO: 695811 - DNA, 20 bp, mouse
gtccttgagaagcgcggtgg

SEQ ID NO: 695812 - DNA, 20 bp, mouse
ggcgaccgcccgcggagccg

SEQ ID NO: 695813 - DNA, 20 bp, mouse
gcagttgagggcgctcggat

SEQ ID NO: 695814 - DNA, 20 bp, mouse
gcctgccctgcccgagtctc

SEQ ID NO: 695815 - DNA, 20 bp, mouse
gcaggtgaggccccgggaag

SEQ ID NO: 695816 - DNA, 20 bp, mouse
ggaagcgggcggtccgcgga

SEQ ID NO: 695817 - DNA, 20 bp, mouse
ggggcggtgcaaacccagaa

SEQ ID NO: 695818 - DNA, 20 bp, mouse
gaggccgtgaaatcactgga

SEQ ID NO: 695819 - DNA, 20 bp, mouse
ggccggaagcgcacccagcg

SEQ ID NO: 695820 - DNA, 20 bp, mouse
gcgcggaagcgggcggtccg

SEQ ID NO: 695821 - DNA, 20 bp, mouse
gtccgcgctgggtgcgcttc

SEQ ID NO: 695822 - DNA, 20 bp, mouse
gctgcacaaggaagcttttt

SEQ ID NO: 695823 - DNA, 20 bp, mouse
gagcgcacccagcgcggaag

SEQ ID NO: 695824 - DNA, 20 bp, mouse
gctgcccggggcgcccccag

SEQ ID NO: 695825 - DNA, 20 bp, mouse
gggagctcctccgccctccg

SEQ ID NO: 695826 - DNA, 20 bp, mouse
ggggtcgagcaaagtggcga

SEQ ID NO: 695827 - DNA, 20 bp, mouse
gaccctgcggagcttcccta

SEQ ID NO: 695828 - DNA, 20 bp, mouse
gagggaaggctgcttgtcaa

SEQ ID NO: 695829 - DNA, 20 bp, mouse
gccagtgcctggtgaccgtc

SEQ ID NO: 695830 - DNA, 20 bp, mouse
gtcgagcaaagtggcgatgg

SEQ ID NO: 695831 - DNA, 20 bp, mouse
ggccctagggaagctccgca

SEQ ID NO: 695832 - DNA, 20 bp, mouse
ggaaccttggcgcggcccta

SEQ ID NO: 695833 - DNA, 20 bp, mouse
ggacgatatcctctccccga

SEQ ID NO: 695834 - DNA, 20 bp, mouse
ggccaaggttcgaatgtgag

SEQ ID NO: 695835 - DNA, 20 bp, mouse
ggccactttgctcgaccctg

SEQ ID NO: 695836 - DNA, 20 bp, mouse
gggaagaggcgggtcccaga

SEQ ID NO: 695837 - DNA, 20 bp, mouse
ggccccggacacctaaacgg

SEQ ID NO: 695838 - DNA, 20 bp, mouse
gtcccagagggaagactgac

SEQ ID NO: 695839 - DNA, 20 bp, mouse
ggctgccccggacacctaaa

SEQ ID NO: 695840 - DNA, 20 bp, mouse
gttcctgcgtgcgcggtgat

SEQ ID NO: 695841 - DNA, 20 bp, mouse
gcacaggctcaggggtcctc

SEQ ID NO: 695842 - DNA, 20 bp, mouse
gggctcaggggtcctctggt

SEQ ID NO: 695843 - DNA, 20 bp, mouse
gtggttgggaaggtgttggt

SEQ ID NO: 695844 - DNA, 20 bp, mouse
gggaacttcgcgtctccgaa

SEQ ID NO: 695845 - DNA, 20 bp, mouse
ggcctgttcaaaaacaaaac

SEQ ID NO: 695846 - DNA, 20 bp, mouse
gcgaaccagtggaacgccca

SEQ ID NO: 695847 - DNA, 20 bp, mouse
ggaagctagggcggagtcta

SEQ ID NO: 695848 - DNA, 20 bp, mouse
gcgtggaggtgcagccctag

SEQ ID NO: 695849 - DNA, 20 bp, mouse
gaggccgcggctctgcccct

SEQ ID NO: 695850 - DNA, 20 bp, mouse
gcgcgcgaggtaggcgtgaa

SEQ ID NO: 695851 - DNA, 20 bp, mouse
gtgccgccactcagaagcta

SEQ ID NO: 695852 - DNA, 20 bp, mouse
ggaggtaggcgtgaagggcg

SEQ ID NO: 695853 - DNA, 20 bp, mouse
gctcaccctgggcgttccac

SEQ ID NO: 695854 - DNA, 20 bp, mouse
gacttggggaagagactgat

SEQ ID NO: 695855 - DNA, 20 bp, mouse
gggaacgcccagggtgagcg

SEQ ID NO: 695856 - DNA, 20 bp, mouse
ggggcggggctgggaatgga

SEQ ID NO: 695857 - DNA, 20 bp, mouse
gaggggacctggaacgggcg

SEQ ID NO: 695858 - DNA, 20 bp, mouse
ggctcaaatccgctctgcgc

SEQ ID NO: 695859 - DNA, 20 bp, mouse
ggagcccggacatgcgcagt

SEQ ID NO: 695860 - DNA, 20 bp, mouse
gtgagccgcggagcctggag

SEQ ID NO: 695861 - DNA, 20 bp, mouse
gcccccttgctgcaggtcaa

SEQ ID NO: 695862 - DNA, 20 bp, mouse
gggggcgtggcgagaggcta

SEQ ID NO: 695863 - DNA, 20 bp, mouse
gggaggctgggcaggacacg

SEQ ID NO: 695864 - DNA, 20 bp, mouse
ggcagagcggatttgagccg

SEQ ID NO: 695865 - DNA, 20 bp, mouse
gcgcagtgggcacacggcgc

SEQ ID NO: 695866 - DNA, 20 bp, mouse
gaatcagggtggcttggaca

SEQ ID NO: 695867 - DNA, 20 bp, mouse
gcactcaccaagtgaaataa

SEQ ID NO: 695868 - DNA, 20 bp, mouse
gcaaaagtgcctcccatctt

SEQ ID NO: 695869 - DNA, 20 bp, mouse
gaggcggctcctggcttcta

SEQ ID NO: 695870 - DNA, 20 bp, mouse
ggattccagcacttccccaa

SEQ ID NO: 695871 - DNA, 20 bp, mouse
ggtgttctgagtctcggaca

SEQ ID NO: 695872 - DNA, 20 bp, mouse
ggggccttaaacccccaaga

SEQ ID NO: 695873 - DNA, 20 bp, mouse
gttgtgcctctcaatcaggg

SEQ ID NO: 695874 - DNA, 20 bp, mouse
gcggaacaaggcgaacaagg

SEQ ID NO: 695875 - DNA, 20 bp, mouse
gtgaggcagccgcccccaaa

SEQ ID NO: 695876 - DNA, 20 bp, mouse
gtggactcagatgagagctc

SEQ ID NO: 695877 - DNA, 20 bp, mouse
gggcgtggtcggccgttcgg

SEQ ID NO: 695878 - DNA, 20 bp, mouse
ggcaaggctgaaagctcggg

SEQ ID NO: 695879 - DNA, 20 bp, mouse
gaaagctcggggggcgtggt

SEQ ID NO: 695880 - DNA, 20 bp, mouse
gcctaggccacgcccccgaa

SEQ ID NO: 695881 - DNA, 20 bp, mouse
ggatccttggtcatgtggca

SEQ ID NO: 695882 - DNA, 20 bp, mouse
gttcctgggcacccaagcaa

SEQ ID NO: 695883 - DNA, 20 bp, mouse
ggatgagagctctggatcct

SEQ ID NO: 695884 - DNA, 20 bp, mouse
ggcaggggcctctgttgtgc

SEQ ID NO: 695885 - DNA, 20 bp, mouse
gtaagtcacgcccaactcct

SEQ ID NO: 695886 - DNA, 20 bp, mouse
gtgggggcgtggtaaattcg

SEQ ID NO: 695887 - DNA, 20 bp, mouse
gccgtctcgccaggttgctc

SEQ ID NO: 695888 - DNA, 20 bp, mouse
gagttcccagaattcggtcc

SEQ ID NO: 695889 - DNA, 20 bp, mouse
gttgctccgggaccgaattc

SEQ ID NO: 695890 - DNA, 20 bp, mouse
gcaggggtgcagtgggtcgg

SEQ ID NO: 695891 - DNA, 20 bp, mouse
gaggtcacgcaggggtgcag

SEQ ID NO: 695892 - DNA, 20 bp, mouse
ggggccgctcagggttaaag

SEQ ID NO: 695893 - DNA, 20 bp, mouse
gcctgaaaaatccctcttaa

SEQ ID NO: 695894 - DNA, 20 bp, mouse
gggcgtggtaaattcggggg

SEQ ID NO: 695895 - DNA, 20 bp, mouse
gcacccctgcgtgacctccc

SEQ ID NO: 695896 - DNA, 20 bp, mouse
gcctgcgccacaggactcgt

SEQ ID NO: 695897 - DNA, 20 bp, mouse
gtggaggcctggtgggtact

SEQ ID NO: 695898 - DNA, 20 bp, mouse
gccaacctcaggctacccac

SEQ ID NO: 695899 - DNA, 20 bp, mouse
gccacaggactcgtcggtga

SEQ ID NO: 695900 - DNA, 20 bp, mouse
ggaggctcggggtaccgccc

SEQ ID NO: 695901 - DNA, 20 bp, mouse
ggggaagagaggggcggatc

SEQ ID NO: 695902 - DNA, 20 bp, mouse
ggtagcctgaggttgggctt

SEQ ID NO: 695903 - DNA, 20 bp, mouse
gaactgaggccctggaaggt

SEQ ID NO: 695904 - DNA, 20 bp, mouse
gcctcggctcgcatattgga

SEQ ID NO: 695905 - DNA, 20 bp, mouse
ggggcggatcggggagatac

SEQ ID NO: 695906 - DNA, 20 bp, mouse
gcctggggccccagaggaaa

SEQ ID NO: 695907 - DNA, 20 bp, mouse
gagtcgccctgctgcatctg

SEQ ID NO: 695908 - DNA, 20 bp, mouse
gccctccgggagaacgtccc

SEQ ID NO: 695909 - DNA, 20 bp, mouse
ggggccaatcaggaagtccg

SEQ ID NO: 695910 - DNA, 20 bp, mouse
ggggcagccggaaggccaag

SEQ ID NO: 695911 - DNA, 20 bp, mouse
ggggtggcgcgccgttcgaa

SEQ ID NO: 695912 - DNA, 20 bp, mouse
gagagaagaaaggtctgcca

SEQ ID NO: 695913 - DNA, 20 bp, mouse
gcagcagggcgactgctgcc

SEQ ID NO: 695914 - DNA, 20 bp, mouse
ggaaggccaagcggccagct

SEQ ID NO: 695915 - DNA, 20 bp, mouse
gaagcggccagctgggctcc

SEQ ID NO: 695916 - DNA, 20 bp, mouse
gagggcacagggtgggcgtg

SEQ ID NO: 695917 - DNA, 20 bp, mouse
ggaagagtgcgggtgcggag

SEQ ID NO: 695918 - DNA, 20 bp, mouse
ggtggggccaaggcgcaggt

SEQ ID NO: 695919 - DNA, 20 bp, mouse
gcatcaaggcttaggagcag

SEQ ID NO: 695920 - DNA, 20 bp, mouse
gaggctccgcaggagagcga

SEQ ID NO: 695921 - DNA, 20 bp, mouse
gggggcgggaaggtaggctg

SEQ ID NO: 695922 - DNA, 20 bp, mouse
gtcccagagcatcaaggctt

SEQ ID NO: 695923 - DNA, 20 bp, mouse
gaccccgcccacctgcgcct

SEQ ID NO: 695924 - DNA, 20 bp, mouse
gcaaggcttaggagcagtgg

SEQ ID NO: 695925 - DNA, 20 bp, mouse
gctcctaagccttgatgctc

SEQ ID NO: 695926 - DNA, 20 bp, mouse
gaaaccaaaaggtaaggggc

SEQ ID NO: 695927 - DNA, 20 bp, mouse
gccgaagtccgcaaggggtg

SEQ ID NO: 695928 - DNA, 20 bp, mouse
ggagttggggcgagccagag

SEQ ID NO: 695929 - DNA, 20 bp, mouse
gtctgggcggaggggccgta

SEQ ID NO: 695930 - DNA, 20 bp, mouse
gcgggaaaccaaaaggtaag

SEQ ID NO: 695931 - DNA, 20 bp, mouse
gtgtaggaggttcaagtcct

SEQ ID NO: 695932 - DNA, 20 bp, mouse
ggggaggagccagctggcgc

SEQ ID NO: 695933 - DNA, 20 bp, mouse
ggggcggggacagcaggtgt

SEQ ID NO: 695934 - DNA, 20 bp, mouse
gagagggagtgtggggtcgg

SEQ ID NO: 695935 - DNA, 20 bp, mouse
gtcgggggacggtaagacag

SEQ ID NO: 695936 - DNA, 20 bp, mouse
gcggcccttagagaccaggg

SEQ ID NO: 695937 - DNA, 20 bp, mouse
gggaagcccgccaatcgagt

SEQ ID NO: 695938 - DNA, 20 bp, mouse
gggctctaaaaggagatccc

SEQ ID NO: 695939 - DNA, 20 bp, mouse
ggcgcagtgtgcatccgccc

SEQ ID NO: 695940 - DNA, 20 bp, mouse
gtaggcggcccttagagacc

SEQ ID NO: 695941 - DNA, 20 bp, mouse
gaggaccacacccactcgat

SEQ ID NO: 695942 - DNA, 20 bp, mouse
gtcagagggtggagagactg

SEQ ID NO: 695943 - DNA, 20 bp, mouse
gtctaagggccgcctagtca

SEQ ID NO: 695944 - DNA, 20 bp, mouse
ggcatccgccctggtctcta

SEQ ID NO: 695945 - DNA, 20 bp, mouse
gggagatccctggagagtag

SEQ ID NO: 695946 - DNA, 20 bp, mouse
gctccgccgtcccagatcgg

SEQ ID NO: 695947 - DNA, 20 bp, mouse
gctgccccgaccaccgatct

SEQ ID NO: 695948 - DNA, 20 bp, mouse
ggaactccgccgtcccagat

SEQ ID NO: 695949 - DNA, 20 bp, mouse
gaaatcccacggtgaggcta

SEQ ID NO: 695950 - DNA, 20 bp, mouse
gcggagttcgcagcaggtca

SEQ ID NO: 695951 - DNA, 20 bp, mouse
gagtcccctagcctcaccgt

SEQ ID NO: 695952 - DNA, 20 bp, mouse
gcccgccacgtcggcaggac

SEQ ID NO: 695953 - DNA, 20 bp, mouse
gcttccccagtgcttcgtaa

SEQ ID NO: 695954 - DNA, 20 bp, mouse
gttagaaccgggaaatccca

SEQ ID NO: 695955 - DNA, 20 bp, mouse
gaccacgtcagcgatgggag

SEQ ID NO: 695956 - DNA, 20 bp, mouse
gcacacccagccttcacgga

SEQ ID NO: 695957 - DNA, 20 bp, mouse
gccgggtcaagcatcctcta

SEQ ID NO: 695958 - DNA, 20 bp, mouse
ggatgcttgaagctggacac

SEQ ID NO: 695959 - DNA, 20 bp, mouse
gtccgccctccgtgaaggct

SEQ ID NO: 695960 - DNA, 20 bp, mouse
gagtgaatccgctgctccgg

SEQ ID NO: 695961 - DNA, 20 bp, mouse
ggctcactgcaaaggtggtg

SEQ ID NO: 695962 - DNA, 20 bp, mouse
gcgagggccagcgacgatcc

SEQ ID NO: 695963 - DNA, 20 bp, mouse
gccgcctccgcgctgaggtc

SEQ ID NO: 695964 - DNA, 20 bp, mouse
ggggaagcctgcctgtaggg

SEQ ID NO: 695965 - DNA, 20 bp, mouse
gaaaacaacggaatctgagg

SEQ ID NO: 695966 - DNA, 20 bp, mouse
gcagctgcacatccaagcct

SEQ ID NO: 695967 - DNA, 20 bp, mouse
ggagagcctctaaggtctgg

SEQ ID NO: 695968 - DNA, 20 bp, mouse
ggggggacgtggaaagtcac

SEQ ID NO: 695969 - DNA, 20 bp, mouse
gctctgcccccagaccttag

SEQ ID NO: 695970 - DNA, 20 bp, mouse
gacataaaggagagcctcta

SEQ ID NO: 695971 - DNA, 20 bp, mouse
gggagcagaaattgacataa

SEQ ID NO: 695972 - DNA, 20 bp, mouse
gggctacacggggatgtggg

SEQ ID NO: 695973 - DNA, 20 bp, mouse
gagaactgattggctacacg

SEQ ID NO: 695974 - DNA, 20 bp, mouse
ggtacagaactgtaagatgt

SEQ ID NO: 695975 - DNA, 20 bp, mouse
gtaaagctgggaaaatcaat

SEQ ID NO: 695976 - DNA, 20 bp, mouse
ggggatgagacctcctctag

SEQ ID NO: 695977 - DNA, 20 bp, mouse
gaaggcattgaggtggatta

SEQ ID NO: 695978 - DNA, 20 bp, mouse
gggagtaggagcccgagggg

SEQ ID NO: 695979 - DNA, 20 bp, mouse
gaagcgacaaggcattgagg

SEQ ID NO: 695980 - DNA, 20 bp, mouse
gtactccagccgggaggaag

SEQ ID NO: 695981 - DNA, 20 bp, mouse
gctcaagcgacaaggcattg

SEQ ID NO: 695982 - DNA, 20 bp, mouse
ggtaactggctcaagcgaca

SEQ ID NO: 695983 - DNA, 20 bp, mouse
gaagtggggaggagactgac

SEQ ID NO: 695984 - DNA, 20 bp, mouse
gttggcaagcgccgcccctc

SEQ ID NO: 695985 - DNA, 20 bp, mouse
gacaaagaagcgctgtctat

SEQ ID NO: 695986 - DNA, 20 bp, mouse
gccccgggatagccacgccc

SEQ ID NO: 695987 - DNA, 20 bp, mouse
gcgagggcggagcttcccag

SEQ ID NO: 695988 - DNA, 20 bp, mouse
ggggccgatttgagtctcga

SEQ ID NO: 695989 - DNA, 20 bp, mouse
gcaggggcggatcttttcca

SEQ ID NO: 695990 - DNA, 20 bp, mouse
gccgccctcgagactcaaat

SEQ ID NO: 695991 - DNA, 20 bp, mouse
gtctggcagagcaactgtta

SEQ ID NO: 695992 - DNA, 20 bp, mouse
ggggaagccctctatgaagc

SEQ ID NO: 695993 - DNA, 20 bp, mouse
gcagggaactggttagttgt

SEQ ID NO: 695994 - DNA, 20 bp, mouse
ggcgtggctatcccggggca

SEQ ID NO: 695995 - DNA, 20 bp, mouse
ggatgagctacccagggaac

SEQ ID NO: 695996 - DNA, 20 bp, mouse
gcccatcattctgagcaaca

SEQ ID NO: 695997 - DNA, 20 bp, mouse
gactcccaagacacgttcac

SEQ ID NO: 695998 - DNA, 20 bp, mouse
gtccctgttgctcagaatga

SEQ ID NO: 695999 - DNA, 20 bp, mouse
gttgaagtggagagaggacg

SEQ ID NO: 696000 - DNA, 20 bp, mouse
gcttgagaggtttgatgtat

SEQ ID NO: 696001 - DNA, 20 bp, mouse
ggatgatggggtgtttgaag

SEQ ID NO: 696002 - DNA, 20 bp, mouse
gaatctgaagatcctggaac

SEQ ID NO: 696003 - DNA, 20 bp, mouse
gggtgcctctagcctgttcc

SEQ ID NO: 696004 - DNA, 20 bp, mouse
gtctttgcccaggtggatcc

SEQ ID NO: 696005 - DNA, 20 bp, mouse
ggttcctcacaaataacagt

SEQ ID NO: 696006 - DNA, 20 bp, mouse
ggggccggtccgcgcccgta

SEQ ID NO: 696007 - DNA, 20 bp, mouse
gcacatggaccaatcatcct

SEQ ID NO: 696008 - DNA, 20 bp, mouse
ggaagagccccgccatggat

SEQ ID NO: 696009 - DNA, 20 bp, mouse
gaaacagaagagccccgcca

SEQ ID NO: 696010 - DNA, 20 bp, mouse
gctctactggaaggtccaat

SEQ ID NO: 696011 - DNA, 20 bp, mouse
gcccctcaaccaatccatgg

SEQ ID NO: 696012 - DNA, 20 bp, mouse
gcccgccatggattggttga

SEQ ID NO: 696013 - DNA, 20 bp, mouse
gaattggcctacagagtccc

SEQ ID NO: 696014 - DNA, 20 bp, mouse
gcggggctcttctgtttccg

SEQ ID NO: 696015 - DNA, 20 bp, mouse
gggtgggggtcttgacttga

SEQ ID NO: 696016 - DNA, 20 bp, mouse
gtggtgcaagataactgcac

SEQ ID NO: 696017 - DNA, 20 bp, mouse
ggcagagtgttacatctttt

SEQ ID NO: 696018 - DNA, 20 bp, mouse
gtaaaaaggctgcgagccgg

SEQ ID NO: 696019 - DNA, 20 bp, mouse
ggggcgcccggcacaggaaa

SEQ ID NO: 696020 - DNA, 20 bp, mouse
gagccgggggactgggtttc

SEQ ID NO: 696021 - DNA, 20 bp, mouse
gtgtgaccgttcatccagaa

SEQ ID NO: 696022 - DNA, 20 bp, mouse
gagaacaagcgctctaaatg

SEQ ID NO: 696023 - DNA, 20 bp, mouse
gctggatgaacggtcacaga

SEQ ID NO: 696024 - DNA, 20 bp, mouse
ggtgttacatcttttgggat

SEQ ID NO: 696025 - DNA, 20 bp, mouse
gctactgtaagtgtgctgtt

SEQ ID NO: 696026 - DNA, 20 bp, mouse
gaggcccgcccccgaggggt

SEQ ID NO: 696027 - DNA, 20 bp, mouse
gggtgcggagggaacgcttg

SEQ ID NO: 696028 - DNA, 20 bp, mouse
ggtcgggcggcggaggaaac

SEQ ID NO: 696029 - DNA, 20 bp, mouse
gcccccgaggggtcgggcgg

SEQ ID NO: 696030 - DNA, 20 bp, mouse
gaaagaggcccgcccccgag

SEQ ID NO: 696031 - DNA, 20 bp, mouse
ggccccctggtcctgaagtc

SEQ ID NO: 696032 - DNA, 20 bp, mouse
gggcggctgcatcacctcgt

SEQ ID NO: 696033 - DNA, 20 bp, mouse
gtcccaggggctccctccag

SEQ ID NO: 696034 - DNA, 20 bp, mouse
gacgctacaccaatgagcgg

SEQ ID NO: 696035 - DNA, 20 bp, mouse
gggaggaaaccggccgtggc

SEQ ID NO: 696036 - DNA, 20 bp, mouse
gtccaatcgtagcttctctt

SEQ ID NO: 696037 - DNA, 20 bp, mouse
ggacacgacagcacagtccg

SEQ ID NO: 696038 - DNA, 20 bp, mouse
gcacccgggtcgcgcccctt

SEQ ID NO: 696039 - DNA, 20 bp, mouse
gacgggaagccccgcccgaa

SEQ ID NO: 696040 - DNA, 20 bp, mouse
gagccccgcccgaaggggcg

SEQ ID NO: 696041 - DNA, 20 bp, mouse
gccccaagagaagctacgat

SEQ ID NO: 696042 - DNA, 20 bp, mouse
gctgtccaggcgtgcagatg

SEQ ID NO: 696043 - DNA, 20 bp, mouse
ggaagctacgattggaccca

SEQ ID NO: 696044 - DNA, 20 bp, mouse
gtggccacgccccttcgggc

SEQ ID NO: 696045 - DNA, 20 bp, mouse
gcggctccacccagccgaag

SEQ ID NO: 696046 - DNA, 20 bp, mouse
gcgggagtgaacaatctccc

SEQ ID NO: 696047 - DNA, 20 bp, mouse
gcccctgaatgctcagagat

SEQ ID NO: 696048 - DNA, 20 bp, mouse
gtgggccctgctgatcacgt

SEQ ID NO: 696049 - DNA, 20 bp, mouse
gaagcagggcgcggccatct

SEQ ID NO: 696050 - DNA, 20 bp, mouse
gggccccgccctcgccaaga

SEQ ID NO: 696051 - DNA, 20 bp, mouse
gaccgccccacgtgacccgt

SEQ ID NO: 696052 - DNA, 20 bp, mouse
gcgaactcatactcaaaagc

SEQ ID NO: 696053 - DNA, 20 bp, mouse
gcggccatcttggcgagggc

SEQ ID NO: 696054 - DNA, 20 bp, mouse
ggggcggtgcgcgctcagtg

SEQ ID NO: 696055 - DNA, 20 bp, mouse
ggtagcctacgggtcacgtg

SEQ ID NO: 696056 - DNA, 20 bp, mouse
gcagccgggcgggttcgggg

SEQ ID NO: 696057 - DNA, 20 bp, mouse
ggagaaggcggagcgctact

SEQ ID NO: 696058 - DNA, 20 bp, mouse
gaggccgcggcctccgaggc

SEQ ID NO: 696059 - DNA, 20 bp, mouse
gccggctgcggccccctaaa

SEQ ID NO: 696060 - DNA, 20 bp, mouse
ggaggcgcctgggcccgtgc

SEQ ID NO: 696061 - DNA, 20 bp, mouse
ggggcccgcagccgcgagcg

SEQ ID NO: 696062 - DNA, 20 bp, mouse
gggcttgtcgggccctttag

SEQ ID NO: 696063 - DNA, 20 bp, mouse
ggcgcggcctgcacgggccc

SEQ ID NO: 696064 - DNA, 20 bp, mouse
ggcggggcggcgctgacgtc

SEQ ID NO: 696065 - DNA, 20 bp, mouse
ggctggctccgccccgctcg

SEQ ID NO: 696066 - DNA, 20 bp, mouse
gctagagcgggaggcgaagt

SEQ ID NO: 696067 - DNA, 20 bp, mouse
gaaaggacgaagagacgaaa

SEQ ID NO: 696068 - DNA, 20 bp, mouse
gagtacgcaagcgctagagc

SEQ ID NO: 696069 - DNA, 20 bp, mouse
gtcccagtccggctatccag

SEQ ID NO: 696070 - DNA, 20 bp, mouse
gggcgtcctaggctattccc

SEQ ID NO: 696071 - DNA, 20 bp, mouse
gacgcaagcgctagagcggg

SEQ ID NO: 696072 - DNA, 20 bp, mouse
gagcaaccggggaatagcct

SEQ ID NO: 696073 - DNA, 20 bp, mouse
gagactgtgggtctgaaatc

SEQ ID NO: 696074 - DNA, 20 bp, mouse
gaggcacccagtgctagtgc

SEQ ID NO: 696075 - DNA, 20 bp, mouse
gtgagcacgccgtagactgt

SEQ ID NO: 696076 - DNA, 20 bp, mouse
gaggggcgagggaacgtggg

SEQ ID NO: 696077 - DNA, 20 bp, mouse
ggggaggggcgagggaacgt

SEQ ID NO: 696078 - DNA, 20 bp, mouse
gtccacccgcacccagtctg

SEQ ID NO: 696079 - DNA, 20 bp, mouse
gcggaggggaacgggaaaag

SEQ ID NO: 696080 - DNA, 20 bp, mouse
ggcaacatggctcccggagg

SEQ ID NO: 696081 - DNA, 20 bp, mouse
gaagagcagcggaggggaac

SEQ ID NO: 696082 - DNA, 20 bp, mouse
ggagaccacagactgggtgc

SEQ ID NO: 696083 - DNA, 20 bp, mouse
gaatggagatgatgcatcat

SEQ ID NO: 696084 - DNA, 20 bp, mouse
gaccacagactgggtgcggg

SEQ ID NO: 696085 - DNA, 20 bp, mouse
gcggggggtaggggcgaggg

SEQ ID NO: 696086 - DNA, 20 bp, mouse
gctcgcgggaaggcaggtta

SEQ ID NO: 696087 - DNA, 20 bp, mouse
gtcactgggcgcgggctcgc

SEQ ID NO: 696088 - DNA, 20 bp, mouse
ggcgggaaggcaggttacgg

SEQ ID NO: 696089 - DNA, 20 bp, mouse
gcgcgcccagtgactatttg

SEQ ID NO: 696090 - DNA, 20 bp, mouse
ggcagggggcgagcagtggt

SEQ ID NO: 696091 - DNA, 20 bp, mouse
gttcccagagggaagtctga

SEQ ID NO: 696092 - DNA, 20 bp, mouse
gccagagggaagtctgaagg

SEQ ID NO: 696093 - DNA, 20 bp, mouse
gtgggcgcgggctcgcggga

SEQ ID NO: 696094 - DNA, 20 bp, mouse
gcaggcgtgccccttcgcgc

SEQ ID NO: 696095 - DNA, 20 bp, mouse
gtcacctagctgggtagcag

SEQ ID NO: 696096 - DNA, 20 bp, mouse
gagggtgacaggatgaaaaa

SEQ ID NO: 696097 - DNA, 20 bp, mouse
gtggaagcacaggagaagaa

SEQ ID NO: 696098 - DNA, 20 bp, mouse
gaggatatagagctggtgtt

SEQ ID NO: 696099 - DNA, 20 bp, mouse
ggggaccggggcccagagca

SEQ ID NO: 696100 - DNA, 20 bp, mouse
gatggaggaaagacaaaggt

SEQ ID NO: 696101 - DNA, 20 bp, mouse
gctggtgttgggagggtgac

SEQ ID NO: 696102 - DNA, 20 bp, mouse
ggacaggatgaaaaagggga

SEQ ID NO: 696103 - DNA, 20 bp, mouse
ggggcccctcagcgcaggga

SEQ ID NO: 696104 - DNA, 20 bp, mouse
gtatagagctggtgttggga

SEQ ID NO: 696105 - DNA, 20 bp, mouse
ggtcagggtgaaggggcaca

SEQ ID NO: 696106 - DNA, 20 bp, mouse
gccaacaagaagtaaatacc

SEQ ID NO: 696107 - DNA, 20 bp, mouse
gtggagcagtacatgcttaa

SEQ ID NO: 696108 - DNA, 20 bp, mouse
gaaaactaggtatacactga

SEQ ID NO: 696109 - DNA, 20 bp, mouse
gaagaggaatgggctatttg

SEQ ID NO: 696110 - DNA, 20 bp, mouse
gctggtcacaactatctgta

SEQ ID NO: 696111 - DNA, 20 bp, mouse
ggtatgaataaaataggacg

SEQ ID NO: 696112 - DNA, 20 bp, mouse
gaatcagctctctatttgct

SEQ ID NO: 696113 - DNA, 20 bp, mouse
gtgattatgacacttctggg

SEQ ID NO: 696114 - DNA, 20 bp, mouse
gcagagatatctgttccctc

SEQ ID NO: 696115 - DNA, 20 bp, mouse
gaggttgaagtgttacttta

SEQ ID NO: 696116 - DNA, 20 bp, mouse
gcatgagcgaggagtgcagt

SEQ ID NO: 696117 - DNA, 20 bp, mouse
gcgagcgcgagcgtgagtgc

SEQ ID NO: 696118 - DNA, 20 bp, mouse
gaccaggcgaggatccgagc

SEQ ID NO: 696119 - DNA, 20 bp, mouse
gaggatccgagcgggtgcac

SEQ ID NO: 696120 - DNA, 20 bp, mouse
gagcgctggcatgcaccagg

SEQ ID NO: 696121 - DNA, 20 bp, mouse
gttactgtggacccagggga

SEQ ID NO: 696122 - DNA, 20 bp, mouse
gagcaaagctgccctcccct

SEQ ID NO: 696123 - DNA, 20 bp, mouse
ggtgagtgcgggaggtgccg

SEQ ID NO: 696124 - DNA, 20 bp, mouse
gcccgcgcagcgccgagcgg

SEQ ID NO: 696125 - DNA, 20 bp, mouse
gactatagaacgcacagcgc

SEQ ID NO: 696126 - DNA, 20 bp, mouse
ggagacccacgcccagtggg

SEQ ID NO: 696127 - DNA, 20 bp, mouse
gatcggccgaaaggaacagg

SEQ ID NO: 696128 - DNA, 20 bp, mouse
gagaaccacccactgggcgt

SEQ ID NO: 696129 - DNA, 20 bp, mouse
ggctgagacccacgcccagt

SEQ ID NO: 696130 - DNA, 20 bp, mouse
gaatgtaagaaccacccact

SEQ ID NO: 696131 - DNA, 20 bp, mouse
ggaggaaatgatcggccgaa

SEQ ID NO: 696132 - DNA, 20 bp, mouse
gtgactagacatccatttgg

SEQ ID NO: 696133 - DNA, 20 bp, mouse
gactcaatagaggaaatgat

SEQ ID NO: 696134 - DNA, 20 bp, mouse
gcccattgtggtccaccaaa

SEQ ID NO: 696135 - DNA, 20 bp, mouse
gatgatcggccgaaaggaac

SEQ ID NO: 696136 - DNA, 20 bp, mouse
ggggggggggcgatttgagt

SEQ ID NO: 696137 - DNA, 20 bp, mouse
ggtggtccgggaacgcccag

SEQ ID NO: 696138 - DNA, 20 bp, mouse
gtgggcgtggtctgcgcgat

SEQ ID NO: 696139 - DNA, 20 bp, mouse
gagcctatcactgaccccca

SEQ ID NO: 696140 - DNA, 20 bp, mouse
gaatctgaaactattgatgg

SEQ ID NO: 696141 - DNA, 20 bp, mouse
gcgtctcccctgggcgttcc

SEQ ID NO: 696142 - DNA, 20 bp, mouse
gttgttctgggcccaccctg

SEQ ID NO: 696143 - DNA, 20 bp, mouse
gtgcgcgatgggcgtggtcc

SEQ ID NO: 696144 - DNA, 20 bp, mouse
gacagtcaatcgtctcccct

SEQ ID NO: 696145 - DNA, 20 bp, mouse
gaaccaccaccgtcccacac

SEQ ID NO: 696146 - DNA, 20 bp, mouse
gccgctgcaaggttcttgct

SEQ ID NO: 696147 - DNA, 20 bp, mouse
gtgcagctggagtctgcttg

SEQ ID NO: 696148 - DNA, 20 bp, mouse
gccgcctaaagattccgtcc

SEQ ID NO: 696149 - DNA, 20 bp, mouse
gggggagatggtaaacgttc

SEQ ID NO: 696150 - DNA, 20 bp, mouse
gcggggtgacaggtaggcgg

SEQ ID NO: 696151 - DNA, 20 bp, mouse
gtaggcggagcaccgagagg

SEQ ID NO: 696152 - DNA, 20 bp, mouse
gtcctggagcaagacaaaca

SEQ ID NO: 696153 - DNA, 20 bp, mouse
gctgcggggtgacaggtagg

SEQ ID NO: 696154 - DNA, 20 bp, mouse
gggtggcggtaggaagcctg

SEQ ID NO: 696155 - DNA, 20 bp, mouse
ggcgctccctagctagatcc

SEQ ID NO: 696156 - DNA, 20 bp, mouse
gagcccagacccatcgtgga

SEQ ID NO: 696157 - DNA, 20 bp, mouse
gtcgctgcgctggaaccccg

SEQ ID NO: 696158 - DNA, 20 bp, mouse
ggcgccctcggaagatgtgt

SEQ ID NO: 696159 - DNA, 20 bp, mouse
gggttccagcgcagcgaggg

SEQ ID NO: 696160 - DNA, 20 bp, mouse
ggatgtgtgggctggcccgg

SEQ ID NO: 696161 - DNA, 20 bp, mouse
gtcctccaggcccgcgccct

SEQ ID NO: 696162 - DNA, 20 bp, mouse
gctctccactccctccacga

SEQ ID NO: 696163 - DNA, 20 bp, mouse
gctccctccacgatgggtct

SEQ ID NO: 696164 - DNA, 20 bp, mouse
gcggaggtggggatgcggat

SEQ ID NO: 696165 - DNA, 20 bp, mouse
ggttcctaggacagcccccg

SEQ ID NO: 696166 - DNA, 20 bp, mouse
gacgcggtggggatctcggt

SEQ ID NO: 696167 - DNA, 20 bp, mouse
gaaaatggacaagtatgggg

SEQ ID NO: 696168 - DNA, 20 bp, mouse
ggtagtccctacattgtcct

SEQ ID NO: 696169 - DNA, 20 bp, mouse
gaggggacctccagacagcg

SEQ ID NO: 696170 - DNA, 20 bp, mouse
ggaggggagaggagacgctt

SEQ ID NO: 696171 - DNA, 20 bp, mouse
gtcagatagcagcgaagaaa

SEQ ID NO: 696172 - DNA, 20 bp, mouse
gacaatagataggggtagac

SEQ ID NO: 696173 - DNA, 20 bp, mouse
gagaaaacggagagcccttg

SEQ ID NO: 696174 - DNA, 20 bp, mouse
gcaccaagcaggtccgtccc

SEQ ID NO: 696175 - DNA, 20 bp, mouse
gcagctgtgggcgagactgg

SEQ ID NO: 696176 - DNA, 20 bp, mouse
gacagccccaggggagaccc

SEQ ID NO: 696177 - DNA, 20 bp, mouse
gacgccctggcacagatgga

SEQ ID NO: 696178 - DNA, 20 bp, mouse
gggtagtggggacagcccca

SEQ ID NO: 696179 - DNA, 20 bp, mouse
gtggtccagcctgtcccttg

SEQ ID NO: 696180 - DNA, 20 bp, mouse
gcacccatccatctgtgcca

SEQ ID NO: 696181 - DNA, 20 bp, mouse
gcaggctggaccaagactgg

SEQ ID NO: 696182 - DNA, 20 bp, mouse
gaagcaggctacatggggat

SEQ ID NO: 696183 - DNA, 20 bp, mouse
gtaaggaagcaggctacatg

SEQ ID NO: 696184 - DNA, 20 bp, mouse
gcctcctggcctcaagggac

SEQ ID NO: 696185 - DNA, 20 bp, mouse
gggacaggctggaccaagac

SEQ ID NO: 696186 - DNA, 20 bp, mouse
gacccgcaggggctcctcca

SEQ ID NO: 696187 - DNA, 20 bp, mouse
gcctgaaagagcacggtgta

SEQ ID NO: 696188 - DNA, 20 bp, mouse
ggtgtagggtgtcctgtcat

SEQ ID NO: 696189 - DNA, 20 bp, mouse
gggaagagcgcgaagctcac

SEQ ID NO: 696190 - DNA, 20 bp, mouse
gacagaccggtctggaagtc

SEQ ID NO: 696191 - DNA, 20 bp, mouse
gagcccggaaggggtgcacg

SEQ ID NO: 696192 - DNA, 20 bp, mouse
ggcaagagaagtagcccttc

SEQ ID NO: 696193 - DNA, 20 bp, mouse
gtaagtcacaatccgatgac

SEQ ID NO: 696194 - DNA, 20 bp, mouse
gcggattgtgacttacagac

SEQ ID NO: 696195 - DNA, 20 bp, mouse
ggaatgaacagaggcctgaa

SEQ ID NO: 696196 - DNA, 20 bp, mouse
ggggacctcgccaagttctc

SEQ ID NO: 696197 - DNA, 20 bp, mouse
gtctctggcttgtggggctg

SEQ ID NO: 696198 - DNA, 20 bp, mouse
gccccacaagccagagaact

SEQ ID NO: 696199 - DNA, 20 bp, mouse
gtgaggaagtgggagtgcca

SEQ ID NO: 696200 - DNA, 20 bp, mouse
gtccctgggcctcagccagt

SEQ ID NO: 696201 - DNA, 20 bp, mouse
gtcttccctgactacaggag

SEQ ID NO: 696202 - DNA, 20 bp, mouse
gcaagccagagaacttggcg

SEQ ID NO: 696203 - DNA, 20 bp, mouse
gactaggcataagttccaag

SEQ ID NO: 696204 - DNA, 20 bp, mouse
ggacgtctgctccagctaaa

SEQ ID NO: 696205 - DNA, 20 bp, mouse
gcacactcttccctgactac

SEQ ID NO: 696206 - DNA, 20 bp, mouse
gtgtcagtatcgctccgcag

SEQ ID NO: 696207 - DNA, 20 bp, mouse
gtgccccgcctgctctgggt

SEQ ID NO: 696208 - DNA, 20 bp, mouse
gggccccgcgcttacgtcac

SEQ ID NO: 696209 - DNA, 20 bp, mouse
gtggggaattgcttttctgg

SEQ ID NO: 696210 - DNA, 20 bp, mouse
gtcatttagggcttctacaa

SEQ ID NO: 696211 - DNA, 20 bp, mouse
ggtccccaaaattttctgac

SEQ ID NO: 696212 - DNA, 20 bp, mouse
gcactgagtggctgtgacgt

SEQ ID NO: 696213 - DNA, 20 bp, mouse
gctcagagctcggatcaatc

SEQ ID NO: 696214 - DNA, 20 bp, mouse
gagggccggtgacgtaagcg

SEQ ID NO: 696215 - DNA, 20 bp, mouse
gtgcccacccagagcaggcg

SEQ ID NO: 696216 - DNA, 20 bp, mouse
ggcgaggagctcaggggcgg

SEQ ID NO: 696217 - DNA, 20 bp, mouse
gggagcgcggtgcccggtcg

SEQ ID NO: 696218 - DNA, 20 bp, mouse
ggagggggctgctcggggat

SEQ ID NO: 696219 - DNA, 20 bp, mouse
ggggccctggcttcctgacc

SEQ ID NO: 696220 - DNA, 20 bp, mouse
ggccggggagggggctgctc

SEQ ID NO: 696221 - DNA, 20 bp, mouse
gcggggatggcgaggagctc

SEQ ID NO: 696222 - DNA, 20 bp, mouse
gggttgcgaaggacaggcgg

SEQ ID NO: 696223 - DNA, 20 bp, mouse
gtgagggctgcggggtgaga

SEQ ID NO: 696224 - DNA, 20 bp, mouse
gaaggacaggcggagggacg

SEQ ID NO: 696225 - DNA, 20 bp, mouse
gcatctgggacgcacgaatc

SEQ ID NO: 696226 - DNA, 20 bp, mouse
gttctggagctcaaggtcag

SEQ ID NO: 696227 - DNA, 20 bp, mouse
ggagctcaaggtcaggggaa

SEQ ID NO: 696228 - DNA, 20 bp, mouse
gaaggtcaggggaaagggct

SEQ ID NO: 696229 - DNA, 20 bp, mouse
gaggtacactggcacagagg

SEQ ID NO: 696230 - DNA, 20 bp, mouse
gagggatcaaagtacacttg

SEQ ID NO: 696231 - DNA, 20 bp, mouse
gccaaggccgggcgacaccg

SEQ ID NO: 696232 - DNA, 20 bp, mouse
gcattgtgcacagtgggatg

SEQ ID NO: 696233 - DNA, 20 bp, mouse
gtacacttggggtggcgggt

SEQ ID NO: 696234 - DNA, 20 bp, mouse
gctgagtagcgcctgctttc

SEQ ID NO: 696235 - DNA, 20 bp, mouse
gaggccgggcgacaccgcgg

SEQ ID NO: 696236 - DNA, 20 bp, mouse
gggcacttccaccacttgga

SEQ ID NO: 696237 - DNA, 20 bp, mouse
gtcacccctaaggagttggg

SEQ ID NO: 696238 - DNA, 20 bp, mouse
ggaaagaatcactggtcata

SEQ ID NO: 696239 - DNA, 20 bp, mouse
gtccaaggggaggactcatt

SEQ ID NO: 696240 - DNA, 20 bp, mouse
gttagggtggggtctgaagg

SEQ ID NO: 696241 - DNA, 20 bp, mouse
gtaaatagaaacctgcagag

SEQ ID NO: 696242 - DNA, 20 bp, mouse
gttaggggtgaaagaatcac

SEQ ID NO: 696243 - DNA, 20 bp, mouse
gaggcctcccaggctccaag

SEQ ID NO: 696244 - DNA, 20 bp, mouse
gagtcctccccttggagcct

SEQ ID NO: 696245 - DNA, 20 bp, mouse
gctccgccccgccttccaag

SEQ ID NO: 696246 - DNA, 20 bp, mouse
gaggaggcgggcgcccgatc

SEQ ID NO: 696247 - DNA, 20 bp, mouse
gtcgggcgcccgcctcctca

SEQ ID NO: 696248 - DNA, 20 bp, mouse
gggcgtgcacggaccggatc

SEQ ID NO: 696249 - DNA, 20 bp, mouse
gcggctagggcacgctctgc

SEQ ID NO: 696250 - DNA, 20 bp, mouse
gggtgtccttagagaaaggg

SEQ ID NO: 696251 - DNA, 20 bp, mouse
gtgtgcagatacatccgggg

SEQ ID NO: 696252 - DNA, 20 bp, mouse
gagcaaagtggaggcgtgca

SEQ ID NO: 696253 - DNA, 20 bp, mouse
gacgtgcagaatggtgcagt

SEQ ID NO: 696254 - DNA, 20 bp, mouse
gtctcctagccctgcacccg

SEQ ID NO: 696255 - DNA, 20 bp, mouse
ggaagctaaccctgggctac

SEQ ID NO: 696256 - DNA, 20 bp, mouse
ggaatggttaagtgggtcac

SEQ ID NO: 696257 - DNA, 20 bp, mouse
gagtgggtcctgctcaggaa

SEQ ID NO: 696258 - DNA, 20 bp, mouse
ggtggcgcatacggtctccc

SEQ ID NO: 696259 - DNA, 20 bp, mouse
gcggcgctagcgaccgcctg

SEQ ID NO: 696260 - DNA, 20 bp, mouse
gtgctcaggaatggttaagt

SEQ ID NO: 696261 - DNA, 20 bp, mouse
gtctgggcggggcatagagg

SEQ ID NO: 696262 - DNA, 20 bp, mouse
gaatcggtaactcagttcct

SEQ ID NO: 696263 - DNA, 20 bp, mouse
ggaatcctgctgcagctcct

SEQ ID NO: 696264 - DNA, 20 bp, mouse
gacacgcactgcacacctgt

SEQ ID NO: 696265 - DNA, 20 bp, mouse
gctgtcctccgcaccaccag

SEQ ID NO: 696266 - DNA, 20 bp, mouse
ggtgctggaggggtgatccg

SEQ ID NO: 696267 - DNA, 20 bp, mouse
gcctggaagcacaccttcgt

SEQ ID NO: 696268 - DNA, 20 bp, mouse
gcacgcgcgggcgtcccatc

SEQ ID NO: 696269 - DNA, 20 bp, mouse
gtgatccggggcgggcgttg

SEQ ID NO: 696270 - DNA, 20 bp, mouse
gaggggactggaggcgaaga

SEQ ID NO: 696271 - DNA, 20 bp, mouse
gcagccgccctgtaaacacc

SEQ ID NO: 696272 - DNA, 20 bp, mouse
gcgtgatcctgcacccacga

SEQ ID NO: 696273 - DNA, 20 bp, mouse
gaacaccgggagaagacctc

SEQ ID NO: 696274 - DNA, 20 bp, mouse
ggcagcctcaacgcccgccc

SEQ ID NO: 696275 - DNA, 20 bp, mouse
gtggaggggtgatccggggc

SEQ ID NO: 696276 - DNA, 20 bp, mouse
gtggggcaatcaggctgtga

SEQ ID NO: 696277 - DNA, 20 bp, mouse
gacgttgtcatggggcaatc

SEQ ID NO: 696278 - DNA, 20 bp, mouse
gcaacttccccgtgactcaa

SEQ ID NO: 696279 - DNA, 20 bp, mouse
gagtggccggggaacatggc

SEQ ID NO: 696280 - DNA, 20 bp, mouse
gctgtgagaaggtgtcacca

SEQ ID NO: 696281 - DNA, 20 bp, mouse
gcacccccattgcttcactg

SEQ ID NO: 696282 - DNA, 20 bp, mouse
gaggtggagtagccacggac

SEQ ID NO: 696283 - DNA, 20 bp, mouse
gtagaaaagtctcacccaaa

SEQ ID NO: 696284 - DNA, 20 bp, mouse
gggccacagtgaagcaatgg

SEQ ID NO: 696285 - DNA, 20 bp, mouse
gagcacccggccatgttccc

SEQ ID NO: 696286 - DNA, 20 bp, mouse
gcgcgcatgcgcagacgctc

SEQ ID NO: 696287 - DNA, 20 bp, mouse
gccggtgcgcattcatcaga

SEQ ID NO: 696288 - DNA, 20 bp, mouse
gtggagcggagaacgattag

SEQ ID NO: 696289 - DNA, 20 bp, mouse
gcacgactgaagcccgatga

SEQ ID NO: 696290 - DNA, 20 bp, mouse
gcatgcgcgcgtgggcgttc

SEQ ID NO: 696291 - DNA, 20 bp, mouse
ggcgctcgccggcaagacgc

SEQ ID NO: 696292 - DNA, 20 bp, mouse
gcagaagcacgatttggctg

SEQ ID NO: 696293 - DNA, 20 bp, mouse
gagcggagaacgattagggg

SEQ ID NO: 696294 - DNA, 20 bp, mouse
gaggggtggagcgcattgtc

SEQ ID NO: 696295 - DNA, 20 bp, mouse
ggactgaagcccgatgaagg

SEQ ID NO: 696296 - DNA, 20 bp, mouse
gaaggcgggacgttgcggga

SEQ ID NO: 696297 - DNA, 20 bp, mouse
gcaacgtcccgccttctctg

SEQ ID NO: 696298 - DNA, 20 bp, mouse
gtctcgcgggaactcgggag

SEQ ID NO: 696299 - DNA, 20 bp, mouse
gaactcgggaggggcgagcc

SEQ ID NO: 696300 - DNA, 20 bp, mouse
gcgggacttggagcccaagg

SEQ ID NO: 696301 - DNA, 20 bp, mouse
gcggcagctgagtctcctgg

SEQ ID NO: 696302 - DNA, 20 bp, mouse
gtcctcgcctcagagaaggc

SEQ ID NO: 696303 - DNA, 20 bp, mouse
ggggggatagtgtgaaccac

SEQ ID NO: 696304 - DNA, 20 bp, mouse
gaaaagcgcgagcccagccg

SEQ ID NO: 696305 - DNA, 20 bp, mouse
gcgggtcctcgcctcagaga

SEQ ID NO: 696306 - DNA, 20 bp, mouse
ggcctcgggcaccttagctc

SEQ ID NO: 696307 - DNA, 20 bp, mouse
gggaaggagagcaagggcgc

SEQ ID NO: 696308 - DNA, 20 bp, mouse
gccagccacggcccaagtag

SEQ ID NO: 696309 - DNA, 20 bp, mouse
gcgaggcaaggttgtgaatg

SEQ ID NO: 696310 - DNA, 20 bp, mouse
gtgccgccgtggtgctgatg

SEQ ID NO: 696311 - DNA, 20 bp, mouse
gccagtcttctcctaggcgg

SEQ ID NO: 696312 - DNA, 20 bp, mouse
gagcccgcccggcctgtgga

SEQ ID NO: 696313 - DNA, 20 bp, mouse
ggggcagctgttgcaccaag

SEQ ID NO: 696314 - DNA, 20 bp, mouse
gagactgggagcctctactt

SEQ ID NO: 696315 - DNA, 20 bp, mouse
gctcccagtcttctcctagg

SEQ ID NO: 696316 - DNA, 20 bp, mouse
ggggcgggactcactagcta

SEQ ID NO: 696317 - DNA, 20 bp, mouse
gggaacgggaacgcttactg

SEQ ID NO: 696318 - DNA, 20 bp, mouse
ggacaagggcgcaatggcca

SEQ ID NO: 696319 - DNA, 20 bp, mouse
gaggtactcggaagactgtg

SEQ ID NO: 696320 - DNA, 20 bp, mouse
gtgtgcggtgactcggtggg

SEQ ID NO: 696321 - DNA, 20 bp, mouse
gagggcggggcgaagccgga

SEQ ID NO: 696322 - DNA, 20 bp, mouse
gggactcactagctaggggc

SEQ ID NO: 696323 - DNA, 20 bp, mouse
gaggggcggggcgcagccga

SEQ ID NO: 696324 - DNA, 20 bp, mouse
gccagggggcgatgaggatg

SEQ ID NO: 696325 - DNA, 20 bp, mouse
ggaacgcttactgaggacaa

SEQ ID NO: 696326 - DNA, 20 bp, mouse
gcgtgtgttcagggaggcaa

SEQ ID NO: 696327 - DNA, 20 bp, mouse
gtatgtatgaaccattcctg

SEQ ID NO: 696328 - DNA, 20 bp, mouse
gagagcatgggtttcttttg

SEQ ID NO: 696329 - DNA, 20 bp, mouse
ggtgggtgggtgtgtacaat

SEQ ID NO: 696330 - DNA, 20 bp, mouse
gtgcatgcgtgtgttcaggg

SEQ ID NO: 696331 - DNA, 20 bp, mouse
gttaagtaaaaacagagcat

SEQ ID NO: 696332 - DNA, 20 bp, mouse
gatatcctaaaacaacccac

SEQ ID NO: 696333 - DNA, 20 bp, mouse
gcattcacatcgggcagctc

SEQ ID NO: 696334 - DNA, 20 bp, mouse
gaggctgttaggtgaggttg

SEQ ID NO: 696335 - DNA, 20 bp, mouse
gggtgaggttgtggcaagag

SEQ ID NO: 696336 - DNA, 20 bp, mouse
gcggagcagtggagtgtgaa

SEQ ID NO: 696337 - DNA, 20 bp, mouse
gccaatcagaggcggagcag

SEQ ID NO: 696338 - DNA, 20 bp, mouse
gacccagagccaatcagagg

SEQ ID NO: 696339 - DNA, 20 bp, mouse
ggctctgctcgctgcttagt

SEQ ID NO: 696340 - DNA, 20 bp, mouse
gtgggctcctctgcagttat

SEQ ID NO: 696341 - DNA, 20 bp, mouse
gtggggaagaaactgtgggt

SEQ ID NO: 696342 - DNA, 20 bp, mouse
gctggaacaaaaggtcaaag

SEQ ID NO: 696343 - DNA, 20 bp, mouse
ggtggactgcagtgtaaatg

SEQ ID NO: 696344 - DNA, 20 bp, mouse
gacagactgacagacttgtc

SEQ ID NO: 696345 - DNA, 20 bp, mouse
ggagcaaccaataactgcag

SEQ ID NO: 696346 - DNA, 20 bp, mouse
ggacctccgcacccacaagt

SEQ ID NO: 696347 - DNA, 20 bp, mouse
gctccggcccgcccacttgt

SEQ ID NO: 696348 - DNA, 20 bp, mouse
gaacgggggaggattcggga

SEQ ID NO: 696349 - DNA, 20 bp, mouse
gattcggcgctggactgcgg

SEQ ID NO: 696350 - DNA, 20 bp, mouse
gggcgatctgggtcagatga

SEQ ID NO: 696351 - DNA, 20 bp, mouse
ggggatgaaggggaagactt

SEQ ID NO: 696352 - DNA, 20 bp, mouse
gccgggagcgagcggaggga

SEQ ID NO: 696353 - DNA, 20 bp, mouse
ggggtgcggaggtcctgtgc

SEQ ID NO: 696354 - DNA, 20 bp, mouse
ggcagtccagcgccgaatcc

SEQ ID NO: 696355 - DNA, 20 bp, mouse
gcgcccacttgtgggtgcgg

SEQ ID NO: 696356 - DNA, 20 bp, mouse
gaagcatggagagatcgaga

SEQ ID NO: 696357 - DNA, 20 bp, mouse
gtggggaggtaacaagccat

SEQ ID NO: 696358 - DNA, 20 bp, mouse
ggtgtcctaggcatcagcga

SEQ ID NO: 696359 - DNA, 20 bp, mouse
gcatggagagatcgagaagg

SEQ ID NO: 696360 - DNA, 20 bp, mouse
gtgctccgcgcaaccctggt

SEQ ID NO: 696361 - DNA, 20 bp, mouse
ggggcattgtatccactggg

SEQ ID NO: 696362 - DNA, 20 bp, mouse
gagagcgcagacggacctgt

SEQ ID NO: 696363 - DNA, 20 bp, mouse
gcgaggctgcggggacgatg

SEQ ID NO: 696364 - DNA, 20 bp, mouse
gaaggtgcggggctgctgtg

SEQ ID NO: 696365 - DNA, 20 bp, mouse
gtagctcctagctgcctacc

SEQ ID NO: 696366 - DNA, 20 bp, mouse
gttagagaggactgtggggt

SEQ ID NO: 696367 - DNA, 20 bp, mouse
gggactgtggggttggctca

SEQ ID NO: 696368 - DNA, 20 bp, mouse
gcctctctggccaggacctc

SEQ ID NO: 696369 - DNA, 20 bp, mouse
ggctgcagtgggcagaatcg

SEQ ID NO: 696370 - DNA, 20 bp, mouse
gagctaggctggaaatatca

SEQ ID NO: 696371 - DNA, 20 bp, mouse
ggggagaccaccaaatcctc

SEQ ID NO: 696372 - DNA, 20 bp, mouse
gggtcctggccagagagggc

SEQ ID NO: 696373 - DNA, 20 bp, mouse
gcagtggccagcttttccgg

SEQ ID NO: 696374 - DNA, 20 bp, mouse
gaagcagtggccagcttttc

SEQ ID NO: 696375 - DNA, 20 bp, mouse
ggatcagcaaagacgctctg

SEQ ID NO: 696376 - DNA, 20 bp, mouse
gtgggcagcctgaagctgta

SEQ ID NO: 696377 - DNA, 20 bp, mouse
gcaaggtcctagtagctcct

SEQ ID NO: 696378 - DNA, 20 bp, mouse
gttaaggcaagagtcaagga

SEQ ID NO: 696379 - DNA, 20 bp, mouse
gcctgaagctgtaaggatgg

SEQ ID NO: 696380 - DNA, 20 bp, mouse
ggcccctggggctgcacagg

SEQ ID NO: 696381 - DNA, 20 bp, mouse
ggagcaggaaggtgaattga

SEQ ID NO: 696382 - DNA, 20 bp, mouse
gaggctgcccaggagctact

SEQ ID NO: 696383 - DNA, 20 bp, mouse
gggagctggtgtttctattg

SEQ ID NO: 696384 - DNA, 20 bp, mouse
gagaacattctggaaccgat

SEQ ID NO: 696385 - DNA, 20 bp, mouse
gtctctgctaattggactcc

SEQ ID NO: 696386 - DNA, 20 bp, mouse
gtgaacgcctgcaagtcgtg

SEQ ID NO: 696387 - DNA, 20 bp, mouse
gcgcactagagactatactc

SEQ ID NO: 696388 - DNA, 20 bp, mouse
gtgggtcctcgcgttcgctt

SEQ ID NO: 696389 - DNA, 20 bp, mouse
gacccagcatgggccgggat

SEQ ID NO: 696390 - DNA, 20 bp, mouse
gaggtcggaagactatagag

SEQ ID NO: 696391 - DNA, 20 bp, mouse
gcagcaggacacttggtcag

SEQ ID NO: 696392 - DNA, 20 bp, mouse
gacttgcaggcgttcaggcg

SEQ ID NO: 696393 - DNA, 20 bp, mouse
gtaagcgacggggcgagacg

SEQ ID NO: 696394 - DNA, 20 bp, mouse
gcgaacgcgaggacccagca

SEQ ID NO: 696395 - DNA, 20 bp, mouse
gcacgagagagctattgaaa

SEQ ID NO: 696396 - DNA, 20 bp, mouse
gaagctgcgtgagctccgga

SEQ ID NO: 696397 - DNA, 20 bp, mouse
gacccagagacccacaatta

SEQ ID NO: 696398 - DNA, 20 bp, mouse
ggccccacatcctgaagccg

SEQ ID NO: 696399 - DNA, 20 bp, mouse
gtcctcggcttcaggatgtg

SEQ ID NO: 696400 - DNA, 20 bp, mouse
gccaagagaacccaggacga

SEQ ID NO: 696401 - DNA, 20 bp, mouse
gacccaggacgagggtatgt

SEQ ID NO: 696402 - DNA, 20 bp, mouse
gtccggggggatcttttcct

SEQ ID NO: 696403 - DNA, 20 bp, mouse
gcggagctcacgcagcttcc

SEQ ID NO: 696404 - DNA, 20 bp, mouse
gagctcacgcagcttccggg

SEQ ID NO: 696405 - DNA, 20 bp, mouse
gagacaggaccaagtcgcac

SEQ ID NO: 696406 - DNA, 20 bp, mouse
ggggtggagacgtgagggag

SEQ ID NO: 696407 - DNA, 20 bp, mouse
ggggacccgcctgacgtcgg

SEQ ID NO: 696408 - DNA, 20 bp, mouse
ggacgcgggtggagacgtga

SEQ ID NO: 696409 - DNA, 20 bp, mouse
gactgggcctggaggggaca

SEQ ID NO: 696410 - DNA, 20 bp, mouse
gactgaagactgggcctgga

SEQ ID NO: 696411 - DNA, 20 bp, mouse
ggaggggatgagagagcgag

SEQ ID NO: 696412 - DNA, 20 bp, mouse
ggacgtcaggcgggtccccc

SEQ ID NO: 696413 - DNA, 20 bp, mouse
gagagggggagaccagacgc

SEQ ID NO: 696414 - DNA, 20 bp, mouse
gtggggcgcggatattcgtc

SEQ ID NO: 696415 - DNA, 20 bp, mouse
ggggggagaccagacgcggg

SEQ ID NO: 696416 - DNA, 20 bp, mouse
gtgggaacgttgggaagcgg

SEQ ID NO: 696417 - DNA, 20 bp, mouse
gttgggaagcggtggaggat

SEQ ID NO: 696418 - DNA, 20 bp, mouse
gatccagcttggatgggaag

SEQ ID NO: 696419 - DNA, 20 bp, mouse
gcagcccgacccttggtgca

SEQ ID NO: 696420 - DNA, 20 bp, mouse
gacttgggaacgttgggaag

SEQ ID NO: 696421 - DNA, 20 bp, mouse
gctacccttgcaccaagggt

SEQ ID NO: 696422 - DNA, 20 bp, mouse
ggccacctcccaaatgaact

SEQ ID NO: 696423 - DNA, 20 bp, mouse
gggaagccctacgtcatgaa

SEQ ID NO: 696424 - DNA, 20 bp, mouse
gcctcctacccttgcaccaa

SEQ ID NO: 696425 - DNA, 20 bp, mouse
ggtagctgatagacagggct

SEQ ID NO: 696426 - DNA, 20 bp, mouse
gaagagaggaggtgggtcgc

SEQ ID NO: 696427 - DNA, 20 bp, mouse
ggaactgctaggcttggggc

SEQ ID NO: 696428 - DNA, 20 bp, mouse
gagtagctccacaccagaac

SEQ ID NO: 696429 - DNA, 20 bp, mouse
gtggggcagggagagaagcg

SEQ ID NO: 696430 - DNA, 20 bp, mouse
gcatgcgcactggaactgct

SEQ ID NO: 696431 - DNA, 20 bp, mouse
gtcgcggggagaggattgcg

SEQ ID NO: 696432 - DNA, 20 bp, mouse
gaactggaccactgcactat

SEQ ID NO: 696433 - DNA, 20 bp, mouse
gcactggaactgctaggctt

SEQ ID NO: 696434 - DNA, 20 bp, mouse
gaaaaggtgcgcatgcgcac

SEQ ID NO: 696435 - DNA, 20 bp, mouse
gctgacagcacaaacggaag

SEQ ID NO: 696436 - DNA, 20 bp, mouse
gtctcccactggaacttgga

SEQ ID NO: 696437 - DNA, 20 bp, mouse
gacctggcagacccaagaca

SEQ ID NO: 696438 - DNA, 20 bp, mouse
gggactctcccactggaact

SEQ ID NO: 696439 - DNA, 20 bp, mouse
gaagacagggactctcccac

SEQ ID NO: 696440 - DNA, 20 bp, mouse
gagacggacaatgtgtccta

SEQ ID NO: 696441 - DNA, 20 bp, mouse
ggtctgccaggtgagatact

SEQ ID NO: 696442 - DNA, 20 bp, mouse
gggttaactctgggactcgg

SEQ ID NO: 696443 - DNA, 20 bp, mouse
gaagatggaagataccttgg

SEQ ID NO: 696444 - DNA, 20 bp, mouse
gaggaagatggaagatacct

SEQ ID NO: 696445 - DNA, 20 bp, mouse
gcgtgctgttggttaactct

SEQ ID NO: 696446 - DNA, 20 bp, mouse
gtaggtgcgtgggtgaggtg

SEQ ID NO: 696447 - DNA, 20 bp, mouse
gcgggggggtcatgtcgatt

SEQ ID NO: 696448 - DNA, 20 bp, mouse
gcccacgcacctaagactcc

SEQ ID NO: 696449 - DNA, 20 bp, mouse
ggggtcatgtcgattgggct

SEQ ID NO: 696450 - DNA, 20 bp, mouse
gagctcagaccggaagtcgc

SEQ ID NO: 696451 - DNA, 20 bp, mouse
ggccggcgaccagacggtga

SEQ ID NO: 696452 - DNA, 20 bp, mouse
gagggacccggtactctcag

SEQ ID NO: 696453 - DNA, 20 bp, mouse
ggggcgaggagtgtcccgag

SEQ ID NO: 696454 - DNA, 20 bp, mouse
gagacggtgacggagacccg

SEQ ID NO: 696455 - DNA, 20 bp, mouse
gtgagtggggggacttgcta

SEQ ID NO: 696456 - DNA, 20 bp, mouse
ggggagagccagcgcgaagt

SEQ ID NO: 696457 - DNA, 20 bp, mouse
gcccgcgccccgagcttggg

SEQ ID NO: 696458 - DNA, 20 bp, mouse
gacagtcggagcgcggggtg

SEQ ID NO: 696459 - DNA, 20 bp, mouse
gaggcccagagcaggcgact

SEQ ID NO: 696460 - DNA, 20 bp, mouse
gctccccgcgccccgagctt

SEQ ID NO: 696461 - DNA, 20 bp, mouse
gccggcggccgcccaagctc

SEQ ID NO: 696462 - DNA, 20 bp, mouse
ggctgtgctggccggtgggg

SEQ ID NO: 696463 - DNA, 20 bp, mouse
ggccgctgcaggtctgcccg

SEQ ID NO: 696464 - DNA, 20 bp, mouse
gaggaggaggggaggcgctc

SEQ ID NO: 696465 - DNA, 20 bp, mouse
ggggccgagtcgcctgctct

SEQ ID NO: 696466 - DNA, 20 bp, mouse
gtggggacccagtccagggt

SEQ ID NO: 696467 - DNA, 20 bp, mouse
gcggaggcaggggtgcacgt

SEQ ID NO: 696468 - DNA, 20 bp, mouse
gcacgtggggacccagtcca

SEQ ID NO: 696469 - DNA, 20 bp, mouse
gtggctgtcgcgtggtgtct

SEQ ID NO: 696470 - DNA, 20 bp, mouse
ggaggcgcgcggtgaggacg

SEQ ID NO: 696471 - DNA, 20 bp, mouse
gacccggtggtcaggtgcgc

SEQ ID NO: 696472 - DNA, 20 bp, mouse
gcgcccgcgcacctgaccac

SEQ ID NO: 696473 - DNA, 20 bp, mouse
gggcagaacggggtcctctg

SEQ ID NO: 696474 - DNA, 20 bp, mouse
gcaccacgcgacagccagag

SEQ ID NO: 696475 - DNA, 20 bp, mouse
gacccagagaagggtcctgg

SEQ ID NO: 696476 - DNA, 20 bp, mouse
gtctgtagagggaacagcag

SEQ ID NO: 696477 - DNA, 20 bp, mouse
gtagcagtcttcacatcaga

SEQ ID NO: 696478 - DNA, 20 bp, mouse
ggggctgggccatcagagaa

SEQ ID NO: 696479 - DNA, 20 bp, mouse
gacagtcggagttccggaga

SEQ ID NO: 696480 - DNA, 20 bp, mouse
gggaacagcagaggtgggct

SEQ ID NO: 696481 - DNA, 20 bp, mouse
gggactactaatccaggttg

SEQ ID NO: 696482 - DNA, 20 bp, mouse
gacaaagtgccatgacactt

SEQ ID NO: 696483 - DNA, 20 bp, mouse
gccccatttgccatgtcact

SEQ ID NO: 696484 - DNA, 20 bp, mouse
ggcttgcaaaggctttacct

SEQ ID NO: 696485 - DNA, 20 bp, mouse
gctaatccaggttggggagc

SEQ ID NO: 696486 - DNA, 20 bp, mouse
gctacagcccagggaataaa

SEQ ID NO: 696487 - DNA, 20 bp, mouse
ggcctctgaagctcacccat

SEQ ID NO: 696488 - DNA, 20 bp, mouse
ggacttggtgcaataacttg

SEQ ID NO: 696489 - DNA, 20 bp, mouse
gcaagctcttctgtaggctt

SEQ ID NO: 696490 - DNA, 20 bp, mouse
gcagaagagcttggttggtg

SEQ ID NO: 696491 - DNA, 20 bp, mouse
gtaggtcagaactgtgctat

SEQ ID NO: 696492 - DNA, 20 bp, mouse
gcatgtattaaacaattatg

SEQ ID NO: 696493 - DNA, 20 bp, mouse
gaaactaaacttgggtgact

SEQ ID NO: 696494 - DNA, 20 bp, mouse
ggcctacagaagagcttggt

SEQ ID NO: 696495 - DNA, 20 bp, mouse
gcctgaatgctgggatggat

SEQ ID NO: 696496 - DNA, 20 bp, mouse
gagccggcctggcctttcca

SEQ ID NO: 696497 - DNA, 20 bp, mouse
gagtgctgcgtcttcagggt

SEQ ID NO: 696498 - DNA, 20 bp, mouse
gagggagtgctgcgtcttca

SEQ ID NO: 696499 - DNA, 20 bp, mouse
ggtattaagggaaacaagtc

SEQ ID NO: 696500 - DNA, 20 bp, mouse
gaagctagcaggtggggtac

SEQ ID NO: 696501 - DNA, 20 bp, mouse
gtcaaggctaagttctgaag

SEQ ID NO: 696502 - DNA, 20 bp, mouse
gccaaaacaagatggtatta

SEQ ID NO: 696503 - DNA, 20 bp, mouse
gcacagcagctgatcacgca

SEQ ID NO: 696504 - DNA, 20 bp, mouse
ggaacagagccaaaacaaga

SEQ ID NO: 696505 - DNA, 20 bp, mouse
gtggggtacaggctctagct

SEQ ID NO: 696506 - DNA, 20 bp, mouse
ggaggagaggttaaacccat

SEQ ID NO: 696507 - DNA, 20 bp, mouse
gaccgaactctgagtagtaa

SEQ ID NO: 696508 - DNA, 20 bp, mouse
gtgcttgcaacgggactcag

SEQ ID NO: 696509 - DNA, 20 bp, mouse
gtactcagagttcggtcttt

SEQ ID NO: 696510 - DNA, 20 bp, mouse
gtgtgggcagcgaagagtac

SEQ ID NO: 696511 - DNA, 20 bp, mouse
ggtggacagcaaggcaaatg

SEQ ID NO: 696512 - DNA, 20 bp, mouse
gtagggacctcctgcatcgg

SEQ ID NO: 696513 - DNA, 20 bp, mouse
ggaggaggtatcaactaatg

SEQ ID NO: 696514 - DNA, 20 bp, mouse
gccgttgcaagcacctgatt

SEQ ID NO: 696515 - DNA, 20 bp, mouse
gacccatgggtgaactagga

SEQ ID NO: 696516 - DNA, 20 bp, mouse
ggaaacgggcgtcgacgctc

SEQ ID NO: 696517 - DNA, 20 bp, mouse
gctcagaagggcggagtctg

SEQ ID NO: 696518 - DNA, 20 bp, mouse
gagggcagaaggctgctcta

SEQ ID NO: 696519 - DNA, 20 bp, mouse
gggcgtcgacgctctggctg

SEQ ID NO: 696520 - DNA, 20 bp, mouse
gctgcccagccgtgcgtcac

SEQ ID NO: 696521 - DNA, 20 bp, mouse
ggacgcccgtttcctggcaa

SEQ ID NO: 696522 - DNA, 20 bp, mouse
gcctgcgctcggccgttgcc

SEQ ID NO: 696523 - DNA, 20 bp, mouse
gagtctgcgggtcgaggggg

SEQ ID NO: 696524 - DNA, 20 bp, mouse
gtcggccgttgccaggaaac

SEQ ID NO: 696525 - DNA, 20 bp, mouse
gataggggacgactgagaag

SEQ ID NO: 696526 - DNA, 20 bp, mouse
ggcggggcgctgaaaggctg

SEQ ID NO: 696527 - DNA, 20 bp, mouse
gtctccgctgccggcgtcgc

SEQ ID NO: 696528 - DNA, 20 bp, mouse
gacgccggcagcggagacct

SEQ ID NO: 696529 - DNA, 20 bp, mouse
ggagggcggggccgacttga

SEQ ID NO: 696530 - DNA, 20 bp, mouse
ggggcgcgcagaggccaggg

SEQ ID NO: 696531 - DNA, 20 bp, mouse
gggcggggccgacttgaggg

SEQ ID NO: 696532 - DNA, 20 bp, mouse
gaagcccaggtctccgctgc

SEQ ID NO: 696533 - DNA, 20 bp, mouse
gggtgctggcactcgtctct

SEQ ID NO: 696534 - DNA, 20 bp, mouse
gacagcgggtccacgtgcta

SEQ ID NO: 696535 - DNA, 20 bp, mouse
gggggccgatggggagagca

SEQ ID NO: 696536 - DNA, 20 bp, mouse
gaaaccccgcccctgccgga

SEQ ID NO: 696537 - DNA, 20 bp, mouse
ggggcggtggggagcaccct

SEQ ID NO: 696538 - DNA, 20 bp, mouse
gccagagccgtgtgtgtcca

SEQ ID NO: 696539 - DNA, 20 bp, mouse
ggctgggcaggtcctgatgg

SEQ ID NO: 696540 - DNA, 20 bp, mouse
gaggaggcggcccaacgggc

SEQ ID NO: 696541 - DNA, 20 bp, mouse
gcgaggaattagaagtctct

SEQ ID NO: 696542 - DNA, 20 bp, mouse
ggtctctgggtgttactcaa

SEQ ID NO: 696543 - DNA, 20 bp, mouse
gcgggggcgctctaagccca

SEQ ID NO: 696544 - DNA, 20 bp, mouse
ggtgtcaaggacactccaga

SEQ ID NO: 696545 - DNA, 20 bp, mouse
ggtcccgcctcccgcccgtt

SEQ ID NO: 696546 - DNA, 20 bp, mouse
gtggggcgagcggttactag

SEQ ID NO: 696547 - DNA, 20 bp, mouse
gcgcccgcgcccgcccaggg

SEQ ID NO: 696548 - DNA, 20 bp, mouse
gacgctacaggaggtggcga

SEQ ID NO: 696549 - DNA, 20 bp, mouse
gccacctagctcacagatcc

SEQ ID NO: 696550 - DNA, 20 bp, mouse
gttactagggacgctacagg

SEQ ID NO: 696551 - DNA, 20 bp, mouse
gtgggcgggcgcgggcgctt

SEQ ID NO: 696552 - DNA, 20 bp, mouse
gactaggggctcggttacta

SEQ ID NO: 696553 - DNA, 20 bp, mouse
gtaaccgctcgccccaagcc

SEQ ID NO: 696554 - DNA, 20 bp, mouse
gacacccaggtctccggcaa

SEQ ID NO: 696555 - DNA, 20 bp, mouse
gcccgcccagggcggcgtgc

SEQ ID NO: 696556 - DNA, 20 bp, mouse
gcccgggacttctccctgat

SEQ ID NO: 696557 - DNA, 20 bp, mouse
gcaggcaggagtcattatgg

SEQ ID NO: 696558 - DNA, 20 bp, mouse
ggtcctggaaagtgcttccg

SEQ ID NO: 696559 - DNA, 20 bp, mouse
gcaaggctaaagccatgaag

SEQ ID NO: 696560 - DNA, 20 bp, mouse
ggcgcaggcaggagtcatta

SEQ ID NO: 696561 - DNA, 20 bp, mouse
ggcaactagcgggcctcctc

SEQ ID NO: 696562 - DNA, 20 bp, mouse
gtgccccggaagcactttcc

SEQ ID NO: 696563 - DNA, 20 bp, mouse
gagggagaagtcccgggcgc

SEQ ID NO: 696564 - DNA, 20 bp, mouse
ggcggcccgcattggctcca

SEQ ID NO: 696565 - DNA, 20 bp, mouse
gacttctccctgataggtcc

SEQ ID NO: 696566 - DNA, 20 bp, mouse
gtgcccgggcatgatgaagg

SEQ ID NO: 696567 - DNA, 20 bp, mouse
ggcctgcccgggcatgatga

SEQ ID NO: 696568 - DNA, 20 bp, mouse
gggacgtgcgcgacgagcgg

SEQ ID NO: 696569 - DNA, 20 bp, mouse
gaagcgctgagtagtgtttt

SEQ ID NO: 696570 - DNA, 20 bp, mouse
gctactcagcgcttcgcagt

SEQ ID NO: 696571 - DNA, 20 bp, mouse
gccgggcatgatgaaggcgg

SEQ ID NO: 696572 - DNA, 20 bp, mouse
gccgaagcccggacgccata

SEQ ID NO: 696573 - DNA, 20 bp, mouse
gagcgagtcacacacgcgga

SEQ ID NO: 696574 - DNA, 20 bp, mouse
ggcgggacgtgcgcgacgag

SEQ ID NO: 696575 - DNA, 20 bp, mouse
ggcgcgacgagcggaggatg

SEQ ID NO: 696576 - DNA, 20 bp, mouse
ggggtcccagggaaattttc

SEQ ID NO: 696577 - DNA, 20 bp, mouse
gcccctaggaggtctgtcct

SEQ ID NO: 696578 - DNA, 20 bp, mouse
gaggaggtctgtcctggggt

SEQ ID NO: 696579 - DNA, 20 bp, mouse
ggacccagcctgcccctagg

SEQ ID NO: 696580 - DNA, 20 bp, mouse
gaggggcaggctgggtccca

SEQ ID NO: 696581 - DNA, 20 bp, mouse
gatcccctgtgaggaatctc

SEQ ID NO: 696582 - DNA, 20 bp, mouse
gctgcgcccgaaaatttccc

SEQ ID NO: 696583 - DNA, 20 bp, mouse
gaaactaaagatcccctgtg

SEQ ID NO: 696584 - DNA, 20 bp, mouse
gttcccagagattcctcaca

SEQ ID NO: 696585 - DNA, 20 bp, mouse
ggaacaactgcggagttcag

SEQ ID NO: 696586 - DNA, 20 bp, mouse
ggcgggttggggattctctc

SEQ ID NO: 696587 - DNA, 20 bp, mouse
ggcaggtgataggagctaga

SEQ ID NO: 696588 - DNA, 20 bp, mouse
gcctccaggtggccgaggat

SEQ ID NO: 696589 - DNA, 20 bp, mouse
gaaggaggattgctcttagt

SEQ ID NO: 696590 - DNA, 20 bp, mouse
gcagcagtcggggctctcca

SEQ ID NO: 696591 - DNA, 20 bp, mouse
gggccctgccggcccacgtg

SEQ ID NO: 696592 - DNA, 20 bp, mouse
gggaggagccaggagattca

SEQ ID NO: 696593 - DNA, 20 bp, mouse
ggggcagagcagcctcacgt

SEQ ID NO: 696594 - DNA, 20 bp, mouse
ggccccggctctgagagcac

SEQ ID NO: 696595 - DNA, 20 bp, mouse
gttgctcttagtggggtgat

SEQ ID NO: 696596 - DNA, 20 bp, mouse
gagggcgcgcacaacagtgt

SEQ ID NO: 696597 - DNA, 20 bp, mouse
ggccctgcgcgcgccgtcgg

SEQ ID NO: 696598 - DNA, 20 bp, mouse
gcggaccagcgtcagcacca

SEQ ID NO: 696599 - DNA, 20 bp, mouse
gagctcacatgcaaggtcta

SEQ ID NO: 696600 - DNA, 20 bp, mouse
gcggctgcggggagcaggcg

SEQ ID NO: 696601 - DNA, 20 bp, mouse
gctgcgcgcgccgtcggcgg

SEQ ID NO: 696602 - DNA, 20 bp, mouse
gcgcgcgcgctagcctgctg

SEQ ID NO: 696603 - DNA, 20 bp, mouse
gcccgcgcccgggactaggc

SEQ ID NO: 696604 - DNA, 20 bp, mouse
ggcagccctgcgcgcgccgt

SEQ ID NO: 696605 - DNA, 20 bp, mouse
gtccccgcagccgccgccga

SEQ ID NO: 696606 - DNA, 20 bp, mouse
gaggacctgagcaaggtagg

SEQ ID NO: 696607 - DNA, 20 bp, mouse
gcaagatgggagtgctcaca

SEQ ID NO: 696608 - DNA, 20 bp, mouse
gcctcagtggagaaggacta

SEQ ID NO: 696609 - DNA, 20 bp, mouse
gcctgaactctgggtgagta

SEQ ID NO: 696610 - DNA, 20 bp, mouse
gggactctcactaccctcag

SEQ ID NO: 696611 - DNA, 20 bp, mouse
gatgctgccccccttcacaa

SEQ ID NO: 696612 - DNA, 20 bp, mouse
ggttcaaagaccagctagga

SEQ ID NO: 696613 - DNA, 20 bp, mouse
gtgctcacagggttaacaga

SEQ ID NO: 696614 - DNA, 20 bp, mouse
gtaggggctgcttttcactt

SEQ ID NO: 696615 - DNA, 20 bp, mouse
gaaccagagatgctgcaaga

SEQ ID NO: 696616 - DNA, 20 bp, mouse
gacagagcggcacccactcc

SEQ ID NO: 696617 - DNA, 20 bp, mouse
gcctctgggtggaaggcaag

SEQ ID NO: 696618 - DNA, 20 bp, mouse
ggtcacttggaaaagggcag

SEQ ID NO: 696619 - DNA, 20 bp, mouse
gcacccactccgggaagacc

SEQ ID NO: 696620 - DNA, 20 bp, mouse
gtgggtgccgctctgtcact

SEQ ID NO: 696621 - DNA, 20 bp, mouse
gcgctctgtcacttggaaaa

SEQ ID NO: 696622 - DNA, 20 bp, mouse
gaacagctgcgaaagcctct

SEQ ID NO: 696623 - DNA, 20 bp, mouse
ggccgagagttggcgaatga

SEQ ID NO: 696624 - DNA, 20 bp, mouse
gatccccactccagggagtg

SEQ ID NO: 696625 - DNA, 20 bp, mouse
gcaccccccactccctggag

SEQ ID NO: 696626 - DNA, 20 bp, mouse
gcacggggagggagaatcgg

SEQ ID NO: 696627 - DNA, 20 bp, mouse
gactgggcttggccttgcac

SEQ ID NO: 696628 - DNA, 20 bp, mouse
gctgccgcggcttgaatggg

SEQ ID NO: 696629 - DNA, 20 bp, mouse
ggacctgccgcggcttgaat

SEQ ID NO: 696630 - DNA, 20 bp, mouse
gccgggaggccgacctgccg

SEQ ID NO: 696631 - DNA, 20 bp, mouse
ggcttggccttgcacgggga

SEQ ID NO: 696632 - DNA, 20 bp, mouse
gtggcggcggactagctcta

SEQ ID NO: 696633 - DNA, 20 bp, mouse
gagggagggggcagtaagac

SEQ ID NO: 696634 - DNA, 20 bp, mouse
ggcagtaagacgggacggga

SEQ ID NO: 696635 - DNA, 20 bp, mouse
gccgcctcccattcaagccg

SEQ ID NO: 696636 - DNA, 20 bp, mouse
gaggagggccaagccggctg

SEQ ID NO: 696637 - DNA, 20 bp, mouse
gctcccaagacccaagtcag

SEQ ID NO: 696638 - DNA, 20 bp, mouse
ggacttgggtcttgggagga

SEQ ID NO: 696639 - DNA, 20 bp, mouse
gctcctgcccccacccggat

SEQ ID NO: 696640 - DNA, 20 bp, mouse
gaggggaagagacagctgac

SEQ ID NO: 696641 - DNA, 20 bp, mouse
gacgtgatgcccatccgggt

SEQ ID NO: 696642 - DNA, 20 bp, mouse
gaccctattgccttgcagaa

SEQ ID NO: 696643 - DNA, 20 bp, mouse
gctcctctgacttgggtctt

SEQ ID NO: 696644 - DNA, 20 bp, mouse
ggaaaagcatcgtccacagc

SEQ ID NO: 696645 - DNA, 20 bp, mouse
ggggccctggtgctactttg

SEQ ID NO: 696646 - DNA, 20 bp, mouse
gtcctggaccgcaccctctt

SEQ ID NO: 696647 - DNA, 20 bp, mouse
gtgggagaaccaggccgcgc

SEQ ID NO: 696648 - DNA, 20 bp, mouse
ggcggtccaggaccggagca

SEQ ID NO: 696649 - DNA, 20 bp, mouse
gtccaggaccggagcagggt

SEQ ID NO: 696650 - DNA, 20 bp, mouse
ggtagtaccgggtctgagag

SEQ ID NO: 696651 - DNA, 20 bp, mouse
gctcccggcatgctctgcca

SEQ ID NO: 696652 - DNA, 20 bp, mouse
ggagaatgggaaactgtgtg

SEQ ID NO: 696653 - DNA, 20 bp, mouse
gggaggctgtgggacgtgtc

SEQ ID NO: 696654 - DNA, 20 bp, mouse
gctgggaggtgtagtccctt

SEQ ID NO: 696655 - DNA, 20 bp, mouse
gggttctcccaaccctgctc

SEQ ID NO: 696656 - DNA, 20 bp, mouse
gttagccggagcttgagcgg

SEQ ID NO: 696657 - DNA, 20 bp, mouse
gtcaagctccggctaaaacc

SEQ ID NO: 696658 - DNA, 20 bp, mouse
ggaagtgaggtcgtgggctg

SEQ ID NO: 696659 - DNA, 20 bp, mouse
ggagcggaggctcgcagtct

SEQ ID NO: 696660 - DNA, 20 bp, mouse
gcatctcgcgcaagcctctc

SEQ ID NO: 696661 - DNA, 20 bp, mouse
ggggttgttcacaagagtgc

SEQ ID NO: 696662 - DNA, 20 bp, mouse
ggaggcttgcgcgagatgcc

SEQ ID NO: 696663 - DNA, 20 bp, mouse
gggcgcgcgtcctagcatcc

SEQ ID NO: 696664 - DNA, 20 bp, mouse
gcccccggctggcgcgcggc

SEQ ID NO: 696665 - DNA, 20 bp, mouse
ggcgggcggaagtgaggtcg

SEQ ID NO: 696666 - DNA, 20 bp, mouse
gagcgggcagcgcgcacctg

SEQ ID NO: 696667 - DNA, 20 bp, mouse
gcgagcgggcgtgctgcggg

SEQ ID NO: 696668 - DNA, 20 bp, mouse
ggcagcacgcccgctcggtc

SEQ ID NO: 696669 - DNA, 20 bp, mouse
gccgcgcaggtcgaccttaa

SEQ ID NO: 696670 - DNA, 20 bp, mouse
gaatagaagcgagtaagccg

SEQ ID NO: 696671 - DNA, 20 bp, mouse
gcgccgcggcgcctcctcgc

SEQ ID NO: 696672 - DNA, 20 bp, mouse
gtaatacggcccgaccgagc

SEQ ID NO: 696673 - DNA, 20 bp, mouse
gcggcctccggacctcccgg

SEQ ID NO: 696674 - DNA, 20 bp, mouse
gtccggaggccgcacccacc

SEQ ID NO: 696675 - DNA, 20 bp, mouse
gcgggagccgccccgcctcg

SEQ ID NO: 696676 - DNA, 20 bp, mouse
gtcccaatggaacccctcta

SEQ ID NO: 696677 - DNA, 20 bp, mouse
ggagaactgagttccttaga

SEQ ID NO: 696678 - DNA, 20 bp, mouse
gtccttagaggggttccatt

SEQ ID NO: 696679 - DNA, 20 bp, mouse
gtgcttaagggtagaaatga

SEQ ID NO: 696680 - DNA, 20 bp, mouse
gagttctcatctctcgattg

SEQ ID NO: 696681 - DNA, 20 bp, mouse
ggaaacaatgaacacaaagc

SEQ ID NO: 696682 - DNA, 20 bp, mouse
gtcactgagaatcctccagt

SEQ ID NO: 696683 - DNA, 20 bp, mouse
gggaactgttcttgtaaaca

SEQ ID NO: 696684 - DNA, 20 bp, mouse
gggaaagatgggccttgatg

SEQ ID NO: 696685 - DNA, 20 bp, mouse
gatgacatcagagcattcta

SEQ ID NO: 696686 - DNA, 20 bp, mouse
gtggggagaaaaggtcacag

SEQ ID NO: 696687 - DNA, 20 bp, mouse
gaactctgcgagaatagtca

SEQ ID NO: 696688 - DNA, 20 bp, mouse
gaggttaccaggaaagtatg

SEQ ID NO: 696689 - DNA, 20 bp, mouse
gtacttgaaagcatgcgtct

SEQ ID NO: 696690 - DNA, 20 bp, mouse
ggggacgtttagtcttgcca

SEQ ID NO: 696691 - DNA, 20 bp, mouse
gaagactaaacgtccctgcc

SEQ ID NO: 696692 - DNA, 20 bp, mouse
gacgtccctgccaggttacc

SEQ ID NO: 696693 - DNA, 20 bp, mouse
ggtgatgtcatcagtgacac

SEQ ID NO: 696694 - DNA, 20 bp, mouse
ggacatcacagaataaagcc

SEQ ID NO: 696695 - DNA, 20 bp, mouse
gtgctttcaagtatgtgtgc

SEQ ID NO: 696696 - DNA, 20 bp, mouse
gtaacccagcgtgacgtcga

SEQ ID NO: 696697 - DNA, 20 bp, mouse
ggccgctctgcgggagtccc

SEQ ID NO: 696698 - DNA, 20 bp, mouse
gaggtggcaccacggaccca

SEQ ID NO: 696699 - DNA, 20 bp, mouse
gcaggaaggggttaaggcgc

SEQ ID NO: 696700 - DNA, 20 bp, mouse
ggtcacgctgggttacctaa

SEQ ID NO: 696701 - DNA, 20 bp, mouse
gtggacagcttcaggatgag

SEQ ID NO: 696702 - DNA, 20 bp, mouse
ggctgtcaaatctaccctgg

SEQ ID NO: 696703 - DNA, 20 bp, mouse
ggcctgggactcccgcagag

SEQ ID NO: 696704 - DNA, 20 bp, mouse
ggcaggaagcatttgagtct

SEQ ID NO: 696705 - DNA, 20 bp, mouse
gtgcggggccccggccaatc

SEQ ID NO: 696706 - DNA, 20 bp, mouse
gcaatggagtgcagcgatta

SEQ ID NO: 696707 - DNA, 20 bp, mouse
gccaagattccagacagcaa

SEQ ID NO: 696708 - DNA, 20 bp, mouse
ggggggcaattacccgggtt

SEQ ID NO: 696709 - DNA, 20 bp, mouse
gaggcagagccgggcctcga

SEQ ID NO: 696710 - DNA, 20 bp, mouse
gaggaggctgacatgaccac

SEQ ID NO: 696711 - DNA, 20 bp, mouse
gcaattacccgggttggggt

SEQ ID NO: 696712 - DNA, 20 bp, mouse
gactacggagctctcggtgt

SEQ ID NO: 696713 - DNA, 20 bp, mouse
gcgggtgggggctgccgggt

SEQ ID NO: 696714 - DNA, 20 bp, mouse
ggattagggggcaattaccc

SEQ ID NO: 696715 - DNA, 20 bp, mouse
ggccccctgcagtcgacacc

SEQ ID NO: 696716 - DNA, 20 bp, mouse
gtccgcctagctaaacgcct

SEQ ID NO: 696717 - DNA, 20 bp, mouse
gtagctaggcggagattaac

SEQ ID NO: 696718 - DNA, 20 bp, mouse
gggtgcccaggcgtttagct

SEQ ID NO: 696719 - DNA, 20 bp, mouse
ggcagcaggaaaatgtagag

SEQ ID NO: 696720 - DNA, 20 bp, mouse
gaccttgcagagcacttgct

SEQ ID NO: 696721 - DNA, 20 bp, mouse
ggcacagcctcggcaggagg

SEQ ID NO: 696722 - DNA, 20 bp, mouse
gtgcgcgaggatgcgaaagc

SEQ ID NO: 696723 - DNA, 20 bp, mouse
gcgcacgtgaccgccgggag

SEQ ID NO: 696724 - DNA, 20 bp, mouse
gctccccctcgcgccgtctg

SEQ ID NO: 696725 - DNA, 20 bp, mouse
gcacttgctgggtagccaca

SEQ ID NO: 696726 - DNA, 20 bp, mouse
ggcgccaagaacccggaaat

SEQ ID NO: 696727 - DNA, 20 bp, mouse
ggacatggggaattcgctta

SEQ ID NO: 696728 - DNA, 20 bp, mouse
gtagaatagcagcgtacgac

SEQ ID NO: 696729 - DNA, 20 bp, mouse
gaacttgaatatcaagggtg

SEQ ID NO: 696730 - DNA, 20 bp, mouse
gaattccccatgtccgtcca

SEQ ID NO: 696731 - DNA, 20 bp, mouse
gccaagaacccggaaatggg

SEQ ID NO: 696732 - DNA, 20 bp, mouse
gtgtgtggtgtgcgttgttg

SEQ ID NO: 696733 - DNA, 20 bp, mouse
gggccgcggcgccaagaacc

SEQ ID NO: 696734 - DNA, 20 bp, mouse
ggtctcaacttgaatatcaa

SEQ ID NO: 696735 - DNA, 20 bp, mouse
gcatgaaccatggacggaca

SEQ ID NO: 696736 - DNA, 20 bp, mouse
ggcgatgggcgagaatgaca

SEQ ID NO: 696737 - DNA, 20 bp, mouse
ggtagcgatgacccaggcga

SEQ ID NO: 696738 - DNA, 20 bp, mouse
gggttccgggtgatggtttg

SEQ ID NO: 696739 - DNA, 20 bp, mouse
gtacggtccgagacatacag

SEQ ID NO: 696740 - DNA, 20 bp, mouse
gagaccctggctataacccg

SEQ ID NO: 696741 - DNA, 20 bp, mouse
gcagtcgccggaagtggaag

SEQ ID NO: 696742 - DNA, 20 bp, mouse
gtttgccacgagtgggtcta

SEQ ID NO: 696743 - DNA, 20 bp, mouse
ggacagggtttgccacgagt

SEQ ID NO: 696744 - DNA, 20 bp, mouse
gaatgtcggactggcctcgg

SEQ ID NO: 696745 - DNA, 20 bp, mouse
gcagcctcgggttatagcca

SEQ ID NO: 696746 - DNA, 20 bp, mouse
gtaaccagcggggaccactc

SEQ ID NO: 696747 - DNA, 20 bp, mouse
gggggtgttcgaaacttaga

SEQ ID NO: 696748 - DNA, 20 bp, mouse
ggattccagaagctactctg

SEQ ID NO: 696749 - DNA, 20 bp, mouse
gctctcgcgagagggaggtg

SEQ ID NO: 696750 - DNA, 20 bp, mouse
gggtccccgctggttactgg

SEQ ID NO: 696751 - DNA, 20 bp, mouse
gtcgcccgcccggtgagctg

SEQ ID NO: 696752 - DNA, 20 bp, mouse
gatcgcaagtcccgtctcat

SEQ ID NO: 696753 - DNA, 20 bp, mouse
ggcgtcctctcgcgagaggg

SEQ ID NO: 696754 - DNA, 20 bp, mouse
gcgcgaagccgcgggatgaa

SEQ ID NO: 696755 - DNA, 20 bp, mouse
gttccacgaaccgagggggg

SEQ ID NO: 696756 - DNA, 20 bp, mouse
gaaaaggcttgggccagagt

SEQ ID NO: 696757 - DNA, 20 bp, mouse
gctgcgctcagtgacgtcag

SEQ ID NO: 696758 - DNA, 20 bp, mouse
gcccgcagccactgctgcta

SEQ ID NO: 696759 - DNA, 20 bp, mouse
gagctgtgggacgctctgag

SEQ ID NO: 696760 - DNA, 20 bp, mouse
ggttgctaatatgtaggggc

SEQ ID NO: 696761 - DNA, 20 bp, mouse
gtccggttgctaatatgtag

SEQ ID NO: 696762 - DNA, 20 bp, mouse
gaaacatggaaaacctagtt

SEQ ID NO: 696763 - DNA, 20 bp, mouse
gcctaatagtgaaaaggctt

SEQ ID NO: 696764 - DNA, 20 bp, mouse
gtattgcgcacgcgtagctg

SEQ ID NO: 696765 - DNA, 20 bp, mouse
gctgctgctacggacgcctc

SEQ ID NO: 696766 - DNA, 20 bp, mouse
gcgcagcggggacccagccg

SEQ ID NO: 696767 - DNA, 20 bp, mouse
ggaggtctgccccgcccacg

SEQ ID NO: 696768 - DNA, 20 bp, mouse
ggattcctccatggggtctt

SEQ ID NO: 696769 - DNA, 20 bp, mouse
gatcgggttgggctacccag

SEQ ID NO: 696770 - DNA, 20 bp, mouse
ggggcggggcagacctcggc

SEQ ID NO: 696771 - DNA, 20 bp, mouse
gactctgtgcaacgtgttgg

SEQ ID NO: 696772 - DNA, 20 bp, mouse
gggggtcttaggtcctgatc

SEQ ID NO: 696773 - DNA, 20 bp, mouse
gacgggcttcggccccgcgt

SEQ ID NO: 696774 - DNA, 20 bp, mouse
gcggcggcgcgggttcttcc

SEQ ID NO: 696775 - DNA, 20 bp, mouse
gcccaggggcggagcgcagc

SEQ ID NO: 696776 - DNA, 20 bp, mouse
gaggctggagcgtaggggcg

SEQ ID NO: 696777 - DNA, 20 bp, mouse
gacgggaggctggagcgtag

SEQ ID NO: 696778 - DNA, 20 bp, mouse
gcctgcgcaccgggagacgc

SEQ ID NO: 696779 - DNA, 20 bp, mouse
gccgggagacgcgggttgta

SEQ ID NO: 696780 - DNA, 20 bp, mouse
ggagacacctgcagcatgca

SEQ ID NO: 696781 - DNA, 20 bp, mouse
gatgaaagaagcaccctacc

SEQ ID NO: 696782 - DNA, 20 bp, mouse
gcggtgtcctctagccgggt

SEQ ID NO: 696783 - DNA, 20 bp, mouse
gagcgcggtgtcctctagcc

SEQ ID NO: 696784 - DNA, 20 bp, mouse
gggtgcttctttcatcagct

SEQ ID NO: 696785 - DNA, 20 bp, mouse
gcatagtttaaggctactaa

SEQ ID NO: 696786 - DNA, 20 bp, mouse
gacagacaggccggtgtctg

SEQ ID NO: 696787 - DNA, 20 bp, mouse
gaggctgtgcaccctccgcg

SEQ ID NO: 696788 - DNA, 20 bp, mouse
gataacaaggctgtacagac

SEQ ID NO: 696789 - DNA, 20 bp, mouse
gagctaggacagggaagtaa

SEQ ID NO: 696790 - DNA, 20 bp, mouse
ggctactcgaagctaggaca

SEQ ID NO: 696791 - DNA, 20 bp, mouse
gcagcggcggggcgtccgga

SEQ ID NO: 696792 - DNA, 20 bp, mouse
gaccctccgcggggcatgat

SEQ ID NO: 696793 - DNA, 20 bp, mouse
gaagttgaaggatggaaggc

SEQ ID NO: 696794 - DNA, 20 bp, mouse
ggtgctggttctctttgatc

SEQ ID NO: 696795 - DNA, 20 bp, mouse
gcagaagggttgcatgtcgg

SEQ ID NO: 696796 - DNA, 20 bp, mouse
gtaagtaaaggatgtgtgct

SEQ ID NO: 696797 - DNA, 20 bp, mouse
gtcaaaaactccctaagtaa

SEQ ID NO: 696798 - DNA, 20 bp, mouse
ggctgcgcagggcccagtct

SEQ ID NO: 696799 - DNA, 20 bp, mouse
gggtaccgccctacctgcgc

SEQ ID NO: 696800 - DNA, 20 bp, mouse
gtaccagctgggaaccggtg

SEQ ID NO: 696801 - DNA, 20 bp, mouse
gcctgcgccggatgatcacg

SEQ ID NO: 696802 - DNA, 20 bp, mouse
ggggcccgcggaagcgacga

SEQ ID NO: 696803 - DNA, 20 bp, mouse
ggactgagaacccaccacac

SEQ ID NO: 696804 - DNA, 20 bp, mouse
gtgatcatccggcgcaggta

SEQ ID NO: 696805 - DNA, 20 bp, mouse
gagctgggaaccggtgtggt

SEQ ID NO: 696806 - DNA, 20 bp, mouse
gcacgtgacgggcccgggga

SEQ ID NO: 696807 - DNA, 20 bp, mouse
gcgccccaggcgcacgtgac

SEQ ID NO: 696808 - DNA, 20 bp, mouse
gggcccgtcacgtgcgcctg

SEQ ID NO: 696809 - DNA, 20 bp, mouse
gagagggcgggttttttgga

SEQ ID NO: 696810 - DNA, 20 bp, mouse
gggcgcgcgcctcctcgtcg

SEQ ID NO: 696811 - DNA, 20 bp, mouse
ggcgacagccgcctgatcga

SEQ ID NO: 696812 - DNA, 20 bp, mouse
ggcggccttggccggtgcgt

SEQ ID NO: 696813 - DNA, 20 bp, mouse
ggcaccggccaaggccgccg

SEQ ID NO: 696814 - DNA, 20 bp, mouse
gacgaggaggcgcgcgcccc

SEQ ID NO: 696815 - DNA, 20 bp, mouse
ggccctctcccggcaggcgg

SEQ ID NO: 696816 - DNA, 20 bp, mouse
gcgacccgagggcgcgtagg

SEQ ID NO: 696817 - DNA, 20 bp, mouse
gtggcccaagatcaaaggga

SEQ ID NO: 696818 - DNA, 20 bp, mouse
gcatctggaaaacccaaggc

SEQ ID NO: 696819 - DNA, 20 bp, mouse
ggatgcggagggcttgcttg

SEQ ID NO: 696820 - DNA, 20 bp, mouse
ggagtggcgcggggtgatcc

SEQ ID NO: 696821 - DNA, 20 bp, mouse
gccgggcgcgcgcacgtgga

SEQ ID NO: 696822 - DNA, 20 bp, mouse
ggggttgccacgcgacccga

SEQ ID NO: 696823 - DNA, 20 bp, mouse
ggggttgccacgtgacgggg

SEQ ID NO: 696824 - DNA, 20 bp, mouse
ggtggggaggagcacgtgag

SEQ ID NO: 696825 - DNA, 20 bp, mouse
gcttgtggcccaagatcaaa

SEQ ID NO: 696826 - DNA, 20 bp, mouse
ggaggacaggttggcctctg

SEQ ID NO: 696827 - DNA, 20 bp, mouse
gggaagccacgggggaaatg

SEQ ID NO: 696828 - DNA, 20 bp, mouse
gagggccacaacaaagcatg

SEQ ID NO: 696829 - DNA, 20 bp, mouse
ggcaccgggggaagccacgg

SEQ ID NO: 696830 - DNA, 20 bp, mouse
gagcccaagtccctgtgtgg

SEQ ID NO: 696831 - DNA, 20 bp, mouse
gctacccagtggatcccagc

SEQ ID NO: 696832 - DNA, 20 bp, mouse
gggtgctgggcacgccccag

SEQ ID NO: 696833 - DNA, 20 bp, mouse
gtgttgtggccctagaggac

SEQ ID NO: 696834 - DNA, 20 bp, mouse
gccagcaccgggggaagcca

SEQ ID NO: 696835 - DNA, 20 bp, mouse
ggtggccctagaggacaggt

SEQ ID NO: 696836 - DNA, 20 bp, mouse
gtgaccccgcctcttcattc

SEQ ID NO: 696837 - DNA, 20 bp, mouse
gcatggtgatgcacccagag

SEQ ID NO: 696838 - DNA, 20 bp, mouse
gaatctgccgcggtggatgc

SEQ ID NO: 696839 - DNA, 20 bp, mouse
ggggttatgtagtccatgta

SEQ ID NO: 696840 - DNA, 20 bp, mouse
gcccggaaaccaatctgccg

SEQ ID NO: 696841 - DNA, 20 bp, mouse
gccacggaaaactggaaccc

SEQ ID NO: 696842 - DNA, 20 bp, mouse
gaaacctcaactcttatggg

SEQ ID NO: 696843 - DNA, 20 bp, mouse
ggcggggtcaaggccttaga

SEQ ID NO: 696844 - DNA, 20 bp, mouse
ggcgccacccggcgtaacca

SEQ ID NO: 696845 - DNA, 20 bp, mouse
gctggctcctggggcactcg

SEQ ID NO: 696846 - DNA, 20 bp, mouse
gagagagcccggcgagaagt

SEQ ID NO: 696847 - DNA, 20 bp, mouse
gaggttgcctggcagacggt

SEQ ID NO: 696848 - DNA, 20 bp, mouse
gggctctctaacaagttccg

SEQ ID NO: 696849 - DNA, 20 bp, mouse
gggctctgaagtagtatgtg

SEQ ID NO: 696850 - DNA, 20 bp, mouse
gaaaacagccaacttctcgc

SEQ ID NO: 696851 - DNA, 20 bp, mouse
gggagctcagagttgcctgt

SEQ ID NO: 696852 - DNA, 20 bp, mouse
gcatgtgatctctttggcag

SEQ ID NO: 696853 - DNA, 20 bp, mouse
ggaagtagtatgtgtggaca

SEQ ID NO: 696854 - DNA, 20 bp, mouse
gtctccctggctccacagga

SEQ ID NO: 696855 - DNA, 20 bp, mouse
gtggcagacggtggggctgg

SEQ ID NO: 696856 - DNA, 20 bp, mouse
gcggggctccgccgcctgat

SEQ ID NO: 696857 - DNA, 20 bp, mouse
ggaggagtgggtatggagac

SEQ ID NO: 696858 - DNA, 20 bp, mouse
gacaaagcatcccaatcagg

SEQ ID NO: 696859 - DNA, 20 bp, mouse
gctgaagggtagaaatttac

SEQ ID NO: 696860 - DNA, 20 bp, mouse
gggatggggtaagccggagt

SEQ ID NO: 696861 - DNA, 20 bp, mouse
gtggagacctgaagtatctg

SEQ ID NO: 696862 - DNA, 20 bp, mouse
gtggggaaaggtagccctgg

SEQ ID NO: 696863 - DNA, 20 bp, mouse
gcccaaatgcaatcatttcc

SEQ ID NO: 696864 - DNA, 20 bp, mouse
gggcaaagaatgtgggaccg

SEQ ID NO: 696865 - DNA, 20 bp, mouse
gccagggggacccttcagga

SEQ ID NO: 696866 - DNA, 20 bp, mouse
gcaggctgctggtatctatt

SEQ ID NO: 696867 - DNA, 20 bp, mouse
gcctagagatgatttgggga

SEQ ID NO: 696868 - DNA, 20 bp, mouse
gtagatccagaggctgaatc

SEQ ID NO: 696869 - DNA, 20 bp, mouse
gagggaaaggctttctgggc

SEQ ID NO: 696870 - DNA, 20 bp, mouse
gcaggtggtgctccgagcct

SEQ ID NO: 696871 - DNA, 20 bp, mouse
gggggtgactctagatccag

SEQ ID NO: 696872 - DNA, 20 bp, mouse
gctgttgcctagagacagaa

SEQ ID NO: 696873 - DNA, 20 bp, mouse
gctagcagcgcacaggacac

SEQ ID NO: 696874 - DNA, 20 bp, mouse
ggaggctgaatctgggtctg

SEQ ID NO: 696875 - DNA, 20 bp, mouse
gaagccagggaaaggctttc

SEQ ID NO: 696876 - DNA, 20 bp, mouse
ggggacgcggagctatgggc

SEQ ID NO: 696877 - DNA, 20 bp, mouse
gaggcagggcgcctagtgtg

SEQ ID NO: 696878 - DNA, 20 bp, mouse
gtgcagggacgcggagctat

SEQ ID NO: 696879 - DNA, 20 bp, mouse
gtggctgcggggaaatgacg

SEQ ID NO: 696880 - DNA, 20 bp, mouse
gggtgcagactgtgggaaat

SEQ ID NO: 696881 - DNA, 20 bp, mouse
gcgcggagctatgggctgga

SEQ ID NO: 696882 - DNA, 20 bp, mouse
gtaggcgccctgcctcacgg

SEQ ID NO: 696883 - DNA, 20 bp, mouse
gcaggttggaggttgcgggt

SEQ ID NO: 696884 - DNA, 20 bp, mouse
gactgtgagaggcctccgtg

SEQ ID NO: 696885 - DNA, 20 bp, mouse
gctggagggccgaggggttc

SEQ ID NO: 696886 - DNA, 20 bp, mouse
gagcttctgaggggtgttgg

SEQ ID NO: 696887 - DNA, 20 bp, mouse
gacccagttggccaaggaga

SEQ ID NO: 696888 - DNA, 20 bp, mouse
gaacgagcacgagcagagga

SEQ ID NO: 696889 - DNA, 20 bp, mouse
gagcccgaggtggatagctc

SEQ ID NO: 696890 - DNA, 20 bp, mouse
ggacagcttctgaggggtgt

SEQ ID NO: 696891 - DNA, 20 bp, mouse
gggcctgagctatccacctc

SEQ ID NO: 696892 - DNA, 20 bp, mouse
gcaagaggacagcttctgag

SEQ ID NO: 696893 - DNA, 20 bp, mouse
gcgcgaacgagcacgagcag

SEQ ID NO: 696894 - DNA, 20 bp, mouse
ggcaccatgcagcgtagcgc

SEQ ID NO: 696895 - DNA, 20 bp, mouse
gatgctgaagggcagaagtg

SEQ ID NO: 696896 - DNA, 20 bp, mouse
gcgggggctcctctaccaat

SEQ ID NO: 696897 - DNA, 20 bp, mouse
gaacgggaaagcaacgaggg

SEQ ID NO: 696898 - DNA, 20 bp, mouse
gaccaataggaagagtagaa

SEQ ID NO: 696899 - DNA, 20 bp, mouse
gactgacagccgattggtag

SEQ ID NO: 696900 - DNA, 20 bp, mouse
gagcaacgaggggggagcgg

SEQ ID NO: 696901 - DNA, 20 bp, mouse
gaactcagctgtggttactt

SEQ ID NO: 696902 - DNA, 20 bp, mouse
gagcaacgggaaagcaacga

SEQ ID NO: 696903 - DNA, 20 bp, mouse
gtattcagcgcactgtctcc

SEQ ID NO: 696904 - DNA, 20 bp, mouse
gacacagactgacagccgat

SEQ ID NO: 696905 - DNA, 20 bp, mouse
ggacgggataaactcagctg

SEQ ID NO: 696906 - DNA, 20 bp, mouse
ggggtagcaggaatgctaaa

SEQ ID NO: 696907 - DNA, 20 bp, mouse
ggtagaaaacacagggtagc

SEQ ID NO: 696908 - DNA, 20 bp, mouse
gtacgattgtagaacaggga

SEQ ID NO: 696909 - DNA, 20 bp, mouse
ggggcagatgaggagctcgt

SEQ ID NO: 696910 - DNA, 20 bp, mouse
gagaggagagactggatatt

SEQ ID NO: 696911 - DNA, 20 bp, mouse
ggcaggaatgctaaaaggaa

SEQ ID NO: 696912 - DNA, 20 bp, mouse
gtgggcagctctgactgcag

SEQ ID NO: 696913 - DNA, 20 bp, mouse
gcaaatggtagaaaagttat

SEQ ID NO: 696914 - DNA, 20 bp, mouse
gtctatacgattgtagaaca

SEQ ID NO: 696915 - DNA, 20 bp, mouse
gggggaggcgctgggattac

SEQ ID NO: 696916 - DNA, 20 bp, mouse
gtccccttggcaccacactg

SEQ ID NO: 696917 - DNA, 20 bp, mouse
gcgaaacaaacaaaggataa

SEQ ID NO: 696918 - DNA, 20 bp, mouse
gcaagaggacacagatccta

SEQ ID NO: 696919 - DNA, 20 bp, mouse
gggtgaggcgaaacaaacaa

SEQ ID NO: 696920 - DNA, 20 bp, mouse
gccaaagatccgtacgtgga

SEQ ID NO: 696921 - DNA, 20 bp, mouse
ggaccagaaccttccacgta

SEQ ID NO: 696922 - DNA, 20 bp, mouse
ggataatggcaggcaacggc

SEQ ID NO: 696923 - DNA, 20 bp, mouse
ggcaacggctggcatacagc

SEQ ID NO: 696924 - DNA, 20 bp, mouse
gttcccaaactaaatattaa

SEQ ID NO: 696925 - DNA, 20 bp, mouse
gtcctcttgaagggcattgt

SEQ ID NO: 696926 - DNA, 20 bp, mouse
ggggccaggggaatctagaa

SEQ ID NO: 696927 - DNA, 20 bp, mouse
gcatccatccgagagataat

SEQ ID NO: 696928 - DNA, 20 bp, mouse
gctagccagacctgagccaa

SEQ ID NO: 696929 - DNA, 20 bp, mouse
gttacccaaaaatgggccag

SEQ ID NO: 696930 - DNA, 20 bp, mouse
gagggtttcccattatctct

SEQ ID NO: 696931 - DNA, 20 bp, mouse
gatgaccagctgtgcaagtg

SEQ ID NO: 696932 - DNA, 20 bp, mouse
gagacctgagccaaaggttt

SEQ ID NO: 696933 - DNA, 20 bp, mouse
gtttcccattatctctcgga

SEQ ID NO: 696934 - DNA, 20 bp, mouse
gtgtgggagaattaagtccc

SEQ ID NO: 696935 - DNA, 20 bp, mouse
ggatgaaaggatgttctttt

SEQ ID NO: 696936 - DNA, 20 bp, mouse
gggcctgaaactcacctctc

SEQ ID NO: 696937 - DNA, 20 bp, mouse
gggacacagtctacctatat

SEQ ID NO: 696938 - DNA, 20 bp, mouse
gatcctgagaggtgagtttc

SEQ ID NO: 696939 - DNA, 20 bp, mouse
ggctacagtaaggctgtgtc

SEQ ID NO: 696940 - DNA, 20 bp, mouse
ggacagcggggtgaactgag

SEQ ID NO: 696941 - DNA, 20 bp, mouse
ggtcacaatgtgcaggctgg

SEQ ID NO: 696942 - DNA, 20 bp, mouse
gagcctgcacattgtgacag

SEQ ID NO: 696943 - DNA, 20 bp, mouse
gtaagcaactgttcctatat

SEQ ID NO: 696944 - DNA, 20 bp, mouse
ggagtttcaggcccaggtac

SEQ ID NO: 696945 - DNA, 20 bp, mouse
gccccgctgtcacaatgtgc

SEQ ID NO: 696946 - DNA, 20 bp, mouse
gcaggtggagcacgcccaga

SEQ ID NO: 696947 - DNA, 20 bp, mouse
gggcctccctccccggaagt

SEQ ID NO: 696948 - DNA, 20 bp, mouse
ggaaccgcccaggtacacaa

SEQ ID NO: 696949 - DNA, 20 bp, mouse
gtggctgcacaggtcgccta

SEQ ID NO: 696950 - DNA, 20 bp, mouse
gaggagggcgtctgcaccat

SEQ ID NO: 696951 - DNA, 20 bp, mouse
gctgaggacagagaccctct

SEQ ID NO: 696952 - DNA, 20 bp, mouse
gaacaggtgcgcacaaggcc

SEQ ID NO: 696953 - DNA, 20 bp, mouse
gtacacaagggtgggagccc

SEQ ID NO: 696954 - DNA, 20 bp, mouse
gcccggaagtgggctgactc

SEQ ID NO: 696955 - DNA, 20 bp, mouse
gcgcccaggtacacaagggt

SEQ ID NO: 696956 - DNA, 20 bp, mouse
gtgtcctgtttggggatagt

SEQ ID NO: 696957 - DNA, 20 bp, mouse
gagtccaactatccccaaac

SEQ ID NO: 696958 - DNA, 20 bp, mouse
gttagccccgcccccgcgga

SEQ ID NO: 696959 - DNA, 20 bp, mouse
gtcttccccggaagcagaag

SEQ ID NO: 696960 - DNA, 20 bp, mouse
gggagactttggcttttttt

SEQ ID NO: 696961 - DNA, 20 bp, mouse
gctaaaggaagccggaagtc

SEQ ID NO: 696962 - DNA, 20 bp, mouse
gccggaagcggcctgacttc

SEQ ID NO: 696963 - DNA, 20 bp, mouse
gttgggagctgtcctgtttg

SEQ ID NO: 696964 - DNA, 20 bp, mouse
gtctaaacgctaggagactt

SEQ ID NO: 696965 - DNA, 20 bp, mouse
gaaaaagtagagcagagtcc

SEQ ID NO: 696966 - DNA, 20 bp, mouse
gagcaactggcagagagtag

SEQ ID NO: 696967 - DNA, 20 bp, mouse
gctcggcgcccagaactcat

SEQ ID NO: 696968 - DNA, 20 bp, mouse
gctaggagggcgggagagaa

SEQ ID NO: 696969 - DNA, 20 bp, mouse
ggaggtaactgcaatcctga

SEQ ID NO: 696970 - DNA, 20 bp, mouse
gggaaacacgccctaccctg

SEQ ID NO: 696971 - DNA, 20 bp, mouse
ggaaggggaggagttcttcc

SEQ ID NO: 696972 - DNA, 20 bp, mouse
ggcagagagtagcggcttgg

SEQ ID NO: 696973 - DNA, 20 bp, mouse
gtggttcttaaagtctgaac

SEQ ID NO: 696974 - DNA, 20 bp, mouse
ggggaaacaagcgttctagg

SEQ ID NO: 696975 - DNA, 20 bp, mouse
ggccctgacagtccaccctc

SEQ ID NO: 696976 - DNA, 20 bp, mouse
ggagggaaccgaagccgaag

SEQ ID NO: 696977 - DNA, 20 bp, mouse
gtgggccgagtcggatactg

SEQ ID NO: 696978 - DNA, 20 bp, mouse
gccaggaggaggcaccaacg

SEQ ID NO: 696979 - DNA, 20 bp, mouse
gatactggggagaggacgga

SEQ ID NO: 696980 - DNA, 20 bp, mouse
gtggacaccggcaaggacag

SEQ ID NO: 696981 - DNA, 20 bp, mouse
gagcggggttgtgggacctg

SEQ ID NO: 696982 - DNA, 20 bp, mouse
gttgtcccccccttcggctt

SEQ ID NO: 696983 - DNA, 20 bp, mouse
gagggagcaggagaggtcgc

SEQ ID NO: 696984 - DNA, 20 bp, mouse
gacggacggagcctggacac

SEQ ID NO: 696985 - DNA, 20 bp, mouse
gtcgctcccgaagcccgcgg

SEQ ID NO: 696986 - DNA, 20 bp, mouse
gtcaccgtgggtgaccgaga

SEQ ID NO: 696987 - DNA, 20 bp, mouse
ggtcccctctcggtcaccca

SEQ ID NO: 696988 - DNA, 20 bp, mouse
ggaaaagtgtccagggacgg

SEQ ID NO: 696989 - DNA, 20 bp, mouse
gtcaccgggaaaagtgtcca

SEQ ID NO: 696990 - DNA, 20 bp, mouse
gaccgagaggggacggcggg

SEQ ID NO: 696991 - DNA, 20 bp, mouse
ggggctgtgggcgacccgac

SEQ ID NO: 696992 - DNA, 20 bp, mouse
gcccggtgaccccaaggcaa

SEQ ID NO: 696993 - DNA, 20 bp, mouse
gcgggccccgcggggcacgt

SEQ ID NO: 696994 - DNA, 20 bp, mouse
gacggcgcacttgtcaccgt

SEQ ID NO: 696995 - DNA, 20 bp, mouse
gcgcgcccacgtgccccgcg

SEQ ID NO: 696996 - DNA, 20 bp, mouse
gggtgcgtggtgcggaggag

SEQ ID NO: 696997 - DNA, 20 bp, mouse
gagggcgaggctagggatgg

SEQ ID NO: 696998 - DNA, 20 bp, mouse
gcttaactgctcaggcttca

SEQ ID NO: 696999 - DNA, 20 bp, mouse
gacctcatcccgggaacctg

SEQ ID NO: 697000 - DNA, 20 bp, mouse
gaggcttcagggcgaggcta

SEQ ID NO: 697001 - DNA, 20 bp, mouse
ggaacctgtggggcagaaaa

SEQ ID NO: 697002 - DNA, 20 bp, mouse
ggggttgcacttggcaaagt

SEQ ID NO: 697003 - DNA, 20 bp, mouse
gcaggctgataggcgggaga

SEQ ID NO: 697004 - DNA, 20 bp, mouse
gaagtgggcaggctgatagg

SEQ ID NO: 697005 - DNA, 20 bp, mouse
gttcagggcgaggctaggga

SEQ ID NO: 697006 - DNA, 20 bp, mouse
gcggaagagcacataatcga

SEQ ID NO: 697007 - DNA, 20 bp, mouse
gttgccaaggcgacccccac

SEQ ID NO: 697008 - DNA, 20 bp, mouse
gcatgcctgctggaactcca

SEQ ID NO: 697009 - DNA, 20 bp, mouse
gcagctgtgggggcacccag

SEQ ID NO: 697010 - DNA, 20 bp, mouse
gtgaagacagtcccttgcca

SEQ ID NO: 697011 - DNA, 20 bp, mouse
gtaggagcgggcagcccgtg

SEQ ID NO: 697012 - DNA, 20 bp, mouse
gaccccggaggccgcagtcc

SEQ ID NO: 697013 - DNA, 20 bp, mouse
gggacccgccgcctcagctc

SEQ ID NO: 697014 - DNA, 20 bp, mouse
ggaggccgcagtccaggcta

SEQ ID NO: 697015 - DNA, 20 bp, mouse
gccatccagcgcagccgcgc

SEQ ID NO: 697016 - DNA, 20 bp, mouse
gaggaaggggcgtttcctag

SEQ ID NO: 697017 - DNA, 20 bp, mouse
gtccacgaggcgctcgggga

SEQ ID NO: 697018 - DNA, 20 bp, mouse
gagggcttgccactgaggaa

SEQ ID NO: 697019 - DNA, 20 bp, mouse
gcttcggcaaggggattagc

SEQ ID NO: 697020 - DNA, 20 bp, mouse
gggcccgggcggtgtgaagc

SEQ ID NO: 697021 - DNA, 20 bp, mouse
gggaaacgccccttcctcag

SEQ ID NO: 697022 - DNA, 20 bp, mouse
gggattagctggttcattcc

SEQ ID NO: 697023 - DNA, 20 bp, mouse
gcgtatggagcgatctgatt

SEQ ID NO: 697024 - DNA, 20 bp, mouse
ggagggagagagctgttgat

SEQ ID NO: 697025 - DNA, 20 bp, mouse
gagagcggtaaagatggacg

SEQ ID NO: 697026 - DNA, 20 bp, mouse
ggcctcgcgcgtggcgtcgg

SEQ ID NO: 697027 - DNA, 20 bp, mouse
gggtcccgccccacacgccc

SEQ ID NO: 697028 - DNA, 20 bp, mouse
gtaactgcgcgtggccctac

SEQ ID NO: 697029 - DNA, 20 bp, mouse
gcggctccgcccgggcgtgt

SEQ ID NO: 697030 - DNA, 20 bp, mouse
ggccacgcgcgaggcatgcc

SEQ ID NO: 697031 - DNA, 20 bp, mouse
gcatgcctcgcgcgtggcgt

SEQ ID NO: 697032 - DNA, 20 bp, mouse
gtccgcccgggcgtgtgggg

SEQ ID NO: 697033 - DNA, 20 bp, mouse
gtggcaggaggctgtactaa

SEQ ID NO: 697034 - DNA, 20 bp, mouse
gggcgcgccgcccgggaggg

SEQ ID NO: 697035 - DNA, 20 bp, mouse
gaggggcgcgccgcccggga

SEQ ID NO: 697036 - DNA, 20 bp, mouse
gtaggacaggatctcgcccg

SEQ ID NO: 697037 - DNA, 20 bp, mouse
gtcctaagcactagtccgaa

SEQ ID NO: 697038 - DNA, 20 bp, mouse
gtcggctggagaaacacatt

SEQ ID NO: 697039 - DNA, 20 bp, mouse
gtagtccgaaaggctgcgat

SEQ ID NO: 697040 - DNA, 20 bp, mouse
gctgctgccaacaggtcaga

SEQ ID NO: 697041 - DNA, 20 bp, mouse
ggcggcttccgtggcgactg

SEQ ID NO: 697042 - DNA, 20 bp, mouse
gcgcgccgccgcagtcgcca

SEQ ID NO: 697043 - DNA, 20 bp, mouse
ggcttccgtggcgactgcgg

SEQ ID NO: 697044 - DNA, 20 bp, mouse
gttaataaggccacctcgct

SEQ ID NO: 697045 - DNA, 20 bp, mouse
gttcgcctcaggctgaccac

SEQ ID NO: 697046 - DNA, 20 bp, mouse
gaaggtccggctccagggaa

SEQ ID NO: 697047 - DNA, 20 bp, mouse
gcggaccttctggcttttta

SEQ ID NO: 697048 - DNA, 20 bp, mouse
gagggaggttgcttctctgc

SEQ ID NO: 697049 - DNA, 20 bp, mouse
gaaaggttccgaggttgccc

SEQ ID NO: 697050 - DNA, 20 bp, mouse
gcagtgccaaatgacattat

SEQ ID NO: 697051 - DNA, 20 bp, mouse
ggcaacctcggaacctttca

SEQ ID NO: 697052 - DNA, 20 bp, mouse
gtgcttctctgctggctaag

SEQ ID NO: 697053 - DNA, 20 bp, mouse
gaggcaatgtaatcataaga

SEQ ID NO: 697054 - DNA, 20 bp, mouse
gcagaaagaagcttggcgca

SEQ ID NO: 697055 - DNA, 20 bp, mouse
gatagtaagcagagttttac

SEQ ID NO: 697056 - DNA, 20 bp, mouse
gctagagatggcatacccct

SEQ ID NO: 697057 - DNA, 20 bp, mouse
ggggtatgccatctctagac

SEQ ID NO: 697058 - DNA, 20 bp, mouse
gggtagccttcccaaccctt

SEQ ID NO: 697059 - DNA, 20 bp, mouse
ggtgtactagggtagtgcta

SEQ ID NO: 697060 - DNA, 20 bp, mouse
ggcacgctccagtctagaga

SEQ ID NO: 697061 - DNA, 20 bp, mouse
gaggctcggcccctttaagg

SEQ ID NO: 697062 - DNA, 20 bp, mouse
gacttggccaattttccaaa

SEQ ID NO: 697063 - DNA, 20 bp, mouse
gaagggcagggggcgtgtgt

SEQ ID NO: 697064 - DNA, 20 bp, mouse
gagagaggctctttcagttg

SEQ ID NO: 697065 - DNA, 20 bp, mouse
gtgggaccgcaaagtgaagc

SEQ ID NO: 697066 - DNA, 20 bp, mouse
gaaacacgggtgggtgtcgg

SEQ ID NO: 697067 - DNA, 20 bp, mouse
gtgggtgtcgggggaaggga

SEQ ID NO: 697068 - DNA, 20 bp, mouse
gtcgtcccggaaacacgggt

SEQ ID NO: 697069 - DNA, 20 bp, mouse
gggccggggaaatgcgtgtc

SEQ ID NO: 697070 - DNA, 20 bp, mouse
gcgggtgggtgtcgggggaa

SEQ ID NO: 697071 - DNA, 20 bp, mouse
ggaacggagtgcggcgaggt

SEQ ID NO: 697072 - DNA, 20 bp, mouse
gaacatcggcgcaccggccc

SEQ ID NO: 697073 - DNA, 20 bp, mouse
gcgaggtcgtcccggaaaca

SEQ ID NO: 697074 - DNA, 20 bp, mouse
gaccatcgccaggtacgcgg

SEQ ID NO: 697075 - DNA, 20 bp, mouse
gaggctggttaggacttgtg

SEQ ID NO: 697076 - DNA, 20 bp, mouse
gacggatcgcgggcaagagg

SEQ ID NO: 697077 - DNA, 20 bp, mouse
ggagcccctccagccagaga

SEQ ID NO: 697078 - DNA, 20 bp, mouse
gaaccctaggaatgtggctg

SEQ ID NO: 697079 - DNA, 20 bp, mouse
gcttgcccgcgatccgtctc

SEQ ID NO: 697080 - DNA, 20 bp, mouse
ggatccgtctctggctggag

SEQ ID NO: 697081 - DNA, 20 bp, mouse
ggggccaggccgcgtgcgtg

SEQ ID NO: 697082 - DNA, 20 bp, mouse
gaggtgctggaagcagccgc

SEQ ID NO: 697083 - DNA, 20 bp, mouse
gctcagaaaccctaggaatg

SEQ ID NO: 697084 - DNA, 20 bp, mouse
gctcctcagccacattccta

SEQ ID NO: 697085 - DNA, 20 bp, mouse
gcgctcgcctgccaccgagg

SEQ ID NO: 697086 - DNA, 20 bp, mouse
gggtagcctaaatgtaggga

SEQ ID NO: 697087 - DNA, 20 bp, mouse
gtctgggtagcctaaatgta

SEQ ID NO: 697088 - DNA, 20 bp, mouse
gctagagtttgaagagctag

SEQ ID NO: 697089 - DNA, 20 bp, mouse
gccacaggatgaattcttta

SEQ ID NO: 697090 - DNA, 20 bp, mouse
gcatcctggctaacttaaca

SEQ ID NO: 697091 - DNA, 20 bp, mouse
ggaaaagaaaagccctctag

SEQ ID NO: 697092 - DNA, 20 bp, mouse
gaggatgaattctttaagga

SEQ ID NO: 697093 - DNA, 20 bp, mouse
gaggaactcgatgactaagc

SEQ ID NO: 697094 - DNA, 20 bp, mouse
gcctggcgagacctccaggg

SEQ ID NO: 697095 - DNA, 20 bp, mouse
gagatggatttcatacctct

SEQ ID NO: 697096 - DNA, 20 bp, mouse
gcaggcgctgaacccagtgg

SEQ ID NO: 697097 - DNA, 20 bp, mouse
ggggctgcgctgctaggctg

SEQ ID NO: 697098 - DNA, 20 bp, mouse
gctgcctggagtgaggtctc

SEQ ID NO: 697099 - DNA, 20 bp, mouse
gccccagaaagcacagaagg

SEQ ID NO: 697100 - DNA, 20 bp, mouse
gccagtgggggtacgggtgg

SEQ ID NO: 697101 - DNA, 20 bp, mouse
ggctgaacccagtgggggta

SEQ ID NO: 697102 - DNA, 20 bp, mouse
ggcactgtgcccaaagaaac

SEQ ID NO: 697103 - DNA, 20 bp, mouse
gcaccttagaggcgcgattg

SEQ ID NO: 697104 - DNA, 20 bp, mouse
gaagcctcctccagccgctg

SEQ ID NO: 697105 - DNA, 20 bp, mouse
gacagaagctgcctggagtg

SEQ ID NO: 697106 - DNA, 20 bp, mouse
gatgaccttggggtctcact

SEQ ID NO: 697107 - DNA, 20 bp, mouse
ggcaggatcagatgaccttg

SEQ ID NO: 697108 - DNA, 20 bp, mouse
ggaaaaggctgtgatgtggt

SEQ ID NO: 697109 - DNA, 20 bp, mouse
gctgaaaacaggttagtgat

SEQ ID NO: 697110 - DNA, 20 bp, mouse
gtagagaaaaggctgtgatg

SEQ ID NO: 697111 - DNA, 20 bp, mouse
gtaagcccagtgagacccca

SEQ ID NO: 697112 - DNA, 20 bp, mouse
ggtaatcgtccctatcccat

SEQ ID NO: 697113 - DNA, 20 bp, mouse
gagcctggaccccttctgat

SEQ ID NO: 697114 - DNA, 20 bp, mouse
gctccaatcagaaggggtcc

SEQ ID NO: 697115 - DNA, 20 bp, mouse
gcagccttttctctaaaaag

SEQ ID NO: 697116 - DNA, 20 bp, mouse
gacaaaaagggggtctgcag

SEQ ID NO: 697117 - DNA, 20 bp, mouse
gtaaaatgcggaagcaagat

SEQ ID NO: 697118 - DNA, 20 bp, mouse
gggctgactctgggaatgaa

SEQ ID NO: 697119 - DNA, 20 bp, mouse
gttcctctacaagaggaaag

SEQ ID NO: 697120 - DNA, 20 bp, mouse
gtcttgtagaggaactgaaa

SEQ ID NO: 697121 - DNA, 20 bp, mouse
gcgcctctttcctcttgtag

SEQ ID NO: 697122 - DNA, 20 bp, mouse
ggtagaatttgtggaaggaa

SEQ ID NO: 697123 - DNA, 20 bp, mouse
gttaaactttacaccaaact

SEQ ID NO: 697124 - DNA, 20 bp, mouse
gccaaacttggtagaatttg

SEQ ID NO: 697125 - DNA, 20 bp, mouse
gtctcctgggaaaggctgat

SEQ ID NO: 697126 - DNA, 20 bp, mouse
gccccctgccggagtggagg

SEQ ID NO: 697127 - DNA, 20 bp, mouse
gaagcccagggcgacccaac

SEQ ID NO: 697128 - DNA, 20 bp, mouse
gcccttgccccctgccggag

SEQ ID NO: 697129 - DNA, 20 bp, mouse
gtggggaccgcgtagagcac

SEQ ID NO: 697130 - DNA, 20 bp, mouse
ggctaagtccctagtcctaa

SEQ ID NO: 697131 - DNA, 20 bp, mouse
ggtagagcaccgggccggtt

SEQ ID NO: 697132 - DNA, 20 bp, mouse
ggggccggttgggtcgccct

SEQ ID NO: 697133 - DNA, 20 bp, mouse
gttgccccctgccggagtgg

SEQ ID NO: 697134 - DNA, 20 bp, mouse
gctacgcggtccccaattct

SEQ ID NO: 697135 - DNA, 20 bp, mouse
gcaggagctggcagcggcca

SEQ ID NO: 697136 - DNA, 20 bp, mouse
gtgagtcatgggagagttaa

SEQ ID NO: 697137 - DNA, 20 bp, mouse
gaaagcgctgcttgagtcat

SEQ ID NO: 697138 - DNA, 20 bp, mouse
gttaccctcgattatagata

SEQ ID NO: 697139 - DNA, 20 bp, mouse
gctaccttatctataatcga

SEQ ID NO: 697140 - DNA, 20 bp, mouse
gttgctggcaacaagattca

SEQ ID NO: 697141 - DNA, 20 bp, mouse
gcagttccctggcatgagaa

SEQ ID NO: 697142 - DNA, 20 bp, mouse
gaagctagctgaatatagct

SEQ ID NO: 697143 - DNA, 20 bp, mouse
ggcctaatagtctttggtgg

SEQ ID NO: 697144 - DNA, 20 bp, mouse
gacctccaccaaagactatt

SEQ ID NO: 697145 - DNA, 20 bp, mouse
ggatattgcctaatagtctt

SEQ ID NO: 697146 - DNA, 20 bp, mouse
gggactatgtctccctctag

SEQ ID NO: 697147 - DNA, 20 bp, mouse
gctccctctagcggtaaatc

SEQ ID NO: 697148 - DNA, 20 bp, mouse
gaacgctttgccggctgtca

SEQ ID NO: 697149 - DNA, 20 bp, mouse
gtatgagtctccgtgacagc

SEQ ID NO: 697150 - DNA, 20 bp, mouse
gctggattagaacgctttgc

SEQ ID NO: 697151 - DNA, 20 bp, mouse
gcagccactgctgacagaat

SEQ ID NO: 697152 - DNA, 20 bp, mouse
gaatccagatttaccgctag

SEQ ID NO: 697153 - DNA, 20 bp, mouse
ggcaatgaatatgctatcat

SEQ ID NO: 697154 - DNA, 20 bp, mouse
gctcccaattctgtcagcag

SEQ ID NO: 697155 - DNA, 20 bp, mouse
ggacagagtcaaagttaagg

SEQ ID NO: 697156 - DNA, 20 bp, mouse
gggcccgcagcggcctcttg

SEQ ID NO: 697157 - DNA, 20 bp, mouse
gttgtggcgcacagcaagtc

SEQ ID NO: 697158 - DNA, 20 bp, mouse
gtccctgaaaagagagtcgg

SEQ ID NO: 697159 - DNA, 20 bp, mouse
gaagccggcggtgcccgcaa

SEQ ID NO: 697160 - DNA, 20 bp, mouse
gtccttgaactactagacta

SEQ ID NO: 697161 - DNA, 20 bp, mouse
gggcttcttcgaaactgtgt

SEQ ID NO: 697162 - DNA, 20 bp, mouse
ggggcacagctggcccgcag

SEQ ID NO: 697163 - DNA, 20 bp, mouse
gggtgctctgcggggaacct

SEQ ID NO: 697164 - DNA, 20 bp, mouse
ggcccaccgactctcttttc

SEQ ID NO: 697165 - DNA, 20 bp, mouse
gaggtgtgaaaccctgtccg

SEQ ID NO: 697166 - DNA, 20 bp, mouse
gggactgcggggtttgacaa

SEQ ID NO: 697167 - DNA, 20 bp, mouse
gcgcacacagcagtacggta

SEQ ID NO: 697168 - DNA, 20 bp, mouse
gcaaaccccgcagtccacgt

SEQ ID NO: 697169 - DNA, 20 bp, mouse
gcgaggcgctcgcttaggag

SEQ ID NO: 697170 - DNA, 20 bp, mouse
gagaggcgcacacagcagta

SEQ ID NO: 697171 - DNA, 20 bp, mouse
ggctgtggccactactccgc

SEQ ID NO: 697172 - DNA, 20 bp, mouse
gtccgcaggtgctggaggaa

SEQ ID NO: 697173 - DNA, 20 bp, mouse
gcctgcttgcagtctgtagt

SEQ ID NO: 697174 - DNA, 20 bp, mouse
ggacaggcccacgtggactg

SEQ ID NO: 697175 - DNA, 20 bp, mouse
gggggtggggctcagaggac

SEQ ID NO: 697176 - DNA, 20 bp, mouse
ggccccgcagcgcgcgatgg

SEQ ID NO: 697177 - DNA, 20 bp, mouse
gcggcggcggggctgattca

SEQ ID NO: 697178 - DNA, 20 bp, mouse
ggggctgattcatggggccg

SEQ ID NO: 697179 - DNA, 20 bp, mouse
ggcggccagtcccccgctcc

SEQ ID NO: 697180 - DNA, 20 bp, mouse
ggaggttagcagaaagtctc

SEQ ID NO: 697181 - DNA, 20 bp, mouse
gagaaagtctcgggccgcgg

SEQ ID NO: 697182 - DNA, 20 bp, mouse
gggaaggcgacgccgatctc

SEQ ID NO: 697183 - DNA, 20 bp, mouse
gccgccagcagggcccagac

SEQ ID NO: 697184 - DNA, 20 bp, mouse
gcgggccgttgcgcaatccg

SEQ ID NO: 697185 - DNA, 20 bp, mouse
gcggccaccatcgcgcgctg

SEQ ID NO: 697186 - DNA, 20 bp, mouse
gcaaacacgcaataggcagc

SEQ ID NO: 697187 - DNA, 20 bp, mouse
gccttgcaaggatctggtgg

SEQ ID NO: 697188 - DNA, 20 bp, mouse
gtgcatctgcaccagcttaa

SEQ ID NO: 697189 - DNA, 20 bp, mouse
gtattaggcaccccttaagc

SEQ ID NO: 697190 - DNA, 20 bp, mouse
gagtcgttaaaacccttccg

SEQ ID NO: 697191 - DNA, 20 bp, mouse
gtcctgcaccctccggttcc

SEQ ID NO: 697192 - DNA, 20 bp, mouse
gggcaaagcaaacacgcaat

SEQ ID NO: 697193 - DNA, 20 bp, mouse
gcattgtgggccacagtatt

SEQ ID NO: 697194 - DNA, 20 bp, mouse
gagaacctggctgaaggggg

SEQ ID NO: 697195 - DNA, 20 bp, mouse
gaaaagtccttgcaaggatc

SEQ ID NO: 697196 - DNA, 20 bp, mouse
gcgcgcgtctggggtagaat

SEQ ID NO: 697197 - DNA, 20 bp, mouse
gcgctagcgcgttagacgtg

SEQ ID NO: 697198 - DNA, 20 bp, mouse
gacagccggaaatagagccg

SEQ ID NO: 697199 - DNA, 20 bp, mouse
gcgttagacgtgtggcgatg

SEQ ID NO: 697200 - DNA, 20 bp, mouse
gactgcgcacgcgctacggg

SEQ ID NO: 697201 - DNA, 20 bp, mouse
ggagccgcggctgcgtagat

SEQ ID NO: 697202 - DNA, 20 bp, mouse
ggacgcgcgcgatagaaaca

SEQ ID NO: 697203 - DNA, 20 bp, mouse
ggctacgggaggcacttccg

SEQ ID NO: 697204 - DNA, 20 bp, mouse
ggggaggcacttccggggac

SEQ ID NO: 697205 - DNA, 20 bp, mouse
ggtggctgcagccaagagcc

SEQ ID NO: 697206 - DNA, 20 bp, mouse
gctgcctggtaggacttcca

SEQ ID NO: 697207 - DNA, 20 bp, mouse
ggtacaaggtgtcccaacag

SEQ ID NO: 697208 - DNA, 20 bp, mouse
gcgtccctggaagtcctacc

SEQ ID NO: 697209 - DNA, 20 bp, mouse
gctaccaggcaggctactca

SEQ ID NO: 697210 - DNA, 20 bp, mouse
gcttccagggacgagaagag

SEQ ID NO: 697211 - DNA, 20 bp, mouse
ggacgatggcctctccttag

SEQ ID NO: 697212 - DNA, 20 bp, mouse
gtgaaaccagaaacagacga

SEQ ID NO: 697213 - DNA, 20 bp, mouse
gcatcctctcttctcgtccc

SEQ ID NO: 697214 - DNA, 20 bp, mouse
gaacccttagatggtagtgt

SEQ ID NO: 697215 - DNA, 20 bp, mouse
gggggctcgtgatgtcacag

SEQ ID NO: 697216 - DNA, 20 bp, mouse
gaaggaaagtggggacaaag

SEQ ID NO: 697217 - DNA, 20 bp, mouse
ggggcagagccggcagcaaa

SEQ ID NO: 697218 - DNA, 20 bp, mouse
gagcaaagggattgggagtt

SEQ ID NO: 697219 - DNA, 20 bp, mouse
ggagaggattgatgacaagg

SEQ ID NO: 697220 - DNA, 20 bp, mouse
ggagccggcagcaaagggat

SEQ ID NO: 697221 - DNA, 20 bp, mouse
ggccagctaagagtgggcgg

SEQ ID NO: 697222 - DNA, 20 bp, mouse
gctaagagtgggcggaggtg

SEQ ID NO: 697223 - DNA, 20 bp, mouse
ggattgatgacaaggtggaa

SEQ ID NO: 697224 - DNA, 20 bp, mouse
gttgccagatgtgtgtctgg

SEQ ID NO: 697225 - DNA, 20 bp, mouse
gagccctgagcaaggaaagt

SEQ ID NO: 697226 - DNA, 20 bp, mouse
ggggagcggcgaccggggaa

SEQ ID NO: 697227 - DNA, 20 bp, mouse
gcgccggcccggccattccc

SEQ ID NO: 697228 - DNA, 20 bp, mouse
gtcgccgctccccgcggagc

SEQ ID NO: 697229 - DNA, 20 bp, mouse
gtggggctgcccctccccgg

SEQ ID NO: 697230 - DNA, 20 bp, mouse
gccgcggggagcggcgaccg

SEQ ID NO: 697231 - DNA, 20 bp, mouse
gtagtcccgcctacccgcaa

SEQ ID NO: 697232 - DNA, 20 bp, mouse
gcgcctacccgcaacggggg

SEQ ID NO: 697233 - DNA, 20 bp, mouse
ggctgcgccgggtgcgcact

SEQ ID NO: 697234 - DNA, 20 bp, mouse
gtgggctccgcagacaccgt

SEQ ID NO: 697235 - DNA, 20 bp, mouse
gtcccgcctacccgcaacgg

SEQ ID NO: 697236 - DNA, 20 bp, mouse
ggggaacccgcaggcagcgg

SEQ ID NO: 697237 - DNA, 20 bp, mouse
gaggaggcgcggcgacaccg

SEQ ID NO: 697238 - DNA, 20 bp, mouse
ggccgccagggttaaggcgc

SEQ ID NO: 697239 - DNA, 20 bp, mouse
gcaccgcggggcgcggccaa

SEQ ID NO: 697240 - DNA, 20 bp, mouse
gcgtggagcttcagggacgc

SEQ ID NO: 697241 - DNA, 20 bp, mouse
gctgacgcggggggcggctc

SEQ ID NO: 697242 - DNA, 20 bp, mouse
gcagacgccccgcgggcttc

SEQ ID NO: 697243 - DNA, 20 bp, mouse
ggccctgtgcgcgcggctct

SEQ ID NO: 697244 - DNA, 20 bp, mouse
gctgcctgcgggttcccagc

SEQ ID NO: 697245 - DNA, 20 bp, mouse
ggccccgcgggcttcgggga

SEQ ID NO: 697246 - DNA, 20 bp, mouse
gcggccagctagtgcgaaag

SEQ ID NO: 697247 - DNA, 20 bp, mouse
gctggggcgcagcctctgat

SEQ ID NO: 697248 - DNA, 20 bp, mouse
ggaggcggaaggtaccagtg

SEQ ID NO: 697249 - DNA, 20 bp, mouse
gccagctagtgcgaaagagg

SEQ ID NO: 697250 - DNA, 20 bp, mouse
gacccatagctcccgatcag

SEQ ID NO: 697251 - DNA, 20 bp, mouse
ggtcccgtggcctaccaggt

SEQ ID NO: 697252 - DNA, 20 bp, mouse
gctagtgcgaaagaggcgga

SEQ ID NO: 697253 - DNA, 20 bp, mouse
gccacgggactcctcagcat

SEQ ID NO: 697254 - DNA, 20 bp, mouse
gcagagagaaggtgtttaag

SEQ ID NO: 697255 - DNA, 20 bp, mouse
gctcccacctggtaggccac

SEQ ID NO: 697256 - DNA, 20 bp, mouse
gccgccgcgcggggaaccat

SEQ ID NO: 697257 - DNA, 20 bp, mouse
ggggactcgtagttccaacg

SEQ ID NO: 697258 - DNA, 20 bp, mouse
gcgggacttagtcaattcca

SEQ ID NO: 697259 - DNA, 20 bp, mouse
gaagtcccgggcgcactccc

SEQ ID NO: 697260 - DNA, 20 bp, mouse
gtgcctctagccctgcgagc

SEQ ID NO: 697261 - DNA, 20 bp, mouse
gccttgttacgtcacttccg

SEQ ID NO: 697262 - DNA, 20 bp, mouse
gcacgctcccagtctggcct

SEQ ID NO: 697263 - DNA, 20 bp, mouse
gtgacgtaacaaggcacgcg

SEQ ID NO: 697264 - DNA, 20 bp, mouse
ggccctgcgagcgggcacgg

SEQ ID NO: 697265 - DNA, 20 bp, mouse
ggtttccgcaaacagaatcg

SEQ ID NO: 697266 - DNA, 20 bp, mouse
ggccccacccactcatggat

SEQ ID NO: 697267 - DNA, 20 bp, mouse
gggccctaaaggtgttgggg

SEQ ID NO: 697268 - DNA, 20 bp, mouse
ggataggctgcttctgcgga

SEQ ID NO: 697269 - DNA, 20 bp, mouse
gatagcggagcgcaggtttt

SEQ ID NO: 697270 - DNA, 20 bp, mouse
ggaacttagccaaggaagcg

SEQ ID NO: 697271 - DNA, 20 bp, mouse
gagaactaggctgatagact

SEQ ID NO: 697272 - DNA, 20 bp, mouse
ggggcgggccctaaaggtgt

SEQ ID NO: 697273 - DNA, 20 bp, mouse
gcagcctatccatgagtggg

SEQ ID NO: 697274 - DNA, 20 bp, mouse
ggggctctatagcggagcgc

SEQ ID NO: 697275 - DNA, 20 bp, mouse
gaagcagcctatccatgagt

SEQ ID NO: 697276 - DNA, 20 bp, mouse
ggagggagggagacacgcgg

SEQ ID NO: 697277 - DNA, 20 bp, mouse
gaaggagcgggcgccggaga

SEQ ID NO: 697278 - DNA, 20 bp, mouse
gcggggcggggccgacgggc

SEQ ID NO: 697279 - DNA, 20 bp, mouse
gctagcccagagccgcgcgg

SEQ ID NO: 697280 - DNA, 20 bp, mouse
gccgcgcggcgggaaggagc

SEQ ID NO: 697281 - DNA, 20 bp, mouse
gggcgagcgccgggacgggc

SEQ ID NO: 697282 - DNA, 20 bp, mouse
gccttcccgccgcgcggctc

SEQ ID NO: 697283 - DNA, 20 bp, mouse
gtggcggcgagcgccgggac

SEQ ID NO: 697284 - DNA, 20 bp, mouse
ggagcgggcgccggagaggg

SEQ ID NO: 697285 - DNA, 20 bp, mouse
ggctcgccgccagcccgtcc

SEQ ID NO: 697286 - DNA, 20 bp, mouse
ggcagccagggcggacgctg

SEQ ID NO: 697287 - DNA, 20 bp, mouse
gcggctgcgcgcccaagcac

SEQ ID NO: 697288 - DNA, 20 bp, mouse
gcccgcgtacgacctggtgt

SEQ ID NO: 697289 - DNA, 20 bp, mouse
ggccccgcccgcgtacgacc

SEQ ID NO: 697290 - DNA, 20 bp, mouse
ggccgccagcgtggagccca

SEQ ID NO: 697291 - DNA, 20 bp, mouse
gtcctccgcagcgtccgccc

SEQ ID NO: 697292 - DNA, 20 bp, mouse
gatgggcaatgccgggtcta

SEQ ID NO: 697293 - DNA, 20 bp, mouse
gaatcatgtggccccagtcg

SEQ ID NO: 697294 - DNA, 20 bp, mouse
ggcagaggtttcgttgtcga

SEQ ID NO: 697295 - DNA, 20 bp, mouse
ggacgctgcggaggacaagg

SEQ ID NO: 697296 - DNA, 20 bp, mouse
gggcgggagggggtcgtgtc

SEQ ID NO: 697297 - DNA, 20 bp, mouse
gagcccggctgtagtagcac

SEQ ID NO: 697298 - DNA, 20 bp, mouse
ggcgccctagccaatggagg

SEQ ID NO: 697299 - DNA, 20 bp, mouse
gcctccagcccccactctgc

SEQ ID NO: 697300 - DNA, 20 bp, mouse
gctcccgtgctactacagcc

SEQ ID NO: 697301 - DNA, 20 bp, mouse
gtgcacgggacgaacgtgcg

SEQ ID NO: 697302 - DNA, 20 bp, mouse
ggccccgcctccattggcta

SEQ ID NO: 697303 - DNA, 20 bp, mouse
gtggagggcggggctgaaag

SEQ ID NO: 697304 - DNA, 20 bp, mouse
gggcgcggctgccagatgtt

SEQ ID NO: 697305 - DNA, 20 bp, mouse
gcgggacgaacgtgcggggg

SEQ ID NO: 697306 - DNA, 20 bp, mouse
gaactcagaaggggtatctt

SEQ ID NO: 697307 - DNA, 20 bp, mouse
ggcagacagcagcaactact

SEQ ID NO: 697308 - DNA, 20 bp, mouse
gacccgagaaagtctgtcac

SEQ ID NO: 697309 - DNA, 20 bp, mouse
gtgggaagagcggtcgggga

SEQ ID NO: 697310 - DNA, 20 bp, mouse
ggccggtgacagactttctc

SEQ ID NO: 697311 - DNA, 20 bp, mouse
gtcaatgcccgggatagggg

SEQ ID NO: 697312 - DNA, 20 bp, mouse
gccaatgggaagagcggtcg

SEQ ID NO: 697313 - DNA, 20 bp, mouse
gaccccttctgagttctcat

SEQ ID NO: 697314 - DNA, 20 bp, mouse
gccgctcaatgcccgggata

SEQ ID NO: 697315 - DNA, 20 bp, mouse
ggttctgtggggcatggaac

SEQ ID NO: 697316 - DNA, 20 bp, mouse
gactggggactgggtagaac

SEQ ID NO: 697317 - DNA, 20 bp, mouse
ggaaagtggcgtggtggcgt

SEQ ID NO: 697318 - DNA, 20 bp, mouse
ggcccccgcagctccagact

SEQ ID NO: 697319 - DNA, 20 bp, mouse
gcgagcaaagaagtgcccga

SEQ ID NO: 697320 - DNA, 20 bp, mouse
ggaactagcgtggctttgtg

SEQ ID NO: 697321 - DNA, 20 bp, mouse
gtcacgtgaaagtggcgtgg

SEQ ID NO: 697322 - DNA, 20 bp, mouse
gggttgctcaaagaagctag

SEQ ID NO: 697323 - DNA, 20 bp, mouse
gagctagtttggaactagcg

SEQ ID NO: 697324 - DNA, 20 bp, mouse
gttgagggcgggtgagacta

SEQ ID NO: 697325 - DNA, 20 bp, mouse
gcctggggaactgtggcagg

SEQ ID NO: 697326 - DNA, 20 bp, mouse
gaatcccgccccagtcctgg

SEQ ID NO: 697327 - DNA, 20 bp, mouse
gaggactggggcgggattat

SEQ ID NO: 697328 - DNA, 20 bp, mouse
gtgtatactaatatcagggg

SEQ ID NO: 697329 - DNA, 20 bp, mouse
gtgtgcgcttgtctcgcccc

SEQ ID NO: 697330 - DNA, 20 bp, mouse
gctggtgggcaccacctcca

SEQ ID NO: 697331 - DNA, 20 bp, mouse
gccaccctgctgcactacta

SEQ ID NO: 697332 - DNA, 20 bp, mouse
ggggcataggctggctgaag

SEQ ID NO: 697333 - DNA, 20 bp, mouse
ggtgcccaccaggactgggg

SEQ ID NO: 697334 - DNA, 20 bp, mouse
gatgagaacaacctaggctt

SEQ ID NO: 697335 - DNA, 20 bp, mouse
gctggctgaagaggctgcgc

SEQ ID NO: 697336 - DNA, 20 bp, mouse
gcacccggagcgcagttcct

SEQ ID NO: 697337 - DNA, 20 bp, mouse
gccgccgcgcgtcctggagt

SEQ ID NO: 697338 - DNA, 20 bp, mouse
gcggaggaagtgacgagagt

SEQ ID NO: 697339 - DNA, 20 bp, mouse
gaggagcgaggggtcccgga

SEQ ID NO: 697340 - DNA, 20 bp, mouse
gtcctctgagacccttatcc

SEQ ID NO: 697341 - DNA, 20 bp, mouse
ggcagcgcgcatctaccccg

SEQ ID NO: 697342 - DNA, 20 bp, mouse
ggcggcgttgccataacaac

SEQ ID NO: 697343 - DNA, 20 bp, mouse
ggtcctggagttggagattg

SEQ ID NO: 697344 - DNA, 20 bp, mouse
ggcaacgccgccgcgcgtcc

SEQ ID NO: 697345 - DNA, 20 bp, mouse
gcggtgcaggcagtccctgc

SEQ ID NO: 697346 - DNA, 20 bp, mouse
gacccccagcactgcgacca

SEQ ID NO: 697347 - DNA, 20 bp, mouse
gggtgcaacagcagctagag

SEQ ID NO: 697348 - DNA, 20 bp, mouse
gagccgtggtcgcagtgctg

SEQ ID NO: 697349 - DNA, 20 bp, mouse
gcacgcttgaggttgctgag

SEQ ID NO: 697350 - DNA, 20 bp, mouse
gcccggggagggaccgtcgc

SEQ ID NO: 697351 - DNA, 20 bp, mouse
ggggagggaccgtcgcaggg

SEQ ID NO: 697352 - DNA, 20 bp, mouse
ggggcggagcgacattgggt

SEQ ID NO: 697353 - DNA, 20 bp, mouse
ggggtggctgggcgctgggc

SEQ ID NO: 697354 - DNA, 20 bp, mouse
ggggcaacaactatgttcat

SEQ ID NO: 697355 - DNA, 20 bp, mouse
gggcgggcggccccatcagc

SEQ ID NO: 697356 - DNA, 20 bp, mouse
gctaccgaggcggagtctga

SEQ ID NO: 697357 - DNA, 20 bp, mouse
ggaaacaggggttgggtctc

SEQ ID NO: 697358 - DNA, 20 bp, mouse
gaaggtgggaactgggacaa

SEQ ID NO: 697359 - DNA, 20 bp, mouse
gggcgtggtcagggctaccg

SEQ ID NO: 697360 - DNA, 20 bp, mouse
gacgaaaggggcggagtcac

SEQ ID NO: 697361 - DNA, 20 bp, mouse
gggaccagccccgggaaggt

SEQ ID NO: 697362 - DNA, 20 bp, mouse
gaatgcaaagaagacgaaag

SEQ ID NO: 697363 - DNA, 20 bp, mouse
gaggcggggctctgacccaa

SEQ ID NO: 697364 - DNA, 20 bp, mouse
gccccgggaaggtgggaact

SEQ ID NO: 697365 - DNA, 20 bp, mouse
gcaaaagggggcgggaaaca

SEQ ID NO: 697366 - DNA, 20 bp, mouse
gcgtgccgtgctcagagagg

SEQ ID NO: 697367 - DNA, 20 bp, mouse
gctgtcgcgcgaaggctgaa

SEQ ID NO: 697368 - DNA, 20 bp, mouse
ggtgctgaacgagcgatctg

SEQ ID NO: 697369 - DNA, 20 bp, mouse
gcgttccggggaatgtgcgt

SEQ ID NO: 697370 - DNA, 20 bp, mouse
gctgaagggagtgtggccgt

SEQ ID NO: 697371 - DNA, 20 bp, mouse
gggctcctacgcacattccc

SEQ ID NO: 697372 - DNA, 20 bp, mouse
gccggaggcccaaccgataa

SEQ ID NO: 697373 - DNA, 20 bp, mouse
gaggagctgcggtgcgtggg

SEQ ID NO: 697374 - DNA, 20 bp, mouse
gagggtctagaatactgagg

SEQ ID NO: 697375 - DNA, 20 bp, mouse
gagactacggagcgtcccca

SEQ ID NO: 697376 - DNA, 20 bp, mouse
gctcccccaagaaatatgaa

SEQ ID NO: 697377 - DNA, 20 bp, mouse
gggtagatgctaaggattaa

SEQ ID NO: 697378 - DNA, 20 bp, mouse
gcattcaagagcacagttga

SEQ ID NO: 697379 - DNA, 20 bp, mouse
gtccaagcaacaccaggata

SEQ ID NO: 697380 - DNA, 20 bp, mouse
gatgtcacccagaaacagaa

SEQ ID NO: 697381 - DNA, 20 bp, mouse
ggatgcgtattccccaaata

SEQ ID NO: 697382 - DNA, 20 bp, mouse
gattgcagaaaagttcttgt

SEQ ID NO: 697383 - DNA, 20 bp, mouse
gcccccttcatatttcttgg

SEQ ID NO: 697384 - DNA, 20 bp, mouse
gctcaagagtaccttttctg

SEQ ID NO: 697385 - DNA, 20 bp, mouse
gtgtgaagtgtgtaccaaga

SEQ ID NO: 697386 - DNA, 20 bp, mouse
ggcaactcaccctctgctgc

SEQ ID NO: 697387 - DNA, 20 bp, mouse
ggcaggctaacagcaatata

SEQ ID NO: 697388 - DNA, 20 bp, mouse
gttggcatgagagctaagta

SEQ ID NO: 697389 - DNA, 20 bp, mouse
gcatgagagctaagtaaggc

SEQ ID NO: 697390 - DNA, 20 bp, mouse
gctaagtaaggcaggaagac

SEQ ID NO: 697391 - DNA, 20 bp, mouse
ggagttgccatgtgggccag

SEQ ID NO: 697392 - DNA, 20 bp, mouse
gtagttaatgaggaggcttc

SEQ ID NO: 697393 - DNA, 20 bp, mouse
gttgtttaaagcacatgtgg

SEQ ID NO: 697394 - DNA, 20 bp, mouse
ggggatcaatttagttaatg

SEQ ID NO: 697395 - DNA, 20 bp, mouse
gatcaatttagttaatgagg

SEQ ID NO: 697396 - DNA, 20 bp, mouse
gcgggtggcgctatccaagg

SEQ ID NO: 697397 - DNA, 20 bp, mouse
gaagcggccgacaccgtgca

SEQ ID NO: 697398 - DNA, 20 bp, mouse
gctgcccgccgctgagacca

SEQ ID NO: 697399 - DNA, 20 bp, mouse
gaccccggggtcgagggcag

SEQ ID NO: 697400 - DNA, 20 bp, mouse
ggtagcgccctgcacggtgt

SEQ ID NO: 697401 - DNA, 20 bp, mouse
gccagctgggccatgtcaaa

SEQ ID NO: 697402 - DNA, 20 bp, mouse
gcccgtaagagctcagagga

SEQ ID NO: 697403 - DNA, 20 bp, mouse
ggggccatgtcaaaaggctc

SEQ ID NO: 697404 - DNA, 20 bp, mouse
gtatccaaggcggcttcccg

SEQ ID NO: 697405 - DNA, 20 bp, mouse
gcgcttggagaagttgcggg

SEQ ID NO: 697406 - DNA, 20 bp, mouse
ggagctcccgcaagtgggaa

SEQ ID NO: 697407 - DNA, 20 bp, mouse
gtgggcgcgcagggatcctc

SEQ ID NO: 697408 - DNA, 20 bp, mouse
gcggggaggaggcggaactt

SEQ ID NO: 697409 - DNA, 20 bp, mouse
gctagcgccccctccggaca

SEQ ID NO: 697410 - DNA, 20 bp, mouse
ggccccctccggacacgggg

SEQ ID NO: 697411 - DNA, 20 bp, mouse
gccctccggacacggggagg

SEQ ID NO: 697412 - DNA, 20 bp, mouse
ggcaaggagctcccgcaagt

SEQ ID NO: 697413 - DNA, 20 bp, mouse
gcggggacagctgacgttgt

SEQ ID NO: 697414 - DNA, 20 bp, mouse
gcgggagctccttgcgcgga

SEQ ID NO: 697415 - DNA, 20 bp, mouse
ggcctcctccccgtgtccgg

SEQ ID NO: 697416 - DNA, 20 bp, mouse
gtacctgaaaggcaagacct

SEQ ID NO: 697417 - DNA, 20 bp, mouse
ggggtcgggctcatatgaag

SEQ ID NO: 697418 - DNA, 20 bp, mouse
ggggctggccagttcctgac

SEQ ID NO: 697419 - DNA, 20 bp, mouse
gcacaggctcagacagactt

SEQ ID NO: 697420 - DNA, 20 bp, mouse
gtgctgcggagagagcatca

SEQ ID NO: 697421 - DNA, 20 bp, mouse
gcgcaggcgcgggtttccct

SEQ ID NO: 697422 - DNA, 20 bp, mouse
gggccagttcctgacgggta

SEQ ID NO: 697423 - DNA, 20 bp, mouse
ggccccggctgcggtgaaag

SEQ ID NO: 697424 - DNA, 20 bp, mouse
gaggttccgccctacccgtc

SEQ ID NO: 697425 - DNA, 20 bp, mouse
gagcccaggtcttgcctttc

SEQ ID NO: 697426 - DNA, 20 bp, mouse
ggcgcatgagttggagacta

SEQ ID NO: 697427 - DNA, 20 bp, mouse
gatgagttggagactagggt

SEQ ID NO: 697428 - DNA, 20 bp, mouse
gcggcctgacgtcacaaagc

SEQ ID NO: 697429 - DNA, 20 bp, mouse
gggccgccccgcccctcggg

SEQ ID NO: 697430 - DNA, 20 bp, mouse
gaagtgaagtgcgcatgagt

SEQ ID NO: 697431 - DNA, 20 bp, mouse
gtgcatctggcgtcctctaa

SEQ ID NO: 697432 - DNA, 20 bp, mouse
ggcccaggaaggtcagatat

SEQ ID NO: 697433 - DNA, 20 bp, mouse
gtgcaggaaagccgcccgag

SEQ ID NO: 697434 - DNA, 20 bp, mouse
ggagttgagaataacgacac

SEQ ID NO: 697435 - DNA, 20 bp, mouse
gctcaactcttcaccattag

SEQ ID NO: 697436 - DNA, 20 bp, mouse
gtggggcggagcccagagga

SEQ ID NO: 697437 - DNA, 20 bp, mouse
gggagggggaagattgattg

SEQ ID NO: 697438 - DNA, 20 bp, mouse
gtaggacaggccggatgcta

SEQ ID NO: 697439 - DNA, 20 bp, mouse
gatgagggcggagctaagtg

SEQ ID NO: 697440 - DNA, 20 bp, mouse
gactaagcgggtgaaacaga

SEQ ID NO: 697441 - DNA, 20 bp, mouse
gggagaggacgggagctgag

SEQ ID NO: 697442 - DNA, 20 bp, mouse
gggacaagggcgggactaag

SEQ ID NO: 697443 - DNA, 20 bp, mouse
gaggacggggcggggctaag

SEQ ID NO: 697444 - DNA, 20 bp, mouse
gtgattggggaggagctgcg

SEQ ID NO: 697445 - DNA, 20 bp, mouse
ggcaaagcggggcttggcca

SEQ ID NO: 697446 - DNA, 20 bp, mouse
ggtgacaaggggtggaacaa

SEQ ID NO: 697447 - DNA, 20 bp, mouse
gccacatctcccagtgaacg

SEQ ID NO: 697448 - DNA, 20 bp, mouse
ggcggtgaggcttgagacag

SEQ ID NO: 697449 - DNA, 20 bp, mouse
ggctgtgcagacctaggaat

SEQ ID NO: 697450 - DNA, 20 bp, mouse
gggctgctttggatctagtt

SEQ ID NO: 697451 - DNA, 20 bp, mouse
ggacccagggccgggcggtg

SEQ ID NO: 697452 - DNA, 20 bp, mouse
gtgggctgggaattgtgaca

SEQ ID NO: 697453 - DNA, 20 bp, mouse
ggggaggaacacggcccgag

SEQ ID NO: 697454 - DNA, 20 bp, mouse
ggcttgagacagaggctcta

SEQ ID NO: 697455 - DNA, 20 bp, mouse
gacgccagaggccacccccc

SEQ ID NO: 697456 - DNA, 20 bp, mouse
ggacgcgacgggtactgaga

SEQ ID NO: 697457 - DNA, 20 bp, mouse
gtcaggcggcgcatcctcgc

SEQ ID NO: 697458 - DNA, 20 bp, mouse
gctcccagcgcggacggaga

SEQ ID NO: 697459 - DNA, 20 bp, mouse
gggtcccaggcggacgcgac

SEQ ID NO: 697460 - DNA, 20 bp, mouse
ggcgcctcccgccggacgta

SEQ ID NO: 697461 - DNA, 20 bp, mouse
ggaggcgcagcgcctcccgc

SEQ ID NO: 697462 - DNA, 20 bp, mouse
gtgagccgggccccgaaggg

SEQ ID NO: 697463 - DNA, 20 bp, mouse
gcggtgagccgggccccgaa

SEQ ID NO: 697464 - DNA, 20 bp, mouse
gggcgctgcgcctcccttcg

SEQ ID NO: 697465 - DNA, 20 bp, mouse
ggcgacgggtactgagaggg

SEQ ID NO: 697466 - DNA, 20 bp, mouse
gtccccggagcgaggtgcgc

SEQ ID NO: 697467 - DNA, 20 bp, mouse
gagagggccccgggcaatcc

SEQ ID NO: 697468 - DNA, 20 bp, mouse
ggctactgagccttcctttt

SEQ ID NO: 697469 - DNA, 20 bp, mouse
ggcctgatgtcctgcttctc

SEQ ID NO: 697470 - DNA, 20 bp, mouse
gttctagaggcctaaaagga

SEQ ID NO: 697471 - DNA, 20 bp, mouse
gcgcctgcgcacctcgctcc

SEQ ID NO: 697472 - DNA, 20 bp, mouse
gtagtcagagatgtacagta

SEQ ID NO: 697473 - DNA, 20 bp, mouse
gcccagagaagcaggacatc

SEQ ID NO: 697474 - DNA, 20 bp, mouse
gtgactgccggagagggccc

SEQ ID NO: 697475 - DNA, 20 bp, mouse
ggcaatgataaagacgtccc

SEQ ID NO: 697476 - DNA, 20 bp, mouse
gagcccctgcggactctcta

SEQ ID NO: 697477 - DNA, 20 bp, mouse
gcgaagcagcggagcccctg

SEQ ID NO: 697478 - DNA, 20 bp, mouse
ggggctccgctgcttcgcgg

SEQ ID NO: 697479 - DNA, 20 bp, mouse
gtgcgcatgcgcagcctctc

SEQ ID NO: 697480 - DNA, 20 bp, mouse
gaggctgcgcatgcgcacga

SEQ ID NO: 697481 - DNA, 20 bp, mouse
ggcttcgcggaggctcgtct

SEQ ID NO: 697482 - DNA, 20 bp, mouse
gacgagcctccgcgaagcag

SEQ ID NO: 697483 - DNA, 20 bp, mouse
gcacacatgccttgtggcat

SEQ ID NO: 697484 - DNA, 20 bp, mouse
gtacccctggagaagcgggc

SEQ ID NO: 697485 - DNA, 20 bp, mouse
gcggaggctcgtctcggagc

SEQ ID NO: 697486 - DNA, 20 bp, mouse
gggagcgcgtggagcggagg

SEQ ID NO: 697487 - DNA, 20 bp, mouse
gcccgccctccggtgttctg

SEQ ID NO: 697488 - DNA, 20 bp, mouse
gctcagagggagaatcccgt

SEQ ID NO: 697489 - DNA, 20 bp, mouse
ggccacggggaagctgacca

SEQ ID NO: 697490 - DNA, 20 bp, mouse
gccgagccacccgacccgag

SEQ ID NO: 697491 - DNA, 20 bp, mouse
ggggggagcgcgtggagcgg

SEQ ID NO: 697492 - DNA, 20 bp, mouse
ggaccacggcgcatgctcag

SEQ ID NO: 697493 - DNA, 20 bp, mouse
gggtcggcatcccctcgggt

SEQ ID NO: 697494 - DNA, 20 bp, mouse
gcggggcctggcggttgcca

SEQ ID NO: 697495 - DNA, 20 bp, mouse
gcccagcggaggtctcactg

SEQ ID NO: 697496 - DNA, 20 bp, mouse
ggaggggaaacgcctctgaa

SEQ ID NO: 697497 - DNA, 20 bp, mouse
gcctgcgacaccaacgtccc

SEQ ID NO: 697498 - DNA, 20 bp, mouse
ggacaccaacgtccctggaa

SEQ ID NO: 697499 - DNA, 20 bp, mouse
gcacactcctacaaattgag

SEQ ID NO: 697500 - DNA, 20 bp, mouse
ggcgtttcccctcaatttgt

SEQ ID NO: 697501 - DNA, 20 bp, mouse
gtactaataaacttcaacca

SEQ ID NO: 697502 - DNA, 20 bp, mouse
gaggagaatggcgtatccac

SEQ ID NO: 697503 - DNA, 20 bp, mouse
gtgtaggaagcaaggccacg

SEQ ID NO: 697504 - DNA, 20 bp, mouse
gagcctcagtcagtaagtgt

SEQ ID NO: 697505 - DNA, 20 bp, mouse
gctctctccttgcctttcag

SEQ ID NO: 697506 - DNA, 20 bp, mouse
gagtcctccgaaggcagcgg

SEQ ID NO: 697507 - DNA, 20 bp, mouse
ggggaactaaacacagagta

SEQ ID NO: 697508 - DNA, 20 bp, mouse
gcggaggactaattgatggg

SEQ ID NO: 697509 - DNA, 20 bp, mouse
gacagagtaggggctacaag

SEQ ID NO: 697510 - DNA, 20 bp, mouse
gcaggactcaggattcagtt

SEQ ID NO: 697511 - DNA, 20 bp, mouse
gaggagacgaggctccgcta

SEQ ID NO: 697512 - DNA, 20 bp, mouse
gtagctctaaagagcctcca

SEQ ID NO: 697513 - DNA, 20 bp, mouse
gctcccgccgctgccttcgg

SEQ ID NO: 697514 - DNA, 20 bp, mouse
gcatgtgctgccatcttgga

SEQ ID NO: 697515 - DNA, 20 bp, mouse
gttgccgcaggttcctagta

SEQ ID NO: 697516 - DNA, 20 bp, mouse
gaggcgggccttctccatgt

SEQ ID NO: 697517 - DNA, 20 bp, mouse
gagctggatggggacttcgg

SEQ ID NO: 697518 - DNA, 20 bp, mouse
gtgggtggccgcgtaggtca

SEQ ID NO: 697519 - DNA, 20 bp, mouse
gaacagctggatggggactt

SEQ ID NO: 697520 - DNA, 20 bp, mouse
gcagagtggtagcgatgctg

SEQ ID NO: 697521 - DNA, 20 bp, mouse
gggtagcgatgctggggaac

SEQ ID NO: 697522 - DNA, 20 bp, mouse
ggttgggaaagagtgcaaac

SEQ ID NO: 697523 - DNA, 20 bp, mouse
ggatggggacttcggaggtg

SEQ ID NO: 697524 - DNA, 20 bp, mouse
gccgggccctcactaaatgc

SEQ ID NO: 697525 - DNA, 20 bp, mouse
gcctggaagcggagcccaca

SEQ ID NO: 697526 - DNA, 20 bp, mouse
gacccagtcggtggtcgtac

SEQ ID NO: 697527 - DNA, 20 bp, mouse
gctcctgctggtcctcccgg

SEQ ID NO: 697528 - DNA, 20 bp, mouse
gaacaagggcattacgacat

SEQ ID NO: 697529 - DNA, 20 bp, mouse
gctaaggcgggagtttgggc

SEQ ID NO: 697530 - DNA, 20 bp, mouse
gggtgagctacccccgtccg

SEQ ID NO: 697531 - DNA, 20 bp, mouse
ggcggcagcgacgtgactta

SEQ ID NO: 697532 - DNA, 20 bp, mouse
gaaagctaaggcgggagttt

SEQ ID NO: 697533 - DNA, 20 bp, mouse
gacttaaggccgcccctcgt

SEQ ID NO: 697534 - DNA, 20 bp, mouse
gctcaacgacgccctacgag

SEQ ID NO: 697535 - DNA, 20 bp, mouse
gaacgacgccctacgagggg

SEQ ID NO: 697536 - DNA, 20 bp, mouse
gctgtgggttgatgtcacac

SEQ ID NO: 697537 - DNA, 20 bp, mouse
gaaacactgccaatcacgaa

SEQ ID NO: 697538 - DNA, 20 bp, mouse
gacgaatggctttaaatgta

SEQ ID NO: 697539 - DNA, 20 bp, mouse
gaaaaggcagtggcggatca

SEQ ID NO: 697540 - DNA, 20 bp, mouse
gactaggatacttacctctg

SEQ ID NO: 697541 - DNA, 20 bp, mouse
gcatctgaacaaagcctcag

SEQ ID NO: 697542 - DNA, 20 bp, mouse
gtgtcacacaggctggttcg

SEQ ID NO: 697543 - DNA, 20 bp, mouse
gtgtagctgttcaaccatga

SEQ ID NO: 697544 - DNA, 20 bp, mouse
gggtagaggctcacccttca

SEQ ID NO: 697545 - DNA, 20 bp, mouse
gggaatttggaattctgagg

SEQ ID NO: 697546 - DNA, 20 bp, mouse
gtcacagggtccttgaagag

SEQ ID NO: 697547 - DNA, 20 bp, mouse
ggtgggggctcattgaaaga

SEQ ID NO: 697548 - DNA, 20 bp, mouse
gcctactactggctaggtaa

SEQ ID NO: 697549 - DNA, 20 bp, mouse
gaaggcttgtgcacagtact

SEQ ID NO: 697550 - DNA, 20 bp, mouse
gcctgtgaagcagagataaa

SEQ ID NO: 697551 - DNA, 20 bp, mouse
gagagaggtcatctctgaac

SEQ ID NO: 697552 - DNA, 20 bp, mouse
gctgtgccctccagacggtc

SEQ ID NO: 697553 - DNA, 20 bp, mouse
gactctgagccccctgtcta

SEQ ID NO: 697554 - DNA, 20 bp, mouse
gtactggctaggtaagggct

SEQ ID NO: 697555 - DNA, 20 bp, mouse
ggatgagtcaggtcagagcc

SEQ ID NO: 697556 - DNA, 20 bp, mouse
gatagctgggagaaagcgaa

SEQ ID NO: 697557 - DNA, 20 bp, mouse
gacctctcagggtctcatca

SEQ ID NO: 697558 - DNA, 20 bp, mouse
gaaacatacaaggatgtgtt

SEQ ID NO: 697559 - DNA, 20 bp, mouse
ggaggtgcattgaaagatgg

SEQ ID NO: 697560 - DNA, 20 bp, mouse
gccagctgtgaccattttat

SEQ ID NO: 697561 - DNA, 20 bp, mouse
gaaagaggtgcattgaaaga

SEQ ID NO: 697562 - DNA, 20 bp, mouse
gaagatggcgggagtctgcc

SEQ ID NO: 697563 - DNA, 20 bp, mouse
gaacaggaggccaggaacaa

SEQ ID NO: 697564 - DNA, 20 bp, mouse
gtgtgtaaatttattagctc

SEQ ID NO: 697565 - DNA, 20 bp, mouse
gaggatagcactggtttaac

SEQ ID NO: 697566 - DNA, 20 bp, mouse
gatagaaattgtccagtggg

SEQ ID NO: 697567 - DNA, 20 bp, mouse
ggtcagcaaccaccagtagg

SEQ ID NO: 697568 - DNA, 20 bp, mouse
gtgtatgagcattttcgatt

SEQ ID NO: 697569 - DNA, 20 bp, mouse
gacgtgcaaagactattaaa

SEQ ID NO: 697570 - DNA, 20 bp, mouse
gagataatgcctcctactgg

SEQ ID NO: 697571 - DNA, 20 bp, mouse
ggatcatgaaacactgggtc

SEQ ID NO: 697572 - DNA, 20 bp, mouse
gggaaacaatgtcattcccc

SEQ ID NO: 697573 - DNA, 20 bp, mouse
gttcagataatgcctcctac

SEQ ID NO: 697574 - DNA, 20 bp, mouse
ggaagcactgagccccccac

SEQ ID NO: 697575 - DNA, 20 bp, mouse
ggcattatctgaacgttgtt

SEQ ID NO: 697576 - DNA, 20 bp, mouse
ggggatgtggagtggatctt

SEQ ID NO: 697577 - DNA, 20 bp, mouse
gtccacatcccaagactgta

SEQ ID NO: 697578 - DNA, 20 bp, mouse
gttaggagatcaaagatcac

SEQ ID NO: 697579 - DNA, 20 bp, mouse
gtgactgtgtatctcaacat

SEQ ID NO: 697580 - DNA, 20 bp, mouse
gtccctacagtcttgggatg

SEQ ID NO: 697581 - DNA, 20 bp, mouse
gttctgctccctacagtctt

SEQ ID NO: 697582 - DNA, 20 bp, mouse
gtaacagcaaagctgtcctt

SEQ ID NO: 697583 - DNA, 20 bp, mouse
gcaggcatgcagacacaatg

SEQ ID NO: 697584 - DNA, 20 bp, mouse
gtcacagggactttatttgt

SEQ ID NO: 697585 - DNA, 20 bp, mouse
gatcctggaaggctggctag

SEQ ID NO: 697586 - DNA, 20 bp, mouse
gtgccaagactacccgagac

SEQ ID NO: 697587 - DNA, 20 bp, mouse
gagtgcacacttccggtctc

SEQ ID NO: 697588 - DNA, 20 bp, mouse
gtaggacgcacgcgtcctca

SEQ ID NO: 697589 - DNA, 20 bp, mouse
gaatcagaaggaagcgagga

SEQ ID NO: 697590 - DNA, 20 bp, mouse
gtttaggcgagctatgttgt

SEQ ID NO: 697591 - DNA, 20 bp, mouse
gtcctagctgaccaatcaga

SEQ ID NO: 697592 - DNA, 20 bp, mouse
gttccggtctcgggtagtct

SEQ ID NO: 697593 - DNA, 20 bp, mouse
gaagcgaggagggtttcggc

SEQ ID NO: 697594 - DNA, 20 bp, mouse
gtgtatgcaaacaggaagtg

SEQ ID NO: 697595 - DNA, 20 bp, mouse
ggagacacagtctttagttc

SEQ ID NO: 697596 - DNA, 20 bp, mouse
gccaccgggaggacggactt

SEQ ID NO: 697597 - DNA, 20 bp, mouse
gctcccggtggggcgacaag

SEQ ID NO: 697598 - DNA, 20 bp, mouse
gaggccgggcaaggccgcgg

SEQ ID NO: 697599 - DNA, 20 bp, mouse
gaggcgaggcccagcgccct

SEQ ID NO: 697600 - DNA, 20 bp, mouse
gcctggaccgcggggaggaa

SEQ ID NO: 697601 - DNA, 20 bp, mouse
ggcgacaagcggcgcagggg

SEQ ID NO: 697602 - DNA, 20 bp, mouse
gttgcccggcctccaggcgg

SEQ ID NO: 697603 - DNA, 20 bp, mouse
gggggcgcgcctttgcagat

SEQ ID NO: 697604 - DNA, 20 bp, mouse
gccgggaggacggacttcgg

SEQ ID NO: 697605 - DNA, 20 bp, mouse
ggccttgcccggcctccagg

SEQ ID NO: 697606 - DNA, 20 bp, mouse
gagggaggaggccggtctgg

SEQ ID NO: 697607 - DNA, 20 bp, mouse
ggggtgggaggtgccgagtg

SEQ ID NO: 697608 - DNA, 20 bp, mouse
gggaggctccacctccagac

SEQ ID NO: 697609 - DNA, 20 bp, mouse
gggtccgcaggtcctcacgg

SEQ ID NO: 697610 - DNA, 20 bp, mouse
gtggaggtggagcctccgtg

SEQ ID NO: 697611 - DNA, 20 bp, mouse
ggagagggaggaggccggtc

SEQ ID NO: 697612 - DNA, 20 bp, mouse
ggacactgtaggaagctagg

SEQ ID NO: 697613 - DNA, 20 bp, mouse
gcacctaagaggacgtgtgg

SEQ ID NO: 697614 - DNA, 20 bp, mouse
ggacctacagcacagcctat

SEQ ID NO: 697615 - DNA, 20 bp, mouse
gggctgtgctgtaggtccgc

SEQ ID NO: 697616 - DNA, 20 bp, mouse
gcaggctaacaggtatgggt

SEQ ID NO: 697617 - DNA, 20 bp, mouse
gaaagtgcctcctgcttctt

SEQ ID NO: 697618 - DNA, 20 bp, mouse
ggtagcaccctggagctcca

SEQ ID NO: 697619 - DNA, 20 bp, mouse
gtggggctacagacggccaa

SEQ ID NO: 697620 - DNA, 20 bp, mouse
gctggcaggctaacaggtat

SEQ ID NO: 697621 - DNA, 20 bp, mouse
gcaggaaggttcagagtagc

SEQ ID NO: 697622 - DNA, 20 bp, mouse
gggaccaattcccagcaaat

SEQ ID NO: 697623 - DNA, 20 bp, mouse
ggtcgggaatactattgtta

SEQ ID NO: 697624 - DNA, 20 bp, mouse
gtgcacagctggtagcaccc

SEQ ID NO: 697625 - DNA, 20 bp, mouse
gccagggtcacctaagaagc

SEQ ID NO: 697626 - DNA, 20 bp, mouse
gacgcgacccgggatcttgg

SEQ ID NO: 697627 - DNA, 20 bp, mouse
gcctccagggacctcagcgt

SEQ ID NO: 697628 - DNA, 20 bp, mouse
gtggccgcgtcgggaagcgt

SEQ ID NO: 697629 - DNA, 20 bp, mouse
gccacagccgccaagatccc

SEQ ID NO: 697630 - DNA, 20 bp, mouse
gccaatgagcccggcaaccg

SEQ ID NO: 697631 - DNA, 20 bp, mouse
gacctgagaggcacccgggg

SEQ ID NO: 697632 - DNA, 20 bp, mouse
ggagccgacgctgaggtccc

SEQ ID NO: 697633 - DNA, 20 bp, mouse
ggaggaccgagccgacgctg

SEQ ID NO: 697634 - DNA, 20 bp, mouse
gcggagccgcgcacgccccc

SEQ ID NO: 697635 - DNA, 20 bp, mouse
gccgacgcggccaatgagcc

SEQ ID NO: 697636 - DNA, 20 bp, mouse
ggggaccaggttgcaggcac

SEQ ID NO: 697637 - DNA, 20 bp, mouse
gcaggcactggtcgagagaa

SEQ ID NO: 697638 - DNA, 20 bp, mouse
gacaggagaggatcccttta

SEQ ID NO: 697639 - DNA, 20 bp, mouse
gccggcgtcgcagccctaaa

SEQ ID NO: 697640 - DNA, 20 bp, mouse
ggcggacaggggaggagcac

SEQ ID NO: 697641 - DNA, 20 bp, mouse
gtggaacgtggttgcctaag

SEQ ID NO: 697642 - DNA, 20 bp, mouse
gttacccgatagatagcaag

SEQ ID NO: 697643 - DNA, 20 bp, mouse
ggcagttctggtctcttaaa

SEQ ID NO: 697644 - DNA, 20 bp, mouse
gagggaagactagtccactt

SEQ ID NO: 697645 - DNA, 20 bp, mouse
ggcgacgccggacgcagttc

SEQ ID NO: 697646 - DNA, 20 bp, mouse
gaagaatagaggggcagcga

SEQ ID NO: 697647 - DNA, 20 bp, mouse
ggcttcccaagacccagcac

SEQ ID NO: 697648 - DNA, 20 bp, mouse
gcgcgcctgtgctgggtctt

SEQ ID NO: 697649 - DNA, 20 bp, mouse
gagaggggcagcgaaggaac

SEQ ID NO: 697650 - DNA, 20 bp, mouse
gaagcgcgagtctgcgcgga

SEQ ID NO: 697651 - DNA, 20 bp, mouse
ggtcgcgactccacctccct

SEQ ID NO: 697652 - DNA, 20 bp, mouse
gtgcgggtaggaacgctctg

SEQ ID NO: 697653 - DNA, 20 bp, mouse
gggggctctccctgggaact

SEQ ID NO: 697654 - DNA, 20 bp, mouse
gtgggaagcgcgagtctgcg

SEQ ID NO: 697655 - DNA, 20 bp, mouse
gtgaaagcagagatttgggg

SEQ ID NO: 697656 - DNA, 20 bp, mouse
gaagggacgggacttgttat

SEQ ID NO: 697657 - DNA, 20 bp, mouse
gtagcggcggaagatggctg

SEQ ID NO: 697658 - DNA, 20 bp, mouse
ggcaccctgccggaagggac

SEQ ID NO: 697659 - DNA, 20 bp, mouse
gaggctgcaagaaggaagtt

SEQ ID NO: 697660 - DNA, 20 bp, mouse
gagggtgcagcaggcactac

SEQ ID NO: 697661 - DNA, 20 bp, mouse
gctgctgcaccctgccggaa

SEQ ID NO: 697662 - DNA, 20 bp, mouse
gcagagcagcaacacatatt

SEQ ID NO: 697663 - DNA, 20 bp, mouse
gagtgcctgctgcaccctgc

SEQ ID NO: 697664 - DNA, 20 bp, mouse
gagtgcggagcccagggtag

SEQ ID NO: 697665 - DNA, 20 bp, mouse
gccagctgatgctcggagtc

SEQ ID NO: 697666 - DNA, 20 bp, mouse
gagctgctggagctaggcca

SEQ ID NO: 697667 - DNA, 20 bp, mouse
gtgtctgtgctcatagccag

SEQ ID NO: 697668 - DNA, 20 bp, mouse
ggcgctgggtggacagtcgc

SEQ ID NO: 697669 - DNA, 20 bp, mouse
gcccgctgcggtggtctcgg

SEQ ID NO: 697670 - DNA, 20 bp, mouse
ggagcaccgcccccagcgct

SEQ ID NO: 697671 - DNA, 20 bp, mouse
gtccacccggccagaaggct

SEQ ID NO: 697672 - DNA, 20 bp, mouse
gcaaggggcgggaacgctca

SEQ ID NO: 697673 - DNA, 20 bp, mouse
gcggccagaaggctaggctt

SEQ ID NO: 697674 - DNA, 20 bp, mouse
gcgagtgtgcgcggtggcat

SEQ ID NO: 697675 - DNA, 20 bp, mouse
gcacaaacggacactgttga

SEQ ID NO: 697676 - DNA, 20 bp, mouse
ggctctcaggagtttctgat

SEQ ID NO: 697677 - DNA, 20 bp, mouse
gctccagcggcagaagtcga

SEQ ID NO: 697678 - DNA, 20 bp, mouse
ggggcccagctgacacttat

SEQ ID NO: 697679 - DNA, 20 bp, mouse
ggggaattcggtccgagaga

SEQ ID NO: 697680 - DNA, 20 bp, mouse
gggccaacacagttttgcaa

SEQ ID NO: 697681 - DNA, 20 bp, mouse
ggagcctgccgggacttaga

SEQ ID NO: 697682 - DNA, 20 bp, mouse
gcaggcatgcggtaattcga

SEQ ID NO: 697683 - DNA, 20 bp, mouse
gtgtccctctaagtcccggc

SEQ ID NO: 697684 - DNA, 20 bp, mouse
gttgtccctccccctatcac

SEQ ID NO: 697685 - DNA, 20 bp, mouse
ggcgctgtccctctaagtcc

SEQ ID NO: 697686 - DNA, 20 bp, mouse
gacgaacgccgccctctgat

SEQ ID NO: 697687 - DNA, 20 bp, mouse
gcggggcgcaaggatcccgc

SEQ ID NO: 697688 - DNA, 20 bp, mouse
gaaggggcggggtgaccaag

SEQ ID NO: 697689 - DNA, 20 bp, mouse
gtcgggcggcgcaaaggggc

SEQ ID NO: 697690 - DNA, 20 bp, mouse
gttgcgcaggcgcaatagag

SEQ ID NO: 697691 - DNA, 20 bp, mouse
ggggcggcgaactaactttg

SEQ ID NO: 697692 - DNA, 20 bp, mouse
gtgcgccccgcgctgacggc

SEQ ID NO: 697693 - DNA, 20 bp, mouse
gcggccccccgccgtcagcg

SEQ ID NO: 697694 - DNA, 20 bp, mouse
gtccttgcgccccgcgctga

SEQ ID NO: 697695 - DNA, 20 bp, mouse
gtggtcaggccggttaagat

SEQ ID NO: 697696 - DNA, 20 bp, mouse
gttaataggtgcataatatt

SEQ ID NO: 697697 - DNA, 20 bp, mouse
gagaacctgtttccacatgc

SEQ ID NO: 697698 - DNA, 20 bp, mouse
gttagccagcatgtggaaac

SEQ ID NO: 697699 - DNA, 20 bp, mouse
gcttaataacacaatttaat

SEQ ID NO: 697700 - DNA, 20 bp, mouse
gcctatgcgggtttaactgt

SEQ ID NO: 697701 - DNA, 20 bp, mouse
gccaaaccatactcggtgct

SEQ ID NO: 697702 - DNA, 20 bp, mouse
gaatgtttaagtatatatgt

SEQ ID NO: 697703 - DNA, 20 bp, mouse
ggagaaaagtcttatattat

SEQ ID NO: 697704 - DNA, 20 bp, mouse
gaagagtattagccagcatg

SEQ ID NO: 697705 - DNA, 20 bp, mouse
gtacttatattatgtatcta

SEQ ID NO: 697706 - DNA, 20 bp, mouse
gtcccgcctctctagctcgt

SEQ ID NO: 697707 - DNA, 20 bp, mouse
gtggctgcagtgagtcgctt

SEQ ID NO: 697708 - DNA, 20 bp, mouse
gcgactcactgcagccatgt

SEQ ID NO: 697709 - DNA, 20 bp, mouse
ggcagtgagtcgcttcggtt

SEQ ID NO: 697710 - DNA, 20 bp, mouse
gctaaaccgaaacaggaagt

SEQ ID NO: 697711 - DNA, 20 bp, mouse
gtcccacgagctagagaggc

SEQ ID NO: 697712 - DNA, 20 bp, mouse
gggagtcccacgagctagag

SEQ ID NO: 697713 - DNA, 20 bp, mouse
ggactgggacgacgccaaca

SEQ ID NO: 697714 - DNA, 20 bp, mouse
gtaacacgcgggacaggggc

SEQ ID NO: 697715 - DNA, 20 bp, mouse
gcggttgtagcgggtttcga

SEQ ID NO: 697716 - DNA, 20 bp, mouse
ggaaggagccaatgaagggg

SEQ ID NO: 697717 - DNA, 20 bp, mouse
gaagtccacccctagtccag

SEQ ID NO: 697718 - DNA, 20 bp, mouse
gggaagaatgagtttgagtc

SEQ ID NO: 697719 - DNA, 20 bp, mouse
gcattgctccactggactag

SEQ ID NO: 697720 - DNA, 20 bp, mouse
gacccctgccaccccttcat

SEQ ID NO: 697721 - DNA, 20 bp, mouse
gtgctccactggactagggg

SEQ ID NO: 697722 - DNA, 20 bp, mouse
ggagccaatgaaggggtggc

SEQ ID NO: 697723 - DNA, 20 bp, mouse
gaatccagccaaaaggcatc

SEQ ID NO: 697724 - DNA, 20 bp, mouse
gagctaaaattccactagaa

SEQ ID NO: 697725 - DNA, 20 bp, mouse
gtagtggaattttagctacg

SEQ ID NO: 697726 - DNA, 20 bp, mouse
gtgacacgcaggctttagag

SEQ ID NO: 697727 - DNA, 20 bp, mouse
gtaatccccaggaccccagt

SEQ ID NO: 697728 - DNA, 20 bp, mouse
gtgtgctctgagtgacacgc

SEQ ID NO: 697729 - DNA, 20 bp, mouse
ggacctccaagtgtacacta

SEQ ID NO: 697730 - DNA, 20 bp, mouse
gcctgtgctcaccctcctgc

SEQ ID NO: 697731 - DNA, 20 bp, mouse
ggtgcacagcatgagcagat

SEQ ID NO: 697732 - DNA, 20 bp, mouse
gtggactttagtctgcatca

SEQ ID NO: 697733 - DNA, 20 bp, mouse
gtgaacttgggacctgacac

SEQ ID NO: 697734 - DNA, 20 bp, mouse
gcagcatgagcagatcggtg

SEQ ID NO: 697735 - DNA, 20 bp, mouse
ggtaagagcagtagtattac

SEQ ID NO: 697736 - DNA, 20 bp, mouse
ggatccgggaaatgtactag

SEQ ID NO: 697737 - DNA, 20 bp, mouse
gtggaggtataaaactggcc

SEQ ID NO: 697738 - DNA, 20 bp, mouse
ggggcaggtccgggcaactc

SEQ ID NO: 697739 - DNA, 20 bp, mouse
gtgcccggacctgcccaatt

SEQ ID NO: 697740 - DNA, 20 bp, mouse
gtaaaaatctgactaaatcg

SEQ ID NO: 697741 - DNA, 20 bp, mouse
gtctagtctgggtagtgttg

SEQ ID NO: 697742 - DNA, 20 bp, mouse
gagaagggaccctggctggc

SEQ ID NO: 697743 - DNA, 20 bp, mouse
ggctgcgcgccaaattgggc

SEQ ID NO: 697744 - DNA, 20 bp, mouse
gactgacaatctatagctgg

SEQ ID NO: 697745 - DNA, 20 bp, mouse
gcgccaaattgggcaggtcc

SEQ ID NO: 697746 - DNA, 20 bp, mouse
ggggctggaagtcgactctc

SEQ ID NO: 697747 - DNA, 20 bp, mouse
gaggtacagtgctaactcct

SEQ ID NO: 697748 - DNA, 20 bp, mouse
gcaccctgctgtcacccgga

SEQ ID NO: 697749 - DNA, 20 bp, mouse
gtagaagtgaaccggccctc

SEQ ID NO: 697750 - DNA, 20 bp, mouse
gggccctccgggtgacagca

SEQ ID NO: 697751 - DNA, 20 bp, mouse
gtagtgaatagcaagacaag

SEQ ID NO: 697752 - DNA, 20 bp, mouse
gagcctggctagaagtgaac

SEQ ID NO: 697753 - DNA, 20 bp, mouse
gggcactaggatctgcaccc

SEQ ID NO: 697754 - DNA, 20 bp, mouse
ggaagtcgactctcgggctg

SEQ ID NO: 697755 - DNA, 20 bp, mouse
gatagcaagacaagtggtcc

SEQ ID NO: 697756 - DNA, 20 bp, mouse
gcgccccgcccctttcccga

SEQ ID NO: 697757 - DNA, 20 bp, mouse
gcggccggagacaggtggtc

SEQ ID NO: 697758 - DNA, 20 bp, mouse
ggcgccccaaggaaagccgg

SEQ ID NO: 697759 - DNA, 20 bp, mouse
gtctcccacccctcgggaaa

SEQ ID NO: 697760 - DNA, 20 bp, mouse
ggggcgcggccggagacagg

SEQ ID NO: 697761 - DNA, 20 bp, mouse
gcgccccccggctttccttg

SEQ ID NO: 697762 - DNA, 20 bp, mouse
gagggcgccgcggacctgtc

SEQ ID NO: 697763 - DNA, 20 bp, mouse
gcgaacgccgcctcccgcga

SEQ ID NO: 697764 - DNA, 20 bp, mouse
gcgcccctttcccgaggggt

SEQ ID NO: 697765 - DNA, 20 bp, mouse
gaaaggggcagcaccttcgc

SEQ ID NO: 697766 - DNA, 20 bp, mouse
gccagcccgcacagtgacct

SEQ ID NO: 697767 - DNA, 20 bp, mouse
gtgacgcggggcccgtgctg

SEQ ID NO: 697768 - DNA, 20 bp, mouse
gcccggcgccgcacaaaagg

SEQ ID NO: 697769 - DNA, 20 bp, mouse
gcgcctaggcccgaccccca

SEQ ID NO: 697770 - DNA, 20 bp, mouse
ggccccgcgtcaccgcgccc

SEQ ID NO: 697771 - DNA, 20 bp, mouse
ggacccctcgtcccaggtga

SEQ ID NO: 697772 - DNA, 20 bp, mouse
gctccctcacctgggacgag

SEQ ID NO: 697773 - DNA, 20 bp, mouse
gcagcccggcgccgcacaaa

SEQ ID NO: 697774 - DNA, 20 bp, mouse
gcatctcgacccctcgtccc

SEQ ID NO: 697775 - DNA, 20 bp, mouse
ggtcactgtgcgggctgggg

SEQ ID NO: 697776 - DNA, 20 bp, mouse
ggcacctcgccccgcctcac

SEQ ID NO: 697777 - DNA, 20 bp, mouse
gggtatgggatgaactcgtc

SEQ ID NO: 697778 - DNA, 20 bp, mouse
gaggccctgccctacgcccg

SEQ ID NO: 697779 - DNA, 20 bp, mouse
ggacccagctccatgtcaca

SEQ ID NO: 697780 - DNA, 20 bp, mouse
ggccccgcctcacaggaggc

SEQ ID NO: 697781 - DNA, 20 bp, mouse
ggcgtccgcacgttccctgg

SEQ ID NO: 697782 - DNA, 20 bp, mouse
gcctgcgtccgcacgttccc

SEQ ID NO: 697783 - DNA, 20 bp, mouse
gcctcgccccgcctcacagg

SEQ ID NO: 697784 - DNA, 20 bp, mouse
gtgtcagagccgcgggcgta

SEQ ID NO: 697785 - DNA, 20 bp, mouse
gaaggcagtggcggtttcag

SEQ ID NO: 697786 - DNA, 20 bp, mouse
gcagtccaggaaaacttcat

SEQ ID NO: 697787 - DNA, 20 bp, mouse
ggagatcagacgctggcagc

SEQ ID NO: 697788 - DNA, 20 bp, mouse
ggggcaggctctaaccaatc

SEQ ID NO: 697789 - DNA, 20 bp, mouse
ggacagagattgggccaatc

SEQ ID NO: 697790 - DNA, 20 bp, mouse
gtccatcagtcagtccaagt

SEQ ID NO: 697791 - DNA, 20 bp, mouse
ggccgacttggactgactga

SEQ ID NO: 697792 - DNA, 20 bp, mouse
gttgtcaggagatcagacgc

SEQ ID NO: 697793 - DNA, 20 bp, mouse
gaagtgagcaacgacagtcc

SEQ ID NO: 697794 - DNA, 20 bp, mouse
gtcctcccatgaagttttcc

SEQ ID NO: 697795 - DNA, 20 bp, mouse
gagagattgggccaatcagg

SEQ ID NO: 697796 - DNA, 20 bp, mouse
ggctgtggttggtggtcata

SEQ ID NO: 697797 - DNA, 20 bp, mouse
ggaggcagaccctgggaaca

SEQ ID NO: 697798 - DNA, 20 bp, mouse
gaactcgtggaggcagaccc

SEQ ID NO: 697799 - DNA, 20 bp, mouse
ggcaaagtgcacttttttag

SEQ ID NO: 697800 - DNA, 20 bp, mouse
gcaaaaatgcagtcaactcg

SEQ ID NO: 697801 - DNA, 20 bp, mouse
gaaaaagtgcactttgccaa

SEQ ID NO: 697802 - DNA, 20 bp, mouse
ggtcctgccaaatagatcct

SEQ ID NO: 697803 - DNA, 20 bp, mouse
gtacggtggtgaaggagcac

SEQ ID NO: 697804 - DNA, 20 bp, mouse
gaccacagggtgacttgata

SEQ ID NO: 697805 - DNA, 20 bp, mouse
gaaatgcagtcaactcgtgg

SEQ ID NO: 697806 - DNA, 20 bp, mouse
gtcactgcccggcgtgttgt

SEQ ID NO: 697807 - DNA, 20 bp, mouse
ggcgcacggtacccgtagga

SEQ ID NO: 697808 - DNA, 20 bp, mouse
ggggcatcgaaggccggtag

SEQ ID NO: 697809 - DNA, 20 bp, mouse
gcccgtaggagggaagtgag

SEQ ID NO: 697810 - DNA, 20 bp, mouse
gcgcctagcggtgcggctga

SEQ ID NO: 697811 - DNA, 20 bp, mouse
gtgcgcgagcggacggctga

SEQ ID NO: 697812 - DNA, 20 bp, mouse
gatgccccgcggacacccga

SEQ ID NO: 697813 - DNA, 20 bp, mouse
ggcccggcgtgttgtgggtg

SEQ ID NO: 697814 - DNA, 20 bp, mouse
gcgggccagctcgcacaggg

SEQ ID NO: 697815 - DNA, 20 bp, mouse
gtaaccttcgggtgtccgcg

SEQ ID NO: 697816 - DNA, 20 bp, mouse
gcacccggccacactgacgg

SEQ ID NO: 697817 - DNA, 20 bp, mouse
gcgcctccgtcagtgtggcc

SEQ ID NO: 697818 - DNA, 20 bp, mouse
gggacacccggccacactga

SEQ ID NO: 697819 - DNA, 20 bp, mouse
gaagtagcaccgcacaagtc

SEQ ID NO: 697820 - DNA, 20 bp, mouse
gcgtgagaggtgcgtggtgc

SEQ ID NO: 697821 - DNA, 20 bp, mouse
gacctctcacgcctggatgc

SEQ ID NO: 697822 - DNA, 20 bp, mouse
ggtgcgtggtgcgggttcac

SEQ ID NO: 697823 - DNA, 20 bp, mouse
gcggcgcgcctccgtcagtg

SEQ ID NO: 697824 - DNA, 20 bp, mouse
gcgcccggcgtgccgctacg

SEQ ID NO: 697825 - DNA, 20 bp, mouse
gagtgcgcgcagccgccggt

SEQ ID NO: 697826 - DNA, 20 bp, mouse
gcccgtaggggaagccatgt

SEQ ID NO: 697827 - DNA, 20 bp, mouse
ggtccccaaaccacagctct

SEQ ID NO: 697828 - DNA, 20 bp, mouse
gagcctagagctgtggtttg

SEQ ID NO: 697829 - DNA, 20 bp, mouse
gcagttgcggggtgtatggg

SEQ ID NO: 697830 - DNA, 20 bp, mouse
ggcagctagaagaggggctc

SEQ ID NO: 697831 - DNA, 20 bp, mouse
ggggaggatggtttagtgga

SEQ ID NO: 697832 - DNA, 20 bp, mouse
gagttagtgaggagacactc

SEQ ID NO: 697833 - DNA, 20 bp, mouse
ggggaagccatgtcggataa

SEQ ID NO: 697834 - DNA, 20 bp, mouse
gttaagggagacaccacgta

SEQ ID NO: 697835 - DNA, 20 bp, mouse
gtgcagaaaggtggctgtgt

SEQ ID NO: 697836 - DNA, 20 bp, mouse
ggcgcccgcggggacagaga

SEQ ID NO: 697837 - DNA, 20 bp, mouse
gcgggtggagattagaaata

SEQ ID NO: 697838 - DNA, 20 bp, mouse
gctcctgcccgcgcctatcg

SEQ ID NO: 697839 - DNA, 20 bp, mouse
gtgcccgcgcctatcgcggc

SEQ ID NO: 697840 - DNA, 20 bp, mouse
gataggcgcgggcaggagct

SEQ ID NO: 697841 - DNA, 20 bp, mouse
gccagcgcgccggccgcgat

SEQ ID NO: 697842 - DNA, 20 bp, mouse
ggcgccggccgcgataggcg

SEQ ID NO: 697843 - DNA, 20 bp, mouse
gccggcgcgctggtcacgcg

SEQ ID NO: 697844 - DNA, 20 bp, mouse
gggcggggcccgagtggcgg

SEQ ID NO: 697845 - DNA, 20 bp, mouse
gctgcaggacgtgcacgatg

SEQ ID NO: 697846 - DNA, 20 bp, mouse
gaaagtgctgacaggaaagg

SEQ ID NO: 697847 - DNA, 20 bp, mouse
gctaggtggaggtgtccggg

SEQ ID NO: 697848 - DNA, 20 bp, mouse
gtgctggggacaagggctta

SEQ ID NO: 697849 - DNA, 20 bp, mouse
gtgtccctcagtggcctgca

SEQ ID NO: 697850 - DNA, 20 bp, mouse
gctgctaggtggaggtgtcc

SEQ ID NO: 697851 - DNA, 20 bp, mouse
gataaatgggtgtccctcag

SEQ ID NO: 697852 - DNA, 20 bp, mouse
gagacaggagctgcagtgca

SEQ ID NO: 697853 - DNA, 20 bp, mouse
gcgtccgcctctccagtcag

SEQ ID NO: 697854 - DNA, 20 bp, mouse
gtagatggtgtgttccctga

SEQ ID NO: 697855 - DNA, 20 bp, mouse
ggggaacacaccatctactc

SEQ ID NO: 697856 - DNA, 20 bp, mouse
ggagcagcttggtggagacg

SEQ ID NO: 697857 - DNA, 20 bp, mouse
ggtcacagaggcaaatgcca

SEQ ID NO: 697858 - DNA, 20 bp, mouse
ggtggcggcaggacgggtgg

SEQ ID NO: 697859 - DNA, 20 bp, mouse
gccgagcagggtgggcgtgg

SEQ ID NO: 697860 - DNA, 20 bp, mouse
gaaagcccccagggtcacag

SEQ ID NO: 697861 - DNA, 20 bp, mouse
gagtgcctatcttttaatat

SEQ ID NO: 697862 - DNA, 20 bp, mouse
ggctccgggggtcctcgcgg

SEQ ID NO: 697863 - DNA, 20 bp, mouse
ggcgccgaggccggctccgg

SEQ ID NO: 697864 - DNA, 20 bp, mouse
gtaggaggaaaagccgagca

SEQ ID NO: 697865 - DNA, 20 bp, mouse
gtgggggcgtggccgcttga

SEQ ID NO: 697866 - DNA, 20 bp, mouse
gggacgctgctgcgcgtgga

SEQ ID NO: 697867 - DNA, 20 bp, mouse
gaggcgggggaggtaaaggg

SEQ ID NO: 697868 - DNA, 20 bp, mouse
ggcgtccgcgcgcgttcccg

SEQ ID NO: 697869 - DNA, 20 bp, mouse
gagctcgattcaagagaatt

SEQ ID NO: 697870 - DNA, 20 bp, mouse
gcggtgcaaaactgtctccg

SEQ ID NO: 697871 - DNA, 20 bp, mouse
gcggcgaggcgcgggaaacg

SEQ ID NO: 697872 - DNA, 20 bp, mouse
gaaggtgagtgattctagtc

SEQ ID NO: 697873 - DNA, 20 bp, mouse
gacagttttgcaccgatgtc

SEQ ID NO: 697874 - DNA, 20 bp, mouse
ggggcgtggcaggacgcgaa

SEQ ID NO: 697875 - DNA, 20 bp, mouse
gttcaagagaatttggtccc

SEQ ID NO: 697876 - DNA, 20 bp, mouse
gggcctgcgggtcacccatg

SEQ ID NO: 697877 - DNA, 20 bp, mouse
gcgggacgcacgcgtggccg

SEQ ID NO: 697878 - DNA, 20 bp, mouse
ggcgctccgtcgctccgcat

SEQ ID NO: 697879 - DNA, 20 bp, mouse
gggtcacccatgcggagcga

SEQ ID NO: 697880 - DNA, 20 bp, mouse
ggcgacggagcgctgctcgg

SEQ ID NO: 697881 - DNA, 20 bp, mouse
ggatgccgccggacaacaaa

SEQ ID NO: 697882 - DNA, 20 bp, mouse
gcggggctccgaggcacggg

SEQ ID NO: 697883 - DNA, 20 bp, mouse
gcagcgaggctgtgtccgtg

SEQ ID NO: 697884 - DNA, 20 bp, mouse
gggccggggctccgaggcac

SEQ ID NO: 697885 - DNA, 20 bp, mouse
ggctcggcgggacgcacgcg

SEQ ID NO: 697886 - DNA, 20 bp, mouse
ggggctgcggcgggcatcca

SEQ ID NO: 697887 - DNA, 20 bp, mouse
gctgcggcgggcatccaggg

SEQ ID NO: 697888 - DNA, 20 bp, mouse
gccgccgcagccctctgctc

SEQ ID NO: 697889 - DNA, 20 bp, mouse
ggctctggagccaagaaagc

SEQ ID NO: 697890 - DNA, 20 bp, mouse
gcagctgtgtacctggtcgg

SEQ ID NO: 697891 - DNA, 20 bp, mouse
ggaggagcagggcgggacag

SEQ ID NO: 697892 - DNA, 20 bp, mouse
gccaagaaagcagggcggaa

SEQ ID NO: 697893 - DNA, 20 bp, mouse
gccttccagcggcaggcgga

SEQ ID NO: 697894 - DNA, 20 bp, mouse
gaagccttgggaaagagctc

SEQ ID NO: 697895 - DNA, 20 bp, mouse
ggcggcctggcagagcccgg

SEQ ID NO: 697896 - DNA, 20 bp, mouse
gctcccgcgcgttcaggcta

SEQ ID NO: 697897 - DNA, 20 bp, mouse
ggaagcgcccggacccactc

SEQ ID NO: 697898 - DNA, 20 bp, mouse
gcgcgcgttcaggctaggga

SEQ ID NO: 697899 - DNA, 20 bp, mouse
gcgggaggggcgtggcctcg

SEQ ID NO: 697900 - DNA, 20 bp, mouse
ggggagaagcgctccccgag

SEQ ID NO: 697901 - DNA, 20 bp, mouse
gggaaggcagagcgaggcca

SEQ ID NO: 697902 - DNA, 20 bp, mouse
gggggagcgcttctcccccg

SEQ ID NO: 697903 - DNA, 20 bp, mouse
gggagagccgcagcgccact

SEQ ID NO: 697904 - DNA, 20 bp, mouse
ggcgctcccgccgccctcta

SEQ ID NO: 697905 - DNA, 20 bp, mouse
gagcgctccccgagtgggtc

SEQ ID NO: 697906 - DNA, 20 bp, mouse
ggggtctacgaacgatgtat

SEQ ID NO: 697907 - DNA, 20 bp, mouse
gccggggcggcggtggtgga

SEQ ID NO: 697908 - DNA, 20 bp, mouse
ggccgcgcggagtttcaaat

SEQ ID NO: 697909 - DNA, 20 bp, mouse
gcctctgcggcgagccaggt

SEQ ID NO: 697910 - DNA, 20 bp, mouse
ggaggggtccaggtcgccac

SEQ ID NO: 697911 - DNA, 20 bp, mouse
gagcccgcctccctacatcc

SEQ ID NO: 697912 - DNA, 20 bp, mouse
gaccaagcagccgggatgta

SEQ ID NO: 697913 - DNA, 20 bp, mouse
ggtcggtaacagtgatccgg

SEQ ID NO: 697914 - DNA, 20 bp, mouse
gctggtcggtaacagtgatc

SEQ ID NO: 697915 - DNA, 20 bp, mouse
gaagcagccgggatgtaggg

SEQ ID NO: 697916 - DNA, 20 bp, mouse
ggaggggagcgcaggaggtg

SEQ ID NO: 697917 - DNA, 20 bp, mouse
gggagagcgaaggtgtctgc

SEQ ID NO: 697918 - DNA, 20 bp, mouse
gcgaaggcggagcgagctgt

SEQ ID NO: 697919 - DNA, 20 bp, mouse
gccggctcccgcaccccgaa

SEQ ID NO: 697920 - DNA, 20 bp, mouse
gcgagctgtgggcgcccctt

SEQ ID NO: 697921 - DNA, 20 bp, mouse
gttgtggaaagggagagcga

SEQ ID NO: 697922 - DNA, 20 bp, mouse
ggccccctaccccagattta

SEQ ID NO: 697923 - DNA, 20 bp, mouse
gtctgccgggtaactcgcga

SEQ ID NO: 697924 - DNA, 20 bp, mouse
gggtaggcagaccactctgc

SEQ ID NO: 697925 - DNA, 20 bp, mouse
ggcaggaggtggggcccaga

SEQ ID NO: 697926 - DNA, 20 bp, mouse
ggcggaagctgccctcccca

SEQ ID NO: 697927 - DNA, 20 bp, mouse
gtccagcatagatatcactc

SEQ ID NO: 697928 - DNA, 20 bp, mouse
ggattgcccaagccctgggg

SEQ ID NO: 697929 - DNA, 20 bp, mouse
gggcttgggcaatccgctgt

SEQ ID NO: 697930 - DNA, 20 bp, mouse
ggcggattgcccaagccctg

SEQ ID NO: 697931 - DNA, 20 bp, mouse
ggaaagacttgtttcggaag

SEQ ID NO: 697932 - DNA, 20 bp, mouse
gaaaacgcaactgttgctaa

SEQ ID NO: 697933 - DNA, 20 bp, mouse
gtggtgagaattacctcacc

SEQ ID NO: 697934 - DNA, 20 bp, mouse
gcaggctttggtgtagcaca

SEQ ID NO: 697935 - DNA, 20 bp, mouse
ggggcaatccgctgtgggga

SEQ ID NO: 697936 - DNA, 20 bp, mouse
gcaggcagacgatcagctgg

SEQ ID NO: 697937 - DNA, 20 bp, mouse
ggtcccagagcctgacgtgc

SEQ ID NO: 697938 - DNA, 20 bp, mouse
gctgaaggagtcgggctgaa

SEQ ID NO: 697939 - DNA, 20 bp, mouse
ggctggtctcaactcccctg

SEQ ID NO: 697940 - DNA, 20 bp, mouse
ggggctggcgcgtcaccggt

SEQ ID NO: 697941 - DNA, 20 bp, mouse
gtagaaggactccgccgcag

SEQ ID NO: 697942 - DNA, 20 bp, mouse
gtcctctaatgctccgtgtc

SEQ ID NO: 697943 - DNA, 20 bp, mouse
gagcgcggtagcggagaggg

SEQ ID NO: 697944 - DNA, 20 bp, mouse
ggcacccaagcgcaccctga

SEQ ID NO: 697945 - DNA, 20 bp, mouse
gctggcgcgtcaccggtggg

SEQ ID NO: 697946 - DNA, 20 bp, mouse
gtggctaaatttagcatggt

SEQ ID NO: 697947 - DNA, 20 bp, mouse
gggaactggtaggtcaaacc

SEQ ID NO: 697948 - DNA, 20 bp, mouse
gcaagccctggccagcattt

SEQ ID NO: 697949 - DNA, 20 bp, mouse
gtcctctcaggctataccaa

SEQ ID NO: 697950 - DNA, 20 bp, mouse
gtgccccagggctttttcac

SEQ ID NO: 697951 - DNA, 20 bp, mouse
gccctctgggtcagacggtc

SEQ ID NO: 697952 - DNA, 20 bp, mouse
ggagcatgcggtaaaatgag

SEQ ID NO: 697953 - DNA, 20 bp, mouse
gctgatgggcagtgatgcag

SEQ ID NO: 697954 - DNA, 20 bp, mouse
gctctcctaaatgctggcca

SEQ ID NO: 697955 - DNA, 20 bp, mouse
ggaaattgcagggttctgat

SEQ ID NO: 697956 - DNA, 20 bp, mouse
gccagccgcggcggtcgtca

SEQ ID NO: 697957 - DNA, 20 bp, mouse
ggcggggctccgccataaag

SEQ ID NO: 697958 - DNA, 20 bp, mouse
ggggaggggtacggccgagg

SEQ ID NO: 697959 - DNA, 20 bp, mouse
gcgcgccttgacgaccgccg

SEQ ID NO: 697960 - DNA, 20 bp, mouse
gggcgcaggcggatttgtgt

SEQ ID NO: 697961 - DNA, 20 bp, mouse
gcgcggacgggggaggggta

SEQ ID NO: 697962 - DNA, 20 bp, mouse
gtaaaggggaggcgcggacg

SEQ ID NO: 697963 - DNA, 20 bp, mouse
gcggcgagggcggcgggtag

SEQ ID NO: 697964 - DNA, 20 bp, mouse
gacgggggtgcgcaaaacgt

SEQ ID NO: 697965 - DNA, 20 bp, mouse
gcgggggaggggtacggccg

SEQ ID NO: 697966 - DNA, 20 bp, mouse
gaaggggcgtgcacgcgcgt

SEQ ID NO: 697967 - DNA, 20 bp, mouse
gtgcacgcgcgtgggaggac

SEQ ID NO: 697968 - DNA, 20 bp, mouse
ggggtggcgtaggtccccag

SEQ ID NO: 697969 - DNA, 20 bp, mouse
gcgtgtggagacaaacggaa

SEQ ID NO: 697970 - DNA, 20 bp, mouse
ggggcgtgcacgcgcgtggg

SEQ ID NO: 697971 - DNA, 20 bp, mouse
ggggtcccggagctctcggg

SEQ ID NO: 697972 - DNA, 20 bp, mouse
gaggaggggcgtgcacgcgc

SEQ ID NO: 697973 - DNA, 20 bp, mouse
gcgcgggaagatggacagag

SEQ ID NO: 697974 - DNA, 20 bp, mouse
ggggagagctagactagccg

SEQ ID NO: 697975 - DNA, 20 bp, mouse
gcggggagacggcctggagg

SEQ ID NO: 697976 - DNA, 20 bp, mouse
gtcaccccgggaagtgggga

SEQ ID NO: 697977 - DNA, 20 bp, mouse
gggcggcagtctaggaacga

SEQ ID NO: 697978 - DNA, 20 bp, mouse
gaagtgagaggcttggtctt

SEQ ID NO: 697979 - DNA, 20 bp, mouse
gggccctgcggagaagtgag

SEQ ID NO: 697980 - DNA, 20 bp, mouse
gggaagtggggagggatccg

SEQ ID NO: 697981 - DNA, 20 bp, mouse
ggagcggcgaccggagctca

SEQ ID NO: 697982 - DNA, 20 bp, mouse
gccagcctggggcaccgcgt

SEQ ID NO: 697983 - DNA, 20 bp, mouse
gggaaaagaaagtgtaaagg

SEQ ID NO: 697984 - DNA, 20 bp, mouse
gccttcgccgcgtggaccgc

SEQ ID NO: 697985 - DNA, 20 bp, mouse
ggggccgggctgcacggtgc

SEQ ID NO: 697986 - DNA, 20 bp, mouse
gcgacaggtcacaaagggag

SEQ ID NO: 697987 - DNA, 20 bp, mouse
gtatataagtacttccaaat

SEQ ID NO: 697988 - DNA, 20 bp, mouse
gacatgaaatggcatcagat

SEQ ID NO: 697989 - DNA, 20 bp, mouse
gctgggggatgggacaaagg

SEQ ID NO: 697990 - DNA, 20 bp, mouse
gtgtgggaattcgaggaaat

SEQ ID NO: 697991 - DNA, 20 bp, mouse
ggccagcgacaggtcacaaa

SEQ ID NO: 697992 - DNA, 20 bp, mouse
gttcagtttgggctaagaga

SEQ ID NO: 697993 - DNA, 20 bp, mouse
gggagggtaccaacatgaaa

SEQ ID NO: 697994 - DNA, 20 bp, mouse
gcaaagcctgtgggaattcg

SEQ ID NO: 697995 - DNA, 20 bp, mouse
gcatccatggatccttccac

SEQ ID NO: 697996 - DNA, 20 bp, mouse
ggatgctgacaaaagcgaaa

SEQ ID NO: 697997 - DNA, 20 bp, mouse
gtggtggtatggctggggta

SEQ ID NO: 697998 - DNA, 20 bp, mouse
gttgaggggtgattgcttaa

SEQ ID NO: 697999 - DNA, 20 bp, mouse
gaggtcacaaaggacggcag

SEQ ID NO: 698000 - DNA, 20 bp, mouse
ggtggggtgtggcttgttag

SEQ ID NO: 698001 - DNA, 20 bp, mouse
gaggacagaatcctcgtggt

SEQ ID NO: 698002 - DNA, 20 bp, mouse
gcctgtaataagtctaacga

SEQ ID NO: 698003 - DNA, 20 bp, mouse
gaggacaaaggggtatgtgc

SEQ ID NO: 698004 - DNA, 20 bp, mouse
gactctgactgctggtggta

SEQ ID NO: 698005 - DNA, 20 bp, mouse
ggggtgttggtctgatttga

SEQ ID NO: 698006 - DNA, 20 bp, mouse
ggcccctgtctgagcttctc

SEQ ID NO: 698007 - DNA, 20 bp, mouse
gggggcagctggaagttctg

SEQ ID NO: 698008 - DNA, 20 bp, mouse
ggaccaaacagcccctgaga

SEQ ID NO: 698009 - DNA, 20 bp, mouse
gctccaaaaaccaggatata

SEQ ID NO: 698010 - DNA, 20 bp, mouse
gtctgaagtaagaagagcat

SEQ ID NO: 698011 - DNA, 20 bp, mouse
gattcctgagaagctcagac

SEQ ID NO: 698012 - DNA, 20 bp, mouse
gagccatcttgatgatggtg

SEQ ID NO: 698013 - DNA, 20 bp, mouse
gcctacaggccaacagtgtt

SEQ ID NO: 698014 - DNA, 20 bp, mouse
gaaactgagggcctggtgtc

SEQ ID NO: 698015 - DNA, 20 bp, mouse
gtgtcagcacattgtgatgc

SEQ ID NO: 698016 - DNA, 20 bp, mouse
gaacgtgagccctagagacc

SEQ ID NO: 698017 - DNA, 20 bp, mouse
gccgcctgctcccgcagtca

SEQ ID NO: 698018 - DNA, 20 bp, mouse
gactgcgggagcaggcggac

SEQ ID NO: 698019 - DNA, 20 bp, mouse
ggcacccgcggccaccatac

SEQ ID NO: 698020 - DNA, 20 bp, mouse
gcagcccgctaggaaacaca

SEQ ID NO: 698021 - DNA, 20 bp, mouse
gtgagccctagagacccgga

SEQ ID NO: 698022 - DNA, 20 bp, mouse
gttctccatccgggtctcta

SEQ ID NO: 698023 - DNA, 20 bp, mouse
gcctgctcccgcagtcaggg

SEQ ID NO: 698024 - DNA, 20 bp, mouse
ggaaatggccgccctgactg

SEQ ID NO: 698025 - DNA, 20 bp, mouse
gtcccaagcacggagatgag

SEQ ID NO: 698026 - DNA, 20 bp, mouse
gaaggtgtggactcttttga

SEQ ID NO: 698027 - DNA, 20 bp, mouse
ggatggagatgttctgatag

SEQ ID NO: 698028 - DNA, 20 bp, mouse
gggaaactgaggctcaatgt

SEQ ID NO: 698029 - DNA, 20 bp, mouse
gtgacctcactagaccctag

SEQ ID NO: 698030 - DNA, 20 bp, mouse
ggaccctcctctttactctc

SEQ ID NO: 698031 - DNA, 20 bp, mouse
ggcctcaccattccagaata

SEQ ID NO: 698032 - DNA, 20 bp, mouse
gaggcccctaggcagttccc

SEQ ID NO: 698033 - DNA, 20 bp, mouse
ggcttcctgggaactgccta

SEQ ID NO: 698034 - DNA, 20 bp, mouse
gatagggatcattaacccaa

SEQ ID NO: 698035 - DNA, 20 bp, mouse
gggttctaacacagatccct

SEQ ID NO: 698036 - DNA, 20 bp, mouse
gctccaagggggccctgaga

SEQ ID NO: 698037 - DNA, 20 bp, mouse
gtggcccaggaggaaatggg

SEQ ID NO: 698038 - DNA, 20 bp, mouse
gcactggcccaggaggaaat

SEQ ID NO: 698039 - DNA, 20 bp, mouse
ggggggccctgagaaggatg

SEQ ID NO: 698040 - DNA, 20 bp, mouse
ggcaggaagcaaggactgtt

SEQ ID NO: 698041 - DNA, 20 bp, mouse
gagttccgtgaatgctccaa

SEQ ID NO: 698042 - DNA, 20 bp, mouse
gggagcctcccatttcctcc

SEQ ID NO: 698043 - DNA, 20 bp, mouse
ggtcagctcacaatgatgaa

SEQ ID NO: 698044 - DNA, 20 bp, mouse
gctggggatatagtttggta

SEQ ID NO: 698045 - DNA, 20 bp, mouse
gacaggaagggcctttcttc

SEQ ID NO: 698046 - DNA, 20 bp, mouse
gaggaaggggtacacaggac

SEQ ID NO: 698047 - DNA, 20 bp, mouse
gaggccaggaaggggtacac

SEQ ID NO: 698048 - DNA, 20 bp, mouse
gtctggggaaggtcatcgct

SEQ ID NO: 698049 - DNA, 20 bp, mouse
gccagccagctcactgtctg

SEQ ID NO: 698050 - DNA, 20 bp, mouse
ggctcggctgcctggggtaa

SEQ ID NO: 698051 - DNA, 20 bp, mouse
gcctcccgaagcctgacttt

SEQ ID NO: 698052 - DNA, 20 bp, mouse
gtccgccaacgaaggactct

SEQ ID NO: 698053 - DNA, 20 bp, mouse
gagggccagtgtatagaatc

SEQ ID NO: 698054 - DNA, 20 bp, mouse
ggaatctggaagtttacagc

SEQ ID NO: 698055 - DNA, 20 bp, mouse
gctaacagtaggaaaggggg

SEQ ID NO: 698056 - DNA, 20 bp, mouse
gaacggtgccgatatcagat

SEQ ID NO: 698057 - DNA, 20 bp, mouse
ggatgctggccaatgatctt

SEQ ID NO: 698058 - DNA, 20 bp, mouse
gtggcctctgagctcacgtc

SEQ ID NO: 698059 - DNA, 20 bp, mouse
gcagagagccgatctgatat

SEQ ID NO: 698060 - DNA, 20 bp, mouse
gcggggctgacgaaacttag

SEQ ID NO: 698061 - DNA, 20 bp, mouse
gatcagatcggctctctgat

SEQ ID NO: 698062 - DNA, 20 bp, mouse
gtctcctgacgtgagctcag

SEQ ID NO: 698063 - DNA, 20 bp, mouse
gcacaccccgagtttcttat

SEQ ID NO: 698064 - DNA, 20 bp, mouse
gaagacgggaccaatcggac

SEQ ID NO: 698065 - DNA, 20 bp, mouse
ggccccagacccacattgga

SEQ ID NO: 698066 - DNA, 20 bp, mouse
ggggaggcggagttcttccg

SEQ ID NO: 698067 - DNA, 20 bp, mouse
gcgcgggcggactgcgtgag

SEQ ID NO: 698068 - DNA, 20 bp, mouse
gaaagtggaggggccgcggg

SEQ ID NO: 698069 - DNA, 20 bp, mouse
ggcgtgaggggctacgtgcg

SEQ ID NO: 698070 - DNA, 20 bp, mouse
gtgaacaaacatggcgggag

SEQ ID NO: 698071 - DNA, 20 bp, mouse
ggggtcacgacgcaaaggta

SEQ ID NO: 698072 - DNA, 20 bp, mouse
gtgccctgaacaaacatggc

SEQ ID NO: 698073 - DNA, 20 bp, mouse
gaatctgactaaaacgatgg

SEQ ID NO: 698074 - DNA, 20 bp, mouse
ggaggagttggtaacttctt

SEQ ID NO: 698075 - DNA, 20 bp, mouse
gtaaaaaatggccagagcta

SEQ ID NO: 698076 - DNA, 20 bp, mouse
ggcggtgcgaaaagcgaggg

SEQ ID NO: 698077 - DNA, 20 bp, mouse
gggggcggtgcgaaaagcga

SEQ ID NO: 698078 - DNA, 20 bp, mouse
gcacactgcaaccacactta

SEQ ID NO: 698079 - DNA, 20 bp, mouse
gtctaatcctagtgaccaat

SEQ ID NO: 698080 - DNA, 20 bp, mouse
gcacacggacactaaaaagg

SEQ ID NO: 698081 - DNA, 20 bp, mouse
gaaaaaggcggtggagttag

SEQ ID NO: 698082 - DNA, 20 bp, mouse
gtgcaaccacacttaggggg

SEQ ID NO: 698083 - DNA, 20 bp, mouse
ggcgaggcccttggccaatg

SEQ ID NO: 698084 - DNA, 20 bp, mouse
gtggagttagtggacacctg

SEQ ID NO: 698085 - DNA, 20 bp, mouse
gtcgcaccgccccctaagtg

SEQ ID NO: 698086 - DNA, 20 bp, mouse
gcggaacgtggagttcccga

SEQ ID NO: 698087 - DNA, 20 bp, mouse
ggcggccccgagcgtcacag

SEQ ID NO: 698088 - DNA, 20 bp, mouse
gtggacgtcgatcacgcggg

SEQ ID NO: 698089 - DNA, 20 bp, mouse
ggtaaagcgcagtcacgcgg

SEQ ID NO: 698090 - DNA, 20 bp, mouse
gcggaccgaatcagagccgt

SEQ ID NO: 698091 - DNA, 20 bp, mouse
ggctcccgcagcccccggag

SEQ ID NO: 698092 - DNA, 20 bp, mouse
gtaggatagcggaagccctc

SEQ ID NO: 698093 - DNA, 20 bp, mouse
gacgtcgatcacgcgggagg

SEQ ID NO: 698094 - DNA, 20 bp, mouse
gtacgccactgtgacgctcg

SEQ ID NO: 698095 - DNA, 20 bp, mouse
gcctcgctccgcctctccgg

SEQ ID NO: 698096 - DNA, 20 bp, mouse
gccctgccgaacctaggcca

SEQ ID NO: 698097 - DNA, 20 bp, mouse
ggaaagctccgcccagtccc

SEQ ID NO: 698098 - DNA, 20 bp, mouse
gccagtccctggcctaggtt

SEQ ID NO: 698099 - DNA, 20 bp, mouse
gagagaaagtaccaaccaat

SEQ ID NO: 698100 - DNA, 20 bp, mouse
gactggccgtggcttgtggg

SEQ ID NO: 698101 - DNA, 20 bp, mouse
ggcaccagccaaacgacgac

SEQ ID NO: 698102 - DNA, 20 bp, mouse
gacgactggccgtggcttgt

SEQ ID NO: 698103 - DNA, 20 bp, mouse
gtaggaggggcttaaggata

SEQ ID NO: 698104 - DNA, 20 bp, mouse
gcgcttgagcccattggcca

SEQ ID NO: 698105 - DNA, 20 bp, mouse
ggccacggccagtcgtcgtt

SEQ ID NO: 698106 - DNA, 20 bp, mouse
gaatacagggttggggtttg

SEQ ID NO: 698107 - DNA, 20 bp, mouse
gtagctcgagggaggggtga

SEQ ID NO: 698108 - DNA, 20 bp, mouse
ggaagctccaagacttggga

SEQ ID NO: 698109 - DNA, 20 bp, mouse
gccggcagctaggatcccca

SEQ ID NO: 698110 - DNA, 20 bp, mouse
ggccccggggatcgagacac

SEQ ID NO: 698111 - DNA, 20 bp, mouse
ggtgtcagcggagatgtcac

SEQ ID NO: 698112 - DNA, 20 bp, mouse
ggggcgccccgaaaacgtgc

SEQ ID NO: 698113 - DNA, 20 bp, mouse
gtcagcggagatgtcacggg

SEQ ID NO: 698114 - DNA, 20 bp, mouse
ggagaaggggcgtttcacgc

SEQ ID NO: 698115 - DNA, 20 bp, mouse
ggacttggggcactgccctg

SEQ ID NO: 698116 - DNA, 20 bp, mouse
gcggagagcccagcgggcta

SEQ ID NO: 698117 - DNA, 20 bp, mouse
gcagccggatgcgggagtgt

SEQ ID NO: 698118 - DNA, 20 bp, mouse
gctcccgcatccggctgcgg

SEQ ID NO: 698119 - DNA, 20 bp, mouse
gggctctccgcccggggcta

SEQ ID NO: 698120 - DNA, 20 bp, mouse
gacgcccccgcagccggatg

SEQ ID NO: 698121 - DNA, 20 bp, mouse
ggccaggggaccgtagcccc

SEQ ID NO: 698122 - DNA, 20 bp, mouse
gcccgctgggctctccgccc

SEQ ID NO: 698123 - DNA, 20 bp, mouse
gctacgggggacaagctccg

SEQ ID NO: 698124 - DNA, 20 bp, mouse
gcgggagtgtgggcgctgtc

SEQ ID NO: 698125 - DNA, 20 bp, mouse
ggcccagcgggctagggcta

SEQ ID NO: 698126 - DNA, 20 bp, mouse
gcggggaaagcctccagctc

SEQ ID NO: 698127 - DNA, 20 bp, mouse
gtgactccctgcagcgaact

SEQ ID NO: 698128 - DNA, 20 bp, mouse
gcggcccggcccggggttcg

SEQ ID NO: 698129 - DNA, 20 bp, mouse
gtccctgcagcgaactgggt

SEQ ID NO: 698130 - DNA, 20 bp, mouse
gcaggcaacgcgcccggaag

SEQ ID NO: 698131 - DNA, 20 bp, mouse
gggctcgcgcccttccaggg

SEQ ID NO: 698132 - DNA, 20 bp, mouse
gagaacctcagtcccgtcgt

SEQ ID NO: 698133 - DNA, 20 bp, mouse
gcgcctcccagagcctcttc

SEQ ID NO: 698134 - DNA, 20 bp, mouse
gcgaactgggtggggacccg

SEQ ID NO: 698135 - DNA, 20 bp, mouse
ggacccgcggcgccgcggaa

SEQ ID NO: 698136 - DNA, 20 bp, mouse
gcaccctgcccacaagtcag

SEQ ID NO: 698137 - DNA, 20 bp, mouse
gcagcctgaggctgaagcgg

SEQ ID NO: 698138 - DNA, 20 bp, mouse
gacaaaggccggagggttcc

SEQ ID NO: 698139 - DNA, 20 bp, mouse
ggacaggagcaaggaggact

SEQ ID NO: 698140 - DNA, 20 bp, mouse
gccttggcacagtcaaccat

SEQ ID NO: 698141 - DNA, 20 bp, mouse
gcttggttgcacaacactga

SEQ ID NO: 698142 - DNA, 20 bp, mouse
gtgagccagggagcacaaag

SEQ ID NO: 698143 - DNA, 20 bp, mouse
gtgcccacaagtcagagggc

SEQ ID NO: 698144 - DNA, 20 bp, mouse
gccctggctcaaactccgtt

SEQ ID NO: 698145 - DNA, 20 bp, mouse
gtgcaaccaagtgggaaagc

SEQ ID NO: 698146 - DNA, 20 bp, mouse
gtgggacgctggagcaagtc

SEQ ID NO: 698147 - DNA, 20 bp, mouse
gcgtcccagcccggcgggcg

SEQ ID NO: 698148 - DNA, 20 bp, mouse
gagaaagagtgctgtgtgca

SEQ ID NO: 698149 - DNA, 20 bp, mouse
gcacctgcgcgctgcgagca

SEQ ID NO: 698150 - DNA, 20 bp, mouse
gctggagcccaagagccagg

SEQ ID NO: 698151 - DNA, 20 bp, mouse
gggagctggccgcacctccc

SEQ ID NO: 698152 - DNA, 20 bp, mouse
gggtgccgagcgtgtcacca

SEQ ID NO: 698153 - DNA, 20 bp, mouse
ggggggcggcgagttgcaac

SEQ ID NO: 698154 - DNA, 20 bp, mouse
ggacacgctcggcaccgccc

SEQ ID NO: 698155 - DNA, 20 bp, mouse
gctccagcgtcccagcccgg

SEQ ID NO: 698156 - DNA, 20 bp, mouse
gagccagcagcacacacgaa

SEQ ID NO: 698157 - DNA, 20 bp, mouse
gccctacccctcaacatcca

SEQ ID NO: 698158 - DNA, 20 bp, mouse
gccaaggccaggggcaatgg

SEQ ID NO: 698159 - DNA, 20 bp, mouse
gacacgcctgctcggggaag

SEQ ID NO: 698160 - DNA, 20 bp, mouse
gtgggtgggactgacccgac

SEQ ID NO: 698161 - DNA, 20 bp, mouse
gcccctcaacatccagggtg

SEQ ID NO: 698162 - DNA, 20 bp, mouse
gttcccaaggccaggggcaa

SEQ ID NO: 698163 - DNA, 20 bp, mouse
ggtcgggacacgcctgctcg

SEQ ID NO: 698164 - DNA, 20 bp, mouse
ggctgaaggtcagggaatac

SEQ ID NO: 698165 - DNA, 20 bp, mouse
gaatctctgcaggttgctga

SEQ ID NO: 698166 - DNA, 20 bp, mouse
gggtgggcgggttctgtctc

SEQ ID NO: 698167 - DNA, 20 bp, mouse
ggcaaccaatagcaatgagg

SEQ ID NO: 698168 - DNA, 20 bp, mouse
gcccgccccagcaatcccat

SEQ ID NO: 698169 - DNA, 20 bp, mouse
gcagtgcggggctatgtccc

SEQ ID NO: 698170 - DNA, 20 bp, mouse
gggcggcgagccaatagagc

SEQ ID NO: 698171 - DNA, 20 bp, mouse
gcagggttctggagccgcta

SEQ ID NO: 698172 - DNA, 20 bp, mouse
gggcgtgctcggacagtgcg

SEQ ID NO: 698173 - DNA, 20 bp, mouse
gccccagcaatcccattggc

SEQ ID NO: 698174 - DNA, 20 bp, mouse
gttatagggcactcggcagg

SEQ ID NO: 698175 - DNA, 20 bp, mouse
ggctatgtcccgggttggca

SEQ ID NO: 698176 - DNA, 20 bp, mouse
gcccccaacaccaaggtctt

SEQ ID NO: 698177 - DNA, 20 bp, mouse
ggggatgtggggcaaggcgt

SEQ ID NO: 698178 - DNA, 20 bp, mouse
gcaaggcgtgggaacaggtg

SEQ ID NO: 698179 - DNA, 20 bp, mouse
gcagacccatttttggggaa

SEQ ID NO: 698180 - DNA, 20 bp, mouse
gtgcccgagccccgcctgct

SEQ ID NO: 698181 - DNA, 20 bp, mouse
ggggaaaagctaatcctagg

SEQ ID NO: 698182 - DNA, 20 bp, mouse
gggaacggacatagggtctg

SEQ ID NO: 698183 - DNA, 20 bp, mouse
gcaggggctgcccaggtgca

SEQ ID NO: 698184 - DNA, 20 bp, mouse
gcttgggaaaagctaatcct

SEQ ID NO: 698185 - DNA, 20 bp, mouse
gagcagctctccacccaacg

SEQ ID NO: 698186 - DNA, 20 bp, mouse
gcaccccagccgggctaagt

SEQ ID NO: 698187 - DNA, 20 bp, mouse
gagggaccgccgcctctgca

SEQ ID NO: 698188 - DNA, 20 bp, mouse
gggggtgcagagtgtcggcg

SEQ ID NO: 698189 - DNA, 20 bp, mouse
ggggtgctggaggcgtaaag

SEQ ID NO: 698190 - DNA, 20 bp, mouse
gggccagagacgcagggcgt

SEQ ID NO: 698191 - DNA, 20 bp, mouse
gagccgacgccctgcgtctc

SEQ ID NO: 698192 - DNA, 20 bp, mouse
gcttgcggggacctcacggg

SEQ ID NO: 698193 - DNA, 20 bp, mouse
gcgcggccgtcgggcggaga

SEQ ID NO: 698194 - DNA, 20 bp, mouse
gtgcgggcgcggccgtcggg

SEQ ID NO: 698195 - DNA, 20 bp, mouse
gctaagtaggccagagacgc

SEQ ID NO: 698196 - DNA, 20 bp, mouse
gcgggacgccagcccaagtg

SEQ ID NO: 698197 - DNA, 20 bp, mouse
gcaggcggatcccaagacag

SEQ ID NO: 698198 - DNA, 20 bp, mouse
gctggaccgccggtgactaa

SEQ ID NO: 698199 - DNA, 20 bp, mouse
gcagaggcagaggacaaccg

SEQ ID NO: 698200 - DNA, 20 bp, mouse
gcgggggcgtggcgaaggaa

SEQ ID NO: 698201 - DNA, 20 bp, mouse
gcgggaccgcccttagtcac

SEQ ID NO: 698202 - DNA, 20 bp, mouse
gccagtccggagtaagagcc

SEQ ID NO: 698203 - DNA, 20 bp, mouse
gggcgatcctggtccatctc

SEQ ID NO: 698204 - DNA, 20 bp, mouse
gtgtcctctgcctctgtctt

SEQ ID NO: 698205 - DNA, 20 bp, mouse
ggcagaggaagacttccacg

SEQ ID NO: 698206 - DNA, 20 bp, mouse
gccctccgcgccccggaccc

SEQ ID NO: 698207 - DNA, 20 bp, mouse
gagcctgcggggagtggact

SEQ ID NO: 698208 - DNA, 20 bp, mouse
gagcgctcaggggtcggggt

SEQ ID NO: 698209 - DNA, 20 bp, mouse
gaatgcgggcgcgtcggggt

SEQ ID NO: 698210 - DNA, 20 bp, mouse
gggtcaggggtcggcagtag

SEQ ID NO: 698211 - DNA, 20 bp, mouse
gggaccccggccgcgatccc

SEQ ID NO: 698212 - DNA, 20 bp, mouse
ggcggagggcgcaggaatgc

SEQ ID NO: 698213 - DNA, 20 bp, mouse
gggtccggagcgcagctctg

SEQ ID NO: 698214 - DNA, 20 bp, mouse
ggaagccacactgggaaccc

SEQ ID NO: 698215 - DNA, 20 bp, mouse
ggctccaccagagcgctcag

SEQ ID NO: 698216 - DNA, 20 bp, mouse
gcccgtggggagcataagag

SEQ ID NO: 698217 - DNA, 20 bp, mouse
gttgaggctggggaatgctg

SEQ ID NO: 698218 - DNA, 20 bp, mouse
gagccctgccaatctcggct

SEQ ID NO: 698219 - DNA, 20 bp, mouse
gtcccaatgcgttgaggctg

SEQ ID NO: 698220 - DNA, 20 bp, mouse
ggtaggtgtgagcacccgtg

SEQ ID NO: 698221 - DNA, 20 bp, mouse
gcggctgggggtggaatcag

SEQ ID NO: 698222 - DNA, 20 bp, mouse
gtgggcagggcggagcacaa

SEQ ID NO: 698223 - DNA, 20 bp, mouse
gttccccagcctcaacgcat

SEQ ID NO: 698224 - DNA, 20 bp, mouse
ggggacgagtcctagccaat

SEQ ID NO: 698225 - DNA, 20 bp, mouse
gaatgggcgcgttccggggc

SEQ ID NO: 698226 - DNA, 20 bp, mouse
gccaactcagcataacagaa

SEQ ID NO: 698227 - DNA, 20 bp, mouse
ggggctccgagggactaagc

SEQ ID NO: 698228 - DNA, 20 bp, mouse
gtccgtagcgggtttaaatc

SEQ ID NO: 698229 - DNA, 20 bp, mouse
gagaggaagcctgctcccgt

SEQ ID NO: 698230 - DNA, 20 bp, mouse
gagaaaggcaagggggctca

SEQ ID NO: 698231 - DNA, 20 bp, mouse
gaagggcggagcagccctag

SEQ ID NO: 698232 - DNA, 20 bp, mouse
gggaagcctgctcccgtggg

SEQ ID NO: 698233 - DNA, 20 bp, mouse
ggtgtacctcccacgggagc

SEQ ID NO: 698234 - DNA, 20 bp, mouse
gtacggagggggcacggtcc

SEQ ID NO: 698235 - DNA, 20 bp, mouse
ggtaaatagtgtacctccca

SEQ ID NO: 698236 - DNA, 20 bp, mouse
gcggggcggggagtacggtg

SEQ ID NO: 698237 - DNA, 20 bp, mouse
ggggcaagatggtgcccgcg

SEQ ID NO: 698238 - DNA, 20 bp, mouse
gaggaggcgtggcaactagg

SEQ ID NO: 698239 - DNA, 20 bp, mouse
ggaagcgaggcctgagacgg

SEQ ID NO: 698240 - DNA, 20 bp, mouse
ggcggggagtacggtggggc

SEQ ID NO: 698241 - DNA, 20 bp, mouse
gcaagatggtgcccgcgggg

SEQ ID NO: 698242 - DNA, 20 bp, mouse
gtgggcccgagcgggaatgg

SEQ ID NO: 698243 - DNA, 20 bp, mouse
gcaactaggaggtaagatgt

SEQ ID NO: 698244 - DNA, 20 bp, mouse
gtccccagtcaggcccaacc

SEQ ID NO: 698245 - DNA, 20 bp, mouse
ggcccgcggggcggggagta

SEQ ID NO: 698246 - DNA, 20 bp, mouse
gccggagcgcagatgagtgg

SEQ ID NO: 698247 - DNA, 20 bp, mouse
ggaggggcgggtcccgagag

SEQ ID NO: 698248 - DNA, 20 bp, mouse
gagtccggagcgcagatgag

SEQ ID NO: 698249 - DNA, 20 bp, mouse
gtgagtggaggtcgagatgg

SEQ ID NO: 698250 - DNA, 20 bp, mouse
ggggcgggtcccgagagggg

SEQ ID NO: 698251 - DNA, 20 bp, mouse
ggcagcgggcggaactcggg

SEQ ID NO: 698252 - DNA, 20 bp, mouse
ggggaggggacttgcacgta

SEQ ID NO: 698253 - DNA, 20 bp, mouse
ggaggctgagagaatagcgg

SEQ ID NO: 698254 - DNA, 20 bp, mouse
ggtggtgtggcgaaaaaggg

SEQ ID NO: 698255 - DNA, 20 bp, mouse
gcgctccggactagccctcg

SEQ ID NO: 698256 - DNA, 20 bp, mouse
gcggctggtggccagagcta

SEQ ID NO: 698257 - DNA, 20 bp, mouse
gtgaccctgacctacgggct

SEQ ID NO: 698258 - DNA, 20 bp, mouse
gcagccgagcccgtaggtca

SEQ ID NO: 698259 - DNA, 20 bp, mouse
gtatctgaggcaagtagaaa

SEQ ID NO: 698260 - DNA, 20 bp, mouse
gtggtacccaaccatagctc

SEQ ID NO: 698261 - DNA, 20 bp, mouse
gtgtggaaagacaaccctga

SEQ ID NO: 698262 - DNA, 20 bp, mouse
gtggcgctttagtcaaaggg

SEQ ID NO: 698263 - DNA, 20 bp, mouse
gctaagggccactttatctg

SEQ ID NO: 698264 - DNA, 20 bp, mouse
gcacatgtggtagctgaggg

SEQ ID NO: 698265 - DNA, 20 bp, mouse
gtgggaggcggggccgtagt

SEQ ID NO: 698266 - DNA, 20 bp, mouse
ggggagaggacacattgtat

SEQ ID NO: 698267 - DNA, 20 bp, mouse
ggggacaggggaggccgaaa

SEQ ID NO: 698268 - DNA, 20 bp, mouse
gaggccgaaagggtcagaaa

SEQ ID NO: 698269 - DNA, 20 bp, mouse
gtctaaaagcacggggatgt

SEQ ID NO: 698270 - DNA, 20 bp, mouse
gacccatcaaagaactggat

SEQ ID NO: 698271 - DNA, 20 bp, mouse
gagggtcagaaacggttttt

SEQ ID NO: 698272 - DNA, 20 bp, mouse
gggcggggcctctcttaacg

SEQ ID NO: 698273 - DNA, 20 bp, mouse
gtgtgggaggcccgagtctg

SEQ ID NO: 698274 - DNA, 20 bp, mouse
ggtagagtcaggatggttaa

SEQ ID NO: 698275 - DNA, 20 bp, mouse
gaggcggagtcctaggagtc

SEQ ID NO: 698276 - DNA, 20 bp, mouse
gaacccaccagcaaccggaa

SEQ ID NO: 698277 - DNA, 20 bp, mouse
gcagcaaccggaaggggtac

SEQ ID NO: 698278 - DNA, 20 bp, mouse
ggccccggcggtcaagagca

SEQ ID NO: 698279 - DNA, 20 bp, mouse
gaccccttccggttgctggt

SEQ ID NO: 698280 - DNA, 20 bp, mouse
gtctagccctcccaggcttc

SEQ ID NO: 698281 - DNA, 20 bp, mouse
gcaagggagaccagagggca

SEQ ID NO: 698282 - DNA, 20 bp, mouse
gggctcgtggaagctgcctt

SEQ ID NO: 698283 - DNA, 20 bp, mouse
gggcgcgcgccgcgtcgcca

SEQ ID NO: 698284 - DNA, 20 bp, mouse
gccagagggcatggggcaga

SEQ ID NO: 698285 - DNA, 20 bp, mouse
gaggcttctgggagcgaagg

SEQ ID NO: 698286 - DNA, 20 bp, mouse
ggggtccagggtgaagtccc

SEQ ID NO: 698287 - DNA, 20 bp, mouse
gctcccctgcggggtgagga

SEQ ID NO: 698288 - DNA, 20 bp, mouse
ggcaaccagggcctcccctg

SEQ ID NO: 698289 - DNA, 20 bp, mouse
gggccctcctcaccccgcag

SEQ ID NO: 698290 - DNA, 20 bp, mouse
gtgggagccagtgtcactga

SEQ ID NO: 698291 - DNA, 20 bp, mouse
gcggacagggagatccccga

SEQ ID NO: 698292 - DNA, 20 bp, mouse
ggtaaccaccaggaacggac

SEQ ID NO: 698293 - DNA, 20 bp, mouse
gcccaggcaagctcccttcg

SEQ ID NO: 698294 - DNA, 20 bp, mouse
gccaagaacaccatattcaa

SEQ ID NO: 698295 - DNA, 20 bp, mouse
gaggagcccagctggttgct

SEQ ID NO: 698296 - DNA, 20 bp, mouse
gcggcggcgaaatgtatatg

SEQ ID NO: 698297 - DNA, 20 bp, mouse
ggcatgctgggatgtctaag

SEQ ID NO: 698298 - DNA, 20 bp, mouse
gctaaggggcgttagcggag

SEQ ID NO: 698299 - DNA, 20 bp, mouse
ggatgtctaaggggcgttag

SEQ ID NO: 698300 - DNA, 20 bp, mouse
gagtccgttacacgatcctc

SEQ ID NO: 698301 - DNA, 20 bp, mouse
gtagccagaggatcgtgtaa

SEQ ID NO: 698302 - DNA, 20 bp, mouse
gaggggcgttagcggagcgg

SEQ ID NO: 698303 - DNA, 20 bp, mouse
gaatgccccactcagttcct

SEQ ID NO: 698304 - DNA, 20 bp, mouse
gatgaatcctaaagaggtag

SEQ ID NO: 698305 - DNA, 20 bp, mouse
gagatcaaggttactactac

SEQ ID NO: 698306 - DNA, 20 bp, mouse
gtggctacggggtcgtgcaa

SEQ ID NO: 698307 - DNA, 20 bp, mouse
gagagggcgtggtgtggcta

SEQ ID NO: 698308 - DNA, 20 bp, mouse
gcaaaggagacagtctggta

SEQ ID NO: 698309 - DNA, 20 bp, mouse
gcccacggctaagaaccgaa

SEQ ID NO: 698310 - DNA, 20 bp, mouse
ggctgtcagccaggctatgg

SEQ ID NO: 698311 - DNA, 20 bp, mouse
gagggacacgccacactcca

SEQ ID NO: 698312 - DNA, 20 bp, mouse
gcttcctgggaacgaggaga

SEQ ID NO: 698313 - DNA, 20 bp, mouse
gtgctcgcaggactgaatga

SEQ ID NO: 698314 - DNA, 20 bp, mouse
gtcgccgaatccctggagtg

SEQ ID NO: 698315 - DNA, 20 bp, mouse
gcgtctgacaagggcactaa

SEQ ID NO: 698316 - DNA, 20 bp, mouse
gggaaggagcgcatgcgcta

SEQ ID NO: 698317 - DNA, 20 bp, mouse
gggcaggaaggcaggtggcg

SEQ ID NO: 698318 - DNA, 20 bp, mouse
ggcccccacctcaccggccg

SEQ ID NO: 698319 - DNA, 20 bp, mouse
ggaagctagctgccctaaga

SEQ ID NO: 698320 - DNA, 20 bp, mouse
gggtgtgcgcgtgcccagta

SEQ ID NO: 698321 - DNA, 20 bp, mouse
gccaagagctccgcgccccc

SEQ ID NO: 698322 - DNA, 20 bp, mouse
gggcaggtggcgtggcaccg

SEQ ID NO: 698323 - DNA, 20 bp, mouse
gtgccttcctgcccttctta

SEQ ID NO: 698324 - DNA, 20 bp, mouse
gcagaagcaggatccagcct

SEQ ID NO: 698325 - DNA, 20 bp, mouse
gagcttcactaccccatact

SEQ ID NO: 698326 - DNA, 20 bp, mouse
ggtagccgtggcaaccgtgg

SEQ ID NO: 698327 - DNA, 20 bp, mouse
ggctacaagtcccggaacct

SEQ ID NO: 698328 - DNA, 20 bp, mouse
gaaccagcgtcagcacgcca

SEQ ID NO: 698329 - DNA, 20 bp, mouse
gcaggtgtgtgtagatgctc

SEQ ID NO: 698330 - DNA, 20 bp, mouse
gaaccttggcgtgctgacgc

SEQ ID NO: 698331 - DNA, 20 bp, mouse
gagagcactggcacatgtat

SEQ ID NO: 698332 - DNA, 20 bp, mouse
ggactcctccacggttgcca

SEQ ID NO: 698333 - DNA, 20 bp, mouse
gtgctccggaaaccagcaga

SEQ ID NO: 698334 - DNA, 20 bp, mouse
gttgccacggctacaagtcc

SEQ ID NO: 698335 - DNA, 20 bp, mouse
ggttccgggacttgtagccg

SEQ ID NO: 698336 - DNA, 20 bp, mouse
gggcgcttccacgctcctat

SEQ ID NO: 698337 - DNA, 20 bp, mouse
gggcgcgcgaccaagccaat

SEQ ID NO: 698338 - DNA, 20 bp, mouse
gcgcgccacgcgcacccttc

SEQ ID NO: 698339 - DNA, 20 bp, mouse
ggcccccttccgccagggaa

SEQ ID NO: 698340 - DNA, 20 bp, mouse
gacgaggtcgcaggaggctc

SEQ ID NO: 698341 - DNA, 20 bp, mouse
gactggacaagttacctgaa

SEQ ID NO: 698342 - DNA, 20 bp, mouse
gtaacactggacccactgtg

SEQ ID NO: 698343 - DNA, 20 bp, mouse
ggggcggagcctttccctgg

SEQ ID NO: 698344 - DNA, 20 bp, mouse
gcaaccatattctcgtgcga

SEQ ID NO: 698345 - DNA, 20 bp, mouse
gggatctacgaggtcgcagg

SEQ ID NO: 698346 - DNA, 20 bp, mouse
gaagacgcggggatcggctg

SEQ ID NO: 698347 - DNA, 20 bp, mouse
gggagcgaagacgcggggat

SEQ ID NO: 698348 - DNA, 20 bp, mouse
ggacagagtgatcgagcaga

SEQ ID NO: 698349 - DNA, 20 bp, mouse
gaaagggattaccaccacaa

SEQ ID NO: 698350 - DNA, 20 bp, mouse
gtctgagttagaggtgatcc

SEQ ID NO: 698351 - DNA, 20 bp, mouse
ggagccttggagcgaagacg

SEQ ID NO: 698352 - DNA, 20 bp, mouse
gagccagagcaaggcgctac

SEQ ID NO: 698353 - DNA, 20 bp, mouse
gcctcaagagctttacacta

SEQ ID NO: 698354 - DNA, 20 bp, mouse
gagcagaacattaaccgttg

SEQ ID NO: 698355 - DNA, 20 bp, mouse
ggctgggtgagatgacggca

SEQ ID NO: 698356 - DNA, 20 bp, mouse
gagcaagggtccgccctcgg

SEQ ID NO: 698357 - DNA, 20 bp, mouse
gagggcggacccttgctctg

SEQ ID NO: 698358 - DNA, 20 bp, mouse
ggccaggcgctggcgctcat

SEQ ID NO: 698359 - DNA, 20 bp, mouse
gtgcgttcgggtggcagaga

SEQ ID NO: 698360 - DNA, 20 bp, mouse
gggcagagaaggcagtatgg

SEQ ID NO: 698361 - DNA, 20 bp, mouse
ggagtctggctgcgttcggg

SEQ ID NO: 698362 - DNA, 20 bp, mouse
ggccaatcggaaggcagcgc

SEQ ID NO: 698363 - DNA, 20 bp, mouse
gctgcgcctgacaacttaga

SEQ ID NO: 698364 - DNA, 20 bp, mouse
gccggagtctggctgcgttc

SEQ ID NO: 698365 - DNA, 20 bp, mouse
gtgcttgaccacacccccga

SEQ ID NO: 698366 - DNA, 20 bp, mouse
gctaccccggacaacactat

SEQ ID NO: 698367 - DNA, 20 bp, mouse
ggggaggggcggagcctccg

SEQ ID NO: 698368 - DNA, 20 bp, mouse
ggctacttggggcgggacac

SEQ ID NO: 698369 - DNA, 20 bp, mouse
gagccagaggggacctggga

SEQ ID NO: 698370 - DNA, 20 bp, mouse
ggtgccaggaggtcgtcgga

SEQ ID NO: 698371 - DNA, 20 bp, mouse
gaaaagcatcagagtgctcc

SEQ ID NO: 698372 - DNA, 20 bp, mouse
gaccggtgccaggaggtcgt

SEQ ID NO: 698373 - DNA, 20 bp, mouse
gaatcccatagtgttgtccg

SEQ ID NO: 698374 - DNA, 20 bp, mouse
gcccaaaggtagatcaagaa

SEQ ID NO: 698375 - DNA, 20 bp, mouse
gtgctccaggctacttgggg

SEQ ID NO: 698376 - DNA, 20 bp, mouse
gaactcgcggcgccgagtga

SEQ ID NO: 698377 - DNA, 20 bp, mouse
gcgcgctcccgcggcatgat

SEQ ID NO: 698378 - DNA, 20 bp, mouse
gacgggctatagctaactcg

SEQ ID NO: 698379 - DNA, 20 bp, mouse
gggaggaagtgggcgactac

SEQ ID NO: 698380 - DNA, 20 bp, mouse
gaatgtggttcttgagagac

SEQ ID NO: 698381 - DNA, 20 bp, mouse
gcacaaacgagttttgtctg

SEQ ID NO: 698382 - DNA, 20 bp, mouse
gcagtacatgggcctgacta

SEQ ID NO: 698383 - DNA, 20 bp, mouse
gctctcaagaaccacattcc

SEQ ID NO: 698384 - DNA, 20 bp, mouse
ggcacgcgcagtgcactctg

SEQ ID NO: 698385 - DNA, 20 bp, mouse
gatcgctccaatccctagtc

SEQ ID NO: 698386 - DNA, 20 bp, mouse
gtccacgccagccagactga

SEQ ID NO: 698387 - DNA, 20 bp, mouse
gcagactgaggggcgggtga

SEQ ID NO: 698388 - DNA, 20 bp, mouse
gctggctggcgtggaatctg

SEQ ID NO: 698389 - DNA, 20 bp, mouse
gtgaggggcgggtgaaggcc

SEQ ID NO: 698390 - DNA, 20 bp, mouse
gaaggcccggagccgaaagc

SEQ ID NO: 698391 - DNA, 20 bp, mouse
gacccgcccctcagtctggc

SEQ ID NO: 698392 - DNA, 20 bp, mouse
gttcgctgagagttcgctgc

SEQ ID NO: 698393 - DNA, 20 bp, mouse
gcgcccgcaccggaagttga

SEQ ID NO: 698394 - DNA, 20 bp, mouse
gctgcgggtcgggaggagtt

SEQ ID NO: 698395 - DNA, 20 bp, mouse
gaccacccagaggcggatgt

SEQ ID NO: 698396 - DNA, 20 bp, mouse
ggcacacaagtgtaaagcag

SEQ ID NO: 698397 - DNA, 20 bp, mouse
gccttctggaaggcctctga

SEQ ID NO: 698398 - DNA, 20 bp, mouse
ggaggtggggatatggctcg

SEQ ID NO: 698399 - DNA, 20 bp, mouse
gtggagctgtcttccatcag

SEQ ID NO: 698400 - DNA, 20 bp, mouse
ggttgctaggcgccgaatgg

SEQ ID NO: 698401 - DNA, 20 bp, mouse
gagtcacaaaggcggttgct

SEQ ID NO: 698402 - DNA, 20 bp, mouse
gatggctcgaggcgcccttc

SEQ ID NO: 698403 - DNA, 20 bp, mouse
gacaagtgtaaagcaggggc

SEQ ID NO: 698404 - DNA, 20 bp, mouse
gtaactacaggtcttggaac

SEQ ID NO: 698405 - DNA, 20 bp, mouse
gaaaaaaagcggcagctacc

SEQ ID NO: 698406 - DNA, 20 bp, mouse
gcggagcggggacggagcga

SEQ ID NO: 698407 - DNA, 20 bp, mouse
ggggacggagcgagggcatc

SEQ ID NO: 698408 - DNA, 20 bp, mouse
ggggacgtgatcatcgggag

SEQ ID NO: 698409 - DNA, 20 bp, mouse
ggtacgagaagcccgcgaag

SEQ ID NO: 698410 - DNA, 20 bp, mouse
gtaagagagcgtccaggaga

SEQ ID NO: 698411 - DNA, 20 bp, mouse
gccggaagggacgtgatcat

SEQ ID NO: 698412 - DNA, 20 bp, mouse
gcgggcttctcgtactatgc

SEQ ID NO: 698413 - DNA, 20 bp, mouse
ggtccaggagaggggcggag

SEQ ID NO: 698414 - DNA, 20 bp, mouse
ggggcgggatctagcgatcg

SEQ ID NO: 698415 - DNA, 20 bp, mouse
gcatcaagcgcggatcagat

SEQ ID NO: 698416 - DNA, 20 bp, mouse
ggtgctgtgccattggacga

SEQ ID NO: 698417 - DNA, 20 bp, mouse
gtctcgcaccatggtttccg

SEQ ID NO: 698418 - DNA, 20 bp, mouse
gcatggtttccggggcacat

SEQ ID NO: 698419 - DNA, 20 bp, mouse
gtttcagcgccaatgtgccc

SEQ ID NO: 698420 - DNA, 20 bp, mouse
gctcgcgcctcgggatgtca

SEQ ID NO: 698421 - DNA, 20 bp, mouse
ggctcacgctcatgtccaat

SEQ ID NO: 698422 - DNA, 20 bp, mouse
gtgacacggccgtcgtccaa

SEQ ID NO: 698423 - DNA, 20 bp, mouse
gtccaatcggctcgcgcctc

SEQ ID NO: 698424 - DNA, 20 bp, mouse
gagtcccaagcttttactct

SEQ ID NO: 698425 - DNA, 20 bp, mouse
gatgaacatgggtccccttt

SEQ ID NO: 698426 - DNA, 20 bp, mouse
gtctcccgaaaactaaggac

SEQ ID NO: 698427 - DNA, 20 bp, mouse
gagacccagcagttcgtcct

SEQ ID NO: 698428 - DNA, 20 bp, mouse
gagaaaggatgagattacca

SEQ ID NO: 698429 - DNA, 20 bp, mouse
gggtctgcagggcctccgcg

SEQ ID NO: 698430 - DNA, 20 bp, mouse
gacgaactgctgggtctgca

SEQ ID NO: 698431 - DNA, 20 bp, mouse
ggcagagcgccgccagagac

SEQ ID NO: 698432 - DNA, 20 bp, mouse
gtggactgccgttggttcta

SEQ ID NO: 698433 - DNA, 20 bp, mouse
gagagtgttgaggctagttt

SEQ ID NO: 698434 - DNA, 20 bp, mouse
ggctgggagttgtagtactg

SEQ ID NO: 698435 - DNA, 20 bp, mouse
gccgctccgtggctggaaga

SEQ ID NO: 698436 - DNA, 20 bp, mouse
gcgggagagggaggtgcaac

SEQ ID NO: 698437 - DNA, 20 bp, mouse
ggcaaccggctcacacgctt

SEQ ID NO: 698438 - DNA, 20 bp, mouse
gtagcatgcgcgttatggta

SEQ ID NO: 698439 - DNA, 20 bp, mouse
ggatgatggcccaaattcgc

SEQ ID NO: 698440 - DNA, 20 bp, mouse
gtaacgcgcatgctactctg

SEQ ID NO: 698441 - DNA, 20 bp, mouse
gagtcggaagtgcacctcgg

SEQ ID NO: 698442 - DNA, 20 bp, mouse
gggcccaaattcgcgggaga

SEQ ID NO: 698443 - DNA, 20 bp, mouse
gccccccaaagcgtgtgagc

SEQ ID NO: 698444 - DNA, 20 bp, mouse
gtaagcatgtgaaggtgctt

SEQ ID NO: 698445 - DNA, 20 bp, mouse
ggcaacaggtcccgcccccg

SEQ ID NO: 698446 - DNA, 20 bp, mouse
gctgacctggacaatgaact

SEQ ID NO: 698447 - DNA, 20 bp, mouse
gtccacaggcctgacggttc

SEQ ID NO: 698448 - DNA, 20 bp, mouse
ggcgggaaaaactaactggt

SEQ ID NO: 698449 - DNA, 20 bp, mouse
gacggggcggaaacccgctt

SEQ ID NO: 698450 - DNA, 20 bp, mouse
gttcggcgggaaaaactaac

SEQ ID NO: 698451 - DNA, 20 bp, mouse
gaactggtctgcttagtagc

SEQ ID NO: 698452 - DNA, 20 bp, mouse
gggtaaaaacagtatgctat

SEQ ID NO: 698453 - DNA, 20 bp, mouse
gagtctgcaaagggacgggg

SEQ ID NO: 698454 - DNA, 20 bp, mouse
gcttagtagcaggagaaagc

SEQ ID NO: 698455 - DNA, 20 bp, mouse
gagatcactcacaagtccac

SEQ ID NO: 698456 - DNA, 20 bp, mouse
gcccgctcgagggatgggaa

SEQ ID NO: 698457 - DNA, 20 bp, mouse
gtgccttcaagcccgctcga

SEQ ID NO: 698458 - DNA, 20 bp, mouse
gcgaagtgtgtgacgggctg

SEQ ID NO: 698459 - DNA, 20 bp, mouse
gttcaagcccgctcgaggga

SEQ ID NO: 698460 - DNA, 20 bp, mouse
gaaacctggagcggtggctc

SEQ ID NO: 698461 - DNA, 20 bp, mouse
gaatctcaaacctggagcgg

SEQ ID NO: 698462 - DNA, 20 bp, mouse
gcttcccgccgcaaaatcgg

SEQ ID NO: 698463 - DNA, 20 bp, mouse
gaacccgccagtcccgcccc

SEQ ID NO: 698464 - DNA, 20 bp, mouse
gttgaaggcaatctcaaacc

SEQ ID NO: 698465 - DNA, 20 bp, mouse
gcgggctgggggcgggtgtc

SEQ ID NO: 698466 - DNA, 20 bp, mouse
ggggcccggcggacggcgag

SEQ ID NO: 698467 - DNA, 20 bp, mouse
ggaagctcccgcccaggctc

SEQ ID NO: 698468 - DNA, 20 bp, mouse
gagcagcgcacgggcgggag

SEQ ID NO: 698469 - DNA, 20 bp, mouse
gacgggcgggagtggcgcag

SEQ ID NO: 698470 - DNA, 20 bp, mouse
gtgccctgacaaccggggat

SEQ ID NO: 698471 - DNA, 20 bp, mouse
ggccgctgcaggtaacggca

SEQ ID NO: 698472 - DNA, 20 bp, mouse
gcgttcccgagctcggggcg

SEQ ID NO: 698473 - DNA, 20 bp, mouse
gcggccgccgctgcaggtaa

SEQ ID NO: 698474 - DNA, 20 bp, mouse
gcgctctgtcagctcctcta

SEQ ID NO: 698475 - DNA, 20 bp, mouse
gccctcagctgtgcctggtc

SEQ ID NO: 698476 - DNA, 20 bp, mouse
gtgtgcctgcagcacctcat

SEQ ID NO: 698477 - DNA, 20 bp, mouse
gggggacgaccgcagagtag

SEQ ID NO: 698478 - DNA, 20 bp, mouse
gccactcatagttcacttaa

SEQ ID NO: 698479 - DNA, 20 bp, mouse
ggattctcactgcacagcgt

SEQ ID NO: 698480 - DNA, 20 bp, mouse
gcctgacttcagcttccaag

SEQ ID NO: 698481 - DNA, 20 bp, mouse
gtctgcggtcgtccccgaga

SEQ ID NO: 698482 - DNA, 20 bp, mouse
ggtcaaaagtccgtgggaaa

SEQ ID NO: 698483 - DNA, 20 bp, mouse
gaaaagtccgtgggaaaggg

SEQ ID NO: 698484 - DNA, 20 bp, mouse
gcctctcagctgcaaacaag

SEQ ID NO: 698485 - DNA, 20 bp, mouse
gcagcacctcataggctccc

SEQ ID NO: 698486 - DNA, 20 bp, mouse
gaggagcagacgtggaaaag

SEQ ID NO: 698487 - DNA, 20 bp, mouse
gccgcgcctcggggtctgac

SEQ ID NO: 698488 - DNA, 20 bp, mouse
ggagggtgagcggttctccc

SEQ ID NO: 698489 - DNA, 20 bp, mouse
ggcggctgaagaagagtgga

SEQ ID NO: 698490 - DNA, 20 bp, mouse
gcagaccccgaggcgcggtc

SEQ ID NO: 698491 - DNA, 20 bp, mouse
ggcctcggggtctgactggt

SEQ ID NO: 698492 - DNA, 20 bp, mouse
gagccaatcaggagcagacg

SEQ ID NO: 698493 - DNA, 20 bp, mouse
ggggtcccgaccgcgcctcg

SEQ ID NO: 698494 - DNA, 20 bp, mouse
gcaggcaggacggccaatgg

SEQ ID NO: 698495 - DNA, 20 bp, mouse
gcggctgggcggtgtggtcg

SEQ ID NO: 698496 - DNA, 20 bp, mouse
gctcggggcctgtgcgtccg

SEQ ID NO: 698497 - DNA, 20 bp, mouse
ggacgcacaggccccgagga

SEQ ID NO: 698498 - DNA, 20 bp, mouse
gcagcgaccaggaaggtcgg

SEQ ID NO: 698499 - DNA, 20 bp, mouse
gcccccttggtgtgcattgt

SEQ ID NO: 698500 - DNA, 20 bp, mouse
gggtgtgcattgttgggtga

SEQ ID NO: 698501 - DNA, 20 bp, mouse
gccaggcgatgccatcctcg

SEQ ID NO: 698502 - DNA, 20 bp, mouse
gaccaggaaggtcggaggga

SEQ ID NO: 698503 - DNA, 20 bp, mouse
ggatggcatcgcctgggctt

SEQ ID NO: 698504 - DNA, 20 bp, mouse
ggccggggcctcggacgcac

SEQ ID NO: 698505 - DNA, 20 bp, mouse
gcccgccctggcagaggcct

SEQ ID NO: 698506 - DNA, 20 bp, mouse
ggcgcagaaaggtggaccgt

SEQ ID NO: 698507 - DNA, 20 bp, mouse
gtgcgcacctgcctccgggg

SEQ ID NO: 698508 - DNA, 20 bp, mouse
ggctgtgcgggcgcaggtca

SEQ ID NO: 698509 - DNA, 20 bp, mouse
gaggcaggtgcgcagaaagg

SEQ ID NO: 698510 - DNA, 20 bp, mouse
gcaagtaaggcacagctcca

SEQ ID NO: 698511 - DNA, 20 bp, mouse
ggtaaggcacagctccaggg

SEQ ID NO: 698512 - DNA, 20 bp, mouse
ggaaaggtggaccgtgggca

SEQ ID NO: 698513 - DNA, 20 bp, mouse
gcccaggctccccctgccga

SEQ ID NO: 698514 - DNA, 20 bp, mouse
gggagcccggagaaggtgcg

SEQ ID NO: 698515 - DNA, 20 bp, mouse
gagggcggagcaggcggggt

SEQ ID NO: 698516 - DNA, 20 bp, mouse
ggggtgcaacagggcttcgg

SEQ ID NO: 698517 - DNA, 20 bp, mouse
gccgcccgcaggccaatcgg

SEQ ID NO: 698518 - DNA, 20 bp, mouse
gcgcgggtgcaacagggctt

SEQ ID NO: 698519 - DNA, 20 bp, mouse
gcggggaagcagctagctgt

SEQ ID NO: 698520 - DNA, 20 bp, mouse
gcttctccgcgggtgcaaca

SEQ ID NO: 698521 - DNA, 20 bp, mouse
ggacccgcccgcaggccaat

SEQ ID NO: 698522 - DNA, 20 bp, mouse
gaagctgtgcagcttctccg

SEQ ID NO: 698523 - DNA, 20 bp, mouse
gctctgattggtgatcacat

SEQ ID NO: 698524 - DNA, 20 bp, mouse
gccaatcggtggtgcgtccg

SEQ ID NO: 698525 - DNA, 20 bp, mouse
ggatcacatgggacagggcg

SEQ ID NO: 698526 - DNA, 20 bp, mouse
ggggcctaggcaggtgtagg

SEQ ID NO: 698527 - DNA, 20 bp, mouse
gctgctgtgcacgaaaacga

SEQ ID NO: 698528 - DNA, 20 bp, mouse
ggcgtggtgtcaggagacac

SEQ ID NO: 698529 - DNA, 20 bp, mouse
gaacccaggcaacggggcct

SEQ ID NO: 698530 - DNA, 20 bp, mouse
gcccaggctcgctcctcggg

SEQ ID NO: 698531 - DNA, 20 bp, mouse
gtgcctaggccccgttgcct

SEQ ID NO: 698532 - DNA, 20 bp, mouse
ggaggctccgcgttcctcac

SEQ ID NO: 698533 - DNA, 20 bp, mouse
gggagcgcggctcgtaaccc

SEQ ID NO: 698534 - DNA, 20 bp, mouse
ggcagggcggcgggcagcta

SEQ ID NO: 698535 - DNA, 20 bp, mouse
ggcggttcgaaaggcggagg

SEQ ID NO: 698536 - DNA, 20 bp, mouse
ggagcctcaaatgtacttaa

SEQ ID NO: 698537 - DNA, 20 bp, mouse
gcaaagggcgacttggaagc

SEQ ID NO: 698538 - DNA, 20 bp, mouse
gggccgccggacctgactag

SEQ ID NO: 698539 - DNA, 20 bp, mouse
gctgactaggggaccggaac

SEQ ID NO: 698540 - DNA, 20 bp, mouse
ggtcccctagtcaggtccgg

SEQ ID NO: 698541 - DNA, 20 bp, mouse
gcccggctgagaattcttga

SEQ ID NO: 698542 - DNA, 20 bp, mouse
gccggtcccctagtcaggtc

SEQ ID NO: 698543 - DNA, 20 bp, mouse
gcacgcgctatcgcgacttc

SEQ ID NO: 698544 - DNA, 20 bp, mouse
ggatctgagcctgctagtgg

SEQ ID NO: 698545 - DNA, 20 bp, mouse
gattacagacaatcactcta

SEQ ID NO: 698546 - DNA, 20 bp, mouse
gggaagatgccaagttgggt

SEQ ID NO: 698547 - DNA, 20 bp, mouse
gcaacttggcatcttcccta

SEQ ID NO: 698548 - DNA, 20 bp, mouse
ggatgcttcccaaagcccta

SEQ ID NO: 698549 - DNA, 20 bp, mouse
gaggcggagcgctagattgg

SEQ ID NO: 698550 - DNA, 20 bp, mouse
gataggaaaacacctctctc

SEQ ID NO: 698551 - DNA, 20 bp, mouse
ggacccgacgctccgctctt

SEQ ID NO: 698552 - DNA, 20 bp, mouse
gggtaggcggagcgctagat

SEQ ID NO: 698553 - DNA, 20 bp, mouse
ggcgctccgcctacccaact

SEQ ID NO: 698554 - DNA, 20 bp, mouse
gcagcccaagagcggagcgt

SEQ ID NO: 698555 - DNA, 20 bp, mouse
ggaaaataggtgtaatcggg

SEQ ID NO: 698556 - DNA, 20 bp, mouse
gtgtggaagcgcccaggatg

SEQ ID NO: 698557 - DNA, 20 bp, mouse
gtgtgcagtggtgagtcagt

SEQ ID NO: 698558 - DNA, 20 bp, mouse
gcaggcggcctgagcggggt

SEQ ID NO: 698559 - DNA, 20 bp, mouse
ggacctgaataggagcgaag

SEQ ID NO: 698560 - DNA, 20 bp, mouse
gtgacctgagggtgtgactg

SEQ ID NO: 698561 - DNA, 20 bp, mouse
gaatcttcgtaaagccccaa

SEQ ID NO: 698562 - DNA, 20 bp, mouse
gggttgcgagaaagttctgc

SEQ ID NO: 698563 - DNA, 20 bp, mouse
gcccacaggcagtctagagc

SEQ ID NO: 698564 - DNA, 20 bp, mouse
gcagtctagagctggtgggt

SEQ ID NO: 698565 - DNA, 20 bp, mouse
gaactttctcgcaacccttg

SEQ ID NO: 698566 - DNA, 20 bp, mouse
gaggacacaccccagagctg

SEQ ID NO: 698567 - DNA, 20 bp, mouse
gtctgggcggaaacttcctg

SEQ ID NO: 698568 - DNA, 20 bp, mouse
gctctggggtgtgtcctgag

SEQ ID NO: 698569 - DNA, 20 bp, mouse
gttagcacagagacgccaat

SEQ ID NO: 698570 - DNA, 20 bp, mouse
ggaagagctaatgtcctcaa

SEQ ID NO: 698571 - DNA, 20 bp, mouse
gacttgctgagttggacctc

SEQ ID NO: 698572 - DNA, 20 bp, mouse
gaatgtgtgccaggtgttca

SEQ ID NO: 698573 - DNA, 20 bp, mouse
gcagcaccaacaggcctctc

SEQ ID NO: 698574 - DNA, 20 bp, mouse
ggtcgtcagaaatttctggg

SEQ ID NO: 698575 - DNA, 20 bp, mouse
gcagcgctgacttgctgagt

SEQ ID NO: 698576 - DNA, 20 bp, mouse
gcgcgcgggcatcaccccac

SEQ ID NO: 698577 - DNA, 20 bp, mouse
gcccgtgcagggtcccggct

SEQ ID NO: 698578 - DNA, 20 bp, mouse
gcggggacggaagcaggcgg

SEQ ID NO: 698579 - DNA, 20 bp, mouse
gtccgcgcgcgctacgatcg

SEQ ID NO: 698580 - DNA, 20 bp, mouse
gaccctgcacgggcgcgcgc

SEQ ID NO: 698581 - DNA, 20 bp, mouse
gtgcgcgcgcagtgtgggtc

SEQ ID NO: 698582 - DNA, 20 bp, mouse
ggggccaccgagaacggcct

SEQ ID NO: 698583 - DNA, 20 bp, mouse
gccggcgcgccgccgccggt

SEQ ID NO: 698584 - DNA, 20 bp, mouse
ggtagcgcgcgcggaaccga

SEQ ID NO: 698585 - DNA, 20 bp, mouse
ggcgcagccccgacgctcat

SEQ ID NO: 698586 - DNA, 20 bp, mouse
gagcttgcgctgaaaggtgc

SEQ ID NO: 698587 - DNA, 20 bp, mouse
gggaaatgcgcacgtcgcgg

SEQ ID NO: 698588 - DNA, 20 bp, mouse
ggccgccagggcaccccaat

SEQ ID NO: 698589 - DNA, 20 bp, mouse
gagcccttgttctacgagaa

SEQ ID NO: 698590 - DNA, 20 bp, mouse
gggactgcgattggcgtctg

SEQ ID NO: 698591 - DNA, 20 bp, mouse
gtggtgaaggggaatcgaga

SEQ ID NO: 698592 - DNA, 20 bp, mouse
gggtcctctgtccagccctg

SEQ ID NO: 698593 - DNA, 20 bp, mouse
gtgagtgctcaagctacccc

SEQ ID NO: 698594 - DNA, 20 bp, mouse
ggactgggagactggtgaag

SEQ ID NO: 698595 - DNA, 20 bp, mouse
gcttgagcactcaggaccta

SEQ ID NO: 698596 - DNA, 20 bp, mouse
gaaggcacagcgagaggcat

SEQ ID NO: 698597 - DNA, 20 bp, mouse
gggccccacgagaaggaaga

SEQ ID NO: 698598 - DNA, 20 bp, mouse
gaaggcctatgaggcggcaa

SEQ ID NO: 698599 - DNA, 20 bp, mouse
ggtccagcgttcttcgtgat

SEQ ID NO: 698600 - DNA, 20 bp, mouse
gaggtcagtgcttctgcaac

SEQ ID NO: 698601 - DNA, 20 bp, mouse
gtcccagaaggcacagcgag

SEQ ID NO: 698602 - DNA, 20 bp, mouse
gtacgcacgcagggagttct

SEQ ID NO: 698603 - DNA, 20 bp, mouse
gctaccttcttccttctcgt

SEQ ID NO: 698604 - DNA, 20 bp, mouse
gtgtagtgtgcgttacaaag

SEQ ID NO: 698605 - DNA, 20 bp, mouse
gcaaaatagagatacacttg

SEQ ID NO: 698606 - DNA, 20 bp, mouse
gaggccatgtgcaaataggg

SEQ ID NO: 698607 - DNA, 20 bp, mouse
ggcgcaggcgcgttcaaaag

SEQ ID NO: 698608 - DNA, 20 bp, mouse
gcggaggccatgtgcaaata

SEQ ID NO: 698609 - DNA, 20 bp, mouse
ggagcaatggggacacgttg

SEQ ID NO: 698610 - DNA, 20 bp, mouse
gaacaaggctgaccacccat

SEQ ID NO: 698611 - DNA, 20 bp, mouse
gaactgggaccgtggcgtca

SEQ ID NO: 698612 - DNA, 20 bp, mouse
gcgggtactaaaactggcgc

SEQ ID NO: 698613 - DNA, 20 bp, mouse
gccgcggcgggtactaaaac

SEQ ID NO: 698614 - DNA, 20 bp, mouse
gaaagaggctgcaccgccag

SEQ ID NO: 698615 - DNA, 20 bp, mouse
gtctagcaagacctagaaac

SEQ ID NO: 698616 - DNA, 20 bp, mouse
gcgcgcctggaggtattcgg

SEQ ID NO: 698617 - DNA, 20 bp, mouse
gtgcctgtcggaggagaacg

SEQ ID NO: 698618 - DNA, 20 bp, mouse
gcctccgacaggcacagtcc

SEQ ID NO: 698619 - DNA, 20 bp, mouse
gaaccccgttctcctccgac

SEQ ID NO: 698620 - DNA, 20 bp, mouse
gggagcgacggaagcggtgg

SEQ ID NO: 698621 - DNA, 20 bp, mouse
gacggcgggagcgacggaag

SEQ ID NO: 698622 - DNA, 20 bp, mouse
gcgcggtccggaaaactcag

SEQ ID NO: 698623 - DNA, 20 bp, mouse
gcgcgcgtgcgcagtgctcc

SEQ ID NO: 698624 - DNA, 20 bp, mouse
gggagaacggggttccgcgc

SEQ ID NO: 698625 - DNA, 20 bp, mouse
gcgaccgccaacagacatgc

SEQ ID NO: 698626 - DNA, 20 bp, mouse
ggctccggtaccaacgtaag

SEQ ID NO: 698627 - DNA, 20 bp, mouse
gtatgcaaggatcccggcat

SEQ ID NO: 698628 - DNA, 20 bp, mouse
gagggccgctggccggaagt

SEQ ID NO: 698629 - DNA, 20 bp, mouse
ggagcagaagtaattggcac

SEQ ID NO: 698630 - DNA, 20 bp, mouse
gtgaccttagaacatggaga

SEQ ID NO: 698631 - DNA, 20 bp, mouse
gagagggaaaaatattatcc

SEQ ID NO: 698632 - DNA, 20 bp, mouse
gtttccctctccatgttcta

SEQ ID NO: 698633 - DNA, 20 bp, mouse
gcaacgtaagcggaaggtga

SEQ ID NO: 698634 - DNA, 20 bp, mouse
ggctggccggaagtgggttg

SEQ ID NO: 698635 - DNA, 20 bp, mouse
ggaaaaatattatcctggat

SEQ ID NO: 698636 - DNA, 20 bp, mouse
gttgcagaggacctgttccc

SEQ ID NO: 698637 - DNA, 20 bp, mouse
gtcagtgtacgcctgggaac

SEQ ID NO: 698638 - DNA, 20 bp, mouse
gtcagcatcagtgtacgcct

SEQ ID NO: 698639 - DNA, 20 bp, mouse
gtactcatagtcagtgtggg

SEQ ID NO: 698640 - DNA, 20 bp, mouse
gggggaatgcttgatgcata

SEQ ID NO: 698641 - DNA, 20 bp, mouse
ggagtgttgatgttggtgtt

SEQ ID NO: 698642 - DNA, 20 bp, mouse
gaagagtgtcacttgctgga

SEQ ID NO: 698643 - DNA, 20 bp, mouse
ggcttactcatagtcagtgt

SEQ ID NO: 698644 - DNA, 20 bp, mouse
ggactgaggcaagagggcta

SEQ ID NO: 698645 - DNA, 20 bp, mouse
gtaacaatcaaattcagggt

SEQ ID NO: 698646 - DNA, 20 bp, mouse
gcagctctctggctcaccgc

SEQ ID NO: 698647 - DNA, 20 bp, mouse
gactacctgcccaggcactc

SEQ ID NO: 698648 - DNA, 20 bp, mouse
gttaccccattgtgagctct

SEQ ID NO: 698649 - DNA, 20 bp, mouse
gatgaagtcagcgaagatga

SEQ ID NO: 698650 - DNA, 20 bp, mouse
gaccgcagggagagaaagca

SEQ ID NO: 698651 - DNA, 20 bp, mouse
gggcgtggtgtctgaaaatt

SEQ ID NO: 698652 - DNA, 20 bp, mouse
gcagacttctaggctgagga

SEQ ID NO: 698653 - DNA, 20 bp, mouse
gcagagctggaagtgtgggg

SEQ ID NO: 698654 - DNA, 20 bp, mouse
gcagaggctgctgagaaagt

SEQ ID NO: 698655 - DNA, 20 bp, mouse
gctcaagaacccgagtgcct

SEQ ID NO: 698656 - DNA, 20 bp, mouse
gttcccactactgttgagat

SEQ ID NO: 698657 - DNA, 20 bp, mouse
gagtgggaaagcgtcactta

SEQ ID NO: 698658 - DNA, 20 bp, mouse
gaaccaatctcaacagtagt

SEQ ID NO: 698659 - DNA, 20 bp, mouse
gaggaagttcaatcaagata

SEQ ID NO: 698660 - DNA, 20 bp, mouse
gcaacttagaaatgtataat

SEQ ID NO: 698661 - DNA, 20 bp, mouse
gttgtggaaaaggctactgt

SEQ ID NO: 698662 - DNA, 20 bp, mouse
gaaactttctcgtataattg

SEQ ID NO: 698663 - DNA, 20 bp, mouse
ggcgtctttcttttgaaatt

SEQ ID NO: 698664 - DNA, 20 bp, mouse
gcaaatttattatatgttag

SEQ ID NO: 698665 - DNA, 20 bp, mouse
gggtatagcaattaaaatga

SEQ ID NO: 698666 - DNA, 20 bp, mouse
ggcagcctgggctggacctc

SEQ ID NO: 698667 - DNA, 20 bp, mouse
gcagcccgggctgcccgcag

SEQ ID NO: 698668 - DNA, 20 bp, mouse
gcgacccgcggcgagagcaa

SEQ ID NO: 698669 - DNA, 20 bp, mouse
ggacccccgtggcgctgagg

SEQ ID NO: 698670 - DNA, 20 bp, mouse
gcgggctgcccgcagaggca

SEQ ID NO: 698671 - DNA, 20 bp, mouse
gagcctggaaggtggtctgt

SEQ ID NO: 698672 - DNA, 20 bp, mouse
ggtccagcccaggctgccgc

SEQ ID NO: 698673 - DNA, 20 bp, mouse
ggagcccctggcatggtgag

SEQ ID NO: 698674 - DNA, 20 bp, mouse
ggacctcgggcttcgacccg

SEQ ID NO: 698675 - DNA, 20 bp, mouse
gtccgacccccgtggcgctg

SEQ ID NO: 698676 - DNA, 20 bp, mouse
ggaccaggacaaggtacaag

SEQ ID NO: 698677 - DNA, 20 bp, mouse
gaaacagcccaaaccagttt

SEQ ID NO: 698678 - DNA, 20 bp, mouse
ggcagaatgtggaagtctgg

SEQ ID NO: 698679 - DNA, 20 bp, mouse
gagtctggtggtcaaacttg

SEQ ID NO: 698680 - DNA, 20 bp, mouse
gaaactcaacaattgtaaaa

SEQ ID NO: 698681 - DNA, 20 bp, mouse
gttctgacccattctcctgt

SEQ ID NO: 698682 - DNA, 20 bp, mouse
gacctcatcccacaggagaa

SEQ ID NO: 698683 - DNA, 20 bp, mouse
ggactatgtctgcttccaac

SEQ ID NO: 698684 - DNA, 20 bp, mouse
gctaggatctatgatcgacc

SEQ ID NO: 698685 - DNA, 20 bp, mouse
gaaccagtttaggagccagt

SEQ ID NO: 698686 - DNA, 20 bp, mouse
gcgcctgcgtacagcgtaag

SEQ ID NO: 698687 - DNA, 20 bp, mouse
gcgaccgcgcggatcgctgg

SEQ ID NO: 698688 - DNA, 20 bp, mouse
gtgagggaatacgaagttca

SEQ ID NO: 698689 - DNA, 20 bp, mouse
gtaagagcccggtggacaga

SEQ ID NO: 698690 - DNA, 20 bp, mouse
gaaggggcgggctgggacgg

SEQ ID NO: 698691 - DNA, 20 bp, mouse
gcgcaggcgttcggtccttg

SEQ ID NO: 698692 - DNA, 20 bp, mouse
ggtggtcatgagcaacagtg

SEQ ID NO: 698693 - DNA, 20 bp, mouse
gctgcgtacagcgtaagggg

SEQ ID NO: 698694 - DNA, 20 bp, mouse
gctcctccagtcctgcaaag

SEQ ID NO: 698695 - DNA, 20 bp, mouse
ggaagctggtaagagcccgg

SEQ ID NO: 698696 - DNA, 20 bp, mouse
gcgggaggctgcgatggctg

SEQ ID NO: 698697 - DNA, 20 bp, mouse
gtggacgcccgggctcgggg

SEQ ID NO: 698698 - DNA, 20 bp, mouse
gcgggagcgggtggaaccga

SEQ ID NO: 698699 - DNA, 20 bp, mouse
gcccccgccccgcatccccg

SEQ ID NO: 698700 - DNA, 20 bp, mouse
ggcggcgcgggaggctgcga

SEQ ID NO: 698701 - DNA, 20 bp, mouse
ggcgtccagccccgcagctg

SEQ ID NO: 698702 - DNA, 20 bp, mouse
gcgggtggaaccgagggcgg

SEQ ID NO: 698703 - DNA, 20 bp, mouse
gggccagggcagattaaggt

SEQ ID NO: 698704 - DNA, 20 bp, mouse
ggcagcgcaccgcggggatg

SEQ ID NO: 698705 - DNA, 20 bp, mouse
gctgggcccggcaacagagg

SEQ ID NO: 698706 - DNA, 20 bp, mouse
gccagcgtgccccgcagcgg

SEQ ID NO: 698707 - DNA, 20 bp, mouse
gaggccagaggctgcgaggt

SEQ ID NO: 698708 - DNA, 20 bp, mouse
ggaactcccttgcacctagt

SEQ ID NO: 698709 - DNA, 20 bp, mouse
gggttcggcccgctagtgaa

SEQ ID NO: 698710 - DNA, 20 bp, mouse
gggagttcctcaagttcgga

SEQ ID NO: 698711 - DNA, 20 bp, mouse
gcactagcgggccgaaccac

SEQ ID NO: 698712 - DNA, 20 bp, mouse
gccgaaccacaggacttgac

SEQ ID NO: 698713 - DNA, 20 bp, mouse
gtctggcctcaaatagacgg

SEQ ID NO: 698714 - DNA, 20 bp, mouse
gctcccagcgtgccccgcag

SEQ ID NO: 698715 - DNA, 20 bp, mouse
gcccgctagtgaacgggcga

SEQ ID NO: 698716 - DNA, 20 bp, mouse
ggccactctaggaaaaagtg

SEQ ID NO: 698717 - DNA, 20 bp, mouse
ggtctcccggaagtcggagt

SEQ ID NO: 698718 - DNA, 20 bp, mouse
gaagtcggagtcggcccctt

SEQ ID NO: 698719 - DNA, 20 bp, mouse
gcgtcccgtctcccggaagt

SEQ ID NO: 698720 - DNA, 20 bp, mouse
gagacgggacgcgcgtctaa

SEQ ID NO: 698721 - DNA, 20 bp, mouse
gcggagtcggccccttgggt

SEQ ID NO: 698722 - DNA, 20 bp, mouse
ggagtgctagcataagtgag

SEQ ID NO: 698723 - DNA, 20 bp, mouse
gcggtataacccctgattcc

SEQ ID NO: 698724 - DNA, 20 bp, mouse
gcgtagagacacgacagagc

SEQ ID NO: 698725 - DNA, 20 bp, mouse
ggattcagaactcccaccca

SEQ ID NO: 698726 - DNA, 20 bp, mouse
gcccctccccggtgcaccgt

SEQ ID NO: 698727 - DNA, 20 bp, mouse
gccccacggtgcaccgggga

SEQ ID NO: 698728 - DNA, 20 bp, mouse
gaaaaggtgacgctcgggga

SEQ ID NO: 698729 - DNA, 20 bp, mouse
gggggcgcggccacaggtgg

SEQ ID NO: 698730 - DNA, 20 bp, mouse
ggaggagtggtgggaacaaa

SEQ ID NO: 698731 - DNA, 20 bp, mouse
gaggctccacctgccccaat

SEQ ID NO: 698732 - DNA, 20 bp, mouse
gtacccctctccaccaattg

SEQ ID NO: 698733 - DNA, 20 bp, mouse
gaggtgacctagagcgaggt

SEQ ID NO: 698734 - DNA, 20 bp, mouse
ggcccacccccacggtgcac

SEQ ID NO: 698735 - DNA, 20 bp, mouse
gcccggtgcaccgtgggggt

SEQ ID NO: 698736 - DNA, 20 bp, mouse
gctgacagatacaccttccc

SEQ ID NO: 698737 - DNA, 20 bp, mouse
gggaatgtctgactcacaga

SEQ ID NO: 698738 - DNA, 20 bp, mouse
ggcaactacattttctttgg

SEQ ID NO: 698739 - DNA, 20 bp, mouse
gtaaggagtccgcctctgtc

SEQ ID NO: 698740 - DNA, 20 bp, mouse
gctagtgcgggccgaggaag

SEQ ID NO: 698741 - DNA, 20 bp, mouse
gtaaaccagctccccttcct

SEQ ID NO: 698742 - DNA, 20 bp, mouse
gtaagcaactacattttctt

SEQ ID NO: 698743 - DNA, 20 bp, mouse
gttagagaatggaagattga

SEQ ID NO: 698744 - DNA, 20 bp, mouse
gacaacgtgactgagctgca

SEQ ID NO: 698745 - DNA, 20 bp, mouse
ggggctgatctgctagttat

SEQ ID NO: 698746 - DNA, 20 bp, mouse
ggtctctgtggcagagagat

SEQ ID NO: 698747 - DNA, 20 bp, mouse
gcaaagggttacaagtgagc

SEQ ID NO: 698748 - DNA, 20 bp, mouse
gggctacaggggctacaaaa

SEQ ID NO: 698749 - DNA, 20 bp, mouse
gcagtggccaagcgtctctg

SEQ ID NO: 698750 - DNA, 20 bp, mouse
gttggccactgcgagatcca

SEQ ID NO: 698751 - DNA, 20 bp, mouse
gtggtgcaggggggcttccg

SEQ ID NO: 698752 - DNA, 20 bp, mouse
ggcgcgcagctggtgcaggg

SEQ ID NO: 698753 - DNA, 20 bp, mouse
gggggcttccggggctacag

SEQ ID NO: 698754 - DNA, 20 bp, mouse
gtaccagcagactcgagaga

SEQ ID NO: 698755 - DNA, 20 bp, mouse
ggcgtcaaagcgtggatccg

SEQ ID NO: 698756 - DNA, 20 bp, mouse
ggccacccagactctcctgc

SEQ ID NO: 698757 - DNA, 20 bp, mouse
gcatccccgcaggagagtct

SEQ ID NO: 698758 - DNA, 20 bp, mouse
gagacgtgccacccacctac

SEQ ID NO: 698759 - DNA, 20 bp, mouse
gccccgcaggagagtctggg

SEQ ID NO: 698760 - DNA, 20 bp, mouse
ggggaaaatggctcgctcga

SEQ ID NO: 698761 - DNA, 20 bp, mouse
gagtcctctaaactgtctgg

SEQ ID NO: 698762 - DNA, 20 bp, mouse
gccagctgcgcagtgctgaa

SEQ ID NO: 698763 - DNA, 20 bp, mouse
gcacacgcccaacactccaa

SEQ ID NO: 698764 - DNA, 20 bp, mouse
gctgaagggagggtccccgc

SEQ ID NO: 698765 - DNA, 20 bp, mouse
gcgggcgggataattgaacg

SEQ ID NO: 698766 - DNA, 20 bp, mouse
ggggactcagagacccggac

SEQ ID NO: 698767 - DNA, 20 bp, mouse
gggctcctgggctcctattt

SEQ ID NO: 698768 - DNA, 20 bp, mouse
ggagccggcgctctcctgtc

SEQ ID NO: 698769 - DNA, 20 bp, mouse
gccctgaggcgggacctgtg

SEQ ID NO: 698770 - DNA, 20 bp, mouse
gacagggtgctgggtccagg

SEQ ID NO: 698771 - DNA, 20 bp, mouse
gcaagcccaaataggagccc

SEQ ID NO: 698772 - DNA, 20 bp, mouse
ggtgctcaacaagcccaaat

SEQ ID NO: 698773 - DNA, 20 bp, mouse
ggtctgcagaaactaggcat

SEQ ID NO: 698774 - DNA, 20 bp, mouse
ggtccaggaggagaagctaa

SEQ ID NO: 698775 - DNA, 20 bp, mouse
gggcagggtgatctagacag

SEQ ID NO: 698776 - DNA, 20 bp, mouse
ggcgcccggcctccccaggg

SEQ ID NO: 698777 - DNA, 20 bp, mouse
gacgccccaagattgttgtg

SEQ ID NO: 698778 - DNA, 20 bp, mouse
gagggccaagtgctcggcgc

SEQ ID NO: 698779 - DNA, 20 bp, mouse
gcggagcggggcgcgtgcga

SEQ ID NO: 698780 - DNA, 20 bp, mouse
gaggggagcccgtcagagcg

SEQ ID NO: 698781 - DNA, 20 bp, mouse
gggggcgcccggcctcccca

SEQ ID NO: 698782 - DNA, 20 bp, mouse
gtgcgagggggcgtgtcatc

SEQ ID NO: 698783 - DNA, 20 bp, mouse
ggccccgctccgccctgggg

SEQ ID NO: 698784 - DNA, 20 bp, mouse
ggaccaggaagagcaagcaa

SEQ ID NO: 698785 - DNA, 20 bp, mouse
ggactcctcacaacaatctt

SEQ ID NO: 698786 - DNA, 20 bp, mouse
gcggacagtggggcagccca

SEQ ID NO: 698787 - DNA, 20 bp, mouse
gggcccctgccaactacacg

SEQ ID NO: 698788 - DNA, 20 bp, mouse
gacagtggggcagcccaggg

SEQ ID NO: 698789 - DNA, 20 bp, mouse
gtgcgacgcctcgcgaccaa

SEQ ID NO: 698790 - DNA, 20 bp, mouse
gtgcccgccgggagagacct

SEQ ID NO: 698791 - DNA, 20 bp, mouse
gtctctcccggcgggcagtg

SEQ ID NO: 698792 - DNA, 20 bp, mouse
gcggggaggcgccagccctg

SEQ ID NO: 698793 - DNA, 20 bp, mouse
gtcgcccaatcctctgctct

SEQ ID NO: 698794 - DNA, 20 bp, mouse
gagtggggactgcggacagt

SEQ ID NO: 698795 - DNA, 20 bp, mouse
ggacgcctcgcgaccaaggg

SEQ ID NO: 698796 - DNA, 20 bp, mouse
gagggaggcccgggtccggg

SEQ ID NO: 698797 - DNA, 20 bp, mouse
gaatgagggaggcccgggtc

SEQ ID NO: 698798 - DNA, 20 bp, mouse
gggcactgatcctgcgaatg

SEQ ID NO: 698799 - DNA, 20 bp, mouse
gccgggcctccctcattcgc

SEQ ID NO: 698800 - DNA, 20 bp, mouse
gggaggatagatggggccgg

SEQ ID NO: 698801 - DNA, 20 bp, mouse
gccagccaccgcccggaccc

SEQ ID NO: 698802 - DNA, 20 bp, mouse
gccgggcggtggctggcaga

SEQ ID NO: 698803 - DNA, 20 bp, mouse
ggtggaaagggaggatagat

SEQ ID NO: 698804 - DNA, 20 bp, mouse
ggatagatggggccgggggt

SEQ ID NO: 698805 - DNA, 20 bp, mouse
ggcgcggacgatacttgaag

SEQ ID NO: 698806 - DNA, 20 bp, mouse
gagggggtgggggtgtacag

SEQ ID NO: 698807 - DNA, 20 bp, mouse
ggcactccgggcacagatcc

SEQ ID NO: 698808 - DNA, 20 bp, mouse
gtgggcggggacaatgatag

SEQ ID NO: 698809 - DNA, 20 bp, mouse
gagccccgcgagctgacgaa

SEQ ID NO: 698810 - DNA, 20 bp, mouse
gccccggtgcgctgcctatc

SEQ ID NO: 698811 - DNA, 20 bp, mouse
gtggctgcacagcccggcgg

SEQ ID NO: 698812 - DNA, 20 bp, mouse
ggcgctggatctagcgcagg

SEQ ID NO: 698813 - DNA, 20 bp, mouse
ggatgcaacgtggaccgcgc

SEQ ID NO: 698814 - DNA, 20 bp, mouse
ggccgccggcccctcggtcc

SEQ ID NO: 698815 - DNA, 20 bp, mouse
gagggcaggaggctggacgc

SEQ ID NO: 698816 - DNA, 20 bp, mouse
ggggagggtgcatggaacgg

SEQ ID NO: 698817 - DNA, 20 bp, mouse
gcagaggcaaggtgggcggt

SEQ ID NO: 698818 - DNA, 20 bp, mouse
gtaggggagggtgcatggaa

SEQ ID NO: 698819 - DNA, 20 bp, mouse
gcagcttggcatctagggga

SEQ ID NO: 698820 - DNA, 20 bp, mouse
gagcccagaggcaaggtggg

SEQ ID NO: 698821 - DNA, 20 bp, mouse
ggcagaatggcagttggtag

SEQ ID NO: 698822 - DNA, 20 bp, mouse
ggcatctaggggagggtgca

SEQ ID NO: 698823 - DNA, 20 bp, mouse
gggtagcccagaggcaaggt

SEQ ID NO: 698824 - DNA, 20 bp, mouse
ggttgtcagcttggcatcta

SEQ ID NO: 698825 - DNA, 20 bp, mouse
gggaagtagcgttgtcagct

SEQ ID NO: 698826 - DNA, 20 bp, mouse
gagtactgcgctacagggaa

SEQ ID NO: 698827 - DNA, 20 bp, mouse
gctgccacagtgcaagaagc

SEQ ID NO: 698828 - DNA, 20 bp, mouse
ggccagggaagtttccttga

SEQ ID NO: 698829 - DNA, 20 bp, mouse
gctgccaccgtcagggaggg

SEQ ID NO: 698830 - DNA, 20 bp, mouse
gcagctgccaccgtcaggga

SEQ ID NO: 698831 - DNA, 20 bp, mouse
gtggcctccctccctgacgg

SEQ ID NO: 698832 - DNA, 20 bp, mouse
gcctcctatgggaagcaaga

SEQ ID NO: 698833 - DNA, 20 bp, mouse
gccctggcctccctccctga

SEQ ID NO: 698834 - DNA, 20 bp, mouse
gtatctgagtcacgtggggt

SEQ ID NO: 698835 - DNA, 20 bp, mouse
gtgactgtgccaaagtccga

SEQ ID NO: 698836 - DNA, 20 bp, mouse
gtggcccaaagaggctgact

SEQ ID NO: 698837 - DNA, 20 bp, mouse
gcagtcaccttggcccaaag

SEQ ID NO: 698838 - DNA, 20 bp, mouse
gtggctcaaggctaaaggga

SEQ ID NO: 698839 - DNA, 20 bp, mouse
gcccaaagaggctgactcgg

SEQ ID NO: 698840 - DNA, 20 bp, mouse
ggggagtggctcaaggctaa

SEQ ID NO: 698841 - DNA, 20 bp, mouse
ggccaccgagtcagcctctt

SEQ ID NO: 698842 - DNA, 20 bp, mouse
gcaggtcctgctctgtggga

SEQ ID NO: 698843 - DNA, 20 bp, mouse
gccctcccctcccacagagc

SEQ ID NO: 698844 - DNA, 20 bp, mouse
gctgtggagggagtggctca

SEQ ID NO: 698845 - DNA, 20 bp, mouse
gcgatcaggtcctgctctgt

SEQ ID NO: 698846 - DNA, 20 bp, mouse
ggggcggggcttaacgtgaa

SEQ ID NO: 698847 - DNA, 20 bp, mouse
gagctgtgcgcaaacgggtg

SEQ ID NO: 698848 - DNA, 20 bp, mouse
gaaagcttcccccctttcgg

SEQ ID NO: 698849 - DNA, 20 bp, mouse
ggggcgtgatctgacagggt

SEQ ID NO: 698850 - DNA, 20 bp, mouse
gaaagcgtagacaagagagg

SEQ ID NO: 698851 - DNA, 20 bp, mouse
gaggtggagccgggaagaat

SEQ ID NO: 698852 - DNA, 20 bp, mouse
gtaagccccgcccccgaaag

SEQ ID NO: 698853 - DNA, 20 bp, mouse
gaatggggcgtgatctgaca

SEQ ID NO: 698854 - DNA, 20 bp, mouse
gtgttgcaggggcggagcaa

SEQ ID NO: 698855 - DNA, 20 bp, mouse
gcgtgatctgacagggtcgg

SEQ ID NO: 698856 - DNA, 20 bp, mouse
gccaggagctggggtatgaa

SEQ ID NO: 698857 - DNA, 20 bp, mouse
gcgccaacctggggtaccac

SEQ ID NO: 698858 - DNA, 20 bp, mouse
gggccacaagaaacgcccgt

SEQ ID NO: 698859 - DNA, 20 bp, mouse
gggcgcagatctgcccgcgc

SEQ ID NO: 698860 - DNA, 20 bp, mouse
gggcaggcggggcgctgtgt

SEQ ID NO: 698861 - DNA, 20 bp, mouse
gcagatctgcccgcgcaggg

SEQ ID NO: 698862 - DNA, 20 bp, mouse
gcgggcagatctgcgcctcg

SEQ ID NO: 698863 - DNA, 20 bp, mouse
gcagatctgcgcctcggggc

SEQ ID NO: 698864 - DNA, 20 bp, mouse
gcctcggggctggattagtt

SEQ ID NO: 698865 - DNA, 20 bp, mouse
gggccattgcgcgccaacct

SEQ ID NO: 698866 - DNA, 20 bp, mouse
ggcaaagccgggtgagtctg

SEQ ID NO: 698867 - DNA, 20 bp, mouse
ggggttgcgggaggcaaagc

SEQ ID NO: 698868 - DNA, 20 bp, mouse
gccaagacttgggaacctag

SEQ ID NO: 698869 - DNA, 20 bp, mouse
gataggttcgaggatattgg

SEQ ID NO: 698870 - DNA, 20 bp, mouse
gggaacctaggggttgcggg

SEQ ID NO: 698871 - DNA, 20 bp, mouse
gggcagcttcccgtgatctc

SEQ ID NO: 698872 - DNA, 20 bp, mouse
gcgggaagctgccaagactt

SEQ ID NO: 698873 - DNA, 20 bp, mouse
gatgagaggcccgagatcac

SEQ ID NO: 698874 - DNA, 20 bp, mouse
gacaactcgtagctcgagcg

SEQ ID NO: 698875 - DNA, 20 bp, mouse
ggcccggactgccgcagtta

SEQ ID NO: 698876 - DNA, 20 bp, mouse
gcggggcgagtgcagagagg

SEQ ID NO: 698877 - DNA, 20 bp, mouse
gcggggccgggtaaaatgag

SEQ ID NO: 698878 - DNA, 20 bp, mouse
gcggggcaactggggcgggg

SEQ ID NO: 698879 - DNA, 20 bp, mouse
gggggcggggcgattgcaga

SEQ ID NO: 698880 - DNA, 20 bp, mouse
ggagtgttggggcggagcta

SEQ ID NO: 698881 - DNA, 20 bp, mouse
gaagaaagaacctagcaggg

SEQ ID NO: 698882 - DNA, 20 bp, mouse
gggggcggggcaactggggc

SEQ ID NO: 698883 - DNA, 20 bp, mouse
gggggcgattgcagaggggc

SEQ ID NO: 698884 - DNA, 20 bp, mouse
gggcaggacagtacaggccg

SEQ ID NO: 698885 - DNA, 20 bp, mouse
ggacgggagagtgagtgttg

SEQ ID NO: 698886 - DNA, 20 bp, mouse
gcgggacgcggcgaactcac

SEQ ID NO: 698887 - DNA, 20 bp, mouse
ggctgcgcggggggactctg

SEQ ID NO: 698888 - DNA, 20 bp, mouse
gcgcggctggccggctccta

SEQ ID NO: 698889 - DNA, 20 bp, mouse
gggcgcgtaccactgagcgg

SEQ ID NO: 698890 - DNA, 20 bp, mouse
gccggcgcggaggacgcgga

SEQ ID NO: 698891 - DNA, 20 bp, mouse
gggcgcaggcccgatcacgc

SEQ ID NO: 698892 - DNA, 20 bp, mouse
ggggcctgcgccctaggagc

SEQ ID NO: 698893 - DNA, 20 bp, mouse
gggacccgcgcgacttaggc

SEQ ID NO: 698894 - DNA, 20 bp, mouse
gcccgcgccgccggaactgg

SEQ ID NO: 698895 - DNA, 20 bp, mouse
gcgaactcaccggcgtgatc

SEQ ID NO: 698896 - DNA, 20 bp, mouse
gaagcccgaggctggagtag

SEQ ID NO: 698897 - DNA, 20 bp, mouse
ggccgcctctgagtggtgat

SEQ ID NO: 698898 - DNA, 20 bp, mouse
ggccctgaagtggaaagaga

SEQ ID NO: 698899 - DNA, 20 bp, mouse
gtgcccagactataactagc

SEQ ID NO: 698900 - DNA, 20 bp, mouse
gtagctgagaagacatctaa

SEQ ID NO: 698901 - DNA, 20 bp, mouse
ggcgagcccgcctccttggt

SEQ ID NO: 698902 - DNA, 20 bp, mouse
gcggatggatcccgaaactg

SEQ ID NO: 698903 - DNA, 20 bp, mouse
gaccactcagaggcggctac

SEQ ID NO: 698904 - DNA, 20 bp, mouse
gtaccagctagttatagtct

SEQ ID NO: 698905 - DNA, 20 bp, mouse
gagaccgcactcgattaaat

SEQ ID NO: 698906 - DNA, 20 bp, mouse
gcgcgagggcgcggctctta

SEQ ID NO: 698907 - DNA, 20 bp, mouse
gtctccgcgcgctcccggtg

SEQ ID NO: 698908 - DNA, 20 bp, mouse
gccggcgtccggaccaatcc

SEQ ID NO: 698909 - DNA, 20 bp, mouse
gctcccggtgcggtaccgac

SEQ ID NO: 698910 - DNA, 20 bp, mouse
ggccgcgcgtgccccccgcc

SEQ ID NO: 698911 - DNA, 20 bp, mouse
gccgcctggcgcgtgcccgt

SEQ ID NO: 698912 - DNA, 20 bp, mouse
gtgcccgtcggtaccgcacc

SEQ ID NO: 698913 - DNA, 20 bp, mouse
gaatcctaggggccataagg

SEQ ID NO: 698914 - DNA, 20 bp, mouse
gctcgcgcgctcccggcgtc

SEQ ID NO: 698915 - DNA, 20 bp, mouse
gctggctctagaacccggat

SEQ ID NO: 698916 - DNA, 20 bp, mouse
gggcgcgcgggtctcaccca

SEQ ID NO: 698917 - DNA, 20 bp, mouse
ggggagaagcggggacctcg

SEQ ID NO: 698918 - DNA, 20 bp, mouse
gcggggccgcgcactccctc

SEQ ID NO: 698919 - DNA, 20 bp, mouse
gcgcgggtctcacccagggg

SEQ ID NO: 698920 - DNA, 20 bp, mouse
gaggacgggcgcgagctgtg

SEQ ID NO: 698921 - DNA, 20 bp, mouse
ggaagcgtctccatccgctt

SEQ ID NO: 698922 - DNA, 20 bp, mouse
ggagaggggcgtgagcccgg

SEQ ID NO: 698923 - DNA, 20 bp, mouse
gtgcagccggagggagtgcg

SEQ ID NO: 698924 - DNA, 20 bp, mouse
gtccctccggctgcacacgg

SEQ ID NO: 698925 - DNA, 20 bp, mouse
ggggcagcgcgggcccgact

SEQ ID NO: 698926 - DNA, 20 bp, mouse
gcgacagcaagaaactgcgg

SEQ ID NO: 698927 - DNA, 20 bp, mouse
ggcgcgaatggcaaatgcaa

SEQ ID NO: 698928 - DNA, 20 bp, mouse
gcgcccggatggacccggtg

SEQ ID NO: 698929 - DNA, 20 bp, mouse
gcgcaagcggaagtacgtct

SEQ ID NO: 698930 - DNA, 20 bp, mouse
gggagcagaacgcatgttgt

SEQ ID NO: 698931 - DNA, 20 bp, mouse
gccaacatggcgaccgcacc

SEQ ID NO: 698932 - DNA, 20 bp, mouse
gccacagagaccccggtaag

SEQ ID NO: 698933 - DNA, 20 bp, mouse
ggcggtcgccatgttgggtg

SEQ ID NO: 698934 - DNA, 20 bp, mouse
gtgtggcataaagtactctc

SEQ ID NO: 698935 - DNA, 20 bp, mouse
gaaggttgctatggttatct

SEQ ID NO: 698936 - DNA, 20 bp, mouse
gagcgcgtgcaaagcacgac

SEQ ID NO: 698937 - DNA, 20 bp, mouse
gtaaaggtggtgaaggaagg

SEQ ID NO: 698938 - DNA, 20 bp, mouse
gtgggaaaagtgggacacaa

SEQ ID NO: 698939 - DNA, 20 bp, mouse
gcgctcgtcctggaaagtaa

SEQ ID NO: 698940 - DNA, 20 bp, mouse
gcaaattctagcactatcgt

SEQ ID NO: 698941 - DNA, 20 bp, mouse
gagtgcctggaaaggaggtc

SEQ ID NO: 698942 - DNA, 20 bp, mouse
gtcgtcctggaaagtaaagg

SEQ ID NO: 698943 - DNA, 20 bp, mouse
gagcactatcgtgggaaaag

SEQ ID NO: 698944 - DNA, 20 bp, mouse
gccacgctggaagccgagca

SEQ ID NO: 698945 - DNA, 20 bp, mouse
gtggaaagtaaaggtggtga

SEQ ID NO: 698946 - DNA, 20 bp, mouse
gaagccttttccaggaacct

SEQ ID NO: 698947 - DNA, 20 bp, mouse
gcctcccgcctgctggaagg

SEQ ID NO: 698948 - DNA, 20 bp, mouse
gcccccaaggacttgtgtgt

SEQ ID NO: 698949 - DNA, 20 bp, mouse
ggctcaggacacacactaaa

SEQ ID NO: 698950 - DNA, 20 bp, mouse
gggtaaatcagtgagggaat

SEQ ID NO: 698951 - DNA, 20 bp, mouse
gtaagtacccacgtgagaga

SEQ ID NO: 698952 - DNA, 20 bp, mouse
gtagagtaccaaggtttgaa

SEQ ID NO: 698953 - DNA, 20 bp, mouse
ggggtctggctagagtacca

SEQ ID NO: 698954 - DNA, 20 bp, mouse
gtatgagttgaagctccctc

SEQ ID NO: 698955 - DNA, 20 bp, mouse
ggggacactaagcatttcag

SEQ ID NO: 698956 - DNA, 20 bp, mouse
ggcgtggggcaaggagaagt

SEQ ID NO: 698957 - DNA, 20 bp, mouse
gcccgccccggcctcaaggt

SEQ ID NO: 698958 - DNA, 20 bp, mouse
gtccctcctcagagctgcgt

SEQ ID NO: 698959 - DNA, 20 bp, mouse
gcgactgccacgtgatccgt

SEQ ID NO: 698960 - DNA, 20 bp, mouse
ggagaagtgggcgggccgaa

SEQ ID NO: 698961 - DNA, 20 bp, mouse
gctcagagctgcgtggggca

SEQ ID NO: 698962 - DNA, 20 bp, mouse
ggatccgtaggcacgccctt

SEQ ID NO: 698963 - DNA, 20 bp, mouse
ggggccgaagggcgtgccta

SEQ ID NO: 698964 - DNA, 20 bp, mouse
gtgggctcggagaccgctat

SEQ ID NO: 698965 - DNA, 20 bp, mouse
ggactaggtgtggagcccca

SEQ ID NO: 698966 - DNA, 20 bp, mouse
gctcgcgggctcaccgtccg

SEQ ID NO: 698967 - DNA, 20 bp, mouse
gccgggcctcggaacgtcgg

SEQ ID NO: 698968 - DNA, 20 bp, mouse
gcccgcgagcgcctggaacg

SEQ ID NO: 698969 - DNA, 20 bp, mouse
gagccctcgcagtgctggag

SEQ ID NO: 698970 - DNA, 20 bp, mouse
gtcaccgtccggggctgcgc

SEQ ID NO: 698971 - DNA, 20 bp, mouse
gggaggggaggagcgctcgg

SEQ ID NO: 698972 - DNA, 20 bp, mouse
gcggctgctcaccctccaat

SEQ ID NO: 698973 - DNA, 20 bp, mouse
ggggctggcgtcaatcgggt

SEQ ID NO: 698974 - DNA, 20 bp, mouse
gcccgcgcgcgcaccgaagc

SEQ ID NO: 698975 - DNA, 20 bp, mouse
gaggctacacctcgggatca

SEQ ID NO: 698976 - DNA, 20 bp, mouse
gggcggagcgagactcccgg

SEQ ID NO: 698977 - DNA, 20 bp, mouse
gggcggggcagaattgacgg

SEQ ID NO: 698978 - DNA, 20 bp, mouse
gtaagaggcagccacttccg

SEQ ID NO: 698979 - DNA, 20 bp, mouse
gccagcctcgcccccggaag

SEQ ID NO: 698980 - DNA, 20 bp, mouse
gcgaggctacctagagtcag

SEQ ID NO: 698981 - DNA, 20 bp, mouse
ggggggcggggcagaattga

SEQ ID NO: 698982 - DNA, 20 bp, mouse
gtaaacttagcgtttggggg

SEQ ID NO: 698983 - DNA, 20 bp, mouse
gtgcgtcagggtctacctct

SEQ ID NO: 698984 - DNA, 20 bp, mouse
gtcctggaggggtgtggcgc

SEQ ID NO: 698985 - DNA, 20 bp, mouse
ggaggtggagcttttatcag

SEQ ID NO: 698986 - DNA, 20 bp, mouse
gagcgacaacagcccttcct

SEQ ID NO: 698987 - DNA, 20 bp, mouse
gtggtgctgaagctcggggt

SEQ ID NO: 698988 - DNA, 20 bp, mouse
gtggttcggcttatgttcag

SEQ ID NO: 698989 - DNA, 20 bp, mouse
gacttactcgaagccatctg

SEQ ID NO: 698990 - DNA, 20 bp, mouse
gcaggactggtggacatata

SEQ ID NO: 698991 - DNA, 20 bp, mouse
gttcctccccagatcaggac

SEQ ID NO: 698992 - DNA, 20 bp, mouse
gtcagagggcctgaaagtcc

SEQ ID NO: 698993 - DNA, 20 bp, mouse
ggcacgtgaatgcccagaaa

SEQ ID NO: 698994 - DNA, 20 bp, mouse
ggtatcagagtgtgtcggtg

SEQ ID NO: 698995 - DNA, 20 bp, mouse
gggaaaagaaatccctttta

SEQ ID NO: 698996 - DNA, 20 bp, mouse
gcgcgcccggccagcccctt

SEQ ID NO: 698997 - DNA, 20 bp, mouse
ggggaaaggccagccacgtc

SEQ ID NO: 698998 - DNA, 20 bp, mouse
ggggcgggacgcacccctac

SEQ ID NO: 698999 - DNA, 20 bp, mouse
gcggcccggggtgctgtgtg

SEQ ID NO: 699000 - DNA, 20 bp, mouse
gcagcctcccgggctgtccc

SEQ ID NO: 699001 - DNA, 20 bp, mouse
gtccctggccaagtttgttt

SEQ ID NO: 699002 - DNA, 20 bp, mouse
gcgcctagggcgtctcgggc

SEQ ID NO: 699003 - DNA, 20 bp, mouse
ggaccgcgcgggacagagaa

SEQ ID NO: 699004 - DNA, 20 bp, mouse
gccggctgccccggtgtgtg

SEQ ID NO: 699005 - DNA, 20 bp, mouse
gcgaagcttcggcccagtta

SEQ ID NO: 699006 - DNA, 20 bp, mouse
gcgacccggaaggaagaccg

SEQ ID NO: 699007 - DNA, 20 bp, mouse
gcggggcggggcctggcgaa

SEQ ID NO: 699008 - DNA, 20 bp, mouse
ggccagtggtgctttagaaa

SEQ ID NO: 699009 - DNA, 20 bp, mouse
gacttctggagggctatctt

SEQ ID NO: 699010 - DNA, 20 bp, mouse
gggctgctgccggattgccc

SEQ ID NO: 699011 - DNA, 20 bp, mouse
gcaaaaaagcacttcagcac

SEQ ID NO: 699012 - DNA, 20 bp, mouse
gctaatcagctcaaacaacc

SEQ ID NO: 699013 - DNA, 20 bp, mouse
gtttgctcggggactggcag

SEQ ID NO: 699014 - DNA, 20 bp, mouse
gggcctgtttgctcggggac

SEQ ID NO: 699015 - DNA, 20 bp, mouse
gccgccccgcctcccggcct

SEQ ID NO: 699016 - DNA, 20 bp, mouse
ggggccgcggcaccgcatgg

SEQ ID NO: 699017 - DNA, 20 bp, mouse
gcgcccagagctctctcctc

SEQ ID NO: 699018 - DNA, 20 bp, mouse
gcagggacgaccatgcccac

SEQ ID NO: 699019 - DNA, 20 bp, mouse
gccaccggaggagagagctc

SEQ ID NO: 699020 - DNA, 20 bp, mouse
gccagggcgagggtcttcaa

SEQ ID NO: 699021 - DNA, 20 bp, mouse
ggtgaccggcgcgcgcgctg

SEQ ID NO: 699022 - DNA, 20 bp, mouse
gaggcagcaaaggcggctga

SEQ ID NO: 699023 - DNA, 20 bp, mouse
gccgcggggccgtgacgcgg

SEQ ID NO: 699024 - DNA, 20 bp, mouse
gggacgaccatgcccaccgg

SEQ ID NO: 699025 - DNA, 20 bp, mouse
gcgcgcgggccgccgccatg

SEQ ID NO: 699026 - DNA, 20 bp, mouse
gcgtggatcggcaagaggtg

SEQ ID NO: 699027 - DNA, 20 bp, mouse
ggctaagtggcgtgctcccg

SEQ ID NO: 699028 - DNA, 20 bp, mouse
ggatcggcaagaggtgtggc

SEQ ID NO: 699029 - DNA, 20 bp, mouse
gtgcggtgcatcaggggcgt

SEQ ID NO: 699030 - DNA, 20 bp, mouse
gttaaagcatggttccgggg

SEQ ID NO: 699031 - DNA, 20 bp, mouse
gtactacaaccctttggctg

SEQ ID NO: 699032 - DNA, 20 bp, mouse
ggcacgccacttagcccgga

SEQ ID NO: 699033 - DNA, 20 bp, mouse
gtgaactaaaagcggaaggt

SEQ ID NO: 699034 - DNA, 20 bp, mouse
gcggctaatgcgctagactg

SEQ ID NO: 699035 - DNA, 20 bp, mouse
ggatgcaccgcactcagccg

SEQ ID NO: 699036 - DNA, 20 bp, mouse
gacgccggagggttcgcgag

SEQ ID NO: 699037 - DNA, 20 bp, mouse
ggatgcgcggccttttaaag

SEQ ID NO: 699038 - DNA, 20 bp, mouse
gctaacgcgaggaatggagg

SEQ ID NO: 699039 - DNA, 20 bp, mouse
gcacggtccttcacgccgga

SEQ ID NO: 699040 - DNA, 20 bp, mouse
ggcagcacggtccttcacgc

SEQ ID NO: 699041 - DNA, 20 bp, mouse
ggtgccactcgcgaaccctc

SEQ ID NO: 699042 - DNA, 20 bp, mouse
gtccgggccggccttcctcc

SEQ ID NO: 699043 - DNA, 20 bp, mouse
ggcccagcgtcaatcacagc

SEQ ID NO: 699044 - DNA, 20 bp, mouse
ggggctaacgcgaggaatgg

SEQ ID NO: 699045 - DNA, 20 bp, mouse
gaggccggcccggagatgcg

SEQ ID NO: 699046 - DNA, 20 bp, mouse
ggagccaggcgagtgtgcgg

SEQ ID NO: 699047 - DNA, 20 bp, mouse
gggacccggcgactctgcta

SEQ ID NO: 699048 - DNA, 20 bp, mouse
ggagagatctggcttcccga

SEQ ID NO: 699049 - DNA, 20 bp, mouse
gtttgctggggctgcaccga

SEQ ID NO: 699050 - DNA, 20 bp, mouse
ggcagagccaggcgagtgtg

SEQ ID NO: 699051 - DNA, 20 bp, mouse
gcccagcaaagcgagagatc

SEQ ID NO: 699052 - DNA, 20 bp, mouse
gccctgcggaggaggggata

SEQ ID NO: 699053 - DNA, 20 bp, mouse
gcccgagggcgagcaccgcg

SEQ ID NO: 699054 - DNA, 20 bp, mouse
gtggccgccgcacactcgcc

SEQ ID NO: 699055 - DNA, 20 bp, mouse
ggagggtgggtgggctccct

SEQ ID NO: 699056 - DNA, 20 bp, mouse
gggcgagcgtggcctccgaa

SEQ ID NO: 699057 - DNA, 20 bp, mouse
gagcggggctcggcgatgga

SEQ ID NO: 699058 - DNA, 20 bp, mouse
gcggccgtgagactggaagg

SEQ ID NO: 699059 - DNA, 20 bp, mouse
gggggtgggaacagcatcgt

SEQ ID NO: 699060 - DNA, 20 bp, mouse
gaactgccggaggctcctag

SEQ ID NO: 699061 - DNA, 20 bp, mouse
ggatgctgttcccacccctt

SEQ ID NO: 699062 - DNA, 20 bp, mouse
gcgtgggcgggaactgccgg

SEQ ID NO: 699063 - DNA, 20 bp, mouse
ggctcctaggggcctggaag

SEQ ID NO: 699064 - DNA, 20 bp, mouse
gctgacttctagctgggctc

SEQ ID NO: 699065 - DNA, 20 bp, mouse
ggctgttcccaccccttcgg

SEQ ID NO: 699066 - DNA, 20 bp, mouse
gaggagggaaggttccttta

SEQ ID NO: 699067 - DNA, 20 bp, mouse
gcggcggggagggaccgaca

SEQ ID NO: 699068 - DNA, 20 bp, mouse
ggaggctccggcggtgtcaa

SEQ ID NO: 699069 - DNA, 20 bp, mouse
gggcttgagcggagaggctc

SEQ ID NO: 699070 - DNA, 20 bp, mouse
gaaggggaaatgagtgtaaa

SEQ ID NO: 699071 - DNA, 20 bp, mouse
gagggaaggttcctttaagg

SEQ ID NO: 699072 - DNA, 20 bp, mouse
gtggcagggcgggtgataat

SEQ ID NO: 699073 - DNA, 20 bp, mouse
gcccgccgcggggctggccg

SEQ ID NO: 699074 - DNA, 20 bp, mouse
gggaagcgcccgtacggtgt

SEQ ID NO: 699075 - DNA, 20 bp, mouse
gtcaatggctcctcctgcca

SEQ ID NO: 699076 - DNA, 20 bp, mouse
gatctgggaactaagggcgg

SEQ ID NO: 699077 - DNA, 20 bp, mouse
gataacaatggaattcctag

SEQ ID NO: 699078 - DNA, 20 bp, mouse
gaaaccggactaggctaaaa

SEQ ID NO: 699079 - DNA, 20 bp, mouse
ggctcaatgacaagaatccc

SEQ ID NO: 699080 - DNA, 20 bp, mouse
gccccccttccaaaacaaac

SEQ ID NO: 699081 - DNA, 20 bp, mouse
gatggcacgtgcagtaaaca

SEQ ID NO: 699082 - DNA, 20 bp, mouse
gtctccatgggtctaggagg

SEQ ID NO: 699083 - DNA, 20 bp, mouse
gagtccggtttgttttggaa

SEQ ID NO: 699084 - DNA, 20 bp, mouse
gctgcctcctcctagaccca

SEQ ID NO: 699085 - DNA, 20 bp, mouse
ggtatgaccaatcctgcata

SEQ ID NO: 699086 - DNA, 20 bp, mouse
gtggccagggtatccaagga

SEQ ID NO: 699087 - DNA, 20 bp, mouse
gctgctggaagcagtaaggt

SEQ ID NO: 699088 - DNA, 20 bp, mouse
ggaaggctggctccaaaatt

SEQ ID NO: 699089 - DNA, 20 bp, mouse
gctggcatccggggtctctt

SEQ ID NO: 699090 - DNA, 20 bp, mouse
gagaggggaggggaggtcgt

SEQ ID NO: 699091 - DNA, 20 bp, mouse
gaaggagaaagtgtggcagt

SEQ ID NO: 699092 - DNA, 20 bp, mouse
ggtgtggcagtcgggtgagt

SEQ ID NO: 699093 - DNA, 20 bp, mouse
gcagggtatccaaggaaggc

SEQ ID NO: 699094 - DNA, 20 bp, mouse
gaaacgcagcaagtcttgaa

SEQ ID NO: 699095 - DNA, 20 bp, mouse
gtggcctgctggaagcagta

SEQ ID NO: 699096 - DNA, 20 bp, mouse
ggggcgggtctcagggaagg

SEQ ID NO: 699097 - DNA, 20 bp, mouse
ggcggagcccgcgtgttgaa

SEQ ID NO: 699098 - DNA, 20 bp, mouse
gtgcccggggtgtccaccag

SEQ ID NO: 699099 - DNA, 20 bp, mouse
ggtcgtcagggtaaattctt

SEQ ID NO: 699100 - DNA, 20 bp, mouse
gctgcctggggcggaagagt

SEQ ID NO: 699101 - DNA, 20 bp, mouse
gttaccctgacgacggtgtt

SEQ ID NO: 699102 - DNA, 20 bp, mouse
gtggggcggaagagtggggc

SEQ ID NO: 699103 - DNA, 20 bp, mouse
gtaggaaaagctgcctgggg

SEQ ID NO: 699104 - DNA, 20 bp, mouse
gaatcccctggtggacaccc

SEQ ID NO: 699105 - DNA, 20 bp, mouse
gtttcctaacaccgtcgtca

SEQ ID NO: 699106 - DNA, 20 bp, mouse
ggaagcactccgaactggaa

SEQ ID NO: 699107 - DNA, 20 bp, mouse
gccaagacgcaccctcccac

SEQ ID NO: 699108 - DNA, 20 bp, mouse
gggtggcgaaagcacagacg

SEQ ID NO: 699109 - DNA, 20 bp, mouse
gccccctcccgcttcgcgta

SEQ ID NO: 699110 - DNA, 20 bp, mouse
gcacgcggacggacagactc

SEQ ID NO: 699111 - DNA, 20 bp, mouse
gggggacccagggagctcta

SEQ ID NO: 699112 - DNA, 20 bp, mouse
gccgcgtgacccttccagtt

SEQ ID NO: 699113 - DNA, 20 bp, mouse
gagggggctggggtcggctg

SEQ ID NO: 699114 - DNA, 20 bp, mouse
gaatccgtacgcgaagcggg

SEQ ID NO: 699115 - DNA, 20 bp, mouse
gcgaaagcacagacggggcg

SEQ ID NO: 699116 - DNA, 20 bp, mouse
gcggactactggggagtaga

SEQ ID NO: 699117 - DNA, 20 bp, mouse
ggtgcctggaggatgactgc

SEQ ID NO: 699118 - DNA, 20 bp, mouse
gccaaggtgcggcttccggg

SEQ ID NO: 699119 - DNA, 20 bp, mouse
ggcgccgagcccagtggagt

SEQ ID NO: 699120 - DNA, 20 bp, mouse
ggcctctggcccccggctaa

SEQ ID NO: 699121 - DNA, 20 bp, mouse
ggcaggaggacatatggagt

SEQ ID NO: 699122 - DNA, 20 bp, mouse
gcgccccgtaacccaaggtg

SEQ ID NO: 699123 - DNA, 20 bp, mouse
gaacccaaggtgcggcttcc

SEQ ID NO: 699124 - DNA, 20 bp, mouse
gactcccagcccttagccgg

SEQ ID NO: 699125 - DNA, 20 bp, mouse
gcggcttccgggaggagcct

SEQ ID NO: 699126 - DNA, 20 bp, mouse
ggggtcccgcccactccgct

SEQ ID NO: 699127 - DNA, 20 bp, mouse
gccactccgcttggaggact

SEQ ID NO: 699128 - DNA, 20 bp, mouse
gatagctgggtgctcgtctt

SEQ ID NO: 699129 - DNA, 20 bp, mouse
ggggagaatcaggacgcgaa

SEQ ID NO: 699130 - DNA, 20 bp, mouse
gaacgccccgcccacgccag

SEQ ID NO: 699131 - DNA, 20 bp, mouse
ggggcgggaccccctggcgt

SEQ ID NO: 699132 - DNA, 20 bp, mouse
gaagccgtaccacgccctca

SEQ ID NO: 699133 - DNA, 20 bp, mouse
gtccccctgagggcgtggta

SEQ ID NO: 699134 - DNA, 20 bp, mouse
gtcccagccactccccctga

SEQ ID NO: 699135 - DNA, 20 bp, mouse
gctgctgctgcagagataaa

SEQ ID NO: 699136 - DNA, 20 bp, mouse
gtccgcccggaagggaccgg

SEQ ID NO: 699137 - DNA, 20 bp, mouse
gggaagcggcccaccggaag

SEQ ID NO: 699138 - DNA, 20 bp, mouse
ggcctccggtcccttccggg

SEQ ID NO: 699139 - DNA, 20 bp, mouse
gcggcctgcacagttccgcc

SEQ ID NO: 699140 - DNA, 20 bp, mouse
gtgcacagttccgcccggaa

SEQ ID NO: 699141 - DNA, 20 bp, mouse
gggccggtgcaccgccgcag

SEQ ID NO: 699142 - DNA, 20 bp, mouse
gagcaggcgcgcgccacttc

SEQ ID NO: 699143 - DNA, 20 bp, mouse
gagttccgcccggaagggac

SEQ ID NO: 699144 - DNA, 20 bp, mouse
gagggagctcgggttgtagg

SEQ ID NO: 699145 - DNA, 20 bp, mouse
ggcagcggcgtgtccagtac

SEQ ID NO: 699146 - DNA, 20 bp, mouse
gcctcctgggcgggtctcat

SEQ ID NO: 699147 - DNA, 20 bp, mouse
ggagacccgcccaggaggcg

SEQ ID NO: 699148 - DNA, 20 bp, mouse
ggagccaatgagacccgccc

SEQ ID NO: 699149 - DNA, 20 bp, mouse
gagcaccccgccaacggccg

SEQ ID NO: 699150 - DNA, 20 bp, mouse
gctagattacactgagggaa

SEQ ID NO: 699151 - DNA, 20 bp, mouse
gaacggccgcggttcctggt

SEQ ID NO: 699152 - DNA, 20 bp, mouse
ggtagtccccgcctcctggg

SEQ ID NO: 699153 - DNA, 20 bp, mouse
ggaaccgtccctcagagaag

SEQ ID NO: 699154 - DNA, 20 bp, mouse
gcatccaatcacaactctcg

SEQ ID NO: 699155 - DNA, 20 bp, mouse
gtggtcttggttgaaaaagc

SEQ ID NO: 699156 - DNA, 20 bp, mouse
gaacccagaagctacctctg

SEQ ID NO: 699157 - DNA, 20 bp, mouse
gtacctctggggtcaggcta

SEQ ID NO: 699158 - DNA, 20 bp, mouse
gctgggttctcgctcagtta

SEQ ID NO: 699159 - DNA, 20 bp, mouse
gtggctgccagagggctcat

SEQ ID NO: 699160 - DNA, 20 bp, mouse
gctcagttatggctgccaga

SEQ ID NO: 699161 - DNA, 20 bp, mouse
gagaactcctaagtagtacc

SEQ ID NO: 699162 - DNA, 20 bp, mouse
ggaccccagaggtagcttct

SEQ ID NO: 699163 - DNA, 20 bp, mouse
gtggaagcccggtactactt

SEQ ID NO: 699164 - DNA, 20 bp, mouse
gctccttagcctgaccccag

SEQ ID NO: 699165 - DNA, 20 bp, mouse
gggtggggcctagatgatag

SEQ ID NO: 699166 - DNA, 20 bp, mouse
gaccctggggcgcctaggat

SEQ ID NO: 699167 - DNA, 20 bp, mouse
gctggggcgcctaggatggg

SEQ ID NO: 699168 - DNA, 20 bp, mouse
gcaagggaggtctgtaggtc

SEQ ID NO: 699169 - DNA, 20 bp, mouse
gcggcgcaagggaggtctgt

SEQ ID NO: 699170 - DNA, 20 bp, mouse
gaaccgaccctggggcgcct

SEQ ID NO: 699171 - DNA, 20 bp, mouse
ggccccgaggcctccgagtt

SEQ ID NO: 699172 - DNA, 20 bp, mouse
gttgtctggcggaacccgtg

SEQ ID NO: 699173 - DNA, 20 bp, mouse
gaccaccagaaccgaccctg

SEQ ID NO: 699174 - DNA, 20 bp, mouse
ggggttccgccagacaactt

SEQ ID NO: 699175 - DNA, 20 bp, mouse
gtgggcaatgccaacaaggc

SEQ ID NO: 699176 - DNA, 20 bp, mouse
gcctaagccggaaggaggtg

SEQ ID NO: 699177 - DNA, 20 bp, mouse
gtgtaggctgtgagaccaga

SEQ ID NO: 699178 - DNA, 20 bp, mouse
ggggcctagaggaagcctag

SEQ ID NO: 699179 - DNA, 20 bp, mouse
gggaaaccagtgagaggata

SEQ ID NO: 699180 - DNA, 20 bp, mouse
ggagtcacaaggtatgaaat

SEQ ID NO: 699181 - DNA, 20 bp, mouse
gaggatagggcggagtcaca

SEQ ID NO: 699182 - DNA, 20 bp, mouse
gcccgctgcgctgtggtcac

SEQ ID NO: 699183 - DNA, 20 bp, mouse
ggcttcggggatgttagtct

SEQ ID NO: 699184 - DNA, 20 bp, mouse
gtcacaaggtatgaaatggg

SEQ ID NO: 699185 - DNA, 20 bp, mouse
gaacccctgtggccaaggtg

SEQ ID NO: 699186 - DNA, 20 bp, mouse
ggtgcgtccatcggaaagga

SEQ ID NO: 699187 - DNA, 20 bp, mouse
gatagtgcacacttcaagag

SEQ ID NO: 699188 - DNA, 20 bp, mouse
gccgcaaaccctaagaaagg

SEQ ID NO: 699189 - DNA, 20 bp, mouse
ggagctcgtgggatgacagc

SEQ ID NO: 699190 - DNA, 20 bp, mouse
gggggagcttaaggagaggg

SEQ ID NO: 699191 - DNA, 20 bp, mouse
ggagctttcggtgcgtccat

SEQ ID NO: 699192 - DNA, 20 bp, mouse
gtgtcccgatccccttacat

SEQ ID NO: 699193 - DNA, 20 bp, mouse
gttcggtgcgtccatcggaa

SEQ ID NO: 699194 - DNA, 20 bp, mouse
gctgataaaaggaacgacaa

SEQ ID NO: 699195 - DNA, 20 bp, mouse
gatgacgaccgcctttctta

SEQ ID NO: 699196 - DNA, 20 bp, mouse
gcccccgcagggctgaccgc

SEQ ID NO: 699197 - DNA, 20 bp, mouse
gggacagcagcgcccccgca

SEQ ID NO: 699198 - DNA, 20 bp, mouse
gcaccccgcggtcagccctg

SEQ ID NO: 699199 - DNA, 20 bp, mouse
gactcagaaacagactggca

SEQ ID NO: 699200 - DNA, 20 bp, mouse
ggggacccaaaggccaggta

SEQ ID NO: 699201 - DNA, 20 bp, mouse
ggagtggcaatgggagtccg

SEQ ID NO: 699202 - DNA, 20 bp, mouse
gtagcaaggaaggaatgatg

SEQ ID NO: 699203 - DNA, 20 bp, mouse
gggcaacagagaccatggat

SEQ ID NO: 699204 - DNA, 20 bp, mouse
gggtttgggacccaaaggcc

SEQ ID NO: 699205 - DNA, 20 bp, mouse
ggcaattccgagtgcaggtg

SEQ ID NO: 699206 - DNA, 20 bp, mouse
gacccggcagggagcaccaa

SEQ ID NO: 699207 - DNA, 20 bp, mouse
gcgagcgcagagaacccacg

SEQ ID NO: 699208 - DNA, 20 bp, mouse
gaagggagaggctgccccgt

SEQ ID NO: 699209 - DNA, 20 bp, mouse
gaaggcgcgaaaggcggacc

SEQ ID NO: 699210 - DNA, 20 bp, mouse
ggcagggagcaccaagggag

SEQ ID NO: 699211 - DNA, 20 bp, mouse
gacgctgtcctgtgccggtc

SEQ ID NO: 699212 - DNA, 20 bp, mouse
gcgctcggcctgaccggcac

SEQ ID NO: 699213 - DNA, 20 bp, mouse
gggtcagcccccgttgtcgg

SEQ ID NO: 699214 - DNA, 20 bp, mouse
gtctctgcgctcggcctgac

SEQ ID NO: 699215 - DNA, 20 bp, mouse
ggcgaaaggcggacccggca

SEQ ID NO: 699216 - DNA, 20 bp, mouse
gggaagggtgggagcgtcta

SEQ ID NO: 699217 - DNA, 20 bp, mouse
gagggtgtggctccatacaa

SEQ ID NO: 699218 - DNA, 20 bp, mouse
ggcggggcgagtcttcatgg

SEQ ID NO: 699219 - DNA, 20 bp, mouse
gaggccccgccctacgtgtt

SEQ ID NO: 699220 - DNA, 20 bp, mouse
gcggggcgaagcgtctgggt

SEQ ID NO: 699221 - DNA, 20 bp, mouse
ggcggggcctactgctcaag

SEQ ID NO: 699222 - DNA, 20 bp, mouse
ggggcctactgctcaagggg

SEQ ID NO: 699223 - DNA, 20 bp, mouse
ggagcctgcaagcgggacta

SEQ ID NO: 699224 - DNA, 20 bp, mouse
gggtgggagcgtctaggggc

SEQ ID NO: 699225 - DNA, 20 bp, mouse
gggggcggagcctggaaata

SEQ ID NO: 699226 - DNA, 20 bp, mouse
gccagggcaccgagggtcag

SEQ ID NO: 699227 - DNA, 20 bp, mouse
ggccacgtggctttgtttat

SEQ ID NO: 699228 - DNA, 20 bp, mouse
gaggggacccagtgcggtag

SEQ ID NO: 699229 - DNA, 20 bp, mouse
ggggaactgtcagtcccaga

SEQ ID NO: 699230 - DNA, 20 bp, mouse
gagaacgtctggggacgggt

SEQ ID NO: 699231 - DNA, 20 bp, mouse
gcgagggtcagcgggacatc

SEQ ID NO: 699232 - DNA, 20 bp, mouse
gacgcctgatgggggagtag

SEQ ID NO: 699233 - DNA, 20 bp, mouse
gggggaggccagaacgtctg

SEQ ID NO: 699234 - DNA, 20 bp, mouse
gcttgtccgggacccgtaga

SEQ ID NO: 699235 - DNA, 20 bp, mouse
gccagagggtctggaagctg

SEQ ID NO: 699236 - DNA, 20 bp, mouse
ggaaccaagtgcactcggac

SEQ ID NO: 699237 - DNA, 20 bp, mouse
gcccgggtcgctgacgtcaa

SEQ ID NO: 699238 - DNA, 20 bp, mouse
gcggaggctcggtagtggta

SEQ ID NO: 699239 - DNA, 20 bp, mouse
ggtcacgtgccgcgcgatcc

SEQ ID NO: 699240 - DNA, 20 bp, mouse
ggggaaaagctggcgcgggg

SEQ ID NO: 699241 - DNA, 20 bp, mouse
gtccctggtccgttcgagag

SEQ ID NO: 699242 - DNA, 20 bp, mouse
ggaacggaccagggatgcgg

SEQ ID NO: 699243 - DNA, 20 bp, mouse
gcgcccgagggctcgcacgc

SEQ ID NO: 699244 - DNA, 20 bp, mouse
gtgggcgtccctcgccgggt

SEQ ID NO: 699245 - DNA, 20 bp, mouse
gggacgcggaggctcggtag

SEQ ID NO: 699246 - DNA, 20 bp, mouse
gcacgcgccggcccaatcga

SEQ ID NO: 699247 - DNA, 20 bp, mouse
gggcggccgcgagcgctgtg

SEQ ID NO: 699248 - DNA, 20 bp, mouse
gtcactctaactgtgctcta

SEQ ID NO: 699249 - DNA, 20 bp, mouse
ggcgctcgcggccgcccgca

SEQ ID NO: 699250 - DNA, 20 bp, mouse
gtaactgtgctctagggtta

SEQ ID NO: 699251 - DNA, 20 bp, mouse
gccaatcgacggttgcccgg

SEQ ID NO: 699252 - DNA, 20 bp, mouse
gctggtgtggcgggagattg

SEQ ID NO: 699253 - DNA, 20 bp, mouse
gctggcgcacgcaggctttg

SEQ ID NO: 699254 - DNA, 20 bp, mouse
gccggcgcgtgatgtcacgc

SEQ ID NO: 699255 - DNA, 20 bp, mouse
gcgccccgaaacccatttgt

SEQ ID NO: 699256 - DNA, 20 bp, mouse
gccctccaagggaccaggaa

SEQ ID NO: 699257 - DNA, 20 bp, mouse
gccagcggagggataccaag

SEQ ID NO: 699258 - DNA, 20 bp, mouse
gtgctagcgcggaggggcgg

SEQ ID NO: 699259 - DNA, 20 bp, mouse
ggggtcacccaggacctgac

SEQ ID NO: 699260 - DNA, 20 bp, mouse
gaaggggcggggcttgcccg

SEQ ID NO: 699261 - DNA, 20 bp, mouse
gtccttgtaagccctggtaa

SEQ ID NO: 699262 - DNA, 20 bp, mouse
ggggatcggaaggagactgg

SEQ ID NO: 699263 - DNA, 20 bp, mouse
gccgatccctccaagggacc

SEQ ID NO: 699264 - DNA, 20 bp, mouse
gggagggatcggaaggagac

SEQ ID NO: 699265 - DNA, 20 bp, mouse
ggctgcggccccctgacccc

SEQ ID NO: 699266 - DNA, 20 bp, mouse
gtagcagccggcccttcttc

SEQ ID NO: 699267 - DNA, 20 bp, mouse
ggcctcaccgcgtccatgtt

SEQ ID NO: 699268 - DNA, 20 bp, mouse
gacgtcaccggaagaagggc

SEQ ID NO: 699269 - DNA, 20 bp, mouse
gaccgcgtccatgttaggtg

SEQ ID NO: 699270 - DNA, 20 bp, mouse
ggacgcggtgaggcccgccc

SEQ ID NO: 699271 - DNA, 20 bp, mouse
gcggaagcgctgcggaggtg

SEQ ID NO: 699272 - DNA, 20 bp, mouse
gtccgaagaagtgtcatcga

SEQ ID NO: 699273 - DNA, 20 bp, mouse
ggaagcggccatgataagcg

SEQ ID NO: 699274 - DNA, 20 bp, mouse
gtagggaacgcctacgtcac

SEQ ID NO: 699275 - DNA, 20 bp, mouse
gacgctagaggcggcggaag

SEQ ID NO: 699276 - DNA, 20 bp, mouse
gtggctgcgcgtcacaaagg

SEQ ID NO: 699277 - DNA, 20 bp, mouse
gctgctatgagcagaggatt

SEQ ID NO: 699278 - DNA, 20 bp, mouse
gacactgaaggcgaaggaag

SEQ ID NO: 699279 - DNA, 20 bp, mouse
ggtgacgcgcagccacccac

SEQ ID NO: 699280 - DNA, 20 bp, mouse
gcccggaggtcaagactgga

SEQ ID NO: 699281 - DNA, 20 bp, mouse
ggcccgcgggctttcctatt

SEQ ID NO: 699282 - DNA, 20 bp, mouse
gacccaataggaaagcccgc

SEQ ID NO: 699283 - DNA, 20 bp, mouse
gtctctgctgctatgagcag

SEQ ID NO: 699284 - DNA, 20 bp, mouse
gccagatacactgaaggcga

SEQ ID NO: 699285 - DNA, 20 bp, mouse
ggggtggctgcgcgtcacaa

SEQ ID NO: 699286 - DNA, 20 bp, mouse
gcacaaggacctgggagcta

SEQ ID NO: 699287 - DNA, 20 bp, mouse
gacccggaggatgtgtagtg

SEQ ID NO: 699288 - DNA, 20 bp, mouse
ggtgacgcacagaggcaggg

SEQ ID NO: 699289 - DNA, 20 bp, mouse
gtgagcccgtggaggctatc

SEQ ID NO: 699290 - DNA, 20 bp, mouse
ggaggcagggagggacccgg

SEQ ID NO: 699291 - DNA, 20 bp, mouse
gtcaacaagccctagctccc

SEQ ID NO: 699292 - DNA, 20 bp, mouse
gcgccccgctggtacgaccc

SEQ ID NO: 699293 - DNA, 20 bp, mouse
gtccttgtggtgacgcacag

SEQ ID NO: 699294 - DNA, 20 bp, mouse
gctaacggggtgagtcattc

SEQ ID NO: 699295 - DNA, 20 bp, mouse
ggtggtgacgcacagaggca

SEQ ID NO: 699296 - DNA, 20 bp, mouse
gaggggcttgggtggaacac

SEQ ID NO: 699297 - DNA, 20 bp, mouse
gctctgtgaaacaaagtccg

SEQ ID NO: 699298 - DNA, 20 bp, mouse
gggggcagaggagagcccat

SEQ ID NO: 699299 - DNA, 20 bp, mouse
gtgcaagaagggtcagagca

SEQ ID NO: 699300 - DNA, 20 bp, mouse
ggaagtagcaagttgtgcaa

SEQ ID NO: 699301 - DNA, 20 bp, mouse
gcaatgtctaagtgctggag

SEQ ID NO: 699302 - DNA, 20 bp, mouse
gcacggcacacacaggactc

SEQ ID NO: 699303 - DNA, 20 bp, mouse
gggccctggcctttcccagg

SEQ ID NO: 699304 - DNA, 20 bp, mouse
gtccagctgtgtccaggagc

SEQ ID NO: 699305 - DNA, 20 bp, mouse
gagccagtgaggggcttggg

SEQ ID NO: 699306 - DNA, 20 bp, mouse
ggtggtgcctggtgagggga

SEQ ID NO: 699307 - DNA, 20 bp, mouse
gaggtgcaggccaagtccga

SEQ ID NO: 699308 - DNA, 20 bp, mouse
gttaacccacccctcggact

SEQ ID NO: 699309 - DNA, 20 bp, mouse
ggtggaggatgggcactacg

SEQ ID NO: 699310 - DNA, 20 bp, mouse
gggagccggcccctcctccg

SEQ ID NO: 699311 - DNA, 20 bp, mouse
gaggatgggcactacgggga

SEQ ID NO: 699312 - DNA, 20 bp, mouse
ggggcagcagaagacacagc

SEQ ID NO: 699313 - DNA, 20 bp, mouse
ggggaggcggccgggaggtg

SEQ ID NO: 699314 - DNA, 20 bp, mouse
gagcttctgcggaaaacgtg

SEQ ID NO: 699315 - DNA, 20 bp, mouse
gctaatcagaagcagatctt

SEQ ID NO: 699316 - DNA, 20 bp, mouse
ggggcggcgccatattgaga

SEQ ID NO: 699317 - DNA, 20 bp, mouse
gccctcggcccttctcaata

SEQ ID NO: 699318 - DNA, 20 bp, mouse
gtgtgcccccaggtacccac

SEQ ID NO: 699319 - DNA, 20 bp, mouse
gtgaccggccttccgcgcgg

SEQ ID NO: 699320 - DNA, 20 bp, mouse
gcggccgccgcgcggaaggc

SEQ ID NO: 699321 - DNA, 20 bp, mouse
gtcaacccgtgggtacctgg

SEQ ID NO: 699322 - DNA, 20 bp, mouse
gcgagggcgcggagctttct

SEQ ID NO: 699323 - DNA, 20 bp, mouse
ggagaggaagctcccggcgt

SEQ ID NO: 699324 - DNA, 20 bp, mouse
gactcttatcaggatcggcg

SEQ ID NO: 699325 - DNA, 20 bp, mouse
gtgcagggatgggttctaga

SEQ ID NO: 699326 - DNA, 20 bp, mouse
gcggagctgcgaagggatga

SEQ ID NO: 699327 - DNA, 20 bp, mouse
ggggcgagcgctcagacgga

SEQ ID NO: 699328 - DNA, 20 bp, mouse
gctcagacggaaggtgggga

SEQ ID NO: 699329 - DNA, 20 bp, mouse
gcgagcgctcagacggaagg

SEQ ID NO: 699330 - DNA, 20 bp, mouse
ggagcagggcggagctgcga

SEQ ID NO: 699331 - DNA, 20 bp, mouse
ggggcggggaaaggtggcag

SEQ ID NO: 699332 - DNA, 20 bp, mouse
gtgccctgggcggggaaagg

SEQ ID NO: 699333 - DNA, 20 bp, mouse
gagctgcgaagggatgaggg

SEQ ID NO: 699334 - DNA, 20 bp, mouse
gccgcgccgcccacctgagc

SEQ ID NO: 699335 - DNA, 20 bp, mouse
gggcggggcgagcgctcaga

SEQ ID NO: 699336 - DNA, 20 bp, mouse
gtggtctgacaaacagtggg

SEQ ID NO: 699337 - DNA, 20 bp, mouse
gggagaggggccagtgttgt

SEQ ID NO: 699338 - DNA, 20 bp, mouse
ggggtctgatgagtagtagg

SEQ ID NO: 699339 - DNA, 20 bp, mouse
gcgaccaaaagtagttgaca

SEQ ID NO: 699340 - DNA, 20 bp, mouse
gcggactactggggagtaga

SEQ ID NO: 699341 - DNA, 20 bp, mouse
gagtgggcgggtcgcacccc

SEQ ID NO: 699342 - DNA, 20 bp, mouse
ggcgtggtctgacaaacagt

SEQ ID NO: 699343 - DNA, 20 bp, mouse
gtcgcaccccgggcctccat

SEQ ID NO: 699344 - DNA, 20 bp, mouse
ggcgccgagcccagtggagt

SEQ ID NO: 699345 - DNA, 20 bp, mouse
ggggcagccggactaaaagc

SEQ ID NO: 699346 - DNA, 20 bp, mouse
ggcgcgccccgcctcactga

SEQ ID NO: 699347 - DNA, 20 bp, mouse
gggccaacagcctcatacct

SEQ ID NO: 699348 - DNA, 20 bp, mouse
gtcgctccctaaagcttgat

SEQ ID NO: 699349 - DNA, 20 bp, mouse
ggctcggcgccaccgggaac

SEQ ID NO: 699350 - DNA, 20 bp, mouse
gctgcccggaagtgactgtt

SEQ ID NO: 699351 - DNA, 20 bp, mouse
gctgccgaacagtcacttcc

SEQ ID NO: 699352 - DNA, 20 bp, mouse
gcgaggggcgggaacccgag

SEQ ID NO: 699353 - DNA, 20 bp, mouse
gcaccgggaacgggaagccc

SEQ ID NO: 699354 - DNA, 20 bp, mouse
ggatccgccatgcgagttga

SEQ ID NO: 699355 - DNA, 20 bp, mouse
gagttgagggcaagaagcaa

SEQ ID NO: 699356 - DNA, 20 bp, mouse
gagtaggaaacaaactaggc

SEQ ID NO: 699357 - DNA, 20 bp, mouse
gagaatcgaggctacttcaa

SEQ ID NO: 699358 - DNA, 20 bp, mouse
gatgcaatacggtaacttgg

SEQ ID NO: 699359 - DNA, 20 bp, mouse
ggggcctcgggccaaaatgg

SEQ ID NO: 699360 - DNA, 20 bp, mouse
gcctcgggccaaaatggagg

SEQ ID NO: 699361 - DNA, 20 bp, mouse
gagggcacactaaaatacgc

SEQ ID NO: 699362 - DNA, 20 bp, mouse
gggccagaacccggaagggg

SEQ ID NO: 699363 - DNA, 20 bp, mouse
ggcccttgaaaagagaatcg

SEQ ID NO: 699364 - DNA, 20 bp, mouse
ggggcttcggggccagaacc

SEQ ID NO: 699365 - DNA, 20 bp, mouse
gcaatacggtaacttggagg

SEQ ID NO: 699366 - DNA, 20 bp, mouse
gtaggcgggaggttactggg

SEQ ID NO: 699367 - DNA, 20 bp, mouse
ggggatggaaacagtattac

SEQ ID NO: 699368 - DNA, 20 bp, mouse
gaaggaaggccctggcaaag

SEQ ID NO: 699369 - DNA, 20 bp, mouse
gcaagtaggcgggaggttac

SEQ ID NO: 699370 - DNA, 20 bp, mouse
gggccaggacagcaagtagg

SEQ ID NO: 699371 - DNA, 20 bp, mouse
gctgaaccccggtcgctcat

SEQ ID NO: 699372 - DNA, 20 bp, mouse
gtgggcacggctctgaaccc

SEQ ID NO: 699373 - DNA, 20 bp, mouse
gagccgtgcccaaataagga

SEQ ID NO: 699374 - DNA, 20 bp, mouse
gtgtcaacaaaggggcggat

SEQ ID NO: 699375 - DNA, 20 bp, mouse
ggcgtctgtcaacaaagggg

SEQ ID NO: 699376 - DNA, 20 bp, mouse
ggctccgcccgcagggttcc

SEQ ID NO: 699377 - DNA, 20 bp, mouse
gagcctcaccctctcaagaa

SEQ ID NO: 699378 - DNA, 20 bp, mouse
gctcccgtgcgtggactcct

SEQ ID NO: 699379 - DNA, 20 bp, mouse
ggctccgagcgattcaagag

SEQ ID NO: 699380 - DNA, 20 bp, mouse
gtcaagaaaggatgagacgc

SEQ ID NO: 699381 - DNA, 20 bp, mouse
ggatctcccgggaaccctgc

SEQ ID NO: 699382 - DNA, 20 bp, mouse
gctcccaggagtccacgcac

SEQ ID NO: 699383 - DNA, 20 bp, mouse
gaatcgctcggagcactccc

SEQ ID NO: 699384 - DNA, 20 bp, mouse
ggatgagacgccgggatcct

SEQ ID NO: 699385 - DNA, 20 bp, mouse
gctcccgggaaccctgcggg

SEQ ID NO: 699386 - DNA, 20 bp, mouse
ggctcagtaagtgaataact

SEQ ID NO: 699387 - DNA, 20 bp, mouse
gtgagcatttatgactcagt

SEQ ID NO: 699388 - DNA, 20 bp, mouse
gaagcatagcttattacata

SEQ ID NO: 699389 - DNA, 20 bp, mouse
gtgaataacttggagtgtga

SEQ ID NO: 699390 - DNA, 20 bp, mouse
gcggggacacactactaccg

SEQ ID NO: 699391 - DNA, 20 bp, mouse
gagagacagagctggggctt

SEQ ID NO: 699392 - DNA, 20 bp, mouse
gatagcttattacataagtc

SEQ ID NO: 699393 - DNA, 20 bp, mouse
ggcagcatagtttatcacat

SEQ ID NO: 699394 - DNA, 20 bp, mouse
gggtttcatgcaacacagac

SEQ ID NO: 699395 - DNA, 20 bp, mouse
gacagtggcagtgacaatga

SEQ ID NO: 699396 - DNA, 20 bp, mouse
gtgcccgctgtcactcagcg

SEQ ID NO: 699397 - DNA, 20 bp, mouse
gcatgcaaatgggtggagcg

SEQ ID NO: 699398 - DNA, 20 bp, mouse
gtgacagcgggcacatgggc

SEQ ID NO: 699399 - DNA, 20 bp, mouse
gaggcaccgcgcatgcaaat

SEQ ID NO: 699400 - DNA, 20 bp, mouse
ggggtggagcgaggcttgag

SEQ ID NO: 699401 - DNA, 20 bp, mouse
gtgagtgacagcgggcacat

SEQ ID NO: 699402 - DNA, 20 bp, mouse
gtcaggttgcagagtcccct

SEQ ID NO: 699403 - DNA, 20 bp, mouse
gccaaggctctctctcccca

SEQ ID NO: 699404 - DNA, 20 bp, mouse
ggggcgggacttaaaagagc

SEQ ID NO: 699405 - DNA, 20 bp, mouse
ggctagcgagggctttgaga

SEQ ID NO: 699406 - DNA, 20 bp, mouse
gtaggcgtggcctgtgaagg

SEQ ID NO: 699407 - DNA, 20 bp, mouse
gtcgcccaataggagggcgc

SEQ ID NO: 699408 - DNA, 20 bp, mouse
gccctcgctcgcccaatagg

SEQ ID NO: 699409 - DNA, 20 bp, mouse
gcgcccccgcgccctcctat

SEQ ID NO: 699410 - DNA, 20 bp, mouse
gaataggcaggcggcatgag

SEQ ID NO: 699411 - DNA, 20 bp, mouse
gacgccctcgctcgcccaat

SEQ ID NO: 699412 - DNA, 20 bp, mouse
gtcgcgggataacggagggg

SEQ ID NO: 699413 - DNA, 20 bp, mouse
gtgggaggagcccaggctcc

SEQ ID NO: 699414 - DNA, 20 bp, mouse
gtcacaggccacgcctacat

SEQ ID NO: 699415 - DNA, 20 bp, mouse
gggcgaggatctgggcgtgt

SEQ ID NO: 699416 - DNA, 20 bp, mouse
ggaggaagcaggcccgaggt

SEQ ID NO: 699417 - DNA, 20 bp, mouse
gtccccctccaggcgacaag

SEQ ID NO: 699418 - DNA, 20 bp, mouse
ggaaccgcttgtcgcctgga

SEQ ID NO: 699419 - DNA, 20 bp, mouse
gggcagagctgtacctcctc

SEQ ID NO: 699420 - DNA, 20 bp, mouse
gtggagggggagacggaagc

SEQ ID NO: 699421 - DNA, 20 bp, mouse
ggcagatccagtcgcctgtc

SEQ ID NO: 699422 - DNA, 20 bp, mouse
gtggatctgccccacccatg

SEQ ID NO: 699423 - DNA, 20 bp, mouse
gaatctagtccctaccagac

SEQ ID NO: 699424 - DNA, 20 bp, mouse
gagcagcttgctcccacctc

SEQ ID NO: 699425 - DNA, 20 bp, mouse
gggaggaggaagcaggcccg

SEQ ID NO: 699426 - DNA, 20 bp, mouse
gggccctaacctgatgtcac

SEQ ID NO: 699427 - DNA, 20 bp, mouse
gcgagcgctggggattcctc

SEQ ID NO: 699428 - DNA, 20 bp, mouse
ggctcgagcggaaggctcta

SEQ ID NO: 699429 - DNA, 20 bp, mouse
gacatcgccacctggaggcg

SEQ ID NO: 699430 - DNA, 20 bp, mouse
gccgactccggcacctcgag

SEQ ID NO: 699431 - DNA, 20 bp, mouse
ggcaggcgctgggtttgctt

SEQ ID NO: 699432 - DNA, 20 bp, mouse
gtgcgcgcctcgcctccagg

SEQ ID NO: 699433 - DNA, 20 bp, mouse
gcgcgcagctgcccgagcgt

SEQ ID NO: 699434 - DNA, 20 bp, mouse
gagtgtggagacatgacaga

SEQ ID NO: 699435 - DNA, 20 bp, mouse
gggcgcgcgacatcgccacc

SEQ ID NO: 699436 - DNA, 20 bp, mouse
gaagctgcgcgaacggagtg

SEQ ID NO: 699437 - DNA, 20 bp, mouse
ggggtcgcccctcgtgccga

SEQ ID NO: 699438 - DNA, 20 bp, mouse
gggcgcgggcgtaaggctct

SEQ ID NO: 699439 - DNA, 20 bp, mouse
gcggaagtgacgtcgaggag

SEQ ID NO: 699440 - DNA, 20 bp, mouse
gagcccctaagcaaactgaa

SEQ ID NO: 699441 - DNA, 20 bp, mouse
ggagtgtggaatctgcatct

SEQ ID NO: 699442 - DNA, 20 bp, mouse
gcggttcccgccacgttctc

SEQ ID NO: 699443 - DNA, 20 bp, mouse
ggacccgaggcgcgggcgta

SEQ ID NO: 699444 - DNA, 20 bp, mouse
gcctgaagaagctgcgcgaa

SEQ ID NO: 699445 - DNA, 20 bp, mouse
gcaacccaggaacctcggtg

SEQ ID NO: 699446 - DNA, 20 bp, mouse
gacagggcacccagtgtcca

SEQ ID NO: 699447 - DNA, 20 bp, mouse
gcgtcgcgagctagggtgat

SEQ ID NO: 699448 - DNA, 20 bp, mouse
gcaccctagctcgcgacggg

SEQ ID NO: 699449 - DNA, 20 bp, mouse
gcaaacaggcgggctgagtg

SEQ ID NO: 699450 - DNA, 20 bp, mouse
gtggctggtagccaagcagg

SEQ ID NO: 699451 - DNA, 20 bp, mouse
gttctcagcatcaaacaggc

SEQ ID NO: 699452 - DNA, 20 bp, mouse
gatgctgagaacacccaggc

SEQ ID NO: 699453 - DNA, 20 bp, mouse
gcccctgagtcgatcctaat

SEQ ID NO: 699454 - DNA, 20 bp, mouse
gcatgtgtgcagccggagag

SEQ ID NO: 699455 - DNA, 20 bp, mouse
gggtgttctcagcatcaaac

SEQ ID NO: 699456 - DNA, 20 bp, mouse
gcaactcccaacatatcctc

SEQ ID NO: 699457 - DNA, 20 bp, mouse
gtccacagggaaccactctc

SEQ ID NO: 699458 - DNA, 20 bp, mouse
gagacagttgctgtatattc

SEQ ID NO: 699459 - DNA, 20 bp, mouse
gagactgaatataatatgca

SEQ ID NO: 699460 - DNA, 20 bp, mouse
ggtgagaccttctgctacat

SEQ ID NO: 699461 - DNA, 20 bp, mouse
gaatataatatgcagggcac

SEQ ID NO: 699462 - DNA, 20 bp, mouse
gaagacaggtgcttttactg

SEQ ID NO: 699463 - DNA, 20 bp, mouse
gtgtaatcttcttacatttg

SEQ ID NO: 699464 - DNA, 20 bp, mouse
gcggtaaagccatgtttcta

SEQ ID NO: 699465 - DNA, 20 bp, mouse
gatgaagactgtgaagtctg

SEQ ID NO: 699466 - DNA, 20 bp, mouse
gcatgcgcagtgggtgtctg

SEQ ID NO: 699467 - DNA, 20 bp, mouse
gagagcacctaggggagcgc

SEQ ID NO: 699468 - DNA, 20 bp, mouse
gccaccggagagagcaccta

SEQ ID NO: 699469 - DNA, 20 bp, mouse
gagtgccggacgtgcagagc

SEQ ID NO: 699470 - DNA, 20 bp, mouse
ggacctggacggaaactccg

SEQ ID NO: 699471 - DNA, 20 bp, mouse
gtgcactaggaagtgtggga

SEQ ID NO: 699472 - DNA, 20 bp, mouse
gcgcgcgcgaggtcttcttc

SEQ ID NO: 699473 - DNA, 20 bp, mouse
gctcgcgcgcgaggatttct

SEQ ID NO: 699474 - DNA, 20 bp, mouse
gcaactcccggcagccgcgg

SEQ ID NO: 699475 - DNA, 20 bp, mouse
gagcgcagggctgtgagtgc

SEQ ID NO: 699476 - DNA, 20 bp, mouse
gtgctccagtcaaaggctga

SEQ ID NO: 699477 - DNA, 20 bp, mouse
ggattatgttgaagtccgtt

SEQ ID NO: 699478 - DNA, 20 bp, mouse
gtagaaagtggcagtcaaag

SEQ ID NO: 699479 - DNA, 20 bp, mouse
gcagagcagcaggaaacatc

SEQ ID NO: 699480 - DNA, 20 bp, mouse
gtgtgcaggcacagataggt

SEQ ID NO: 699481 - DNA, 20 bp, mouse
gaaaagcacatgatatgggg

SEQ ID NO: 699482 - DNA, 20 bp, mouse
gaggctgtgcaggcacagat

SEQ ID NO: 699483 - DNA, 20 bp, mouse
ggaccaaaagcacatgatat

SEQ ID NO: 699484 - DNA, 20 bp, mouse
gtgctgcttgctccagtcaa

SEQ ID NO: 699485 - DNA, 20 bp, mouse
gtcacttggtattttctaga

SEQ ID NO: 699486 - DNA, 20 bp, mouse
gagtgcatctggctgcagtg

SEQ ID NO: 699487 - DNA, 20 bp, mouse
gtagaaagtggctgtcaaag

SEQ ID NO: 699488 - DNA, 20 bp, mouse
ggagagcagcaggaaacatc

SEQ ID NO: 699489 - DNA, 20 bp, mouse
gtggctgcagtgagggaggc

SEQ ID NO: 699490 - DNA, 20 bp, mouse
gacttaaagcacattatttg

SEQ ID NO: 699491 - DNA, 20 bp, mouse
gtaaagcacattatttgggg

SEQ ID NO: 699492 - DNA, 20 bp, mouse
gttagctctctagtagaaag

SEQ ID NO: 699493 - DNA, 20 bp, mouse
gtttggggtggcctgattga

SEQ ID NO: 699494 - DNA, 20 bp, mouse
gtctaactcaggtctcaaag

SEQ ID NO: 699495 - DNA, 20 bp, mouse
gttctctaaattattggtgt

SEQ ID NO: 699496 - DNA, 20 bp, mouse
gtgtcccctgcccacatcac

SEQ ID NO: 699497 - DNA, 20 bp, mouse
gtttctggctccagtgatgt

SEQ ID NO: 699498 - DNA, 20 bp, mouse
gggtttccacagtgcaagaa

SEQ ID NO: 699499 - DNA, 20 bp, mouse
gaaacccctttcttgcactg

SEQ ID NO: 699500 - DNA, 20 bp, mouse
ggacacctgatgttttctac

SEQ ID NO: 699501 - DNA, 20 bp, mouse
gacacagtgaaaaatcacag

SEQ ID NO: 699502 - DNA, 20 bp, mouse
gaaggtagacatgaacctaa

SEQ ID NO: 699503 - DNA, 20 bp, mouse
gaagaccagtagaaaacatc

SEQ ID NO: 699504 - DNA, 20 bp, mouse
gtttgcacatacacaggcat

SEQ ID NO: 699505 - DNA, 20 bp, mouse
gcagctcatctggctttgat

SEQ ID NO: 699506 - DNA, 20 bp, mouse
gagactgattgtgagaggag

SEQ ID NO: 699507 - DNA, 20 bp, mouse
ggcctagcgatcactgaagt

SEQ ID NO: 699508 - DNA, 20 bp, mouse
gagcctggggaggcgagcgc

SEQ ID NO: 699509 - DNA, 20 bp, mouse
gaagcagacgcacggggcta

SEQ ID NO: 699510 - DNA, 20 bp, mouse
ggggcgggctcatctaactg

SEQ ID NO: 699511 - DNA, 20 bp, mouse
gtggaggaagcagacgcacg

SEQ ID NO: 699512 - DNA, 20 bp, mouse
ggcggtaggacaaagagtag

SEQ ID NO: 699513 - DNA, 20 bp, mouse
gagaatcataagcagggagg

SEQ ID NO: 699514 - DNA, 20 bp, mouse
gctaccgcacagcccatttc

SEQ ID NO: 699515 - DNA, 20 bp, mouse
gggcagtaatgatggtcgat

SEQ ID NO: 699516 - DNA, 20 bp, mouse
gctaacaagtacatcatcaa

SEQ ID NO: 699517 - DNA, 20 bp, mouse
gacaagtacatcatcaatgg

SEQ ID NO: 699518 - DNA, 20 bp, mouse
ggagaccagcaggaaacatc

SEQ ID NO: 699519 - DNA, 20 bp, mouse
ggacacctgatgtttcctgc

SEQ ID NO: 699520 - DNA, 20 bp, mouse
gtgcttatgtgaagtctgtt

SEQ ID NO: 699521 - DNA, 20 bp, mouse
gtagaaagtggcggtcaaag

SEQ ID NO: 699522 - DNA, 20 bp, mouse
ggctttctagtagaaagtgg

SEQ ID NO: 699523 - DNA, 20 bp, mouse
gtgcagcttgctccaaccaa

SEQ ID NO: 699524 - DNA, 20 bp, mouse
ggtttctggctgcagtgaga

SEQ ID NO: 699525 - DNA, 20 bp, mouse
gtgctccaaccaaaggctga

SEQ ID NO: 699526 - DNA, 20 bp, mouse
gggaggtgccaggtgtcaat

SEQ ID NO: 699527 - DNA, 20 bp, mouse
ggaaagaatggccccgactg

SEQ ID NO: 699528 - DNA, 20 bp, mouse
gaaggtgtaagcgcagacgg

SEQ ID NO: 699529 - DNA, 20 bp, mouse
ggcccagcgtcgggcggaag

SEQ ID NO: 699530 - DNA, 20 bp, mouse
gcggaagccgctcccctgtg

SEQ ID NO: 699531 - DNA, 20 bp, mouse
gcggtggtacagcacatgtt

SEQ ID NO: 699532 - DNA, 20 bp, mouse
gccattccggcgcccagcgt

SEQ ID NO: 699533 - DNA, 20 bp, mouse
gggagatgacgcagcagcac

SEQ ID NO: 699534 - DNA, 20 bp, mouse
gaaacattgtgcaaatctag

SEQ ID NO: 699535 - DNA, 20 bp, mouse
gcaaacagcccattgacacc

SEQ ID NO: 699536 - DNA, 20 bp, mouse
ggtcaaagcctcatgacctg

SEQ ID NO: 699537 - DNA, 20 bp, mouse
ggtctctgtgtgggcagcag

SEQ ID NO: 699538 - DNA, 20 bp, mouse
ggacacctgatgtttactgc

SEQ ID NO: 699539 - DNA, 20 bp, mouse
gaggaatttgagaaacctaa

SEQ ID NO: 699540 - DNA, 20 bp, mouse
gatcactttggagtgagttc

SEQ ID NO: 699541 - DNA, 20 bp, mouse
gttgacaaccacaggtcatg

SEQ ID NO: 699542 - DNA, 20 bp, mouse
gtttactgctggtctctgtg

SEQ ID NO: 699543 - DNA, 20 bp, mouse
ggagaccagcagtaaacatc

SEQ ID NO: 699544 - DNA, 20 bp, mouse
gtgcatctggcacaagtgag

SEQ ID NO: 699545 - DNA, 20 bp, mouse
gtatgcaataaaaatcactt

SEQ ID NO: 699546 - DNA, 20 bp, mouse
gtgcttatgtgacatccatt

SEQ ID NO: 699547 - DNA, 20 bp, mouse
gaaaccagattgcctacatc

SEQ ID NO: 699548 - DNA, 20 bp, mouse
gggaatttggagcagcctaa

SEQ ID NO: 699549 - DNA, 20 bp, mouse
ggatgactgatgtttattgc

SEQ ID NO: 699550 - DNA, 20 bp, mouse
gatgtttattgctggtctct

SEQ ID NO: 699551 - DNA, 20 bp, mouse
gacagagaggtgggccctgc

SEQ ID NO: 699552 - DNA, 20 bp, mouse
gattgcctacatcaggaatt

SEQ ID NO: 699553 - DNA, 20 bp, mouse
gtgctccaaattcctgatgt

SEQ ID NO: 699554 - DNA, 20 bp, mouse
gactcccagcccccacacac

SEQ ID NO: 699555 - DNA, 20 bp, mouse
ggcatctggcaccagtgtgt

SEQ ID NO: 699556 - DNA, 20 bp, mouse
ggtcaaatcctgatgaacta

SEQ ID NO: 699557 - DNA, 20 bp, mouse
gttgccaaccatagttcatc

SEQ ID NO: 699558 - DNA, 20 bp, mouse
gaatcctgatgaactatggt

SEQ ID NO: 699559 - DNA, 20 bp, mouse
gttaaatttctattagacag

SEQ ID NO: 699560 - DNA, 20 bp, mouse
ggagattagcagtaaatatt

SEQ ID NO: 699561 - DNA, 20 bp, mouse
gggtctccacagtaccagga

SEQ ID NO: 699562 - DNA, 20 bp, mouse
gcacaagcacatgctctcag

SEQ ID NO: 699563 - DNA, 20 bp, mouse
ggcatctggctgcagtgaga

SEQ ID NO: 699564 - DNA, 20 bp, mouse
gtttccctacaccaggaatt

SEQ ID NO: 699565 - DNA, 20 bp, mouse
gtaacacactaattgtcaac

SEQ ID NO: 699566 - DNA, 20 bp, mouse
gattcctggtgtagagactc

SEQ ID NO: 699567 - DNA, 20 bp, mouse
gggaatttgtagtaacctaa

SEQ ID NO: 699568 - DNA, 20 bp, mouse
gcttgtgtacttagctttct

SEQ ID NO: 699569 - DNA, 20 bp, mouse
ggagaaagtggcggtcaaag

SEQ ID NO: 699570 - DNA, 20 bp, mouse
ggagagcagcaggaaacatc

SEQ ID NO: 699571 - DNA, 20 bp, mouse
ggctttctaggagaaagtgg

SEQ ID NO: 699572 - DNA, 20 bp, mouse
gttagctttctaggagaaag

SEQ ID NO: 699573 - DNA, 20 bp, mouse
gaaaccagagtctctacacc

SEQ ID NO: 699574 - DNA, 20 bp, mouse
gttctggctgcagtgagtgg

SEQ ID NO: 699575 - DNA, 20 bp, mouse
ggaaacttggtgtgttactt

SEQ ID NO: 699576 - DNA, 20 bp, mouse
gtagaaagtggctgtcaaag

SEQ ID NO: 699577 - DNA, 20 bp, mouse
ggagagcagcaggaaacatc

SEQ ID NO: 699578 - DNA, 20 bp, mouse
gacttaaagcacatgatttg

SEQ ID NO: 699579 - DNA, 20 bp, mouse
gactccccttcccctctcac

SEQ ID NO: 699580 - DNA, 20 bp, mouse
ggcatctgactccagtgaga

SEQ ID NO: 699581 - DNA, 20 bp, mouse
gtaaagcacatgatttgggg

SEQ ID NO: 699582 - DNA, 20 bp, mouse
gttagctctctagtagaaag

SEQ ID NO: 699583 - DNA, 20 bp, mouse
gtttggggtggcctgattga

SEQ ID NO: 699584 - DNA, 20 bp, mouse
gtctaactcaggtctcaaag

SEQ ID NO: 699585 - DNA, 20 bp, mouse
gttctctaaattattggtgt

SEQ ID NO: 699586 - DNA, 20 bp, mouse
ggatgtcagtgaccaggttg

SEQ ID NO: 699587 - DNA, 20 bp, mouse
gagaggaggcgacaccacgt

SEQ ID NO: 699588 - DNA, 20 bp, mouse
gcggaccgggtcacatgggg

SEQ ID NO: 699589 - DNA, 20 bp, mouse
gggaccaaaaggccccttga

SEQ ID NO: 699590 - DNA, 20 bp, mouse
ggaggggcgggtctcggctt

SEQ ID NO: 699591 - DNA, 20 bp, mouse
gcccggcatgaggctaaggc

SEQ ID NO: 699592 - DNA, 20 bp, mouse
gccctcacgcctgtatttcg

SEQ ID NO: 699593 - DNA, 20 bp, mouse
gtcctggtgctccagaagat

SEQ ID NO: 699594 - DNA, 20 bp, mouse
gaggcgacaccacgtcggac

SEQ ID NO: 699595 - DNA, 20 bp, mouse
gtgatcccggcatgaggcta

SEQ ID NO: 699596 - DNA, 20 bp, mouse
gcgcaggcgcaagacgggga

SEQ ID NO: 699597 - DNA, 20 bp, mouse
gggaaagtaagagtttgcgc

SEQ ID NO: 699598 - DNA, 20 bp, mouse
gagaaacgctggctgctagt

SEQ ID NO: 699599 - DNA, 20 bp, mouse
ggagagccccgaggcatcga

SEQ ID NO: 699600 - DNA, 20 bp, mouse
ggggttaggggttcagtaat

SEQ ID NO: 699601 - DNA, 20 bp, mouse
gtgaggcgcaggcgcaagac

SEQ ID NO: 699602 - DNA, 20 bp, mouse
gaggcgcaagacggggaagg

SEQ ID NO: 699603 - DNA, 20 bp, mouse
gcgcctccataaagacgtgg

SEQ ID NO: 699604 - DNA, 20 bp, mouse
gtagtcggagcctgaggcgc

SEQ ID NO: 699605 - DNA, 20 bp, mouse
gacaggacagcgaggtggag

SEQ ID NO: 699606 - DNA, 20 bp, mouse
gtgcaccattctgtgttcaa

SEQ ID NO: 699607 - DNA, 20 bp, mouse
gagtctgcattgctgaaccc

SEQ ID NO: 699608 - DNA, 20 bp, mouse
gacacaacgcactgaacaga

SEQ ID NO: 699609 - DNA, 20 bp, mouse
gctgaacagagggcggacgt

SEQ ID NO: 699610 - DNA, 20 bp, mouse
ggaacccacaagattattgg

SEQ ID NO: 699611 - DNA, 20 bp, mouse
gtctgccaagtctatccagt

SEQ ID NO: 699612 - DNA, 20 bp, mouse
gcgagaacccacaagattat

SEQ ID NO: 699613 - DNA, 20 bp, mouse
gcagtgcgttgtgtgcttac

SEQ ID NO: 699614 - DNA, 20 bp, mouse
gtgtgtgcttacgggctccc

SEQ ID NO: 699615 - DNA, 20 bp, mouse
gacacagaatggtgcagtcc

SEQ ID NO: 699616 - DNA, 20 bp, mouse
gcaaggtgctccctagaaag

SEQ ID NO: 699617 - DNA, 20 bp, mouse
gttatggtgacgtttgagaa

SEQ ID NO: 699618 - DNA, 20 bp, mouse
ggacaggagcaaagcagggc

SEQ ID NO: 699619 - DNA, 20 bp, mouse
gagcaccttggttatttagt

SEQ ID NO: 699620 - DNA, 20 bp, mouse
gtaacagcgagagagcggta

SEQ ID NO: 699621 - DNA, 20 bp, mouse
gcagtcacttgatgcagagg

SEQ ID NO: 699622 - DNA, 20 bp, mouse
gtcttactttccactttcta

SEQ ID NO: 699623 - DNA, 20 bp, mouse
gcgttccaactaaataacca

SEQ ID NO: 699624 - DNA, 20 bp, mouse
gagcaggagactggtctgta

SEQ ID NO: 699625 - DNA, 20 bp, mouse
gagctcaccagctgtttgac

SEQ ID NO: 699626 - DNA, 20 bp, mouse
gcgccggaagtgtccgtagt

SEQ ID NO: 699627 - DNA, 20 bp, mouse
gaagggatgtcgaagcagag

SEQ ID NO: 699628 - DNA, 20 bp, mouse
gagcgcgtcttgtaggttcc

SEQ ID NO: 699629 - DNA, 20 bp, mouse
gcacccaggggctgccagaa

SEQ ID NO: 699630 - DNA, 20 bp, mouse
gatgtcgaagcagaggggcg

SEQ ID NO: 699631 - DNA, 20 bp, mouse
gcgcgctcccggaagtctcc

SEQ ID NO: 699632 - DNA, 20 bp, mouse
gttccgggagcgcgtcttgt

SEQ ID NO: 699633 - DNA, 20 bp, mouse
gaacctacaagacgcgctcc

SEQ ID NO: 699634 - DNA, 20 bp, mouse
gaagcaagccatgctttaaa

SEQ ID NO: 699635 - DNA, 20 bp, mouse
gcttcgacatcccttgtttt

SEQ ID NO: 699636 - DNA, 20 bp, mouse
gcagacgtctagtcctgtgc

SEQ ID NO: 699637 - DNA, 20 bp, mouse
gagtcctgtgcgggtgtgaa

SEQ ID NO: 699638 - DNA, 20 bp, mouse
gaaaccattcacacccgcac

SEQ ID NO: 699639 - DNA, 20 bp, mouse
gaaaggcgtgcccactgccc

SEQ ID NO: 699640 - DNA, 20 bp, mouse
ggtctctgacgtcatctaat

SEQ ID NO: 699641 - DNA, 20 bp, mouse
gctgcctaggaaacaagacg

SEQ ID NO: 699642 - DNA, 20 bp, mouse
ggggtcctcaacccgggcag

SEQ ID NO: 699643 - DNA, 20 bp, mouse
gacacctgccagatattgct

SEQ ID NO: 699644 - DNA, 20 bp, mouse
gaggaaacaagacgcggctc

SEQ ID NO: 699645 - DNA, 20 bp, mouse
gagagtagaagccggattaa

SEQ ID NO: 699646 - DNA, 20 bp, mouse
ggctatcagcggctgcccga

SEQ ID NO: 699647 - DNA, 20 bp, mouse
gccccaaagctggctatcag

SEQ ID NO: 699648 - DNA, 20 bp, mouse
gaccttgcacagggtataag

SEQ ID NO: 699649 - DNA, 20 bp, mouse
ggcaaggtctcagacattta

SEQ ID NO: 699650 - DNA, 20 bp, mouse
gaagtgtccaggtcagccat

SEQ ID NO: 699651 - DNA, 20 bp, mouse
gcctagaagctgaagtgtcc

SEQ ID NO: 699652 - DNA, 20 bp, mouse
gggctgcccgatggctgacc

SEQ ID NO: 699653 - DNA, 20 bp, mouse
gggatttcagggttcaggag

SEQ ID NO: 699654 - DNA, 20 bp, mouse
gaaagagacctggacaagtg

SEQ ID NO: 699655 - DNA, 20 bp, mouse
ggctcaggtggttacatcac

SEQ ID NO: 699656 - DNA, 20 bp, mouse
gctgacacctagaatcttat

SEQ ID NO: 699657 - DNA, 20 bp, mouse
gtccctgcctataagattct

SEQ ID NO: 699658 - DNA, 20 bp, mouse
ggggtctaagcagagtcatg

SEQ ID NO: 699659 - DNA, 20 bp, mouse
gtcttataggcagggaccaa

SEQ ID NO: 699660 - DNA, 20 bp, mouse
gaatagggttgtgccaaatt

SEQ ID NO: 699661 - DNA, 20 bp, mouse
ggattctaggtgtcagctga

SEQ ID NO: 699662 - DNA, 20 bp, mouse
gcacctagaatcttataggc

SEQ ID NO: 699663 - DNA, 20 bp, mouse
gatgtcttctgtgttgtatc

SEQ ID NO: 699664 - DNA, 20 bp, mouse
gtgcattgaatgtcacctta

SEQ ID NO: 699665 - DNA, 20 bp, mouse
ggatggaaagcaatactatc

SEQ ID NO: 699666 - DNA, 20 bp, mouse
gagaccaggcagctcccgga

SEQ ID NO: 699667 - DNA, 20 bp, mouse
gagtggtgggtggttaaata

SEQ ID NO: 699668 - DNA, 20 bp, mouse
gtggtcagggaactgttcgt

SEQ ID NO: 699669 - DNA, 20 bp, mouse
gcgaaggcgtggcaggaagg

SEQ ID NO: 699670 - DNA, 20 bp, mouse
gctcccggaagggccatttt

SEQ ID NO: 699671 - DNA, 20 bp, mouse
gaaggagggaactgtggtca

SEQ ID NO: 699672 - DNA, 20 bp, mouse
gctccccaaaatggcccttc

SEQ ID NO: 699673 - DNA, 20 bp, mouse
gtggtctgtagtacaggaag

SEQ ID NO: 699674 - DNA, 20 bp, mouse
gggaaggtaagggttatggt

SEQ ID NO: 699675 - DNA, 20 bp, mouse
gatagcatgcatctgagtgg

SEQ ID NO: 699676 - DNA, 20 bp, mouse
gtggatctgaatcaaacctg

SEQ ID NO: 699677 - DNA, 20 bp, mouse
gtctcaggtaagcaaactgt

SEQ ID NO: 699678 - DNA, 20 bp, mouse
gaggcggtgagcccataatt

SEQ ID NO: 699679 - DNA, 20 bp, mouse
gttggtgctccctagaacct

SEQ ID NO: 699680 - DNA, 20 bp, mouse
gttctagggagcaccaaaaa

SEQ ID NO: 699681 - DNA, 20 bp, mouse
gggaaggaaatgacacaacc

SEQ ID NO: 699682 - DNA, 20 bp, mouse
gagaaagtggaatgattgtg

SEQ ID NO: 699683 - DNA, 20 bp, mouse
ggtgtgtgctgtggccaccc

SEQ ID NO: 699684 - DNA, 20 bp, mouse
gtatgggctcaccgcctggg

SEQ ID NO: 699685 - DNA, 20 bp, mouse
gaatgattgtggggaaagac

SEQ ID NO: 699686 - DNA, 20 bp, mouse
gccgagccggctcctaacgc

SEQ ID NO: 699687 - DNA, 20 bp, mouse
ggcagagcccagccgaccgt

SEQ ID NO: 699688 - DNA, 20 bp, mouse
gcggaggcggaagctacttt

SEQ ID NO: 699689 - DNA, 20 bp, mouse
gaaaaacgttacccgaacgg

SEQ ID NO: 699690 - DNA, 20 bp, mouse
gcgacactggagattttttt

SEQ ID NO: 699691 - DNA, 20 bp, mouse
gaaggcgagcgagagaagag

SEQ ID NO: 699692 - DNA, 20 bp, mouse
ggtggccaagtcctagttct

SEQ ID NO: 699693 - DNA, 20 bp, mouse
gggacgagggcagaggggtc

SEQ ID NO: 699694 - DNA, 20 bp, mouse
gtgggctctgcctccggctg

SEQ ID NO: 699695 - DNA, 20 bp, mouse
gcgctggcggagatcgacac

SEQ ID NO: 699696 - DNA, 20 bp, mouse
gagccctgaagatctgccaa

SEQ ID NO: 699697 - DNA, 20 bp, mouse
ggtgacccggggtgtggcca

SEQ ID NO: 699698 - DNA, 20 bp, mouse
gcacccttggcagatcttca

SEQ ID NO: 699699 - DNA, 20 bp, mouse
gctccccagctgtctctata

SEQ ID NO: 699700 - DNA, 20 bp, mouse
gaggatgccgatctcagacc

SEQ ID NO: 699701 - DNA, 20 bp, mouse
gatcccggctccctgggcat

SEQ ID NO: 699702 - DNA, 20 bp, mouse
gatgccgatctcagaccagg

SEQ ID NO: 699703 - DNA, 20 bp, mouse
ggagcagaatgccgagatcc

SEQ ID NO: 699704 - DNA, 20 bp, mouse
gcatgattgaattgatccag

SEQ ID NO: 699705 - DNA, 20 bp, mouse
gtgtgcgcgtcaggtgaccc

SEQ ID NO: 699706 - DNA, 20 bp, mouse
gaaccctgaaagagtgaggt

SEQ ID NO: 699707 - DNA, 20 bp, mouse
ggggaccaagattagaaaag

SEQ ID NO: 699708 - DNA, 20 bp, mouse
gctcccacctcactctttca

SEQ ID NO: 699709 - DNA, 20 bp, mouse
gagtaaatctgaggataacc

SEQ ID NO: 699710 - DNA, 20 bp, mouse
ggctagcctggtctgcattc

SEQ ID NO: 699711 - DNA, 20 bp, mouse
ggaagcaggcatgtaaagct

SEQ ID NO: 699712 - DNA, 20 bp, mouse
gacgatgcaagtatccagca

SEQ ID NO: 699713 - DNA, 20 bp, mouse
ggatagcctgaatgcagacc

SEQ ID NO: 699714 - DNA, 20 bp, mouse
gttgcatcgtatcctttggg

SEQ ID NO: 699715 - DNA, 20 bp, mouse
gtacttgcatcgtatccttt

SEQ ID NO: 699716 - DNA, 20 bp, mouse
gggctccagcagaacatgaa

SEQ ID NO: 699717 - DNA, 20 bp, mouse
gaggacttaccagaataaac

SEQ ID NO: 699718 - DNA, 20 bp, mouse
gaaacggtctgtttaatcct

SEQ ID NO: 699719 - DNA, 20 bp, mouse
gcatcctccatcacagactg

SEQ ID NO: 699720 - DNA, 20 bp, mouse
gctggacgtctggtacagag

SEQ ID NO: 699721 - DNA, 20 bp, mouse
gttgcctcagtctgtgatgg

SEQ ID NO: 699722 - DNA, 20 bp, mouse
gcgtagctgacctggacgtc

SEQ ID NO: 699723 - DNA, 20 bp, mouse
gctaatagagaacggatgaa

SEQ ID NO: 699724 - DNA, 20 bp, mouse
gggggagggattcaggacta

SEQ ID NO: 699725 - DNA, 20 bp, mouse
gtcctccagaaactgaataa

SEQ ID NO: 699726 - DNA, 20 bp, mouse
gtgtagaagggatatctgtc

SEQ ID NO: 699727 - DNA, 20 bp, mouse
gcggggcagtaagtaaatag

SEQ ID NO: 699728 - DNA, 20 bp, mouse
gagaaggtgctgcgtgtaga

SEQ ID NO: 699729 - DNA, 20 bp, mouse
ggcaccttcttgtacccttg

SEQ ID NO: 699730 - DNA, 20 bp, mouse
gtcacagcaaacagtagctt

SEQ ID NO: 699731 - DNA, 20 bp, mouse
gagcttggggttttccccaa

SEQ ID NO: 699732 - DNA, 20 bp, mouse
ggccttgagcctttctgcat

SEQ ID NO: 699733 - DNA, 20 bp, mouse
gagcatcgaatcaagactcg

SEQ ID NO: 699734 - DNA, 20 bp, mouse
gcgcataacaaacttgttgg

SEQ ID NO: 699735 - DNA, 20 bp, mouse
gctctcttgcttaaccgcac

SEQ ID NO: 699736 - DNA, 20 bp, mouse
gcctgactgtgggctctgat

SEQ ID NO: 699737 - DNA, 20 bp, mouse
gccccaggaaaacataccaa

SEQ ID NO: 699738 - DNA, 20 bp, mouse
gcacacagagagtctatcag

SEQ ID NO: 699739 - DNA, 20 bp, mouse
gaaactggtgagatggactg

SEQ ID NO: 699740 - DNA, 20 bp, mouse
gagcaagggccatgtcccag

SEQ ID NO: 699741 - DNA, 20 bp, mouse
gcaagtggttctatccccct

SEQ ID NO: 699742 - DNA, 20 bp, mouse
gagtcaaatagggcccttaa

SEQ ID NO: 699743 - DNA, 20 bp, mouse
ggtgagccctgtggtagggc

SEQ ID NO: 699744 - DNA, 20 bp, mouse
gcccttgcctgcatgcagat

SEQ ID NO: 699745 - DNA, 20 bp, mouse
gctgatctacacagaacaag

SEQ ID NO: 699746 - DNA, 20 bp, mouse
gtcccggggcaaacgtcatt

SEQ ID NO: 699747 - DNA, 20 bp, mouse
gaggctggacagaggcccaa

SEQ ID NO: 699748 - DNA, 20 bp, mouse
gccacagcccacaaatcctg

SEQ ID NO: 699749 - DNA, 20 bp, mouse
gtagactcgcagccctggaa

SEQ ID NO: 699750 - DNA, 20 bp, mouse
gagacaggggccaaaggcaa

SEQ ID NO: 699751 - DNA, 20 bp, mouse
ggctcctaagcacacccctt

SEQ ID NO: 699752 - DNA, 20 bp, mouse
gtcagcgtgcaggcctttcc

SEQ ID NO: 699753 - DNA, 20 bp, mouse
gtactcgtttggagcatttt

SEQ ID NO: 699754 - DNA, 20 bp, mouse
gacagacaggtaggttgaca

SEQ ID NO: 699755 - DNA, 20 bp, mouse
gagttcctgctgtatctggt

SEQ ID NO: 699756 - DNA, 20 bp, mouse
gggacctccccatagtcaca

SEQ ID NO: 699757 - DNA, 20 bp, mouse
gacacaaatgggggaggtga

SEQ ID NO: 699758 - DNA, 20 bp, mouse
gaggccaaggtagacacttg

SEQ ID NO: 699759 - DNA, 20 bp, mouse
ggggaggtgagggagcagac

SEQ ID NO: 699760 - DNA, 20 bp, mouse
gacagggcagccacacaaat

SEQ ID NO: 699761 - DNA, 20 bp, mouse
gtgcccatgagtggaaaccg

SEQ ID NO: 699762 - DNA, 20 bp, mouse
gtgggcggggaggtgacggt

SEQ ID NO: 699763 - DNA, 20 bp, mouse
gagcctcggtttccactcat

SEQ ID NO: 699764 - DNA, 20 bp, mouse
gcctctgggtgctagggtga

SEQ ID NO: 699765 - DNA, 20 bp, mouse
gaggtcagtatgcccatgag

SEQ ID NO: 699766 - DNA, 20 bp, mouse
gttgacaggtgcagagatca

SEQ ID NO: 699767 - DNA, 20 bp, mouse
gtctttggagaacccctccg

SEQ ID NO: 699768 - DNA, 20 bp, mouse
gagcctgcggatgaatttcc

SEQ ID NO: 699769 - DNA, 20 bp, mouse
ggcgctgctggccccgccat

SEQ ID NO: 699770 - DNA, 20 bp, mouse
ggctggccccgccatgggtg

SEQ ID NO: 699771 - DNA, 20 bp, mouse
gagtctctcgggagactggg

SEQ ID NO: 699772 - DNA, 20 bp, mouse
gagcctggaaattcatccgc

SEQ ID NO: 699773 - DNA, 20 bp, mouse
ggtcaagtctctcgggagac

SEQ ID NO: 699774 - DNA, 20 bp, mouse
gtggctcttgcttaatgctg

SEQ ID NO: 699775 - DNA, 20 bp, mouse
gtcataaaccctgcactggt

SEQ ID NO: 699776 - DNA, 20 bp, mouse
gagaccgcccgcgccctcta

SEQ ID NO: 699777 - DNA, 20 bp, mouse
gcgaacgctcggacccggac

SEQ ID NO: 699778 - DNA, 20 bp, mouse
gcgactcccgccagccccgg

SEQ ID NO: 699779 - DNA, 20 bp, mouse
ggcactcgggagcgacagtc

SEQ ID NO: 699780 - DNA, 20 bp, mouse
gtctcgccccgtggtggcgg

SEQ ID NO: 699781 - DNA, 20 bp, mouse
gtccgagcgttcgcaaggaa

SEQ ID NO: 699782 - DNA, 20 bp, mouse
gccggggggcggagctaata

SEQ ID NO: 699783 - DNA, 20 bp, mouse
gtcaggctctcgccccgtgg

SEQ ID NO: 699784 - DNA, 20 bp, mouse
gtagtctgcgcgagcctccg

SEQ ID NO: 699785 - DNA, 20 bp, mouse
ggactgctggagatcctaga

SEQ ID NO: 699786 - DNA, 20 bp, mouse
ggcacgctgcgtccgcccgg

SEQ ID NO: 699787 - DNA, 20 bp, mouse
gccggcgcggaagaacacag

SEQ ID NO: 699788 - DNA, 20 bp, mouse
gcggtggcctggacctttcc

SEQ ID NO: 699789 - DNA, 20 bp, mouse
gaatgaccagaagtaattac

SEQ ID NO: 699790 - DNA, 20 bp, mouse
gaaaggtccaggccaccggg

SEQ ID NO: 699791 - DNA, 20 bp, mouse
gggtatcagtgaaggggcgt

SEQ ID NO: 699792 - DNA, 20 bp, mouse
gcgcgcagcttgacgagagt

SEQ ID NO: 699793 - DNA, 20 bp, mouse
gaaaaagacgggtacatcct

SEQ ID NO: 699794 - DNA, 20 bp, mouse
ggagcgggccaactctgggg

SEQ ID NO: 699795 - DNA, 20 bp, mouse
ggcagcgtgcgcctggcggt

SEQ ID NO: 699796 - DNA, 20 bp, mouse
gagggccgggctgcccgagt

SEQ ID NO: 699797 - DNA, 20 bp, mouse
gcggcccggggggtgtgtga

SEQ ID NO: 699798 - DNA, 20 bp, mouse
ggggctgcccgagtgggtgg

SEQ ID NO: 699799 - DNA, 20 bp, mouse
gcggctgcagctggctgacg

SEQ ID NO: 699800 - DNA, 20 bp, mouse
ggcggcgagcgcggacgacg

SEQ ID NO: 699801 - DNA, 20 bp, mouse
gctgcagctggctgacgcgg

SEQ ID NO: 699802 - DNA, 20 bp, mouse
gggttggcggagctctaaca

SEQ ID NO: 699803 - DNA, 20 bp, mouse
ggctcgccgggcggctgagg

SEQ ID NO: 699804 - DNA, 20 bp, mouse
ggcggctcgccgggcggctg

SEQ ID NO: 699805 - DNA, 20 bp, mouse
gccccgctccggctgcagag

SEQ ID NO: 699806 - DNA, 20 bp, mouse
gagtcagcactggggattcg

SEQ ID NO: 699807 - DNA, 20 bp, mouse
gtctgctatccatggatggg

SEQ ID NO: 699808 - DNA, 20 bp, mouse
gaggttcagcatttggctct

SEQ ID NO: 699809 - DNA, 20 bp, mouse
ggaactgctgggtgtggcgc

SEQ ID NO: 699810 - DNA, 20 bp, mouse
ggaaaggcaaggctggccaa

SEQ ID NO: 699811 - DNA, 20 bp, mouse
gtgtgctacagggaactgct

SEQ ID NO: 699812 - DNA, 20 bp, mouse
gcagtgcctcacactctctc

SEQ ID NO: 699813 - DNA, 20 bp, mouse
gggcagggtagtgagaacga

SEQ ID NO: 699814 - DNA, 20 bp, mouse
gactgtactcatgtgctaca

SEQ ID NO: 699815 - DNA, 20 bp, mouse
gggagctcagtaggcgcctt

SEQ ID NO: 699816 - DNA, 20 bp, mouse
gagacctaaaatagtcccaa

SEQ ID NO: 699817 - DNA, 20 bp, mouse
ggaagaacagacataccctt

SEQ ID NO: 699818 - DNA, 20 bp, mouse
ggggtatgtctgttcttcca

SEQ ID NO: 699819 - DNA, 20 bp, mouse
gaggaagtgactatctcctg

SEQ ID NO: 699820 - DNA, 20 bp, mouse
gcttccagggaggcctttgg

SEQ ID NO: 699821 - DNA, 20 bp, mouse
gaggggaagtgaacctccaa

SEQ ID NO: 699822 - DNA, 20 bp, mouse
ggcatctgagccaggtctag

SEQ ID NO: 699823 - DNA, 20 bp, mouse
gtggctcagatgcctctgca

SEQ ID NO: 699824 - DNA, 20 bp, mouse
gggacattggagcccaaggt

SEQ ID NO: 699825 - DNA, 20 bp, mouse
gatacccttgggactatttt

SEQ ID NO: 699826 - DNA, 20 bp, mouse
gctccaggaaggccccagaa

SEQ ID NO: 699827 - DNA, 20 bp, mouse
gtggaggaagaactgaacac

SEQ ID NO: 699828 - DNA, 20 bp, mouse
gaagaactgaacactggaca

SEQ ID NO: 699829 - DNA, 20 bp, mouse
gtggaagacactccttccta

SEQ ID NO: 699830 - DNA, 20 bp, mouse
ggaaggagtgtcttccattc

SEQ ID NO: 699831 - DNA, 20 bp, mouse
gtttgggtatcaggagatgc

SEQ ID NO: 699832 - DNA, 20 bp, mouse
gtaaagcctggatcatctac

SEQ ID NO: 699833 - DNA, 20 bp, mouse
gggtttgaggaagtcgtggt

SEQ ID NO: 699834 - DNA, 20 bp, mouse
gaatggaagggagtattcgc

SEQ ID NO: 699835 - DNA, 20 bp, mouse
gcagtgtgtggtgtgaaatc

SEQ ID NO: 699836 - DNA, 20 bp, mouse
gtaagcatcagacgtgatca

SEQ ID NO: 699837 - DNA, 20 bp, mouse
gaagatggttctataaaaaa

SEQ ID NO: 699838 - DNA, 20 bp, mouse
gttccccagcagccaaaatg

SEQ ID NO: 699839 - DNA, 20 bp, mouse
ggaggctacacatacgtaaa

SEQ ID NO: 699840 - DNA, 20 bp, mouse
gcagacgtgatcatggctgt

SEQ ID NO: 699841 - DNA, 20 bp, mouse
ggttacggtaacaccattaa

SEQ ID NO: 699842 - DNA, 20 bp, mouse
gcatggctgtgggattgtta

SEQ ID NO: 699843 - DNA, 20 bp, mouse
gagacaaagtgaaaactttg

SEQ ID NO: 699844 - DNA, 20 bp, mouse
gggtaacaccattaatggta

SEQ ID NO: 699845 - DNA, 20 bp, mouse
gcaccacattttggctgctg

SEQ ID NO: 699846 - DNA, 20 bp, mouse
gggcaagggagagagacatc

SEQ ID NO: 699847 - DNA, 20 bp, mouse
gcctggctatgtggtgacat

SEQ ID NO: 699848 - DNA, 20 bp, mouse
gtggtgacattggttgtgat

SEQ ID NO: 699849 - DNA, 20 bp, mouse
ggggaaggacagtaaggacc

SEQ ID NO: 699850 - DNA, 20 bp, mouse
gggacctggggaatacaaag

SEQ ID NO: 699851 - DNA, 20 bp, mouse
gtttgacgtaggttcttcca

SEQ ID NO: 699852 - DNA, 20 bp, mouse
ggtcaccacatagccaggag

SEQ ID NO: 699853 - DNA, 20 bp, mouse
ggtggcccttctgacttaag

SEQ ID NO: 699854 - DNA, 20 bp, mouse
gttattggggaaggacagta

SEQ ID NO: 699855 - DNA, 20 bp, mouse
gctcaccactcctggctatg

SEQ ID NO: 699856 - DNA, 20 bp, mouse
gcaccctgagggatgaagga

SEQ ID NO: 699857 - DNA, 20 bp, mouse
gctgtggccaagtctccaat

SEQ ID NO: 699858 - DNA, 20 bp, mouse
gagcgagctggactgttgtg

SEQ ID NO: 699859 - DNA, 20 bp, mouse
ggtaggaggccggaaattaa

SEQ ID NO: 699860 - DNA, 20 bp, mouse
ggtgtggaggcgagacagtt

SEQ ID NO: 699861 - DNA, 20 bp, mouse
gcatttaatctacaccctga

SEQ ID NO: 699862 - DNA, 20 bp, mouse
gtctacaccctgagggatga

SEQ ID NO: 699863 - DNA, 20 bp, mouse
gtgtggggttgacttctctc

SEQ ID NO: 699864 - DNA, 20 bp, mouse
gcaattggctcttgtcactc

SEQ ID NO: 699865 - DNA, 20 bp, mouse
gagagaggacagattgataa

SEQ ID NO: 699866 - DNA, 20 bp, mouse
gtggctacagaggggtagat

SEQ ID NO: 699867 - DNA, 20 bp, mouse
gaggacagtgcttgatgctt

SEQ ID NO: 699868 - DNA, 20 bp, mouse
gagctggaacatggctacag

SEQ ID NO: 699869 - DNA, 20 bp, mouse
gagtgcttgatgcttggggt

SEQ ID NO: 699870 - DNA, 20 bp, mouse
gggaagcagacattgggaac

SEQ ID NO: 699871 - DNA, 20 bp, mouse
gatggtggaacacaaagacc

SEQ ID NO: 699872 - DNA, 20 bp, mouse
ggtaggtgagtaacacactc

SEQ ID NO: 699873 - DNA, 20 bp, mouse
gggcttctctatagaagtca

SEQ ID NO: 699874 - DNA, 20 bp, mouse
gaggttggaggcatggatgt

SEQ ID NO: 699875 - DNA, 20 bp, mouse
gcattcccacttcctcaaga

SEQ ID NO: 699876 - DNA, 20 bp, mouse
gagtccataccccaacccaa

SEQ ID NO: 699877 - DNA, 20 bp, mouse
ggcaacggtgctgcttagta

SEQ ID NO: 699878 - DNA, 20 bp, mouse
gaaaggaaggcgtcctacgc

SEQ ID NO: 699879 - DNA, 20 bp, mouse
gtctaagcaagtctgtaaag

SEQ ID NO: 699880 - DNA, 20 bp, mouse
gcacctgatttgaatttcag

SEQ ID NO: 699881 - DNA, 20 bp, mouse
gccccaaactcagtattctc

SEQ ID NO: 699882 - DNA, 20 bp, mouse
ggcccactgaaattcaaatc

SEQ ID NO: 699883 - DNA, 20 bp, mouse
ggcggtcagtccagactagg

SEQ ID NO: 699884 - DNA, 20 bp, mouse
gccagcggtcagtccagact

SEQ ID NO: 699885 - DNA, 20 bp, mouse
gagcaagtctgtaaagagga

SEQ ID NO: 699886 - DNA, 20 bp, mouse
ggacgcgcggagtggactga

SEQ ID NO: 699887 - DNA, 20 bp, mouse
gctacgacacgcaggaacaa

SEQ ID NO: 699888 - DNA, 20 bp, mouse
gtggactgacggacgttgat

SEQ ID NO: 699889 - DNA, 20 bp, mouse
gcggcgcggccggttgagga

SEQ ID NO: 699890 - DNA, 20 bp, mouse
ggcctccaggctaggacgcg

SEQ ID NO: 699891 - DNA, 20 bp, mouse
gttaaccaatcggaagccgg

SEQ ID NO: 699892 - DNA, 20 bp, mouse
gggccagagctgctcgcacc

SEQ ID NO: 699893 - DNA, 20 bp, mouse
gtcagagtgaaagggtagca

SEQ ID NO: 699894 - DNA, 20 bp, mouse
gcaggctaggacgcgcggag

SEQ ID NO: 699895 - DNA, 20 bp, mouse
ggggtaccaatcgtgttcgc

SEQ ID NO: 699896 - DNA, 20 bp, mouse
gacaccgccgaccgcctagt

SEQ ID NO: 699897 - DNA, 20 bp, mouse
gaaactcagacttgtgtctc

SEQ ID NO: 699898 - DNA, 20 bp, mouse
ggtgacggctggccaatgaa

SEQ ID NO: 699899 - DNA, 20 bp, mouse
gcagcccactaggcggtcgg

SEQ ID NO: 699900 - DNA, 20 bp, mouse
gtacgactcccggcatgcca

SEQ ID NO: 699901 - DNA, 20 bp, mouse
gcatcagcccactaggcggt

SEQ ID NO: 699902 - DNA, 20 bp, mouse
gccgcgcgccaccctttcat

SEQ ID NO: 699903 - DNA, 20 bp, mouse
gtgtggcctagttcgctgat

SEQ ID NO: 699904 - DNA, 20 bp, mouse
ggggtcgtgtaatgagtttt

SEQ ID NO: 699905 - DNA, 20 bp, mouse
gcggcatgccacggactagg

SEQ ID NO: 699906 - DNA, 20 bp, mouse
gctgccacgccttcgcgggg

SEQ ID NO: 699907 - DNA, 20 bp, mouse
gctggagcaattactcatca

SEQ ID NO: 699908 - DNA, 20 bp, mouse
gcggggccgagcactgttcc

SEQ ID NO: 699909 - DNA, 20 bp, mouse
ggggcgcagccgcgggttat

SEQ ID NO: 699910 - DNA, 20 bp, mouse
ggagcactgttccagggatc

SEQ ID NO: 699911 - DNA, 20 bp, mouse
gccgctgccacgccttcgcg

SEQ ID NO: 699912 - DNA, 20 bp, mouse
gcaaaaggcaaaagttaatc

SEQ ID NO: 699913 - DNA, 20 bp, mouse
gcgaaggcgtggcagcggcg

SEQ ID NO: 699914 - DNA, 20 bp, mouse
ggctcggccccgccccgcga

SEQ ID NO: 699915 - DNA, 20 bp, mouse
ggccccgccccgcgaaggcg

SEQ ID NO: 699916 - DNA, 20 bp, mouse
gggagcccagaagagttgat

SEQ ID NO: 699917 - DNA, 20 bp, mouse
gggctccataggcacccact

SEQ ID NO: 699918 - DNA, 20 bp, mouse
gactacccatcaactcttct

SEQ ID NO: 699919 - DNA, 20 bp, mouse
gggagatcaaggccagacta

SEQ ID NO: 699920 - DNA, 20 bp, mouse
gggaagaaatatccaaccac

SEQ ID NO: 699921 - DNA, 20 bp, mouse
ggacttccggcctcgccctg

SEQ ID NO: 699922 - DNA, 20 bp, mouse
gaagagttgatgggtagtgt

SEQ ID NO: 699923 - DNA, 20 bp, mouse
gtccaaccacagggcgaggc

SEQ ID NO: 699924 - DNA, 20 bp, mouse
ggggcgccgtgtgaggtcaa

SEQ ID NO: 699925 - DNA, 20 bp, mouse
ggaggtcaaaggtgatgcac

SEQ ID NO: 699926 - DNA, 20 bp, mouse
ggaggcgcacaaaggtgaag

SEQ ID NO: 699927 - DNA, 20 bp, mouse
gagagcgccggcaggtaagc

SEQ ID NO: 699928 - DNA, 20 bp, mouse
gttcgagcggggaagtaaaa

SEQ ID NO: 699929 - DNA, 20 bp, mouse
gtacctgccggcgctctccg

SEQ ID NO: 699930 - DNA, 20 bp, mouse
gactgctcgggagcttcgag

SEQ ID NO: 699931 - DNA, 20 bp, mouse
gggagacgaggcccacgcga

SEQ ID NO: 699932 - DNA, 20 bp, mouse
ggctcagggccgtccgtgtt

SEQ ID NO: 699933 - DNA, 20 bp, mouse
gcttccccggcgcctcctgt

SEQ ID NO: 699934 - DNA, 20 bp, mouse
gtcggacggcccaacacgga

SEQ ID NO: 699935 - DNA, 20 bp, mouse
gagcctttggaggcgcacaa

SEQ ID NO: 699936 - DNA, 20 bp, mouse
gcggggccttggcgagatgg

SEQ ID NO: 699937 - DNA, 20 bp, mouse
gggggcatggttctctttgg

SEQ ID NO: 699938 - DNA, 20 bp, mouse
gtccagaggagcgtcctcgg

SEQ ID NO: 699939 - DNA, 20 bp, mouse
gcaagcgggaggcgaggctt

SEQ ID NO: 699940 - DNA, 20 bp, mouse
gttgaggattggacgttctg

SEQ ID NO: 699941 - DNA, 20 bp, mouse
gggggcggggctccagtgat

SEQ ID NO: 699942 - DNA, 20 bp, mouse
gtctaagcaagcgggaggcg

SEQ ID NO: 699943 - DNA, 20 bp, mouse
gtccggcatctggaggtact

SEQ ID NO: 699944 - DNA, 20 bp, mouse
gatgggggcatggttctctt

SEQ ID NO: 699945 - DNA, 20 bp, mouse
gcggggctccagtgatgggc

SEQ ID NO: 699946 - DNA, 20 bp, mouse
gcaggtgcgctgacccgtgg

SEQ ID NO: 699947 - DNA, 20 bp, mouse
gctggccaagataaggccgt

SEQ ID NO: 699948 - DNA, 20 bp, mouse
gagggcgggcccaggagggc

SEQ ID NO: 699949 - DNA, 20 bp, mouse
gaatcaggtgcgctgacccg

SEQ ID NO: 699950 - DNA, 20 bp, mouse
gcaagccaacggccttatct

SEQ ID NO: 699951 - DNA, 20 bp, mouse
gaggcgctgtggcgcgggtg

SEQ ID NO: 699952 - DNA, 20 bp, mouse
gaaaagcatgggcacgtcta

SEQ ID NO: 699953 - DNA, 20 bp, mouse
gagggcggggcttgtaggct

SEQ ID NO: 699954 - DNA, 20 bp, mouse
gtgcgctgacccgtggtggc

SEQ ID NO: 699955 - DNA, 20 bp, mouse
gcgccgccgcagaggatccc

SEQ ID NO: 699956 - DNA, 20 bp, mouse
gtcggcgggcgatcgctcat

SEQ ID NO: 699957 - DNA, 20 bp, mouse
gataggggggaaccggtgac

SEQ ID NO: 699958 - DNA, 20 bp, mouse
gcttcctggtattgactcta

SEQ ID NO: 699959 - DNA, 20 bp, mouse
gggttcccccctatcccttt

SEQ ID NO: 699960 - DNA, 20 bp, mouse
gatcgcccgccgaatgatac

SEQ ID NO: 699961 - DNA, 20 bp, mouse
gactctaaggcggagattgc

SEQ ID NO: 699962 - DNA, 20 bp, mouse
gtatgtcaccacatttccca

SEQ ID NO: 699963 - DNA, 20 bp, mouse
gcaaaaggacgtctctcaaa

SEQ ID NO: 699964 - DNA, 20 bp, mouse
ggaaattgccgtcctgtcac

SEQ ID NO: 699965 - DNA, 20 bp, mouse
gtaaaatggccgccgcgaag

SEQ ID NO: 699966 - DNA, 20 bp, mouse
ggcccccgcgcgtgaatcac

SEQ ID NO: 699967 - DNA, 20 bp, mouse
gagtgcccgcggttttcctg

SEQ ID NO: 699968 - DNA, 20 bp, mouse
ggatgcttagtcaaggctgg

SEQ ID NO: 699969 - DNA, 20 bp, mouse
gaacacccacgcgcggctca

SEQ ID NO: 699970 - DNA, 20 bp, mouse
gagatggctacttgcgtcaa

SEQ ID NO: 699971 - DNA, 20 bp, mouse
gcgcccaccggcgatcgaaa

SEQ ID NO: 699972 - DNA, 20 bp, mouse
ggagaaggctactgaatcta

SEQ ID NO: 699973 - DNA, 20 bp, mouse
gccttcggctccgtctgcgg

SEQ ID NO: 699974 - DNA, 20 bp, mouse
ggggtcctgtgggggcgaga

SEQ ID NO: 699975 - DNA, 20 bp, mouse
gcacagcggaacctttcttt

SEQ ID NO: 699976 - DNA, 20 bp, mouse
gcacctgcgtgctacggaaa

SEQ ID NO: 699977 - DNA, 20 bp, mouse
gcgcctgcgtactaagggag

SEQ ID NO: 699978 - DNA, 20 bp, mouse
gggaaggggtggagcctaag

SEQ ID NO: 699979 - DNA, 20 bp, mouse
ggggagaggcgtggcgttgt

SEQ ID NO: 699980 - DNA, 20 bp, mouse
gccgccgccagcaaccgcct

SEQ ID NO: 699981 - DNA, 20 bp, mouse
ggccagcaaccgcctagggg

SEQ ID NO: 699982 - DNA, 20 bp, mouse
gagagtgcgcctgcgtacta

SEQ ID NO: 699983 - DNA, 20 bp, mouse
gcacgcaggtgcattttcca

SEQ ID NO: 699984 - DNA, 20 bp, mouse
ggcggggcctgagagctccc

SEQ ID NO: 699985 - DNA, 20 bp, mouse
gggagcctgcgcgcgctcca

SEQ ID NO: 699986 - DNA, 20 bp, mouse
gggagtcggactgtgggaaa

SEQ ID NO: 699987 - DNA, 20 bp, mouse
ggctgtgagtagcatggagt

SEQ ID NO: 699988 - DNA, 20 bp, mouse
gaggcctccgcggaagaacg

SEQ ID NO: 699989 - DNA, 20 bp, mouse
gaaagggtggtgtgaagttt

SEQ ID NO: 699990 - DNA, 20 bp, mouse
gcccacaatgccacgcgcaa

SEQ ID NO: 699991 - DNA, 20 bp, mouse
gcgccaccggaagaacacgt

SEQ ID NO: 699992 - DNA, 20 bp, mouse
ggtagcatggagtcggactg

SEQ ID NO: 699993 - DNA, 20 bp, mouse
gcaggcgcgaacagcctcct

SEQ ID NO: 699994 - DNA, 20 bp, mouse
gatagtgggcgttctttctg

SEQ ID NO: 699995 - DNA, 20 bp, mouse
ggggcaaaatggtgagatga

SEQ ID NO: 699996 - DNA, 20 bp, mouse
ggcccactgggttgttgggt

SEQ ID NO: 699997 - DNA, 20 bp, mouse
ggggccatccttttgactgg

SEQ ID NO: 699998 - DNA, 20 bp, mouse
gggatggcccactgggttgt

SEQ ID NO: 699999 - DNA, 20 bp, mouse
gtatcctccagtcaaaagga

SEQ ID NO: 700000 - DNA, 20 bp, mouse
gagtgggccatccttttgac

SEQ ID NO: 700001 - DNA, 20 bp, mouse
gaaccaacccaacaacccag

SEQ ID NO: 700002 - DNA, 20 bp, mouse
ggatgaattatatactgctc

SEQ ID NO: 700003 - DNA, 20 bp, mouse
gccagcttcgacaagagtca

SEQ ID NO: 700004 - DNA, 20 bp, mouse
gctgctttatttctcaaatt

SEQ ID NO: 700005 - DNA, 20 bp, mouse
gtaactgattatgtttccca

SEQ ID NO: 700006 - DNA, 20 bp, mouse
gaggcctggaggtcacggtt

SEQ ID NO: 700007 - DNA, 20 bp, mouse
gactctgcctgtactgtctg

SEQ ID NO: 700008 - DNA, 20 bp, mouse
ggcaacactggtgggcagaa

SEQ ID NO: 700009 - DNA, 20 bp, mouse
gtggaggtcacggttgggga

SEQ ID NO: 700010 - DNA, 20 bp, mouse
gcacggttggggaaggatcg

SEQ ID NO: 700011 - DNA, 20 bp, mouse
gatgggagctgggataggta

SEQ ID NO: 700012 - DNA, 20 bp, mouse
gtagcacccgcagacagtac

SEQ ID NO: 700013 - DNA, 20 bp, mouse
gtggtccacgctagcctcgc

SEQ ID NO: 700014 - DNA, 20 bp, mouse
gagtcacgggcaacactggt

SEQ ID NO: 700015 - DNA, 20 bp, mouse
gctagcctcgcaggcctcca

SEQ ID NO: 700016 - DNA, 20 bp, mouse
ggcaactcagatatcaagag

SEQ ID NO: 700017 - DNA, 20 bp, mouse
ggggtgtggctgaatcaaca

SEQ ID NO: 700018 - DNA, 20 bp, mouse
ggctgagaagcctgacagat

SEQ ID NO: 700019 - DNA, 20 bp, mouse
gataaactgtcccctcagac

SEQ ID NO: 700020 - DNA, 20 bp, mouse
gggtgggtagggctatttgg

SEQ ID NO: 700021 - DNA, 20 bp, mouse
ggacagattggtccagtctg

SEQ ID NO: 700022 - DNA, 20 bp, mouse
gtgttaccccgtgcactcaa

SEQ ID NO: 700023 - DNA, 20 bp, mouse
gttttgctttaatcactgaa

SEQ ID NO: 700024 - DNA, 20 bp, mouse
gtacgccgacagctttattc

SEQ ID NO: 700025 - DNA, 20 bp, mouse
gtcccccagaataaagctgt

SEQ ID NO: 700026 - DNA, 20 bp, mouse
ggcacagcaggtaagaactg

SEQ ID NO: 700027 - DNA, 20 bp, mouse
gctcaaggcggcagactttc

SEQ ID NO: 700028 - DNA, 20 bp, mouse
gctgcagaggtggtgcagca

SEQ ID NO: 700029 - DNA, 20 bp, mouse
gaagttcaagcattcacaga

SEQ ID NO: 700030 - DNA, 20 bp, mouse
gctgaaaaaggattcttagc

SEQ ID NO: 700031 - DNA, 20 bp, mouse
gagaacattgaatggatact

SEQ ID NO: 700032 - DNA, 20 bp, mouse
ggcagggagactgaaggcta

SEQ ID NO: 700033 - DNA, 20 bp, mouse
gcatcgcagtggaaagattt

SEQ ID NO: 700034 - DNA, 20 bp, mouse
gtctatcagcttacagaaga

SEQ ID NO: 700035 - DNA, 20 bp, mouse
gccttcctgccaggggtcga

SEQ ID NO: 700036 - DNA, 20 bp, mouse
gtggacgccgccaacgttct

SEQ ID NO: 700037 - DNA, 20 bp, mouse
gaaaggccatacaaaagtgg

SEQ ID NO: 700038 - DNA, 20 bp, mouse
ggggtcctgggccagtacca

SEQ ID NO: 700039 - DNA, 20 bp, mouse
gctagcgcggcgggcaggtg

SEQ ID NO: 700040 - DNA, 20 bp, mouse
gcagggccctggggatacgg

SEQ ID NO: 700041 - DNA, 20 bp, mouse
gtctcgctccgagtaggaga

SEQ ID NO: 700042 - DNA, 20 bp, mouse
gagggttgaagggagccgca

SEQ ID NO: 700043 - DNA, 20 bp, mouse
ggctgcccgcccaggaagtg

SEQ ID NO: 700044 - DNA, 20 bp, mouse
ggaaggctgcagatacaata

SEQ ID NO: 700045 - DNA, 20 bp, mouse
ggctgtctggagaatctaac

SEQ ID NO: 700046 - DNA, 20 bp, mouse
gcccccgcagcgctcccccg

SEQ ID NO: 700047 - DNA, 20 bp, mouse
gggggcggtgcgcgcctcgg

SEQ ID NO: 700048 - DNA, 20 bp, mouse
gtctgaccgcgctcccgcgg

SEQ ID NO: 700049 - DNA, 20 bp, mouse
gctccgcagggccgagattg

SEQ ID NO: 700050 - DNA, 20 bp, mouse
gggtcagagaagagccagag

SEQ ID NO: 700051 - DNA, 20 bp, mouse
gcagccgagagcccggatgt

SEQ ID NO: 700052 - DNA, 20 bp, mouse
ggaggcggcgcgcgctctgg

SEQ ID NO: 700053 - DNA, 20 bp, mouse
gtgcgggcggtgctgcgggg

SEQ ID NO: 700054 - DNA, 20 bp, mouse
ggcgcgctctggtggggccg

SEQ ID NO: 700055 - DNA, 20 bp, mouse
ggaggcggcggccgcaatct

SEQ ID NO: 700056 - DNA, 20 bp, mouse
ggcaaccagtagatgcctgg

SEQ ID NO: 700057 - DNA, 20 bp, mouse
gagcacgcagagggctccac

SEQ ID NO: 700058 - DNA, 20 bp, mouse
gcaacagcccgccctgggga

SEQ ID NO: 700059 - DNA, 20 bp, mouse
gggcgcacccagcaccacca

SEQ ID NO: 700060 - DNA, 20 bp, mouse
gatgagggaagaacagtgct

SEQ ID NO: 700061 - DNA, 20 bp, mouse
gccagtagatgcctgggggt

SEQ ID NO: 700062 - DNA, 20 bp, mouse
gagaggctctagcatgtcac

SEQ ID NO: 700063 - DNA, 20 bp, mouse
ggcacactgccagcacgcag

SEQ ID NO: 700064 - DNA, 20 bp, mouse
gggtgcaaccagtagatgcc

SEQ ID NO: 700065 - DNA, 20 bp, mouse
gacccagcaccaccagggcc

SEQ ID NO: 700066 - DNA, 20 bp, mouse
ggcggggcgggtccactata

SEQ ID NO: 700067 - DNA, 20 bp, mouse
gtggcccagggcacgcagag

SEQ ID NO: 700068 - DNA, 20 bp, mouse
ggagctgtcgctgtaggctg

SEQ ID NO: 700069 - DNA, 20 bp, mouse
gcacggaaacggaagggagg

SEQ ID NO: 700070 - DNA, 20 bp, mouse
gcgggaccctggagagtgcc

SEQ ID NO: 700071 - DNA, 20 bp, mouse
gagccacggaaacggaaggg

SEQ ID NO: 700072 - DNA, 20 bp, mouse
gggcgcctgaggtctcctta

SEQ ID NO: 700073 - DNA, 20 bp, mouse
gccggggcacccagggtgtg

SEQ ID NO: 700074 - DNA, 20 bp, mouse
gaggcctcaggcagggtgtt

SEQ ID NO: 700075 - DNA, 20 bp, mouse
ggcagggcgttgagtctcag

SEQ ID NO: 700076 - DNA, 20 bp, mouse
gtcaggggagtacatttgtt

SEQ ID NO: 700077 - DNA, 20 bp, mouse
gtggggcatgcccatgtcag

SEQ ID NO: 700078 - DNA, 20 bp, mouse
gttgctgcgtcatgcgtggg

SEQ ID NO: 700079 - DNA, 20 bp, mouse
gggtgacagcagcacagcac

SEQ ID NO: 700080 - DNA, 20 bp, mouse
gttcttgctgcgtcatgcgt

SEQ ID NO: 700081 - DNA, 20 bp, mouse
gccaagggctctgttctcag

SEQ ID NO: 700082 - DNA, 20 bp, mouse
gctgttcccagaggccctcc

SEQ ID NO: 700083 - DNA, 20 bp, mouse
gcggatccttctcacccttc

SEQ ID NO: 700084 - DNA, 20 bp, mouse
gggcctccagaagggtgaga

SEQ ID NO: 700085 - DNA, 20 bp, mouse
gtgcgtcatgcgtgggcggg

SEQ ID NO: 700086 - DNA, 20 bp, mouse
ggcagaaacaaagtactggg

SEQ ID NO: 700087 - DNA, 20 bp, mouse
ggggtcccacccataggctg

SEQ ID NO: 700088 - DNA, 20 bp, mouse
gggaagccacagcctatggg

SEQ ID NO: 700089 - DNA, 20 bp, mouse
gaaagtgcgggcagagcatt

SEQ ID NO: 700090 - DNA, 20 bp, mouse
ggcagggaagccacagccta

SEQ ID NO: 700091 - DNA, 20 bp, mouse
ggagagaataagctctaatt

SEQ ID NO: 700092 - DNA, 20 bp, mouse
gcccaaggctgtcactcagt

SEQ ID NO: 700093 - DNA, 20 bp, mouse
gagagcattgggaaaagccc

SEQ ID NO: 700094 - DNA, 20 bp, mouse
gtggctgcccgcagcaggct

SEQ ID NO: 700095 - DNA, 20 bp, mouse
gcaccctaactatgaattag

SEQ ID NO: 700096 - DNA, 20 bp, mouse
gccaaggtgaggacccttga

SEQ ID NO: 700097 - DNA, 20 bp, mouse
ggtcctccaagcgctctcac

SEQ ID NO: 700098 - DNA, 20 bp, mouse
gtccccgcccgtggcgactg

SEQ ID NO: 700099 - DNA, 20 bp, mouse
ggagagcgcttggaggacca

SEQ ID NO: 700100 - DNA, 20 bp, mouse
gaaagcaggggtctctggcg

SEQ ID NO: 700101 - DNA, 20 bp, mouse
gggtgcttggaagtctcggc

SEQ ID NO: 700102 - DNA, 20 bp, mouse
ggctcaggggcgacgcccag

SEQ ID NO: 700103 - DNA, 20 bp, mouse
gcatcccccgcgtgtctcct

SEQ ID NO: 700104 - DNA, 20 bp, mouse
gggtacatgttgatcagcag

SEQ ID NO: 700105 - DNA, 20 bp, mouse
gagcttcggggtttcgatgt

SEQ ID NO: 700106 - DNA, 20 bp, mouse
gctcgtgcccgggctcccgg

SEQ ID NO: 700107 - DNA, 20 bp, mouse
gaggggcacaagtagattgc

SEQ ID NO: 700108 - DNA, 20 bp, mouse
gcggtgcagcacaacgtcag

SEQ ID NO: 700109 - DNA, 20 bp, mouse
gaggaaggaatcggatccca

SEQ ID NO: 700110 - DNA, 20 bp, mouse
gagaatgccccgtctgagga

SEQ ID NO: 700111 - DNA, 20 bp, mouse
gggtaggtccacgtgctcta

SEQ ID NO: 700112 - DNA, 20 bp, mouse
gactcgggaacccgcctaac

SEQ ID NO: 700113 - DNA, 20 bp, mouse
gcctgggcgcgcccgttagg

SEQ ID NO: 700114 - DNA, 20 bp, mouse
gcggaggcgcgcccgcactc

SEQ ID NO: 700115 - DNA, 20 bp, mouse
gtggtccccgcgctcgtgcc

SEQ ID NO: 700116 - DNA, 20 bp, mouse
gaaggggcgtggcctcaagt

SEQ ID NO: 700117 - DNA, 20 bp, mouse
gagctggaggacaaggggcg

SEQ ID NO: 700118 - DNA, 20 bp, mouse
gggcgggcaccgttggggcg

SEQ ID NO: 700119 - DNA, 20 bp, mouse
gtctaaatgctcaagaacat

SEQ ID NO: 700120 - DNA, 20 bp, mouse
ggcgtggcctggaagcgaca

SEQ ID NO: 700121 - DNA, 20 bp, mouse
ggggcgtggcctcaagtggg

SEQ ID NO: 700122 - DNA, 20 bp, mouse
gaagtgggcgggcaccgttg

SEQ ID NO: 700123 - DNA, 20 bp, mouse
gtaaaagcatggctgaggta

SEQ ID NO: 700124 - DNA, 20 bp, mouse
gaagtgactcaactcggtta

SEQ ID NO: 700125 - DNA, 20 bp, mouse
gaccaagagctggaggacaa

SEQ ID NO: 700126 - DNA, 20 bp, mouse
gagtgcttgcgcgtcgggga

SEQ ID NO: 700127 - DNA, 20 bp, mouse
gagtcccggaggatgaaagt

SEQ ID NO: 700128 - DNA, 20 bp, mouse
gcgggcgagtgcttgcgcgt

SEQ ID NO: 700129 - DNA, 20 bp, mouse
gcgcccccgcctcttctggg

SEQ ID NO: 700130 - DNA, 20 bp, mouse
gccccgcccagaagaggcgg

SEQ ID NO: 700131 - DNA, 20 bp, mouse
gagagcgcccccgcctcttc

SEQ ID NO: 700132 - DNA, 20 bp, mouse
ggaaacagagtctaattcag

SEQ ID NO: 700133 - DNA, 20 bp, mouse
gtagggggaggggcagctga

SEQ ID NO: 700134 - DNA, 20 bp, mouse
gagaccccctcgagtcccgg

SEQ ID NO: 700135 - DNA, 20 bp, mouse
gttaacgattggcgagatct

SEQ ID NO: 700136 - DNA, 20 bp, mouse
gggaacgcagggtcctcaac

SEQ ID NO: 700137 - DNA, 20 bp, mouse
gaccgcccctcaaactttaa

SEQ ID NO: 700138 - DNA, 20 bp, mouse
ggcccctcaaactttaaagg

SEQ ID NO: 700139 - DNA, 20 bp, mouse
gtggcggcggccggcaggcg

SEQ ID NO: 700140 - DNA, 20 bp, mouse
ggtttgcgaatcgggaagga

SEQ ID NO: 700141 - DNA, 20 bp, mouse
gctagcgcccgcgctccctt

SEQ ID NO: 700142 - DNA, 20 bp, mouse
gaccgctcgcactttcccga

SEQ ID NO: 700143 - DNA, 20 bp, mouse
gtgaagtggaatgacatggg

SEQ ID NO: 700144 - DNA, 20 bp, mouse
gagcggtttgcgaatcggga

SEQ ID NO: 700145 - DNA, 20 bp, mouse
gacagtgatctcacgcggag

SEQ ID NO: 700146 - DNA, 20 bp, mouse
gcgaactcgggtcagcatca

SEQ ID NO: 700147 - DNA, 20 bp, mouse
gccggagagcaaccgaactc

SEQ ID NO: 700148 - DNA, 20 bp, mouse
gcctaagagcggtactgtgg

SEQ ID NO: 700149 - DNA, 20 bp, mouse
gcagctggggactgaaagct

SEQ ID NO: 700150 - DNA, 20 bp, mouse
gcacagaaggaaatggccgc

SEQ ID NO: 700151 - DNA, 20 bp, mouse
ggccagtcctagagtcactg

SEQ ID NO: 700152 - DNA, 20 bp, mouse
ggataacgactgggtgtaac

SEQ ID NO: 700153 - DNA, 20 bp, mouse
gcatcctaagagcggtactg

SEQ ID NO: 700154 - DNA, 20 bp, mouse
gggactggcttctggtgctc

SEQ ID NO: 700155 - DNA, 20 bp, mouse
gttaggatgaagataacgac

SEQ ID NO: 700156 - DNA, 20 bp, mouse
gggaatagaacagatctcca

SEQ ID NO: 700157 - DNA, 20 bp, mouse
gggaggggggcagtgtctca

SEQ ID NO: 700158 - DNA, 20 bp, mouse
gcataaggaacttggttggt

SEQ ID NO: 700159 - DNA, 20 bp, mouse
gaaggagctgacaggggtag

SEQ ID NO: 700160 - DNA, 20 bp, mouse
ggggcagtgtctcagggttt

SEQ ID NO: 700161 - DNA, 20 bp, mouse
gtagacaagggaggaatcac

SEQ ID NO: 700162 - DNA, 20 bp, mouse
gttcctctcaaacccaaagg

SEQ ID NO: 700163 - DNA, 20 bp, mouse
ggacagaaaaggagctgaca

SEQ ID NO: 700164 - DNA, 20 bp, mouse
gccccccctttgggtttgag

SEQ ID NO: 700165 - DNA, 20 bp, mouse
gtctgtctcaacaaggccga

SEQ ID NO: 700166 - DNA, 20 bp, mouse
gcagatggtcagtagcagag

SEQ ID NO: 700167 - DNA, 20 bp, mouse
gtaaaggcaaagcaggatgg

SEQ ID NO: 700168 - DNA, 20 bp, mouse
gagtaggaggcacaaatgga

SEQ ID NO: 700169 - DNA, 20 bp, mouse
gaaggagataaaggcaaagc

SEQ ID NO: 700170 - DNA, 20 bp, mouse
ggcgagtggagtgacgtcat

SEQ ID NO: 700171 - DNA, 20 bp, mouse
ggctcatcagagtgggaagt

SEQ ID NO: 700172 - DNA, 20 bp, mouse
ggatatgcatcgttctaaag

SEQ ID NO: 700173 - DNA, 20 bp, mouse
gtgtccatatgcaaaaagaa

SEQ ID NO: 700174 - DNA, 20 bp, mouse
gttatagagcgggagacaca

SEQ ID NO: 700175 - DNA, 20 bp, mouse
ggtgtgcatctctgcgcaga

SEQ ID NO: 700176 - DNA, 20 bp, mouse
gctggcctgaacaccgtggg

SEQ ID NO: 700177 - DNA, 20 bp, mouse
gggcgtaggagctgcgtcca

SEQ ID NO: 700178 - DNA, 20 bp, mouse
gaacactggcctgaacaccg

SEQ ID NO: 700179 - DNA, 20 bp, mouse
gagagcctgggcaactcggg

SEQ ID NO: 700180 - DNA, 20 bp, mouse
gtccagggcgcaccggaacg

SEQ ID NO: 700181 - DNA, 20 bp, mouse
gaatgccaaggcggggaaag

SEQ ID NO: 700182 - DNA, 20 bp, mouse
gctgaacaccgtgggtggga

SEQ ID NO: 700183 - DNA, 20 bp, mouse
gatgaagaaggcggcctcgg

SEQ ID NO: 700184 - DNA, 20 bp, mouse
gcctcccgcccgagttgccc

SEQ ID NO: 700185 - DNA, 20 bp, mouse
gaaggcggcctcgggggcgg

SEQ ID NO: 700186 - DNA, 20 bp, mouse
gttccaaggcccccatttcc

SEQ ID NO: 700187 - DNA, 20 bp, mouse
ggctctgaccataataacca

SEQ ID NO: 700188 - DNA, 20 bp, mouse
gcaggacacactgtgagctt

SEQ ID NO: 700189 - DNA, 20 bp, mouse
gagagacattggactgtgtg

SEQ ID NO: 700190 - DNA, 20 bp, mouse
gaatgggggccttggaagct

SEQ ID NO: 700191 - DNA, 20 bp, mouse
gtggctctgagcacttatga

SEQ ID NO: 700192 - DNA, 20 bp, mouse
ggaattgagcaagagtttct

SEQ ID NO: 700193 - DNA, 20 bp, mouse
gttgtgcagtcagcagttgg

SEQ ID NO: 700194 - DNA, 20 bp, mouse
gtggggggaatctacattcc

SEQ ID NO: 700195 - DNA, 20 bp, mouse
gcctcctgccggtttaagta

SEQ ID NO: 700196 - DNA, 20 bp, mouse
gtgaggaagagctgtctgat

SEQ ID NO: 700197 - DNA, 20 bp, mouse
gggcctaatgtggacacagg

SEQ ID NO: 700198 - DNA, 20 bp, mouse
gaaccccctgtgtccacatt

SEQ ID NO: 700199 - DNA, 20 bp, mouse
gctctccccggcatgacttc

SEQ ID NO: 700200 - DNA, 20 bp, mouse
gctgtctcggaggtctcgta

SEQ ID NO: 700201 - DNA, 20 bp, mouse
ggctgtctgataggtaaata

SEQ ID NO: 700202 - DNA, 20 bp, mouse
ggctctgactcaatgattcg

SEQ ID NO: 700203 - DNA, 20 bp, mouse
gcattcctgaagtcatgccg

SEQ ID NO: 700204 - DNA, 20 bp, mouse
gtaggtaaataaggcttgct

SEQ ID NO: 700205 - DNA, 20 bp, mouse
gccacattaggccagcagtg

SEQ ID NO: 700206 - DNA, 20 bp, mouse
gaactctgggacatgtggaa

SEQ ID NO: 700207 - DNA, 20 bp, mouse
gggcatgagatgcgacggaa

SEQ ID NO: 700208 - DNA, 20 bp, mouse
gaagaaggcatgagatgcga

SEQ ID NO: 700209 - DNA, 20 bp, mouse
ggccaagcctagcttaactc

SEQ ID NO: 700210 - DNA, 20 bp, mouse
gcccagagactcgcctctgt

SEQ ID NO: 700211 - DNA, 20 bp, mouse
ggaaactggccctagcgagg

SEQ ID NO: 700212 - DNA, 20 bp, mouse
gggagccccgccccctcgtc

SEQ ID NO: 700213 - DNA, 20 bp, mouse
ggcgacggaagggtcgattt

SEQ ID NO: 700214 - DNA, 20 bp, mouse
gttctgggaaagagtgtgat

SEQ ID NO: 700215 - DNA, 20 bp, mouse
gtcccacagaggcgagtctc

SEQ ID NO: 700216 - DNA, 20 bp, mouse
ggggccgggcagtacttcac

SEQ ID NO: 700217 - DNA, 20 bp, mouse
gctgggtagaagtatctgag

SEQ ID NO: 700218 - DNA, 20 bp, mouse
gttagagaaggcacgggctg

SEQ ID NO: 700219 - DNA, 20 bp, mouse
ggggggaaaggggacggctc

SEQ ID NO: 700220 - DNA, 20 bp, mouse
ggcacgggctgtggcaacag

SEQ ID NO: 700221 - DNA, 20 bp, mouse
gccaggaagctgctcatccc

SEQ ID NO: 700222 - DNA, 20 bp, mouse
gctgtggcaacagtggtcac

SEQ ID NO: 700223 - DNA, 20 bp, mouse
gtctctgcatggggggaaag

SEQ ID NO: 700224 - DNA, 20 bp, mouse
gaagtactgcccggccctct

SEQ ID NO: 700225 - DNA, 20 bp, mouse
gaggccagcactccctactg

SEQ ID NO: 700226 - DNA, 20 bp, mouse
ggggctccaggagggctaag

SEQ ID NO: 700227 - DNA, 20 bp, mouse
gtgagtggggccactggccc

SEQ ID NO: 700228 - DNA, 20 bp, mouse
ggctccttgccgtgttgcta

SEQ ID NO: 700229 - DNA, 20 bp, mouse
gatggcgtcctgaggctgta

SEQ ID NO: 700230 - DNA, 20 bp, mouse
ggggggaacaggaatccacg

SEQ ID NO: 700231 - DNA, 20 bp, mouse
gactcacggatggcgtcctg

SEQ ID NO: 700232 - DNA, 20 bp, mouse
ggtggggccactggccccgg

SEQ ID NO: 700233 - DNA, 20 bp, mouse
gtccccagctctccacgtgc

SEQ ID NO: 700234 - DNA, 20 bp, mouse
ggggtgatatgtccactgtg

SEQ ID NO: 700235 - DNA, 20 bp, mouse
gtccgtgagtctgtcagaag

SEQ ID NO: 700236 - DNA, 20 bp, mouse
ggctactgcagaacctggta

SEQ ID NO: 700237 - DNA, 20 bp, mouse
gacgcaacgtgagaggaggt

SEQ ID NO: 700238 - DNA, 20 bp, mouse
gttggtctgctggtcctgaa

SEQ ID NO: 700239 - DNA, 20 bp, mouse
ggatgacgcaacgtgagagg

SEQ ID NO: 700240 - DNA, 20 bp, mouse
gtgagaggaggttggtctgc

SEQ ID NO: 700241 - DNA, 20 bp, mouse
gctcctgcatctggtttggt

SEQ ID NO: 700242 - DNA, 20 bp, mouse
ggaagggcctggtctgcttg

SEQ ID NO: 700243 - DNA, 20 bp, mouse
gggggaagaggatccatcag

SEQ ID NO: 700244 - DNA, 20 bp, mouse
gtggctgctactgcagaacc

SEQ ID NO: 700245 - DNA, 20 bp, mouse
gagcgatgacgcaacgtgag

SEQ ID NO: 700246 - DNA, 20 bp, mouse
gcgagcgccgaagaggcttg

SEQ ID NO: 700247 - DNA, 20 bp, mouse
gcagcatcccagggcgtggt

SEQ ID NO: 700248 - DNA, 20 bp, mouse
gggtcccccccaagcctctt

SEQ ID NO: 700249 - DNA, 20 bp, mouse
gctaccgcgctgcaaacttt

SEQ ID NO: 700250 - DNA, 20 bp, mouse
gtcccgcccgagcgccgaag

SEQ ID NO: 700251 - DNA, 20 bp, mouse
ggcgtcgcccattggcccag

SEQ ID NO: 700252 - DNA, 20 bp, mouse
gctgccttcccctgggccaa

SEQ ID NO: 700253 - DNA, 20 bp, mouse
gctgccggagagtccgacga

SEQ ID NO: 700254 - DNA, 20 bp, mouse
gagctgatgaggcgtttctg

SEQ ID NO: 700255 - DNA, 20 bp, mouse
ggtcggtaagtaagctgatg

SEQ ID NO: 700256 - DNA, 20 bp, mouse
gcgtccccacgcacacttaa

SEQ ID NO: 700257 - DNA, 20 bp, mouse
gcgggagcgggaggaaacat

SEQ ID NO: 700258 - DNA, 20 bp, mouse
gcgggaggaaacataggagg

SEQ ID NO: 700259 - DNA, 20 bp, mouse
ggcactccgcggcaaggcga

SEQ ID NO: 700260 - DNA, 20 bp, mouse
gggggccagggctatgatca

SEQ ID NO: 700261 - DNA, 20 bp, mouse
ggcccctttaagtgtgcgtg

SEQ ID NO: 700262 - DNA, 20 bp, mouse
gcgcacacttaaaggggcca

SEQ ID NO: 700263 - DNA, 20 bp, mouse
ggagcgggaggaaacatagg

SEQ ID NO: 700264 - DNA, 20 bp, mouse
gaagccttgtacagctcctt

SEQ ID NO: 700265 - DNA, 20 bp, mouse
gcctcccgctcccgagagga

SEQ ID NO: 700266 - DNA, 20 bp, mouse
gagtagtcaggggatgtaaa

SEQ ID NO: 700267 - DNA, 20 bp, mouse
gcggctcctgcccacctcgg

SEQ ID NO: 700268 - DNA, 20 bp, mouse
gaggcgccccctagtagtca

SEQ ID NO: 700269 - DNA, 20 bp, mouse
gggtgagcgtgtaggctgga

SEQ ID NO: 700270 - DNA, 20 bp, mouse
gctctctccaataggagctc

SEQ ID NO: 700271 - DNA, 20 bp, mouse
gagcgtgtaggctggagggg

SEQ ID NO: 700272 - DNA, 20 bp, mouse
gccacccgcctcagcacgat

SEQ ID NO: 700273 - DNA, 20 bp, mouse
ggcacgagaggagatcgcag

SEQ ID NO: 700274 - DNA, 20 bp, mouse
ggacctgcttattggagaag

SEQ ID NO: 700275 - DNA, 20 bp, mouse
gcgtgctgaggcgggtggta

SEQ ID NO: 700276 - DNA, 20 bp, mouse
gacaccatgccagtcccaga

SEQ ID NO: 700277 - DNA, 20 bp, mouse
gcccctctgctgatgagcaa

SEQ ID NO: 700278 - DNA, 20 bp, mouse
gtggggtggtctgcaggcag

SEQ ID NO: 700279 - DNA, 20 bp, mouse
ggggctgtggcatgcacatc

SEQ ID NO: 700280 - DNA, 20 bp, mouse
gccacacagccctctgggac

SEQ ID NO: 700281 - DNA, 20 bp, mouse
gtggggagagggacgggctg

SEQ ID NO: 700282 - DNA, 20 bp, mouse
ggctgatgagcaagggccaa

SEQ ID NO: 700283 - DNA, 20 bp, mouse
gcagacctgggactgcagag

SEQ ID NO: 700284 - DNA, 20 bp, mouse
gacctggaggccagcgctct

SEQ ID NO: 700285 - DNA, 20 bp, mouse
ggtgagggagccgagagcgc

SEQ ID NO: 700286 - DNA, 20 bp, mouse
ggagggggcggggggatctt

SEQ ID NO: 700287 - DNA, 20 bp, mouse
gcccacggaggcggcgagga

SEQ ID NO: 700288 - DNA, 20 bp, mouse
gctgggaacgccagagaaaa

SEQ ID NO: 700289 - DNA, 20 bp, mouse
gagcaaggggctccctgtag

SEQ ID NO: 700290 - DNA, 20 bp, mouse
gggagggggtcaaacggcgg

SEQ ID NO: 700291 - DNA, 20 bp, mouse
gggagctgcaggctgcgggg

SEQ ID NO: 700292 - DNA, 20 bp, mouse
gtgcgcccacggaggcggcg

SEQ ID NO: 700293 - DNA, 20 bp, mouse
gcggggggatcttgggcgag

SEQ ID NO: 700294 - DNA, 20 bp, mouse
gggtcaaacctcatttgcag

SEQ ID NO: 700295 - DNA, 20 bp, mouse
gtggccagcgctgcgagcac

SEQ ID NO: 700296 - DNA, 20 bp, mouse
gcaggagcggccccaaaata

SEQ ID NO: 700297 - DNA, 20 bp, mouse
gaccctgtgtaagagtaggc

SEQ ID NO: 700298 - DNA, 20 bp, mouse
ggcccagcctactcttacac

SEQ ID NO: 700299 - DNA, 20 bp, mouse
gagggtagaaagaagcctcg

SEQ ID NO: 700300 - DNA, 20 bp, mouse
gccacaccctgtgtaagagt

SEQ ID NO: 700301 - DNA, 20 bp, mouse
gagaggaggtatcttctatc

SEQ ID NO: 700302 - DNA, 20 bp, mouse
gggctgctgtcaatgtcaag

SEQ ID NO: 700303 - DNA, 20 bp, mouse
ggtggacattagctcaccct

SEQ ID NO: 700304 - DNA, 20 bp, mouse
ggtggagggtagcaaggtga

SEQ ID NO: 700305 - DNA, 20 bp, mouse
gatgtgttctcaataccccg

SEQ ID NO: 700306 - DNA, 20 bp, mouse
gtcagggtaccaagtggaaa

SEQ ID NO: 700307 - DNA, 20 bp, mouse
gcaaagggcagtagggagtt

SEQ ID NO: 700308 - DNA, 20 bp, mouse
ggagaggcgcaagcgttgta

SEQ ID NO: 700309 - DNA, 20 bp, mouse
ggggtaccaagtggaaaggg

SEQ ID NO: 700310 - DNA, 20 bp, mouse
gcccccgccgccagtggttg

SEQ ID NO: 700311 - DNA, 20 bp, mouse
gaccggctgcggttctccgg

SEQ ID NO: 700312 - DNA, 20 bp, mouse
gcaaagcgatccacgtccaa

SEQ ID NO: 700313 - DNA, 20 bp, mouse
gtcgctttggggtgcaagtt

SEQ ID NO: 700314 - DNA, 20 bp, mouse
gccacgtccaaagggcagta

SEQ ID NO: 700315 - DNA, 20 bp, mouse
gctgcgttcagggtaccaag

SEQ ID NO: 700316 - DNA, 20 bp, mouse
ggaaagagggctttgggcaa

SEQ ID NO: 700317 - DNA, 20 bp, mouse
gagcggggactctgcacccg

SEQ ID NO: 700318 - DNA, 20 bp, mouse
gcctcccggaacccagctac

SEQ ID NO: 700319 - DNA, 20 bp, mouse
ggggccgccgagacagggag

SEQ ID NO: 700320 - DNA, 20 bp, mouse
gtctccctaagcctctttta

SEQ ID NO: 700321 - DNA, 20 bp, mouse
gtagggagaaacagtgatgg

SEQ ID NO: 700322 - DNA, 20 bp, mouse
gatcttctacaggtgttcgt

SEQ ID NO: 700323 - DNA, 20 bp, mouse
gcggggggtggggcggtcgg

SEQ ID NO: 700324 - DNA, 20 bp, mouse
gggccccctccctgtctcgg

SEQ ID NO: 700325 - DNA, 20 bp, mouse
gtacaggtgttcgtgggagc

SEQ ID NO: 700326 - DNA, 20 bp, mouse
gtgtgtagacacatcggatg

SEQ ID NO: 700327 - DNA, 20 bp, mouse
gggatggggaccacatagtt

SEQ ID NO: 700328 - DNA, 20 bp, mouse
gccaagatgctagactaagg

SEQ ID NO: 700329 - DNA, 20 bp, mouse
gccctgctcaagctgccctc

SEQ ID NO: 700330 - DNA, 20 bp, mouse
ggaaaggttggcagatctgt

SEQ ID NO: 700331 - DNA, 20 bp, mouse
gatagttgggaggggatagt

SEQ ID NO: 700332 - DNA, 20 bp, mouse
gtgtggccgcacctgcctga

SEQ ID NO: 700333 - DNA, 20 bp, mouse
gtatcgctggagccctctca

SEQ ID NO: 700334 - DNA, 20 bp, mouse
gtgtgggtccctggccgcga

SEQ ID NO: 700335 - DNA, 20 bp, mouse
ggaagagagtccaacaagtt

SEQ ID NO: 700336 - DNA, 20 bp, mouse
gcggccagatctggcagagg

SEQ ID NO: 700337 - DNA, 20 bp, mouse
gtgggcggggtcactgggtt

SEQ ID NO: 700338 - DNA, 20 bp, mouse
gcgcccaggccggccagatc

SEQ ID NO: 700339 - DNA, 20 bp, mouse
gggccagggtcgcaaagggg

SEQ ID NO: 700340 - DNA, 20 bp, mouse
gcactgggttggggcttgaa

SEQ ID NO: 700341 - DNA, 20 bp, mouse
gccccaggccagggtcgcaa

SEQ ID NO: 700342 - DNA, 20 bp, mouse
gtctggggccgggagaatga

SEQ ID NO: 700343 - DNA, 20 bp, mouse
gcggcctgggcggggtcact

SEQ ID NO: 700344 - DNA, 20 bp, mouse
ggctcctcctctgccagatc

SEQ ID NO: 700345 - DNA, 20 bp, mouse
ggcggagacttgatgcaatt

SEQ ID NO: 700346 - DNA, 20 bp, mouse
gagccaaatggatacgagaa

SEQ ID NO: 700347 - DNA, 20 bp, mouse
gtctcctggcctctcatagc

SEQ ID NO: 700348 - DNA, 20 bp, mouse
gcaaatggatacgagaaggg

SEQ ID NO: 700349 - DNA, 20 bp, mouse
gccaggaagccagctatgag

SEQ ID NO: 700350 - DNA, 20 bp, mouse
gccaatggcctccacgtact

SEQ ID NO: 700351 - DNA, 20 bp, mouse
gaagccagctatgagaggcc

SEQ ID NO: 700352 - DNA, 20 bp, mouse
gtctcagcggcggggagcgt

SEQ ID NO: 700353 - DNA, 20 bp, mouse
gtggctctttttgggagagg

SEQ ID NO: 700354 - DNA, 20 bp, mouse
gcccctcagagattggtgtg

SEQ ID NO: 700355 - DNA, 20 bp, mouse
gaggctgcggaaggggtatc

SEQ ID NO: 700356 - DNA, 20 bp, mouse
gccactaggaaggaggggta

SEQ ID NO: 700357 - DNA, 20 bp, mouse
gccctccagggagcaggggt

SEQ ID NO: 700358 - DNA, 20 bp, mouse
gtggggacactggtgaattg

SEQ ID NO: 700359 - DNA, 20 bp, mouse
gtcaccccttgccactagga

SEQ ID NO: 700360 - DNA, 20 bp, mouse
gagctgcaggtaccgagctg

SEQ ID NO: 700361 - DNA, 20 bp, mouse
ggctgctgaccctgaggaag

SEQ ID NO: 700362 - DNA, 20 bp, mouse
gggggtaaggctgtgaacag

SEQ ID NO: 700363 - DNA, 20 bp, mouse
gagcctccctccagggagca

SEQ ID NO: 700364 - DNA, 20 bp, mouse
gcccgccctcaggtttgatg

SEQ ID NO: 700365 - DNA, 20 bp, mouse
ggggtggtgtggtcagctat

SEQ ID NO: 700366 - DNA, 20 bp, mouse
gggcccgcgccggcacaatg

SEQ ID NO: 700367 - DNA, 20 bp, mouse
ggggaggcactcaatactgt

SEQ ID NO: 700368 - DNA, 20 bp, mouse
gtccggccgcgccccgaggg

SEQ ID NO: 700369 - DNA, 20 bp, mouse
gggcgggcgcccagacggag

SEQ ID NO: 700370 - DNA, 20 bp, mouse
gaccctgagccgccagaagg

SEQ ID NO: 700371 - DNA, 20 bp, mouse
gcggggcgttttctacgcga

SEQ ID NO: 700372 - DNA, 20 bp, mouse
gccaaccctgagccgccaga

SEQ ID NO: 700373 - DNA, 20 bp, mouse
gccggcacaatgaggatgcg

SEQ ID NO: 700374 - DNA, 20 bp, mouse
ggggctgcgggttcagtcca

SEQ ID NO: 700375 - DNA, 20 bp, mouse
gcagatgcgcgccccagcct

SEQ ID NO: 700376 - DNA, 20 bp, mouse
gacccagcccgagacagcgt

SEQ ID NO: 700377 - DNA, 20 bp, mouse
gcacaagctgtgtaaggata

SEQ ID NO: 700378 - DNA, 20 bp, mouse
gtaacagagggtctgaactg

SEQ ID NO: 700379 - DNA, 20 bp, mouse
ggagacagaggcctgcaatg

SEQ ID NO: 700380 - DNA, 20 bp, mouse
gtacgtgttgaggactcaag

SEQ ID NO: 700381 - DNA, 20 bp, mouse
gcatcttcccacgctgtctc

SEQ ID NO: 700382 - DNA, 20 bp, mouse
ggcagggcaagcgccagttc

SEQ ID NO: 700383 - DNA, 20 bp, mouse
gactggggagggatcaagtc

SEQ ID NO: 700384 - DNA, 20 bp, mouse
gtcgggctgggtgcccagaa

SEQ ID NO: 700385 - DNA, 20 bp, mouse
gacacgtaagagcccagaac

SEQ ID NO: 700386 - DNA, 20 bp, mouse
gacccagcccgagacagcgt

SEQ ID NO: 700387 - DNA, 20 bp, mouse
gcacaagctgtgtaaggata

SEQ ID NO: 700388 - DNA, 20 bp, mouse
gtattggggtcaagcctatt

SEQ ID NO: 700389 - DNA, 20 bp, mouse
ggaggtgcagacaatctatt

SEQ ID NO: 700390 - DNA, 20 bp, mouse
ggagacagaggcctgcaatg

SEQ ID NO: 700391 - DNA, 20 bp, mouse
gtaacagagggtctgaactg

SEQ ID NO: 700392 - DNA, 20 bp, mouse
gtgtagaggtgcacccccac

SEQ ID NO: 700393 - DNA, 20 bp, mouse
gaggtgcacccccacaggta

SEQ ID NO: 700394 - DNA, 20 bp, mouse
gcatcttcccacgctgtctc

SEQ ID NO: 700395 - DNA, 20 bp, mouse
gggggtgcacctctacagtg

SEQ ID NO: 700396 - DNA, 20 bp, mouse
gacactgtgtgtcgtggggt

SEQ ID NO: 700397 - DNA, 20 bp, mouse
ggatctacgctgctcactgg

SEQ ID NO: 700398 - DNA, 20 bp, mouse
gaccgcgcaggtgacgccag

SEQ ID NO: 700399 - DNA, 20 bp, mouse
ggactgacacttgacagtgg

SEQ ID NO: 700400 - DNA, 20 bp, mouse
ggggactgctgtacactaat

SEQ ID NO: 700401 - DNA, 20 bp, mouse
ggtggatctacgctgctcac

SEQ ID NO: 700402 - DNA, 20 bp, mouse
gtagtgcacagagacgtgcc

SEQ ID NO: 700403 - DNA, 20 bp, mouse
gggggtgtctggtttgtatt

SEQ ID NO: 700404 - DNA, 20 bp, mouse
gcacagagacgtgcctggcg

SEQ ID NO: 700405 - DNA, 20 bp, mouse
gcacttgacagtggaggttg

SEQ ID NO: 700406 - DNA, 20 bp, mouse
gaatgaaaagggctaggcat

SEQ ID NO: 700407 - DNA, 20 bp, mouse
gagggaggagggttggactc

SEQ ID NO: 700408 - DNA, 20 bp, mouse
gcatgggccccctgggtttg

SEQ ID NO: 700409 - DNA, 20 bp, mouse
gaattccaccgtggccaggg

SEQ ID NO: 700410 - DNA, 20 bp, mouse
ggggtctgcactcctaaatc

SEQ ID NO: 700411 - DNA, 20 bp, mouse
gggtctgaatgaaaagggct

SEQ ID NO: 700412 - DNA, 20 bp, mouse
gagtggggagggcacgtggg

SEQ ID NO: 700413 - DNA, 20 bp, mouse
ggcctggacggatgatgcaa

SEQ ID NO: 700414 - DNA, 20 bp, mouse
gtgggggggtctttccaaca

SEQ ID NO: 700415 - DNA, 20 bp, mouse
gctcctaaatctggaggagg

SEQ ID NO: 700416 - DNA, 20 bp, mouse
ggggggcgggtacaggtgca

SEQ ID NO: 700417 - DNA, 20 bp, mouse
ggggcctcgactccaattgc

SEQ ID NO: 700418 - DNA, 20 bp, mouse
gctcctggttgtccctagtc

SEQ ID NO: 700419 - DNA, 20 bp, mouse
ggtccggttgtcaccaaggg

SEQ ID NO: 700420 - DNA, 20 bp, mouse
gcgccccccttggtgacaac

SEQ ID NO: 700421 - DNA, 20 bp, mouse
gcccccacgcgtccattgga

SEQ ID NO: 700422 - DNA, 20 bp, mouse
gagcccacagaacccgcaat

SEQ ID NO: 700423 - DNA, 20 bp, mouse
gactccaattgcgggttctg

SEQ ID NO: 700424 - DNA, 20 bp, mouse
gctagtccggttgtcaccaa

SEQ ID NO: 700425 - DNA, 20 bp, mouse
ggttccagctgcacggtcgg

SEQ ID NO: 700426 - DNA, 20 bp, mouse
gcggaaggcgcgtcagttcc

SEQ ID NO: 700427 - DNA, 20 bp, mouse
ggcactggcttgaaattgag

SEQ ID NO: 700428 - DNA, 20 bp, mouse
gcccaggaagggtgttaggt

SEQ ID NO: 700429 - DNA, 20 bp, mouse
ggaaaaagcccagacttctt

SEQ ID NO: 700430 - DNA, 20 bp, mouse
gcaggtcaacaaatgaccca

SEQ ID NO: 700431 - DNA, 20 bp, mouse
gcccacacatcattcactta

SEQ ID NO: 700432 - DNA, 20 bp, mouse
gcccataagtgaatgatgtg

SEQ ID NO: 700433 - DNA, 20 bp, mouse
gtggtggtgtgacatcaagc

SEQ ID NO: 700434 - DNA, 20 bp, mouse
gcttccatcaggaagtgtga

SEQ ID NO: 700435 - DNA, 20 bp, mouse
gcaaaagttatctgtgaccc

SEQ ID NO: 700436 - DNA, 20 bp, mouse
gaaacacgacccccattcct

SEQ ID NO: 700437 - DNA, 20 bp, mouse
gcggaggagcggcggcccga

SEQ ID NO: 700438 - DNA, 20 bp, mouse
gagggcgcacggcggaggag

SEQ ID NO: 700439 - DNA, 20 bp, mouse
gaaaaggcggccgtggtccc

SEQ ID NO: 700440 - DNA, 20 bp, mouse
gggctcagggcgcacggcgg

SEQ ID NO: 700441 - DNA, 20 bp, mouse
gagcggcggcccgacggctc

SEQ ID NO: 700442 - DNA, 20 bp, mouse
gcggcccgacggctctggcc

SEQ ID NO: 700443 - DNA, 20 bp, mouse
gtcgcctgcgcacagctccc

SEQ ID NO: 700444 - DNA, 20 bp, mouse
gaattttcacccaggaatgg

SEQ ID NO: 700445 - DNA, 20 bp, mouse
ggcgcccccgccagggacca

SEQ ID NO: 700446 - DNA, 20 bp, mouse
gggggcggagccaagagtaa

SEQ ID NO: 700447 - DNA, 20 bp, mouse
gaggcccgcgcctcctcccc

SEQ ID NO: 700448 - DNA, 20 bp, mouse
ggagccaagagtaaggggtt

SEQ ID NO: 700449 - DNA, 20 bp, mouse
ggccaaggggcgggatcaac

SEQ ID NO: 700450 - DNA, 20 bp, mouse
gcggggcaggcgagtaggag

SEQ ID NO: 700451 - DNA, 20 bp, mouse
gaacaggttcgagtgcgggg

SEQ ID NO: 700452 - DNA, 20 bp, mouse
gtgggaggcaagtcacactg

SEQ ID NO: 700453 - DNA, 20 bp, mouse
ggaccccaaccccttactct

SEQ ID NO: 700454 - DNA, 20 bp, mouse
gcgcctgccccgcggggcgt

SEQ ID NO: 700455 - DNA, 20 bp, mouse
gggaggtagggcacgatcgg

SEQ ID NO: 700456 - DNA, 20 bp, mouse
gaggagggagatgcgatccc

SEQ ID NO: 700457 - DNA, 20 bp, mouse
ggtcccgggggcagcttctg

SEQ ID NO: 700458 - DNA, 20 bp, mouse
gcggtcgcagccagcgtccc

SEQ ID NO: 700459 - DNA, 20 bp, mouse
ggagatgcgatcccgggagt

SEQ ID NO: 700460 - DNA, 20 bp, mouse
ggggtgaggggaagcttcgc

SEQ ID NO: 700461 - DNA, 20 bp, mouse
gcgatcccgggagtgggagg

SEQ ID NO: 700462 - DNA, 20 bp, mouse
gccagcgccgagatccgctc

SEQ ID NO: 700463 - DNA, 20 bp, mouse
gtagcctcggggaagggaga

SEQ ID NO: 700464 - DNA, 20 bp, mouse
gctcacggccggtacgggga

SEQ ID NO: 700465 - DNA, 20 bp, mouse
ggaagctgcccccgggacgc

SEQ ID NO: 700466 - DNA, 20 bp, mouse
gggcccagctcacttaccca

SEQ ID NO: 700467 - DNA, 20 bp, mouse
ggtggctctcagaatccctg

SEQ ID NO: 700468 - DNA, 20 bp, mouse
gttagcagagagcatctctg

SEQ ID NO: 700469 - DNA, 20 bp, mouse
gagagagcatctctgcggga

SEQ ID NO: 700470 - DNA, 20 bp, mouse
gcctctagctggaatgacag

SEQ ID NO: 700471 - DNA, 20 bp, mouse
ggccacccaggacccaaatt

SEQ ID NO: 700472 - DNA, 20 bp, mouse
ggaatccctggggactggag

SEQ ID NO: 700473 - DNA, 20 bp, mouse
gagctgggccggctgacgtc

SEQ ID NO: 700474 - DNA, 20 bp, mouse
ggggccggctgacgtcaggg

SEQ ID NO: 700475 - DNA, 20 bp, mouse
gtcagggtggtgatgggtga

SEQ ID NO: 700476 - DNA, 20 bp, mouse
gggagctgtggacacggctt

SEQ ID NO: 700477 - DNA, 20 bp, mouse
gctgttgagtggtcgtaagg

SEQ ID NO: 700478 - DNA, 20 bp, mouse
gacactgttgagtggtcgta

SEQ ID NO: 700479 - DNA, 20 bp, mouse
gtggtcgtaagggggagctg

SEQ ID NO: 700480 - DNA, 20 bp, mouse
gtcggcttaaatccacaagt

SEQ ID NO: 700481 - DNA, 20 bp, mouse
gcaagtgggcattcacgctg

SEQ ID NO: 700482 - DNA, 20 bp, mouse
gcctgaaagcaggtatccct

SEQ ID NO: 700483 - DNA, 20 bp, mouse
gaggcttgtacactgttgag

SEQ ID NO: 700484 - DNA, 20 bp, mouse
gtgtctaaaacagcagaatt

SEQ ID NO: 700485 - DNA, 20 bp, mouse
gggaggaggttggtaagtga

SEQ ID NO: 700486 - DNA, 20 bp, mouse
gggagcccgcacccccggct

SEQ ID NO: 700487 - DNA, 20 bp, mouse
gcggggcggcgggcagagca

SEQ ID NO: 700488 - DNA, 20 bp, mouse
gggcgccgcaccggccgcga

SEQ ID NO: 700489 - DNA, 20 bp, mouse
gcggccccagcgcccagccg

SEQ ID NO: 700490 - DNA, 20 bp, mouse
gggtaacgggcctgtggggt

SEQ ID NO: 700491 - DNA, 20 bp, mouse
gggtccctagacccctcccc

SEQ ID NO: 700492 - DNA, 20 bp, mouse
ggcgggcagagcagggattg

SEQ ID NO: 700493 - DNA, 20 bp, mouse
ggccccgcgctcccccctcg

SEQ ID NO: 700494 - DNA, 20 bp, mouse
gcgagcaggcgggagggtaa

SEQ ID NO: 700495 - DNA, 20 bp, mouse
gtcccccctcgcggccggtg

SEQ ID NO: 700496 - DNA, 20 bp, mouse
ggcagagcgcgggacttctc

SEQ ID NO: 700497 - DNA, 20 bp, mouse
ggctagagacgcagggtcag

SEQ ID NO: 700498 - DNA, 20 bp, mouse
gccactctgcgcgccggcgg

SEQ ID NO: 700499 - DNA, 20 bp, mouse
ggagacgcggtgccagagac

SEQ ID NO: 700500 - DNA, 20 bp, mouse
gtcttgtggccgaatgtctt

SEQ ID NO: 700501 - DNA, 20 bp, mouse
gtctgccgcaggccgggcac

SEQ ID NO: 700502 - DNA, 20 bp, mouse
gagcgcgggacttctccggg

SEQ ID NO: 700503 - DNA, 20 bp, mouse
gcccgcctgtgcccggcctg

SEQ ID NO: 700504 - DNA, 20 bp, mouse
gttctccgggaggacgacct

SEQ ID NO: 700505 - DNA, 20 bp, mouse
gtctccggcgtctctaaagc

SEQ ID NO: 700506 - DNA, 20 bp, mouse
ggggtggaatccaatggctg

SEQ ID NO: 700507 - DNA, 20 bp, mouse
gagtcctggagggaaggtac

SEQ ID NO: 700508 - DNA, 20 bp, mouse
gagaaagatcgctgctggat

SEQ ID NO: 700509 - DNA, 20 bp, mouse
gcctcccagccacacccctc

SEQ ID NO: 700510 - DNA, 20 bp, mouse
gggtactgggtggaatccaa

SEQ ID NO: 700511 - DNA, 20 bp, mouse
ggaaaggcactagaggaaat

SEQ ID NO: 700512 - DNA, 20 bp, mouse
gcaggactggctctccctga

SEQ ID NO: 700513 - DNA, 20 bp, mouse
ggatcgctgctggatgggaa

SEQ ID NO: 700514 - DNA, 20 bp, mouse
gaatcggtgggccccagggg

SEQ ID NO: 700515 - DNA, 20 bp, mouse
gtctccctgaggggtgtggc

SEQ ID NO: 700516 - DNA, 20 bp, mouse
gaaactgagttggatctctg

SEQ ID NO: 700517 - DNA, 20 bp, mouse
gcgggccctacaaactgagt

SEQ ID NO: 700518 - DNA, 20 bp, mouse
gacccgcgtgcagaagcacg

SEQ ID NO: 700519 - DNA, 20 bp, mouse
gtccgcgtgcttctgcacgc

SEQ ID NO: 700520 - DNA, 20 bp, mouse
ggtctgggaggggcatgaag

SEQ ID NO: 700521 - DNA, 20 bp, mouse
gaaaacctgcaaatagcatc

SEQ ID NO: 700522 - DNA, 20 bp, mouse
gtgaatgaacctgttatcaa

SEQ ID NO: 700523 - DNA, 20 bp, mouse
gctcccagacttctctcagt

SEQ ID NO: 700524 - DNA, 20 bp, mouse
gaacctactgagagaagtct

SEQ ID NO: 700525 - DNA, 20 bp, mouse
gcttctgtcccattgataac

SEQ ID NO: 700526 - DNA, 20 bp, mouse
ggcccagcaggcaactgcaa

SEQ ID NO: 700527 - DNA, 20 bp, mouse
gtacacacagtctgaaattc

SEQ ID NO: 700528 - DNA, 20 bp, mouse
gagatcagcgatttggggac

SEQ ID NO: 700529 - DNA, 20 bp, mouse
gtgtgtagatcagcgatttg

SEQ ID NO: 700530 - DNA, 20 bp, mouse
gtgaaattcgggcgccctcc

SEQ ID NO: 700531 - DNA, 20 bp, mouse
ggtgcctggctataattttg

SEQ ID NO: 700532 - DNA, 20 bp, mouse
ggaggaggtgggactagcgc

SEQ ID NO: 700533 - DNA, 20 bp, mouse
gtgctcgctccaggcttctc

SEQ ID NO: 700534 - DNA, 20 bp, mouse
gctgcagccccggagaagcc

SEQ ID NO: 700535 - DNA, 20 bp, mouse
gtgaaagctggtgatttcta

SEQ ID NO: 700536 - DNA, 20 bp, mouse
gcggcggggtctgctgtctc

SEQ ID NO: 700537 - DNA, 20 bp, mouse
gccccgccgccgagcaaaac

SEQ ID NO: 700538 - DNA, 20 bp, mouse
gttaagccggttttgctcgg

SEQ ID NO: 700539 - DNA, 20 bp, mouse
gagcttaagccggttttgct

SEQ ID NO: 700540 - DNA, 20 bp, mouse
gagccggttttgctcggcgg

SEQ ID NO: 700541 - DNA, 20 bp, mouse
gtgaccccgccccgtgtcca

SEQ ID NO: 700542 - DNA, 20 bp, mouse
gacgcggggaagaagaccta

SEQ ID NO: 700543 - DNA, 20 bp, mouse
ggggcggagccatggacacg

SEQ ID NO: 700544 - DNA, 20 bp, mouse
gcggagccatggacacgggg

SEQ ID NO: 700545 - DNA, 20 bp, mouse
gtcagcgtgtcgtttatggg

SEQ ID NO: 700546 - DNA, 20 bp, mouse
gtaccggcccggactggagg

SEQ ID NO: 700547 - DNA, 20 bp, mouse
gccgtggcttagtactttgt

SEQ ID NO: 700548 - DNA, 20 bp, mouse
gggctaccggcccggactgg

SEQ ID NO: 700549 - DNA, 20 bp, mouse
gcccggactggaggcggaga

SEQ ID NO: 700550 - DNA, 20 bp, mouse
ggagcaaaaccttgagaggg

SEQ ID NO: 700551 - DNA, 20 bp, mouse
gcactctcgcgtgttttccg

SEQ ID NO: 700552 - DNA, 20 bp, mouse
gtggccgttgattggagaac

SEQ ID NO: 700553 - DNA, 20 bp, mouse
gaggccccacccccggtaaa

SEQ ID NO: 700554 - DNA, 20 bp, mouse
gtaaacggctggccgttgat

SEQ ID NO: 700555 - DNA, 20 bp, mouse
ggtccgggccggtagcccct

SEQ ID NO: 700556 - DNA, 20 bp, mouse
ggggcccctcgcctgcctgg

SEQ ID NO: 700557 - DNA, 20 bp, mouse
gtgcggctgctaggcttcgg

SEQ ID NO: 700558 - DNA, 20 bp, mouse
ggccccgccgcgctgcccgc

SEQ ID NO: 700559 - DNA, 20 bp, mouse
gggcgccgccgtccaggaaa

SEQ ID NO: 700560 - DNA, 20 bp, mouse
ggacacccgccaggcaggcg

SEQ ID NO: 700561 - DNA, 20 bp, mouse
gaaacggctcgggtttcagc

SEQ ID NO: 700562 - DNA, 20 bp, mouse
gggaagcagcggatgttcgt

SEQ ID NO: 700563 - DNA, 20 bp, mouse
ggcggcgaggggagagagcc

SEQ ID NO: 700564 - DNA, 20 bp, mouse
gcagaggccgttcaccaaca

SEQ ID NO: 700565 - DNA, 20 bp, mouse
ggggcgtgacccgcccgagg

SEQ ID NO: 700566 - DNA, 20 bp, mouse
gggcgccgggcggtcccaga

SEQ ID NO: 700567 - DNA, 20 bp, mouse
gaagaggcgtggtcaggcgg

SEQ ID NO: 700568 - DNA, 20 bp, mouse
ggggcggagcaggcgaggca

SEQ ID NO: 700569 - DNA, 20 bp, mouse
gcccctggccgccggggaag

SEQ ID NO: 700570 - DNA, 20 bp, mouse
ggatccgaagaggcgtggtc

SEQ ID NO: 700571 - DNA, 20 bp, mouse
ggggggcgggagatccgaag

SEQ ID NO: 700572 - DNA, 20 bp, mouse
ggagctcggcattgcttcaa

SEQ ID NO: 700573 - DNA, 20 bp, mouse
gctgggctcccacgccctct

SEQ ID NO: 700574 - DNA, 20 bp, mouse
gcccttgagcacagctttat

SEQ ID NO: 700575 - DNA, 20 bp, mouse
gcgcctgctccgccccagct

SEQ ID NO: 700576 - DNA, 20 bp, mouse
ggccccggaacgactgagac

SEQ ID NO: 700577 - DNA, 20 bp, mouse
gtggcggcggcgcactgggg

SEQ ID NO: 700578 - DNA, 20 bp, mouse
ggccccacgtccaacctgca

SEQ ID NO: 700579 - DNA, 20 bp, mouse
gtggcactcaccaggctctc

SEQ ID NO: 700580 - DNA, 20 bp, mouse
ggctcccgcactagggtacc

SEQ ID NO: 700581 - DNA, 20 bp, mouse
ggggcgatccagtcccaacg

SEQ ID NO: 700582 - DNA, 20 bp, mouse
gagaccttgcaggttggacg

SEQ ID NO: 700583 - DNA, 20 bp, mouse
gtagtgcgggagctccccgt

SEQ ID NO: 700584 - DNA, 20 bp, mouse
gagaggcgtggtccgagacc

SEQ ID NO: 700585 - DNA, 20 bp, mouse
ggggagctccccgttgggac

SEQ ID NO: 700586 - DNA, 20 bp, mouse
gagcctggcgggcacgtgtg

SEQ ID NO: 700587 - DNA, 20 bp, mouse
gaagggcagaagcactgcga

SEQ ID NO: 700588 - DNA, 20 bp, mouse
gggggagccgccagcctgaa

SEQ ID NO: 700589 - DNA, 20 bp, mouse
gtcccagagcccaggggcgg

SEQ ID NO: 700590 - DNA, 20 bp, mouse
gggaggggcggggaacgggg

SEQ ID NO: 700591 - DNA, 20 bp, mouse
gggagcaaagtttcggggag

SEQ ID NO: 700592 - DNA, 20 bp, mouse
gtccccggagcgcgcccagt

SEQ ID NO: 700593 - DNA, 20 bp, mouse
ggcgggggcgcggcgaggca

SEQ ID NO: 700594 - DNA, 20 bp, mouse
ggggctccgcggccatcagc

SEQ ID NO: 700595 - DNA, 20 bp, mouse
gcgcgcgttcccagagccca

SEQ ID NO: 700596 - DNA, 20 bp, mouse
ggggtctgaggagacaggtt

SEQ ID NO: 700597 - DNA, 20 bp, mouse
gggggggggtgctgctccga

SEQ ID NO: 700598 - DNA, 20 bp, mouse
gggtggctggaactggtcac

SEQ ID NO: 700599 - DNA, 20 bp, mouse
gggtttaagctcctcccttt

SEQ ID NO: 700600 - DNA, 20 bp, mouse
gcaaaagccagcaaaacagg

SEQ ID NO: 700601 - DNA, 20 bp, mouse
gtcagtctgggcgggactaa

SEQ ID NO: 700602 - DNA, 20 bp, mouse
gaaacctgtgcgcaaaatct

SEQ ID NO: 700603 - DNA, 20 bp, mouse
gggctctcactcgtgctctg

SEQ ID NO: 700604 - DNA, 20 bp, mouse
ggataagcttggtttgttgt

SEQ ID NO: 700605 - DNA, 20 bp, mouse
ggtctgggcgggactaaggg

SEQ ID NO: 700606 - DNA, 20 bp, mouse
gccactgtactgtaagtctt

SEQ ID NO: 700607 - DNA, 20 bp, mouse
gccctccagcaacccttgta

SEQ ID NO: 700608 - DNA, 20 bp, mouse
gctagccaacctacagtatg

SEQ ID NO: 700609 - DNA, 20 bp, mouse
gaggttagctggcgctcaga

SEQ ID NO: 700610 - DNA, 20 bp, mouse
ggacttacagtacagtgggg

SEQ ID NO: 700611 - DNA, 20 bp, mouse
ggagcagggctcacaagtac

SEQ ID NO: 700612 - DNA, 20 bp, mouse
gttgaaacgggcaccgtgaa

SEQ ID NO: 700613 - DNA, 20 bp, mouse
gtgagcaccaggattgctat

SEQ ID NO: 700614 - DNA, 20 bp, mouse
gtggaggggctggactgaag

SEQ ID NO: 700615 - DNA, 20 bp, mouse
gtccaccacatactgtaggt

SEQ ID NO: 700616 - DNA, 20 bp, mouse
gtaggtaagcaggggagatg

SEQ ID NO: 700617 - DNA, 20 bp, mouse
gagactgaagtgcgcagtac

SEQ ID NO: 700618 - DNA, 20 bp, mouse
gctcccctgcttacctaaac

SEQ ID NO: 700619 - DNA, 20 bp, mouse
gcaggactattcactcttat

SEQ ID NO: 700620 - DNA, 20 bp, mouse
gtctcccacatgctctaaga

SEQ ID NO: 700621 - DNA, 20 bp, mouse
ggagcatgtgggagacttgc

SEQ ID NO: 700622 - DNA, 20 bp, mouse
gaatccggtttaggtaagca

SEQ ID NO: 700623 - DNA, 20 bp, mouse
gctattcactcttataggag

SEQ ID NO: 700624 - DNA, 20 bp, mouse
ggccacaggtaaatctggat

SEQ ID NO: 700625 - DNA, 20 bp, mouse
gtcaccatcttagagcatgt

SEQ ID NO: 700626 - DNA, 20 bp, mouse
gaggcaggcaaagttgactc

SEQ ID NO: 700627 - DNA, 20 bp, mouse
gttccccattatttgattag

SEQ ID NO: 700628 - DNA, 20 bp, mouse
gcctgcctctaatcaaataa

SEQ ID NO: 700629 - DNA, 20 bp, mouse
ggatttcctcatgttgtttc

SEQ ID NO: 700630 - DNA, 20 bp, mouse
gtgtaaggcaaagtttcaga

SEQ ID NO: 700631 - DNA, 20 bp, mouse
gatgaggaaatcagttttac

SEQ ID NO: 700632 - DNA, 20 bp, mouse
gaataaaatgtcctgcacgg

SEQ ID NO: 700633 - DNA, 20 bp, mouse
gataagagtattggggccag

SEQ ID NO: 700634 - DNA, 20 bp, mouse
gggatgaacacaactataaa

SEQ ID NO: 700635 - DNA, 20 bp, mouse
gtcagatggctttgactttt

SEQ ID NO: 700636 - DNA, 20 bp, mouse
gtggctggctgcgcttgctg

SEQ ID NO: 700637 - DNA, 20 bp, mouse
gacagtctcagacgccacac

SEQ ID NO: 700638 - DNA, 20 bp, mouse
gcacaatagaatgcctgccg

SEQ ID NO: 700639 - DNA, 20 bp, mouse
gccactagtggggaaagagt

SEQ ID NO: 700640 - DNA, 20 bp, mouse
gagacgccacacaggaggag

SEQ ID NO: 700641 - DNA, 20 bp, mouse
gaatgcgtggcacccacggc

SEQ ID NO: 700642 - DNA, 20 bp, mouse
gaactcagaacgcctgagtc

SEQ ID NO: 700643 - DNA, 20 bp, mouse
gggagatgacagcatttggc

SEQ ID NO: 700644 - DNA, 20 bp, mouse
gatacaatgcgtggcaccca

SEQ ID NO: 700645 - DNA, 20 bp, mouse
gaatgcgcccgcccttttct

SEQ ID NO: 700646 - DNA, 20 bp, mouse
gcgccccagctccttcccaa

SEQ ID NO: 700647 - DNA, 20 bp, mouse
gcccacttcccgctgtggat

SEQ ID NO: 700648 - DNA, 20 bp, mouse
gtggggcgcagggacagcgc

SEQ ID NO: 700649 - DNA, 20 bp, mouse
ggggaaggagctggggcgca

SEQ ID NO: 700650 - DNA, 20 bp, mouse
gtggctcccacttcccgctg

SEQ ID NO: 700651 - DNA, 20 bp, mouse
gcctacctaggagatgagtg

SEQ ID NO: 700652 - DNA, 20 bp, mouse
gtgggggcccctcctggctt

SEQ ID NO: 700653 - DNA, 20 bp, mouse
gtactagagtgggataccaa

SEQ ID NO: 700654 - DNA, 20 bp, mouse
ggcccctactacctactctg

SEQ ID NO: 700655 - DNA, 20 bp, mouse
gcctccccagagtaggtagt

SEQ ID NO: 700656 - DNA, 20 bp, mouse
gctagtgcggaaggaatcat

SEQ ID NO: 700657 - DNA, 20 bp, mouse
gggttcacgggaaactagtg

SEQ ID NO: 700658 - DNA, 20 bp, mouse
gggggcgggttgccttccct

SEQ ID NO: 700659 - DNA, 20 bp, mouse
gtggccaataataactaatg

SEQ ID NO: 700660 - DNA, 20 bp, mouse
gcatactacaggcccaggga

SEQ ID NO: 700661 - DNA, 20 bp, mouse
gctgctaggaggcaggaaac

SEQ ID NO: 700662 - DNA, 20 bp, mouse
gcacgggaaactagtgcgga

SEQ ID NO: 700663 - DNA, 20 bp, mouse
gggccggaatctgacgtatt

SEQ ID NO: 700664 - DNA, 20 bp, mouse
gcggaatctgacgtattagg

SEQ ID NO: 700665 - DNA, 20 bp, mouse
gccaataataactaatgggg

SEQ ID NO: 700666 - DNA, 20 bp, mouse
gacacgggcgggagagaaag

SEQ ID NO: 700667 - DNA, 20 bp, mouse
ggaggggcgtggccttgcgg

SEQ ID NO: 700668 - DNA, 20 bp, mouse
gaggacgcctcatttcctag

SEQ ID NO: 700669 - DNA, 20 bp, mouse
ggcgacgcacgtacacaggc

SEQ ID NO: 700670 - DNA, 20 bp, mouse
gtgatcaagacgttgtggag

SEQ ID NO: 700671 - DNA, 20 bp, mouse
ggcgcgcgcgggtaggagtc

SEQ ID NO: 700672 - DNA, 20 bp, mouse
gcgtcgccatgacaacgtgg

SEQ ID NO: 700673 - DNA, 20 bp, mouse
gtcgggtatgactgtatttc

SEQ ID NO: 700674 - DNA, 20 bp, mouse
gcatgacaacgtggcgggcg

SEQ ID NO: 700675 - DNA, 20 bp, mouse
gggagagagaacgctgcatg

SEQ ID NO: 700676 - DNA, 20 bp, mouse
gatccctagcagggacagta

SEQ ID NO: 700677 - DNA, 20 bp, mouse
gacagtagggacaaccctcc

SEQ ID NO: 700678 - DNA, 20 bp, mouse
ggggacaaccctcccgggaa

SEQ ID NO: 700679 - DNA, 20 bp, mouse
gccacgcaggatccctagca

SEQ ID NO: 700680 - DNA, 20 bp, mouse
ggccagccgcgaaacccctg

SEQ ID NO: 700681 - DNA, 20 bp, mouse
gggagagtgcggggcactca

SEQ ID NO: 700682 - DNA, 20 bp, mouse
gcagtctcggaccatctcag

SEQ ID NO: 700683 - DNA, 20 bp, mouse
ggccccgcactctccagtct

SEQ ID NO: 700684 - DNA, 20 bp, mouse
gggtccgagactggagagtg

SEQ ID NO: 700685 - DNA, 20 bp, mouse
gtgggcggggaagcttggac

SEQ ID NO: 700686 - DNA, 20 bp, mouse
ggctgggcgggcaaccacag

SEQ ID NO: 700687 - DNA, 20 bp, mouse
ggggagcccggagctggcga

SEQ ID NO: 700688 - DNA, 20 bp, mouse
gagtctcgggagcccggagc

SEQ ID NO: 700689 - DNA, 20 bp, mouse
gctcagtggcggtgctgttc

SEQ ID NO: 700690 - DNA, 20 bp, mouse
ggcgagggcgagctcagtgg

SEQ ID NO: 700691 - DNA, 20 bp, mouse
ggtgctgttcgggttgaagg

SEQ ID NO: 700692 - DNA, 20 bp, mouse
gcagccccgagctggtcttc

SEQ ID NO: 700693 - DNA, 20 bp, mouse
gagctcgccctcgccagctc

SEQ ID NO: 700694 - DNA, 20 bp, mouse
ggcggcggctttcgagtctc

SEQ ID NO: 700695 - DNA, 20 bp, mouse
ggcggtgctgttcgggttga

SEQ ID NO: 700696 - DNA, 20 bp, mouse
gaagctgagtgaggaggtta

SEQ ID NO: 700697 - DNA, 20 bp, mouse
gtctctacagataaaggcag

SEQ ID NO: 700698 - DNA, 20 bp, mouse
gcggggcgaaaccgctctcg

SEQ ID NO: 700699 - DNA, 20 bp, mouse
ggtaaacaatgatgctatgc

SEQ ID NO: 700700 - DNA, 20 bp, mouse
gaggagcaagctgagtgagg

SEQ ID NO: 700701 - DNA, 20 bp, mouse
gaacgtaaatatgcacacag

SEQ ID NO: 700702 - DNA, 20 bp, mouse
gaaaggctggagtgaagggt

SEQ ID NO: 700703 - DNA, 20 bp, mouse
gggtctgtggtagagatgta

SEQ ID NO: 700704 - DNA, 20 bp, mouse
ggggttcaataggtcagaat

SEQ ID NO: 700705 - DNA, 20 bp, mouse
gggcgaaaccgctctcgcgg

SEQ ID NO: 700706 - DNA, 20 bp, mouse
gtaaggggcgggagccaagg

SEQ ID NO: 700707 - DNA, 20 bp, mouse
gagactacgctgtaccaatc

SEQ ID NO: 700708 - DNA, 20 bp, mouse
gctgacatttggttcccgat

SEQ ID NO: 700709 - DNA, 20 bp, mouse
gcccacagcaacctgcggta

SEQ ID NO: 700710 - DNA, 20 bp, mouse
gagcaacctgcggtaagggg

SEQ ID NO: 700711 - DNA, 20 bp, mouse
ggcaaaggaacgtactgaat

SEQ ID NO: 700712 - DNA, 20 bp, mouse
gggctcccgccccttaccgc

SEQ ID NO: 700713 - DNA, 20 bp, mouse
gacacttcttagagcatcta

SEQ ID NO: 700714 - DNA, 20 bp, mouse
gggcacagaaagactgtgat

SEQ ID NO: 700715 - DNA, 20 bp, mouse
gactgtgatgggatttcgtt

SEQ ID NO: 700716 - DNA, 20 bp, mouse
ggatccaagggagaagaata

SEQ ID NO: 700717 - DNA, 20 bp, mouse
gccacatagaaagtcatccc

SEQ ID NO: 700718 - DNA, 20 bp, mouse
gactttctatgtggcctttc

SEQ ID NO: 700719 - DNA, 20 bp, mouse
gccctggaccggaataaaat

SEQ ID NO: 700720 - DNA, 20 bp, mouse
ggctacatataaatacctgt

SEQ ID NO: 700721 - DNA, 20 bp, mouse
gaaggttgtgatctcagggg

SEQ ID NO: 700722 - DNA, 20 bp, mouse
ggggccctattcttctccct

SEQ ID NO: 700723 - DNA, 20 bp, mouse
gtctggctctgaagctaatt

SEQ ID NO: 700724 - DNA, 20 bp, mouse
gtagaaagtcatccctggac

SEQ ID NO: 700725 - DNA, 20 bp, mouse
gattaaggttgtgatctcag

SEQ ID NO: 700726 - DNA, 20 bp, mouse
gactcggcgggggttctcga

SEQ ID NO: 700727 - DNA, 20 bp, mouse
gcaggggaacagacgacgac

SEQ ID NO: 700728 - DNA, 20 bp, mouse
gcccaagggcgaaatgacat

SEQ ID NO: 700729 - DNA, 20 bp, mouse
gcgtcctggccttggctcca

SEQ ID NO: 700730 - DNA, 20 bp, mouse
ggcaactagccctggagcca

SEQ ID NO: 700731 - DNA, 20 bp, mouse
gtctgtggtagcgtcatcag

SEQ ID NO: 700732 - DNA, 20 bp, mouse
gtgtagcagctgacacccaa

SEQ ID NO: 700733 - DNA, 20 bp, mouse
gcggtggggccggggtctaa

SEQ ID NO: 700734 - DNA, 20 bp, mouse
gtggtcaaatgactcggcgg

SEQ ID NO: 700735 - DNA, 20 bp, mouse
gcaaggccaggacgcagcga

SEQ ID NO: 700736 - DNA, 20 bp, mouse
gggcgagcaaggagtggtcg

SEQ ID NO: 700737 - DNA, 20 bp, mouse
gagcccagcccagtcgaacc

SEQ ID NO: 700738 - DNA, 20 bp, mouse
gccgtcccccggggtccgaa

SEQ ID NO: 700739 - DNA, 20 bp, mouse
gggcccgagcacttcctcgg

SEQ ID NO: 700740 - DNA, 20 bp, mouse
gtgcgcccttcggaccccgg

SEQ ID NO: 700741 - DNA, 20 bp, mouse
ggggctcgccgcaggcagga

SEQ ID NO: 700742 - DNA, 20 bp, mouse
ggacggctggaagcgatctc

SEQ ID NO: 700743 - DNA, 20 bp, mouse
gaggaggcgggttaagctgc

SEQ ID NO: 700744 - DNA, 20 bp, mouse
gtccgaagggcgcaggaggc

SEQ ID NO: 700745 - DNA, 20 bp, mouse
gggaagcgatctcaggccag

SEQ ID NO: 700746 - DNA, 20 bp, mouse
gcggggagaccctccggatg

SEQ ID NO: 700747 - DNA, 20 bp, mouse
gcctgcgcgcgcgcctcatc

SEQ ID NO: 700748 - DNA, 20 bp, mouse
ggaggaggcgggagctccgg

SEQ ID NO: 700749 - DNA, 20 bp, mouse
gcgcgcgccgagcgaccggt

SEQ ID NO: 700750 - DNA, 20 bp, mouse
gccccctcgcctgctctgat

SEQ ID NO: 700751 - DNA, 20 bp, mouse
gccgagcgaccggtgggcgc

SEQ ID NO: 700752 - DNA, 20 bp, mouse
gtcggaacccgaggcgcggg

SEQ ID NO: 700753 - DNA, 20 bp, mouse
ggcgcgcgcgcctcatccgg

SEQ ID NO: 700754 - DNA, 20 bp, mouse
gtgctctgattgggtggccg

SEQ ID NO: 700755 - DNA, 20 bp, mouse
gacccaatcagagcaggcga

SEQ ID NO: 700756 - DNA, 20 bp, mouse
gcctctgagaattcttatga

SEQ ID NO: 700757 - DNA, 20 bp, mouse
gtcagagtatattgggagag

SEQ ID NO: 700758 - DNA, 20 bp, mouse
gtgaaagaatggtctcaaat

SEQ ID NO: 700759 - DNA, 20 bp, mouse
gtggctcatgacataacaat

SEQ ID NO: 700760 - DNA, 20 bp, mouse
ggtatattgggagagaggtt

SEQ ID NO: 700761 - DNA, 20 bp, mouse
gagagaaagtcagagtatat

SEQ ID NO: 700762 - DNA, 20 bp, mouse
ggacttctgcctgggtcccc

SEQ ID NO: 700763 - DNA, 20 bp, mouse
ggccacactgtgtgacttca

SEQ ID NO: 700764 - DNA, 20 bp, mouse
gcactgacctatatgacaaa

SEQ ID NO: 700765 - DNA, 20 bp, mouse
gagtgtggtcaggaaataaa

SEQ ID NO: 700766 - DNA, 20 bp, mouse
ggtagctgggccactctcaa

SEQ ID NO: 700767 - DNA, 20 bp, mouse
ggcccaagcgccgcctccgg

SEQ ID NO: 700768 - DNA, 20 bp, mouse
gcgcgctcgccgctcagtct

SEQ ID NO: 700769 - DNA, 20 bp, mouse
gtgaaggtaggaccaaggaa

SEQ ID NO: 700770 - DNA, 20 bp, mouse
gcaagcgccgcctccggcgg

SEQ ID NO: 700771 - DNA, 20 bp, mouse
gggatcaccagctctctgag

SEQ ID NO: 700772 - DNA, 20 bp, mouse
gggcggagccagatgaaggt

SEQ ID NO: 700773 - DNA, 20 bp, mouse
gcggggttaaccaccgccgg

SEQ ID NO: 700774 - DNA, 20 bp, mouse
gtccgcctcagagcagaggg

SEQ ID NO: 700775 - DNA, 20 bp, mouse
gccagatgaaggtaggacca

SEQ ID NO: 700776 - DNA, 20 bp, mouse
gaggtcggggaagcccggtc

SEQ ID NO: 700777 - DNA, 20 bp, mouse
gtgcccagtaaaccgagcag

SEQ ID NO: 700778 - DNA, 20 bp, mouse
ggagcgctggcactagactg

SEQ ID NO: 700779 - DNA, 20 bp, mouse
gccaggggtaacgtagtcag

SEQ ID NO: 700780 - DNA, 20 bp, mouse
gagagtcgtttgcgcagcgt

SEQ ID NO: 700781 - DNA, 20 bp, mouse
gctcccctgctcggtttact

SEQ ID NO: 700782 - DNA, 20 bp, mouse
gctgcagcggtcgcgaaggt

SEQ ID NO: 700783 - DNA, 20 bp, mouse
ggtccctgcagcggtcgcga

SEQ ID NO: 700784 - DNA, 20 bp, mouse
gcgcgaaggtcggggaagcc

SEQ ID NO: 700785 - DNA, 20 bp, mouse
ggccccccgtggccggagtc

SEQ ID NO: 700786 - DNA, 20 bp, mouse
gggagcaataaaaggccctg

SEQ ID NO: 700787 - DNA, 20 bp, mouse
gagggtccgagacgaagacg

SEQ ID NO: 700788 - DNA, 20 bp, mouse
gacgcgcgcgcgccccccga

SEQ ID NO: 700789 - DNA, 20 bp, mouse
gaagacgcggagactgagcc

SEQ ID NO: 700790 - DNA, 20 bp, mouse
gtcttcgtctcggaccctca

SEQ ID NO: 700791 - DNA, 20 bp, mouse
gtcactcttagagccctcgg

SEQ ID NO: 700792 - DNA, 20 bp, mouse
gagccgcggggagcaataaa

SEQ ID NO: 700793 - DNA, 20 bp, mouse
gagggcgcgcaggttcctcg

SEQ ID NO: 700794 - DNA, 20 bp, mouse
gcggtcgctggggggtgagg

SEQ ID NO: 700795 - DNA, 20 bp, mouse
gcgcgtgctcgggaagccgc

SEQ ID NO: 700796 - DNA, 20 bp, mouse
ggagccagagggaactccga

SEQ ID NO: 700797 - DNA, 20 bp, mouse
gggaagccaaggaacaaatt

SEQ ID NO: 700798 - DNA, 20 bp, mouse
ggagacggagctagtagcta

SEQ ID NO: 700799 - DNA, 20 bp, mouse
gtagcccgacccaccgactg

SEQ ID NO: 700800 - DNA, 20 bp, mouse
ggcagcaggtccccagtcgg

SEQ ID NO: 700801 - DNA, 20 bp, mouse
gccgtctccctggagccaga

SEQ ID NO: 700802 - DNA, 20 bp, mouse
ggaccctgtacctttaataa

SEQ ID NO: 700803 - DNA, 20 bp, mouse
gataagacgtatcttgaatg

SEQ ID NO: 700804 - DNA, 20 bp, mouse
gtcaccttcggagttccctc

SEQ ID NO: 700805 - DNA, 20 bp, mouse
gggagcagcaggtccccagt

SEQ ID NO: 700806 - DNA, 20 bp, mouse
gagtgacagaaggggttaac

SEQ ID NO: 700807 - DNA, 20 bp, mouse
gcgggagaatctgcaagaca

SEQ ID NO: 700808 - DNA, 20 bp, mouse
gtaggatacaggtcaaaact

SEQ ID NO: 700809 - DNA, 20 bp, mouse
ggaagatgggagtgacagaa

SEQ ID NO: 700810 - DNA, 20 bp, mouse
gctgagaaaactgagaagat

SEQ ID NO: 700811 - DNA, 20 bp, mouse
ggggcacccggagctgatga

SEQ ID NO: 700812 - DNA, 20 bp, mouse
gagctctgtgaacggttttt

SEQ ID NO: 700813 - DNA, 20 bp, mouse
gtgtctcactagctccgtcc

SEQ ID NO: 700814 - DNA, 20 bp, mouse
gactccgggaacaagaaaaa

SEQ ID NO: 700815 - DNA, 20 bp, mouse
gcggtttttcggaagatgtc

SEQ ID NO: 700816 - DNA, 20 bp, mouse
ggggtcgaggccaccggcta

SEQ ID NO: 700817 - DNA, 20 bp, mouse
gacggcgcgcctttcccggg

SEQ ID NO: 700818 - DNA, 20 bp, mouse
gctagctagagcatcccccc

SEQ ID NO: 700819 - DNA, 20 bp, mouse
gcgcccttgccgcggcggat

SEQ ID NO: 700820 - DNA, 20 bp, mouse
ggggaacggccgcgcgggtt

SEQ ID NO: 700821 - DNA, 20 bp, mouse
gctagaacccggaagcgcgg

SEQ ID NO: 700822 - DNA, 20 bp, mouse
gcacacggcgcgcctttccc

SEQ ID NO: 700823 - DNA, 20 bp, mouse
gcaggaaggtagcagatgct

SEQ ID NO: 700824 - DNA, 20 bp, mouse
ggccctgggccggttcgtag

SEQ ID NO: 700825 - DNA, 20 bp, mouse
gtagagcatccccccgggaa

SEQ ID NO: 700826 - DNA, 20 bp, mouse
gggcggggctacaggatcac

SEQ ID NO: 700827 - DNA, 20 bp, mouse
gttgctgagggcggacgcta

SEQ ID NO: 700828 - DNA, 20 bp, mouse
gagggtgccatctttcttaa

SEQ ID NO: 700829 - DNA, 20 bp, mouse
gcagcccaaaccggaggggc

SEQ ID NO: 700830 - DNA, 20 bp, mouse
gaggatcacggggttgctga

SEQ ID NO: 700831 - DNA, 20 bp, mouse
gagcccagcccaaaccggag

SEQ ID NO: 700832 - DNA, 20 bp, mouse
gtagccccgcccctccggtt

SEQ ID NO: 700833 - DNA, 20 bp, mouse
gatcacggggttgctgaggg

SEQ ID NO: 700834 - DNA, 20 bp, mouse
gaacaccaaacgttcagcag

SEQ ID NO: 700835 - DNA, 20 bp, mouse
ggagcccgctgctgaacgtt

SEQ ID NO: 700836 - DNA, 20 bp, mouse
gctcctgcaagctctcttga

SEQ ID NO: 700837 - DNA, 20 bp, mouse
gaaagctgactcacatgggc

SEQ ID NO: 700838 - DNA, 20 bp, mouse
ggcagatgggcttcagtaga

SEQ ID NO: 700839 - DNA, 20 bp, mouse
gaacgctgggaagtcttggc

SEQ ID NO: 700840 - DNA, 20 bp, mouse
ggccatcagaactgtgttct

SEQ ID NO: 700841 - DNA, 20 bp, mouse
gagaaaacgctgggaagtct

SEQ ID NO: 700842 - DNA, 20 bp, mouse
gaaactgccctgctcttgct

SEQ ID NO: 700843 - DNA, 20 bp, mouse
gtacatgtgcttttttatat

SEQ ID NO: 700844 - DNA, 20 bp, mouse
gtttaaaagctgactcacat

SEQ ID NO: 700845 - DNA, 20 bp, mouse
ggttctgggtttcatgttac

SEQ ID NO: 700846 - DNA, 20 bp, mouse
gggcatgagctgaggagggg

SEQ ID NO: 700847 - DNA, 20 bp, mouse
ggcggggcatgagctgagga

SEQ ID NO: 700848 - DNA, 20 bp, mouse
gagtgcgaggtgggttgcgg

SEQ ID NO: 700849 - DNA, 20 bp, mouse
gcgagggcacgaggtagagg

SEQ ID NO: 700850 - DNA, 20 bp, mouse
gacgcacctgagtgcgaggt

SEQ ID NO: 700851 - DNA, 20 bp, mouse
gtgggccctgagagggtaag

SEQ ID NO: 700852 - DNA, 20 bp, mouse
gggaggggcggggcatgagg

SEQ ID NO: 700853 - DNA, 20 bp, mouse
gaggcggagccttggatgga

SEQ ID NO: 700854 - DNA, 20 bp, mouse
gtacaagctccttccatcca

SEQ ID NO: 700855 - DNA, 20 bp, mouse
gctgagtgcgaggtgggttg

SEQ ID NO: 700856 - DNA, 20 bp, mouse
ggagccccgggagggagcgg

SEQ ID NO: 700857 - DNA, 20 bp, mouse
gagaggcgggcgttggagcg

SEQ ID NO: 700858 - DNA, 20 bp, mouse
ggaaggagccagcatgccag

SEQ ID NO: 700859 - DNA, 20 bp, mouse
gccgcgggagcgcagctgtg

SEQ ID NO: 700860 - DNA, 20 bp, mouse
gtacacggcccgggcctcgg

SEQ ID NO: 700861 - DNA, 20 bp, mouse
ggggagggctggccaggcta

SEQ ID NO: 700862 - DNA, 20 bp, mouse
gtgacctcggggccccctcc

SEQ ID NO: 700863 - DNA, 20 bp, mouse
gcgcgatcgcgcgtccctga

SEQ ID NO: 700864 - DNA, 20 bp, mouse
gcggcgcgggccgggactgc

SEQ ID NO: 700865 - DNA, 20 bp, mouse
gctgctgcgcgcacgggacg

SEQ ID NO: 700866 - DNA, 20 bp, mouse
gcatgcgtgtagagtaaggg

SEQ ID NO: 700867 - DNA, 20 bp, mouse
gtcccctgggagggcgaaag

SEQ ID NO: 700868 - DNA, 20 bp, mouse
gaggcctgaggtcaccgccc

SEQ ID NO: 700869 - DNA, 20 bp, mouse
gtcccgcgttaaggcctggg

SEQ ID NO: 700870 - DNA, 20 bp, mouse
gtccggcccgcgctctatga

SEQ ID NO: 700871 - DNA, 20 bp, mouse
ggctgcacgcagcgtgaggg

SEQ ID NO: 700872 - DNA, 20 bp, mouse
gtgcgcatgcgtgtagagta

SEQ ID NO: 700873 - DNA, 20 bp, mouse
gcgcgctgcacgcagcgtga

SEQ ID NO: 700874 - DNA, 20 bp, mouse
ggtgagggcggagtctcgga

SEQ ID NO: 700875 - DNA, 20 bp, mouse
gcaccgcccaggccttaacg

SEQ ID NO: 700876 - DNA, 20 bp, mouse
gggaagggccagaccatgtg

SEQ ID NO: 700877 - DNA, 20 bp, mouse
ggggcatagccggtgtggtc

SEQ ID NO: 700878 - DNA, 20 bp, mouse
gcatggaccagatcgaggga

SEQ ID NO: 700879 - DNA, 20 bp, mouse
gtctaggtctaaagggtctc

SEQ ID NO: 700880 - DNA, 20 bp, mouse
ggtggtcagggtaacttgcc

SEQ ID NO: 700881 - DNA, 20 bp, mouse
gcgggagtgaaggtttacta

SEQ ID NO: 700882 - DNA, 20 bp, mouse
ggaacagcaagtgtctgcta

SEQ ID NO: 700883 - DNA, 20 bp, mouse
gggtaacttgccgggagtga

SEQ ID NO: 700884 - DNA, 20 bp, mouse
ggtctcgggtagcctgtcat

SEQ ID NO: 700885 - DNA, 20 bp, mouse
gtgagcgtacccatcagccc

SEQ ID NO: 700886 - DNA, 20 bp, mouse
gtcactgcgctgacagtgtg

SEQ ID NO: 700887 - DNA, 20 bp, mouse
gaagccggcagaccctttta

SEQ ID NO: 700888 - DNA, 20 bp, mouse
gagtgtgcggggaacagcag

SEQ ID NO: 700889 - DNA, 20 bp, mouse
gtcagcgcagtgactttgtt

SEQ ID NO: 700890 - DNA, 20 bp, mouse
gctggcctcgctgagaacac

SEQ ID NO: 700891 - DNA, 20 bp, mouse
gtcaccccgcaaagatcccg

SEQ ID NO: 700892 - DNA, 20 bp, mouse
ggcggggtgagcggggatgt

SEQ ID NO: 700893 - DNA, 20 bp, mouse
gggcttccccgggatctttg

SEQ ID NO: 700894 - DNA, 20 bp, mouse
ggctgcctaggaactgagca

SEQ ID NO: 700895 - DNA, 20 bp, mouse
ggatctttgcggggtgagcg

SEQ ID NO: 700896 - DNA, 20 bp, mouse
gtggacttgaggcagcgacg

SEQ ID NO: 700897 - DNA, 20 bp, mouse
ggcagcgacgtggcagagaa

SEQ ID NO: 700898 - DNA, 20 bp, mouse
ggggcaacctagtatctctc

SEQ ID NO: 700899 - DNA, 20 bp, mouse
ggggttacggctgtcaagta

SEQ ID NO: 700900 - DNA, 20 bp, mouse
gctggctcacagtggacttg

SEQ ID NO: 700901 - DNA, 20 bp, mouse
gcaaactcatgtgcgtatcc

SEQ ID NO: 700902 - DNA, 20 bp, mouse
ggtccacagcagacaagtag

SEQ ID NO: 700903 - DNA, 20 bp, mouse
gaactgagctgcaagattaa

SEQ ID NO: 700904 - DNA, 20 bp, mouse
gagaggcaggtaatcgctct

SEQ ID NO: 700905 - DNA, 20 bp, mouse
ggagccagaaacagcaatgc

SEQ ID NO: 700906 - DNA, 20 bp, mouse
gagctagaatccttggggtg

SEQ ID NO: 700907 - DNA, 20 bp, mouse
ggggcatagtggcacttggt

SEQ ID NO: 700908 - DNA, 20 bp, mouse
ggcggcgcggcgtctctagg

SEQ ID NO: 700909 - DNA, 20 bp, mouse
gtgcgcaagcgccgcgcgat

SEQ ID NO: 700910 - DNA, 20 bp, mouse
gggtggttacgcttccgcgg

SEQ ID NO: 700911 - DNA, 20 bp, mouse
gggcgcatgcgcagacggat

SEQ ID NO: 700912 - DNA, 20 bp, mouse
gtgcgccgcaggcacccaag

SEQ ID NO: 700913 - DNA, 20 bp, mouse
ggcggcgcttgcgcaatgag

SEQ ID NO: 700914 - DNA, 20 bp, mouse
gtagactagtggagggagaa

SEQ ID NO: 700915 - DNA, 20 bp, mouse
gtagagacgccgcgccgctt

SEQ ID NO: 700916 - DNA, 20 bp, mouse
gatccagggtcctagagtga

SEQ ID NO: 700917 - DNA, 20 bp, mouse
ggagtgaggggttcttacac

SEQ ID NO: 700918 - DNA, 20 bp, mouse
gcctaggataatgtgatgca

SEQ ID NO: 700919 - DNA, 20 bp, mouse
gagggaggatctaggacatc

SEQ ID NO: 700920 - DNA, 20 bp, mouse
gcccgcccgccccaaggcaa

SEQ ID NO: 700921 - DNA, 20 bp, mouse
gacccctcactctaggaccc

SEQ ID NO: 700922 - DNA, 20 bp, mouse
gtgacccaagttttcggagg

SEQ ID NO: 700923 - DNA, 20 bp, mouse
gccggcccctggtactcatt

SEQ ID NO: 700924 - DNA, 20 bp, mouse
ggtggacagccattcttaat

SEQ ID NO: 700925 - DNA, 20 bp, mouse
ggtcatgtgacccaagtttt

SEQ ID NO: 700926 - DNA, 20 bp, mouse
ggggcggggcgacactagga

SEQ ID NO: 700927 - DNA, 20 bp, mouse
gcggagcgagaggacctcac

SEQ ID NO: 700928 - DNA, 20 bp, mouse
gaacgcgcgctgctccccaa

SEQ ID NO: 700929 - DNA, 20 bp, mouse
ggggagcagcgcgcgttcac

SEQ ID NO: 700930 - DNA, 20 bp, mouse
gcgcagcaggagctgtccaa

SEQ ID NO: 700931 - DNA, 20 bp, mouse
gagctgtccaaagggaggcg

SEQ ID NO: 700932 - DNA, 20 bp, mouse
ggcaggagctgtccaaaggg

SEQ ID NO: 700933 - DNA, 20 bp, mouse
gggccgagcgagaccaaggg

SEQ ID NO: 700934 - DNA, 20 bp, mouse
ggcgctaccgggtgttggaa

SEQ ID NO: 700935 - DNA, 20 bp, mouse
gaggaccggagctgctccat

SEQ ID NO: 700936 - DNA, 20 bp, mouse
gccagcaaggggccagtttg

SEQ ID NO: 700937 - DNA, 20 bp, mouse
ggcagctggcaggcaagaaa

SEQ ID NO: 700938 - DNA, 20 bp, mouse
ggacaggtgtggtagacaca

SEQ ID NO: 700939 - DNA, 20 bp, mouse
ggctggcaggcaagaaaggg

SEQ ID NO: 700940 - DNA, 20 bp, mouse
gtcaacatggtcctggcctt

SEQ ID NO: 700941 - DNA, 20 bp, mouse
gaaaggacacaggctatgtc

SEQ ID NO: 700942 - DNA, 20 bp, mouse
ggacaaggataggcagtgac

SEQ ID NO: 700943 - DNA, 20 bp, mouse
gacacagggcagagcgctgt

SEQ ID NO: 700944 - DNA, 20 bp, mouse
gggacaaggacagctcggaa

SEQ ID NO: 700945 - DNA, 20 bp, mouse
gagctaacaggaaaggacac

SEQ ID NO: 700946 - DNA, 20 bp, mouse
gcgggcgaagggtaagacgg

SEQ ID NO: 700947 - DNA, 20 bp, mouse
gacccatcaaggccactaga

SEQ ID NO: 700948 - DNA, 20 bp, mouse
ggagggagacacgccctcta

SEQ ID NO: 700949 - DNA, 20 bp, mouse
gtgggggcgatgagtggaag

SEQ ID NO: 700950 - DNA, 20 bp, mouse
gtggccgagaaggctctgga

SEQ ID NO: 700951 - DNA, 20 bp, mouse
ggcgcccagaggggatgtgg

SEQ ID NO: 700952 - DNA, 20 bp, mouse
gagcgcgcatgcgcccagag

SEQ ID NO: 700953 - DNA, 20 bp, mouse
gtgatctcagccagtagctt

SEQ ID NO: 700954 - DNA, 20 bp, mouse
gctgctcccctcatgtttgt

SEQ ID NO: 700955 - DNA, 20 bp, mouse
gggcaccaccacatcccctc

SEQ ID NO: 700956 - DNA, 20 bp, mouse
gaacctccgcggctggaaat

SEQ ID NO: 700957 - DNA, 20 bp, mouse
ggcggggcctaagttacccg

SEQ ID NO: 700958 - DNA, 20 bp, mouse
gcgcggaggttaaagaagct

SEQ ID NO: 700959 - DNA, 20 bp, mouse
gccgcggctggaaataggaa

SEQ ID NO: 700960 - DNA, 20 bp, mouse
gcgcggcgccatatagacta

SEQ ID NO: 700961 - DNA, 20 bp, mouse
ggtaccggatagatgagaag

SEQ ID NO: 700962 - DNA, 20 bp, mouse
gatggcgccgcgggtaactt

SEQ ID NO: 700963 - DNA, 20 bp, mouse
gagctgaggcggaagtcgag

SEQ ID NO: 700964 - DNA, 20 bp, mouse
gcgggttgggaaggcttcgt

SEQ ID NO: 700965 - DNA, 20 bp, mouse
gtgcagcatttcgtagccca

SEQ ID NO: 700966 - DNA, 20 bp, mouse
gaagtccgggacagaacgtg

SEQ ID NO: 700967 - DNA, 20 bp, mouse
gggggcagagaccaattgta

SEQ ID NO: 700968 - DNA, 20 bp, mouse
ggccacctctcgctcctgga

SEQ ID NO: 700969 - DNA, 20 bp, mouse
gtctgtcccggacttcgggg

SEQ ID NO: 700970 - DNA, 20 bp, mouse
gtcctccccgccccgaagtc

SEQ ID NO: 700971 - DNA, 20 bp, mouse
ggaactgagggcgtccgtgc

SEQ ID NO: 700972 - DNA, 20 bp, mouse
ggtggccccacgttctgtcc

SEQ ID NO: 700973 - DNA, 20 bp, mouse
gtggggccacctctcgctcc

SEQ ID NO: 700974 - DNA, 20 bp, mouse
gggggaggaggctgaactga

SEQ ID NO: 700975 - DNA, 20 bp, mouse
gcacaggcgcccggaccacg

SEQ ID NO: 700976 - DNA, 20 bp, mouse
gccgccctggcgggtccacg

SEQ ID NO: 700977 - DNA, 20 bp, mouse
ggggccaggttgagagtctc

SEQ ID NO: 700978 - DNA, 20 bp, mouse
gctggcgggtccacgtggaa

SEQ ID NO: 700979 - DNA, 20 bp, mouse
ggcgggtccacgtggaatgg

SEQ ID NO: 700980 - DNA, 20 bp, mouse
gaggccccgggtctcagtcc

SEQ ID NO: 700981 - DNA, 20 bp, mouse
gcatccgggactgagacccg

SEQ ID NO: 700982 - DNA, 20 bp, mouse
gcctcccccaaaactccatc

SEQ ID NO: 700983 - DNA, 20 bp, mouse
ggggtcctaaagcctgttgg

SEQ ID NO: 700984 - DNA, 20 bp, mouse
ggacccggggcctggcccag

SEQ ID NO: 700985 - DNA, 20 bp, mouse
gccagaaggggcctagattt

SEQ ID NO: 700986 - DNA, 20 bp, mouse
gcatccgcgacctccatcac

SEQ ID NO: 700987 - DNA, 20 bp, mouse
gcagtctcttcccctctagg

SEQ ID NO: 700988 - DNA, 20 bp, mouse
gccagtctggcctggagtga

SEQ ID NO: 700989 - DNA, 20 bp, mouse
gtaacctgtgatggaggtcg

SEQ ID NO: 700990 - DNA, 20 bp, mouse
ggagggagggctgcaagagg

SEQ ID NO: 700991 - DNA, 20 bp, mouse
gaaacccgcccataccagtc

SEQ ID NO: 700992 - DNA, 20 bp, mouse
gtctttctgacccatgacga

SEQ ID NO: 700993 - DNA, 20 bp, mouse
ggtgccctagctatgaaatg

SEQ ID NO: 700994 - DNA, 20 bp, mouse
gtcttcccctctaggaggtg

SEQ ID NO: 700995 - DNA, 20 bp, mouse
gggagtgagggaacccgtcc

SEQ ID NO: 700996 - DNA, 20 bp, mouse
gggcgccgaaaaaaatgtag

SEQ ID NO: 700997 - DNA, 20 bp, mouse
gtctaataaggcagcttcta

SEQ ID NO: 700998 - DNA, 20 bp, mouse
gggctctaggactgttccga

SEQ ID NO: 700999 - DNA, 20 bp, mouse
ggggaaaggcgtccttccac

SEQ ID NO: 701000 - DNA, 20 bp, mouse
gtcaggcgcctcccagccaa

SEQ ID NO: 701001 - DNA, 20 bp, mouse
gccagctgccttcccgaggt

SEQ ID NO: 701002 - DNA, 20 bp, mouse
gtccaggctaacatcctcgg

SEQ ID NO: 701003 - DNA, 20 bp, mouse
gaaggggcacatccgagccc

SEQ ID NO: 701004 - DNA, 20 bp, mouse
gtagtggttctgtgtgctgt

SEQ ID NO: 701005 - DNA, 20 bp, mouse
ggggagaatttcctaatcag

SEQ ID NO: 701006 - DNA, 20 bp, mouse
gaggaactccacctcctcgg

SEQ ID NO: 701007 - DNA, 20 bp, mouse
gggagcaaaggcaaatgagg

SEQ ID NO: 701008 - DNA, 20 bp, mouse
gcccagaggagacccagcgg

SEQ ID NO: 701009 - DNA, 20 bp, mouse
gcacccagggggcgggtcca

SEQ ID NO: 701010 - DNA, 20 bp, mouse
gaggcctcaccagccctccg

SEQ ID NO: 701011 - DNA, 20 bp, mouse
gggtggagcaaaggcaaatg

SEQ ID NO: 701012 - DNA, 20 bp, mouse
ggttctgagcggtgattggt

SEQ ID NO: 701013 - DNA, 20 bp, mouse
ggattggtgggatcacccag

SEQ ID NO: 701014 - DNA, 20 bp, mouse
gggagacccagcggtggagg

SEQ ID NO: 701015 - DNA, 20 bp, mouse
gagaggagacccagcggtgg

SEQ ID NO: 701016 - DNA, 20 bp, mouse
gccgccgcagctgcatccgg

SEQ ID NO: 701017 - DNA, 20 bp, mouse
gaagcggggcagctaggcgg

SEQ ID NO: 701018 - DNA, 20 bp, mouse
gctgaagcggggcagctagg

SEQ ID NO: 701019 - DNA, 20 bp, mouse
gggagggaccggaagtccgg

SEQ ID NO: 701020 - DNA, 20 bp, mouse
gtgagcgcctcgcgcaaata

SEQ ID NO: 701021 - DNA, 20 bp, mouse
gggcagctaggcggagggac

SEQ ID NO: 701022 - DNA, 20 bp, mouse
gagacccccggatgcagctg

SEQ ID NO: 701023 - DNA, 20 bp, mouse
ggtgcgcaggagccacgaga

SEQ ID NO: 701024 - DNA, 20 bp, mouse
gggcggagggaccggaagtc

SEQ ID NO: 701025 - DNA, 20 bp, mouse
gtattactgcggcgtctccg

SEQ ID NO: 701026 - DNA, 20 bp, mouse
gtcagccagtgggttaatgg

SEQ ID NO: 701027 - DNA, 20 bp, mouse
ggagggaagcgaccctgacg

SEQ ID NO: 701028 - DNA, 20 bp, mouse
ggaccctgacgtggctgctc

SEQ ID NO: 701029 - DNA, 20 bp, mouse
gacccactggctgaaagggg

SEQ ID NO: 701030 - DNA, 20 bp, mouse
gctaaccaccattaacccac

SEQ ID NO: 701031 - DNA, 20 bp, mouse
gtggagctgtgcgacaaggt

SEQ ID NO: 701032 - DNA, 20 bp, mouse
ggggttaatggtggttagtc

SEQ ID NO: 701033 - DNA, 20 bp, mouse
gatccggagcagccacgtca

SEQ ID NO: 701034 - DNA, 20 bp, mouse
gggggtggagctgtgcgaca

SEQ ID NO: 701035 - DNA, 20 bp, mouse
gtacagggtgcaaagcccca

SEQ ID NO: 701036 - DNA, 20 bp, mouse
gcgtgacaacgtcacttccg

SEQ ID NO: 701037 - DNA, 20 bp, mouse
gcgcctggaggggttctagc

SEQ ID NO: 701038 - DNA, 20 bp, mouse
gacccaaaggcgtgccggtc

SEQ ID NO: 701039 - DNA, 20 bp, mouse
gtgcctgctagaacccctcc

SEQ ID NO: 701040 - DNA, 20 bp, mouse
gacacgctgcccgccctcat

SEQ ID NO: 701041 - DNA, 20 bp, mouse
gagctcagggccatgtggta

SEQ ID NO: 701042 - DNA, 20 bp, mouse
gtcccacaacaactacccaa

SEQ ID NO: 701043 - DNA, 20 bp, mouse
gtgactgcacgcgcctggag

SEQ ID NO: 701044 - DNA, 20 bp, mouse
gaaacccgctgctgcatcta

SEQ ID NO: 701045 - DNA, 20 bp, mouse
gcttccggggttcagattcc

SEQ ID NO: 701046 - DNA, 20 bp, mouse
ggggccccggagtcccgcgc

SEQ ID NO: 701047 - DNA, 20 bp, mouse
gagtcccgcgcaggacccgt

SEQ ID NO: 701048 - DNA, 20 bp, mouse
gcagccccggccctgaaggg

SEQ ID NO: 701049 - DNA, 20 bp, mouse
gcgtggggacagagagtgga

SEQ ID NO: 701050 - DNA, 20 bp, mouse
gacgcagccccggccctgaa

SEQ ID NO: 701051 - DNA, 20 bp, mouse
gggggctgcgtagaaagtgt

SEQ ID NO: 701052 - DNA, 20 bp, mouse
gggaccgcgccggattgagg

SEQ ID NO: 701053 - DNA, 20 bp, mouse
gcgtggcgcgcgaggaggcg

SEQ ID NO: 701054 - DNA, 20 bp, mouse
gaagcccgggccacgccctg

SEQ ID NO: 701055 - DNA, 20 bp, mouse
gcggcgcggtcccgccctca

SEQ ID NO: 701056 - DNA, 20 bp, mouse
gggcacgagcgggctgcaaa

SEQ ID NO: 701057 - DNA, 20 bp, mouse
gtggactgagggtactggag

SEQ ID NO: 701058 - DNA, 20 bp, mouse
gggtggggcggaacgacata

SEQ ID NO: 701059 - DNA, 20 bp, mouse
gcagggaggagcggcacgag

SEQ ID NO: 701060 - DNA, 20 bp, mouse
ggaagcggttaaacgggttg

SEQ ID NO: 701061 - DNA, 20 bp, mouse
gtctagagaagcggttaaac

SEQ ID NO: 701062 - DNA, 20 bp, mouse
gtaggaggagggcactccta

SEQ ID NO: 701063 - DNA, 20 bp, mouse
gccagaggtcctggtgtagg

SEQ ID NO: 701064 - DNA, 20 bp, mouse
ggggaagattgtgatcccag

SEQ ID NO: 701065 - DNA, 20 bp, mouse
gggttgaggctcttggactg

SEQ ID NO: 701066 - DNA, 20 bp, mouse
gcacgtgggcagcggtgaag

SEQ ID NO: 701067 - DNA, 20 bp, mouse
ggcggagatgcaaacgaacg

SEQ ID NO: 701068 - DNA, 20 bp, mouse
gcacggccaccaatcgggac

SEQ ID NO: 701069 - DNA, 20 bp, mouse
gcagcccgcgcgccttttgg

SEQ ID NO: 701070 - DNA, 20 bp, mouse
ggggcaagggccagacacgt

SEQ ID NO: 701071 - DNA, 20 bp, mouse
gcccgcgcgccttttggggg

SEQ ID NO: 701072 - DNA, 20 bp, mouse
ggcagtgcacggccaccaat

SEQ ID NO: 701073 - DNA, 20 bp, mouse
gtcgctccgcccgtcccgat

SEQ ID NO: 701074 - DNA, 20 bp, mouse
ggtgggcagcggtgaagagg

SEQ ID NO: 701075 - DNA, 20 bp, mouse
gggcagccccgtggccctat

SEQ ID NO: 701076 - DNA, 20 bp, mouse
gcgggagcacggagactcca

SEQ ID NO: 701077 - DNA, 20 bp, mouse
gagggagcgcctagtgggag

SEQ ID NO: 701078 - DNA, 20 bp, mouse
ggtgacggatcaagcggggt

SEQ ID NO: 701079 - DNA, 20 bp, mouse
gcggcgcaagaggaccccaa

SEQ ID NO: 701080 - DNA, 20 bp, mouse
gtgcgggctccgggaatccc

SEQ ID NO: 701081 - DNA, 20 bp, mouse
gcaagcaagcccagcttttt

SEQ ID NO: 701082 - DNA, 20 bp, mouse
gagaggagggagcgcctagt

SEQ ID NO: 701083 - DNA, 20 bp, mouse
gctgctggggcccaccctac

SEQ ID NO: 701084 - DNA, 20 bp, mouse
gccagccagggaatctggag

SEQ ID NO: 701085 - DNA, 20 bp, mouse
gttgatccgtcacagacttc

SEQ ID NO: 701086 - DNA, 20 bp, mouse
gagcatgcgagcatgcgctg

SEQ ID NO: 701087 - DNA, 20 bp, mouse
ggggctgtgcacgagagaaa

SEQ ID NO: 701088 - DNA, 20 bp, mouse
ggcgctgcacacgtgatggc

SEQ ID NO: 701089 - DNA, 20 bp, mouse
gtcggacaaagcattttatg

SEQ ID NO: 701090 - DNA, 20 bp, mouse
ggtgatggcaggcgcaaagc

SEQ ID NO: 701091 - DNA, 20 bp, mouse
gtggcaggcgcaaagcagga

SEQ ID NO: 701092 - DNA, 20 bp, mouse
gcacgtgtgcagcgcgtgct

SEQ ID NO: 701093 - DNA, 20 bp, mouse
gtttgtccgaagccctccca

SEQ ID NO: 701094 - DNA, 20 bp, mouse
gcggaagtcaggcaccacgc

SEQ ID NO: 701095 - DNA, 20 bp, mouse
gggaaggaaaggtgaactct

SEQ ID NO: 701096 - DNA, 20 bp, mouse
gaacctgcggacagggtgtg

SEQ ID NO: 701097 - DNA, 20 bp, mouse
gcgaaagaaacctgcggaca

SEQ ID NO: 701098 - DNA, 20 bp, mouse
ggctccggttggctgtactc

SEQ ID NO: 701099 - DNA, 20 bp, mouse
gggccgttgggtgctccggt

SEQ ID NO: 701100 - DNA, 20 bp, mouse
gagccaaccggagcacccaa

SEQ ID NO: 701101 - DNA, 20 bp, mouse
gtcttggccgttgggtgctc

SEQ ID NO: 701102 - DNA, 20 bp, mouse
gcgcaccagcaaatcgccgc

SEQ ID NO: 701103 - DNA, 20 bp, mouse
gtagccagagtacagccaac

SEQ ID NO: 701104 - DNA, 20 bp, mouse
gccagcaaatcgccgccggt

SEQ ID NO: 701105 - DNA, 20 bp, mouse
gtccaaggcggggctacgag

SEQ ID NO: 701106 - DNA, 20 bp, mouse
gtctaggtggaggggctgtt

SEQ ID NO: 701107 - DNA, 20 bp, mouse
gaacgcactgggcgcacagt

SEQ ID NO: 701108 - DNA, 20 bp, mouse
gggcgcgcggggcattgtgg

SEQ ID NO: 701109 - DNA, 20 bp, mouse
ggctctagcctctaggtgga

SEQ ID NO: 701110 - DNA, 20 bp, mouse
ggtgacggggcgtagcgagg

SEQ ID NO: 701111 - DNA, 20 bp, mouse
gtccgctggccgtttcttaa

SEQ ID NO: 701112 - DNA, 20 bp, mouse
gccagcatgaactcaaatca

SEQ ID NO: 701113 - DNA, 20 bp, mouse
gtgggagatgggaacgcact

SEQ ID NO: 701114 - DNA, 20 bp, mouse
gcaggaaggaggtggtgtcg

SEQ ID NO: 701115 - DNA, 20 bp, mouse
gccagcggagcttaccagga

SEQ ID NO: 701116 - DNA, 20 bp, mouse
ggagccgcgcccagcccgag

SEQ ID NO: 701117 - DNA, 20 bp, mouse
gcagcccgaggggcgtccac

SEQ ID NO: 701118 - DNA, 20 bp, mouse
gatcctctcccggcttctgg

SEQ ID NO: 701119 - DNA, 20 bp, mouse
gagtcagagcgatcctctcc

SEQ ID NO: 701120 - DNA, 20 bp, mouse
gtccgccccgtgccgggccg

SEQ ID NO: 701121 - DNA, 20 bp, mouse
gcccgtgccgggccgagggg

SEQ ID NO: 701122 - DNA, 20 bp, mouse
gttccccgcctccagaagcc

SEQ ID NO: 701123 - DNA, 20 bp, mouse
ggatccgcagtgctcaggcg

SEQ ID NO: 701124 - DNA, 20 bp, mouse
gctgcggcccggggctagcc

SEQ ID NO: 701125 - DNA, 20 bp, mouse
gtgggcgcggctcctcccct

SEQ ID NO: 701126 - DNA, 20 bp, mouse
gaaatgggaaacttgggctg

SEQ ID NO: 701127 - DNA, 20 bp, mouse
gctattgcttaggtctagtc

SEQ ID NO: 701128 - DNA, 20 bp, mouse
gaattagccaaatcgaaccg

SEQ ID NO: 701129 - DNA, 20 bp, mouse
gaccgaggttgacaaagatc

SEQ ID NO: 701130 - DNA, 20 bp, mouse
gtgtcaacctcggttcgatt

SEQ ID NO: 701131 - DNA, 20 bp, mouse
gttggctaattctattgctt

SEQ ID NO: 701132 - DNA, 20 bp, mouse
gaggtctagtccggttgcta

SEQ ID NO: 701133 - DNA, 20 bp, mouse
gtgaactgaagctcgaactt

SEQ ID NO: 701134 - DNA, 20 bp, mouse
gagcttcagttcaaatgtaa

SEQ ID NO: 701135 - DNA, 20 bp, mouse
gtcaccatagaggcgggaca

SEQ ID NO: 701136 - DNA, 20 bp, mouse
gtctgccgggagccgcgagt

SEQ ID NO: 701137 - DNA, 20 bp, mouse
gagtgctgagaaagtggatg

SEQ ID NO: 701138 - DNA, 20 bp, mouse
gtcgcccagacaggctctct

SEQ ID NO: 701139 - DNA, 20 bp, mouse
gtgtctgggcgatgcgactc

SEQ ID NO: 701140 - DNA, 20 bp, mouse
gcaagcccagagagcctgtc

SEQ ID NO: 701141 - DNA, 20 bp, mouse
gctggcatggggtaccttgg

SEQ ID NO: 701142 - DNA, 20 bp, mouse
gccagcatctggttaggatc

SEQ ID NO: 701143 - DNA, 20 bp, mouse
gcgatgcgactcggggttcc

SEQ ID NO: 701144 - DNA, 20 bp, mouse
gggctcgtcactcccactcg

SEQ ID NO: 701145 - DNA, 20 bp, mouse
ggcgggccgggaccggtcag

SEQ ID NO: 701146 - DNA, 20 bp, mouse
gcgcagaaagtgcaaaccta

SEQ ID NO: 701147 - DNA, 20 bp, mouse
gtccctccggcagtgccctg

SEQ ID NO: 701148 - DNA, 20 bp, mouse
gaactgtcccccgtagtgta

SEQ ID NO: 701149 - DNA, 20 bp, mouse
ggcctcagggcactgccgga

SEQ ID NO: 701150 - DNA, 20 bp, mouse
gctgcaatcagccgtccctc

SEQ ID NO: 701151 - DNA, 20 bp, mouse
gtctgatgagccgtacacta

SEQ ID NO: 701152 - DNA, 20 bp, mouse
gccaaataggccacactaat

SEQ ID NO: 701153 - DNA, 20 bp, mouse
ggatgagccgtacactacgg

SEQ ID NO: 701154 - DNA, 20 bp, mouse
ggatatagaacggggtgcgt

SEQ ID NO: 701155 - DNA, 20 bp, mouse
ggctgattgcagatttctga

SEQ ID NO: 701156 - DNA, 20 bp, mouse
ggaggcgcgtgagcgattgc

SEQ ID NO: 701157 - DNA, 20 bp, mouse
gactgtccggaagtaaaaat

SEQ ID NO: 701158 - DNA, 20 bp, mouse
gggggcctggccttagccca

SEQ ID NO: 701159 - DNA, 20 bp, mouse
gcctggccttagcccatgga

SEQ ID NO: 701160 - DNA, 20 bp, mouse
gtgtcctaggacatgcggaa

SEQ ID NO: 701161 - DNA, 20 bp, mouse
gaagtgttctggtactcgaa

SEQ ID NO: 701162 - DNA, 20 bp, mouse
gccggacagtgatgactaca

SEQ ID NO: 701163 - DNA, 20 bp, mouse
gtactcgaagggaaaatatt

SEQ ID NO: 701164 - DNA, 20 bp, mouse
gaacatgaagcattgtaagg

SEQ ID NO: 701165 - DNA, 20 bp, mouse
gcgcctcatcgcggagctag

SEQ ID NO: 701166 - DNA, 20 bp, mouse
ggtacggacaggtcctggga

SEQ ID NO: 701167 - DNA, 20 bp, mouse
ggcgtcccccgcaggcgact

SEQ ID NO: 701168 - DNA, 20 bp, mouse
ggaggggcgcgcgtggccga

SEQ ID NO: 701169 - DNA, 20 bp, mouse
gggcgcggcaagtcgccccg

SEQ ID NO: 701170 - DNA, 20 bp, mouse
ggggcgacttgccgcgccga

SEQ ID NO: 701171 - DNA, 20 bp, mouse
gggaaggtacggacaggtcc

SEQ ID NO: 701172 - DNA, 20 bp, mouse
gccacgcgcgcccctcggcg

SEQ ID NO: 701173 - DNA, 20 bp, mouse
ggacgcaacgctgctcgctc

SEQ ID NO: 701174 - DNA, 20 bp, mouse
gccccgcggaaaagcgtaga

SEQ ID NO: 701175 - DNA, 20 bp, mouse
gttcctcttcggtagggaca

SEQ ID NO: 701176 - DNA, 20 bp, mouse
gccagagcatgtcttcattg

SEQ ID NO: 701177 - DNA, 20 bp, mouse
gctctgggacactctcctgt

SEQ ID NO: 701178 - DNA, 20 bp, mouse
ggataaacatgcaaggggtg

SEQ ID NO: 701179 - DNA, 20 bp, mouse
gaaggaagataaacatgcaa

SEQ ID NO: 701180 - DNA, 20 bp, mouse
gtcactatatacgaccctac

SEQ ID NO: 701181 - DNA, 20 bp, mouse
ggtcttcattgtggaaggtg

SEQ ID NO: 701182 - DNA, 20 bp, mouse
gagagtgttaaatacttggc

SEQ ID NO: 701183 - DNA, 20 bp, mouse
gagcagagactttgatgtag

SEQ ID NO: 701184 - DNA, 20 bp, mouse
gtggcagagtgttaaatact

SEQ ID NO: 701185 - DNA, 20 bp, mouse
gtcaagctagaagctatata

SEQ ID NO: 701186 - DNA, 20 bp, mouse
gcagggcgaggagaggacga

SEQ ID NO: 701187 - DNA, 20 bp, mouse
gcgaaaagcagggcgaggag

SEQ ID NO: 701188 - DNA, 20 bp, mouse
ggcgagtgatgcgaaaagca

SEQ ID NO: 701189 - DNA, 20 bp, mouse
gagctggccaggaacaatga

SEQ ID NO: 701190 - DNA, 20 bp, mouse
gtggaccccgtcattgttcc

SEQ ID NO: 701191 - DNA, 20 bp, mouse
gggagaggacgagggggtgt

SEQ ID NO: 701192 - DNA, 20 bp, mouse
gagggagcggatactgggcg

SEQ ID NO: 701193 - DNA, 20 bp, mouse
ggcagtgcatgaatgtaact

SEQ ID NO: 701194 - DNA, 20 bp, mouse
gcacacaggatacttgctcc

SEQ ID NO: 701195 - DNA, 20 bp, mouse
gccccaaaaaagtttgactc

SEQ ID NO: 701196 - DNA, 20 bp, mouse
gaggcctgtaggggtcccgc

SEQ ID NO: 701197 - DNA, 20 bp, mouse
gaacacttccagtctcctgt

SEQ ID NO: 701198 - DNA, 20 bp, mouse
gcagcccaagcgacagtgcc

SEQ ID NO: 701199 - DNA, 20 bp, mouse
gtctcctgtcggaacgtgga

SEQ ID NO: 701200 - DNA, 20 bp, mouse
gctgtcggaacgtggagggt

SEQ ID NO: 701201 - DNA, 20 bp, mouse
ggcggcgcgcgcgggttaaa

SEQ ID NO: 701202 - DNA, 20 bp, mouse
ggttctggggaggcctgtag

SEQ ID NO: 701203 - DNA, 20 bp, mouse
gagagctgcgaggcctccct

SEQ ID NO: 701204 - DNA, 20 bp, mouse
gggtccaggcactgtcgctt

SEQ ID NO: 701205 - DNA, 20 bp, mouse
gcgcgcgcgggttaaagggg

SEQ ID NO: 701206 - DNA, 20 bp, mouse
gtggggcattccaacgggag

SEQ ID NO: 701207 - DNA, 20 bp, mouse
gcctccgagcatgaacgacg

SEQ ID NO: 701208 - DNA, 20 bp, mouse
gagtgcagaggcagcttcgg

SEQ ID NO: 701209 - DNA, 20 bp, mouse
gccaacgggaggggcgaggt

SEQ ID NO: 701210 - DNA, 20 bp, mouse
gcccaaggaaactttgcctc

SEQ ID NO: 701211 - DNA, 20 bp, mouse
gcagaacagaggttgcactg

SEQ ID NO: 701212 - DNA, 20 bp, mouse
ggcgttgtggggcattccaa

SEQ ID NO: 701213 - DNA, 20 bp, mouse
gcccagaggctccgccccca

SEQ ID NO: 701214 - DNA, 20 bp, mouse
gttgaggcgcgaggaacgga

SEQ ID NO: 701215 - DNA, 20 bp, mouse
gaggcagcttcgggggatgg

SEQ ID NO: 701216 - DNA, 20 bp, mouse
gtacgccggagggtagggtg

SEQ ID NO: 701217 - DNA, 20 bp, mouse
ggggactagcctagaaggaa

SEQ ID NO: 701218 - DNA, 20 bp, mouse
gctgggcagtacatcaggtt

SEQ ID NO: 701219 - DNA, 20 bp, mouse
gctaccctccggcgtaatgc

SEQ ID NO: 701220 - DNA, 20 bp, mouse
gtagctgcgctcgccctcta

SEQ ID NO: 701221 - DNA, 20 bp, mouse
ggcaggctttggaccgtaga

SEQ ID NO: 701222 - DNA, 20 bp, mouse
gaaacggggcggagcctcgg

SEQ ID NO: 701223 - DNA, 20 bp, mouse
gtaaggagttcgcttctata

SEQ ID NO: 701224 - DNA, 20 bp, mouse
gccttgctgggcagtacatc

SEQ ID NO: 701225 - DNA, 20 bp, mouse
gaggaatggttgcgtcaaga

SEQ ID NO: 701226 - DNA, 20 bp, mouse
gctgaggactgcgtggagga

SEQ ID NO: 701227 - DNA, 20 bp, mouse
gcctgctgaggactgcgtgg

SEQ ID NO: 701228 - DNA, 20 bp, mouse
gcctcagcaggagcggggat

SEQ ID NO: 701229 - DNA, 20 bp, mouse
ggaaactgaggcagtggtta

SEQ ID NO: 701230 - DNA, 20 bp, mouse
gttggggtgtacagtgtgca

SEQ ID NO: 701231 - DNA, 20 bp, mouse
gagtgtccctcatccctaaa

SEQ ID NO: 701232 - DNA, 20 bp, mouse
gcgctctgacgtggaccctg

SEQ ID NO: 701233 - DNA, 20 bp, mouse
ggccgggcggcattcctggg

SEQ ID NO: 701234 - DNA, 20 bp, mouse
gcgggccgggcggcattcct

SEQ ID NO: 701235 - DNA, 20 bp, mouse
gaatggctaagactaggttg

SEQ ID NO: 701236 - DNA, 20 bp, mouse
ggggaaaggggcggaccgag

SEQ ID NO: 701237 - DNA, 20 bp, mouse
gccccccccgctcgaagcat

SEQ ID NO: 701238 - DNA, 20 bp, mouse
gttcccggcaggctccgctc

SEQ ID NO: 701239 - DNA, 20 bp, mouse
ggccgagaactgtagtgctg

SEQ ID NO: 701240 - DNA, 20 bp, mouse
ggtagtgctgcggacccgag

SEQ ID NO: 701241 - DNA, 20 bp, mouse
ggaagggcgtggcctcggtt

SEQ ID NO: 701242 - DNA, 20 bp, mouse
gaggccacgcccttccactc

SEQ ID NO: 701243 - DNA, 20 bp, mouse
gcagttctcggcagcccagg

SEQ ID NO: 701244 - DNA, 20 bp, mouse
ggggttggttgttggtgggg

SEQ ID NO: 701245 - DNA, 20 bp, mouse
ggaagctccgcccccaaccg

SEQ ID NO: 701246 - DNA, 20 bp, mouse
gggggccggcatgtggaaag

SEQ ID NO: 701247 - DNA, 20 bp, mouse
gcccgccggaagtgtagcgg

SEQ ID NO: 701248 - DNA, 20 bp, mouse
gggccccgccggaagtgtag

SEQ ID NO: 701249 - DNA, 20 bp, mouse
gacctcgggcaccggcccta

SEQ ID NO: 701250 - DNA, 20 bp, mouse
ggtgccccaaaggtgctaca

SEQ ID NO: 701251 - DNA, 20 bp, mouse
gagcccgggagtctgcccta

SEQ ID NO: 701252 - DNA, 20 bp, mouse
ggaataaagcgagctgactg

SEQ ID NO: 701253 - DNA, 20 bp, mouse
ggaaagggccggagactttg

SEQ ID NO: 701254 - DNA, 20 bp, mouse
gccggcatgtggaaagaggc

SEQ ID NO: 701255 - DNA, 20 bp, mouse
gtggccctgtagcacctttg

SEQ ID NO: 701256 - DNA, 20 bp, mouse
gggcgagaaaggccccactc

SEQ ID NO: 701257 - DNA, 20 bp, mouse
ggggcaggggctggtctgct

SEQ ID NO: 701258 - DNA, 20 bp, mouse
gcagcccctgccccctaaag

SEQ ID NO: 701259 - DNA, 20 bp, mouse
gaagccactttagggggcag

SEQ ID NO: 701260 - DNA, 20 bp, mouse
gctaaagtggcttcccaaag

SEQ ID NO: 701261 - DNA, 20 bp, mouse
gcctgtggtacttgtcccta

SEQ ID NO: 701262 - DNA, 20 bp, mouse
gaccaggcagtaggcgagaa

SEQ ID NO: 701263 - DNA, 20 bp, mouse
ggttactcctgcttcagccc

SEQ ID NO: 701264 - DNA, 20 bp, mouse
gcaaaccaaaaccagacctg

SEQ ID NO: 701265 - DNA, 20 bp, mouse
ggcttggctgctcctgtttg

SEQ ID NO: 701266 - DNA, 20 bp, mouse
gcccggaaagccagcgtctg

SEQ ID NO: 701267 - DNA, 20 bp, mouse
gtgggcgtgtggctgtctag

SEQ ID NO: 701268 - DNA, 20 bp, mouse
gctgtctaggggcacttggg

SEQ ID NO: 701269 - DNA, 20 bp, mouse
gtggctgtctaggggcactt

SEQ ID NO: 701270 - DNA, 20 bp, mouse
gcggagtgtagggtgaacac

SEQ ID NO: 701271 - DNA, 20 bp, mouse
gaagccagttccctcctcga

SEQ ID NO: 701272 - DNA, 20 bp, mouse
gtgcagttccagtgggcgtg

SEQ ID NO: 701273 - DNA, 20 bp, mouse
ggtgagggctgggtctggtc

SEQ ID NO: 701274 - DNA, 20 bp, mouse
ggcgcaatctagcttctatc

SEQ ID NO: 701275 - DNA, 20 bp, mouse
gagcttctatccggagtgta

SEQ ID NO: 701276 - DNA, 20 bp, mouse
ggagcagcgctgggtcaagt

SEQ ID NO: 701277 - DNA, 20 bp, mouse
ggtgcacttaactctctcca

SEQ ID NO: 701278 - DNA, 20 bp, mouse
gaagctccgggtgtgtaggg

SEQ ID NO: 701279 - DNA, 20 bp, mouse
gttgaggaagcttagagaga

SEQ ID NO: 701280 - DNA, 20 bp, mouse
gtgtgtagggaggacgcttg

SEQ ID NO: 701281 - DNA, 20 bp, mouse
gtgggtcaagttggcatccc

SEQ ID NO: 701282 - DNA, 20 bp, mouse
gaagtgggagggactccgca

SEQ ID NO: 701283 - DNA, 20 bp, mouse
ggagaagctccgggtgtgta

SEQ ID NO: 701284 - DNA, 20 bp, mouse
gagtgcaccccgctttgcca

SEQ ID NO: 701285 - DNA, 20 bp, mouse
gggtgtagacatacatccag

SEQ ID NO: 701286 - DNA, 20 bp, mouse
gtcagctttggcaaactgaa

SEQ ID NO: 701287 - DNA, 20 bp, mouse
gcctcgcagtggttgaggaa

SEQ ID NO: 701288 - DNA, 20 bp, mouse
gccaaatggcatctcagctt

SEQ ID NO: 701289 - DNA, 20 bp, mouse
ggagctttgccaacgctaga

SEQ ID NO: 701290 - DNA, 20 bp, mouse
gggtttgtaggcagcaactc

SEQ ID NO: 701291 - DNA, 20 bp, mouse
gttgctgcctacaaaccaaa

SEQ ID NO: 701292 - DNA, 20 bp, mouse
gctctcaccccctctagcgt

SEQ ID NO: 701293 - DNA, 20 bp, mouse
gttaaagcttcacctcgcag

SEQ ID NO: 701294 - DNA, 20 bp, mouse
ggcccagctcttgttcagtg

SEQ ID NO: 701295 - DNA, 20 bp, mouse
ggagatgccatttggtttgt

SEQ ID NO: 701296 - DNA, 20 bp, mouse
gcacgcgcgctctggccccc

SEQ ID NO: 701297 - DNA, 20 bp, mouse
gcggcccccgcccctccggg

SEQ ID NO: 701298 - DNA, 20 bp, mouse
gggcgagggcgggtagcccg

SEQ ID NO: 701299 - DNA, 20 bp, mouse
gggtcgccggacaggttcgc

SEQ ID NO: 701300 - DNA, 20 bp, mouse
gccgggaggaagaagagggt

SEQ ID NO: 701301 - DNA, 20 bp, mouse
ggaggggcgggggccggcga

SEQ ID NO: 701302 - DNA, 20 bp, mouse
gcctcccgcgacggtgtccc

SEQ ID NO: 701303 - DNA, 20 bp, mouse
gtaggtggggaggcggatga

SEQ ID NO: 701304 - DNA, 20 bp, mouse
gggcgcgcgggtcgccggac

SEQ ID NO: 701305 - DNA, 20 bp, mouse
gctgaacctgcgaacctgtc

SEQ ID NO: 701306 - DNA, 20 bp, mouse
ggctgctaggcgggctgaac

SEQ ID NO: 701307 - DNA, 20 bp, mouse
gaggtccggggactcaacca

SEQ ID NO: 701308 - DNA, 20 bp, mouse
gcggcaggggagactgggtg

SEQ ID NO: 701309 - DNA, 20 bp, mouse
gcggccgctcgctgctaggc

SEQ ID NO: 701310 - DNA, 20 bp, mouse
ggggaccacggcgggcacgt

SEQ ID NO: 701311 - DNA, 20 bp, mouse
gaacctctctccagaggccg

SEQ ID NO: 701312 - DNA, 20 bp, mouse
gaccacagattccctcggac

SEQ ID NO: 701313 - DNA, 20 bp, mouse
gcacggcgggcacgtgggat

SEQ ID NO: 701314 - DNA, 20 bp, mouse
gctgccgcagtcccggtgcc

SEQ ID NO: 701315 - DNA, 20 bp, mouse
gactgggtgcggttcggctg

SEQ ID NO: 701316 - DNA, 20 bp, mouse
gcggccgcagacctcagctt

SEQ ID NO: 701317 - DNA, 20 bp, mouse
ggagcagggtgcgagacctg

SEQ ID NO: 701318 - DNA, 20 bp, mouse
gtggggcaagcctggtgcgt

SEQ ID NO: 701319 - DNA, 20 bp, mouse
gtccccgaggggcggtccca

SEQ ID NO: 701320 - DNA, 20 bp, mouse
gcggtcggggttcttagaag

SEQ ID NO: 701321 - DNA, 20 bp, mouse
gtcccaaggtccccactccc

SEQ ID NO: 701322 - DNA, 20 bp, mouse
ggggcccaagctgaggtctg

SEQ ID NO: 701323 - DNA, 20 bp, mouse
gggccctgaaaggatagcga

SEQ ID NO: 701324 - DNA, 20 bp, mouse
gctcccgggcagagggagca

SEQ ID NO: 701325 - DNA, 20 bp, mouse
gcaccaggcttgccccagct

SEQ ID NO: 701326 - DNA, 20 bp, mouse
gcccaggctggattctcctg

SEQ ID NO: 701327 - DNA, 20 bp, mouse
gtgatggctgctttggaact

SEQ ID NO: 701328 - DNA, 20 bp, mouse
gaacgaatataacgttaaaa

SEQ ID NO: 701329 - DNA, 20 bp, mouse
gtctctatagtgtgaaagac

SEQ ID NO: 701330 - DNA, 20 bp, mouse
gcttccatccataagcagag

SEQ ID NO: 701331 - DNA, 20 bp, mouse
gttcgttgccgctctgctta

SEQ ID NO: 701332 - DNA, 20 bp, mouse
gaggggcgaggggcgggctg

SEQ ID NO: 701333 - DNA, 20 bp, mouse
ggaggggcgggctgaggcta

SEQ ID NO: 701334 - DNA, 20 bp, mouse
gggagaatccagcctgggta

SEQ ID NO: 701335 - DNA, 20 bp, mouse
gcccactttgcgtacgttaa

SEQ ID NO: 701336 - DNA, 20 bp, mouse
gaggggcgggtctactaaca

SEQ ID NO: 701337 - DNA, 20 bp, mouse
gaggcgcggagccattcctg

SEQ ID NO: 701338 - DNA, 20 bp, mouse
gcccgctactgcatccggga

SEQ ID NO: 701339 - DNA, 20 bp, mouse
gcctagccaatcagcatcag

SEQ ID NO: 701340 - DNA, 20 bp, mouse
gagcatgcgcagcagaggcg

SEQ ID NO: 701341 - DNA, 20 bp, mouse
ggctgggagtcatcactaaa

SEQ ID NO: 701342 - DNA, 20 bp, mouse
gctactgcatccgggagggc

SEQ ID NO: 701343 - DNA, 20 bp, mouse
gggcacgggctcgctcccca

SEQ ID NO: 701344 - DNA, 20 bp, mouse
gccgccgccaactgccccct

SEQ ID NO: 701345 - DNA, 20 bp, mouse
gaagaaggcgggacaaccca

SEQ ID NO: 701346 - DNA, 20 bp, mouse
gggcggagccagtaggaatt

SEQ ID NO: 701347 - DNA, 20 bp, mouse
ggggtccattacccgggaag

SEQ ID NO: 701348 - DNA, 20 bp, mouse
gaggggcgggtccattaccc

SEQ ID NO: 701349 - DNA, 20 bp, mouse
gtcacggggcgagcatgcgc

SEQ ID NO: 701350 - DNA, 20 bp, mouse
ggctcgatgaataggcgtga

SEQ ID NO: 701351 - DNA, 20 bp, mouse
gagggagtcagagtcaaata

SEQ ID NO: 701352 - DNA, 20 bp, mouse
gcaggtagcccaattcctac

SEQ ID NO: 701353 - DNA, 20 bp, mouse
gccgcccccttcccgggtaa

SEQ ID NO: 701354 - DNA, 20 bp, mouse
gagggctgggctaatgacaa

SEQ ID NO: 701355 - DNA, 20 bp, mouse
ggagtcagagtcaaatacgg

SEQ ID NO: 701356 - DNA, 20 bp, mouse
gaatcccagcccaggacttc

SEQ ID NO: 701357 - DNA, 20 bp, mouse
gtgcaccagggggtggttca

SEQ ID NO: 701358 - DNA, 20 bp, mouse
gaggagaatcgtaggctctg

SEQ ID NO: 701359 - DNA, 20 bp, mouse
gtgggctgggattacgggac

SEQ ID NO: 701360 - DNA, 20 bp, mouse
ggagctcctcctgaagtcct

SEQ ID NO: 701361 - DNA, 20 bp, mouse
gtcgcattcaacttcctcat

SEQ ID NO: 701362 - DNA, 20 bp, mouse
ggaggaagttgaatgcgacc

SEQ ID NO: 701363 - DNA, 20 bp, mouse
gacagccctgaaccaccccc

SEQ ID NO: 701364 - DNA, 20 bp, mouse
gaatctcttgggctgcacca

SEQ ID NO: 701365 - DNA, 20 bp, mouse
gtaactgctctcagagttgt

SEQ ID NO: 701366 - DNA, 20 bp, mouse
ggccccttcagtgccccctt

SEQ ID NO: 701367 - DNA, 20 bp, mouse
gtctagtacttcataattgg

SEQ ID NO: 701368 - DNA, 20 bp, mouse
ggagccaaagggggcactga

SEQ ID NO: 701369 - DNA, 20 bp, mouse
ggttgcaggaggagccaaag

SEQ ID NO: 701370 - DNA, 20 bp, mouse
ggggggcactgaaggggcgg

SEQ ID NO: 701371 - DNA, 20 bp, mouse
gtgaagtactagagatagac

SEQ ID NO: 701372 - DNA, 20 bp, mouse
ggcagccacagccgcaggga

SEQ ID NO: 701373 - DNA, 20 bp, mouse
gatagacgggttttcctact

SEQ ID NO: 701374 - DNA, 20 bp, mouse
ggcaacatgttttattttca

SEQ ID NO: 701375 - DNA, 20 bp, mouse
ggtacttctgacctggaatt

SEQ ID NO: 701376 - DNA, 20 bp, mouse
gccggctcgggcaggtgcat

SEQ ID NO: 701377 - DNA, 20 bp, mouse
gcctggggccgggtgcgcgg

SEQ ID NO: 701378 - DNA, 20 bp, mouse
ggcctcgcctgggtcggctc

SEQ ID NO: 701379 - DNA, 20 bp, mouse
gccccctggggccgggtgcg

SEQ ID NO: 701380 - DNA, 20 bp, mouse
gctgccgagcagtgcacctg

SEQ ID NO: 701381 - DNA, 20 bp, mouse
gcgggcgcgggcgacggccg

SEQ ID NO: 701382 - DNA, 20 bp, mouse
ggctcgggcaggtgcatcgg

SEQ ID NO: 701383 - DNA, 20 bp, mouse
gtgggcccagagatgatctg

SEQ ID NO: 701384 - DNA, 20 bp, mouse
gcatggctgcggaggacccc

SEQ ID NO: 701385 - DNA, 20 bp, mouse
gccgagcagtgcacctgcgg

SEQ ID NO: 701386 - DNA, 20 bp, mouse
gcaaactgtcggagtgaggg

SEQ ID NO: 701387 - DNA, 20 bp, mouse
gaaaccgcgcgcgctcctgg

SEQ ID NO: 701388 - DNA, 20 bp, mouse
gtggagggccgcgctgtagt

SEQ ID NO: 701389 - DNA, 20 bp, mouse
gtccgctcgctgtggggccg

SEQ ID NO: 701390 - DNA, 20 bp, mouse
gtacgcgtcccggcagtccg

SEQ ID NO: 701391 - DNA, 20 bp, mouse
gggccctccaggagcgcgcg

SEQ ID NO: 701392 - DNA, 20 bp, mouse
gcacccgccccgcggactgc

SEQ ID NO: 701393 - DNA, 20 bp, mouse
gacaagctggacgccgtgaa

SEQ ID NO: 701394 - DNA, 20 bp, mouse
ggaagtgtcagattttacgt

SEQ ID NO: 701395 - DNA, 20 bp, mouse
gtcccggcagtccgcggggc

SEQ ID NO: 701396 - DNA, 20 bp, mouse
gcgccctggtggcccttggt

SEQ ID NO: 701397 - DNA, 20 bp, mouse
gggcgggaggctctgtgatt

SEQ ID NO: 701398 - DNA, 20 bp, mouse
gaagttaactgggaacacta

SEQ ID NO: 701399 - DNA, 20 bp, mouse
gccaggcgcgaggccgccga

SEQ ID NO: 701400 - DNA, 20 bp, mouse
gctgcgaggcgccccctgag

SEQ ID NO: 701401 - DNA, 20 bp, mouse
gaacagacctgagtcacaga

SEQ ID NO: 701402 - DNA, 20 bp, mouse
gaggatgtagccacagagcg

SEQ ID NO: 701403 - DNA, 20 bp, mouse
gggggcgcctcgcagtccgg

SEQ ID NO: 701404 - DNA, 20 bp, mouse
gggaggcgcggctgtcagtt

SEQ ID NO: 701405 - DNA, 20 bp, mouse
ggcggactgcaaagttaact

SEQ ID NO: 701406 - DNA, 20 bp, mouse
gccagctctggccaaggggt

SEQ ID NO: 701407 - DNA, 20 bp, mouse
gcaagactctgcccaccgaa

SEQ ID NO: 701408 - DNA, 20 bp, mouse
gtggctgaaaccagaccctt

SEQ ID NO: 701409 - DNA, 20 bp, mouse
gggtacataacccagctcag

SEQ ID NO: 701410 - DNA, 20 bp, mouse
gcctctgtagactatctgtg

SEQ ID NO: 701411 - DNA, 20 bp, mouse
gagagccagctctggccaag

SEQ ID NO: 701412 - DNA, 20 bp, mouse
gaagaccacaagtgagtgaa

SEQ ID NO: 701413 - DNA, 20 bp, mouse
gctcctccaggctccaaccc

SEQ ID NO: 701414 - DNA, 20 bp, mouse
gttaacgcaattgtagcttc

SEQ ID NO: 701415 - DNA, 20 bp, mouse
gtgaaaccagacccttcggt

SEQ ID NO: 701416 - DNA, 20 bp, mouse
gtctccgcacacaaccctca

SEQ ID NO: 701417 - DNA, 20 bp, mouse
gacactgaacacatagcatt

SEQ ID NO: 701418 - DNA, 20 bp, mouse
gtccccctgagggttgtgtg

SEQ ID NO: 701419 - DNA, 20 bp, mouse
gtctctgaatggtgatggta

SEQ ID NO: 701420 - DNA, 20 bp, mouse
gaagtccttagaggtttagc

SEQ ID NO: 701421 - DNA, 20 bp, mouse
gtgaacacatagcattcgga

SEQ ID NO: 701422 - DNA, 20 bp, mouse
ggggttgtgtgcggagagat

SEQ ID NO: 701423 - DNA, 20 bp, mouse
ggcagaagagttccccctga

SEQ ID NO: 701424 - DNA, 20 bp, mouse
ggcaagagatgcacttctta

SEQ ID NO: 701425 - DNA, 20 bp, mouse
gagatgcacttcttaaggtc

SEQ ID NO: 701426 - DNA, 20 bp, mouse
ggggaggagcttatcttaaa

SEQ ID NO: 701427 - DNA, 20 bp, mouse
gggtctgtgggccacctctc

SEQ ID NO: 701428 - DNA, 20 bp, mouse
gggccaaagagtgaaactgg

SEQ ID NO: 701429 - DNA, 20 bp, mouse
gcaggagagtcattggaaca

SEQ ID NO: 701430 - DNA, 20 bp, mouse
gcagcacatcacaggagctg

SEQ ID NO: 701431 - DNA, 20 bp, mouse
gcaggtctgagtggccagag

SEQ ID NO: 701432 - DNA, 20 bp, mouse
ggagggccaaagagtgaaac

SEQ ID NO: 701433 - DNA, 20 bp, mouse
gtctgccaccactaaagcga

SEQ ID NO: 701434 - DNA, 20 bp, mouse
ggttactaactactgctaac

SEQ ID NO: 701435 - DNA, 20 bp, mouse
gttggccctcgctttagtgg

SEQ ID NO: 701436 - DNA, 20 bp, mouse
gaaggctgggtgcctttaga

SEQ ID NO: 701437 - DNA, 20 bp, mouse
gaatcagggtgtcactaaga

SEQ ID NO: 701438 - DNA, 20 bp, mouse
gaaagtttggcgccctctaa

SEQ ID NO: 701439 - DNA, 20 bp, mouse
gggaatgtgtaggaatgtgg

SEQ ID NO: 701440 - DNA, 20 bp, mouse
ggtaggaatgtgggggaagt

SEQ ID NO: 701441 - DNA, 20 bp, mouse
gggcttccgttttagttcga

SEQ ID NO: 701442 - DNA, 20 bp, mouse
gtccaatggacaagaggtaa

SEQ ID NO: 701443 - DNA, 20 bp, mouse
gacaccctccaatggacaag

SEQ ID NO: 701444 - DNA, 20 bp, mouse
ggttggcacagagtagtgga

SEQ ID NO: 701445 - DNA, 20 bp, mouse
gaaaacggaagccattattt

SEQ ID NO: 701446 - DNA, 20 bp, mouse
gttctcagcagcacccgcat

SEQ ID NO: 701447 - DNA, 20 bp, mouse
gggtgggcgggataggaggt

SEQ ID NO: 701448 - DNA, 20 bp, mouse
gcagcagaggccaataggga

SEQ ID NO: 701449 - DNA, 20 bp, mouse
gatagggagagcgaccctcc

SEQ ID NO: 701450 - DNA, 20 bp, mouse
gtcctatcccgcccacccaa

SEQ ID NO: 701451 - DNA, 20 bp, mouse
gagggtcgctctccctatgc

SEQ ID NO: 701452 - DNA, 20 bp, mouse
gaaacagctcaaaaatgctt

SEQ ID NO: 701453 - DNA, 20 bp, mouse
gagggtgcacgcccttgggt

SEQ ID NO: 701454 - DNA, 20 bp, mouse
gaagaagggtgcacgccctt

SEQ ID NO: 701455 - DNA, 20 bp, mouse
gcctcatataaacacagcag

SEQ ID NO: 701456 - DNA, 20 bp, mouse
ggagggaacaagtaagaaag

SEQ ID NO: 701457 - DNA, 20 bp, mouse
ggggttgtaaagtgaaactc

SEQ ID NO: 701458 - DNA, 20 bp, mouse
gttgtggtgggaataagaga

SEQ ID NO: 701459 - DNA, 20 bp, mouse
gtggagaaaggacttgaacg

SEQ ID NO: 701460 - DNA, 20 bp, mouse
ggagaaaaattgcttgtggt

SEQ ID NO: 701461 - DNA, 20 bp, mouse
ggttgagctccgctaaaacc

SEQ ID NO: 701462 - DNA, 20 bp, mouse
gtttctcttccaggttttag

SEQ ID NO: 701463 - DNA, 20 bp, mouse
gaagagcagactgtggatct

SEQ ID NO: 701464 - DNA, 20 bp, mouse
gagtttgttgggccaacagt

SEQ ID NO: 701465 - DNA, 20 bp, mouse
gtcttatagtccaggtgctt

SEQ ID NO: 701466 - DNA, 20 bp, mouse
gtcccatgactcttctaatt

SEQ ID NO: 701467 - DNA, 20 bp, mouse
gaaatagtttttgtcagcca

SEQ ID NO: 701468 - DNA, 20 bp, mouse
gtccaaattagaagagtcat

SEQ ID NO: 701469 - DNA, 20 bp, mouse
gaaaagaaacatttggacta

SEQ ID NO: 701470 - DNA, 20 bp, mouse
ggacccctaaaccctctgaa

SEQ ID NO: 701471 - DNA, 20 bp, mouse
gtaaaccctctgaaaggtgg

SEQ ID NO: 701472 - DNA, 20 bp, mouse
gagaagtgaacattaacttg

SEQ ID NO: 701473 - DNA, 20 bp, mouse
gaaaatgtcatggacatatt

SEQ ID NO: 701474 - DNA, 20 bp, mouse
ggggaaagcataataaaaat

SEQ ID NO: 701475 - DNA, 20 bp, mouse
gagcaatgttgttatttaac

SEQ ID NO: 701476 - DNA, 20 bp, mouse
gtgtgagctccgccccttac

SEQ ID NO: 701477 - DNA, 20 bp, mouse
ggcaaaattccgtccgaccc

SEQ ID NO: 701478 - DNA, 20 bp, mouse
gtggctttttcagtcctgta

SEQ ID NO: 701479 - DNA, 20 bp, mouse
gggactgaaaaagccagctt

SEQ ID NO: 701480 - DNA, 20 bp, mouse
gagactgcagaaataacttc

SEQ ID NO: 701481 - DNA, 20 bp, mouse
gaaacccataaagtagacac

SEQ ID NO: 701482 - DNA, 20 bp, mouse
gatatctcaaagaggggctg

SEQ ID NO: 701483 - DNA, 20 bp, mouse
gttcagcagcaagagacttc

SEQ ID NO: 701484 - DNA, 20 bp, mouse
ggataagtgcagactcccgg

SEQ ID NO: 701485 - DNA, 20 bp, mouse
gagataacccagtggaaaga

SEQ ID NO: 701486 - DNA, 20 bp, mouse
gggtgcgccctgataccctg

SEQ ID NO: 701487 - DNA, 20 bp, mouse
gactgcccgagaggaggcaa

SEQ ID NO: 701488 - DNA, 20 bp, mouse
gggcgcgcgcacttggtgaa

SEQ ID NO: 701489 - DNA, 20 bp, mouse
gtaaagggcagtactaagtc

SEQ ID NO: 701490 - DNA, 20 bp, mouse
ggggcccgaccagaagtgga

SEQ ID NO: 701491 - DNA, 20 bp, mouse
gcacgcgcatgcgccctcct

SEQ ID NO: 701492 - DNA, 20 bp, mouse
ggggccgcgcctgagagggc

SEQ ID NO: 701493 - DNA, 20 bp, mouse
gggcaagggcggagcggaga

SEQ ID NO: 701494 - DNA, 20 bp, mouse
ggaagcgaggacatgggaaa

SEQ ID NO: 701495 - DNA, 20 bp, mouse
gaaaggcgggaaagcgtaaa

SEQ ID NO: 701496 - DNA, 20 bp, mouse
ggatttgggatttttctcag

SEQ ID NO: 701497 - DNA, 20 bp, mouse
gaaatcggcaagtgtatgga

SEQ ID NO: 701498 - DNA, 20 bp, mouse
ggttaaaatcggcaagtgta

SEQ ID NO: 701499 - DNA, 20 bp, mouse
gacttaaaactctcagggag

SEQ ID NO: 701500 - DNA, 20 bp, mouse
gccatccaaagggttaaaat

SEQ ID NO: 701501 - DNA, 20 bp, mouse
gtgctgatctcgcgagattt

SEQ ID NO: 701502 - DNA, 20 bp, mouse
gcttgccgattttaaccctt

SEQ ID NO: 701503 - DNA, 20 bp, mouse
gtttatacacatgaataaca

SEQ ID NO: 701504 - DNA, 20 bp, mouse
gtatcagtttcttaccagtt

SEQ ID NO: 701505 - DNA, 20 bp, mouse
gagagctgaggagtgaacct

SEQ ID NO: 701506 - DNA, 20 bp, mouse
gtgacgtcacggggtacggt

SEQ ID NO: 701507 - DNA, 20 bp, mouse
gccggcgcgcagggcctcgt

SEQ ID NO: 701508 - DNA, 20 bp, mouse
gccaataggcgcgcggtcgg

SEQ ID NO: 701509 - DNA, 20 bp, mouse
gctgatctcccgccaggtct

SEQ ID NO: 701510 - DNA, 20 bp, mouse
gagagtccgggtgacgtcac

SEQ ID NO: 701511 - DNA, 20 bp, mouse
gcgggtgacgtcacggggta

SEQ ID NO: 701512 - DNA, 20 bp, mouse
gggcggctgcggcggcagga

SEQ ID NO: 701513 - DNA, 20 bp, mouse
gcggaccggaccctcctccc

SEQ ID NO: 701514 - DNA, 20 bp, mouse
gccctgcgcgccggggagga

SEQ ID NO: 701515 - DNA, 20 bp, mouse
gggggcgggaggagtcggac

SEQ ID NO: 701516 - DNA, 20 bp, mouse
gcaccagagctagggtggga

SEQ ID NO: 701517 - DNA, 20 bp, mouse
gcagggatagcatgcaccgg

SEQ ID NO: 701518 - DNA, 20 bp, mouse
gctcttgggcaccagagcta

SEQ ID NO: 701519 - DNA, 20 bp, mouse
gtggtgcccaagagcatgca

SEQ ID NO: 701520 - DNA, 20 bp, mouse
gaacacccgccacccggtct

SEQ ID NO: 701521 - DNA, 20 bp, mouse
gtccaaggcgatttccaccc

SEQ ID NO: 701522 - DNA, 20 bp, mouse
gtgggcaccagagctagggt

SEQ ID NO: 701523 - DNA, 20 bp, mouse
gggggagtcggggaccagaa

SEQ ID NO: 701524 - DNA, 20 bp, mouse
gcgcgcggagggcggatcag

SEQ ID NO: 701525 - DNA, 20 bp, mouse
gagaagggaacacgcgcgga

SEQ ID NO: 701526 - DNA, 20 bp, mouse
ggggaggggcgtggcctgac

SEQ ID NO: 701527 - DNA, 20 bp, mouse
gcaggagccgggtggtaagt

SEQ ID NO: 701528 - DNA, 20 bp, mouse
gtggcctgactggttaggat

SEQ ID NO: 701529 - DNA, 20 bp, mouse
gaccgctgccaagttttctc

SEQ ID NO: 701530 - DNA, 20 bp, mouse
gaaggggcggggaaaccttt

SEQ ID NO: 701531 - DNA, 20 bp, mouse
gcagctgtgtagaaggacgg

SEQ ID NO: 701532 - DNA, 20 bp, mouse
ggctccacccacttaccacc

SEQ ID NO: 701533 - DNA, 20 bp, mouse
gggcggggaaacctttggga

SEQ ID NO: 701534 - DNA, 20 bp, mouse
ggaaacctttgggaggggcg

SEQ ID NO: 701535 - DNA, 20 bp, mouse
ggccagagaaaacttggcag

SEQ ID NO: 701536 - DNA, 20 bp, mouse
ggctaggcgcgatgggtaga

SEQ ID NO: 701537 - DNA, 20 bp, mouse
gggaaggacgtgaacccctg

SEQ ID NO: 701538 - DNA, 20 bp, mouse
gggtagaaggcagatggcga

SEQ ID NO: 701539 - DNA, 20 bp, mouse
gcgcaggtcccaaaagagtt

SEQ ID NO: 701540 - DNA, 20 bp, mouse
gagggagcctgtgggcggga

SEQ ID NO: 701541 - DNA, 20 bp, mouse
gtgcgccaaagggagcctgt

SEQ ID NO: 701542 - DNA, 20 bp, mouse
gagaaggcagatggcgatgg

SEQ ID NO: 701543 - DNA, 20 bp, mouse
gccgcccctcagctccggtg

SEQ ID NO: 701544 - DNA, 20 bp, mouse
gcccggggcaactgcgccaa

SEQ ID NO: 701545 - DNA, 20 bp, mouse
ggggcctgggaccgtgacgt

SEQ ID NO: 701546 - DNA, 20 bp, mouse
gcgcccggggcggggatcct

SEQ ID NO: 701547 - DNA, 20 bp, mouse
gggtccgaggatccccgccc

SEQ ID NO: 701548 - DNA, 20 bp, mouse
gccgccccgggcgagctgtt

SEQ ID NO: 701549 - DNA, 20 bp, mouse
gcgggcccgccccgatccca

SEQ ID NO: 701550 - DNA, 20 bp, mouse
ggcgggccgcggtgcaccct

SEQ ID NO: 701551 - DNA, 20 bp, mouse
gcgagcaaggcagggaccgt

SEQ ID NO: 701552 - DNA, 20 bp, mouse
gcctccgaacagctcgcccg

SEQ ID NO: 701553 - DNA, 20 bp, mouse
ggtgcaccctgggatcgggg

SEQ ID NO: 701554 - DNA, 20 bp, mouse
gcccccgcgcgcgcgagtgc

SEQ ID NO: 701555 - DNA, 20 bp, mouse
ggggatcctcggaccctcgg

SEQ ID NO: 701556 - DNA, 20 bp, mouse
ggcaccgcgccggttaaaag

SEQ ID NO: 701557 - DNA, 20 bp, mouse
gggaacgtgcgtaaaagcac

SEQ ID NO: 701558 - DNA, 20 bp, mouse
gcgctccatccatggtgggt

SEQ ID NO: 701559 - DNA, 20 bp, mouse
gcgtaaaagcaccggggcgc

SEQ ID NO: 701560 - DNA, 20 bp, mouse
gactcggtagccaatagcaa

SEQ ID NO: 701561 - DNA, 20 bp, mouse
ggttccgctccatccatggt

SEQ ID NO: 701562 - DNA, 20 bp, mouse
gatggtgcaaccccagtcta

SEQ ID NO: 701563 - DNA, 20 bp, mouse
ggaggagatccgcttttaac

SEQ ID NO: 701564 - DNA, 20 bp, mouse
gtcctcgggaggcggtgcca

SEQ ID NO: 701565 - DNA, 20 bp, mouse
ggcgaacgacggcagattag

SEQ ID NO: 701566 - DNA, 20 bp, mouse
gaacaccagggaggtaataa

SEQ ID NO: 701567 - DNA, 20 bp, mouse
gaggtaataatggtcaggaa

SEQ ID NO: 701568 - DNA, 20 bp, mouse
gcagggaggtaataatggtc

SEQ ID NO: 701569 - DNA, 20 bp, mouse
ggaaggggaacttgacattg

SEQ ID NO: 701570 - DNA, 20 bp, mouse
ggggaacttgacattgggga

SEQ ID NO: 701571 - DNA, 20 bp, mouse
ggaagggttgggaagcccaa

SEQ ID NO: 701572 - DNA, 20 bp, mouse
ggggtcaaacaacgggttaa

SEQ ID NO: 701573 - DNA, 20 bp, mouse
gttcctgagggcctgtttca

SEQ ID NO: 701574 - DNA, 20 bp, mouse
gggctgataatgttgcacag

SEQ ID NO: 701575 - DNA, 20 bp, mouse
gtagggttgagtggatttca

SEQ ID NO: 701576 - DNA, 20 bp, mouse
gtgcgccccgcccgcctcgt

SEQ ID NO: 701577 - DNA, 20 bp, mouse
gcaaagggagggaactttcc

SEQ ID NO: 701578 - DNA, 20 bp, mouse
ggcgcccgagcgcatctaaa

SEQ ID NO: 701579 - DNA, 20 bp, mouse
ggtattagagacttagacaa

SEQ ID NO: 701580 - DNA, 20 bp, mouse
gctcgcgatgagaccccacg

SEQ ID NO: 701581 - DNA, 20 bp, mouse
gtctctaatacgctctggcc

SEQ ID NO: 701582 - DNA, 20 bp, mouse
gctacgcagccggagctctt

SEQ ID NO: 701583 - DNA, 20 bp, mouse
gaacaatcggtgctaagatg

SEQ ID NO: 701584 - DNA, 20 bp, mouse
gatgtgcagaaaaaggtgga

SEQ ID NO: 701585 - DNA, 20 bp, mouse
gagcaccgattgtttataat

SEQ ID NO: 701586 - DNA, 20 bp, mouse
gccagagcccgggaactgtg

SEQ ID NO: 701587 - DNA, 20 bp, mouse
gcggggaagcgccccgaagt

SEQ ID NO: 701588 - DNA, 20 bp, mouse
gttgcgggcccgggaagcct

SEQ ID NO: 701589 - DNA, 20 bp, mouse
ggcggcgggcgagcgggttc

SEQ ID NO: 701590 - DNA, 20 bp, mouse
gtaaccgtctgggagtggga

SEQ ID NO: 701591 - DNA, 20 bp, mouse
ggctgcgcgagccccgccga

SEQ ID NO: 701592 - DNA, 20 bp, mouse
gggctgacacggttcgtctc

SEQ ID NO: 701593 - DNA, 20 bp, mouse
gcacacacacttgcgggccc

SEQ ID NO: 701594 - DNA, 20 bp, mouse
ggcccccggccgcctggacc

SEQ ID NO: 701595 - DNA, 20 bp, mouse
ggtgtgtggcatgcgagctc

SEQ ID NO: 701596 - DNA, 20 bp, mouse
gcgcgcagagctgggattcg

SEQ ID NO: 701597 - DNA, 20 bp, mouse
gagccccgctgtgtgtagcc

SEQ ID NO: 701598 - DNA, 20 bp, mouse
gctggcttggcttatggtaa

SEQ ID NO: 701599 - DNA, 20 bp, mouse
gtgtctagccggaactgaaa

SEQ ID NO: 701600 - DNA, 20 bp, mouse
gaggaggcggcggagagcag

SEQ ID NO: 701601 - DNA, 20 bp, mouse
gcccccgccggggcctcttg

SEQ ID NO: 701602 - DNA, 20 bp, mouse
gcaagccaggctacacacag

SEQ ID NO: 701603 - DNA, 20 bp, mouse
gtagttgcgcgtgtactggg

SEQ ID NO: 701604 - DNA, 20 bp, mouse
gagggcgcgcggccaggccg

SEQ ID NO: 701605 - DNA, 20 bp, mouse
gctcccctcaggctgaaacg

SEQ ID NO: 701606 - DNA, 20 bp, mouse
ggggcggggccaacaggcca

SEQ ID NO: 701607 - DNA, 20 bp, mouse
gcgagctggccaccccgcca

SEQ ID NO: 701608 - DNA, 20 bp, mouse
gccaagggggcgtgagcagg

SEQ ID NO: 701609 - DNA, 20 bp, mouse
gggtgagggaggggcggcga

SEQ ID NO: 701610 - DNA, 20 bp, mouse
gtgctcacgcccccttggcg

SEQ ID NO: 701611 - DNA, 20 bp, mouse
gcggccgggtgagcgcggag

SEQ ID NO: 701612 - DNA, 20 bp, mouse
ggcacgaggcggtgagggag

SEQ ID NO: 701613 - DNA, 20 bp, mouse
gcggaccgtgcggtggtgac

SEQ ID NO: 701614 - DNA, 20 bp, mouse
ggcagctgttcggagcccaa

SEQ ID NO: 701615 - DNA, 20 bp, mouse
ggagaagcacgaggcggtga

SEQ ID NO: 701616 - DNA, 20 bp, mouse
gccgccatagggagggtcgt

SEQ ID NO: 701617 - DNA, 20 bp, mouse
gccggcaggccgccataggg

SEQ ID NO: 701618 - DNA, 20 bp, mouse
gcgtcccagcccggctgcag

SEQ ID NO: 701619 - DNA, 20 bp, mouse
gaagggataggggccccggc

SEQ ID NO: 701620 - DNA, 20 bp, mouse
gcctcccacgaccctcccta

SEQ ID NO: 701621 - DNA, 20 bp, mouse
gcatctccgaatgcaggagg

SEQ ID NO: 701622 - DNA, 20 bp, mouse
ggccccggcaggccgccata

SEQ ID NO: 701623 - DNA, 20 bp, mouse
ggtggctctagtcagttaat

SEQ ID NO: 701624 - DNA, 20 bp, mouse
gcagttaatcggctagagca

SEQ ID NO: 701625 - DNA, 20 bp, mouse
gccccagccacgttctccct

SEQ ID NO: 701626 - DNA, 20 bp, mouse
gttaaggctgggactgaccg

SEQ ID NO: 701627 - DNA, 20 bp, mouse
gcgggaccggggccaggtca

SEQ ID NO: 701628 - DNA, 20 bp, mouse
gcggggccaggtcagggtta

SEQ ID NO: 701629 - DNA, 20 bp, mouse
ggacccgtagcaccgtgccg

SEQ ID NO: 701630 - DNA, 20 bp, mouse
gccggtcccgctcttcctta

SEQ ID NO: 701631 - DNA, 20 bp, mouse
ggccaggtcagggttaaggc

SEQ ID NO: 701632 - DNA, 20 bp, mouse
gggggcggggtgaggaccga

SEQ ID NO: 701633 - DNA, 20 bp, mouse
gtgaccgcggcacggtgcta

SEQ ID NO: 701634 - DNA, 20 bp, mouse
ggcagcggccgcgtccacgt

SEQ ID NO: 701635 - DNA, 20 bp, mouse
gtccacgtcgggcgcctggg

SEQ ID NO: 701636 - DNA, 20 bp, mouse
gaggcaggtctcttacttca

SEQ ID NO: 701637 - DNA, 20 bp, mouse
gtaggagagtcatgccaagc

SEQ ID NO: 701638 - DNA, 20 bp, mouse
gagagaagctcctgtgacct

SEQ ID NO: 701639 - DNA, 20 bp, mouse
gggcagggttctgactgttc

SEQ ID NO: 701640 - DNA, 20 bp, mouse
gagtgctacatgactatacc

SEQ ID NO: 701641 - DNA, 20 bp, mouse
ggaaataattcaagagagag

SEQ ID NO: 701642 - DNA, 20 bp, mouse
gacatacttccttgaaacca

SEQ ID NO: 701643 - DNA, 20 bp, mouse
gccattgtagccaaaagacc

SEQ ID NO: 701644 - DNA, 20 bp, mouse
gaacaaaaaataagactcac

SEQ ID NO: 701645 - DNA, 20 bp, mouse
gttttaataaattctactcc

SEQ ID NO: 701646 - DNA, 20 bp, mouse
gcaaacgcctgggttagggg

SEQ ID NO: 701647 - DNA, 20 bp, mouse
gtagagagggtcatgtgtgc

SEQ ID NO: 701648 - DNA, 20 bp, mouse
ggggtcatgtgtgctggaag

SEQ ID NO: 701649 - DNA, 20 bp, mouse
gacagagtgtaacaatcggg

SEQ ID NO: 701650 - DNA, 20 bp, mouse
gctggacagaccaaacgcct

SEQ ID NO: 701651 - DNA, 20 bp, mouse
gggaaggggtagcaggctag

SEQ ID NO: 701652 - DNA, 20 bp, mouse
gctgtccaggaaggggtagc

SEQ ID NO: 701653 - DNA, 20 bp, mouse
gcaaacttcctatcaagggg

SEQ ID NO: 701654 - DNA, 20 bp, mouse
gatcacagagtgtaacaatc

SEQ ID NO: 701655 - DNA, 20 bp, mouse
gggccatcaagtttctttct

SEQ ID NO: 701656 - DNA, 20 bp, mouse
gttcagggaccagtctgagt

SEQ ID NO: 701657 - DNA, 20 bp, mouse
gagaagaatgtgctatcttg

SEQ ID NO: 701658 - DNA, 20 bp, mouse
ggaaccaaagctcctttcac

SEQ ID NO: 701659 - DNA, 20 bp, mouse
gggcaaaagcctactcagac

SEQ ID NO: 701660 - DNA, 20 bp, mouse
gcctgctgggtgcaaattcc

SEQ ID NO: 701661 - DNA, 20 bp, mouse
gccttcagcaagaaacgagc

SEQ ID NO: 701662 - DNA, 20 bp, mouse
ggtctcaaacagagagtaga

SEQ ID NO: 701663 - DNA, 20 bp, mouse
ggtaggcttttgccagtgaa

SEQ ID NO: 701664 - DNA, 20 bp, mouse
gatgaataatgtgagcgttg

SEQ ID NO: 701665 - DNA, 20 bp, mouse
gaacagagagtagacggttc

SEQ ID NO: 701666 - DNA, 20 bp, mouse
gcccgtgagaggccgcgtga

SEQ ID NO: 701667 - DNA, 20 bp, mouse
gaggcggggccgcctgccat

SEQ ID NO: 701668 - DNA, 20 bp, mouse
gtggcagcaaactgagcggg

SEQ ID NO: 701669 - DNA, 20 bp, mouse
gacgcggcctctcacggggc

SEQ ID NO: 701670 - DNA, 20 bp, mouse
gtgaccctcccaaactgcta

SEQ ID NO: 701671 - DNA, 20 bp, mouse
gcacggggcggggcgtgcga

SEQ ID NO: 701672 - DNA, 20 bp, mouse
gcacgtggcagcaaactgag

SEQ ID NO: 701673 - DNA, 20 bp, mouse
gccgtgagccagccaatggc

SEQ ID NO: 701674 - DNA, 20 bp, mouse
gggggcggagcgcgagattg

SEQ ID NO: 701675 - DNA, 20 bp, mouse
ggagccctagcagtttggga

SEQ ID NO: 701676 - DNA, 20 bp, mouse
gcctgcgccgacatcactag

SEQ ID NO: 701677 - DNA, 20 bp, mouse
gcactcgccgggctcttact

SEQ ID NO: 701678 - DNA, 20 bp, mouse
gaagagtggaacgtgttggg

SEQ ID NO: 701679 - DNA, 20 bp, mouse
gcccggcgagtgataactcc

SEQ ID NO: 701680 - DNA, 20 bp, mouse
gatgaagagtggaacgtgtt

SEQ ID NO: 701681 - DNA, 20 bp, mouse
ggggaggaatacaagggagt

SEQ ID NO: 701682 - DNA, 20 bp, mouse
ggaggctcgtagggaggagt

SEQ ID NO: 701683 - DNA, 20 bp, mouse
gtggggctagagagttgggc

SEQ ID NO: 701684 - DNA, 20 bp, mouse
ggagcgcaggcgatgaagag

SEQ ID NO: 701685 - DNA, 20 bp, mouse
gggcgcagggcgggtaaagc

SEQ ID NO: 701686 - DNA, 20 bp, mouse
gcatagaggcgtggggtaga

SEQ ID NO: 701687 - DNA, 20 bp, mouse
ggaaaacctgcattcgggaa

SEQ ID NO: 701688 - DNA, 20 bp, mouse
gtcctcgggtcctaccatag

SEQ ID NO: 701689 - DNA, 20 bp, mouse
gtaccccacgcctctatggt

SEQ ID NO: 701690 - DNA, 20 bp, mouse
gaggcgtggggtagagggcc

SEQ ID NO: 701691 - DNA, 20 bp, mouse
gccccggcgaggcccacttc

SEQ ID NO: 701692 - DNA, 20 bp, mouse
gggtcctaccatagaggcgt

SEQ ID NO: 701693 - DNA, 20 bp, mouse
gtcaacgcttaggatggaac

SEQ ID NO: 701694 - DNA, 20 bp, mouse
gaggcccacttccggttcct

SEQ ID NO: 701695 - DNA, 20 bp, mouse
ggacccgaggaaccggaagt

SEQ ID NO: 701696 - DNA, 20 bp, mouse
gcagctcatctgtccgacgg

SEQ ID NO: 701697 - DNA, 20 bp, mouse
gcagcagctcatctgtccga

SEQ ID NO: 701698 - DNA, 20 bp, mouse
gcgagcgggctaaggcgcta

SEQ ID NO: 701699 - DNA, 20 bp, mouse
ggggtccttgacagcctctt

SEQ ID NO: 701700 - DNA, 20 bp, mouse
gcttcaagaagtgagttact

SEQ ID NO: 701701 - DNA, 20 bp, mouse
gaaggagatctaggatgcct

SEQ ID NO: 701702 - DNA, 20 bp, mouse
gagctgaggcttctcctaag

SEQ ID NO: 701703 - DNA, 20 bp, mouse
gaagctactgcattacaatt

SEQ ID NO: 701704 - DNA, 20 bp, mouse
gttctcctaagaggctgtca

SEQ ID NO: 701705 - DNA, 20 bp, mouse
gttagttaatagcgtgactg

SEQ ID NO: 701706 - DNA, 20 bp, mouse
gcgaagtctggctgtggcta

SEQ ID NO: 701707 - DNA, 20 bp, mouse
gcccctgcgaagtctggctg

SEQ ID NO: 701708 - DNA, 20 bp, mouse
gccagacttcgcaggggtgc

SEQ ID NO: 701709 - DNA, 20 bp, mouse
gtaactgcagtgagccgcca

SEQ ID NO: 701710 - DNA, 20 bp, mouse
gaggacccgcctccgagcgg

SEQ ID NO: 701711 - DNA, 20 bp, mouse
gatgcgtgacaaggccttgg

SEQ ID NO: 701712 - DNA, 20 bp, mouse
ggtcacgcatgcgcgcgagg

SEQ ID NO: 701713 - DNA, 20 bp, mouse
ggcgggcatcccagcagagg

SEQ ID NO: 701714 - DNA, 20 bp, mouse
gcaggctgatcttcaggctc

SEQ ID NO: 701715 - DNA, 20 bp, mouse
ggcggtgcgtgggacacgtc

SEQ ID NO: 701716 - DNA, 20 bp, mouse
gtgggggcggagaaagtctt

SEQ ID NO: 701717 - DNA, 20 bp, mouse
gaacagacagagaactatca

SEQ ID NO: 701718 - DNA, 20 bp, mouse
gtaagggaaactgcctactc

SEQ ID NO: 701719 - DNA, 20 bp, mouse
ggccaattgtagttaggcta

SEQ ID NO: 701720 - DNA, 20 bp, mouse
gacagtacgccagaatttgg

SEQ ID NO: 701721 - DNA, 20 bp, mouse
gctgtgagccaattgtagtt

SEQ ID NO: 701722 - DNA, 20 bp, mouse
gttcccaggggaatagcagt

SEQ ID NO: 701723 - DNA, 20 bp, mouse
gcactcatgtgtgtaagtat

SEQ ID NO: 701724 - DNA, 20 bp, mouse
gctctggcttctttggagtg

SEQ ID NO: 701725 - DNA, 20 bp, mouse
gcccttagcctaactacaat

SEQ ID NO: 701726 - DNA, 20 bp, mouse
gtgaggtgaagattgagctg

SEQ ID NO: 701727 - DNA, 20 bp, mouse
gctcaggagcatcacccagg

SEQ ID NO: 701728 - DNA, 20 bp, mouse
ggggcagagacagcttagaa

SEQ ID NO: 701729 - DNA, 20 bp, mouse
ggagctcaggagcatcaccc

SEQ ID NO: 701730 - DNA, 20 bp, mouse
gcctcaaatcctcactggaa

SEQ ID NO: 701731 - DNA, 20 bp, mouse
gggaaccaggcacgccaacc

SEQ ID NO: 701732 - DNA, 20 bp, mouse
ggaaaacaagcagagactgg

SEQ ID NO: 701733 - DNA, 20 bp, mouse
gttcagaagctgtagagctc

SEQ ID NO: 701734 - DNA, 20 bp, mouse
ggccagaaaagcatttggaa

SEQ ID NO: 701735 - DNA, 20 bp, mouse
ggctggagaaggtttaggtc

SEQ ID NO: 701736 - DNA, 20 bp, mouse
gtgaccagtgattgtctcta

SEQ ID NO: 701737 - DNA, 20 bp, mouse
gtctgagcctcacagagtct

SEQ ID NO: 701738 - DNA, 20 bp, mouse
gcaggaccactaagtctaac

SEQ ID NO: 701739 - DNA, 20 bp, mouse
ggtctgggaagactgacagg

SEQ ID NO: 701740 - DNA, 20 bp, mouse
gacccaaggtctgtgagtgc

SEQ ID NO: 701741 - DNA, 20 bp, mouse
gctgaagcatctgcctccaa

SEQ ID NO: 701742 - DNA, 20 bp, mouse
ggtggtcctgagactcacac

SEQ ID NO: 701743 - DNA, 20 bp, mouse
gagcctgcactcacagacct

SEQ ID NO: 701744 - DNA, 20 bp, mouse
gtcacattcaaaacctttgg

SEQ ID NO: 701745 - DNA, 20 bp, mouse
gtaaactctgttctttcaaa

SEQ ID NO: 701746 - DNA, 20 bp, mouse
ggggccctgtgagagatctc

SEQ ID NO: 701747 - DNA, 20 bp, mouse
gactcatgggagcccagaac

SEQ ID NO: 701748 - DNA, 20 bp, mouse
ggctgacagaggtacatcca

SEQ ID NO: 701749 - DNA, 20 bp, mouse
gtctagccctgtggaaaagt

SEQ ID NO: 701750 - DNA, 20 bp, mouse
gagccaggctaactgaacac

SEQ ID NO: 701751 - DNA, 20 bp, mouse
ggttgactccaccctgttct

SEQ ID NO: 701752 - DNA, 20 bp, mouse
gtgatggtcagacgaggaca

SEQ ID NO: 701753 - DNA, 20 bp, mouse
gcaactcaacaagaggaaag

SEQ ID NO: 701754 - DNA, 20 bp, mouse
gcaagaggaaaggggctgaa

SEQ ID NO: 701755 - DNA, 20 bp, mouse
gccccggctgaggggaagcc

SEQ ID NO: 701756 - DNA, 20 bp, mouse
ggtagagtaagacttggatc

SEQ ID NO: 701757 - DNA, 20 bp, mouse
gaaagcaaactgaccaacag

SEQ ID NO: 701758 - DNA, 20 bp, mouse
gttaggttgctgaaatattc

SEQ ID NO: 701759 - DNA, 20 bp, mouse
gggggctccaaggcttcctt

SEQ ID NO: 701760 - DNA, 20 bp, mouse
gtgatgctgctctacacaga

SEQ ID NO: 701761 - DNA, 20 bp, mouse
ggtggggatgaactactctg

SEQ ID NO: 701762 - DNA, 20 bp, mouse
gtcagtgcctggtggttggc

SEQ ID NO: 701763 - DNA, 20 bp, mouse
gtatggcaaaagaacatggt

SEQ ID NO: 701764 - DNA, 20 bp, mouse
gtagggaatagaactagggt

SEQ ID NO: 701765 - DNA, 20 bp, mouse
gcagaatgtagagtaagact

SEQ ID NO: 701766 - DNA, 20 bp, mouse
ggtaccagagatccctgaag

SEQ ID NO: 701767 - DNA, 20 bp, mouse
gtgaacttgccacccacttc

SEQ ID NO: 701768 - DNA, 20 bp, mouse
gcagagatccctgaagtggg

SEQ ID NO: 701769 - DNA, 20 bp, mouse
ggttggcagaatctgtccgg

SEQ ID NO: 701770 - DNA, 20 bp, mouse
gaatctgtccggcggggtgg

SEQ ID NO: 701771 - DNA, 20 bp, mouse
gtgtagctcatagaagctga

SEQ ID NO: 701772 - DNA, 20 bp, mouse
gtagacccggatgctgtggg

SEQ ID NO: 701773 - DNA, 20 bp, mouse
gtcttggaggcaggctactc

SEQ ID NO: 701774 - DNA, 20 bp, mouse
ggctgttggcagaatctgtc

SEQ ID NO: 701775 - DNA, 20 bp, mouse
gaggactgttaagacatccc

SEQ ID NO: 701776 - DNA, 20 bp, mouse
gtcacacggtcgctgattgg

SEQ ID NO: 701777 - DNA, 20 bp, mouse
gaatcagcgaccgtgtgagg

SEQ ID NO: 701778 - DNA, 20 bp, mouse
ggtggcggctcgccaatcac

SEQ ID NO: 701779 - DNA, 20 bp, mouse
gaagcagttgggtacagatt

SEQ ID NO: 701780 - DNA, 20 bp, mouse
ggacaaaaggcaaagcagtt

SEQ ID NO: 701781 - DNA, 20 bp, mouse
gcctcagaaagacccaaggg

SEQ ID NO: 701782 - DNA, 20 bp, mouse
gttgacctgtaggacttggg

SEQ ID NO: 701783 - DNA, 20 bp, mouse
gtgaaaaatggcgactgtta

SEQ ID NO: 701784 - DNA, 20 bp, mouse
gggcgcggcctccaaccaat

SEQ ID NO: 701785 - DNA, 20 bp, mouse
ggaaccttccgtatatgata

SEQ ID NO: 701786 - DNA, 20 bp, mouse
gtcactgggcggaactggaa

SEQ ID NO: 701787 - DNA, 20 bp, mouse
gaactctgagggtgcagcgc

SEQ ID NO: 701788 - DNA, 20 bp, mouse
gcgcgccccaaggccctctg

SEQ ID NO: 701789 - DNA, 20 bp, mouse
gctggagaaggagtcggctg

SEQ ID NO: 701790 - DNA, 20 bp, mouse
gagcccggcaaggggtccag

SEQ ID NO: 701791 - DNA, 20 bp, mouse
ggtcccccccccagaacaac

SEQ ID NO: 701792 - DNA, 20 bp, mouse
gacccggttcccagggtcaa

SEQ ID NO: 701793 - DNA, 20 bp, mouse
gcggggaggcgctactgcag

SEQ ID NO: 701794 - DNA, 20 bp, mouse
gcccaaatgtgaacactcat

SEQ ID NO: 701795 - DNA, 20 bp, mouse
gcagtcgcggttggagtagt

SEQ ID NO: 701796 - DNA, 20 bp, mouse
gacccccagggtcacactat

SEQ ID NO: 701797 - DNA, 20 bp, mouse
gcgggcgcgcgcaggagcga

SEQ ID NO: 701798 - DNA, 20 bp, mouse
ggggacccccgagaccccca

SEQ ID NO: 701799 - DNA, 20 bp, mouse
gccacaaggagctcagtcgg

SEQ ID NO: 701800 - DNA, 20 bp, mouse
ggcgccacaaggagctcagt

SEQ ID NO: 701801 - DNA, 20 bp, mouse
gctccttgtggcgccctcca

SEQ ID NO: 701802 - DNA, 20 bp, mouse
ggcgttctgaggggcttcgc

SEQ ID NO: 701803 - DNA, 20 bp, mouse
gggagctcagtcggcgggaa

SEQ ID NO: 701804 - DNA, 20 bp, mouse
gcaggtgcacgaggccctgg

SEQ ID NO: 701805 - DNA, 20 bp, mouse
gcagttccacgctgtcccgg

SEQ ID NO: 701806 - DNA, 20 bp, mouse
gtggccgccgcggatgctag

SEQ ID NO: 701807 - DNA, 20 bp, mouse
gtatgggcagctgcgtcaga

SEQ ID NO: 701808 - DNA, 20 bp, mouse
gcagttgcaagccccaactt

SEQ ID NO: 701809 - DNA, 20 bp, mouse
gagggtcgtgaagttccgag

SEQ ID NO: 701810 - DNA, 20 bp, mouse
gcgagcggaccggtccacag

SEQ ID NO: 701811 - DNA, 20 bp, mouse
ggggcagctgcgtcagaggg

SEQ ID NO: 701812 - DNA, 20 bp, mouse
gctctccagatgaacctctg

SEQ ID NO: 701813 - DNA, 20 bp, mouse
gcgtcccctagcatccgcgg

SEQ ID NO: 701814 - DNA, 20 bp, mouse
gacgcaccttgccgaagttg

SEQ ID NO: 701815 - DNA, 20 bp, mouse
gatgctaggggacgccaagt

SEQ ID NO: 701816 - DNA, 20 bp, mouse
gctgccaagcgacacccgcg

SEQ ID NO: 701817 - DNA, 20 bp, mouse
gggagctctgccgggaccca

SEQ ID NO: 701818 - DNA, 20 bp, mouse
gtgtcgcttggcagctctgg

SEQ ID NO: 701819 - DNA, 20 bp, mouse
gcccacgggctggagaaaaa

SEQ ID NO: 701820 - DNA, 20 bp, mouse
ggggtgtcgcttggcagctc

SEQ ID NO: 701821 - DNA, 20 bp, mouse
ggagccccgcgggtgtcgct

SEQ ID NO: 701822 - DNA, 20 bp, mouse
ggctgcgcgcgggggcggaa

SEQ ID NO: 701823 - DNA, 20 bp, mouse
gtctgccgggacccacgggc

SEQ ID NO: 701824 - DNA, 20 bp, mouse
gagagcgagcgcaagaaaga

SEQ ID NO: 701825 - DNA, 20 bp, mouse
gaaaagactaggagccccgc

SEQ ID NO: 701826 - DNA, 20 bp, mouse
gccgaggtgcacctgtgagg

SEQ ID NO: 701827 - DNA, 20 bp, mouse
gtcccgcagcacagctcttt

SEQ ID NO: 701828 - DNA, 20 bp, mouse
ggcgcggcggctggactggc

SEQ ID NO: 701829 - DNA, 20 bp, mouse
gagccctggcctgtcctcca

SEQ ID NO: 701830 - DNA, 20 bp, mouse
ggcctcgcggctagggaaag

SEQ ID NO: 701831 - DNA, 20 bp, mouse
gtttgtgcggcggacaaatg

SEQ ID NO: 701832 - DNA, 20 bp, mouse
ggtggtgagcacctctagga

SEQ ID NO: 701833 - DNA, 20 bp, mouse
gccccgaaggccgggaagta

SEQ ID NO: 701834 - DNA, 20 bp, mouse
gaagtaggggtagtcttcca

SEQ ID NO: 701835 - DNA, 20 bp, mouse
gctcgcacctacaaagcccg

SEQ ID NO: 701836 - DNA, 20 bp, mouse
ggcgggaagtagctgggagt

SEQ ID NO: 701837 - DNA, 20 bp, mouse
gtacttcccgccgcaggccg

SEQ ID NO: 701838 - DNA, 20 bp, mouse
ggggctgccggtgcaggctg

SEQ ID NO: 701839 - DNA, 20 bp, mouse
gcctgcggcgggaagtagct

SEQ ID NO: 701840 - DNA, 20 bp, mouse
gcgacagagtgcacgcccga

SEQ ID NO: 701841 - DNA, 20 bp, mouse
ggaaggtggctggcggagga

SEQ ID NO: 701842 - DNA, 20 bp, mouse
gtagctgggagtgggcggga

SEQ ID NO: 701843 - DNA, 20 bp, mouse
gcggggggagagcgagagga

SEQ ID NO: 701844 - DNA, 20 bp, mouse
gtctcgggttccggcctcca

SEQ ID NO: 701845 - DNA, 20 bp, mouse
gacgcccgacggcgagtctc

SEQ ID NO: 701846 - DNA, 20 bp, mouse
gggccttgtgggatgacttc

SEQ ID NO: 701847 - DNA, 20 bp, mouse
gagggcagtaggtgggggta

SEQ ID NO: 701848 - DNA, 20 bp, mouse
gcaaacagggcagtaggtgg

SEQ ID NO: 701849 - DNA, 20 bp, mouse
gttctctgcctgcagagacc

SEQ ID NO: 701850 - DNA, 20 bp, mouse
gaatcaataatgggccttgt

SEQ ID NO: 701851 - DNA, 20 bp, mouse
gcttgtgggatgacttcagg

SEQ ID NO: 701852 - DNA, 20 bp, mouse
gaaacaaacagggcagtagg

SEQ ID NO: 701853 - DNA, 20 bp, mouse
gctaaaacaaacagggcagt

SEQ ID NO: 701854 - DNA, 20 bp, mouse
gctcctagagagaagagttt

SEQ ID NO: 701855 - DNA, 20 bp, mouse
gctaaggtaagcctagattt

SEQ ID NO: 701856 - DNA, 20 bp, mouse
gtcggggactacaaggcgtg

SEQ ID NO: 701857 - DNA, 20 bp, mouse
gagggggcgccccaatccga

SEQ ID NO: 701858 - DNA, 20 bp, mouse
gtgaagagtcggggactaca

SEQ ID NO: 701859 - DNA, 20 bp, mouse
ggcactgggagcctcggtcc

SEQ ID NO: 701860 - DNA, 20 bp, mouse
gggcacctggaagcttgcga

SEQ ID NO: 701861 - DNA, 20 bp, mouse
ggtgtcccggctataaaaag

SEQ ID NO: 701862 - DNA, 20 bp, mouse
gagcgcggcgccctcggatt

SEQ ID NO: 701863 - DNA, 20 bp, mouse
gctgggccagcgggactccc

SEQ ID NO: 701864 - DNA, 20 bp, mouse
gtctcaagaagagagacctc

SEQ ID NO: 701865 - DNA, 20 bp, mouse
gcttgcgatggatgaagagt

SEQ ID NO: 701866 - DNA, 20 bp, mouse
gccaaggtgtccatgtaaat

SEQ ID NO: 701867 - DNA, 20 bp, mouse
ggcagatagctcagagtgag

SEQ ID NO: 701868 - DNA, 20 bp, mouse
ggggagcgggcagcgcctac

SEQ ID NO: 701869 - DNA, 20 bp, mouse
gttcccggtctcccagtctt

SEQ ID NO: 701870 - DNA, 20 bp, mouse
gcggtctcccagtcttcggc

SEQ ID NO: 701871 - DNA, 20 bp, mouse
gcgctccccgcgggcggcag

SEQ ID NO: 701872 - DNA, 20 bp, mouse
gaggcgctgcccgctccccg

SEQ ID NO: 701873 - DNA, 20 bp, mouse
ggggcggcagaggctcttcc

SEQ ID NO: 701874 - DNA, 20 bp, mouse
gcgcaatgggaaggtatgag

SEQ ID NO: 701875 - DNA, 20 bp, mouse
ggagagagcctggccagcgc

SEQ ID NO: 701876 - DNA, 20 bp, mouse
gtaaagctggcgagtctctc

SEQ ID NO: 701877 - DNA, 20 bp, mouse
ggctctggagcgaaaggctg

SEQ ID NO: 701878 - DNA, 20 bp, mouse
gacttgagctctggagcgaa

SEQ ID NO: 701879 - DNA, 20 bp, mouse
gagtctagtcatccaagagg

SEQ ID NO: 701880 - DNA, 20 bp, mouse
gagtaccaggtcagcttcca

SEQ ID NO: 701881 - DNA, 20 bp, mouse
gctagctgtcccgaggccac

SEQ ID NO: 701882 - DNA, 20 bp, mouse
gagtctctctggctactgtg

SEQ ID NO: 701883 - DNA, 20 bp, mouse
gtcgaaagatcggtcaccag

SEQ ID NO: 701884 - DNA, 20 bp, mouse
ggggtacgtacgtacagtag

SEQ ID NO: 701885 - DNA, 20 bp, mouse
gatccaagaggaggacgaga

SEQ ID NO: 701886 - DNA, 20 bp, mouse
ggagccccgccccactacgg

SEQ ID NO: 701887 - DNA, 20 bp, mouse
gtacggaggcggcagccaat

SEQ ID NO: 701888 - DNA, 20 bp, mouse
gaaggcggccaaataaccag

SEQ ID NO: 701889 - DNA, 20 bp, mouse
ggccaaataaccaggggcgg

SEQ ID NO: 701890 - DNA, 20 bp, mouse
ggcccccgcccctggttatt

SEQ ID NO: 701891 - DNA, 20 bp, mouse
ggggctgaccacacgcgcgc

SEQ ID NO: 701892 - DNA, 20 bp, mouse
gtggctgccgcctccgtagt

SEQ ID NO: 701893 - DNA, 20 bp, mouse
gctgagaaaaggtgacgcgg

SEQ ID NO: 701894 - DNA, 20 bp, mouse
gcggccgctggctcattcac

SEQ ID NO: 701895 - DNA, 20 bp, mouse
gttccaggagacactgctcg

SEQ ID NO: 701896 - DNA, 20 bp, mouse
ggaggagcgcctgaatccgt

SEQ ID NO: 701897 - DNA, 20 bp, mouse
gcaaacggactgagcgtgta

SEQ ID NO: 701898 - DNA, 20 bp, mouse
gagttaacttgagctggggg

SEQ ID NO: 701899 - DNA, 20 bp, mouse
gcccagctcaagttaacttg

SEQ ID NO: 701900 - DNA, 20 bp, mouse
gagatctggctaagagcatc

SEQ ID NO: 701901 - DNA, 20 bp, mouse
gtcttagagccgacggattc

SEQ ID NO: 701902 - DNA, 20 bp, mouse
gtcatctggcagctgcgaga

SEQ ID NO: 701903 - DNA, 20 bp, mouse
gtcctcaagttaacttgagc

SEQ ID NO: 701904 - DNA, 20 bp, mouse
gcctacttacaaggtcttgg

SEQ ID NO: 701905 - DNA, 20 bp, mouse
ggatggcaccaatcaaaacg

SEQ ID NO: 701906 - DNA, 20 bp, mouse
gtcagagcgcggcccaggga

SEQ ID NO: 701907 - DNA, 20 bp, mouse
gaaaagaaaggcgagggaat

SEQ ID NO: 701908 - DNA, 20 bp, mouse
gtagctctcgggtcggctcg

SEQ ID NO: 701909 - DNA, 20 bp, mouse
ggctggctagggtgggattc

SEQ ID NO: 701910 - DNA, 20 bp, mouse
gggcgagggaatcggcgtgt

SEQ ID NO: 701911 - DNA, 20 bp, mouse
ggggctaatccgggagaata

SEQ ID NO: 701912 - DNA, 20 bp, mouse
gcgcttgagattagggttga

SEQ ID NO: 701913 - DNA, 20 bp, mouse
gccccggagcgcttgagatt

SEQ ID NO: 701914 - DNA, 20 bp, mouse
ggtcggctcgcggctggcta

SEQ ID NO: 701915 - DNA, 20 bp, mouse
gggctcgcggctggctaggg

SEQ ID NO: 701916 - DNA, 20 bp, mouse
gggactagaaaaccaggcac

SEQ ID NO: 701917 - DNA, 20 bp, mouse
gggcccctagacacataagt

SEQ ID NO: 701918 - DNA, 20 bp, mouse
ggcccggggcggagctctct

SEQ ID NO: 701919 - DNA, 20 bp, mouse
gaagaactgtgggcccgggg

SEQ ID NO: 701920 - DNA, 20 bp, mouse
gtcccggggcagcaccggtt

SEQ ID NO: 701921 - DNA, 20 bp, mouse
gagggggcgctgaggagcta

SEQ ID NO: 701922 - DNA, 20 bp, mouse
gaagccccacttatgtgtct

SEQ ID NO: 701923 - DNA, 20 bp, mouse
gcccagattcgaccgagtaa

SEQ ID NO: 701924 - DNA, 20 bp, mouse
gcggaagaactgtgggcccg

SEQ ID NO: 701925 - DNA, 20 bp, mouse
gcccacagttcttccgcctt

SEQ ID NO: 701926 - DNA, 20 bp, mouse
gcgggatgctagcgcctagt

SEQ ID NO: 701927 - DNA, 20 bp, mouse
ggagccgggtgtggggttca

SEQ ID NO: 701928 - DNA, 20 bp, mouse
gtcagggagggcgtgagagt

SEQ ID NO: 701929 - DNA, 20 bp, mouse
ggagctggccaaactcaagt

SEQ ID NO: 701930 - DNA, 20 bp, mouse
gcacgctggagccgggtgtg

SEQ ID NO: 701931 - DNA, 20 bp, mouse
ggtgaccgcgcgtgacgtca

SEQ ID NO: 701932 - DNA, 20 bp, mouse
ggcaggccccgaaagctctt

SEQ ID NO: 701933 - DNA, 20 bp, mouse
gcagtccggaggacactctt

SEQ ID NO: 701934 - DNA, 20 bp, mouse
ggggagacccctgcccacgc

SEQ ID NO: 701935 - DNA, 20 bp, mouse
gacccggctccagcgtgggc

SEQ ID NO: 701936 - DNA, 20 bp, mouse
gtgacgcggtccaatgatgg

SEQ ID NO: 701937 - DNA, 20 bp, mouse
gggaccgcgtcaggaggacg

SEQ ID NO: 701938 - DNA, 20 bp, mouse
ggtggctccagcccgaggaa

SEQ ID NO: 701939 - DNA, 20 bp, mouse
gtcttcacaaccatccacta

SEQ ID NO: 701940 - DNA, 20 bp, mouse
gaccaaggaccccccatcat

SEQ ID NO: 701941 - DNA, 20 bp, mouse
gtcacaaccatccactacgg

SEQ ID NO: 701942 - DNA, 20 bp, mouse
ggcacaatgtcagagcactt

SEQ ID NO: 701943 - DNA, 20 bp, mouse
gaaccatcctccgtagtgga

SEQ ID NO: 701944 - DNA, 20 bp, mouse
gactcgccaaagtcagtact

SEQ ID NO: 701945 - DNA, 20 bp, mouse
gtggatggttgtgaagagga

SEQ ID NO: 701946 - DNA, 20 bp, mouse
gctccccgctctgacgtttt

SEQ ID NO: 701947 - DNA, 20 bp, mouse
ggggagggcgcctggagatt

SEQ ID NO: 701948 - DNA, 20 bp, mouse
gtctcccgcttggcgcgcag

SEQ ID NO: 701949 - DNA, 20 bp, mouse
gggccagcccccgaatctcc

SEQ ID NO: 701950 - DNA, 20 bp, mouse
gtgtgtctcacgtggaaaga

SEQ ID NO: 701951 - DNA, 20 bp, mouse
gcggcccagcgctcctgaat

SEQ ID NO: 701952 - DNA, 20 bp, mouse
ggccccctctgcgcgccaag

SEQ ID NO: 701953 - DNA, 20 bp, mouse
ggagtcccaaaacgtcagag

SEQ ID NO: 701954 - DNA, 20 bp, mouse
gtggggaggtgtgcccgtcg

SEQ ID NO: 701955 - DNA, 20 bp, mouse
gggaggtgtgcccgtcgcgg

SEQ ID NO: 701956 - DNA, 20 bp, mouse
ggggcccagagactgactca

SEQ ID NO: 701957 - DNA, 20 bp, mouse
gagggactagaccaagggag

SEQ ID NO: 701958 - DNA, 20 bp, mouse
ggagactgactcagggatga

SEQ ID NO: 701959 - DNA, 20 bp, mouse
gcctccctgaccagctacat

SEQ ID NO: 701960 - DNA, 20 bp, mouse
gtgggctgccagcccgggaa

SEQ ID NO: 701961 - DNA, 20 bp, mouse
gctcgcgccccggagagcgg

SEQ ID NO: 701962 - DNA, 20 bp, mouse
gagaagcatggggaaggcta

SEQ ID NO: 701963 - DNA, 20 bp, mouse
ggcagtagagtgtgctgaat

SEQ ID NO: 701964 - DNA, 20 bp, mouse
gcccagagggactagaccaa

SEQ ID NO: 701965 - DNA, 20 bp, mouse
gctaccaaataccacgggat

SEQ ID NO: 701966 - DNA, 20 bp, mouse
gcaaaggcgtgcaccggcgg

SEQ ID NO: 701967 - DNA, 20 bp, mouse
ggggaggccacgcgcatcag

SEQ ID NO: 701968 - DNA, 20 bp, mouse
gagaatagcgcgcctgggga

SEQ ID NO: 701969 - DNA, 20 bp, mouse
gggggcgcaaaggcgtgcac

SEQ ID NO: 701970 - DNA, 20 bp, mouse
gcgcgtggcctcccgcaggg

SEQ ID NO: 701971 - DNA, 20 bp, mouse
gatgcgcgtggcctcccgca

SEQ ID NO: 701972 - DNA, 20 bp, mouse
ggcgcaaaggcgtgcaccgg

SEQ ID NO: 701973 - DNA, 20 bp, mouse
gtgcacctctgccgtcactg

SEQ ID NO: 701974 - DNA, 20 bp, mouse
gcgctcgggagccgcagtga

SEQ ID NO: 701975 - DNA, 20 bp, mouse
ggaggagaatagcgcgcctg

SEQ ID NO: 701976 - DNA, 20 bp, mouse
ggcgccgcccgccacgggga

SEQ ID NO: 701977 - DNA, 20 bp, mouse
gagcccgccgccaggtccag

SEQ ID NO: 701978 - DNA, 20 bp, mouse
ggggcggcgcggagcaagga

SEQ ID NO: 701979 - DNA, 20 bp, mouse
ggccacggggagggcgcaca

SEQ ID NO: 701980 - DNA, 20 bp, mouse
gctgaatgcgggtgtatctg

SEQ ID NO: 701981 - DNA, 20 bp, mouse
ggcgccctccccgtggcggg

SEQ ID NO: 701982 - DNA, 20 bp, mouse
ggctccgcgccgcccgccac

SEQ ID NO: 701983 - DNA, 20 bp, mouse
ggccctgtgcgccctccccg

SEQ ID NO: 701984 - DNA, 20 bp, mouse
gtccgggaggcgataagagc

SEQ ID NO: 701985 - DNA, 20 bp, mouse
gagagcaggagcccgccgcc

SEQ ID NO: 701986 - DNA, 20 bp, mouse
ggaaatggggcgcagaaaga

SEQ ID NO: 701987 - DNA, 20 bp, mouse
gaaaaaacagggcctatgtg

SEQ ID NO: 701988 - DNA, 20 bp, mouse
ggagggaggtggagacacat

SEQ ID NO: 701989 - DNA, 20 bp, mouse
gcgccccatttcaaatttgg

SEQ ID NO: 701990 - DNA, 20 bp, mouse
gaccccccaaatttgaaatg

SEQ ID NO: 701991 - DNA, 20 bp, mouse
gtcaaaatgaatgctggcat

SEQ ID NO: 701992 - DNA, 20 bp, mouse
gttaaagtcagcggatatgt

SEQ ID NO: 701993 - DNA, 20 bp, mouse
gtggggcgcagaaagagggg

SEQ ID NO: 701994 - DNA, 20 bp, mouse
gcaagcagtggaaggatatt

SEQ ID NO: 701995 - DNA, 20 bp, mouse
gaagctatgcatgacggaaa

SEQ ID NO: 701996 - DNA, 20 bp, mouse
gtgggagtggagattgattt

SEQ ID NO: 701997 - DNA, 20 bp, mouse
gggtatgcccagacacccaa

SEQ ID NO: 701998 - DNA, 20 bp, mouse
gaggcagatagggtattctg

SEQ ID NO: 701999 - DNA, 20 bp, mouse
ggagtggagattgatttcgg

SEQ ID NO: 702000 - DNA, 20 bp, mouse
ggacctagcccaggcagata

SEQ ID NO: 702001 - DNA, 20 bp, mouse
gagacacccaaaggcaacct

SEQ ID NO: 702002 - DNA, 20 bp, mouse
gaaggaaaagcccttgaaag

SEQ ID NO: 702003 - DNA, 20 bp, mouse
gggcagaaaagattccagta

SEQ ID NO: 702004 - DNA, 20 bp, mouse
gtggggtagacctctttcaa

SEQ ID NO: 702005 - DNA, 20 bp, mouse
gggccaccaaaagtccctac

SEQ ID NO: 702006 - DNA, 20 bp, mouse
gagggaggcgggccctggtc

SEQ ID NO: 702007 - DNA, 20 bp, mouse
gaaaggcagggaacgtgagg

SEQ ID NO: 702008 - DNA, 20 bp, mouse
ggaaaggtactctggaacga

SEQ ID NO: 702009 - DNA, 20 bp, mouse
ggggaaagagaaaggtactc

SEQ ID NO: 702010 - DNA, 20 bp, mouse
gcagggaacgtgaggaggga

SEQ ID NO: 702011 - DNA, 20 bp, mouse
gcatgctaaaggagacttat

SEQ ID NO: 702012 - DNA, 20 bp, mouse
ggtgagagacagaatgaagc

SEQ ID NO: 702013 - DNA, 20 bp, mouse
gacaggcagctaaggcaaga

SEQ ID NO: 702014 - DNA, 20 bp, mouse
gggagggagggaaaatgcaa

SEQ ID NO: 702015 - DNA, 20 bp, mouse
gctggcaggtggccgcccct

SEQ ID NO: 702016 - DNA, 20 bp, mouse
ggggctgaaaactgacctga

SEQ ID NO: 702017 - DNA, 20 bp, mouse
gaggtctctctgttaggtcg

SEQ ID NO: 702018 - DNA, 20 bp, mouse
ggggtctgaaatgtgcaaag

SEQ ID NO: 702019 - DNA, 20 bp, mouse
gagttccaagactgtttgtc

SEQ ID NO: 702020 - DNA, 20 bp, mouse
gcagtcttggaactctccga

SEQ ID NO: 702021 - DNA, 20 bp, mouse
gttgtctggctgtcccaggg

SEQ ID NO: 702022 - DNA, 20 bp, mouse
gagagcagagccttaggagc

SEQ ID NO: 702023 - DNA, 20 bp, mouse
ggaactctccgagggtactt

SEQ ID NO: 702024 - DNA, 20 bp, mouse
gagcatgggggtatccaagg

SEQ ID NO: 702025 - DNA, 20 bp, mouse
gtcctccaaggtgacaaggg

SEQ ID NO: 702026 - DNA, 20 bp, mouse
gggcacatggggcgtggcga

SEQ ID NO: 702027 - DNA, 20 bp, mouse
gcaggcaggcggggcaaagg

SEQ ID NO: 702028 - DNA, 20 bp, mouse
gggacaggagggccggataa

SEQ ID NO: 702029 - DNA, 20 bp, mouse
ggaccagaccgtaggacagg

SEQ ID NO: 702030 - DNA, 20 bp, mouse
ggtacgcgggctaagatggg

SEQ ID NO: 702031 - DNA, 20 bp, mouse
gcggagctagcagaaagcag

SEQ ID NO: 702032 - DNA, 20 bp, mouse
gcggataaaggaaggaccga

SEQ ID NO: 702033 - DNA, 20 bp, mouse
ggaccaggcaggcggggcaa

SEQ ID NO: 702034 - DNA, 20 bp, mouse
gatcgtacgcgggctaagat

SEQ ID NO: 702035 - DNA, 20 bp, mouse
ggatgaccagaccgtaggac

SEQ ID NO: 702036 - DNA, 20 bp, mouse
ggcacagagtcggatctcgg

SEQ ID NO: 702037 - DNA, 20 bp, mouse
gtcctctggcggcaactctc

SEQ ID NO: 702038 - DNA, 20 bp, mouse
gcccgcgctgggtctcacgg

SEQ ID NO: 702039 - DNA, 20 bp, mouse
gagacccagcgcggggccct

SEQ ID NO: 702040 - DNA, 20 bp, mouse
ggccgccagaggagctgcaa

SEQ ID NO: 702041 - DNA, 20 bp, mouse
gaatgcacagagtcggatct

SEQ ID NO: 702042 - DNA, 20 bp, mouse
gcaagggcccgcggtctcct

SEQ ID NO: 702043 - DNA, 20 bp, mouse
gaacccctcccccaacgcgt

SEQ ID NO: 702044 - DNA, 20 bp, mouse
gggttcccggggcctcgagc

SEQ ID NO: 702045 - DNA, 20 bp, mouse
gcagcgcggggccctcgggc

SEQ ID NO: 702046 - DNA, 20 bp, mouse
ggtcgccgaccctccgtccc

SEQ ID NO: 702047 - DNA, 20 bp, mouse
gagtgcccgggacggagggt

SEQ ID NO: 702048 - DNA, 20 bp, mouse
gacggagggtcggcgacccg

SEQ ID NO: 702049 - DNA, 20 bp, mouse
ggatgccagcgtccacgcta

SEQ ID NO: 702050 - DNA, 20 bp, mouse
gtggcccttagcgtggacgc

SEQ ID NO: 702051 - DNA, 20 bp, mouse
gaacccgcgccgggaggcgg

SEQ ID NO: 702052 - DNA, 20 bp, mouse
gtagaccacagcacaatgag

SEQ ID NO: 702053 - DNA, 20 bp, mouse
ggcatcgccagtgcccggga

SEQ ID NO: 702054 - DNA, 20 bp, mouse
gctcccggcgcgggttaagg

SEQ ID NO: 702055 - DNA, 20 bp, mouse
gtcgccagtgcccgggacgg

SEQ ID NO: 702056 - DNA, 20 bp, mouse
gcgcaagcaggcagagccgc

SEQ ID NO: 702057 - DNA, 20 bp, mouse
gccagccgctgtcaagtccg

SEQ ID NO: 702058 - DNA, 20 bp, mouse
gtgtgcgagggatccctccg

SEQ ID NO: 702059 - DNA, 20 bp, mouse
ggttgctgcgcgatgtgcga

SEQ ID NO: 702060 - DNA, 20 bp, mouse
ggcactacttgtccccgcgg

SEQ ID NO: 702061 - DNA, 20 bp, mouse
ggggagcgctgagacgtcgc

SEQ ID NO: 702062 - DNA, 20 bp, mouse
gcggccccggccccactccc

SEQ ID NO: 702063 - DNA, 20 bp, mouse
gaatcccgggagtggggccg

SEQ ID NO: 702064 - DNA, 20 bp, mouse
gacatcgcgcagcaacgacg

SEQ ID NO: 702065 - DNA, 20 bp, mouse
ggctcccggcccggcgtcct

SEQ ID NO: 702066 - DNA, 20 bp, mouse
gtgcacccgcccacctcgag

SEQ ID NO: 702067 - DNA, 20 bp, mouse
gcacccttcgggactggagg

SEQ ID NO: 702068 - DNA, 20 bp, mouse
gggaaacccgggctggatcg

SEQ ID NO: 702069 - DNA, 20 bp, mouse
gcgcagcttccactcgaggt

SEQ ID NO: 702070 - DNA, 20 bp, mouse
gatgaatccaagcacccttc

SEQ ID NO: 702071 - DNA, 20 bp, mouse
gtccaagcacccttcgggac

SEQ ID NO: 702072 - DNA, 20 bp, mouse
ggcttccactcgaggtgggc

SEQ ID NO: 702073 - DNA, 20 bp, mouse
gcgcgcgcagcttccactcg

SEQ ID NO: 702074 - DNA, 20 bp, mouse
ggcgcagcgcgagggtcctg

SEQ ID NO: 702075 - DNA, 20 bp, mouse
gagcggagccgggacaccgc

SEQ ID NO: 702076 - DNA, 20 bp, mouse
ggggcgcggcgcacgcagtg

SEQ ID NO: 702077 - DNA, 20 bp, mouse
gcggcggcgcggaaaacccg

SEQ ID NO: 702078 - DNA, 20 bp, mouse
gccggggcggagtgaggagt

SEQ ID NO: 702079 - DNA, 20 bp, mouse
gcctgactctacgcaaccta

SEQ ID NO: 702080 - DNA, 20 bp, mouse
gcggcgcggaaaacccgggg

SEQ ID NO: 702081 - DNA, 20 bp, mouse
ggtcgtcgcgcgacgcaggt

SEQ ID NO: 702082 - DNA, 20 bp, mouse
gcgccgagcgcccgcacgtc

SEQ ID NO: 702083 - DNA, 20 bp, mouse
gcgggggtccaaggtcacga

SEQ ID NO: 702084 - DNA, 20 bp, mouse
gctagggcggagtgtgagag

SEQ ID NO: 702085 - DNA, 20 bp, mouse
gctaccgaggccggccaatg

SEQ ID NO: 702086 - DNA, 20 bp, mouse
gcactagggactccaggagg

SEQ ID NO: 702087 - DNA, 20 bp, mouse
ggcgcactagggactccagg

SEQ ID NO: 702088 - DNA, 20 bp, mouse
gggagtctgcccaacagcga

SEQ ID NO: 702089 - DNA, 20 bp, mouse
ggagcccatacgaatcagaa

SEQ ID NO: 702090 - DNA, 20 bp, mouse
ggtcgcgcctcggggaaacc

SEQ ID NO: 702091 - DNA, 20 bp, mouse
ggcgcctcggggaaaccggg

SEQ ID NO: 702092 - DNA, 20 bp, mouse
gtgacgcaagcggaactctg

SEQ ID NO: 702093 - DNA, 20 bp, mouse
ggctggctgccccgctatag

SEQ ID NO: 702094 - DNA, 20 bp, mouse
ggcggctgcgccagagacgc

SEQ ID NO: 702095 - DNA, 20 bp, mouse
gcgaggctcctggcgcacta

SEQ ID NO: 702096 - DNA, 20 bp, mouse
ggacccaggggtaaccgagt

SEQ ID NO: 702097 - DNA, 20 bp, mouse
gggccccggcggggctcgag

SEQ ID NO: 702098 - DNA, 20 bp, mouse
gccggaccgccctgcctcag

SEQ ID NO: 702099 - DNA, 20 bp, mouse
gacagcgtacgccacttccc

SEQ ID NO: 702100 - DNA, 20 bp, mouse
ggccgggagggcgggtaagg

SEQ ID NO: 702101 - DNA, 20 bp, mouse
ggcggccgggagggcgggta

SEQ ID NO: 702102 - DNA, 20 bp, mouse
ggagcgtcgccaatcggcac

SEQ ID NO: 702103 - DNA, 20 bp, mouse
ggacaccgagcgttcggggc

SEQ ID NO: 702104 - DNA, 20 bp, mouse
ggagcgttgcggtcacgtga

SEQ ID NO: 702105 - DNA, 20 bp, mouse
gggttccggccccgaacgct

SEQ ID NO: 702106 - DNA, 20 bp, mouse
gagccacaggccatgcccac

SEQ ID NO: 702107 - DNA, 20 bp, mouse
gggcccaggctggcacagga

SEQ ID NO: 702108 - DNA, 20 bp, mouse
gaggcctgggccccacccat

SEQ ID NO: 702109 - DNA, 20 bp, mouse
gggggctgacatctctgttc

SEQ ID NO: 702110 - DNA, 20 bp, mouse
ggggtggggcccaggcctgt

SEQ ID NO: 702111 - DNA, 20 bp, mouse
ggcccccagtccctgccagt

SEQ ID NO: 702112 - DNA, 20 bp, mouse
gtgccagtgggcatggcctg

SEQ ID NO: 702113 - DNA, 20 bp, mouse
ggcccactggcagggactgg

SEQ ID NO: 702114 - DNA, 20 bp, mouse
gcctggaggagggggggacc

SEQ ID NO: 702115 - DNA, 20 bp, mouse
gagggactgggggcccaggc

SEQ ID NO: 702116 - DNA, 20 bp, mouse
gaggaggcgggacgaggcaa

SEQ ID NO: 702117 - DNA, 20 bp, mouse
gcggccgccgccctggtagg

SEQ ID NO: 702118 - DNA, 20 bp, mouse
gggctcggaaggcaaagcga

SEQ ID NO: 702119 - DNA, 20 bp, mouse
gccgccgccctggtaggagg

SEQ ID NO: 702120 - DNA, 20 bp, mouse
gaggaagcgagcaggcggga

SEQ ID NO: 702121 - DNA, 20 bp, mouse
ggggaaggtggcgtccggaa

SEQ ID NO: 702122 - DNA, 20 bp, mouse
ggggcggccgccgccctggt

SEQ ID NO: 702123 - DNA, 20 bp, mouse
gtgcaggacgacagctcgga

SEQ ID NO: 702124 - DNA, 20 bp, mouse
gacgaggcaagggcgggctg

SEQ ID NO: 702125 - DNA, 20 bp, mouse
ggcaaagcgaggggacgctg

SEQ ID NO: 702126 - DNA, 20 bp, mouse
gtggacagctatctgtgaac

SEQ ID NO: 702127 - DNA, 20 bp, mouse
gcctgctcgcctagctacct

SEQ ID NO: 702128 - DNA, 20 bp, mouse
gctgaaaaacccagctggac

SEQ ID NO: 702129 - DNA, 20 bp, mouse
ggggggattgagtctcagat

SEQ ID NO: 702130 - DNA, 20 bp, mouse
ggatgaaagcagagtccaat

SEQ ID NO: 702131 - DNA, 20 bp, mouse
gtgttctctctctccctgtc

SEQ ID NO: 702132 - DNA, 20 bp, mouse
gaagcgcggaaggtacccgg

SEQ ID NO: 702133 - DNA, 20 bp, mouse
gtcgcctagctacctgggag

SEQ ID NO: 702134 - DNA, 20 bp, mouse
gggtgtcgctggatgacctc

SEQ ID NO: 702135 - DNA, 20 bp, mouse
ggcaccactcccaggtagct

SEQ ID NO: 702136 - DNA, 20 bp, mouse
gccacaacgcgcgtcctctc

SEQ ID NO: 702137 - DNA, 20 bp, mouse
ggagtgagaagccttcagga

SEQ ID NO: 702138 - DNA, 20 bp, mouse
gcaagaactgagaggcactc

SEQ ID NO: 702139 - DNA, 20 bp, mouse
gacactcttcagtgaaaagc

SEQ ID NO: 702140 - DNA, 20 bp, mouse
ggaagagtgtcatttgtctg

SEQ ID NO: 702141 - DNA, 20 bp, mouse
gggtctcaggaatgtctaga

SEQ ID NO: 702142 - DNA, 20 bp, mouse
ggacgcgcgttgtggctgtg

SEQ ID NO: 702143 - DNA, 20 bp, mouse
ggaaggagtgagaagccttc

SEQ ID NO: 702144 - DNA, 20 bp, mouse
gctgcttctggggcacaaga

SEQ ID NO: 702145 - DNA, 20 bp, mouse
gctctcagttcttggatagt

SEQ ID NO: 702146 - DNA, 20 bp, mouse
gccggagagacggaaaacgt

SEQ ID NO: 702147 - DNA, 20 bp, mouse
ggggtccctgggtgccgcac

SEQ ID NO: 702148 - DNA, 20 bp, mouse
ggggttcccgggctcccgtg

SEQ ID NO: 702149 - DNA, 20 bp, mouse
gcgaccccgagctgcggcgc

SEQ ID NO: 702150 - DNA, 20 bp, mouse
gctcccgctcgcctccgctg

SEQ ID NO: 702151 - DNA, 20 bp, mouse
gggccccgagcgagcgtccg

SEQ ID NO: 702152 - DNA, 20 bp, mouse
gggctcccgtgcggcaccca

SEQ ID NO: 702153 - DNA, 20 bp, mouse
ggcggcgcgggtccgcaggg

SEQ ID NO: 702154 - DNA, 20 bp, mouse
gcaggaggaggggaagcgcg

SEQ ID NO: 702155 - DNA, 20 bp, mouse
gcccgtgtggcctgaagcag

SEQ ID NO: 702156 - DNA, 20 bp, mouse
gaatgcgcccgggccacctg

SEQ ID NO: 702157 - DNA, 20 bp, mouse
gtccctaagggtcagttaca

SEQ ID NO: 702158 - DNA, 20 bp, mouse
ggtggcccgggcgcattccc

SEQ ID NO: 702159 - DNA, 20 bp, mouse
ggggtcaaggagatttcagc

SEQ ID NO: 702160 - DNA, 20 bp, mouse
gcggctcccggccctggggt

SEQ ID NO: 702161 - DNA, 20 bp, mouse
gacaaggtccaggagcgcag

SEQ ID NO: 702162 - DNA, 20 bp, mouse
gtgagcccgcgctacgccgg

SEQ ID NO: 702163 - DNA, 20 bp, mouse
gaaaaggggtgtctctccct

SEQ ID NO: 702164 - DNA, 20 bp, mouse
ggaaaggtggcgcgtagcac

SEQ ID NO: 702165 - DNA, 20 bp, mouse
gtagatgctgcaggggacct

SEQ ID NO: 702166 - DNA, 20 bp, mouse
gcgcccaggcccgcgttcat

SEQ ID NO: 702167 - DNA, 20 bp, mouse
gccgaagcagccaatgaacg

SEQ ID NO: 702168 - DNA, 20 bp, mouse
gacctactgccgcctcccga

SEQ ID NO: 702169 - DNA, 20 bp, mouse
gaggcaaaccggcgtggagg

SEQ ID NO: 702170 - DNA, 20 bp, mouse
gggcgctgccttccctcggg

SEQ ID NO: 702171 - DNA, 20 bp, mouse
ggagctgcgcgaagacgcgt

SEQ ID NO: 702172 - DNA, 20 bp, mouse
ggcagcctgtcagtcagggg

SEQ ID NO: 702173 - DNA, 20 bp, mouse
gggattgctaggaggcaaac

SEQ ID NO: 702174 - DNA, 20 bp, mouse
gagctctcgggaagtcggtg

SEQ ID NO: 702175 - DNA, 20 bp, mouse
gtgggcggagcgggcttgag

SEQ ID NO: 702176 - DNA, 20 bp, mouse
gagagcgcgggaccccaacc

SEQ ID NO: 702177 - DNA, 20 bp, mouse
gcgcggggctgcgggaatgg

SEQ ID NO: 702178 - DNA, 20 bp, mouse
gcgcgggaccccaaccggga

SEQ ID NO: 702179 - DNA, 20 bp, mouse
ggaggtccccaggagagcgc

SEQ ID NO: 702180 - DNA, 20 bp, mouse
gaggaacccgatactggggc

SEQ ID NO: 702181 - DNA, 20 bp, mouse
gcacgctggcccgggacggg

SEQ ID NO: 702182 - DNA, 20 bp, mouse
ggggcccgtggcctgcccgt

SEQ ID NO: 702183 - DNA, 20 bp, mouse
gcggcagccgcaggtgacaa

SEQ ID NO: 702184 - DNA, 20 bp, mouse
gggggtcccgcgctctcctg

SEQ ID NO: 702185 - DNA, 20 bp, mouse
ggctccgcagccctcccggt

SEQ ID NO: 702186 - DNA, 20 bp, mouse
ggccacgcgccgctctcctg

SEQ ID NO: 702187 - DNA, 20 bp, mouse
ggcggcgcgtggcaggatgt

SEQ ID NO: 702188 - DNA, 20 bp, mouse
gcgcgtggcaggatgtgggg

SEQ ID NO: 702189 - DNA, 20 bp, mouse
gggactcctgatcgcaaggt

SEQ ID NO: 702190 - DNA, 20 bp, mouse
gtcgaggaagtgggtgaaaa

SEQ ID NO: 702191 - DNA, 20 bp, mouse
ggctctcctgcggccgatat

SEQ ID NO: 702192 - DNA, 20 bp, mouse
gaccccgaaactcgaggaag

SEQ ID NO: 702193 - DNA, 20 bp, mouse
gaaacagagacgtctggcgg

SEQ ID NO: 702194 - DNA, 20 bp, mouse
gcgcgcctcaggagccactt

SEQ ID NO: 702195 - DNA, 20 bp, mouse
gacctggagggaagaggcga

SEQ ID NO: 702196 - DNA, 20 bp, mouse
gctcggggagggcaacgtag

SEQ ID NO: 702197 - DNA, 20 bp, mouse
gtgccccgcctgctgactgt

SEQ ID NO: 702198 - DNA, 20 bp, mouse
ggggcgtggagctcccgcta

SEQ ID NO: 702199 - DNA, 20 bp, mouse
ggacccggagcaaaaggagg

SEQ ID NO: 702200 - DNA, 20 bp, mouse
gcagccccgctgtgcaccaa

SEQ ID NO: 702201 - DNA, 20 bp, mouse
gttctcgcctgctccctagg

SEQ ID NO: 702202 - DNA, 20 bp, mouse
gggagcaggcgagaaacgtc

SEQ ID NO: 702203 - DNA, 20 bp, mouse
ggcggggcacccagtaagca

SEQ ID NO: 702204 - DNA, 20 bp, mouse
gcccccacagtcagcaggcg

SEQ ID NO: 702205 - DNA, 20 bp, mouse
gacagcgccccctagggagc

SEQ ID NO: 702206 - DNA, 20 bp, mouse
gccgctgcgccccacacaat

SEQ ID NO: 702207 - DNA, 20 bp, mouse
gcagcccgagaggggtcacc

SEQ ID NO: 702208 - DNA, 20 bp, mouse
ggagttgctggggagacaaa

SEQ ID NO: 702209 - DNA, 20 bp, mouse
gttgctggggagacaaaagg

SEQ ID NO: 702210 - DNA, 20 bp, mouse
gcgggcggagcccattgtgt

SEQ ID NO: 702211 - DNA, 20 bp, mouse
gtaacccggtgacccctctc

SEQ ID NO: 702212 - DNA, 20 bp, mouse
gccagacgtcagcccgagag

SEQ ID NO: 702213 - DNA, 20 bp, mouse
gggcgcggggtgtttagagg

SEQ ID NO: 702214 - DNA, 20 bp, mouse
gcacctgccgcgcgcggagg

SEQ ID NO: 702215 - DNA, 20 bp, mouse
gccggcgcggtgccgggctc

SEQ ID NO: 702216 - DNA, 20 bp, mouse
gaacactcttaagtactgtt

SEQ ID NO: 702217 - DNA, 20 bp, mouse
gcctatgaggggcgggcagg

SEQ ID NO: 702218 - DNA, 20 bp, mouse
gtacttaagagtgttctagg

SEQ ID NO: 702219 - DNA, 20 bp, mouse
gggacctgacgtcatccagg

SEQ ID NO: 702220 - DNA, 20 bp, mouse
gcccgactcgccgtctgggg

SEQ ID NO: 702221 - DNA, 20 bp, mouse
gtctcctatgaggggcgggc

SEQ ID NO: 702222 - DNA, 20 bp, mouse
gcagagcagcttctcctatg

SEQ ID NO: 702223 - DNA, 20 bp, mouse
gccagacggcgagtcgggga

SEQ ID NO: 702224 - DNA, 20 bp, mouse
ggagcctcctggatgacgtc

SEQ ID NO: 702225 - DNA, 20 bp, mouse
gggcagctccccccacaacc

SEQ ID NO: 702226 - DNA, 20 bp, mouse
gtgtgctgataattgcaggg

SEQ ID NO: 702227 - DNA, 20 bp, mouse
gcacaaaggcatcccgaggc

SEQ ID NO: 702228 - DNA, 20 bp, mouse
gattagaagagcgaggtctg

SEQ ID NO: 702229 - DNA, 20 bp, mouse
ggctgggttgaacagaagaa

SEQ ID NO: 702230 - DNA, 20 bp, mouse
gtgtgtgtgctgataattgc

SEQ ID NO: 702231 - DNA, 20 bp, mouse
ggctgataattgcagggtgg

SEQ ID NO: 702232 - DNA, 20 bp, mouse
gttttcagatgacttgtaaa

SEQ ID NO: 702233 - DNA, 20 bp, mouse
gtgaagcctgccatgtgaat

SEQ ID NO: 702234 - DNA, 20 bp, mouse
gacactcatcaaaaaaaaat

SEQ ID NO: 702235 - DNA, 20 bp, mouse
gacgccgtggtttttcttct

SEQ ID NO: 702236 - DNA, 20 bp, mouse
gaccggctccggactccgag

SEQ ID NO: 702237 - DNA, 20 bp, mouse
gccgtaggggcgaccggctc

SEQ ID NO: 702238 - DNA, 20 bp, mouse
gactgagccccggctgcgag

SEQ ID NO: 702239 - DNA, 20 bp, mouse
gcgaacgagcgagcggcgga

SEQ ID NO: 702240 - DNA, 20 bp, mouse
ggccggtcgcccctacggac

SEQ ID NO: 702241 - DNA, 20 bp, mouse
ggccctgatcgcgtgttggg

SEQ ID NO: 702242 - DNA, 20 bp, mouse
gcgccgagcgacagggagga

SEQ ID NO: 702243 - DNA, 20 bp, mouse
ggggcggggcacaccgggcg

SEQ ID NO: 702244 - DNA, 20 bp, mouse
gtcgcagccactcgcagccg

SEQ ID NO: 702245 - DNA, 20 bp, mouse
gtggcactgtccggtccgta

SEQ ID NO: 702246 - DNA, 20 bp, mouse
ggggagcgagcgcacggcta

SEQ ID NO: 702247 - DNA, 20 bp, mouse
gggcgcaggttgtttgtttt

SEQ ID NO: 702248 - DNA, 20 bp, mouse
gtccccccaaggcgttcatc

SEQ ID NO: 702249 - DNA, 20 bp, mouse
ggcgggcggggcagccgcac

SEQ ID NO: 702250 - DNA, 20 bp, mouse
gggcgcagaaacccactcgg

SEQ ID NO: 702251 - DNA, 20 bp, mouse
ggtggccgcggctcccccca

SEQ ID NO: 702252 - DNA, 20 bp, mouse
ggcggccacagagtctccgc

SEQ ID NO: 702253 - DNA, 20 bp, mouse
ggagaccgaaagggcggggc

SEQ ID NO: 702254 - DNA, 20 bp, mouse
gccgtgcgctcgctccccat

SEQ ID NO: 702255 - DNA, 20 bp, mouse
gtggcgagaccgaaagggcg

SEQ ID NO: 702256 - DNA, 20 bp, mouse
gtctctgggtgggtgagcta

SEQ ID NO: 702257 - DNA, 20 bp, mouse
ggctcgagggggtgtatctc

SEQ ID NO: 702258 - DNA, 20 bp, mouse
gcccctcgagccaaggtctc

SEQ ID NO: 702259 - DNA, 20 bp, mouse
gctagggaggagtttaaatg

SEQ ID NO: 702260 - DNA, 20 bp, mouse
ggggaggagtttaaatgcgg

SEQ ID NO: 702261 - DNA, 20 bp, mouse
gtgcgggggcgtggtgttgc

SEQ ID NO: 702262 - DNA, 20 bp, mouse
ggatacaccccctcgagcca

SEQ ID NO: 702263 - DNA, 20 bp, mouse
gtccagagaccttggctcga

SEQ ID NO: 702264 - DNA, 20 bp, mouse
gatggctcaaaggagggtca

SEQ ID NO: 702265 - DNA, 20 bp, mouse
ggggcgtggcggcgcacttt

SEQ ID NO: 702266 - DNA, 20 bp, mouse
gctgggataagcattgtctg

SEQ ID NO: 702267 - DNA, 20 bp, mouse
ggggaaacaggtaagctgac

SEQ ID NO: 702268 - DNA, 20 bp, mouse
gccacgggtcacttctacca

SEQ ID NO: 702269 - DNA, 20 bp, mouse
gactctccttgggaatccac

SEQ ID NO: 702270 - DNA, 20 bp, mouse
ggtgttctgctgttgggctg

SEQ ID NO: 702271 - DNA, 20 bp, mouse
gtcacttctaccagggaaac

SEQ ID NO: 702272 - DNA, 20 bp, mouse
ggccatccaaaggaggtggg

SEQ ID NO: 702273 - DNA, 20 bp, mouse
ggccccccacctcctttgga

SEQ ID NO: 702274 - DNA, 20 bp, mouse
gtaagcattgtctgggggat

SEQ ID NO: 702275 - DNA, 20 bp, mouse
gctgtgccatccaaaggagg

SEQ ID NO: 702276 - DNA, 20 bp, mouse
gaggcttaaaactaaggcta

SEQ ID NO: 702277 - DNA, 20 bp, mouse
gagggaatagttttagttgt

SEQ ID NO: 702278 - DNA, 20 bp, mouse
gactgtttgtactttataat

SEQ ID NO: 702279 - DNA, 20 bp, mouse
gttacagtttacagctttta

SEQ ID NO: 702280 - DNA, 20 bp, mouse
gggctatctatttgatgaat

SEQ ID NO: 702281 - DNA, 20 bp, mouse
gtttctggccttctaaacat

SEQ ID NO: 702282 - DNA, 20 bp, mouse
gcaaatttaatgtggctttt

SEQ ID NO: 702283 - DNA, 20 bp, mouse
gtagatagccaatgtttaga

SEQ ID NO: 702284 - DNA, 20 bp, mouse
gaccacaactgactgggttt

SEQ ID NO: 702285 - DNA, 20 bp, mouse
gactgtttgtaaatgttttt

SEQ ID NO: 702286 - DNA, 20 bp, mouse
ggaggctcgtagcggaagtg

SEQ ID NO: 702287 - DNA, 20 bp, mouse
ggaaaggggcgggaccacgg

SEQ ID NO: 702288 - DNA, 20 bp, mouse
ggccctgagcgggaaagggg

SEQ ID NO: 702289 - DNA, 20 bp, mouse
gcgcgcgccctgagcgggaa

SEQ ID NO: 702290 - DNA, 20 bp, mouse
gagaccggggccgggaactc

SEQ ID NO: 702291 - DNA, 20 bp, mouse
gggaccacggaggctcgtag

SEQ ID NO: 702292 - DNA, 20 bp, mouse
gtccacccctccacgctata

SEQ ID NO: 702293 - DNA, 20 bp, mouse
gcccctatagcgtggagggg

SEQ ID NO: 702294 - DNA, 20 bp, mouse
gggagcctgaagagcactgc

SEQ ID NO: 702295 - DNA, 20 bp, mouse
gtcatctcgcgcgccctgag

SEQ ID NO: 702296 - DNA, 20 bp, mouse
gccggccgccccaccagtcc

SEQ ID NO: 702297 - DNA, 20 bp, mouse
gcacgccgggactggtgggg

SEQ ID NO: 702298 - DNA, 20 bp, mouse
ggggaacagcaggtccatga

SEQ ID NO: 702299 - DNA, 20 bp, mouse
ggcagcacgccgggactggt

SEQ ID NO: 702300 - DNA, 20 bp, mouse
ggctgtgagcgctgtttctg

SEQ ID NO: 702301 - DNA, 20 bp, mouse
gcacgcgccagaagcagtgc

SEQ ID NO: 702302 - DNA, 20 bp, mouse
gctccactgcagcctgtcgt

SEQ ID NO: 702303 - DNA, 20 bp, mouse
gacgcgcagcacgccgggac

SEQ ID NO: 702304 - DNA, 20 bp, mouse
gcactccgggccaatagcag

SEQ ID NO: 702305 - DNA, 20 bp, mouse
ggtgacccgccccctgctat

SEQ ID NO: 702306 - DNA, 20 bp, mouse
gaccgcccttgtcaagtcta

SEQ ID NO: 702307 - DNA, 20 bp, mouse
gtctaaggaggcggtaaggg

SEQ ID NO: 702308 - DNA, 20 bp, mouse
gaagtctaaggaggcggtaa

SEQ ID NO: 702309 - DNA, 20 bp, mouse
ggaagctctgagcagctgca

SEQ ID NO: 702310 - DNA, 20 bp, mouse
gacaagggcggtgagagagg

SEQ ID NO: 702311 - DNA, 20 bp, mouse
ggcctccttagacttgacaa

SEQ ID NO: 702312 - DNA, 20 bp, mouse
gtccttagacttgacaaggg

SEQ ID NO: 702313 - DNA, 20 bp, mouse
ggagggaaggaccgcgtggt

SEQ ID NO: 702314 - DNA, 20 bp, mouse
gccagcctcccagcctagaa

SEQ ID NO: 702315 - DNA, 20 bp, mouse
gcctgtctcactcaatttca

SEQ ID NO: 702316 - DNA, 20 bp, mouse
gggcgagagcagcgcacctc

SEQ ID NO: 702317 - DNA, 20 bp, mouse
gataaggcgctgcttctcat

SEQ ID NO: 702318 - DNA, 20 bp, mouse
gtgctctcgccatgcttcta

SEQ ID NO: 702319 - DNA, 20 bp, mouse
gttgtgaggggcagatggtc

SEQ ID NO: 702320 - DNA, 20 bp, mouse
ggagggaagagggtgttcct

SEQ ID NO: 702321 - DNA, 20 bp, mouse
gagagcgccccctagaagca

SEQ ID NO: 702322 - DNA, 20 bp, mouse
ggaagagggtgttcctggga

SEQ ID NO: 702323 - DNA, 20 bp, mouse
ggagaagcagcgccttatca

SEQ ID NO: 702324 - DNA, 20 bp, mouse
gaaaatctagagactcggat

SEQ ID NO: 702325 - DNA, 20 bp, mouse
ggggcgaagcggggcggctc

SEQ ID NO: 702326 - DNA, 20 bp, mouse
ggccaactgtaagaggaggt

SEQ ID NO: 702327 - DNA, 20 bp, mouse
gagatggggccaactgtaag

SEQ ID NO: 702328 - DNA, 20 bp, mouse
gtgacctggagggctaggag

SEQ ID NO: 702329 - DNA, 20 bp, mouse
ggggcagcaaggccaacccc

SEQ ID NO: 702330 - DNA, 20 bp, mouse
gtggggccaactgtaagagg

SEQ ID NO: 702331 - DNA, 20 bp, mouse
gtgggagatgtccaagtcct

SEQ ID NO: 702332 - DNA, 20 bp, mouse
ggggagagccagtctcacct

SEQ ID NO: 702333 - DNA, 20 bp, mouse
gcaggggcagcacgggaatg

SEQ ID NO: 702334 - DNA, 20 bp, mouse
gtggcctctcctagccctcc

SEQ ID NO: 702335 - DNA, 20 bp, mouse
gacaactggattgagggtaa

SEQ ID NO: 702336 - DNA, 20 bp, mouse
gtgcgcaagcggcgtttcct

SEQ ID NO: 702337 - DNA, 20 bp, mouse
gggcgggcacctagcggggt

SEQ ID NO: 702338 - DNA, 20 bp, mouse
gtcctgggcaacgatctgtg

SEQ ID NO: 702339 - DNA, 20 bp, mouse
gctagcggggtcgggttgtg

SEQ ID NO: 702340 - DNA, 20 bp, mouse
gaacgatctgtggggcagat

SEQ ID NO: 702341 - DNA, 20 bp, mouse
ggtggtggatccactaatgg

SEQ ID NO: 702342 - DNA, 20 bp, mouse
gggaggcttctgacaggaat

SEQ ID NO: 702343 - DNA, 20 bp, mouse
ggccccacagatcgttgccc

SEQ ID NO: 702344 - DNA, 20 bp, mouse
ggggaagttggacaactgaa

SEQ ID NO: 702345 - DNA, 20 bp, mouse
gttgtcagacacggtaaggc

SEQ ID NO: 702346 - DNA, 20 bp, mouse
gtctcagactgattatgaaa

SEQ ID NO: 702347 - DNA, 20 bp, mouse
gtgactctatgttacaccac

SEQ ID NO: 702348 - DNA, 20 bp, mouse
gggcaggcctgagattatca

SEQ ID NO: 702349 - DNA, 20 bp, mouse
gtgtggaaaaccttaatcaa

SEQ ID NO: 702350 - DNA, 20 bp, mouse
gatgttaccctgataatctc

SEQ ID NO: 702351 - DNA, 20 bp, mouse
gagttgagatttattcttta

SEQ ID NO: 702352 - DNA, 20 bp, mouse
gaatgactgttacacagttg

SEQ ID NO: 702353 - DNA, 20 bp, mouse
gctagaaggatattcagttg

SEQ ID NO: 702354 - DNA, 20 bp, mouse
gcatttacatacaaagagta

SEQ ID NO: 702355 - DNA, 20 bp, mouse
gagacatcatctataatctt

SEQ ID NO: 702356 - DNA, 20 bp, mouse
gttaaaaagtacctattcta

SEQ ID NO: 702357 - DNA, 20 bp, mouse
gaggggtaatagagtaaatg

SEQ ID NO: 702358 - DNA, 20 bp, mouse
gctacatccagtacactctc

SEQ ID NO: 702359 - DNA, 20 bp, mouse
ggaaggtgatgtgggatctg

SEQ ID NO: 702360 - DNA, 20 bp, mouse
gagtaaggatattggagcct

SEQ ID NO: 702361 - DNA, 20 bp, mouse
ggaggtaaggcgggacaaga

SEQ ID NO: 702362 - DNA, 20 bp, mouse
gtcaggtcaacatcagagta

SEQ ID NO: 702363 - DNA, 20 bp, mouse
gttaaaatagaaggtgatgt

SEQ ID NO: 702364 - DNA, 20 bp, mouse
ggaggcatgagtttaccatg

SEQ ID NO: 702365 - DNA, 20 bp, mouse
gtgatgtgggatctgaggta

SEQ ID NO: 702366 - DNA, 20 bp, mouse
gcataagtacgagttgggag

SEQ ID NO: 702367 - DNA, 20 bp, mouse
gaatatctattcaaggtcat

SEQ ID NO: 702368 - DNA, 20 bp, mouse
gcctagattaccctcagaat

SEQ ID NO: 702369 - DNA, 20 bp, mouse
gcaaagcataagtacgagtt

SEQ ID NO: 702370 - DNA, 20 bp, mouse
gtgaattgaggatagacagg

SEQ ID NO: 702371 - DNA, 20 bp, mouse
gtattgaattgaggatagac

SEQ ID NO: 702372 - DNA, 20 bp, mouse
gttgaatagatattgaattg

SEQ ID NO: 702373 - DNA, 20 bp, mouse
gatttagaatgtttagggtg

SEQ ID NO: 702374 - DNA, 20 bp, mouse
gatcagtcttttgctctcat

SEQ ID NO: 702375 - DNA, 20 bp, mouse
gaagaaaaatgttggaacag

SEQ ID NO: 702376 - DNA, 20 bp, mouse
gttgaactgagcataggcag

SEQ ID NO: 702377 - DNA, 20 bp, mouse
gctgatattgaactgagcat

SEQ ID NO: 702378 - DNA, 20 bp, mouse
gaactagttagaggaaatag

SEQ ID NO: 702379 - DNA, 20 bp, mouse
gaagcataagaactagttag

SEQ ID NO: 702380 - DNA, 20 bp, mouse
gtctgatggttcccaagtta

SEQ ID NO: 702381 - DNA, 20 bp, mouse
gtcagttcaatatcagtgca

SEQ ID NO: 702382 - DNA, 20 bp, mouse
gagcagttttctttatctga

SEQ ID NO: 702383 - DNA, 20 bp, mouse
gactagttcttatgctttgc

SEQ ID NO: 702384 - DNA, 20 bp, mouse
gaatatcagtgcaaggtcat

SEQ ID NO: 702385 - DNA, 20 bp, mouse
ggatgaaaagcaaggaacaa

SEQ ID NO: 702386 - DNA, 20 bp, mouse
gcagaaatgcattgggtaac

SEQ ID NO: 702387 - DNA, 20 bp, mouse
gtttccagaacaatccaacc

SEQ ID NO: 702388 - DNA, 20 bp, mouse
gtacaaaaccaacaggagga

SEQ ID NO: 702389 - DNA, 20 bp, mouse
ggaaacagcagaaatgcatt

SEQ ID NO: 702390 - DNA, 20 bp, mouse
gtggaaaagctatgaggctg

SEQ ID NO: 702391 - DNA, 20 bp, mouse
gactgtgactaagtgtagaa

SEQ ID NO: 702392 - DNA, 20 bp, mouse
gcatctgctttatatttcgt

SEQ ID NO: 702393 - DNA, 20 bp, mouse
gttgatttggatatactctc

SEQ ID NO: 702394 - DNA, 20 bp, mouse
gcagcatttggtgaccaggt

SEQ ID NO: 702395 - DNA, 20 bp, mouse
ggattccttctgctctgata

SEQ ID NO: 702396 - DNA, 20 bp, mouse
ggggatccagtgttatcttt

SEQ ID NO: 702397 - DNA, 20 bp, mouse
gtcccagaagccaggcaaat

SEQ ID NO: 702398 - DNA, 20 bp, mouse
gggccctagcatctgtgctc

SEQ ID NO: 702399 - DNA, 20 bp, mouse
ggctagggccaaaaattgac

SEQ ID NO: 702400 - DNA, 20 bp, mouse
gataaaaactccacttgggc

SEQ ID NO: 702401 - DNA, 20 bp, mouse
gcctaagattcccagaagcc

SEQ ID NO: 702402 - DNA, 20 bp, mouse
ggattataaaaactccactt

SEQ ID NO: 702403 - DNA, 20 bp, mouse
gagagtttctacaacaaggt

SEQ ID NO: 702404 - DNA, 20 bp, mouse
gaccaagagtttctacaaca

SEQ ID NO: 702405 - DNA, 20 bp, mouse
ggttcagtcctgtcaatttt

SEQ ID NO: 702406 - DNA, 20 bp, mouse
gtcccagaagccaggcaaat

SEQ ID NO: 702407 - DNA, 20 bp, mouse
ggggatccagtgttatcttt

SEQ ID NO: 702408 - DNA, 20 bp, mouse
gggccctagcatctgtgctc

SEQ ID NO: 702409 - DNA, 20 bp, mouse
gcctaagattcccagaagcc

SEQ ID NO: 702410 - DNA, 20 bp, mouse
ggctagggccaaaaattgac

SEQ ID NO: 702411 - DNA, 20 bp, mouse
gataaaaactccacttgggc

SEQ ID NO: 702412 - DNA, 20 bp, mouse
gagagtttctacaacaaggt

SEQ ID NO: 702413 - DNA, 20 bp, mouse
ggattataaaaactccactt

SEQ ID NO: 702414 - DNA, 20 bp, mouse
gaccaagagtttctacaaca

SEQ ID NO: 702415 - DNA, 20 bp, mouse
ggttcagtcctgtcaatttt

SEQ ID NO: 702416 - DNA, 20 bp, mouse
ggggtgataaggcagatctg

SEQ ID NO: 702417 - DNA, 20 bp, mouse
gcgggggtaaacaaagacgg

SEQ ID NO: 702418 - DNA, 20 bp, mouse
ggctcgggggtaaacaaaga

SEQ ID NO: 702419 - DNA, 20 bp, mouse
ggaaaaaggagatggcccaa

SEQ ID NO: 702420 - DNA, 20 bp, mouse
gtgcagccagaatggctcgg

SEQ ID NO: 702421 - DNA, 20 bp, mouse
ggctgggcgaggatgctcgg

SEQ ID NO: 702422 - DNA, 20 bp, mouse
gatggcccaaaggaaaaatg

SEQ ID NO: 702423 - DNA, 20 bp, mouse
gctcggtggaggcgttacta

SEQ ID NO: 702424 - DNA, 20 bp, mouse
gttcccagccggtacccgta

SEQ ID NO: 702425 - DNA, 20 bp, mouse
ggcggctgaagagatcgagt

SEQ ID NO: 702426 - DNA, 20 bp, mouse
gcagctcggggtgcacggtg

SEQ ID NO: 702427 - DNA, 20 bp, mouse
gcaccccgagctgcgctgca

SEQ ID NO: 702428 - DNA, 20 bp, mouse
gggtgcgattacccaagtgg

SEQ ID NO: 702429 - DNA, 20 bp, mouse
gccgccctgcagcgcagctc

SEQ ID NO: 702430 - DNA, 20 bp, mouse
ggtgcacggtgcggggaggt

SEQ ID NO: 702431 - DNA, 20 bp, mouse
gatctggggagcattgagtt

SEQ ID NO: 702432 - DNA, 20 bp, mouse
gaggggcgggcgcgagaaag

SEQ ID NO: 702433 - DNA, 20 bp, mouse
gtttccaggcccctcatctg

SEQ ID NO: 702434 - DNA, 20 bp, mouse
gggaggtgcgattacccaag

SEQ ID NO: 702435 - DNA, 20 bp, mouse
gcacaggataagtccccgag

SEQ ID NO: 702436 - DNA, 20 bp, mouse
ggacctgggctcggcgaagt

SEQ ID NO: 702437 - DNA, 20 bp, mouse
ggaagtcggtgccccgtccc

SEQ ID NO: 702438 - DNA, 20 bp, mouse
gagcgggcgcggcagaggag

SEQ ID NO: 702439 - DNA, 20 bp, mouse
gttcgccgagcccaggtcct

SEQ ID NO: 702440 - DNA, 20 bp, mouse
gcaggcgttacccacacgtg

SEQ ID NO: 702441 - DNA, 20 bp, mouse
gtatctctgggcagacagtg

SEQ ID NO: 702442 - DNA, 20 bp, mouse
gccaccgcgcgcgaccgtgg

SEQ ID NO: 702443 - DNA, 20 bp, mouse
gcggggaggggcgaccccga

SEQ ID NO: 702444 - DNA, 20 bp, mouse
gtgcccagagatagtttata

SEQ ID NO: 702445 - DNA, 20 bp, mouse
gaccctcggcgactgccaat

SEQ ID NO: 702446 - DNA, 20 bp, mouse
gccttctgctggttggtcag

SEQ ID NO: 702447 - DNA, 20 bp, mouse
ggctccccgccagggaggtc

SEQ ID NO: 702448 - DNA, 20 bp, mouse
ggcagggagcccgacctccc

SEQ ID NO: 702449 - DNA, 20 bp, mouse
ggcacccgacctattaacaa

SEQ ID NO: 702450 - DNA, 20 bp, mouse
ggggagcccgacctccctgg

SEQ ID NO: 702451 - DNA, 20 bp, mouse
ggagctgaggctccccgcca

SEQ ID NO: 702452 - DNA, 20 bp, mouse
gttaacacgcccttctctgg

SEQ ID NO: 702453 - DNA, 20 bp, mouse
gccagtgttaatactgagga

SEQ ID NO: 702454 - DNA, 20 bp, mouse
ggctccctgcaaacagttgc

SEQ ID NO: 702455 - DNA, 20 bp, mouse
ggggccgcttccatgaaaaa

SEQ ID NO: 702456 - DNA, 20 bp, mouse
gggaggaggccctgagtcca

SEQ ID NO: 702457 - DNA, 20 bp, mouse
gaggccctgagtccagggtt

SEQ ID NO: 702458 - DNA, 20 bp, mouse
ggctctgagagaggtgcaac

SEQ ID NO: 702459 - DNA, 20 bp, mouse
ggtccgggcaagcaagctca

SEQ ID NO: 702460 - DNA, 20 bp, mouse
gtgagagaggtgcaacaggt

SEQ ID NO: 702461 - DNA, 20 bp, mouse
gctacccaaccctggactca

SEQ ID NO: 702462 - DNA, 20 bp, mouse
gctgctgtcaatcagctccc

SEQ ID NO: 702463 - DNA, 20 bp, mouse
ggagccgcagccccaggtcc

SEQ ID NO: 702464 - DNA, 20 bp, mouse
gaacacttccagcgcgtccc

SEQ ID NO: 702465 - DNA, 20 bp, mouse
gctgcgcagtttccccgcct

SEQ ID NO: 702466 - DNA, 20 bp, mouse
gtgtcagcggtaagagagac

SEQ ID NO: 702467 - DNA, 20 bp, mouse
gtgatgaagcagcttattcc

SEQ ID NO: 702468 - DNA, 20 bp, mouse
gcagagacactattcctcct

SEQ ID NO: 702469 - DNA, 20 bp, mouse
ggaaaaagcactcctgtcag

SEQ ID NO: 702470 - DNA, 20 bp, mouse
gtggggaagcaacaatttcc

SEQ ID NO: 702471 - DNA, 20 bp, mouse
gggtctcacacaaagcaatt

SEQ ID NO: 702472 - DNA, 20 bp, mouse
gtgtgtgtcagggacggggc

SEQ ID NO: 702473 - DNA, 20 bp, mouse
gccaacgtgaaactcaattt

SEQ ID NO: 702474 - DNA, 20 bp, mouse
gtgtgtgtgtgtcagggacg

SEQ ID NO: 702475 - DNA, 20 bp, mouse
gtggcatggtctgttcaccc

SEQ ID NO: 702476 - DNA, 20 bp, mouse
gcgccccctggtggaagcga

SEQ ID NO: 702477 - DNA, 20 bp, mouse
gaggttgtaaagaccatacc

SEQ ID NO: 702478 - DNA, 20 bp, mouse
gctcggcagcaggaaactgt

SEQ ID NO: 702479 - DNA, 20 bp, mouse
ggcaggaacgctgacgtgat

SEQ ID NO: 702480 - DNA, 20 bp, mouse
ggcgaagtcccggatgttcg

SEQ ID NO: 702481 - DNA, 20 bp, mouse
ggcactacggcggccgtgga

SEQ ID NO: 702482 - DNA, 20 bp, mouse
gtgtccgctgcaaagagagt

SEQ ID NO: 702483 - DNA, 20 bp, mouse
gtctctgtgcaggcccagtc

SEQ ID NO: 702484 - DNA, 20 bp, mouse
ggataccttcgcttccacca

SEQ ID NO: 702485 - DNA, 20 bp, mouse
gtacagggaaagacagtatt

SEQ ID NO: 702486 - DNA, 20 bp, mouse
gagaaacaggctagcccaga

SEQ ID NO: 702487 - DNA, 20 bp, mouse
gaagggggctggtctatcct

SEQ ID NO: 702488 - DNA, 20 bp, mouse
gttaaaggcgataacctcca

SEQ ID NO: 702489 - DNA, 20 bp, mouse
gggagcgggaaagctgacct

SEQ ID NO: 702490 - DNA, 20 bp, mouse
gaatctggcttcttggtaag

SEQ ID NO: 702491 - DNA, 20 bp, mouse
ggctggtctatcctgggtgt

SEQ ID NO: 702492 - DNA, 20 bp, mouse
gctgccttgcattctgtgta

SEQ ID NO: 702493 - DNA, 20 bp, mouse
gagccaaaacccagagaaac

SEQ ID NO: 702494 - DNA, 20 bp, mouse
gtgggaaaaagcagcctttc

SEQ ID NO: 702495 - DNA, 20 bp, mouse
gtgatctaaaaggaactccc

SEQ ID NO: 702496 - DNA, 20 bp, mouse
gctagctaggaaaggaggcg

SEQ ID NO: 702497 - DNA, 20 bp, mouse
ggggagcccaggaccctcct

SEQ ID NO: 702498 - DNA, 20 bp, mouse
gccaaccgcgagccctagga

SEQ ID NO: 702499 - DNA, 20 bp, mouse
gctggcgggggccacttcca

SEQ ID NO: 702500 - DNA, 20 bp, mouse
gagcaaccgcgatgggagga

SEQ ID NO: 702501 - DNA, 20 bp, mouse
gccctgacgctcagaagctc

SEQ ID NO: 702502 - DNA, 20 bp, mouse
ggcagcagcagccctggaag

SEQ ID NO: 702503 - DNA, 20 bp, mouse
gcatcagcggaattcccttg

SEQ ID NO: 702504 - DNA, 20 bp, mouse
gaaccgcgatgggaggaggg

SEQ ID NO: 702505 - DNA, 20 bp, mouse
gtgggcttgaaggctgaggg

SEQ ID NO: 702506 - DNA, 20 bp, mouse
gtcccccaggtctcttgcaa

SEQ ID NO: 702507 - DNA, 20 bp, mouse
ggggcttgcggcatgggctg

SEQ ID NO: 702508 - DNA, 20 bp, mouse
gccagagaatgcagatccga

SEQ ID NO: 702509 - DNA, 20 bp, mouse
gaggagagggcttgcggcat

SEQ ID NO: 702510 - DNA, 20 bp, mouse
gctccattgcaagagacctg

SEQ ID NO: 702511 - DNA, 20 bp, mouse
gcgggtgcggctaggatcac

SEQ ID NO: 702512 - DNA, 20 bp, mouse
ggcttaaggagatgctaagg

SEQ ID NO: 702513 - DNA, 20 bp, mouse
gaaggaggatgattgtgatc

SEQ ID NO: 702514 - DNA, 20 bp, mouse
gaagccagaagcggctcagg

SEQ ID NO: 702515 - DNA, 20 bp, mouse
ggacaattggactagatcga

SEQ ID NO: 702516 - DNA, 20 bp, mouse
gtacatgtggtacaggcaga

SEQ ID NO: 702517 - DNA, 20 bp, mouse
gtcctccctagtgcagaaga

SEQ ID NO: 702518 - DNA, 20 bp, mouse
ggtgtctggcagtgtacatg

SEQ ID NO: 702519 - DNA, 20 bp, mouse
gtttcccttgaagatgtcaa

SEQ ID NO: 702520 - DNA, 20 bp, mouse
gtgcctgttaggaattttga

SEQ ID NO: 702521 - DNA, 20 bp, mouse
gtggtataaaacaaaaccgg

SEQ ID NO: 702522 - DNA, 20 bp, mouse
gggcagtgtacatgtggtac

SEQ ID NO: 702523 - DNA, 20 bp, mouse
gctccacagggctgcctgtt

SEQ ID NO: 702524 - DNA, 20 bp, mouse
ggggactgatattgtacatg

SEQ ID NO: 702525 - DNA, 20 bp, mouse
gtttccattgacatcttcaa

SEQ ID NO: 702526 - DNA, 20 bp, mouse
gcgcgcccagggagcaccca

SEQ ID NO: 702527 - DNA, 20 bp, mouse
gtgaaatgcagctccctact

SEQ ID NO: 702528 - DNA, 20 bp, mouse
gtgtcccggccaggttgggg

SEQ ID NO: 702529 - DNA, 20 bp, mouse
ggtgtcccggggctaggtct

SEQ ID NO: 702530 - DNA, 20 bp, mouse
gcatgccgccccaacctggc

SEQ ID NO: 702531 - DNA, 20 bp, mouse
gggagcacccagggctggcc

SEQ ID NO: 702532 - DNA, 20 bp, mouse
gcccagggagcacccagggc

SEQ ID NO: 702533 - DNA, 20 bp, mouse
gggccgggacacacagtgaa

SEQ ID NO: 702534 - DNA, 20 bp, mouse
gggaagctggcgctgggtgg

SEQ ID NO: 702535 - DNA, 20 bp, mouse
gcagtgaaaggcgagttcag

SEQ ID NO: 702536 - DNA, 20 bp, mouse
gccgcgaagggagcgagcca

SEQ ID NO: 702537 - DNA, 20 bp, mouse
gaggaatggggatgatgagc

SEQ ID NO: 702538 - DNA, 20 bp, mouse
gtcccttcgcgggcggtggt

SEQ ID NO: 702539 - DNA, 20 bp, mouse
gtgcccgtgcccagctcatg

SEQ ID NO: 702540 - DNA, 20 bp, mouse
gctagggggctggcccgact

SEQ ID NO: 702541 - DNA, 20 bp, mouse
gaatggggatgatgagcggg

SEQ ID NO: 702542 - DNA, 20 bp, mouse
gcagggcttggggcgctagg

SEQ ID NO: 702543 - DNA, 20 bp, mouse
gtgtggacacttcacgagat

SEQ ID NO: 702544 - DNA, 20 bp, mouse
gccaatggaggtcagcgcgg

SEQ ID NO: 702545 - DNA, 20 bp, mouse
gcagcagtagtgagcccagt

SEQ ID NO: 702546 - DNA, 20 bp, mouse
gccgccccgccccaaattga

SEQ ID NO: 702547 - DNA, 20 bp, mouse
gcagagagctggggtgatcg

SEQ ID NO: 702548 - DNA, 20 bp, mouse
ggccgtgggcgtgaactcga

SEQ ID NO: 702549 - DNA, 20 bp, mouse
gcacccctccgcaggactct

SEQ ID NO: 702550 - DNA, 20 bp, mouse
gacccagggaccaggggacg

SEQ ID NO: 702551 - DNA, 20 bp, mouse
gagcagggagggcgtgtctc

SEQ ID NO: 702552 - DNA, 20 bp, mouse
gggggcggagcggaaggcgt

SEQ ID NO: 702553 - DNA, 20 bp, mouse
gccccgccccaaattgaagg

SEQ ID NO: 702554 - DNA, 20 bp, mouse
ggacccaaccaagagtcctg

SEQ ID NO: 702555 - DNA, 20 bp, mouse
gccaaccaagagtcctgcgg

SEQ ID NO: 702556 - DNA, 20 bp, mouse
gcagcagtgcaaacgccctt

SEQ ID NO: 702557 - DNA, 20 bp, mouse
gcagcctcctctttggtcca

SEQ ID NO: 702558 - DNA, 20 bp, mouse
gtgaagtgaagcacacccaa

SEQ ID NO: 702559 - DNA, 20 bp, mouse
ggaagcagggatgcctggct

SEQ ID NO: 702560 - DNA, 20 bp, mouse
gactgaggatcgatagcatc

SEQ ID NO: 702561 - DNA, 20 bp, mouse
ggtgggcccggctggaagca

SEQ ID NO: 702562 - DNA, 20 bp, mouse
gggtccacgggaaatccaac

SEQ ID NO: 702563 - DNA, 20 bp, mouse
gaacagggagtaaacagtct

SEQ ID NO: 702564 - DNA, 20 bp, mouse
ggatttcccgtggaccaaag

SEQ ID NO: 702565 - DNA, 20 bp, mouse
gtttgcactgctgagtactg

SEQ ID NO: 702566 - DNA, 20 bp, mouse
ggagtgagggcgacgggaga

SEQ ID NO: 702567 - DNA, 20 bp, mouse
ggggacaatacaggactcgg

SEQ ID NO: 702568 - DNA, 20 bp, mouse
ggtgcggggagtgagggcga

SEQ ID NO: 702569 - DNA, 20 bp, mouse
gagagggacaatacaggact

SEQ ID NO: 702570 - DNA, 20 bp, mouse
gctaagtaagctgggaacca

SEQ ID NO: 702571 - DNA, 20 bp, mouse
gaagacccttggtctgtaat

SEQ ID NO: 702572 - DNA, 20 bp, mouse
gttggctgtgcggggagtga

SEQ ID NO: 702573 - DNA, 20 bp, mouse
gcgggagtacgcgtgcgccg

SEQ ID NO: 702574 - DNA, 20 bp, mouse
ggccccgcctctccgactga

SEQ ID NO: 702575 - DNA, 20 bp, mouse
ggcaacactactcatgtagt

SEQ ID NO: 702576 - DNA, 20 bp, mouse
gtatcccccggcgggtgagt

SEQ ID NO: 702577 - DNA, 20 bp, mouse
gacgctgcgtatcccccggc

SEQ ID NO: 702578 - DNA, 20 bp, mouse
gccagcctcagtgttcccgt

SEQ ID NO: 702579 - DNA, 20 bp, mouse
ggggaacactgaggctggga

SEQ ID NO: 702580 - DNA, 20 bp, mouse
ggggaagccagagcttagaa

SEQ ID NO: 702581 - DNA, 20 bp, mouse
ggggaaggccagccgaggca

SEQ ID NO: 702582 - DNA, 20 bp, mouse
gaggtcctgggccgtcgcag

SEQ ID NO: 702583 - DNA, 20 bp, mouse
gcgcccgcgccgtctggcgg

SEQ ID NO: 702584 - DNA, 20 bp, mouse
gggatacgcagcgtccccac

SEQ ID NO: 702585 - DNA, 20 bp, mouse
gccgcggctgcagcccgagg

SEQ ID NO: 702586 - DNA, 20 bp, mouse
gaatgctaggattattgggg

SEQ ID NO: 702587 - DNA, 20 bp, mouse
gacatatctagctctttaat

SEQ ID NO: 702588 - DNA, 20 bp, mouse
gcaggggaagagctgggcag

SEQ ID NO: 702589 - DNA, 20 bp, mouse
gaaaaaacaggggaagagct

SEQ ID NO: 702590 - DNA, 20 bp, mouse
gggaactagctccttagagc

SEQ ID NO: 702591 - DNA, 20 bp, mouse
gaaaaaccatctcaaaaaac

SEQ ID NO: 702592 - DNA, 20 bp, mouse
gagaggtggactgatgtctt

SEQ ID NO: 702593 - DNA, 20 bp, mouse
gaataatcctagcattgggg

SEQ ID NO: 702594 - DNA, 20 bp, mouse
gggactgatgtctttggtca

SEQ ID NO: 702595 - DNA, 20 bp, mouse
gcaaacaaaacagaggaaaa

SEQ ID NO: 702596 - DNA, 20 bp, mouse
gcccaagcaggaccattgat

SEQ ID NO: 702597 - DNA, 20 bp, mouse
ggatctggaggctcccggag

SEQ ID NO: 702598 - DNA, 20 bp, mouse
ggtgcagcgctaattaggag

SEQ ID NO: 702599 - DNA, 20 bp, mouse
gcaggcgccctgaggaccag

SEQ ID NO: 702600 - DNA, 20 bp, mouse
gcgccccgccctgagagctt

SEQ ID NO: 702601 - DNA, 20 bp, mouse
ggaccagaggctagggtgag

SEQ ID NO: 702602 - DNA, 20 bp, mouse
gcaggctgggcacaaggagc

SEQ ID NO: 702603 - DNA, 20 bp, mouse
gaggcagctgcagtgctgtg

SEQ ID NO: 702604 - DNA, 20 bp, mouse
gcgacgggatcgtttgtcag

SEQ ID NO: 702605 - DNA, 20 bp, mouse
gcgaagcgggcgcccatcaa

SEQ ID NO: 702606 - DNA, 20 bp, mouse
gcgggctcggaaaccaggta

SEQ ID NO: 702607 - DNA, 20 bp, mouse
gcagtcctaaagcccatccc

SEQ ID NO: 702608 - DNA, 20 bp, mouse
gaaaccaggtagggcagctt

SEQ ID NO: 702609 - DNA, 20 bp, mouse
gtgcacatgtgaaactagaa

SEQ ID NO: 702610 - DNA, 20 bp, mouse
ggtaccgcggagctgcaact

SEQ ID NO: 702611 - DNA, 20 bp, mouse
gggtatgcattcaaataggc

SEQ ID NO: 702612 - DNA, 20 bp, mouse
gactgggaaaccggcaggga

SEQ ID NO: 702613 - DNA, 20 bp, mouse
gtcgctcaggcaggaggagc

SEQ ID NO: 702614 - DNA, 20 bp, mouse
gcgacccaagctgccctacc

SEQ ID NO: 702615 - DNA, 20 bp, mouse
gaggctggtagagaaaacca

SEQ ID NO: 702616 - DNA, 20 bp, mouse
gctcccaggaaactcctcca

SEQ ID NO: 702617 - DNA, 20 bp, mouse
ggagcctgccagtgggtgat

SEQ ID NO: 702618 - DNA, 20 bp, mouse
ggacaagtcaagtgttgtga

SEQ ID NO: 702619 - DNA, 20 bp, mouse
gtaggaagtgttgatttaga

SEQ ID NO: 702620 - DNA, 20 bp, mouse
gctccagcatcttagatttc

SEQ ID NO: 702621 - DNA, 20 bp, mouse
gctgccagtgggtgatagga

SEQ ID NO: 702622 - DNA, 20 bp, mouse
gagggtcctgaaggtggatt

SEQ ID NO: 702623 - DNA, 20 bp, mouse
gtatcagactacggagagag

SEQ ID NO: 702624 - DNA, 20 bp, mouse
gttatcagttgccacaaaag

SEQ ID NO: 702625 - DNA, 20 bp, mouse
gagcctgaaatctaagatgc

SEQ ID NO: 702626 - DNA, 20 bp, mouse
gggaccagaaaggtcaaatc

SEQ ID NO: 702627 - DNA, 20 bp, mouse
ggatggggagaatagaaaga

SEQ ID NO: 702628 - DNA, 20 bp, mouse
gtggaggcgactgggcgatg

SEQ ID NO: 702629 - DNA, 20 bp, mouse
ggacgcgaagaaggagcgtc

SEQ ID NO: 702630 - DNA, 20 bp, mouse
gaggagcgtcaggcgaggag

SEQ ID NO: 702631 - DNA, 20 bp, mouse
gggtccctgggtgcttagtg

SEQ ID NO: 702632 - DNA, 20 bp, mouse
gagaaagaaggacgcgaaga

SEQ ID NO: 702633 - DNA, 20 bp, mouse
gatacaagcaagctcccagg

SEQ ID NO: 702634 - DNA, 20 bp, mouse
gggcgacagtcattctaata

SEQ ID NO: 702635 - DNA, 20 bp, mouse
gccagaaaggtcaaatctgg

SEQ ID NO: 702636 - DNA, 20 bp, mouse
gggggcccgcgggaccacag

SEQ ID NO: 702637 - DNA, 20 bp, mouse
gctaacccctgtggtcccgc

SEQ ID NO: 702638 - DNA, 20 bp, mouse
gctaacaggcgttaaaataa

SEQ ID NO: 702639 - DNA, 20 bp, mouse
ggggaccacaggggttagca

SEQ ID NO: 702640 - DNA, 20 bp, mouse
ggggttagcaaggagcccgg

SEQ ID NO: 702641 - DNA, 20 bp, mouse
gctgccagccctcccgggag

SEQ ID NO: 702642 - DNA, 20 bp, mouse
gggccacgcccctcccggga

SEQ ID NO: 702643 - DNA, 20 bp, mouse
gttaaaataaggggtgccag

SEQ ID NO: 702644 - DNA, 20 bp, mouse
gccgagcccggagcattcac

SEQ ID NO: 702645 - DNA, 20 bp, mouse
gccccggaagtgcttgtcta

SEQ ID NO: 702646 - DNA, 20 bp, mouse
gcgggacggggacagaggta

SEQ ID NO: 702647 - DNA, 20 bp, mouse
gtcctccaaagggaccttct

SEQ ID NO: 702648 - DNA, 20 bp, mouse
gcccgcgactaggactcctg

SEQ ID NO: 702649 - DNA, 20 bp, mouse
gagcatgcgcagacgccaga

SEQ ID NO: 702650 - DNA, 20 bp, mouse
gccaggaggggaagtggcga

SEQ ID NO: 702651 - DNA, 20 bp, mouse
ggcgctcggggcccgcgact

SEQ ID NO: 702652 - DNA, 20 bp, mouse
gcgacccgagccggggcaac

SEQ ID NO: 702653 - DNA, 20 bp, mouse
ggcgtggcctgtctggagaa

SEQ ID NO: 702654 - DNA, 20 bp, mouse
ggcagcctagaaggtccctt

SEQ ID NO: 702655 - DNA, 20 bp, mouse
gggcggaccgacccgagccg

SEQ ID NO: 702656 - DNA, 20 bp, mouse
gaagcagcggcgtttgggga

SEQ ID NO: 702657 - DNA, 20 bp, mouse
gtgggagctcaggttgagaa

SEQ ID NO: 702658 - DNA, 20 bp, mouse
gccgctgcttccaaatgcaa

SEQ ID NO: 702659 - DNA, 20 bp, mouse
gggcagcccggggtgtgctc

SEQ ID NO: 702660 - DNA, 20 bp, mouse
gtccacctcccagctcgcta

SEQ ID NO: 702661 - DNA, 20 bp, mouse
gtgcacatcccagagaagga

SEQ ID NO: 702662 - DNA, 20 bp, mouse
gttggaagcagcggcgtttg

SEQ ID NO: 702663 - DNA, 20 bp, mouse
ggcagccccccgctgaggga

SEQ ID NO: 702664 - DNA, 20 bp, mouse
ggaggctcctcggtgcagaa

SEQ ID NO: 702665 - DNA, 20 bp, mouse
gaccctgcagccccccgctg

SEQ ID NO: 702666 - DNA, 20 bp, mouse
ggtggggaaactctgagcgg

SEQ ID NO: 702667 - DNA, 20 bp, mouse
gaccgagagtgattagaggt

SEQ ID NO: 702668 - DNA, 20 bp, mouse
gttctccaaagcaacgttgg

SEQ ID NO: 702669 - DNA, 20 bp, mouse
ggcactgccgggcgcccgtc

SEQ ID NO: 702670 - DNA, 20 bp, mouse
ggaggaccgagagtgattag

SEQ ID NO: 702671 - DNA, 20 bp, mouse
gtagaggtaggtccaacccg

SEQ ID NO: 702672 - DNA, 20 bp, mouse
ggaaactctgagcggcgggg

SEQ ID NO: 702673 - DNA, 20 bp, mouse
ggggcgaggaccgctgttcc

SEQ ID NO: 702674 - DNA, 20 bp, mouse
gcacctgattgggtaagaaa

SEQ ID NO: 702675 - DNA, 20 bp, mouse
gtaggtccaacccgggggag

SEQ ID NO: 702676 - DNA, 20 bp, mouse
ggggaccaagggttcgtcta

SEQ ID NO: 702677 - DNA, 20 bp, mouse
gatggataggggacctccga

SEQ ID NO: 702678 - DNA, 20 bp, mouse
gctcgcggggcgggatacag

SEQ ID NO: 702679 - DNA, 20 bp, mouse
gtctgcaaagtgagatggat

SEQ ID NO: 702680 - DNA, 20 bp, mouse
gacaggggtgcgcatctctg

SEQ ID NO: 702681 - DNA, 20 bp, mouse
gcagctgcgccttcccacct

SEQ ID NO: 702682 - DNA, 20 bp, mouse
gtgggggtgggaggactaat

SEQ ID NO: 702683 - DNA, 20 bp, mouse
gaaggcgcagctgcgagcca

SEQ ID NO: 702684 - DNA, 20 bp, mouse
ggggcaacgagggacggtgt

SEQ ID NO: 702685 - DNA, 20 bp, mouse
gagctcctctggccgctcgc

SEQ ID NO: 702686 - DNA, 20 bp, mouse
gggcccacgcctacagggga

SEQ ID NO: 702687 - DNA, 20 bp, mouse
gagccctcccctgtaggcgt

SEQ ID NO: 702688 - DNA, 20 bp, mouse
ggtaggcgtgggcctaaatg

SEQ ID NO: 702689 - DNA, 20 bp, mouse
gcaggcaggggtgaacgtgg

SEQ ID NO: 702690 - DNA, 20 bp, mouse
gcacgcatgtatgctggcag

SEQ ID NO: 702691 - DNA, 20 bp, mouse
gttaataagccctcccctgt

SEQ ID NO: 702692 - DNA, 20 bp, mouse
gcaccaggcaggggtgaacg

SEQ ID NO: 702693 - DNA, 20 bp, mouse
gaaaacacacttgtgtatac

SEQ ID NO: 702694 - DNA, 20 bp, mouse
gagcttaagctgacttacgc

SEQ ID NO: 702695 - DNA, 20 bp, mouse
gcagtatgcagagtctgtaa

SEQ ID NO: 702696 - DNA, 20 bp, mouse
gattactagtggctttcttg

SEQ ID NO: 702697 - DNA, 20 bp, mouse
ggaaagccactagtaattaa

SEQ ID NO: 702698 - DNA, 20 bp, mouse
gttttagaagcttccctcaa

SEQ ID NO: 702699 - DNA, 20 bp, mouse
ggtgatgtcacagacccttg

SEQ ID NO: 702700 - DNA, 20 bp, mouse
gctgctgagaatataacttc

SEQ ID NO: 702701 - DNA, 20 bp, mouse
gtcattgagggagtttcaca

SEQ ID NO: 702702 - DNA, 20 bp, mouse
gggagtttcacagggatgaa

SEQ ID NO: 702703 - DNA, 20 bp, mouse
gaagcagaatggagattcca

SEQ ID NO: 702704 - DNA, 20 bp, mouse
ggatattgacttctgaatca

SEQ ID NO: 702705 - DNA, 20 bp, mouse
gattcagaagtcaatatcca

SEQ ID NO: 702706 - DNA, 20 bp, mouse
gtccccggagtgtttttctg

SEQ ID NO: 702707 - DNA, 20 bp, mouse
gcggggaagcgcaggggacc

SEQ ID NO: 702708 - DNA, 20 bp, mouse
ggcgcccagggttttatagg

SEQ ID NO: 702709 - DNA, 20 bp, mouse
ggcggcgcccagggttttat

SEQ ID NO: 702710 - DNA, 20 bp, mouse
gtacccgggcctgccgggga

SEQ ID NO: 702711 - DNA, 20 bp, mouse
ggggctctgcagcgcgcgcc

SEQ ID NO: 702712 - DNA, 20 bp, mouse
gaccctccctccatcctgaa

SEQ ID NO: 702713 - DNA, 20 bp, mouse
gcgaacgggccagaggcaga

SEQ ID NO: 702714 - DNA, 20 bp, mouse
gacactccggggaagcgcag

SEQ ID NO: 702715 - DNA, 20 bp, mouse
gctgcagagcacgactgtgg

SEQ ID NO: 702716 - DNA, 20 bp, mouse
ggggcggatcagaagtgcac

SEQ ID NO: 702717 - DNA, 20 bp, mouse
gacctccttgtcctcaccca

SEQ ID NO: 702718 - DNA, 20 bp, mouse
ggccatgggtgaggacaagg

SEQ ID NO: 702719 - DNA, 20 bp, mouse
gagccgagggcgggtgagag

SEQ ID NO: 702720 - DNA, 20 bp, mouse
gtcctgctggacattgactc

SEQ ID NO: 702721 - DNA, 20 bp, mouse
gcataggacccaggcagcca

SEQ ID NO: 702722 - DNA, 20 bp, mouse
ggtccagcaggacaaaagcg

SEQ ID NO: 702723 - DNA, 20 bp, mouse
ggccagcgggcagccgaggg

SEQ ID NO: 702724 - DNA, 20 bp, mouse
gtgggaagccctgaagcaat

SEQ ID NO: 702725 - DNA, 20 bp, mouse
ggtggaatctacagtttata

SEQ ID NO: 702726 - DNA, 20 bp, mouse
gaatcatgggccaaaggaag

SEQ ID NO: 702727 - DNA, 20 bp, mouse
ggggaaagggcgctggcaat

SEQ ID NO: 702728 - DNA, 20 bp, mouse
ggggacagacctaaagtctc

SEQ ID NO: 702729 - DNA, 20 bp, mouse
gcccttgttaggaagtaaat

SEQ ID NO: 702730 - DNA, 20 bp, mouse
ggcaataggagcatcaatca

SEQ ID NO: 702731 - DNA, 20 bp, mouse
gacctcaattgcttggagtt

SEQ ID NO: 702732 - DNA, 20 bp, mouse
ggcttgggacccacttcctt

SEQ ID NO: 702733 - DNA, 20 bp, mouse
gagcatcaatcatgggccaa

SEQ ID NO: 702734 - DNA, 20 bp, mouse
gctaacaagggcattctgct

SEQ ID NO: 702735 - DNA, 20 bp, mouse
ggaagtgggtcccaagcttt

SEQ ID NO: 702736 - DNA, 20 bp, mouse
gaagccctcaggcggaaggc

SEQ ID NO: 702737 - DNA, 20 bp, mouse
gagtcctgagttcacaagac

SEQ ID NO: 702738 - DNA, 20 bp, mouse
gatcaatctgaggtgagtaa

SEQ ID NO: 702739 - DNA, 20 bp, mouse
gcctgagagctgtccttcgg

SEQ ID NO: 702740 - DNA, 20 bp, mouse
ggaaggacagctctcagggt

SEQ ID NO: 702741 - DNA, 20 bp, mouse
gagcaaaccggatcaatctg

SEQ ID NO: 702742 - DNA, 20 bp, mouse
gacagctctcagggtaggaa

SEQ ID NO: 702743 - DNA, 20 bp, mouse
gtcccagtgtaatactggga

SEQ ID NO: 702744 - DNA, 20 bp, mouse
ggggataacccaagctccgg

SEQ ID NO: 702745 - DNA, 20 bp, mouse
gaaggcaggatatctgagtt

SEQ ID NO: 702746 - DNA, 20 bp, mouse
gcgtgcgccgacacccgcac

SEQ ID NO: 702747 - DNA, 20 bp, mouse
gcaggtgaaggatgcgtccc

SEQ ID NO: 702748 - DNA, 20 bp, mouse
ggacacccgcaccggcggag

SEQ ID NO: 702749 - DNA, 20 bp, mouse
gggccttgcaatgaaccatt

SEQ ID NO: 702750 - DNA, 20 bp, mouse
gaggcccgcagcgatggcac

SEQ ID NO: 702751 - DNA, 20 bp, mouse
ggccgcggaaacatgtggaa

SEQ ID NO: 702752 - DNA, 20 bp, mouse
gtgcccaatggttcattgca

SEQ ID NO: 702753 - DNA, 20 bp, mouse
gctaagtggagagacgctgc

SEQ ID NO: 702754 - DNA, 20 bp, mouse
gcactgggcctggcctacca

SEQ ID NO: 702755 - DNA, 20 bp, mouse
gacccagcagccaggtcgtg

SEQ ID NO: 702756 - DNA, 20 bp, mouse
ggtggctgggcgaacggaaa

SEQ ID NO: 702757 - DNA, 20 bp, mouse
ggggctgagacccgagactc

SEQ ID NO: 702758 - DNA, 20 bp, mouse
gctgagacccgagactcagg

SEQ ID NO: 702759 - DNA, 20 bp, mouse
gcgcccagccacctgagtct

SEQ ID NO: 702760 - DNA, 20 bp, mouse
gacccgagactcaggtggct

SEQ ID NO: 702761 - DNA, 20 bp, mouse
gcacagcatgtgacctcccc

SEQ ID NO: 702762 - DNA, 20 bp, mouse
gtggagacgctaacagtcct

SEQ ID NO: 702763 - DNA, 20 bp, mouse
gtaacactcaagtgtcacca

SEQ ID NO: 702764 - DNA, 20 bp, mouse
gactcaggtggctgggcgaa

SEQ ID NO: 702765 - DNA, 20 bp, mouse
gacacttgagtgttaagaag

SEQ ID NO: 702766 - DNA, 20 bp, mouse
gtgtgctgccatatcagatt

SEQ ID NO: 702767 - DNA, 20 bp, mouse
gaatttacaaggtgagggag

SEQ ID NO: 702768 - DNA, 20 bp, mouse
gaatcattgtttagacggac

SEQ ID NO: 702769 - DNA, 20 bp, mouse
ggtacaaaccgaatctgata

SEQ ID NO: 702770 - DNA, 20 bp, mouse
gggagtgttcagtctgttct

SEQ ID NO: 702771 - DNA, 20 bp, mouse
gtgtggcatttagactgctt

SEQ ID NO: 702772 - DNA, 20 bp, mouse
gtaaaaccctgtggatttac

SEQ ID NO: 702773 - DNA, 20 bp, mouse
gcaacataaagcctgctgaa

SEQ ID NO: 702774 - DNA, 20 bp, mouse
gaagggaatcattgtttaga

SEQ ID NO: 702775 - DNA, 20 bp, mouse
gtaacacccagtaaatccac

SEQ ID NO: 702776 - DNA, 20 bp, mouse
gaggtcttgaaggataagac

SEQ ID NO: 702777 - DNA, 20 bp, mouse
gccgctgtaggtgggtgata

SEQ ID NO: 702778 - DNA, 20 bp, mouse
gaagagagtagtgaccagta

SEQ ID NO: 702779 - DNA, 20 bp, mouse
gtgggtgatagggttctctg

SEQ ID NO: 702780 - DNA, 20 bp, mouse
gactgcatggaggtccctac

SEQ ID NO: 702781 - DNA, 20 bp, mouse
gatgacaacaagtagaaact

SEQ ID NO: 702782 - DNA, 20 bp, mouse
gtgttgtcattttggggtca

SEQ ID NO: 702783 - DNA, 20 bp, mouse
gtctacttgttgtcattttg

SEQ ID NO: 702784 - DNA, 20 bp, mouse
gggatgtacttgccgggaaa

SEQ ID NO: 702785 - DNA, 20 bp, mouse
gagcactaagccgctgtagg

SEQ ID NO: 702786 - DNA, 20 bp, mouse
ggtcctggttgggattggag

SEQ ID NO: 702787 - DNA, 20 bp, mouse
gtgcgcgcttctagttgcca

SEQ ID NO: 702788 - DNA, 20 bp, mouse
gaccccctccaatcccaacc

SEQ ID NO: 702789 - DNA, 20 bp, mouse
gtcaaagaacgctgttgccc

SEQ ID NO: 702790 - DNA, 20 bp, mouse
ggaagagaggatagtgatat

SEQ ID NO: 702791 - DNA, 20 bp, mouse
gagtctcgcgataggtttaa

SEQ ID NO: 702792 - DNA, 20 bp, mouse
gtcccgtaccttcaagaatt

SEQ ID NO: 702793 - DNA, 20 bp, mouse
gagaattgggtattgaagcc

SEQ ID NO: 702794 - DNA, 20 bp, mouse
gttcaatacccaattcttga

SEQ ID NO: 702795 - DNA, 20 bp, mouse
ggcagtcttcttgtaacttc

SEQ ID NO: 702796 - DNA, 20 bp, mouse
ggggttggatagtctgaggg

SEQ ID NO: 702797 - DNA, 20 bp, mouse
ggggtgggttggatagtctg

SEQ ID NO: 702798 - DNA, 20 bp, mouse
gacgacctcaatcgaaaatc

SEQ ID NO: 702799 - DNA, 20 bp, mouse
gtgcctcagattgggaaatt

SEQ ID NO: 702800 - DNA, 20 bp, mouse
gagaaccagattttcgattg

SEQ ID NO: 702801 - DNA, 20 bp, mouse
gcggcctccactgttctacg

SEQ ID NO: 702802 - DNA, 20 bp, mouse
gaggcactctatctcctacg

SEQ ID NO: 702803 - DNA, 20 bp, mouse
gagaacagtggaggccgcgt

SEQ ID NO: 702804 - DNA, 20 bp, mouse
ggggttggatagttatcaac

SEQ ID NO: 702805 - DNA, 20 bp, mouse
ggagatagagtgcctcagat

SEQ ID NO: 702806 - DNA, 20 bp, mouse
ggctgggggcgacgcgtcgg

SEQ ID NO: 702807 - DNA, 20 bp, mouse
gagggtgtgccggctctttg

SEQ ID NO: 702808 - DNA, 20 bp, mouse
gaagcagctcagggatcctg

SEQ ID NO: 702809 - DNA, 20 bp, mouse
gtccgacagataattgggaa

SEQ ID NO: 702810 - DNA, 20 bp, mouse
ggaggtgcccgaaatcaaag

SEQ ID NO: 702811 - DNA, 20 bp, mouse
ggtgctggggacccattccc

SEQ ID NO: 702812 - DNA, 20 bp, mouse
ggccgcgaccgagggtgtgc

SEQ ID NO: 702813 - DNA, 20 bp, mouse
ggaaatcaaagcggcaggag

SEQ ID NO: 702814 - DNA, 20 bp, mouse
gggcacctccgacagataat

SEQ ID NO: 702815 - DNA, 20 bp, mouse
gggggcgacgcgtcgggggt

SEQ ID NO: 702816 - DNA, 20 bp, mouse
ggggaaggaggggtcttaag

SEQ ID NO: 702817 - DNA, 20 bp, mouse
gtggggtctaggagaggacg

SEQ ID NO: 702818 - DNA, 20 bp, mouse
gcggcccccgccagtagccc

SEQ ID NO: 702819 - DNA, 20 bp, mouse
ggggggcagcgctgcagaag

SEQ ID NO: 702820 - DNA, 20 bp, mouse
ggaccctgaaacaaaggcgg

SEQ ID NO: 702821 - DNA, 20 bp, mouse
ggacgctcctgggctactgg

SEQ ID NO: 702822 - DNA, 20 bp, mouse
ggctcctgggctactggcgg

SEQ ID NO: 702823 - DNA, 20 bp, mouse
ggcggtgcatggacgctcct

SEQ ID NO: 702824 - DNA, 20 bp, mouse
gagcccaggtcggacttcct

SEQ ID NO: 702825 - DNA, 20 bp, mouse
gacagtgggcatccatgcca

SEQ ID NO: 702826 - DNA, 20 bp, mouse
gtcacaaagtgtggcccgga

SEQ ID NO: 702827 - DNA, 20 bp, mouse
gccggagggcatgtcctggg

SEQ ID NO: 702828 - DNA, 20 bp, mouse
gagggcccgggcctgcgcgg

SEQ ID NO: 702829 - DNA, 20 bp, mouse
gggcaggccgtgtcccatct

SEQ ID NO: 702830 - DNA, 20 bp, mouse
gtccccgaggcgcagggccc

SEQ ID NO: 702831 - DNA, 20 bp, mouse
gggcccggagggcatgtcct

SEQ ID NO: 702832 - DNA, 20 bp, mouse
ggcaccccagagatccccaa

SEQ ID NO: 702833 - DNA, 20 bp, mouse
gcaactgtctggttcccaga

SEQ ID NO: 702834 - DNA, 20 bp, mouse
gggacacggcctgcccccgg

SEQ ID NO: 702835 - DNA, 20 bp, mouse
gggggtcaggtcacaaagtg

SEQ ID NO: 702836 - DNA, 20 bp, mouse
gggaaggtgtgattatgcag

SEQ ID NO: 702837 - DNA, 20 bp, mouse
ggaggggcggagtctagaga

SEQ ID NO: 702838 - DNA, 20 bp, mouse
ggggcggagtctagagaggg

SEQ ID NO: 702839 - DNA, 20 bp, mouse
gaaacggcaagaccaaggta

SEQ ID NO: 702840 - DNA, 20 bp, mouse
gtgcaggggcggagcctatc

SEQ ID NO: 702841 - DNA, 20 bp, mouse
gtccacacctagcgagaaga

SEQ ID NO: 702842 - DNA, 20 bp, mouse
gacttgggcaacaaccggat

SEQ ID NO: 702843 - DNA, 20 bp, mouse
gcgaagcctgggaaaagata

SEQ ID NO: 702844 - DNA, 20 bp, mouse
ggtaaggccggctgaggggc

SEQ ID NO: 702845 - DNA, 20 bp, mouse
gccaaggtaaggccggctga

SEQ ID NO: 702846 - DNA, 20 bp, mouse
gccaggtggtgcagggaaca

SEQ ID NO: 702847 - DNA, 20 bp, mouse
gtgggcaggcggggcccgga

SEQ ID NO: 702848 - DNA, 20 bp, mouse
ggtctggcccaggtggtgca

SEQ ID NO: 702849 - DNA, 20 bp, mouse
gggcccggaaaagagcttag

SEQ ID NO: 702850 - DNA, 20 bp, mouse
gggtctgacccgcaagcagg

SEQ ID NO: 702851 - DNA, 20 bp, mouse
gagcacaggtggcggcgatt

SEQ ID NO: 702852 - DNA, 20 bp, mouse
gcggtcccggcggcagaaat

SEQ ID NO: 702853 - DNA, 20 bp, mouse
ggctgctctacacctgccgc

SEQ ID NO: 702854 - DNA, 20 bp, mouse
gggcgcgcaagcagagcgcg

SEQ ID NO: 702855 - DNA, 20 bp, mouse
ggcttgcgggtcagaccccg

SEQ ID NO: 702856 - DNA, 20 bp, mouse
gccttggctgggcttctgat

SEQ ID NO: 702857 - DNA, 20 bp, mouse
gagcccagcagaaactataa

SEQ ID NO: 702858 - DNA, 20 bp, mouse
ggcggtcccagcgaaggagg

SEQ ID NO: 702859 - DNA, 20 bp, mouse
gagaccaggcttcctagtat

SEQ ID NO: 702860 - DNA, 20 bp, mouse
ggaggggcggccccttggct

SEQ ID NO: 702861 - DNA, 20 bp, mouse
gtgtgaggtcgcagagtccc

SEQ ID NO: 702862 - DNA, 20 bp, mouse
ggcgacctcacagcccgcta

SEQ ID NO: 702863 - DNA, 20 bp, mouse
gagtctggtcctctggattg

SEQ ID NO: 702864 - DNA, 20 bp, mouse
gccaggctgcccgtcaaccc

SEQ ID NO: 702865 - DNA, 20 bp, mouse
ggaagcctggtctccctagc

SEQ ID NO: 702866 - DNA, 20 bp, mouse
gagggacaaagttcaggcta

SEQ ID NO: 702867 - DNA, 20 bp, mouse
ggtcagaggggcacaggccg

SEQ ID NO: 702868 - DNA, 20 bp, mouse
gggcacaggccgaggacccc

SEQ ID NO: 702869 - DNA, 20 bp, mouse
gggaccccaggaggcctaga

SEQ ID NO: 702870 - DNA, 20 bp, mouse
gccagaaaggccacactctg

SEQ ID NO: 702871 - DNA, 20 bp, mouse
gtaaccagggacagtgcgat

SEQ ID NO: 702872 - DNA, 20 bp, mouse
gtgagctcaaggcccagctt

SEQ ID NO: 702873 - DNA, 20 bp, mouse
gagaatgcaggggtgctctc

SEQ ID NO: 702874 - DNA, 20 bp, mouse
gtaactgtggggaggtataa

SEQ ID NO: 702875 - DNA, 20 bp, mouse
gctgggccttgagctcaagt

SEQ ID NO: 702876 - DNA, 20 bp, mouse
gccgccccgcctcttcctgt

SEQ ID NO: 702877 - DNA, 20 bp, mouse
gtgagtgtgaggcgacgcaa

SEQ ID NO: 702878 - DNA, 20 bp, mouse
gggcacagagggtaccgatg

SEQ ID NO: 702879 - DNA, 20 bp, mouse
gagaacgtctggcgcaggag

SEQ ID NO: 702880 - DNA, 20 bp, mouse
gaaacagcgcgcttgttgcc

SEQ ID NO: 702881 - DNA, 20 bp, mouse
ggggtcccagatgggcacag

SEQ ID NO: 702882 - DNA, 20 bp, mouse
gcgcccgcgccctgcgggtt

SEQ ID NO: 702883 - DNA, 20 bp, mouse
ggcaacacgcccacaggaag

SEQ ID NO: 702884 - DNA, 20 bp, mouse
gaacaagcgcgctgtttctg

SEQ ID NO: 702885 - DNA, 20 bp, mouse
gcaggaaaccgcggcgactc

SEQ ID NO: 702886 - DNA, 20 bp, mouse
gcatcagtggaaatgcagag

SEQ ID NO: 702887 - DNA, 20 bp, mouse
gcagagggggcgggtataaa

SEQ ID NO: 702888 - DNA, 20 bp, mouse
gagtggaaatgcagaggggg

SEQ ID NO: 702889 - DNA, 20 bp, mouse
gagggcatcagtggaaagta

SEQ ID NO: 702890 - DNA, 20 bp, mouse
gagggaggggcgggcttcaa

SEQ ID NO: 702891 - DNA, 20 bp, mouse
gatgagcatcagcggaaatt

SEQ ID NO: 702892 - DNA, 20 bp, mouse
gcatcagcggaaattagggt

SEQ ID NO: 702893 - DNA, 20 bp, mouse
ggtgggcatcatcggaaatg

SEQ ID NO: 702894 - DNA, 20 bp, mouse
gcgggcttcaatggaaatga

SEQ ID NO: 702895 - DNA, 20 bp, mouse
ggggtgtcacacctcatttc

SEQ ID NO: 702896 - DNA, 20 bp, mouse
gtcccatgagatgaagtcac

SEQ ID NO: 702897 - DNA, 20 bp, mouse
gtcccgtgacttcatctcat

SEQ ID NO: 702898 - DNA, 20 bp, mouse
ggcgaggccttgtgaaatgg

SEQ ID NO: 702899 - DNA, 20 bp, mouse
gagcgcgaggccttgtgaaa

SEQ ID NO: 702900 - DNA, 20 bp, mouse
gcggtggcgtgaggcggaga

SEQ ID NO: 702901 - DNA, 20 bp, mouse
gtcatctcatgggactgggt

SEQ ID NO: 702902 - DNA, 20 bp, mouse
gtgaccaatccggagctgag

SEQ ID NO: 702903 - DNA, 20 bp, mouse
ggcaacctggaggggtcgca

SEQ ID NO: 702904 - DNA, 20 bp, mouse
gaggggcggtggtccggatc

SEQ ID NO: 702905 - DNA, 20 bp, mouse
gccgccgattggttagtctc

SEQ ID NO: 702906 - DNA, 20 bp, mouse
ggcactaggcccgcaggaaa

SEQ ID NO: 702907 - DNA, 20 bp, mouse
gtaggcacggatgtggcact

SEQ ID NO: 702908 - DNA, 20 bp, mouse
gtaggggcagtcctctgaat

SEQ ID NO: 702909 - DNA, 20 bp, mouse
ggaccgttacataacgtcag

SEQ ID NO: 702910 - DNA, 20 bp, mouse
ggttgcggtaggcacggatg

SEQ ID NO: 702911 - DNA, 20 bp, mouse
ggatgtggcactaggcccgc

SEQ ID NO: 702912 - DNA, 20 bp, mouse
gaacggtcatttgttgcggt

SEQ ID NO: 702913 - DNA, 20 bp, mouse
gggccactgacgttatgtaa

SEQ ID NO: 702914 - DNA, 20 bp, mouse
gcagccaattcaggcaattc

SEQ ID NO: 702915 - DNA, 20 bp, mouse
gaattactaacacaagattc

SEQ ID NO: 702916 - DNA, 20 bp, mouse
gagactcccgagtactcctt

SEQ ID NO: 702917 - DNA, 20 bp, mouse
ggactggagaaattcagctc

SEQ ID NO: 702918 - DNA, 20 bp, mouse
ggggaaatgtagttctccgt

SEQ ID NO: 702919 - DNA, 20 bp, mouse
gcggagcccaaggagtactc

SEQ ID NO: 702920 - DNA, 20 bp, mouse
ggagtctcgcgcagcattct

SEQ ID NO: 702921 - DNA, 20 bp, mouse
ggcaaccggtagctagctga

SEQ ID NO: 702922 - DNA, 20 bp, mouse
gtgcaggcccagaggagcac

SEQ ID NO: 702923 - DNA, 20 bp, mouse
gccgctacgcgacccgccga

SEQ ID NO: 702924 - DNA, 20 bp, mouse
ggtagggtgcgggccgtcgg

SEQ ID NO: 702925 - DNA, 20 bp, mouse
gtagctgagggcgaacgcgg

SEQ ID NO: 702926 - DNA, 20 bp, mouse
gagaactcaggatcttgctc

SEQ ID NO: 702927 - DNA, 20 bp, mouse
gagtgagcgggcgatggggg

SEQ ID NO: 702928 - DNA, 20 bp, mouse
gcacggagagaccttgacgt

SEQ ID NO: 702929 - DNA, 20 bp, mouse
gaacgtcatacgttgtgctc

SEQ ID NO: 702930 - DNA, 20 bp, mouse
ggggtcctatagctgcgatc

SEQ ID NO: 702931 - DNA, 20 bp, mouse
gtgtctgagtgagcgggcga

SEQ ID NO: 702932 - DNA, 20 bp, mouse
gctgagtgagcgggcgatgg

SEQ ID NO: 702933 - DNA, 20 bp, mouse
gacgatgtcagttgcattct

SEQ ID NO: 702934 - DNA, 20 bp, mouse
gggaaaggaaattacgcaaa

SEQ ID NO: 702935 - DNA, 20 bp, mouse
gtaaccgtcccgatgtaaaa

SEQ ID NO: 702936 - DNA, 20 bp, mouse
gggggtgccagggaaaatct

SEQ ID NO: 702937 - DNA, 20 bp, mouse
gcgaaggtatggatggtccc

SEQ ID NO: 702938 - DNA, 20 bp, mouse
ggtcccgggcgaatgagatc

SEQ ID NO: 702939 - DNA, 20 bp, mouse
gacgctggaggtcgggagtg

SEQ ID NO: 702940 - DNA, 20 bp, mouse
gcctgaggtcgggaagacca

SEQ ID NO: 702941 - DNA, 20 bp, mouse
gagggaaactacagagagta

SEQ ID NO: 702942 - DNA, 20 bp, mouse
gcgggagagacgctggaggt

SEQ ID NO: 702943 - DNA, 20 bp, mouse
gtggctggggcgcgaaggta

SEQ ID NO: 702944 - DNA, 20 bp, mouse
gtcaaacccaccaggaaaac

SEQ ID NO: 702945 - DNA, 20 bp, mouse
ggagcagcttcaaacccacc

SEQ ID NO: 702946 - DNA, 20 bp, mouse
ggacccggaactgttctcgg

SEQ ID NO: 702947 - DNA, 20 bp, mouse
gagagggtccagtggatcag

SEQ ID NO: 702948 - DNA, 20 bp, mouse
gacacagcagatccagtccc

SEQ ID NO: 702949 - DNA, 20 bp, mouse
gggcgatccctgccgagaga

SEQ ID NO: 702950 - DNA, 20 bp, mouse
gggtccagtggatcaggggt

SEQ ID NO: 702951 - DNA, 20 bp, mouse
gacagtggctgtattagtag

SEQ ID NO: 702952 - DNA, 20 bp, mouse
ggaggcgaaagcatgcgccc

SEQ ID NO: 702953 - DNA, 20 bp, mouse
gcctgccgagagagggaaga

SEQ ID NO: 702954 - DNA, 20 bp, mouse
gtgtggcgatacaaacacag

SEQ ID NO: 702955 - DNA, 20 bp, mouse
gagggaagatggcgcttgat

SEQ ID NO: 702956 - DNA, 20 bp, mouse
gctgacgcgcgattggcggg

SEQ ID NO: 702957 - DNA, 20 bp, mouse
gggtacagagaagggacgcc

SEQ ID NO: 702958 - DNA, 20 bp, mouse
ggcagcgtgtgctgtagcgt

SEQ ID NO: 702959 - DNA, 20 bp, mouse
gcctcctcgcagcgcgagtg

SEQ ID NO: 702960 - DNA, 20 bp, mouse
gagagagaccctactctcgt

SEQ ID NO: 702961 - DNA, 20 bp, mouse
ggtaaggggcctgacgtcgt

SEQ ID NO: 702962 - DNA, 20 bp, mouse
gcggcgccccggagcatggt

SEQ ID NO: 702963 - DNA, 20 bp, mouse
gccgggctcccacgagagta

SEQ ID NO: 702964 - DNA, 20 bp, mouse
ggccgtaaaggggcggagac

SEQ ID NO: 702965 - DNA, 20 bp, mouse
gcgcgggcggcacacttccc

SEQ ID NO: 702966 - DNA, 20 bp, mouse
gcccacttccggccggacag

SEQ ID NO: 702967 - DNA, 20 bp, mouse
gcgtggccgtggcgcgaggg

SEQ ID NO: 702968 - DNA, 20 bp, mouse
ggaaagcagcgtctgtgagg

SEQ ID NO: 702969 - DNA, 20 bp, mouse
ggggcgtggccgtggcgcga

SEQ ID NO: 702970 - DNA, 20 bp, mouse
gaccgctgtccggccggaag

SEQ ID NO: 702971 - DNA, 20 bp, mouse
gccacgcccccacttccggc

SEQ ID NO: 702972 - DNA, 20 bp, mouse
ggaaggcactgctagctcag

SEQ ID NO: 702973 - DNA, 20 bp, mouse
ggcaggcccccctcgcgcca

SEQ ID NO: 702974 - DNA, 20 bp, mouse
gaaagtcgccccacttccgg

SEQ ID NO: 702975 - DNA, 20 bp, mouse
gccccgccctccaaaggcgt

SEQ ID NO: 702976 - DNA, 20 bp, mouse
ggagaaagacccaaggtgtg

SEQ ID NO: 702977 - DNA, 20 bp, mouse
gctggagcgccctctggcat

SEQ ID NO: 702978 - DNA, 20 bp, mouse
ggcgccctctggcattggaa

SEQ ID NO: 702979 - DNA, 20 bp, mouse
gttgttgcaccaatcttcag

SEQ ID NO: 702980 - DNA, 20 bp, mouse
gcgcctctcagagtaacgat

SEQ ID NO: 702981 - DNA, 20 bp, mouse
gggcgcttgcgtgttaagag

SEQ ID NO: 702982 - DNA, 20 bp, mouse
gtctcccttccaatgccaga

SEQ ID NO: 702983 - DNA, 20 bp, mouse
gaagggagaaagacttaagg

SEQ ID NO: 702984 - DNA, 20 bp, mouse
gaaatccttaggcgagtcta

SEQ ID NO: 702985 - DNA, 20 bp, mouse
gtgcaccaatcttcagggga

SEQ ID NO: 702986 - DNA, 20 bp, mouse
gtaaaagagcctcagagaca

SEQ ID NO: 702987 - DNA, 20 bp, mouse
gccccaggggaactgaagga

SEQ ID NO: 702988 - DNA, 20 bp, mouse
gtgtagtgcggggtcagcag

SEQ ID NO: 702989 - DNA, 20 bp, mouse
ggtgcggggtcagcagtgga

SEQ ID NO: 702990 - DNA, 20 bp, mouse
ggaggtggctctgtagtgcg

SEQ ID NO: 702991 - DNA, 20 bp, mouse
gagatccccaggggaactga

SEQ ID NO: 702992 - DNA, 20 bp, mouse
gctcaggctctggaagagaa

SEQ ID NO: 702993 - DNA, 20 bp, mouse
gctgaggctcttttagactg

SEQ ID NO: 702994 - DNA, 20 bp, mouse
gggaagtctcttgattggaa

SEQ ID NO: 702995 - DNA, 20 bp, mouse
gccttctgacaagctaggag

SEQ ID NO: 702996 - DNA, 20 bp, mouse
gactactgtgatctggagta

SEQ ID NO: 702997 - DNA, 20 bp, mouse
ggactgggaaacagagccaa

SEQ ID NO: 702998 - DNA, 20 bp, mouse
gccaagggctgttaaaaatg

SEQ ID NO: 702999 - DNA, 20 bp, mouse
ggggcaaaaactgacttcct

SEQ ID NO: 703000 - DNA, 20 bp, mouse
gtgagtaatgcaaccttctt

SEQ ID NO: 703001 - DNA, 20 bp, mouse
gtaagtagatcagatctgac

SEQ ID NO: 703002 - DNA, 20 bp, mouse
gcctgagacaggaacttcgt

SEQ ID NO: 703003 - DNA, 20 bp, mouse
gaatgagctctggttactta

SEQ ID NO: 703004 - DNA, 20 bp, mouse
gcatctgaccaaaccggtct

SEQ ID NO: 703005 - DNA, 20 bp, mouse
gcctgtcacctgacccagac

SEQ ID NO: 703006 - DNA, 20 bp, mouse
ggggctgcgagtaggttctg

SEQ ID NO: 703007 - DNA, 20 bp, mouse
ggtaaggcggggctgcgagt

SEQ ID NO: 703008 - DNA, 20 bp, mouse
ggcagccccgccttactgaa

SEQ ID NO: 703009 - DNA, 20 bp, mouse
gcaaagttctcaaacttaca

SEQ ID NO: 703010 - DNA, 20 bp, mouse
gttgtcctttcagtaaggcg

SEQ ID NO: 703011 - DNA, 20 bp, mouse
gctgggaaatggagttcatt

SEQ ID NO: 703012 - DNA, 20 bp, mouse
gaggaaggcaaatgagttcc

SEQ ID NO: 703013 - DNA, 20 bp, mouse
gttctgaggactctggcggg

SEQ ID NO: 703014 - DNA, 20 bp, mouse
gatgcccagccaccacggga

SEQ ID NO: 703015 - DNA, 20 bp, mouse
gggttgcacacacactcaat

SEQ ID NO: 703016 - DNA, 20 bp, mouse
ggctgcgcacaaattgttgg

SEQ ID NO: 703017 - DNA, 20 bp, mouse
gtgacgcgactgtgtgggcg

SEQ ID NO: 703018 - DNA, 20 bp, mouse
gggcggtgacgcgactgtgt

SEQ ID NO: 703019 - DNA, 20 bp, mouse
gcaaggcttgggacttgtga

SEQ ID NO: 703020 - DNA, 20 bp, mouse
ggtgcgcagccgcaaggctt

SEQ ID NO: 703021 - DNA, 20 bp, mouse
gaggccgagttggaagtcta

SEQ ID NO: 703022 - DNA, 20 bp, mouse
gggtaatgcccaggctacag

SEQ ID NO: 703023 - DNA, 20 bp, mouse
gggtcgtgtacagggaagag

SEQ ID NO: 703024 - DNA, 20 bp, mouse
gttgttggaggtcgtgtaca

SEQ ID NO: 703025 - DNA, 20 bp, mouse
ggcggctgcgcacaaattgt

SEQ ID NO: 703026 - DNA, 20 bp, mouse
ggacaggaaagatgtctaat

SEQ ID NO: 703027 - DNA, 20 bp, mouse
gccctgccggaagccagctg

SEQ ID NO: 703028 - DNA, 20 bp, mouse
ggtagcagctgctccaggac

SEQ ID NO: 703029 - DNA, 20 bp, mouse
gcagccccacacttgcgcag

SEQ ID NO: 703030 - DNA, 20 bp, mouse
gccgctgtctccgactgcca

SEQ ID NO: 703031 - DNA, 20 bp, mouse
gaaagatgtctaatgggacc

SEQ ID NO: 703032 - DNA, 20 bp, mouse
gctcccctctccagtcccaa

SEQ ID NO: 703033 - DNA, 20 bp, mouse
ggatgactaacgcctgttcc

SEQ ID NO: 703034 - DNA, 20 bp, mouse
gtctccgactgccaagggac

SEQ ID NO: 703035 - DNA, 20 bp, mouse
gctggcttccggcagggggt

SEQ ID NO: 703036 - DNA, 20 bp, mouse
gggccccgccccaatccatg

SEQ ID NO: 703037 - DNA, 20 bp, mouse
gcccaacagctgggtaactg

SEQ ID NO: 703038 - DNA, 20 bp, mouse
ggggcggtgccacatggatt

SEQ ID NO: 703039 - DNA, 20 bp, mouse
ggtgccacatggattggggc

SEQ ID NO: 703040 - DNA, 20 bp, mouse
gagaggcgggcccaacagct

SEQ ID NO: 703041 - DNA, 20 bp, mouse
gttggggcatcagagatcat

SEQ ID NO: 703042 - DNA, 20 bp, mouse
gcggccatggttgcgctcaa

SEQ ID NO: 703043 - DNA, 20 bp, mouse
gataccagagccatctggat

SEQ ID NO: 703044 - DNA, 20 bp, mouse
gtctgatgccccaatccaga

SEQ ID NO: 703045 - DNA, 20 bp, mouse
gatcagagatcattgggcta

SEQ ID NO: 703046 - DNA, 20 bp, mouse
gtctcggggcgccctgtctg

SEQ ID NO: 703047 - DNA, 20 bp, mouse
ggctgccagcggggcgggta

SEQ ID NO: 703048 - DNA, 20 bp, mouse
gccgctggcagccgcagaca

SEQ ID NO: 703049 - DNA, 20 bp, mouse
gcggcctgacccgacccggg

SEQ ID NO: 703050 - DNA, 20 bp, mouse
ggggcgagatggcgagggaa

SEQ ID NO: 703051 - DNA, 20 bp, mouse
gagggcgccccgagaacgca

SEQ ID NO: 703052 - DNA, 20 bp, mouse
gcggcgggccctgcgttctc

SEQ ID NO: 703053 - DNA, 20 bp, mouse
gaacaccggccgggcccggc

SEQ ID NO: 703054 - DNA, 20 bp, mouse
gcccgcgggcgagatggcga

SEQ ID NO: 703055 - DNA, 20 bp, mouse
gtaacgcggtgcggaccgag

SEQ ID NO: 703056 - DNA, 20 bp, mouse
gccggggatacggagagctc

SEQ ID NO: 703057 - DNA, 20 bp, mouse
ggaaggcgagccccgggcga

SEQ ID NO: 703058 - DNA, 20 bp, mouse
gtctccgtatccccggggaa

SEQ ID NO: 703059 - DNA, 20 bp, mouse
gaaagcgcgtgcgagtgttt

SEQ ID NO: 703060 - DNA, 20 bp, mouse
gtggggtagaggtgtgtcga

SEQ ID NO: 703061 - DNA, 20 bp, mouse
gacgacccggcctcccgcta

SEQ ID NO: 703062 - DNA, 20 bp, mouse
gggctctcgtccgtcgcccg

SEQ ID NO: 703063 - DNA, 20 bp, mouse
gcggggaagggtggggacct

SEQ ID NO: 703064 - DNA, 20 bp, mouse
gtctgcctctagtggggtag

SEQ ID NO: 703065 - DNA, 20 bp, mouse
ggggccggtcggaaggattt

SEQ ID NO: 703066 - DNA, 20 bp, mouse
gtccacctgggcggaggaga

SEQ ID NO: 703067 - DNA, 20 bp, mouse
ggacccggggactagcaccc

SEQ ID NO: 703068 - DNA, 20 bp, mouse
ggcacgatgggcagcccaac

SEQ ID NO: 703069 - DNA, 20 bp, mouse
gagtccccgggtccatacag

SEQ ID NO: 703070 - DNA, 20 bp, mouse
gcagcttctgggtaccagtt

SEQ ID NO: 703071 - DNA, 20 bp, mouse
gcgcagcgccccatccacct

SEQ ID NO: 703072 - DNA, 20 bp, mouse
gtgcgccctctcctccgccc

SEQ ID NO: 703073 - DNA, 20 bp, mouse
gagcccgggtgctagtcccc

SEQ ID NO: 703074 - DNA, 20 bp, mouse
gaagtcacggcactggagat

SEQ ID NO: 703075 - DNA, 20 bp, mouse
gcagaggatacggcagcttc

SEQ ID NO: 703076 - DNA, 20 bp, mouse
ggccgggagaggtaccaata

SEQ ID NO: 703077 - DNA, 20 bp, mouse
gtcccggcttcaaaacactt

SEQ ID NO: 703078 - DNA, 20 bp, mouse
ggcaacttcccggtgaccat

SEQ ID NO: 703079 - DNA, 20 bp, mouse
gctctcccggctattggctc

SEQ ID NO: 703080 - DNA, 20 bp, mouse
gagacccggagaagactcga

SEQ ID NO: 703081 - DNA, 20 bp, mouse
gctcgcaggctgacttcggc

SEQ ID NO: 703082 - DNA, 20 bp, mouse
ggtacccttcctttcaagag

SEQ ID NO: 703083 - DNA, 20 bp, mouse
gcgtggatctaggatctcgc

SEQ ID NO: 703084 - DNA, 20 bp, mouse
gagagcccctcttgaaagga

SEQ ID NO: 703085 - DNA, 20 bp, mouse
gactttggacagccccttat

SEQ ID NO: 703086 - DNA, 20 bp, mouse
gtccatagcaggggcatcct

SEQ ID NO: 703087 - DNA, 20 bp, mouse
gaaagtcgcgagtaatgaga

SEQ ID NO: 703088 - DNA, 20 bp, mouse
ggctaggaatgaccgtggtc

SEQ ID NO: 703089 - DNA, 20 bp, mouse
gaatgaaaggtccatagcag

SEQ ID NO: 703090 - DNA, 20 bp, mouse
gccaaagcccagtaacgtcc

SEQ ID NO: 703091 - DNA, 20 bp, mouse
gcccagtaacgtcctggcac

SEQ ID NO: 703092 - DNA, 20 bp, mouse
gggctttggtattgactgag

SEQ ID NO: 703093 - DNA, 20 bp, mouse
gcatgcgccgcgtgccccta

SEQ ID NO: 703094 - DNA, 20 bp, mouse
ggcccaggatgcccctgcta

SEQ ID NO: 703095 - DNA, 20 bp, mouse
gccccgccctgcggcgggtg

SEQ ID NO: 703096 - DNA, 20 bp, mouse
gatcccagcaggcacctgag

SEQ ID NO: 703097 - DNA, 20 bp, mouse
gacccggaggaggcagtcaa

SEQ ID NO: 703098 - DNA, 20 bp, mouse
gtgctgggatgatagccagg

SEQ ID NO: 703099 - DNA, 20 bp, mouse
gttcctctcaggtgcctgct

SEQ ID NO: 703100 - DNA, 20 bp, mouse
ggacagaggttgaggctctt

SEQ ID NO: 703101 - DNA, 20 bp, mouse
gatgtcagcaggtacaccct

SEQ ID NO: 703102 - DNA, 20 bp, mouse
ggaggctcttgggaatctgc

SEQ ID NO: 703103 - DNA, 20 bp, mouse
gccagagaggctggacccgg

SEQ ID NO: 703104 - DNA, 20 bp, mouse
gtgaaaagcacctgctaaca

SEQ ID NO: 703105 - DNA, 20 bp, mouse
gcaaaagtagagtagtcctc

SEQ ID NO: 703106 - DNA, 20 bp, mouse
ggggctaggagaacagtgtc

SEQ ID NO: 703107 - DNA, 20 bp, mouse
gcctcccccagaagcctcga

SEQ ID NO: 703108 - DNA, 20 bp, mouse
gccagcggggcgctgtttct

SEQ ID NO: 703109 - DNA, 20 bp, mouse
gaccccaggtgaggcgccag

SEQ ID NO: 703110 - DNA, 20 bp, mouse
gaagcctcgaaggggtggtg

SEQ ID NO: 703111 - DNA, 20 bp, mouse
gccccgctggcgcctcacct

SEQ ID NO: 703112 - DNA, 20 bp, mouse
ggccccaggccgggcccgca

SEQ ID NO: 703113 - DNA, 20 bp, mouse
gtctcggagtccaagagccc

SEQ ID NO: 703114 - DNA, 20 bp, mouse
gtcagggtggcgctgggcca

SEQ ID NO: 703115 - DNA, 20 bp, mouse
gacagtgtctggaagggtca

SEQ ID NO: 703116 - DNA, 20 bp, mouse
ggaccagcatggttgggaag

SEQ ID NO: 703117 - DNA, 20 bp, mouse
gcccgtcttctgctcaaaga

SEQ ID NO: 703118 - DNA, 20 bp, mouse
ggcccccttcccaaccatgc

SEQ ID NO: 703119 - DNA, 20 bp, mouse
gtctagggaccagcatggtt

SEQ ID NO: 703120 - DNA, 20 bp, mouse
gtttgagcagaagacggggt

SEQ ID NO: 703121 - DNA, 20 bp, mouse
gggacggaggtgctcattgg

SEQ ID NO: 703122 - DNA, 20 bp, mouse
ggcttcctcaccttggtaga

SEQ ID NO: 703123 - DNA, 20 bp, mouse
gtgcctagctggtcatttct

SEQ ID NO: 703124 - DNA, 20 bp, mouse
gagaggacggaggtgctcat

SEQ ID NO: 703125 - DNA, 20 bp, mouse
gagagcaactgcattttccc

SEQ ID NO: 703126 - DNA, 20 bp, mouse
gtgccggggcggaaacaaag

SEQ ID NO: 703127 - DNA, 20 bp, mouse
gcgtaaggtgggcacgaggt

SEQ ID NO: 703128 - DNA, 20 bp, mouse
gaaaggggcagatatcacta

SEQ ID NO: 703129 - DNA, 20 bp, mouse
gtcctggggtcaccagcttg

SEQ ID NO: 703130 - DNA, 20 bp, mouse
gagcttgcgcaatgcctaaa

SEQ ID NO: 703131 - DNA, 20 bp, mouse
ggtgaagaaagatgccgggg

SEQ ID NO: 703132 - DNA, 20 bp, mouse
gataacgtaaggtgggcacg

SEQ ID NO: 703133 - DNA, 20 bp, mouse
gttgaggtataacgtaaggt

SEQ ID NO: 703134 - DNA, 20 bp, mouse
ggggaagagcatgtgggcgt

SEQ ID NO: 703135 - DNA, 20 bp, mouse
ggaggtgaagaaagatgccg

SEQ ID NO: 703136 - DNA, 20 bp, mouse
gaaggccgcctgagggtcgg

SEQ ID NO: 703137 - DNA, 20 bp, mouse
gtggaactcgggtcccgccg

SEQ ID NO: 703138 - DNA, 20 bp, mouse
gcgcgtgcgcgcgtggtctc

SEQ ID NO: 703139 - DNA, 20 bp, mouse
gaccccgctggggctcaata

SEQ ID NO: 703140 - DNA, 20 bp, mouse
gcggagctgcagcatccacc

SEQ ID NO: 703141 - DNA, 20 bp, mouse
gagcgtgcgcgcgcggagag

SEQ ID NO: 703142 - DNA, 20 bp, mouse
gagaacccggccactcgggt

SEQ ID NO: 703143 - DNA, 20 bp, mouse
gaggaaagggagggacgggt

SEQ ID NO: 703144 - DNA, 20 bp, mouse
gctcccggtcggagccactc

SEQ ID NO: 703145 - DNA, 20 bp, mouse
gccccagcggggtgcgcctc

SEQ ID NO: 703146 - DNA, 20 bp, mouse
gtactcccaggcacagtcac

SEQ ID NO: 703147 - DNA, 20 bp, mouse
ggagatgatcaccgagagtt

SEQ ID NO: 703148 - DNA, 20 bp, mouse
ggccgagcgtgggtactccc

SEQ ID NO: 703149 - DNA, 20 bp, mouse
gggggggaagggatgcgcga

SEQ ID NO: 703150 - DNA, 20 bp, mouse
gcatggagcggcagggtatt

SEQ ID NO: 703151 - DNA, 20 bp, mouse
ggtattggggcaagacccac

SEQ ID NO: 703152 - DNA, 20 bp, mouse
gagcaggcacgcggcaggga

SEQ ID NO: 703153 - DNA, 20 bp, mouse
ggagcatagcagccgggtac

SEQ ID NO: 703154 - DNA, 20 bp, mouse
gcccgactcaacacacgcgg

SEQ ID NO: 703155 - DNA, 20 bp, mouse
gccgagagttgggaagagaa

SEQ ID NO: 703156 - DNA, 20 bp, mouse
gtaaacaactggttgaggat

SEQ ID NO: 703157 - DNA, 20 bp, mouse
gcaagcgttcaagttgttcc

SEQ ID NO: 703158 - DNA, 20 bp, mouse
ggtaattacagcacacatga

SEQ ID NO: 703159 - DNA, 20 bp, mouse
gggcggaaaaagaatcctgt

SEQ ID NO: 703160 - DNA, 20 bp, mouse
ggggctgagttgatgaaggc

SEQ ID NO: 703161 - DNA, 20 bp, mouse
gaaaagatgtgaagctgtcc

SEQ ID NO: 703162 - DNA, 20 bp, mouse
ggaagaatctagtttgaaga

SEQ ID NO: 703163 - DNA, 20 bp, mouse
gggaggggctgagttgatga

SEQ ID NO: 703164 - DNA, 20 bp, mouse
gcaaagatggccgtatgctc

SEQ ID NO: 703165 - DNA, 20 bp, mouse
gagacggtggcacagcggtt

SEQ ID NO: 703166 - DNA, 20 bp, mouse
gaatccgcctccagcagggg

SEQ ID NO: 703167 - DNA, 20 bp, mouse
gcctccgccgctgtcctgct

SEQ ID NO: 703168 - DNA, 20 bp, mouse
gcggcagtttcaatatggaa

SEQ ID NO: 703169 - DNA, 20 bp, mouse
gaattggccgagcaggacag

SEQ ID NO: 703170 - DNA, 20 bp, mouse
gatggaaaggaggggctaat

SEQ ID NO: 703171 - DNA, 20 bp, mouse
gggacgaaggcacgcctctg

SEQ ID NO: 703172 - DNA, 20 bp, mouse
gcggggaatccgcctccagc

SEQ ID NO: 703173 - DNA, 20 bp, mouse
gccccggctgctgggaatct

SEQ ID NO: 703174 - DNA, 20 bp, mouse
gcatggcagccgctgatctc

SEQ ID NO: 703175 - DNA, 20 bp, mouse
ggcaggggcggaacctccag

SEQ ID NO: 703176 - DNA, 20 bp, mouse
gaagggatacgttgcgagtt

SEQ ID NO: 703177 - DNA, 20 bp, mouse
gccagccgcggcgctcgggg

SEQ ID NO: 703178 - DNA, 20 bp, mouse
gtctggttaaaggtctgcac

SEQ ID NO: 703179 - DNA, 20 bp, mouse
gtagtgctggacctgcgcgc

SEQ ID NO: 703180 - DNA, 20 bp, mouse
gagcccagccgcggcgctcg

SEQ ID NO: 703181 - DNA, 20 bp, mouse
gtccgccccgcgcgaggact

SEQ ID NO: 703182 - DNA, 20 bp, mouse
gtgcgagtttggcgcagagc

SEQ ID NO: 703183 - DNA, 20 bp, mouse
gcggctgggctcctgcgcgc

SEQ ID NO: 703184 - DNA, 20 bp, mouse
gaggactcggtggtgccacc

SEQ ID NO: 703185 - DNA, 20 bp, mouse
ggcaccaccgagtcctcgcg

SEQ ID NO: 703186 - DNA, 20 bp, mouse
gaggcgggccgcgcgggcgt

SEQ ID NO: 703187 - DNA, 20 bp, mouse
gagcccgtagggagcgtcgc

SEQ ID NO: 703188 - DNA, 20 bp, mouse
gccgctctgcgcgggtcctt

SEQ ID NO: 703189 - DNA, 20 bp, mouse
gggcgtgggcgtgggcggac

SEQ ID NO: 703190 - DNA, 20 bp, mouse
gtccttgggcggctacccag

SEQ ID NO: 703191 - DNA, 20 bp, mouse
gcgcgcggatcctggggcga

SEQ ID NO: 703192 - DNA, 20 bp, mouse
gctgacgggaagagcccgta

SEQ ID NO: 703193 - DNA, 20 bp, mouse
gggccggcgacgctccctac

SEQ ID NO: 703194 - DNA, 20 bp, mouse
gcgggagggcgggacgctcc

SEQ ID NO: 703195 - DNA, 20 bp, mouse
gtcgcgcacaatgagtgagg

SEQ ID NO: 703196 - DNA, 20 bp, mouse
gcccgctcgccagcgcgtca

SEQ ID NO: 703197 - DNA, 20 bp, mouse
gcaagcgcagagaggcgacc

SEQ ID NO: 703198 - DNA, 20 bp, mouse
gcgcagagaggcgaccagga

SEQ ID NO: 703199 - DNA, 20 bp, mouse
gggccaaggcgcaggcgtct

SEQ ID NO: 703200 - DNA, 20 bp, mouse
gggggccgcgctcgctgcat

SEQ ID NO: 703201 - DNA, 20 bp, mouse
ggcggggaaaggaagggaca

SEQ ID NO: 703202 - DNA, 20 bp, mouse
gagccggagggccaaggcgc

SEQ ID NO: 703203 - DNA, 20 bp, mouse
ggcccccctctccctttgat

SEQ ID NO: 703204 - DNA, 20 bp, mouse
gcgcgctcgctgcatcggat

SEQ ID NO: 703205 - DNA, 20 bp, mouse
ggttctgcgcaagcgcagag

SEQ ID NO: 703206 - DNA, 20 bp, mouse
gtagcgggccagggcagtct

SEQ ID NO: 703207 - DNA, 20 bp, mouse
gcccaacgagcaactgaaac

SEQ ID NO: 703208 - DNA, 20 bp, mouse
gtggcagaacactgggtcag

SEQ ID NO: 703209 - DNA, 20 bp, mouse
ggggtggagcatccagttct

SEQ ID NO: 703210 - DNA, 20 bp, mouse
gctgccctggcccgctagct

SEQ ID NO: 703211 - DNA, 20 bp, mouse
gccccccccaaagactcagg

SEQ ID NO: 703212 - DNA, 20 bp, mouse
gaacaggggacagcgtgaat

SEQ ID NO: 703213 - DNA, 20 bp, mouse
gaaactggagcccaggctgg

SEQ ID NO: 703214 - DNA, 20 bp, mouse
gcatgtgattgcgtgtggac

SEQ ID NO: 703215 - DNA, 20 bp, mouse
gtaacctagctagcgggcca

SEQ ID NO: 703216 - DNA, 20 bp, mouse
gcgcagctgggagtgagatg

SEQ ID NO: 703217 - DNA, 20 bp, mouse
gagggacagcagtgctattg

SEQ ID NO: 703218 - DNA, 20 bp, mouse
gaaggctgagtgtccccaga

SEQ ID NO: 703219 - DNA, 20 bp, mouse
gctcccagctgcggcttccc

SEQ ID NO: 703220 - DNA, 20 bp, mouse
gggtcagcaagagcccctct

SEQ ID NO: 703221 - DNA, 20 bp, mouse
gtttaccccagtcacaagaa

SEQ ID NO: 703222 - DNA, 20 bp, mouse
gagccggggaagccgcagct

SEQ ID NO: 703223 - DNA, 20 bp, mouse
gatagataggggtcctgggt

SEQ ID NO: 703224 - DNA, 20 bp, mouse
gaggggtcctgggtcgggat

SEQ ID NO: 703225 - DNA, 20 bp, mouse
gaagatgcactctcggtgaa

SEQ ID NO: 703226 - DNA, 20 bp, mouse
ggggacccacgtgagggtag

SEQ ID NO: 703227 - DNA, 20 bp, mouse
ggagcaagggacccacgtga

SEQ ID NO: 703228 - DNA, 20 bp, mouse
gcccagggaccctgcagtta

SEQ ID NO: 703229 - DNA, 20 bp, mouse
gaccctgaacctgcctgcct

SEQ ID NO: 703230 - DNA, 20 bp, mouse
gcccctaactgcagggtccc

SEQ ID NO: 703231 - DNA, 20 bp, mouse
gagagcacggtgcagaccac

SEQ ID NO: 703232 - DNA, 20 bp, mouse
gctaaggtcccctaactgca

SEQ ID NO: 703233 - DNA, 20 bp, mouse
gtgggacctactgggtggga

SEQ ID NO: 703234 - DNA, 20 bp, mouse
gcccaggggcaagagatatc

SEQ ID NO: 703235 - DNA, 20 bp, mouse
gagacttcccaaaagggtca

SEQ ID NO: 703236 - DNA, 20 bp, mouse
gtagcctcaggtaaagtgga

SEQ ID NO: 703237 - DNA, 20 bp, mouse
ggggtgggctgaggattgga

SEQ ID NO: 703238 - DNA, 20 bp, mouse
gcacaagtcaggtctccctg

SEQ ID NO: 703239 - DNA, 20 bp, mouse
gtcaaaggagactgggaacg

SEQ ID NO: 703240 - DNA, 20 bp, mouse
gtgtctctttaagggaggaa

SEQ ID NO: 703241 - DNA, 20 bp, mouse
gtcaggtctccctgaggcga

SEQ ID NO: 703242 - DNA, 20 bp, mouse
ggccctgagcaaacctgggc

SEQ ID NO: 703243 - DNA, 20 bp, mouse
gccacgccctgagcaaacct

SEQ ID NO: 703244 - DNA, 20 bp, mouse
gtgggggcgtccctcgcctc

SEQ ID NO: 703245 - DNA, 20 bp, mouse
gatagtagcctcaggtaaag

SEQ ID NO: 703246 - DNA, 20 bp, mouse
ggtgggctgtagccatgctg

SEQ ID NO: 703247 - DNA, 20 bp, mouse
gtcagaagacccgataactg

SEQ ID NO: 703248 - DNA, 20 bp, mouse
ggggggctgccggagagagg

SEQ ID NO: 703249 - DNA, 20 bp, mouse
gaggctggaaacaatgtttc

SEQ ID NO: 703250 - DNA, 20 bp, mouse
gggctacagcccacagttat

SEQ ID NO: 703251 - DNA, 20 bp, mouse
ggtggcccggccccgcccgg

SEQ ID NO: 703252 - DNA, 20 bp, mouse
gcgccttgctggccccagca

SEQ ID NO: 703253 - DNA, 20 bp, mouse
gggtgtgaaagaaacagtcc

SEQ ID NO: 703254 - DNA, 20 bp, mouse
ggactgtgagtcatttcaaa

SEQ ID NO: 703255 - DNA, 20 bp, mouse
gtagtcttctgtttgggaaa

SEQ ID NO: 703256 - DNA, 20 bp, mouse
gatggccttaagagcaggtg

SEQ ID NO: 703257 - DNA, 20 bp, mouse
gtagagccagtgctgggtcc

SEQ ID NO: 703258 - DNA, 20 bp, mouse
gccagcactggctctaccct

SEQ ID NO: 703259 - DNA, 20 bp, mouse
gaggaggcccccttttcctc

SEQ ID NO: 703260 - DNA, 20 bp, mouse
gctacgggagcataagaggt

SEQ ID NO: 703261 - DNA, 20 bp, mouse
gagctcacttaccacaccca

SEQ ID NO: 703262 - DNA, 20 bp, mouse
gacgggaaaactgagactac

SEQ ID NO: 703263 - DNA, 20 bp, mouse
ggccttaagagcaggtgggg

SEQ ID NO: 703264 - DNA, 20 bp, mouse
ggggcctcctcagtctacct

SEQ ID NO: 703265 - DNA, 20 bp, mouse
gtcctggctccttcaagcta

SEQ ID NO: 703266 - DNA, 20 bp, mouse
gaagggaagacccttgggtg

SEQ ID NO: 703267 - DNA, 20 bp, mouse
ggggaggagaccctggaggg

SEQ ID NO: 703268 - DNA, 20 bp, mouse
ggatctgagggacgcagatg

SEQ ID NO: 703269 - DNA, 20 bp, mouse
gcgtccctcagatcctcgag

SEQ ID NO: 703270 - DNA, 20 bp, mouse
ggcctccactcgaggatctg

SEQ ID NO: 703271 - DNA, 20 bp, mouse
ggatggtgggggactgaagg

SEQ ID NO: 703272 - DNA, 20 bp, mouse
gaagacccttgggtgaggtg

SEQ ID NO: 703273 - DNA, 20 bp, mouse
gaggcgctctagggagactg

SEQ ID NO: 703274 - DNA, 20 bp, mouse
gtgcccacagagtgaatacg

SEQ ID NO: 703275 - DNA, 20 bp, mouse
gagggacgcagatgggggca

SEQ ID NO: 703276 - DNA, 20 bp, mouse
gggcgcgggcgacatcacag

SEQ ID NO: 703277 - DNA, 20 bp, mouse
gacatcacaggggtctgcaa

SEQ ID NO: 703278 - DNA, 20 bp, mouse
gtctgcgagctcttcgcaaa

SEQ ID NO: 703279 - DNA, 20 bp, mouse
gaatgggagccagagttagg

SEQ ID NO: 703280 - DNA, 20 bp, mouse
gctcgcagagagaagggcgc

SEQ ID NO: 703281 - DNA, 20 bp, mouse
gcggaggaggcgcccagcgc

SEQ ID NO: 703282 - DNA, 20 bp, mouse
gaatgaacgcaggttgcagg

SEQ ID NO: 703283 - DNA, 20 bp, mouse
gctcttcgcaaagggaagtg

SEQ ID NO: 703284 - DNA, 20 bp, mouse
gcccagaagccagtggacga

SEQ ID NO: 703285 - DNA, 20 bp, mouse
gcctaccctcaccaaagggg

SEQ ID NO: 703286 - DNA, 20 bp, mouse
ggtccccgccccttccccaa

SEQ ID NO: 703287 - DNA, 20 bp, mouse
ggggcggggacgtcagcagt

SEQ ID NO: 703288 - DNA, 20 bp, mouse
ggcagcaaggggtgtccgaa

SEQ ID NO: 703289 - DNA, 20 bp, mouse
gccgccccttccccaagggt

SEQ ID NO: 703290 - DNA, 20 bp, mouse
gggacgtcagcagtgggcgg

SEQ ID NO: 703291 - DNA, 20 bp, mouse
gcacaggcgagcatctgggt

SEQ ID NO: 703292 - DNA, 20 bp, mouse
gctgatgcagggaacgctgg

SEQ ID NO: 703293 - DNA, 20 bp, mouse
gagcccccttggccccggca

SEQ ID NO: 703294 - DNA, 20 bp, mouse
gtgggggcctatagccaatg

SEQ ID NO: 703295 - DNA, 20 bp, mouse
gcgccccctgccggggccaa

SEQ ID NO: 703296 - DNA, 20 bp, mouse
gtctcgcgaaggaaaggcta

SEQ ID NO: 703297 - DNA, 20 bp, mouse
gatctgaggcaagagtgctg

SEQ ID NO: 703298 - DNA, 20 bp, mouse
gtaaaatactgtaccttcaa

SEQ ID NO: 703299 - DNA, 20 bp, mouse
gaatgtttctcgcgaaggaa

SEQ ID NO: 703300 - DNA, 20 bp, mouse
gttgtgaatgtttctcgcga

SEQ ID NO: 703301 - DNA, 20 bp, mouse
gactgaaaaacatacagcgg

SEQ ID NO: 703302 - DNA, 20 bp, mouse
gacaacttgttttgccatag

SEQ ID NO: 703303 - DNA, 20 bp, mouse
gagtctcagttgtaaaaagt

SEQ ID NO: 703304 - DNA, 20 bp, mouse
gtaacatttaagttcctcta

SEQ ID NO: 703305 - DNA, 20 bp, mouse
gtggacttcaaaacgaaagt

SEQ ID NO: 703306 - DNA, 20 bp, mouse
gtgcacccgatgggagttgt

SEQ ID NO: 703307 - DNA, 20 bp, mouse
gcgactcccggcatgtctca

SEQ ID NO: 703308 - DNA, 20 bp, mouse
gcccatcgggtgcaactgga

SEQ ID NO: 703309 - DNA, 20 bp, mouse
gaactcccatcgggtgcaac

SEQ ID NO: 703310 - DNA, 20 bp, mouse
gatcgggtgcaactggacgg

SEQ ID NO: 703311 - DNA, 20 bp, mouse
gggacgctaactacgactcc

SEQ ID NO: 703312 - DNA, 20 bp, mouse
gcgaagcttgttcgagtttc

SEQ ID NO: 703313 - DNA, 20 bp, mouse
ggcgcgcggactacaactcc

SEQ ID NO: 703314 - DNA, 20 bp, mouse
ggtctgccgtgagacatgcc

SEQ ID NO: 703315 - DNA, 20 bp, mouse
gcgaacaagcttcggatacc

SEQ ID NO: 703316 - DNA, 20 bp, mouse
gatcccgaggggttcgagag

SEQ ID NO: 703317 - DNA, 20 bp, mouse
gcggccacagggtgtgtgag

SEQ ID NO: 703318 - DNA, 20 bp, mouse
gaggcgggacggccatgggt

SEQ ID NO: 703319 - DNA, 20 bp, mouse
ggggctgctccggatcccga

SEQ ID NO: 703320 - DNA, 20 bp, mouse
gcactcggcggccccaccca

SEQ ID NO: 703321 - DNA, 20 bp, mouse
ggggttgagctttacagtgg

SEQ ID NO: 703322 - DNA, 20 bp, mouse
gctatcaaagggcccgctga

SEQ ID NO: 703323 - DNA, 20 bp, mouse
gtaaagctcaacccactcgg

SEQ ID NO: 703324 - DNA, 20 bp, mouse
gcctccgacgcattcaccaa

SEQ ID NO: 703325 - DNA, 20 bp, mouse
gtcggaggcgggacggccat

SEQ ID NO: 703326 - DNA, 20 bp, mouse
gcccagggcgccgggaatag

SEQ ID NO: 703327 - DNA, 20 bp, mouse
gacggcgccccgcaccggta

SEQ ID NO: 703328 - DNA, 20 bp, mouse
ggtcctggagcctcagccca

SEQ ID NO: 703329 - DNA, 20 bp, mouse
gccaggacggcgccccgcac

SEQ ID NO: 703330 - DNA, 20 bp, mouse
ggagctgcgggcggctagag

SEQ ID NO: 703331 - DNA, 20 bp, mouse
gggactaccgagacgagctg

SEQ ID NO: 703332 - DNA, 20 bp, mouse
gctaggcgccagtttcgcgt

SEQ ID NO: 703333 - DNA, 20 bp, mouse
gggctgtcctagcgcctcga

SEQ ID NO: 703334 - DNA, 20 bp, mouse
gctaggacagccgctattcc

SEQ ID NO: 703335 - DNA, 20 bp, mouse
ggggtctgtccagcctccgt

SEQ ID NO: 703336 - DNA, 20 bp, mouse
gggagcccgcagcagaccgg

SEQ ID NO: 703337 - DNA, 20 bp, mouse
ggtccgggctcggagggaaa

SEQ ID NO: 703338 - DNA, 20 bp, mouse
gagtagctatgaagccggac

SEQ ID NO: 703339 - DNA, 20 bp, mouse
gactggagcccgcagcagac

SEQ ID NO: 703340 - DNA, 20 bp, mouse
gtgaagcgggtgctgcgatt

SEQ ID NO: 703341 - DNA, 20 bp, mouse
gggctccagtccgggctcgg

SEQ ID NO: 703342 - DNA, 20 bp, mouse
ggaaaccgacgcggagctgg

SEQ ID NO: 703343 - DNA, 20 bp, mouse
gcacccgcttcacagcgcaa

SEQ ID NO: 703344 - DNA, 20 bp, mouse
ggacgcggagctggcggctc

SEQ ID NO: 703345 - DNA, 20 bp, mouse
ggcgggctccagtccgggct

SEQ ID NO: 703346 - DNA, 20 bp, mouse
gcccccctctggggcgggga

SEQ ID NO: 703347 - DNA, 20 bp, mouse
ggcctcccaccccccctctg

SEQ ID NO: 703348 - DNA, 20 bp, mouse
gtgccctccccgccccagag

SEQ ID NO: 703349 - DNA, 20 bp, mouse
gtggtcctcacccggggttg

SEQ ID NO: 703350 - DNA, 20 bp, mouse
gccaccccccctctggggcg

SEQ ID NO: 703351 - DNA, 20 bp, mouse
gggtaccggggacaatctca

SEQ ID NO: 703352 - DNA, 20 bp, mouse
ggcaaagcagcagcggggcg

SEQ ID NO: 703353 - DNA, 20 bp, mouse
ggagctcggactccggggag

SEQ ID NO: 703354 - DNA, 20 bp, mouse
gtccgccctcagccccagct

SEQ ID NO: 703355 - DNA, 20 bp, mouse
gtgagggcggaggctgcccg

SEQ ID NO: 703356 - DNA, 20 bp, mouse
gtcgaccaatccagcccttg

SEQ ID NO: 703357 - DNA, 20 bp, mouse
gcctcagccccccctcaaaa

SEQ ID NO: 703358 - DNA, 20 bp, mouse
gactggaggaccagccccaa

SEQ ID NO: 703359 - DNA, 20 bp, mouse
gcctccagtttaaatctgat

SEQ ID NO: 703360 - DNA, 20 bp, mouse
gaaggatcccttttgagggg

SEQ ID NO: 703361 - DNA, 20 bp, mouse
ggaggaccagccccaagggc

SEQ ID NO: 703362 - DNA, 20 bp, mouse
gagggcggggccgccagtgg

SEQ ID NO: 703363 - DNA, 20 bp, mouse
gcaaaggagtcgctgggtag

SEQ ID NO: 703364 - DNA, 20 bp, mouse
gggtgcaaagctcgacgggg

SEQ ID NO: 703365 - DNA, 20 bp, mouse
gttggccgagagcacatttt

SEQ ID NO: 703366 - DNA, 20 bp, mouse
gcagccaggagctggatagg

SEQ ID NO: 703367 - DNA, 20 bp, mouse
gagtccccgaggtccgaggt

SEQ ID NO: 703368 - DNA, 20 bp, mouse
gaggtccgaggttggcacac

SEQ ID NO: 703369 - DNA, 20 bp, mouse
gtggacccgcactgagaact

SEQ ID NO: 703370 - DNA, 20 bp, mouse
ggcacagccaggagctggat

SEQ ID NO: 703371 - DNA, 20 bp, mouse
gctcggggactcacggtgaa

SEQ ID NO: 703372 - DNA, 20 bp, mouse
gcgcactgagaacttggctc

SEQ ID NO: 703373 - DNA, 20 bp, mouse
gcaagacgtcactatcacct

SEQ ID NO: 703374 - DNA, 20 bp, mouse
ggagtggggagccctctaag

SEQ ID NO: 703375 - DNA, 20 bp, mouse
gtggtggttcccagcgctgg

SEQ ID NO: 703376 - DNA, 20 bp, mouse
ggaaagccccccctggtcag

SEQ ID NO: 703377 - DNA, 20 bp, mouse
gggcgcctctggagcgagca

SEQ ID NO: 703378 - DNA, 20 bp, mouse
ggtaaggggaaggacgtgaa

SEQ ID NO: 703379 - DNA, 20 bp, mouse
ggcgtgcaatggatccgggt

SEQ ID NO: 703380 - DNA, 20 bp, mouse
gggggcctgacccttacagc

SEQ ID NO: 703381 - DNA, 20 bp, mouse
gccacagcgtgcaatggatc

SEQ ID NO: 703382 - DNA, 20 bp, mouse
gggctcctctcctgctgtaa

SEQ ID NO: 703383 - DNA, 20 bp, mouse
gccgggaagccaagcggggc

SEQ ID NO: 703384 - DNA, 20 bp, mouse
gaggatcaagccgcgggcgg

SEQ ID NO: 703385 - DNA, 20 bp, mouse
gggagagaggatcaagccgc

SEQ ID NO: 703386 - DNA, 20 bp, mouse
ggcgggcagcggaagagcgt

SEQ ID NO: 703387 - DNA, 20 bp, mouse
ggacccggagagcgattcgt

SEQ ID NO: 703388 - DNA, 20 bp, mouse
ggtggaccgggaagttacga

SEQ ID NO: 703389 - DNA, 20 bp, mouse
ggaagagcgtcggccaatag

SEQ ID NO: 703390 - DNA, 20 bp, mouse
gccgcggggcgctcgcggag

SEQ ID NO: 703391 - DNA, 20 bp, mouse
gagaggccaggacagcgggg

SEQ ID NO: 703392 - DNA, 20 bp, mouse
gagaacccgggcgggaaacc

SEQ ID NO: 703393 - DNA, 20 bp, mouse
gtaacttcccggtccactat

SEQ ID NO: 703394 - DNA, 20 bp, mouse
gccccgcccggagcgggcag

SEQ ID NO: 703395 - DNA, 20 bp, mouse
gtcgtgggacggcccagctc

SEQ ID NO: 703396 - DNA, 20 bp, mouse
gagcggaggcgacagctcgg

SEQ ID NO: 703397 - DNA, 20 bp, mouse
gctgcagggcacttccccaa

SEQ ID NO: 703398 - DNA, 20 bp, mouse
gccagccggccgcggtgcgg

SEQ ID NO: 703399 - DNA, 20 bp, mouse
gaggtcgggcgggcaggttg

SEQ ID NO: 703400 - DNA, 20 bp, mouse
gctcggcggcccccgcaccg

SEQ ID NO: 703401 - DNA, 20 bp, mouse
gggacccaggcgtgagaccc

SEQ ID NO: 703402 - DNA, 20 bp, mouse
ggggtccgcggtgcgagcgg

SEQ ID NO: 703403 - DNA, 20 bp, mouse
gcctgggtccgcggtgcgag

SEQ ID NO: 703404 - DNA, 20 bp, mouse
gggcacttccccaacggcct

SEQ ID NO: 703405 - DNA, 20 bp, mouse
gactgcgccgccaggtcggg

SEQ ID NO: 703406 - DNA, 20 bp, mouse
ggggtggaagtcggaagggg

SEQ ID NO: 703407 - DNA, 20 bp, mouse
ggcggccgaggaaacaagga

SEQ ID NO: 703408 - DNA, 20 bp, mouse
gaagtcggaaggggcggccg

SEQ ID NO: 703409 - DNA, 20 bp, mouse
gaggggcggccgaggaaaca

SEQ ID NO: 703410 - DNA, 20 bp, mouse
gtggacctgttccgattggg

SEQ ID NO: 703411 - DNA, 20 bp, mouse
ggctctgggcggattcctga

SEQ ID NO: 703412 - DNA, 20 bp, mouse
gcgcgctattggatgtccag

SEQ ID NO: 703413 - DNA, 20 bp, mouse
gcccggagtggtttgtgaat

SEQ ID NO: 703414 - DNA, 20 bp, mouse
gtgggcggattcctgagggg

SEQ ID NO: 703415 - DNA, 20 bp, mouse
ggattgggtggaagtcggaa

SEQ ID NO: 703416 - DNA, 20 bp, mouse
gaggactgagtgcgactcag

SEQ ID NO: 703417 - DNA, 20 bp, mouse
gctcctctgcagagaaaagt

SEQ ID NO: 703418 - DNA, 20 bp, mouse
gcctcccccacgcctctcct

SEQ ID NO: 703419 - DNA, 20 bp, mouse
ggtcaccccaggagaggcgt

SEQ ID NO: 703420 - DNA, 20 bp, mouse
ggggcgcgggacagaccctg

SEQ ID NO: 703421 - DNA, 20 bp, mouse
gaacgcgccacaattccaca

SEQ ID NO: 703422 - DNA, 20 bp, mouse
gaaccctccgggcccgaaga

SEQ ID NO: 703423 - DNA, 20 bp, mouse
gccagcgcgcagcatggagt

SEQ ID NO: 703424 - DNA, 20 bp, mouse
ggacagaccctgtggaattg

SEQ ID NO: 703425 - DNA, 20 bp, mouse
gcctgcgcgccgcctagaga

SEQ ID NO: 703426 - DNA, 20 bp, mouse
gggcgtgtgggcaacgttgt

SEQ ID NO: 703427 - DNA, 20 bp, mouse
gtgcccacacgcctccagcg

SEQ ID NO: 703428 - DNA, 20 bp, mouse
gccgcggctcggcaccccga

SEQ ID NO: 703429 - DNA, 20 bp, mouse
gcggactgtcgagtctgcaa

SEQ ID NO: 703430 - DNA, 20 bp, mouse
gtgccacgctggaggcgtgt

SEQ ID NO: 703431 - DNA, 20 bp, mouse
gcgcctctctgccacgctgg

SEQ ID NO: 703432 - DNA, 20 bp, mouse
gcgacgggggcgtgccctga

SEQ ID NO: 703433 - DNA, 20 bp, mouse
gcgagggcgtggtcagtagg

SEQ ID NO: 703434 - DNA, 20 bp, mouse
gcgcccccgtcgcgctttaa

SEQ ID NO: 703435 - DNA, 20 bp, mouse
gccccgagggcgtggtcagt

SEQ ID NO: 703436 - DNA, 20 bp, mouse
ggggccgtgagcgtggctga

SEQ ID NO: 703437 - DNA, 20 bp, mouse
ggggcgtgcccgcaagggac

SEQ ID NO: 703438 - DNA, 20 bp, mouse
ggaggcgttggtaactcgag

SEQ ID NO: 703439 - DNA, 20 bp, mouse
gacgccctcagccacgctca

SEQ ID NO: 703440 - DNA, 20 bp, mouse
gaaaaccttggcggcgttgg

SEQ ID NO: 703441 - DNA, 20 bp, mouse
gcgcgagcacggcacagagt

SEQ ID NO: 703442 - DNA, 20 bp, mouse
gcacagagtgggagtgtcta

SEQ ID NO: 703443 - DNA, 20 bp, mouse
gcggagagatccgtgcgtgt

SEQ ID NO: 703444 - DNA, 20 bp, mouse
gcggcctgcgggacagattg

SEQ ID NO: 703445 - DNA, 20 bp, mouse
gtgcgtgtgggccgtgagcg

SEQ ID NO: 703446 - DNA, 20 bp, mouse
gcaggggcgtgcactactcg

SEQ ID NO: 703447 - DNA, 20 bp, mouse
gctactcgtggtcacctccc

SEQ ID NO: 703448 - DNA, 20 bp, mouse
gagaacgggaggggcgctgc

SEQ ID NO: 703449 - DNA, 20 bp, mouse
gccagcgggctagggtctca

SEQ ID NO: 703450 - DNA, 20 bp, mouse
gggtggaaaggaagaacggg

SEQ ID NO: 703451 - DNA, 20 bp, mouse
gagaccaccaggtgacggtg

SEQ ID NO: 703452 - DNA, 20 bp, mouse
gtacaggggagcttgggcca

SEQ ID NO: 703453 - DNA, 20 bp, mouse
gagcggggcgggagtggcag

SEQ ID NO: 703454 - DNA, 20 bp, mouse
ggatccgcctcctggctcac

SEQ ID NO: 703455 - DNA, 20 bp, mouse
gagcccaaggcaccacttca

SEQ ID NO: 703456 - DNA, 20 bp, mouse
gtccccggggaagtggacgc

SEQ ID NO: 703457 - DNA, 20 bp, mouse
gcggggaagtggacgcaggg

SEQ ID NO: 703458 - DNA, 20 bp, mouse
gccagcgtgtggcctgttgg

SEQ ID NO: 703459 - DNA, 20 bp, mouse
gtggctgcgcggacccggcc

SEQ ID NO: 703460 - DNA, 20 bp, mouse
gaagttcgggcgtgcgcgca

SEQ ID NO: 703461 - DNA, 20 bp, mouse
gtcccggtcctgcacgtccg

SEQ ID NO: 703462 - DNA, 20 bp, mouse
gcggcccctccccggggaag

SEQ ID NO: 703463 - DNA, 20 bp, mouse
gtgcgccttggctttcgggg

SEQ ID NO: 703464 - DNA, 20 bp, mouse
gcggtcctgcacgtccgcgg

SEQ ID NO: 703465 - DNA, 20 bp, mouse
gctaatgagaaggcgcgcga

SEQ ID NO: 703466 - DNA, 20 bp, mouse
gaacgggtgcatgcaactat

SEQ ID NO: 703467 - DNA, 20 bp, mouse
gtagaggccgagctcctgag

SEQ ID NO: 703468 - DNA, 20 bp, mouse
gggacagcgtctttgtctag

SEQ ID NO: 703469 - DNA, 20 bp, mouse
gtgcatgcacccgttctcat

SEQ ID NO: 703470 - DNA, 20 bp, mouse
gcaggagcggttgatccaca

SEQ ID NO: 703471 - DNA, 20 bp, mouse
gtggtctataaaaatgaggg

SEQ ID NO: 703472 - DNA, 20 bp, mouse
gaacctcgccaatactcaga

SEQ ID NO: 703473 - DNA, 20 bp, mouse
gctctagctccttcagttat

SEQ ID NO: 703474 - DNA, 20 bp, mouse
gagcgcggctatatagcggg

SEQ ID NO: 703475 - DNA, 20 bp, mouse
gggacaggattcaacctaag

SEQ ID NO: 703476 - DNA, 20 bp, mouse
gaagcctcgggttgcttcga

SEQ ID NO: 703477 - DNA, 20 bp, mouse
gctaggctctcgggaagagg

SEQ ID NO: 703478 - DNA, 20 bp, mouse
gtctgcgcgtgctccgcagt

SEQ ID NO: 703479 - DNA, 20 bp, mouse
gcggaggtcagtagtgtcgc

SEQ ID NO: 703480 - DNA, 20 bp, mouse
gtggctggcgctgtgctggg

SEQ ID NO: 703481 - DNA, 20 bp, mouse
gcagtgggacgcgagaaggt

SEQ ID NO: 703482 - DNA, 20 bp, mouse
ggagggaggagaatctgctg

SEQ ID NO: 703483 - DNA, 20 bp, mouse
ggcccgccgccgctgttggt

SEQ ID NO: 703484 - DNA, 20 bp, mouse
gagccaatcaggcatcagtt

SEQ ID NO: 703485 - DNA, 20 bp, mouse
ggtgaggggccccgagctcg

SEQ ID NO: 703486 - DNA, 20 bp, mouse
ggcaaggtctaagtgagcag

SEQ ID NO: 703487 - DNA, 20 bp, mouse
gaacctgcctggtacggact

SEQ ID NO: 703488 - DNA, 20 bp, mouse
gaacagagttatagggaatg

SEQ ID NO: 703489 - DNA, 20 bp, mouse
gacatggggaacagagttat

SEQ ID NO: 703490 - DNA, 20 bp, mouse
ggtgtgtagagactcaagtc

SEQ ID NO: 703491 - DNA, 20 bp, mouse
gctcaagtctggccactgtg

SEQ ID NO: 703492 - DNA, 20 bp, mouse
gcctggtacggactgggatg

SEQ ID NO: 703493 - DNA, 20 bp, mouse
gcaggccacatgcacatggt

SEQ ID NO: 703494 - DNA, 20 bp, mouse
ggttatagggaatgaggttt

SEQ ID NO: 703495 - DNA, 20 bp, mouse
gggttttggcaaataaggaa

SEQ ID NO: 703496 - DNA, 20 bp, mouse
gctgaggcctgtacaggggt

SEQ ID NO: 703497 - DNA, 20 bp, mouse
gtgtgcaggcggcaggaggg

SEQ ID NO: 703498 - DNA, 20 bp, mouse
ggctccctgcccccaccttg

SEQ ID NO: 703499 - DNA, 20 bp, mouse
gcggcagggccaacacatga

SEQ ID NO: 703500 - DNA, 20 bp, mouse
gggtgtggtggccacaaggt

SEQ ID NO: 703501 - DNA, 20 bp, mouse
gaagagctgaggcctgtaca

SEQ ID NO: 703502 - DNA, 20 bp, mouse
gagcccaggccttgtgcagg

SEQ ID NO: 703503 - DNA, 20 bp, mouse
gccttgtgcaggcggcagga

SEQ ID NO: 703504 - DNA, 20 bp, mouse
gagagcaagagtgagctgat

SEQ ID NO: 703505 - DNA, 20 bp, mouse
ggattggaaacagacaggaa

SEQ ID NO: 703506 - DNA, 20 bp, mouse
gtccatatgctctacgtgtc

SEQ ID NO: 703507 - DNA, 20 bp, mouse
gtcctggattgagtagagaa

SEQ ID NO: 703508 - DNA, 20 bp, mouse
gcaggacccacccagcccgg

SEQ ID NO: 703509 - DNA, 20 bp, mouse
gtcctgacacgtagagcata

SEQ ID NO: 703510 - DNA, 20 bp, mouse
gacgtagagcatatggaaga

SEQ ID NO: 703511 - DNA, 20 bp, mouse
gagtgagagcatcatcctcc

SEQ ID NO: 703512 - DNA, 20 bp, mouse
ggatgctctcacttagagat

SEQ ID NO: 703513 - DNA, 20 bp, mouse
gtgtagccacctaggagatg

SEQ ID NO: 703514 - DNA, 20 bp, mouse
gttgtcctggaggggaaggg

SEQ ID NO: 703515 - DNA, 20 bp, mouse
gatccaggacccacccagcc

SEQ ID NO: 703516 - DNA, 20 bp, mouse
gtgagggcggggtctcctgc

SEQ ID NO: 703517 - DNA, 20 bp, mouse
ggatccacccagtgagggcg

SEQ ID NO: 703518 - DNA, 20 bp, mouse
gaggagaccccgccctcact

SEQ ID NO: 703519 - DNA, 20 bp, mouse
gagaccccgccctcactggg

SEQ ID NO: 703520 - DNA, 20 bp, mouse
ggaagcgaaacgtggttacc

SEQ ID NO: 703521 - DNA, 20 bp, mouse
ggccgcgtggcggagaaatt

SEQ ID NO: 703522 - DNA, 20 bp, mouse
gctgactgatgggtgccgcg

SEQ ID NO: 703523 - DNA, 20 bp, mouse
gtcctgctggaagcgaaacg

SEQ ID NO: 703524 - DNA, 20 bp, mouse
gagtgaggttagagagacgc

SEQ ID NO: 703525 - DNA, 20 bp, mouse
gtagtatcacgtgctcacac

SEQ ID NO: 703526 - DNA, 20 bp, mouse
ggacctacagactgaatcca

SEQ ID NO: 703527 - DNA, 20 bp, mouse
gggctctgccaatggcgatc

SEQ ID NO: 703528 - DNA, 20 bp, mouse
gtcaaccatgactcttgcaa

SEQ ID NO: 703529 - DNA, 20 bp, mouse
gctgccctgggcctctggcc

SEQ ID NO: 703530 - DNA, 20 bp, mouse
ggtgtgcccaagttaataat

SEQ ID NO: 703531 - DNA, 20 bp, mouse
gttacgtaaaatagcaaaac

SEQ ID NO: 703532 - DNA, 20 bp, mouse
gggttgatgcaaacatgttc

SEQ ID NO: 703533 - DNA, 20 bp, mouse
gtcaatccagccctgatctt

SEQ ID NO: 703534 - DNA, 20 bp, mouse
gtggatctggggtccacctc

SEQ ID NO: 703535 - DNA, 20 bp, mouse
gaaaacagcctgatcgccat

SEQ ID NO: 703536 - DNA, 20 bp, mouse
gctgacctggggcaatttag

SEQ ID NO: 703537 - DNA, 20 bp, mouse
gactttaatgggtggaaaag

SEQ ID NO: 703538 - DNA, 20 bp, mouse
gagcagatgagcttttctgg

SEQ ID NO: 703539 - DNA, 20 bp, mouse
gcaactgttcatacacagag

SEQ ID NO: 703540 - DNA, 20 bp, mouse
gaggggaacttgaatttctt

SEQ ID NO: 703541 - DNA, 20 bp, mouse
gtgcttatgactttaatggg

SEQ ID NO: 703542 - DNA, 20 bp, mouse
ggtgcagtatatgctgacct

SEQ ID NO: 703543 - DNA, 20 bp, mouse
gcatctgcttatgactttaa

SEQ ID NO: 703544 - DNA, 20 bp, mouse
gtgacacagaataattattc

SEQ ID NO: 703545 - DNA, 20 bp, mouse
gtgctaatgtctgcccttaa

SEQ ID NO: 703546 - DNA, 20 bp, mouse
gagctggttcccaggttcat

SEQ ID NO: 703547 - DNA, 20 bp, mouse
gtcaggggaccgatgaacct

SEQ ID NO: 703548 - DNA, 20 bp, mouse
ggccgctgttgctagcacgt

SEQ ID NO: 703549 - DNA, 20 bp, mouse
gagaaagggtgggctctaga

SEQ ID NO: 703550 - DNA, 20 bp, mouse
gccctgacccggaacagcag

SEQ ID NO: 703551 - DNA, 20 bp, mouse
ggcccacgtgctagcaacag

SEQ ID NO: 703552 - DNA, 20 bp, mouse
gccagggcgagggtttcttc

SEQ ID NO: 703553 - DNA, 20 bp, mouse
gcgcgtgtcagggactgcgg

SEQ ID NO: 703554 - DNA, 20 bp, mouse
gcccgctgctgttccgggtc

SEQ ID NO: 703555 - DNA, 20 bp, mouse
gaaatggcaggagggtggta

SEQ ID NO: 703556 - DNA, 20 bp, mouse
ggtagccactcatcccattc

SEQ ID NO: 703557 - DNA, 20 bp, mouse
gactaaaggacatttattga

SEQ ID NO: 703558 - DNA, 20 bp, mouse
gtccttgccaaatgcccaaa

SEQ ID NO: 703559 - DNA, 20 bp, mouse
gcacgtcaggtctgagatca

SEQ ID NO: 703560 - DNA, 20 bp, mouse
ggggcttgaactggggagtg

SEQ ID NO: 703561 - DNA, 20 bp, mouse
gtgagatcagggcttgaact

SEQ ID NO: 703562 - DNA, 20 bp, mouse
gggttgtttcatttcctgaa

SEQ ID NO: 703563 - DNA, 20 bp, mouse
gctacaatgttgagcccttt

SEQ ID NO: 703564 - DNA, 20 bp, mouse
gaggagtaactgcaaaaata

SEQ ID NO: 703565 - DNA, 20 bp, mouse
ggttgagccctttgggcatt

SEQ ID NO: 703566 - DNA, 20 bp, mouse
ggggacccaggagaactgtg

SEQ ID NO: 703567 - DNA, 20 bp, mouse
gaaagctaggccatacataa

SEQ ID NO: 703568 - DNA, 20 bp, mouse
gcggggaaggccaaagggcg

SEQ ID NO: 703569 - DNA, 20 bp, mouse
ggaagtggggtcatccggga

SEQ ID NO: 703570 - DNA, 20 bp, mouse
gcgggctagtctatcattgc

SEQ ID NO: 703571 - DNA, 20 bp, mouse
ggctgggtgacacaggagac

SEQ ID NO: 703572 - DNA, 20 bp, mouse
gcggcatcggggaaggccaa

SEQ ID NO: 703573 - DNA, 20 bp, mouse
gcataatggctgggtgacac

SEQ ID NO: 703574 - DNA, 20 bp, mouse
gggggcagcggcatcgggga

SEQ ID NO: 703575 - DNA, 20 bp, mouse
gctaggccatacataatggc

SEQ ID NO: 703576 - DNA, 20 bp, mouse
ggcggtccctggagacgtga

SEQ ID NO: 703577 - DNA, 20 bp, mouse
gaaaagaagaaccgctgaac

SEQ ID NO: 703578 - DNA, 20 bp, mouse
gagggaccgcagcagagctc

SEQ ID NO: 703579 - DNA, 20 bp, mouse
gcagcggttcttcttttgag

SEQ ID NO: 703580 - DNA, 20 bp, mouse
gaacagctcaaaagtacctg

SEQ ID NO: 703581 - DNA, 20 bp, mouse
gagaggtgcggtttctagat

SEQ ID NO: 703582 - DNA, 20 bp, mouse
gctcaagatgctatgaaagt

SEQ ID NO: 703583 - DNA, 20 bp, mouse
gttagtctccgcctgttcag

SEQ ID NO: 703584 - DNA, 20 bp, mouse
gtgcgcctgcgcgcctgggc

SEQ ID NO: 703585 - DNA, 20 bp, mouse
gcagcagtcaaaatgacaac

SEQ ID NO: 703586 - DNA, 20 bp, mouse
gcacagtcaaggggcgggaa

SEQ ID NO: 703587 - DNA, 20 bp, mouse
gaatgtgggcaggagttacg

SEQ ID NO: 703588 - DNA, 20 bp, mouse
gcaaactaaccaagcactga

SEQ ID NO: 703589 - DNA, 20 bp, mouse
gcataacgactaagcttagt

SEQ ID NO: 703590 - DNA, 20 bp, mouse
gcgggaagggatgcgagaga

SEQ ID NO: 703591 - DNA, 20 bp, mouse
ggagggaaaccctcagtgct

SEQ ID NO: 703592 - DNA, 20 bp, mouse
gttccgaaagccacagtcaa

SEQ ID NO: 703593 - DNA, 20 bp, mouse
gtacgaggctgcagacttgg

SEQ ID NO: 703594 - DNA, 20 bp, mouse
ggcacgcagagccaaacgac

SEQ ID NO: 703595 - DNA, 20 bp, mouse
ggccctgaaatccggtcgtt

SEQ ID NO: 703596 - DNA, 20 bp, mouse
ggagaaggggccactcagaa

SEQ ID NO: 703597 - DNA, 20 bp, mouse
gctcctggggccctgaggga

SEQ ID NO: 703598 - DNA, 20 bp, mouse
gttgctgtctgctcgattga

SEQ ID NO: 703599 - DNA, 20 bp, mouse
ggagcaatgacaacgattga

SEQ ID NO: 703600 - DNA, 20 bp, mouse
gcactcatgtgacatgagaa

SEQ ID NO: 703601 - DNA, 20 bp, mouse
gaggtctactgtcccatgcg

SEQ ID NO: 703602 - DNA, 20 bp, mouse
gtctgctcagaagctggagg

SEQ ID NO: 703603 - DNA, 20 bp, mouse
gttggagtcactaacagctc

SEQ ID NO: 703604 - DNA, 20 bp, mouse
gtaacagctcggggttctga

SEQ ID NO: 703605 - DNA, 20 bp, mouse
ggggtggacaataagagcca

SEQ ID NO: 703606 - DNA, 20 bp, mouse
gcacctcctctgaacaacgt

SEQ ID NO: 703607 - DNA, 20 bp, mouse
gtgggcacagctggttttct

SEQ ID NO: 703608 - DNA, 20 bp, mouse
gccattcccacgttgttcag

SEQ ID NO: 703609 - DNA, 20 bp, mouse
gacagctggttttctcggag

SEQ ID NO: 703610 - DNA, 20 bp, mouse
ggagaggtggaatggcgccc

SEQ ID NO: 703611 - DNA, 20 bp, mouse
ggctggttttctcggagagg

SEQ ID NO: 703612 - DNA, 20 bp, mouse
gttttctcggagaggtggaa

SEQ ID NO: 703613 - DNA, 20 bp, mouse
gaataaaatccgaagggccg

SEQ ID NO: 703614 - DNA, 20 bp, mouse
ggaatggcgccccggccctt

SEQ ID NO: 703615 - DNA, 20 bp, mouse
gttcccacgttgttcagagg

SEQ ID NO: 703616 - DNA, 20 bp, mouse
gaagcccggggtagtagtgc

SEQ ID NO: 703617 - DNA, 20 bp, mouse
gactccgccgcctacgcagg

SEQ ID NO: 703618 - DNA, 20 bp, mouse
ggcaacgcgatgacgtccta

SEQ ID NO: 703619 - DNA, 20 bp, mouse
gctgtcgccctcagccacta

SEQ ID NO: 703620 - DNA, 20 bp, mouse
gttatcgctgcgccccctag

SEQ ID NO: 703621 - DNA, 20 bp, mouse
ggtgagcgcaggtgttggaa

SEQ ID NO: 703622 - DNA, 20 bp, mouse
gcgacagtgagcgcaggtgt

SEQ ID NO: 703623 - DNA, 20 bp, mouse
gtgagggcgacagtgagcgc

SEQ ID NO: 703624 - DNA, 20 bp, mouse
gtggcaggccggatgtagat

SEQ ID NO: 703625 - DNA, 20 bp, mouse
gtgactctgactccaggtct

SEQ ID NO: 703626 - DNA, 20 bp, mouse
ggccccgggcccgcgcgcta

SEQ ID NO: 703627 - DNA, 20 bp, mouse
ggcccgcgcgctatggaagg

SEQ ID NO: 703628 - DNA, 20 bp, mouse
gcgggcccgcgcgctatgga

SEQ ID NO: 703629 - DNA, 20 bp, mouse
gcgcgcgctatggaaggcgg

SEQ ID NO: 703630 - DNA, 20 bp, mouse
gtggggtggcgctgcgttcc

SEQ ID NO: 703631 - DNA, 20 bp, mouse
gtatggaaggcggcggtctc

SEQ ID NO: 703632 - DNA, 20 bp, mouse
ggcactcccgctctcacact

SEQ ID NO: 703633 - DNA, 20 bp, mouse
gcctgctgactacagatccc

SEQ ID NO: 703634 - DNA, 20 bp, mouse
gcgccaccccagtgtgagag

SEQ ID NO: 703635 - DNA, 20 bp, mouse
gtggcaaactcagtcggagc

SEQ ID NO: 703636 - DNA, 20 bp, mouse
gctgctgaggcgccctggtg

SEQ ID NO: 703637 - DNA, 20 bp, mouse
gctgccctcggggacctcgc

SEQ ID NO: 703638 - DNA, 20 bp, mouse
gagccccgcgaggtccccga

SEQ ID NO: 703639 - DNA, 20 bp, mouse
gggcgagcgcccgcctgctg

SEQ ID NO: 703640 - DNA, 20 bp, mouse
gtctgcgccggctgccctcg

SEQ ID NO: 703641 - DNA, 20 bp, mouse
gaggctcaacgttcgaccta

SEQ ID NO: 703642 - DNA, 20 bp, mouse
gcagctccaggcttagaggg

SEQ ID NO: 703643 - DNA, 20 bp, mouse
gcagttagcctggaccccac

SEQ ID NO: 703644 - DNA, 20 bp, mouse
gacgaggcagtgaggcgcgc

SEQ ID NO: 703645 - DNA, 20 bp, mouse
gctggaccccacaggcccgg

SEQ ID NO: 703646 - DNA, 20 bp, mouse
gcacccccaggacttgagga

SEQ ID NO: 703647 - DNA, 20 bp, mouse
gaaaacactaggtgacctaa

SEQ ID NO: 703648 - DNA, 20 bp, mouse
ggctgcagaacaaaaatcta

SEQ ID NO: 703649 - DNA, 20 bp, mouse
gatgaaagcaacaggatcat

SEQ ID NO: 703650 - DNA, 20 bp, mouse
gtgttcttgagtttagactg

SEQ ID NO: 703651 - DNA, 20 bp, mouse
gatcccttcctcaagtcctg

SEQ ID NO: 703652 - DNA, 20 bp, mouse
gcgagcaattgctgtgctgc

SEQ ID NO: 703653 - DNA, 20 bp, mouse
ggcacagcaattgctcgaag

SEQ ID NO: 703654 - DNA, 20 bp, mouse
gactatgaaggtaacaatct

SEQ ID NO: 703655 - DNA, 20 bp, mouse
gggggcggcgctatgtaggt

SEQ ID NO: 703656 - DNA, 20 bp, mouse
ggggccggtccgatggtcgg

SEQ ID NO: 703657 - DNA, 20 bp, mouse
ggccttcagcgtaactgctt

SEQ ID NO: 703658 - DNA, 20 bp, mouse
gcaaccccgcccccgaccat

SEQ ID NO: 703659 - DNA, 20 bp, mouse
ggttacgctgaaggcgtaag

SEQ ID NO: 703660 - DNA, 20 bp, mouse
gcgtaagaggaccaggctac

SEQ ID NO: 703661 - DNA, 20 bp, mouse
gctgaaggcgtaagaggacc

SEQ ID NO: 703662 - DNA, 20 bp, mouse
gccgcccccgaccatcggac

SEQ ID NO: 703663 - DNA, 20 bp, mouse
ggggaagtggcgcaaattcg

SEQ ID NO: 703664 - DNA, 20 bp, mouse
gcggaaattacgttggggaa

SEQ ID NO: 703665 - DNA, 20 bp, mouse
gggggcggggttgatgaata

SEQ ID NO: 703666 - DNA, 20 bp, mouse
gaggacctgctggatccggg

SEQ ID NO: 703667 - DNA, 20 bp, mouse
gcagtcagaaggaggagttg

SEQ ID NO: 703668 - DNA, 20 bp, mouse
ggagaaggcaggccagtcgt

SEQ ID NO: 703669 - DNA, 20 bp, mouse
gccagcaggtccttagcgcc

SEQ ID NO: 703670 - DNA, 20 bp, mouse
ggctaaggacctgctggatc

SEQ ID NO: 703671 - DNA, 20 bp, mouse
gcatgatttttgcgtttcga

SEQ ID NO: 703672 - DNA, 20 bp, mouse
gagtggtttaggaaaagctt

SEQ ID NO: 703673 - DNA, 20 bp, mouse
gaaacacaaaaacaccaggg

SEQ ID NO: 703674 - DNA, 20 bp, mouse
gctgtccacccggatccagc

SEQ ID NO: 703675 - DNA, 20 bp, mouse
gtggaaacacaaaaacacca

SEQ ID NO: 703676 - DNA, 20 bp, mouse
ggaatggagactgacgtagg

SEQ ID NO: 703677 - DNA, 20 bp, mouse
gtgggaatggagactgacgt

SEQ ID NO: 703678 - DNA, 20 bp, mouse
ggagactgacgtaggtggct

SEQ ID NO: 703679 - DNA, 20 bp, mouse
gtgagagggcggagcctaag

SEQ ID NO: 703680 - DNA, 20 bp, mouse
gagcttggaacgcttgtaaa

SEQ ID NO: 703681 - DNA, 20 bp, mouse
gctaggagcgctcctgggaa

SEQ ID NO: 703682 - DNA, 20 bp, mouse
gctacgattacgtgagaggg

SEQ ID NO: 703683 - DNA, 20 bp, mouse
ggtgcatgacaggcaggtca

SEQ ID NO: 703684 - DNA, 20 bp, mouse
gcgctcctaggtctccgctt

SEQ ID NO: 703685 - DNA, 20 bp, mouse
gcttgtaaagggctctggaa

SEQ ID NO: 703686 - DNA, 20 bp, mouse
ggaggggccgggatccgggg

SEQ ID NO: 703687 - DNA, 20 bp, mouse
gggagggcgtagaggtagga

SEQ ID NO: 703688 - DNA, 20 bp, mouse
gccgtgggcggtctagggag

SEQ ID NO: 703689 - DNA, 20 bp, mouse
gccgcgccgtgggcggtcta

SEQ ID NO: 703690 - DNA, 20 bp, mouse
gggcgtagaggtaggatgga

SEQ ID NO: 703691 - DNA, 20 bp, mouse
gagggaggggccgggatccg

SEQ ID NO: 703692 - DNA, 20 bp, mouse
ggggagggggagatcggaga

SEQ ID NO: 703693 - DNA, 20 bp, mouse
ggacccgcagactagactga

SEQ ID NO: 703694 - DNA, 20 bp, mouse
gcgccctcccgcgccgtggg

SEQ ID NO: 703695 - DNA, 20 bp, mouse
gcgaccacgcatgcaggcgg

SEQ ID NO: 703696 - DNA, 20 bp, mouse
gcctaaggagactagaggag

SEQ ID NO: 703697 - DNA, 20 bp, mouse
gcagaaggggagaactggta

SEQ ID NO: 703698 - DNA, 20 bp, mouse
gcaaagaggggaagcgaggg

SEQ ID NO: 703699 - DNA, 20 bp, mouse
ggagcaaagaggggaagcga

SEQ ID NO: 703700 - DNA, 20 bp, mouse
gggagcgaggaactaagggt

SEQ ID NO: 703701 - DNA, 20 bp, mouse
gagaggagaggataaggatt

SEQ ID NO: 703702 - DNA, 20 bp, mouse
gtgggtgggaccagtgaaca

SEQ ID NO: 703703 - DNA, 20 bp, mouse
gggagaagagggagagcgca

SEQ ID NO: 703704 - DNA, 20 bp, mouse
gagaaggatagtgtagttga

SEQ ID NO: 703705 - DNA, 20 bp, mouse
gaagatggagcgaggaacta

SEQ ID NO: 703706 - DNA, 20 bp, mouse
gtccagagccccacgttcgg

SEQ ID NO: 703707 - DNA, 20 bp, mouse
gacgtcccgcggctccgagc

SEQ ID NO: 703708 - DNA, 20 bp, mouse
gagctccagagccccacgtt

SEQ ID NO: 703709 - DNA, 20 bp, mouse
gggctcgggaggcgaaggca

SEQ ID NO: 703710 - DNA, 20 bp, mouse
gtcccccgaacgtggggctc

SEQ ID NO: 703711 - DNA, 20 bp, mouse
gtccagggtccgacgtcccg

SEQ ID NO: 703712 - DNA, 20 bp, mouse
gctcccctggccgggctcca

SEQ ID NO: 703713 - DNA, 20 bp, mouse
gcaggaggctcgggaggcga

SEQ ID NO: 703714 - DNA, 20 bp, mouse
gcgggccgcctccggggaca

SEQ ID NO: 703715 - DNA, 20 bp, mouse
gctgcgatcgcgcacggagg

SEQ ID NO: 703716 - DNA, 20 bp, mouse
ggggctgcgctctactccca

SEQ ID NO: 703717 - DNA, 20 bp, mouse
gcgtcccgatccttggggtt

SEQ ID NO: 703718 - DNA, 20 bp, mouse
gagggccggaagtagaacgg

SEQ ID NO: 703719 - DNA, 20 bp, mouse
gtcagtgcaaggtgactggg

SEQ ID NO: 703720 - DNA, 20 bp, mouse
gccgaagggagcttgaacta

SEQ ID NO: 703721 - DNA, 20 bp, mouse
gcggacaggaagcgcctcga

SEQ ID NO: 703722 - DNA, 20 bp, mouse
ggagcctcctaagacaggaa

SEQ ID NO: 703723 - DNA, 20 bp, mouse
gggactcagtgcaaggtgac

SEQ ID NO: 703724 - DNA, 20 bp, mouse
gtgcctgggaggcgggagag

SEQ ID NO: 703725 - DNA, 20 bp, mouse
gcgaaacgcccgcgacgacg

SEQ ID NO: 703726 - DNA, 20 bp, mouse
gctcgctcccggggccagtg

SEQ ID NO: 703727 - DNA, 20 bp, mouse
gtcggcgcggagggacacgg

SEQ ID NO: 703728 - DNA, 20 bp, mouse
gcccgttccggcgggagaaa

SEQ ID NO: 703729 - DNA, 20 bp, mouse
gtctcccgccggaacggggc

SEQ ID NO: 703730 - DNA, 20 bp, mouse
ggctcccggggccagtgggg

SEQ ID NO: 703731 - DNA, 20 bp, mouse
gcccaccgaaaagtccccgt

SEQ ID NO: 703732 - DNA, 20 bp, mouse
gctagcgttcggccacacaa

SEQ ID NO: 703733 - DNA, 20 bp, mouse
ggggccagtggggcggaaac

SEQ ID NO: 703734 - DNA, 20 bp, mouse
ggctgcggcggaatgatccg

SEQ ID NO: 703735 - DNA, 20 bp, mouse
gcgcgccgacggggactttt

SEQ ID NO: 703736 - DNA, 20 bp, mouse
ggggctaacttgagggttgg

SEQ ID NO: 703737 - DNA, 20 bp, mouse
gggaaagtgtccggtcagac

SEQ ID NO: 703738 - DNA, 20 bp, mouse
gcggcgttgaaccagcagga

SEQ ID NO: 703739 - DNA, 20 bp, mouse
gtcaacgccgggctaacttg

SEQ ID NO: 703740 - DNA, 20 bp, mouse
gaccagaaggtcccgaatag

SEQ ID NO: 703741 - DNA, 20 bp, mouse
ggccgggctaacttgagggt

SEQ ID NO: 703742 - DNA, 20 bp, mouse
gaggaaggagtcggactcag

SEQ ID NO: 703743 - DNA, 20 bp, mouse
gtcgctaagtagtcccgctc

SEQ ID NO: 703744 - DNA, 20 bp, mouse
gataccgcgggcatcctgag

SEQ ID NO: 703745 - DNA, 20 bp, mouse
ggggaagactagaataggat

SEQ ID NO: 703746 - DNA, 20 bp, mouse
gcgcaaaccggatgtgaaat

SEQ ID NO: 703747 - DNA, 20 bp, mouse
ggctacagagatggggatta

SEQ ID NO: 703748 - DNA, 20 bp, mouse
ggattggtgtccagatccag

SEQ ID NO: 703749 - DNA, 20 bp, mouse
gtcaccgcctatttcacatc

SEQ ID NO: 703750 - DNA, 20 bp, mouse
gaatacgtcccagcgcaaac

SEQ ID NO: 703751 - DNA, 20 bp, mouse
gagccggcagctacagagat

SEQ ID NO: 703752 - DNA, 20 bp, mouse
gtgcgctgcatataaaaaat

SEQ ID NO: 703753 - DNA, 20 bp, mouse
gaagggggactgaaaaatgg

SEQ ID NO: 703754 - DNA, 20 bp, mouse
ggctgcatataaaaaatggg

SEQ ID NO: 703755 - DNA, 20 bp, mouse
gggtagaaagggttagagat

SEQ ID NO: 703756 - DNA, 20 bp, mouse
gcgagccccgcgcctggagg

SEQ ID NO: 703757 - DNA, 20 bp, mouse
gaggaggaggagctagccca

SEQ ID NO: 703758 - DNA, 20 bp, mouse
gcaaccacgtcgctccacta

SEQ ID NO: 703759 - DNA, 20 bp, mouse
gtggccgcgcgaggagtagg

SEQ ID NO: 703760 - DNA, 20 bp, mouse
ggtagcgatcgcaggagccg

SEQ ID NO: 703761 - DNA, 20 bp, mouse
gccactagggatgatgtcgg

SEQ ID NO: 703762 - DNA, 20 bp, mouse
gaggagctagcccaaggaag

SEQ ID NO: 703763 - DNA, 20 bp, mouse
gaggccctaggtcccacggg

SEQ ID NO: 703764 - DNA, 20 bp, mouse
ggatcgcaggagccggggtg

SEQ ID NO: 703765 - DNA, 20 bp, mouse
gcgtccgtagtggcggtgat

SEQ ID NO: 703766 - DNA, 20 bp, mouse
ggtggtaaagccagcgaagg

SEQ ID NO: 703767 - DNA, 20 bp, mouse
gaaagccagcgaagggggtt

SEQ ID NO: 703768 - DNA, 20 bp, mouse
gtccccccaacccccttcgc

SEQ ID NO: 703769 - DNA, 20 bp, mouse
ggcagtggtaaagccagcga

SEQ ID NO: 703770 - DNA, 20 bp, mouse
gagaagtaagcatctcacag

SEQ ID NO: 703771 - DNA, 20 bp, mouse
gctctcccttccatctctat

SEQ ID NO: 703772 - DNA, 20 bp, mouse
ggcaaaggcttaaaaatctg

SEQ ID NO: 703773 - DNA, 20 bp, mouse
gagcagggcaagcaaagggg

SEQ ID NO: 703774 - DNA, 20 bp, mouse
gaaggaggaagctcacactt

SEQ ID NO: 703775 - DNA, 20 bp, mouse
gaagagcacatagaagataa

SEQ ID NO: 703776 - DNA, 20 bp, mouse
gagcagggaccaaggaccgt

SEQ ID NO: 703777 - DNA, 20 bp, mouse
gcaggagctcccaagttcac

SEQ ID NO: 703778 - DNA, 20 bp, mouse
ggggtcccctgccactggcc

SEQ ID NO: 703779 - DNA, 20 bp, mouse
gcagtggcaggggacccaat

SEQ ID NO: 703780 - DNA, 20 bp, mouse
gagcacttgcaagcttgaca

SEQ ID NO: 703781 - DNA, 20 bp, mouse
gtgcccactgcggagaatgt

SEQ ID NO: 703782 - DNA, 20 bp, mouse
gtcctccagcctagccgcgg

SEQ ID NO: 703783 - DNA, 20 bp, mouse
ggccgggctctcgctcgcac

SEQ ID NO: 703784 - DNA, 20 bp, mouse
ggacggggcaggagggacgg

SEQ ID NO: 703785 - DNA, 20 bp, mouse
gtgtgtgtgcacgcggccag

SEQ ID NO: 703786 - DNA, 20 bp, mouse
gcagcccaggaagcgggcat

SEQ ID NO: 703787 - DNA, 20 bp, mouse
ggctcccatgcccgcttcct

SEQ ID NO: 703788 - DNA, 20 bp, mouse
ggtgactagcgattattcca

SEQ ID NO: 703789 - DNA, 20 bp, mouse
gctaccgggcgcctaggcag

SEQ ID NO: 703790 - DNA, 20 bp, mouse
ggctactgtctgacccgctt

SEQ ID NO: 703791 - DNA, 20 bp, mouse
ggagtctggcggcctctacc

SEQ ID NO: 703792 - DNA, 20 bp, mouse
gagtccgccgggggcgctgg

SEQ ID NO: 703793 - DNA, 20 bp, mouse
gaagcgccacatgtcgtctc

SEQ ID NO: 703794 - DNA, 20 bp, mouse
gtcaccttttaggacagagg

SEQ ID NO: 703795 - DNA, 20 bp, mouse
gtgggcattggaagcatatt

SEQ ID NO: 703796 - DNA, 20 bp, mouse
gggaagagccacaagaatcc

SEQ ID NO: 703797 - DNA, 20 bp, mouse
ggaatcctacatagccctga

SEQ ID NO: 703798 - DNA, 20 bp, mouse
gatggaaaagtcaaatactg

SEQ ID NO: 703799 - DNA, 20 bp, mouse
ggaggaaatctggaaagcag

SEQ ID NO: 703800 - DNA, 20 bp, mouse
gtttggcatggacttcgaat

SEQ ID NO: 703801 - DNA, 20 bp, mouse
gtatttctatggttcacaga

SEQ ID NO: 703802 - DNA, 20 bp, mouse
gaggactatttttcattaca

SEQ ID NO: 703803 - DNA, 20 bp, mouse
gcaaatactggggattttcc

SEQ ID NO: 703804 - DNA, 20 bp, mouse
gggacttcgaatgggctgtg

SEQ ID NO: 703805 - DNA, 20 bp, mouse
gattgagattatgttccaat

SEQ ID NO: 703806 - DNA, 20 bp, mouse
gaacgcggagcacctcagac

SEQ ID NO: 703807 - DNA, 20 bp, mouse
gcggcccggaaaaggagttt

SEQ ID NO: 703808 - DNA, 20 bp, mouse
gagcttaggacaggagggaa

SEQ ID NO: 703809 - DNA, 20 bp, mouse
gaagtctggagatggttctc

SEQ ID NO: 703810 - DNA, 20 bp, mouse
ggaggtgctccgcgttctct

SEQ ID NO: 703811 - DNA, 20 bp, mouse
gctcagacaggaactttaaa

SEQ ID NO: 703812 - DNA, 20 bp, mouse
gacctgctgtctctatgcaa

SEQ ID NO: 703813 - DNA, 20 bp, mouse
gaccacagctcaggaaaact

SEQ ID NO: 703814 - DNA, 20 bp, mouse
gcgcatgcgcaggtccattc

SEQ ID NO: 703815 - DNA, 20 bp, mouse
gcggccggccggcccggaaa

SEQ ID NO: 703816 - DNA, 20 bp, mouse
gttactctggatgcatttct

SEQ ID NO: 703817 - DNA, 20 bp, mouse
gcagtgcagtaattctaatg

SEQ ID NO: 703818 - DNA, 20 bp, mouse
gaacatcaaaggggcagcgg

SEQ ID NO: 703819 - DNA, 20 bp, mouse
ggggacaagcggaggaggtg

SEQ ID NO: 703820 - DNA, 20 bp, mouse
gccctgcctgggacaagcgg

SEQ ID NO: 703821 - DNA, 20 bp, mouse
ggggtgggagcgctaggggt

SEQ ID NO: 703822 - DNA, 20 bp, mouse
ggcgtaccaaaacatcaaag

SEQ ID NO: 703823 - DNA, 20 bp, mouse
gaaaaataggagtagggtgt

SEQ ID NO: 703824 - DNA, 20 bp, mouse
gggtctaagccagttgaaag

SEQ ID NO: 703825 - DNA, 20 bp, mouse
ggggtggggtgggagcgcta

SEQ ID NO: 703826 - DNA, 20 bp, mouse
ggcaccggactcccggggaa

SEQ ID NO: 703827 - DNA, 20 bp, mouse
gagcgaccgcggacccatag

SEQ ID NO: 703828 - DNA, 20 bp, mouse
gaccgcggacccataggggg

SEQ ID NO: 703829 - DNA, 20 bp, mouse
gcggccgcaccggactcccg

SEQ ID NO: 703830 - DNA, 20 bp, mouse
ggcggccgctgccgcggctt

SEQ ID NO: 703831 - DNA, 20 bp, mouse
gccctcccaagccgcggcag

SEQ ID NO: 703832 - DNA, 20 bp, mouse
gtgggtccgcggtcgctccg

SEQ ID NO: 703833 - DNA, 20 bp, mouse
gcccgccccctatgggtccg

SEQ ID NO: 703834 - DNA, 20 bp, mouse
gccggcgccctcccaagccg

SEQ ID NO: 703835 - DNA, 20 bp, mouse
gaacagcacccgccccctat

SEQ ID NO: 703836 - DNA, 20 bp, mouse
gtggtcgctccgctgcgctc

SEQ ID NO: 703837 - DNA, 20 bp, mouse
gggagaggacacagtgtgcg

SEQ ID NO: 703838 - DNA, 20 bp, mouse
gcgccctgccgcacgcgggg

SEQ ID NO: 703839 - DNA, 20 bp, mouse
gagagtggaacgggcgctgg

SEQ ID NO: 703840 - DNA, 20 bp, mouse
ggcgcagcggagcgaccacc

SEQ ID NO: 703841 - DNA, 20 bp, mouse
gccacagctggaggagggtc

SEQ ID NO: 703842 - DNA, 20 bp, mouse
gcgaggctctcggagctctc

SEQ ID NO: 703843 - DNA, 20 bp, mouse
ggcgaccaccgggtgctatg

SEQ ID NO: 703844 - DNA, 20 bp, mouse
gggagctctccggagcgcag

SEQ ID NO: 703845 - DNA, 20 bp, mouse
ggaccaggacgcaagacgag

SEQ ID NO: 703846 - DNA, 20 bp, mouse
gtccgacgacgtgatcgctg

SEQ ID NO: 703847 - DNA, 20 bp, mouse
gcgaggagcgaggctaggga

SEQ ID NO: 703848 - DNA, 20 bp, mouse
gtgagggagccctgtcgcca

SEQ ID NO: 703849 - DNA, 20 bp, mouse
gagcctgcagcgtgaggccc

SEQ ID NO: 703850 - DNA, 20 bp, mouse
gagggagaagacatgcgcgt

SEQ ID NO: 703851 - DNA, 20 bp, mouse
ggccgcagcgatcacgtcgt

SEQ ID NO: 703852 - DNA, 20 bp, mouse
gaaggtgcggagcgcgactg

SEQ ID NO: 703853 - DNA, 20 bp, mouse
ggctgggggccttggcgaca

SEQ ID NO: 703854 - DNA, 20 bp, mouse
gtggggaaaaaccgctgtag

SEQ ID NO: 703855 - DNA, 20 bp, mouse
gcgctgccagacagccaggg

SEQ ID NO: 703856 - DNA, 20 bp, mouse
ggaaaagggctccgtttttt

SEQ ID NO: 703857 - DNA, 20 bp, mouse
gtccctcagaaacattggtg

SEQ ID NO: 703858 - DNA, 20 bp, mouse
gctacggagccaatcacacc

SEQ ID NO: 703859 - DNA, 20 bp, mouse
gtgggcttgatttctagtat

SEQ ID NO: 703860 - DNA, 20 bp, mouse
gaccacaccaatgtttctga

SEQ ID NO: 703861 - DNA, 20 bp, mouse
gaccaatcagcgttccacaa

SEQ ID NO: 703862 - DNA, 20 bp, mouse
gcggagcccttttccccact

SEQ ID NO: 703863 - DNA, 20 bp, mouse
ggtccacagggcactacctg

SEQ ID NO: 703864 - DNA, 20 bp, mouse
gtggtgtggtcttgagagtc

SEQ ID NO: 703865 - DNA, 20 bp, mouse
ggccctgatgttctatatcg

SEQ ID NO: 703866 - DNA, 20 bp, mouse
gccccccacctgcctctagt

SEQ ID NO: 703867 - DNA, 20 bp, mouse
ggagtgacgggacctactag

SEQ ID NO: 703868 - DNA, 20 bp, mouse
gaggataatagaattgaggc

SEQ ID NO: 703869 - DNA, 20 bp, mouse
gagcagcttccaagtctgag

SEQ ID NO: 703870 - DNA, 20 bp, mouse
ggcaatacatctctgagtga

SEQ ID NO: 703871 - DNA, 20 bp, mouse
ggacgggacctactagaggc

SEQ ID NO: 703872 - DNA, 20 bp, mouse
gttaaaaattaatattcagg

SEQ ID NO: 703873 - DNA, 20 bp, mouse
gcccaagggtcggtcctttt

SEQ ID NO: 703874 - DNA, 20 bp, mouse
gggaagagatgtgagtctgc

SEQ ID NO: 703875 - DNA, 20 bp, mouse
ggggctgtgctctctttgtc

SEQ ID NO: 703876 - DNA, 20 bp, mouse
gcacaggggacaagcagggt

SEQ ID NO: 703877 - DNA, 20 bp, mouse
ggactggcccgtgtcatcga

SEQ ID NO: 703878 - DNA, 20 bp, mouse
ggggtgggaaggagagcttg

SEQ ID NO: 703879 - DNA, 20 bp, mouse
gacggcacaggggacaagca

SEQ ID NO: 703880 - DNA, 20 bp, mouse
gagagcttggggatcccgca

SEQ ID NO: 703881 - DNA, 20 bp, mouse
gcccctggtgctcataactg

SEQ ID NO: 703882 - DNA, 20 bp, mouse
gccggctcggggctctgcgc

SEQ ID NO: 703883 - DNA, 20 bp, mouse
gaagagaaggcacacggcac

SEQ ID NO: 703884 - DNA, 20 bp, mouse
ggtgtcatcgatggagtcat

SEQ ID NO: 703885 - DNA, 20 bp, mouse
gcggccggcgggcaccaccg

SEQ ID NO: 703886 - DNA, 20 bp, mouse
gaaccaggtataggtgggtg

SEQ ID NO: 703887 - DNA, 20 bp, mouse
gtctttctcagctgaggttt

SEQ ID NO: 703888 - DNA, 20 bp, mouse
ggagctgctgaaccaggtat

SEQ ID NO: 703889 - DNA, 20 bp, mouse
gtttgggagtgtggctaaaa

SEQ ID NO: 703890 - DNA, 20 bp, mouse
gaaagcagagtttatcaaag

SEQ ID NO: 703891 - DNA, 20 bp, mouse
gcacaagtctttctcagctg

SEQ ID NO: 703892 - DNA, 20 bp, mouse
gatcaaagcacatcaagagc

SEQ ID NO: 703893 - DNA, 20 bp, mouse
gctaatctatgctttgattc

SEQ ID NO: 703894 - DNA, 20 bp, mouse
ggtcagagctccaccaaggg

SEQ ID NO: 703895 - DNA, 20 bp, mouse
gtggtgctcagaagaggtgg

SEQ ID NO: 703896 - DNA, 20 bp, mouse
gtgactgcgcgcagcctgag

SEQ ID NO: 703897 - DNA, 20 bp, mouse
gctgcgcgcagcctgagggg

SEQ ID NO: 703898 - DNA, 20 bp, mouse
gtaaagctgcagagacctga

SEQ ID NO: 703899 - DNA, 20 bp, mouse
ggtcaggccgcaggcccttc

SEQ ID NO: 703900 - DNA, 20 bp, mouse
ggcgcaaggagcggtaaaaa

SEQ ID NO: 703901 - DNA, 20 bp, mouse
gcaggtgctgccgtcggagt

SEQ ID NO: 703902 - DNA, 20 bp, mouse
gtgagactgggtgtcaagta

SEQ ID NO: 703903 - DNA, 20 bp, mouse
gcaggtgactagtgctggtc

SEQ ID NO: 703904 - DNA, 20 bp, mouse
gctggctccgcctactccga

SEQ ID NO: 703905 - DNA, 20 bp, mouse
gcaacccaggtgactagtgc

SEQ ID NO: 703906 - DNA, 20 bp, mouse
ggtggtgggtgtactggtga

SEQ ID NO: 703907 - DNA, 20 bp, mouse
gggaccgtcccgcaggacac

SEQ ID NO: 703908 - DNA, 20 bp, mouse
gccccctgcgtcagatgtca

SEQ ID NO: 703909 - DNA, 20 bp, mouse
ggtcctgcgggacggtccct

SEQ ID NO: 703910 - DNA, 20 bp, mouse
ggccccagggaccgtcccgc

SEQ ID NO: 703911 - DNA, 20 bp, mouse
ggatgcttctagtttgccca

SEQ ID NO: 703912 - DNA, 20 bp, mouse
gctaggagcattaatagatc

SEQ ID NO: 703913 - DNA, 20 bp, mouse
gtcagggattttctaaactg

SEQ ID NO: 703914 - DNA, 20 bp, mouse
gccaaggttacagaagccat

SEQ ID NO: 703915 - DNA, 20 bp, mouse
gctgacgcagggggatttgc

SEQ ID NO: 703916 - DNA, 20 bp, mouse
gtggatttgcatgtgttgaa

SEQ ID NO: 703917 - DNA, 20 bp, mouse
gtggctgtgacagactggag

SEQ ID NO: 703918 - DNA, 20 bp, mouse
gaactctctagaaccatgag

SEQ ID NO: 703919 - DNA, 20 bp, mouse
gaatcaagctgagttgctgc

SEQ ID NO: 703920 - DNA, 20 bp, mouse
gaggtaaaagctgttatcct

SEQ ID NO: 703921 - DNA, 20 bp, mouse
gaatgaccccagcaaaaagc

SEQ ID NO: 703922 - DNA, 20 bp, mouse
ggctgacgttacacacttca

SEQ ID NO: 703923 - DNA, 20 bp, mouse
gaactcagcttgattctgag

SEQ ID NO: 703924 - DNA, 20 bp, mouse
gagctatgaaaaaccactca

SEQ ID NO: 703925 - DNA, 20 bp, mouse
gtaaaaatccagcctagttg

SEQ ID NO: 703926 - DNA, 20 bp, mouse
gtgcagagaggcctgtgtgt

SEQ ID NO: 703927 - DNA, 20 bp, mouse
gaatgaagctgtgagataaa

SEQ ID NO: 703928 - DNA, 20 bp, mouse
gctcctctcctccaacacac

SEQ ID NO: 703929 - DNA, 20 bp, mouse
gagagaggcctgtgtgttgg

SEQ ID NO: 703930 - DNA, 20 bp, mouse
gagaggagatgattcctttc

SEQ ID NO: 703931 - DNA, 20 bp, mouse
gggctctaatcctcttaatc

SEQ ID NO: 703932 - DNA, 20 bp, mouse
gaaataatatgcttaatgag

SEQ ID NO: 703933 - DNA, 20 bp, mouse
gaacctgtcagtgttaagtt

SEQ ID NO: 703934 - DNA, 20 bp, mouse
gtatattgcaccggattaag

SEQ ID NO: 703935 - DNA, 20 bp, mouse
gaaatgaaatgttactgtac

SEQ ID NO: 703936 - DNA, 20 bp, mouse
gcgcgggggcagctcgtccg

SEQ ID NO: 703937 - DNA, 20 bp, mouse
gggtttgcgaccagaaagga

SEQ ID NO: 703938 - DNA, 20 bp, mouse
gacgaggccgttgctcgcgg

SEQ ID NO: 703939 - DNA, 20 bp, mouse
ggagctgcccccgcgagcaa

SEQ ID NO: 703940 - DNA, 20 bp, mouse
gggcagtcagacacctgcaa

SEQ ID NO: 703941 - DNA, 20 bp, mouse
gagcgctggggctcctttgc

SEQ ID NO: 703942 - DNA, 20 bp, mouse
ggaggcggggacccgctcgg

SEQ ID NO: 703943 - DNA, 20 bp, mouse
gctccaagatacgggatgga

SEQ ID NO: 703944 - DNA, 20 bp, mouse
gaaggagccccagcgctccg

SEQ ID NO: 703945 - DNA, 20 bp, mouse
gcgggagtgcagaaactcca

SEQ ID NO: 703946 - DNA, 20 bp, mouse
gagcacactgatcctttcac

SEQ ID NO: 703947 - DNA, 20 bp, mouse
gtctgaggacataaaagcat

SEQ ID NO: 703948 - DNA, 20 bp, mouse
gcatctccaacgtgatgcca

SEQ ID NO: 703949 - DNA, 20 bp, mouse
gaaaagcatgggattcactt

SEQ ID NO: 703950 - DNA, 20 bp, mouse
gtgccatggtagagactctg

SEQ ID NO: 703951 - DNA, 20 bp, mouse
gcaaaatgatgaatcgtctt

SEQ ID NO: 703952 - DNA, 20 bp, mouse
gaatctctgtaagattatca

SEQ ID NO: 703953 - DNA, 20 bp, mouse
gatcgtcttcggatgcattc

SEQ ID NO: 703954 - DNA, 20 bp, mouse
gcctctatgtaaatattaac

SEQ ID NO: 703955 - DNA, 20 bp, mouse
gacgttggagatgtctttgc

SEQ ID NO: 703956 - DNA, 20 bp, mouse
ggcgccgccgaggttaaatg

SEQ ID NO: 703957 - DNA, 20 bp, mouse
gtccccccatttaacctcgg

SEQ ID NO: 703958 - DNA, 20 bp, mouse
gtggagcggcagcgcgacga

SEQ ID NO: 703959 - DNA, 20 bp, mouse
gagatgagagagtgacggaa

SEQ ID NO: 703960 - DNA, 20 bp, mouse
gcgagggtgggtgtcacaca

SEQ ID NO: 703961 - DNA, 20 bp, mouse
gtagggagagggagcttggt

SEQ ID NO: 703962 - DNA, 20 bp, mouse
ggtgaggtgcgagtcagatg

SEQ ID NO: 703963 - DNA, 20 bp, mouse
gctaggtgaccccagggaca

SEQ ID NO: 703964 - DNA, 20 bp, mouse
ggtcacagcgacctcagcac

SEQ ID NO: 703965 - DNA, 20 bp, mouse
gggagaagggcaccgcgcga

SEQ ID NO: 703966 - DNA, 20 bp, mouse
gggagcccacgggacgaagg

SEQ ID NO: 703967 - DNA, 20 bp, mouse
gggaaaggggcggagctacg

SEQ ID NO: 703968 - DNA, 20 bp, mouse
gtacgcgggagggagcccac

SEQ ID NO: 703969 - DNA, 20 bp, mouse
gggggcggagctacgcggga

SEQ ID NO: 703970 - DNA, 20 bp, mouse
gagggctagccccatatctc

SEQ ID NO: 703971 - DNA, 20 bp, mouse
ggagggagcccacgggacga

SEQ ID NO: 703972 - DNA, 20 bp, mouse
gaggcagagttgagcggaaa

SEQ ID NO: 703973 - DNA, 20 bp, mouse
gggtgctgaaacccggttgg

SEQ ID NO: 703974 - DNA, 20 bp, mouse
gagcaccaccttcgtcccgt

SEQ ID NO: 703975 - DNA, 20 bp, mouse
ggctcaggaccccaccaacc

SEQ ID NO: 703976 - DNA, 20 bp, mouse
gcggccccacgtgggggtca

SEQ ID NO: 703977 - DNA, 20 bp, mouse
gagctccggcggccccacgt

SEQ ID NO: 703978 - DNA, 20 bp, mouse
gcagccctgacccccacgtg

SEQ ID NO: 703979 - DNA, 20 bp, mouse
gtggcctgaactttcgggga

SEQ ID NO: 703980 - DNA, 20 bp, mouse
gggagcgtgaacgccagcag

SEQ ID NO: 703981 - DNA, 20 bp, mouse
gggaaagcgcatgcctccag

SEQ ID NO: 703982 - DNA, 20 bp, mouse
gaggctggcctgaactttcg

SEQ ID NO: 703983 - DNA, 20 bp, mouse
gaatctcagcgcgggatact

SEQ ID NO: 703984 - DNA, 20 bp, mouse
gcgctgagattggctggaga

SEQ ID NO: 703985 - DNA, 20 bp, mouse
gaaaggctagggactctccg

SEQ ID NO: 703986 - DNA, 20 bp, mouse
gcgtgccagaaggccacgtg

SEQ ID NO: 703987 - DNA, 20 bp, mouse
gaaagcgggcgctggccaat

SEQ ID NO: 703988 - DNA, 20 bp, mouse
gcagaaggccacgtggggag

SEQ ID NO: 703989 - DNA, 20 bp, mouse
ggacaaaagcggcagatttg

SEQ ID NO: 703990 - DNA, 20 bp, mouse
ggcctgcggctcgtgccaga

SEQ ID NO: 703991 - DNA, 20 bp, mouse
gtggcgcactcgctggtggt

SEQ ID NO: 703992 - DNA, 20 bp, mouse
ggcggagggaacccgagcgc

SEQ ID NO: 703993 - DNA, 20 bp, mouse
gtgggcgcgcatcggactct

SEQ ID NO: 703994 - DNA, 20 bp, mouse
ggcctcccgccagctggcgg

SEQ ID NO: 703995 - DNA, 20 bp, mouse
gaaggcgagatgaaatctgc

SEQ ID NO: 703996 - DNA, 20 bp, mouse
gtgaacgtttaatgcgggtg

SEQ ID NO: 703997 - DNA, 20 bp, mouse
gtgcgcggcggaaacaccgg

SEQ ID NO: 703998 - DNA, 20 bp, mouse
ggcaggtgaacgtttaatgc

SEQ ID NO: 703999 - DNA, 20 bp, mouse
ggccgggaagaaggctcgga

SEQ ID NO: 704000 - DNA, 20 bp, mouse
ggcggcgctcctccgctccc

SEQ ID NO: 704001 - DNA, 20 bp, mouse
gcgcgctgctttagtccgta

SEQ ID NO: 704002 - DNA, 20 bp, mouse
gcaccgggggcctccggccg

SEQ ID NO: 704003 - DNA, 20 bp, mouse
ggcctgcgcggcggaaacac

SEQ ID NO: 704004 - DNA, 20 bp, mouse
gcgctcctccgctccccggc

SEQ ID NO: 704005 - DNA, 20 bp, mouse
gttgttaagagaatattgta

SEQ ID NO: 704006 - DNA, 20 bp, mouse
gtccctccgccctgtctgga

SEQ ID NO: 704007 - DNA, 20 bp, mouse
gccttcccctggggctgatg

SEQ ID NO: 704008 - DNA, 20 bp, mouse
gctgcccctaccttcccctg

SEQ ID NO: 704009 - DNA, 20 bp, mouse
gaggtggggagtaggtgcca

SEQ ID NO: 704010 - DNA, 20 bp, mouse
gtcagccccaggggaaggta

SEQ ID NO: 704011 - DNA, 20 bp, mouse
gtgtcccagtgacacacccc

SEQ ID NO: 704012 - DNA, 20 bp, mouse
ggaagccccatcagccccag

SEQ ID NO: 704013 - DNA, 20 bp, mouse
ggggtggagaaaaaaagagt

SEQ ID NO: 704014 - DNA, 20 bp, mouse
ggtaggggcagcaaggcagt

SEQ ID NO: 704015 - DNA, 20 bp, mouse
gggtgccaggggtgtgtcac

SEQ ID NO: 704016 - DNA, 20 bp, mouse
gcctaggaggcacggaggta

SEQ ID NO: 704017 - DNA, 20 bp, mouse
gcggacctcaagctcctagg

SEQ ID NO: 704018 - DNA, 20 bp, mouse
gcgcagagggtgcgatccta

SEQ ID NO: 704019 - DNA, 20 bp, mouse
gcgagcggcgggctctgggg

SEQ ID NO: 704020 - DNA, 20 bp, mouse
gctacggacctcaagctcct

SEQ ID NO: 704021 - DNA, 20 bp, mouse
gcagcggaagcaaccagatg

SEQ ID NO: 704022 - DNA, 20 bp, mouse
gtaggtggctagagcgtcgc

SEQ ID NO: 704023 - DNA, 20 bp, mouse
gacgctctagccacctaggc

SEQ ID NO: 704024 - DNA, 20 bp, mouse
gcgggcattagggacactta

SEQ ID NO: 704025 - DNA, 20 bp, mouse
gaagctcctaggaggcacgg

SEQ ID NO: 704026 - DNA, 20 bp, mouse
gtgactctgtgatgcagggt

SEQ ID NO: 704027 - DNA, 20 bp, mouse
gtggctgggtctgagactgt

SEQ ID NO: 704028 - DNA, 20 bp, mouse
gtctcaggaccggaggtgta

SEQ ID NO: 704029 - DNA, 20 bp, mouse
gctcctgtaggtctcaggac

SEQ ID NO: 704030 - DNA, 20 bp, mouse
gtcccaagggccgctgtgac

SEQ ID NO: 704031 - DNA, 20 bp, mouse
gcgctctcgctcccgaggct

SEQ ID NO: 704032 - DNA, 20 bp, mouse
gtgagtaccgggcggagcag

SEQ ID NO: 704033 - DNA, 20 bp, mouse
gggaaagcaagacctcctgt

SEQ ID NO: 704034 - DNA, 20 bp, mouse
gagagcggttccggtcacag

SEQ ID NO: 704035 - DNA, 20 bp, mouse
gcgcctcctgcgagtcccaa

SEQ ID NO: 704036 - DNA, 20 bp, mouse
gcctgcgccgcctgcccaag

SEQ ID NO: 704037 - DNA, 20 bp, mouse
ggcggcgcaggggagaggac

SEQ ID NO: 704038 - DNA, 20 bp, mouse
ggcaccctctattcccttct

SEQ ID NO: 704039 - DNA, 20 bp, mouse
gccagcccagaagggaatag

SEQ ID NO: 704040 - DNA, 20 bp, mouse
ggagacaaatagtccttgtt

SEQ ID NO: 704041 - DNA, 20 bp, mouse
ggtcctactgccagcccaga

SEQ ID NO: 704042 - DNA, 20 bp, mouse
ggagcctgggctctggagaa

SEQ ID NO: 704043 - DNA, 20 bp, mouse
gggtctgggcaagtaagtag

SEQ ID NO: 704044 - DNA, 20 bp, mouse
gccgtggcgcccattggctc

SEQ ID NO: 704045 - DNA, 20 bp, mouse
gtccttgttaggccggaggc

SEQ ID NO: 704046 - DNA, 20 bp, mouse
gtgtcagggctccacccccc

SEQ ID NO: 704047 - DNA, 20 bp, mouse
gtccccttcctgtatcacca

SEQ ID NO: 704048 - DNA, 20 bp, mouse
gttgaagaagaaagtatttc

SEQ ID NO: 704049 - DNA, 20 bp, mouse
gccttcctgtatcaccaggg

SEQ ID NO: 704050 - DNA, 20 bp, mouse
gtcctgtatcaccagggggg

SEQ ID NO: 704051 - DNA, 20 bp, mouse
gagaaatgagacctcctcca

SEQ ID NO: 704052 - DNA, 20 bp, mouse
ggaagcttacctactggctc

SEQ ID NO: 704053 - DNA, 20 bp, mouse
gcctcctccaaggctcagaa

SEQ ID NO: 704054 - DNA, 20 bp, mouse
gatacaggaaggggagagga

SEQ ID NO: 704055 - DNA, 20 bp, mouse
gttacctactggctcaggtg

SEQ ID NO: 704056 - DNA, 20 bp, mouse
ggggcctggcggctcagagg

SEQ ID NO: 704057 - DNA, 20 bp, mouse
ggtagaggtgggaagtacgg

SEQ ID NO: 704058 - DNA, 20 bp, mouse
gcccgcccccggtgtgagat

SEQ ID NO: 704059 - DNA, 20 bp, mouse
gagaagcgaaaaccgaggca

SEQ ID NO: 704060 - DNA, 20 bp, mouse
ggggccagacaggcgagtag

SEQ ID NO: 704061 - DNA, 20 bp, mouse
gtaaagatgccaataccaac

SEQ ID NO: 704062 - DNA, 20 bp, mouse
gcagacaggcgagtagaggt

SEQ ID NO: 704063 - DNA, 20 bp, mouse
ggctgggtcctgtcggtcac

SEQ ID NO: 704064 - DNA, 20 bp, mouse
gagctggagggcaaactgga

SEQ ID NO: 704065 - DNA, 20 bp, mouse
ggtcccccatctcacaccgg

SEQ ID NO: 704066 - DNA, 20 bp, mouse
ggactggtaaaggggcaggg

SEQ ID NO: 704067 - DNA, 20 bp, mouse
gcttggaccggcgggacaaa

SEQ ID NO: 704068 - DNA, 20 bp, mouse
ggcggactggtaaaggggca

SEQ ID NO: 704069 - DNA, 20 bp, mouse
gctaggcgatctttccccag

SEQ ID NO: 704070 - DNA, 20 bp, mouse
gtgtggggcaagttgatcca

SEQ ID NO: 704071 - DNA, 20 bp, mouse
ggatccaaggagccgggcgg

SEQ ID NO: 704072 - DNA, 20 bp, mouse
ggggcattgatcagtctctc

SEQ ID NO: 704073 - DNA, 20 bp, mouse
gcgatctttccccagcggac

SEQ ID NO: 704074 - DNA, 20 bp, mouse
gggtgctgagaaaagtttgt

SEQ ID NO: 704075 - DNA, 20 bp, mouse
gggaccggcgggacaaaggg

SEQ ID NO: 704076 - DNA, 20 bp, mouse
ggtcaacaacggtcaaaaga

SEQ ID NO: 704077 - DNA, 20 bp, mouse
gccgctgttgtgttgagctg

SEQ ID NO: 704078 - DNA, 20 bp, mouse
gatgatccatcaggtgaggt

SEQ ID NO: 704079 - DNA, 20 bp, mouse
gactgtggcgcccggggagg

SEQ ID NO: 704080 - DNA, 20 bp, mouse
gcctgaggaagaagagcggg

SEQ ID NO: 704081 - DNA, 20 bp, mouse
ggggaatgctcggctagagt

SEQ ID NO: 704082 - DNA, 20 bp, mouse
gtaagatgatccatcaggtg

SEQ ID NO: 704083 - DNA, 20 bp, mouse
gctagccgagcattcccagt

SEQ ID NO: 704084 - DNA, 20 bp, mouse
gttagaaaacgggaagtgaa

SEQ ID NO: 704085 - DNA, 20 bp, mouse
ggcgactgtggcgcccgggg

SEQ ID NO: 704086 - DNA, 20 bp, mouse
gagggcggaaatgaggggtg

SEQ ID NO: 704087 - DNA, 20 bp, mouse
gcatcgagggcggaaatgag

SEQ ID NO: 704088 - DNA, 20 bp, mouse
gcctggacggcaaccctgga

SEQ ID NO: 704089 - DNA, 20 bp, mouse
gcgcagtgcgcttccatcga

SEQ ID NO: 704090 - DNA, 20 bp, mouse
gcagcccgccggtaaccgga

SEQ ID NO: 704091 - DNA, 20 bp, mouse
ggacgccatccggttaccgg

SEQ ID NO: 704092 - DNA, 20 bp, mouse
gagtgcgcttccatcgaggg

SEQ ID NO: 704093 - DNA, 20 bp, mouse
ggggctgtcaggtcttaaag

SEQ ID NO: 704094 - DNA, 20 bp, mouse
gaactggagctgcccgacca

SEQ ID NO: 704095 - DNA, 20 bp, mouse
gaacagtggctctgagtgga

SEQ ID NO: 704096 - DNA, 20 bp, mouse
gcaacgcggcagctgacagc

SEQ ID NO: 704097 - DNA, 20 bp, mouse
ggggatgggagcgcattaag

SEQ ID NO: 704098 - DNA, 20 bp, mouse
gcgcggcagctgacagctgg

SEQ ID NO: 704099 - DNA, 20 bp, mouse
gggcggggccgtcgtagcgg

SEQ ID NO: 704100 - DNA, 20 bp, mouse
ggaccccgcccccgctacga

SEQ ID NO: 704101 - DNA, 20 bp, mouse
gtggaccccgctctgcaggt

SEQ ID NO: 704102 - DNA, 20 bp, mouse
gtgttgccctggctgtgtga

SEQ ID NO: 704103 - DNA, 20 bp, mouse
gtctccagcgcaagccaacg

SEQ ID NO: 704104 - DNA, 20 bp, mouse
gtgcgctggagagctaagtt

SEQ ID NO: 704105 - DNA, 20 bp, mouse
gctgccgcgttggcttgcgc

SEQ ID NO: 704106 - DNA, 20 bp, mouse
gctgagagggatcagaggaa

SEQ ID NO: 704107 - DNA, 20 bp, mouse
ggctgtactcagccacatca

SEQ ID NO: 704108 - DNA, 20 bp, mouse
gagggatcagaggaaaggta

SEQ ID NO: 704109 - DNA, 20 bp, mouse
gcagcgaaaggtggtggcca

SEQ ID NO: 704110 - DNA, 20 bp, mouse
gtatggatgggtcttcaact

SEQ ID NO: 704111 - DNA, 20 bp, mouse
gaaagactgagagggatcag

SEQ ID NO: 704112 - DNA, 20 bp, mouse
gttgctgcttacccagcgaa

SEQ ID NO: 704113 - DNA, 20 bp, mouse
gaggcaacagctgtcaaccg

SEQ ID NO: 704114 - DNA, 20 bp, mouse
gctgcttacccagcgaaagg

SEQ ID NO: 704115 - DNA, 20 bp, mouse
ggggggcgggacagcctgaa

SEQ ID NO: 704116 - DNA, 20 bp, mouse
gcacctgcgcaaaataaagt

SEQ ID NO: 704117 - DNA, 20 bp, mouse
gcgcgtaaggcatctttagg

SEQ ID NO: 704118 - DNA, 20 bp, mouse
gtaaacagttgaccactcct

SEQ ID NO: 704119 - DNA, 20 bp, mouse
gtctcagttacctcggataa

SEQ ID NO: 704120 - DNA, 20 bp, mouse
ggagcattttccccgacccc

SEQ ID NO: 704121 - DNA, 20 bp, mouse
ggttctctcttgtccctaat

SEQ ID NO: 704122 - DNA, 20 bp, mouse
gataaagttcccgggagaag

SEQ ID NO: 704123 - DNA, 20 bp, mouse
gccaagagatgatgaaaagt

SEQ ID NO: 704124 - DNA, 20 bp, mouse
ggaaaagtaggtaaaggagc

SEQ ID NO: 704125 - DNA, 20 bp, mouse
ggcgcgcgtaaggcatcttt

SEQ ID NO: 704126 - DNA, 20 bp, mouse
ggtctgagtgacaagggagt

SEQ ID NO: 704127 - DNA, 20 bp, mouse
ggggctgggccttacgggaa

SEQ ID NO: 704128 - DNA, 20 bp, mouse
gccgcccagactctcaggtc

SEQ ID NO: 704129 - DNA, 20 bp, mouse
gtggctccgcccagactctc

SEQ ID NO: 704130 - DNA, 20 bp, mouse
gaggccggacctgagagtct

SEQ ID NO: 704131 - DNA, 20 bp, mouse
ggcgggctctgagcctcggt

SEQ ID NO: 704132 - DNA, 20 bp, mouse
ggcggggcctgcctccacat

SEQ ID NO: 704133 - DNA, 20 bp, mouse
gagcctcggtgggaggagaa

SEQ ID NO: 704134 - DNA, 20 bp, mouse
ggtcccgcccctttcccgta

SEQ ID NO: 704135 - DNA, 20 bp, mouse
gggagtgggctgggccttac

SEQ ID NO: 704136 - DNA, 20 bp, mouse
gaggcccggcacggaggctg

SEQ ID NO: 704137 - DNA, 20 bp, mouse
gtgcgcgcctcgctgacggg

SEQ ID NO: 704138 - DNA, 20 bp, mouse
gctcccccgcgcagccgcac

SEQ ID NO: 704139 - DNA, 20 bp, mouse
gggaccccgcgcatccgggg

SEQ ID NO: 704140 - DNA, 20 bp, mouse
gcccgcgaggcccggcacgg

SEQ ID NO: 704141 - DNA, 20 bp, mouse
gggtgtgcgcgcctcgctga

SEQ ID NO: 704142 - DNA, 20 bp, mouse
gcggccgagctcgtcccgcg

SEQ ID NO: 704143 - DNA, 20 bp, mouse
gtgtgtgcggacaaagacgg

SEQ ID NO: 704144 - DNA, 20 bp, mouse
gaagcgcggcgggaagactc

SEQ ID NO: 704145 - DNA, 20 bp, mouse
gcgcccgggcgcagtcctcg

SEQ ID NO: 704146 - DNA, 20 bp, mouse
gacgtggaatgagatgccga

SEQ ID NO: 704147 - DNA, 20 bp, mouse
ggggttggagcgcaccccca

SEQ ID NO: 704148 - DNA, 20 bp, mouse
ggaaggcgaggtgcaggacg

SEQ ID NO: 704149 - DNA, 20 bp, mouse
gcacccccacggcggtgaca

SEQ ID NO: 704150 - DNA, 20 bp, mouse
ggagatgccgagggatgatg

SEQ ID NO: 704151 - DNA, 20 bp, mouse
gccccacggcggtgacacgg

SEQ ID NO: 704152 - DNA, 20 bp, mouse
gtccaccgtgtcaccgccgt

SEQ ID NO: 704153 - DNA, 20 bp, mouse
gtagatgaagaattgaagga

SEQ ID NO: 704154 - DNA, 20 bp, mouse
gctcccccgccggcgagcag

SEQ ID NO: 704155 - DNA, 20 bp, mouse
ggggccgcggagcacgcgat

SEQ ID NO: 704156 - DNA, 20 bp, mouse
ggcctggcgtcacgaggccc

SEQ ID NO: 704157 - DNA, 20 bp, mouse
ggacgcgtgccgtgacgcga

SEQ ID NO: 704158 - DNA, 20 bp, mouse
gggctcctccccgcccagtg

SEQ ID NO: 704159 - DNA, 20 bp, mouse
gcgggcggtgacgtcatcct

SEQ ID NO: 704160 - DNA, 20 bp, mouse
gtctggagtgaacttcacta

SEQ ID NO: 704161 - DNA, 20 bp, mouse
ggtgacgcgagggctccgca

SEQ ID NO: 704162 - DNA, 20 bp, mouse
gaacttcactaaggccctat

SEQ ID NO: 704163 - DNA, 20 bp, mouse
gcccgcggcctggcgtcacg

SEQ ID NO: 704164 - DNA, 20 bp, mouse
gacgtcatcctcggaggcga

SEQ ID NO: 704165 - DNA, 20 bp, mouse
gccgcaaggctgcgtgtcgt

SEQ ID NO: 704166 - DNA, 20 bp, mouse
gtgaaagcagcccagagcaa

SEQ ID NO: 704167 - DNA, 20 bp, mouse
ggagctctaactttcaggaa

SEQ ID NO: 704168 - DNA, 20 bp, mouse
gactccttcccctttgctct

SEQ ID NO: 704169 - DNA, 20 bp, mouse
ggaactaaggtctgagttat

SEQ ID NO: 704170 - DNA, 20 bp, mouse
ggtactgcatgtcccatcgc

SEQ ID NO: 704171 - DNA, 20 bp, mouse
gaatccactggttgtagacc

SEQ ID NO: 704172 - DNA, 20 bp, mouse
gaaccagtggattccaagac

SEQ ID NO: 704173 - DNA, 20 bp, mouse
gtcctgctgtcttgaataca

SEQ ID NO: 704174 - DNA, 20 bp, mouse
gacaatgggtagggtggttt

SEQ ID NO: 704175 - DNA, 20 bp, mouse
gtgaatacatggcctgcgat

SEQ ID NO: 704176 - DNA, 20 bp, mouse
ggacccttgcggcgtgagtg

SEQ ID NO: 704177 - DNA, 20 bp, mouse
ggcccacactcacgccgcaa

SEQ ID NO: 704178 - DNA, 20 bp, mouse
gaagagggcggggcgcaggt

SEQ ID NO: 704179 - DNA, 20 bp, mouse
ggagagcttggcgacccttg

SEQ ID NO: 704180 - DNA, 20 bp, mouse
gctagtgtcacgtaagttca

SEQ ID NO: 704181 - DNA, 20 bp, mouse
ggcagctagcgggtgcatgt

SEQ ID NO: 704182 - DNA, 20 bp, mouse
ggtcacgtaagttcaaggaa

SEQ ID NO: 704183 - DNA, 20 bp, mouse
gggcacaggcaggtgggcgc

SEQ ID NO: 704184 - DNA, 20 bp, mouse
ggccgcggggtgcagctagc

SEQ ID NO: 704185 - DNA, 20 bp, mouse
gggctctgtgcggtactcag

SEQ ID NO: 704186 - DNA, 20 bp, mouse
gtgcgcagcgccccagcccg

SEQ ID NO: 704187 - DNA, 20 bp, mouse
ggacctggggactgccctcg

SEQ ID NO: 704188 - DNA, 20 bp, mouse
gcccctgcgctagcgagtat

SEQ ID NO: 704189 - DNA, 20 bp, mouse
ggcgatgtccacacactctc

SEQ ID NO: 704190 - DNA, 20 bp, mouse
gcgaccccacagttgctttt

SEQ ID NO: 704191 - DNA, 20 bp, mouse
ggggaggaggaccggggtgc

SEQ ID NO: 704192 - DNA, 20 bp, mouse
gtccacacactctccgggct

SEQ ID NO: 704193 - DNA, 20 bp, mouse
ggtgcgcctcgcaggagccg

SEQ ID NO: 704194 - DNA, 20 bp, mouse
gaagtcccgcgatacttggc

SEQ ID NO: 704195 - DNA, 20 bp, mouse
ggcaactgggctttgtgccg

SEQ ID NO: 704196 - DNA, 20 bp, mouse
gagcggggcgggagcgaacc

SEQ ID NO: 704197 - DNA, 20 bp, mouse
gcgaaccgggctctgagcgg

SEQ ID NO: 704198 - DNA, 20 bp, mouse
ggtggagcaccctgcggttg

SEQ ID NO: 704199 - DNA, 20 bp, mouse
gactgactccgagggagagc

SEQ ID NO: 704200 - DNA, 20 bp, mouse
gacagacagactgactccga

SEQ ID NO: 704201 - DNA, 20 bp, mouse
gcagggtgctccacggtcgg

SEQ ID NO: 704202 - DNA, 20 bp, mouse
gggtcccagagctgcatcca

SEQ ID NO: 704203 - DNA, 20 bp, mouse
gccaaggtccctcaaccgca

SEQ ID NO: 704204 - DNA, 20 bp, mouse
ggcagctctgggaccatcct

SEQ ID NO: 704205 - DNA, 20 bp, mouse
gccgcagggtgctccacggt

SEQ ID NO: 704206 - DNA, 20 bp, mouse
gaggaaggagaattcccttc

SEQ ID NO: 704207 - DNA, 20 bp, mouse
gggaggttgctgttttggat

SEQ ID NO: 704208 - DNA, 20 bp, mouse
ggaggatgcctccctatgaa

SEQ ID NO: 704209 - DNA, 20 bp, mouse
gtctccccacccagaagagc

SEQ ID NO: 704210 - DNA, 20 bp, mouse
ggtgctcaagtctgaactcc

SEQ ID NO: 704211 - DNA, 20 bp, mouse
gctcttggggtgacgctgtg

SEQ ID NO: 704212 - DNA, 20 bp, mouse
gggagattgaaggtgctgac

SEQ ID NO: 704213 - DNA, 20 bp, mouse
ggcagcctgtccaaaccaga

SEQ ID NO: 704214 - DNA, 20 bp, mouse
ggacttgagcaccattcata

SEQ ID NO: 704215 - DNA, 20 bp, mouse
gtggcccagggaacagttgg

SEQ ID NO: 704216 - DNA, 20 bp, mouse
gggtctcagcgagacagacg

SEQ ID NO: 704217 - DNA, 20 bp, mouse
gagacagacgcggggtggaa

SEQ ID NO: 704218 - DNA, 20 bp, mouse
ggggtgtgataggaagagac

SEQ ID NO: 704219 - DNA, 20 bp, mouse
gtcggcggtgggttaggtgt

SEQ ID NO: 704220 - DNA, 20 bp, mouse
gggcccgcgccacttcccag

SEQ ID NO: 704221 - DNA, 20 bp, mouse
gcagacgccgcgggcagccg

SEQ ID NO: 704222 - DNA, 20 bp, mouse
ggggccttcctcccgcatcc

SEQ ID NO: 704223 - DNA, 20 bp, mouse
gtcgctgagacccgggatgc

SEQ ID NO: 704224 - DNA, 20 bp, mouse
ggaagggcattaggaccgtg

SEQ ID NO: 704225 - DNA, 20 bp, mouse
gctcggggctgaagggcatt

SEQ ID NO: 704226 - DNA, 20 bp, mouse
ggcgccctcgggccacccta

SEQ ID NO: 704227 - DNA, 20 bp, mouse
gccccctggcccctcctcgt

SEQ ID NO: 704228 - DNA, 20 bp, mouse
ggctgcggaccaacgaggag

SEQ ID NO: 704229 - DNA, 20 bp, mouse
ggcgctctggctctggaaaa

SEQ ID NO: 704230 - DNA, 20 bp, mouse
ggaaaagggtcgggactggg

SEQ ID NO: 704231 - DNA, 20 bp, mouse
gcgggagactcagctgtgtc

SEQ ID NO: 704232 - DNA, 20 bp, mouse
gcggggaattactctagagg

SEQ ID NO: 704233 - DNA, 20 bp, mouse
gaggccctagggtggcccga

SEQ ID NO: 704234 - DNA, 20 bp, mouse
ggggcggctgcggaccaacg

SEQ ID NO: 704235 - DNA, 20 bp, mouse
ggagcggggaattactctag

SEQ ID NO: 704236 - DNA, 20 bp, mouse
gggcggggtcagggagcaaa

SEQ ID NO: 704237 - DNA, 20 bp, mouse
gcgcccccgggagtggcagg

SEQ ID NO: 704238 - DNA, 20 bp, mouse
ggcgcgcccccgggagtggc

SEQ ID NO: 704239 - DNA, 20 bp, mouse
ggggctggatggtgagttcg

SEQ ID NO: 704240 - DNA, 20 bp, mouse
gcggcccagcggcggggtca

SEQ ID NO: 704241 - DNA, 20 bp, mouse
gcggggcgatctctgcagac

SEQ ID NO: 704242 - DNA, 20 bp, mouse
gctccacctgccactcccgg

SEQ ID NO: 704243 - DNA, 20 bp, mouse
gcgccgctgccatggagact

SEQ ID NO: 704244 - DNA, 20 bp, mouse
gaccaatcgacgctgagggg

SEQ ID NO: 704245 - DNA, 20 bp, mouse
ggcgaccaatcgacgctgag

SEQ ID NO: 704246 - DNA, 20 bp, mouse
ggcaggctcggcactgcgga

SEQ ID NO: 704247 - DNA, 20 bp, mouse
gaggaaccgcgtggggttag

SEQ ID NO: 704248 - DNA, 20 bp, mouse
gagaggaagaggaaccgcgt

SEQ ID NO: 704249 - DNA, 20 bp, mouse
gacgtcggcaggggcgaggc

SEQ ID NO: 704250 - DNA, 20 bp, mouse
gcggtctcccaggggtcccg

SEQ ID NO: 704251 - DNA, 20 bp, mouse
gcctgcgctgccccgcgccg

SEQ ID NO: 704252 - DNA, 20 bp, mouse
gcggcactgcggagggctgg

SEQ ID NO: 704253 - DNA, 20 bp, mouse
gggcggcggaggagtttgct

SEQ ID NO: 704254 - DNA, 20 bp, mouse
ggagcgctcaggtaggaccg

SEQ ID NO: 704255 - DNA, 20 bp, mouse
gaagcagcacggtctcccag

SEQ ID NO: 704256 - DNA, 20 bp, mouse
gaggcgcgatgggatgtacc

SEQ ID NO: 704257 - DNA, 20 bp, mouse
gtgagtgagccaggcgcgat

SEQ ID NO: 704258 - DNA, 20 bp, mouse
ggggatgtacccggccactc

SEQ ID NO: 704259 - DNA, 20 bp, mouse
gaaccaccaggaggagtgag

SEQ ID NO: 704260 - DNA, 20 bp, mouse
gcgcctggctcactcaggca

SEQ ID NO: 704261 - DNA, 20 bp, mouse
gtgctgggtaaggactcgac

SEQ ID NO: 704262 - DNA, 20 bp, mouse
gaggcgtgggcattacaacc

SEQ ID NO: 704263 - DNA, 20 bp, mouse
gcatcagcgggcagcgagag

SEQ ID NO: 704264 - DNA, 20 bp, mouse
gttcacgaaagttgtctgtc

SEQ ID NO: 704265 - DNA, 20 bp, mouse
ggggtcctcctcttcgatcc

SEQ ID NO: 704266 - DNA, 20 bp, mouse
gttacagcatgcagcgaact

SEQ ID NO: 704267 - DNA, 20 bp, mouse
ggggttaatgtgtaagagtg

SEQ ID NO: 704268 - DNA, 20 bp, mouse
gtgagagagtatgtgtttta

SEQ ID NO: 704269 - DNA, 20 bp, mouse
gaggttaatggcttaaaaaa

SEQ ID NO: 704270 - DNA, 20 bp, mouse
gagagctgaaggaagtttgc

SEQ ID NO: 704271 - DNA, 20 bp, mouse
gctctctcacatagcacaga

SEQ ID NO: 704272 - DNA, 20 bp, mouse
ggggtgtttagctattttgg

SEQ ID NO: 704273 - DNA, 20 bp, mouse
gtgctgggtaatggcttgaa

SEQ ID NO: 704274 - DNA, 20 bp, mouse
gatagctaaacacccctctc

SEQ ID NO: 704275 - DNA, 20 bp, mouse
gagggtttccacattgaatt

SEQ ID NO: 704276 - DNA, 20 bp, mouse
ggggtggcggtgccctgggg

SEQ ID NO: 704277 - DNA, 20 bp, mouse
gaccgtgcacccaacgtgag

SEQ ID NO: 704278 - DNA, 20 bp, mouse
gtgagcggcctcgcatgccg

SEQ ID NO: 704279 - DNA, 20 bp, mouse
gacatggggtggcggtgccc

SEQ ID NO: 704280 - DNA, 20 bp, mouse
ggggtggcggtgacatgggg

SEQ ID NO: 704281 - DNA, 20 bp, mouse
gacgttgggtgcacggtccg

SEQ ID NO: 704282 - DNA, 20 bp, mouse
gagccccgaggctctgtccc

SEQ ID NO: 704283 - DNA, 20 bp, mouse
gaggtggcttggagtggcga

SEQ ID NO: 704284 - DNA, 20 bp, mouse
gtccagggcgggtcctgtcg

SEQ ID NO: 704285 - DNA, 20 bp, mouse
gcatgcgaggccgctcacgt

SEQ ID NO: 704286 - DNA, 20 bp, mouse
ggtaaagccgaggggagttc

SEQ ID NO: 704287 - DNA, 20 bp, mouse
gccaggggaaggtaaagccg

SEQ ID NO: 704288 - DNA, 20 bp, mouse
ggtgcggcagagcagtgcag

SEQ ID NO: 704289 - DNA, 20 bp, mouse
gccgaggggagttccggatc

SEQ ID NO: 704290 - DNA, 20 bp, mouse
gggcgggcgtagtgatccgg

SEQ ID NO: 704291 - DNA, 20 bp, mouse
gcagtgcagaggcaggcgcg

SEQ ID NO: 704292 - DNA, 20 bp, mouse
gctggagagggcaggcggtg

SEQ ID NO: 704293 - DNA, 20 bp, mouse
gctgccgcccggtgcccctc

SEQ ID NO: 704294 - DNA, 20 bp, mouse
gccggccggtcggagctctg

SEQ ID NO: 704295 - DNA, 20 bp, mouse
ggggtactgcggagctagag

SEQ ID NO: 704296 - DNA, 20 bp, mouse
gcctgggcctcgctccacgt

SEQ ID NO: 704297 - DNA, 20 bp, mouse
gcggagggcggtctgaagct

SEQ ID NO: 704298 - DNA, 20 bp, mouse
ggtggcgcgcgggatcggtt

SEQ ID NO: 704299 - DNA, 20 bp, mouse
gaaaataagcccaggcgcgg

SEQ ID NO: 704300 - DNA, 20 bp, mouse
gcaggggtggcgcgcgggat

SEQ ID NO: 704301 - DNA, 20 bp, mouse
ggtgggcaggcaaatctagg

SEQ ID NO: 704302 - DNA, 20 bp, mouse
gtcctgaccggcgttcccta

SEQ ID NO: 704303 - DNA, 20 bp, mouse
ggcgcgggatcggtttgggg

SEQ ID NO: 704304 - DNA, 20 bp, mouse
gccgcgcgccacccctggcc

SEQ ID NO: 704305 - DNA, 20 bp, mouse
ggctccacgtgggcctatcc

SEQ ID NO: 704306 - DNA, 20 bp, mouse
ggagtcaaggtcaaaaccca

SEQ ID NO: 704307 - DNA, 20 bp, mouse
gcaggaagctagaacccaaa

SEQ ID NO: 704308 - DNA, 20 bp, mouse
gggccaagcctgcataccct

SEQ ID NO: 704309 - DNA, 20 bp, mouse
gaactgaaatatgagaccaa

SEQ ID NO: 704310 - DNA, 20 bp, mouse
ggaaagtctcatgagagtca

SEQ ID NO: 704311 - DNA, 20 bp, mouse
ggtcaaaacccagggtatgc

SEQ ID NO: 704312 - DNA, 20 bp, mouse
gtgtcattcctcctcagcta

SEQ ID NO: 704313 - DNA, 20 bp, mouse
gacatcacacaaggcactgt

SEQ ID NO: 704314 - DNA, 20 bp, mouse
gtccagacagaggcctctgt

SEQ ID NO: 704315 - DNA, 20 bp, mouse
gtcctcttactctcacagaa

SEQ ID NO: 704316 - DNA, 20 bp, mouse
gacctcccacactaagggcg

SEQ ID NO: 704317 - DNA, 20 bp, mouse
gcccggacctcccacactaa

SEQ ID NO: 704318 - DNA, 20 bp, mouse
gcatcccccgcccttagtgt

SEQ ID NO: 704319 - DNA, 20 bp, mouse
ggaggtccgggatgtagagt

SEQ ID NO: 704320 - DNA, 20 bp, mouse
gagaataatggtaagttatg

SEQ ID NO: 704321 - DNA, 20 bp, mouse
ggctagatctatcagtaaat

SEQ ID NO: 704322 - DNA, 20 bp, mouse
gcgatcgtttcatagaataa

SEQ ID NO: 704323 - DNA, 20 bp, mouse
gtgacgacggcattatctat

SEQ ID NO: 704324 - DNA, 20 bp, mouse
gaagctgttcggggaagata

SEQ ID NO: 704325 - DNA, 20 bp, mouse
gccgtcgtcatagttttctg

SEQ ID NO: 704326 - DNA, 20 bp, mouse
gaacacaaggggatctgaga

SEQ ID NO: 704327 - DNA, 20 bp, mouse
gggacctacgtggctgaagg

SEQ ID NO: 704328 - DNA, 20 bp, mouse
gcattaggtaaggtacttga

SEQ ID NO: 704329 - DNA, 20 bp, mouse
gtcaactccagtttcagcag

SEQ ID NO: 704330 - DNA, 20 bp, mouse
gtttcctccttcagccacgt

SEQ ID NO: 704331 - DNA, 20 bp, mouse
gagaagacacaggtcaaact

SEQ ID NO: 704332 - DNA, 20 bp, mouse
ggagaataacttgtgagtat

SEQ ID NO: 704333 - DNA, 20 bp, mouse
gaggagccatttttagaatg

SEQ ID NO: 704334 - DNA, 20 bp, mouse
gagtcatcctctgctgaaac

SEQ ID NO: 704335 - DNA, 20 bp, mouse
gcatagggtatctgtagcct

SEQ ID NO: 704336 - DNA, 20 bp, mouse
ggtgaacagcgtgcgtgcgt

SEQ ID NO: 704337 - DNA, 20 bp, mouse
gctcgtccagtcacaagcta

SEQ ID NO: 704338 - DNA, 20 bp, mouse
gcttgtgactggacgaggga

SEQ ID NO: 704339 - DNA, 20 bp, mouse
gcacgcacgctgttcacctc

SEQ ID NO: 704340 - DNA, 20 bp, mouse
gacgctggtaaagaaaactc

SEQ ID NO: 704341 - DNA, 20 bp, mouse
gagaagcagtggctcatagt

SEQ ID NO: 704342 - DNA, 20 bp, mouse
gtcagatgagtaatgtctgg

SEQ ID NO: 704343 - DNA, 20 bp, mouse
gagggagcgggaaaaaccaa

SEQ ID NO: 704344 - DNA, 20 bp, mouse
gagagaatatcacagaatcc

SEQ ID NO: 704345 - DNA, 20 bp, mouse
gaagggttggtactgctacc

SEQ ID NO: 704346 - DNA, 20 bp, mouse
gctaaagcagagcgggtccc

SEQ ID NO: 704347 - DNA, 20 bp, mouse
gcatcccattcttggaatga

SEQ ID NO: 704348 - DNA, 20 bp, mouse
gggtcccaggacttgagcgc

SEQ ID NO: 704349 - DNA, 20 bp, mouse
gtgggagaggcctagaaata

SEQ ID NO: 704350 - DNA, 20 bp, mouse
gagggtgcgtgtgggacatg

SEQ ID NO: 704351 - DNA, 20 bp, mouse
gtgaggggtgaccaaccaca

SEQ ID NO: 704352 - DNA, 20 bp, mouse
gaatgcaaaagggtgagtct

SEQ ID NO: 704353 - DNA, 20 bp, mouse
gcgggagccaaatggagtca

SEQ ID NO: 704354 - DNA, 20 bp, mouse
gtgggggaagggggcgttga

SEQ ID NO: 704355 - DNA, 20 bp, mouse
ggctcccgcgctcaagtcct

SEQ ID NO: 704356 - DNA, 20 bp, mouse
gcagagaagtagctacaatc

SEQ ID NO: 704357 - DNA, 20 bp, mouse
gccgccacgctcacttcccc

SEQ ID NO: 704358 - DNA, 20 bp, mouse
gggcacagcctgccacttga

SEQ ID NO: 704359 - DNA, 20 bp, mouse
gcgccaacacgtgacggtgg

SEQ ID NO: 704360 - DNA, 20 bp, mouse
gtgcccccaccgtcacgtgt

SEQ ID NO: 704361 - DNA, 20 bp, mouse
gggagagcatctgtgaaaac

SEQ ID NO: 704362 - DNA, 20 bp, mouse
gcaacctggggaagtgagcg

SEQ ID NO: 704363 - DNA, 20 bp, mouse
ggcgactagccaatcatcca

SEQ ID NO: 704364 - DNA, 20 bp, mouse
gacagcctgccacttgaggg

SEQ ID NO: 704365 - DNA, 20 bp, mouse
gaagcaacccgaatccgtgg

SEQ ID NO: 704366 - DNA, 20 bp, mouse
ggggtccagtcattagaaga

SEQ ID NO: 704367 - DNA, 20 bp, mouse
gcgagtaggccccgcccaca

SEQ ID NO: 704368 - DNA, 20 bp, mouse
ggggcctactcgctggggcg

SEQ ID NO: 704369 - DNA, 20 bp, mouse
gcacggtcggggctactcgc

SEQ ID NO: 704370 - DNA, 20 bp, mouse
gaagccccgccccagcgagt

SEQ ID NO: 704371 - DNA, 20 bp, mouse
ggggcggggcctactcgctg

SEQ ID NO: 704372 - DNA, 20 bp, mouse
gtgcgccctaaagaactccg

SEQ ID NO: 704373 - DNA, 20 bp, mouse
gtcagccacggagttcttta

SEQ ID NO: 704374 - DNA, 20 bp, mouse
gtggagcgtgctcacggtcg

SEQ ID NO: 704375 - DNA, 20 bp, mouse
gaggggcggatctacggaat

SEQ ID NO: 704376 - DNA, 20 bp, mouse
gcgcaccaagcacagcccgt

SEQ ID NO: 704377 - DNA, 20 bp, mouse
ggcagcccagcccttctgat

SEQ ID NO: 704378 - DNA, 20 bp, mouse
ggcagccaatcagaagggct

SEQ ID NO: 704379 - DNA, 20 bp, mouse
gcgagtgctctcagtgtgga

SEQ ID NO: 704380 - DNA, 20 bp, mouse
gtggctgctgcgaggtaggg

SEQ ID NO: 704381 - DNA, 20 bp, mouse
gtaggggtaaggtgttccga

SEQ ID NO: 704382 - DNA, 20 bp, mouse
gcgcgcccacgggctgtgct

SEQ ID NO: 704383 - DNA, 20 bp, mouse
ggaagggtttagcggttccg

SEQ ID NO: 704384 - DNA, 20 bp, mouse
ggaaaggaataataagtcct

SEQ ID NO: 704385 - DNA, 20 bp, mouse
gcgtgcggacggcgccttta

SEQ ID NO: 704386 - DNA, 20 bp, mouse
gccccgggctctgcgttctc

SEQ ID NO: 704387 - DNA, 20 bp, mouse
gaacgtgcacaggggcgggt

SEQ ID NO: 704388 - DNA, 20 bp, mouse
ggggcgtgcctcgacgcccc

SEQ ID NO: 704389 - DNA, 20 bp, mouse
gccggaaggggcgggcacta

SEQ ID NO: 704390 - DNA, 20 bp, mouse
gggccggacgtctatcccat

SEQ ID NO: 704391 - DNA, 20 bp, mouse
gccccttccggccttccgat

SEQ ID NO: 704392 - DNA, 20 bp, mouse
gcacaggggcgggtaggttc

SEQ ID NO: 704393 - DNA, 20 bp, mouse
ggaccaatgggatagacgtc

SEQ ID NO: 704394 - DNA, 20 bp, mouse
gggctcaacgtgcacagggg

SEQ ID NO: 704395 - DNA, 20 bp, mouse
ggcctgagaacgcagagccc

SEQ ID NO: 704396 - DNA, 20 bp, mouse
ggggacgagccggaagaagg

SEQ ID NO: 704397 - DNA, 20 bp, mouse
ggaactacctagccggaaga

SEQ ID NO: 704398 - DNA, 20 bp, mouse
gagtagcgccggaagagggt

SEQ ID NO: 704399 - DNA, 20 bp, mouse
gggaagaaggctcaatactt

SEQ ID NO: 704400 - DNA, 20 bp, mouse
gggtgggacgagccggaaga

SEQ ID NO: 704401 - DNA, 20 bp, mouse
ggggccaagcgtgttcttac

SEQ ID NO: 704402 - DNA, 20 bp, mouse
gcccgcccacaaagtagcgc

SEQ ID NO: 704403 - DNA, 20 bp, mouse
gactttgggtaggcgcttca

SEQ ID NO: 704404 - DNA, 20 bp, mouse
gcacaaagtagcgccggaag

SEQ ID NO: 704405 - DNA, 20 bp, mouse
ggaaggcggaactacctagc

SEQ ID NO: 704406 - DNA, 20 bp, mouse
ggcagttagcagcaactgta

SEQ ID NO: 704407 - DNA, 20 bp, mouse
ggagagagaatgtgcgtgtg

SEQ ID NO: 704408 - DNA, 20 bp, mouse
ggagcaagcgagcagaaaag

SEQ ID NO: 704409 - DNA, 20 bp, mouse
gcagttgctgctaactgccc

SEQ ID NO: 704410 - DNA, 20 bp, mouse
gaaaggatattccagagagt

SEQ ID NO: 704411 - DNA, 20 bp, mouse
gaacatgttttagggaagtg

SEQ ID NO: 704412 - DNA, 20 bp, mouse
gtccaatctctccaactctc

SEQ ID NO: 704413 - DNA, 20 bp, mouse
gaactgccctggtgtgtgtg

SEQ ID NO: 704414 - DNA, 20 bp, mouse
ggtgcggtgagcaatagctg

SEQ ID NO: 704415 - DNA, 20 bp, mouse
gaagaggaggaagggacgag

SEQ ID NO: 704416 - DNA, 20 bp, mouse
gtgggctccgaactgatagg

SEQ ID NO: 704417 - DNA, 20 bp, mouse
gtataggaacccggatggtg

SEQ ID NO: 704418 - DNA, 20 bp, mouse
gagagaggcccagctactcg

SEQ ID NO: 704419 - DNA, 20 bp, mouse
ggccccgctcaggaggtgac

SEQ ID NO: 704420 - DNA, 20 bp, mouse
ggcaggaggccggggacagt

SEQ ID NO: 704421 - DNA, 20 bp, mouse
gggcgggtccaaagagaggg

SEQ ID NO: 704422 - DNA, 20 bp, mouse
gaggaacccggatggtgggg

SEQ ID NO: 704423 - DNA, 20 bp, mouse
ggcctctgcgcccttgagct

SEQ ID NO: 704424 - DNA, 20 bp, mouse
ggttcccaggataggactca

SEQ ID NO: 704425 - DNA, 20 bp, mouse
gtgaccgggtgatggttccc

SEQ ID NO: 704426 - DNA, 20 bp, mouse
gtgaagcaagagttggttct

SEQ ID NO: 704427 - DNA, 20 bp, mouse
gaggagcgggaggtcaggta

SEQ ID NO: 704428 - DNA, 20 bp, mouse
gctataagactcacatgagt

SEQ ID NO: 704429 - DNA, 20 bp, mouse
gcgagtgcttacagctgagt

SEQ ID NO: 704430 - DNA, 20 bp, mouse
gggacactggactgcagaag

SEQ ID NO: 704431 - DNA, 20 bp, mouse
gcaagagttggttctaggct

SEQ ID NO: 704432 - DNA, 20 bp, mouse
gggcaacattctcacgggtg

SEQ ID NO: 704433 - DNA, 20 bp, mouse
gtggttgaaaaccacaatgt

SEQ ID NO: 704434 - DNA, 20 bp, mouse
gagggctgcagtacataaaa

SEQ ID NO: 704435 - DNA, 20 bp, mouse
ggcgggaggtcaggtaggga

SEQ ID NO: 704436 - DNA, 20 bp, mouse
ggaccctccctctttgtagg

SEQ ID NO: 704437 - DNA, 20 bp, mouse
gggcaacttcctcacgaacc

SEQ ID NO: 704438 - DNA, 20 bp, mouse
ggttccacctacaaagaggg

SEQ ID NO: 704439 - DNA, 20 bp, mouse
gaaaagttccacctacaaag

SEQ ID NO: 704440 - DNA, 20 bp, mouse
ggtcctgaggcatactactc

SEQ ID NO: 704441 - DNA, 20 bp, mouse
gggtcacttacttccttctt

SEQ ID NO: 704442 - DNA, 20 bp, mouse
gtgaactagtgcccgtatgt

SEQ ID NO: 704443 - DNA, 20 bp, mouse
gtattaaatacactgaaggg

SEQ ID NO: 704444 - DNA, 20 bp, mouse
gtcagcagatatttaatttt

SEQ ID NO: 704445 - DNA, 20 bp, mouse
gaagtattaaatacactgaa

SEQ ID NO: 704446 - DNA, 20 bp, mouse
gcaggtacacggagacgtga

SEQ ID NO: 704447 - DNA, 20 bp, mouse
gtacctggtgctagagaaga

SEQ ID NO: 704448 - DNA, 20 bp, mouse
ggtacacggagacgtgaggg

SEQ ID NO: 704449 - DNA, 20 bp, mouse
gagacgtgagggcggaggat

SEQ ID NO: 704450 - DNA, 20 bp, mouse
gcgggggcccctgggatcgg

SEQ ID NO: 704451 - DNA, 20 bp, mouse
gcacggagacgtgagggcgg

SEQ ID NO: 704452 - DNA, 20 bp, mouse
gcgcacgcgcactgctgagg

SEQ ID NO: 704453 - DNA, 20 bp, mouse
gcgtacaggtcctggcaagg

SEQ ID NO: 704454 - DNA, 20 bp, mouse
gttcgcgaccgggagcggaa

SEQ ID NO: 704455 - DNA, 20 bp, mouse
gtggcaaggcggttcgcgac

SEQ ID NO: 704456 - DNA, 20 bp, mouse
ggccaccgcgctagaggtgg

SEQ ID NO: 704457 - DNA, 20 bp, mouse
gcccttgcgtggatgaggtg

SEQ ID NO: 704458 - DNA, 20 bp, mouse
ggacgctattgtttctcttc

SEQ ID NO: 704459 - DNA, 20 bp, mouse
gcctccgtacgcgacgtttc

SEQ ID NO: 704460 - DNA, 20 bp, mouse
gagggccaccgcgctagagg

SEQ ID NO: 704461 - DNA, 20 bp, mouse
gggcgcgttgcccttggaaa

SEQ ID NO: 704462 - DNA, 20 bp, mouse
gaggaagggcccgtcactac

SEQ ID NO: 704463 - DNA, 20 bp, mouse
ggggcgggggggggtcacgc

SEQ ID NO: 704464 - DNA, 20 bp, mouse
gccgacctgactctgctcca

SEQ ID NO: 704465 - DNA, 20 bp, mouse
gcaacgcgccgccacacttc

SEQ ID NO: 704466 - DNA, 20 bp, mouse
gggagtggagctagcgtcgt

SEQ ID NO: 704467 - DNA, 20 bp, mouse
ggacgctagctccactccgc

SEQ ID NO: 704468 - DNA, 20 bp, mouse
gtacgcaggcttcgcttccc

SEQ ID NO: 704469 - DNA, 20 bp, mouse
ggaggcggagctagtgaagg

SEQ ID NO: 704470 - DNA, 20 bp, mouse
gggggcggagctatgagagg

SEQ ID NO: 704471 - DNA, 20 bp, mouse
gagcgaagcctgcgtaccag

SEQ ID NO: 704472 - DNA, 20 bp, mouse
gagcctgcgtaccagcggag

SEQ ID NO: 704473 - DNA, 20 bp, mouse
ggaagaaggtatggtcatgt

SEQ ID NO: 704474 - DNA, 20 bp, mouse
ggaggcggagcctatactcc

SEQ ID NO: 704475 - DNA, 20 bp, mouse
gtgcatgagggagattgaag

SEQ ID NO: 704476 - DNA, 20 bp, mouse
gcacccggccagagtcccat

SEQ ID NO: 704477 - DNA, 20 bp, mouse
gccggagcgcccaggtgaca

SEQ ID NO: 704478 - DNA, 20 bp, mouse
gccaggtgacagggtgctcg

SEQ ID NO: 704479 - DNA, 20 bp, mouse
ggaaaagagaacaggtccga

SEQ ID NO: 704480 - DNA, 20 bp, mouse
gcctcgcggagtccggactc

SEQ ID NO: 704481 - DNA, 20 bp, mouse
gaaaacctcggacacccacc

SEQ ID NO: 704482 - DNA, 20 bp, mouse
gaacaggtccgatgggactc

SEQ ID NO: 704483 - DNA, 20 bp, mouse
gggcggggatgctcagactg

SEQ ID NO: 704484 - DNA, 20 bp, mouse
gtggcacgaggggaaaacct

SEQ ID NO: 704485 - DNA, 20 bp, mouse
gtccgctactccaagctcag

SEQ ID NO: 704486 - DNA, 20 bp, mouse
gtgacccagccttacaggaa

SEQ ID NO: 704487 - DNA, 20 bp, mouse
gtgtaaggctgggtcaccag

SEQ ID NO: 704488 - DNA, 20 bp, mouse
gggtcagaaaacacccttgg

SEQ ID NO: 704489 - DNA, 20 bp, mouse
gagtctggaagggggtgcct

SEQ ID NO: 704490 - DNA, 20 bp, mouse
gaaagagtgagggcgagaaa

SEQ ID NO: 704491 - DNA, 20 bp, mouse
gtgccaggacactgtttgat

SEQ ID NO: 704492 - DNA, 20 bp, mouse
ggacctcggaaccaaaatgc

SEQ ID NO: 704493 - DNA, 20 bp, mouse
ggacaacaacagtgcctcca

SEQ ID NO: 704494 - DNA, 20 bp, mouse
gaatgaaaacagtctggaag

SEQ ID NO: 704495 - DNA, 20 bp, mouse
gtcaaggggttctagacatg

SEQ ID NO: 704496 - DNA, 20 bp, mouse
gcgcgcgcctgcgggaagtg

SEQ ID NO: 704497 - DNA, 20 bp, mouse
ggcgtctgcaaccgcagatt

SEQ ID NO: 704498 - DNA, 20 bp, mouse
ggcgcagccgcacttcccgc

SEQ ID NO: 704499 - DNA, 20 bp, mouse
gtaaaggtgctcgggcatct

SEQ ID NO: 704500 - DNA, 20 bp, mouse
ggggttctctgccgaatctg

SEQ ID NO: 704501 - DNA, 20 bp, mouse
ggtgctcgggcatctaggtt

SEQ ID NO: 704502 - DNA, 20 bp, mouse
gtgctcaaaaatgtgtgaag

SEQ ID NO: 704503 - DNA, 20 bp, mouse
gtggggcgattcgagcgtct

SEQ ID NO: 704504 - DNA, 20 bp, mouse
ggccctgcgcaccgcctagg

SEQ ID NO: 704505 - DNA, 20 bp, mouse
gattcggcagagaacccgga

SEQ ID NO: 704506 - DNA, 20 bp, mouse
gcccgcgaggcgacccgtgg

SEQ ID NO: 704507 - DNA, 20 bp, mouse
gcggagcccgctgcctagcc

SEQ ID NO: 704508 - DNA, 20 bp, mouse
gaggctctggggtaaacgca

SEQ ID NO: 704509 - DNA, 20 bp, mouse
gcagccgagtccatcggagg

SEQ ID NO: 704510 - DNA, 20 bp, mouse
ggggctccgaccgcacccta

SEQ ID NO: 704511 - DNA, 20 bp, mouse
ggctctgcccccagtgtagg

SEQ ID NO: 704512 - DNA, 20 bp, mouse
gaggcgggaggaacccccac

SEQ ID NO: 704513 - DNA, 20 bp, mouse
gctccgaccgcaccctaagg

SEQ ID NO: 704514 - DNA, 20 bp, mouse
gtcgcgggcggggacctagg

SEQ ID NO: 704515 - DNA, 20 bp, mouse
gttcctcccgccttagggtg

SEQ ID NO: 704516 - DNA, 20 bp, mouse
gagctcgcaaagccggggaa

SEQ ID NO: 704517 - DNA, 20 bp, mouse
ggggccagggctcggcgagc

SEQ ID NO: 704518 - DNA, 20 bp, mouse
ggcgccgcggcaccacacgg

SEQ ID NO: 704519 - DNA, 20 bp, mouse
gagccagcgggcagggctta

SEQ ID NO: 704520 - DNA, 20 bp, mouse
gggggccgagcaaagggcgc

SEQ ID NO: 704521 - DNA, 20 bp, mouse
gtggctctgtgcgcgagctg

SEQ ID NO: 704522 - DNA, 20 bp, mouse
gtggagtggggctgcagagt

SEQ ID NO: 704523 - DNA, 20 bp, mouse
gggcttgaaaggaacggctt

SEQ ID NO: 704524 - DNA, 20 bp, mouse
gggggaagggggccgagcaa

SEQ ID NO: 704525 - DNA, 20 bp, mouse
ggctcacattcaggcattca

SEQ ID NO: 704526 - DNA, 20 bp, mouse
gcaaactcctggacacgttg

SEQ ID NO: 704527 - DNA, 20 bp, mouse
gcccgcagggtccgtggcct

SEQ ID NO: 704528 - DNA, 20 bp, mouse
gctgggcggggccgactccg

SEQ ID NO: 704529 - DNA, 20 bp, mouse
gcgcgcctgcacgagctggg

SEQ ID NO: 704530 - DNA, 20 bp, mouse
gggcccgggaacagcaagct

SEQ ID NO: 704531 - DNA, 20 bp, mouse
gtcgcgtagcagcagcgctt

SEQ ID NO: 704532 - DNA, 20 bp, mouse
gtgcgcctgctgtgccgcct

SEQ ID NO: 704533 - DNA, 20 bp, mouse
gacgtcgtctcggtggtccg

SEQ ID NO: 704534 - DNA, 20 bp, mouse
gctgctacgcgaggaagacc

SEQ ID NO: 704535 - DNA, 20 bp, mouse
gggacacgttgtggacgcgc

SEQ ID NO: 704536 - DNA, 20 bp, mouse
gcagacccggagttaaaggg

SEQ ID NO: 704537 - DNA, 20 bp, mouse
gccggggaggccactgtcac

SEQ ID NO: 704538 - DNA, 20 bp, mouse
gaggctcagggatcggaagg

SEQ ID NO: 704539 - DNA, 20 bp, mouse
gaggccactgtcacggggga

SEQ ID NO: 704540 - DNA, 20 bp, mouse
ggcctccccggaagcgatag

SEQ ID NO: 704541 - DNA, 20 bp, mouse
ggggtctgggtcttcctagg

SEQ ID NO: 704542 - DNA, 20 bp, mouse
gccggaagcgataggggccg

SEQ ID NO: 704543 - DNA, 20 bp, mouse
gacccagacccggagttaaa

SEQ ID NO: 704544 - DNA, 20 bp, mouse
gtggccggatccaaattcca

SEQ ID NO: 704545 - DNA, 20 bp, mouse
ggagtcacctccgtcccggg

SEQ ID NO: 704546 - DNA, 20 bp, mouse
gtccctgtgctcaggcacac

SEQ ID NO: 704547 - DNA, 20 bp, mouse
gaagctgagggagacgttcc

SEQ ID NO: 704548 - DNA, 20 bp, mouse
gcacagggagccggccagag

SEQ ID NO: 704549 - DNA, 20 bp, mouse
gcagtcccaccctctctggc

SEQ ID NO: 704550 - DNA, 20 bp, mouse
gcggggctggggcttaagga

SEQ ID NO: 704551 - DNA, 20 bp, mouse
gccctggaaatgagtgagcg

SEQ ID NO: 704552 - DNA, 20 bp, mouse
gtccttgtgggggacttgag

SEQ ID NO: 704553 - DNA, 20 bp, mouse
gactaggcacagagagatcg

SEQ ID NO: 704554 - DNA, 20 bp, mouse
gtgtagcagcggcgtctcca

SEQ ID NO: 704555 - DNA, 20 bp, mouse
gccacctccagaggaatata

SEQ ID NO: 704556 - DNA, 20 bp, mouse
gacgacgggacaaataggag

SEQ ID NO: 704557 - DNA, 20 bp, mouse
gagaaccggaggcgtggtct

SEQ ID NO: 704558 - DNA, 20 bp, mouse
gtcgtgcggtagaaagtctc

SEQ ID NO: 704559 - DNA, 20 bp, mouse
gggtctgggcgccacgcctc

SEQ ID NO: 704560 - DNA, 20 bp, mouse
gtgcggtagaaagtctccgg

SEQ ID NO: 704561 - DNA, 20 bp, mouse
gggcggcggcggttggttgc

SEQ ID NO: 704562 - DNA, 20 bp, mouse
gggcgcccagaccacgcctc

SEQ ID NO: 704563 - DNA, 20 bp, mouse
gtgggaagagcaacattcca

SEQ ID NO: 704564 - DNA, 20 bp, mouse
gggaaggagctcaaagtcct

SEQ ID NO: 704565 - DNA, 20 bp, mouse
ggtgtgaagcccgcctctca

SEQ ID NO: 704566 - DNA, 20 bp, mouse
gccgaaaacgatgtctgcag

SEQ ID NO: 704567 - DNA, 20 bp, mouse
gaaacggtcaaattgtacct

SEQ ID NO: 704568 - DNA, 20 bp, mouse
ggggcctagtgtgagtaggg

SEQ ID NO: 704569 - DNA, 20 bp, mouse
gcggggcttagggcgggtgg

SEQ ID NO: 704570 - DNA, 20 bp, mouse
gagtagggcggggcctttgg

SEQ ID NO: 704571 - DNA, 20 bp, mouse
gaaaacgatgtctgcagagg

SEQ ID NO: 704572 - DNA, 20 bp, mouse
gtgaaggaggcagcgggtga

SEQ ID NO: 704573 - DNA, 20 bp, mouse
gtgaaaggagaattgtatct

SEQ ID NO: 704574 - DNA, 20 bp, mouse
gggtggggcctagtgtgagt

SEQ ID NO: 704575 - DNA, 20 bp, mouse
gtgccttgcctcacccagct

SEQ ID NO: 704576 - DNA, 20 bp, mouse
ggcacgggagcagatttggg

SEQ ID NO: 704577 - DNA, 20 bp, mouse
gcaggcacgggagcagattt

SEQ ID NO: 704578 - DNA, 20 bp, mouse
gaggaactgtgcaatgtagt

SEQ ID NO: 704579 - DNA, 20 bp, mouse
ggggctgttgatttcccaac

SEQ ID NO: 704580 - DNA, 20 bp, mouse
ggccacaggaacatccccca

SEQ ID NO: 704581 - DNA, 20 bp, mouse
ggtatctggaaaggcctgca

SEQ ID NO: 704582 - DNA, 20 bp, mouse
gaccctgggggatgttcctg

SEQ ID NO: 704583 - DNA, 20 bp, mouse
gtctcagcctaaaaaaaaat

SEQ ID NO: 704584 - DNA, 20 bp, mouse
gatctgctcccgtgcctgtt

SEQ ID NO: 704585 - DNA, 20 bp, mouse
gcaaaggtgcccttgttcat

SEQ ID NO: 704586 - DNA, 20 bp, mouse
ggagaccagcaatacaccga

SEQ ID NO: 704587 - DNA, 20 bp, mouse
gctctctcccactacaactt

SEQ ID NO: 704588 - DNA, 20 bp, mouse
gctaagggacctgggcaacc

SEQ ID NO: 704589 - DNA, 20 bp, mouse
ggaacccgaggaaccacaat

SEQ ID NO: 704590 - DNA, 20 bp, mouse
gtgcccaggtcccttagggc

SEQ ID NO: 704591 - DNA, 20 bp, mouse
gccacccacccccgccctaa

SEQ ID NO: 704592 - DNA, 20 bp, mouse
gagactgaacgtgtaaagct

SEQ ID NO: 704593 - DNA, 20 bp, mouse
ggggcgctcacaaggaggaa

SEQ ID NO: 704594 - DNA, 20 bp, mouse
gatggcgggcgctcacaagg

SEQ ID NO: 704595 - DNA, 20 bp, mouse
gagaggaagactgcatgcgt

SEQ ID NO: 704596 - DNA, 20 bp, mouse
gaaagggaagggctgaaaca

SEQ ID NO: 704597 - DNA, 20 bp, mouse
gacagctctgtgacagggtg

SEQ ID NO: 704598 - DNA, 20 bp, mouse
ggactacatcccatggggcg

SEQ ID NO: 704599 - DNA, 20 bp, mouse
gcagggtggggcagagtgac

SEQ ID NO: 704600 - DNA, 20 bp, mouse
gggtttgggaggaacctcga

SEQ ID NO: 704601 - DNA, 20 bp, mouse
gtcacctggaaggagggttt

SEQ ID NO: 704602 - DNA, 20 bp, mouse
ggaacctcgagggctttata

SEQ ID NO: 704603 - DNA, 20 bp, mouse
gcctctcagccccgccccat

SEQ ID NO: 704604 - DNA, 20 bp, mouse
gctaggaagccgatggccca

SEQ ID NO: 704605 - DNA, 20 bp, mouse
gcctggaaggagggtttggg

SEQ ID NO: 704606 - DNA, 20 bp, mouse
gggagtggctggtgccccag

SEQ ID NO: 704607 - DNA, 20 bp, mouse
gtggctggtgccccagtggg

SEQ ID NO: 704608 - DNA, 20 bp, mouse
gggggtgtgccgcctccttg

SEQ ID NO: 704609 - DNA, 20 bp, mouse
ggatagacaggaagggcgga

SEQ ID NO: 704610 - DNA, 20 bp, mouse
gtccttgtggaggacctttt

SEQ ID NO: 704611 - DNA, 20 bp, mouse
gggggcaccagccactccct

SEQ ID NO: 704612 - DNA, 20 bp, mouse
gctgcactgccccacccact

SEQ ID NO: 704613 - DNA, 20 bp, mouse
gggagggactagagcctaaa

SEQ ID NO: 704614 - DNA, 20 bp, mouse
ggtactaggccaggactagt

SEQ ID NO: 704615 - DNA, 20 bp, mouse
gtaccaggctatgtgtgggt

SEQ ID NO: 704616 - DNA, 20 bp, mouse
gacccgcaagctggcctcct

SEQ ID NO: 704617 - DNA, 20 bp, mouse
gcacggcgaaggtcccctgg

SEQ ID NO: 704618 - DNA, 20 bp, mouse
gcgtctgccggaggggtgca

SEQ ID NO: 704619 - DNA, 20 bp, mouse
gcgcagagagggcgctggta

SEQ ID NO: 704620 - DNA, 20 bp, mouse
ggcgaaggtcccctgggggg

SEQ ID NO: 704621 - DNA, 20 bp, mouse
gggcagaccctgcacccctc

SEQ ID NO: 704622 - DNA, 20 bp, mouse
gtggctggcgccggcttcat

SEQ ID NO: 704623 - DNA, 20 bp, mouse
gccagcctccgcccccccat

SEQ ID NO: 704624 - DNA, 20 bp, mouse
ggcatcagaggccgcagaga

SEQ ID NO: 704625 - DNA, 20 bp, mouse
gcagggtctgcccacggcga

SEQ ID NO: 704626 - DNA, 20 bp, mouse
gcgccgggctggccaggctt

SEQ ID NO: 704627 - DNA, 20 bp, mouse
gtgcttgcgtggccctgaga

SEQ ID NO: 704628 - DNA, 20 bp, mouse
gacggtgtgtctgaaaggag

SEQ ID NO: 704629 - DNA, 20 bp, mouse
ggctctgcgccctgtctgcc

SEQ ID NO: 704630 - DNA, 20 bp, mouse
ggagagcagaagtgcttgcg

SEQ ID NO: 704631 - DNA, 20 bp, mouse
gcgaggcgcgcacaccctgc

SEQ ID NO: 704632 - DNA, 20 bp, mouse
gtccccagacaggggctttc

SEQ ID NO: 704633 - DNA, 20 bp, mouse
gggccactcccgccttctca

SEQ ID NO: 704634 - DNA, 20 bp, mouse
gctcaaaagagagacatcgc

SEQ ID NO: 704635 - DNA, 20 bp, mouse
gcatctgtggggaagaatgt

SEQ ID NO: 704636 - DNA, 20 bp, mouse
ggaggggcggcggtgtgccg

SEQ ID NO: 704637 - DNA, 20 bp, mouse
gcccctttccggtcagtaga

SEQ ID NO: 704638 - DNA, 20 bp, mouse
ggggcggcggtgtgccgggg

SEQ ID NO: 704639 - DNA, 20 bp, mouse
gtgaagtcctggagcgggtt

SEQ ID NO: 704640 - DNA, 20 bp, mouse
gctcccgcccctctactgac

SEQ ID NO: 704641 - DNA, 20 bp, mouse
gtgccctaggcggcccttgg

SEQ ID NO: 704642 - DNA, 20 bp, mouse
gccttggcggcgcccctttc

SEQ ID NO: 704643 - DNA, 20 bp, mouse
gttccggtcagtagaggggc

SEQ ID NO: 704644 - DNA, 20 bp, mouse
ggaggggccgcgggcagggt

SEQ ID NO: 704645 - DNA, 20 bp, mouse
gcgccgccaagggccgccta

SEQ ID NO: 704646 - DNA, 20 bp, mouse
gttgcaaaggggtaggagga

SEQ ID NO: 704647 - DNA, 20 bp, mouse
gaaactgagttggaccgggt

SEQ ID NO: 704648 - DNA, 20 bp, mouse
gttccgggttgcaaaggggt

SEQ ID NO: 704649 - DNA, 20 bp, mouse
gaacccggtctggagacagt

SEQ ID NO: 704650 - DNA, 20 bp, mouse
gcacacaaaccgcacatcag

SEQ ID NO: 704651 - DNA, 20 bp, mouse
gcgggttgcaaaggggtagg

SEQ ID NO: 704652 - DNA, 20 bp, mouse
gtagacagcagagctcttcc

SEQ ID NO: 704653 - DNA, 20 bp, mouse
gcggtctggagacagtgggc

SEQ ID NO: 704654 - DNA, 20 bp, mouse
gtggaatgggccattatcat

SEQ ID NO: 704655 - DNA, 20 bp, mouse
ggctcttccgggttgcaaag

SEQ ID NO: 704656 - DNA, 20 bp, mouse
gcatgcgcgcggaactctcg

SEQ ID NO: 704657 - DNA, 20 bp, mouse
ggagtcacgtgcaagggcgg

SEQ ID NO: 704658 - DNA, 20 bp, mouse
gctaagggagtcacgtgcaa

SEQ ID NO: 704659 - DNA, 20 bp, mouse
gcaagggccccgtagatctg

SEQ ID NO: 704660 - DNA, 20 bp, mouse
ggacgtggaccactgagagt

SEQ ID NO: 704661 - DNA, 20 bp, mouse
gaggacgtcgggctgcactg

SEQ ID NO: 704662 - DNA, 20 bp, mouse
ggtgcagcccgacgtccttg

SEQ ID NO: 704663 - DNA, 20 bp, mouse
gcagcaaaccgcaaggacgt

SEQ ID NO: 704664 - DNA, 20 bp, mouse
gtggaccactgagagtaggg

SEQ ID NO: 704665 - DNA, 20 bp, mouse
gcagccccgccccttgaaca

SEQ ID NO: 704666 - DNA, 20 bp, mouse
gcctgtcggggcataagcac

SEQ ID NO: 704667 - DNA, 20 bp, mouse
gtcggggcataagcactggc

SEQ ID NO: 704668 - DNA, 20 bp, mouse
gaagtggaagaaagccctgt

SEQ ID NO: 704669 - DNA, 20 bp, mouse
gcacaggcggaacactccta

SEQ ID NO: 704670 - DNA, 20 bp, mouse
gcagaaggactgcacacagg

SEQ ID NO: 704671 - DNA, 20 bp, mouse
gtccacttccacacgtacca

SEQ ID NO: 704672 - DNA, 20 bp, mouse
gcagcgagtcccgtggctgg

SEQ ID NO: 704673 - DNA, 20 bp, mouse
gtccttggtacgtgtggaag

SEQ ID NO: 704674 - DNA, 20 bp, mouse
gagtccttctgagtgacctt

SEQ ID NO: 704675 - DNA, 20 bp, mouse
gcggcagaacctcctggatg

SEQ ID NO: 704676 - DNA, 20 bp, mouse
gggagctcggaatagacgtg

SEQ ID NO: 704677 - DNA, 20 bp, mouse
gctgaccctgagcggaggga

SEQ ID NO: 704678 - DNA, 20 bp, mouse
gcgagctgtggtctcaaagc

SEQ ID NO: 704679 - DNA, 20 bp, mouse
gggggccacgtgacccgaac

SEQ ID NO: 704680 - DNA, 20 bp, mouse
gccggacagcagagcctgtt

SEQ ID NO: 704681 - DNA, 20 bp, mouse
gcgccggggctccagccgcg

SEQ ID NO: 704682 - DNA, 20 bp, mouse
gccgagctcccgcccaaagc

SEQ ID NO: 704683 - DNA, 20 bp, mouse
gtagggaatcccgggaactt

SEQ ID NO: 704684 - DNA, 20 bp, mouse
gccgctctgtagggaatccc

SEQ ID NO: 704685 - DNA, 20 bp, mouse
gcagctcgcccgcgtaccct

SEQ ID NO: 704686 - DNA, 20 bp, mouse
gtacaagctgctgggtgcgg

SEQ ID NO: 704687 - DNA, 20 bp, mouse
gaggagaaaaaaagcgggtg

SEQ ID NO: 704688 - DNA, 20 bp, mouse
gggctagcgctgtttgttta

SEQ ID NO: 704689 - DNA, 20 bp, mouse
gtggggaggggacggcgagg

SEQ ID NO: 704690 - DNA, 20 bp, mouse
gtggggatgtgttacagcgc

SEQ ID NO: 704691 - DNA, 20 bp, mouse
gtggactcgctcctactctg

SEQ ID NO: 704692 - DNA, 20 bp, mouse
ggaccgtcgccgcaaaggga

SEQ ID NO: 704693 - DNA, 20 bp, mouse
gctagcggacaataagagct

SEQ ID NO: 704694 - DNA, 20 bp, mouse
gaggagcgagtccaccccgg

SEQ ID NO: 704695 - DNA, 20 bp, mouse
gcagctcaacccacgcccgc

SEQ ID NO: 704696 - DNA, 20 bp, mouse
gaccctgcctccgcccaccg

SEQ ID NO: 704697 - DNA, 20 bp, mouse
gcaccggggcttccggcgat

SEQ ID NO: 704698 - DNA, 20 bp, mouse
ggagccccaaagcctaggtc

SEQ ID NO: 704699 - DNA, 20 bp, mouse
gcgggagctccgcccatcgc

SEQ ID NO: 704700 - DNA, 20 bp, mouse
ggaaccagtgtgcctgacct

SEQ ID NO: 704701 - DNA, 20 bp, mouse
gtgacaggcaatggtaagtc

SEQ ID NO: 704702 - DNA, 20 bp, mouse
gcggaagccccggtgggcgg

SEQ ID NO: 704703 - DNA, 20 bp, mouse
gaaagccagctccgccctag

SEQ ID NO: 704704 - DNA, 20 bp, mouse
gaagcctaggtcaggcacac

SEQ ID NO: 704705 - DNA, 20 bp, mouse
ggtcgccctggggaccccgg

SEQ ID NO: 704706 - DNA, 20 bp, mouse
gggcggggtcgggaagggag

SEQ ID NO: 704707 - DNA, 20 bp, mouse
gcacccgcccgcacccggat

SEQ ID NO: 704708 - DNA, 20 bp, mouse
ggcagcgtcgccagtctttg

SEQ ID NO: 704709 - DNA, 20 bp, mouse
gccgcccagcctcgcctcca

SEQ ID NO: 704710 - DNA, 20 bp, mouse
gcacccggatgggcggggtc

SEQ ID NO: 704711 - DNA, 20 bp, mouse
gcggatgggcggggtcggga

SEQ ID NO: 704712 - DNA, 20 bp, mouse
ggacctggtgcgcatgtccc

SEQ ID NO: 704713 - DNA, 20 bp, mouse
gccgcccgcacccggatggg

SEQ ID NO: 704714 - DNA, 20 bp, mouse
gctggtgcgcatgtcccggg

SEQ ID NO: 704715 - DNA, 20 bp, mouse
ggaggggctccctgtgggcg

SEQ ID NO: 704716 - DNA, 20 bp, mouse
gtgccccggccagacttcat

SEQ ID NO: 704717 - DNA, 20 bp, mouse
ggggaagccgggctgtgaag

SEQ ID NO: 704718 - DNA, 20 bp, mouse
gggctggccacacccctcgt

SEQ ID NO: 704719 - DNA, 20 bp, mouse
gcctagcaaccggggaagcc

SEQ ID NO: 704720 - DNA, 20 bp, mouse
gaaggagcggtgagaccgag

SEQ ID NO: 704721 - DNA, 20 bp, mouse
gggagagacgtgcatcaacc

SEQ ID NO: 704722 - DNA, 20 bp, mouse
ggccctccggatcgctccgg

SEQ ID NO: 704723 - DNA, 20 bp, mouse
ggggcaatttcagtgagaga

SEQ ID NO: 704724 - DNA, 20 bp, mouse
ggcgccggggcgctgacccc

SEQ ID NO: 704725 - DNA, 20 bp, mouse
gtcaagatcggcaccccacg

SEQ ID NO: 704726 - DNA, 20 bp, mouse
gtaaaggcctttggagacta

SEQ ID NO: 704727 - DNA, 20 bp, mouse
gaacactaaactcttgtgaa

SEQ ID NO: 704728 - DNA, 20 bp, mouse
gtacttaatatagatgtcgt

SEQ ID NO: 704729 - DNA, 20 bp, mouse
gcgttggacagtaatagcat

SEQ ID NO: 704730 - DNA, 20 bp, mouse
gaatatgccatagtctccaa

SEQ ID NO: 704731 - DNA, 20 bp, mouse
ggaactttggtgtctgagtc

SEQ ID NO: 704732 - DNA, 20 bp, mouse
ggggcactttttataattaa

SEQ ID NO: 704733 - DNA, 20 bp, mouse
ggagtttagtgtttgatttt

SEQ ID NO: 704734 - DNA, 20 bp, mouse
gagtttgtttaattatatac

SEQ ID NO: 704735 - DNA, 20 bp, mouse
gttttataattaaaggcctt

SEQ ID NO: 704736 - DNA, 20 bp, mouse
gagaagttcctcaaagggga

SEQ ID NO: 704737 - DNA, 20 bp, mouse
gaccgccatgaacagcgtcg

SEQ ID NO: 704738 - DNA, 20 bp, mouse
gtcctcaaaggggacggctc

SEQ ID NO: 704739 - DNA, 20 bp, mouse
gcgaccagtgcttcaaccgc

SEQ ID NO: 704740 - DNA, 20 bp, mouse
gaaaccagcggttgaagcac

SEQ ID NO: 704741 - DNA, 20 bp, mouse
gcccggagccgtcccctttg

SEQ ID NO: 704742 - DNA, 20 bp, mouse
gtccccgacgctgttcatgg

SEQ ID NO: 704743 - DNA, 20 bp, mouse
gctgctggtagcgtttgaag

SEQ ID NO: 704744 - DNA, 20 bp, mouse
ggccctaccgtctgtcccta

SEQ ID NO: 704745 - DNA, 20 bp, mouse
gagggcaggctgctgcggcg

SEQ ID NO: 704746 - DNA, 20 bp, mouse
ggcggcgaagacccatgaag

SEQ ID NO: 704747 - DNA, 20 bp, mouse
gcgtccgtgggtcacgtccc

SEQ ID NO: 704748 - DNA, 20 bp, mouse
gccgtactggctcaggtcag

SEQ ID NO: 704749 - DNA, 20 bp, mouse
gtactggctcaggtcagcgg

SEQ ID NO: 704750 - DNA, 20 bp, mouse
gcgcccagggcctggcccat

SEQ ID NO: 704751 - DNA, 20 bp, mouse
gagccccgggacgtgaccca

SEQ ID NO: 704752 - DNA, 20 bp, mouse
gaggctacccaatgcctagc

SEQ ID NO: 704753 - DNA, 20 bp, mouse
gaccaccaccacataggctc

SEQ ID NO: 704754 - DNA, 20 bp, mouse
ggtgcctcccgtactggctc

SEQ ID NO: 704755 - DNA, 20 bp, mouse
gcattgggtagcctcttcat

SEQ ID NO: 704756 - DNA, 20 bp, mouse
ggcaagctggagtagtccgg

SEQ ID NO: 704757 - DNA, 20 bp, mouse
ggaacccgatgggacatata

SEQ ID NO: 704758 - DNA, 20 bp, mouse
ggggctgggctgctgcgcca

SEQ ID NO: 704759 - DNA, 20 bp, mouse
gaggccacgcaatgccaatc

SEQ ID NO: 704760 - DNA, 20 bp, mouse
gtgctgcgccacggtgccct

SEQ ID NO: 704761 - DNA, 20 bp, mouse
ggatgtcaagccaggggggc

SEQ ID NO: 704762 - DNA, 20 bp, mouse
gttgctgatgtcaagccagg

SEQ ID NO: 704763 - DNA, 20 bp, mouse
gtggagtagtccggggggtt

SEQ ID NO: 704764 - DNA, 20 bp, mouse
gcaagatttcggggttcccc

SEQ ID NO: 704765 - DNA, 20 bp, mouse
gagtagtccggggggttggg

SEQ ID NO: 704766 - DNA, 20 bp, mouse
ggaaggactcagatgggtga

SEQ ID NO: 704767 - DNA, 20 bp, mouse
gagggctagaagagtggctt

SEQ ID NO: 704768 - DNA, 20 bp, mouse
gagcgggcgtccagcggaaa

SEQ ID NO: 704769 - DNA, 20 bp, mouse
gcgagcctggaggatagaca

SEQ ID NO: 704770 - DNA, 20 bp, mouse
gccgcagcgcccggtaggca

SEQ ID NO: 704771 - DNA, 20 bp, mouse
ggcagcccgcagcgcccggt

SEQ ID NO: 704772 - DNA, 20 bp, mouse
gaggcgtggccacttcacag

SEQ ID NO: 704773 - DNA, 20 bp, mouse
gctggaggatagacagggag

SEQ ID NO: 704774 - DNA, 20 bp, mouse
ggggcgtggccgccgaagtg

SEQ ID NO: 704775 - DNA, 20 bp, mouse
ggtccttgaaggactcagat

SEQ ID NO: 704776 - DNA, 20 bp, mouse
gtgtatggacagctgagtag

SEQ ID NO: 704777 - DNA, 20 bp, mouse
gtgaatacagtggccctcac

SEQ ID NO: 704778 - DNA, 20 bp, mouse
gggcctccccaaaattcaca

SEQ ID NO: 704779 - DNA, 20 bp, mouse
ggaattttggggaggcctaa

SEQ ID NO: 704780 - DNA, 20 bp, mouse
gtaagccggtcacgtgatgc

SEQ ID NO: 704781 - DNA, 20 bp, mouse
gaattctaacaaggattgta

SEQ ID NO: 704782 - DNA, 20 bp, mouse
gcctaaaggatgacaccttt

SEQ ID NO: 704783 - DNA, 20 bp, mouse
gagttccttccggcttaaag

SEQ ID NO: 704784 - DNA, 20 bp, mouse
gagtcacatgatgactaagc

SEQ ID NO: 704785 - DNA, 20 bp, mouse
gacttcctgcatcacgtgac

SEQ ID NO: 704786 - DNA, 20 bp, mouse
gcggtctcgcaggggcgggt

SEQ ID NO: 704787 - DNA, 20 bp, mouse
gctccgagccggtctcgcag

SEQ ID NO: 704788 - DNA, 20 bp, mouse
gtgccgcgcgacagactccg

SEQ ID NO: 704789 - DNA, 20 bp, mouse
gctaggacgtggagcctcga

SEQ ID NO: 704790 - DNA, 20 bp, mouse
gtcgcaggggcgggtaggtg

SEQ ID NO: 704791 - DNA, 20 bp, mouse
gcgagccggtctcgcagggg

SEQ ID NO: 704792 - DNA, 20 bp, mouse
gcccgcaagtcggaccggaa

SEQ ID NO: 704793 - DNA, 20 bp, mouse
gagcaccccgcaagtcggac

SEQ ID NO: 704794 - DNA, 20 bp, mouse
gggcgcaaggggcctaaccc

SEQ ID NO: 704795 - DNA, 20 bp, mouse
ggagacgcgcggcgatgtcc

SEQ ID NO: 704796 - DNA, 20 bp, mouse
gatcccgcgaggggagttca

SEQ ID NO: 704797 - DNA, 20 bp, mouse
gccccctggcggcagcactg

SEQ ID NO: 704798 - DNA, 20 bp, mouse
gtgcaggggagcggccgcta

SEQ ID NO: 704799 - DNA, 20 bp, mouse
gccgctgtagtgcaggggag

SEQ ID NO: 704800 - DNA, 20 bp, mouse
gagaccctgaactcccctcg

SEQ ID NO: 704801 - DNA, 20 bp, mouse
gtgtacacggggagatccac

SEQ ID NO: 704802 - DNA, 20 bp, mouse
gactcccctcgcgggatcta

SEQ ID NO: 704803 - DNA, 20 bp, mouse
gcgcctcagtgctgccgcca

SEQ ID NO: 704804 - DNA, 20 bp, mouse
gcgggccgaccaggctgggg

SEQ ID NO: 704805 - DNA, 20 bp, mouse
gggaggggtcgcggtagcgg

SEQ ID NO: 704806 - DNA, 20 bp, mouse
gagagcaggtgtttgaggag

SEQ ID NO: 704807 - DNA, 20 bp, mouse
gggccagccagcacagttca

SEQ ID NO: 704808 - DNA, 20 bp, mouse
ggtgaccaccgggcaggaag

SEQ ID NO: 704809 - DNA, 20 bp, mouse
ggggccgagtggagtgcgag

SEQ ID NO: 704810 - DNA, 20 bp, mouse
gggccggccccgtgagtggg

SEQ ID NO: 704811 - DNA, 20 bp, mouse
ggtgctggctggccaccggg

SEQ ID NO: 704812 - DNA, 20 bp, mouse
gcccgctccgccgctataaa

SEQ ID NO: 704813 - DNA, 20 bp, mouse
gagccctgaactgtgctggc

SEQ ID NO: 704814 - DNA, 20 bp, mouse
gagcgggccagggtgagccc

SEQ ID NO: 704815 - DNA, 20 bp, mouse
gcggccccgtgagtgggcgg

SEQ ID NO: 704816 - DNA, 20 bp, mouse
ggtaggtaggggacagccaa

SEQ ID NO: 704817 - DNA, 20 bp, mouse
gtgaagaggtggggtcagat

SEQ ID NO: 704818 - DNA, 20 bp, mouse
ggggacagccaacggatacg

SEQ ID NO: 704819 - DNA, 20 bp, mouse
ggcagtgcgctgtttagcag

SEQ ID NO: 704820 - DNA, 20 bp, mouse
gccaaagagaccagattaca

SEQ ID NO: 704821 - DNA, 20 bp, mouse
ggctgggcggttgaagaggt

SEQ ID NO: 704822 - DNA, 20 bp, mouse
gagagaatcctcgtatccgt

SEQ ID NO: 704823 - DNA, 20 bp, mouse
ggaagaaagaaattagctct

SEQ ID NO: 704824 - DNA, 20 bp, mouse
ggaaagaaattagctctggg

SEQ ID NO: 704825 - DNA, 20 bp, mouse
gctgggcatcctgggcagga

SEQ ID NO: 704826 - DNA, 20 bp, mouse
ggggcggagcaaagtaagtc

SEQ ID NO: 704827 - DNA, 20 bp, mouse
gcaaggctgaaggcatggat

SEQ ID NO: 704828 - DNA, 20 bp, mouse
gtggatgggtgggactcagg

SEQ ID NO: 704829 - DNA, 20 bp, mouse
gatggtaggtctcccaacac

SEQ ID NO: 704830 - DNA, 20 bp, mouse
gttgctccgccccaaggacc

SEQ ID NO: 704831 - DNA, 20 bp, mouse
gcagcaggattcctggtcct

SEQ ID NO: 704832 - DNA, 20 bp, mouse
gaacagagaagttactgaca

SEQ ID NO: 704833 - DNA, 20 bp, mouse
gtcctgctgtgtgctgggtt

SEQ ID NO: 704834 - DNA, 20 bp, mouse
gtaggagctgtacgttccgc

SEQ ID NO: 704835 - DNA, 20 bp, mouse
gaaagcttggtcagcccaaa

SEQ ID NO: 704836 - DNA, 20 bp, mouse
ggtaacttagccaaggctgg

SEQ ID NO: 704837 - DNA, 20 bp, mouse
gccaaggctggggggttgag

SEQ ID NO: 704838 - DNA, 20 bp, mouse
ggccaatggtaacttagcca

SEQ ID NO: 704839 - DNA, 20 bp, mouse
ggccttggctaagttaccat

SEQ ID NO: 704840 - DNA, 20 bp, mouse
gtaaagtagaataaggccaa

SEQ ID NO: 704841 - DNA, 20 bp, mouse
ggggttgagagggaggtcag

SEQ ID NO: 704842 - DNA, 20 bp, mouse
gaaactggagatgggttcaa

SEQ ID NO: 704843 - DNA, 20 bp, mouse
gtggggcagcccagaagaaa

SEQ ID NO: 704844 - DNA, 20 bp, mouse
ggtggaggcctgctgtcttt

SEQ ID NO: 704845 - DNA, 20 bp, mouse
gaaacccaggtccccatcag

SEQ ID NO: 704846 - DNA, 20 bp, mouse
gttaacttagccaagctggg

SEQ ID NO: 704847 - DNA, 20 bp, mouse
gtaaacacatttcacagtag

SEQ ID NO: 704848 - DNA, 20 bp, mouse
ggaaaaaaatctcatgctgt

SEQ ID NO: 704849 - DNA, 20 bp, mouse
gtgtgttcagctcacataaa

SEQ ID NO: 704850 - DNA, 20 bp, mouse
gactattgagcaagagagag

SEQ ID NO: 704851 - DNA, 20 bp, mouse
gactggcttttttgatagcc

SEQ ID NO: 704852 - DNA, 20 bp, mouse
gcagcttggctaagttaaca

SEQ ID NO: 704853 - DNA, 20 bp, mouse
gctcttctctcaggaagcat

SEQ ID NO: 704854 - DNA, 20 bp, mouse
gttagccaagctggggggtg

SEQ ID NO: 704855 - DNA, 20 bp, mouse
ggggcctgactcaaaataaa

SEQ ID NO: 704856 - DNA, 20 bp, mouse
gttgaaacacccacaagaaa

SEQ ID NO: 704857 - DNA, 20 bp, mouse
gaaatggtgccatttcttgt

SEQ ID NO: 704858 - DNA, 20 bp, mouse
gggaatgaggggtttgctca

SEQ ID NO: 704859 - DNA, 20 bp, mouse
gagagttcctaactggggtg

SEQ ID NO: 704860 - DNA, 20 bp, mouse
gaataaaaatagaacgaaaa

SEQ ID NO: 704861 - DNA, 20 bp, mouse
gatgactcaaccagcactgc

SEQ ID NO: 704862 - DNA, 20 bp, mouse
ggtgggtgtttcaaaatgta

SEQ ID NO: 704863 - DNA, 20 bp, mouse
gaactttgtgtaacacagtg

SEQ ID NO: 704864 - DNA, 20 bp, mouse
gaaccagcactgcaggaatg

SEQ ID NO: 704865 - DNA, 20 bp, mouse
gctaaaagagttcctaactg

SEQ ID NO: 704866 - DNA, 20 bp, mouse
gagtagtcctaaatcatcag

SEQ ID NO: 704867 - DNA, 20 bp, mouse
ggaccgccccagaaattgga

SEQ ID NO: 704868 - DNA, 20 bp, mouse
ggctgaggggttctatgaaa

SEQ ID NO: 704869 - DNA, 20 bp, mouse
gagtgcttatagccttacat

SEQ ID NO: 704870 - DNA, 20 bp, mouse
gcaccagccactgatgattt

SEQ ID NO: 704871 - DNA, 20 bp, mouse
gatgaaagggctggtccttg

SEQ ID NO: 704872 - DNA, 20 bp, mouse
gaggggttctatgaaagggc

SEQ ID NO: 704873 - DNA, 20 bp, mouse
ggtccctccaatttctgggg

SEQ ID NO: 704874 - DNA, 20 bp, mouse
gtcaaactgcctcatgaaca

SEQ ID NO: 704875 - DNA, 20 bp, mouse
gctcaggattatccagctga

SEQ ID NO: 704876 - DNA, 20 bp, mouse
gataactgcagaaagttcgg

SEQ ID NO: 704877 - DNA, 20 bp, mouse
gcggtgatggaacacactgt

SEQ ID NO: 704878 - DNA, 20 bp, mouse
gctcaatctgcaagatgtgg

SEQ ID NO: 704879 - DNA, 20 bp, mouse
gtgactcagtcagtcgttga

SEQ ID NO: 704880 - DNA, 20 bp, mouse
gagtctcaatctgcaagatg

SEQ ID NO: 704881 - DNA, 20 bp, mouse
gctgtctgtagtactcacca

SEQ ID NO: 704882 - DNA, 20 bp, mouse
ggtgataactgcagaaagtt

SEQ ID NO: 704883 - DNA, 20 bp, mouse
gagaaagttcggggggatct

SEQ ID NO: 704884 - DNA, 20 bp, mouse
gtctgggtcccctgccctct

SEQ ID NO: 704885 - DNA, 20 bp, mouse
ggcagtctaaatcagcagtg

SEQ ID NO: 704886 - DNA, 20 bp, mouse
ggtgtcatttacactgatgg

SEQ ID NO: 704887 - DNA, 20 bp, mouse
gatgtaaatactttccacag

SEQ ID NO: 704888 - DNA, 20 bp, mouse
ggaaggaaagagggtaagaa

SEQ ID NO: 704889 - DNA, 20 bp, mouse
ggagggtaagaaaggaagag

SEQ ID NO: 704890 - DNA, 20 bp, mouse
gatttacactgatgggggcc

SEQ ID NO: 704891 - DNA, 20 bp, mouse
ggagggagaggggacagtga

SEQ ID NO: 704892 - DNA, 20 bp, mouse
gaaccaaggcattgttaact

SEQ ID NO: 704893 - DNA, 20 bp, mouse
gggccaagttaacaatgcct

SEQ ID NO: 704894 - DNA, 20 bp, mouse
gtatttacattctctttctt

SEQ ID NO: 704895 - DNA, 20 bp, mouse
gctgaaagtaaagtaaacca

SEQ ID NO: 704896 - DNA, 20 bp, mouse
gagaacaggaatctgcaaaa

SEQ ID NO: 704897 - DNA, 20 bp, mouse
gaagttctctcccagctctc

SEQ ID NO: 704898 - DNA, 20 bp, mouse
gaactcagggtgtcatgttg

SEQ ID NO: 704899 - DNA, 20 bp, mouse
ggagaggaaaggaaattccc

SEQ ID NO: 704900 - DNA, 20 bp, mouse
gagtcttcaaatagtacgtg

SEQ ID NO: 704901 - DNA, 20 bp, mouse
gcagaaaggagagattgcaa

SEQ ID NO: 704902 - DNA, 20 bp, mouse
ggttcagactgtatagttga

SEQ ID NO: 704903 - DNA, 20 bp, mouse
gcagagcagacaaaccgtac

SEQ ID NO: 704904 - DNA, 20 bp, mouse
gagctgactcagtcacagaa

SEQ ID NO: 704905 - DNA, 20 bp, mouse
gggggattttcaaaagcaga

SEQ ID NO: 704906 - DNA, 20 bp, mouse
gataaagcacagtaaaaccc

SEQ ID NO: 704907 - DNA, 20 bp, mouse
gctggcttttcgggatagac

SEQ ID NO: 704908 - DNA, 20 bp, mouse
gaaacccaggcagccatcag

SEQ ID NO: 704909 - DNA, 20 bp, mouse
gaggacaattgagcaagaga

SEQ ID NO: 704910 - DNA, 20 bp, mouse
ggagtatcacactggctttt

SEQ ID NO: 704911 - DNA, 20 bp, mouse
gaggtaaacagattccacag

SEQ ID NO: 704912 - DNA, 20 bp, mouse
gcaagagaggggggtatgtg

SEQ ID NO: 704913 - DNA, 20 bp, mouse
gagtggaaattacaaaatcc

SEQ ID NO: 704914 - DNA, 20 bp, mouse
gatagtgagtcatgcccacc

SEQ ID NO: 704915 - DNA, 20 bp, mouse
gagcacacttgcaatactcc

SEQ ID NO: 704916 - DNA, 20 bp, mouse
gaaagaaaacggaatctgtg

SEQ ID NO: 704917 - DNA, 20 bp, mouse
gatccgccgcccatctggca

SEQ ID NO: 704918 - DNA, 20 bp, mouse
gttccctgccagatgggcgg

SEQ ID NO: 704919 - DNA, 20 bp, mouse
gccgtaggggacatgaaaaa

SEQ ID NO: 704920 - DNA, 20 bp, mouse
gattgcctgcacttagttgt

SEQ ID NO: 704921 - DNA, 20 bp, mouse
gcatagcaagctaacccgta

SEQ ID NO: 704922 - DNA, 20 bp, mouse
gtgcacagcaagataaatga

SEQ ID NO: 704923 - DNA, 20 bp, mouse
gactaagtgcaggcaatatc

SEQ ID NO: 704924 - DNA, 20 bp, mouse
gtaaggtaaaaacgtctcgt

SEQ ID NO: 704925 - DNA, 20 bp, mouse
ggtgatatatgatgcagact

SEQ ID NO: 704926 - DNA, 20 bp, mouse
gcaaagacaaaacacgatct

SEQ ID NO: 704927 - DNA, 20 bp, mouse
gatcgtgttttgtctttgac

SEQ ID NO: 704928 - DNA, 20 bp, mouse
gacaaaacacgatcttggtc

SEQ ID NO: 704929 - DNA, 20 bp, mouse
gaccctcaaagagggaatta

SEQ ID NO: 704930 - DNA, 20 bp, mouse
gcaactggatcttaagttcc

SEQ ID NO: 704931 - DNA, 20 bp, mouse
gttctctgtcatgagttggc

SEQ ID NO: 704932 - DNA, 20 bp, mouse
gaaaagcgtttgtttcttcc

SEQ ID NO: 704933 - DNA, 20 bp, mouse
ggaccttaattccctctttg

SEQ ID NO: 704934 - DNA, 20 bp, mouse
gtctttgagggtcttaatct

SEQ ID NO: 704935 - DNA, 20 bp, mouse
gagagttctctgtcatgagt

SEQ ID NO: 704936 - DNA, 20 bp, mouse
gaaagaaatggcaacagtta

SEQ ID NO: 704937 - DNA, 20 bp, mouse
gtgcccagctcgctgttgtc

SEQ ID NO: 704938 - DNA, 20 bp, mouse
gttcctgacaacagcgagct

SEQ ID NO: 704939 - DNA, 20 bp, mouse
gaggctgaggaaactggaga

SEQ ID NO: 704940 - DNA, 20 bp, mouse
gaggaagagaggaagatctc

SEQ ID NO: 704941 - DNA, 20 bp, mouse
gagaaagaagagggtaagaa

SEQ ID NO: 704942 - DNA, 20 bp, mouse
gccagtttcctcagccttct

SEQ ID NO: 704943 - DNA, 20 bp, mouse
gagaggacttgagaaagaag

SEQ ID NO: 704944 - DNA, 20 bp, mouse
gcgctgttgtcaggaaactg

SEQ ID NO: 704945 - DNA, 20 bp, mouse
ggagggtaagaaaggaagag

SEQ ID NO: 704946 - DNA, 20 bp, mouse
gagggggaagggtaagtact

SEQ ID NO: 704947 - DNA, 20 bp, mouse
gttaaaggcggctaaaagag

SEQ ID NO: 704948 - DNA, 20 bp, mouse
gtaagtacttggccctgtgt

SEQ ID NO: 704949 - DNA, 20 bp, mouse
gcgcttatgcgggaattcct

SEQ ID NO: 704950 - DNA, 20 bp, mouse
gtggccctgtgtgggcaccc

SEQ ID NO: 704951 - DNA, 20 bp, mouse
gtcaggcccgagaatgaata

SEQ ID NO: 704952 - DNA, 20 bp, mouse
gagcgagaagttggagatgg

SEQ ID NO: 704953 - DNA, 20 bp, mouse
ggactcggttctctaagctc

SEQ ID NO: 704954 - DNA, 20 bp, mouse
gtgacactctcgacctgccc

SEQ ID NO: 704955 - DNA, 20 bp, mouse
gtggagccagggagccaatc

SEQ ID NO: 704956 - DNA, 20 bp, mouse
gtgcggcccgcctgggtgaa

SEQ ID NO: 704957 - DNA, 20 bp, mouse
gggaaggcggggcgaaatta

SEQ ID NO: 704958 - DNA, 20 bp, mouse
gacccaggcgggccgcaaat

SEQ ID NO: 704959 - DNA, 20 bp, mouse
gactcccggcccatcggtgg

SEQ ID NO: 704960 - DNA, 20 bp, mouse
gcgggccgcaaatgggctac

SEQ ID NO: 704961 - DNA, 20 bp, mouse
ggggctaccggcgccacggt

SEQ ID NO: 704962 - DNA, 20 bp, mouse
ggcgcggagcaaacttaaga

SEQ ID NO: 704963 - DNA, 20 bp, mouse
gggctccgcccccttcaccc

SEQ ID NO: 704964 - DNA, 20 bp, mouse
gggcgccggtagcccatttg

SEQ ID NO: 704965 - DNA, 20 bp, mouse
gttgctattcaggggaaggc

SEQ ID NO: 704966 - DNA, 20 bp, mouse
gatacccctggggaatatgg

SEQ ID NO: 704967 - DNA, 20 bp, mouse
gaggcaaatagatacccctg

SEQ ID NO: 704968 - DNA, 20 bp, mouse
ggggaatatggaggagagtc

SEQ ID NO: 704969 - DNA, 20 bp, mouse
gaatctctgcccagaagcaa

SEQ ID NO: 704970 - DNA, 20 bp, mouse
gggaaagtatccacatgcct

SEQ ID NO: 704971 - DNA, 20 bp, mouse
ggccatggaaaaactgcagt

SEQ ID NO: 704972 - DNA, 20 bp, mouse
gtacacttccctattctata

SEQ ID NO: 704973 - DNA, 20 bp, mouse
gtcccactgcagtttttcca

SEQ ID NO: 704974 - DNA, 20 bp, mouse
gatatggaggagagtctggg

SEQ ID NO: 704975 - DNA, 20 bp, mouse
ggtacattaagtagatgcca

SEQ ID NO: 704976 - DNA, 20 bp, mouse
ggagggtggggaaataactg

SEQ ID NO: 704977 - DNA, 20 bp, mouse
gagaagctctccttggaggg

SEQ ID NO: 704978 - DNA, 20 bp, mouse
gggtggggaaataactgtgg

SEQ ID NO: 704979 - DNA, 20 bp, mouse
gggcctggagaagctctcct

SEQ ID NO: 704980 - DNA, 20 bp, mouse
gggggtgggcctgtggtcgg

SEQ ID NO: 704981 - DNA, 20 bp, mouse
ggcaatagctatggtggtca

SEQ ID NO: 704982 - DNA, 20 bp, mouse
ggtccaaaggaaatacggat

SEQ ID NO: 704983 - DNA, 20 bp, mouse
gcgcccatctcacctgtgat

SEQ ID NO: 704984 - DNA, 20 bp, mouse
ggcaggggtgggcctgtggt

SEQ ID NO: 704985 - DNA, 20 bp, mouse
ggagtcccgcccccgaccac

SEQ ID NO: 704986 - DNA, 20 bp, mouse
ggggcacgtaggtgggtctt

SEQ ID NO: 704987 - DNA, 20 bp, mouse
gacacccgggaggtccgcga

SEQ ID NO: 704988 - DNA, 20 bp, mouse
gcgcgatggggaagctgagt

SEQ ID NO: 704989 - DNA, 20 bp, mouse
gggtgtgtaggcaaggtctc

SEQ ID NO: 704990 - DNA, 20 bp, mouse
gtccccatcgcggacctccc

SEQ ID NO: 704991 - DNA, 20 bp, mouse
ggggcggagcctgacagcgt

SEQ ID NO: 704992 - DNA, 20 bp, mouse
gagcgtcggcccgccaagaa

SEQ ID NO: 704993 - DNA, 20 bp, mouse
ggctccccgtcacgtgacgt

SEQ ID NO: 704994 - DNA, 20 bp, mouse
ggggagactccacccgcggg

SEQ ID NO: 704995 - DNA, 20 bp, mouse
ggtgtaggcaaggtctcggg

SEQ ID NO: 704996 - DNA, 20 bp, mouse
gtggagagggagtaacccgt

SEQ ID NO: 704997 - DNA, 20 bp, mouse
gtctgctggtggcctggaga

SEQ ID NO: 704998 - DNA, 20 bp, mouse
ggtagcttgagggcaaagtt

SEQ ID NO: 704999 - DNA, 20 bp, mouse
gtccaggccaccagcagaca

SEQ ID NO: 705000 - DNA, 20 bp, mouse
gcccgccgtgggcgtgagat

SEQ ID NO: 705001 - DNA, 20 bp, mouse
gtccgcaccgtgtctgctgg

SEQ ID NO: 705002 - DNA, 20 bp, mouse
gctcactggtggtagcttga

SEQ ID NO: 705003 - DNA, 20 bp, mouse
gtaccaccagtgagcgacag

SEQ ID NO: 705004 - DNA, 20 bp, mouse
ggccaccagcagacacggtg

SEQ ID NO: 705005 - DNA, 20 bp, mouse
gcatctccaaaccactgctc

SEQ ID NO: 705006 - DNA, 20 bp, mouse
gggcacagggtagtagtgca

SEQ ID NO: 705007 - DNA, 20 bp, mouse
gactcagcgcgttccggcac

SEQ ID NO: 705008 - DNA, 20 bp, mouse
ggctgccgagcgcgggtcaa

SEQ ID NO: 705009 - DNA, 20 bp, mouse
gtagccttggagacgcgggg

SEQ ID NO: 705010 - DNA, 20 bp, mouse
gcgcaaagacgacttcctcc

SEQ ID NO: 705011 - DNA, 20 bp, mouse
gcgcgttccggcaccggcca

SEQ ID NO: 705012 - DNA, 20 bp, mouse
gttcctcccggacaccaagg

SEQ ID NO: 705013 - DNA, 20 bp, mouse
gacgcctccccgcgtctcca

SEQ ID NO: 705014 - DNA, 20 bp, mouse
gtgtgctcaaacctgtcacc

SEQ ID NO: 705015 - DNA, 20 bp, mouse
gcaggtcccctggccggtgc

SEQ ID NO: 705016 - DNA, 20 bp, mouse
gggcggggcagaaatacagt

SEQ ID NO: 705017 - DNA, 20 bp, mouse
gacagaggaggcggtgttct

SEQ ID NO: 705018 - DNA, 20 bp, mouse
gtctgggcaactagctaacc

SEQ ID NO: 705019 - DNA, 20 bp, mouse
gctgccttggctcttttaaa

SEQ ID NO: 705020 - DNA, 20 bp, mouse
gggaaggatgtgatcttctg

SEQ ID NO: 705021 - DNA, 20 bp, mouse
gcctaataggggttgctcat

SEQ ID NO: 705022 - DNA, 20 bp, mouse
ggaaatacagttggccaatc

SEQ ID NO: 705023 - DNA, 20 bp, mouse
gaggcgttcttattgaactt

SEQ ID NO: 705024 - DNA, 20 bp, mouse
gaaagcaacaagttgggatg

SEQ ID NO: 705025 - DNA, 20 bp, mouse
gtagctaaccaggaatgggc

SEQ ID NO: 705026 - DNA, 20 bp, mouse
ggatgtgcaggtaatctccc

SEQ ID NO: 705027 - DNA, 20 bp, mouse
gtcggccaattcagaccatt

SEQ ID NO: 705028 - DNA, 20 bp, mouse
gggtacccaatggtctgaat

SEQ ID NO: 705029 - DNA, 20 bp, mouse
gcctccacttctgtctgttc

SEQ ID NO: 705030 - DNA, 20 bp, mouse
gtagtgggacagataataac

SEQ ID NO: 705031 - DNA, 20 bp, mouse
gtcgagacgcgcgactgcgc

SEQ ID NO: 705032 - DNA, 20 bp, mouse
gagcagggttcggtacccaa

SEQ ID NO: 705033 - DNA, 20 bp, mouse
gcgcctggtgcagcagggtt

SEQ ID NO: 705034 - DNA, 20 bp, mouse
gagctccgcctggtgcagca

SEQ ID NO: 705035 - DNA, 20 bp, mouse
gataaatgacctgaggcctg

SEQ ID NO: 705036 - DNA, 20 bp, mouse
gagcagatgagcaaagtgag

SEQ ID NO: 705037 - DNA, 20 bp, mouse
ggtgcctgactgagaccgaa

SEQ ID NO: 705038 - DNA, 20 bp, mouse
gtaccgggttgagaccgcag

SEQ ID NO: 705039 - DNA, 20 bp, mouse
gtagccaaataccaaatcaa

SEQ ID NO: 705040 - DNA, 20 bp, mouse
gtgctttttacgctgatacc

SEQ ID NO: 705041 - DNA, 20 bp, mouse
gccacccttcggtctcagtc

SEQ ID NO: 705042 - DNA, 20 bp, mouse
gaaatgtttccgggcctctg

SEQ ID NO: 705043 - DNA, 20 bp, mouse
gggttgagaccgcagaggcc

SEQ ID NO: 705044 - DNA, 20 bp, mouse
gctcttgtgcctttctgttt

SEQ ID NO: 705045 - DNA, 20 bp, mouse
ggtgcctttctgtttgggaa

SEQ ID NO: 705046 - DNA, 20 bp, mouse
gcagcccaggagatatactc

SEQ ID NO: 705047 - DNA, 20 bp, mouse
gcctgctcctgtgtgccaga

SEQ ID NO: 705048 - DNA, 20 bp, mouse
gaaccccgagtatatctcct

SEQ ID NO: 705049 - DNA, 20 bp, mouse
gcgcccgcgccttagtgcag

SEQ ID NO: 705050 - DNA, 20 bp, mouse
ggggtctgagagctcgctgc

SEQ ID NO: 705051 - DNA, 20 bp, mouse
gactcggggttacaccgaga

SEQ ID NO: 705052 - DNA, 20 bp, mouse
ggcgagctctcagaccctct

SEQ ID NO: 705053 - DNA, 20 bp, mouse
gtcctgtgtgccagagggga

SEQ ID NO: 705054 - DNA, 20 bp, mouse
gttctcggaagggacccgta

SEQ ID NO: 705055 - DNA, 20 bp, mouse
ggtccgctgcactaaggcgc

SEQ ID NO: 705056 - DNA, 20 bp, mouse
gccaggagggcggggctcag

SEQ ID NO: 705057 - DNA, 20 bp, mouse
gttgtcttgtgtaactgcgg

SEQ ID NO: 705058 - DNA, 20 bp, mouse
ggtttaggggccacccagga

SEQ ID NO: 705059 - DNA, 20 bp, mouse
gaacacgcccccttttccgg

SEQ ID NO: 705060 - DNA, 20 bp, mouse
ggaccccctcgacttataaa

SEQ ID NO: 705061 - DNA, 20 bp, mouse
ggagagatccatgacgcaag

SEQ ID NO: 705062 - DNA, 20 bp, mouse
gaggggccacccaggagggc

SEQ ID NO: 705063 - DNA, 20 bp, mouse
gtgtaactgcgggggtttag

SEQ ID NO: 705064 - DNA, 20 bp, mouse
gtatggcagggcgactcggc

SEQ ID NO: 705065 - DNA, 20 bp, mouse
gacaaaaagccaagaatccg

SEQ ID NO: 705066 - DNA, 20 bp, mouse
gtgtccccgcggacttcact

SEQ ID NO: 705067 - DNA, 20 bp, mouse
gggacagagcagggagtaac

SEQ ID NO: 705068 - DNA, 20 bp, mouse
gctcaggctccaaagtccgg

SEQ ID NO: 705069 - DNA, 20 bp, mouse
gaagagggcaaaggggcgac

SEQ ID NO: 705070 - DNA, 20 bp, mouse
gcggacttcactaggagttg

SEQ ID NO: 705071 - DNA, 20 bp, mouse
gtcccgccgccccagagacc

SEQ ID NO: 705072 - DNA, 20 bp, mouse
ggggacaggcggaaaccgac

SEQ ID NO: 705073 - DNA, 20 bp, mouse
gggctcgtgcagtgtccgca

SEQ ID NO: 705074 - DNA, 20 bp, mouse
gtcactaggagttgtggcca

SEQ ID NO: 705075 - DNA, 20 bp, mouse
gactcctagtgaagtccgcg

SEQ ID NO: 705076 - DNA, 20 bp, mouse
gaccaagctggcagtcactg

SEQ ID NO: 705077 - DNA, 20 bp, mouse
gggagggcctgtggtttcta

SEQ ID NO: 705078 - DNA, 20 bp, mouse
gtaccacctgcttagttccc

SEQ ID NO: 705079 - DNA, 20 bp, mouse
gggtggctctaatgagacaa

SEQ ID NO: 705080 - DNA, 20 bp, mouse
ggaagaaagctgaggcgtga

SEQ ID NO: 705081 - DNA, 20 bp, mouse
gactgacctgggaactaagc

SEQ ID NO: 705082 - DNA, 20 bp, mouse
gcatctactccacacctggt

SEQ ID NO: 705083 - DNA, 20 bp, mouse
gggtgacagagtggtcacca

SEQ ID NO: 705084 - DNA, 20 bp, mouse
gggcttcagaccaagagaaa

SEQ ID NO: 705085 - DNA, 20 bp, mouse
gaccacagtgactgccagct

SEQ ID NO: 705086 - DNA, 20 bp, mouse
gccctcacaggagctcctga

SEQ ID NO: 705087 - DNA, 20 bp, mouse
gaagccccggcgacaggaac

SEQ ID NO: 705088 - DNA, 20 bp, mouse
gaggaacgggtgttgaagag

SEQ ID NO: 705089 - DNA, 20 bp, mouse
gacacccgttcctgtcgccg

SEQ ID NO: 705090 - DNA, 20 bp, mouse
gtcctcttctccaagggcag

SEQ ID NO: 705091 - DNA, 20 bp, mouse
gttgaagagaggggcgtagg

SEQ ID NO: 705092 - DNA, 20 bp, mouse
gatacgcaaagaggaccctc

SEQ ID NO: 705093 - DNA, 20 bp, mouse
gggcaaaagcaaagaacgtc

SEQ ID NO: 705094 - DNA, 20 bp, mouse
gggctggaagccccggcgac

SEQ ID NO: 705095 - DNA, 20 bp, mouse
gtgggccacagatttgttca

SEQ ID NO: 705096 - DNA, 20 bp, mouse
gaggccgagggtgtccgcgg

SEQ ID NO: 705097 - DNA, 20 bp, mouse
ggaacgaagcggcaggtcgt

SEQ ID NO: 705098 - DNA, 20 bp, mouse
gaataaggactgaaaagtct

SEQ ID NO: 705099 - DNA, 20 bp, mouse
gaagcggcaggtcgtgggtg

SEQ ID NO: 705100 - DNA, 20 bp, mouse
ggagcggcaggcgcggaact

SEQ ID NO: 705101 - DNA, 20 bp, mouse
ggcccccccgcggacaccct

SEQ ID NO: 705102 - DNA, 20 bp, mouse
gtggagcgcggcgcacggag

SEQ ID NO: 705103 - DNA, 20 bp, mouse
ggggcggggaacgaagcggc

SEQ ID NO: 705104 - DNA, 20 bp, mouse
gtacttgcgacccaaagctg

SEQ ID NO: 705105 - DNA, 20 bp, mouse
ggccgcgctccagattttat

SEQ ID NO: 705106 - DNA, 20 bp, mouse
gcccgccgcgggacgagtaa

SEQ ID NO: 705107 - DNA, 20 bp, mouse
gcccgcgggtgactggccct

SEQ ID NO: 705108 - DNA, 20 bp, mouse
gtaggccgcgcgccgcgctc

SEQ ID NO: 705109 - DNA, 20 bp, mouse
ggtgactggccctcggcctg

SEQ ID NO: 705110 - DNA, 20 bp, mouse
ggccgagggccagtcacccg

SEQ ID NO: 705111 - DNA, 20 bp, mouse
gccggcgcggacggtcgctg

SEQ ID NO: 705112 - DNA, 20 bp, mouse
gacggagaggcggtcccgga

SEQ ID NO: 705113 - DNA, 20 bp, mouse
ggcgcaggcccgcgggtgac

SEQ ID NO: 705114 - DNA, 20 bp, mouse
gccacgcccgccgcaggccg

SEQ ID NO: 705115 - DNA, 20 bp, mouse
ggccgccgccgctgaaacga

SEQ ID NO: 705116 - DNA, 20 bp, mouse
ggagcagcccagctcttctc

SEQ ID NO: 705117 - DNA, 20 bp, mouse
gtcctcttagcattaaggag

SEQ ID NO: 705118 - DNA, 20 bp, mouse
gtagcaccctgagaagagct

SEQ ID NO: 705119 - DNA, 20 bp, mouse
ggcagtgcaaacaccgaggg

SEQ ID NO: 705120 - DNA, 20 bp, mouse
gtgtaccctgacctgggtta

SEQ ID NO: 705121 - DNA, 20 bp, mouse
gtgtgagcgagaaggcagac

SEQ ID NO: 705122 - DNA, 20 bp, mouse
gtgttccctaacccaggtca

SEQ ID NO: 705123 - DNA, 20 bp, mouse
gtaacttaaaaggatattga

SEQ ID NO: 705124 - DNA, 20 bp, mouse
ggaatcccaggtagtctgct

SEQ ID NO: 705125 - DNA, 20 bp, mouse
ggcatagtgtaccctgacct

SEQ ID NO: 705126 - DNA, 20 bp, mouse
gagaaggaggtaagtgaaag

SEQ ID NO: 705127 - DNA, 20 bp, mouse
gtaaaggtgcttctgttcag

SEQ ID NO: 705128 - DNA, 20 bp, mouse
ggcagtgggtgccctgtcat

SEQ ID NO: 705129 - DNA, 20 bp, mouse
ggactcttttccaagtgaga

SEQ ID NO: 705130 - DNA, 20 bp, mouse
gagcacctcagccaatgaca

SEQ ID NO: 705131 - DNA, 20 bp, mouse
gtcttttccaagtgagaagg

SEQ ID NO: 705132 - DNA, 20 bp, mouse
gcaggtttgtacagagacac

SEQ ID NO: 705133 - DNA, 20 bp, mouse
gtctgtacaaacctgcttaa

SEQ ID NO: 705134 - DNA, 20 bp, mouse
ggaggggggaggaaatagga

SEQ ID NO: 705135 - DNA, 20 bp, mouse
gaacagagagacagatatgg

SEQ ID NO: 705136 - DNA, 20 bp, mouse
gcagctctggcatccttggg

SEQ ID NO: 705137 - DNA, 20 bp, mouse
ggcctaggaaacagcacgat

SEQ ID NO: 705138 - DNA, 20 bp, mouse
gggctgcagagcacgacctg

SEQ ID NO: 705139 - DNA, 20 bp, mouse
ggaggagatcccgcgcccag

SEQ ID NO: 705140 - DNA, 20 bp, mouse
ggggtgtcggtgctggaccc

SEQ ID NO: 705141 - DNA, 20 bp, mouse
gtaggaaacagcacgatggg

SEQ ID NO: 705142 - DNA, 20 bp, mouse
gagagctgcagggcgctgtc

SEQ ID NO: 705143 - DNA, 20 bp, mouse
ggggcctgagactagtcttt

SEQ ID NO: 705144 - DNA, 20 bp, mouse
gtcctcgattcggcctcccc

SEQ ID NO: 705145 - DNA, 20 bp, mouse
gaggcctcgccttgccgcgt

SEQ ID NO: 705146 - DNA, 20 bp, mouse
gagggcgccctcacctcgag

SEQ ID NO: 705147 - DNA, 20 bp, mouse
gcaggtgggcgaagtggaac

SEQ ID NO: 705148 - DNA, 20 bp, mouse
ggacaactgcaactcccaga

SEQ ID NO: 705149 - DNA, 20 bp, mouse
gcggccaccgctcgaggtga

SEQ ID NO: 705150 - DNA, 20 bp, mouse
ggtgggcgaagtggaaccgg

SEQ ID NO: 705151 - DNA, 20 bp, mouse
gcatccaggtagcttgtcct

SEQ ID NO: 705152 - DNA, 20 bp, mouse
gtcgagcggtggccgcaggt

SEQ ID NO: 705153 - DNA, 20 bp, mouse
gggggcgtggtcttaagggt

SEQ ID NO: 705154 - DNA, 20 bp, mouse
gcctgggggcgtggtctcga

SEQ ID NO: 705155 - DNA, 20 bp, mouse
ggcgccctcacctcgagcgg

SEQ ID NO: 705156 - DNA, 20 bp, mouse
gcaccctcacgcctggacta

SEQ ID NO: 705157 - DNA, 20 bp, mouse
gtccaggcgtgagggtggta

SEQ ID NO: 705158 - DNA, 20 bp, mouse
gtgccacaggaagaccctga

SEQ ID NO: 705159 - DNA, 20 bp, mouse
gataaccagacacttaaatt

SEQ ID NO: 705160 - DNA, 20 bp, mouse
gattgggtatcagggagcaa

SEQ ID NO: 705161 - DNA, 20 bp, mouse
gcgcctggactaggggactg

SEQ ID NO: 705162 - DNA, 20 bp, mouse
gtcccctagtccaggcgtga

SEQ ID NO: 705163 - DNA, 20 bp, mouse
gctaggaggctcacccctca

SEQ ID NO: 705164 - DNA, 20 bp, mouse
gtaagatgaacgtagttttc

SEQ ID NO: 705165 - DNA, 20 bp, mouse
gctagttactgaaaacaagg

SEQ ID NO: 705166 - DNA, 20 bp, mouse
ggctagggaagtccttaaaa

SEQ ID NO: 705167 - DNA, 20 bp, mouse
gacccagctggtacaaaggg

SEQ ID NO: 705168 - DNA, 20 bp, mouse
gccagctgaaagcttcaatt

SEQ ID NO: 705169 - DNA, 20 bp, mouse
gagtacgggtggaaaaaggc

SEQ ID NO: 705170 - DNA, 20 bp, mouse
gttgtgccaaattctttcca

SEQ ID NO: 705171 - DNA, 20 bp, mouse
gatgatgcccagagaagtaa

SEQ ID NO: 705172 - DNA, 20 bp, mouse
gcatacccagctggtacaaa

SEQ ID NO: 705173 - DNA, 20 bp, mouse
gtcaccaaccccaaattcca

SEQ ID NO: 705174 - DNA, 20 bp, mouse
gtgtagcctccatggaattt

SEQ ID NO: 705175 - DNA, 20 bp, mouse
ggtttcagttgcttcatcca

SEQ ID NO: 705176 - DNA, 20 bp, mouse
gtgcgctcgagctagactac

SEQ ID NO: 705177 - DNA, 20 bp, mouse
gtctatgtgattggcgtcat

SEQ ID NO: 705178 - DNA, 20 bp, mouse
gacagcctgacgtttaaata

SEQ ID NO: 705179 - DNA, 20 bp, mouse
gataaagaggatgagcacct

SEQ ID NO: 705180 - DNA, 20 bp, mouse
gcgccaatcacatagacccg

SEQ ID NO: 705181 - DNA, 20 bp, mouse
gagtctagctcgagcgcata

SEQ ID NO: 705182 - DNA, 20 bp, mouse
gtctgaaatgtctaacaaat

SEQ ID NO: 705183 - DNA, 20 bp, mouse
ggtgctcatcctctttataa

SEQ ID NO: 705184 - DNA, 20 bp, mouse
gcttcagaaacttgagaagc

SEQ ID NO: 705185 - DNA, 20 bp, mouse
gggaaactctaaatattata

SEQ ID NO: 705186 - DNA, 20 bp, mouse
ggcccgctgcatccgaccaa

SEQ ID NO: 705187 - DNA, 20 bp, mouse
gcctagccaggcgttatcag

SEQ ID NO: 705188 - DNA, 20 bp, mouse
gcaggcgttatcagcggagt

SEQ ID NO: 705189 - DNA, 20 bp, mouse
gtccactctgggctccgggg

SEQ ID NO: 705190 - DNA, 20 bp, mouse
gccggcggggggtgagaaag

SEQ ID NO: 705191 - DNA, 20 bp, mouse
gggatgcagcgggctctcca

SEQ ID NO: 705192 - DNA, 20 bp, mouse
gcgcccttggtcggatgcag

SEQ ID NO: 705193 - DNA, 20 bp, mouse
gcagcgggctctccagggcg

SEQ ID NO: 705194 - DNA, 20 bp, mouse
ggccgatgctggcctcgccc

SEQ ID NO: 705195 - DNA, 20 bp, mouse
gtccagggcgaggccagcat

SEQ ID NO: 705196 - DNA, 20 bp, mouse
gccgccaggcccgccacacc

SEQ ID NO: 705197 - DNA, 20 bp, mouse
ggccctgagagatgctgata

SEQ ID NO: 705198 - DNA, 20 bp, mouse
gaacaagaatacaggtcccc

SEQ ID NO: 705199 - DNA, 20 bp, mouse
gaccttatcagcatctctca

SEQ ID NO: 705200 - DNA, 20 bp, mouse
gaggggttttcagagtctgc

SEQ ID NO: 705201 - DNA, 20 bp, mouse
ggtgcatgacacgccaggtg

SEQ ID NO: 705202 - DNA, 20 bp, mouse
gatgacacgccaggtgtggc

SEQ ID NO: 705203 - DNA, 20 bp, mouse
gacaatcttgaaggattctc

SEQ ID NO: 705204 - DNA, 20 bp, mouse
gacgccaggtgtggcgggcc

SEQ ID NO: 705205 - DNA, 20 bp, mouse
gggtgtgtgcatgacacgcc

SEQ ID NO: 705206 - DNA, 20 bp, mouse
gtggacagggagatacagag

SEQ ID NO: 705207 - DNA, 20 bp, mouse
ggtgtgcaggaagactggac

SEQ ID NO: 705208 - DNA, 20 bp, mouse
gagaggagacgctcaacttt

SEQ ID NO: 705209 - DNA, 20 bp, mouse
gacagtgtgtgcaggaagac

SEQ ID NO: 705210 - DNA, 20 bp, mouse
gtcgtgaggccaaaaggaca

SEQ ID NO: 705211 - DNA, 20 bp, mouse
gcctgcacacactgtgggtc

SEQ ID NO: 705212 - DNA, 20 bp, mouse
gagggtcccagtagtccttg

SEQ ID NO: 705213 - DNA, 20 bp, mouse
gggtgcaaatctgtgaggac

SEQ ID NO: 705214 - DNA, 20 bp, mouse
gctcctgggctccagccctg

SEQ ID NO: 705215 - DNA, 20 bp, mouse
gctggggtcgtgaggccaaa

SEQ ID NO: 705216 - DNA, 20 bp, mouse
gaaagcctgggactccctag

SEQ ID NO: 705217 - DNA, 20 bp, mouse
gctcccatggttcctccgtt

SEQ ID NO: 705218 - DNA, 20 bp, mouse
gaaccatgggagattttcca

SEQ ID NO: 705219 - DNA, 20 bp, mouse
ggggagagggttagccacta

SEQ ID NO: 705220 - DNA, 20 bp, mouse
gaaaaaggttggttagggag

SEQ ID NO: 705221 - DNA, 20 bp, mouse
ggcaccagactattaaccaa

SEQ ID NO: 705222 - DNA, 20 bp, mouse
gcctccgttaggaaaagcct

SEQ ID NO: 705223 - DNA, 20 bp, mouse
gtatatgcccagctagactg

SEQ ID NO: 705224 - DNA, 20 bp, mouse
gtgccatggaaaatctccca

SEQ ID NO: 705225 - DNA, 20 bp, mouse
gagaaagaggaggtgcctgc

SEQ ID NO: 705226 - DNA, 20 bp, mouse
gccggatggggctgtgtgag

SEQ ID NO: 705227 - DNA, 20 bp, mouse
gaggcgctgaggcccggatg

SEQ ID NO: 705228 - DNA, 20 bp, mouse
gtgtgcatgtggaggcgctg

SEQ ID NO: 705229 - DNA, 20 bp, mouse
ggataggacaacccgcgcga

SEQ ID NO: 705230 - DNA, 20 bp, mouse
gtgagaggcgcagattggct

SEQ ID NO: 705231 - DNA, 20 bp, mouse
gctgtgtgagaggcgcagat

SEQ ID NO: 705232 - DNA, 20 bp, mouse
gggggtgggtccagagtaag

SEQ ID NO: 705233 - DNA, 20 bp, mouse
gcatcttgaaggttccactt

SEQ ID NO: 705234 - DNA, 20 bp, mouse
gtgcacaaggtcacccccat

SEQ ID NO: 705235 - DNA, 20 bp, mouse
ggggagaggcgcgctctgat

SEQ ID NO: 705236 - DNA, 20 bp, mouse
gggagctggagccaactcag

SEQ ID NO: 705237 - DNA, 20 bp, mouse
ggaggaaagccacaccccaa

SEQ ID NO: 705238 - DNA, 20 bp, mouse
gcaaaaccaacgcaggggtg

SEQ ID NO: 705239 - DNA, 20 bp, mouse
gtgaggggatgaacggtcct

SEQ ID NO: 705240 - DNA, 20 bp, mouse
gcagaggagaaaaatcctat

SEQ ID NO: 705241 - DNA, 20 bp, mouse
gcgatcgcctggggaagcgg

SEQ ID NO: 705242 - DNA, 20 bp, mouse
ggggcgcagagcggttcctg

SEQ ID NO: 705243 - DNA, 20 bp, mouse
gacatccaaaaccaacgcag

SEQ ID NO: 705244 - DNA, 20 bp, mouse
ggagttggctccagctccct

SEQ ID NO: 705245 - DNA, 20 bp, mouse
gttcctccccacccctgcgt

SEQ ID NO: 705246 - DNA, 20 bp, mouse
gtatgcccaagcaacgtcca

SEQ ID NO: 705247 - DNA, 20 bp, mouse
gggatgctgtgctgcctagt

SEQ ID NO: 705248 - DNA, 20 bp, mouse
gacttcctctacggtcgaac

SEQ ID NO: 705249 - DNA, 20 bp, mouse
gctcacagatgatctcttaa

SEQ ID NO: 705250 - DNA, 20 bp, mouse
ggcgtaaaggacttcctcta

SEQ ID NO: 705251 - DNA, 20 bp, mouse
gtgtgctgcctagtcggctg

SEQ ID NO: 705252 - DNA, 20 bp, mouse
gtgggccttggacgttgctt

SEQ ID NO: 705253 - DNA, 20 bp, mouse
ggatcatctgtgagatgtaa

SEQ ID NO: 705254 - DNA, 20 bp, mouse
gttaagggcctcagccgact

SEQ ID NO: 705255 - DNA, 20 bp, mouse
gaacagcaggacatgatctc

SEQ ID NO: 705256 - DNA, 20 bp, mouse
gaggacctccagctgggagg

SEQ ID NO: 705257 - DNA, 20 bp, mouse
gaggaggggcaaggggatcc

SEQ ID NO: 705258 - DNA, 20 bp, mouse
gcaactgtgagcgctctggg

SEQ ID NO: 705259 - DNA, 20 bp, mouse
gacagcccgcgatccgagga

SEQ ID NO: 705260 - DNA, 20 bp, mouse
gtccctccctagggccctca

SEQ ID NO: 705261 - DNA, 20 bp, mouse
gctcactgggtgcaggagga

SEQ ID NO: 705262 - DNA, 20 bp, mouse
gagtaatgacatcgcgggga

SEQ ID NO: 705263 - DNA, 20 bp, mouse
gctccctgagggccctaggg

SEQ ID NO: 705264 - DNA, 20 bp, mouse
ggggaaggttgcagaaaccc

SEQ ID NO: 705265 - DNA, 20 bp, mouse
gaagaggggcaggctcgaag

SEQ ID NO: 705266 - DNA, 20 bp, mouse
gcggaagtggcgggtctcgt

SEQ ID NO: 705267 - DNA, 20 bp, mouse
gacggcagagcgctgtgatt

SEQ ID NO: 705268 - DNA, 20 bp, mouse
gcgcgctaagggcactaggg

SEQ ID NO: 705269 - DNA, 20 bp, mouse
gggcggaagaaacttccaat

SEQ ID NO: 705270 - DNA, 20 bp, mouse
gagagtgaggtgagtgttgc

SEQ ID NO: 705271 - DNA, 20 bp, mouse
gctaagggcactagggaggc

SEQ ID NO: 705272 - DNA, 20 bp, mouse
gaagaaacttccaatcggac

SEQ ID NO: 705273 - DNA, 20 bp, mouse
gcaccgtgaacaccactgtg

SEQ ID NO: 705274 - DNA, 20 bp, mouse
ggcccccgggccggagtgcg

SEQ ID NO: 705275 - DNA, 20 bp, mouse
gcaatcggaccggaagtggc

SEQ ID NO: 705276 - DNA, 20 bp, mouse
gcgaagcgcccttggaaccc

SEQ ID NO: 705277 - DNA, 20 bp, mouse
gagtcccggagcttcggcgt

SEQ ID NO: 705278 - DNA, 20 bp, mouse
gacagggcctgtaatgagcc

SEQ ID NO: 705279 - DNA, 20 bp, mouse
gtgggagcagcgctgcacaa

SEQ ID NO: 705280 - DNA, 20 bp, mouse
ggaagctccgggactctgat

SEQ ID NO: 705281 - DNA, 20 bp, mouse
gctccagccaatcagagtcc

SEQ ID NO: 705282 - DNA, 20 bp, mouse
gggtaagcctggctcattac

SEQ ID NO: 705283 - DNA, 20 bp, mouse
gccccccaacgccgaagctc

SEQ ID NO: 705284 - DNA, 20 bp, mouse
gcgcccttggaacccaggcc

SEQ ID NO: 705285 - DNA, 20 bp, mouse
gggggccggaaccgctgtca

SEQ ID NO: 705286 - DNA, 20 bp, mouse
gcagtcgcagacttgagtag

SEQ ID NO: 705287 - DNA, 20 bp, mouse
gggcccccccagagcaagaa

SEQ ID NO: 705288 - DNA, 20 bp, mouse
ggggtggtgctctgcataac

SEQ ID NO: 705289 - DNA, 20 bp, mouse
gagtctgcgactgccttctg

SEQ ID NO: 705290 - DNA, 20 bp, mouse
ggccctgcattcagaccagt

SEQ ID NO: 705291 - DNA, 20 bp, mouse
ggctgcggcgcgtgacgcga

SEQ ID NO: 705292 - DNA, 20 bp, mouse
gggagctgacaaatggtagt

SEQ ID NO: 705293 - DNA, 20 bp, mouse
gtagacccatagaaattcac

SEQ ID NO: 705294 - DNA, 20 bp, mouse
ggagccatcttgaccgcaga

SEQ ID NO: 705295 - DNA, 20 bp, mouse
gtggctgtacccacagaacc

SEQ ID NO: 705296 - DNA, 20 bp, mouse
gcggctgcggggctagtctc

SEQ ID NO: 705297 - DNA, 20 bp, mouse
gggtgtgcgctcccgagtgt

SEQ ID NO: 705298 - DNA, 20 bp, mouse
ggccacagaccgtctcttgg

SEQ ID NO: 705299 - DNA, 20 bp, mouse
ggccgccaagagacggtctg

SEQ ID NO: 705300 - DNA, 20 bp, mouse
gcgcgcgcacgcccgcacac

SEQ ID NO: 705301 - DNA, 20 bp, mouse
gtggccgatagcgccctcgg

SEQ ID NO: 705302 - DNA, 20 bp, mouse
gacccacggcccccacactc

SEQ ID NO: 705303 - DNA, 20 bp, mouse
gagtcccggcgccgctccgt

SEQ ID NO: 705304 - DNA, 20 bp, mouse
gtgcgtgcgtcccggtgtgc

SEQ ID NO: 705305 - DNA, 20 bp, mouse
ggggctgggcgggctttgga

SEQ ID NO: 705306 - DNA, 20 bp, mouse
gccggcccccgtgtcgtcag

SEQ ID NO: 705307 - DNA, 20 bp, mouse
gccggggcgggcagctgggg

SEQ ID NO: 705308 - DNA, 20 bp, mouse
ggcggccgctgacgacacgg

SEQ ID NO: 705309 - DNA, 20 bp, mouse
ggctataaagggcccggccc

SEQ ID NO: 705310 - DNA, 20 bp, mouse
gagatcggggacagacggag

SEQ ID NO: 705311 - DNA, 20 bp, mouse
ggctgcggagccaacaaaag

SEQ ID NO: 705312 - DNA, 20 bp, mouse
ggggggctgcccggccgagg

SEQ ID NO: 705313 - DNA, 20 bp, mouse
gcgggggccggggctataaa

SEQ ID NO: 705314 - DNA, 20 bp, mouse
gccggctccctctctcgcct

SEQ ID NO: 705315 - DNA, 20 bp, mouse
gtgtcatccgaggcgagaga

SEQ ID NO: 705316 - DNA, 20 bp, mouse
gtgggagggagggaaaccgc

SEQ ID NO: 705317 - DNA, 20 bp, mouse
gaattcgggcgggaatccca

SEQ ID NO: 705318 - DNA, 20 bp, mouse
gcactcaggtcccagcccgg

SEQ ID NO: 705319 - DNA, 20 bp, mouse
gaatcccagggctccgcagg

SEQ ID NO: 705320 - DNA, 20 bp, mouse
gcccgtgtgcgatgccaact

SEQ ID NO: 705321 - DNA, 20 bp, mouse
gagagagtcctggtcccaag

SEQ ID NO: 705322 - DNA, 20 bp, mouse
ggggaatcccagggctccgc

SEQ ID NO: 705323 - DNA, 20 bp, mouse
gggagggaaaccgccgggct

SEQ ID NO: 705324 - DNA, 20 bp, mouse
gggagcggacagagtccagt

SEQ ID NO: 705325 - DNA, 20 bp, mouse
gggacgatcagccctcactc

SEQ ID NO: 705326 - DNA, 20 bp, mouse
gaacatctgaccagcactag

SEQ ID NO: 705327 - DNA, 20 bp, mouse
ggcactaggggctggtggaa

SEQ ID NO: 705328 - DNA, 20 bp, mouse
gcacacccagataagaagag

SEQ ID NO: 705329 - DNA, 20 bp, mouse
ggaccagcactaggggctgg

SEQ ID NO: 705330 - DNA, 20 bp, mouse
gaggatgctgactactgtaa

SEQ ID NO: 705331 - DNA, 20 bp, mouse
gggaacaaagattctaatta

SEQ ID NO: 705332 - DNA, 20 bp, mouse
gtaaaggatcggcatttctc

SEQ ID NO: 705333 - DNA, 20 bp, mouse
gtgctcggacctcttatctc

SEQ ID NO: 705334 - DNA, 20 bp, mouse
gaagaagagtggaggattgt

SEQ ID NO: 705335 - DNA, 20 bp, mouse
gaagatgacacaaactgtgg

SEQ ID NO: 705336 - DNA, 20 bp, mouse
gccaacccgcggggagtaga

SEQ ID NO: 705337 - DNA, 20 bp, mouse
gcactgctgaccaacccgcg

SEQ ID NO: 705338 - DNA, 20 bp, mouse
ggtgtacagcgtgagtgaaa

SEQ ID NO: 705339 - DNA, 20 bp, mouse
gaggctcctgaattgagcag

SEQ ID NO: 705340 - DNA, 20 bp, mouse
gtaaaagagaaacaagttga

SEQ ID NO: 705341 - DNA, 20 bp, mouse
gttctccttctactccccgc

SEQ ID NO: 705342 - DNA, 20 bp, mouse
gtcacacttgattagctccc

SEQ ID NO: 705343 - DNA, 20 bp, mouse
gacattgaattgcctctgag

SEQ ID NO: 705344 - DNA, 20 bp, mouse
ggcatgccacagtacagggg

SEQ ID NO: 705345 - DNA, 20 bp, mouse
gagcctcctctgctcaattc

SEQ ID NO: 705346 - DNA, 20 bp, mouse
gctcccgcacaactgactga

SEQ ID NO: 705347 - DNA, 20 bp, mouse
gcttgaaggaggcttgtata

SEQ ID NO: 705348 - DNA, 20 bp, mouse
gtgtgtgtaagtattttcac

SEQ ID NO: 705349 - DNA, 20 bp, mouse
ggaggcttgtataaggctga

SEQ ID NO: 705350 - DNA, 20 bp, mouse
gaaaaaaaactggagcgcac

SEQ ID NO: 705351 - DNA, 20 bp, mouse
gcaactgactgagggcttga

SEQ ID NO: 705352 - DNA, 20 bp, mouse
gaagcctgagtcccgctatg

SEQ ID NO: 705353 - DNA, 20 bp, mouse
gaagccctcagtcagttgtg

SEQ ID NO: 705354 - DNA, 20 bp, mouse
ggtcagttgtgcgggagaaa

SEQ ID NO: 705355 - DNA, 20 bp, mouse
gaaaacccctgagtctactc

SEQ ID NO: 705356 - DNA, 20 bp, mouse
gagtgcgggcaggaggtgtg

SEQ ID NO: 705357 - DNA, 20 bp, mouse
gcggcgctccggaccccgtg

SEQ ID NO: 705358 - DNA, 20 bp, mouse
gagcgctgcggggataggga

SEQ ID NO: 705359 - DNA, 20 bp, mouse
gggaagagccccacggggtc

SEQ ID NO: 705360 - DNA, 20 bp, mouse
gggcgagcgcctctgtccca

SEQ ID NO: 705361 - DNA, 20 bp, mouse
gagagctggaagagccccac

SEQ ID NO: 705362 - DNA, 20 bp, mouse
gtctccccacctcccggcga

SEQ ID NO: 705363 - DNA, 20 bp, mouse
gcgcccctcgccgggaggtg

SEQ ID NO: 705364 - DNA, 20 bp, mouse
gggacagaggcgctcgcctc

SEQ ID NO: 705365 - DNA, 20 bp, mouse
ggccgcggctgccactcccc

SEQ ID NO: 705366 - DNA, 20 bp, mouse
gctaccctgcactgcgcgat

SEQ ID NO: 705367 - DNA, 20 bp, mouse
gggaccaggcactacagcaa

SEQ ID NO: 705368 - DNA, 20 bp, mouse
ggccccgcctcccctcccga

SEQ ID NO: 705369 - DNA, 20 bp, mouse
gtgctccgagcgctgggcgg

SEQ ID NO: 705370 - DNA, 20 bp, mouse
ggcgcgataggcctgagttg

SEQ ID NO: 705371 - DNA, 20 bp, mouse
gttgtggcaggagcctcggg

SEQ ID NO: 705372 - DNA, 20 bp, mouse
gcactccttggctggaagat

SEQ ID NO: 705373 - DNA, 20 bp, mouse
gtacggcgagaaagctggat

SEQ ID NO: 705374 - DNA, 20 bp, mouse
gcgggttgaacgttcagcag

SEQ ID NO: 705375 - DNA, 20 bp, mouse
gaggcctatcgcgcagtgca

SEQ ID NO: 705376 - DNA, 20 bp, mouse
gtagggtgacgatacttggt

SEQ ID NO: 705377 - DNA, 20 bp, mouse
gccactagggtgacgatact

SEQ ID NO: 705378 - DNA, 20 bp, mouse
gcagcagtcagctgacaaca

SEQ ID NO: 705379 - DNA, 20 bp, mouse
gtgcaagtagctgttgtctt

SEQ ID NO: 705380 - DNA, 20 bp, mouse
ggtacagctaggcatgcttg

SEQ ID NO: 705381 - DNA, 20 bp, mouse
ggtccaggtggcttagtaga

SEQ ID NO: 705382 - DNA, 20 bp, mouse
gagtagaggggttgtaaagt

SEQ ID NO: 705383 - DNA, 20 bp, mouse
gaggtggttagaataactga

SEQ ID NO: 705384 - DNA, 20 bp, mouse
gatgtgactgcagaagtatt

SEQ ID NO: 705385 - DNA, 20 bp, mouse
gcctatataagtagtccact

SEQ ID NO: 705386 - DNA, 20 bp, mouse
gttcgcccgtcacttccggg

SEQ ID NO: 705387 - DNA, 20 bp, mouse
gcgctcctcccggaagtgac

SEQ ID NO: 705388 - DNA, 20 bp, mouse
gccagggccgccgtcaccat

SEQ ID NO: 705389 - DNA, 20 bp, mouse
gccttgagatcgaaagaaaa

SEQ ID NO: 705390 - DNA, 20 bp, mouse
gagggctgggcggagcttag

SEQ ID NO: 705391 - DNA, 20 bp, mouse
ggaaagccggctcagagctc

SEQ ID NO: 705392 - DNA, 20 bp, mouse
gggaagtgacgggcgaaagc

SEQ ID NO: 705393 - DNA, 20 bp, mouse
ggggacagaagatagacgcg

SEQ ID NO: 705394 - DNA, 20 bp, mouse
gtagaggtgaccgatcctgg

SEQ ID NO: 705395 - DNA, 20 bp, mouse
gagccggctcagagctctgg

SEQ ID NO: 705396 - DNA, 20 bp, mouse
gctcccgcgcaaggatcttt

SEQ ID NO: 705397 - DNA, 20 bp, mouse
gatgactgcaggggttatcg

SEQ ID NO: 705398 - DNA, 20 bp, mouse
gagcccagaaaaatacgggg

SEQ ID NO: 705399 - DNA, 20 bp, mouse
gtgtgcaacaacacacagca

SEQ ID NO: 705400 - DNA, 20 bp, mouse
gccccgccccgtatttttct

SEQ ID NO: 705401 - DNA, 20 bp, mouse
gcgtgagcccagaaaaatac

SEQ ID NO: 705402 - DNA, 20 bp, mouse
gagtccctctctctctccgc

SEQ ID NO: 705403 - DNA, 20 bp, mouse
gcgctcccgtaccgccccct

SEQ ID NO: 705404 - DNA, 20 bp, mouse
gggggccagcggagagagag

SEQ ID NO: 705405 - DNA, 20 bp, mouse
gccgcgcaaggatctttcgg

SEQ ID NO: 705406 - DNA, 20 bp, mouse
gtctcgcgagaggggaacga

SEQ ID NO: 705407 - DNA, 20 bp, mouse
gttcccctctcgcgagagaa

SEQ ID NO: 705408 - DNA, 20 bp, mouse
gaggctgccaaccttcggag

SEQ ID NO: 705409 - DNA, 20 bp, mouse
gcgacggcgccgtcagtcaa

SEQ ID NO: 705410 - DNA, 20 bp, mouse
gcgcgagaggggaacgaggg

SEQ ID NO: 705411 - DNA, 20 bp, mouse
gaggacgccagcctctccga

SEQ ID NO: 705412 - DNA, 20 bp, mouse
gccctctcgcgagagaaggg

SEQ ID NO: 705413 - DNA, 20 bp, mouse
ggccaggagccaagctgcag

SEQ ID NO: 705414 - DNA, 20 bp, mouse
gccggggcggggcgtgcgag

SEQ ID NO: 705415 - DNA, 20 bp, mouse
gcgagcggggccaagtcgtg

SEQ ID NO: 705416 - DNA, 20 bp, mouse
gaggccggtgtgcgaggtgt

SEQ ID NO: 705417 - DNA, 20 bp, mouse
ggccgccgcgaggagggcga

SEQ ID NO: 705418 - DNA, 20 bp, mouse
ggggccccgcccagaaggtc

SEQ ID NO: 705419 - DNA, 20 bp, mouse
gcgcgcgcggcgctcgctct

SEQ ID NO: 705420 - DNA, 20 bp, mouse
gctcctgcccgaggtccgga

SEQ ID NO: 705421 - DNA, 20 bp, mouse
gtgagcagccgcccctgcct

SEQ ID NO: 705422 - DNA, 20 bp, mouse
ggcagccttcgccctcctcg

SEQ ID NO: 705423 - DNA, 20 bp, mouse
ggctgcgggtggctccgagg

SEQ ID NO: 705424 - DNA, 20 bp, mouse
gggcaacggcggcctgagtg

SEQ ID NO: 705425 - DNA, 20 bp, mouse
gcccgaggaggtgcagagtg

SEQ ID NO: 705426 - DNA, 20 bp, mouse
ggcgctacggcgcggagcgt

SEQ ID NO: 705427 - DNA, 20 bp, mouse
gcaaaggggctcagatacgc

SEQ ID NO: 705428 - DNA, 20 bp, mouse
gcagatacgcaggcgcgcta

SEQ ID NO: 705429 - DNA, 20 bp, mouse
gcttcgaagcacctgcgcgt

SEQ ID NO: 705430 - DNA, 20 bp, mouse
gcagcgcccgagcaacaaag

SEQ ID NO: 705431 - DNA, 20 bp, mouse
gaacaagtgcgctacgccga

SEQ ID NO: 705432 - DNA, 20 bp, mouse
gcaagccaggatagccttcg

SEQ ID NO: 705433 - DNA, 20 bp, mouse
gacgcaggcgcgctacggcg

SEQ ID NO: 705434 - DNA, 20 bp, mouse
ggcgcggagcgttgggcgtc

SEQ ID NO: 705435 - DNA, 20 bp, mouse
gtgcttcgaagaagaccccg

SEQ ID NO: 705436 - DNA, 20 bp, mouse
ggctcgagcacagtcatggt

SEQ ID NO: 705437 - DNA, 20 bp, mouse
gtctggagctggcagtcagg

SEQ ID NO: 705438 - DNA, 20 bp, mouse
gcctcccagtcactgcctga

SEQ ID NO: 705439 - DNA, 20 bp, mouse
gaggccaggactgagggcat

SEQ ID NO: 705440 - DNA, 20 bp, mouse
gccaggactgagggcatagg

SEQ ID NO: 705441 - DNA, 20 bp, mouse
ggatgagcgagtgagctagc

SEQ ID NO: 705442 - DNA, 20 bp, mouse
gggtcggcttctttactctc

SEQ ID NO: 705443 - DNA, 20 bp, mouse
ggccaagttgcaaaattgtg

SEQ ID NO: 705444 - DNA, 20 bp, mouse
ggactcctggtccagaaatg

SEQ ID NO: 705445 - DNA, 20 bp, mouse
gtcccctagaaactcttgag

SEQ ID NO: 705446 - DNA, 20 bp, mouse
ggggtgctgggatctgtgaa

SEQ ID NO: 705447 - DNA, 20 bp, mouse
ggcagtatggcccagagctg

SEQ ID NO: 705448 - DNA, 20 bp, mouse
ggggatctgtgaaaggtctc

SEQ ID NO: 705449 - DNA, 20 bp, mouse
gacgtggccagactgcagta

SEQ ID NO: 705450 - DNA, 20 bp, mouse
gcacatggtcaagaacaaaa

SEQ ID NO: 705451 - DNA, 20 bp, mouse
gtaactgcttggagtgagtt

SEQ ID NO: 705452 - DNA, 20 bp, mouse
gagtgagttggggtgactca

SEQ ID NO: 705453 - DNA, 20 bp, mouse
gtctgggccatactgcagtc

SEQ ID NO: 705454 - DNA, 20 bp, mouse
gcatcagagccctttgggac

SEQ ID NO: 705455 - DNA, 20 bp, mouse
gttgttcttgaccatgtggg

SEQ ID NO: 705456 - DNA, 20 bp, mouse
ggggcgtggccactcgtcgt

SEQ ID NO: 705457 - DNA, 20 bp, mouse
gtaggaccaagtactgtagt

SEQ ID NO: 705458 - DNA, 20 bp, mouse
ggggaaaaccctgtgaaacc

SEQ ID NO: 705459 - DNA, 20 bp, mouse
gtacttggtcctaaaattgg

SEQ ID NO: 705460 - DNA, 20 bp, mouse
gaaaccaggcccccaatttt

SEQ ID NO: 705461 - DNA, 20 bp, mouse
ggccacgcccccacgacgag

SEQ ID NO: 705462 - DNA, 20 bp, mouse
gacgccctgcacccgtgctc

SEQ ID NO: 705463 - DNA, 20 bp, mouse
gtcacacagggctgcagtct

SEQ ID NO: 705464 - DNA, 20 bp, mouse
gtgacctgagcacgggtgca

SEQ ID NO: 705465 - DNA, 20 bp, mouse
gtgtctacacgaatggaaat

SEQ ID NO: 705466 - DNA, 20 bp, mouse
gacactgctaggccggtccc

SEQ ID NO: 705467 - DNA, 20 bp, mouse
ggccgggccgggagcaaagg

SEQ ID NO: 705468 - DNA, 20 bp, mouse
ggggcgtgagagacactgct

SEQ ID NO: 705469 - DNA, 20 bp, mouse
ggcctggagatcaagatggt

SEQ ID NO: 705470 - DNA, 20 bp, mouse
gccaatgggagagtggaaga

SEQ ID NO: 705471 - DNA, 20 bp, mouse
gtggcccctcccctaaaggg

SEQ ID NO: 705472 - DNA, 20 bp, mouse
gagccctgccgagacagctc

SEQ ID NO: 705473 - DNA, 20 bp, mouse
gccaggggcggggtttctgt

SEQ ID NO: 705474 - DNA, 20 bp, mouse
gctcccggcccggccagggg

SEQ ID NO: 705475 - DNA, 20 bp, mouse
ggcaagagccaatgggagag

SEQ ID NO: 705476 - DNA, 20 bp, mouse
gcccgcgggcccaggagagc

SEQ ID NO: 705477 - DNA, 20 bp, mouse
gaagggtggcggggcactgt

SEQ ID NO: 705478 - DNA, 20 bp, mouse
gggccccgccccgatgcgtc

SEQ ID NO: 705479 - DNA, 20 bp, mouse
gcacccttagcgccgctcag

SEQ ID NO: 705480 - DNA, 20 bp, mouse
ggatgcgtccggctcctccc

SEQ ID NO: 705481 - DNA, 20 bp, mouse
gggagccggacgcatcgggg

SEQ ID NO: 705482 - DNA, 20 bp, mouse
ggtggcggggcactgtaggc

SEQ ID NO: 705483 - DNA, 20 bp, mouse
gccaggcagcggttgctacg

SEQ ID NO: 705484 - DNA, 20 bp, mouse
ggagcggcgctaagggtggc

SEQ ID NO: 705485 - DNA, 20 bp, mouse
gcgagcccgcgcaggggagt

SEQ ID NO: 705486 - DNA, 20 bp, mouse
ggactcccctatccccttga

SEQ ID NO: 705487 - DNA, 20 bp, mouse
gatccccttgaggggagtga

SEQ ID NO: 705488 - DNA, 20 bp, mouse
gtacaagtgctctgctggga

SEQ ID NO: 705489 - DNA, 20 bp, mouse
gactcccctcaaggggatag

SEQ ID NO: 705490 - DNA, 20 bp, mouse
gtcagcgctcccgccgggag

SEQ ID NO: 705491 - DNA, 20 bp, mouse
gggcgggagcgctgacgtca

SEQ ID NO: 705492 - DNA, 20 bp, mouse
ggcgcccggcagccccgcga

SEQ ID NO: 705493 - DNA, 20 bp, mouse
gccgggcgcgctataaacgg

SEQ ID NO: 705494 - DNA, 20 bp, mouse
gctgccgggcgcgctataaa

SEQ ID NO: 705495 - DNA, 20 bp, mouse
gaggctacagccaccctgag

SEQ ID NO: 705496 - DNA, 20 bp, mouse
gccaccggctacaggcgcaa

SEQ ID NO: 705497 - DNA, 20 bp, mouse
gaagcttatggcaccggtgg

SEQ ID NO: 705498 - DNA, 20 bp, mouse
ggggtaggcggcagggactg

SEQ ID NO: 705499 - DNA, 20 bp, mouse
gagcgacctagaaactcttc

SEQ ID NO: 705500 - DNA, 20 bp, mouse
gcagaaagacaccaccctaa

SEQ ID NO: 705501 - DNA, 20 bp, mouse
gtaaagcttgggtaggcggc

SEQ ID NO: 705502 - DNA, 20 bp, mouse
gagcgctcgagaataattcc

SEQ ID NO: 705503 - DNA, 20 bp, mouse
gcgtctaaagcttgggtagg

SEQ ID NO: 705504 - DNA, 20 bp, mouse
gcgcctgtagccggtggcct

SEQ ID NO: 705505 - DNA, 20 bp, mouse
gatcaagcttatggcaccgg

SEQ ID NO: 705506 - DNA, 20 bp, mouse
gcgtgcgccttgaacggcag

SEQ ID NO: 705507 - DNA, 20 bp, mouse
ggggaagcctaggccgagag

SEQ ID NO: 705508 - DNA, 20 bp, mouse
gagacagccaacagtacctg

SEQ ID NO: 705509 - DNA, 20 bp, mouse
gaatgaggggtctggactaa

SEQ ID NO: 705510 - DNA, 20 bp, mouse
ggggggcgctgtggctaggg

SEQ ID NO: 705511 - DNA, 20 bp, mouse
gagagggggcgctgtggcta

SEQ ID NO: 705512 - DNA, 20 bp, mouse
gagtacgcgtgcgccttgaa

SEQ ID NO: 705513 - DNA, 20 bp, mouse
gcctgagtgagggtgaatga

SEQ ID NO: 705514 - DNA, 20 bp, mouse
gtgagggtgaatgaggggtc

SEQ ID NO: 705515 - DNA, 20 bp, mouse
gacagtacctgtggttaaga

SEQ ID NO: 705516 - DNA, 20 bp, mouse
ggggagacaacactctcacc

SEQ ID NO: 705517 - DNA, 20 bp, mouse
gagggcatgtggtgctccct

SEQ ID NO: 705518 - DNA, 20 bp, mouse
gtctccctcgggacaggtgg

SEQ ID NO: 705519 - DNA, 20 bp, mouse
gtgagagtgttgtctccctc

SEQ ID NO: 705520 - DNA, 20 bp, mouse
gcacccgcagcaatgatccc

SEQ ID NO: 705521 - DNA, 20 bp, mouse
ggacccagcgccgagcgttg

SEQ ID NO: 705522 - DNA, 20 bp, mouse
gtccctgggaactggcctta

SEQ ID NO: 705523 - DNA, 20 bp, mouse
gctgcgggtggtccagactc

SEQ ID NO: 705524 - DNA, 20 bp, mouse
gggacctcaacgctcggcgc

SEQ ID NO: 705525 - DNA, 20 bp, mouse
gaggggaaagatggcagcgc

SEQ ID NO: 705526 - DNA, 20 bp, mouse
gccgcctggaactaaattcc

SEQ ID NO: 705527 - DNA, 20 bp, mouse
gggagcgagaggcgcgggtt

SEQ ID NO: 705528 - DNA, 20 bp, mouse
gtaaaccccgcccctggagg

SEQ ID NO: 705529 - DNA, 20 bp, mouse
gccgtagcgcccgcctccag

SEQ ID NO: 705530 - DNA, 20 bp, mouse
ggctggttggcgggttccac

SEQ ID NO: 705531 - DNA, 20 bp, mouse
ggtgctcagtggctggttgg

SEQ ID NO: 705532 - DNA, 20 bp, mouse
gggacctggaatttagttcc

SEQ ID NO: 705533 - DNA, 20 bp, mouse
gcccctcccgctccacgccg

SEQ ID NO: 705534 - DNA, 20 bp, mouse
gagcgcccgcctccaggggc

SEQ ID NO: 705535 - DNA, 20 bp, mouse
gggcgctacggagcgcgttg

SEQ ID NO: 705536 - DNA, 20 bp, mouse
ggcaggggagctaccactgg

SEQ ID NO: 705537 - DNA, 20 bp, mouse
gaaggcaggggagctaccac

SEQ ID NO: 705538 - DNA, 20 bp, mouse
gcacaaactgactacgattc

SEQ ID NO: 705539 - DNA, 20 bp, mouse
gtagtcagtttgtgaagcca

SEQ ID NO: 705540 - DNA, 20 bp, mouse
gtctaaatctatcacccgga

SEQ ID NO: 705541 - DNA, 20 bp, mouse
gtatcacccggacggtgatt

SEQ ID NO: 705542 - DNA, 20 bp, mouse
gcctgtactgacatttgctc

SEQ ID NO: 705543 - DNA, 20 bp, mouse
gctggaacacccatggaagg

SEQ ID NO: 705544 - DNA, 20 bp, mouse
ggaaaacagtctgtatgctt

SEQ ID NO: 705545 - DNA, 20 bp, mouse
gcagtttccaaatcaccgtc

SEQ ID NO: 705546 - DNA, 20 bp, mouse
gaacggaggcaaaggactac

SEQ ID NO: 705547 - DNA, 20 bp, mouse
ggcactgcaggttgtgtcca

SEQ ID NO: 705548 - DNA, 20 bp, mouse
gagtgcaagaacggaggcaa

SEQ ID NO: 705549 - DNA, 20 bp, mouse
gacaacctgcagtgcaagaa

SEQ ID NO: 705550 - DNA, 20 bp, mouse
gaaggtgcacgcattttaac

SEQ ID NO: 705551 - DNA, 20 bp, mouse
gacaggatggaggattctgg

SEQ ID NO: 705552 - DNA, 20 bp, mouse
gacctgcagtgcaagaacgg

SEQ ID NO: 705553 - DNA, 20 bp, mouse
gagagctttgtgttgaattc

SEQ ID NO: 705554 - DNA, 20 bp, mouse
gcctcaaagctttttaagtg

SEQ ID NO: 705555 - DNA, 20 bp, mouse
ggctctctgggtaaacctta

SEQ ID NO: 705556 - DNA, 20 bp, mouse
gtctccagggcacgcgacca

SEQ ID NO: 705557 - DNA, 20 bp, mouse
ggagaggccgatgaacatgt

SEQ ID NO: 705558 - DNA, 20 bp, mouse
ggacagaggttcagaaagtt

SEQ ID NO: 705559 - DNA, 20 bp, mouse
gtttggggagcacgagacag

SEQ ID NO: 705560 - DNA, 20 bp, mouse
gaacctgtgaaaaggggcat

SEQ ID NO: 705561 - DNA, 20 bp, mouse
gttaaatgtccctaacccac

SEQ ID NO: 705562 - DNA, 20 bp, mouse
ggtctcgtgctccccaaagt

SEQ ID NO: 705563 - DNA, 20 bp, mouse
gtccggatgggcacagagtc

SEQ ID NO: 705564 - DNA, 20 bp, mouse
gcctcagcagaggtccggat

SEQ ID NO: 705565 - DNA, 20 bp, mouse
gcggggcgggggcggaactc

SEQ ID NO: 705566 - DNA, 20 bp, mouse
gagtggctacacagagtcaa

SEQ ID NO: 705567 - DNA, 20 bp, mouse
gacagagtcaagggcggcac

SEQ ID NO: 705568 - DNA, 20 bp, mouse
gcggtacggggcttgaaaga

SEQ ID NO: 705569 - DNA, 20 bp, mouse
gggaaggggcgggagaagtg

SEQ ID NO: 705570 - DNA, 20 bp, mouse
ggaagcgaattcgtttgttt

SEQ ID NO: 705571 - DNA, 20 bp, mouse
gggagctcgcttccggtacg

SEQ ID NO: 705572 - DNA, 20 bp, mouse
gctgacacgacgttacgtca

SEQ ID NO: 705573 - DNA, 20 bp, mouse
ggtcccggcagctagctatt

SEQ ID NO: 705574 - DNA, 20 bp, mouse
ggctagctattgggcactag

SEQ ID NO: 705575 - DNA, 20 bp, mouse
gtgcccaatagctagctgcc

SEQ ID NO: 705576 - DNA, 20 bp, mouse
gctgcggcggatctagacag

SEQ ID NO: 705577 - DNA, 20 bp, mouse
gcgggagcgtggggaaagcg

SEQ ID NO: 705578 - DNA, 20 bp, mouse
gcggcggatctagacagcgg

SEQ ID NO: 705579 - DNA, 20 bp, mouse
gcaggcgcgggcggagtccg

SEQ ID NO: 705580 - DNA, 20 bp, mouse
gtgcccggccgacagtgaga

SEQ ID NO: 705581 - DNA, 20 bp, mouse
gggaggcacgcgccccgctg

SEQ ID NO: 705582 - DNA, 20 bp, mouse
gcggatctagacagcggggg

SEQ ID NO: 705583 - DNA, 20 bp, mouse
gagacctgttgccaaggcgc

SEQ ID NO: 705584 - DNA, 20 bp, mouse
gggtgggtgggaagatctcc

SEQ ID NO: 705585 - DNA, 20 bp, mouse
gagggcgaggcgggtctgga

SEQ ID NO: 705586 - DNA, 20 bp, mouse
ggggccgcacgtgatcgagg

SEQ ID NO: 705587 - DNA, 20 bp, mouse
gaggaaaagccgacggggtg

SEQ ID NO: 705588 - DNA, 20 bp, mouse
gcgaggacacgcccctgagg

SEQ ID NO: 705589 - DNA, 20 bp, mouse
ggccgcgaggagccgtgcga

SEQ ID NO: 705590 - DNA, 20 bp, mouse
gaggctgcgcaagtaaactg

SEQ ID NO: 705591 - DNA, 20 bp, mouse
gtggggctctcagactatcg

SEQ ID NO: 705592 - DNA, 20 bp, mouse
gcgcgggccgcacgtgatcg

SEQ ID NO: 705593 - DNA, 20 bp, mouse
ggctccgcctcgatcacgtg

SEQ ID NO: 705594 - DNA, 20 bp, mouse
gtcctcgcggccaccgtaga

SEQ ID NO: 705595 - DNA, 20 bp, mouse
ggaccctgagaacacaggcc

SEQ ID NO: 705596 - DNA, 20 bp, mouse
ggggccccagcccagctagg

SEQ ID NO: 705597 - DNA, 20 bp, mouse
gaactcctctcaccccactg

SEQ ID NO: 705598 - DNA, 20 bp, mouse
gtctccccctagctgggctg

SEQ ID NO: 705599 - DNA, 20 bp, mouse
gtgggtacagtgacctcagt

SEQ ID NO: 705600 - DNA, 20 bp, mouse
ggacccatttaccagaaagg

SEQ ID NO: 705601 - DNA, 20 bp, mouse
gtggtaaatgggtcaagaga

SEQ ID NO: 705602 - DNA, 20 bp, mouse
ggtgacctcagtggggtgag

SEQ ID NO: 705603 - DNA, 20 bp, mouse
gaagggggttccttgatcaa

SEQ ID NO: 705604 - DNA, 20 bp, mouse
gcccctcaggctattcaatg

SEQ ID NO: 705605 - DNA, 20 bp, mouse
ggatcaaggaaccccctttc

SEQ ID NO: 705606 - DNA, 20 bp, mouse
ggcccgggtcgcggaggcgt

SEQ ID NO: 705607 - DNA, 20 bp, mouse
gcgggtcgcggaggcgtagg

SEQ ID NO: 705608 - DNA, 20 bp, mouse
ggaggcggcggcccgggtcg

SEQ ID NO: 705609 - DNA, 20 bp, mouse
gctcaggccggggcaggagg

SEQ ID NO: 705610 - DNA, 20 bp, mouse
gcggaggcgtaggaggcctc

SEQ ID NO: 705611 - DNA, 20 bp, mouse
gggcgtaggaggcctcgggg

SEQ ID NO: 705612 - DNA, 20 bp, mouse
gccgcctcggcctgggcctc

SEQ ID NO: 705613 - DNA, 20 bp, mouse
ggcagccgccagtgccgcct

SEQ ID NO: 705614 - DNA, 20 bp, mouse
gcaggccgaggcggcactgg

SEQ ID NO: 705615 - DNA, 20 bp, mouse
ggcccggcgtgcgtggtcca

SEQ ID NO: 705616 - DNA, 20 bp, mouse
ggtggcccgctgtcccactg

SEQ ID NO: 705617 - DNA, 20 bp, mouse
gccatcccccagtgggacag

SEQ ID NO: 705618 - DNA, 20 bp, mouse
ggggctatctatagagtccc

SEQ ID NO: 705619 - DNA, 20 bp, mouse
gtcaggggtgcccaaggagt

SEQ ID NO: 705620 - DNA, 20 bp, mouse
gctcctttgcgcaaggggtc

SEQ ID NO: 705621 - DNA, 20 bp, mouse
gctcctgaccccttgcgcaa

SEQ ID NO: 705622 - DNA, 20 bp, mouse
gatcccacagacaaacaaat

SEQ ID NO: 705623 - DNA, 20 bp, mouse
gcttgcgcaaaggaggctcg

SEQ ID NO: 705624 - DNA, 20 bp, mouse
ggctcaggaagtgaagtttg

SEQ ID NO: 705625 - DNA, 20 bp, mouse
gtgtttgtctgtgggatcgc

SEQ ID NO: 705626 - DNA, 20 bp, mouse
ggggaaacacagaaacgaaa

SEQ ID NO: 705627 - DNA, 20 bp, mouse
gtttctggagaaatttccag

SEQ ID NO: 705628 - DNA, 20 bp, mouse
gtggctgcactttcgcgctc

SEQ ID NO: 705629 - DNA, 20 bp, mouse
gtcagcgagaaagtgtgtga

SEQ ID NO: 705630 - DNA, 20 bp, mouse
gcagattgaaaatcagggag

SEQ ID NO: 705631 - DNA, 20 bp, mouse
gactttcgcgctctggtcat

SEQ ID NO: 705632 - DNA, 20 bp, mouse
gtctcgctgaggcattagag

SEQ ID NO: 705633 - DNA, 20 bp, mouse
ggtgtgtgatggtggaatct

SEQ ID NO: 705634 - DNA, 20 bp, mouse
gtatttgtgtcaaaatctgg

SEQ ID NO: 705635 - DNA, 20 bp, mouse
ggcatttgggtgaaagagag

SEQ ID NO: 705636 - DNA, 20 bp, mouse
gggaggtgtcattactacgg

SEQ ID NO: 705637 - DNA, 20 bp, mouse
gtctcctcctgaccaggaga

SEQ ID NO: 705638 - DNA, 20 bp, mouse
gcctcccggaagtgctcctg

SEQ ID NO: 705639 - DNA, 20 bp, mouse
gggacggccagaggaagaca

SEQ ID NO: 705640 - DNA, 20 bp, mouse
gccacgtcgagctcagacag

SEQ ID NO: 705641 - DNA, 20 bp, mouse
gcgtggcgcgcgccctctcc

SEQ ID NO: 705642 - DNA, 20 bp, mouse
gttatgcagaggattgtcac

SEQ ID NO: 705643 - DNA, 20 bp, mouse
ggcagaggattgtcacaggg

SEQ ID NO: 705644 - DNA, 20 bp, mouse
gaggtcaggaggacggccag

SEQ ID NO: 705645 - DNA, 20 bp, mouse
ggaaagcgtagtttatgcag

SEQ ID NO: 705646 - DNA, 20 bp, mouse
ggacccggaacacaaatctt

SEQ ID NO: 705647 - DNA, 20 bp, mouse
gtgctccgcggctgtcatca

SEQ ID NO: 705648 - DNA, 20 bp, mouse
gtcgtcgcccgcgtccgagg

SEQ ID NO: 705649 - DNA, 20 bp, mouse
gctccactcggccttcttaa

SEQ ID NO: 705650 - DNA, 20 bp, mouse
gggctgtcatcatggtaagg

SEQ ID NO: 705651 - DNA, 20 bp, mouse
gggcctggggttagcgtggt

SEQ ID NO: 705652 - DNA, 20 bp, mouse
gaggaggcctcctcggacgc

SEQ ID NO: 705653 - DNA, 20 bp, mouse
ggagagaggaccgtggtagg

SEQ ID NO: 705654 - DNA, 20 bp, mouse
ggaagggcctggggttagcg

SEQ ID NO: 705655 - DNA, 20 bp, mouse
gttagcgtggttgggctgtc

SEQ ID NO: 705656 - DNA, 20 bp, mouse
ggggcagcaggcgagacagg

SEQ ID NO: 705657 - DNA, 20 bp, mouse
ggccggggaggagtcaaagc

SEQ ID NO: 705658 - DNA, 20 bp, mouse
gagaaagggaagccacccgg

SEQ ID NO: 705659 - DNA, 20 bp, mouse
ggagcacggcgctaccgcaa

SEQ ID NO: 705660 - DNA, 20 bp, mouse
gcggtagcgccgtgctccat

SEQ ID NO: 705661 - DNA, 20 bp, mouse
ggagtcaaagcgggttccag

SEQ ID NO: 705662 - DNA, 20 bp, mouse
gcgggggcagcaggcgagac

SEQ ID NO: 705663 - DNA, 20 bp, mouse
gtgggcggcggagacaaggg

SEQ ID NO: 705664 - DNA, 20 bp, mouse
gccttgggcggcggagacaa

SEQ ID NO: 705665 - DNA, 20 bp, mouse
gcgggatcccgcgggtacga

SEQ ID NO: 705666 - DNA, 20 bp, mouse
gggtgcttgggaaaccttca

SEQ ID NO: 705667 - DNA, 20 bp, mouse
gacagcaataggctccctga

SEQ ID NO: 705668 - DNA, 20 bp, mouse
gcatgctcgcgccttggggg

SEQ ID NO: 705669 - DNA, 20 bp, mouse
gcatgcgcagctcttcatcc

SEQ ID NO: 705670 - DNA, 20 bp, mouse
ggcgcatgctcagtgatggg

SEQ ID NO: 705671 - DNA, 20 bp, mouse
ggaggtggacccgcgggagg

SEQ ID NO: 705672 - DNA, 20 bp, mouse
gtcggtggtagatgtgttga

SEQ ID NO: 705673 - DNA, 20 bp, mouse
gctgcgcatgctcgcgcctt

SEQ ID NO: 705674 - DNA, 20 bp, mouse
gaggggtctctggtacggag

SEQ ID NO: 705675 - DNA, 20 bp, mouse
gtgatgggaggtggacccgc

SEQ ID NO: 705676 - DNA, 20 bp, mouse
gccgccgcggctctcccatt

SEQ ID NO: 705677 - DNA, 20 bp, mouse
gcggcccaatgggagagccg

SEQ ID NO: 705678 - DNA, 20 bp, mouse
gcggctccaggaacctaaag

SEQ ID NO: 705679 - DNA, 20 bp, mouse
gtcggctcgccctcagcggg

SEQ ID NO: 705680 - DNA, 20 bp, mouse
ggcgggtagcgacgtggcag

SEQ ID NO: 705681 - DNA, 20 bp, mouse
gaggctcggctcgccctcag

SEQ ID NO: 705682 - DNA, 20 bp, mouse
gtcctggagccgcccgctga

SEQ ID NO: 705683 - DNA, 20 bp, mouse
ggcgcgcagacgcagagctg

SEQ ID NO: 705684 - DNA, 20 bp, mouse
gagagctgcgggtagcgacg

SEQ ID NO: 705685 - DNA, 20 bp, mouse
gcggcgcgggcgcggcccaa

SEQ ID NO: 705686 - DNA, 20 bp, mouse
ggcccccaagactcagggta

SEQ ID NO: 705687 - DNA, 20 bp, mouse
ggggagggaggaagcccaat

SEQ ID NO: 705688 - DNA, 20 bp, mouse
gagggaggaagcccaatcgg

SEQ ID NO: 705689 - DNA, 20 bp, mouse
gaccccttaccctgagtctt

SEQ ID NO: 705690 - DNA, 20 bp, mouse
gagtctctactgtaagggga

SEQ ID NO: 705691 - DNA, 20 bp, mouse
ggctccagtctctactgtaa

SEQ ID NO: 705692 - DNA, 20 bp, mouse
gtagccctccgagaggggtg

SEQ ID NO: 705693 - DNA, 20 bp, mouse
gtctgtctggccttaacctc

SEQ ID NO: 705694 - DNA, 20 bp, mouse
gaaggtgtttaccaccgatt

SEQ ID NO: 705695 - DNA, 20 bp, mouse
gtagacgtgaaactttagca

SEQ ID NO: 705696 - DNA, 20 bp, mouse
gactcgctgcagctggacac

SEQ ID NO: 705697 - DNA, 20 bp, mouse
gctggaggggaggtggcgat

SEQ ID NO: 705698 - DNA, 20 bp, mouse
gcccctggccccaaagttgg

SEQ ID NO: 705699 - DNA, 20 bp, mouse
ggagctggtaaggtccgcta

SEQ ID NO: 705700 - DNA, 20 bp, mouse
gtcctcttgccggactgcct

SEQ ID NO: 705701 - DNA, 20 bp, mouse
gggaagagaggctcgtccag

SEQ ID NO: 705702 - DNA, 20 bp, mouse
gcccgcctggtactgaaacc

SEQ ID NO: 705703 - DNA, 20 bp, mouse
gaagtcccccgaggcgggag

SEQ ID NO: 705704 - DNA, 20 bp, mouse
gcaaaatggaaagggatggc

SEQ ID NO: 705705 - DNA, 20 bp, mouse
gacaccggtcaattgggttc

SEQ ID NO: 705706 - DNA, 20 bp, mouse
gcagcgccccggctccctgg

SEQ ID NO: 705707 - DNA, 20 bp, mouse
gtgagccccgagcagaggag

SEQ ID NO: 705708 - DNA, 20 bp, mouse
ggggcgaggcgcgagagcct

SEQ ID NO: 705709 - DNA, 20 bp, mouse
gtaggcgaggaagccgcgaa

SEQ ID NO: 705710 - DNA, 20 bp, mouse
gccgccagccgccagggagc

SEQ ID NO: 705711 - DNA, 20 bp, mouse
gaggaagccgcgaaggggga

SEQ ID NO: 705712 - DNA, 20 bp, mouse
ggagccgagggagccagcgg

SEQ ID NO: 705713 - DNA, 20 bp, mouse
gcgcccctctcctctgctcg

SEQ ID NO: 705714 - DNA, 20 bp, mouse
gagggggcgggaggcttcgt

SEQ ID NO: 705715 - DNA, 20 bp, mouse
gtcccggccgcgagagcgaa

SEQ ID NO: 705716 - DNA, 20 bp, mouse
gttactccgggacccagagt

SEQ ID NO: 705717 - DNA, 20 bp, mouse
gactctcccactagggtcgt

SEQ ID NO: 705718 - DNA, 20 bp, mouse
gctgaagtgccgggcagcat

SEQ ID NO: 705719 - DNA, 20 bp, mouse
ggtaggtgggcagactctag

SEQ ID NO: 705720 - DNA, 20 bp, mouse
gcatcgggcggctattactc

SEQ ID NO: 705721 - DNA, 20 bp, mouse
gcggtgcccacgaccctagt

SEQ ID NO: 705722 - DNA, 20 bp, mouse
ggagacttcaaggccgcttg

SEQ ID NO: 705723 - DNA, 20 bp, mouse
ggcgccgccactctcccact

SEQ ID NO: 705724 - DNA, 20 bp, mouse
gttaattggcagtagacagt

SEQ ID NO: 705725 - DNA, 20 bp, mouse
gtgctcctggatgggtagag

SEQ ID NO: 705726 - DNA, 20 bp, mouse
gtccacgcagcgattcccgt

SEQ ID NO: 705727 - DNA, 20 bp, mouse
gcagctgcgctctgagtacg

SEQ ID NO: 705728 - DNA, 20 bp, mouse
gcctgggccgggcagcgccc

SEQ ID NO: 705729 - DNA, 20 bp, mouse
ggggaatcgctgcgtggacg

SEQ ID NO: 705730 - DNA, 20 bp, mouse
gaaggggtacccaaacccaa

SEQ ID NO: 705731 - DNA, 20 bp, mouse
gggcgtgtacagcagacgag

SEQ ID NO: 705732 - DNA, 20 bp, mouse
gaggcccacgcgcgaagaag

SEQ ID NO: 705733 - DNA, 20 bp, mouse
gcctgcccccgggcgctgcc

SEQ ID NO: 705734 - DNA, 20 bp, mouse
gggccacactctctcccctt

SEQ ID NO: 705735 - DNA, 20 bp, mouse
gagtacgtggcacgatgcct

SEQ ID NO: 705736 - DNA, 20 bp, mouse
ggcaaagcttagtgttctag

SEQ ID NO: 705737 - DNA, 20 bp, mouse
gacctcatggtcaaatttct

SEQ ID NO: 705738 - DNA, 20 bp, mouse
gtctgcaaaccaaataacag

SEQ ID NO: 705739 - DNA, 20 bp, mouse
gtcatgaataggggacctca

SEQ ID NO: 705740 - DNA, 20 bp, mouse
ggatttgcaatcatttccct

SEQ ID NO: 705741 - DNA, 20 bp, mouse
gcagcatccaagacagagca

SEQ ID NO: 705742 - DNA, 20 bp, mouse
gaccccaagaagatttaaaa

SEQ ID NO: 705743 - DNA, 20 bp, mouse
gtgagaacttttcatgaata

SEQ ID NO: 705744 - DNA, 20 bp, mouse
gttataatgtaagcaatata

SEQ ID NO: 705745 - DNA, 20 bp, mouse
gcataatcagtattctcatt

SEQ ID NO: 705746 - DNA, 20 bp, mouse
gcggtcccgcggggtttcta

SEQ ID NO: 705747 - DNA, 20 bp, mouse
gtaagcggaagtacccctga

SEQ ID NO: 705748 - DNA, 20 bp, mouse
ggacgaggcgacgctctagg

SEQ ID NO: 705749 - DNA, 20 bp, mouse
gggctccacccgcgtctcga

SEQ ID NO: 705750 - DNA, 20 bp, mouse
gaccccgcggagtaggaacg

SEQ ID NO: 705751 - DNA, 20 bp, mouse
ggtgccgcgttcctactccg

SEQ ID NO: 705752 - DNA, 20 bp, mouse
gtccgccagccgccaggggg

SEQ ID NO: 705753 - DNA, 20 bp, mouse
gcgctctcgcgggaactcct

SEQ ID NO: 705754 - DNA, 20 bp, mouse
ggccgggcaccatcgagacg

SEQ ID NO: 705755 - DNA, 20 bp, mouse
gggcaccatcgagacgcggg

SEQ ID NO: 705756 - DNA, 20 bp, mouse
gagacctcgtgagttggagg

SEQ ID NO: 705757 - DNA, 20 bp, mouse
gcgaatggaagatacatact

SEQ ID NO: 705758 - DNA, 20 bp, mouse
ggtgacggggcgggccctat

SEQ ID NO: 705759 - DNA, 20 bp, mouse
gcggccacctccaactcacg

SEQ ID NO: 705760 - DNA, 20 bp, mouse
gacactgagaggcacgtgac

SEQ ID NO: 705761 - DNA, 20 bp, mouse
ggtcaaaagccaagctagtt

SEQ ID NO: 705762 - DNA, 20 bp, mouse
ggcccccacgcacctcctcc

SEQ ID NO: 705763 - DNA, 20 bp, mouse
ggccgggaggaggtgcgtgg

SEQ ID NO: 705764 - DNA, 20 bp, mouse
gcgacgcggcagacactgag

SEQ ID NO: 705765 - DNA, 20 bp, mouse
gcccctcttcttcagaagca

SEQ ID NO: 705766 - DNA, 20 bp, mouse
gaccgcgtcggaggccgcga

SEQ ID NO: 705767 - DNA, 20 bp, mouse
ggcgccgtctggaaccttcc

SEQ ID NO: 705768 - DNA, 20 bp, mouse
gggcgtgggtttcccttcag

SEQ ID NO: 705769 - DNA, 20 bp, mouse
ggtcctgacagcggccaaga

SEQ ID NO: 705770 - DNA, 20 bp, mouse
gacgcccgaggaaagtgcgc

SEQ ID NO: 705771 - DNA, 20 bp, mouse
ggcgcgccggaccgcgtcgg

SEQ ID NO: 705772 - DNA, 20 bp, mouse
gagagcctgcgcactttcct

SEQ ID NO: 705773 - DNA, 20 bp, mouse
gacggcgcacctcactccca

SEQ ID NO: 705774 - DNA, 20 bp, mouse
ggtgagtgagcgacaggaca

SEQ ID NO: 705775 - DNA, 20 bp, mouse
ggccgctgtcaggacctcgg

SEQ ID NO: 705776 - DNA, 20 bp, mouse
gggttccggcacatggggag

SEQ ID NO: 705777 - DNA, 20 bp, mouse
gcccccgaccgctgcaggtg

SEQ ID NO: 705778 - DNA, 20 bp, mouse
ggacgctagcggacattcgc

SEQ ID NO: 705779 - DNA, 20 bp, mouse
ggcgctccgtggcgctgccg

SEQ ID NO: 705780 - DNA, 20 bp, mouse
gagcttgcttgcttgcattt

SEQ ID NO: 705781 - DNA, 20 bp, mouse
ggggctcgactgctcccacc

SEQ ID NO: 705782 - DNA, 20 bp, mouse
gagcgccgcccggggcggtt

SEQ ID NO: 705783 - DNA, 20 bp, mouse
gtgcgcggttccggcacatg

SEQ ID NO: 705784 - DNA, 20 bp, mouse
gcggaaatgcccagctgggc

SEQ ID NO: 705785 - DNA, 20 bp, mouse
gcagcgccacggagcgcacc

SEQ ID NO: 705786 - DNA, 20 bp, mouse
gggcgggaggagctgtagac

SEQ ID NO: 705787 - DNA, 20 bp, mouse
ggcagggggccgtacatccg

SEQ ID NO: 705788 - DNA, 20 bp, mouse
ggaaaagcgacgtcagtggg

SEQ ID NO: 705789 - DNA, 20 bp, mouse
gctaacggacagcccgagag

SEQ ID NO: 705790 - DNA, 20 bp, mouse
gaatagaaaagcgacgtcag

SEQ ID NO: 705791 - DNA, 20 bp, mouse
gcctcagcgcgctctctgtg

SEQ ID NO: 705792 - DNA, 20 bp, mouse
ggtgagctaactaccaggat

SEQ ID NO: 705793 - DNA, 20 bp, mouse
gcagagagcgcgctgaggat

SEQ ID NO: 705794 - DNA, 20 bp, mouse
gccggcgtgagctaactacc

SEQ ID NO: 705795 - DNA, 20 bp, mouse
gtgcctgaggcgccgctgat

SEQ ID NO: 705796 - DNA, 20 bp, mouse
ggagccctgagctcagagac

SEQ ID NO: 705797 - DNA, 20 bp, mouse
gcggccccgcactgaagcat

SEQ ID NO: 705798 - DNA, 20 bp, mouse
gtgagctcagggctcggctc

SEQ ID NO: 705799 - DNA, 20 bp, mouse
gtgggctaggagtgtgggcg

SEQ ID NO: 705800 - DNA, 20 bp, mouse
gcctgagctcagagaccggg

SEQ ID NO: 705801 - DNA, 20 bp, mouse
gactgaagcatagggggcgt

SEQ ID NO: 705802 - DNA, 20 bp, mouse
gtatgaggacctttggggat

SEQ ID NO: 705803 - DNA, 20 bp, mouse
gcagagaccgggtgggtatg

SEQ ID NO: 705804 - DNA, 20 bp, mouse
gccccgcactgaagcatagg

SEQ ID NO: 705805 - DNA, 20 bp, mouse
gacagcaagtctaagtctgg

SEQ ID NO: 705806 - DNA, 20 bp, mouse
gtgggcggtgccaagctcga

SEQ ID NO: 705807 - DNA, 20 bp, mouse
gggggcgggccggggacaga

SEQ ID NO: 705808 - DNA, 20 bp, mouse
ggcctctgggaagtgcagtc

SEQ ID NO: 705809 - DNA, 20 bp, mouse
ggcgcccggcggccaggttg

SEQ ID NO: 705810 - DNA, 20 bp, mouse
gcggcggccaggttggggcg

SEQ ID NO: 705811 - DNA, 20 bp, mouse
gcgagttgcaggtcgcgcgt

SEQ ID NO: 705812 - DNA, 20 bp, mouse
gaggccacataagagttcac

SEQ ID NO: 705813 - DNA, 20 bp, mouse
gctccctgtgaactcttatg

SEQ ID NO: 705814 - DNA, 20 bp, mouse
gcgcgcgcgtgccactcgct

SEQ ID NO: 705815 - DNA, 20 bp, mouse
gcccggactgcacttcccag

SEQ ID NO: 705816 - DNA, 20 bp, mouse
gtgaagggctgcactcaagc

SEQ ID NO: 705817 - DNA, 20 bp, mouse
gagaaggtggtccacggtca

SEQ ID NO: 705818 - DNA, 20 bp, mouse
gaggggtgtggcattataaa

SEQ ID NO: 705819 - DNA, 20 bp, mouse
gagagggtgcgtcacggaag

SEQ ID NO: 705820 - DNA, 20 bp, mouse
gagggtgatccaggtttgaa

SEQ ID NO: 705821 - DNA, 20 bp, mouse
ggtcagggctctgaatggga

SEQ ID NO: 705822 - DNA, 20 bp, mouse
gaggccccgccccgagctcg

SEQ ID NO: 705823 - DNA, 20 bp, mouse
gggggcggggcctagatctc

SEQ ID NO: 705824 - DNA, 20 bp, mouse
ggcctggcagggttcgaaaa

SEQ ID NO: 705825 - DNA, 20 bp, mouse
gggtggggcttaatgagaag

SEQ ID NO: 705826 - DNA, 20 bp, mouse
gcgcacagccaatgaggaga

SEQ ID NO: 705827 - DNA, 20 bp, mouse
gagttctggagtagcagtga

SEQ ID NO: 705828 - DNA, 20 bp, mouse
gcgcgtgcacgcgggacaac

SEQ ID NO: 705829 - DNA, 20 bp, mouse
gctacaagccgtctcctcat

SEQ ID NO: 705830 - DNA, 20 bp, mouse
gagccacgggctccgcagta

SEQ ID NO: 705831 - DNA, 20 bp, mouse
ggacggagggccggggcttg

SEQ ID NO: 705832 - DNA, 20 bp, mouse
ggacaaccgggtctgaagtc

SEQ ID NO: 705833 - DNA, 20 bp, mouse
gccaatgcggccaggcacgg

SEQ ID NO: 705834 - DNA, 20 bp, mouse
gttggggagggcggcggaag

SEQ ID NO: 705835 - DNA, 20 bp, mouse
gtcgtcccgccgcgcgaggt

SEQ ID NO: 705836 - DNA, 20 bp, mouse
gtgcaaagaaggtgagcccc

SEQ ID NO: 705837 - DNA, 20 bp, mouse
gggggtaacctcatcttgtt

SEQ ID NO: 705838 - DNA, 20 bp, mouse
gctggcccccagttactttc

SEQ ID NO: 705839 - DNA, 20 bp, mouse
gccagagggcgattgaagtt

SEQ ID NO: 705840 - DNA, 20 bp, mouse
ggggcgattgaagttaggag

SEQ ID NO: 705841 - DNA, 20 bp, mouse
gcatcttgttaggtgtggag

SEQ ID NO: 705842 - DNA, 20 bp, mouse
gggcagctccagaaagtaac

SEQ ID NO: 705843 - DNA, 20 bp, mouse
gcgcatgcgtgcccctttgt

SEQ ID NO: 705844 - DNA, 20 bp, mouse
gtggagctgcccaaaccaga

SEQ ID NO: 705845 - DNA, 20 bp, mouse
gagaggctgctgggcgcaga

SEQ ID NO: 705846 - DNA, 20 bp, mouse
ggggccgcgaactccaggcg

SEQ ID NO: 705847 - DNA, 20 bp, mouse
ggtgtcccgactttcgaaat

SEQ ID NO: 705848 - DNA, 20 bp, mouse
gagggagggcgggggacgtg

SEQ ID NO: 705849 - DNA, 20 bp, mouse
ggacacgagcgaggcggccg

SEQ ID NO: 705850 - DNA, 20 bp, mouse
gcggtctcgcgagaagaggc

SEQ ID NO: 705851 - DNA, 20 bp, mouse
ggcgccacggggagtgtggg

SEQ ID NO: 705852 - DNA, 20 bp, mouse
ggaaatcggcttgtacgggt

SEQ ID NO: 705853 - DNA, 20 bp, mouse
gcagccgagcgcgacagcac

SEQ ID NO: 705854 - DNA, 20 bp, mouse
gtccctgccagtgacgaccc

SEQ ID NO: 705855 - DNA, 20 bp, mouse
ggccgcggtctcgcgagaag

SEQ ID NO: 705856 - DNA, 20 bp, mouse
gaggcatccgggaaagaggt

SEQ ID NO: 705857 - DNA, 20 bp, mouse
gaggcgcggccatgaggcag

SEQ ID NO: 705858 - DNA, 20 bp, mouse
ggacgcctgcgcagtgtgat

SEQ ID NO: 705859 - DNA, 20 bp, mouse
gcgttcgacgagagagggga

SEQ ID NO: 705860 - DNA, 20 bp, mouse
gaggccaatcggtaaactga

SEQ ID NO: 705861 - DNA, 20 bp, mouse
gtgcctgcgttcgacgagag

SEQ ID NO: 705862 - DNA, 20 bp, mouse
gaattcccagaaagtattga

SEQ ID NO: 705863 - DNA, 20 bp, mouse
gggaaggaggcgcggccatg

SEQ ID NO: 705864 - DNA, 20 bp, mouse
gtcgtcgaacgcaggcaagt

SEQ ID NO: 705865 - DNA, 20 bp, mouse
gcaagtgggcattgcggtct

SEQ ID NO: 705866 - DNA, 20 bp, mouse
ggtcctggcaggagcattga

SEQ ID NO: 705867 - DNA, 20 bp, mouse
gtgggggagggtactaggtg

SEQ ID NO: 705868 - DNA, 20 bp, mouse
gcaggtgataggagtggtgg

SEQ ID NO: 705869 - DNA, 20 bp, mouse
gcgtcaccaggtgataggag

SEQ ID NO: 705870 - DNA, 20 bp, mouse
gccgctggaaaacccttcaa

SEQ ID NO: 705871 - DNA, 20 bp, mouse
gcaccaggtgataggagtgg

SEQ ID NO: 705872 - DNA, 20 bp, mouse
ggcaagcgtcaccaggtgat

SEQ ID NO: 705873 - DNA, 20 bp, mouse
gaagggttttccagcgggag

SEQ ID NO: 705874 - DNA, 20 bp, mouse
ggcagggggtggcttctgaa

SEQ ID NO: 705875 - DNA, 20 bp, mouse
gggtgacgcttgctcaccag

SEQ ID NO: 705876 - DNA, 20 bp, mouse
gccccaagccagctagggga

SEQ ID NO: 705877 - DNA, 20 bp, mouse
gctggctcgggtttcttctc

SEQ ID NO: 705878 - DNA, 20 bp, mouse
ggcccaccccaagccagcta

SEQ ID NO: 705879 - DNA, 20 bp, mouse
ggggtgggcggaggctttaa

SEQ ID NO: 705880 - DNA, 20 bp, mouse
gaaggcatgtggctgcactc

SEQ ID NO: 705881 - DNA, 20 bp, mouse
gtctactagggcaaggcatg

SEQ ID NO: 705882 - DNA, 20 bp, mouse
gcaaagaggagggatgattt

SEQ ID NO: 705883 - DNA, 20 bp, mouse
ggtggcccagatagtctaga

SEQ ID NO: 705884 - DNA, 20 bp, mouse
gagctccgcttagactgtcc

SEQ ID NO: 705885 - DNA, 20 bp, mouse
gaggctcaataggggtcata

SEQ ID NO: 705886 - DNA, 20 bp, mouse
gtgcctgggtggaaccagtt

SEQ ID NO: 705887 - DNA, 20 bp, mouse
gccatgggatcaactggcga

SEQ ID NO: 705888 - DNA, 20 bp, mouse
gactgggactgaggagtctt

SEQ ID NO: 705889 - DNA, 20 bp, mouse
gttgatgcacccaggggaac

SEQ ID NO: 705890 - DNA, 20 bp, mouse
ggatgcctggcttgcctcca

SEQ ID NO: 705891 - DNA, 20 bp, mouse
ggcgatggaagagttaacag

SEQ ID NO: 705892 - DNA, 20 bp, mouse
ggtgatgcttgatgcaccca

SEQ ID NO: 705893 - DNA, 20 bp, mouse
gggcaggccatgggatcaac

SEQ ID NO: 705894 - DNA, 20 bp, mouse
gacccagctggtacagagat

SEQ ID NO: 705895 - DNA, 20 bp, mouse
ggcctccagggttgagcctc

SEQ ID NO: 705896 - DNA, 20 bp, mouse
gagggtcatggtccaatctt

SEQ ID NO: 705897 - DNA, 20 bp, mouse
ggaaatctggcgaacagctt

SEQ ID NO: 705898 - DNA, 20 bp, mouse
gtagctatagactaagaggt

SEQ ID NO: 705899 - DNA, 20 bp, mouse
gcctctgtggggaaacagtc

SEQ ID NO: 705900 - DNA, 20 bp, mouse
gtaccccagtgcctgaataa

SEQ ID NO: 705901 - DNA, 20 bp, mouse
gaagccacatgacacatcca

SEQ ID NO: 705902 - DNA, 20 bp, mouse
gcggagtcagagacctctgt

SEQ ID NO: 705903 - DNA, 20 bp, mouse
gggggggtgagggccatccc

SEQ ID NO: 705904 - DNA, 20 bp, mouse
gatctggcgaacagcttggg

SEQ ID NO: 705905 - DNA, 20 bp, mouse
gctggagtgcggaacagtca

SEQ ID NO: 705906 - DNA, 20 bp, mouse
gaagggccagggattgtttg

SEQ ID NO: 705907 - DNA, 20 bp, mouse
gaggacagtggaaggttgcc

SEQ ID NO: 705908 - DNA, 20 bp, mouse
gtctagaagcatatggaatc

SEQ ID NO: 705909 - DNA, 20 bp, mouse
gccggaagtggcagtgaaga

SEQ ID NO: 705910 - DNA, 20 bp, mouse
gaggacactgctgacggtgg

SEQ ID NO: 705911 - DNA, 20 bp, mouse
gctcctggacagccgggagg

SEQ ID NO: 705912 - DNA, 20 bp, mouse
ggcgctcaaaagtcagtctg

SEQ ID NO: 705913 - DNA, 20 bp, mouse
gaggatgaagacgctactct

SEQ ID NO: 705914 - DNA, 20 bp, mouse
gggcgggggcgagtcatact

SEQ ID NO: 705915 - DNA, 20 bp, mouse
ggtagactttaagcaggcgg

SEQ ID NO: 705916 - DNA, 20 bp, mouse
gtgggcccgagcgactcttg

SEQ ID NO: 705917 - DNA, 20 bp, mouse
gcgcggtagcgctgcagaga

SEQ ID NO: 705918 - DNA, 20 bp, mouse
gctgcaccggcgttctgtgg

SEQ ID NO: 705919 - DNA, 20 bp, mouse
ggtggaggagccacggggtg

SEQ ID NO: 705920 - DNA, 20 bp, mouse
ggcgccgagcgtctgacctc

SEQ ID NO: 705921 - DNA, 20 bp, mouse
ggagctgcaccggcgttctg

SEQ ID NO: 705922 - DNA, 20 bp, mouse
ggcgcccccaagagtcgctc

SEQ ID NO: 705923 - DNA, 20 bp, mouse
gtggctcctccacagaacgc

SEQ ID NO: 705924 - DNA, 20 bp, mouse
gtaccgagctccgttagaaa

SEQ ID NO: 705925 - DNA, 20 bp, mouse
ggcgctaccgcgagctgcac

SEQ ID NO: 705926 - DNA, 20 bp, mouse
gtccctggggtccttcctga

SEQ ID NO: 705927 - DNA, 20 bp, mouse
ggggccaggaagaggctagg

SEQ ID NO: 705928 - DNA, 20 bp, mouse
gaggaagaggctaggagggc

SEQ ID NO: 705929 - DNA, 20 bp, mouse
gactagctcctccctcagga

SEQ ID NO: 705930 - DNA, 20 bp, mouse
gacctccgggcgaatgaaag

SEQ ID NO: 705931 - DNA, 20 bp, mouse
gtccctcaggaaggacccca

SEQ ID NO: 705932 - DNA, 20 bp, mouse
gaagcgggaaataatgttgt

SEQ ID NO: 705933 - DNA, 20 bp, mouse
gctaagaaaaggcagggcta

SEQ ID NO: 705934 - DNA, 20 bp, mouse
gtgctgcgggggccaggaag

SEQ ID NO: 705935 - DNA, 20 bp, mouse
gcattcgcccggaggtagat

SEQ ID NO: 705936 - DNA, 20 bp, mouse
gtggggacgcgatgagtggg

SEQ ID NO: 705937 - DNA, 20 bp, mouse
gtgaccgcagaagaggagtg

SEQ ID NO: 705938 - DNA, 20 bp, mouse
ggagtggggacgcgatgagt

SEQ ID NO: 705939 - DNA, 20 bp, mouse
gcgtccccactcctcttctg

SEQ ID NO: 705940 - DNA, 20 bp, mouse
ggcgatgagacgataaggtc

SEQ ID NO: 705941 - DNA, 20 bp, mouse
gaggtggcgatgagacgata

SEQ ID NO: 705942 - DNA, 20 bp, mouse
gcatcagcacaagctgtcag

SEQ ID NO: 705943 - DNA, 20 bp, mouse
gccttggggtcgaggaaaac

SEQ ID NO: 705944 - DNA, 20 bp, mouse
gcccagcgacagagcccacc

SEQ ID NO: 705945 - DNA, 20 bp, mouse
gaccgggtgggctctgtcgc

SEQ ID NO: 705946 - DNA, 20 bp, mouse
ggctcaggttggcagatgga

SEQ ID NO: 705947 - DNA, 20 bp, mouse
gatcgtcgagaaagacaggg

SEQ ID NO: 705948 - DNA, 20 bp, mouse
gtggggcggaatgttcttaa

SEQ ID NO: 705949 - DNA, 20 bp, mouse
gagggcttgggcaggaaatc

SEQ ID NO: 705950 - DNA, 20 bp, mouse
gaagatcgtcgagaaagaca

SEQ ID NO: 705951 - DNA, 20 bp, mouse
gcctgactgggaggacccgg

SEQ ID NO: 705952 - DNA, 20 bp, mouse
gatggagggagttaaggcca

SEQ ID NO: 705953 - DNA, 20 bp, mouse
ggagggagttaaggccaggg

SEQ ID NO: 705954 - DNA, 20 bp, mouse
gactagttgttgcagcccta

SEQ ID NO: 705955 - DNA, 20 bp, mouse
ggaaatccggcctgactggg

SEQ ID NO: 705956 - DNA, 20 bp, mouse
ggggcgcagtggcgaaggcg

SEQ ID NO: 705957 - DNA, 20 bp, mouse
gcagtggcgaaggcggggct

SEQ ID NO: 705958 - DNA, 20 bp, mouse
gcactcgctgccaataggtg

SEQ ID NO: 705959 - DNA, 20 bp, mouse
ggcgaaggcggggcttggtt

SEQ ID NO: 705960 - DNA, 20 bp, mouse
gcggggcttggtttggagac

SEQ ID NO: 705961 - DNA, 20 bp, mouse
gccaaagcgtttgccagtgt

SEQ ID NO: 705962 - DNA, 20 bp, mouse
gtcacagtcagcgtcctttc

SEQ ID NO: 705963 - DNA, 20 bp, mouse
gtcctttctgggtccgagta

SEQ ID NO: 705964 - DNA, 20 bp, mouse
ggagcaggcttctaacggaa

SEQ ID NO: 705965 - DNA, 20 bp, mouse
gtcgctgccaataggtgtgg

SEQ ID NO: 705966 - DNA, 20 bp, mouse
ggggcggggtgaaacgggaa

SEQ ID NO: 705967 - DNA, 20 bp, mouse
gctggcgttcggctctgcga

SEQ ID NO: 705968 - DNA, 20 bp, mouse
gggaagggcagcgggagctg

SEQ ID NO: 705969 - DNA, 20 bp, mouse
ggcagcctggatccccgagg

SEQ ID NO: 705970 - DNA, 20 bp, mouse
ggccgccgcctcggggatcc

SEQ ID NO: 705971 - DNA, 20 bp, mouse
ggggaagaggaggcggtcta

SEQ ID NO: 705972 - DNA, 20 bp, mouse
gagggacccgccgccgcctc

SEQ ID NO: 705973 - DNA, 20 bp, mouse
gtcggggatccaggctgcct

SEQ ID NO: 705974 - DNA, 20 bp, mouse
gctcccgctgcccttcccct

SEQ ID NO: 705975 - DNA, 20 bp, mouse
gccccgctactcagtccgca

SEQ ID NO: 705976 - DNA, 20 bp, mouse
gtacgtgctctggaacatac

SEQ ID NO: 705977 - DNA, 20 bp, mouse
gacctgaggtgcttgctatc

SEQ ID NO: 705978 - DNA, 20 bp, mouse
gtaacctataacccgaaaac

SEQ ID NO: 705979 - DNA, 20 bp, mouse
gtagcagaagtggagccaaa

SEQ ID NO: 705980 - DNA, 20 bp, mouse
gcaaaacgaacagactctgg

SEQ ID NO: 705981 - DNA, 20 bp, mouse
gaaaggccatgtacgtgctc

SEQ ID NO: 705982 - DNA, 20 bp, mouse
gggtagtcatcaccagtttt

SEQ ID NO: 705983 - DNA, 20 bp, mouse
ggacatgaccttactcagag

SEQ ID NO: 705984 - DNA, 20 bp, mouse
gacgaacagactctggaggc

SEQ ID NO: 705985 - DNA, 20 bp, mouse
gacagactctggctgggcaa

SEQ ID NO: 705986 - DNA, 20 bp, mouse
gactaagtggaggattcctg

SEQ ID NO: 705987 - DNA, 20 bp, mouse
gactccgtgtcctcagcagg

SEQ ID NO: 705988 - DNA, 20 bp, mouse
gggaaagcatcctgactaag

SEQ ID NO: 705989 - DNA, 20 bp, mouse
ggggttctgactgtcaggat

SEQ ID NO: 705990 - DNA, 20 bp, mouse
gagaagaggggcaagtgaca

SEQ ID NO: 705991 - DNA, 20 bp, mouse
gtaggtatactcagacatca

SEQ ID NO: 705992 - DNA, 20 bp, mouse
gcacccagctgaatattgaa

SEQ ID NO: 705993 - DNA, 20 bp, mouse
ggtgggcggggccaacagaa

SEQ ID NO: 705994 - DNA, 20 bp, mouse
gggacacggagtcccattta

SEQ ID NO: 705995 - DNA, 20 bp, mouse
gtgaatattgaacgggatgg

SEQ ID NO: 705996 - DNA, 20 bp, mouse
ggtgccaaagtcgggacagt

SEQ ID NO: 705997 - DNA, 20 bp, mouse
gggaggacaggtgccaaagt

SEQ ID NO: 705998 - DNA, 20 bp, mouse
gaagccaactgtcccgactt

SEQ ID NO: 705999 - DNA, 20 bp, mouse
gtacacagcctcaagagatg

SEQ ID NO: 706000 - DNA, 20 bp, mouse
gagaacaaacagtggaggac

SEQ ID NO: 706001 - DNA, 20 bp, mouse
gacagggaccatggagaatc

SEQ ID NO: 706002 - DNA, 20 bp, mouse
gcgggacagttggcttgggt

SEQ ID NO: 706003 - DNA, 20 bp, mouse
gactgttgaagaacaaacag

SEQ ID NO: 706004 - DNA, 20 bp, mouse
gccagggccaagcccacaca

SEQ ID NO: 706005 - DNA, 20 bp, mouse
gaccatggagaatcaggagc

SEQ ID NO: 706006 - DNA, 20 bp, mouse
gaaaaagcgagtgttcccct

SEQ ID NO: 706007 - DNA, 20 bp, mouse
gccaccctagcgcccaagag

SEQ ID NO: 706008 - DNA, 20 bp, mouse
gtgggtaaagtaatgaaggg

SEQ ID NO: 706009 - DNA, 20 bp, mouse
gctgaaggcatctttcacta

SEQ ID NO: 706010 - DNA, 20 bp, mouse
gtagggtggccgggaaggat

SEQ ID NO: 706011 - DNA, 20 bp, mouse
gagggctgggatttagaaca

SEQ ID NO: 706012 - DNA, 20 bp, mouse
gattgccagaagctcttccc

SEQ ID NO: 706013 - DNA, 20 bp, mouse
gcgggaaggataggtcattt

SEQ ID NO: 706014 - DNA, 20 bp, mouse
gaagcgagtgttcccctcgg

SEQ ID NO: 706015 - DNA, 20 bp, mouse
gcctttctttctccaccgag

SEQ ID NO: 706016 - DNA, 20 bp, mouse
gacgtggcgcagagcgcgaa

SEQ ID NO: 706017 - DNA, 20 bp, mouse
ggcgcgccgtaggtgtcatg

SEQ ID NO: 706018 - DNA, 20 bp, mouse
gggcggacagagaaagcacg

SEQ ID NO: 706019 - DNA, 20 bp, mouse
gcccctccatgccgcgccac

SEQ ID NO: 706020 - DNA, 20 bp, mouse
ggcggggcgcacggctgcga

SEQ ID NO: 706021 - DNA, 20 bp, mouse
gggcgtgctgaggaggctga

SEQ ID NO: 706022 - DNA, 20 bp, mouse
gtcccgtggcgcggcatgga

SEQ ID NO: 706023 - DNA, 20 bp, mouse
gagaaccccacacccctcgc

SEQ ID NO: 706024 - DNA, 20 bp, mouse
gccaccggtccctcagccgg

SEQ ID NO: 706025 - DNA, 20 bp, mouse
gtggcgcgcagcggggcgca

SEQ ID NO: 706026 - DNA, 20 bp, mouse
gggttggcgcgagagtcaaa

SEQ ID NO: 706027 - DNA, 20 bp, mouse
gcggcagggctctggctcta

SEQ ID NO: 706028 - DNA, 20 bp, mouse
ggggctctggctctacgggt

SEQ ID NO: 706029 - DNA, 20 bp, mouse
gcgaccgcccgggcggtcgc

SEQ ID NO: 706030 - DNA, 20 bp, mouse
gcgggcggtcgccggaaacc

SEQ ID NO: 706031 - DNA, 20 bp, mouse
gcgggcggtcgattcgcgag

SEQ ID NO: 706032 - DNA, 20 bp, mouse
gctcgcgagaggtgtctgag

SEQ ID NO: 706033 - DNA, 20 bp, mouse
gtgcgcagaactcttcggca

SEQ ID NO: 706034 - DNA, 20 bp, mouse
ggaactcttcggcagggctc

SEQ ID NO: 706035 - DNA, 20 bp, mouse
gctgagtgctagcgcgggga

SEQ ID NO: 706036 - DNA, 20 bp, mouse
ggctgcattacccaaccttc

SEQ ID NO: 706037 - DNA, 20 bp, mouse
gagctgtatcaaggtaggag

SEQ ID NO: 706038 - DNA, 20 bp, mouse
gccagtaagtaaactcagat

SEQ ID NO: 706039 - DNA, 20 bp, mouse
gggccctccatggtatgtaa

SEQ ID NO: 706040 - DNA, 20 bp, mouse
gcagaatggtatgagcctga

SEQ ID NO: 706041 - DNA, 20 bp, mouse
gaggtaggaggggtcagcat

SEQ ID NO: 706042 - DNA, 20 bp, mouse
gatggtatgagcctgaaggt

SEQ ID NO: 706043 - DNA, 20 bp, mouse
gatcaggaggctattggcat

SEQ ID NO: 706044 - DNA, 20 bp, mouse
gtaaactcagataggcaaat

SEQ ID NO: 706045 - DNA, 20 bp, mouse
gcaaactcctagtaacaggt

SEQ ID NO: 706046 - DNA, 20 bp, mouse
gccaaagctgagtcagggta

SEQ ID NO: 706047 - DNA, 20 bp, mouse
gagagggcgtcccactgagc

SEQ ID NO: 706048 - DNA, 20 bp, mouse
ggtgtgagtggtcacctgtc

SEQ ID NO: 706049 - DNA, 20 bp, mouse
ggtgcagggcagatcagtca

SEQ ID NO: 706050 - DNA, 20 bp, mouse
gagttaaccaaagctgagtc

SEQ ID NO: 706051 - DNA, 20 bp, mouse
gaggctagagctagttgctt

SEQ ID NO: 706052 - DNA, 20 bp, mouse
gtggtcagaggtgctctcat

SEQ ID NO: 706053 - DNA, 20 bp, mouse
gcatctgggagagatcctta

SEQ ID NO: 706054 - DNA, 20 bp, mouse
gtcagtgggacgccctctgg

SEQ ID NO: 706055 - DNA, 20 bp, mouse
gcactggcccagcaaagtgc

SEQ ID NO: 706056 - DNA, 20 bp, mouse
gaggaagggaacgatgtcgt

SEQ ID NO: 706057 - DNA, 20 bp, mouse
ggccctgcatccgggtctca

SEQ ID NO: 706058 - DNA, 20 bp, mouse
gatgcagggccgggcgagga

SEQ ID NO: 706059 - DNA, 20 bp, mouse
gaggggcgtgtccgagggga

SEQ ID NO: 706060 - DNA, 20 bp, mouse
gctcgcccggccctgcatcc

SEQ ID NO: 706061 - DNA, 20 bp, mouse
gggggcaggccgtcgaggaa

SEQ ID NO: 706062 - DNA, 20 bp, mouse
gacatcgttcccttcctcga

SEQ ID NO: 706063 - DNA, 20 bp, mouse
ggcatccgggtctcagggag

SEQ ID NO: 706064 - DNA, 20 bp, mouse
gcacgcccctccctgagacc

SEQ ID NO: 706065 - DNA, 20 bp, mouse
gcagggaggggcgtgtccga

SEQ ID NO: 706066 - DNA, 20 bp, mouse
gagagtgcgtgatttcatag

SEQ ID NO: 706067 - DNA, 20 bp, mouse
gaaaggctgtttgtccagaa

SEQ ID NO: 706068 - DNA, 20 bp, mouse
gctatcttctctgtgactaa

SEQ ID NO: 706069 - DNA, 20 bp, mouse
ggagaaaggccggatgatga

SEQ ID NO: 706070 - DNA, 20 bp, mouse
ggagcatagaggaagtcgct

SEQ ID NO: 706071 - DNA, 20 bp, mouse
gtgcctgggtcttagagatc

SEQ ID NO: 706072 - DNA, 20 bp, mouse
gagcctccaattgagattgg

SEQ ID NO: 706073 - DNA, 20 bp, mouse
gaatagcctccaattgagat

SEQ ID NO: 706074 - DNA, 20 bp, mouse
gttcctgatctctaagaccc

SEQ ID NO: 706075 - DNA, 20 bp, mouse
gctattctagaattggctac

SEQ ID NO: 706076 - DNA, 20 bp, mouse
gtagacttctagattctctt

SEQ ID NO: 706077 - DNA, 20 bp, mouse
gcctaaagtggctctctcca

SEQ ID NO: 706078 - DNA, 20 bp, mouse
gggcagaggcacagggactt

SEQ ID NO: 706079 - DNA, 20 bp, mouse
gctgaaaaggggtgctctga

SEQ ID NO: 706080 - DNA, 20 bp, mouse
gcttcctgctccaccctcat

SEQ ID NO: 706081 - DNA, 20 bp, mouse
gccatctaagaagctacctc

SEQ ID NO: 706082 - DNA, 20 bp, mouse
gtggcttctagggagagtat

SEQ ID NO: 706083 - DNA, 20 bp, mouse
gttgtacacaaacatctcag

SEQ ID NO: 706084 - DNA, 20 bp, mouse
gtggccgatgagggtggagc

SEQ ID NO: 706085 - DNA, 20 bp, mouse
ggtggtgtggccgatgaggg

SEQ ID NO: 706086 - DNA, 20 bp, mouse
gtgagatgacacagaacaag

SEQ ID NO: 706087 - DNA, 20 bp, mouse
gtagcagagaggaagcgagg

SEQ ID NO: 706088 - DNA, 20 bp, mouse
ggtgcagcttgctaggaaga

SEQ ID NO: 706089 - DNA, 20 bp, mouse
gggggaggaactgtggaaat

SEQ ID NO: 706090 - DNA, 20 bp, mouse
gcatctcatgtggtacccat

SEQ ID NO: 706091 - DNA, 20 bp, mouse
gtgaatgacaatgacttggc

SEQ ID NO: 706092 - DNA, 20 bp, mouse
gaagcgagggggaggaactg

SEQ ID NO: 706093 - DNA, 20 bp, mouse
gttgcagtcaactaaagtcc

SEQ ID NO: 706094 - DNA, 20 bp, mouse
ggtagctaccagcagcccat

SEQ ID NO: 706095 - DNA, 20 bp, mouse
gctggtagctacttagcact

SEQ ID NO: 706096 - DNA, 20 bp, mouse
gccctgaaggggaaatgagt

SEQ ID NO: 706097 - DNA, 20 bp, mouse
gaaggggaaatgagtagggc

SEQ ID NO: 706098 - DNA, 20 bp, mouse
gtcccctcgggtaggtggaa

SEQ ID NO: 706099 - DNA, 20 bp, mouse
gtgccctcaacaccccctga

SEQ ID NO: 706100 - DNA, 20 bp, mouse
gcgaggggatatagtctgca

SEQ ID NO: 706101 - DNA, 20 bp, mouse
ggtgttgagggcacagttct

SEQ ID NO: 706102 - DNA, 20 bp, mouse
gtgcacttccccaagctcct

SEQ ID NO: 706103 - DNA, 20 bp, mouse
ggggcagtccgggttctccg

SEQ ID NO: 706104 - DNA, 20 bp, mouse
ggggccgggaggctttccac

SEQ ID NO: 706105 - DNA, 20 bp, mouse
gtccccttcagggggtgttg

SEQ ID NO: 706106 - DNA, 20 bp, mouse
gactccagaaagcttgtctc

SEQ ID NO: 706107 - DNA, 20 bp, mouse
gtaacaaggctcagaggctt

SEQ ID NO: 706108 - DNA, 20 bp, mouse
gacaggataacaaggctcag

SEQ ID NO: 706109 - DNA, 20 bp, mouse
gttggggaaagatctcccta

SEQ ID NO: 706110 - DNA, 20 bp, mouse
gaaacactggtcccagcttt

SEQ ID NO: 706111 - DNA, 20 bp, mouse
gggctgtaagcggaagtgac

SEQ ID NO: 706112 - DNA, 20 bp, mouse
gtcgctgtgcaatgagaaac

SEQ ID NO: 706113 - DNA, 20 bp, mouse
ggaaagcttgtctcgggaac

SEQ ID NO: 706114 - DNA, 20 bp, mouse
gtcagtgaatccccacactt

SEQ ID NO: 706115 - DNA, 20 bp, mouse
ggttatttttaccttgacac

SEQ ID NO: 706116 - DNA, 20 bp, mouse
gggtgaatcccttccttctt

SEQ ID NO: 706117 - DNA, 20 bp, mouse
ggaaggaagggattcaccta

SEQ ID NO: 706118 - DNA, 20 bp, mouse
gacagcaagcccaagaagga

SEQ ID NO: 706119 - DNA, 20 bp, mouse
ggaagcatccaccacaacag

SEQ ID NO: 706120 - DNA, 20 bp, mouse
gcctgagcacagaaactgga

SEQ ID NO: 706121 - DNA, 20 bp, mouse
gaggaaacagtcccctgttg

SEQ ID NO: 706122 - DNA, 20 bp, mouse
gaaacagtcccctgttgtgg

SEQ ID NO: 706123 - DNA, 20 bp, mouse
gggctctgaagaccgttcag

SEQ ID NO: 706124 - DNA, 20 bp, mouse
ggagtgtcctaagcaacatg

SEQ ID NO: 706125 - DNA, 20 bp, mouse
gagtcagctcagttgaagtg

SEQ ID NO: 706126 - DNA, 20 bp, mouse
ggtaacagaaaggcctactt

SEQ ID NO: 706127 - DNA, 20 bp, mouse
gacactgctacagacaaaga

SEQ ID NO: 706128 - DNA, 20 bp, mouse
ggacaaagatggtaacagaa

SEQ ID NO: 706129 - DNA, 20 bp, mouse
gcacggaaggggcttaggga

SEQ ID NO: 706130 - DNA, 20 bp, mouse
gagctcgggccacctgccga

SEQ ID NO: 706131 - DNA, 20 bp, mouse
gccacaggccagtctgttat

SEQ ID NO: 706132 - DNA, 20 bp, mouse
ggccacatggtggcacccaa

SEQ ID NO: 706133 - DNA, 20 bp, mouse
ggcccttgggtgccaccatg

SEQ ID NO: 706134 - DNA, 20 bp, mouse
gcataggatgaacacggaag

SEQ ID NO: 706135 - DNA, 20 bp, mouse
gggtgtgaacacaaaggcac

SEQ ID NO: 706136 - DNA, 20 bp, mouse
gcggtcgccaggaatgtctc

SEQ ID NO: 706137 - DNA, 20 bp, mouse
gtcttctgctacctgctcag

SEQ ID NO: 706138 - DNA, 20 bp, mouse
gccctgacaggaagttctat

SEQ ID NO: 706139 - DNA, 20 bp, mouse
gacagaccttgttgcctcgg

SEQ ID NO: 706140 - DNA, 20 bp, mouse
gccaggcacggagaatgaac

SEQ ID NO: 706141 - DNA, 20 bp, mouse
gcggagaatgaactggcagt

SEQ ID NO: 706142 - DNA, 20 bp, mouse
gtgcaactttctgactaggc

SEQ ID NO: 706143 - DNA, 20 bp, mouse
gggtacagaccttgttgcct

SEQ ID NO: 706144 - DNA, 20 bp, mouse
gaccttgttgcctcggaggt

SEQ ID NO: 706145 - DNA, 20 bp, mouse
gacttcctgtcagggaatga

SEQ ID NO: 706146 - DNA, 20 bp, mouse
gcagggaagaggcgtgtcgg

SEQ ID NO: 706147 - DNA, 20 bp, mouse
ggggcagggaagaggcgtgt

SEQ ID NO: 706148 - DNA, 20 bp, mouse
gtccctgcccgccctccaca

SEQ ID NO: 706149 - DNA, 20 bp, mouse
gagtgccagcggttccgcgg

SEQ ID NO: 706150 - DNA, 20 bp, mouse
ggtgccgaggcggctctcgg

SEQ ID NO: 706151 - DNA, 20 bp, mouse
ggttccgcggtggccggcga

SEQ ID NO: 706152 - DNA, 20 bp, mouse
gcctcgcccccgcaattaaa

SEQ ID NO: 706153 - DNA, 20 bp, mouse
gcggccggtgcagtttccgt

SEQ ID NO: 706154 - DNA, 20 bp, mouse
ggcgggcagcaagcgatctg

SEQ ID NO: 706155 - DNA, 20 bp, mouse
gaaggacgcttgtgccgagg

SEQ ID NO: 706156 - DNA, 20 bp, mouse
gcgacccgccccatttggga

SEQ ID NO: 706157 - DNA, 20 bp, mouse
gcgggtcgaccgagctgctg

SEQ ID NO: 706158 - DNA, 20 bp, mouse
ggggaccgacccctcccaaa

SEQ ID NO: 706159 - DNA, 20 bp, mouse
ggggagtttgagatgagaaa

SEQ ID NO: 706160 - DNA, 20 bp, mouse
gcggaggacgctcacaaagt

SEQ ID NO: 706161 - DNA, 20 bp, mouse
gcggtcgacccgccccattt

SEQ ID NO: 706162 - DNA, 20 bp, mouse
gctccgcccatagacgtcaa

SEQ ID NO: 706163 - DNA, 20 bp, mouse
gcgacccctcccaaatgggg

SEQ ID NO: 706164 - DNA, 20 bp, mouse
gcgcaggcctttgacgtcta

SEQ ID NO: 706165 - DNA, 20 bp, mouse
gtctcatctcaaactcccgg

SEQ ID NO: 706166 - DNA, 20 bp, mouse
gggagagaactgagctacgg

SEQ ID NO: 706167 - DNA, 20 bp, mouse
gactgagcttcaggaaaatt

SEQ ID NO: 706168 - DNA, 20 bp, mouse
ggtgggagagaactgagcta

SEQ ID NO: 706169 - DNA, 20 bp, mouse
gtgagctacggtggccgaga

SEQ ID NO: 706170 - DNA, 20 bp, mouse
gcgcaccagtgcacttctat

SEQ ID NO: 706171 - DNA, 20 bp, mouse
gagcaacctcactgagcttc

SEQ ID NO: 706172 - DNA, 20 bp, mouse
gaaattgcgtctaagattgt

SEQ ID NO: 706173 - DNA, 20 bp, mouse
gtggcgccaaagcgaggagc

SEQ ID NO: 706174 - DNA, 20 bp, mouse
gaatgtgcactttactttgc

SEQ ID NO: 706175 - DNA, 20 bp, mouse
gaaagcgaggagctggttgc

SEQ ID NO: 706176 - DNA, 20 bp, mouse
gtgtactagctgtgacttgg

SEQ ID NO: 706177 - DNA, 20 bp, mouse
gggagcccaagtactggaaa

SEQ ID NO: 706178 - DNA, 20 bp, mouse
gctagtacaaactcgcggat

SEQ ID NO: 706179 - DNA, 20 bp, mouse
gtactggaaagggcatcggt

SEQ ID NO: 706180 - DNA, 20 bp, mouse
gaacggaagacgtcctgcgg

SEQ ID NO: 706181 - DNA, 20 bp, mouse
ggggccgtgagcgtggtagg

SEQ ID NO: 706182 - DNA, 20 bp, mouse
gaagagagcaacgtctctat

SEQ ID NO: 706183 - DNA, 20 bp, mouse
gtcgcggattggtctgtagg

SEQ ID NO: 706184 - DNA, 20 bp, mouse
gcgccggccccgcccctcta

SEQ ID NO: 706185 - DNA, 20 bp, mouse
gtagtagggcggggccgtca

SEQ ID NO: 706186 - DNA, 20 bp, mouse
gcaggcaaaagcaatcaata

SEQ ID NO: 706187 - DNA, 20 bp, mouse
gaagccctggatgagtcggc

SEQ ID NO: 706188 - DNA, 20 bp, mouse
ggcggaagccctggatgagt

SEQ ID NO: 706189 - DNA, 20 bp, mouse
gcaagctgcaggaggacttc

SEQ ID NO: 706190 - DNA, 20 bp, mouse
gccgcccaatgcggaagccc

SEQ ID NO: 706191 - DNA, 20 bp, mouse
gtcatccagggcttccgcat

SEQ ID NO: 706192 - DNA, 20 bp, mouse
gcttccggccgactcatcca

SEQ ID NO: 706193 - DNA, 20 bp, mouse
gagacccgagcagtcgattt

SEQ ID NO: 706194 - DNA, 20 bp, mouse
ggaagcttgaacatcattga

SEQ ID NO: 706195 - DNA, 20 bp, mouse
gtcgccgaaatcgactgctc

SEQ ID NO: 706196 - DNA, 20 bp, mouse
gcaagagcccgccccggggt

SEQ ID NO: 706197 - DNA, 20 bp, mouse
gccacccggcacttcactcc

SEQ ID NO: 706198 - DNA, 20 bp, mouse
ggggtggcaccgtctcggga

SEQ ID NO: 706199 - DNA, 20 bp, mouse
gaggccgggagtgaagtgcc

SEQ ID NO: 706200 - DNA, 20 bp, mouse
gggccccgcctaccccgggg

SEQ ID NO: 706201 - DNA, 20 bp, mouse
gtacttccggaaggcgggga

SEQ ID NO: 706202 - DNA, 20 bp, mouse
gcgtctcgggacggccacgt

SEQ ID NO: 706203 - DNA, 20 bp, mouse
gtgccgggtggcaccgtctc

SEQ ID NO: 706204 - DNA, 20 bp, mouse
gtcggcaagagcccgccccg

SEQ ID NO: 706205 - DNA, 20 bp, mouse
gagatcgcgcggaaagcccg

SEQ ID NO: 706206 - DNA, 20 bp, mouse
gtgctcctgggctgtgctaa

SEQ ID NO: 706207 - DNA, 20 bp, mouse
gaacagcaggccctgtgccc

SEQ ID NO: 706208 - DNA, 20 bp, mouse
gtctccccacagtatccaac

SEQ ID NO: 706209 - DNA, 20 bp, mouse
ggaaagggttgcctcggtag

SEQ ID NO: 706210 - DNA, 20 bp, mouse
gtgtgcccaggaaagaagag

SEQ ID NO: 706211 - DNA, 20 bp, mouse
gttatctggggcctgcctgg

SEQ ID NO: 706212 - DNA, 20 bp, mouse
ggtatctctagcgttatctg

SEQ ID NO: 706213 - DNA, 20 bp, mouse
gaagtcacctatggctttgt

SEQ ID NO: 706214 - DNA, 20 bp, mouse
gaaagtgattaggtgtataa

SEQ ID NO: 706215 - DNA, 20 bp, mouse
gggtgtataatgggcctcac

SEQ ID NO: 706216 - DNA, 20 bp, mouse
gaccaatgggcgcctcccgt

SEQ ID NO: 706217 - DNA, 20 bp, mouse
gtcccgtcggaacgctccag

SEQ ID NO: 706218 - DNA, 20 bp, mouse
ggaagggctgaaccattgtg

SEQ ID NO: 706219 - DNA, 20 bp, mouse
gactcgctctaaatagggaa

SEQ ID NO: 706220 - DNA, 20 bp, mouse
gaacccttgcagcctcacaa

SEQ ID NO: 706221 - DNA, 20 bp, mouse
ggatccctccgccgcgcctc

SEQ ID NO: 706222 - DNA, 20 bp, mouse
gagagtcagatgaccgggtt

SEQ ID NO: 706223 - DNA, 20 bp, mouse
gcgcggcggagggatccctc

SEQ ID NO: 706224 - DNA, 20 bp, mouse
gcgggcggactaatcagcga

SEQ ID NO: 706225 - DNA, 20 bp, mouse
gtgggcggggccggcgtccc

SEQ ID NO: 706226 - DNA, 20 bp, mouse
gaggaggtctgagtctagaa

SEQ ID NO: 706227 - DNA, 20 bp, mouse
gcaggtgccctgtccttcac

SEQ ID NO: 706228 - DNA, 20 bp, mouse
gaaggacagggcacctgagc

SEQ ID NO: 706229 - DNA, 20 bp, mouse
gtgagcgcccagattctgaa

SEQ ID NO: 706230 - DNA, 20 bp, mouse
gtcccctccctgtgaaggac

SEQ ID NO: 706231 - DNA, 20 bp, mouse
ggccctgtccttcacaggga

SEQ ID NO: 706232 - DNA, 20 bp, mouse
gtgaagcccgcgccgctagg

SEQ ID NO: 706233 - DNA, 20 bp, mouse
gtcaggtcccctccctgtga

SEQ ID NO: 706234 - DNA, 20 bp, mouse
gagaatctgggcgctcaact

SEQ ID NO: 706235 - DNA, 20 bp, mouse
gaaggccggtccgcgagcaa

SEQ ID NO: 706236 - DNA, 20 bp, mouse
gagttcacagacagggtcgg

SEQ ID NO: 706237 - DNA, 20 bp, mouse
gggaagaccgctgacatgga

SEQ ID NO: 706238 - DNA, 20 bp, mouse
gagaccgctgacatggacgg

SEQ ID NO: 706239 - DNA, 20 bp, mouse
gcagggtggaccctgaggta

SEQ ID NO: 706240 - DNA, 20 bp, mouse
gtggaccctgaggtagggca

SEQ ID NO: 706241 - DNA, 20 bp, mouse
ggagaaggggaggacgggcg

SEQ ID NO: 706242 - DNA, 20 bp, mouse
gatggacggtgggctgtgtg

SEQ ID NO: 706243 - DNA, 20 bp, mouse
ggggactcgcgaacaacagg

SEQ ID NO: 706244 - DNA, 20 bp, mouse
gagcccaccgtccatgtcag

SEQ ID NO: 706245 - DNA, 20 bp, mouse
gggcacggagttcacagaca

SEQ ID NO: 706246 - DNA, 20 bp, mouse
ggctggcatagtgtgttctg

SEQ ID NO: 706247 - DNA, 20 bp, mouse
gcggaccagagaacaggagg

SEQ ID NO: 706248 - DNA, 20 bp, mouse
ggagaggctgtgtaagtggc

SEQ ID NO: 706249 - DNA, 20 bp, mouse
gttccctctacgtgacacaa

SEQ ID NO: 706250 - DNA, 20 bp, mouse
gctgtgtgaggcagcgtgag

SEQ ID NO: 706251 - DNA, 20 bp, mouse
ggggaacagtcacacagtta

SEQ ID NO: 706252 - DNA, 20 bp, mouse
gccagggcggaccagagaac

SEQ ID NO: 706253 - DNA, 20 bp, mouse
gagccattgtgtcacgtaga

SEQ ID NO: 706254 - DNA, 20 bp, mouse
gcaagtgattgggaagctgt

SEQ ID NO: 706255 - DNA, 20 bp, mouse
gcgccccctcccaacacccc

SEQ ID NO: 706256 - DNA, 20 bp, mouse
gcgcaggcgggagtggacgg

SEQ ID NO: 706257 - DNA, 20 bp, mouse
gagtggacgggggttcttaa

SEQ ID NO: 706258 - DNA, 20 bp, mouse
gcggcccaggccgctcctgc

SEQ ID NO: 706259 - DNA, 20 bp, mouse
gagacggacgtggtggggat

SEQ ID NO: 706260 - DNA, 20 bp, mouse
gagaaaggaagcctgcgcgc

SEQ ID NO: 706261 - DNA, 20 bp, mouse
gggttccgggccagccccgg

SEQ ID NO: 706262 - DNA, 20 bp, mouse
gtgagcggagcgccggggcg

SEQ ID NO: 706263 - DNA, 20 bp, mouse
gcggcccaaaaaccgagaga

SEQ ID NO: 706264 - DNA, 20 bp, mouse
gcaggcttcctttctccgag

SEQ ID NO: 706265 - DNA, 20 bp, mouse
gcagtgaaagccctgcccac

SEQ ID NO: 706266 - DNA, 20 bp, mouse
gacggcctgcggagccctgc

SEQ ID NO: 706267 - DNA, 20 bp, mouse
gttccagcgcctctcagccc

SEQ ID NO: 706268 - DNA, 20 bp, mouse
gcaggtcatgtgaccggaaa

SEQ ID NO: 706269 - DNA, 20 bp, mouse
gtctagagacaggcactgga

SEQ ID NO: 706270 - DNA, 20 bp, mouse
ggtatcgccatcttgaatga

SEQ ID NO: 706271 - DNA, 20 bp, mouse
ggcgcgtgcgcagtgtgccg

SEQ ID NO: 706272 - DNA, 20 bp, mouse
gcctctgccctcattcaaga

SEQ ID NO: 706273 - DNA, 20 bp, mouse
gtccggtcacatgacctgca

SEQ ID NO: 706274 - DNA, 20 bp, mouse
ggcgcgggggagacggcctg

SEQ ID NO: 706275 - DNA, 20 bp, mouse
gggtcattggagagtgaatg

SEQ ID NO: 706276 - DNA, 20 bp, mouse
ggagtggaggctggcgagcg

SEQ ID NO: 706277 - DNA, 20 bp, mouse
gtcaatgtgctgacgagaag

SEQ ID NO: 706278 - DNA, 20 bp, mouse
ggaaggaggggctaggagaa

SEQ ID NO: 706279 - DNA, 20 bp, mouse
gaacaaaggaaagaggcggt

SEQ ID NO: 706280 - DNA, 20 bp, mouse
ggcaggcagaagaagcaacc

SEQ ID NO: 706281 - DNA, 20 bp, mouse
gactgactcaactggaagga

SEQ ID NO: 706282 - DNA, 20 bp, mouse
gaactcgtgcagacttgttc

SEQ ID NO: 706283 - DNA, 20 bp, mouse
gttggatgggtcattccttc

SEQ ID NO: 706284 - DNA, 20 bp, mouse
gggtgtgtgaagcttgaggt

SEQ ID NO: 706285 - DNA, 20 bp, mouse
ggatgtacgtcagctactgc

SEQ ID NO: 706286 - DNA, 20 bp, mouse
gtcaacagggaaagcaaagt

SEQ ID NO: 706287 - DNA, 20 bp, mouse
gtgcaagtagagtctctcca

SEQ ID NO: 706288 - DNA, 20 bp, mouse
ggagagactctacttgcagg

SEQ ID NO: 706289 - DNA, 20 bp, mouse
gtagaaaaggggaaagtagg

SEQ ID NO: 706290 - DNA, 20 bp, mouse
ggcagggggcgcaccttttc

SEQ ID NO: 706291 - DNA, 20 bp, mouse
gcaagttagtggtaatgttg

SEQ ID NO: 706292 - DNA, 20 bp, mouse
gcttacaatggtagcacgtg

SEQ ID NO: 706293 - DNA, 20 bp, mouse
gaacaccacaacagtcttct

SEQ ID NO: 706294 - DNA, 20 bp, mouse
gggtagtggaagcttagaaa

SEQ ID NO: 706295 - DNA, 20 bp, mouse
gaatccttgggagctgcttc

SEQ ID NO: 706296 - DNA, 20 bp, mouse
gcctcaccgggtcccgtctg

SEQ ID NO: 706297 - DNA, 20 bp, mouse
ggcagagtgggaggtggcga

SEQ ID NO: 706298 - DNA, 20 bp, mouse
gtggcctgtgggatgcgggg

SEQ ID NO: 706299 - DNA, 20 bp, mouse
gagggcgtggcggggcgaca

SEQ ID NO: 706300 - DNA, 20 bp, mouse
gccgccgcaggtgtcggatg

SEQ ID NO: 706301 - DNA, 20 bp, mouse
ggggtcccgtctggggaagc

SEQ ID NO: 706302 - DNA, 20 bp, mouse
ggggccgggtcctatagggc

SEQ ID NO: 706303 - DNA, 20 bp, mouse
ggaaccccatccgacacctg

SEQ ID NO: 706304 - DNA, 20 bp, mouse
gtggcggggcgacagggcag

SEQ ID NO: 706305 - DNA, 20 bp, mouse
gctcgcgcgcccacatcctc

SEQ ID NO: 706306 - DNA, 20 bp, mouse
gcgcccagattgtgcttctt

SEQ ID NO: 706307 - DNA, 20 bp, mouse
gggagtgcagtctgggatac

SEQ ID NO: 706308 - DNA, 20 bp, mouse
gtgcagtctgggataccgga

SEQ ID NO: 706309 - DNA, 20 bp, mouse
gtagggagggcactggacct

SEQ ID NO: 706310 - DNA, 20 bp, mouse
gaaccaaagaagcacaatct

SEQ ID NO: 706311 - DNA, 20 bp, mouse
gggagggcactggacctggg

SEQ ID NO: 706312 - DNA, 20 bp, mouse
gaacgccagccagagggctc

SEQ ID NO: 706313 - DNA, 20 bp, mouse
gacatcctgctgcggaccta

SEQ ID NO: 706314 - DNA, 20 bp, mouse
gccctccctaggtccgcagc

SEQ ID NO: 706315 - DNA, 20 bp, mouse
ggaggctgtaaggagtgggt

SEQ ID NO: 706316 - DNA, 20 bp, mouse
ggggacagggacagtgacgg

SEQ ID NO: 706317 - DNA, 20 bp, mouse
gtctcgactggtgaggaaaa

SEQ ID NO: 706318 - DNA, 20 bp, mouse
ggggacagggacagcgggac

SEQ ID NO: 706319 - DNA, 20 bp, mouse
gacagggacagtgacggcgg

SEQ ID NO: 706320 - DNA, 20 bp, mouse
ggtagggtgtctttctcgac

SEQ ID NO: 706321 - DNA, 20 bp, mouse
ggagccagctagcaagtgca

SEQ ID NO: 706322 - DNA, 20 bp, mouse
ggtgggcgggagcaactaac

SEQ ID NO: 706323 - DNA, 20 bp, mouse
ggggataccggttaaaaaga

SEQ ID NO: 706324 - DNA, 20 bp, mouse
ggtgtctttctcgactggtg

SEQ ID NO: 706325 - DNA, 20 bp, mouse
ggggagaattaccttttcct

SEQ ID NO: 706326 - DNA, 20 bp, mouse
ggaactcccccagaccagtc

SEQ ID NO: 706327 - DNA, 20 bp, mouse
ggcaaggaagagattctcat

SEQ ID NO: 706328 - DNA, 20 bp, mouse
gtgaggccagactggtctgg

SEQ ID NO: 706329 - DNA, 20 bp, mouse
gtcttccttgctaggcgtgg

SEQ ID NO: 706330 - DNA, 20 bp, mouse
gccaagtgtaaggtgggcct

SEQ ID NO: 706331 - DNA, 20 bp, mouse
gtgttgaggccagactggtc

SEQ ID NO: 706332 - DNA, 20 bp, mouse
gcccctcccctttgtaggag

SEQ ID NO: 706333 - DNA, 20 bp, mouse
gtcctggggatatttcagaa

SEQ ID NO: 706334 - DNA, 20 bp, mouse
ggagattccaagtgtaaggt

SEQ ID NO: 706335 - DNA, 20 bp, mouse
gtcccctcctacaaagggga

SEQ ID NO: 706336 - DNA, 20 bp, mouse
ggctgggcaccaggggagga

SEQ ID NO: 706337 - DNA, 20 bp, mouse
gagacagcttttatgaaggg

SEQ ID NO: 706338 - DNA, 20 bp, mouse
ggggatgtttggaaaacaat

SEQ ID NO: 706339 - DNA, 20 bp, mouse
gtgggagcttaaaatattgc

SEQ ID NO: 706340 - DNA, 20 bp, mouse
gcagtcgtgcagcacattag

SEQ ID NO: 706341 - DNA, 20 bp, mouse
gtcgtgcagcacattagggg

SEQ ID NO: 706342 - DNA, 20 bp, mouse
gagaatgggagagctgtgct

SEQ ID NO: 706343 - DNA, 20 bp, mouse
ggtggggggaaagctgacgt

SEQ ID NO: 706344 - DNA, 20 bp, mouse
gagagctgtgctgggcacca

SEQ ID NO: 706345 - DNA, 20 bp, mouse
gtgcagaggacaggtgtgta

SEQ ID NO: 706346 - DNA, 20 bp, mouse
gcacaaagtgggtctactga

SEQ ID NO: 706347 - DNA, 20 bp, mouse
ggtcccaatggatttggatc

SEQ ID NO: 706348 - DNA, 20 bp, mouse
gtgtgtgtggaacggggggt

SEQ ID NO: 706349 - DNA, 20 bp, mouse
gcatgtcaagctccggtcct

SEQ ID NO: 706350 - DNA, 20 bp, mouse
gactccagatccaaatccat

SEQ ID NO: 706351 - DNA, 20 bp, mouse
gtcaaagcccaacccagggg

SEQ ID NO: 706352 - DNA, 20 bp, mouse
gtgctgcttgcccacaaagt

SEQ ID NO: 706353 - DNA, 20 bp, mouse
gagttcttgccctgtcccag

SEQ ID NO: 706354 - DNA, 20 bp, mouse
gcctgaggtcccaatggatt

SEQ ID NO: 706355 - DNA, 20 bp, mouse
gacatggcccacagcccaag

SEQ ID NO: 706356 - DNA, 20 bp, mouse
ggccacgggcggggctctcc

SEQ ID NO: 706357 - DNA, 20 bp, mouse
gcgggcacccagagccgtca

SEQ ID NO: 706358 - DNA, 20 bp, mouse
gacccccagcgccacgggcg

SEQ ID NO: 706359 - DNA, 20 bp, mouse
ggcgactcggcgggccctga

SEQ ID NO: 706360 - DNA, 20 bp, mouse
gtgagctcaaagagagctgg

SEQ ID NO: 706361 - DNA, 20 bp, mouse
gtgcgctcgggacaggacac

SEQ ID NO: 706362 - DNA, 20 bp, mouse
ggtggggtggggagtgacct

SEQ ID NO: 706363 - DNA, 20 bp, mouse
gagccccgcccgtggcgctg

SEQ ID NO: 706364 - DNA, 20 bp, mouse
gaggagagctcgcgactcgg

SEQ ID NO: 706365 - DNA, 20 bp, mouse
ggctccagggtgagagaggc

SEQ ID NO: 706366 - DNA, 20 bp, mouse
gggcgcagacggggtatccg

SEQ ID NO: 706367 - DNA, 20 bp, mouse
ggttaagtgccgtggcagta

SEQ ID NO: 706368 - DNA, 20 bp, mouse
gcactggcagggctgttgca

SEQ ID NO: 706369 - DNA, 20 bp, mouse
gaggcccagcttgtgaaggg

SEQ ID NO: 706370 - DNA, 20 bp, mouse
ggcgctgactagggaacagc

SEQ ID NO: 706371 - DNA, 20 bp, mouse
gaggagcccggagtcgcctc

SEQ ID NO: 706372 - DNA, 20 bp, mouse
gtatccgtggtaaccagcgt

SEQ ID NO: 706373 - DNA, 20 bp, mouse
gaaggactgcaatgacatta

SEQ ID NO: 706374 - DNA, 20 bp, mouse
gggagcagctgcgctgacta

SEQ ID NO: 706375 - DNA, 20 bp, mouse
gacagcaggctcctttgcgg

SEQ ID NO: 706376 - DNA, 20 bp, mouse
gtgggcagaaggacttccct

SEQ ID NO: 706377 - DNA, 20 bp, mouse
gggcaggaggaggaaggcgt

SEQ ID NO: 706378 - DNA, 20 bp, mouse
gcaagagagagtgctggagt

SEQ ID NO: 706379 - DNA, 20 bp, mouse
gcacctgtggctcatctctt

SEQ ID NO: 706380 - DNA, 20 bp, mouse
gggtgggactggagtgatgg

SEQ ID NO: 706381 - DNA, 20 bp, mouse
gggcccaagagatgagccac

SEQ ID NO: 706382 - DNA, 20 bp, mouse
gcctgcctgtctgggttggt

SEQ ID NO: 706383 - DNA, 20 bp, mouse
gatggcaagctgaaaggaac

SEQ ID NO: 706384 - DNA, 20 bp, mouse
ggcactctctcttggctcat

SEQ ID NO: 706385 - DNA, 20 bp, mouse
ggtctgggttggtaggtatg

SEQ ID NO: 706386 - DNA, 20 bp, mouse
gggaaggagggaaaccccta

SEQ ID NO: 706387 - DNA, 20 bp, mouse
gcagcccaggcgtgtcctgt

SEQ ID NO: 706388 - DNA, 20 bp, mouse
gggtgaaaggtcaaagtgta

SEQ ID NO: 706389 - DNA, 20 bp, mouse
gctccagaaaaaagccctag

SEQ ID NO: 706390 - DNA, 20 bp, mouse
ggggccaactctttcgaaga

SEQ ID NO: 706391 - DNA, 20 bp, mouse
gaacccctagggcttttttc

SEQ ID NO: 706392 - DNA, 20 bp, mouse
gcatccccacacaaggttgg

SEQ ID NO: 706393 - DNA, 20 bp, mouse
gaagtcttgctttggaagga

SEQ ID NO: 706394 - DNA, 20 bp, mouse
ggggcggagaggggcaatgg

SEQ ID NO: 706395 - DNA, 20 bp, mouse
ggggactggagagtaactgg

SEQ ID NO: 706396 - DNA, 20 bp, mouse
ggtgcgcaccgccctctctc

SEQ ID NO: 706397 - DNA, 20 bp, mouse
gtctccgggacagaggagcg

SEQ ID NO: 706398 - DNA, 20 bp, mouse
gtacacctggagtctctcct

SEQ ID NO: 706399 - DNA, 20 bp, mouse
gagaggagagggtgcccaaa

SEQ ID NO: 706400 - DNA, 20 bp, mouse
gcggggcgggtccccttctg

SEQ ID NO: 706401 - DNA, 20 bp, mouse
gctcctctgtcccggagaga

SEQ ID NO: 706402 - DNA, 20 bp, mouse
gggtccctggcttcagaaga

SEQ ID NO: 706403 - DNA, 20 bp, mouse
gctaagacctggccctaaca

SEQ ID NO: 706404 - DNA, 20 bp, mouse
gcccgtgcggcgtcaggcag

SEQ ID NO: 706405 - DNA, 20 bp, mouse
ggcactcgacgcgccttctg

SEQ ID NO: 706406 - DNA, 20 bp, mouse
gcagccgcgcccccgctccc

SEQ ID NO: 706407 - DNA, 20 bp, mouse
gcgtgcgcctcgagtgggag

SEQ ID NO: 706408 - DNA, 20 bp, mouse
gtccaccaggcggggatggt

SEQ ID NO: 706409 - DNA, 20 bp, mouse
gtcactggccggctcctccg

SEQ ID NO: 706410 - DNA, 20 bp, mouse
gctgcacgtgcgcctcgagt

SEQ ID NO: 706411 - DNA, 20 bp, mouse
gctagcgcacgagataacgg

SEQ ID NO: 706412 - DNA, 20 bp, mouse
gaccggccgcgcgcgttccc

SEQ ID NO: 706413 - DNA, 20 bp, mouse
ggaccctggaaactcaggtg

SEQ ID NO: 706414 - DNA, 20 bp, mouse
gttcctgtggcgtgattccc

SEQ ID NO: 706415 - DNA, 20 bp, mouse
ggaacgcgcgcggccggtca

SEQ ID NO: 706416 - DNA, 20 bp, mouse
gggaggctggggagaccagc

SEQ ID NO: 706417 - DNA, 20 bp, mouse
gtggacttcaagtggaggct

SEQ ID NO: 706418 - DNA, 20 bp, mouse
gccacccccagggacaatca

SEQ ID NO: 706419 - DNA, 20 bp, mouse
ggggaacaatggagcccttg

SEQ ID NO: 706420 - DNA, 20 bp, mouse
gggctccattgttcccccta

SEQ ID NO: 706421 - DNA, 20 bp, mouse
gtgaatccatgattgtccct

SEQ ID NO: 706422 - DNA, 20 bp, mouse
ggaactgcctggacttcaag

SEQ ID NO: 706423 - DNA, 20 bp, mouse
gctgcctggacttcaagtgg

SEQ ID NO: 706424 - DNA, 20 bp, mouse
gcagacttgggggtattaac

SEQ ID NO: 706425 - DNA, 20 bp, mouse
gtgctcctggggcagacttg

SEQ ID NO: 706426 - DNA, 20 bp, mouse
gtccagagatcgcggcttga

SEQ ID NO: 706427 - DNA, 20 bp, mouse
gctctgagacaaacaaactt

SEQ ID NO: 706428 - DNA, 20 bp, mouse
ggactctggcgtccgggtca

SEQ ID NO: 706429 - DNA, 20 bp, mouse
ggccctcaagccgcgatctc

SEQ ID NO: 706430 - DNA, 20 bp, mouse
ggatctctggaaagtgactc

SEQ ID NO: 706431 - DNA, 20 bp, mouse
gggaaagtgactctggcgtc

SEQ ID NO: 706432 - DNA, 20 bp, mouse
ggcattcaattggttgtctt

SEQ ID NO: 706433 - DNA, 20 bp, mouse
gtcctcgcctgagctcccta

SEQ ID NO: 706434 - DNA, 20 bp, mouse
gggcagctcatccctagaca

SEQ ID NO: 706435 - DNA, 20 bp, mouse
gagggtctaggatcttgcga

SEQ ID NO: 706436 - DNA, 20 bp, mouse
ggcgccgcggggggaggaga

SEQ ID NO: 706437 - DNA, 20 bp, mouse
gcccccgctgcgccggagat

SEQ ID NO: 706438 - DNA, 20 bp, mouse
gtgccgctgtcgccgagcgt

SEQ ID NO: 706439 - DNA, 20 bp, mouse
gagaactgcagcgccccttg

SEQ ID NO: 706440 - DNA, 20 bp, mouse
ggcaggaggaacagacacat

SEQ ID NO: 706441 - DNA, 20 bp, mouse
ggcggggggaggagacggtc

SEQ ID NO: 706442 - DNA, 20 bp, mouse
gctggccgccagtctcccgc

SEQ ID NO: 706443 - DNA, 20 bp, mouse
ggcgcccaggtaacctcacc

SEQ ID NO: 706444 - DNA, 20 bp, mouse
gaaaggtaagggacagacgg

SEQ ID NO: 706445 - DNA, 20 bp, mouse
gtccccatctccggcgcagc

SEQ ID NO: 706446 - DNA, 20 bp, mouse
gcgtccctcaacaatctcgg

SEQ ID NO: 706447 - DNA, 20 bp, mouse
gcgccctccgagattgttga

SEQ ID NO: 706448 - DNA, 20 bp, mouse
gtgggcatagaggggtgctg

SEQ ID NO: 706449 - DNA, 20 bp, mouse
gctatgggattccttcatat

SEQ ID NO: 706450 - DNA, 20 bp, mouse
gcccctctatgcccatatga

SEQ ID NO: 706451 - DNA, 20 bp, mouse
gccccgtccctcaacaatct

SEQ ID NO: 706452 - DNA, 20 bp, mouse
gtagaatctggggaacctta

SEQ ID NO: 706453 - DNA, 20 bp, mouse
gatagtccatcctcagctat

SEQ ID NO: 706454 - DNA, 20 bp, mouse
gaggaagggaagattgaggg

SEQ ID NO: 706455 - DNA, 20 bp, mouse
gggcccaggccaggtgtgcg

SEQ ID NO: 706456 - DNA, 20 bp, mouse
gaggttaagaatagtcacag

SEQ ID NO: 706457 - DNA, 20 bp, mouse
gaagtctggaatgtcctgcg

SEQ ID NO: 706458 - DNA, 20 bp, mouse
ggcaagcacagctacaagtc

SEQ ID NO: 706459 - DNA, 20 bp, mouse
gtctgggccctgcagttgtc

SEQ ID NO: 706460 - DNA, 20 bp, mouse
gcttctattatgtcccgaag

SEQ ID NO: 706461 - DNA, 20 bp, mouse
gtctcattggcaagcagctt

SEQ ID NO: 706462 - DNA, 20 bp, mouse
gtgaaggtgagcagtaacta

SEQ ID NO: 706463 - DNA, 20 bp, mouse
gcagtacagaaaacgttcat

SEQ ID NO: 706464 - DNA, 20 bp, mouse
gaagcagctacttttagccc

SEQ ID NO: 706465 - DNA, 20 bp, mouse
gaatagaagttttctctcct

SEQ ID NO: 706466 - DNA, 20 bp, mouse
ggtgataggaaagttgacta

SEQ ID NO: 706467 - DNA, 20 bp, mouse
gccaggagtgctagcaaagc

SEQ ID NO: 706468 - DNA, 20 bp, mouse
gaagagactgcagggcccct

SEQ ID NO: 706469 - DNA, 20 bp, mouse
gagcactcctggctgactgg

SEQ ID NO: 706470 - DNA, 20 bp, mouse
ggtactctaaagtgttaaca

SEQ ID NO: 706471 - DNA, 20 bp, mouse
gcaattctcaagagactgca

SEQ ID NO: 706472 - DNA, 20 bp, mouse
gttgctgatcttgcaagtca

SEQ ID NO: 706473 - DNA, 20 bp, mouse
gagttctgatattttttggt

SEQ ID NO: 706474 - DNA, 20 bp, mouse
gcactgctaatattcagcat

SEQ ID NO: 706475 - DNA, 20 bp, mouse
gggaaaaagatgtctctatt

SEQ ID NO: 706476 - DNA, 20 bp, mouse
gcactggactctcacgtgtg

SEQ ID NO: 706477 - DNA, 20 bp, mouse
gaggggcaggacttaggtga

SEQ ID NO: 706478 - DNA, 20 bp, mouse
ggctgccagtcccacagctt

SEQ ID NO: 706479 - DNA, 20 bp, mouse
ggctcccgaagctgtgggac

SEQ ID NO: 706480 - DNA, 20 bp, mouse
gccctggaaatggtatggag

SEQ ID NO: 706481 - DNA, 20 bp, mouse
gcttaggtgagggggtaaat

SEQ ID NO: 706482 - DNA, 20 bp, mouse
gaacagccagtcaggtacgg

SEQ ID NO: 706483 - DNA, 20 bp, mouse
gcaggtacggtggagtgcgc

SEQ ID NO: 706484 - DNA, 20 bp, mouse
gaataggctcccgaagctgt

SEQ ID NO: 706485 - DNA, 20 bp, mouse
ggcactccaccgtacctgac

SEQ ID NO: 706486 - DNA, 20 bp, mouse
ggggtagcaaggcttcccga

SEQ ID NO: 706487 - DNA, 20 bp, mouse
ggcggggcggggtcttgtga

SEQ ID NO: 706488 - DNA, 20 bp, mouse
gcgagcagctcgtgggaatt

SEQ ID NO: 706489 - DNA, 20 bp, mouse
gccctagcaccgtgacgtca

SEQ ID NO: 706490 - DNA, 20 bp, mouse
gccgcctcgttcagcccctt

SEQ ID NO: 706491 - DNA, 20 bp, mouse
gacagggcgcggtgtaggag

SEQ ID NO: 706492 - DNA, 20 bp, mouse
ggcggagcctaactcgtcga

SEQ ID NO: 706493 - DNA, 20 bp, mouse
gttcccgaaggggctgaacg

SEQ ID NO: 706494 - DNA, 20 bp, mouse
gggcggagcgtggggtagca

SEQ ID NO: 706495 - DNA, 20 bp, mouse
gagcctaactcgtcgagggg

SEQ ID NO: 706496 - DNA, 20 bp, mouse
ggggccgcgcagggtccaaa

SEQ ID NO: 706497 - DNA, 20 bp, mouse
gtccgccgcgctgcgaccct

SEQ ID NO: 706498 - DNA, 20 bp, mouse
ggacgccgaggagaggtccg

SEQ ID NO: 706499 - DNA, 20 bp, mouse
gggacgctgacgccgaggag

SEQ ID NO: 706500 - DNA, 20 bp, mouse
ggccgaggagaggtccgcgg

SEQ ID NO: 706501 - DNA, 20 bp, mouse
ggccccggaggtgctcccgc

SEQ ID NO: 706502 - DNA, 20 bp, mouse
gtcccccgcggacctctcct

SEQ ID NO: 706503 - DNA, 20 bp, mouse
ggggtccaaacggctcgcgt

SEQ ID NO: 706504 - DNA, 20 bp, mouse
ggtcctcggggtcgcggagc

SEQ ID NO: 706505 - DNA, 20 bp, mouse
gcggctgggcggtagcggac

SEQ ID NO: 706506 - DNA, 20 bp, mouse
gtcgtcagaggatgagtcag

SEQ ID NO: 706507 - DNA, 20 bp, mouse
gcctaagggccctactgagc

SEQ ID NO: 706508 - DNA, 20 bp, mouse
gctactgagcaggcagctaa

SEQ ID NO: 706509 - DNA, 20 bp, mouse
gtgtgctcaggtggagtcca

SEQ ID NO: 706510 - DNA, 20 bp, mouse
gactgagataccttcgtcag

SEQ ID NO: 706511 - DNA, 20 bp, mouse
ggctcaagctaggtgtgctc

SEQ ID NO: 706512 - DNA, 20 bp, mouse
ggagggaagcagataagccg

SEQ ID NO: 706513 - DNA, 20 bp, mouse
gcaggcagctaaaggcttcc

SEQ ID NO: 706514 - DNA, 20 bp, mouse
gcgtaaaatacccacaccca

SEQ ID NO: 706515 - DNA, 20 bp, mouse
gtacacacagatctcatcta

SEQ ID NO: 706516 - DNA, 20 bp, mouse
gctaaggtgtgtcagaggta

SEQ ID NO: 706517 - DNA, 20 bp, mouse
gtgtactgaaaactccccat

SEQ ID NO: 706518 - DNA, 20 bp, mouse
gaacactccgtttatctctc

SEQ ID NO: 706519 - DNA, 20 bp, mouse
ggtgttgaagggaccctgaa

SEQ ID NO: 706520 - DNA, 20 bp, mouse
ggtaagctgaatggtgttga

SEQ ID NO: 706521 - DNA, 20 bp, mouse
gctgaagtatcattacaggg

SEQ ID NO: 706522 - DNA, 20 bp, mouse
gctgataagggagtttgcta

SEQ ID NO: 706523 - DNA, 20 bp, mouse
ggtcctgaagtatcattaca

SEQ ID NO: 706524 - DNA, 20 bp, mouse
gttatctctcaggtttgcac

SEQ ID NO: 706525 - DNA, 20 bp, mouse
ggtgtttgcagagtgaccaa

SEQ ID NO: 706526 - DNA, 20 bp, mouse
gaatagctcggcaggttcca

SEQ ID NO: 706527 - DNA, 20 bp, mouse
gaacactcggatctagtaaa

SEQ ID NO: 706528 - DNA, 20 bp, mouse
gagtccttacacagtggctc

SEQ ID NO: 706529 - DNA, 20 bp, mouse
gcaggtctcactatgataag

SEQ ID NO: 706530 - DNA, 20 bp, mouse
ggcaaacactggataagaat

SEQ ID NO: 706531 - DNA, 20 bp, mouse
gtacgatccagaaaccatta

SEQ ID NO: 706532 - DNA, 20 bp, mouse
gaaagctagttatgtaatta

SEQ ID NO: 706533 - DNA, 20 bp, mouse
gctgctgatacaaaatcaag

SEQ ID NO: 706534 - DNA, 20 bp, mouse
gaaactgtgtgatctgtgtt

SEQ ID NO: 706535 - DNA, 20 bp, mouse
gcactatgataaggggctca

SEQ ID NO: 706536 - DNA, 20 bp, mouse
gcaactctcggcttaaactc

SEQ ID NO: 706537 - DNA, 20 bp, mouse
gtggcccgccccatttccaa

SEQ ID NO: 706538 - DNA, 20 bp, mouse
gtctacgtcatgtgagatct

SEQ ID NO: 706539 - DNA, 20 bp, mouse
gcaccaacctccaacgagac

SEQ ID NO: 706540 - DNA, 20 bp, mouse
gtaaaagcccagcttaactc

SEQ ID NO: 706541 - DNA, 20 bp, mouse
gcggtcacgtgagcaactct

SEQ ID NO: 706542 - DNA, 20 bp, mouse
ggctgattggtccgccccga

SEQ ID NO: 706543 - DNA, 20 bp, mouse
gaatgaaccaatgaacagtc

SEQ ID NO: 706544 - DNA, 20 bp, mouse
gccccggtctcgttggaggt

SEQ ID NO: 706545 - DNA, 20 bp, mouse
gggcctgcgctgcgtctggt

SEQ ID NO: 706546 - DNA, 20 bp, mouse
gcggaaggaaacacagttgt

SEQ ID NO: 706547 - DNA, 20 bp, mouse
gaggggctggccattcacag

SEQ ID NO: 706548 - DNA, 20 bp, mouse
gggctgaaggcccctgtgaa

SEQ ID NO: 706549 - DNA, 20 bp, mouse
gcagaagttgccagagggaa

SEQ ID NO: 706550 - DNA, 20 bp, mouse
ggagcaatgatgaagttcag

SEQ ID NO: 706551 - DNA, 20 bp, mouse
gtccctgctcagttcttttc

SEQ ID NO: 706552 - DNA, 20 bp, mouse
gggggtgccgccattccgga

SEQ ID NO: 706553 - DNA, 20 bp, mouse
ggtgctagggagagttttag

SEQ ID NO: 706554 - DNA, 20 bp, mouse
gttcaggggtgccgccattc

SEQ ID NO: 706555 - DNA, 20 bp, mouse
gggctctgtgctgcgagtgg

SEQ ID NO: 706556 - DNA, 20 bp, mouse
gttaacggcctgaaaagttg

SEQ ID NO: 706557 - DNA, 20 bp, mouse
gactctaattctagaggtct

SEQ ID NO: 706558 - DNA, 20 bp, mouse
gcaaactagtggaccgtgga

SEQ ID NO: 706559 - DNA, 20 bp, mouse
gagctcccaggtgatgctaa

SEQ ID NO: 706560 - DNA, 20 bp, mouse
gaatccgacatcaagcaaag

SEQ ID NO: 706561 - DNA, 20 bp, mouse
gtctaaactgaactctcgga

SEQ ID NO: 706562 - DNA, 20 bp, mouse
ggagaccacctcaacttttc

SEQ ID NO: 706563 - DNA, 20 bp, mouse
gccgacatcaagcaaagggg

SEQ ID NO: 706564 - DNA, 20 bp, mouse
gaatccaacacgtgacgggt

SEQ ID NO: 706565 - DNA, 20 bp, mouse
ggatggctacaggcaaagtc

SEQ ID NO: 706566 - DNA, 20 bp, mouse
ggcacaggccggagaccggt

SEQ ID NO: 706567 - DNA, 20 bp, mouse
gtggcggcgcaggaggtgcg

SEQ ID NO: 706568 - DNA, 20 bp, mouse
gggtccctggcccttcgcac

SEQ ID NO: 706569 - DNA, 20 bp, mouse
gggtggactcggccagaggt

SEQ ID NO: 706570 - DNA, 20 bp, mouse
ggtcgctcgggaacgagcac

SEQ ID NO: 706571 - DNA, 20 bp, mouse
gcggactgatgatgtcatcc

SEQ ID NO: 706572 - DNA, 20 bp, mouse
ggggccagggaccggaagcc

SEQ ID NO: 706573 - DNA, 20 bp, mouse
gggtctccggcctgtgcgaa

SEQ ID NO: 706574 - DNA, 20 bp, mouse
gcggcctgtgcgaagggcca

SEQ ID NO: 706575 - DNA, 20 bp, mouse
gggagggtggactcggccag

SEQ ID NO: 706576 - DNA, 20 bp, mouse
gccgggccttgcacagacaa

SEQ ID NO: 706577 - DNA, 20 bp, mouse
gccttgcacagacaagggat

SEQ ID NO: 706578 - DNA, 20 bp, mouse
ggacagccccgccccctgac

SEQ ID NO: 706579 - DNA, 20 bp, mouse
ggcacagacaagggatcggc

SEQ ID NO: 706580 - DNA, 20 bp, mouse
gaagcaggcaacttcagctg

SEQ ID NO: 706581 - DNA, 20 bp, mouse
gtacctgggcaaccatgtta

SEQ ID NO: 706582 - DNA, 20 bp, mouse
ggcggagctggcctgtcagg

SEQ ID NO: 706583 - DNA, 20 bp, mouse
gtgcccaggtaaccagtgag

SEQ ID NO: 706584 - DNA, 20 bp, mouse
gtcagccaatgggcgccagt

SEQ ID NO: 706585 - DNA, 20 bp, mouse
ggtgcaaggcccgggaatgg

SEQ ID NO: 706586 - DNA, 20 bp, mouse
gggagcaaaaggaagggcac

SEQ ID NO: 706587 - DNA, 20 bp, mouse
gcacaacacaaagatcagag

SEQ ID NO: 706588 - DNA, 20 bp, mouse
gttaaaaaggcgattgggaa

SEQ ID NO: 706589 - DNA, 20 bp, mouse
gtaaaaagggagtatcatca

SEQ ID NO: 706590 - DNA, 20 bp, mouse
gtccttaaactgcagccagc

SEQ ID NO: 706591 - DNA, 20 bp, mouse
gcgtggtaggagcaaaagga

SEQ ID NO: 706592 - DNA, 20 bp, mouse
gatcagggttatctcggcct

SEQ ID NO: 706593 - DNA, 20 bp, mouse
gttggtatataggaaggatg

SEQ ID NO: 706594 - DNA, 20 bp, mouse
ggtggcgctagtttttaaaa

SEQ ID NO: 706595 - DNA, 20 bp, mouse
ggccagctggctgcagttta

SEQ ID NO: 706596 - DNA, 20 bp, mouse
gaccctactccgggatgcca

SEQ ID NO: 706597 - DNA, 20 bp, mouse
gagtccgcgcagggcacgta

SEQ ID NO: 706598 - DNA, 20 bp, mouse
gcggctgcgagcgctgtgat

SEQ ID NO: 706599 - DNA, 20 bp, mouse
gggcagcgccaccctactcc

SEQ ID NO: 706600 - DNA, 20 bp, mouse
gggaaacgtggtactgtaat

SEQ ID NO: 706601 - DNA, 20 bp, mouse
ggtcggagtgagaggagact

SEQ ID NO: 706602 - DNA, 20 bp, mouse
gcgcccccagagcggaaacg

SEQ ID NO: 706603 - DNA, 20 bp, mouse
ggttccggacccggctcctg

SEQ ID NO: 706604 - DNA, 20 bp, mouse
gcctctgggcgttccggacc

SEQ ID NO: 706605 - DNA, 20 bp, mouse
ggcagcgcgcgcgtgtcttt

SEQ ID NO: 706606 - DNA, 20 bp, mouse
gcagcataggtgaagataag

SEQ ID NO: 706607 - DNA, 20 bp, mouse
gaactcaaacttttcagcat

SEQ ID NO: 706608 - DNA, 20 bp, mouse
ggggctcagaacagactgaa

SEQ ID NO: 706609 - DNA, 20 bp, mouse
gaaggcctggccagcatgta

SEQ ID NO: 706610 - DNA, 20 bp, mouse
gccaccacctcccaactata

SEQ ID NO: 706611 - DNA, 20 bp, mouse
gactgaagggagtagccagt

SEQ ID NO: 706612 - DNA, 20 bp, mouse
gaacattgttgagatactag

SEQ ID NO: 706613 - DNA, 20 bp, mouse
gggaacactgaatgaaaatt

SEQ ID NO: 706614 - DNA, 20 bp, mouse
gaggtgtttctttaagttag

SEQ ID NO: 706615 - DNA, 20 bp, mouse
gcctggccagcatgtaaggg

SEQ ID NO: 706616 - DNA, 20 bp, mouse
gggaatgggttgcagggcgg

SEQ ID NO: 706617 - DNA, 20 bp, mouse
gtccaccctgctgctgaaga

SEQ ID NO: 706618 - DNA, 20 bp, mouse
ggaacccctgtgtaagaaga

SEQ ID NO: 706619 - DNA, 20 bp, mouse
ggcccactggccgggttgta

SEQ ID NO: 706620 - DNA, 20 bp, mouse
gtgaccctaaagtcagtaag

SEQ ID NO: 706621 - DNA, 20 bp, mouse
gccaatgggaatgggttgca

SEQ ID NO: 706622 - DNA, 20 bp, mouse
ggggcgccgcttaaagtgtg

SEQ ID NO: 706623 - DNA, 20 bp, mouse
ggcctgatgctggaagttta

SEQ ID NO: 706624 - DNA, 20 bp, mouse
ggccctacaacccggccagt

SEQ ID NO: 706625 - DNA, 20 bp, mouse
gtttaagcggcgcccgaagg

SEQ ID NO: 706626 - DNA, 20 bp, mouse
ggggacaggcgggcagcaag

SEQ ID NO: 706627 - DNA, 20 bp, mouse
ggctgcccgcctgtccctct

SEQ ID NO: 706628 - DNA, 20 bp, mouse
gccagaggagacaagtgcgg

SEQ ID NO: 706629 - DNA, 20 bp, mouse
gcccagaagcccagagggac

SEQ ID NO: 706630 - DNA, 20 bp, mouse
gagtcagggtcagactgagg

SEQ ID NO: 706631 - DNA, 20 bp, mouse
gctgcccgtgggcattgcca

SEQ ID NO: 706632 - DNA, 20 bp, mouse
gaggagacaagtgcggagga

SEQ ID NO: 706633 - DNA, 20 bp, mouse
gcatagtcagggtcagactg

SEQ ID NO: 706634 - DNA, 20 bp, mouse
gggtggcagagccgtgagtc

SEQ ID NO: 706635 - DNA, 20 bp, mouse
gtggcgccccagaagcccag

SEQ ID NO: 706636 - DNA, 20 bp, mouse
gagtccgtgacagcggtttg

SEQ ID NO: 706637 - DNA, 20 bp, mouse
ggaaggcggcgccacctcgg

SEQ ID NO: 706638 - DNA, 20 bp, mouse
gagaggctgcgccggatgtg

SEQ ID NO: 706639 - DNA, 20 bp, mouse
gcggggcgctgctgacggac

SEQ ID NO: 706640 - DNA, 20 bp, mouse
gctggccagagcaagaatgc

SEQ ID NO: 706641 - DNA, 20 bp, mouse
gggactcatgagcagtagat

SEQ ID NO: 706642 - DNA, 20 bp, mouse
gacctcggcggcggattcga

SEQ ID NO: 706643 - DNA, 20 bp, mouse
gagggggcggcgctcactag

SEQ ID NO: 706644 - DNA, 20 bp, mouse
gccgtgacagcggtttgagg

SEQ ID NO: 706645 - DNA, 20 bp, mouse
gtcttgctctggccaggggg

SEQ ID NO: 706646 - DNA, 20 bp, mouse
gttcccgccagccgggtcca

SEQ ID NO: 706647 - DNA, 20 bp, mouse
gaggttgcgctgcgaaggaa

SEQ ID NO: 706648 - DNA, 20 bp, mouse
gtggactgacacaactaaga

SEQ ID NO: 706649 - DNA, 20 bp, mouse
ggacccggctggcgggaaag

SEQ ID NO: 706650 - DNA, 20 bp, mouse
gtagactcgggagtccgcgg

SEQ ID NO: 706651 - DNA, 20 bp, mouse
gcggtagactcgggagtccg

SEQ ID NO: 706652 - DNA, 20 bp, mouse
gggaaagtggatagccttcc

SEQ ID NO: 706653 - DNA, 20 bp, mouse
gcccacgccctggacccggc

SEQ ID NO: 706654 - DNA, 20 bp, mouse
gacgccctggacccggctgg

SEQ ID NO: 706655 - DNA, 20 bp, mouse
gcagctccaacagttcctcc

SEQ ID NO: 706656 - DNA, 20 bp, mouse
gccggcgcggatccctggat

SEQ ID NO: 706657 - DNA, 20 bp, mouse
gggatcggctgtccacgaag

SEQ ID NO: 706658 - DNA, 20 bp, mouse
gcgcccgaacacgctgctct

SEQ ID NO: 706659 - DNA, 20 bp, mouse
gaaatcccggcgcggatccc

SEQ ID NO: 706660 - DNA, 20 bp, mouse
ggatcctccccctcccttga

SEQ ID NO: 706661 - DNA, 20 bp, mouse
gaagggagggggaggatcct

SEQ ID NO: 706662 - DNA, 20 bp, mouse
ggcagtatagggtccctcaa

SEQ ID NO: 706663 - DNA, 20 bp, mouse
gtagggtccctcaagggagg

SEQ ID NO: 706664 - DNA, 20 bp, mouse
gggcctacagaccacgacat

SEQ ID NO: 706665 - DNA, 20 bp, mouse
ggcagcgtgttcgggcgggg

SEQ ID NO: 706666 - DNA, 20 bp, mouse
ggcggcggctacagaggacg

SEQ ID NO: 706667 - DNA, 20 bp, mouse
gctacagaggacgcggagga

SEQ ID NO: 706668 - DNA, 20 bp, mouse
ggcggctacagaggacgcgg

SEQ ID NO: 706669 - DNA, 20 bp, mouse
ggggactcgggcagtcccta

SEQ ID NO: 706670 - DNA, 20 bp, mouse
gcggcggggcgggcaagcta

SEQ ID NO: 706671 - DNA, 20 bp, mouse
gcgacccgtgctccttcctc

SEQ ID NO: 706672 - DNA, 20 bp, mouse
gcatcaatgagacttcgagg

SEQ ID NO: 706673 - DNA, 20 bp, mouse
gtgctggcctggtgtcctta

SEQ ID NO: 706674 - DNA, 20 bp, mouse
gttcgccagccgaggcagca

SEQ ID NO: 706675 - DNA, 20 bp, mouse
gaggcagggtgcacgcggcg

SEQ ID NO: 706676 - DNA, 20 bp, mouse
gagggaagaaggagccggga

SEQ ID NO: 706677 - DNA, 20 bp, mouse
gactcggaggagcgctgggg

SEQ ID NO: 706678 - DNA, 20 bp, mouse
gccagcgctcctccgagtgg

SEQ ID NO: 706679 - DNA, 20 bp, mouse
gccgagtggcggaaattaga

SEQ ID NO: 706680 - DNA, 20 bp, mouse
gcggcggcggcgtcgtcccg

SEQ ID NO: 706681 - DNA, 20 bp, mouse
gtggcggaaattagagggac

SEQ ID NO: 706682 - DNA, 20 bp, mouse
gggaaattagagggacgggg

SEQ ID NO: 706683 - DNA, 20 bp, mouse
gtcagggccggtgactcaga

SEQ ID NO: 706684 - DNA, 20 bp, mouse
gtccgcgcgcgcggatccca

SEQ ID NO: 706685 - DNA, 20 bp, mouse
gaccacatctgtgaaaactt

SEQ ID NO: 706686 - DNA, 20 bp, mouse
gaggctcctcaagctgaagt

SEQ ID NO: 706687 - DNA, 20 bp, mouse
ggacgtcatgttctgctctc

SEQ ID NO: 706688 - DNA, 20 bp, mouse
ggacgtcacgaaacttacac

SEQ ID NO: 706689 - DNA, 20 bp, mouse
gcacagcctacttcagcttg

SEQ ID NO: 706690 - DNA, 20 bp, mouse
gcccacttgtgtccatttaa

SEQ ID NO: 706691 - DNA, 20 bp, mouse
gaggctgtgctttgtaaagc

SEQ ID NO: 706692 - DNA, 20 bp, mouse
gttaccttttctattttgaa

SEQ ID NO: 706693 - DNA, 20 bp, mouse
ggcccttaaatggacacaag

SEQ ID NO: 706694 - DNA, 20 bp, mouse
gtctggcaaacaaataacaa

SEQ ID NO: 706695 - DNA, 20 bp, mouse
gtatatggcttgcagctcat

SEQ ID NO: 706696 - DNA, 20 bp, mouse
gtgtggagagtgcttggact

SEQ ID NO: 706697 - DNA, 20 bp, mouse
ggaacagaggcaggagcaat

SEQ ID NO: 706698 - DNA, 20 bp, mouse
gcaaactcttctgttagcac

SEQ ID NO: 706699 - DNA, 20 bp, mouse
gcgctgcgctcagtgaacag

SEQ ID NO: 706700 - DNA, 20 bp, mouse
gtgagaccctgtcaggctac

SEQ ID NO: 706701 - DNA, 20 bp, mouse
gactcccttgtcaaacatcc

SEQ ID NO: 706702 - DNA, 20 bp, mouse
gagaggcaattggcgaactc

SEQ ID NO: 706703 - DNA, 20 bp, mouse
gcactctccacagtgagtct

SEQ ID NO: 706704 - DNA, 20 bp, mouse
gactcactgtggagagtgct

SEQ ID NO: 706705 - DNA, 20 bp, mouse
gagccaacccagactcactg

SEQ ID NO: 706706 - DNA, 20 bp, mouse
ggtagattggcaggtcacag

SEQ ID NO: 706707 - DNA, 20 bp, mouse
gagttgacttgtgacaccaa

SEQ ID NO: 706708 - DNA, 20 bp, mouse
gcaatctacggatcgaggga

SEQ ID NO: 706709 - DNA, 20 bp, mouse
gctgccaatctacggatcga

SEQ ID NO: 706710 - DNA, 20 bp, mouse
gaagacagtttccccttcca

SEQ ID NO: 706711 - DNA, 20 bp, mouse
gagctgaatgttagtaacat

SEQ ID NO: 706712 - DNA, 20 bp, mouse
gagcacactaaatggttgag

SEQ ID NO: 706713 - DNA, 20 bp, mouse
gaatctgagttcccctggaa

SEQ ID NO: 706714 - DNA, 20 bp, mouse
gtaaaaaatctgagttcccc

SEQ ID NO: 706715 - DNA, 20 bp, mouse
gaaaagaataaaggcacaac

SEQ ID NO: 706716 - DNA, 20 bp, mouse
gggaaccgtggggaactaca

SEQ ID NO: 706717 - DNA, 20 bp, mouse
gccagcggcggaatcccacc

SEQ ID NO: 706718 - DNA, 20 bp, mouse
gccgtggggaactacaggga

SEQ ID NO: 706719 - DNA, 20 bp, mouse
gggaaggggaagcagaactt

SEQ ID NO: 706720 - DNA, 20 bp, mouse
gcgcgaccgacgcctggaga

SEQ ID NO: 706721 - DNA, 20 bp, mouse
ggccacccctagaattcatt

SEQ ID NO: 706722 - DNA, 20 bp, mouse
ggacccctggtggcgccgga

SEQ ID NO: 706723 - DNA, 20 bp, mouse
gtggggatgcatagcgggac

SEQ ID NO: 706724 - DNA, 20 bp, mouse
gttccctccggcgccaccag

SEQ ID NO: 706725 - DNA, 20 bp, mouse
gtcggtcgcgcgggaaccgt

SEQ ID NO: 706726 - DNA, 20 bp, mouse
gtcccggcagccggcgtgca

SEQ ID NO: 706727 - DNA, 20 bp, mouse
gcaggctgaggttttgacag

SEQ ID NO: 706728 - DNA, 20 bp, mouse
gcaagccaatggcggctcga

SEQ ID NO: 706729 - DNA, 20 bp, mouse
ggggaggagcagaatcccgc

SEQ ID NO: 706730 - DNA, 20 bp, mouse
gtggcagccgcagagtccgg

SEQ ID NO: 706731 - DNA, 20 bp, mouse
gagggcgtgccgctcgcctg

SEQ ID NO: 706732 - DNA, 20 bp, mouse
gccggctgccgggacgccgc

SEQ ID NO: 706733 - DNA, 20 bp, mouse
gccccggggtgtcgccccgt

SEQ ID NO: 706734 - DNA, 20 bp, mouse
ggagaaaacgcgacccgggg

SEQ ID NO: 706735 - DNA, 20 bp, mouse
gagaggaggaggccagccga

SEQ ID NO: 706736 - DNA, 20 bp, mouse
gtggggccgcagtagtgaga

SEQ ID NO: 706737 - DNA, 20 bp, mouse
ggtagtgagaggggtttgta

SEQ ID NO: 706738 - DNA, 20 bp, mouse
gagcgagccgcgagggaggg

SEQ ID NO: 706739 - DNA, 20 bp, mouse
ggactggcggccttggagga

SEQ ID NO: 706740 - DNA, 20 bp, mouse
gagcgagcgagccgcgaggg

SEQ ID NO: 706741 - DNA, 20 bp, mouse
gaggacgcgcgtctctgccg

SEQ ID NO: 706742 - DNA, 20 bp, mouse
gcaaacccctctcactactg

SEQ ID NO: 706743 - DNA, 20 bp, mouse
gcccccgcgcacgctccgtc

SEQ ID NO: 706744 - DNA, 20 bp, mouse
gggagcgggcaccggaggga

SEQ ID NO: 706745 - DNA, 20 bp, mouse
ggcgagcgagcgagccgcga

SEQ ID NO: 706746 - DNA, 20 bp, mouse
ggggagaaggttgcttggat

SEQ ID NO: 706747 - DNA, 20 bp, mouse
gagccagcagggcacaaatg

SEQ ID NO: 706748 - DNA, 20 bp, mouse
gtaatgtggcccaagggaga

SEQ ID NO: 706749 - DNA, 20 bp, mouse
gccaagcaaccttctccctt

SEQ ID NO: 706750 - DNA, 20 bp, mouse
gcccttgggccacattatta

SEQ ID NO: 706751 - DNA, 20 bp, mouse
gtctaggcatgaataagcga

SEQ ID NO: 706752 - DNA, 20 bp, mouse
gtaaaaatgaacgggataat

SEQ ID NO: 706753 - DNA, 20 bp, mouse
ggtagctgtgtttcacggtc

SEQ ID NO: 706754 - DNA, 20 bp, mouse
gatgagggcagtgattcata

SEQ ID NO: 706755 - DNA, 20 bp, mouse
gcccataataatgtggccca

SEQ ID NO: 706756 - DNA, 20 bp, mouse
ggggcctagagagcaaggta

SEQ ID NO: 706757 - DNA, 20 bp, mouse
ggtacggcagagtcagccat

SEQ ID NO: 706758 - DNA, 20 bp, mouse
gggaaatgcggtcagaagag

SEQ ID NO: 706759 - DNA, 20 bp, mouse
gcccgcccccagcccggttc

SEQ ID NO: 706760 - DNA, 20 bp, mouse
ggaacaagagccaccgtccc

SEQ ID NO: 706761 - DNA, 20 bp, mouse
gctcacgcttcgcccggaac

SEQ ID NO: 706762 - DNA, 20 bp, mouse
gggagagcgagaactccggg

SEQ ID NO: 706763 - DNA, 20 bp, mouse
gcgtaccggtagcatctcgg

SEQ ID NO: 706764 - DNA, 20 bp, mouse
gttctgaccgcatttcccca

SEQ ID NO: 706765 - DNA, 20 bp, mouse
gttcgcccggaaccgggctg

SEQ ID NO: 706766 - DNA, 20 bp, mouse
gcatgctgaaccagactcac

SEQ ID NO: 706767 - DNA, 20 bp, mouse
gaggttgccgccccgaggaa

SEQ ID NO: 706768 - DNA, 20 bp, mouse
ggccaaggggcgggcggacg

SEQ ID NO: 706769 - DNA, 20 bp, mouse
ggattggattccagtgagtc

SEQ ID NO: 706770 - DNA, 20 bp, mouse
gcagccatgtgcaccgtggt

SEQ ID NO: 706771 - DNA, 20 bp, mouse
gccaacagccatgtgcaccg

SEQ ID NO: 706772 - DNA, 20 bp, mouse
gcgcggctcccagccaacca

SEQ ID NO: 706773 - DNA, 20 bp, mouse
ggactgcaaaggcgtccccc

SEQ ID NO: 706774 - DNA, 20 bp, mouse
ggaaaactacccattcctcg

SEQ ID NO: 706775 - DNA, 20 bp, mouse
gatgccattgtgcacaatag

SEQ ID NO: 706776 - DNA, 20 bp, mouse
gagggcatgtggtgctccct

SEQ ID NO: 706777 - DNA, 20 bp, mouse
ggggagacaacactctcacc

SEQ ID NO: 706778 - DNA, 20 bp, mouse
gcacccgcagcaatgatccc

SEQ ID NO: 706779 - DNA, 20 bp, mouse
ggacccagcgccgagcgttg

SEQ ID NO: 706780 - DNA, 20 bp, mouse
gaggggaaagatggcagcgc

SEQ ID NO: 706781 - DNA, 20 bp, mouse
gtctccctcgggacaggtgg

SEQ ID NO: 706782 - DNA, 20 bp, mouse
gtgagagtgttgtctccctc

SEQ ID NO: 706783 - DNA, 20 bp, mouse
gctgcgggtggtccagactc

SEQ ID NO: 706784 - DNA, 20 bp, mouse
gtccctgggaactggcctta

SEQ ID NO: 706785 - DNA, 20 bp, mouse
gggacctcaacgctcggcgc

SEQ ID NO: 706786 - DNA, 20 bp, mouse
gtgcctggagatcaaggggc

SEQ ID NO: 706787 - DNA, 20 bp, mouse
gggtgctagctgaggacatt

SEQ ID NO: 706788 - DNA, 20 bp, mouse
gctagtctcaacactctcga

SEQ ID NO: 706789 - DNA, 20 bp, mouse
ggaagactaactgaaactcg

SEQ ID NO: 706790 - DNA, 20 bp, mouse
gtagcaggacgtgacacatc

SEQ ID NO: 706791 - DNA, 20 bp, mouse
gtctgtgcctggagatcaag

SEQ ID NO: 706792 - DNA, 20 bp, mouse
gacagtgctgaagaaaccct

SEQ ID NO: 706793 - DNA, 20 bp, mouse
gtggatcggagctctctcat

SEQ ID NO: 706794 - DNA, 20 bp, mouse
gctagtcacacactacaagg

SEQ ID NO: 706795 - DNA, 20 bp, mouse
gtcctcttttgaggagctga

SEQ ID NO: 706796 - DNA, 20 bp, mouse
gaacctgagtggagcccgcg

SEQ ID NO: 706797 - DNA, 20 bp, mouse
ggaccggcctccagcgtccc

SEQ ID NO: 706798 - DNA, 20 bp, mouse
gctccccgcgggctccactc

SEQ ID NO: 706799 - DNA, 20 bp, mouse
gggccaggcgcaggcaccac

SEQ ID NO: 706800 - DNA, 20 bp, mouse
gcccgggcctcctgaaaccc

SEQ ID NO: 706801 - DNA, 20 bp, mouse
gcccgtccgcaggagggatc

SEQ ID NO: 706802 - DNA, 20 bp, mouse
ggctagaagctccgctcctg

SEQ ID NO: 706803 - DNA, 20 bp, mouse
gggcccgggacgctggaggc

SEQ ID NO: 706804 - DNA, 20 bp, mouse
gaacccaggcggaagaggac

SEQ ID NO: 706805 - DNA, 20 bp, mouse
gggtgggaggcgggctccac

SEQ ID NO: 706806 - DNA, 20 bp, mouse
gtgcgtaagaatagaatcct

SEQ ID NO: 706807 - DNA, 20 bp, mouse
ggtagagcaactcagacagt

SEQ ID NO: 706808 - DNA, 20 bp, mouse
ggaccagattgagattcgga

SEQ ID NO: 706809 - DNA, 20 bp, mouse
gggcttgctgaggaagtccc

SEQ ID NO: 706810 - DNA, 20 bp, mouse
ggagcaactcagacagtcgg

SEQ ID NO: 706811 - DNA, 20 bp, mouse
gaagaatagaatcctcggaa

SEQ ID NO: 706812 - DNA, 20 bp, mouse
gtcggatggctggagaggat

SEQ ID NO: 706813 - DNA, 20 bp, mouse
gaggcagcgtagacgtcttg

SEQ ID NO: 706814 - DNA, 20 bp, mouse
gacacgaccagattgagatt

SEQ ID NO: 706815 - DNA, 20 bp, mouse
ggagattcggatggctggag

SEQ ID NO: 706816 - DNA, 20 bp, mouse
ggcgctgggaggcacgtttg

SEQ ID NO: 706817 - DNA, 20 bp, mouse
gctggcccgaggggttttag

SEQ ID NO: 706818 - DNA, 20 bp, mouse
gaagatgccagccgggtcta

SEQ ID NO: 706819 - DNA, 20 bp, mouse
gcatctcgacaggaaaataa

SEQ ID NO: 706820 - DNA, 20 bp, mouse
gcggcagcagacaggaacgg

SEQ ID NO: 706821 - DNA, 20 bp, mouse
gagagcgtccagcccggctg

SEQ ID NO: 706822 - DNA, 20 bp, mouse
gcgtcggggaccagagaaca

SEQ ID NO: 706823 - DNA, 20 bp, mouse
gtgaaaggaagaaatccgtg

SEQ ID NO: 706824 - DNA, 20 bp, mouse
gggcctcagacccttagacc

SEQ ID NO: 706825 - DNA, 20 bp, mouse
gtggagctggccatctcgac

SEQ ID NO: 706826 - DNA, 20 bp, mouse
gtcggagagaggcttttgag

SEQ ID NO: 706827 - DNA, 20 bp, mouse
gtggctagagtctgtgtaga

SEQ ID NO: 706828 - DNA, 20 bp, mouse
gaggagtgcgataacaacta

SEQ ID NO: 706829 - DNA, 20 bp, mouse
ggtgactgattctttggtaa

SEQ ID NO: 706830 - DNA, 20 bp, mouse
ggaagtcaacatctagtcag

SEQ ID NO: 706831 - DNA, 20 bp, mouse
gacaacagagaacaagatcc

SEQ ID NO: 706832 - DNA, 20 bp, mouse
gtccgagtgctgaaatttat

SEQ ID NO: 706833 - DNA, 20 bp, mouse
gtgcagagtgactgattctt

SEQ ID NO: 706834 - DNA, 20 bp, mouse
gagaaatgcctgtgggtagg

SEQ ID NO: 706835 - DNA, 20 bp, mouse
ggcctgtgggtaggcgggaa

SEQ ID NO: 706836 - DNA, 20 bp, mouse
gctgaaaaggggagattcag

SEQ ID NO: 706837 - DNA, 20 bp, mouse
gtaggctcctagagagagtg

SEQ ID NO: 706838 - DNA, 20 bp, mouse
gaattggtgcagagcccact

SEQ ID NO: 706839 - DNA, 20 bp, mouse
gagggcagaactacacgggg

SEQ ID NO: 706840 - DNA, 20 bp, mouse
gcattcccttgcttggtaag

SEQ ID NO: 706841 - DNA, 20 bp, mouse
ggcgcggcaaagacaggcgg

SEQ ID NO: 706842 - DNA, 20 bp, mouse
ggaatccttggagctgaaaa

SEQ ID NO: 706843 - DNA, 20 bp, mouse
gactactgtctcatagagct

SEQ ID NO: 706844 - DNA, 20 bp, mouse
gctctctctaggagcctagt

SEQ ID NO: 706845 - DNA, 20 bp, mouse
gttcagcccctaaaaaggag

SEQ ID NO: 706846 - DNA, 20 bp, mouse
ggctgggtacaggagtaaca

SEQ ID NO: 706847 - DNA, 20 bp, mouse
ggtgtggagtctgactccag

SEQ ID NO: 706848 - DNA, 20 bp, mouse
gttgactccaggctaaaaag

SEQ ID NO: 706849 - DNA, 20 bp, mouse
gacctcagaaggccatgggg

SEQ ID NO: 706850 - DNA, 20 bp, mouse
gaggctggacctaacacccc

SEQ ID NO: 706851 - DNA, 20 bp, mouse
ggactgaggggaaccaagga

SEQ ID NO: 706852 - DNA, 20 bp, mouse
gagggctccactttgactcc

SEQ ID NO: 706853 - DNA, 20 bp, mouse
gcccccaggcctccatccag

SEQ ID NO: 706854 - DNA, 20 bp, mouse
gtccagcctccaactctaac

SEQ ID NO: 706855 - DNA, 20 bp, mouse
gccagcttgtctgagtacta

SEQ ID NO: 706856 - DNA, 20 bp, mouse
ggcggaggtcgccaccgaga

SEQ ID NO: 706857 - DNA, 20 bp, mouse
gacgagacgctgcacggtgg

SEQ ID NO: 706858 - DNA, 20 bp, mouse
gacgctgcacggtggtggtg

SEQ ID NO: 706859 - DNA, 20 bp, mouse
gggcgcgccgcggacaactg

SEQ ID NO: 706860 - DNA, 20 bp, mouse
ggggacgagacgctgcacgg

SEQ ID NO: 706861 - DNA, 20 bp, mouse
gggagggagaagggacctta

SEQ ID NO: 706862 - DNA, 20 bp, mouse
gcatcatcgcaggaccccag

SEQ ID NO: 706863 - DNA, 20 bp, mouse
ggcacggtggtggtggggac

SEQ ID NO: 706864 - DNA, 20 bp, mouse
gtaaaggagcagggctcaag

SEQ ID NO: 706865 - DNA, 20 bp, mouse
gcgccacggcgcacgctcag

SEQ ID NO: 706866 - DNA, 20 bp, mouse
gagggctgtttgaatagcaa

SEQ ID NO: 706867 - DNA, 20 bp, mouse
ggagggagggcctgcgagtg

SEQ ID NO: 706868 - DNA, 20 bp, mouse
ggtgggctgactcctgtctc

SEQ ID NO: 706869 - DNA, 20 bp, mouse
gcaacattggagtttgggga

SEQ ID NO: 706870 - DNA, 20 bp, mouse
gtgactcctgtctccggaat

SEQ ID NO: 706871 - DNA, 20 bp, mouse
gacagtggccatggacttcc

SEQ ID NO: 706872 - DNA, 20 bp, mouse
gagggttaaacgctgctgtg

SEQ ID NO: 706873 - DNA, 20 bp, mouse
gacaaatgtctctggagtga

SEQ ID NO: 706874 - DNA, 20 bp, mouse
ggttacaaactgtggcgcat

SEQ ID NO: 706875 - DNA, 20 bp, mouse
gtccatggccactgtgccgg

SEQ ID NO: 706876 - DNA, 20 bp, mouse
gtggctgtgtaagctataac

SEQ ID NO: 706877 - DNA, 20 bp, mouse
ggggcctcctacccagaaac

SEQ ID NO: 706878 - DNA, 20 bp, mouse
gtaggcctaccattgcacac

SEQ ID NO: 706879 - DNA, 20 bp, mouse
gctgtctctgctaccctaga

SEQ ID NO: 706880 - DNA, 20 bp, mouse
gggaggaggagttaccaagt

SEQ ID NO: 706881 - DNA, 20 bp, mouse
gggtgacttagttctgttct

SEQ ID NO: 706882 - DNA, 20 bp, mouse
ggaaagctttggctcttcat

SEQ ID NO: 706883 - DNA, 20 bp, mouse
gccccaaagtcagttcattt

SEQ ID NO: 706884 - DNA, 20 bp, mouse
gacagcgcagaccagtttct

SEQ ID NO: 706885 - DNA, 20 bp, mouse
gtggggactgcatagtgatt

SEQ ID NO: 706886 - DNA, 20 bp, mouse
ggggagaactcggtagagat

SEQ ID NO: 706887 - DNA, 20 bp, mouse
gtgcaggttcgcatcctcgg

SEQ ID NO: 706888 - DNA, 20 bp, mouse
gcgtgggcgcgcggagacgg

SEQ ID NO: 706889 - DNA, 20 bp, mouse
gcgcgtgcccgcgagcctgc

SEQ ID NO: 706890 - DNA, 20 bp, mouse
ggcggcgcggacagcccgat

SEQ ID NO: 706891 - DNA, 20 bp, mouse
gggtagagatcggaagaact

SEQ ID NO: 706892 - DNA, 20 bp, mouse
ggtgcctcgctctaccgccg

SEQ ID NO: 706893 - DNA, 20 bp, mouse
gaatgcgggcgtgaggagct

SEQ ID NO: 706894 - DNA, 20 bp, mouse
gcggcctcgctccgccccat

SEQ ID NO: 706895 - DNA, 20 bp, mouse
gtcaacctgcctatggactc

SEQ ID NO: 706896 - DNA, 20 bp, mouse
gaaggtcacgccctcggact

SEQ ID NO: 706897 - DNA, 20 bp, mouse
gccctcggactgggagaact

SEQ ID NO: 706898 - DNA, 20 bp, mouse
ggcgtggcatagtgtgtcag

SEQ ID NO: 706899 - DNA, 20 bp, mouse
gtcggactgggagaactggg

SEQ ID NO: 706900 - DNA, 20 bp, mouse
ggagctcagaaacctgtaat

SEQ ID NO: 706901 - DNA, 20 bp, mouse
ggaactgggaggctctgggt

SEQ ID NO: 706902 - DNA, 20 bp, mouse
gccacgccctccggcactga

SEQ ID NO: 706903 - DNA, 20 bp, mouse
ggcactgaaggtcacgccct

SEQ ID NO: 706904 - DNA, 20 bp, mouse
gccacgcccgctgagatcgg

SEQ ID NO: 706905 - DNA, 20 bp, mouse
gcacactatgccacgccctc

SEQ ID NO: 706906 - DNA, 20 bp, mouse
gcctgggagccgcgtcctac

SEQ ID NO: 706907 - DNA, 20 bp, mouse
gctagcaagcctgtaggacg

SEQ ID NO: 706908 - DNA, 20 bp, mouse
gacggtgtaagcgatgtgat

SEQ ID NO: 706909 - DNA, 20 bp, mouse
gtgtccggccggcccaccag

SEQ ID NO: 706910 - DNA, 20 bp, mouse
ggtgtaagcgatgtgattgg

SEQ ID NO: 706911 - DNA, 20 bp, mouse
gtgggccggccggacaccac

SEQ ID NO: 706912 - DNA, 20 bp, mouse
gggacaaatcggacgtccgt

SEQ ID NO: 706913 - DNA, 20 bp, mouse
gcggatacgccaagatgata

SEQ ID NO: 706914 - DNA, 20 bp, mouse
gacgcccgcacgaggaaagc

SEQ ID NO: 706915 - DNA, 20 bp, mouse
gctgggatgagtctcgtgat

SEQ ID NO: 706916 - DNA, 20 bp, mouse
gacccagcgggactgcgtac

SEQ ID NO: 706917 - DNA, 20 bp, mouse
gcgcccgtacgcagtcccgc

SEQ ID NO: 706918 - DNA, 20 bp, mouse
gctcaggtggcccgaggcaa

SEQ ID NO: 706919 - DNA, 20 bp, mouse
gaatcagaagagaggtcggc

SEQ ID NO: 706920 - DNA, 20 bp, mouse
gaagggggaagagcggtcgg

SEQ ID NO: 706921 - DNA, 20 bp, mouse
gacgcagtcccgctgggtcc

SEQ ID NO: 706922 - DNA, 20 bp, mouse
ggggcgaggacccgtagctc

SEQ ID NO: 706923 - DNA, 20 bp, mouse
gcccgccctccaggacccag

SEQ ID NO: 706924 - DNA, 20 bp, mouse
gcgctcttcccccttgcctc

SEQ ID NO: 706925 - DNA, 20 bp, mouse
ggctggaggacgtgcttccc

SEQ ID NO: 706926 - DNA, 20 bp, mouse
gagcgccacgggttcgattg

SEQ ID NO: 706927 - DNA, 20 bp, mouse
gtgggagtggttggggtccg

SEQ ID NO: 706928 - DNA, 20 bp, mouse
ggaggctgtgaggggactat

SEQ ID NO: 706929 - DNA, 20 bp, mouse
gccgtggcgctcctggctgg

SEQ ID NO: 706930 - DNA, 20 bp, mouse
ggaaccgcgtccaatcactg

SEQ ID NO: 706931 - DNA, 20 bp, mouse
gaacccgtggcgctcctggc

SEQ ID NO: 706932 - DNA, 20 bp, mouse
gtcctggctggaggctgtga

SEQ ID NO: 706933 - DNA, 20 bp, mouse
ggggactatgggtgtacctg

SEQ ID NO: 706934 - DNA, 20 bp, mouse
ggggccagtccgggacgact

SEQ ID NO: 706935 - DNA, 20 bp, mouse
gggggaaggaccggcccggt

SEQ ID NO: 706936 - DNA, 20 bp, mouse
ggcaggggaggggacacgaa

SEQ ID NO: 706937 - DNA, 20 bp, mouse
ggggacctgaggagactagc

SEQ ID NO: 706938 - DNA, 20 bp, mouse
ggcggagcccgcaggttcag

SEQ ID NO: 706939 - DNA, 20 bp, mouse
gcccacccgctagtctcctc

SEQ ID NO: 706940 - DNA, 20 bp, mouse
gagcccgcaggttcaggggt

SEQ ID NO: 706941 - DNA, 20 bp, mouse
gagtctcctcaggtcccctc

SEQ ID NO: 706942 - DNA, 20 bp, mouse
ggagactagcgggtgggggt

SEQ ID NO: 706943 - DNA, 20 bp, mouse
ggagatctgggggccccgag

SEQ ID NO: 706944 - DNA, 20 bp, mouse
gagccacgagctcagaaaga

SEQ ID NO: 706945 - DNA, 20 bp, mouse
gacctgaggagactagcggg

SEQ ID NO: 706946 - DNA, 20 bp, mouse
gccgcctccgccaggtgctc

SEQ ID NO: 706947 - DNA, 20 bp, mouse
gcgacagggcggggcttact

SEQ ID NO: 706948 - DNA, 20 bp, mouse
gtctcccgagcacctggcgg

SEQ ID NO: 706949 - DNA, 20 bp, mouse
gcacctggcggaggcgggtc

SEQ ID NO: 706950 - DNA, 20 bp, mouse
gggccccgcccccttcacct

SEQ ID NO: 706951 - DNA, 20 bp, mouse
gcccccttcacctaggaaac

SEQ ID NO: 706952 - DNA, 20 bp, mouse
gcagagaggcgagcccccaa

SEQ ID NO: 706953 - DNA, 20 bp, mouse
gcacgcccggctggtttcta

SEQ ID NO: 706954 - DNA, 20 bp, mouse
gtgcctgtcaggcgtgacgc

SEQ ID NO: 706955 - DNA, 20 bp, mouse
gaggcgagcccccaagggcg

SEQ ID NO: 706956 - DNA, 20 bp, mouse
ggggaccaagccatgtcatc

SEQ ID NO: 706957 - DNA, 20 bp, mouse
gtgacatggcttggtcccac

SEQ ID NO: 706958 - DNA, 20 bp, mouse
gagaaggaattcactctcta

SEQ ID NO: 706959 - DNA, 20 bp, mouse
gcatcacaatagcacctctt

SEQ ID NO: 706960 - DNA, 20 bp, mouse
gctggtgacatcattaacag

SEQ ID NO: 706961 - DNA, 20 bp, mouse
gtgaagagagctaaccaaag

SEQ ID NO: 706962 - DNA, 20 bp, mouse
gacgccgtggaagtataaga

SEQ ID NO: 706963 - DNA, 20 bp, mouse
gctagggttctgagtaccac

SEQ ID NO: 706964 - DNA, 20 bp, mouse
gagtcctttcatgtttccag

SEQ ID NO: 706965 - DNA, 20 bp, mouse
ggaccaaagaaagcagtaca

SEQ ID NO: 706966 - DNA, 20 bp, mouse
gcggaagcggatgtctccga

SEQ ID NO: 706967 - DNA, 20 bp, mouse
gccctcgtgagcagtgtaca

SEQ ID NO: 706968 - DNA, 20 bp, mouse
ggacgcgcgccctcaccatc

SEQ ID NO: 706969 - DNA, 20 bp, mouse
gtggctccggtgagggtgag

SEQ ID NO: 706970 - DNA, 20 bp, mouse
gcgccccgcgccatcgacaa

SEQ ID NO: 706971 - DNA, 20 bp, mouse
gacactgctcacgagggctg

SEQ ID NO: 706972 - DNA, 20 bp, mouse
ggctccaaagagaagtgcgg

SEQ ID NO: 706973 - DNA, 20 bp, mouse
ggacgtacctcccttgtcga

SEQ ID NO: 706974 - DNA, 20 bp, mouse
gcgggaaaggggatctattc

SEQ ID NO: 706975 - DNA, 20 bp, mouse
ggagcagtgtacagggttct

SEQ ID NO: 706976 - DNA, 20 bp, mouse
gtcctgaaggcagggcaggt

SEQ ID NO: 706977 - DNA, 20 bp, mouse
gacaaggcttgggttcccag

SEQ ID NO: 706978 - DNA, 20 bp, mouse
gtgcgcttgcgttgcctgaa

SEQ ID NO: 706979 - DNA, 20 bp, mouse
ggaaggcagggcaggttggc

SEQ ID NO: 706980 - DNA, 20 bp, mouse
ggggagaggcatcagtcagg

SEQ ID NO: 706981 - DNA, 20 bp, mouse
gcgcaagcgcaagcggaggt

SEQ ID NO: 706982 - DNA, 20 bp, mouse
gccttcaggacgagcacatc

SEQ ID NO: 706983 - DNA, 20 bp, mouse
gctctgcctgcacaaggctt

SEQ ID NO: 706984 - DNA, 20 bp, mouse
gtgtgctcgtcctgaaggca

SEQ ID NO: 706985 - DNA, 20 bp, mouse
gaggtgggtgtggacggctg

SEQ ID NO: 706986 - DNA, 20 bp, mouse
gcctcaggggctctgccaat

SEQ ID NO: 706987 - DNA, 20 bp, mouse
gtggcagagcccctgagggg

SEQ ID NO: 706988 - DNA, 20 bp, mouse
ggggaaacaaggccccgtca

SEQ ID NO: 706989 - DNA, 20 bp, mouse
ggggcttcgattggtcggaa

SEQ ID NO: 706990 - DNA, 20 bp, mouse
gagccgccgcgccattggtc

SEQ ID NO: 706991 - DNA, 20 bp, mouse
ggcggcgggcttcgattggt

SEQ ID NO: 706992 - DNA, 20 bp, mouse
gcacctggtgagccgcgccc

SEQ ID NO: 706993 - DNA, 20 bp, mouse
gcggccagagcatcccaacc

SEQ ID NO: 706994 - DNA, 20 bp, mouse
gggtgagccgcgcccaggtt

SEQ ID NO: 706995 - DNA, 20 bp, mouse
gcgcccgcaggccggagcca

SEQ ID NO: 706996 - DNA, 20 bp, mouse
gcgcctgcgcgcagtgcgga

SEQ ID NO: 706997 - DNA, 20 bp, mouse
gaggaagggggcggtctcgg

SEQ ID NO: 706998 - DNA, 20 bp, mouse
gcgcgctcacatcagacgcc

SEQ ID NO: 706999 - DNA, 20 bp, mouse
gcggggcagaggctggactt

SEQ ID NO: 707000 - DNA, 20 bp, mouse
gggatgatcagcaaccaatt

SEQ ID NO: 707001 - DNA, 20 bp, mouse
gctgccgcctggttcacgtc

SEQ ID NO: 707002 - DNA, 20 bp, mouse
gcagaggccagcgatgggga

SEQ ID NO: 707003 - DNA, 20 bp, mouse
gagtgcggagggactcgccg

SEQ ID NO: 707004 - DNA, 20 bp, mouse
gcgcgcgcggggtctgcctg

SEQ ID NO: 707005 - DNA, 20 bp, mouse
gggcaggaagggggcggtct

SEQ ID NO: 707006 - DNA, 20 bp, mouse
ggtaagaggcagcgtcttgt

SEQ ID NO: 707007 - DNA, 20 bp, mouse
ggtaaaggcaatgcagagac

SEQ ID NO: 707008 - DNA, 20 bp, mouse
gggggctagcttgtcgtaag

SEQ ID NO: 707009 - DNA, 20 bp, mouse
gtacgacaagctagccccac

SEQ ID NO: 707010 - DNA, 20 bp, mouse
gccctagaggtcagatccta

SEQ ID NO: 707011 - DNA, 20 bp, mouse
ggagagacataatgacgatt

SEQ ID NO: 707012 - DNA, 20 bp, mouse
gaagctagccccacaggtaa

SEQ ID NO: 707013 - DNA, 20 bp, mouse
gagggcaaaggacacaaggg

SEQ ID NO: 707014 - DNA, 20 bp, mouse
gaagacgtattgggcaactg

SEQ ID NO: 707015 - DNA, 20 bp, mouse
gaagcccagtaagcttcctg

SEQ ID NO: 707016 - DNA, 20 bp, mouse
ggggaggtctggaaagacaa

SEQ ID NO: 707017 - DNA, 20 bp, mouse
gaagagcctggaagagagtg

SEQ ID NO: 707018 - DNA, 20 bp, mouse
gcaagaggatggacagttgt

SEQ ID NO: 707019 - DNA, 20 bp, mouse
ggacagttgtaggtaaacct

SEQ ID NO: 707020 - DNA, 20 bp, mouse
gctaaactggattacagcta

SEQ ID NO: 707021 - DNA, 20 bp, mouse
gagtgaggaaggttatcagc

SEQ ID NO: 707022 - DNA, 20 bp, mouse
gtggcaaaagacatgcatgg

SEQ ID NO: 707023 - DNA, 20 bp, mouse
ggagaggaactcaagttcac

SEQ ID NO: 707024 - DNA, 20 bp, mouse
gagtacagtcctggcattgg

SEQ ID NO: 707025 - DNA, 20 bp, mouse
gagctggcaaaagacatgca

SEQ ID NO: 707026 - DNA, 20 bp, mouse
gggaatctgcatgtggccgg

SEQ ID NO: 707027 - DNA, 20 bp, mouse
gcatccggtcacaaccctga

SEQ ID NO: 707028 - DNA, 20 bp, mouse
gtcgggaatctgcatgtggc

SEQ ID NO: 707029 - DNA, 20 bp, mouse
gtcaaacgtagaatgagtaa

SEQ ID NO: 707030 - DNA, 20 bp, mouse
gtctctcgggaatctgcatg

SEQ ID NO: 707031 - DNA, 20 bp, mouse
gctaagatagctgcagccac

SEQ ID NO: 707032 - DNA, 20 bp, mouse
gctccttcatggtctctctc

SEQ ID NO: 707033 - DNA, 20 bp, mouse
gtggcataagtcctccttca

SEQ ID NO: 707034 - DNA, 20 bp, mouse
gagtccttcagggttgtgac

SEQ ID NO: 707035 - DNA, 20 bp, mouse
gccgacttctcaacgtattt

SEQ ID NO: 707036 - DNA, 20 bp, mouse
ggggctgcggccgacctcgg

SEQ ID NO: 707037 - DNA, 20 bp, mouse
gtcgctctaactccgatatc

SEQ ID NO: 707038 - DNA, 20 bp, mouse
gtatcaagatggtcgcaaac

SEQ ID NO: 707039 - DNA, 20 bp, mouse
gctaactccgatatccggtt

SEQ ID NO: 707040 - DNA, 20 bp, mouse
gggtcgacctctaaccccag

SEQ ID NO: 707041 - DNA, 20 bp, mouse
gtcgacctgcaatttcgggt

SEQ ID NO: 707042 - DNA, 20 bp, mouse
gtggtagggagtaggctatg

SEQ ID NO: 707043 - DNA, 20 bp, mouse
gagcgcacgaccgggtacgt

SEQ ID NO: 707044 - DNA, 20 bp, mouse
gagacgcgcacgttccaaac

SEQ ID NO: 707045 - DNA, 20 bp, mouse
gaagtcccgccccacgtacc

SEQ ID NO: 707046 - DNA, 20 bp, mouse
gggggcgcgcctttgcagat

SEQ ID NO: 707047 - DNA, 20 bp, mouse
gttgcccggcctccaggcgg

SEQ ID NO: 707048 - DNA, 20 bp, mouse
gaggccgggcaaggccgcgg

SEQ ID NO: 707049 - DNA, 20 bp, mouse
ggccttgcccggcctccagg

SEQ ID NO: 707050 - DNA, 20 bp, mouse
ggccgcgtccgaccgctctc

SEQ ID NO: 707051 - DNA, 20 bp, mouse
ggcaccaagcccatctgcaa

SEQ ID NO: 707052 - DNA, 20 bp, mouse
gaggcgaggcccagcgccct

SEQ ID NO: 707053 - DNA, 20 bp, mouse
gccaccgggaggacggactt

SEQ ID NO: 707054 - DNA, 20 bp, mouse
gctcccggtggggcgacaag

SEQ ID NO: 707055 - DNA, 20 bp, mouse
gtcggcgcggcgtcactctc

SEQ ID NO: 707056 - DNA, 20 bp, mouse
gaccctgcagagcggagaat

SEQ ID NO: 707057 - DNA, 20 bp, mouse
ggccctgaggccattggccg

SEQ ID NO: 707058 - DNA, 20 bp, mouse
gaggctcccgcacagttcct

SEQ ID NO: 707059 - DNA, 20 bp, mouse
gtgaacaggtcaggagagcg

SEQ ID NO: 707060 - DNA, 20 bp, mouse
ggaccctcggacccaggctg

SEQ ID NO: 707061 - DNA, 20 bp, mouse
gctccgctctgcagggtcgc

SEQ ID NO: 707062 - DNA, 20 bp, mouse
gccggcgcgcagcagctgat

SEQ ID NO: 707063 - DNA, 20 bp, mouse
gtctcgctcgccccaccctg

SEQ ID NO: 707064 - DNA, 20 bp, mouse
gcgcagcagctgatgggcgc

SEQ ID NO: 707065 - DNA, 20 bp, mouse
ggctgcgcgccggggccctg

SEQ ID NO: 707066 - DNA, 20 bp, mouse
ggaatcggctctgcaagatg

SEQ ID NO: 707067 - DNA, 20 bp, mouse
ggcatgagatcagcaaagga

SEQ ID NO: 707068 - DNA, 20 bp, mouse
ggagggaagagttagatttc

SEQ ID NO: 707069 - DNA, 20 bp, mouse
ggatctcatgctgtaggaat

SEQ ID NO: 707070 - DNA, 20 bp, mouse
gagtccctacagcaagtcat

SEQ ID NO: 707071 - DNA, 20 bp, mouse
gtgggccaagctcacttcta

SEQ ID NO: 707072 - DNA, 20 bp, mouse
gctatagtaaaggcaagtgg

SEQ ID NO: 707073 - DNA, 20 bp, mouse
gctgcaggcaagtccctttc

SEQ ID NO: 707074 - DNA, 20 bp, mouse
gatgagtcagcagggtggaa

SEQ ID NO: 707075 - DNA, 20 bp, mouse
gtttgatgatgagaatggga

SEQ ID NO: 707076 - DNA, 20 bp, mouse
gaataaaagcagaagatggg

SEQ ID NO: 707077 - DNA, 20 bp, mouse
gggaaatgataagaatgcgg

SEQ ID NO: 707078 - DNA, 20 bp, mouse
gaggaataaaagcagaagat

SEQ ID NO: 707079 - DNA, 20 bp, mouse
gccaaagaaaacatcaccac

SEQ ID NO: 707080 - DNA, 20 bp, mouse
gctagagagaccactgtctc

SEQ ID NO: 707081 - DNA, 20 bp, mouse
gcccatgtccatatagttgc

SEQ ID NO: 707082 - DNA, 20 bp, mouse
ggctgatgcctcctttgaag

SEQ ID NO: 707083 - DNA, 20 bp, mouse
gactagacaactctttagag

SEQ ID NO: 707084 - DNA, 20 bp, mouse
gtctactgggaatatgcctg

SEQ ID NO: 707085 - DNA, 20 bp, mouse
ggcagaagatgggaggctgc

SEQ ID NO: 707086 - DNA, 20 bp, mouse
gccagtaatgggtaacatta

SEQ ID NO: 707087 - DNA, 20 bp, mouse
gtaaggatgggagtctactc

SEQ ID NO: 707088 - DNA, 20 bp, mouse
gagtagctaggccaaaggga

SEQ ID NO: 707089 - DNA, 20 bp, mouse
gtggcagtagctaggccaaa

SEQ ID NO: 707090 - DNA, 20 bp, mouse
ggtctgaataggaattggag

SEQ ID NO: 707091 - DNA, 20 bp, mouse
gccagctgctagagaggtac

SEQ ID NO: 707092 - DNA, 20 bp, mouse
gtagcagctggctcatactt

SEQ ID NO: 707093 - DNA, 20 bp, mouse
gctccacatcagttcaggaa

SEQ ID NO: 707094 - DNA, 20 bp, mouse
gtatgagccagctgctagag

SEQ ID NO: 707095 - DNA, 20 bp, mouse
gaagaccagatggtcctcca

SEQ ID NO: 707096 - DNA, 20 bp, mouse
ggggcactgccgtggtgtga

SEQ ID NO: 707097 - DNA, 20 bp, mouse
gaagctgggtccatgtggaa

SEQ ID NO: 707098 - DNA, 20 bp, mouse
gagtggtaaaggaacgtcta

SEQ ID NO: 707099 - DNA, 20 bp, mouse
gcacggcagtgccccctttc

SEQ ID NO: 707100 - DNA, 20 bp, mouse
ggcaaaggaggtgacctagg

SEQ ID NO: 707101 - DNA, 20 bp, mouse
ggctagaggtcaatggactc

SEQ ID NO: 707102 - DNA, 20 bp, mouse
gaggcataaatgccagaaag

SEQ ID NO: 707103 - DNA, 20 bp, mouse
gtaggcaaaggaggtgacct

SEQ ID NO: 707104 - DNA, 20 bp, mouse
gctaaggaagctcaggactc

SEQ ID NO: 707105 - DNA, 20 bp, mouse
gttccaaagccctcacacca

SEQ ID NO: 707106 - DNA, 20 bp, mouse
gtgtcacgagccggagggga

SEQ ID NO: 707107 - DNA, 20 bp, mouse
gcggccggactagcgcgaaa

SEQ ID NO: 707108 - DNA, 20 bp, mouse
ggcgggagcttggagtctct

SEQ ID NO: 707109 - DNA, 20 bp, mouse
gcggcaccgcccattggagt

SEQ ID NO: 707110 - DNA, 20 bp, mouse
gccgcggtccaaagcagcgg

SEQ ID NO: 707111 - DNA, 20 bp, mouse
gcggtccaaagcagcggcgg

SEQ ID NO: 707112 - DNA, 20 bp, mouse
gccgcgccgcggccgtccat

SEQ ID NO: 707113 - DNA, 20 bp, mouse
gtcgttgtcacgagccggag

SEQ ID NO: 707114 - DNA, 20 bp, mouse
ggtgcctccaagcagtccaa

SEQ ID NO: 707115 - DNA, 20 bp, mouse
gcttcgacgcgctgagagcg

SEQ ID NO: 707116 - DNA, 20 bp, mouse
gttcccgcgtgggtgccgat

SEQ ID NO: 707117 - DNA, 20 bp, mouse
ggagctcgctgattgagaga

SEQ ID NO: 707118 - DNA, 20 bp, mouse
ggtcccccggaggccagcgc

SEQ ID NO: 707119 - DNA, 20 bp, mouse
gaacctatcggcacccacgc

SEQ ID NO: 707120 - DNA, 20 bp, mouse
gcacccacgcgggaagcctc

SEQ ID NO: 707121 - DNA, 20 bp, mouse
gaattctcgtgggatctacc

SEQ ID NO: 707122 - DNA, 20 bp, mouse
gttccagaggcttcccgcgt

SEQ ID NO: 707123 - DNA, 20 bp, mouse
gggcctggaaggacagctag

SEQ ID NO: 707124 - DNA, 20 bp, mouse
gggcccgcgctggcctccgg

SEQ ID NO: 707125 - DNA, 20 bp, mouse
gaatcagcgagctctccgaa

SEQ ID NO: 707126 - DNA, 20 bp, mouse
gacagatcggggcgcgggtg

SEQ ID NO: 707127 - DNA, 20 bp, mouse
gtcggatgcgtgacaggtgc

SEQ ID NO: 707128 - DNA, 20 bp, mouse
gggtgggcgcttgtccattt

SEQ ID NO: 707129 - DNA, 20 bp, mouse
gtgtgtggcttgcattcctc

SEQ ID NO: 707130 - DNA, 20 bp, mouse
gcgggtgtgtgtctgcagtt

SEQ ID NO: 707131 - DNA, 20 bp, mouse
gtggcgcccggctcatgata

SEQ ID NO: 707132 - DNA, 20 bp, mouse
ggaaaagaacccggaggaaa

SEQ ID NO: 707133 - DNA, 20 bp, mouse
ggcgagtcgagacaattctt

SEQ ID NO: 707134 - DNA, 20 bp, mouse
gcgagcttacgtaagtgact

SEQ ID NO: 707135 - DNA, 20 bp, mouse
ggactcggcgagctggcatg

SEQ ID NO: 707136 - DNA, 20 bp, mouse
ggagcccggtggggagcaac

SEQ ID NO: 707137 - DNA, 20 bp, mouse
gcaggacgagggcggaacgt

SEQ ID NO: 707138 - DNA, 20 bp, mouse
ggcctgaggcaccagtctgt

SEQ ID NO: 707139 - DNA, 20 bp, mouse
gacgagggcggaacgtaggc

SEQ ID NO: 707140 - DNA, 20 bp, mouse
gcgagaggcggagcccggtg

SEQ ID NO: 707141 - DNA, 20 bp, mouse
gtgaggcaccagtctgtggg

SEQ ID NO: 707142 - DNA, 20 bp, mouse
ggtgtgacgccagcggctga

SEQ ID NO: 707143 - DNA, 20 bp, mouse
gggtgcttgttgctcgagag

SEQ ID NO: 707144 - DNA, 20 bp, mouse
gagagtggtgcaataactga

SEQ ID NO: 707145 - DNA, 20 bp, mouse
gtcctagtgtgggaggtgga

SEQ ID NO: 707146 - DNA, 20 bp, mouse
gccaaggtctggcatagccc

SEQ ID NO: 707147 - DNA, 20 bp, mouse
gcaagtgacctgtgagtcac

SEQ ID NO: 707148 - DNA, 20 bp, mouse
gttggtcatcttcttctcct

SEQ ID NO: 707149 - DNA, 20 bp, mouse
gtttatatcctgcccaagtc

SEQ ID NO: 707150 - DNA, 20 bp, mouse
gagaccttggtattcacaag

SEQ ID NO: 707151 - DNA, 20 bp, mouse
ggtctgcttgagaaaggaaa

SEQ ID NO: 707152 - DNA, 20 bp, mouse
ggaggtagtctgcttgagaa

SEQ ID NO: 707153 - DNA, 20 bp, mouse
gaatgggaacatctgtggga

SEQ ID NO: 707154 - DNA, 20 bp, mouse
gagcaggaagtgctagtgat

SEQ ID NO: 707155 - DNA, 20 bp, mouse
gagggaaacaagtaatatat

SEQ ID NO: 707156 - DNA, 20 bp, mouse
gagggaggggtcagggatac

SEQ ID NO: 707157 - DNA, 20 bp, mouse
gcaccggggcaaaagggcaa

SEQ ID NO: 707158 - DNA, 20 bp, mouse
gcggggcaaaagggcaaggg

SEQ ID NO: 707159 - DNA, 20 bp, mouse
gaaagggcaagggaggggtc

SEQ ID NO: 707160 - DNA, 20 bp, mouse
ggaaaaacaccggggcaaaa

SEQ ID NO: 707161 - DNA, 20 bp, mouse
ggagcaaagtggaaaaacac

SEQ ID NO: 707162 - DNA, 20 bp, mouse
gagggatacaggggtggagc

SEQ ID NO: 707163 - DNA, 20 bp, mouse
gcacactgctggtgtggtag

SEQ ID NO: 707164 - DNA, 20 bp, mouse
gaagaagtacctaaaggacc

SEQ ID NO: 707165 - DNA, 20 bp, mouse
gtggaaaaagaagtacctaa

SEQ ID NO: 707166 - DNA, 20 bp, mouse
gtgggagcccagactcagca

SEQ ID NO: 707167 - DNA, 20 bp, mouse
ggcccagactcagcaggggc

SEQ ID NO: 707168 - DNA, 20 bp, mouse
gggcagaagcaagggcatag

SEQ ID NO: 707169 - DNA, 20 bp, mouse
gttctggacccctggaactt

SEQ ID NO: 707170 - DNA, 20 bp, mouse
gactcagcaggggctggaac

SEQ ID NO: 707171 - DNA, 20 bp, mouse
gacagatggagtcagataac

SEQ ID NO: 707172 - DNA, 20 bp, mouse
ggcatgtaagtatgcacatg

SEQ ID NO: 707173 - DNA, 20 bp, mouse
gtgagaagtgggatctttgt

SEQ ID NO: 707174 - DNA, 20 bp, mouse
gcatctcccctggggccatc

SEQ ID NO: 707175 - DNA, 20 bp, mouse
ggaacttggtagactccaga

SEQ ID NO: 707176 - DNA, 20 bp, mouse
gggtcaccctgcactgtcta

SEQ ID NO: 707177 - DNA, 20 bp, mouse
ggacagccgtagacagtgca

SEQ ID NO: 707178 - DNA, 20 bp, mouse
gctacagtgaacaagagaat

SEQ ID NO: 707179 - DNA, 20 bp, mouse
gcacggagaaagtgggacaa

SEQ ID NO: 707180 - DNA, 20 bp, mouse
gaacgcccagaggcagacat

SEQ ID NO: 707181 - DNA, 20 bp, mouse
gtgggcgtttggtagagtgg

SEQ ID NO: 707182 - DNA, 20 bp, mouse
gtatgagtggttatttacct

SEQ ID NO: 707183 - DNA, 20 bp, mouse
gactgccctaagcaagttgg

SEQ ID NO: 707184 - DNA, 20 bp, mouse
gtttgtgcacgggttttaga

SEQ ID NO: 707185 - DNA, 20 bp, mouse
gctttccatcgctgtcctgc

SEQ ID NO: 707186 - DNA, 20 bp, mouse
ggagacagagtgtgaattgc

SEQ ID NO: 707187 - DNA, 20 bp, mouse
gacctcccacatgcaatgat

SEQ ID NO: 707188 - DNA, 20 bp, mouse
gctgagagagatggtatcta

SEQ ID NO: 707189 - DNA, 20 bp, mouse
gagaggacggcatgtaccca

SEQ ID NO: 707190 - DNA, 20 bp, mouse
gtggtgggacatgctcacgg

SEQ ID NO: 707191 - DNA, 20 bp, mouse
gtacatgccgtcctctgtaa

SEQ ID NO: 707192 - DNA, 20 bp, mouse
gtgtgggaggtagtttgccc

SEQ ID NO: 707193 - DNA, 20 bp, mouse
gaacagaaaaggccattgaa

SEQ ID NO: 707194 - DNA, 20 bp, mouse
gaaagcacagacgatgtgtg

SEQ ID NO: 707195 - DNA, 20 bp, mouse
gtaacttgttggtaattgcc

SEQ ID NO: 707196 - DNA, 20 bp, mouse
gccctgccccacaggtagaa

SEQ ID NO: 707197 - DNA, 20 bp, mouse
gagggtccgctattggaggc

SEQ ID NO: 707198 - DNA, 20 bp, mouse
gctggcactggtttcactcc

SEQ ID NO: 707199 - DNA, 20 bp, mouse
gtggactcccttctacctgt

SEQ ID NO: 707200 - DNA, 20 bp, mouse
gcgggagggtccgctattgg

SEQ ID NO: 707201 - DNA, 20 bp, mouse
gtctgggaaaggtctgtgcc

SEQ ID NO: 707202 - DNA, 20 bp, mouse
gtgagtggcagtccgcctgg

SEQ ID NO: 707203 - DNA, 20 bp, mouse
gagaatactggagcacaaat

SEQ ID NO: 707204 - DNA, 20 bp, mouse
gaggcggactgccactcaga

SEQ ID NO: 707205 - DNA, 20 bp, mouse
gcacactacataatgtgctg

SEQ ID NO: 707206 - DNA, 20 bp, mouse
ggcggtagaaaggaactcgg

SEQ ID NO: 707207 - DNA, 20 bp, mouse
ggctggattgctctgttcac

SEQ ID NO: 707208 - DNA, 20 bp, mouse
ggaggggccaagcggtagaa

SEQ ID NO: 707209 - DNA, 20 bp, mouse
gtagaaaggaactcggaggc

SEQ ID NO: 707210 - DNA, 20 bp, mouse
gaaaacctgagcaagaatct

SEQ ID NO: 707211 - DNA, 20 bp, mouse
gtgagcaagaatctaggatg

SEQ ID NO: 707212 - DNA, 20 bp, mouse
gaggatgaggagctgtttcc

SEQ ID NO: 707213 - DNA, 20 bp, mouse
gatctaggatggggtaacat

SEQ ID NO: 707214 - DNA, 20 bp, mouse
ggccaggttagtgattaaga

SEQ ID NO: 707215 - DNA, 20 bp, mouse
ggagtgggacagattttcat

SEQ ID NO: 707216 - DNA, 20 bp, mouse
gaatatgggtgggatcccac

SEQ ID NO: 707217 - DNA, 20 bp, mouse
gtggctacaggacaatctcc

SEQ ID NO: 707218 - DNA, 20 bp, mouse
gaccagcgcaggaaccacac

SEQ ID NO: 707219 - DNA, 20 bp, mouse
gtaggaaaatgccataggct

SEQ ID NO: 707220 - DNA, 20 bp, mouse
ggggtgggatcccaccgggg

SEQ ID NO: 707221 - DNA, 20 bp, mouse
gtatccagcagagttcatca

SEQ ID NO: 707222 - DNA, 20 bp, mouse
gatcatgaggaaaggcaatt

SEQ ID NO: 707223 - DNA, 20 bp, mouse
gcttgttatcaatactaatt

SEQ ID NO: 707224 - DNA, 20 bp, mouse
gtcaagtcaggaaccagcgc

SEQ ID NO: 707225 - DNA, 20 bp, mouse
gagtggtagaaacctttaca

SEQ ID NO: 707226 - DNA, 20 bp, mouse
gacggtgagcacaaggtggg

SEQ ID NO: 707227 - DNA, 20 bp, mouse
gccaagtagaggtaggtcat

SEQ ID NO: 707228 - DNA, 20 bp, mouse
gcccacggtgagcacaaggt

SEQ ID NO: 707229 - DNA, 20 bp, mouse
gtcattggagacatacctct

SEQ ID NO: 707230 - DNA, 20 bp, mouse
ggtgggagccaagtagaggt

SEQ ID NO: 707231 - DNA, 20 bp, mouse
gacctcttggaagggaatat

SEQ ID NO: 707232 - DNA, 20 bp, mouse
gtcactggagcttccacagg

SEQ ID NO: 707233 - DNA, 20 bp, mouse
gtggagacatacctcttgga

SEQ ID NO: 707234 - DNA, 20 bp, mouse
gcagtgaaccctttgtgagg

SEQ ID NO: 707235 - DNA, 20 bp, mouse
gcatgtggtgaaggaacaaa

SEQ ID NO: 707236 - DNA, 20 bp, mouse
gttaaatataagataccaag

SEQ ID NO: 707237 - DNA, 20 bp, mouse
gaaagaggaggtctcttcta

SEQ ID NO: 707238 - DNA, 20 bp, mouse
gaatccttctacacagatgt

SEQ ID NO: 707239 - DNA, 20 bp, mouse
ggtgtaagtgatgtactcct

SEQ ID NO: 707240 - DNA, 20 bp, mouse
gtaacaaaatacataataat

SEQ ID NO: 707241 - DNA, 20 bp, mouse
ggagcagcaacacatcttag

SEQ ID NO: 707242 - DNA, 20 bp, mouse
gacactgtttgtatgtacat

SEQ ID NO: 707243 - DNA, 20 bp, mouse
gacagtgtacatttcaatta

SEQ ID NO: 707244 - DNA, 20 bp, mouse
gaggtttcttagctaagtgg

SEQ ID NO: 707245 - DNA, 20 bp, mouse
gttgctgctcaaaatcagat

SEQ ID NO: 707246 - DNA, 20 bp, mouse
ggaccatgagatcaagaggg

SEQ ID NO: 707247 - DNA, 20 bp, mouse
gctcctccctcttgatctca

SEQ ID NO: 707248 - DNA, 20 bp, mouse
gacaacccaggtgtataaaa

SEQ ID NO: 707249 - DNA, 20 bp, mouse
gtttgaccatgagatcaaga

SEQ ID NO: 707250 - DNA, 20 bp, mouse
gattcaacttccaagtctcc

SEQ ID NO: 707251 - DNA, 20 bp, mouse
gaaaccaagcttgttttatt

SEQ ID NO: 707252 - DNA, 20 bp, mouse
gcaccccaataaaacaagct

SEQ ID NO: 707253 - DNA, 20 bp, mouse
gagaacgcagatgatattta

SEQ ID NO: 707254 - DNA, 20 bp, mouse
gtattggagcataatattta

SEQ ID NO: 707255 - DNA, 20 bp, mouse
gctgaatccatcaagtcaac

SEQ ID NO: 707256 - DNA, 20 bp, mouse
gtccagagtactgtatttaa

SEQ ID NO: 707257 - DNA, 20 bp, mouse
gcaggaacaggctggtctcg

SEQ ID NO: 707258 - DNA, 20 bp, mouse
gcaaacaggagcatttcatt

SEQ ID NO: 707259 - DNA, 20 bp, mouse
gtcaccatactgggcttcca

SEQ ID NO: 707260 - DNA, 20 bp, mouse
gtcaccatggaagcccagta

SEQ ID NO: 707261 - DNA, 20 bp, mouse
ggggcatacacagctgacag

SEQ ID NO: 707262 - DNA, 20 bp, mouse
ggctgacaggggaagctgac

SEQ ID NO: 707263 - DNA, 20 bp, mouse
gagacattatggagttcgaa

SEQ ID NO: 707264 - DNA, 20 bp, mouse
gtggtgatttttaagactct

SEQ ID NO: 707265 - DNA, 20 bp, mouse
ggatctacgtgcagaattcc

SEQ ID NO: 707266 - DNA, 20 bp, mouse
ggtgagtaagacacgaggac

SEQ ID NO: 707267 - DNA, 20 bp, mouse
ggtgtggtgagtaagacacg

SEQ ID NO: 707268 - DNA, 20 bp, mouse
gcgtgaaacaacatctgccg

SEQ ID NO: 707269 - DNA, 20 bp, mouse
gtatgactgccagcaagcca

SEQ ID NO: 707270 - DNA, 20 bp, mouse
gtaggcacaaatgactttgt

SEQ ID NO: 707271 - DNA, 20 bp, mouse
gatatgtacttcttgttgtg

SEQ ID NO: 707272 - DNA, 20 bp, mouse
gtcttcctttgacagtggag

SEQ ID NO: 707273 - DNA, 20 bp, mouse
gagaaaccaagcaagatcca

SEQ ID NO: 707274 - DNA, 20 bp, mouse
gtgtctatgctggaaacctg

SEQ ID NO: 707275 - DNA, 20 bp, mouse
ggcaaccagcgaactgacct

SEQ ID NO: 707276 - DNA, 20 bp, mouse
gtctccttcttctagtcctt

SEQ ID NO: 707277 - DNA, 20 bp, mouse
ggagttaggccaaggggtcc

SEQ ID NO: 707278 - DNA, 20 bp, mouse
gcccctacggtcataaaaat

SEQ ID NO: 707279 - DNA, 20 bp, mouse
gctcccttatgccttgttca

SEQ ID NO: 707280 - DNA, 20 bp, mouse
ggagccaaaggactagaaga

SEQ ID NO: 707281 - DNA, 20 bp, mouse
ggtaggggataagaatcgcc

SEQ ID NO: 707282 - DNA, 20 bp, mouse
gcggtcataaaaatgggtgg

SEQ ID NO: 707283 - DNA, 20 bp, mouse
ggaaccctgaacaaggcata

SEQ ID NO: 707284 - DNA, 20 bp, mouse
gaggagagaaagacacatcc

SEQ ID NO: 707285 - DNA, 20 bp, mouse
gaaagaaacggctaatgtag

SEQ ID NO: 707286 - DNA, 20 bp, mouse
gcatctcaccagcccggaaa

SEQ ID NO: 707287 - DNA, 20 bp, mouse
gtgaactctagcaagttcca

SEQ ID NO: 707288 - DNA, 20 bp, mouse
gcagcccggaaaaggttctt

SEQ ID NO: 707289 - DNA, 20 bp, mouse
ggaaaactggctaggcctga

SEQ ID NO: 707290 - DNA, 20 bp, mouse
gaaccccaaagaaccttttc

SEQ ID NO: 707291 - DNA, 20 bp, mouse
gctagagttcaagaccagga

SEQ ID NO: 707292 - DNA, 20 bp, mouse
gggctatagaggccaaagga

SEQ ID NO: 707293 - DNA, 20 bp, mouse
gtaacaaaaaaactgaaaac

SEQ ID NO: 707294 - DNA, 20 bp, mouse
ggggtatcactaactaaccc

SEQ ID NO: 707295 - DNA, 20 bp, mouse
gttgcctctgctcgaattaa

SEQ ID NO: 707296 - DNA, 20 bp, mouse
ggatgactgcccaataccac

SEQ ID NO: 707297 - DNA, 20 bp, mouse
gtcttggataaacttccctt

SEQ ID NO: 707298 - DNA, 20 bp, mouse
gtatgataggggaagagcca

SEQ ID NO: 707299 - DNA, 20 bp, mouse
gtactggaagattctccaaa

SEQ ID NO: 707300 - DNA, 20 bp, mouse
gattttataaacatttgtac

SEQ ID NO: 707301 - DNA, 20 bp, mouse
gcttctacacctgtggtatt

SEQ ID NO: 707302 - DNA, 20 bp, mouse
ggcagttacttctacacctg

SEQ ID NO: 707303 - DNA, 20 bp, mouse
gataactagaagcaaactta

SEQ ID NO: 707304 - DNA, 20 bp, mouse
gatggccaagaaagtttgaa

SEQ ID NO: 707305 - DNA, 20 bp, mouse
gaagttactgctaactagcc

SEQ ID NO: 707306 - DNA, 20 bp, mouse
gaataacaaagatttaatta

SEQ ID NO: 707307 - DNA, 20 bp, mouse
gaagttttctcttctctgaa

SEQ ID NO: 707308 - DNA, 20 bp, mouse
ggagagcagcataagccacg

SEQ ID NO: 707309 - DNA, 20 bp, mouse
gattatcagtggactcctcg

SEQ ID NO: 707310 - DNA, 20 bp, mouse
gatccatcttatgactgtgt

SEQ ID NO: 707311 - DNA, 20 bp, mouse
gtatcaagctatgagacttg

SEQ ID NO: 707312 - DNA, 20 bp, mouse
gtgatgtcatctggcaagtt

SEQ ID NO: 707313 - DNA, 20 bp, mouse
gtctctgaagaaccagtaaa

SEQ ID NO: 707314 - DNA, 20 bp, mouse
gggtcccagtgtattatctg

SEQ ID NO: 707315 - DNA, 20 bp, mouse
gcaggcttctaataacacaa

SEQ ID NO: 707316 - DNA, 20 bp, mouse
gggaccgaggcgcttgtgaa

SEQ ID NO: 707317 - DNA, 20 bp, mouse
gtgcgggccaagccgaggga

SEQ ID NO: 707318 - DNA, 20 bp, mouse
gtaggcggcgcggagttcta

SEQ ID NO: 707319 - DNA, 20 bp, mouse
gagggagggcgcggagagtc

SEQ ID NO: 707320 - DNA, 20 bp, mouse
gtgcacacgggtcggggcta

SEQ ID NO: 707321 - DNA, 20 bp, mouse
gcggagagtcgggattccag

SEQ ID NO: 707322 - DNA, 20 bp, mouse
gtcgcgggcgtggggagtgc

SEQ ID NO: 707323 - DNA, 20 bp, mouse
ggaggtcgccaccctggaaa

SEQ ID NO: 707324 - DNA, 20 bp, mouse
gcggcccttcacaagcgcct

SEQ ID NO: 707325 - DNA, 20 bp, mouse
gggggcacgtcgtttggctc

SEQ ID NO: 707326 - DNA, 20 bp, mouse
gaagactcaaggtgatatac

SEQ ID NO: 707327 - DNA, 20 bp, mouse
gaatctgttcaggaaagtgt

SEQ ID NO: 707328 - DNA, 20 bp, mouse
gaaccatctacaagaagcta

SEQ ID NO: 707329 - DNA, 20 bp, mouse
ggcaatgacagctgacattg

SEQ ID NO: 707330 - DNA, 20 bp, mouse
ggagatgcttagagtgtctc

SEQ ID NO: 707331 - DNA, 20 bp, mouse
gaccaaggaaacatattcat

SEQ ID NO: 707332 - DNA, 20 bp, mouse
gtccaatgaatatgtttcct

SEQ ID NO: 707333 - DNA, 20 bp, mouse
gagtgattatcaatctgttc

SEQ ID NO: 707334 - DNA, 20 bp, mouse
gagtttccctgtcttcacta

SEQ ID NO: 707335 - DNA, 20 bp, mouse
gatcactccctagtgaagac

SEQ ID NO: 707336 - DNA, 20 bp, mouse
gaggcgataacctcagaatt

SEQ ID NO: 707337 - DNA, 20 bp, mouse
gcttacctgagtcacgaatc

SEQ ID NO: 707338 - DNA, 20 bp, mouse
gggagaaagtgatgatgtta

SEQ ID NO: 707339 - DNA, 20 bp, mouse
gagaatttggaagtctgagc

SEQ ID NO: 707340 - DNA, 20 bp, mouse
gagaaagttccaagcatgct

SEQ ID NO: 707341 - DNA, 20 bp, mouse
gttctgaggttatcgccttg

SEQ ID NO: 707342 - DNA, 20 bp, mouse
gtgggtagccccaactagct

SEQ ID NO: 707343 - DNA, 20 bp, mouse
gtcatcactttctcctcata

SEQ ID NO: 707344 - DNA, 20 bp, mouse
gttttgaggtaggttttaat

SEQ ID NO: 707345 - DNA, 20 bp, mouse
gtccaagcatgctgggcaga

SEQ ID NO: 707346 - DNA, 20 bp, mouse
gggaagggggaggattatat

SEQ ID NO: 707347 - DNA, 20 bp, mouse
ggaaggaacgacaatataaa

SEQ ID NO: 707348 - DNA, 20 bp, mouse
gtatagggggcttttcggaa

SEQ ID NO: 707349 - DNA, 20 bp, mouse
gacatcctctgctgcgtaag

SEQ ID NO: 707350 - DNA, 20 bp, mouse
gcctctgctgcgtaagtggc

SEQ ID NO: 707351 - DNA, 20 bp, mouse
gcacaatagtgactggtata

SEQ ID NO: 707352 - DNA, 20 bp, mouse
gagtacccaaagatctgatg

SEQ ID NO: 707353 - DNA, 20 bp, mouse
gagggggaggattatatagg

SEQ ID NO: 707354 - DNA, 20 bp, mouse
ggcaaaccccatcagatctt

SEQ ID NO: 707355 - DNA, 20 bp, mouse
ggctcctgttagcaagcagt

SEQ ID NO: 707356 - DNA, 20 bp, mouse
gaacagaaaacttctcatcg

SEQ ID NO: 707357 - DNA, 20 bp, mouse
ggtttctaggatgaggggat

SEQ ID NO: 707358 - DNA, 20 bp, mouse
ggggcggggtttctaggatg

SEQ ID NO: 707359 - DNA, 20 bp, mouse
gaagatctctggcttcagcc

SEQ ID NO: 707360 - DNA, 20 bp, mouse
gtcgagggggcggggtttct

SEQ ID NO: 707361 - DNA, 20 bp, mouse
ggatgaggatccaagattga

SEQ ID NO: 707362 - DNA, 20 bp, mouse
gtgtgtgttttatttcgagg

SEQ ID NO: 707363 - DNA, 20 bp, mouse
gagctgttcattgcaaagtc

SEQ ID NO: 707364 - DNA, 20 bp, mouse
gtcagattacatagattcta

SEQ ID NO: 707365 - DNA, 20 bp, mouse
gatggtttggacacgcgaaa

SEQ ID NO: 707366 - DNA, 20 bp, mouse
ggacttgcatggcccgagga

SEQ ID NO: 707367 - DNA, 20 bp, mouse
gcgaaaggctcagtccttcc

SEQ ID NO: 707368 - DNA, 20 bp, mouse
gtaggccacgagggtaagaa

SEQ ID NO: 707369 - DNA, 20 bp, mouse
gtccggctctgcagagcgaa

SEQ ID NO: 707370 - DNA, 20 bp, mouse
gcatggcccgaggatggcag

SEQ ID NO: 707371 - DNA, 20 bp, mouse
gtgccagcaagagcaggtta

SEQ ID NO: 707372 - DNA, 20 bp, mouse
gaatgctcttggtggacaaa

SEQ ID NO: 707373 - DNA, 20 bp, mouse
gacaagtgacagcttcatgg

SEQ ID NO: 707374 - DNA, 20 bp, mouse
gagagtctctccccttatct

SEQ ID NO: 707375 - DNA, 20 bp, mouse
ggacactgggcagtcacaag

SEQ ID NO: 707376 - DNA, 20 bp, mouse
gaacatggggggaagttggg

SEQ ID NO: 707377 - DNA, 20 bp, mouse
gaaacggcccgcaaacatgg

SEQ ID NO: 707378 - DNA, 20 bp, mouse
gagaaagttagggcactttg

SEQ ID NO: 707379 - DNA, 20 bp, mouse
gtaaaactgggaggggataa

SEQ ID NO: 707380 - DNA, 20 bp, mouse
gggacgagggttaacttctt

SEQ ID NO: 707381 - DNA, 20 bp, mouse
ggcgtcccccagcacatctt

SEQ ID NO: 707382 - DNA, 20 bp, mouse
ggaggtcccgcccactgtgc

SEQ ID NO: 707383 - DNA, 20 bp, mouse
gttgggttctgaacagtatg

SEQ ID NO: 707384 - DNA, 20 bp, mouse
ggagagcgccacttactatg

SEQ ID NO: 707385 - DNA, 20 bp, mouse
ggggcagggcgccggcacag

SEQ ID NO: 707386 - DNA, 20 bp, mouse
gagttcctggagaaggtcta

SEQ ID NO: 707387 - DNA, 20 bp, mouse
ggctcagtatctgacatctg

SEQ ID NO: 707388 - DNA, 20 bp, mouse
gagcccagcagcgttctggg

SEQ ID NO: 707389 - DNA, 20 bp, mouse
gcatgcaatgcaaaacgcag

SEQ ID NO: 707390 - DNA, 20 bp, mouse
gcgggagggccccaagttgt

SEQ ID NO: 707391 - DNA, 20 bp, mouse
gccggggtgtggaagatgta

SEQ ID NO: 707392 - DNA, 20 bp, mouse
ggctcacaatggacacatct

SEQ ID NO: 707393 - DNA, 20 bp, mouse
gtgacatctggggctcacaa

SEQ ID NO: 707394 - DNA, 20 bp, mouse
ggcagaggctgagggacggg

SEQ ID NO: 707395 - DNA, 20 bp, mouse
gctagcactggagacagagc

SEQ ID NO: 707396 - DNA, 20 bp, mouse
gccctccaacatgtttatga

SEQ ID NO: 707397 - DNA, 20 bp, mouse
gggggccctcataaacatgt

SEQ ID NO: 707398 - DNA, 20 bp, mouse
ggtaaaagggctttagagat

SEQ ID NO: 707399 - DNA, 20 bp, mouse
ggccctcataaacatgttgg

SEQ ID NO: 707400 - DNA, 20 bp, mouse
gataaacatgttggagggta

SEQ ID NO: 707401 - DNA, 20 bp, mouse
gaacaggaaattatgatcag

SEQ ID NO: 707402 - DNA, 20 bp, mouse
gcagtcaacagtggatcact

SEQ ID NO: 707403 - DNA, 20 bp, mouse
gaattatgatcagaggaatc

SEQ ID NO: 707404 - DNA, 20 bp, mouse
gaagtcataatacaaaaaac

SEQ ID NO: 707405 - DNA, 20 bp, mouse
gatgcaaacttatactcaag

SEQ ID NO: 707406 - DNA, 20 bp, mouse
ggggagagttggcccagata

SEQ ID NO: 707407 - DNA, 20 bp, mouse
ggtactgaagggcagagtgg

SEQ ID NO: 707408 - DNA, 20 bp, mouse
gtcaccaaatatcaatgtgg

SEQ ID NO: 707409 - DNA, 20 bp, mouse
ggaagggcagagtgggggac

SEQ ID NO: 707410 - DNA, 20 bp, mouse
ggaggagcaaatagagaacc

SEQ ID NO: 707411 - DNA, 20 bp, mouse
gatagggaggtgtactattt

SEQ ID NO: 707412 - DNA, 20 bp, mouse
ggcatctgcagtaggggcaa

SEQ ID NO: 707413 - DNA, 20 bp, mouse
gggggtactgaagggcagag

SEQ ID NO: 707414 - DNA, 20 bp, mouse
gctggctgaaagtctatcaa

SEQ ID NO: 707415 - DNA, 20 bp, mouse
gatacagaaaagaaagtaac

SEQ ID NO: 707416 - DNA, 20 bp, mouse
gggtgcggccagccgggacg

SEQ ID NO: 707417 - DNA, 20 bp, mouse
ggggctgccacgcggcgcag

SEQ ID NO: 707418 - DNA, 20 bp, mouse
gacgcggcgcagaggcgtgc

SEQ ID NO: 707419 - DNA, 20 bp, mouse
gcaggtggcaccagcgacac

SEQ ID NO: 707420 - DNA, 20 bp, mouse
gcagccttctccggtgtcgc

SEQ ID NO: 707421 - DNA, 20 bp, mouse
gttacagcagcccgggaagg

SEQ ID NO: 707422 - DNA, 20 bp, mouse
gtgcaagtcgtccggcacac

SEQ ID NO: 707423 - DNA, 20 bp, mouse
ggcgtggcagccccgcgtcc

SEQ ID NO: 707424 - DNA, 20 bp, mouse
gggaaatcccctcgtaaaag

SEQ ID NO: 707425 - DNA, 20 bp, mouse
gggcagccccgcgtcccggc

SEQ ID NO: 707426 - DNA, 20 bp, mouse
gaggactctgcctattaaat

SEQ ID NO: 707427 - DNA, 20 bp, mouse
gtatgttgtcacagatggca

SEQ ID NO: 707428 - DNA, 20 bp, mouse
gaattctattaatctataaa

SEQ ID NO: 707429 - DNA, 20 bp, mouse
gtaatatacaatgaatgtgg

SEQ ID NO: 707430 - DNA, 20 bp, mouse
gtacagctacagtaatataa

SEQ ID NO: 707431 - DNA, 20 bp, mouse
gagatcaggcttatcctcag

SEQ ID NO: 707432 - DNA, 20 bp, mouse
gctggagctgtgggccactg

SEQ ID NO: 707433 - DNA, 20 bp, mouse
ggtagcacataccagcactc

SEQ ID NO: 707434 - DNA, 20 bp, mouse
gaaaaaagagttacagaacc

SEQ ID NO: 707435 - DNA, 20 bp, mouse
gtcacctatgttgtcacaga

SEQ ID NO: 707436 - DNA, 20 bp, mouse
gtcttctcttccatatgcaa

SEQ ID NO: 707437 - DNA, 20 bp, mouse
ggagtccatgggaagatatt

SEQ ID NO: 707438 - DNA, 20 bp, mouse
gactgtgaactgttagtggc

SEQ ID NO: 707439 - DNA, 20 bp, mouse
ggtgagcagaaacaaggtcg

SEQ ID NO: 707440 - DNA, 20 bp, mouse
ggcaggaagatgctactgat

SEQ ID NO: 707441 - DNA, 20 bp, mouse
gcaaggtcgtggtcctcaag

SEQ ID NO: 707442 - DNA, 20 bp, mouse
ggtggattgcatcaccatcc

SEQ ID NO: 707443 - DNA, 20 bp, mouse
gggctctaagaggggctctt

SEQ ID NO: 707444 - DNA, 20 bp, mouse
gaagatatttggaactctaa

SEQ ID NO: 707445 - DNA, 20 bp, mouse
ggcaatagcagcatttgcaa

SEQ ID NO: 707446 - DNA, 20 bp, mouse
ggacacatctccagttcccg

SEQ ID NO: 707447 - DNA, 20 bp, mouse
gtgctgagtgaggtgccacc

SEQ ID NO: 707448 - DNA, 20 bp, mouse
gtaaagtccactgctgagtg

SEQ ID NO: 707449 - DNA, 20 bp, mouse
gcaagtggagaaacagataa

SEQ ID NO: 707450 - DNA, 20 bp, mouse
gaccaggctgtgagctcctc

SEQ ID NO: 707451 - DNA, 20 bp, mouse
gctgtgagctcctcgggaac

SEQ ID NO: 707452 - DNA, 20 bp, mouse
gtctggttgaaatactgcct

SEQ ID NO: 707453 - DNA, 20 bp, mouse
gggagatgtgtccgtcctcc

SEQ ID NO: 707454 - DNA, 20 bp, mouse
gggcagtaaagccaggagga

SEQ ID NO: 707455 - DNA, 20 bp, mouse
gattgagttccatacttatc

SEQ ID NO: 707456 - DNA, 20 bp, mouse
ggtatcagtccttttaagtg

SEQ ID NO: 707457 - DNA, 20 bp, mouse
gaatcatagccacacttaaa

SEQ ID NO: 707458 - DNA, 20 bp, mouse
gaaaaatgaggttcaatact

SEQ ID NO: 707459 - DNA, 20 bp, mouse
gtaccagaaaatgagtgaca

SEQ ID NO: 707460 - DNA, 20 bp, mouse
gaggcgttcctctaggaaag

SEQ ID NO: 707461 - DNA, 20 bp, mouse
gtgacatggttttggaaatt

SEQ ID NO: 707462 - DNA, 20 bp, mouse
ggtttacaaggcgttcctct

SEQ ID NO: 707463 - DNA, 20 bp, mouse
gaccttgccctctttcctag

SEQ ID NO: 707464 - DNA, 20 bp, mouse
gtaaatgacattgaggtaca

SEQ ID NO: 707465 - DNA, 20 bp, mouse
gaatcaggtaaatgacattg

SEQ ID NO: 707466 - DNA, 20 bp, mouse
gctgatgtggaggaaactca

SEQ ID NO: 707467 - DNA, 20 bp, mouse
gaggcctggagatacaggtg

SEQ ID NO: 707468 - DNA, 20 bp, mouse
gtgacaggggactatcagtg

SEQ ID NO: 707469 - DNA, 20 bp, mouse
gtcagtggggccaatcacct

SEQ ID NO: 707470 - DNA, 20 bp, mouse
ggatctgtaaaaaggatatg

SEQ ID NO: 707471 - DNA, 20 bp, mouse
gaatcccagtgacagtccca

SEQ ID NO: 707472 - DNA, 20 bp, mouse
gtacaacttgtgctagccat

SEQ ID NO: 707473 - DNA, 20 bp, mouse
ggagagaggcctggagatac

SEQ ID NO: 707474 - DNA, 20 bp, mouse
gactcaaggaacatctgatg

SEQ ID NO: 707475 - DNA, 20 bp, mouse
ggtttctggtaggtcaccca

SEQ ID NO: 707476 - DNA, 20 bp, mouse
gcagagtggccagacaacca

SEQ ID NO: 707477 - DNA, 20 bp, mouse
ggcatgagacacgtcaccaa

SEQ ID NO: 707478 - DNA, 20 bp, mouse
ggggttcaggaaaaacacca

SEQ ID NO: 707479 - DNA, 20 bp, mouse
ggatccgaacgctctcccaa

SEQ ID NO: 707480 - DNA, 20 bp, mouse
gatggatgaggattctacat

SEQ ID NO: 707481 - DNA, 20 bp, mouse
ggtctggccactctggaggt

SEQ ID NO: 707482 - DNA, 20 bp, mouse
gaaagacaccgactgagcta

SEQ ID NO: 707483 - DNA, 20 bp, mouse
ggtctcatgccatgctgtgg

SEQ ID NO: 707484 - DNA, 20 bp, mouse
gccaaaggaagttgaagtcc

SEQ ID NO: 707485 - DNA, 20 bp, mouse
gtctgtacacaaacattacc

SEQ ID NO: 707486 - DNA, 20 bp, mouse
ggtacagcgaagtcttagga

SEQ ID NO: 707487 - DNA, 20 bp, mouse
ggatgcaggccagtgtgtga

SEQ ID NO: 707488 - DNA, 20 bp, mouse
gtgtgagggaactagagtac

SEQ ID NO: 707489 - DNA, 20 bp, mouse
gatgaggtcttataatacac

SEQ ID NO: 707490 - DNA, 20 bp, mouse
gtaggagggaagtgtgctgc

SEQ ID NO: 707491 - DNA, 20 bp, mouse
gcctggtagcctgtctctat

SEQ ID NO: 707492 - DNA, 20 bp, mouse
ggaagctagtgtttggaata

SEQ ID NO: 707493 - DNA, 20 bp, mouse
gtatatgggagaaataaatg

SEQ ID NO: 707494 - DNA, 20 bp, mouse
gacgggtcagtggtactcct

SEQ ID NO: 707495 - DNA, 20 bp, mouse
gaccactgacccgtcactgc

SEQ ID NO: 707496 - DNA, 20 bp, mouse
gtagcccgacctcccacctg

SEQ ID NO: 707497 - DNA, 20 bp, mouse
gcgaggccaccgggcagcaa

SEQ ID NO: 707498 - DNA, 20 bp, mouse
gtgcgtgacaggggactttc

SEQ ID NO: 707499 - DNA, 20 bp, mouse
ggcaactcatggtcacccca

SEQ ID NO: 707500 - DNA, 20 bp, mouse
gggtcaccccagggcgacgg

SEQ ID NO: 707501 - DNA, 20 bp, mouse
ggctgcccggtggcctcgga

SEQ ID NO: 707502 - DNA, 20 bp, mouse
ggtcgggctaggcggagctg

SEQ ID NO: 707503 - DNA, 20 bp, mouse
gcacctgcggtctggaacaa

SEQ ID NO: 707504 - DNA, 20 bp, mouse
gggtgggaggtcgggctagg

SEQ ID NO: 707505 - DNA, 20 bp, mouse
ggttccagaccgcaggtggg

SEQ ID NO: 707506 - DNA, 20 bp, mouse
gaagactcttcctcttcaag

SEQ ID NO: 707507 - DNA, 20 bp, mouse
gcaggtgtacgtcactgaat

SEQ ID NO: 707508 - DNA, 20 bp, mouse
gggaactcaaggcacagacc

SEQ ID NO: 707509 - DNA, 20 bp, mouse
ggctttgcctcttcactcgt

SEQ ID NO: 707510 - DNA, 20 bp, mouse
gaaatgctctattgtagtca

SEQ ID NO: 707511 - DNA, 20 bp, mouse
gtatgaacatgttgatctcc

SEQ ID NO: 707512 - DNA, 20 bp, mouse
gctgttaactgccatttctc

SEQ ID NO: 707513 - DNA, 20 bp, mouse
gattgattggttttttttac

SEQ ID NO: 707514 - DNA, 20 bp, mouse
ggtagtcaaggcattttaga

SEQ ID NO: 707515 - DNA, 20 bp, mouse
ggttgatctcctggaactca

SEQ ID NO: 707516 - DNA, 20 bp, mouse
gtgaagctcagagtctggac

SEQ ID NO: 707517 - DNA, 20 bp, mouse
gcagagtctggacaggttga

SEQ ID NO: 707518 - DNA, 20 bp, mouse
ggaagagccaggactctaac

SEQ ID NO: 707519 - DNA, 20 bp, mouse
ggaagggcccaaactgaatc

SEQ ID NO: 707520 - DNA, 20 bp, mouse
gtgagctgggccatggggag

SEQ ID NO: 707521 - DNA, 20 bp, mouse
gtcaatacctgttagagtcc

SEQ ID NO: 707522 - DNA, 20 bp, mouse
ggaaagaggggggctgaaag

SEQ ID NO: 707523 - DNA, 20 bp, mouse
ggactggcaagaatctgctt

SEQ ID NO: 707524 - DNA, 20 bp, mouse
ggatcagagaatttgggcaa

SEQ ID NO: 707525 - DNA, 20 bp, mouse
gatacagggatcagagaatt

SEQ ID NO: 707526 - DNA, 20 bp, mouse
gtgagagtgtggctcaccat

SEQ ID NO: 707527 - DNA, 20 bp, mouse
ggctaggggaacagcattgc

SEQ ID NO: 707528 - DNA, 20 bp, mouse
gtgggcagctgtggatgctc

SEQ ID NO: 707529 - DNA, 20 bp, mouse
ggtggctcaccatgggatgc

SEQ ID NO: 707530 - DNA, 20 bp, mouse
gccacagctgcccatggcta

SEQ ID NO: 707531 - DNA, 20 bp, mouse
ggctagctctgaaacagacc

SEQ ID NO: 707532 - DNA, 20 bp, mouse
gaacagcattgctgggatga

SEQ ID NO: 707533 - DNA, 20 bp, mouse
gtggtggagatccaacctga

SEQ ID NO: 707534 - DNA, 20 bp, mouse
gatgctgttcccctagccat

SEQ ID NO: 707535 - DNA, 20 bp, mouse
gaaggcacatccatcctgtt

SEQ ID NO: 707536 - DNA, 20 bp, mouse
gcggccaagcgccccttctg

SEQ ID NO: 707537 - DNA, 20 bp, mouse
ggaccctccacactgacaac

SEQ ID NO: 707538 - DNA, 20 bp, mouse
gccaagcgccccttctgcgg

SEQ ID NO: 707539 - DNA, 20 bp, mouse
gctgacaactggatgcagac

SEQ ID NO: 707540 - DNA, 20 bp, mouse
gaggcaatggactaacatgg

SEQ ID NO: 707541 - DNA, 20 bp, mouse
ggcacgacaagtctatgaaa

SEQ ID NO: 707542 - DNA, 20 bp, mouse
gtcagtgtggagggtctagt

SEQ ID NO: 707543 - DNA, 20 bp, mouse
gcaagcttgctgcgaggcac

SEQ ID NO: 707544 - DNA, 20 bp, mouse
gtgcagacaggactgactgc

SEQ ID NO: 707545 - DNA, 20 bp, mouse
gtgcagggacaactgcaatg

SEQ ID NO: 707546 - DNA, 20 bp, mouse
gggaaacagcatgtctgact

SEQ ID NO: 707547 - DNA, 20 bp, mouse
ggtctgactggggatggtac

SEQ ID NO: 707548 - DNA, 20 bp, mouse
gcagcatgtctgactgggga

SEQ ID NO: 707549 - DNA, 20 bp, mouse
gaaggtgggagactgaacac

SEQ ID NO: 707550 - DNA, 20 bp, mouse
gacaacagaaacttctccta

SEQ ID NO: 707551 - DNA, 20 bp, mouse
gtgccatggggaggaacatc

SEQ ID NO: 707552 - DNA, 20 bp, mouse
gcttctcctagggttgtcga

SEQ ID NO: 707553 - DNA, 20 bp, mouse
gcagggagctgctcctgata

SEQ ID NO: 707554 - DNA, 20 bp, mouse
ggcaggccctcgacaaccct

SEQ ID NO: 707555 - DNA, 20 bp, mouse
gatctggtcttctggagctt

SEQ ID NO: 707556 - DNA, 20 bp, mouse
gctaagacggggatcttgtg

SEQ ID NO: 707557 - DNA, 20 bp, mouse
gccgggtcacaattcatcga

SEQ ID NO: 707558 - DNA, 20 bp, mouse
gcaagatccccgtcttagtt

SEQ ID NO: 707559 - DNA, 20 bp, mouse
gtgaccaaagcagcttgccc

SEQ ID NO: 707560 - DNA, 20 bp, mouse
gtttctgtgggttgcctgtg

SEQ ID NO: 707561 - DNA, 20 bp, mouse
gtttcctgggcaagctgctt

SEQ ID NO: 707562 - DNA, 20 bp, mouse
gtatttggcttacaaatccc

SEQ ID NO: 707563 - DNA, 20 bp, mouse
gtgtgggttgcctgtgaggc

SEQ ID NO: 707564 - DNA, 20 bp, mouse
gtcggaaaaaacaaaagaga

SEQ ID NO: 707565 - DNA, 20 bp, mouse
ggaaaaaacaaaagagaggg

SEQ ID NO: 707566 - DNA, 20 bp, mouse
ggggcccagagagcccgctg

SEQ ID NO: 707567 - DNA, 20 bp, mouse
gaacgcgtgggctgacagag

SEQ ID NO: 707568 - DNA, 20 bp, mouse
gcagtaccgtgagaacgcgt

SEQ ID NO: 707569 - DNA, 20 bp, mouse
ggtggcctgtccatcaaccc

SEQ ID NO: 707570 - DNA, 20 bp, mouse
ggaagcccgcaggctgggag

SEQ ID NO: 707571 - DNA, 20 bp, mouse
gccaggagggaggctattac

SEQ ID NO: 707572 - DNA, 20 bp, mouse
ggatctcccagcttcagcta

SEQ ID NO: 707573 - DNA, 20 bp, mouse
gtccagccagcctgggttga

SEQ ID NO: 707574 - DNA, 20 bp, mouse
gccagcctgggttgatggac

SEQ ID NO: 707575 - DNA, 20 bp, mouse
ggaggcgtgggaaatgcggg

SEQ ID NO: 707576 - DNA, 20 bp, mouse
gaacacatgagcttccactc

SEQ ID NO: 707577 - DNA, 20 bp, mouse
gtcaagcaggaggctgcatg

SEQ ID NO: 707578 - DNA, 20 bp, mouse
gcctgcccaggtcaagcagg

SEQ ID NO: 707579 - DNA, 20 bp, mouse
gtgggaagaagaccagatct

SEQ ID NO: 707580 - DNA, 20 bp, mouse
gacccctgcccaggtcaagc

SEQ ID NO: 707581 - DNA, 20 bp, mouse
gatggaagcatgtgtctggg

SEQ ID NO: 707582 - DNA, 20 bp, mouse
gagcatgtgtctggggggtc

SEQ ID NO: 707583 - DNA, 20 bp, mouse
gtgcagcctcctgcttgacc

SEQ ID NO: 707584 - DNA, 20 bp, mouse
gcaggatttcctgggggaaa

SEQ ID NO: 707585 - DNA, 20 bp, mouse
gtgacaggaggcatgtgtag

SEQ ID NO: 707586 - DNA, 20 bp, mouse
gggtcacccagacaaacttg

SEQ ID NO: 707587 - DNA, 20 bp, mouse
gcacacacctcaagtttgtc

SEQ ID NO: 707588 - DNA, 20 bp, mouse
gggtgctagaaagcagacct

SEQ ID NO: 707589 - DNA, 20 bp, mouse
gagccaaagggtaaagaaga

SEQ ID NO: 707590 - DNA, 20 bp, mouse
ggctcaggagttaacaaacc

SEQ ID NO: 707591 - DNA, 20 bp, mouse
gccctgagatcggcgggagt

SEQ ID NO: 707592 - DNA, 20 bp, mouse
gaagaaggaatgacaaattc

SEQ ID NO: 707593 - DNA, 20 bp, mouse
gtaaattactaagttgagtg

SEQ ID NO: 707594 - DNA, 20 bp, mouse
gtcgtgggacccgtagcaac

SEQ ID NO: 707595 - DNA, 20 bp, mouse
gtgtgcggctgtggagtcgt

SEQ ID NO: 707596 - DNA, 20 bp, mouse
gtattatatggatcccggag

SEQ ID NO: 707597 - DNA, 20 bp, mouse
gttggtggctgattattata

SEQ ID NO: 707598 - DNA, 20 bp, mouse
gttaggcaaatggttacatc

SEQ ID NO: 707599 - DNA, 20 bp, mouse
gcagctctgaactttgtctc

SEQ ID NO: 707600 - DNA, 20 bp, mouse
gggcaaatggttacatctgg

SEQ ID NO: 707601 - DNA, 20 bp, mouse
ggtgaggccatgccaatgca

SEQ ID NO: 707602 - DNA, 20 bp, mouse
gtacagagactgctccactc

SEQ ID NO: 707603 - DNA, 20 bp, mouse
ggtctctggaagaccttcca

SEQ ID NO: 707604 - DNA, 20 bp, mouse
gctgattattatatggatcc

SEQ ID NO: 707605 - DNA, 20 bp, mouse
gtgcatggtaaatacaaaat

SEQ ID NO: 707606 - DNA, 20 bp, mouse
gagccccgagggtggactag

SEQ ID NO: 707607 - DNA, 20 bp, mouse
gcaccgggtagagaatgctg

SEQ ID NO: 707608 - DNA, 20 bp, mouse
gaagaaggaggggtacatcc

SEQ ID NO: 707609 - DNA, 20 bp, mouse
ggtagagaatgctggggcga

SEQ ID NO: 707610 - DNA, 20 bp, mouse
ggcttcaggccgttggaaca

SEQ ID NO: 707611 - DNA, 20 bp, mouse
gcagacagggggtcaccacc

SEQ ID NO: 707612 - DNA, 20 bp, mouse
gaccccgactcccccaccga

SEQ ID NO: 707613 - DNA, 20 bp, mouse
ggcgaaggatgctcagagca

SEQ ID NO: 707614 - DNA, 20 bp, mouse
gaggccgttggaacatggaa

SEQ ID NO: 707615 - DNA, 20 bp, mouse
gggggcgcgtccgtgggggt

SEQ ID NO: 707616 - DNA, 20 bp, mouse
ggcaactaagggccccaaat

SEQ ID NO: 707617 - DNA, 20 bp, mouse
ggtggcaccctggaagttag

SEQ ID NO: 707618 - DNA, 20 bp, mouse
gaataagatcgtcaatccaa

SEQ ID NO: 707619 - DNA, 20 bp, mouse
ggaaaattgagcctgaccct

SEQ ID NO: 707620 - DNA, 20 bp, mouse
gtcaagtaggtatgtatcct

SEQ ID NO: 707621 - DNA, 20 bp, mouse
gaagcagctaatggatttta

SEQ ID NO: 707622 - DNA, 20 bp, mouse
gtccccaaataatgcaacta

SEQ ID NO: 707623 - DNA, 20 bp, mouse
ggggtatttttatcctcttg

SEQ ID NO: 707624 - DNA, 20 bp, mouse
gacttccagggtgccactaa

SEQ ID NO: 707625 - DNA, 20 bp, mouse
gaagataagtgtaatcatgg

SEQ ID NO: 707626 - DNA, 20 bp, mouse
gcacttgctgacaggaactt

SEQ ID NO: 707627 - DNA, 20 bp, mouse
gaactcagggaccctgctca

SEQ ID NO: 707628 - DNA, 20 bp, mouse
gtggccctgtggaagggaga

SEQ ID NO: 707629 - DNA, 20 bp, mouse
gcaaggactggaggaactgt

SEQ ID NO: 707630 - DNA, 20 bp, mouse
gatggcaacagtgcctgctt

SEQ ID NO: 707631 - DNA, 20 bp, mouse
gttgagccagctccctgagc

SEQ ID NO: 707632 - DNA, 20 bp, mouse
gcctatctaaaagaagatca

SEQ ID NO: 707633 - DNA, 20 bp, mouse
gacctatgtatctggaccaa

SEQ ID NO: 707634 - DNA, 20 bp, mouse
gtgtctaatatcagtaggaa

SEQ ID NO: 707635 - DNA, 20 bp, mouse
gatctagtccttgaaagcac

SEQ ID NO: 707636 - DNA, 20 bp, mouse
gggtaaagagcagagcaggc

SEQ ID NO: 707637 - DNA, 20 bp, mouse
gtgtgtccaggtggtcctca

SEQ ID NO: 707638 - DNA, 20 bp, mouse
gagagagtgatgttgaagat

SEQ ID NO: 707639 - DNA, 20 bp, mouse
gcccaaaaatcacatcactg

SEQ ID NO: 707640 - DNA, 20 bp, mouse
gggagttcagtgtatgtttg

SEQ ID NO: 707641 - DNA, 20 bp, mouse
gcaaggccctgaggaccacc

SEQ ID NO: 707642 - DNA, 20 bp, mouse
gggaggtatagttcaatgaa

SEQ ID NO: 707643 - DNA, 20 bp, mouse
gaaaagtaagacctgaactc

SEQ ID NO: 707644 - DNA, 20 bp, mouse
ggcctcagtgatgtgatttt

SEQ ID NO: 707645 - DNA, 20 bp, mouse
gcttgggaggtagagacccg

SEQ ID NO: 707646 - DNA, 20 bp, mouse
ggcggcggggccgtgcgggg

SEQ ID NO: 707647 - DNA, 20 bp, mouse
gcgccccgggcctagatctc

SEQ ID NO: 707648 - DNA, 20 bp, mouse
gacagcacgcgaagcagcag

SEQ ID NO: 707649 - DNA, 20 bp, mouse
ggctgcttcgcgtgctgtag

SEQ ID NO: 707650 - DNA, 20 bp, mouse
gccagccccggttccctcgg

SEQ ID NO: 707651 - DNA, 20 bp, mouse
ggagcgcgctcgaccttgag

SEQ ID NO: 707652 - DNA, 20 bp, mouse
gcgggaactccttgagcgag

SEQ ID NO: 707653 - DNA, 20 bp, mouse
gcgcgcacgccgcccgccga

SEQ ID NO: 707654 - DNA, 20 bp, mouse
gcaggcgcaggcgcacggca

SEQ ID NO: 707655 - DNA, 20 bp, mouse
ggaccttcttcccccaacag

SEQ ID NO: 707656 - DNA, 20 bp, mouse
gtctacaacatgatccaagt

SEQ ID NO: 707657 - DNA, 20 bp, mouse
gtggatcatgttgtagacat

SEQ ID NO: 707658 - DNA, 20 bp, mouse
gttgcccccacaaacctact

SEQ ID NO: 707659 - DNA, 20 bp, mouse
gtttgtgggggcaaattaaa

SEQ ID NO: 707660 - DNA, 20 bp, mouse
gatgatccaagtaggtttgt

SEQ ID NO: 707661 - DNA, 20 bp, mouse
gagattcacaggcttcatag

SEQ ID NO: 707662 - DNA, 20 bp, mouse
gcacactgaatacattgggc

SEQ ID NO: 707663 - DNA, 20 bp, mouse
gcaaagaaattgagattcac

SEQ ID NO: 707664 - DNA, 20 bp, mouse
gtaaataataaggacgtgct

SEQ ID NO: 707665 - DNA, 20 bp, mouse
gcaaatggtgttaaataata

SEQ ID NO: 707666 - DNA, 20 bp, mouse
ggggccaagaagctcgggaa

SEQ ID NO: 707667 - DNA, 20 bp, mouse
gttgcagtttgctcactctg

SEQ ID NO: 707668 - DNA, 20 bp, mouse
gggtggtgagcagacattta

SEQ ID NO: 707669 - DNA, 20 bp, mouse
ggaacccttcccgagcttct

SEQ ID NO: 707670 - DNA, 20 bp, mouse
gatgaacccaatttgagagc

SEQ ID NO: 707671 - DNA, 20 bp, mouse
gcagtttgctcactctgtgg

SEQ ID NO: 707672 - DNA, 20 bp, mouse
gcaaatacttaacgaaaagt

SEQ ID NO: 707673 - DNA, 20 bp, mouse
gctcaagataatcacgcgca

SEQ ID NO: 707674 - DNA, 20 bp, mouse
gaaaagaactgatcatccac

SEQ ID NO: 707675 - DNA, 20 bp, mouse
gtcatatcgtgctctacaaa

SEQ ID NO: 707676 - DNA, 20 bp, mouse
gtggaaaaaaaaaactggtc

SEQ ID NO: 707677 - DNA, 20 bp, mouse
gcaaactgatctgttactgt

SEQ ID NO: 707678 - DNA, 20 bp, mouse
ggcgctccagcgatcctcgc

SEQ ID NO: 707679 - DNA, 20 bp, mouse
gcctgaaaacttagacatag

SEQ ID NO: 707680 - DNA, 20 bp, mouse
gtagacatagaggtttgtgc

SEQ ID NO: 707681 - DNA, 20 bp, mouse
gggagctacagctgcaggat

SEQ ID NO: 707682 - DNA, 20 bp, mouse
gttcctgttgggatctttga

SEQ ID NO: 707683 - DNA, 20 bp, mouse
ggatcagtttgagtcactaa

SEQ ID NO: 707684 - DNA, 20 bp, mouse
gttggctaacggatcccgcg

SEQ ID NO: 707685 - DNA, 20 bp, mouse
gagccatcaaagatcccaac

SEQ ID NO: 707686 - DNA, 20 bp, mouse
gctcaaggagattgtaagtt

SEQ ID NO: 707687 - DNA, 20 bp, mouse
ggagaaaagtacatgttgtg

SEQ ID NO: 707688 - DNA, 20 bp, mouse
gggagattgtaagtttggtc

SEQ ID NO: 707689 - DNA, 20 bp, mouse
gtggaggctgtagctgggga

SEQ ID NO: 707690 - DNA, 20 bp, mouse
gtggctttcttctactctca

SEQ ID NO: 707691 - DNA, 20 bp, mouse
gaagagctggaggctgtagc

SEQ ID NO: 707692 - DNA, 20 bp, mouse
gtgtggagttaaggtggcag

SEQ ID NO: 707693 - DNA, 20 bp, mouse
gtgtaaaacatgtattttta

SEQ ID NO: 707694 - DNA, 20 bp, mouse
ggctgggagagccaactttg

SEQ ID NO: 707695 - DNA, 20 bp, mouse
gcaactttgtggagttaagg

SEQ ID NO: 707696 - DNA, 20 bp, mouse
gaaatgtgaagttggattgt

SEQ ID NO: 707697 - DNA, 20 bp, mouse
gggttttggttgtatttgct

SEQ ID NO: 707698 - DNA, 20 bp, mouse
gaacggagaaaatgtgaagt

SEQ ID NO: 707699 - DNA, 20 bp, mouse
ggtgaagttggattgttgga

SEQ ID NO: 707700 - DNA, 20 bp, mouse
ggacagaaacagagagaaaa

SEQ ID NO: 707701 - DNA, 20 bp, mouse
gtggattgttggaaggatct

SEQ ID NO: 707702 - DNA, 20 bp, mouse
ggtagtaatttgtttctgtt

SEQ ID NO: 707703 - DNA, 20 bp, mouse
gggtgtgcgccaccaagccc

SEQ ID NO: 707704 - DNA, 20 bp, mouse
gatgttactgcttatttgtt

SEQ ID NO: 707705 - DNA, 20 bp, mouse
gatatgatatattctgatca

SEQ ID NO: 707706 - DNA, 20 bp, mouse
gagcacaggtgttattacgt

SEQ ID NO: 707707 - DNA, 20 bp, mouse
ggacaggagagtaacgcaga

SEQ ID NO: 707708 - DNA, 20 bp, mouse
ggtaggatgtagagtcactt

SEQ ID NO: 707709 - DNA, 20 bp, mouse
gggtgttattacgtggggac

SEQ ID NO: 707710 - DNA, 20 bp, mouse
gaggagagtaacgcagaagg

SEQ ID NO: 707711 - DNA, 20 bp, mouse
gtatcagctgatcctcatct

SEQ ID NO: 707712 - DNA, 20 bp, mouse
gacgcagaaggaggtttaag

SEQ ID NO: 707713 - DNA, 20 bp, mouse
gtgctcaggagtggtgaagt

SEQ ID NO: 707714 - DNA, 20 bp, mouse
ggtcacttgggtagatgctc

SEQ ID NO: 707715 - DNA, 20 bp, mouse
gtcgagcagcaagcagcaat

SEQ ID NO: 707716 - DNA, 20 bp, mouse
gtgctgaggcaagtatcatt

SEQ ID NO: 707717 - DNA, 20 bp, mouse
gatccacagtagccaattca

SEQ ID NO: 707718 - DNA, 20 bp, mouse
gcaaaaatggatataataca

SEQ ID NO: 707719 - DNA, 20 bp, mouse
gcaaagacatggaggtttgc

SEQ ID NO: 707720 - DNA, 20 bp, mouse
gttaggcagactccatgaat

SEQ ID NO: 707721 - DNA, 20 bp, mouse
gctccatgaattggctactg

SEQ ID NO: 707722 - DNA, 20 bp, mouse
ggtgcaggaggccgctcaag

SEQ ID NO: 707723 - DNA, 20 bp, mouse
ggaggggatttgaactgtgc

SEQ ID NO: 707724 - DNA, 20 bp, mouse
gtcagaagaggatattatgt

SEQ ID NO: 707725 - DNA, 20 bp, mouse
gacagttttgtttgggacaa

SEQ ID NO: 707726 - DNA, 20 bp, mouse
gtaccaacacatgatctagg

SEQ ID NO: 707727 - DNA, 20 bp, mouse
gtaagtggtgaaattcctgt

SEQ ID NO: 707728 - DNA, 20 bp, mouse
gtagatcatgtgttggtacg

SEQ ID NO: 707729 - DNA, 20 bp, mouse
gagcctcctagatcatgtgt

SEQ ID NO: 707730 - DNA, 20 bp, mouse
ggtggtgaaattcctgttgg

SEQ ID NO: 707731 - DNA, 20 bp, mouse
ggaggctgctgacctccaac

SEQ ID NO: 707732 - DNA, 20 bp, mouse
gtcgtagtaggcaaacaata

SEQ ID NO: 707733 - DNA, 20 bp, mouse
gtatggttctacattcttca

SEQ ID NO: 707734 - DNA, 20 bp, mouse
gaagtagtgggacttctaga

SEQ ID NO: 707735 - DNA, 20 bp, mouse
gtcaataaatggagacgtat

SEQ ID NO: 707736 - DNA, 20 bp, mouse
ggagagaccttacagttgta

SEQ ID NO: 707737 - DNA, 20 bp, mouse
gagactagaaatccggacaa

SEQ ID NO: 707738 - DNA, 20 bp, mouse
gacttctaagatatgaatgc

SEQ ID NO: 707739 - DNA, 20 bp, mouse
ggtcatcttagagttcatac

SEQ ID NO: 707740 - DNA, 20 bp, mouse
gctgtgacatatcctttgtc

SEQ ID NO: 707741 - DNA, 20 bp, mouse
gtgttcgaagatgtgagtcc

SEQ ID NO: 707742 - DNA, 20 bp, mouse
ggagaaaaaacatacaaatg

SEQ ID NO: 707743 - DNA, 20 bp, mouse
ggagagaccttatgtatgta

SEQ ID NO: 707744 - DNA, 20 bp, mouse
gagagaaaccatacaaatgt

SEQ ID NO: 707745 - DNA, 20 bp, mouse
ggagagaccttacagatgta

SEQ ID NO: 707746 - DNA, 20 bp, mouse
gcaccatgtgctcatgccat

SEQ ID NO: 707747 - DNA, 20 bp, mouse
gtggtgtcaagttttttcat

SEQ ID NO: 707748 - DNA, 20 bp, mouse
gtgcttcaaatggctgaagt

SEQ ID NO: 707749 - DNA, 20 bp, mouse
gttttttcatgggaccgaat

SEQ ID NO: 707750 - DNA, 20 bp, mouse
gagcttccataataactttg

SEQ ID NO: 707751 - DNA, 20 bp, mouse
ggtcagcacatgcgcagctt

SEQ ID NO: 707752 - DNA, 20 bp, mouse
gcttgctttgtttgccaatt

SEQ ID NO: 707753 - DNA, 20 bp, mouse
gtagctgtgtatcaaaaata

SEQ ID NO: 707754 - DNA, 20 bp, mouse
gcttgacaccaataataatg

SEQ ID NO: 707755 - DNA, 20 bp, mouse
gcaaaatacactgcttcaaa

SEQ ID NO: 707756 - DNA, 20 bp, mouse
gaatctgctaagtaagtgtc

SEQ ID NO: 707757 - DNA, 20 bp, mouse
gtgaaaatgaggagattgtt

SEQ ID NO: 707758 - DNA, 20 bp, mouse
ggaatgctgaacatactgtt

SEQ ID NO: 707759 - DNA, 20 bp, mouse
gtcttatggacaaatgttga

SEQ ID NO: 707760 - DNA, 20 bp, mouse
gtgtgcctggtgcctacaag

SEQ ID NO: 707761 - DNA, 20 bp, mouse
gtgaggacctaggtccaatt

SEQ ID NO: 707762 - DNA, 20 bp, mouse
gttggacaaagaagtgttaa

SEQ ID NO: 707763 - DNA, 20 bp, mouse
gtgtgttcccaattggacct

SEQ ID NO: 707764 - DNA, 20 bp, mouse
gttctggaataggagttaaa

SEQ ID NO: 707765 - DNA, 20 bp, mouse
gtttaggggcactgaaaatg

SEQ ID NO: 707766 - DNA, 20 bp, mouse
gggactatatttcagctcat

SEQ ID NO: 707767 - DNA, 20 bp, mouse
gcatatcttctggacagtta

SEQ ID NO: 707768 - DNA, 20 bp, mouse
gaatagtgacatggatatgg

SEQ ID NO: 707769 - DNA, 20 bp, mouse
gacaaatagtgacatggata

SEQ ID NO: 707770 - DNA, 20 bp, mouse
gtatcttatcccagtcagac

SEQ ID NO: 707771 - DNA, 20 bp, mouse
gattaaaaataaattctgaa

SEQ ID NO: 707772 - DNA, 20 bp, mouse
gtctaatgcttgaattacca

SEQ ID NO: 707773 - DNA, 20 bp, mouse
gcaattatgtatctgacagt

SEQ ID NO: 707774 - DNA, 20 bp, mouse
gaaactctgaggagaaagga

SEQ ID NO: 707775 - DNA, 20 bp, mouse
gctaactataccaaactctg

SEQ ID NO: 707776 - DNA, 20 bp, mouse
gcagggcgggaccatggtgc

SEQ ID NO: 707777 - DNA, 20 bp, mouse
gaagggagggtcacccattc

SEQ ID NO: 707778 - DNA, 20 bp, mouse
gccatggtcccgccctgaat

SEQ ID NO: 707779 - DNA, 20 bp, mouse
gagggtcacccattcagggc

SEQ ID NO: 707780 - DNA, 20 bp, mouse
gggcgggaccatggtgcagg

SEQ ID NO: 707781 - DNA, 20 bp, mouse
gtatagcagttgtgaaggga

SEQ ID NO: 707782 - DNA, 20 bp, mouse
gcatgccgttgctttctgaa

SEQ ID NO: 707783 - DNA, 20 bp, mouse
gaatacctgcagactggctc

SEQ ID NO: 707784 - DNA, 20 bp, mouse
gtcctcgtcctcctgcacca

SEQ ID NO: 707785 - DNA, 20 bp, mouse
gtagagggtatggggttcag

SEQ ID NO: 707786 - DNA, 20 bp, mouse
ggggcctcttgtaagtaaat

SEQ ID NO: 707787 - DNA, 20 bp, mouse
gtccccagggacatgtgggt

SEQ ID NO: 707788 - DNA, 20 bp, mouse
gcagaggaggaactaggcaa

SEQ ID NO: 707789 - DNA, 20 bp, mouse
ggtgctccccagggacatgt

SEQ ID NO: 707790 - DNA, 20 bp, mouse
gcagttaaaagattccactc

SEQ ID NO: 707791 - DNA, 20 bp, mouse
ggacgcataggtgctcccca

SEQ ID NO: 707792 - DNA, 20 bp, mouse
gctgtcaccgggcccgtccc

SEQ ID NO: 707793 - DNA, 20 bp, mouse
gtgaccagcagtgtgcacag

SEQ ID NO: 707794 - DNA, 20 bp, mouse
gaaaagattccactcagggc

SEQ ID NO: 707795 - DNA, 20 bp, mouse
gactaggcaaagggacgcat

SEQ ID NO: 707796 - DNA, 20 bp, mouse
gatgccgcggccaacctctg

SEQ ID NO: 707797 - DNA, 20 bp, mouse
gccgcggccaacctctgcgg

SEQ ID NO: 707798 - DNA, 20 bp, mouse
gcggccccggggctccgagc

SEQ ID NO: 707799 - DNA, 20 bp, mouse
gaggaccggtgtccccgccc

SEQ ID NO: 707800 - DNA, 20 bp, mouse
gccctggcctccatcgctac

SEQ ID NO: 707801 - DNA, 20 bp, mouse
ggctgcgtcagcctccgcag

SEQ ID NO: 707802 - DNA, 20 bp, mouse
gggcggcggctggacgaaac

SEQ ID NO: 707803 - DNA, 20 bp, mouse
ggcagcgactgtggggatag

SEQ ID NO: 707804 - DNA, 20 bp, mouse
ggcgccctgagaccctccaa

SEQ ID NO: 707805 - DNA, 20 bp, mouse
gggacggggcagcgactgtg

SEQ ID NO: 707806 - DNA, 20 bp, mouse
ggaggacagacaatccctaa

SEQ ID NO: 707807 - DNA, 20 bp, mouse
ggtagcggaacagttcttag

SEQ ID NO: 707808 - DNA, 20 bp, mouse
gaccaccagcactcagtgca

SEQ ID NO: 707809 - DNA, 20 bp, mouse
gtggacttctgggataggga

SEQ ID NO: 707810 - DNA, 20 bp, mouse
gggagagcagcagccctcgg

SEQ ID NO: 707811 - DNA, 20 bp, mouse
gtcagcagttacctgagaac

SEQ ID NO: 707812 - DNA, 20 bp, mouse
gctgagaactggcctggtag

SEQ ID NO: 707813 - DNA, 20 bp, mouse
gaccctgcactgagtgctgg

SEQ ID NO: 707814 - DNA, 20 bp, mouse
gagcactcagtgcagggtcc

SEQ ID NO: 707815 - DNA, 20 bp, mouse
ggtggaaagcagcttataat

SEQ ID NO: 707816 - DNA, 20 bp, mouse
gcctaaggagatatgggtaa

SEQ ID NO: 707817 - DNA, 20 bp, mouse
gccactaccaaagtccaggt

SEQ ID NO: 707818 - DNA, 20 bp, mouse
gacagctcatgggtgaaagc

SEQ ID NO: 707819 - DNA, 20 bp, mouse
gtataccactaccaaagtcc

SEQ ID NO: 707820 - DNA, 20 bp, mouse
gggattacctaaggagatat

SEQ ID NO: 707821 - DNA, 20 bp, mouse
ggtatagtaggctccttatt

SEQ ID NO: 707822 - DNA, 20 bp, mouse
gactttggtagtggtatagt

SEQ ID NO: 707823 - DNA, 20 bp, mouse
gggatgctatgagctgtcct

SEQ ID NO: 707824 - DNA, 20 bp, mouse
gcaacatactcacccaaata

SEQ ID NO: 707825 - DNA, 20 bp, mouse
gactgtatcatgagagtgcc

SEQ ID NO: 707826 - DNA, 20 bp, mouse
ggactggctggttgaggggt

SEQ ID NO: 707827 - DNA, 20 bp, mouse
gaaaggaagtagggatgatg

SEQ ID NO: 707828 - DNA, 20 bp, mouse
gtgggcttcagagtcagaaa

SEQ ID NO: 707829 - DNA, 20 bp, mouse
gggtgggcgtagtgtggtat

SEQ ID NO: 707830 - DNA, 20 bp, mouse
gcaagagactggctggttga

SEQ ID NO: 707831 - DNA, 20 bp, mouse
ggaggattgaaccaagagac

SEQ ID NO: 707832 - DNA, 20 bp, mouse
gtgaatggagggagttgtta

SEQ ID NO: 707833 - DNA, 20 bp, mouse
ggctatctcgggtgtaatgg

SEQ ID NO: 707834 - DNA, 20 bp, mouse
ggatgtgcttgctatatccc

SEQ ID NO: 707835 - DNA, 20 bp, mouse
gggaagtagggatgatgtgg

SEQ ID NO: 707836 - DNA, 20 bp, mouse
ggatgctagtggtctctctg

SEQ ID NO: 707837 - DNA, 20 bp, mouse
ggaaaaggggcacctgtgaa

SEQ ID NO: 707838 - DNA, 20 bp, mouse
gaggataagtgtgaggaatc

SEQ ID NO: 707839 - DNA, 20 bp, mouse
ggacctgttccttactttga

SEQ ID NO: 707840 - DNA, 20 bp, mouse
gatgacagagaaacatctga

SEQ ID NO: 707841 - DNA, 20 bp, mouse
gtggaagaagaagttatggc

SEQ ID NO: 707842 - DNA, 20 bp, mouse
gttgatggacaggatgctag

SEQ ID NO: 707843 - DNA, 20 bp, mouse
ggtgctttaggataagtgtg

SEQ ID NO: 707844 - DNA, 20 bp, mouse
gtcaatactgcagactcaac

SEQ ID NO: 707845 - DNA, 20 bp, mouse
gtctctgtcatcagtgcttt

SEQ ID NO: 707846 - DNA, 20 bp, mouse
ggcagcagagacagcaccca

SEQ ID NO: 707847 - DNA, 20 bp, mouse
gtccaagtcagagcagtgta

SEQ ID NO: 707848 - DNA, 20 bp, mouse
gctgacttggaaatgttgtg

SEQ ID NO: 707849 - DNA, 20 bp, mouse
gagcacccagggcttgtgaa

SEQ ID NO: 707850 - DNA, 20 bp, mouse
gtcagtaagagcaataatat

SEQ ID NO: 707851 - DNA, 20 bp, mouse
gctggcctttcacaagccct

SEQ ID NO: 707852 - DNA, 20 bp, mouse
ggtaaattctagatatcgcc

SEQ ID NO: 707853 - DNA, 20 bp, mouse
gttggaaatgttgtgaggtc

SEQ ID NO: 707854 - DNA, 20 bp, mouse
gtacccataatggatcaaat

SEQ ID NO: 707855 - DNA, 20 bp, mouse
gaaacctgagctagacattg

SEQ ID NO: 707856 - DNA, 20 bp, mouse
ggataggaaagaacctgatg

SEQ ID NO: 707857 - DNA, 20 bp, mouse
ggatgtggatcatcaaaccg

SEQ ID NO: 707858 - DNA, 20 bp, mouse
gtctttcctatcaagggcag

SEQ ID NO: 707859 - DNA, 20 bp, mouse
gtcaggttctttcctatcaa

SEQ ID NO: 707860 - DNA, 20 bp, mouse
gaggacagccgatagcctgt

SEQ ID NO: 707861 - DNA, 20 bp, mouse
gattagctccagttctgtat

SEQ ID NO: 707862 - DNA, 20 bp, mouse
ggcccatctcacaggataaa

SEQ ID NO: 707863 - DNA, 20 bp, mouse
gagaaatggtaccaaaccaa

SEQ ID NO: 707864 - DNA, 20 bp, mouse
gacactggcaacctttggtt

SEQ ID NO: 707865 - DNA, 20 bp, mouse
gaaataaaccgctcttccac

SEQ ID NO: 707866 - DNA, 20 bp, mouse
gtcctcccatgctgagtggc

SEQ ID NO: 707867 - DNA, 20 bp, mouse
gccatccagccactcagcat

SEQ ID NO: 707868 - DNA, 20 bp, mouse
ggctggatggcacaagcaag

SEQ ID NO: 707869 - DNA, 20 bp, mouse
gacaagcaagaggctctgat

SEQ ID NO: 707870 - DNA, 20 bp, mouse
gtccacttgaaaattgtctc

SEQ ID NO: 707871 - DNA, 20 bp, mouse
gaatgaagccagcagaggat

SEQ ID NO: 707872 - DNA, 20 bp, mouse
gtagctaaagctgagactag

SEQ ID NO: 707873 - DNA, 20 bp, mouse
ggccagagacaattttcaag

SEQ ID NO: 707874 - DNA, 20 bp, mouse
gagagcatagcaaataaatg

SEQ ID NO: 707875 - DNA, 20 bp, mouse
gtctgctggcttcattcctc

SEQ ID NO: 707876 - DNA, 20 bp, mouse
gtaatcagaggacaggactc

SEQ ID NO: 707877 - DNA, 20 bp, mouse
gttactatgaaataattctt

SEQ ID NO: 707878 - DNA, 20 bp, mouse
gattatttcatagtaatcag

SEQ ID NO: 707879 - DNA, 20 bp, mouse
gtttgttaggaggtcaaggc

SEQ ID NO: 707880 - DNA, 20 bp, mouse
gaatctattaaaatggtatc

SEQ ID NO: 707881 - DNA, 20 bp, mouse
gaaaatatttttttgttagg

SEQ ID NO: 707882 - DNA, 20 bp, mouse
gttcatagtaatcagaggac

SEQ ID NO: 707883 - DNA, 20 bp, mouse
gttaaaaatatttttttgtt

SEQ ID NO: 707884 - DNA, 20 bp, mouse
gttgtatgcagaaattttga

SEQ ID NO: 707885 - DNA, 20 bp, mouse
gttaaaaaaatctattaaaa

SEQ ID NO: 707886 - DNA, 20 bp, mouse
gcattcctactgagggtcct

SEQ ID NO: 707887 - DNA, 20 bp, mouse
gtccacccaggaccctcagt

SEQ ID NO: 707888 - DNA, 20 bp, mouse
gtcctactgagggtcctggg

SEQ ID NO: 707889 - DNA, 20 bp, mouse
gaaaacaaccagagctcagt

SEQ ID NO: 707890 - DNA, 20 bp, mouse
gggtcataaaatgtaaccat

SEQ ID NO: 707891 - DNA, 20 bp, mouse
ggtcaagggagcacccagtg

SEQ ID NO: 707892 - DNA, 20 bp, mouse
gtttgtgtgaggtaggtcaa

SEQ ID NO: 707893 - DNA, 20 bp, mouse
gtctaaaatatgattcaaca

SEQ ID NO: 707894 - DNA, 20 bp, mouse
gacacaagtatactcctcac

SEQ ID NO: 707895 - DNA, 20 bp, mouse
gcactgttattattttagga

SEQ ID NO: 707896 - DNA, 20 bp, mouse
gctaccgggaaatatttggt

SEQ ID NO: 707897 - DNA, 20 bp, mouse
gggactaaaaagattgcaca

SEQ ID NO: 707898 - DNA, 20 bp, mouse
gtagaacattacttcgacat

SEQ ID NO: 707899 - DNA, 20 bp, mouse
ggggaacaatttggtgacat

SEQ ID NO: 707900 - DNA, 20 bp, mouse
ggcacagggaagataagacc

SEQ ID NO: 707901 - DNA, 20 bp, mouse
gaagcctaccaaatatttcc

SEQ ID NO: 707902 - DNA, 20 bp, mouse
ggttgtaaattaagtcatga

SEQ ID NO: 707903 - DNA, 20 bp, mouse
gaactggagaattagctgca

SEQ ID NO: 707904 - DNA, 20 bp, mouse
gtccacatgaatgacttgtg

SEQ ID NO: 707905 - DNA, 20 bp, mouse
gaaagaactcatgatgtcac

SEQ ID NO: 707906 - DNA, 20 bp, mouse
gtggtcttgaggctcatgtg

SEQ ID NO: 707907 - DNA, 20 bp, mouse
gccaagtgttgggaatgact

SEQ ID NO: 707908 - DNA, 20 bp, mouse
gtggggtgatgcccttccag

SEQ ID NO: 707909 - DNA, 20 bp, mouse
ggttgacaaggttgtatccc

SEQ ID NO: 707910 - DNA, 20 bp, mouse
gaggatcacgagtcctaggc

SEQ ID NO: 707911 - DNA, 20 bp, mouse
gacaaggttgtatcccaggt

SEQ ID NO: 707912 - DNA, 20 bp, mouse
gaactctctagtcctctgga

SEQ ID NO: 707913 - DNA, 20 bp, mouse
gaggcaccaaaataatatgg

SEQ ID NO: 707914 - DNA, 20 bp, mouse
gatgagcctcaagaccaacc

SEQ ID NO: 707915 - DNA, 20 bp, mouse
ggatatgcaactatacttgg

SEQ ID NO: 707916 - DNA, 20 bp, mouse
ggacatgtcgagcagttagt

SEQ ID NO: 707917 - DNA, 20 bp, mouse
gtcgagcagttagttggtcg

SEQ ID NO: 707918 - DNA, 20 bp, mouse
gttcaggtgccgcctcttgc

SEQ ID NO: 707919 - DNA, 20 bp, mouse
ggctgtacagtgcccgcaag

SEQ ID NO: 707920 - DNA, 20 bp, mouse
gtgtgattactgtaatcata

SEQ ID NO: 707921 - DNA, 20 bp, mouse
ggggatgaatcgggatgagt

SEQ ID NO: 707922 - DNA, 20 bp, mouse
ggtacagtgcccgcaagagg

SEQ ID NO: 707923 - DNA, 20 bp, mouse
gtgtgaagcacggccggccc

SEQ ID NO: 707924 - DNA, 20 bp, mouse
gagccgaggccaataaagac

SEQ ID NO: 707925 - DNA, 20 bp, mouse
gaaagactggttttggtccc

SEQ ID NO: 707926 - DNA, 20 bp, mouse
gaggtagcaccaggagaaga

SEQ ID NO: 707927 - DNA, 20 bp, mouse
gtctagctgctgctacatct

SEQ ID NO: 707928 - DNA, 20 bp, mouse
gacagcgttagtcatggagt

SEQ ID NO: 707929 - DNA, 20 bp, mouse
gaggctctgcaacacaaagg

SEQ ID NO: 707930 - DNA, 20 bp, mouse
gcagctgcattctgggtatt

SEQ ID NO: 707931 - DNA, 20 bp, mouse
gcacaaccacagattctgga

SEQ ID NO: 707932 - DNA, 20 bp, mouse
gctcccacaaccacagattc

SEQ ID NO: 707933 - DNA, 20 bp, mouse
gggaggactgtcatcctaca

SEQ ID NO: 707934 - DNA, 20 bp, mouse
gtagagaacagcgttagtca

SEQ ID NO: 707935 - DNA, 20 bp, mouse
gaagaaatctgaacttcatt

SEQ ID NO: 707936 - DNA, 20 bp, mouse
gtatgtgctgtgctggtcat

SEQ ID NO: 707937 - DNA, 20 bp, mouse
gagaggggtgaggaagatgc

SEQ ID NO: 707938 - DNA, 20 bp, mouse
gtagctaatgcaactgttag

SEQ ID NO: 707939 - DNA, 20 bp, mouse
gaagactagccaatttcctt

SEQ ID NO: 707940 - DNA, 20 bp, mouse
gacacaagaggacgcatcac

SEQ ID NO: 707941 - DNA, 20 bp, mouse
gaatttccttaggaagacag

SEQ ID NO: 707942 - DNA, 20 bp, mouse
gcccttcaatttaaattttg

SEQ ID NO: 707943 - DNA, 20 bp, mouse
gtgtgttgtgtgacaagtgc

SEQ ID NO: 707944 - DNA, 20 bp, mouse
gccctcaaaatttaaattga

SEQ ID NO: 707945 - DNA, 20 bp, mouse
gcaactgttagtggcactgt

SEQ ID NO: 707946 - DNA, 20 bp, mouse
gactaggcaatgggtttcat

SEQ ID NO: 707947 - DNA, 20 bp, mouse
gcacccacatacattcaaat

SEQ ID NO: 707948 - DNA, 20 bp, mouse
gaccctatttgaatgtatgt

SEQ ID NO: 707949 - DNA, 20 bp, mouse
gaatgaagtgtacttctagg

SEQ ID NO: 707950 - DNA, 20 bp, mouse
gtacctgtttactaggcaat

SEQ ID NO: 707951 - DNA, 20 bp, mouse
gaacccattgcctagtaaac

SEQ ID NO: 707952 - DNA, 20 bp, mouse
gagggggaaaagattctacc

SEQ ID NO: 707953 - DNA, 20 bp, mouse
gagtatgatacctgtttact

SEQ ID NO: 707954 - DNA, 20 bp, mouse
gatcagctggaggcatttcc

SEQ ID NO: 707955 - DNA, 20 bp, mouse
gtatatataaaatggtgcat

SEQ ID NO: 707956 - DNA, 20 bp, mouse
gggcactgtcccatgtactg

SEQ ID NO: 707957 - DNA, 20 bp, mouse
ggactcgaggccacagtaca

SEQ ID NO: 707958 - DNA, 20 bp, mouse
gggaacgggcatttcaggtg

SEQ ID NO: 707959 - DNA, 20 bp, mouse
gagtcctgaggtcagactcg

SEQ ID NO: 707960 - DNA, 20 bp, mouse
gggcacagatcagtgctgtg

SEQ ID NO: 707961 - DNA, 20 bp, mouse
gctagtgtgagaatgaccta

SEQ ID NO: 707962 - DNA, 20 bp, mouse
ggctagggaacgggcatttc

SEQ ID NO: 707963 - DNA, 20 bp, mouse
gctcaggacttcgggatgac

SEQ ID NO: 707964 - DNA, 20 bp, mouse
gggatgggcgcacactgctg

SEQ ID NO: 707965 - DNA, 20 bp, mouse
ggtggggactggagaaagtg

SEQ ID NO: 707966 - DNA, 20 bp, mouse
gagttggaacccagagtctg

SEQ ID NO: 707967 - DNA, 20 bp, mouse
ggagtatggctcaggtgtat

SEQ ID NO: 707968 - DNA, 20 bp, mouse
ggagccatactccagcctgt

SEQ ID NO: 707969 - DNA, 20 bp, mouse
gaaaagattttaggttatga

SEQ ID NO: 707970 - DNA, 20 bp, mouse
gtgaaactatttatgcctac

SEQ ID NO: 707971 - DNA, 20 bp, mouse
gaggctcgccaatcagcttg

SEQ ID NO: 707972 - DNA, 20 bp, mouse
gagaagcagcaagctgtcgc

SEQ ID NO: 707973 - DNA, 20 bp, mouse
gtcaggtgtattggcctagc

SEQ ID NO: 707974 - DNA, 20 bp, mouse
gactatttatgcctacaggc

SEQ ID NO: 707975 - DNA, 20 bp, mouse
gttttattctgtgctggagt

SEQ ID NO: 707976 - DNA, 20 bp, mouse
gaaggactctggcttcatca

SEQ ID NO: 707977 - DNA, 20 bp, mouse
ggctgtcaagatttaagagg

SEQ ID NO: 707978 - DNA, 20 bp, mouse
ggccagaggatagaacagaa

SEQ ID NO: 707979 - DNA, 20 bp, mouse
gagacgagaagcctctctgg

SEQ ID NO: 707980 - DNA, 20 bp, mouse
gctggcttcatcaagggtgc

SEQ ID NO: 707981 - DNA, 20 bp, mouse
gtggaggaaacggctcacta

SEQ ID NO: 707982 - DNA, 20 bp, mouse
ggctcggcattcagtcagtc

SEQ ID NO: 707983 - DNA, 20 bp, mouse
gtctcctgtaatactcagtg

SEQ ID NO: 707984 - DNA, 20 bp, mouse
gagagaggcttctcgtctaa

SEQ ID NO: 707985 - DNA, 20 bp, mouse
gatactcagtgaggctatta

SEQ ID NO: 707986 - DNA, 20 bp, mouse
ggttaagagtaggtatgtgt

SEQ ID NO: 707987 - DNA, 20 bp, mouse
gatagcttgccgattctagt

SEQ ID NO: 707988 - DNA, 20 bp, mouse
gcacagagaaaagggatcac

SEQ ID NO: 707989 - DNA, 20 bp, mouse
gtctcaagaccgactagaat

SEQ ID NO: 707990 - DNA, 20 bp, mouse
ggctcacatgtgttaagagt

SEQ ID NO: 707991 - DNA, 20 bp, mouse
gagagaaccagtacataaaa

SEQ ID NO: 707992 - DNA, 20 bp, mouse
gtgactgctacataaaggtt

SEQ ID NO: 707993 - DNA, 20 bp, mouse
gaaatggagtatgatcagcc

SEQ ID NO: 707994 - DNA, 20 bp, mouse
gttatgtactggttctctcc

SEQ ID NO: 707995 - DNA, 20 bp, mouse
gaaacctgactgctacataa

SEQ ID NO: 707996 - DNA, 20 bp, mouse
gaagctgcaggctgtctcgc

SEQ ID NO: 707997 - DNA, 20 bp, mouse
gagaacacagtggctctcaa

SEQ ID NO: 707998 - DNA, 20 bp, mouse
gaccaccagcctgtgaggcg

SEQ ID NO: 707999 - DNA, 20 bp, mouse
gggcgtggcaaggagagcag

SEQ ID NO: 708000 - DNA, 20 bp, mouse
ggggatctgcgatggatgca

SEQ ID NO: 708001 - DNA, 20 bp, mouse
gcccgcccgggtcccaccag

SEQ ID NO: 708002 - DNA, 20 bp, mouse
ggtgctgccccaccggccat

SEQ ID NO: 708003 - DNA, 20 bp, mouse
gtctccttgccacgcctcac

SEQ ID NO: 708004 - DNA, 20 bp, mouse
gcagcctgtgaggcgtggca

SEQ ID NO: 708005 - DNA, 20 bp, mouse
gttccccgctggtgggaccc

SEQ ID NO: 708006 - DNA, 20 bp, mouse
ggagcaccactctccctcaa

SEQ ID NO: 708007 - DNA, 20 bp, mouse
gccagcctgcaagactgcag

SEQ ID NO: 708008 - DNA, 20 bp, mouse
gaacccagaggcgacagagt

SEQ ID NO: 708009 - DNA, 20 bp, mouse
ggggttgtgtggttattcca

SEQ ID NO: 708010 - DNA, 20 bp, mouse
ggtcctccccccaaagaggt

SEQ ID NO: 708011 - DNA, 20 bp, mouse
gcagagaaatatgtgagaga

SEQ ID NO: 708012 - DNA, 20 bp, mouse
gcagacctctgcagtcttgc

SEQ ID NO: 708013 - DNA, 20 bp, mouse
gagcagatccagtagacctg

SEQ ID NO: 708014 - DNA, 20 bp, mouse
gtgtgagagagggaacccag

SEQ ID NO: 708015 - DNA, 20 bp, mouse
gaataaccacacaacccttg

SEQ ID NO: 708016 - DNA, 20 bp, mouse
ggagggagttttcaccctac

SEQ ID NO: 708017 - DNA, 20 bp, mouse
gtggactaatctaggtcctt

SEQ ID NO: 708018 - DNA, 20 bp, mouse
gggttatagagatgaataca

SEQ ID NO: 708019 - DNA, 20 bp, mouse
ggaggcagacagataaacct

SEQ ID NO: 708020 - DNA, 20 bp, mouse
ggacatgattaatcctctaa

SEQ ID NO: 708021 - DNA, 20 bp, mouse
gatgccctgccctaggtgct

SEQ ID NO: 708022 - DNA, 20 bp, mouse
gccaacctctcggccccaga

SEQ ID NO: 708023 - DNA, 20 bp, mouse
gtgagagatagattgaaccc

SEQ ID NO: 708024 - DNA, 20 bp, mouse
gcacctagggcagggcatac

SEQ ID NO: 708025 - DNA, 20 bp, mouse
gaggaccctctggggccgag

SEQ ID NO: 708026 - DNA, 20 bp, mouse
gagcctagactccggtgtaa

SEQ ID NO: 708027 - DNA, 20 bp, mouse
gtgcacacctgaaaggaaaa

SEQ ID NO: 708028 - DNA, 20 bp, mouse
gagctctaacacaggcaatt

SEQ ID NO: 708029 - DNA, 20 bp, mouse
gtgtaccccagctctaacac

SEQ ID NO: 708030 - DNA, 20 bp, mouse
gagactccggtgtaagggaa

SEQ ID NO: 708031 - DNA, 20 bp, mouse
gtctacttctgagactttgc

SEQ ID NO: 708032 - DNA, 20 bp, mouse
gtcctctgtaatctctgaaa

SEQ ID NO: 708033 - DNA, 20 bp, mouse
gggtgtgcaaaaatgacttt

SEQ ID NO: 708034 - DNA, 20 bp, mouse
gcctagcccaaacctttaaa

SEQ ID NO: 708035 - DNA, 20 bp, mouse
gtagcttccaggccttttaa

SEQ ID NO: 708036 - DNA, 20 bp, mouse
gcccgcgcggctctgcagcc

SEQ ID NO: 708037 - DNA, 20 bp, mouse
ggcggcccctcagaagagcc

SEQ ID NO: 708038 - DNA, 20 bp, mouse
ggggccgcagctccgggaga

SEQ ID NO: 708039 - DNA, 20 bp, mouse
gaacggaaccggcggcccaa

SEQ ID NO: 708040 - DNA, 20 bp, mouse
ggttagtgccggggtccctt

SEQ ID NO: 708041 - DNA, 20 bp, mouse
gagttcaaacggactcagaa

SEQ ID NO: 708042 - DNA, 20 bp, mouse
gtgcagcccggctcttctga

SEQ ID NO: 708043 - DNA, 20 bp, mouse
gaaaccgcgaaagtttaatg

SEQ ID NO: 708044 - DNA, 20 bp, mouse
ggagacgctggaggacgaat

SEQ ID NO: 708045 - DNA, 20 bp, mouse
ggaggcacgcacctgctgca

SEQ ID NO: 708046 - DNA, 20 bp, mouse
gagggcggcgtgtgcctcaa

SEQ ID NO: 708047 - DNA, 20 bp, mouse
gaggcgggcgaagaaggcga

SEQ ID NO: 708048 - DNA, 20 bp, mouse
ggcggcgtgtgcctcaacgg

SEQ ID NO: 708049 - DNA, 20 bp, mouse
gcatgcgaggcgggcgaaga

SEQ ID NO: 708050 - DNA, 20 bp, mouse
gacggcctggtcgtcgacca

SEQ ID NO: 708051 - DNA, 20 bp, mouse
gaggccctgccggtggacgg

SEQ ID NO: 708052 - DNA, 20 bp, mouse
gggctcccgccaccgctgtt

SEQ ID NO: 708053 - DNA, 20 bp, mouse
gggcgggagcccatgcgagg

SEQ ID NO: 708054 - DNA, 20 bp, mouse
gaacgggggcgtgtgctccg

SEQ ID NO: 708055 - DNA, 20 bp, mouse
gacgagcctcccaacagcgg

SEQ ID NO: 708056 - DNA, 20 bp, mouse
ggggcaatccgtgttgaacg

SEQ ID NO: 708057 - DNA, 20 bp, mouse
gtgggacgactgtttaggga

SEQ ID NO: 708058 - DNA, 20 bp, mouse
gtctctgggacgactgttta

SEQ ID NO: 708059 - DNA, 20 bp, mouse
ggacctgctcgcctcgctcc

SEQ ID NO: 708060 - DNA, 20 bp, mouse
ggggggctgcaacttcctat

SEQ ID NO: 708061 - DNA, 20 bp, mouse
gataagtagagccctcttcc

SEQ ID NO: 708062 - DNA, 20 bp, mouse
gccaaggggaacaccagcat

SEQ ID NO: 708063 - DNA, 20 bp, mouse
ggaatgaagatgaatgtcat

SEQ ID NO: 708064 - DNA, 20 bp, mouse
ggttgaacgtggaaagcaag

SEQ ID NO: 708065 - DNA, 20 bp, mouse
gttgtaacccagggatctct

SEQ ID NO: 708066 - DNA, 20 bp, mouse
gatcctaaaaaagatcgtta

SEQ ID NO: 708067 - DNA, 20 bp, mouse
gaagatcgttagggttgaaa

SEQ ID NO: 708068 - DNA, 20 bp, mouse
gaaccctaacgatctttttt

SEQ ID NO: 708069 - DNA, 20 bp, mouse
ggatcttttttaggatattg

SEQ ID NO: 708070 - DNA, 20 bp, mouse
gtagggttgaaaaggatata

SEQ ID NO: 708071 - DNA, 20 bp, mouse
gttttttaggatattgtggc

SEQ ID NO: 708072 - DNA, 20 bp, mouse
ggttagcatagagataatgg

SEQ ID NO: 708073 - DNA, 20 bp, mouse
gtaatgggggcgttcctttg

SEQ ID NO: 708074 - DNA, 20 bp, mouse
gaatgtgcatcgatttgaat

SEQ ID NO: 708075 - DNA, 20 bp, mouse
gcacaggagccatgaggtct

SEQ ID NO: 708076 - DNA, 20 bp, mouse
gtcactttgcaaatgtagtt

SEQ ID NO: 708077 - DNA, 20 bp, mouse
gagtcaaagtctactcgaag

SEQ ID NO: 708078 - DNA, 20 bp, mouse
gagaaaagaattagatctta

SEQ ID NO: 708079 - DNA, 20 bp, mouse
gaatgaagttggaaacgcaa

SEQ ID NO: 708080 - DNA, 20 bp, mouse
gctcagatttactactgtca

SEQ ID NO: 708081 - DNA, 20 bp, mouse
ggcataaatgttctgtgagg

SEQ ID NO: 708082 - DNA, 20 bp, mouse
gaatagttctgggagtaaaa

SEQ ID NO: 708083 - DNA, 20 bp, mouse
gtcctatctttgaagacaac

SEQ ID NO: 708084 - DNA, 20 bp, mouse
gaaagaattcccaatgaagt

SEQ ID NO: 708085 - DNA, 20 bp, mouse
gagtatctcctaatagttct

SEQ ID NO: 708086 - DNA, 20 bp, mouse
gtaggcacgtcacccagcca

SEQ ID NO: 708087 - DNA, 20 bp, mouse
gcccagcaggagacacgggc

SEQ ID NO: 708088 - DNA, 20 bp, mouse
ggctttggggtgtcataggt

SEQ ID NO: 708089 - DNA, 20 bp, mouse
gtgtctgggatgttgttgtc

SEQ ID NO: 708090 - DNA, 20 bp, mouse
gtgttcccagcaggagacac

SEQ ID NO: 708091 - DNA, 20 bp, mouse
gagtgatggagcagtggctt

SEQ ID NO: 708092 - DNA, 20 bp, mouse
ggagtcctggcagccagcca

SEQ ID NO: 708093 - DNA, 20 bp, mouse
gacagagtggacagtgtcac

SEQ ID NO: 708094 - DNA, 20 bp, mouse
gccagggctactgagtatga

SEQ ID NO: 708095 - DNA, 20 bp, mouse
gagtatgagggtacagcggc

SEQ ID NO: 708096 - DNA, 20 bp, mouse
gcatggggctagctgaggac

SEQ ID NO: 708097 - DNA, 20 bp, mouse
gtgtcaagcacttagccatg

SEQ ID NO: 708098 - DNA, 20 bp, mouse
ggaagtcagcggaggtcttt

SEQ ID NO: 708099 - DNA, 20 bp, mouse
gcagaattataacctttcag

SEQ ID NO: 708100 - DNA, 20 bp, mouse
gtctttaggaaccccctgaa

SEQ ID NO: 708101 - DNA, 20 bp, mouse
gctgtcctttaacccagcta

SEQ ID NO: 708102 - DNA, 20 bp, mouse
gcaggctcaggatctggatt

SEQ ID NO: 708103 - DNA, 20 bp, mouse
gtaacccagctaaggcaggc

SEQ ID NO: 708104 - DNA, 20 bp, mouse
gaggatctggattaggtaca

SEQ ID NO: 708105 - DNA, 20 bp, mouse
gtgaaaacctcggggtcagt

SEQ ID NO: 708106 - DNA, 20 bp, mouse
gggcacgcgtgcacaaccct

SEQ ID NO: 708107 - DNA, 20 bp, mouse
ggggatctttaagaacccga

SEQ ID NO: 708108 - DNA, 20 bp, mouse
gaaccctcggaagggaccac

SEQ ID NO: 708109 - DNA, 20 bp, mouse
gatcccggtggtcccttccg

SEQ ID NO: 708110 - DNA, 20 bp, mouse
gtgcacgcgtgcccaaagga

SEQ ID NO: 708111 - DNA, 20 bp, mouse
gcgcgtgcacaaccctcgga

SEQ ID NO: 708112 - DNA, 20 bp, mouse
gaggcaaacaccatcccctc

SEQ ID NO: 708113 - DNA, 20 bp, mouse
ggggttcttaaagatcccgg

SEQ ID NO: 708114 - DNA, 20 bp, mouse
gggccccctaggaacacgca

SEQ ID NO: 708115 - DNA, 20 bp, mouse
gcatggcaagttgttcacag

SEQ ID NO: 708116 - DNA, 20 bp, mouse
gaattgagagggagacgcaa

SEQ ID NO: 708117 - DNA, 20 bp, mouse
gacctcatgtttcttcaaga

SEQ ID NO: 708118 - DNA, 20 bp, mouse
gtccatcttgaagaaacatg

SEQ ID NO: 708119 - DNA, 20 bp, mouse
gcccctgcatatagcaccca

SEQ ID NO: 708120 - DNA, 20 bp, mouse
gtgctcatgactttaatcag

SEQ ID NO: 708121 - DNA, 20 bp, mouse
gcatctatgcaaccaattcc

SEQ ID NO: 708122 - DNA, 20 bp, mouse
gagaatacaacttctgtgtc

SEQ ID NO: 708123 - DNA, 20 bp, mouse
gtccttgggtgctatatgca

SEQ ID NO: 708124 - DNA, 20 bp, mouse
gtttaatcagaggcacagga

SEQ ID NO: 708125 - DNA, 20 bp, mouse
gtgactttaatcagaggcac

SEQ ID NO: 708126 - DNA, 20 bp, mouse
gttaatccagaggcatagga

SEQ ID NO: 708127 - DNA, 20 bp, mouse
gcaaaaatattggacaagat

SEQ ID NO: 708128 - DNA, 20 bp, mouse
gcactttaatccagaggcat

SEQ ID NO: 708129 - DNA, 20 bp, mouse
gcatctatgaaaccgattcc

SEQ ID NO: 708130 - DNA, 20 bp, mouse
gatacaccttcctatgcctc

SEQ ID NO: 708131 - DNA, 20 bp, mouse
gatactactagtattttaat

SEQ ID NO: 708132 - DNA, 20 bp, mouse
gttaatgttgcaatttaaac

SEQ ID NO: 708133 - DNA, 20 bp, mouse
gatttataaagagttacaaa

SEQ ID NO: 708134 - DNA, 20 bp, mouse
gcccctgcaaatatcaccca

SEQ ID NO: 708135 - DNA, 20 bp, mouse
gttccttgggtgatatttgc

SEQ ID NO: 708136 - DNA, 20 bp, mouse
gtagaaattgaggagctcaa

SEQ ID NO: 708137 - DNA, 20 bp, mouse
ggactgatagaattttttgt

SEQ ID NO: 708138 - DNA, 20 bp, mouse
gtccttacttagcatcatcg

SEQ ID NO: 708139 - DNA, 20 bp, mouse
gtataaagcccacaaatttt

SEQ ID NO: 708140 - DNA, 20 bp, mouse
gtagagttcctaaaatttgt

SEQ ID NO: 708141 - DNA, 20 bp, mouse
gcttggggttcaaacatgga

SEQ ID NO: 708142 - DNA, 20 bp, mouse
ggaatgtctaaaactgaaag

SEQ ID NO: 708143 - DNA, 20 bp, mouse
gcaattctggtagctattga

SEQ ID NO: 708144 - DNA, 20 bp, mouse
gtcacttctttttggatttc

SEQ ID NO: 708145 - DNA, 20 bp, mouse
gtaataaaatgtagaaattg

SEQ ID NO: 708146 - DNA, 20 bp, mouse
gcctgctgagtgccctctga

SEQ ID NO: 708147 - DNA, 20 bp, mouse
ggaaatctcaagtgtttgac

SEQ ID NO: 708148 - DNA, 20 bp, mouse
gttgactggaatttacattc

SEQ ID NO: 708149 - DNA, 20 bp, mouse
gttgaaagaatcattcaaga

SEQ ID NO: 708150 - DNA, 20 bp, mouse
gtgtgaaaatcctgacgttt

SEQ ID NO: 708151 - DNA, 20 bp, mouse
gtgattgctcaacaaatata

SEQ ID NO: 708152 - DNA, 20 bp, mouse
gaactcattacttagtatcc

SEQ ID NO: 708153 - DNA, 20 bp, mouse
gggactttttacaaagatca

SEQ ID NO: 708154 - DNA, 20 bp, mouse
gggaatgagttgctcatagc

SEQ ID NO: 708155 - DNA, 20 bp, mouse
gctgtggatcgcctgggaca

SEQ ID NO: 708156 - DNA, 20 bp, mouse
ggcagctggagggtacaggc

SEQ ID NO: 708157 - DNA, 20 bp, mouse
gctgggcagctggagggtac

SEQ ID NO: 708158 - DNA, 20 bp, mouse
gattcctcagccatcatctg

SEQ ID NO: 708159 - DNA, 20 bp, mouse
gacaccccagatgatggctg

SEQ ID NO: 708160 - DNA, 20 bp, mouse
gactggactgacaaaagtta

SEQ ID NO: 708161 - DNA, 20 bp, mouse
gtcccatagcaccaccccaa

SEQ ID NO: 708162 - DNA, 20 bp, mouse
gcaccaccccaaaggacctg

SEQ ID NO: 708163 - DNA, 20 bp, mouse
ggaggaatctacatctttgt

SEQ ID NO: 708164 - DNA, 20 bp, mouse
ggacacagaatgtgtaccaa

SEQ ID NO: 708165 - DNA, 20 bp, mouse
ggtcctttggggtggtgcta

SEQ ID NO: 708166 - DNA, 20 bp, mouse
ggatctacaggttcaaagca

SEQ ID NO: 708167 - DNA, 20 bp, mouse
ggcagctggacgaggacaat

SEQ ID NO: 708168 - DNA, 20 bp, mouse
gctggcaaggcagctggacg

SEQ ID NO: 708169 - DNA, 20 bp, mouse
ggctgggtgatgtacattcg

SEQ ID NO: 708170 - DNA, 20 bp, mouse
ggggtgatgtacattcgagg

SEQ ID NO: 708171 - DNA, 20 bp, mouse
gggccaccttggctagctca

SEQ ID NO: 708172 - DNA, 20 bp, mouse
gccctgatggctttgtgttg

SEQ ID NO: 708173 - DNA, 20 bp, mouse
gtgtagatccatcctttggc

SEQ ID NO: 708174 - DNA, 20 bp, mouse
gcacagagcaccagtgcaca

SEQ ID NO: 708175 - DNA, 20 bp, mouse
gctgtcactgaagacagcac

SEQ ID NO: 708176 - DNA, 20 bp, mouse
gggtgaagtctttgtaacag

SEQ ID NO: 708177 - DNA, 20 bp, mouse
gagaaaagtacatactagac

SEQ ID NO: 708178 - DNA, 20 bp, mouse
gtctcacagactgctttagg

SEQ ID NO: 708179 - DNA, 20 bp, mouse
gaaacactatgaatgtaaaa

SEQ ID NO: 708180 - DNA, 20 bp, mouse
gcactatgaatgtaaaaagg

SEQ ID NO: 708181 - DNA, 20 bp, mouse
gctacattgctgatattcat

SEQ ID NO: 708182 - DNA, 20 bp, mouse
gttcaaagataacataaaaa

SEQ ID NO: 708183 - DNA, 20 bp, mouse
gcacatgaaaccattcatac

SEQ ID NO: 708184 - DNA, 20 bp, mouse
gtatgaatgtaaaaaggggg

SEQ ID NO: 708185 - DNA, 20 bp, mouse
ggtattgaaggtattaaata

SEQ ID NO: 708186 - DNA, 20 bp, mouse
gcccccgtggggaattggga

SEQ ID NO: 708187 - DNA, 20 bp, mouse
ggagcagagccaagacaaat

SEQ ID NO: 708188 - DNA, 20 bp, mouse
gagagcccccgtggggaatt

SEQ ID NO: 708189 - DNA, 20 bp, mouse
gtctgggcagcacatttcaa

SEQ ID NO: 708190 - DNA, 20 bp, mouse
ggggacgaggctttcttata

SEQ ID NO: 708191 - DNA, 20 bp, mouse
gaaagcctcgtcccgaggac

SEQ ID NO: 708192 - DNA, 20 bp, mouse
gtgaaggtggaacaggccaa

SEQ ID NO: 708193 - DNA, 20 bp, mouse
gtcctcccgtcctcgggacg

SEQ ID NO: 708194 - DNA, 20 bp, mouse
gtggagtctgtgtttctctc

SEQ ID NO: 708195 - DNA, 20 bp, mouse
ggacttccacccatttgtct

SEQ ID NO: 708196 - DNA, 20 bp, mouse
ggggaggagtctctgaacgt

SEQ ID NO: 708197 - DNA, 20 bp, mouse
ggggtggtgtacccaggaaa

SEQ ID NO: 708198 - DNA, 20 bp, mouse
ggggccccagtatacccatt

SEQ ID NO: 708199 - DNA, 20 bp, mouse
ggcccagcgcagactacaat

SEQ ID NO: 708200 - DNA, 20 bp, mouse
ggggcctgatgaggtgtccc

SEQ ID NO: 708201 - DNA, 20 bp, mouse
ggaccctaatgggtatactg

SEQ ID NO: 708202 - DNA, 20 bp, mouse
gggctgttgccaggagagtt

SEQ ID NO: 708203 - DNA, 20 bp, mouse
ggggtccttcctgagaggac

SEQ ID NO: 708204 - DNA, 20 bp, mouse
gggcggagacagtgagtgca

SEQ ID NO: 708205 - DNA, 20 bp, mouse
ggaggtgtccctgggggagt

SEQ ID NO: 708206 - DNA, 20 bp, mouse
gcggagtcggcgaggagaga

SEQ ID NO: 708207 - DNA, 20 bp, mouse
gctggccactcagacctctc

SEQ ID NO: 708208 - DNA, 20 bp, mouse
gttcacccgcgaccgggaag

SEQ ID NO: 708209 - DNA, 20 bp, mouse
ggtcggcgaggagagagggc

SEQ ID NO: 708210 - DNA, 20 bp, mouse
gggggccagcggggagctga

SEQ ID NO: 708211 - DNA, 20 bp, mouse
ggcccgacggaggacacaac

SEQ ID NO: 708212 - DNA, 20 bp, mouse
gtctgagtggccagactagt

SEQ ID NO: 708213 - DNA, 20 bp, mouse
gttggtcgatagcggggagt

SEQ ID NO: 708214 - DNA, 20 bp, mouse
gctcgccgactccgggttct

SEQ ID NO: 708215 - DNA, 20 bp, mouse
gtgagtggtttacaaatgag

SEQ ID NO: 708216 - DNA, 20 bp, mouse
gttggctcatgggatgttag

SEQ ID NO: 708217 - DNA, 20 bp, mouse
gtagaaaggtgttggctcat

SEQ ID NO: 708218 - DNA, 20 bp, mouse
gaagaagtctagaaaggtgt

SEQ ID NO: 708219 - DNA, 20 bp, mouse
gctcatgggatgttaggggc

SEQ ID NO: 708220 - DNA, 20 bp, mouse
gagtccttggagaatgcaat

SEQ ID NO: 708221 - DNA, 20 bp, mouse
gttcccctgctcatgtatca

SEQ ID NO: 708222 - DNA, 20 bp, mouse
gagtttgttttgtgctacga

SEQ ID NO: 708223 - DNA, 20 bp, mouse
gcactataagaagtctagaa

SEQ ID NO: 708224 - DNA, 20 bp, mouse
ggaaaccttgatacatgagc

SEQ ID NO: 708225 - DNA, 20 bp, mouse
gtccagaaagaagaattgga

SEQ ID NO: 708226 - DNA, 20 bp, mouse
gtagttgtgaccaacagtgg

SEQ ID NO: 708227 - DNA, 20 bp, mouse
ggtgaccaacagtggtggtt

SEQ ID NO: 708228 - DNA, 20 bp, mouse
gaacagtggtggttgggaag

SEQ ID NO: 708229 - DNA, 20 bp, mouse
gagtcctaaagagaaggttg

SEQ ID NO: 708230 - DNA, 20 bp, mouse
gggcaaggggaaatgctata

SEQ ID NO: 708231 - DNA, 20 bp, mouse
ggaagagaaaagctagagac

SEQ ID NO: 708232 - DNA, 20 bp, mouse
gaatgctataaggagtgtgg

SEQ ID NO: 708233 - DNA, 20 bp, mouse
gaggcagcttttggatttca

SEQ ID NO: 708234 - DNA, 20 bp, mouse
gaatcactgaaaaagcagaa

SEQ ID NO: 708235 - DNA, 20 bp, mouse
gttctctttaggactcagaa

SEQ ID NO: 708236 - DNA, 20 bp, mouse
gccgccccctgtgacgtcgc

SEQ ID NO: 708237 - DNA, 20 bp, mouse
gttccctcggttgtaggaca

SEQ ID NO: 708238 - DNA, 20 bp, mouse
gactactgaaacttttgggg

SEQ ID NO: 708239 - DNA, 20 bp, mouse
gcaacccgcgacgtcacagg

SEQ ID NO: 708240 - DNA, 20 bp, mouse
gaggaaccggaaattcagag

SEQ ID NO: 708241 - DNA, 20 bp, mouse
ggggttgcgtggcctcctaa

SEQ ID NO: 708242 - DNA, 20 bp, mouse
gaaaccctgtcctacaaccg

SEQ ID NO: 708243 - DNA, 20 bp, mouse
gtagcctctccagagtaaac

SEQ ID NO: 708244 - DNA, 20 bp, mouse
gacgcaacccgcgacgtcac

SEQ ID NO: 708245 - DNA, 20 bp, mouse
gttagctttccctcggttgt

SEQ ID NO: 708246 - DNA, 20 bp, mouse
gctgggcccgtgttaaggtg

SEQ ID NO: 708247 - DNA, 20 bp, mouse
ggaaacctgggcccgtgtta

SEQ ID NO: 708248 - DNA, 20 bp, mouse
gggcacttcctcatttgaaa

SEQ ID NO: 708249 - DNA, 20 bp, mouse
gaacttaccaggaggacaaa

SEQ ID NO: 708250 - DNA, 20 bp, mouse
gaagtgagggggaacttacc

SEQ ID NO: 708251 - DNA, 20 bp, mouse
gaagagacagccagaaacct

SEQ ID NO: 708252 - DNA, 20 bp, mouse
gcaaagggaagccttattcc

SEQ ID NO: 708253 - DNA, 20 bp, mouse
gtgagggggaacttaccagg

SEQ ID NO: 708254 - DNA, 20 bp, mouse
gcaaatgaggaagtgccaca

SEQ ID NO: 708255 - DNA, 20 bp, mouse
ggttcaccccaccttaacac

SEQ ID NO: 708256 - DNA, 20 bp, mouse
gcggttgcctagctctcccc

SEQ ID NO: 708257 - DNA, 20 bp, mouse
gagggtggaaagagctagca

SEQ ID NO: 708258 - DNA, 20 bp, mouse
gggaagctctgatctaggcc

SEQ ID NO: 708259 - DNA, 20 bp, mouse
ggcagagcacatgagggaaa

SEQ ID NO: 708260 - DNA, 20 bp, mouse
gagcttccatctaccatgag

SEQ ID NO: 708261 - DNA, 20 bp, mouse
gcacaaccgcagagcacatg

SEQ ID NO: 708262 - DNA, 20 bp, mouse
gcaggcaagaggtctgggag

SEQ ID NO: 708263 - DNA, 20 bp, mouse
ggctctctggaggaagctcc

SEQ ID NO: 708264 - DNA, 20 bp, mouse
gtccatctaccatgagaggc

SEQ ID NO: 708265 - DNA, 20 bp, mouse
gtagatggaagctctgatct

SEQ ID NO: 708266 - DNA, 20 bp, mouse
ggctccagagatctactcct

SEQ ID NO: 708267 - DNA, 20 bp, mouse
gccagcggcgaggggctccc

SEQ ID NO: 708268 - DNA, 20 bp, mouse
gccaccgaggggcacgtgga

SEQ ID NO: 708269 - DNA, 20 bp, mouse
gccgctggccggggagtcct

SEQ ID NO: 708270 - DNA, 20 bp, mouse
gggaacgcacgggtcggctc

SEQ ID NO: 708271 - DNA, 20 bp, mouse
gaggacgcggagtccggcca

SEQ ID NO: 708272 - DNA, 20 bp, mouse
gcgcgcagctcggggtgcac

SEQ ID NO: 708273 - DNA, 20 bp, mouse
gccgagctgcgcgctttccc

SEQ ID NO: 708274 - DNA, 20 bp, mouse
ggtgcggcaggacccaccga

SEQ ID NO: 708275 - DNA, 20 bp, mouse
gcccccccgctacgagatat

SEQ ID NO: 708276 - DNA, 20 bp, mouse
gcgggaaggaacagactcta

SEQ ID NO: 708277 - DNA, 20 bp, mouse
ggatgccagcggccccggga

SEQ ID NO: 708278 - DNA, 20 bp, mouse
gcccgcgctgttgctgtccg

SEQ ID NO: 708279 - DNA, 20 bp, mouse
gctaaccaagtgtgaggtga

SEQ ID NO: 708280 - DNA, 20 bp, mouse
gcagcagctaaccaagtgtg

SEQ ID NO: 708281 - DNA, 20 bp, mouse
ggccacgatgccagcggccc

SEQ ID NO: 708282 - DNA, 20 bp, mouse
gcccacggacagcaacagcg

SEQ ID NO: 708283 - DNA, 20 bp, mouse
gcacagcctgctgtcaccac

SEQ ID NO: 708284 - DNA, 20 bp, mouse
ggcacagcccatcgtgtcca

SEQ ID NO: 708285 - DNA, 20 bp, mouse
gtgtctgcaggaatagggac

SEQ ID NO: 708286 - DNA, 20 bp, mouse
gaagccacctcatccttgaa

SEQ ID NO: 708287 - DNA, 20 bp, mouse
gcagccacaggggtcccatg

SEQ ID NO: 708288 - DNA, 20 bp, mouse
gcctgtggtgagtatagaaa

SEQ ID NO: 708289 - DNA, 20 bp, mouse
gaccgcgttcacgggccctg

SEQ ID NO: 708290 - DNA, 20 bp, mouse
ggtgaggtccgatcttaaga

SEQ ID NO: 708291 - DNA, 20 bp, mouse
gtggctggctggtcttgagg

SEQ ID NO: 708292 - DNA, 20 bp, mouse
gtgtgaatataccctaaagg

SEQ ID NO: 708293 - DNA, 20 bp, mouse
gaagatggaagagttgagcg

SEQ ID NO: 708294 - DNA, 20 bp, mouse
ggaagagttgagcggggctg

SEQ ID NO: 708295 - DNA, 20 bp, mouse
ggggttgcttctcctctaga

SEQ ID NO: 708296 - DNA, 20 bp, mouse
gcgtctgtatggcttctcat

SEQ ID NO: 708297 - DNA, 20 bp, mouse
gctacgcatgcatgcaatgt

SEQ ID NO: 708298 - DNA, 20 bp, mouse
gcatacagacgcaatgagtg

SEQ ID NO: 708299 - DNA, 20 bp, mouse
ggtatcaggaaactcaccaa

SEQ ID NO: 708300 - DNA, 20 bp, mouse
gctgtagggcttctcaccat

SEQ ID NO: 708301 - DNA, 20 bp, mouse
ggagtgtggaaaatcttcca

SEQ ID NO: 708302 - DNA, 20 bp, mouse
ggaatgctgtgactgtggag

SEQ ID NO: 708303 - DNA, 20 bp, mouse
gccaaaacttgtgccgtatc

SEQ ID NO: 708304 - DNA, 20 bp, mouse
gtatgctgatgtattaatga

SEQ ID NO: 708305 - DNA, 20 bp, mouse
gtacctgtgttctgaatgta

SEQ ID NO: 708306 - DNA, 20 bp, mouse
ggggacctgggtgacatccg

SEQ ID NO: 708307 - DNA, 20 bp, mouse
gagcagtgtgggatgggtca

SEQ ID NO: 708308 - DNA, 20 bp, mouse
gctggcttcaagccctctga

SEQ ID NO: 708309 - DNA, 20 bp, mouse
gactgctcatgtggggacct

SEQ ID NO: 708310 - DNA, 20 bp, mouse
gcagcagcatgaagtgcgcc

SEQ ID NO: 708311 - DNA, 20 bp, mouse
ggggacccacggttcacagt

SEQ ID NO: 708312 - DNA, 20 bp, mouse
ggcactccattccccacaca

SEQ ID NO: 708313 - DNA, 20 bp, mouse
ggcagtatgttaccttcaga

SEQ ID NO: 708314 - DNA, 20 bp, mouse
ggctaggtgaagaatatatg

SEQ ID NO: 708315 - DNA, 20 bp, mouse
ggctgagggtcactgatata

SEQ ID NO: 708316 - DNA, 20 bp, mouse
gtaactaatccgctatgcac

SEQ ID NO: 708317 - DNA, 20 bp, mouse
gcgtgattcagaactgatac

SEQ ID NO: 708318 - DNA, 20 bp, mouse
gggatagttccagtgcatag

SEQ ID NO: 708319 - DNA, 20 bp, mouse
gaggtcccagtgtccaaaac

SEQ ID NO: 708320 - DNA, 20 bp, mouse
gcatagcggattagttaact

SEQ ID NO: 708321 - DNA, 20 bp, mouse
ggctactaaaccaaagttaa

SEQ ID NO: 708322 - DNA, 20 bp, mouse
gatactctataacgaatcaa

SEQ ID NO: 708323 - DNA, 20 bp, mouse
gttagttaactgggcttttc

SEQ ID NO: 708324 - DNA, 20 bp, mouse
gccatcagcattgaaattag

SEQ ID NO: 708325 - DNA, 20 bp, mouse
ggtggtcctgttttggacac

SEQ ID NO: 708326 - DNA, 20 bp, mouse
ggcgccctgaagtgcgtctc

SEQ ID NO: 708327 - DNA, 20 bp, mouse
gagggctcggatgtcactga

SEQ ID NO: 708328 - DNA, 20 bp, mouse
ggatgtcactgagggatcgc

SEQ ID NO: 708329 - DNA, 20 bp, mouse
gcagcccgagacgcacttca

SEQ ID NO: 708330 - DNA, 20 bp, mouse
gcacaggtacgcagcgggac

SEQ ID NO: 708331 - DNA, 20 bp, mouse
gtctccggccgcagcagggg

SEQ ID NO: 708332 - DNA, 20 bp, mouse
ggaggggccggagtctggag

SEQ ID NO: 708333 - DNA, 20 bp, mouse
gacgcagcgggaccgggtga

SEQ ID NO: 708334 - DNA, 20 bp, mouse
gtgctgcggccggagactgg

SEQ ID NO: 708335 - DNA, 20 bp, mouse
gagggtcggggcggcgacag

SEQ ID NO: 708336 - DNA, 20 bp, mouse
gggaactgacagggtagtga

SEQ ID NO: 708337 - DNA, 20 bp, mouse
gtggcattaccagaagcttc

SEQ ID NO: 708338 - DNA, 20 bp, mouse
gggagtgtttggaactgaca

SEQ ID NO: 708339 - DNA, 20 bp, mouse
gtgacagggtagtgaaggta

SEQ ID NO: 708340 - DNA, 20 bp, mouse
gaaccacccggacctgtggt

SEQ ID NO: 708341 - DNA, 20 bp, mouse
gtactctcccaccacaggtc

SEQ ID NO: 708342 - DNA, 20 bp, mouse
gggagagtaagaaactctca

SEQ ID NO: 708343 - DNA, 20 bp, mouse
gccacaaccacccggacctg

SEQ ID NO: 708344 - DNA, 20 bp, mouse
gctcccaccacaggtccggg

SEQ ID NO: 708345 - DNA, 20 bp, mouse
ggctctccagctgcaaggga

SEQ ID NO: 708346 - DNA, 20 bp, mouse
gtgagctagaaatagagtct

SEQ ID NO: 708347 - DNA, 20 bp, mouse
ggtggccggagaaaggaata

SEQ ID NO: 708348 - DNA, 20 bp, mouse
ggactgtgtgtgactagcta

SEQ ID NO: 708349 - DNA, 20 bp, mouse
ggggatagcaaatacaagga

SEQ ID NO: 708350 - DNA, 20 bp, mouse
gtagaacggtggccggagaa

SEQ ID NO: 708351 - DNA, 20 bp, mouse
ggctcactacacattcgaag

SEQ ID NO: 708352 - DNA, 20 bp, mouse
ggacaaaggacccagatgca

SEQ ID NO: 708353 - DNA, 20 bp, mouse
gccagagatggattctggat

SEQ ID NO: 708354 - DNA, 20 bp, mouse
gattcgaagaggcagatgtg

SEQ ID NO: 708355 - DNA, 20 bp, mouse
gttgcattgtgggagcagga

SEQ ID NO: 708356 - DNA, 20 bp, mouse
gcccgccccgcgttactgga

SEQ ID NO: 708357 - DNA, 20 bp, mouse
gggcgcgcccgggatggcgg

SEQ ID NO: 708358 - DNA, 20 bp, mouse
ggggaagcgggtccgggcgg

SEQ ID NO: 708359 - DNA, 20 bp, mouse
gggcgcgcccagcaactagc

SEQ ID NO: 708360 - DNA, 20 bp, mouse
gttacgggaagccacaagaa

SEQ ID NO: 708361 - DNA, 20 bp, mouse
gcgttactggaaggactgtg

SEQ ID NO: 708362 - DNA, 20 bp, mouse
gccaaggcctccgccatccc

SEQ ID NO: 708363 - DNA, 20 bp, mouse
gatgctctgcagacgtctgg

SEQ ID NO: 708364 - DNA, 20 bp, mouse
gcccgaaggcgcgctcccgg

SEQ ID NO: 708365 - DNA, 20 bp, mouse
gcgagggcgcgaggttgcgc

SEQ ID NO: 708366 - DNA, 20 bp, mouse
gtgcgtgcgcatgacgcggg

SEQ ID NO: 708367 - DNA, 20 bp, mouse
ggggcgcagggcgacgctgg

SEQ ID NO: 708368 - DNA, 20 bp, mouse
gaggctgcgtgtgccggagc

SEQ ID NO: 708369 - DNA, 20 bp, mouse
gcctccagcggcaacaacaa

SEQ ID NO: 708370 - DNA, 20 bp, mouse
gcgggggcgcagggcgacgc

SEQ ID NO: 708371 - DNA, 20 bp, mouse
gcggccagcacgcggttctt

SEQ ID NO: 708372 - DNA, 20 bp, mouse
ggcggtgcgtgcgcatgacg

SEQ ID NO: 708373 - DNA, 20 bp, mouse
gcggccccacccacccgcgt

SEQ ID NO: 708374 - DNA, 20 bp, mouse
gaaggcgcttgcgagagagg

SEQ ID NO: 708375 - DNA, 20 bp, mouse
gcggccgcgccttctggcct

SEQ ID NO: 708376 - DNA, 20 bp, mouse
gagggcttttgcaacaagca

SEQ ID NO: 708377 - DNA, 20 bp, mouse
gtttcatctgtaatattgct

SEQ ID NO: 708378 - DNA, 20 bp, mouse
ggatccctgcctgagccttg

SEQ ID NO: 708379 - DNA, 20 bp, mouse
gagcagctctcagcctgtct

SEQ ID NO: 708380 - DNA, 20 bp, mouse
gtggagtcatccaccattgc

SEQ ID NO: 708381 - DNA, 20 bp, mouse
gctgcacattgtcctcttgt

SEQ ID NO: 708382 - DNA, 20 bp, mouse
ggttattctaatcatacaac

SEQ ID NO: 708383 - DNA, 20 bp, mouse
ggccaaggatgccagtgggt

SEQ ID NO: 708384 - DNA, 20 bp, mouse
gagaacacatacccacccac

SEQ ID NO: 708385 - DNA, 20 bp, mouse
gtgcctgagccttgagggaa

SEQ ID NO: 708386 - DNA, 20 bp, mouse
gaggagggtacgtgcgctca

SEQ ID NO: 708387 - DNA, 20 bp, mouse
ggcttcttaaggctgtgaga

SEQ ID NO: 708388 - DNA, 20 bp, mouse
ggcacgtaccctccttgcct

SEQ ID NO: 708389 - DNA, 20 bp, mouse
gagggataaaggataaaggc

SEQ ID NO: 708390 - DNA, 20 bp, mouse
gcttaagaagccagggataa

SEQ ID NO: 708391 - DNA, 20 bp, mouse
gtcacagccttaagaagcca

SEQ ID NO: 708392 - DNA, 20 bp, mouse
gagccagggataaaggataa

SEQ ID NO: 708393 - DNA, 20 bp, mouse
ggaggatttcactgtcttgc

SEQ ID NO: 708394 - DNA, 20 bp, mouse
gagcggaggcctaggcaagg

SEQ ID NO: 708395 - DNA, 20 bp, mouse
gttctggtgggggactcagg

SEQ ID NO: 708396 - DNA, 20 bp, mouse
gcgcccagaaatggatgctg

SEQ ID NO: 708397 - DNA, 20 bp, mouse
ggcagaacagagctgtttcg

SEQ ID NO: 708398 - DNA, 20 bp, mouse
gctgactgttgggtggaaat

SEQ ID NO: 708399 - DNA, 20 bp, mouse
gtgcatggaactctgcaaga

SEQ ID NO: 708400 - DNA, 20 bp, mouse
gttgacagagcactgaatga

SEQ ID NO: 708401 - DNA, 20 bp, mouse
gcagtcagcacgcccagaaa

SEQ ID NO: 708402 - DNA, 20 bp, mouse
ggggcgtgctgactgttggg

SEQ ID NO: 708403 - DNA, 20 bp, mouse
ggcaagatggcagagagcga

SEQ ID NO: 708404 - DNA, 20 bp, mouse
gtggcagagagcgaaggcaa

SEQ ID NO: 708405 - DNA, 20 bp, mouse
gcctgtgctcctggaagctc

SEQ ID NO: 708406 - DNA, 20 bp, mouse
gaacttggcagatgccataa

SEQ ID NO: 708407 - DNA, 20 bp, mouse
ggtggtggagtagaagaagc

SEQ ID NO: 708408 - DNA, 20 bp, mouse
ggagatgactaagatttaat

SEQ ID NO: 708409 - DNA, 20 bp, mouse
gaccaaatagtcttgtgaga

SEQ ID NO: 708410 - DNA, 20 bp, mouse
gtcacaagactatttggtgg

SEQ ID NO: 708411 - DNA, 20 bp, mouse
gtgtactattactaaagtca

SEQ ID NO: 708412 - DNA, 20 bp, mouse
ggtaacaaatgtgacaaatt

SEQ ID NO: 708413 - DNA, 20 bp, mouse
gcaaagtgtgtgttcaggga

SEQ ID NO: 708414 - DNA, 20 bp, mouse
gaggtaaaagtgaacagtga

SEQ ID NO: 708415 - DNA, 20 bp, mouse
gcacagactatgagtgacaa

SEQ ID NO: 708416 - DNA, 20 bp, mouse
gaacccagttgttttggaga

SEQ ID NO: 708417 - DNA, 20 bp, mouse
ggggttgccagtggctcggt

SEQ ID NO: 708418 - DNA, 20 bp, mouse
gaaaacaactgggttgccag

SEQ ID NO: 708419 - DNA, 20 bp, mouse
gccagtggctcggttggtaa

SEQ ID NO: 708420 - DNA, 20 bp, mouse
gtgtcacaatgaacatgtgc

SEQ ID NO: 708421 - DNA, 20 bp, mouse
gaaccctctccaaaacaact

SEQ ID NO: 708422 - DNA, 20 bp, mouse
gtactacctgaatctgatcc

SEQ ID NO: 708423 - DNA, 20 bp, mouse
ggactcatttattgggagtg

SEQ ID NO: 708424 - DNA, 20 bp, mouse
gttaaatagactcatttatt

SEQ ID NO: 708425 - DNA, 20 bp, mouse
ggagtctatttaaaaagtct

SEQ ID NO: 708426 - DNA, 20 bp, mouse
ggaagagaagatctgagtgg

SEQ ID NO: 708427 - DNA, 20 bp, mouse
gtctgagtggaggtagagaa

SEQ ID NO: 708428 - DNA, 20 bp, mouse
gcagcaaaggagaaagtgac

SEQ ID NO: 708429 - DNA, 20 bp, mouse
gtgactgttgcggtgcgaat

SEQ ID NO: 708430 - DNA, 20 bp, mouse
gttgcggtgcgaatgggctg

SEQ ID NO: 708431 - DNA, 20 bp, mouse
gagataaaatgaagtggata

SEQ ID NO: 708432 - DNA, 20 bp, mouse
gatccagatggactgctccc

SEQ ID NO: 708433 - DNA, 20 bp, mouse
gcgcaccgcaacagtcacag

SEQ ID NO: 708434 - DNA, 20 bp, mouse
gggggtccagttgcatatag

SEQ ID NO: 708435 - DNA, 20 bp, mouse
ggggataactcttgtctctt

SEQ ID NO: 708436 - DNA, 20 bp, mouse
ggatgctcctatgtctgcac

SEQ ID NO: 708437 - DNA, 20 bp, mouse
gcacataagtgtgggaaatg

SEQ ID NO: 708438 - DNA, 20 bp, mouse
ggacataggagcatccacac

SEQ ID NO: 708439 - DNA, 20 bp, mouse
gagagaaaccacataagtgt

SEQ ID NO: 708440 - DNA, 20 bp, mouse
gcacagatgctgtaaggaca

SEQ ID NO: 708441 - DNA, 20 bp, mouse
gtgtttaatgagccttgagg

SEQ ID NO: 708442 - DNA, 20 bp, mouse
ggcaaggttcttctccagtg

SEQ ID NO: 708443 - DNA, 20 bp, mouse
gcttatgtggtttctcttca

SEQ ID NO: 708444 - DNA, 20 bp, mouse
gtataaagtgcatcatggga

SEQ ID NO: 708445 - DNA, 20 bp, mouse
gaataaccacagatgctgta

SEQ ID NO: 708446 - DNA, 20 bp, mouse
gaccgtcgcggggacccaga

SEQ ID NO: 708447 - DNA, 20 bp, mouse
gctggggcccggaagtgtac

SEQ ID NO: 708448 - DNA, 20 bp, mouse
gcccccgccctgtacacttc

SEQ ID NO: 708449 - DNA, 20 bp, mouse
gtcgaagcccgaagctccac

SEQ ID NO: 708450 - DNA, 20 bp, mouse
gtccctctgggtccccgcga

SEQ ID NO: 708451 - DNA, 20 bp, mouse
gatgatgccggtaagcgggt

SEQ ID NO: 708452 - DNA, 20 bp, mouse
ggcccggaagtgtacagggc

SEQ ID NO: 708453 - DNA, 20 bp, mouse
gccgagcagaagtgacccga

SEQ ID NO: 708454 - DNA, 20 bp, mouse
gttcgggcttcgaggctctg

SEQ ID NO: 708455 - DNA, 20 bp, mouse
gggaagcgggggtctggcgg

SEQ ID NO: 708456 - DNA, 20 bp, mouse
gccgcgagccgcgaccggtg

SEQ ID NO: 708457 - DNA, 20 bp, mouse
ggcaccgcctcgcggggaag

SEQ ID NO: 708458 - DNA, 20 bp, mouse
gcgactctgcggccatgtgc

SEQ ID NO: 708459 - DNA, 20 bp, mouse
ggaacgagccgcaccggtcg

SEQ ID NO: 708460 - DNA, 20 bp, mouse
gagcgcccgcggctgtccgc

SEQ ID NO: 708461 - DNA, 20 bp, mouse
ggagtcagactcgtcccggg

SEQ ID NO: 708462 - DNA, 20 bp, mouse
ggccgcagagtcgagcctcc

SEQ ID NO: 708463 - DNA, 20 bp, mouse
ggcgctggaacgagccgcac

SEQ ID NO: 708464 - DNA, 20 bp, mouse
ggcccggaggctcgactctg

SEQ ID NO: 708465 - DNA, 20 bp, mouse
ggtaactaacgcccgagcgc

SEQ ID NO: 708466 - DNA, 20 bp, mouse
gccccactactcctgctaaa

SEQ ID NO: 708467 - DNA, 20 bp, mouse
ggccttttagcaggagtagt

SEQ ID NO: 708468 - DNA, 20 bp, mouse
gtggggcagcagggaaaaag

SEQ ID NO: 708469 - DNA, 20 bp, mouse
gaggacatcggcaatgactt

SEQ ID NO: 708470 - DNA, 20 bp, mouse
ggtcaagtggcacccgacgt

SEQ ID NO: 708471 - DNA, 20 bp, mouse
gagaggaaatgcacctcagc

SEQ ID NO: 708472 - DNA, 20 bp, mouse
gtctcagagcggtgcgttgg

SEQ ID NO: 708473 - DNA, 20 bp, mouse
gggcctggctaatacatttg

SEQ ID NO: 708474 - DNA, 20 bp, mouse
gtttcttttggtgactacat

SEQ ID NO: 708475 - DNA, 20 bp, mouse
gcgtacctcgtgccccacgt

SEQ ID NO: 708476 - DNA, 20 bp, mouse
gagacactcacaatctagtt

SEQ ID NO: 708477 - DNA, 20 bp, mouse
gagtacgatgcgtgtcacga

SEQ ID NO: 708478 - DNA, 20 bp, mouse
gccccacccccaagtctcta

SEQ ID NO: 708479 - DNA, 20 bp, mouse
gcaaaaccctagagacttgg

SEQ ID NO: 708480 - DNA, 20 bp, mouse
gattgtgagtgtctcaagat

SEQ ID NO: 708481 - DNA, 20 bp, mouse
gacacagggtgccagaacat

SEQ ID NO: 708482 - DNA, 20 bp, mouse
gtcagcagcgagaaggaaaa

SEQ ID NO: 708483 - DNA, 20 bp, mouse
gtgccatggaccaagctttg

SEQ ID NO: 708484 - DNA, 20 bp, mouse
gctccctccttggactcaca

SEQ ID NO: 708485 - DNA, 20 bp, mouse
gcagccatgtgagtccaagg

SEQ ID NO: 708486 - DNA, 20 bp, mouse
ggtattagaggttctcattg

SEQ ID NO: 708487 - DNA, 20 bp, mouse
gtgcgcagacatggtctttc

SEQ ID NO: 708488 - DNA, 20 bp, mouse
ggataaaacacaggtattag

SEQ ID NO: 708489 - DNA, 20 bp, mouse
gtcaagcacagataaaacac

SEQ ID NO: 708490 - DNA, 20 bp, mouse
gttgcaaaatgtcctagatc

SEQ ID NO: 708491 - DNA, 20 bp, mouse
gtagagtcacacagagttat

SEQ ID NO: 708492 - DNA, 20 bp, mouse
gcagactcttttcagacaat

SEQ ID NO: 708493 - DNA, 20 bp, mouse
gagatcaggacatgtttttc

SEQ ID NO: 708494 - DNA, 20 bp, mouse
gcaactcatcttcatttatc

SEQ ID NO: 708495 - DNA, 20 bp, mouse
ggcaggagtagacattaagt

SEQ ID NO: 708496 - DNA, 20 bp, mouse
ggaactgtgccagtcagttc

SEQ ID NO: 708497 - DNA, 20 bp, mouse
ggaggcaaaccggaactgac

SEQ ID NO: 708498 - DNA, 20 bp, mouse
gtactaacagctagtgacgg

SEQ ID NO: 708499 - DNA, 20 bp, mouse
ggctagtgacggaggcaaac

SEQ ID NO: 708500 - DNA, 20 bp, mouse
gggatccaatcggtaggtca

SEQ ID NO: 708501 - DNA, 20 bp, mouse
gtccgccttgacctaccgat

SEQ ID NO: 708502 - DNA, 20 bp, mouse
gataccctcgtcaggatctg

SEQ ID NO: 708503 - DNA, 20 bp, mouse
ggcaccaccgcaggggatac

SEQ ID NO: 708504 - DNA, 20 bp, mouse
gggggatacaggccgtctga

SEQ ID NO: 708505 - DNA, 20 bp, mouse
ggatgcacttaatggaacgt

SEQ ID NO: 708506 - DNA, 20 bp, mouse
ggccctgtgccctacggcgg

SEQ ID NO: 708507 - DNA, 20 bp, mouse
gccgcagcgcgcactctggc

SEQ ID NO: 708508 - DNA, 20 bp, mouse
ggtagggcacagggccccgg

SEQ ID NO: 708509 - DNA, 20 bp, mouse
gctgcggtcccggggctgtt

SEQ ID NO: 708510 - DNA, 20 bp, mouse
gggaccgcgccgaacagccc

SEQ ID NO: 708511 - DNA, 20 bp, mouse
ggtcccggggctgttcggcg

SEQ ID NO: 708512 - DNA, 20 bp, mouse
ggccgtagggcacagggccc

SEQ ID NO: 708513 - DNA, 20 bp, mouse
gccgcgccgccgccgccgta

SEQ ID NO: 708514 - DNA, 20 bp, mouse
ggggctgcgccgcctctcct

SEQ ID NO: 708515 - DNA, 20 bp, mouse
ggggaccgcagcgcgcactc

SEQ ID NO: 708516 - DNA, 20 bp, mouse
gctagggtctgttagtacag

SEQ ID NO: 708517 - DNA, 20 bp, mouse
gcaagaaacatgtaagaacc

SEQ ID NO: 708518 - DNA, 20 bp, mouse
gttctgcattcactatttta

SEQ ID NO: 708519 - DNA, 20 bp, mouse
gatgcagaattgtgtcatga

SEQ ID NO: 708520 - DNA, 20 bp, mouse
gaactccccaaggactgagc

SEQ ID NO: 708521 - DNA, 20 bp, mouse
gagctggtctgaagagcttg

SEQ ID NO: 708522 - DNA, 20 bp, mouse
gaccccaaggctgccactca

SEQ ID NO: 708523 - DNA, 20 bp, mouse
gagaggtacaggtcagtgat

SEQ ID NO: 708524 - DNA, 20 bp, mouse
gaccatgagtggcagccttg

SEQ ID NO: 708525 - DNA, 20 bp, mouse
gggccctaacagaccatgag

SEQ ID NO: 708526 - DNA, 20 bp, mouse
gcatatgccatccactagat

SEQ ID NO: 708527 - DNA, 20 bp, mouse
gagtgaatgggcccatctag

SEQ ID NO: 708528 - DNA, 20 bp, mouse
ggagcccctcaacattcatg

SEQ ID NO: 708529 - DNA, 20 bp, mouse
gtttcctgaaccttgagctg

SEQ ID NO: 708530 - DNA, 20 bp, mouse
gaaactggaagaggaaaagc

SEQ ID NO: 708531 - DNA, 20 bp, mouse
gcatccccagctcaaggttc

SEQ ID NO: 708532 - DNA, 20 bp, mouse
gttagttataaaactggaag

SEQ ID NO: 708533 - DNA, 20 bp, mouse
ggtagctaaccaaagatatc

SEQ ID NO: 708534 - DNA, 20 bp, mouse
gtccttagctgaggtgctaa

SEQ ID NO: 708535 - DNA, 20 bp, mouse
ggactaagttgatcttatgt

SEQ ID NO: 708536 - DNA, 20 bp, mouse
gtacccaaaggaccaatcta

SEQ ID NO: 708537 - DNA, 20 bp, mouse
gggtgcagaggtaatgtgtt

SEQ ID NO: 708538 - DNA, 20 bp, mouse
gctgctttctgagctgttag

SEQ ID NO: 708539 - DNA, 20 bp, mouse
ggaggggagtctgggtacgg

SEQ ID NO: 708540 - DNA, 20 bp, mouse
gagactgagagagactcacg

SEQ ID NO: 708541 - DNA, 20 bp, mouse
gttggggtaaccggggcctg

SEQ ID NO: 708542 - DNA, 20 bp, mouse
gtaatgtgttggggtaaccg

SEQ ID NO: 708543 - DNA, 20 bp, mouse
gggagagtgtggctgtggaa

SEQ ID NO: 708544 - DNA, 20 bp, mouse
ggagtcctcaggtaagttga

SEQ ID NO: 708545 - DNA, 20 bp, mouse
gggggaagggaaggatatac

SEQ ID NO: 708546 - DNA, 20 bp, mouse
gacagtgtacgcattgtctg

SEQ ID NO: 708547 - DNA, 20 bp, mouse
ggccaactcaaagtacatgc

SEQ ID NO: 708548 - DNA, 20 bp, mouse
gtctgcatcttggaatgctg

SEQ ID NO: 708549 - DNA, 20 bp, mouse
gatagaacttggaacagaca

SEQ ID NO: 708550 - DNA, 20 bp, mouse
gaatagcttctctttactat

SEQ ID NO: 708551 - DNA, 20 bp, mouse
gtctatttcctaaaactaaa

SEQ ID NO: 708552 - DNA, 20 bp, mouse
ggccagcatgtactttgagt

SEQ ID NO: 708553 - DNA, 20 bp, mouse
gataattgtacttattgcat

SEQ ID NO: 708554 - DNA, 20 bp, mouse
gcattccaagatgcagagac

SEQ ID NO: 708555 - DNA, 20 bp, mouse
ggaacttggaacagacatgg

SEQ ID NO: 708556 - DNA, 20 bp, mouse
gtggccgcagaggtccggga

SEQ ID NO: 708557 - DNA, 20 bp, mouse
gggaggctggccgcaggaga

SEQ ID NO: 708558 - DNA, 20 bp, mouse
gctcccatcccggacctctg

SEQ ID NO: 708559 - DNA, 20 bp, mouse
gggtgatccggaggtggaaa

SEQ ID NO: 708560 - DNA, 20 bp, mouse
gagtgtaggtgatccggagg

SEQ ID NO: 708561 - DNA, 20 bp, mouse
gggaagcagtgtaggtgatc

SEQ ID NO: 708562 - DNA, 20 bp, mouse
gagcagtgtaggtgatccgg

SEQ ID NO: 708563 - DNA, 20 bp, mouse
gggcgagcctcgtagctgga

SEQ ID NO: 708564 - DNA, 20 bp, mouse
gagctgtggccgcagaggtc

SEQ ID NO: 708565 - DNA, 20 bp, mouse
gcctagaaagcctcccatcc

SEQ ID NO: 708566 - DNA, 20 bp, mouse
gggcagacctaagccaccaa

SEQ ID NO: 708567 - DNA, 20 bp, mouse
ggcaagcggagagacatggt

SEQ ID NO: 708568 - DNA, 20 bp, mouse
ggaaaacatcagcttgctag

SEQ ID NO: 708569 - DNA, 20 bp, mouse
ggaggacaaagtgcccttgg

SEQ ID NO: 708570 - DNA, 20 bp, mouse
gaaaacatcagcttgcatgg

SEQ ID NO: 708571 - DNA, 20 bp, mouse
gtcagctatgcctggacaca

SEQ ID NO: 708572 - DNA, 20 bp, mouse
gccgggcaagcggagagaca

SEQ ID NO: 708573 - DNA, 20 bp, mouse
gcagaaaacatcagcttgca

SEQ ID NO: 708574 - DNA, 20 bp, mouse
gtgtacatgtttatctagac

SEQ ID NO: 708575 - DNA, 20 bp, mouse
ggtggcttaggtctgccatg

SEQ ID NO: 708576 - DNA, 20 bp, mouse
ggggactcctccacacgtct

SEQ ID NO: 708577 - DNA, 20 bp, mouse
gggggtagtaaagacacaga

SEQ ID NO: 708578 - DNA, 20 bp, mouse
gaaacccagaaggtctggac

SEQ ID NO: 708579 - DNA, 20 bp, mouse
gacgtgtggaggagtccctg

SEQ ID NO: 708580 - DNA, 20 bp, mouse
gacttagtcctaaagtccgt

SEQ ID NO: 708581 - DNA, 20 bp, mouse
ggaactgctgctcagagtgc

SEQ ID NO: 708582 - DNA, 20 bp, mouse
gtctggcatgagctacctca

SEQ ID NO: 708583 - DNA, 20 bp, mouse
ggtgtcaagcttgggtccag

SEQ ID NO: 708584 - DNA, 20 bp, mouse
gtggggtcttccgagacgtg

SEQ ID NO: 708585 - DNA, 20 bp, mouse
gtctcggaagaccccacttc

SEQ ID NO: 708586 - DNA, 20 bp, mouse
gtgaccagagggaactatga

SEQ ID NO: 708587 - DNA, 20 bp, mouse
gattctgtgtgtgacagaat

SEQ ID NO: 708588 - DNA, 20 bp, mouse
gcaaagaaccaatgtgagga

SEQ ID NO: 708589 - DNA, 20 bp, mouse
gtgtgctgttaccatcatgg

SEQ ID NO: 708590 - DNA, 20 bp, mouse
gttgcaggccctcctcacat

SEQ ID NO: 708591 - DNA, 20 bp, mouse
gaagctacccaactgagccc

SEQ ID NO: 708592 - DNA, 20 bp, mouse
gatgggacaagtatccgtaa

SEQ ID NO: 708593 - DNA, 20 bp, mouse
gaactatgatggactgttgc

SEQ ID NO: 708594 - DNA, 20 bp, mouse
gagtccatcatagttccctc

SEQ ID NO: 708595 - DNA, 20 bp, mouse
ggacaagtatccgtaatgga

SEQ ID NO: 708596 - DNA, 20 bp, mouse
ggatgtggggtgtggagctc

SEQ ID NO: 708597 - DNA, 20 bp, mouse
gggcaaggaggactaacaga

SEQ ID NO: 708598 - DNA, 20 bp, mouse
gtgagggaaaacgagtcccc

SEQ ID NO: 708599 - DNA, 20 bp, mouse
ggcaaagaattgcagactag

SEQ ID NO: 708600 - DNA, 20 bp, mouse
gcaaggcctacctcaattgt

SEQ ID NO: 708601 - DNA, 20 bp, mouse
gagtgtggaggtctgtacca

SEQ ID NO: 708602 - DNA, 20 bp, mouse
gaagcaaaggattcagtctt

SEQ ID NO: 708603 - DNA, 20 bp, mouse
gcagggtcttcctacaattg

SEQ ID NO: 708604 - DNA, 20 bp, mouse
gactggcccaagtccccaaa

SEQ ID NO: 708605 - DNA, 20 bp, mouse
ggggacttgggccagtgatg

SEQ ID NO: 708606 - DNA, 20 bp, mouse
gtagctatgcacaaatgact

SEQ ID NO: 708607 - DNA, 20 bp, mouse
gcaactgggtcttctcaatg

SEQ ID NO: 708608 - DNA, 20 bp, mouse
gtcaagtgttagaaggacaa

SEQ ID NO: 708609 - DNA, 20 bp, mouse
gaaatgaagctgttgccaac

SEQ ID NO: 708610 - DNA, 20 bp, mouse
gaaaatggataagataacag

SEQ ID NO: 708611 - DNA, 20 bp, mouse
gtctttcttatctcttaccc

SEQ ID NO: 708612 - DNA, 20 bp, mouse
gctacgacaactggtttgtt

SEQ ID NO: 708613 - DNA, 20 bp, mouse
gtataaacacatgatcctaa

SEQ ID NO: 708614 - DNA, 20 bp, mouse
gtgtttataagcaatagagc

SEQ ID NO: 708615 - DNA, 20 bp, mouse
gtctgttctctggtgccatc

SEQ ID NO: 708616 - DNA, 20 bp, mouse
gcgaggaggggtcccgagtc

SEQ ID NO: 708617 - DNA, 20 bp, mouse
gtagcggcctggcagagagt

SEQ ID NO: 708618 - DNA, 20 bp, mouse
gaagcagcctgacacggtcg

SEQ ID NO: 708619 - DNA, 20 bp, mouse
gtgcttcaaggggcgcgaaa

SEQ ID NO: 708620 - DNA, 20 bp, mouse
gccgtgtcaggctgcttcaa

SEQ ID NO: 708621 - DNA, 20 bp, mouse
ggaccacccccgaccgtgtc

SEQ ID NO: 708622 - DNA, 20 bp, mouse
ggggtggtcggcgcgaggag

SEQ ID NO: 708623 - DNA, 20 bp, mouse
ggggcccccccaactacggc

SEQ ID NO: 708624 - DNA, 20 bp, mouse
gagaccgcgccgtcgctggt

SEQ ID NO: 708625 - DNA, 20 bp, mouse
gtctctgccaggccgctagc

SEQ ID NO: 708626 - DNA, 20 bp, mouse
gctgtagtccagatcatagt

SEQ ID NO: 708627 - DNA, 20 bp, mouse
gcggggaaagggttgtgtca

SEQ ID NO: 708628 - DNA, 20 bp, mouse
gctgggaccccactatgatc

SEQ ID NO: 708629 - DNA, 20 bp, mouse
gccacccagctatagaacca

SEQ ID NO: 708630 - DNA, 20 bp, mouse
gcggcagaatccacagtcct

SEQ ID NO: 708631 - DNA, 20 bp, mouse
gtagtggggtcccagcagtt

SEQ ID NO: 708632 - DNA, 20 bp, mouse
gccaccctgaaacctgtaat

SEQ ID NO: 708633 - DNA, 20 bp, mouse
ggacatgtgccccacctctg

SEQ ID NO: 708634 - DNA, 20 bp, mouse
ggtcccagcagttgggtcac

SEQ ID NO: 708635 - DNA, 20 bp, mouse
gacacagcaaagctccaaga

SEQ ID NO: 708636 - DNA, 20 bp, mouse
gtcaacacgaaagccgtgtg

SEQ ID NO: 708637 - DNA, 20 bp, mouse
gaaagccgtgtgtggcttaa

SEQ ID NO: 708638 - DNA, 20 bp, mouse
gaagcaggtgagttcgagtt

SEQ ID NO: 708639 - DNA, 20 bp, mouse
gaataactccatgtaatcgg

SEQ ID NO: 708640 - DNA, 20 bp, mouse
ggacagatgcggtgtcgagt

SEQ ID NO: 708641 - DNA, 20 bp, mouse
ggtagccattaagccacaca

SEQ ID NO: 708642 - DNA, 20 bp, mouse
gaccgcatctgtcctaataa

SEQ ID NO: 708643 - DNA, 20 bp, mouse
gctaccatactgaacagcaa

SEQ ID NO: 708644 - DNA, 20 bp, mouse
ggcggctacctgccattatt

SEQ ID NO: 708645 - DNA, 20 bp, mouse
ggtaacaaacagaagaacta

SEQ ID NO: 708646 - DNA, 20 bp, mouse
gagagtgagactggtgcttc

SEQ ID NO: 708647 - DNA, 20 bp, mouse
gtgtgcttgtggctctaaga

SEQ ID NO: 708648 - DNA, 20 bp, mouse
gtgatctgaatgcttgttcc

SEQ ID NO: 708649 - DNA, 20 bp, mouse
ggtgagactggtgcttcagg

SEQ ID NO: 708650 - DNA, 20 bp, mouse
ggggtgcatccctagatccc

SEQ ID NO: 708651 - DNA, 20 bp, mouse
gacagtcatcagagtgagac

SEQ ID NO: 708652 - DNA, 20 bp, mouse
ggggttagagtgatgcccat

SEQ ID NO: 708653 - DNA, 20 bp, mouse
gatatcgtgtacaatgagtt

SEQ ID NO: 708654 - DNA, 20 bp, mouse
gtcactctgatgactgtacc

SEQ ID NO: 708655 - DNA, 20 bp, mouse
gtgtgagtgtgctgcccaat

SEQ ID NO: 708656 - DNA, 20 bp, mouse
gagcgcgcggacgcccgcct

SEQ ID NO: 708657 - DNA, 20 bp, mouse
gaagccctgaacgtggatgt

SEQ ID NO: 708658 - DNA, 20 bp, mouse
gaccccgaactatcccgcaa

SEQ ID NO: 708659 - DNA, 20 bp, mouse
ggctgggcggagcaaggctt

SEQ ID NO: 708660 - DNA, 20 bp, mouse
gtgtacgccctgggccgctg

SEQ ID NO: 708661 - DNA, 20 bp, mouse
gtacacactaagttgcatct

SEQ ID NO: 708662 - DNA, 20 bp, mouse
gctcgtggcgacataaacaa

SEQ ID NO: 708663 - DNA, 20 bp, mouse
ggagcaaggcttaggcttaa

SEQ ID NO: 708664 - DNA, 20 bp, mouse
gctatcccgcaaaggaagct

SEQ ID NO: 708665 - DNA, 20 bp, mouse
gcaacttagtgtgtacgccc

SEQ ID NO: 708666 - DNA, 20 bp, mouse
ggttcccagggttcactctg

SEQ ID NO: 708667 - DNA, 20 bp, mouse
gaataccacagagtgaaccc

SEQ ID NO: 708668 - DNA, 20 bp, mouse
gaggctaagttggacacaac

SEQ ID NO: 708669 - DNA, 20 bp, mouse
gaatgtgacattgaactatt

SEQ ID NO: 708670 - DNA, 20 bp, mouse
gacatcttgattaagaaggg

SEQ ID NO: 708671 - DNA, 20 bp, mouse
ggagacatcttgattaagaa

SEQ ID NO: 708672 - DNA, 20 bp, mouse
gtaagatagatatcatgcta

SEQ ID NO: 708673 - DNA, 20 bp, mouse
gctcaaattcaaggctaagt

SEQ ID NO: 708674 - DNA, 20 bp, mouse
gatagatatcatgctatggc

SEQ ID NO: 708675 - DNA, 20 bp, mouse
gtgagttttttaatcaaagc

SEQ ID NO: 708676 - DNA, 20 bp, mouse
ggaggagtctgatgaatgga

SEQ ID NO: 708677 - DNA, 20 bp, mouse
gaaaggaggagtctgatgaa

SEQ ID NO: 708678 - DNA, 20 bp, mouse
gtaagatcttaaactgttcg

SEQ ID NO: 708679 - DNA, 20 bp, mouse
gataagagactgttagatat

SEQ ID NO: 708680 - DNA, 20 bp, mouse
gctcagaagatgtaagtgca

SEQ ID NO: 708681 - DNA, 20 bp, mouse
gtgtcagtaaggaataatat

SEQ ID NO: 708682 - DNA, 20 bp, mouse
gattcatgtggcaacatgtc

SEQ ID NO: 708683 - DNA, 20 bp, mouse
gcaaaaaagaccttaagttg

SEQ ID NO: 708684 - DNA, 20 bp, mouse
gctggattctgcttgtttat

SEQ ID NO: 708685 - DNA, 20 bp, mouse
gaagaattgcccccaactta

SEQ ID NO: 708686 - DNA, 20 bp, mouse
gtatgagaagtatggggatt

SEQ ID NO: 708687 - DNA, 20 bp, mouse
gcccaactctataggttttg

SEQ ID NO: 708688 - DNA, 20 bp, mouse
ggccctgtagttgctctaac

SEQ ID NO: 708689 - DNA, 20 bp, mouse
gtctccatccccaactctat

SEQ ID NO: 708690 - DNA, 20 bp, mouse
gtggtcaccatcaacttcag

SEQ ID NO: 708691 - DNA, 20 bp, mouse
gtccagttagagcaactaca

SEQ ID NO: 708692 - DNA, 20 bp, mouse
gtttggggtggcaaaactta

SEQ ID NO: 708693 - DNA, 20 bp, mouse
gtcctagcactagagattac

SEQ ID NO: 708694 - DNA, 20 bp, mouse
gaactctataggttttgggg

SEQ ID NO: 708695 - DNA, 20 bp, mouse
gggtggcaaaacttaaggtg

SEQ ID NO: 708696 - DNA, 20 bp, mouse
gtgccggtgcggtaaccctt

SEQ ID NO: 708697 - DNA, 20 bp, mouse
gggaaaagcggaacgagggg

SEQ ID NO: 708698 - DNA, 20 bp, mouse
gtaccggaaaagcggaacga

SEQ ID NO: 708699 - DNA, 20 bp, mouse
gaaagcggaacgaggggcgg

SEQ ID NO: 708700 - DNA, 20 bp, mouse
gaatccctggagtctccgac

SEQ ID NO: 708701 - DNA, 20 bp, mouse
ggccaccaacggccgaacgg

SEQ ID NO: 708702 - DNA, 20 bp, mouse
ggccaccgttcggccgttgg

SEQ ID NO: 708703 - DNA, 20 bp, mouse
ggtgcggtaacccttgggat

SEQ ID NO: 708704 - DNA, 20 bp, mouse
gcctgaagacgcctcgagat

SEQ ID NO: 708705 - DNA, 20 bp, mouse
gttctcttgtccaatcccaa

SEQ ID NO: 708706 - DNA, 20 bp, mouse
gacaactcgagacaccttcc

SEQ ID NO: 708707 - DNA, 20 bp, mouse
gcccgacagggtcaggaaag

SEQ ID NO: 708708 - DNA, 20 bp, mouse
gcgggacgccgcccggtctc

SEQ ID NO: 708709 - DNA, 20 bp, mouse
gccttccaggcccccagaca

SEQ ID NO: 708710 - DNA, 20 bp, mouse
gtaagaacgggcactgcggg

SEQ ID NO: 708711 - DNA, 20 bp, mouse
ggctctggctgcggacaccc

SEQ ID NO: 708712 - DNA, 20 bp, mouse
gggtggcggcggcggattgg

SEQ ID NO: 708713 - DNA, 20 bp, mouse
gaggcccagccccggagacc

SEQ ID NO: 708714 - DNA, 20 bp, mouse
gcccatcgcccgacagggtc

SEQ ID NO: 708715 - DNA, 20 bp, mouse
ggcggattggcgggtaagaa

SEQ ID NO: 708716 - DNA, 20 bp, mouse
gtaggggatggaggtgaatc

SEQ ID NO: 708717 - DNA, 20 bp, mouse
ggatgaacctagtacataga

SEQ ID NO: 708718 - DNA, 20 bp, mouse
gcatgaagttgggagcaggt

SEQ ID NO: 708719 - DNA, 20 bp, mouse
ggtagataggaacaaggcat

SEQ ID NO: 708720 - DNA, 20 bp, mouse
gtgtattgctcatgtacgtc

SEQ ID NO: 708721 - DNA, 20 bp, mouse
gctcatgtacgtctggctgt

SEQ ID NO: 708722 - DNA, 20 bp, mouse
gaatgaagcttaggttgaac

SEQ ID NO: 708723 - DNA, 20 bp, mouse
ggtcctagcaatgctgcatg

SEQ ID NO: 708724 - DNA, 20 bp, mouse
gtttacggtcctaggtgtta

SEQ ID NO: 708725 - DNA, 20 bp, mouse
gctctgcccgtctatgtact

SEQ ID NO: 708726 - DNA, 20 bp, mouse
gggggatcctgaatccaggt

SEQ ID NO: 708727 - DNA, 20 bp, mouse
gtgtgcagagatacaacaca

SEQ ID NO: 708728 - DNA, 20 bp, mouse
gaagtcagatgcccataaat

SEQ ID NO: 708729 - DNA, 20 bp, mouse
gttgtccgtgtgctcacatt

SEQ ID NO: 708730 - DNA, 20 bp, mouse
gttcaggatcccccatttat

SEQ ID NO: 708731 - DNA, 20 bp, mouse
gcaatgcctgcttaaggtga

SEQ ID NO: 708732 - DNA, 20 bp, mouse
gactttgctcgtggtttgtc

SEQ ID NO: 708733 - DNA, 20 bp, mouse
gctttagtcaactttgctcg

SEQ ID NO: 708734 - DNA, 20 bp, mouse
ggacttgtttactacacctt

SEQ ID NO: 708735 - DNA, 20 bp, mouse
gtctctgcttctcaaacatg

SEQ ID NO: 708736 - DNA, 20 bp, mouse
gaggtcacccacctcttcac

SEQ ID NO: 708737 - DNA, 20 bp, mouse
gaggtgggtgacctggcagt

SEQ ID NO: 708738 - DNA, 20 bp, mouse
gagtacaccagtgaagaggt

SEQ ID NO: 708739 - DNA, 20 bp, mouse
ggcaaagtacaccagtgaag

SEQ ID NO: 708740 - DNA, 20 bp, mouse
gcagactcaggcacgatgag

SEQ ID NO: 708741 - DNA, 20 bp, mouse
gccaaggcgcaggtgtgatt

SEQ ID NO: 708742 - DNA, 20 bp, mouse
gtagaactctctacactgca

SEQ ID NO: 708743 - DNA, 20 bp, mouse
ggccagaaggtcgatgggtt

SEQ ID NO: 708744 - DNA, 20 bp, mouse
ggccaaacccatcgaccttc

SEQ ID NO: 708745 - DNA, 20 bp, mouse
ggaaactggtggcagaggtc

SEQ ID NO: 708746 - DNA, 20 bp, mouse
ggggtctgcgtggacatcat

SEQ ID NO: 708747 - DNA, 20 bp, mouse
gtggcggcttcgcctagcgt

SEQ ID NO: 708748 - DNA, 20 bp, mouse
gcgcgagagcagttccaaat

SEQ ID NO: 708749 - DNA, 20 bp, mouse
ggagtcccgtggccccacgt

SEQ ID NO: 708750 - DNA, 20 bp, mouse
ggggagcctcgcactcccat

SEQ ID NO: 708751 - DNA, 20 bp, mouse
gagtgcgaggctcccacgtg

SEQ ID NO: 708752 - DNA, 20 bp, mouse
gtcctcctcgaccctgggaa

SEQ ID NO: 708753 - DNA, 20 bp, mouse
ggagcgagcggcaaagtcgt

SEQ ID NO: 708754 - DNA, 20 bp, mouse
gtcgcctagcgttggccaat

SEQ ID NO: 708755 - DNA, 20 bp, mouse
gactcccattggccaacgct

SEQ ID NO: 708756 - DNA, 20 bp, mouse
gctgaaaggggaaactgcgg

SEQ ID NO: 708757 - DNA, 20 bp, mouse
gatgcaggcaggtaggtcac

SEQ ID NO: 708758 - DNA, 20 bp, mouse
ggggaggggagcacgaggtt

SEQ ID NO: 708759 - DNA, 20 bp, mouse
ggtggggcccgaaacggggt

SEQ ID NO: 708760 - DNA, 20 bp, mouse
gctgatgactcccaagtctg

SEQ ID NO: 708761 - DNA, 20 bp, mouse
gaggggagcacgaggttagg

SEQ ID NO: 708762 - DNA, 20 bp, mouse
ggcttgtggggcccgaaacg

SEQ ID NO: 708763 - DNA, 20 bp, mouse
gaaaggggaaactgcggggg

SEQ ID NO: 708764 - DNA, 20 bp, mouse
gaggcattctccggactttg

SEQ ID NO: 708765 - DNA, 20 bp, mouse
gggtctgcagaagagcacga

SEQ ID NO: 708766 - DNA, 20 bp, mouse
gatgcctgcctccagaactc

SEQ ID NO: 708767 - DNA, 20 bp, mouse
ggaaagatggtgattataat

SEQ ID NO: 708768 - DNA, 20 bp, mouse
gtatttcctagtttggttta

SEQ ID NO: 708769 - DNA, 20 bp, mouse
gaccaaactaggaaataccc

SEQ ID NO: 708770 - DNA, 20 bp, mouse
gtactcatggtggttttgaa

SEQ ID NO: 708771 - DNA, 20 bp, mouse
gatctggaatacaatttcca

SEQ ID NO: 708772 - DNA, 20 bp, mouse
gtcatggtggttttgaatgg

SEQ ID NO: 708773 - DNA, 20 bp, mouse
gtttgtctctttttccagaa

SEQ ID NO: 708774 - DNA, 20 bp, mouse
gaatatatcaaagttttagc

SEQ ID NO: 708775 - DNA, 20 bp, mouse
gaaagagacaaataacagaa

SEQ ID NO: 708776 - DNA, 20 bp, mouse
gacaggaggcttggcttaaa

SEQ ID NO: 708777 - DNA, 20 bp, mouse
gccagctttcaggggttcca

SEQ ID NO: 708778 - DNA, 20 bp, mouse
gtaggtgcatagtgtgttag

SEQ ID NO: 708779 - DNA, 20 bp, mouse
gtaaaagggtgaggaagggc

SEQ ID NO: 708780 - DNA, 20 bp, mouse
gtggcttaaaagggtgagga

SEQ ID NO: 708781 - DNA, 20 bp, mouse
gagtacttcccagctttcag

SEQ ID NO: 708782 - DNA, 20 bp, mouse
gtccacgtctacgactctga

SEQ ID NO: 708783 - DNA, 20 bp, mouse
gtagacgtggaaccggtcct

SEQ ID NO: 708784 - DNA, 20 bp, mouse
ggtctgaggtaggagaatct

SEQ ID NO: 708785 - DNA, 20 bp, mouse
ggccaagcctcctgtagcac

SEQ ID NO: 708786 - DNA, 20 bp, mouse
gggtacatgggcaataggtt

SEQ ID NO: 708787 - DNA, 20 bp, mouse
gtcttgactgagaacttcat

SEQ ID NO: 708788 - DNA, 20 bp, mouse
gttgtgttgggctgcattta

SEQ ID NO: 708789 - DNA, 20 bp, mouse
gcttgaccacataggtacat

SEQ ID NO: 708790 - DNA, 20 bp, mouse
gaaattctcaattttgtgtt

SEQ ID NO: 708791 - DNA, 20 bp, mouse
gttgaaatggcattcatatt

SEQ ID NO: 708792 - DNA, 20 bp, mouse
gattttgtgactgcattatg

SEQ ID NO: 708793 - DNA, 20 bp, mouse
ggaaagaacactctttagct

SEQ ID NO: 708794 - DNA, 20 bp, mouse
gtaagaaaaggatttaaaat

SEQ ID NO: 708795 - DNA, 20 bp, mouse
gaatagttgacactaagaaa

SEQ ID NO: 708796 - DNA, 20 bp, mouse
gacattgaaagaaccctctt

SEQ ID NO: 708797 - DNA, 20 bp, mouse
ggggtacatgagttatagat

SEQ ID NO: 708798 - DNA, 20 bp, mouse
gagatgaataaatggtccta

SEQ ID NO: 708799 - DNA, 20 bp, mouse
gacaatagtagatgaataaa

SEQ ID NO: 708800 - DNA, 20 bp, mouse
gatttcatgcaataatctga

SEQ ID NO: 708801 - DNA, 20 bp, mouse
gcttagagtgtttctgccat

SEQ ID NO: 708802 - DNA, 20 bp, mouse
gaatcaatacacagccaaag

SEQ ID NO: 708803 - DNA, 20 bp, mouse
gtataactcatgtacccatg

SEQ ID NO: 708804 - DNA, 20 bp, mouse
gaatattaactgatgaagga

SEQ ID NO: 708805 - DNA, 20 bp, mouse
gaaattctcagttttgtgtt

SEQ ID NO: 708806 - DNA, 20 bp, mouse
gtctgtggatgctaagacgg

SEQ ID NO: 708807 - DNA, 20 bp, mouse
ggaaagaggctcccaaacac

SEQ ID NO: 708808 - DNA, 20 bp, mouse
ggccaggacagcatcagctc

SEQ ID NO: 708809 - DNA, 20 bp, mouse
gcacgtgcctgcctgcgggt

SEQ ID NO: 708810 - DNA, 20 bp, mouse
gcgtcctgggaagagtgtga

SEQ ID NO: 708811 - DNA, 20 bp, mouse
ggctcaggtcgccacccaaa

SEQ ID NO: 708812 - DNA, 20 bp, mouse
gacagagccactacaagctc

SEQ ID NO: 708813 - DNA, 20 bp, mouse
gtagtggctctgtctgagat

SEQ ID NO: 708814 - DNA, 20 bp, mouse
ggcagtacctgcagcgtcct

SEQ ID NO: 708815 - DNA, 20 bp, mouse
gtgaaggaagccataaggtg

SEQ ID NO: 708816 - DNA, 20 bp, mouse
gtctgtgcgcgggtccgcga

SEQ ID NO: 708817 - DNA, 20 bp, mouse
gagggtggcggggcagtgac

SEQ ID NO: 708818 - DNA, 20 bp, mouse
gccggccgggcgctagaagt

SEQ ID NO: 708819 - DNA, 20 bp, mouse
ggctcagggtgcagctcgga

SEQ ID NO: 708820 - DNA, 20 bp, mouse
ggggccgagcgctgctggag

SEQ ID NO: 708821 - DNA, 20 bp, mouse
gcgcgggtccgcgagggtgg

SEQ ID NO: 708822 - DNA, 20 bp, mouse
gcacagacttactcggcgtc

SEQ ID NO: 708823 - DNA, 20 bp, mouse
gacccgcgcacagacttact

SEQ ID NO: 708824 - DNA, 20 bp, mouse
gggccggagcagctctgcac

SEQ ID NO: 708825 - DNA, 20 bp, mouse
gcccaggccgagcccagtag

SEQ ID NO: 708826 - DNA, 20 bp, mouse
gttcctgtctggatactctg

SEQ ID NO: 708827 - DNA, 20 bp, mouse
gcagctcaaatacagacata

SEQ ID NO: 708828 - DNA, 20 bp, mouse
gagccccagagtatccagac

SEQ ID NO: 708829 - DNA, 20 bp, mouse
gggggccataccatctgata

SEQ ID NO: 708830 - DNA, 20 bp, mouse
gcaaaaccccaaacctctta

SEQ ID NO: 708831 - DNA, 20 bp, mouse
gtctaatcagaataacacac

SEQ ID NO: 708832 - DNA, 20 bp, mouse
gaaaagaaagtcaccttaag

SEQ ID NO: 708833 - DNA, 20 bp, mouse
gaaagtcaccttaagaggtt

SEQ ID NO: 708834 - DNA, 20 bp, mouse
ggtcactcctccataaatga

SEQ ID NO: 708835 - DNA, 20 bp, mouse
gttaatctgagttgtgagac

SEQ ID NO: 708836 - DNA, 20 bp, mouse
gaaaaaccctagaaccagat

SEQ ID NO: 708837 - DNA, 20 bp, mouse
gggttctagggttttttggt

SEQ ID NO: 708838 - DNA, 20 bp, mouse
gctaaacccatctggttcta

SEQ ID NO: 708839 - DNA, 20 bp, mouse
gttagaagagtatgggtatt

SEQ ID NO: 708840 - DNA, 20 bp, mouse
gatattagttagaagagtat

SEQ ID NO: 708841 - DNA, 20 bp, mouse
gtgtatttttttttgccatc

SEQ ID NO: 708842 - DNA, 20 bp, mouse
gtggtgttagttggtctcac

SEQ ID NO: 708843 - DNA, 20 bp, mouse
gaacctagagaaaaaaaata

SEQ ID NO: 708844 - DNA, 20 bp, mouse
gtaccatattttttttctct

SEQ ID NO: 708845 - DNA, 20 bp, mouse
gagagcaggagagagagcgg

SEQ ID NO: 708846 - DNA, 20 bp, mouse
ggatctgaaaagaagaatta

SEQ ID NO: 708847 - DNA, 20 bp, mouse
gtttcaagctcttacacagt

SEQ ID NO: 708848 - DNA, 20 bp, mouse
ggtcagatctcgtgatcaga

SEQ ID NO: 708849 - DNA, 20 bp, mouse
gggtctatggtaattcgttt

SEQ ID NO: 708850 - DNA, 20 bp, mouse
gagaaagagaaataaggagc

SEQ ID NO: 708851 - DNA, 20 bp, mouse
gtgtttagatggtttgcagg

SEQ ID NO: 708852 - DNA, 20 bp, mouse
gccttatttctctttcttta

SEQ ID NO: 708853 - DNA, 20 bp, mouse
gtatttactcttcatcctgt

SEQ ID NO: 708854 - DNA, 20 bp, mouse
gtattataattgtaaccaac

SEQ ID NO: 708855 - DNA, 20 bp, mouse
ggattgtttagatggtttgc

SEQ ID NO: 708856 - DNA, 20 bp, mouse
ggggccagagatcccggctg

SEQ ID NO: 708857 - DNA, 20 bp, mouse
gtaggcccgcccacaatatt

SEQ ID NO: 708858 - DNA, 20 bp, mouse
gcaggggtggcggacgtggt

SEQ ID NO: 708859 - DNA, 20 bp, mouse
gagcgccgcgcgactggtgg

SEQ ID NO: 708860 - DNA, 20 bp, mouse
gaggaagcgcggaacgcgaa

SEQ ID NO: 708861 - DNA, 20 bp, mouse
gggcctacacgagaggaatc

SEQ ID NO: 708862 - DNA, 20 bp, mouse
ggtgggcgggcctacacgag

SEQ ID NO: 708863 - DNA, 20 bp, mouse
ggggaattcgggtccggatt

SEQ ID NO: 708864 - DNA, 20 bp, mouse
gatccagcggcggggaattc

SEQ ID NO: 708865 - DNA, 20 bp, mouse
ggtccagtatgtcttctctt

SEQ ID NO: 708866 - DNA, 20 bp, mouse
gcattctggcttttgttcgc

SEQ ID NO: 708867 - DNA, 20 bp, mouse
gaggggtagggactgaaaac

SEQ ID NO: 708868 - DNA, 20 bp, mouse
gaggcagtgaactcaattga

SEQ ID NO: 708869 - DNA, 20 bp, mouse
gcttacacttaaagggattg

SEQ ID NO: 708870 - DNA, 20 bp, mouse
ggggcgtgacttcctacttc

SEQ ID NO: 708871 - DNA, 20 bp, mouse
gtggcctggatgccggaagt

SEQ ID NO: 708872 - DNA, 20 bp, mouse
gagtactagtcaatcctgcc

SEQ ID NO: 708873 - DNA, 20 bp, mouse
ggtgggctttaaattcacta

SEQ ID NO: 708874 - DNA, 20 bp, mouse
gaatccaatcttacacttaa

SEQ ID NO: 708875 - DNA, 20 bp, mouse
gcaggagttctagctcgcca

SEQ ID NO: 708876 - DNA, 20 bp, mouse
gggccgcccgggccaccgct

SEQ ID NO: 708877 - DNA, 20 bp, mouse
gcctgtcccagcggtggccc

SEQ ID NO: 708878 - DNA, 20 bp, mouse
gatttagaaactttaacgtt

SEQ ID NO: 708879 - DNA, 20 bp, mouse
gtaatttgtaatccacaata

SEQ ID NO: 708880 - DNA, 20 bp, mouse
gactacaagattgaagacag

SEQ ID NO: 708881 - DNA, 20 bp, mouse
gtcagcaagaagcaattgac

SEQ ID NO: 708882 - DNA, 20 bp, mouse
gcgctgggacaggagaagca

SEQ ID NO: 708883 - DNA, 20 bp, mouse
gaaacatccacagcagtgac

SEQ ID NO: 708884 - DNA, 20 bp, mouse
gagaagcaaggtgaggcagc

SEQ ID NO: 708885 - DNA, 20 bp, mouse
ggctgatcctgaatcttgaa

SEQ ID NO: 708886 - DNA, 20 bp, mouse
gcctatcaggaagctgaggg

SEQ ID NO: 708887 - DNA, 20 bp, mouse
ggtccacttgtgttgcataa

SEQ ID NO: 708888 - DNA, 20 bp, mouse
gcaactcgtgtaagctagca

SEQ ID NO: 708889 - DNA, 20 bp, mouse
ggcttggtataacaagtaca

SEQ ID NO: 708890 - DNA, 20 bp, mouse
gctagcttacacgagttgct

SEQ ID NO: 708891 - DNA, 20 bp, mouse
gtgtgtattttgagggttta

SEQ ID NO: 708892 - DNA, 20 bp, mouse
gtagtctgacagacgaagct

SEQ ID NO: 708893 - DNA, 20 bp, mouse
ggtaatgttatattttgtaa

SEQ ID NO: 708894 - DNA, 20 bp, mouse
gaacctttatgcaacacaag

SEQ ID NO: 708895 - DNA, 20 bp, mouse
gtgggatatataagcaatat

SEQ ID NO: 708896 - DNA, 20 bp, mouse
gggcggggaccctgcatcag

SEQ ID NO: 708897 - DNA, 20 bp, mouse
gactcctccgtgctcaatgg

SEQ ID NO: 708898 - DNA, 20 bp, mouse
ggctgtccctggcacctcgg

SEQ ID NO: 708899 - DNA, 20 bp, mouse
ggggtccccgccattgagca

SEQ ID NO: 708900 - DNA, 20 bp, mouse
gacagcggcttcagacacgg

SEQ ID NO: 708901 - DNA, 20 bp, mouse
ggcgactcctccgtgctcaa

SEQ ID NO: 708902 - DNA, 20 bp, mouse
gcaagaggccctcgatgcaa

SEQ ID NO: 708903 - DNA, 20 bp, mouse
gtatactgcccgccccaagg

SEQ ID NO: 708904 - DNA, 20 bp, mouse
gtcgctgttgctctgggtct

SEQ ID NO: 708905 - DNA, 20 bp, mouse
gtctttgcgctgcggcccgg

SEQ ID NO: 708906 - DNA, 20 bp, mouse
ggtcaggagggtcacgtgta

SEQ ID NO: 708907 - DNA, 20 bp, mouse
gtcagcactaaaggtgtagg

SEQ ID NO: 708908 - DNA, 20 bp, mouse
gcccactgggagtgttcagt

SEQ ID NO: 708909 - DNA, 20 bp, mouse
gcgggcccgagcacacacgt

SEQ ID NO: 708910 - DNA, 20 bp, mouse
gctgtcagcactaaaggtgt

SEQ ID NO: 708911 - DNA, 20 bp, mouse
gggagaggaattatcttgtg

SEQ ID NO: 708912 - DNA, 20 bp, mouse
ggagggtcacgtgtaggggc

SEQ ID NO: 708913 - DNA, 20 bp, mouse
gacacagagctatctcagca

SEQ ID NO: 708914 - DNA, 20 bp, mouse
gcacaggacagcagtgggtc

SEQ ID NO: 708915 - DNA, 20 bp, mouse
gactctggactgcttcctta

SEQ ID NO: 708916 - DNA, 20 bp, mouse
gactctgaagggcgcagatc

SEQ ID NO: 708917 - DNA, 20 bp, mouse
gaagcggttaagtgcatcag

SEQ ID NO: 708918 - DNA, 20 bp, mouse
gtgtgagagcccaaaagaac

SEQ ID NO: 708919 - DNA, 20 bp, mouse
gatgctggctggccttttag

SEQ ID NO: 708920 - DNA, 20 bp, mouse
ggtgggaagaagtaaccagt

SEQ ID NO: 708921 - DNA, 20 bp, mouse
gaatagaagtaaacacatgt

SEQ ID NO: 708922 - DNA, 20 bp, mouse
gaggtcacgtgactacttga

SEQ ID NO: 708923 - DNA, 20 bp, mouse
gaaaacagctcctgccccgt

SEQ ID NO: 708924 - DNA, 20 bp, mouse
gctctcttacgtttgttcca

SEQ ID NO: 708925 - DNA, 20 bp, mouse
gcaaccgagaactcacatcc

SEQ ID NO: 708926 - DNA, 20 bp, mouse
gtgacgacacggaaagatta

SEQ ID NO: 708927 - DNA, 20 bp, mouse
gcacggaaagattatggctc

SEQ ID NO: 708928 - DNA, 20 bp, mouse
gattatggctctgggagaaa

SEQ ID NO: 708929 - DNA, 20 bp, mouse
gtttatgcaaggcacttcac

SEQ ID NO: 708930 - DNA, 20 bp, mouse
gagctacaaggctgacgaca

SEQ ID NO: 708931 - DNA, 20 bp, mouse
ggcttactttcttagctaca

SEQ ID NO: 708932 - DNA, 20 bp, mouse
gtgcctctctttgcattgaa

SEQ ID NO: 708933 - DNA, 20 bp, mouse
gataattcacctttatcatt

SEQ ID NO: 708934 - DNA, 20 bp, mouse
ggtaagctgccaaatgataa

SEQ ID NO: 708935 - DNA, 20 bp, mouse
ggcattttcaaagaggtgca

SEQ ID NO: 708936 - DNA, 20 bp, mouse
gagggtgcgcggagtaagag

SEQ ID NO: 708937 - DNA, 20 bp, mouse
gggaaaatgtgtaaacgcga

SEQ ID NO: 708938 - DNA, 20 bp, mouse
ggggagcagcaaaagaaagt

SEQ ID NO: 708939 - DNA, 20 bp, mouse
gcatcccccccaggcctggt

SEQ ID NO: 708940 - DNA, 20 bp, mouse
gaggcctgacactaaagtct

SEQ ID NO: 708941 - DNA, 20 bp, mouse
gctagatcgaggcactcttg

SEQ ID NO: 708942 - DNA, 20 bp, mouse
gtgcgcacctaccaggcctg

SEQ ID NO: 708943 - DNA, 20 bp, mouse
gcgacccagactttagtgtc

SEQ ID NO: 708944 - DNA, 20 bp, mouse
ggggtggggaccgtctctca

SEQ ID NO: 708945 - DNA, 20 bp, mouse
gctaaagccgagtagctgtg

SEQ ID NO: 708946 - DNA, 20 bp, mouse
gggaacttcttacaataaaa

SEQ ID NO: 708947 - DNA, 20 bp, mouse
ggataaatccgcactgaagg

SEQ ID NO: 708948 - DNA, 20 bp, mouse
gtgtaagaagttcccacttg

SEQ ID NO: 708949 - DNA, 20 bp, mouse
gggtcctgcctccttcagtg

SEQ ID NO: 708950 - DNA, 20 bp, mouse
gaatccgcactgaaggaggc

SEQ ID NO: 708951 - DNA, 20 bp, mouse
gcccataatcactgaatgat

SEQ ID NO: 708952 - DNA, 20 bp, mouse
gaccaatcattcagtgatta

SEQ ID NO: 708953 - DNA, 20 bp, mouse
gaatttggtgaacctcaagt

SEQ ID NO: 708954 - DNA, 20 bp, mouse
ggtctttatttaaatacctc

SEQ ID NO: 708955 - DNA, 20 bp, mouse
gtgccaataaaatcgattaa

SEQ ID NO: 708956 - DNA, 20 bp, mouse
gaagactaacctgaactaat

SEQ ID NO: 708957 - DNA, 20 bp, mouse
gtggttggaacttctgaatt

SEQ ID NO: 708958 - DNA, 20 bp, mouse
ggttcaggttagtcttggtc

SEQ ID NO: 708959 - DNA, 20 bp, mouse
gttcactgcctatgtacgtg

SEQ ID NO: 708960 - DNA, 20 bp, mouse
gagtcttggtctggtgtcca

SEQ ID NO: 708961 - DNA, 20 bp, mouse
gtgtactataaatttgctga

SEQ ID NO: 708962 - DNA, 20 bp, mouse
gagacagttttaattccctt

SEQ ID NO: 708963 - DNA, 20 bp, mouse
gagtgatctacaaagtactt

SEQ ID NO: 708964 - DNA, 20 bp, mouse
gtgttgattggtttaagttc

SEQ ID NO: 708965 - DNA, 20 bp, mouse
gctgtctactctagccccat

SEQ ID NO: 708966 - DNA, 20 bp, mouse
gtcagaatgagcagaagcaa

SEQ ID NO: 708967 - DNA, 20 bp, mouse
gcttccttcagccttgggaa

SEQ ID NO: 708968 - DNA, 20 bp, mouse
gatatcctgagcttagggct

SEQ ID NO: 708969 - DNA, 20 bp, mouse
gatcatgtagaaggcaatct

SEQ ID NO: 708970 - DNA, 20 bp, mouse
ggctaggacaatagttgcaa

SEQ ID NO: 708971 - DNA, 20 bp, mouse
ggctgcccagccctaagctc

SEQ ID NO: 708972 - DNA, 20 bp, mouse
ggatagatatcctgagctta

SEQ ID NO: 708973 - DNA, 20 bp, mouse
gtttgtaaagcctgtaccat

SEQ ID NO: 708974 - DNA, 20 bp, mouse
gtttataatgcctatggtac

SEQ ID NO: 708975 - DNA, 20 bp, mouse
gattatatttataatgccta

SEQ ID NO: 708976 - DNA, 20 bp, mouse
gagtccgtgcccgcacacat

SEQ ID NO: 708977 - DNA, 20 bp, mouse
ggactactaactagctgaaa

SEQ ID NO: 708978 - DNA, 20 bp, mouse
gtgggcctaggaatgctgaa

SEQ ID NO: 708979 - DNA, 20 bp, mouse
gctccagcttcaggctgcct

SEQ ID NO: 708980 - DNA, 20 bp, mouse
gtaacttggctgctttttgg

SEQ ID NO: 708981 - DNA, 20 bp, mouse
gcctgcacactgcccggcgc

SEQ ID NO: 708982 - DNA, 20 bp, mouse
gtcgtgtcaaagtcaagtca

SEQ ID NO: 708983 - DNA, 20 bp, mouse
gggagcaaagacattttgct

SEQ ID NO: 708984 - DNA, 20 bp, mouse
ggaaatcgcaactgtgtgaa

SEQ ID NO: 708985 - DNA, 20 bp, mouse
gacacacacactcgctgcca

SEQ ID NO: 708986 - DNA, 20 bp, mouse
gccaacgccggtcactggcc

SEQ ID NO: 708987 - DNA, 20 bp, mouse
gtttggggccggttccaacg

SEQ ID NO: 708988 - DNA, 20 bp, mouse
gcctggcccggctcagtcgt

SEQ ID NO: 708989 - DNA, 20 bp, mouse
gccaacggggctgccaacgc

SEQ ID NO: 708990 - DNA, 20 bp, mouse
gagaggtagactcgggtcgg

SEQ ID NO: 708991 - DNA, 20 bp, mouse
gggctgccaacgccggtcac

SEQ ID NO: 708992 - DNA, 20 bp, mouse
gttggcagccccgttggaac

SEQ ID NO: 708993 - DNA, 20 bp, mouse
gtcggaggcaaacatccact

SEQ ID NO: 708994 - DNA, 20 bp, mouse
gtggcgccgacgactgagcc

SEQ ID NO: 708995 - DNA, 20 bp, mouse
gtcagtcgtcggcgccacgc

SEQ ID NO: 708996 - DNA, 20 bp, mouse
ggctgcagaactactcactt

SEQ ID NO: 708997 - DNA, 20 bp, mouse
gcggcaccttaccacatcat

SEQ ID NO: 708998 - DNA, 20 bp, mouse
ggccgtgcagactgctggga

SEQ ID NO: 708999 - DNA, 20 bp, mouse
gcagcccccatgatgtggta

SEQ ID NO: 709000 - DNA, 20 bp, mouse
gcccatgcgtgctataatac

SEQ ID NO: 709001 - DNA, 20 bp, mouse
gctggacagcccccatgatg

SEQ ID NO: 709002 - DNA, 20 bp, mouse
gaggactccctgagccataa

SEQ ID NO: 709003 - DNA, 20 bp, mouse
gctgggtcctccctgacaaa

SEQ ID NO: 709004 - DNA, 20 bp, mouse
gaactactcactttgggtga

SEQ ID NO: 709005 - DNA, 20 bp, mouse
gttgttggtcagttcaaagt

SEQ ID NO: 709006 - DNA, 20 bp, mouse
gcgggcaggacaaacaggtt

SEQ ID NO: 709007 - DNA, 20 bp, mouse
gggaactcgcggggcccccg

SEQ ID NO: 709008 - DNA, 20 bp, mouse
gcagcccggagcaagggcgg

SEQ ID NO: 709009 - DNA, 20 bp, mouse
gcacgggaccgcttctgctg

SEQ ID NO: 709010 - DNA, 20 bp, mouse
ggatgcgcccaatcagagtg

SEQ ID NO: 709011 - DNA, 20 bp, mouse
gcgggctgtcgggaccgaga

SEQ ID NO: 709012 - DNA, 20 bp, mouse
gcggcgcgagaggcggacac

SEQ ID NO: 709013 - DNA, 20 bp, mouse
ggcggggccccggagaggaa

SEQ ID NO: 709014 - DNA, 20 bp, mouse
gcaggcgcgggaatccacag

SEQ ID NO: 709015 - DNA, 20 bp, mouse
gcgcccgtctgtgtgtacgg

SEQ ID NO: 709016 - DNA, 20 bp, mouse
gctgcctgagggttagaaca

SEQ ID NO: 709017 - DNA, 20 bp, mouse
gtggcgacccagcagctcaa

SEQ ID NO: 709018 - DNA, 20 bp, mouse
gtgtcccaaggcggagggga

SEQ ID NO: 709019 - DNA, 20 bp, mouse
gtctgccggaaggagcccag

SEQ ID NO: 709020 - DNA, 20 bp, mouse
gtccctaagctgtcccaagg

SEQ ID NO: 709021 - DNA, 20 bp, mouse
gacacgccgggctcctacgc

SEQ ID NO: 709022 - DNA, 20 bp, mouse
ggaacccggtcagccccgct

SEQ ID NO: 709023 - DNA, 20 bp, mouse
gccaggtcgggcctgcctga

SEQ ID NO: 709024 - DNA, 20 bp, mouse
gtccacgatacccacaaagg

SEQ ID NO: 709025 - DNA, 20 bp, mouse
gacagcttagggaggtgagg

SEQ ID NO: 709026 - DNA, 20 bp, mouse
ggtctcagatcagattgtaa

SEQ ID NO: 709027 - DNA, 20 bp, mouse
ggaggcctgggtgatatccc

SEQ ID NO: 709028 - DNA, 20 bp, mouse
gcatcacaataatacatgag

SEQ ID NO: 709029 - DNA, 20 bp, mouse
ggtcctaagagaaaatgtga

SEQ ID NO: 709030 - DNA, 20 bp, mouse
ggggtgatatcccaggttgt

SEQ ID NO: 709031 - DNA, 20 bp, mouse
gtggagagtttagtcccaag

SEQ ID NO: 709032 - DNA, 20 bp, mouse
ggatatcacccaggcctctt

SEQ ID NO: 709033 - DNA, 20 bp, mouse
gagtttagtcccaagaggcc

SEQ ID NO: 709034 - DNA, 20 bp, mouse
gaaggcttctgccaacaacc

SEQ ID NO: 709035 - DNA, 20 bp, mouse
gagccttcacattttctctt

SEQ ID NO: 709036 - DNA, 20 bp, mouse
gagaaaatggctgaatatga

SEQ ID NO: 709037 - DNA, 20 bp, mouse
gtctgagtttattcaacttg

SEQ ID NO: 709038 - DNA, 20 bp, mouse
gggaataatagattaagatc

SEQ ID NO: 709039 - DNA, 20 bp, mouse
gagttttccaactttaatgt

SEQ ID NO: 709040 - DNA, 20 bp, mouse
gcaaaggaacccacaatgaa

SEQ ID NO: 709041 - DNA, 20 bp, mouse
gacaatgaatgggaactcca

SEQ ID NO: 709042 - DNA, 20 bp, mouse
ggggaagaacattgatgaca

SEQ ID NO: 709043 - DNA, 20 bp, mouse
gaacacactcatatagaaaa

SEQ ID NO: 709044 - DNA, 20 bp, mouse
gactccatggatgtaaacaa

SEQ ID NO: 709045 - DNA, 20 bp, mouse
gtgcatctttgaagatacac

SEQ ID NO: 709046 - DNA, 20 bp, mouse
gtcggagcggtcaggaagca

SEQ ID NO: 709047 - DNA, 20 bp, mouse
gcaaccatcagcaactatcc

SEQ ID NO: 709048 - DNA, 20 bp, mouse
gtgcagctggaaatgataac

SEQ ID NO: 709049 - DNA, 20 bp, mouse
ggagactgtttgcctcggag

SEQ ID NO: 709050 - DNA, 20 bp, mouse
gtaaaggagactgtttgcct

SEQ ID NO: 709051 - DNA, 20 bp, mouse
gacttctgcccaagcttaat

SEQ ID NO: 709052 - DNA, 20 bp, mouse
gaatggagccaattaagctt

SEQ ID NO: 709053 - DNA, 20 bp, mouse
gcacacaaagagactggatg

SEQ ID NO: 709054 - DNA, 20 bp, mouse
gtacacacccttgctaacag

SEQ ID NO: 709055 - DNA, 20 bp, mouse
gtgtttgcctcggagcggtc

SEQ ID NO: 709056 - DNA, 20 bp, mouse
ggctgtgtctagcaccgtaa

SEQ ID NO: 709057 - DNA, 20 bp, mouse
gggcgcagggccgacgtgga

SEQ ID NO: 709058 - DNA, 20 bp, mouse
ggggtccccggagcgtctgt

SEQ ID NO: 709059 - DNA, 20 bp, mouse
gcacggtgccaaagcatcag

SEQ ID NO: 709060 - DNA, 20 bp, mouse
gcgggcggtcatgagcgaat

SEQ ID NO: 709061 - DNA, 20 bp, mouse
ggcgggcgcccggtagtccg

SEQ ID NO: 709062 - DNA, 20 bp, mouse
gactaccgggcgcccgccca

SEQ ID NO: 709063 - DNA, 20 bp, mouse
gcgggccgggacatctcaca

SEQ ID NO: 709064 - DNA, 20 bp, mouse
gacggtgctagacacagcca

SEQ ID NO: 709065 - DNA, 20 bp, mouse
gggtgtgctgatccgccggg

SEQ ID NO: 709066 - DNA, 20 bp, mouse
gcaatagggtgcaggttcta

SEQ ID NO: 709067 - DNA, 20 bp, mouse
gtgtgcctggggtggagccc

SEQ ID NO: 709068 - DNA, 20 bp, mouse
gcacttcttcgggtagtcat

SEQ ID NO: 709069 - DNA, 20 bp, mouse
gcagggacgactttgcaata

SEQ ID NO: 709070 - DNA, 20 bp, mouse
gtgacaggagcatcttcctt

SEQ ID NO: 709071 - DNA, 20 bp, mouse
gcctcagggactcaacacgg

SEQ ID NO: 709072 - DNA, 20 bp, mouse
ggtcccaaaggggaggttcc

SEQ ID NO: 709073 - DNA, 20 bp, mouse
gtctcgaggcagctgagtgg

SEQ ID NO: 709074 - DNA, 20 bp, mouse
gagccctcagggactcaaca

SEQ ID NO: 709075 - DNA, 20 bp, mouse
gagggacagagtagccctca

SEQ ID NO: 709076 - DNA, 20 bp, mouse
ggagcctggggctatcccat

SEQ ID NO: 709077 - DNA, 20 bp, mouse
gctgcccatgggatagcccc

SEQ ID NO: 709078 - DNA, 20 bp, mouse
gtaagcaggggagagtgtat

SEQ ID NO: 709079 - DNA, 20 bp, mouse
gcccacgagagtcagagaga

SEQ ID NO: 709080 - DNA, 20 bp, mouse
ggggaagtccaagcaaacag

SEQ ID NO: 709081 - DNA, 20 bp, mouse
gagggaggggacatcgggtt

SEQ ID NO: 709082 - DNA, 20 bp, mouse
ggctatcccatgggcagcct

SEQ ID NO: 709083 - DNA, 20 bp, mouse
gtctaagtttggaagaggga

SEQ ID NO: 709084 - DNA, 20 bp, mouse
ggcagcctgggtggataagc

SEQ ID NO: 709085 - DNA, 20 bp, mouse
gaggggacatcgggttaggg

SEQ ID NO: 709086 - DNA, 20 bp, mouse
gataacggggtcaactgaga

SEQ ID NO: 709087 - DNA, 20 bp, mouse
gtggcccataaaggactgac

SEQ ID NO: 709088 - DNA, 20 bp, mouse
gaaggactgacaggactagg

SEQ ID NO: 709089 - DNA, 20 bp, mouse
ggaaggaagcatggcctcat

SEQ ID NO: 709090 - DNA, 20 bp, mouse
gtatgaaggctctatggcac

SEQ ID NO: 709091 - DNA, 20 bp, mouse
gaccccaaacttacatatga

SEQ ID NO: 709092 - DNA, 20 bp, mouse
gggaggcgtggtcttatcga

SEQ ID NO: 709093 - DNA, 20 bp, mouse
gagccttcatatgtaagttt

SEQ ID NO: 709094 - DNA, 20 bp, mouse
ggtagccaataattttgata

SEQ ID NO: 709095 - DNA, 20 bp, mouse
gagtttggggtgatgataac

SEQ ID NO: 709096 - DNA, 20 bp, mouse
gagtggaggcgccacgtcca

SEQ ID NO: 709097 - DNA, 20 bp, mouse
gggcttccgtagctagatga

SEQ ID NO: 709098 - DNA, 20 bp, mouse
gcactgccctcatctagcta

SEQ ID NO: 709099 - DNA, 20 bp, mouse
gggtcatgacctctttggta

SEQ ID NO: 709100 - DNA, 20 bp, mouse
gggaggcgccacgtccaggg

SEQ ID NO: 709101 - DNA, 20 bp, mouse
gaagaaaacctagtgattcg

SEQ ID NO: 709102 - DNA, 20 bp, mouse
ggtggtgaccccgaatcact

SEQ ID NO: 709103 - DNA, 20 bp, mouse
ggcctaaaccaaaattttga

SEQ ID NO: 709104 - DNA, 20 bp, mouse
gtggtgacctagctaggcag

SEQ ID NO: 709105 - DNA, 20 bp, mouse
gtccctcaaaattttggttt

SEQ ID NO: 709106 - DNA, 20 bp, mouse
gcacgagcctgtgtcctcta

SEQ ID NO: 709107 - DNA, 20 bp, mouse
gcacgagcacactccaagta

SEQ ID NO: 709108 - DNA, 20 bp, mouse
gaagaatagcatgagtaggg

SEQ ID NO: 709109 - DNA, 20 bp, mouse
gcagcactgggctatagacc

SEQ ID NO: 709110 - DNA, 20 bp, mouse
gaggactcggaaggacacag

SEQ ID NO: 709111 - DNA, 20 bp, mouse
ggagtccgtgccaaggtaat

SEQ ID NO: 709112 - DNA, 20 bp, mouse
ggcttggcactcacccctag

SEQ ID NO: 709113 - DNA, 20 bp, mouse
ggtgagtgccaagccctact

SEQ ID NO: 709114 - DNA, 20 bp, mouse
gaagccatcgcctccaggga

SEQ ID NO: 709115 - DNA, 20 bp, mouse
gactcacccctagaggacac

SEQ ID NO: 709116 - DNA, 20 bp, mouse
gtccccaggcttggtacctt

SEQ ID NO: 709117 - DNA, 20 bp, mouse
gcctggggaagtattcatac

SEQ ID NO: 709118 - DNA, 20 bp, mouse
gaacaagaaaggtgtcgatc

SEQ ID NO: 709119 - DNA, 20 bp, mouse
gtaccttaggctatcaagag

SEQ ID NO: 709120 - DNA, 20 bp, mouse
gctacctacgtccagaattc

SEQ ID NO: 709121 - DNA, 20 bp, mouse
gtagaagatagaagtctctc

SEQ ID NO: 709122 - DNA, 20 bp, mouse
ggcctaaggtaccaagcctg

SEQ ID NO: 709123 - DNA, 20 bp, mouse
ggctgtgtgaggtcactgaa

SEQ ID NO: 709124 - DNA, 20 bp, mouse
gggtagaagtcctctgaatg

SEQ ID NO: 709125 - DNA, 20 bp, mouse
ggaaaggtgtcgatcgggct

SEQ ID NO: 709126 - DNA, 20 bp, mouse
gtgcgatgctacagctttca

SEQ ID NO: 709127 - DNA, 20 bp, mouse
gagacaggaagcaattctcc

SEQ ID NO: 709128 - DNA, 20 bp, mouse
gaacagttatgcagtcagag

SEQ ID NO: 709129 - DNA, 20 bp, mouse
gccaaatgacaaaggaggtt

SEQ ID NO: 709130 - DNA, 20 bp, mouse
gagctggaaaaggaagcatg

SEQ ID NO: 709131 - DNA, 20 bp, mouse
gctgtaattgttgataggct

SEQ ID NO: 709132 - DNA, 20 bp, mouse
gttccagcttggcacaaagc

SEQ ID NO: 709133 - DNA, 20 bp, mouse
ggtgtcccaaatgacaaagg

SEQ ID NO: 709134 - DNA, 20 bp, mouse
gagactctgtaattgttgat

SEQ ID NO: 709135 - DNA, 20 bp, mouse
gacagactcactgcatgcca

SEQ ID NO: 709136 - DNA, 20 bp, mouse
gtaagtggatagtggctatc

SEQ ID NO: 709137 - DNA, 20 bp, mouse
gtgtttgactatctaagtat

SEQ ID NO: 709138 - DNA, 20 bp, mouse
gttcattcataagtggatag

SEQ ID NO: 709139 - DNA, 20 bp, mouse
ggccaggtctgggaacagta

SEQ ID NO: 709140 - DNA, 20 bp, mouse
ggtagactgtggccaggtct

SEQ ID NO: 709141 - DNA, 20 bp, mouse
gaacagtagggaccacattg

SEQ ID NO: 709142 - DNA, 20 bp, mouse
ggagagctaaggaacaaggt

SEQ ID NO: 709143 - DNA, 20 bp, mouse
gggaccacattgagggtgtt

SEQ ID NO: 709144 - DNA, 20 bp, mouse
gacattgagggtgttaggaa

SEQ ID NO: 709145 - DNA, 20 bp, mouse
gaaaggaaagagaaaatact

SEQ ID NO: 709146 - DNA, 20 bp, mouse
gaaaataacagcacatataa

SEQ ID NO: 709147 - DNA, 20 bp, mouse
ggacaccaggaaagccaatt

SEQ ID NO: 709148 - DNA, 20 bp, mouse
gctctcaaaacaatcctaag

SEQ ID NO: 709149 - DNA, 20 bp, mouse
ggaatagtttacagtgggtg

SEQ ID NO: 709150 - DNA, 20 bp, mouse
gcatctctggaaaatatgtg

SEQ ID NO: 709151 - DNA, 20 bp, mouse
gaaaataaccaggatttgtg

SEQ ID NO: 709152 - DNA, 20 bp, mouse
gctggaaaatatgtgaggac

SEQ ID NO: 709153 - DNA, 20 bp, mouse
gcctggtgtcatttctacat

SEQ ID NO: 709154 - DNA, 20 bp, mouse
gtctgcagggtgataaaata

SEQ ID NO: 709155 - DNA, 20 bp, mouse
gagaatgaaccaaaataacc

SEQ ID NO: 709156 - DNA, 20 bp, mouse
gcacatggtggcttgaggaa

SEQ ID NO: 709157 - DNA, 20 bp, mouse
gtgtgaagcctggatgtatg

SEQ ID NO: 709158 - DNA, 20 bp, mouse
gagcctggatgtatgaggcc

SEQ ID NO: 709159 - DNA, 20 bp, mouse
gatccaggcttcacacatgg

SEQ ID NO: 709160 - DNA, 20 bp, mouse
gagccaccatgtgtgaagcc

SEQ ID NO: 709161 - DNA, 20 bp, mouse
gtacatccaggcttcacaca

SEQ ID NO: 709162 - DNA, 20 bp, mouse
gatccaggcctcatacatcc

SEQ ID NO: 709163 - DNA, 20 bp, mouse
gcttcacacatggtggcttg

SEQ ID NO: 709164 - DNA, 20 bp, mouse
gaggcctggatgtgaagctt

SEQ ID NO: 709165 - DNA, 20 bp, mouse
ggcctgggtgtgtgatgcct

SEQ ID NO: 709166 - DNA, 20 bp, mouse
gtaaggttgggcagctaaag

SEQ ID NO: 709167 - DNA, 20 bp, mouse
gccttcttggggcattattt

SEQ ID NO: 709168 - DNA, 20 bp, mouse
gtgcgcgcacgtgcgcctct

SEQ ID NO: 709169 - DNA, 20 bp, mouse
gttaacaaacgttgctttga

SEQ ID NO: 709170 - DNA, 20 bp, mouse
gtgatcagaatactaaggtt

SEQ ID NO: 709171 - DNA, 20 bp, mouse
gctgcatgatcagaatacta

SEQ ID NO: 709172 - DNA, 20 bp, mouse
gaaaagtgaagtctgcgtcc

SEQ ID NO: 709173 - DNA, 20 bp, mouse
ggtgtgagggggttccttct

SEQ ID NO: 709174 - DNA, 20 bp, mouse
gcactttttaacctgctgag

SEQ ID NO: 709175 - DNA, 20 bp, mouse
gtgatggtccagtgaaacaa

SEQ ID NO: 709176 - DNA, 20 bp, mouse
gcacagaggggggtcggcgg

SEQ ID NO: 709177 - DNA, 20 bp, mouse
gggctgtgaaagcgatgtgg

SEQ ID NO: 709178 - DNA, 20 bp, mouse
ggctgccagtggtccccgag

SEQ ID NO: 709179 - DNA, 20 bp, mouse
gggaccgaatcgcagatctc

SEQ ID NO: 709180 - DNA, 20 bp, mouse
ggctgccgctcggggaccac

SEQ ID NO: 709181 - DNA, 20 bp, mouse
gtgggggcagacaaaggcgg

SEQ ID NO: 709182 - DNA, 20 bp, mouse
gccgggaggcgggagagcgc

SEQ ID NO: 709183 - DNA, 20 bp, mouse
ggctcgtggagaagggacga

SEQ ID NO: 709184 - DNA, 20 bp, mouse
gcgtggagaagggacgacgg

SEQ ID NO: 709185 - DNA, 20 bp, mouse
gccgggcgcgcggagccaat

SEQ ID NO: 709186 - DNA, 20 bp, mouse
gtccaggtcccagttcccaa

SEQ ID NO: 709187 - DNA, 20 bp, mouse
gaacgagtgttctcagctgg

SEQ ID NO: 709188 - DNA, 20 bp, mouse
gggacctggaacaagtaagc

SEQ ID NO: 709189 - DNA, 20 bp, mouse
gctacccatcccttgggaac

SEQ ID NO: 709190 - DNA, 20 bp, mouse
gagtggatcctggaactctc

SEQ ID NO: 709191 - DNA, 20 bp, mouse
ggagcggctacccatccctt

SEQ ID NO: 709192 - DNA, 20 bp, mouse
gctgcccctcagcctttcaa

SEQ ID NO: 709193 - DNA, 20 bp, mouse
gaactaaaggctcaagacaa

SEQ ID NO: 709194 - DNA, 20 bp, mouse
gtgggagccgctcttctcac

SEQ ID NO: 709195 - DNA, 20 bp, mouse
gcaaagggaacaggtcatat

SEQ ID NO: 709196 - DNA, 20 bp, mouse
gtagctcgacagtcagtaga

SEQ ID NO: 709197 - DNA, 20 bp, mouse
gagaaagaaggcaagtactc

SEQ ID NO: 709198 - DNA, 20 bp, mouse
gcctatctccaggtaccaac

SEQ ID NO: 709199 - DNA, 20 bp, mouse
gagcaagtggagagaaaaac

SEQ ID NO: 709200 - DNA, 20 bp, mouse
gtctctcacagctatcctgt

SEQ ID NO: 709201 - DNA, 20 bp, mouse
ggaaattttctccaccctcg

SEQ ID NO: 709202 - DNA, 20 bp, mouse
gttttgcatccaaaccacga

SEQ ID NO: 709203 - DNA, 20 bp, mouse
gagaaggcaagtactctggc

SEQ ID NO: 709204 - DNA, 20 bp, mouse
gcgaccatctaaacaaaact

SEQ ID NO: 709205 - DNA, 20 bp, mouse
gaaaccgagttttgtttaga

SEQ ID NO: 709206 - DNA, 20 bp, mouse
ggtgtggcatcctggaaaag

SEQ ID NO: 709207 - DNA, 20 bp, mouse
gaactctgaaagctctctca

SEQ ID NO: 709208 - DNA, 20 bp, mouse
gtagaaatgcttgacatgtg

SEQ ID NO: 709209 - DNA, 20 bp, mouse
ggagcaacagtggggatcta

SEQ ID NO: 709210 - DNA, 20 bp, mouse
gtacttaacagcagacatga

SEQ ID NO: 709211 - DNA, 20 bp, mouse
ggtcaaaagaaggtcgagtg

SEQ ID NO: 709212 - DNA, 20 bp, mouse
gcatgctatccaatctccac

SEQ ID NO: 709213 - DNA, 20 bp, mouse
gtagcacacacctcttttcc

SEQ ID NO: 709214 - DNA, 20 bp, mouse
gttgtgtaaaaattctattc

SEQ ID NO: 709215 - DNA, 20 bp, mouse
gcttgacatgtgtggcatcc

SEQ ID NO: 709216 - DNA, 20 bp, mouse
gaagtcagagagggcgtgga

SEQ ID NO: 709217 - DNA, 20 bp, mouse
gaggaaatgggtaattacac

SEQ ID NO: 709218 - DNA, 20 bp, mouse
gtactcagagacaaattaaa

SEQ ID NO: 709219 - DNA, 20 bp, mouse
gaatcctcttggtgaggagg

SEQ ID NO: 709220 - DNA, 20 bp, mouse
gagtctgcacccacagtggc

SEQ ID NO: 709221 - DNA, 20 bp, mouse
gctgggcactggagacatag

SEQ ID NO: 709222 - DNA, 20 bp, mouse
gcacggaaatcctcttggtg

SEQ ID NO: 709223 - DNA, 20 bp, mouse
gccacagtggcaggtcccac

SEQ ID NO: 709224 - DNA, 20 bp, mouse
gctaggagggcaccagggct

SEQ ID NO: 709225 - DNA, 20 bp, mouse
gtaggaaaagacggcttctg

SEQ ID NO: 709226 - DNA, 20 bp, mouse
gcggacgttcgcagtagaac

SEQ ID NO: 709227 - DNA, 20 bp, mouse
gtgaacatgactagaaaagg

SEQ ID NO: 709228 - DNA, 20 bp, mouse
gtctacatgattagagcgga

SEQ ID NO: 709229 - DNA, 20 bp, mouse
ggggtgaacatgactagaaa

SEQ ID NO: 709230 - DNA, 20 bp, mouse
gacatgattagagcggatgg

SEQ ID NO: 709231 - DNA, 20 bp, mouse
gtaactccccccataggctg

SEQ ID NO: 709232 - DNA, 20 bp, mouse
ggactctgaaatcaagggca

SEQ ID NO: 709233 - DNA, 20 bp, mouse
gaacgtccgcctcagcctat

SEQ ID NO: 709234 - DNA, 20 bp, mouse
gatcagaaggagatactctg

SEQ ID NO: 709235 - DNA, 20 bp, mouse
gacaggctgtgcagccagga

SEQ ID NO: 709236 - DNA, 20 bp, mouse
gtcgcacagaaaaaggactt

SEQ ID NO: 709237 - DNA, 20 bp, mouse
gtgcccagagcagacataaa

SEQ ID NO: 709238 - DNA, 20 bp, mouse
gatggggatgggaatttact

SEQ ID NO: 709239 - DNA, 20 bp, mouse
gctagctgatacagttacaa

SEQ ID NO: 709240 - DNA, 20 bp, mouse
gttctgtgcgacatggggat

SEQ ID NO: 709241 - DNA, 20 bp, mouse
gagaaatagctcaagggaat

SEQ ID NO: 709242 - DNA, 20 bp, mouse
gaggccttttatgtctgctc

SEQ ID NO: 709243 - DNA, 20 bp, mouse
gtgacctcatcactgtaacc

SEQ ID NO: 709244 - DNA, 20 bp, mouse
gccccatgtcgcacagaaaa

SEQ ID NO: 709245 - DNA, 20 bp, mouse
gtgggcgtcctttcttagac

SEQ ID NO: 709246 - DNA, 20 bp, mouse
gccattcactggcttccatg

SEQ ID NO: 709247 - DNA, 20 bp, mouse
gtccatgtggtagaaactag

SEQ ID NO: 709248 - DNA, 20 bp, mouse
gtagaggtataataatgcct

SEQ ID NO: 709249 - DNA, 20 bp, mouse
gcacttattttcttgaggac

SEQ ID NO: 709250 - DNA, 20 bp, mouse
gccatgatgcaagaactaca

SEQ ID NO: 709251 - DNA, 20 bp, mouse
gtgaggacaggaactatccc

SEQ ID NO: 709252 - DNA, 20 bp, mouse
gtggacaccagataggaatg

SEQ ID NO: 709253 - DNA, 20 bp, mouse
ggtaatcacttattttcttg

SEQ ID NO: 709254 - DNA, 20 bp, mouse
gtatctggtgtccacaaaag

SEQ ID NO: 709255 - DNA, 20 bp, mouse
gacctctagtttctaccaca

SEQ ID NO: 709256 - DNA, 20 bp, mouse
gactctccagttccagtcgt

SEQ ID NO: 709257 - DNA, 20 bp, mouse
ggagagagggagtccaacag

SEQ ID NO: 709258 - DNA, 20 bp, mouse
gtgtgctggagactgacttt

SEQ ID NO: 709259 - DNA, 20 bp, mouse
ggggcatggcagctggtgaa

SEQ ID NO: 709260 - DNA, 20 bp, mouse
gcaggtgaatggagttctca

SEQ ID NO: 709261 - DNA, 20 bp, mouse
gtggaggagtatgagggtcc

SEQ ID NO: 709262 - DNA, 20 bp, mouse
gtgtgggctctgtggaaaca

SEQ ID NO: 709263 - DNA, 20 bp, mouse
gaccgagtggaggagtatga

SEQ ID NO: 709264 - DNA, 20 bp, mouse
gcgctgcccagcagctacca

SEQ ID NO: 709265 - DNA, 20 bp, mouse
gtgcccagaggaccgagtgg

SEQ ID NO: 709266 - DNA, 20 bp, mouse
gacaagctgtagggaaggtg

SEQ ID NO: 709267 - DNA, 20 bp, mouse
gagcatgggggcagacatca

SEQ ID NO: 709268 - DNA, 20 bp, mouse
gaggccccaacagaagtgta

SEQ ID NO: 709269 - DNA, 20 bp, mouse
gttaaagaggacaagctgta

SEQ ID NO: 709270 - DNA, 20 bp, mouse
gttaaaacatccattccctc

SEQ ID NO: 709271 - DNA, 20 bp, mouse
gcataactcaagaagcatgg

SEQ ID NO: 709272 - DNA, 20 bp, mouse
ggctccaatagaagaaggga

SEQ ID NO: 709273 - DNA, 20 bp, mouse
gtgttccctacacttctgtt

SEQ ID NO: 709274 - DNA, 20 bp, mouse
gaggtgctgagatgtgttcc

SEQ ID NO: 709275 - DNA, 20 bp, mouse
gcttagataaggacgatgat

SEQ ID NO: 709276 - DNA, 20 bp, mouse
gcgtctgagtaggagtatgt

SEQ ID NO: 709277 - DNA, 20 bp, mouse
gactggagacgcgctccgtg

SEQ ID NO: 709278 - DNA, 20 bp, mouse
gcggctgccgcgccccggtc

SEQ ID NO: 709279 - DNA, 20 bp, mouse
ggggcggacaggcgcacttc

SEQ ID NO: 709280 - DNA, 20 bp, mouse
gagtgcgcctgtccgcccca

SEQ ID NO: 709281 - DNA, 20 bp, mouse
ggacaggcgcacttccggac

SEQ ID NO: 709282 - DNA, 20 bp, mouse
gtggacgcgcttaccgtctg

SEQ ID NO: 709283 - DNA, 20 bp, mouse
gagaggcgcgtgcgcaccgt

SEQ ID NO: 709284 - DNA, 20 bp, mouse
gcgcgtgcgcaccgtgggtc

SEQ ID NO: 709285 - DNA, 20 bp, mouse
gacgcaggctgcaggagcga

SEQ ID NO: 709286 - DNA, 20 bp, mouse
gaatagagaagttacaaggc

SEQ ID NO: 709287 - DNA, 20 bp, mouse
gtgtcaatagagaagttaca

SEQ ID NO: 709288 - DNA, 20 bp, mouse
gcaacatgttgttgggttat

SEQ ID NO: 709289 - DNA, 20 bp, mouse
gcatataaacccagattctg

SEQ ID NO: 709290 - DNA, 20 bp, mouse
gaaatgcatgctgagaagtc

SEQ ID NO: 709291 - DNA, 20 bp, mouse
gtatcattatggcttagagc

SEQ ID NO: 709292 - DNA, 20 bp, mouse
ggtattggatcctcagaatc

SEQ ID NO: 709293 - DNA, 20 bp, mouse
gttaactctcaacatgttgt

SEQ ID NO: 709294 - DNA, 20 bp, mouse
ggtgtatgggtttccactga

SEQ ID NO: 709295 - DNA, 20 bp, mouse
gtaagaagggagaatacaat

SEQ ID NO: 709296 - DNA, 20 bp, mouse
gcaaagggttactgacaaac

SEQ ID NO: 709297 - DNA, 20 bp, mouse
gtgtgagacaagccctggac

SEQ ID NO: 709298 - DNA, 20 bp, mouse
gtatatccctagacagggaa

SEQ ID NO: 709299 - DNA, 20 bp, mouse
gagccctggacaggaagtat

SEQ ID NO: 709300 - DNA, 20 bp, mouse
gtccagcttcaagtcttgga

SEQ ID NO: 709301 - DNA, 20 bp, mouse
gttggatatcacttctccaa

SEQ ID NO: 709302 - DNA, 20 bp, mouse
gtgtgtaagcagcttggtac

SEQ ID NO: 709303 - DNA, 20 bp, mouse
gtggcagcattttctaagag

SEQ ID NO: 709304 - DNA, 20 bp, mouse
gtggtagcaaggccagagtc

SEQ ID NO: 709305 - DNA, 20 bp, mouse
gtgtctagggatatagtttg

SEQ ID NO: 709306 - DNA, 20 bp, mouse
gagaaccacggcagtgtgaa

SEQ ID NO: 709307 - DNA, 20 bp, mouse
gaggcctgacccgggtccgc

SEQ ID NO: 709308 - DNA, 20 bp, mouse
gaaacagcagagtaaagcga

SEQ ID NO: 709309 - DNA, 20 bp, mouse
gcacggcagtgtgaagggat

SEQ ID NO: 709310 - DNA, 20 bp, mouse
gcgaaggcagaaggccgcgt

SEQ ID NO: 709311 - DNA, 20 bp, mouse
gtgacccgggtccgcagggg

SEQ ID NO: 709312 - DNA, 20 bp, mouse
ggagagatgctaagagctaa

SEQ ID NO: 709313 - DNA, 20 bp, mouse
gcaggcctcatagttcccca

SEQ ID NO: 709314 - DNA, 20 bp, mouse
gttgggtcgaaggtattgaa

SEQ ID NO: 709315 - DNA, 20 bp, mouse
gggaactatgaggcctgacc

SEQ ID NO: 709316 - DNA, 20 bp, mouse
gccctcctggggtgcaaaat

SEQ ID NO: 709317 - DNA, 20 bp, mouse
gtcctggggtgcaaaatcgg

SEQ ID NO: 709318 - DNA, 20 bp, mouse
gttagcgggcgcttagaaca

SEQ ID NO: 709319 - DNA, 20 bp, mouse
gagaggccggaaaggatgag

SEQ ID NO: 709320 - DNA, 20 bp, mouse
ggggtcccttcgctgccaac

SEQ ID NO: 709321 - DNA, 20 bp, mouse
gggacccaggagagtttagc

SEQ ID NO: 709322 - DNA, 20 bp, mouse
ggaagaaggtccccgagccg

SEQ ID NO: 709323 - DNA, 20 bp, mouse
ggcgcccgctaaactctcct

SEQ ID NO: 709324 - DNA, 20 bp, mouse
gcacgccagttggcagcgaa

SEQ ID NO: 709325 - DNA, 20 bp, mouse
gaccaccctgctaagatcag

SEQ ID NO: 709326 - DNA, 20 bp, mouse
gggatagaaaggaggaacat

SEQ ID NO: 709327 - DNA, 20 bp, mouse
gcatgggatacaggtatccg

SEQ ID NO: 709328 - DNA, 20 bp, mouse
gtagctttagctggatagaa

SEQ ID NO: 709329 - DNA, 20 bp, mouse
gatctcctaaaattcagctc

SEQ ID NO: 709330 - DNA, 20 bp, mouse
gtcaagagaaattggatcag

SEQ ID NO: 709331 - DNA, 20 bp, mouse
gatatgcagcatttacaaag

SEQ ID NO: 709332 - DNA, 20 bp, mouse
ggctcccctgtagctttagc

SEQ ID NO: 709333 - DNA, 20 bp, mouse
gaggtatctgcatgggatac

SEQ ID NO: 709334 - DNA, 20 bp, mouse
gttctctcccagtgatagga

SEQ ID NO: 709335 - DNA, 20 bp, mouse
gtcttccagagctgaatttt

SEQ ID NO: 709336 - DNA, 20 bp, mouse
gcacatggtagacagatgta

SEQ ID NO: 709337 - DNA, 20 bp, mouse
gacaggctgttacaaaaaga

SEQ ID NO: 709338 - DNA, 20 bp, mouse
gtcacttgatgttacttgta

SEQ ID NO: 709339 - DNA, 20 bp, mouse
ggcatagttcaccaccatgt

SEQ ID NO: 709340 - DNA, 20 bp, mouse
gtctcatgaaaattacaagc

SEQ ID NO: 709341 - DNA, 20 bp, mouse
gagagtagagagaactcctc

SEQ ID NO: 709342 - DNA, 20 bp, mouse
gctctggaagagcagtgctc

SEQ ID NO: 709343 - DNA, 20 bp, mouse
ggggtgggactggatggaat

SEQ ID NO: 709344 - DNA, 20 bp, mouse
gtagttcaccaccatgtggg

SEQ ID NO: 709345 - DNA, 20 bp, mouse
gatacataaatgaactcgta

SEQ ID NO: 709346 - DNA, 20 bp, mouse
gaaaagcaaggatgcagcac

SEQ ID NO: 709347 - DNA, 20 bp, mouse
gatggaccaaccctggcctg

SEQ ID NO: 709348 - DNA, 20 bp, mouse
gacatcggggctttagggtg

SEQ ID NO: 709349 - DNA, 20 bp, mouse
ggacaaccacaggccagggt

SEQ ID NO: 709350 - DNA, 20 bp, mouse
gctatgacaaccacaggcca

SEQ ID NO: 709351 - DNA, 20 bp, mouse
gatgcagcacaggccaacat

SEQ ID NO: 709352 - DNA, 20 bp, mouse
gggccaacatcggggcttta

SEQ ID NO: 709353 - DNA, 20 bp, mouse
gtaagaaagtaagtatgtac

SEQ ID NO: 709354 - DNA, 20 bp, mouse
gaggtggatgaccaaaatca

SEQ ID NO: 709355 - DNA, 20 bp, mouse
gaaactgctatgacaaccac

SEQ ID NO: 709356 - DNA, 20 bp, mouse
gagtgggcatgaacccccac

SEQ ID NO: 709357 - DNA, 20 bp, mouse
gcatctctgaccacttccag

SEQ ID NO: 709358 - DNA, 20 bp, mouse
ggctaacataaatgtttgac

SEQ ID NO: 709359 - DNA, 20 bp, mouse
ggcccatattgattttcttc

SEQ ID NO: 709360 - DNA, 20 bp, mouse
gtttcagccagcagctccag

SEQ ID NO: 709361 - DNA, 20 bp, mouse
gcagaattaaaaaaaggtca

SEQ ID NO: 709362 - DNA, 20 bp, mouse
gaaaataaagctcatccagt

SEQ ID NO: 709363 - DNA, 20 bp, mouse
gttatggatattattcagta

SEQ ID NO: 709364 - DNA, 20 bp, mouse
gattaaaatagaatataagg

SEQ ID NO: 709365 - DNA, 20 bp, mouse
gttaatttaacatcacatta

SEQ ID NO: 709366 - DNA, 20 bp, mouse
gttgtagtaggtctacaact

SEQ ID NO: 709367 - DNA, 20 bp, mouse
gcgcacctgttcttaaaagc

SEQ ID NO: 709368 - DNA, 20 bp, mouse
ggcttagtttagatttattt

SEQ ID NO: 709369 - DNA, 20 bp, mouse
gacagactgcaatgttttgt

SEQ ID NO: 709370 - DNA, 20 bp, mouse
ggtcaaattttattattcct

SEQ ID NO: 709371 - DNA, 20 bp, mouse
gtgcaatgttttgttgggag

SEQ ID NO: 709372 - DNA, 20 bp, mouse
ggaagcagggtatgtggagg

SEQ ID NO: 709373 - DNA, 20 bp, mouse
gcccacagaagcagggtatg

SEQ ID NO: 709374 - DNA, 20 bp, mouse
gcacctgtggagagaatgaa

SEQ ID NO: 709375 - DNA, 20 bp, mouse
gcacagaattgctttgtttc

SEQ ID NO: 709376 - DNA, 20 bp, mouse
gaaaaggtcatgctacctaa

SEQ ID NO: 709377 - DNA, 20 bp, mouse
gcagcagccaagaggaacca

SEQ ID NO: 709378 - DNA, 20 bp, mouse
gctggcttacagcagccaag

SEQ ID NO: 709379 - DNA, 20 bp, mouse
ggaacgtctgatctaagttc

SEQ ID NO: 709380 - DNA, 20 bp, mouse
gttcggtgatgcctgcgaaa

SEQ ID NO: 709381 - DNA, 20 bp, mouse
gggtagcatgaccttttcgc

SEQ ID NO: 709382 - DNA, 20 bp, mouse
gaattttgtggtttatgggg

SEQ ID NO: 709383 - DNA, 20 bp, mouse
gccacctactctgggcgagc

SEQ ID NO: 709384 - DNA, 20 bp, mouse
gaatgaccttgtttgacaca

SEQ ID NO: 709385 - DNA, 20 bp, mouse
gattaattttgtggtttatg

SEQ ID NO: 709386 - DNA, 20 bp, mouse
gaacccagatgactgctcaa

SEQ ID NO: 709387 - DNA, 20 bp, mouse
gggcccttgagcagtcatct

SEQ ID NO: 709388 - DNA, 20 bp, mouse
gcacttgggaggcatatccg

SEQ ID NO: 709389 - DNA, 20 bp, mouse
ggaggcatatccgaggcata

SEQ ID NO: 709390 - DNA, 20 bp, mouse
gaggtagaaattgatccaga

SEQ ID NO: 709391 - DNA, 20 bp, mouse
gaaagtagtaaccctttcta

SEQ ID NO: 709392 - DNA, 20 bp, mouse
gctttctagggttgatacca

SEQ ID NO: 709393 - DNA, 20 bp, mouse
ggaaattgatccagaaggca

SEQ ID NO: 709394 - DNA, 20 bp, mouse
gtagggttgataccagggac

SEQ ID NO: 709395 - DNA, 20 bp, mouse
gactggaacattgcaatgac

SEQ ID NO: 709396 - DNA, 20 bp, mouse
ggcaacttctgtccatcagg

SEQ ID NO: 709397 - DNA, 20 bp, mouse
gatagtgtgtagaagtcaaa

SEQ ID NO: 709398 - DNA, 20 bp, mouse
gcaggtgacttcacccatta

SEQ ID NO: 709399 - DNA, 20 bp, mouse
gtagttgagggtatactcaa

SEQ ID NO: 709400 - DNA, 20 bp, mouse
gataaaaattgtgtccagcc

SEQ ID NO: 709401 - DNA, 20 bp, mouse
gatctatctatctggtgggg

SEQ ID NO: 709402 - DNA, 20 bp, mouse
gatctaagaagtctagttga

SEQ ID NO: 709403 - DNA, 20 bp, mouse
gacacatgtgatattttggt

SEQ ID NO: 709404 - DNA, 20 bp, mouse
gtgaaattcattatatattc

SEQ ID NO: 709405 - DNA, 20 bp, mouse
gtaacacacatgtgatattt

SEQ ID NO: 709406 - DNA, 20 bp, mouse
gtaaaggctgaggacaagct

SEQ ID NO: 709407 - DNA, 20 bp, mouse
gccagtgtcctcattaaaga

SEQ ID NO: 709408 - DNA, 20 bp, mouse
gaagggacccagaaatgact

SEQ ID NO: 709409 - DNA, 20 bp, mouse
gacaatgcatcactaagcag

SEQ ID NO: 709410 - DNA, 20 bp, mouse
ggccctgtcccagtcatttc

SEQ ID NO: 709411 - DNA, 20 bp, mouse
gtgactgggacagggccaaa

SEQ ID NO: 709412 - DNA, 20 bp, mouse
gctgggtcccttctttaatg

SEQ ID NO: 709413 - DNA, 20 bp, mouse
gaagaaccagccaggcgcgg

SEQ ID NO: 709414 - DNA, 20 bp, mouse
gatgaggttgttctgcttag

SEQ ID NO: 709415 - DNA, 20 bp, mouse
gtgaatggatttattcagat

SEQ ID NO: 709416 - DNA, 20 bp, mouse
ggcccccagacgccaggaaa

SEQ ID NO: 709417 - DNA, 20 bp, mouse
gagctgctctcagaggagag

SEQ ID NO: 709418 - DNA, 20 bp, mouse
ggagagcagctgttaagcac

SEQ ID NO: 709419 - DNA, 20 bp, mouse
ggcttaacagctgctctcag

SEQ ID NO: 709420 - DNA, 20 bp, mouse
gcgccctttcctggcgtctg

SEQ ID NO: 709421 - DNA, 20 bp, mouse
gctgcttcacctaagtacac

SEQ ID NO: 709422 - DNA, 20 bp, mouse
gcgtcggattcccccggaac

SEQ ID NO: 709423 - DNA, 20 bp, mouse
ggcggttgcgaactgccgtg

SEQ ID NO: 709424 - DNA, 20 bp, mouse
gcctggtgcccccagacgcc

SEQ ID NO: 709425 - DNA, 20 bp, mouse
gggaatccgacgccctttcc

SEQ ID NO: 709426 - DNA, 20 bp, mouse
ggggttgtgaatcaggtcac

SEQ ID NO: 709427 - DNA, 20 bp, mouse
gtgagcacgggttgtgaatc

SEQ ID NO: 709428 - DNA, 20 bp, mouse
gacacatagctcatgcacga

SEQ ID NO: 709429 - DNA, 20 bp, mouse
gtgtgtctaagtggcaggtg

SEQ ID NO: 709430 - DNA, 20 bp, mouse
gaggggatgggaaggacggg

SEQ ID NO: 709431 - DNA, 20 bp, mouse
gtcacaacccgtgctcacac

SEQ ID NO: 709432 - DNA, 20 bp, mouse
gaagagaccctgtgtctaag

SEQ ID NO: 709433 - DNA, 20 bp, mouse
gtatgtatacagaaaccgta

SEQ ID NO: 709434 - DNA, 20 bp, mouse
gagagtgtgcacaagaggga

SEQ ID NO: 709435 - DNA, 20 bp, mouse
gagggagggaccgacggagg

SEQ ID NO: 709436 - DNA, 20 bp, mouse
gcagaaggcaacagtacgtt

SEQ ID NO: 709437 - DNA, 20 bp, mouse
ggaaaaattcagcaagtaga

SEQ ID NO: 709438 - DNA, 20 bp, mouse
gaagatgcaaggtcagttcc

SEQ ID NO: 709439 - DNA, 20 bp, mouse
gtgctcttcgaacccagatg

SEQ ID NO: 709440 - DNA, 20 bp, mouse
gagttcctggcattcacata

SEQ ID NO: 709441 - DNA, 20 bp, mouse
gcttctctctatgtaatctt

SEQ ID NO: 709442 - DNA, 20 bp, mouse
gattacatagagagaaggcc

SEQ ID NO: 709443 - DNA, 20 bp, mouse
ggtgcatactctaagatgca

SEQ ID NO: 709444 - DNA, 20 bp, mouse
gagtacagctcaattcgcca

SEQ ID NO: 709445 - DNA, 20 bp, mouse
ggaaaactttaatcccccaa

SEQ ID NO: 709446 - DNA, 20 bp, mouse
ggaaagaaagaaatcacgtt

SEQ ID NO: 709447 - DNA, 20 bp, mouse
gaagtaagaacactggaagt

SEQ ID NO: 709448 - DNA, 20 bp, mouse
gacattgttaagttcttata

SEQ ID NO: 709449 - DNA, 20 bp, mouse
gaagggggtgggtaatgtta

SEQ ID NO: 709450 - DNA, 20 bp, mouse
gttaagttcttataaggtac

SEQ ID NO: 709451 - DNA, 20 bp, mouse
gagaaagctgcgttaagttc

SEQ ID NO: 709452 - DNA, 20 bp, mouse
gaggctttggacccttgtcc

SEQ ID NO: 709453 - DNA, 20 bp, mouse
gccacccccttcgacaaagc

SEQ ID NO: 709454 - DNA, 20 bp, mouse
gcatcatccagctttgtcga

SEQ ID NO: 709455 - DNA, 20 bp, mouse
gcatccagctttgtcgaagg

SEQ ID NO: 709456 - DNA, 20 bp, mouse
ggtcagctgagtatggcaca

SEQ ID NO: 709457 - DNA, 20 bp, mouse
gttacacaaaactagaggga

SEQ ID NO: 709458 - DNA, 20 bp, mouse
gagctctagcgatcaatatt

SEQ ID NO: 709459 - DNA, 20 bp, mouse
gaagtgtggaatggtttgga

SEQ ID NO: 709460 - DNA, 20 bp, mouse
ggaaatgagtcgagtagccc

SEQ ID NO: 709461 - DNA, 20 bp, mouse
gctaaatcttgtactcaggg

SEQ ID NO: 709462 - DNA, 20 bp, mouse
gtaagtcattgattggttct

SEQ ID NO: 709463 - DNA, 20 bp, mouse
gtctcaatgtcagctgagta

SEQ ID NO: 709464 - DNA, 20 bp, mouse
gatcaaagtgtggaatggtt

SEQ ID NO: 709465 - DNA, 20 bp, mouse
gattgatcgctagagcttca

SEQ ID NO: 709466 - DNA, 20 bp, mouse
gaatatgcagtgtactatgg

SEQ ID NO: 709467 - DNA, 20 bp, mouse
ggagaatatgcagtgtacta

SEQ ID NO: 709468 - DNA, 20 bp, mouse
gtatctataacaaaactcac

SEQ ID NO: 709469 - DNA, 20 bp, mouse
gcaaagttaaatatcaattc

SEQ ID NO: 709470 - DNA, 20 bp, mouse
gaattgtgtcgtgagatgaa

SEQ ID NO: 709471 - DNA, 20 bp, mouse
ggcatattctcagtgctatg

SEQ ID NO: 709472 - DNA, 20 bp, mouse
gttaatactggctaatcttc

SEQ ID NO: 709473 - DNA, 20 bp, mouse
gggattatttgggccaaaac

SEQ ID NO: 709474 - DNA, 20 bp, mouse
gcacacaaacgtcacggcct

SEQ ID NO: 709475 - DNA, 20 bp, mouse
gtaaaaatacaaacagttag

SEQ ID NO: 709476 - DNA, 20 bp, mouse
gtcccttggcacatagcaat

SEQ ID NO: 709477 - DNA, 20 bp, mouse
gaacattgcccaggccattc

SEQ ID NO: 709478 - DNA, 20 bp, mouse
gagtctacagaacattgccc

SEQ ID NO: 709479 - DNA, 20 bp, mouse
gcttcttcttctttcaggtg

SEQ ID NO: 709480 - DNA, 20 bp, mouse
ggtccgattgctatgtgcca

SEQ ID NO: 709481 - DNA, 20 bp, mouse
gcttttgcaatatgatgtag

SEQ ID NO: 709482 - DNA, 20 bp, mouse
gccctacagaaggtgctaaa

SEQ ID NO: 709483 - DNA, 20 bp, mouse
ggatcagaaaatcaaatcag

SEQ ID NO: 709484 - DNA, 20 bp, mouse
gcaatatgatgtagtggtga

SEQ ID NO: 709485 - DNA, 20 bp, mouse
gtatgatgtagtggtgatgg

SEQ ID NO: 709486 - DNA, 20 bp, mouse
gtgtgggcacaggacctcgt

SEQ ID NO: 709487 - DNA, 20 bp, mouse
gcaggagaggtcattcatga

SEQ ID NO: 709488 - DNA, 20 bp, mouse
gtgcccacaggccgagagaa

SEQ ID NO: 709489 - DNA, 20 bp, mouse
gtgggaagctagcctgctga

SEQ ID NO: 709490 - DNA, 20 bp, mouse
gacaggacctcgtgggtgga

SEQ ID NO: 709491 - DNA, 20 bp, mouse
ggccacctcctcctcaactg

SEQ ID NO: 709492 - DNA, 20 bp, mouse
ggctagcttcccacagaggt

SEQ ID NO: 709493 - DNA, 20 bp, mouse
gggccgagagaagggcttcg

SEQ ID NO: 709494 - DNA, 20 bp, mouse
gctagcctgctgatggattg

SEQ ID NO: 709495 - DNA, 20 bp, mouse
ggcaggctagcttcccacag

SEQ ID NO: 709496 - DNA, 20 bp, mouse
gaaggcctaagtgggactga

SEQ ID NO: 709497 - DNA, 20 bp, mouse
ggggtcccaaggatgacagt

SEQ ID NO: 709498 - DNA, 20 bp, mouse
ggagccctgaaggcctaagt

SEQ ID NO: 709499 - DNA, 20 bp, mouse
gtctgagtgcgagatggaga

SEQ ID NO: 709500 - DNA, 20 bp, mouse
ggggaactgcggtgcaccct

SEQ ID NO: 709501 - DNA, 20 bp, mouse
gcaaggggtcaagacgcaaa

SEQ ID NO: 709502 - DNA, 20 bp, mouse
gagtcccacttaggccttca

SEQ ID NO: 709503 - DNA, 20 bp, mouse
gcctgggggagaactcccga

SEQ ID NO: 709504 - DNA, 20 bp, mouse
gtgaatgaacctatgaaacc

SEQ ID NO: 709505 - DNA, 20 bp, mouse
gtggggcgtccaactttgga

SEQ ID NO: 709506 - DNA, 20 bp, mouse
gcatctgtacagtcacctac

SEQ ID NO: 709507 - DNA, 20 bp, mouse
gtggaagacccgcactgtgc

SEQ ID NO: 709508 - DNA, 20 bp, mouse
gagagaatgtctcaaatgac

SEQ ID NO: 709509 - DNA, 20 bp, mouse
gttcattgcagttcattata

SEQ ID NO: 709510 - DNA, 20 bp, mouse
ggaggattaacttagtgtat

SEQ ID NO: 709511 - DNA, 20 bp, mouse
gtagtgtataggtagaaata

SEQ ID NO: 709512 - DNA, 20 bp, mouse
gctgcaatgaaaccataaag

SEQ ID NO: 709513 - DNA, 20 bp, mouse
gactaagttaatcctcttta

SEQ ID NO: 709514 - DNA, 20 bp, mouse
gaggacggggatttcctgta

SEQ ID NO: 709515 - DNA, 20 bp, mouse
gataaagtgagtgtggctcc

SEQ ID NO: 709516 - DNA, 20 bp, mouse
gaggctgtagacttaggtca

SEQ ID NO: 709517 - DNA, 20 bp, mouse
gttctatagaacatcatgct

SEQ ID NO: 709518 - DNA, 20 bp, mouse
gcatgatgttctatagaaat

SEQ ID NO: 709519 - DNA, 20 bp, mouse
ggcgaatgagtttggtcaga

SEQ ID NO: 709520 - DNA, 20 bp, mouse
gcaagcactaagaatatagt

SEQ ID NO: 709521 - DNA, 20 bp, mouse
ggggttctggacagtagttt

SEQ ID NO: 709522 - DNA, 20 bp, mouse
gtctcggcagcgaatgagtt

SEQ ID NO: 709523 - DNA, 20 bp, mouse
gtggacagtagttttggttg

SEQ ID NO: 709524 - DNA, 20 bp, mouse
gactaagaatatagtaggaa

SEQ ID NO: 709525 - DNA, 20 bp, mouse
gtttcaggtggtcataaatg

SEQ ID NO: 709526 - DNA, 20 bp, mouse
ggaatctaataaataacaag

SEQ ID NO: 709527 - DNA, 20 bp, mouse
gtataaaggatagttatata

SEQ ID NO: 709528 - DNA, 20 bp, mouse
gttggcacattatgtaagtg

SEQ ID NO: 709529 - DNA, 20 bp, mouse
gctgtaagttactgataaaa

SEQ ID NO: 709530 - DNA, 20 bp, mouse
gctttgtgatccaatatttt

SEQ ID NO: 709531 - DNA, 20 bp, mouse
gcttctcattaattttacca

SEQ ID NO: 709532 - DNA, 20 bp, mouse
gaatattggatcacaaagga

SEQ ID NO: 709533 - DNA, 20 bp, mouse
gagttcactttctataagtt

SEQ ID NO: 709534 - DNA, 20 bp, mouse
gagaagaaaatcacagtctt

SEQ ID NO: 709535 - DNA, 20 bp, mouse
ggtatgtgcacacaaaatta

SEQ ID NO: 709536 - DNA, 20 bp, mouse
ggaaagtctctcaagaacaa

SEQ ID NO: 709537 - DNA, 20 bp, mouse
gtagctcagattaaacggtt

SEQ ID NO: 709538 - DNA, 20 bp, mouse
gcatctatacaccagaagat

SEQ ID NO: 709539 - DNA, 20 bp, mouse
gctgctatttttgatggtag

SEQ ID NO: 709540 - DNA, 20 bp, mouse
gaaaacagtatccaatcttc

SEQ ID NO: 709541 - DNA, 20 bp, mouse
gtaattcctgctatttttga

SEQ ID NO: 709542 - DNA, 20 bp, mouse
ggacttgacgttctggctat

SEQ ID NO: 709543 - DNA, 20 bp, mouse
gggcactagctcagattaaa

SEQ ID NO: 709544 - DNA, 20 bp, mouse
gctagcttttatctttttat

SEQ ID NO: 709545 - DNA, 20 bp, mouse
gctaaacttacttttaataa

SEQ ID NO: 709546 - DNA, 20 bp, mouse
gcaaggttcagtgcagaagg

SEQ ID NO: 709547 - DNA, 20 bp, mouse
gacacaaggttcagtgcaga

SEQ ID NO: 709548 - DNA, 20 bp, mouse
ggacctcctctcaatgggca

SEQ ID NO: 709549 - DNA, 20 bp, mouse
gcagtgcagaagggggagtc

SEQ ID NO: 709550 - DNA, 20 bp, mouse
ggatctagcacaaggcagtt

SEQ ID NO: 709551 - DNA, 20 bp, mouse
gctgctgtggatctagcaca

SEQ ID NO: 709552 - DNA, 20 bp, mouse
gagctacttttccttttcta

SEQ ID NO: 709553 - DNA, 20 bp, mouse
gtctaaatacataaataaac

SEQ ID NO: 709554 - DNA, 20 bp, mouse
gctgagggcagggcttgagt

SEQ ID NO: 709555 - DNA, 20 bp, mouse
ggggctgagagctgggctga

SEQ ID NO: 709556 - DNA, 20 bp, mouse
ggctttgggaagaccctcat

SEQ ID NO: 709557 - DNA, 20 bp, mouse
gacgcagcctggcacctcat

SEQ ID NO: 709558 - DNA, 20 bp, mouse
gaagggctgggatatgatag

SEQ ID NO: 709559 - DNA, 20 bp, mouse
gaatcaccataggattaacg

SEQ ID NO: 709560 - DNA, 20 bp, mouse
ggatgtgcataggggagcac

SEQ ID NO: 709561 - DNA, 20 bp, mouse
gagaacctgactgagggctc

SEQ ID NO: 709562 - DNA, 20 bp, mouse
gtgtgtgatgtggtgggatc

SEQ ID NO: 709563 - DNA, 20 bp, mouse
gtatcccagcccttgacctt

SEQ ID NO: 709564 - DNA, 20 bp, mouse
gctcccctatgcacatctgc

SEQ ID NO: 709565 - DNA, 20 bp, mouse
gagccagccaatgaggtgcc

SEQ ID NO: 709566 - DNA, 20 bp, mouse
gcacctttgtagacccttta

SEQ ID NO: 709567 - DNA, 20 bp, mouse
gttggtccacaaatctcact

SEQ ID NO: 709568 - DNA, 20 bp, mouse
gatagtcatccttcaattcc

SEQ ID NO: 709569 - DNA, 20 bp, mouse
gtcttgctgatttggatacc

SEQ ID NO: 709570 - DNA, 20 bp, mouse
gtgtgattgtttaccctaaa

SEQ ID NO: 709571 - DNA, 20 bp, mouse
gaactgggagggagtcttta

SEQ ID NO: 709572 - DNA, 20 bp, mouse
gctacccagtgcttggggaa

SEQ ID NO: 709573 - DNA, 20 bp, mouse
gcaggggcgactcagctgta

SEQ ID NO: 709574 - DNA, 20 bp, mouse
gtagagctacccagtgcttg

SEQ ID NO: 709575 - DNA, 20 bp, mouse
gaacatcaatagttctctgt

SEQ ID NO: 709576 - DNA, 20 bp, mouse
gtaggaccaaccattcaaat

SEQ ID NO: 709577 - DNA, 20 bp, mouse
gcagtaaaccctgctaccta

SEQ ID NO: 709578 - DNA, 20 bp, mouse
ggatagacattgggtcacat

SEQ ID NO: 709579 - DNA, 20 bp, mouse
ggcatgttgaggatagacat

SEQ ID NO: 709580 - DNA, 20 bp, mouse
gtgacacgagaaggggaaat

SEQ ID NO: 709581 - DNA, 20 bp, mouse
gagggtttactgtatgctaa

SEQ ID NO: 709582 - DNA, 20 bp, mouse
gttgaaacatagcaacgtct

SEQ ID NO: 709583 - DNA, 20 bp, mouse
gtcagaggtgacacgagaag

SEQ ID NO: 709584 - DNA, 20 bp, mouse
gaatatgtttacacttagag

SEQ ID NO: 709585 - DNA, 20 bp, mouse
gcaagagattgaaccttagg

SEQ ID NO: 709586 - DNA, 20 bp, mouse
gcacgtggacagtgaaggta

SEQ ID NO: 709587 - DNA, 20 bp, mouse
gagtgaaggtagggcttgta

SEQ ID NO: 709588 - DNA, 20 bp, mouse
gcctcccacgtggacagtga

SEQ ID NO: 709589 - DNA, 20 bp, mouse
gtctaccgccctgacgacca

SEQ ID NO: 709590 - DNA, 20 bp, mouse
ggcagtggagggctacacta

SEQ ID NO: 709591 - DNA, 20 bp, mouse
gagcctctgcagcagaacag

SEQ ID NO: 709592 - DNA, 20 bp, mouse
gtacactatggtcagaatag

SEQ ID NO: 709593 - DNA, 20 bp, mouse
gtagaaagacaggtctgcct

SEQ ID NO: 709594 - DNA, 20 bp, mouse
gggtagaaggtgagatgttc

SEQ ID NO: 709595 - DNA, 20 bp, mouse
gccctgacgaccacggaatg

SEQ ID NO: 709596 - DNA, 20 bp, mouse
gactgcctgattgaaattgg

SEQ ID NO: 709597 - DNA, 20 bp, mouse
gggagagtctctcaaaagcc

SEQ ID NO: 709598 - DNA, 20 bp, mouse
ggagtctctcaaaagccagg

SEQ ID NO: 709599 - DNA, 20 bp, mouse
gtaatagctgtagtacgggg

SEQ ID NO: 709600 - DNA, 20 bp, mouse
gtttgaagatcagaggtctg

SEQ ID NO: 709601 - DNA, 20 bp, mouse
gatctctgagtaggcaagct

SEQ ID NO: 709602 - DNA, 20 bp, mouse
gaacttaatagctgtagtac

SEQ ID NO: 709603 - DNA, 20 bp, mouse
gtatgtatctccttattgag

SEQ ID NO: 709604 - DNA, 20 bp, mouse
ggccattctcagcagactaa

SEQ ID NO: 709605 - DNA, 20 bp, mouse
gcctgattgaaattggggga

SEQ ID NO: 709606 - DNA, 20 bp, mouse
gcagccacgcgcaggactgg

SEQ ID NO: 709607 - DNA, 20 bp, mouse
gtccgagtaggggctctaag

SEQ ID NO: 709608 - DNA, 20 bp, mouse
gaccccccttaactctggat

SEQ ID NO: 709609 - DNA, 20 bp, mouse
ggggcagccacgcgcaggac

SEQ ID NO: 709610 - DNA, 20 bp, mouse
gcaaaggggcagccacgcgc

SEQ ID NO: 709611 - DNA, 20 bp, mouse
ggggtagagaggcggcgcga

SEQ ID NO: 709612 - DNA, 20 bp, mouse
gcccaggcgggggaagaagg

SEQ ID NO: 709613 - DNA, 20 bp, mouse
gcccctactcggaggtacaa

SEQ ID NO: 709614 - DNA, 20 bp, mouse
gcggactagctgcggtgggg

SEQ ID NO: 709615 - DNA, 20 bp, mouse
gcgcatgcgcggactagctg

SEQ ID NO: 709616 - DNA, 20 bp, mouse
ggggggcattggcagaagag

SEQ ID NO: 709617 - DNA, 20 bp, mouse
gttgccaagtgcagagacga

SEQ ID NO: 709618 - DNA, 20 bp, mouse
gtgtagaccatgtagagttg

SEQ ID NO: 709619 - DNA, 20 bp, mouse
ggattgacctcaactctaca

SEQ ID NO: 709620 - DNA, 20 bp, mouse
ggtttgtgctgagtatggca

SEQ ID NO: 709621 - DNA, 20 bp, mouse
ggtgatgtttgtgctgagta

SEQ ID NO: 709622 - DNA, 20 bp, mouse
gaaattcaaaggtacaatca

SEQ ID NO: 709623 - DNA, 20 bp, mouse
gtgagttgtaagatttctta

SEQ ID NO: 709624 - DNA, 20 bp, mouse
gttgccttcgtctctgcact

SEQ ID NO: 709625 - DNA, 20 bp, mouse
gagacgatgagactgtctct

SEQ ID NO: 709626 - DNA, 20 bp, mouse
ggaaggcaggggccaataga

SEQ ID NO: 709627 - DNA, 20 bp, mouse
gcaggggccaatagagggca

SEQ ID NO: 709628 - DNA, 20 bp, mouse
gtaaccgtacatggtgggtg

SEQ ID NO: 709629 - DNA, 20 bp, mouse
gtcgcaccgctctggactaa

SEQ ID NO: 709630 - DNA, 20 bp, mouse
gcaactgaacaggtgaattc

SEQ ID NO: 709631 - DNA, 20 bp, mouse
gccaccatgtacggttacca

SEQ ID NO: 709632 - DNA, 20 bp, mouse
gctggctggaggcataaggt

SEQ ID NO: 709633 - DNA, 20 bp, mouse
gaggggacaggagaattcgg

SEQ ID NO: 709634 - DNA, 20 bp, mouse
ggtttccggagggaaggcag

SEQ ID NO: 709635 - DNA, 20 bp, mouse
gcctccggaaactcgtggca

SEQ ID NO: 709636 - DNA, 20 bp, mouse
ggggctgggtaagactttta

SEQ ID NO: 709637 - DNA, 20 bp, mouse
gacaccttcaataaagggag

SEQ ID NO: 709638 - DNA, 20 bp, mouse
gactctctgtctactaaatt

SEQ ID NO: 709639 - DNA, 20 bp, mouse
gaaagagtgacaaggtgtgg

SEQ ID NO: 709640 - DNA, 20 bp, mouse
gctctgtctactaaattggg

SEQ ID NO: 709641 - DNA, 20 bp, mouse
gcaggccacaccttcaataa

SEQ ID NO: 709642 - DNA, 20 bp, mouse
ggctgcttgagtgcaagcat

SEQ ID NO: 709643 - DNA, 20 bp, mouse
ggggagagttgtgcaggagg

SEQ ID NO: 709644 - DNA, 20 bp, mouse
gtcattcagcaggagttagt

SEQ ID NO: 709645 - DNA, 20 bp, mouse
gttagggagagttgtgcagg

SEQ ID NO: 709646 - DNA, 20 bp, mouse
ggaaactcaccgcgtagaga

SEQ ID NO: 709647 - DNA, 20 bp, mouse
gcctctgcctccaatggcct

SEQ ID NO: 709648 - DNA, 20 bp, mouse
gagggacaaccttctctacg

SEQ ID NO: 709649 - DNA, 20 bp, mouse
gttacagtctatctggaaac

SEQ ID NO: 709650 - DNA, 20 bp, mouse
gtgctcaattaagaagttat

SEQ ID NO: 709651 - DNA, 20 bp, mouse
gacttcttaattgagcatgg

SEQ ID NO: 709652 - DNA, 20 bp, mouse
ggaagaagactcttactttc

SEQ ID NO: 709653 - DNA, 20 bp, mouse
ggtaacaactaagcactggg

SEQ ID NO: 709654 - DNA, 20 bp, mouse
gaactgtaacaactaagcac

SEQ ID NO: 709655 - DNA, 20 bp, mouse
gacctttaatcccaggccat

SEQ ID NO: 709656 - DNA, 20 bp, mouse
ggatagacggaaaggtcatc

SEQ ID NO: 709657 - DNA, 20 bp, mouse
gtacacaggagctacaaagt

SEQ ID NO: 709658 - DNA, 20 bp, mouse
gtaggtaagttgatcatagc

SEQ ID NO: 709659 - DNA, 20 bp, mouse
gtctgcatagatagacggaa

SEQ ID NO: 709660 - DNA, 20 bp, mouse
gccagcaaggatttattgaa

SEQ ID NO: 709661 - DNA, 20 bp, mouse
gtgtcatctgcatagataga

SEQ ID NO: 709662 - DNA, 20 bp, mouse
gtcatcaggaatgcatacac

SEQ ID NO: 709663 - DNA, 20 bp, mouse
gtagaacacagggtcccaaa

SEQ ID NO: 709664 - DNA, 20 bp, mouse
ggtatagcctcacaagagac

SEQ ID NO: 709665 - DNA, 20 bp, mouse
gtaataaccttaacattcaa

SEQ ID NO: 709666 - DNA, 20 bp, mouse
gaggggctcagggaagctgt

SEQ ID NO: 709667 - DNA, 20 bp, mouse
ggtggggagggaaagagtgc

SEQ ID NO: 709668 - DNA, 20 bp, mouse
gtggttttctgccctttccc

SEQ ID NO: 709669 - DNA, 20 bp, mouse
ggcacgggccactcccaccc

SEQ ID NO: 709670 - DNA, 20 bp, mouse
gtttctgccctttcccgggt

SEQ ID NO: 709671 - DNA, 20 bp, mouse
gtttgggctgactcggcccc

SEQ ID NO: 709672 - DNA, 20 bp, mouse
gagagcaggtaggttcatgg

SEQ ID NO: 709673 - DNA, 20 bp, mouse
ggccactcccacccgggaaa

SEQ ID NO: 709674 - DNA, 20 bp, mouse
ggaggataacaacagtggtg

SEQ ID NO: 709675 - DNA, 20 bp, mouse
gccagcacgaggggtccacg

SEQ ID NO: 709676 - DNA, 20 bp, mouse
gcgggagagccagaggtccc

SEQ ID NO: 709677 - DNA, 20 bp, mouse
gcccagacgtggatttttta

SEQ ID NO: 709678 - DNA, 20 bp, mouse
gtcggggtttgtacttttgt

SEQ ID NO: 709679 - DNA, 20 bp, mouse
gaggtgcacgggagagccag

SEQ ID NO: 709680 - DNA, 20 bp, mouse
gtgaaacgtctgaggtgcac

SEQ ID NO: 709681 - DNA, 20 bp, mouse
gcgggatttagaaaaagtac

SEQ ID NO: 709682 - DNA, 20 bp, mouse
gaccttaaaaaatccacgtc

SEQ ID NO: 709683 - DNA, 20 bp, mouse
gatccacgtctgggaacaga

SEQ ID NO: 709684 - DNA, 20 bp, mouse
gtattatgcagccaaggcac

SEQ ID NO: 709685 - DNA, 20 bp, mouse
gtggattttttaaggtagta

SEQ ID NO: 709686 - DNA, 20 bp, mouse
gacaacccatgtgaagtaca

SEQ ID NO: 709687 - DNA, 20 bp, mouse
gtgagtcaggaggccaacag

SEQ ID NO: 709688 - DNA, 20 bp, mouse
gagtgagcagctgagtcagg

SEQ ID NO: 709689 - DNA, 20 bp, mouse
gtccttctgcagcataatgg

SEQ ID NO: 709690 - DNA, 20 bp, mouse
gaaggatgtgcgtataagag

SEQ ID NO: 709691 - DNA, 20 bp, mouse
gtgctcaactctagtagctt

SEQ ID NO: 709692 - DNA, 20 bp, mouse
gaactctagtagctttggtg

SEQ ID NO: 709693 - DNA, 20 bp, mouse
gggtcatcaggaaaatgacc

SEQ ID NO: 709694 - DNA, 20 bp, mouse
gcaacccctgtacttcacat

SEQ ID NO: 709695 - DNA, 20 bp, mouse
gggaaaagacacaaggtaga

SEQ ID NO: 709696 - DNA, 20 bp, mouse
ggagaactgtcattatctag

SEQ ID NO: 709697 - DNA, 20 bp, mouse
gggcatcattggtgaagttg

SEQ ID NO: 709698 - DNA, 20 bp, mouse
gtcattggtgaagttggggc

SEQ ID NO: 709699 - DNA, 20 bp, mouse
gcagatagacacgtactcac

SEQ ID NO: 709700 - DNA, 20 bp, mouse
gacccaggaatacagctgat

SEQ ID NO: 709701 - DNA, 20 bp, mouse
ggcaccgactcattctgtcc

SEQ ID NO: 709702 - DNA, 20 bp, mouse
gagaacttgtacctgttaat

SEQ ID NO: 709703 - DNA, 20 bp, mouse
gtgttgatgacctttctgtt

SEQ ID NO: 709704 - DNA, 20 bp, mouse
gtcaccatggggaaatgact

SEQ ID NO: 709705 - DNA, 20 bp, mouse
gtaatgacagttctcattgt

SEQ ID NO: 709706 - DNA, 20 bp, mouse
gatccaggggggttctataa

SEQ ID NO: 709707 - DNA, 20 bp, mouse
gtctataaagggtgactcga

SEQ ID NO: 709708 - DNA, 20 bp, mouse
gagggaaaacccagatccag

SEQ ID NO: 709709 - DNA, 20 bp, mouse
ggggaacagggaaggcccct

SEQ ID NO: 709710 - DNA, 20 bp, mouse
gcatgaaggaacaatcccag

SEQ ID NO: 709711 - DNA, 20 bp, mouse
gataccctgggccagtgctc

SEQ ID NO: 709712 - DNA, 20 bp, mouse
gacagccagcctgttaccat

SEQ ID NO: 709713 - DNA, 20 bp, mouse
gagacccgagcactggccca

SEQ ID NO: 709714 - DNA, 20 bp, mouse
gtattcccatggtaacaggc

SEQ ID NO: 709715 - DNA, 20 bp, mouse
gtcaaggacacccgacatga

SEQ ID NO: 709716 - DNA, 20 bp, mouse
gctcctctgggtgaaggtat

SEQ ID NO: 709717 - DNA, 20 bp, mouse
gatcctataccttcacccag

SEQ ID NO: 709718 - DNA, 20 bp, mouse
gttcctctcttcatgatatg

SEQ ID NO: 709719 - DNA, 20 bp, mouse
gagccccatatcatgaagag

SEQ ID NO: 709720 - DNA, 20 bp, mouse
gatcatgaagagaggaatca

SEQ ID NO: 709721 - DNA, 20 bp, mouse
gaatcctacatcccgtgctg

SEQ ID NO: 709722 - DNA, 20 bp, mouse
gcctaaacccatggattggg

SEQ ID NO: 709723 - DNA, 20 bp, mouse
gcaccctaaacccatggatt

SEQ ID NO: 709724 - DNA, 20 bp, mouse
gggcttcctcctctgggtga

SEQ ID NO: 709725 - DNA, 20 bp, mouse
ggtgaaggtataggattctc

SEQ ID NO: 709726 - DNA, 20 bp, mouse
gacagcctgattgacctgtg

SEQ ID NO: 709727 - DNA, 20 bp, mouse
gtcagcctcacaggtcaatc

SEQ ID NO: 709728 - DNA, 20 bp, mouse
gggaacttccttattcgtct

SEQ ID NO: 709729 - DNA, 20 bp, mouse
gttcttaagaacttggccaa

SEQ ID NO: 709730 - DNA, 20 bp, mouse
gctgtctgacaataagcctt

SEQ ID NO: 709731 - DNA, 20 bp, mouse
gaggaagttccctctataca

SEQ ID NO: 709732 - DNA, 20 bp, mouse
gtcagacagagattgtaaag

SEQ ID NO: 709733 - DNA, 20 bp, mouse
gtgctagcccagcttgaaca

SEQ ID NO: 709734 - DNA, 20 bp, mouse
gttggattctaggagttctc

SEQ ID NO: 709735 - DNA, 20 bp, mouse
gctagaatccaagacgaata

SEQ ID NO: 709736 - DNA, 20 bp, mouse
gaatgtccctgccaagtcat

SEQ ID NO: 709737 - DNA, 20 bp, mouse
ggacattgggacacattaga

SEQ ID NO: 709738 - DNA, 20 bp, mouse
gtagaaggttgagaagaaga

SEQ ID NO: 709739 - DNA, 20 bp, mouse
ggggatggggggatgcacgt

SEQ ID NO: 709740 - DNA, 20 bp, mouse
ggggatcacagccaatgact

SEQ ID NO: 709741 - DNA, 20 bp, mouse
gctgttctctagccttggtg

SEQ ID NO: 709742 - DNA, 20 bp, mouse
gttctcctcctgctgttcga

SEQ ID NO: 709743 - DNA, 20 bp, mouse
gttagggtgggaggcgagtc

SEQ ID NO: 709744 - DNA, 20 bp, mouse
gctggccctcgaacagcagg

SEQ ID NO: 709745 - DNA, 20 bp, mouse
gtcatgtggcctgaggtaag

SEQ ID NO: 709746 - DNA, 20 bp, mouse
gtaccatctagcttactatc

SEQ ID NO: 709747 - DNA, 20 bp, mouse
gaacctagcacactaggaaa

SEQ ID NO: 709748 - DNA, 20 bp, mouse
gggtacaactgtctactctt

SEQ ID NO: 709749 - DNA, 20 bp, mouse
gaatcaaaacctagcacact

SEQ ID NO: 709750 - DNA, 20 bp, mouse
gctacacagggaggtgtctg

SEQ ID NO: 709751 - DNA, 20 bp, mouse
ggacaatagtctacacaggg

SEQ ID NO: 709752 - DNA, 20 bp, mouse
gtggcccatcataatgactc

SEQ ID NO: 709753 - DNA, 20 bp, mouse
gctggacaatagtctacaca

SEQ ID NO: 709754 - DNA, 20 bp, mouse
gttccttttcctagtgtgct

SEQ ID NO: 709755 - DNA, 20 bp, mouse
gctccagatagtaagctaga

SEQ ID NO: 709756 - DNA, 20 bp, mouse
ggaagcagggtccacaaata

SEQ ID NO: 709757 - DNA, 20 bp, mouse
gggtccacaaataaggaagc

SEQ ID NO: 709758 - DNA, 20 bp, mouse
gggctgtcagaagtactcta

SEQ ID NO: 709759 - DNA, 20 bp, mouse
gttgggtgggttcatcacat

SEQ ID NO: 709760 - DNA, 20 bp, mouse
gtgagtgatacacaaagcac

SEQ ID NO: 709761 - DNA, 20 bp, mouse
gtaggaaatcctctaggcca

SEQ ID NO: 709762 - DNA, 20 bp, mouse
gatcttaatgagcccggaaa

SEQ ID NO: 709763 - DNA, 20 bp, mouse
gtttgtggaccctgcttctt

SEQ ID NO: 709764 - DNA, 20 bp, mouse
ggctaagggtgctgtgaccc

SEQ ID NO: 709765 - DNA, 20 bp, mouse
gtgggttcatcacatgggtt

SEQ ID NO: 709766 - DNA, 20 bp, mouse
gagccaaaggtataagatga

SEQ ID NO: 709767 - DNA, 20 bp, mouse
gcttatggggaaatgctcta

SEQ ID NO: 709768 - DNA, 20 bp, mouse
gaagccattggaaacaaaca

SEQ ID NO: 709769 - DNA, 20 bp, mouse
gggctatgtgacaattgttg

SEQ ID NO: 709770 - DNA, 20 bp, mouse
gttggctctatgcagattag

SEQ ID NO: 709771 - DNA, 20 bp, mouse
gatggggaaatgctctaagg

SEQ ID NO: 709772 - DNA, 20 bp, mouse
gccgcagagaagcttgcaag

SEQ ID NO: 709773 - DNA, 20 bp, mouse
gcaaggacctagaaaacatc

SEQ ID NO: 709774 - DNA, 20 bp, mouse
gcttctctgcggaacaagct

SEQ ID NO: 709775 - DNA, 20 bp, mouse
gttccttcatcttatacctt

SEQ ID NO: 709776 - DNA, 20 bp, mouse
gagagtggttagatcttatc

SEQ ID NO: 709777 - DNA, 20 bp, mouse
gcttgggtggcaacctgggg

SEQ ID NO: 709778 - DNA, 20 bp, mouse
gatcactcttgtaaatgctc

SEQ ID NO: 709779 - DNA, 20 bp, mouse
ggaagcagatgcggatggtc

SEQ ID NO: 709780 - DNA, 20 bp, mouse
gatgcatgatatgtagggag

SEQ ID NO: 709781 - DNA, 20 bp, mouse
gcggatggtcaggcttatag

SEQ ID NO: 709782 - DNA, 20 bp, mouse
gactgcttgggtggcaacct

SEQ ID NO: 709783 - DNA, 20 bp, mouse
gaggtaagtcactgcttggg

SEQ ID NO: 709784 - DNA, 20 bp, mouse
gacaaggtaagtcactgctt

SEQ ID NO: 709785 - DNA, 20 bp, mouse
gaagagttagcattgactaa

SEQ ID NO: 709786 - DNA, 20 bp, mouse
ggggagagtcattgtctggg

SEQ ID NO: 709787 - DNA, 20 bp, mouse
gagcagggactgaggtgtca

SEQ ID NO: 709788 - DNA, 20 bp, mouse
gcctgcttgtcatgtgacat

SEQ ID NO: 709789 - DNA, 20 bp, mouse
gtcagaggagcttcagatgg

SEQ ID NO: 709790 - DNA, 20 bp, mouse
gatggaggtggaatctgcag

SEQ ID NO: 709791 - DNA, 20 bp, mouse
ggagacagacccatcttgga

SEQ ID NO: 709792 - DNA, 20 bp, mouse
gatgattcatagagaatacc

SEQ ID NO: 709793 - DNA, 20 bp, mouse
gagtcaggtgcactgttgga

SEQ ID NO: 709794 - DNA, 20 bp, mouse
gctcctctgaatgcatgtct

SEQ ID NO: 709795 - DNA, 20 bp, mouse
gtcacttttctcatgtttcc

SEQ ID NO: 709796 - DNA, 20 bp, mouse
gtcaagtcagaaaggtaatt

SEQ ID NO: 709797 - DNA, 20 bp, mouse
gctgacttgacatcatcaaa

SEQ ID NO: 709798 - DNA, 20 bp, mouse
gactcaggggagtaaattca

SEQ ID NO: 709799 - DNA, 20 bp, mouse
gtgatgatgtcaagtcagaa

SEQ ID NO: 709800 - DNA, 20 bp, mouse
gttacattttcagattgggt

SEQ ID NO: 709801 - DNA, 20 bp, mouse
gcaagaggtaaaatgtcctg

SEQ ID NO: 709802 - DNA, 20 bp, mouse
gggtctctattcatgtggca

SEQ ID NO: 709803 - DNA, 20 bp, mouse
gttaaacaagattgctctcc

SEQ ID NO: 709804 - DNA, 20 bp, mouse
gctggttacattttcagatt

SEQ ID NO: 709805 - DNA, 20 bp, mouse
gcggtgtttaggctttctca

SEQ ID NO: 709806 - DNA, 20 bp, mouse
ggaaaccggtgttgagttca

SEQ ID NO: 709807 - DNA, 20 bp, mouse
gtacagtcaggagctatcaa

SEQ ID NO: 709808 - DNA, 20 bp, mouse
gagcgttacaacaaagctga

SEQ ID NO: 709809 - DNA, 20 bp, mouse
gtggaggcctgtcttataaa

SEQ ID NO: 709810 - DNA, 20 bp, mouse
gtcaggagctatcaaaggcc

SEQ ID NO: 709811 - DNA, 20 bp, mouse
gggatgaacctctgatttat

SEQ ID NO: 709812 - DNA, 20 bp, mouse
ggtaaaggtgctatgagata

SEQ ID NO: 709813 - DNA, 20 bp, mouse
gagatgtatcaacgtttctg

SEQ ID NO: 709814 - DNA, 20 bp, mouse
ggtaacgctgatggtcatcc

SEQ ID NO: 709815 - DNA, 20 bp, mouse
ggtaaagaagtccttctgat

SEQ ID NO: 709816 - DNA, 20 bp, mouse
gagttgctgtggctacagaa

SEQ ID NO: 709817 - DNA, 20 bp, mouse
ggctcaagtgatagttgctg

SEQ ID NO: 709818 - DNA, 20 bp, mouse
ggttaattgtggataattca

SEQ ID NO: 709819 - DNA, 20 bp, mouse
gtgatgtaagcagttaattg

SEQ ID NO: 709820 - DNA, 20 bp, mouse
gtggaaaacactttggactc

SEQ ID NO: 709821 - DNA, 20 bp, mouse
gcaaagaattcagggcaaga

SEQ ID NO: 709822 - DNA, 20 bp, mouse
gggtatagcatgggcatcat

SEQ ID NO: 709823 - DNA, 20 bp, mouse
ggcttattgtacacttcagc

SEQ ID NO: 709824 - DNA, 20 bp, mouse
ggctgaaactggtatagcat

SEQ ID NO: 709825 - DNA, 20 bp, mouse
ggggcatcattggtggcaga

SEQ ID NO: 709826 - DNA, 20 bp, mouse
gttaaagctgatgcagtgag

SEQ ID NO: 709827 - DNA, 20 bp, mouse
ggcggttggtttctcatttc

SEQ ID NO: 709828 - DNA, 20 bp, mouse
gagatgtttactttcctaat

SEQ ID NO: 709829 - DNA, 20 bp, mouse
gctcattggcccaaactttg

SEQ ID NO: 709830 - DNA, 20 bp, mouse
gtgatgcagtgagtggcggt

SEQ ID NO: 709831 - DNA, 20 bp, mouse
gctgagacaggagtattact

SEQ ID NO: 709832 - DNA, 20 bp, mouse
gtgcatcagctttaacacta

SEQ ID NO: 709833 - DNA, 20 bp, mouse
gagtaaacatctattactaa

SEQ ID NO: 709834 - DNA, 20 bp, mouse
gacacacaagttctgctcat

SEQ ID NO: 709835 - DNA, 20 bp, mouse
ggcactgtttaggaactatt

SEQ ID NO: 709836 - DNA, 20 bp, mouse
gtaccatctagcttactatc

SEQ ID NO: 709837 - DNA, 20 bp, mouse
gaacctagcacactaggaaa

SEQ ID NO: 709838 - DNA, 20 bp, mouse
gggtacaactgtctactctt

SEQ ID NO: 709839 - DNA, 20 bp, mouse
gaatcaaaacctagcacact

SEQ ID NO: 709840 - DNA, 20 bp, mouse
gctacacagggaggtgtctg

SEQ ID NO: 709841 - DNA, 20 bp, mouse
ggacaatagtctacacaggg

SEQ ID NO: 709842 - DNA, 20 bp, mouse
gtggcccatcataatgactc

SEQ ID NO: 709843 - DNA, 20 bp, mouse
gctggacaatagtctacaca

SEQ ID NO: 709844 - DNA, 20 bp, mouse
gttccttttcctagtgtgct

SEQ ID NO: 709845 - DNA, 20 bp, mouse
gctccagatagtaagctaga

SEQ ID NO: 709846 - DNA, 20 bp, mouse
gtgaggcaggaaagacactt

SEQ ID NO: 709847 - DNA, 20 bp, mouse
gtcaatatgggaactgaatg

SEQ ID NO: 709848 - DNA, 20 bp, mouse
gcctgtaccaatttcaatat

SEQ ID NO: 709849 - DNA, 20 bp, mouse
gaaattggtacaggaaatgt

SEQ ID NO: 709850 - DNA, 20 bp, mouse
gtcagttcccatattgaaat

SEQ ID NO: 709851 - DNA, 20 bp, mouse
gccaacaactcatccacagt

SEQ ID NO: 709852 - DNA, 20 bp, mouse
gtgatggtgactcttaaccc

SEQ ID NO: 709853 - DNA, 20 bp, mouse
gtgacagttggaagaaattg

SEQ ID NO: 709854 - DNA, 20 bp, mouse
gcacaagatcatgtgacagt

SEQ ID NO: 709855 - DNA, 20 bp, mouse
gaaacacagtttcttttcct

SEQ ID NO: 709856 - DNA, 20 bp, mouse
gaggaatcataattactaaa

SEQ ID NO: 709857 - DNA, 20 bp, mouse
gcatcatagtctactcgggg

SEQ ID NO: 709858 - DNA, 20 bp, mouse
gctgcatcatagtctactcg

SEQ ID NO: 709859 - DNA, 20 bp, mouse
gccatctagagcttactatc

SEQ ID NO: 709860 - DNA, 20 bp, mouse
gattgtttgtgttaagaaat

SEQ ID NO: 709861 - DNA, 20 bp, mouse
gtctagagcttactatctgg

SEQ ID NO: 709862 - DNA, 20 bp, mouse
gcccctcagcaggatataaa

SEQ ID NO: 709863 - DNA, 20 bp, mouse
gctcacaaacctaacacact

SEQ ID NO: 709864 - DNA, 20 bp, mouse
ggatctactcagtgtcttat

SEQ ID NO: 709865 - DNA, 20 bp, mouse
gttttctttcctagtgtgtt

SEQ ID NO: 709866 - DNA, 20 bp, mouse
gaggagggctgcggcagtgt

SEQ ID NO: 709867 - DNA, 20 bp, mouse
gaagaactctcgagggtggg

SEQ ID NO: 709868 - DNA, 20 bp, mouse
gcggcagtgtgggtttgctt

SEQ ID NO: 709869 - DNA, 20 bp, mouse
ggggctgggcttgctcaagc

SEQ ID NO: 709870 - DNA, 20 bp, mouse
ggatcccctgggaaggaggt

SEQ ID NO: 709871 - DNA, 20 bp, mouse
gtgggaaggaggtgggtagg

SEQ ID NO: 709872 - DNA, 20 bp, mouse
gaatcaggaagaacgaccaa

SEQ ID NO: 709873 - DNA, 20 bp, mouse
gccaaatcaagaactctcga

SEQ ID NO: 709874 - DNA, 20 bp, mouse
gtttggagaggggatggctc

SEQ ID NO: 709875 - DNA, 20 bp, mouse
ggggcagcccgggctgtcag

SEQ ID NO: 709876 - DNA, 20 bp, mouse
ggtggcctgtccccaacttg

SEQ ID NO: 709877 - DNA, 20 bp, mouse
gaggcatggaaggtgctaga

SEQ ID NO: 709878 - DNA, 20 bp, mouse
gggactaagagtaccagaga

SEQ ID NO: 709879 - DNA, 20 bp, mouse
gggatggtgaagatagtcaa

SEQ ID NO: 709880 - DNA, 20 bp, mouse
gcagctgtgacccaagtccg

SEQ ID NO: 709881 - DNA, 20 bp, mouse
gtcgactttcagtccttctc

SEQ ID NO: 709882 - DNA, 20 bp, mouse
gggagacaaacctcaagttg

SEQ ID NO: 709883 - DNA, 20 bp, mouse
gtggaaggtgctagaaggga

SEQ ID NO: 709884 - DNA, 20 bp, mouse
gcattccccacacctcataa

SEQ ID NO: 709885 - DNA, 20 bp, mouse
gagttggggacaggccacag

SEQ ID NO: 709886 - DNA, 20 bp, mouse
gagaccgaacgggatcagat

SEQ ID NO: 709887 - DNA, 20 bp, mouse
gcatccgccgggtccccagt

SEQ ID NO: 709888 - DNA, 20 bp, mouse
gcagtcggaggagaccgaac

SEQ ID NO: 709889 - DNA, 20 bp, mouse
ggaacgggatcagatcggac

SEQ ID NO: 709890 - DNA, 20 bp, mouse
ggggacccggcggatgaggg

SEQ ID NO: 709891 - DNA, 20 bp, mouse
gcggggcgtcccggatcgaa

SEQ ID NO: 709892 - DNA, 20 bp, mouse
gcgaagggaccagggcaaca

SEQ ID NO: 709893 - DNA, 20 bp, mouse
ggcccggcccggctccccag

SEQ ID NO: 709894 - DNA, 20 bp, mouse
gaggccagccgcggagtgct

SEQ ID NO: 709895 - DNA, 20 bp, mouse
gggcaacagggcgcacagaa

SEQ ID NO: 709896 - DNA, 20 bp, mouse
gggcttgaggagacgtctca

SEQ ID NO: 709897 - DNA, 20 bp, mouse
ggagagagagtgtgggcttg

SEQ ID NO: 709898 - DNA, 20 bp, mouse
gcgtctcatggagcccaagc

SEQ ID NO: 709899 - DNA, 20 bp, mouse
gcaggacagctgggtaatca

SEQ ID NO: 709900 - DNA, 20 bp, mouse
gagggcacgtgcaggacagc

SEQ ID NO: 709901 - DNA, 20 bp, mouse
gctactagggcctcaggcat

SEQ ID NO: 709902 - DNA, 20 bp, mouse
gatgcccctggcctgctctg

SEQ ID NO: 709903 - DNA, 20 bp, mouse
ggaggccctagtagccattg

SEQ ID NO: 709904 - DNA, 20 bp, mouse
gtcctgcacgtgccctgact

SEQ ID NO: 709905 - DNA, 20 bp, mouse
gcagggatttatctagatat

SEQ ID NO: 709906 - DNA, 20 bp, mouse
gaccaagtcaggacatgtga

SEQ ID NO: 709907 - DNA, 20 bp, mouse
gagggacagctgggtaaaca

SEQ ID NO: 709908 - DNA, 20 bp, mouse
gaggacatgtgagggacagc

SEQ ID NO: 709909 - DNA, 20 bp, mouse
gtccctcacatgtcctgact

SEQ ID NO: 709910 - DNA, 20 bp, mouse
gctgtcctctgttgccacca

SEQ ID NO: 709911 - DNA, 20 bp, mouse
ggagagagagtgtgggcttg

SEQ ID NO: 709912 - DNA, 20 bp, mouse
gagagcaaccaaaggcaggt

SEQ ID NO: 709913 - DNA, 20 bp, mouse
gctactagggcctcaggcat

SEQ ID NO: 709914 - DNA, 20 bp, mouse
gatgcccctggcctgctctg

SEQ ID NO: 709915 - DNA, 20 bp, mouse
ggaggccctagtagccattg

SEQ ID NO: 709916 - DNA, 20 bp, mouse
ggggcctgccctcactgtac

SEQ ID NO: 709917 - DNA, 20 bp, mouse
gctggagcgagaagcctgga

SEQ ID NO: 709918 - DNA, 20 bp, mouse
ggcagtgcacgggatgacgc

SEQ ID NO: 709919 - DNA, 20 bp, mouse
gggaggttgacaggagctac

SEQ ID NO: 709920 - DNA, 20 bp, mouse
gctcctgtcaacctccctcc

SEQ ID NO: 709921 - DNA, 20 bp, mouse
gcaggagctaccggagagat

SEQ ID NO: 709922 - DNA, 20 bp, mouse
gcagaggactggaacgggga

SEQ ID NO: 709923 - DNA, 20 bp, mouse
gagctcatgtacctgcgcca

SEQ ID NO: 709924 - DNA, 20 bp, mouse
gaagcaggaatagaggaatt

SEQ ID NO: 709925 - DNA, 20 bp, mouse
ggctccagtacagtgagggc

SEQ ID NO: 709926 - DNA, 20 bp, mouse
gccactagaggggagatctt

SEQ ID NO: 709927 - DNA, 20 bp, mouse
gcattctggaggggcactca

SEQ ID NO: 709928 - DNA, 20 bp, mouse
gagtaagtcagcctccttca

SEQ ID NO: 709929 - DNA, 20 bp, mouse
ggacttactctgccactaga

SEQ ID NO: 709930 - DNA, 20 bp, mouse
gaggggcactcagggttacc

SEQ ID NO: 709931 - DNA, 20 bp, mouse
gcggatagtagtgaatgttc

SEQ ID NO: 709932 - DNA, 20 bp, mouse
gacctgtaagccactgggga

SEQ ID NO: 709933 - DNA, 20 bp, mouse
gggacgttcaagctgattag

SEQ ID NO: 709934 - DNA, 20 bp, mouse
ggttacctggcatgccttga

SEQ ID NO: 709935 - DNA, 20 bp, mouse
gtcaagctgattagtggagt

SEQ ID NO: 709936 - DNA, 20 bp, mouse
ggcggggcccaggacgggaa

SEQ ID NO: 709937 - DNA, 20 bp, mouse
ggggacgggtcgcggtgaca

SEQ ID NO: 709938 - DNA, 20 bp, mouse
ggcgacccgtccccagtcac

SEQ ID NO: 709939 - DNA, 20 bp, mouse
gggaagggtgacagcggctg

SEQ ID NO: 709940 - DNA, 20 bp, mouse
gtgacagcggctgcgggcag

SEQ ID NO: 709941 - DNA, 20 bp, mouse
ggtcactggggaggtggcgc

SEQ ID NO: 709942 - DNA, 20 bp, mouse
gtcttggcggggcccaggac

SEQ ID NO: 709943 - DNA, 20 bp, mouse
gtggcgccggagctcgcagc

SEQ ID NO: 709944 - DNA, 20 bp, mouse
gagctagaaggcatcagcta

SEQ ID NO: 709945 - DNA, 20 bp, mouse
gagcggctgcgggcagaggc

SEQ ID NO: 709946 - DNA, 20 bp, mouse
gggaaagaaacaggctcatg

SEQ ID NO: 709947 - DNA, 20 bp, mouse
gcattttcacgggatactgt

SEQ ID NO: 709948 - DNA, 20 bp, mouse
gttcctctcttcatgatatg

SEQ ID NO: 709949 - DNA, 20 bp, mouse
gagccccatatcatgaagag

SEQ ID NO: 709950 - DNA, 20 bp, mouse
gatcatgaagagaggaatca

SEQ ID NO: 709951 - DNA, 20 bp, mouse
gaagaaacaggctcatgagg

SEQ ID NO: 709952 - DNA, 20 bp, mouse
gtttctttggtcattttcac

SEQ ID NO: 709953 - DNA, 20 bp, mouse
gaggaatcatggcagcatct

SEQ ID NO: 709954 - DNA, 20 bp, mouse
gatatgagggagggagcttt

SEQ ID NO: 709955 - DNA, 20 bp, mouse
gctttagatcccagcatatg

SEQ ID NO: 709956 - DNA, 20 bp, mouse
ggggcactgcagcctcccta

SEQ ID NO: 709957 - DNA, 20 bp, mouse
gtccctaaggcagattttcg

SEQ ID NO: 709958 - DNA, 20 bp, mouse
gggtgagcacgtggagttga

SEQ ID NO: 709959 - DNA, 20 bp, mouse
gctgcagtgcccatttggtg

SEQ ID NO: 709960 - DNA, 20 bp, mouse
ggcacaggctgacttgtaaa

SEQ ID NO: 709961 - DNA, 20 bp, mouse
gtgtgcacgtggagataaag

SEQ ID NO: 709962 - DNA, 20 bp, mouse
gtcctcgaaaatctgcctta

SEQ ID NO: 709963 - DNA, 20 bp, mouse
gtgaaggagtcctcaccaaa

SEQ ID NO: 709964 - DNA, 20 bp, mouse
gaagggaagagcccgtgtca

SEQ ID NO: 709965 - DNA, 20 bp, mouse
gcttgggtaaccagccccaa

SEQ ID NO: 709966 - DNA, 20 bp, mouse
gattccaagggaataggaga

SEQ ID NO: 709967 - DNA, 20 bp, mouse
gttgcctggcaactgaatcc

SEQ ID NO: 709968 - DNA, 20 bp, mouse
gtagccttctcctattccct

SEQ ID NO: 709969 - DNA, 20 bp, mouse
gtcacatggtctagcctggg

SEQ ID NO: 709970 - DNA, 20 bp, mouse
gtggatgtcactcagagctc

SEQ ID NO: 709971 - DNA, 20 bp, mouse
gccccagggcttctggaaaa

SEQ ID NO: 709972 - DNA, 20 bp, mouse
gggtgactcatgtgcattgt

SEQ ID NO: 709973 - DNA, 20 bp, mouse
gcctgtcagtcaatcctccc

SEQ ID NO: 709974 - DNA, 20 bp, mouse
gctcttcaggaattgttact

SEQ ID NO: 709975 - DNA, 20 bp, mouse
gcaagatggctcataaaagt

SEQ ID NO: 709976 - DNA, 20 bp, mouse
gattccaagggaataggaga

SEQ ID NO: 709977 - DNA, 20 bp, mouse
gttgcctggcaactgaatcc

SEQ ID NO: 709978 - DNA, 20 bp, mouse
gtagccttctcctattccct

SEQ ID NO: 709979 - DNA, 20 bp, mouse
gtcacatggtctagcctggg

SEQ ID NO: 709980 - DNA, 20 bp, mouse
gtggatgtcactcagagctc

SEQ ID NO: 709981 - DNA, 20 bp, mouse
gccccagggcttctggaaaa

SEQ ID NO: 709982 - DNA, 20 bp, mouse
gggtgactcatgtgcattgt

SEQ ID NO: 709983 - DNA, 20 bp, mouse
gcctgtcagtcaatcctccc

SEQ ID NO: 709984 - DNA, 20 bp, mouse
gctcttcaggaattgttact

SEQ ID NO: 709985 - DNA, 20 bp, mouse
gcaagatggctcataaaagt

SEQ ID NO: 709986 - DNA, 20 bp, mouse
gttcaggagtgtgtgtcccg

SEQ ID NO: 709987 - DNA, 20 bp, mouse
gtgcagcaggaagcaagttt

SEQ ID NO: 709988 - DNA, 20 bp, mouse
gaaagacaccaccatgtgtc

SEQ ID NO: 709989 - DNA, 20 bp, mouse
gacactcctgaagttttatt

SEQ ID NO: 709990 - DNA, 20 bp, mouse
gcacatggtggtgtctttga

SEQ ID NO: 709991 - DNA, 20 bp, mouse
ggtcccgtggctgataaaga

SEQ ID NO: 709992 - DNA, 20 bp, mouse
ggtgtctttgatggatcgga

SEQ ID NO: 709993 - DNA, 20 bp, mouse
gagactgaagactgaggcca

SEQ ID NO: 709994 - DNA, 20 bp, mouse
gcatggtccctgaaataggt

SEQ ID NO: 709995 - DNA, 20 bp, mouse
gggtggtgtctttgatggat

SEQ ID NO: 709996 - DNA, 20 bp, mouse
gacgttctctgctactgtac

SEQ ID NO: 709997 - DNA, 20 bp, mouse
gaggggcattgtcatgacca

SEQ ID NO: 709998 - DNA, 20 bp, mouse
gatgatcggcagtttggagt

SEQ ID NO: 709999 - DNA, 20 bp, mouse
gatacatgatcgattgatca

SEQ ID NO: 710000 - DNA, 20 bp, mouse
ggctgacctcataagtaact

SEQ ID NO: 710001 - DNA, 20 bp, mouse
ggtgccagcagaagacgtgc

SEQ ID NO: 710002 - DNA, 20 bp, mouse
gagtcagcatgcactcttga

SEQ ID NO: 710003 - DNA, 20 bp, mouse
gttgatcatggaggatctcc

SEQ ID NO: 710004 - DNA, 20 bp, mouse
gcatgatcgattgatcatgg

SEQ ID NO: 710005 - DNA, 20 bp, mouse
gcatgctgactttggtggac

SEQ ID NO: 710006 - DNA, 20 bp, mouse
ggcggtggggcggggtatga

SEQ ID NO: 710007 - DNA, 20 bp, mouse
ggagaatagacgtctgtcgc

SEQ ID NO: 710008 - DNA, 20 bp, mouse
gttctgggagcatttaggca

SEQ ID NO: 710009 - DNA, 20 bp, mouse
gcagggaagggtcactgttc

SEQ ID NO: 710010 - DNA, 20 bp, mouse
ggccccaccgcgcaaggcag

SEQ ID NO: 710011 - DNA, 20 bp, mouse
gcctctgcctctgccttgcg

SEQ ID NO: 710012 - DNA, 20 bp, mouse
gtgcctctgccttgcgcggt

SEQ ID NO: 710013 - DNA, 20 bp, mouse
ggcgtgtgcccggagccaat

SEQ ID NO: 710014 - DNA, 20 bp, mouse
gagttcctgtagagacctca

SEQ ID NO: 710015 - DNA, 20 bp, mouse
gcactgttctgggagcattt

SEQ ID NO: 710016 - DNA, 20 bp, mouse
ggaccacagtgcttttgaga

SEQ ID NO: 710017 - DNA, 20 bp, mouse
gccagcacaggcactaaagt

SEQ ID NO: 710018 - DNA, 20 bp, mouse
ggagatggctggagaattaa

SEQ ID NO: 710019 - DNA, 20 bp, mouse
gacagtgcttttgagatggc

SEQ ID NO: 710020 - DNA, 20 bp, mouse
gagtggcccatactaagaat

SEQ ID NO: 710021 - DNA, 20 bp, mouse
gaaatcaagagggttagccc

SEQ ID NO: 710022 - DNA, 20 bp, mouse
gctaaatgtattctccttcc

SEQ ID NO: 710023 - DNA, 20 bp, mouse
ggcttccacaagtttaggga

SEQ ID NO: 710024 - DNA, 20 bp, mouse
gcctgccctccctaaacttg

SEQ ID NO: 710025 - DNA, 20 bp, mouse
gtctctgcttccacaagttt

SEQ ID NO: 710026 - DNA, 20 bp, mouse
gggaggggtggtacacgacg

SEQ ID NO: 710027 - DNA, 20 bp, mouse
ggcacagtgtgatagagtac

SEQ ID NO: 710028 - DNA, 20 bp, mouse
gggacgccttctcctctctt

SEQ ID NO: 710029 - DNA, 20 bp, mouse
gaggatgtgcagactcctgc

SEQ ID NO: 710030 - DNA, 20 bp, mouse
gcctacctggactgcggggt

SEQ ID NO: 710031 - DNA, 20 bp, mouse
gactggactggacgtgtgat

SEQ ID NO: 710032 - DNA, 20 bp, mouse
ggatcagtatgttgattagg

SEQ ID NO: 710033 - DNA, 20 bp, mouse
ggggtggtacacgacggggg

SEQ ID NO: 710034 - DNA, 20 bp, mouse
gccagggctaaagcgacaaa

SEQ ID NO: 710035 - DNA, 20 bp, mouse
gggtacacgacgggggtggg

SEQ ID NO: 710036 - DNA, 20 bp, mouse
gggagaaaatgccttagcag

SEQ ID NO: 710037 - DNA, 20 bp, mouse
gaacagggggatagggggaa

SEQ ID NO: 710038 - DNA, 20 bp, mouse
gaaggaagagagggaatagg

SEQ ID NO: 710039 - DNA, 20 bp, mouse
gcaagaggagagaagcaaga

SEQ ID NO: 710040 - DNA, 20 bp, mouse
gatagattgtagaggagaag

SEQ ID NO: 710041 - DNA, 20 bp, mouse
ggggaggggacaggcgggag

SEQ ID NO: 710042 - DNA, 20 bp, mouse
ggatagggggaaaggaagag

SEQ ID NO: 710043 - DNA, 20 bp, mouse
gatagggggatagattgtag

SEQ ID NO: 710044 - DNA, 20 bp, mouse
gaggtttcactttctattcc

SEQ ID NO: 710045 - DNA, 20 bp, mouse
gcctctgtgggcccctgcta

SEQ ID NO: 710046 - DNA, 20 bp, mouse
ggggccagaagagcttgctt

SEQ ID NO: 710047 - DNA, 20 bp, mouse
gagactgggctgtgtagcgc

SEQ ID NO: 710048 - DNA, 20 bp, mouse
gccaccaaagcaagctcttc

SEQ ID NO: 710049 - DNA, 20 bp, mouse
gtacgaagtgctgagactgg

SEQ ID NO: 710050 - DNA, 20 bp, mouse
gtctgcctccagagattaaa

SEQ ID NO: 710051 - DNA, 20 bp, mouse
gatagaaagggcagggaggt

SEQ ID NO: 710052 - DNA, 20 bp, mouse
gtgggctgtgtagcgctggt

SEQ ID NO: 710053 - DNA, 20 bp, mouse
gtgtgccttttaatctctgg

SEQ ID NO: 710054 - DNA, 20 bp, mouse
gtggctttagctgagtgctc

SEQ ID NO: 710055 - DNA, 20 bp, mouse
gtgcaggtggcagcatgccc

SEQ ID NO: 710056 - DNA, 20 bp, mouse
gtggacttgaccagtggcag

SEQ ID NO: 710057 - DNA, 20 bp, mouse
gtcgaggtctcccccaccaa

SEQ ID NO: 710058 - DNA, 20 bp, mouse
gtgaccagtggcagcggttt

SEQ ID NO: 710059 - DNA, 20 bp, mouse
gcagcccaaaccgctgccac

SEQ ID NO: 710060 - DNA, 20 bp, mouse
ggggtgctggcctggttgac

SEQ ID NO: 710061 - DNA, 20 bp, mouse
gactgagttgcccttggtgg

SEQ ID NO: 710062 - DNA, 20 bp, mouse
ggtcagccgggtgactgcgt

SEQ ID NO: 710063 - DNA, 20 bp, mouse
gaactcagtgccagtcaacc

SEQ ID NO: 710064 - DNA, 20 bp, mouse
gactggcccacgcagtcacc

SEQ ID NO: 710065 - DNA, 20 bp, mouse
gggcactgagttgcccttgg

SEQ ID NO: 710066 - DNA, 20 bp, mouse
gtccagggtgataaccaatc

SEQ ID NO: 710067 - DNA, 20 bp, mouse
ggctaacctgtgatcactgt

SEQ ID NO: 710068 - DNA, 20 bp, mouse
gaaggcatagtgaaatctcc

SEQ ID NO: 710069 - DNA, 20 bp, mouse
ggcatggaaagtccttgagg

SEQ ID NO: 710070 - DNA, 20 bp, mouse
gccttccccacagtgatcac

SEQ ID NO: 710071 - DNA, 20 bp, mouse
gacttcctactcccaggcca

SEQ ID NO: 710072 - DNA, 20 bp, mouse
gtctgaagccaaatgtgcat

SEQ ID NO: 710073 - DNA, 20 bp, mouse
gaggttagcacatacctgat

SEQ ID NO: 710074 - DNA, 20 bp, mouse
gcagactgtggcaggcaaca

SEQ ID NO: 710075 - DNA, 20 bp, mouse
gcacgcaactgggtagttcc

SEQ ID NO: 710076 - DNA, 20 bp, mouse
ggcggagcccaagacaaatc

SEQ ID NO: 710077 - DNA, 20 bp, mouse
gggtctggatctgcccaatc

SEQ ID NO: 710078 - DNA, 20 bp, mouse
gtaggtgtactgtcactcaa

SEQ ID NO: 710079 - DNA, 20 bp, mouse
gagccaggggcggacctcgg

SEQ ID NO: 710080 - DNA, 20 bp, mouse
gaaaccggaagcaacaagga

SEQ ID NO: 710081 - DNA, 20 bp, mouse
gaccaatcgttggtaaaaca

SEQ ID NO: 710082 - DNA, 20 bp, mouse
gcaggctcatgctccgcagt

SEQ ID NO: 710083 - DNA, 20 bp, mouse
ggggataacacaccccactg

SEQ ID NO: 710084 - DNA, 20 bp, mouse
gtgaaggagctcatactaag

SEQ ID NO: 710085 - DNA, 20 bp, mouse
gagtacacctaaccaatcgt

SEQ ID NO: 710086 - DNA, 20 bp, mouse
ggatccactgtacataaaaa

SEQ ID NO: 710087 - DNA, 20 bp, mouse
ggatgtattgaatgtacata

SEQ ID NO: 710088 - DNA, 20 bp, mouse
gtcttcatgctgatagaaca

SEQ ID NO: 710089 - DNA, 20 bp, mouse
gctacactgttctaggcaat

SEQ ID NO: 710090 - DNA, 20 bp, mouse
gctaaatgtctcctatactt

SEQ ID NO: 710091 - DNA, 20 bp, mouse
gatactttaaagtgagatct

SEQ ID NO: 710092 - DNA, 20 bp, mouse
gttcctctgtgcctaagtat

SEQ ID NO: 710093 - DNA, 20 bp, mouse
gaatacatcacaattacttt

SEQ ID NO: 710094 - DNA, 20 bp, mouse
ggcaatgttaagtttatact

SEQ ID NO: 710095 - DNA, 20 bp, mouse
gattggaatgtaataatgat

SEQ ID NO: 710096 - DNA, 20 bp, mouse
gaatgtgtacaggagtgata

SEQ ID NO: 710097 - DNA, 20 bp, mouse
gggcctgctaagagatgagg

SEQ ID NO: 710098 - DNA, 20 bp, mouse
gacggggtggatcactgctc

SEQ ID NO: 710099 - DNA, 20 bp, mouse
ggtacaggagtgatacgggg

SEQ ID NO: 710100 - DNA, 20 bp, mouse
gagcgaatgcaattcatctg

SEQ ID NO: 710101 - DNA, 20 bp, mouse
ggaactctggggagcaaggg

SEQ ID NO: 710102 - DNA, 20 bp, mouse
gaagaaatcctctatgctca

SEQ ID NO: 710103 - DNA, 20 bp, mouse
gcctggcctgctaagagatg

SEQ ID NO: 710104 - DNA, 20 bp, mouse
ggaatgctgtgaatgtgtac

SEQ ID NO: 710105 - DNA, 20 bp, mouse
gcaccccctcatctcttagc

SEQ ID NO: 710106 - DNA, 20 bp, mouse
gataagtaggcaagtgtagg

SEQ ID NO: 710107 - DNA, 20 bp, mouse
ggggggcaaccagatcttag

SEQ ID NO: 710108 - DNA, 20 bp, mouse
gccccctgggctgttaggga

SEQ ID NO: 710109 - DNA, 20 bp, mouse
ggttgccccctgggctgtta

SEQ ID NO: 710110 - DNA, 20 bp, mouse
gaagcaatgtttgcttgctc

SEQ ID NO: 710111 - DNA, 20 bp, mouse
ggtgtctgacaagtacacag

SEQ ID NO: 710112 - DNA, 20 bp, mouse
gcaggtatgctataaataga

SEQ ID NO: 710113 - DNA, 20 bp, mouse
gacaagtacacagaggttca

SEQ ID NO: 710114 - DNA, 20 bp, mouse
gtaaccatccctaacagccc

SEQ ID NO: 710115 - DNA, 20 bp, mouse
gaatatcagcccctaagatc

SEQ ID NO: 710116 - DNA, 20 bp, mouse
gtggttgctaaaggttgcat

SEQ ID NO: 710117 - DNA, 20 bp, mouse
gggaggaatttggttgctaa

SEQ ID NO: 710118 - DNA, 20 bp, mouse
gattaagagaaggaggaatt

SEQ ID NO: 710119 - DNA, 20 bp, mouse
gcttttatggaattaagaga

SEQ ID NO: 710120 - DNA, 20 bp, mouse
gttatggaattaagagaagg

SEQ ID NO: 710121 - DNA, 20 bp, mouse
gaccgtgggccactgactaa

SEQ ID NO: 710122 - DNA, 20 bp, mouse
gtggttaaaatagtgaccgt

SEQ ID NO: 710123 - DNA, 20 bp, mouse
gcactgactaaaggtcccca

SEQ ID NO: 710124 - DNA, 20 bp, mouse
ggaaatgccagacagtcctt

SEQ ID NO: 710125 - DNA, 20 bp, mouse
gaaggtccccaaggactgtc

SEQ ID NO: 710126 - DNA, 20 bp, mouse
gtcctccagggaaggaacaa

SEQ ID NO: 710127 - DNA, 20 bp, mouse
gtgaaaacccagagcctctg

SEQ ID NO: 710128 - DNA, 20 bp, mouse
gccctagagcaggggtcaga

SEQ ID NO: 710129 - DNA, 20 bp, mouse
gctgggctgtccctagagca

SEQ ID NO: 710130 - DNA, 20 bp, mouse
gagtaccgttgttccttccc

SEQ ID NO: 710131 - DNA, 20 bp, mouse
gggagggaggggcctgtctt

SEQ ID NO: 710132 - DNA, 20 bp, mouse
gcaagggatgagggttcccg

SEQ ID NO: 710133 - DNA, 20 bp, mouse
ggaaccctcatcccttgcca

SEQ ID NO: 710134 - DNA, 20 bp, mouse
ggcactctaaagactggagt

SEQ ID NO: 710135 - DNA, 20 bp, mouse
ggatgagggttcccgaggtg

SEQ ID NO: 710136 - DNA, 20 bp, mouse
gacctagaggggaaggttca

SEQ ID NO: 710137 - DNA, 20 bp, mouse
gtgataggaaacttttacag

SEQ ID NO: 710138 - DNA, 20 bp, mouse
gctctgaaagttgtttttat

SEQ ID NO: 710139 - DNA, 20 bp, mouse
ggaatttcaaagcctttgat

SEQ ID NO: 710140 - DNA, 20 bp, mouse
gttttctaatttactttggt

SEQ ID NO: 710141 - DNA, 20 bp, mouse
gtcattaattattacaccac

SEQ ID NO: 710142 - DNA, 20 bp, mouse
ggcatttttctaatttactt

SEQ ID NO: 710143 - DNA, 20 bp, mouse
gtaggaaacttttacagggg

SEQ ID NO: 710144 - DNA, 20 bp, mouse
gaagacaagtggaaagagag

SEQ ID NO: 710145 - DNA, 20 bp, mouse
gtcattctctgcttctgtat

SEQ ID NO: 710146 - DNA, 20 bp, mouse
gaacaaaaataattgtggga

SEQ ID NO: 710147 - DNA, 20 bp, mouse
gaactgtgtgtaactgtttg

SEQ ID NO: 710148 - DNA, 20 bp, mouse
gaatatctttagagaattag

SEQ ID NO: 710149 - DNA, 20 bp, mouse
gtagaattattctacctctt

SEQ ID NO: 710150 - DNA, 20 bp, mouse
gagaagaagataccaggtaa

SEQ ID NO: 710151 - DNA, 20 bp, mouse
gttgttttacttatgtaaag

SEQ ID NO: 710152 - DNA, 20 bp, mouse
gatgactatattattgaacg

SEQ ID NO: 710153 - DNA, 20 bp, mouse
gttattctacctcttcggtt

SEQ ID NO: 710154 - DNA, 20 bp, mouse
gtctatatacctaaccgaag

SEQ ID NO: 710155 - DNA, 20 bp, mouse
ggaacttgcagagacaaata

SEQ ID NO: 710156 - DNA, 20 bp, mouse
gccttcaagtagtaaaagaa

SEQ ID NO: 710157 - DNA, 20 bp, mouse
gtgtgaaacccataactctc

SEQ ID NO: 710158 - DNA, 20 bp, mouse
gaaaaaacaccagagagtta

SEQ ID NO: 710159 - DNA, 20 bp, mouse
gaagatgattctctgattaa

SEQ ID NO: 710160 - DNA, 20 bp, mouse
gaggggagtggttacattct

SEQ ID NO: 710161 - DNA, 20 bp, mouse
gcttcagtctagaagtcctt

SEQ ID NO: 710162 - DNA, 20 bp, mouse
gacaccaccctctgcacatt

SEQ ID NO: 710163 - DNA, 20 bp, mouse
gctacaacaaaaggcttcgg

SEQ ID NO: 710164 - DNA, 20 bp, mouse
gcagccgaatgtgcagaggg

SEQ ID NO: 710165 - DNA, 20 bp, mouse
ggtaaaagaatggcttatga

SEQ ID NO: 710166 - DNA, 20 bp, mouse
gatgaagcagctgaatgatt

SEQ ID NO: 710167 - DNA, 20 bp, mouse
ggggagtgttaaatgagtat

SEQ ID NO: 710168 - DNA, 20 bp, mouse
gtcccatgatttttcctaaa

SEQ ID NO: 710169 - DNA, 20 bp, mouse
gatgctatactcttcacata

SEQ ID NO: 710170 - DNA, 20 bp, mouse
ggaaaaatcatgggatgtca

SEQ ID NO: 710171 - DNA, 20 bp, mouse
gaatgatttggaaaagatgg

SEQ ID NO: 710172 - DNA, 20 bp, mouse
gcaccttttaggaaaaatca

SEQ ID NO: 710173 - DNA, 20 bp, mouse
gtttgacttctcaaagaaca

SEQ ID NO: 710174 - DNA, 20 bp, mouse
gattcttactagcgagtggg

SEQ ID NO: 710175 - DNA, 20 bp, mouse
gtctaatccctccaaaagaa

SEQ ID NO: 710176 - DNA, 20 bp, mouse
gggtcctgggtcacacaaaa

SEQ ID NO: 710177 - DNA, 20 bp, mouse
gaaaccaaaagacagatctc

SEQ ID NO: 710178 - DNA, 20 bp, mouse
gcagacttctgaatctctac

SEQ ID NO: 710179 - DNA, 20 bp, mouse
gaagcctttttgtgtgaccc

SEQ ID NO: 710180 - DNA, 20 bp, mouse
gtggagcagaattaacaaag

SEQ ID NO: 710181 - DNA, 20 bp, mouse
gcaaagaggctagaggtcct

SEQ ID NO: 710182 - DNA, 20 bp, mouse
ggctgctccggtgtcatgga

SEQ ID NO: 710183 - DNA, 20 bp, mouse
gatctgtcttttggtttaga

SEQ ID NO: 710184 - DNA, 20 bp, mouse
gagagtacgttaattaattt

SEQ ID NO: 710185 - DNA, 20 bp, mouse
gaaagcgatatgaaactcat

SEQ ID NO: 710186 - DNA, 20 bp, mouse
gtgctctaactgctgaatgt

SEQ ID NO: 710187 - DNA, 20 bp, mouse
gaaggtagcacttttattag

SEQ ID NO: 710188 - DNA, 20 bp, mouse
gatgtggccaatatgagtca

SEQ ID NO: 710189 - DNA, 20 bp, mouse
ggtgctgtcaccttctttac

SEQ ID NO: 710190 - DNA, 20 bp, mouse
gaatgcttccataaagccct

SEQ ID NO: 710191 - DNA, 20 bp, mouse
gctaggatgcatctatgcag

SEQ ID NO: 710192 - DNA, 20 bp, mouse
gggaagggagtgctcttcag

SEQ ID NO: 710193 - DNA, 20 bp, mouse
gcatctatgcagtggctgac

SEQ ID NO: 710194 - DNA, 20 bp, mouse
gcatagatgcatcctagaaa

SEQ ID NO: 710195 - DNA, 20 bp, mouse
gagtagaaggagaaataatg

SEQ ID NO: 710196 - DNA, 20 bp, mouse
gccaagaagtgcatgtagaa

SEQ ID NO: 710197 - DNA, 20 bp, mouse
gggcttggaaaccataagat

SEQ ID NO: 710198 - DNA, 20 bp, mouse
gagcaggggttgttatccca

SEQ ID NO: 710199 - DNA, 20 bp, mouse
gagcatgggctctgcactac

SEQ ID NO: 710200 - DNA, 20 bp, mouse
ggccggattatccaatctta

SEQ ID NO: 710201 - DNA, 20 bp, mouse
gtatttgtactgcactggca

SEQ ID NO: 710202 - DNA, 20 bp, mouse
gaacagagttcggccttctc

SEQ ID NO: 710203 - DNA, 20 bp, mouse
gtcttggcattaagaggagc

SEQ ID NO: 710204 - DNA, 20 bp, mouse
gctctgtatttgtactgcac

SEQ ID NO: 710205 - DNA, 20 bp, mouse
gctcttgtaagcacacacag

SEQ ID NO: 710206 - DNA, 20 bp, mouse
ggcccaactatccaatcttg

SEQ ID NO: 710207 - DNA, 20 bp, mouse
gaggccagtgcgagcaagca

SEQ ID NO: 710208 - DNA, 20 bp, mouse
gtagccctgcttgctcgcac

SEQ ID NO: 710209 - DNA, 20 bp, mouse
ggggctatattatattgatt

SEQ ID NO: 710210 - DNA, 20 bp, mouse
gtatattgatttgggaaatg

SEQ ID NO: 710211 - DNA, 20 bp, mouse
gtcctgcaatggtgagacac

SEQ ID NO: 710212 - DNA, 20 bp, mouse
gcatgctgtgagtgaacttt

SEQ ID NO: 710213 - DNA, 20 bp, mouse
ggcaagggttgggatcccgt

SEQ ID NO: 710214 - DNA, 20 bp, mouse
gtagtgcagagcccatgctc

SEQ ID NO: 710215 - DNA, 20 bp, mouse
ggagggatcaatctgttgaa

SEQ ID NO: 710216 - DNA, 20 bp, mouse
gtaaaagtccggaggaaccc

SEQ ID NO: 710217 - DNA, 20 bp, mouse
ggtaagcaagaattctgtgc

SEQ ID NO: 710218 - DNA, 20 bp, mouse
gagtaagagcacttagggga

SEQ ID NO: 710219 - DNA, 20 bp, mouse
gtgtgatgtaagggcttgag

SEQ ID NO: 710220 - DNA, 20 bp, mouse
ggtgtggcattggaagtgta

SEQ ID NO: 710221 - DNA, 20 bp, mouse
gggcagctgactactaagaa

SEQ ID NO: 710222 - DNA, 20 bp, mouse
gactgctaagacaactaaac

SEQ ID NO: 710223 - DNA, 20 bp, mouse
gcagaaagattgtgatgtaa

SEQ ID NO: 710224 - DNA, 20 bp, mouse
gcgaccaggagggtgctcag

SEQ ID NO: 710225 - DNA, 20 bp, mouse
gtctgtgcctagggaccaac

SEQ ID NO: 710226 - DNA, 20 bp, mouse
gaaggcctgagcctatgctc

SEQ ID NO: 710227 - DNA, 20 bp, mouse
gattgccagagcataggctc

SEQ ID NO: 710228 - DNA, 20 bp, mouse
gcaccatcgcaggaaccaga

SEQ ID NO: 710229 - DNA, 20 bp, mouse
gggccttctggttcctgcga

SEQ ID NO: 710230 - DNA, 20 bp, mouse
gaggccagtgcgagcaagct

SEQ ID NO: 710231 - DNA, 20 bp, mouse
gtagcccagcttgctcgcac

SEQ ID NO: 710232 - DNA, 20 bp, mouse
ggggctatattatattgatt

SEQ ID NO: 710233 - DNA, 20 bp, mouse
gtatattgatttgggaaatg

SEQ ID NO: 710234 - DNA, 20 bp, mouse
gtcctatgtctcaccatcgc

SEQ ID NO: 710235 - DNA, 20 bp, mouse
gcatgctgtgagtgaacttt

SEQ ID NO: 710236 - DNA, 20 bp, mouse
gggtcaggcaacaccattca

SEQ ID NO: 710237 - DNA, 20 bp, mouse
ggccaggcagggtttgaacc

SEQ ID NO: 710238 - DNA, 20 bp, mouse
ggcagaggggaggcggaaga

SEQ ID NO: 710239 - DNA, 20 bp, mouse
ggcgctgctacactgatgat

SEQ ID NO: 710240 - DNA, 20 bp, mouse
gtgaacccgggtcccagaac

SEQ ID NO: 710241 - DNA, 20 bp, mouse
gagtgtagcagcgccgtgaa

SEQ ID NO: 710242 - DNA, 20 bp, mouse
gaatggcgaaaaggcatctt

SEQ ID NO: 710243 - DNA, 20 bp, mouse
gcgccgtaggtggacgacga

SEQ ID NO: 710244 - DNA, 20 bp, mouse
gtaggtggacgacgagggga

SEQ ID NO: 710245 - DNA, 20 bp, mouse
gctgacccgctgacaggcct

SEQ ID NO: 710246 - DNA, 20 bp, mouse
gtccccaccagggccagact

SEQ ID NO: 710247 - DNA, 20 bp, mouse
gaacacacgggccctgttcc

SEQ ID NO: 710248 - DNA, 20 bp, mouse
ggaaaggggcattggtcctg

SEQ ID NO: 710249 - DNA, 20 bp, mouse
ggctgagacacagatgaaag

SEQ ID NO: 710250 - DNA, 20 bp, mouse
ggagctgtctgaatgatttt

SEQ ID NO: 710251 - DNA, 20 bp, mouse
ggggccagactgggccaggt

SEQ ID NO: 710252 - DNA, 20 bp, mouse
gtggcccagtctggccctgg

SEQ ID NO: 710253 - DNA, 20 bp, mouse
gcttcaatatcactatttga

SEQ ID NO: 710254 - DNA, 20 bp, mouse
gcgttgtataaagtccctaa

SEQ ID NO: 710255 - DNA, 20 bp, mouse
gagctttccggtctgttcta

SEQ ID NO: 710256 - DNA, 20 bp, mouse
ggggtaccttgcagagtttg

SEQ ID NO: 710257 - DNA, 20 bp, mouse
gtttcaatatggctatttta

SEQ ID NO: 710258 - DNA, 20 bp, mouse
gctggtccaagcaggtaaag

SEQ ID NO: 710259 - DNA, 20 bp, mouse
gggtcacctcaaactctgca

SEQ ID NO: 710260 - DNA, 20 bp, mouse
ggaaaggggtattcgtcctg

SEQ ID NO: 710261 - DNA, 20 bp, mouse
gcatcatataaagtccttag

SEQ ID NO: 710262 - DNA, 20 bp, mouse
ggggccaaactggtccaagc

SEQ ID NO: 710263 - DNA, 20 bp, mouse
gggctattttagggtcctga

SEQ ID NO: 710264 - DNA, 20 bp, mouse
gtccactccaaacagtcata

SEQ ID NO: 710265 - DNA, 20 bp, mouse
gttacctgcttggaccagtt

SEQ ID NO: 710266 - DNA, 20 bp, mouse
gcccgcgtgccgtagcaaat

SEQ ID NO: 710267 - DNA, 20 bp, mouse
ggggcgggacccacagagtg

SEQ ID NO: 710268 - DNA, 20 bp, mouse
gaaagagtggggagtcacga

SEQ ID NO: 710269 - DNA, 20 bp, mouse
ggaggcagccaagtggtgat

SEQ ID NO: 710270 - DNA, 20 bp, mouse
ggctcctcgggtgataaaaa

SEQ ID NO: 710271 - DNA, 20 bp, mouse
ggacccacagagtgaggcgg

SEQ ID NO: 710272 - DNA, 20 bp, mouse
gtcccgaggcgccacctccg

SEQ ID NO: 710273 - DNA, 20 bp, mouse
ggggggctcggccaatagag

SEQ ID NO: 710274 - DNA, 20 bp, mouse
ggaaccgcacgtgtctggga

SEQ ID NO: 710275 - DNA, 20 bp, mouse
gcacttggctgcctctctat

SEQ ID NO: 710276 - DNA, 20 bp, mouse
ggtggagggtgcggagtatc

SEQ ID NO: 710277 - DNA, 20 bp, mouse
gcactgaggcctttccttac

SEQ ID NO: 710278 - DNA, 20 bp, mouse
ggtactcattgtggagggtg

SEQ ID NO: 710279 - DNA, 20 bp, mouse
gagtgggcgggtcttagcgg

SEQ ID NO: 710280 - DNA, 20 bp, mouse
gacaatgagtacagcctgta

SEQ ID NO: 710281 - DNA, 20 bp, mouse
ggcagacccagagacactca

SEQ ID NO: 710282 - DNA, 20 bp, mouse
gggtgtgtgtccacgcgatc

SEQ ID NO: 710283 - DNA, 20 bp, mouse
gctagcacgggtgggtttga

SEQ ID NO: 710284 - DNA, 20 bp, mouse
gcggaagactacagtcggtc

SEQ ID NO: 710285 - DNA, 20 bp, mouse
gcgactgtagtcttccggta

SEQ ID NO: 710286 - DNA, 20 bp, mouse
gccactgtagattagggagt

SEQ ID NO: 710287 - DNA, 20 bp, mouse
gcactggttggaggaagact

SEQ ID NO: 710288 - DNA, 20 bp, mouse
gctgccacctgtgaaatcac

SEQ ID NO: 710289 - DNA, 20 bp, mouse
gcaaccagtgatttcacagg

SEQ ID NO: 710290 - DNA, 20 bp, mouse
gtaagagagggacaggtgaa

SEQ ID NO: 710291 - DNA, 20 bp, mouse
gacaccaaccactgtagatt

SEQ ID NO: 710292 - DNA, 20 bp, mouse
gctccaaccagtgatttcac

SEQ ID NO: 710293 - DNA, 20 bp, mouse
gagggagtgggagctgaagg

SEQ ID NO: 710294 - DNA, 20 bp, mouse
gattagggagtgggagctga

SEQ ID NO: 710295 - DNA, 20 bp, mouse
gtcaaaaaaacaaaaattgt

SEQ ID NO: 710296 - DNA, 20 bp, mouse
ggccgctggttcaataattg

SEQ ID NO: 710297 - DNA, 20 bp, mouse
gaagggagggttcagcggaa

SEQ ID NO: 710298 - DNA, 20 bp, mouse
ggcctcaattattgaaccag

SEQ ID NO: 710299 - DNA, 20 bp, mouse
gcccagctaaagtcagccgc

SEQ ID NO: 710300 - DNA, 20 bp, mouse
gttattctgctagcagcttc

SEQ ID NO: 710301 - DNA, 20 bp, mouse
gttaaatagtgtaggtaaat

SEQ ID NO: 710302 - DNA, 20 bp, mouse
ggtgaatggagactcaatga

SEQ ID NO: 710303 - DNA, 20 bp, mouse
gtagcagaataagggctcca

SEQ ID NO: 710304 - DNA, 20 bp, mouse
gtagcagcttctggagttca

SEQ ID NO: 710305 - DNA, 20 bp, mouse
gtgaggactcacagatcatc

SEQ ID NO: 710306 - DNA, 20 bp, mouse
gccagggtggagaacaatgg

SEQ ID NO: 710307 - DNA, 20 bp, mouse
gcagctcagggggatatcag

SEQ ID NO: 710308 - DNA, 20 bp, mouse
gcctgttctgaacttctcca

SEQ ID NO: 710309 - DNA, 20 bp, mouse
ggagaagcttccagagccgt

SEQ ID NO: 710310 - DNA, 20 bp, mouse
ggtgagccacccaaccaata

SEQ ID NO: 710311 - DNA, 20 bp, mouse
gatggtggttcctacggctc

SEQ ID NO: 710312 - DNA, 20 bp, mouse
gagcatccatattggttggg

SEQ ID NO: 710313 - DNA, 20 bp, mouse
gacaaaaacagtgtgagcag

SEQ ID NO: 710314 - DNA, 20 bp, mouse
ggaataaggggttggtagtc

SEQ ID NO: 710315 - DNA, 20 bp, mouse
gtttatattgaaagctttcc

SEQ ID NO: 710316 - DNA, 20 bp, mouse
gtcaagaggcagaggcaaag

SEQ ID NO: 710317 - DNA, 20 bp, mouse
gccctgctttggccacattg

SEQ ID NO: 710318 - DNA, 20 bp, mouse
gaaaacaaagcagggatgga

SEQ ID NO: 710319 - DNA, 20 bp, mouse
ggacagctaatgctacaaaa

SEQ ID NO: 710320 - DNA, 20 bp, mouse
gcaaagaaatgcattgccat

SEQ ID NO: 710321 - DNA, 20 bp, mouse
gcacattgagttccacaatg

SEQ ID NO: 710322 - DNA, 20 bp, mouse
ggaaaactaaaaacaaagca

SEQ ID NO: 710323 - DNA, 20 bp, mouse
gtacaaaaaggaaccatgta

SEQ ID NO: 710324 - DNA, 20 bp, mouse
ggtttttagttttccataca

SEQ ID NO: 710325 - DNA, 20 bp, mouse
ggtagagagtgataagagtt

SEQ ID NO: 710326 - DNA, 20 bp, mouse
ggaagagtgtgagcagatgt

SEQ ID NO: 710327 - DNA, 20 bp, mouse
gtgagcagatgtcggaaaag

SEQ ID NO: 710328 - DNA, 20 bp, mouse
gacacacgctgcagaaaaga

SEQ ID NO: 710329 - DNA, 20 bp, mouse
gaggcacaggttacagagaa

SEQ ID NO: 710330 - DNA, 20 bp, mouse
ggtaactgccacagaacctc

SEQ ID NO: 710331 - DNA, 20 bp, mouse
gcatcaggcgccattaccaa

SEQ ID NO: 710332 - DNA, 20 bp, mouse
ggccacagaacctcaggcac

SEQ ID NO: 710333 - DNA, 20 bp, mouse
gtctgcagcgtgtgtaccgt

SEQ ID NO: 710334 - DNA, 20 bp, mouse
ggcaagctctttcacagcat

SEQ ID NO: 710335 - DNA, 20 bp, mouse
ggaacatcatggcttccatc

SEQ ID NO: 710336 - DNA, 20 bp, mouse
ggaggggatgtacaatactg

SEQ ID NO: 710337 - DNA, 20 bp, mouse
gaggtgtggctaaacatcag

SEQ ID NO: 710338 - DNA, 20 bp, mouse
gactatgttggtaggagata

SEQ ID NO: 710339 - DNA, 20 bp, mouse
gggtgaaaaaaagattaagt

SEQ ID NO: 710340 - DNA, 20 bp, mouse
gaaatatcctgaatgagctt

SEQ ID NO: 710341 - DNA, 20 bp, mouse
gctaaacatcagaggtttga

SEQ ID NO: 710342 - DNA, 20 bp, mouse
ggagacttcatcatcctatc

SEQ ID NO: 710343 - DNA, 20 bp, mouse
ggtaacaggattgactatgt

SEQ ID NO: 710344 - DNA, 20 bp, mouse
gtatgatcctaagctcattc

SEQ ID NO: 710345 - DNA, 20 bp, mouse
gaggtctctctggagttata

SEQ ID NO: 710346 - DNA, 20 bp, mouse
gcattctacctcttaaagaa

SEQ ID NO: 710347 - DNA, 20 bp, mouse
ggaaaggttagagttcagca

SEQ ID NO: 710348 - DNA, 20 bp, mouse
gtgggaggactcaatgagga

SEQ ID NO: 710349 - DNA, 20 bp, mouse
ggactcaatgaggagggaag

SEQ ID NO: 710350 - DNA, 20 bp, mouse
gtgggcagattataatgcct

SEQ ID NO: 710351 - DNA, 20 bp, mouse
gtgcctgggaggactcaatg

SEQ ID NO: 710352 - DNA, 20 bp, mouse
ggcagattataatgcctggg

SEQ ID NO: 710353 - DNA, 20 bp, mouse
gtggtttatgtaattgagaa

SEQ ID NO: 710354 - DNA, 20 bp, mouse
gtaggactcacagaatatca

SEQ ID NO: 710355 - DNA, 20 bp, mouse
gcatgatgtggtccaatcac

SEQ ID NO: 710356 - DNA, 20 bp, mouse
gaggcttcttttgactcaga

SEQ ID NO: 710357 - DNA, 20 bp, mouse
gaccagttcttgactctgtc

SEQ ID NO: 710358 - DNA, 20 bp, mouse
gtcttttgactcagagggtg

SEQ ID NO: 710359 - DNA, 20 bp, mouse
ggcaccatgttgatcttgta

SEQ ID NO: 710360 - DNA, 20 bp, mouse
ggaacaaataaagcagagac

SEQ ID NO: 710361 - DNA, 20 bp, mouse
gacaaggatgagagtttatg

SEQ ID NO: 710362 - DNA, 20 bp, mouse
gtcataattgctgtgatgac

SEQ ID NO: 710363 - DNA, 20 bp, mouse
gagatcaacatggtgcaaga

SEQ ID NO: 710364 - DNA, 20 bp, mouse
gtggccgtacaagatcaaca

SEQ ID NO: 710365 - DNA, 20 bp, mouse
gtcttgtacggccattgctg

SEQ ID NO: 710366 - DNA, 20 bp, mouse
gactacagagctaaatagaa

SEQ ID NO: 710367 - DNA, 20 bp, mouse
gggtatcaggctagctattt

SEQ ID NO: 710368 - DNA, 20 bp, mouse
gcctcatagtctctttttta

SEQ ID NO: 710369 - DNA, 20 bp, mouse
gagcatgtgttcaaattttc

SEQ ID NO: 710370 - DNA, 20 bp, mouse
ggtacttagtaaaatacagc

SEQ ID NO: 710371 - DNA, 20 bp, mouse
gctctccaaaaggcctgtat

SEQ ID NO: 710372 - DNA, 20 bp, mouse
gtactgacatactctccaaa

SEQ ID NO: 710373 - DNA, 20 bp, mouse
gaaattctaagcttcaggtc

SEQ ID NO: 710374 - DNA, 20 bp, mouse
gatgacccatacaggccttt

SEQ ID NO: 710375 - DNA, 20 bp, mouse
gcagtaaaattctaagcttc

SEQ ID NO: 710376 - DNA, 20 bp, mouse
gctgaaacagaggcccactt

SEQ ID NO: 710377 - DNA, 20 bp, mouse
gtgggctgggactgggataa

SEQ ID NO: 710378 - DNA, 20 bp, mouse
gtatgcttggagtataaaag

SEQ ID NO: 710379 - DNA, 20 bp, mouse
gaacagaggcccactttggc

SEQ ID NO: 710380 - DNA, 20 bp, mouse
ggaatcactgggctgggact

SEQ ID NO: 710381 - DNA, 20 bp, mouse
ggtgagtatcagcatggtcg

SEQ ID NO: 710382 - DNA, 20 bp, mouse
ggagaaaacacaggaatcac

SEQ ID NO: 710383 - DNA, 20 bp, mouse
gaggccaacatggtgcttgt

SEQ ID NO: 710384 - DNA, 20 bp, mouse
gacacaggaatcactgggct

SEQ ID NO: 710385 - DNA, 20 bp, mouse
gtggctgtgtaaggccaaca

SEQ ID NO: 710386 - DNA, 20 bp, mouse
ggggggggaagattcgagaa

SEQ ID NO: 710387 - DNA, 20 bp, mouse
gtggtgtagtggtgtggctg

SEQ ID NO: 710388 - DNA, 20 bp, mouse
gctgagtggtggtggtgtag

SEQ ID NO: 710389 - DNA, 20 bp, mouse
ggatgtaatataagttgggg

SEQ ID NO: 710390 - DNA, 20 bp, mouse
ggtcccagctcctgtggcga

SEQ ID NO: 710391 - DNA, 20 bp, mouse
ggcccacagtgcacagagga

SEQ ID NO: 710392 - DNA, 20 bp, mouse
gaagattcgagaaaggaggc

SEQ ID NO: 710393 - DNA, 20 bp, mouse
gggggaagattcgagaaagg

SEQ ID NO: 710394 - DNA, 20 bp, mouse
ggttcagtcctacctaacaa

SEQ ID NO: 710395 - DNA, 20 bp, mouse
gcaggctggtctccccagta

SEQ ID NO: 710396 - DNA, 20 bp, mouse
gcagaggaccgaccaatcac

SEQ ID NO: 710397 - DNA, 20 bp, mouse
gcatcagaccagtgattggt

SEQ ID NO: 710398 - DNA, 20 bp, mouse
ggattggtcggtcctctgcc

SEQ ID NO: 710399 - DNA, 20 bp, mouse
gggcttttggttttagaaac

SEQ ID NO: 710400 - DNA, 20 bp, mouse
gcacttgattctgacacttt

SEQ ID NO: 710401 - DNA, 20 bp, mouse
ggggaatattggatcggaat

SEQ ID NO: 710402 - DNA, 20 bp, mouse
gatggaagatgtgtggaaat

SEQ ID NO: 710403 - DNA, 20 bp, mouse
gcggaatgggcagaatatca

SEQ ID NO: 710404 - DNA, 20 bp, mouse
gtaggactcacagggaatat

SEQ ID NO: 710405 - DNA, 20 bp, mouse
ggaggaccttgaaggaatgg

SEQ ID NO: 710406 - DNA, 20 bp, mouse
gttgaatgttgtagataatt

SEQ ID NO: 710407 - DNA, 20 bp, mouse
gaagttcttgactatcattc

SEQ ID NO: 710408 - DNA, 20 bp, mouse
gttgcaattgatgttatcaa

SEQ ID NO: 710409 - DNA, 20 bp, mouse
gttgacctaaatttatagtc

SEQ ID NO: 710410 - DNA, 20 bp, mouse
gcacaaagggggacttcacc

SEQ ID NO: 710411 - DNA, 20 bp, mouse
gcatgattcagggtatgtaa

SEQ ID NO: 710412 - DNA, 20 bp, mouse
gtttatagtcaggatgtgat

SEQ ID NO: 710413 - DNA, 20 bp, mouse
gtcaccatggacatgattca

SEQ ID NO: 710414 - DNA, 20 bp, mouse
gttggatcagatctgtactc

SEQ ID NO: 710415 - DNA, 20 bp, mouse
gactgcaaagggactggata

SEQ ID NO: 710416 - DNA, 20 bp, mouse
gcacaatgagttccacattg

SEQ ID NO: 710417 - DNA, 20 bp, mouse
gccctgcttgggccacaatg

SEQ ID NO: 710418 - DNA, 20 bp, mouse
gaagtaggtctcttagttgg

SEQ ID NO: 710419 - DNA, 20 bp, mouse
gtagttacctcatgtgaaaa

SEQ ID NO: 710420 - DNA, 20 bp, mouse
ggactgcttgccctttccaa

SEQ ID NO: 710421 - DNA, 20 bp, mouse
gaaaacaaagcaaggatgga

SEQ ID NO: 710422 - DNA, 20 bp, mouse
gtccacattgtggcccaagc

SEQ ID NO: 710423 - DNA, 20 bp, mouse
gtacaaaaaggaaccatgtg

SEQ ID NO: 710424 - DNA, 20 bp, mouse
ggacaactaatgctacaaaa

SEQ ID NO: 710425 - DNA, 20 bp, mouse
gaattaaccattttcacatg

SEQ ID NO: 710426 - DNA, 20 bp, mouse
gcccacctggagaagatccc

SEQ ID NO: 710427 - DNA, 20 bp, mouse
gccctggggacaaggtgcca

SEQ ID NO: 710428 - DNA, 20 bp, mouse
ggcaggttgggctttatcat

SEQ ID NO: 710429 - DNA, 20 bp, mouse
gagaagtgtgacacagtgtg

SEQ ID NO: 710430 - DNA, 20 bp, mouse
gataaagcccaacctgccct

SEQ ID NO: 710431 - DNA, 20 bp, mouse
gggtgccagggatcttctcc

SEQ ID NO: 710432 - DNA, 20 bp, mouse
gcaggcagctatgacattct

SEQ ID NO: 710433 - DNA, 20 bp, mouse
ggtgtgacacagtgtgagga

SEQ ID NO: 710434 - DNA, 20 bp, mouse
ggacctggagcatcaccagc

SEQ ID NO: 710435 - DNA, 20 bp, mouse
gggaggatgtgggaaactcg

SEQ ID NO: 710436 - DNA, 20 bp, mouse
ggctgtggccagtgatgctt

SEQ ID NO: 710437 - DNA, 20 bp, mouse
ggggactgtggccctgtgat

SEQ ID NO: 710438 - DNA, 20 bp, mouse
gacctggagtggaatgagca

SEQ ID NO: 710439 - DNA, 20 bp, mouse
gggccctgtgatgggtgaga

SEQ ID NO: 710440 - DNA, 20 bp, mouse
gcacccattccccgtgggaa

SEQ ID NO: 710441 - DNA, 20 bp, mouse
gtccctgctcattccactcc

SEQ ID NO: 710442 - DNA, 20 bp, mouse
gctcccttcccacggggaat

SEQ ID NO: 710443 - DNA, 20 bp, mouse
gaagccttctcacccatcac

SEQ ID NO: 710444 - DNA, 20 bp, mouse
gtcaggactcccttcccacg

SEQ ID NO: 710445 - DNA, 20 bp, mouse
ggtgataatgaagtaggctg

SEQ ID NO: 710446 - DNA, 20 bp, mouse
ggctccacatgatgcccgta

SEQ ID NO: 710447 - DNA, 20 bp, mouse
gcaaagagaacgtgttttca

SEQ ID NO: 710448 - DNA, 20 bp, mouse
gtgcccttacgggcatcatg

SEQ ID NO: 710449 - DNA, 20 bp, mouse
gaaaagcaaactgcccttac

SEQ ID NO: 710450 - DNA, 20 bp, mouse
gtttttcaacactgtgtctc

SEQ ID NO: 710451 - DNA, 20 bp, mouse
gtgtctcggggtaacagccc

SEQ ID NO: 710452 - DNA, 20 bp, mouse
gttctctttgaattttctcc

SEQ ID NO: 710453 - DNA, 20 bp, mouse
gtgtccaggaactgactttt

SEQ ID NO: 710454 - DNA, 20 bp, mouse
gcctttggaaaggaacatcc

SEQ ID NO: 710455 - DNA, 20 bp, mouse
gttgatcctggcaaagacag

SEQ ID NO: 710456 - DNA, 20 bp, mouse
gaacgtagataaaatgtcct

SEQ ID NO: 710457 - DNA, 20 bp, mouse
gttgtgcatttatagtccag

SEQ ID NO: 710458 - DNA, 20 bp, mouse
gctacgtttttgtttgtttt

SEQ ID NO: 710459 - DNA, 20 bp, mouse
gaagctgttgaattttgggc

SEQ ID NO: 710460 - DNA, 20 bp, mouse
gtaaaaggcccataagtagg

SEQ ID NO: 710461 - DNA, 20 bp, mouse
gaattaaaaggcccataagt

SEQ ID NO: 710462 - DNA, 20 bp, mouse
gtgaagaagctttgcagagt

SEQ ID NO: 710463 - DNA, 20 bp, mouse
gtctaagcccacctacttat

SEQ ID NO: 710464 - DNA, 20 bp, mouse
gtctgagcatcagaattcaa

SEQ ID NO: 710465 - DNA, 20 bp, mouse
gtaaactcatctaatcgtgc

SEQ ID NO: 710466 - DNA, 20 bp, mouse
gtcgcaggggattctatgtg

SEQ ID NO: 710467 - DNA, 20 bp, mouse
ggcgccgcctcagaagaacg

SEQ ID NO: 710468 - DNA, 20 bp, mouse
gaaagtttgagaatctacgg

SEQ ID NO: 710469 - DNA, 20 bp, mouse
gcatttaggtcatttcgcag

SEQ ID NO: 710470 - DNA, 20 bp, mouse
ggtttgagaatctacggtgg

SEQ ID NO: 710471 - DNA, 20 bp, mouse
gaaaattccccgttcttctg

SEQ ID NO: 710472 - DNA, 20 bp, mouse
gtacagaggccagctgtcac

SEQ ID NO: 710473 - DNA, 20 bp, mouse
gattccccgttcttctgagg

SEQ ID NO: 710474 - DNA, 20 bp, mouse
ggctgtccgcccagcctgag

SEQ ID NO: 710475 - DNA, 20 bp, mouse
gcaaaagaaaattgagaggc

SEQ ID NO: 710476 - DNA, 20 bp, mouse
ggaggcccaccctgccgatc

SEQ ID NO: 710477 - DNA, 20 bp, mouse
gggttcctgatcggcagggt

SEQ ID NO: 710478 - DNA, 20 bp, mouse
ggagtggttcctgatcggca

SEQ ID NO: 710479 - DNA, 20 bp, mouse
gaatgaatgtagtaggacac

SEQ ID NO: 710480 - DNA, 20 bp, mouse
gtattgagcatcagattcag

SEQ ID NO: 710481 - DNA, 20 bp, mouse
ggtagtaggacactggacct

SEQ ID NO: 710482 - DNA, 20 bp, mouse
gtgtgtttccacaacatagt

SEQ ID NO: 710483 - DNA, 20 bp, mouse
gcactcctccaactatgttg

SEQ ID NO: 710484 - DNA, 20 bp, mouse
ggtttccacaacatagttgg

SEQ ID NO: 710485 - DNA, 20 bp, mouse
gtagaagaatggcaagaagc

SEQ ID NO: 710486 - DNA, 20 bp, mouse
gcggggctaggcagcatgaa

SEQ ID NO: 710487 - DNA, 20 bp, mouse
gctcaaaccgcaaaccatat

SEQ ID NO: 710488 - DNA, 20 bp, mouse
gtctacacagcttcctcaaa

SEQ ID NO: 710489 - DNA, 20 bp, mouse
gaacttagataaaatgtcct

SEQ ID NO: 710490 - DNA, 20 bp, mouse
gtggtttgcggtttgagcca

SEQ ID NO: 710491 - DNA, 20 bp, mouse
gctaagttattgtttgtttt

SEQ ID NO: 710492 - DNA, 20 bp, mouse
gaattaaaaggtcccgaagt

SEQ ID NO: 710493 - DNA, 20 bp, mouse
gtcctgggaagttttgtgga

SEQ ID NO: 710494 - DNA, 20 bp, mouse
gtaggtcctgggaagttttg

SEQ ID NO: 710495 - DNA, 20 bp, mouse
ggtctggcagcaaccttttg

SEQ ID NO: 710496 - DNA, 20 bp, mouse
gcaggtgcagtctgaaagaa

SEQ ID NO: 710497 - DNA, 20 bp, mouse
gcccaaggagcaaatggatt

SEQ ID NO: 710498 - DNA, 20 bp, mouse
gtagatcaggccactgagtc

SEQ ID NO: 710499 - DNA, 20 bp, mouse
gggtggcaggtcataaaact

SEQ ID NO: 710500 - DNA, 20 bp, mouse
gagaggggagtgcttggcca

SEQ ID NO: 710501 - DNA, 20 bp, mouse
ggttctcaaggaatatcttc

SEQ ID NO: 710502 - DNA, 20 bp, mouse
gatcacagatgaccaaagtt

SEQ ID NO: 710503 - DNA, 20 bp, mouse
gcatgcttaactctagagag

SEQ ID NO: 710504 - DNA, 20 bp, mouse
gaaacaaaaatccccaactt

SEQ ID NO: 710505 - DNA, 20 bp, mouse
gactgggtcagttgttctca

SEQ ID NO: 710506 - DNA, 20 bp, mouse
gtcctggagccacaattgtt

SEQ ID NO: 710507 - DNA, 20 bp, mouse
gtccaggaagaggtctgttg

SEQ ID NO: 710508 - DNA, 20 bp, mouse
gcacagcatcccaacaattg

SEQ ID NO: 710509 - DNA, 20 bp, mouse
gctacattggctgacttagg

SEQ ID NO: 710510 - DNA, 20 bp, mouse
gcctctacattggctgactt

SEQ ID NO: 710511 - DNA, 20 bp, mouse
gtcccaacaattgtggctcc

SEQ ID NO: 710512 - DNA, 20 bp, mouse
ggattgctgagaaactggtc

SEQ ID NO: 710513 - DNA, 20 bp, mouse
gtgctgtgaatctgtcatcc

SEQ ID NO: 710514 - DNA, 20 bp, mouse
ggccacaacagacctcttcc

SEQ ID NO: 710515 - DNA, 20 bp, mouse
gccttcaattgtatgatata

SEQ ID NO: 710516 - DNA, 20 bp, mouse
gaagtcaggttcatgaagct

SEQ ID NO: 710517 - DNA, 20 bp, mouse
gcccctgtatctgttataaa

SEQ ID NO: 710518 - DNA, 20 bp, mouse
ggctctgtgccacattcccc

SEQ ID NO: 710519 - DNA, 20 bp, mouse
gcactgtagcctggggaatg

SEQ ID NO: 710520 - DNA, 20 bp, mouse
ggttagtactctcttcatgt

SEQ ID NO: 710521 - DNA, 20 bp, mouse
gacagactaggtcagtatta

SEQ ID NO: 710522 - DNA, 20 bp, mouse
ggtaaagagcaaggaaatgt

SEQ ID NO: 710523 - DNA, 20 bp, mouse
ggtcccgagagctacagact

SEQ ID NO: 710524 - DNA, 20 bp, mouse
gggtcactatgaggaacgaa

SEQ ID NO: 710525 - DNA, 20 bp, mouse
gtctttacatggctgtgttc

SEQ ID NO: 710526 - DNA, 20 bp, mouse
ggaagtgaagggaagttccg

SEQ ID NO: 710527 - DNA, 20 bp, mouse
ggcaaaggaacgagcaagaa

SEQ ID NO: 710528 - DNA, 20 bp, mouse
gtaaaaggtccctaagtagg

SEQ ID NO: 710529 - DNA, 20 bp, mouse
gaggggcaagcagaagtgaa

SEQ ID NO: 710530 - DNA, 20 bp, mouse
gtcatgggaagttgtgtgag

SEQ ID NO: 710531 - DNA, 20 bp, mouse
ggctgtgcagagtaggtcat

SEQ ID NO: 710532 - DNA, 20 bp, mouse
gacgagcaagaaaggaagca

SEQ ID NO: 710533 - DNA, 20 bp, mouse
gttctgcttgcccctccttc

SEQ ID NO: 710534 - DNA, 20 bp, mouse
gaacttagataaaatgtcct

SEQ ID NO: 710535 - DNA, 20 bp, mouse
gctaagttattgtttgtttt

SEQ ID NO: 710536 - DNA, 20 bp, mouse
gtgggcaggttcagaaggca

SEQ ID NO: 710537 - DNA, 20 bp, mouse
gcatccagctctgaatagtc

SEQ ID NO: 710538 - DNA, 20 bp, mouse
gctgccagactattcagagc

SEQ ID NO: 710539 - DNA, 20 bp, mouse
gttcagaaggcagggctttg

SEQ ID NO: 710540 - DNA, 20 bp, mouse
gagagtaattccagagaagt

SEQ ID NO: 710541 - DNA, 20 bp, mouse
gggcagggctttgaggaacc

SEQ ID NO: 710542 - DNA, 20 bp, mouse
ggaaatcttttctcatcttc

SEQ ID NO: 710543 - DNA, 20 bp, mouse
gtccagagaagttgggtgaa

SEQ ID NO: 710544 - DNA, 20 bp, mouse
ggagagaacatgctaggaat

SEQ ID NO: 710545 - DNA, 20 bp, mouse
gggaaccaggcagaagtgac

SEQ ID NO: 710546 - DNA, 20 bp, mouse
gggcacaaacacagagcaca

SEQ ID NO: 710547 - DNA, 20 bp, mouse
ggaaacattggcaagagccc

SEQ ID NO: 710548 - DNA, 20 bp, mouse
gggactagagtcaaagacaa

SEQ ID NO: 710549 - DNA, 20 bp, mouse
gataaagcaaagtaatacca

SEQ ID NO: 710550 - DNA, 20 bp, mouse
gtctaatttcaggagtcatc

SEQ ID NO: 710551 - DNA, 20 bp, mouse
gcagtcaaaatgtatcatgt

SEQ ID NO: 710552 - DNA, 20 bp, mouse
gttgcagaaaacagaaaaag

SEQ ID NO: 710553 - DNA, 20 bp, mouse
gatcatgtcggtagaaacat

SEQ ID NO: 710554 - DNA, 20 bp, mouse
ggtcaaagacaaagggctag

SEQ ID NO: 710555 - DNA, 20 bp, mouse
ggaggatgatttctaatttc

SEQ ID NO: 710556 - DNA, 20 bp, mouse
gtctgaagacagctgctatc

SEQ ID NO: 710557 - DNA, 20 bp, mouse
gtaggtccagagaagttgtg

SEQ ID NO: 710558 - DNA, 20 bp, mouse
gaaataaaaacgaagaatcg

SEQ ID NO: 710559 - DNA, 20 bp, mouse
ggcatgattagataagttta

SEQ ID NO: 710560 - DNA, 20 bp, mouse
gaaaaacgaagaatcggggc

SEQ ID NO: 710561 - DNA, 20 bp, mouse
gagagccaagcagaaatgac

SEQ ID NO: 710562 - DNA, 20 bp, mouse
gacttcctgtcatttctgct

SEQ ID NO: 710563 - DNA, 20 bp, mouse
gggaagctaattaatttaaa

SEQ ID NO: 710564 - DNA, 20 bp, mouse
gactgaattcattgattgat

SEQ ID NO: 710565 - DNA, 20 bp, mouse
gtggggaagctgtgcagagt

SEQ ID NO: 710566 - DNA, 20 bp, mouse
gaagcacagaaattcaaaga

SEQ ID NO: 710567 - DNA, 20 bp, mouse
gtggacaaatgacataaaga

SEQ ID NO: 710568 - DNA, 20 bp, mouse
gcaaaagaaaattaagacgc

SEQ ID NO: 710569 - DNA, 20 bp, mouse
gaattaactttgagaatcaa

SEQ ID NO: 710570 - DNA, 20 bp, mouse
ggagttagtgatttgtggta

SEQ ID NO: 710571 - DNA, 20 bp, mouse
gggtttagcattttctgtaa

SEQ ID NO: 710572 - DNA, 20 bp, mouse
gattatgaaacaaacacaag

SEQ ID NO: 710573 - DNA, 20 bp, mouse
gatttatttgtcatgagaat

SEQ ID NO: 710574 - DNA, 20 bp, mouse
gagaatcaagggtggtgggc

SEQ ID NO: 710575 - DNA, 20 bp, mouse
gtaactttgagaatcaaggg

SEQ ID NO: 710576 - DNA, 20 bp, mouse
gattgtgcgtgtagccctct

SEQ ID NO: 710577 - DNA, 20 bp, mouse
gaagctgttgaattttgggc

SEQ ID NO: 710578 - DNA, 20 bp, mouse
gtaaaaggcccataagtagg

SEQ ID NO: 710579 - DNA, 20 bp, mouse
gaggatccattgaatctgaa

SEQ ID NO: 710580 - DNA, 20 bp, mouse
gaattaaaaggcccataagt

SEQ ID NO: 710581 - DNA, 20 bp, mouse
gtgaagaagctttgcagagt

SEQ ID NO: 710582 - DNA, 20 bp, mouse
gtctaagcccacctacttat

SEQ ID NO: 710583 - DNA, 20 bp, mouse
gtctgagcatcagaattcaa

SEQ ID NO: 710584 - DNA, 20 bp, mouse
gtaaactcatctaatcgtgc

SEQ ID NO: 710585 - DNA, 20 bp, mouse
gtgtgcatttatagcccaga

SEQ ID NO: 710586 - DNA, 20 bp, mouse
gcataacttcttcgaatgct

SEQ ID NO: 710587 - DNA, 20 bp, mouse
gtaggcgaccacatgttcac

SEQ ID NO: 710588 - DNA, 20 bp, mouse
gaagaagttatgtgcttcct

SEQ ID NO: 710589 - DNA, 20 bp, mouse
gcaagaggtggaccgatgtt

SEQ ID NO: 710590 - DNA, 20 bp, mouse
gggtaggggaacaggattgg

SEQ ID NO: 710591 - DNA, 20 bp, mouse
gccagggccaaaaactgggg

SEQ ID NO: 710592 - DNA, 20 bp, mouse
ggccaaaaactggggtgggt

SEQ ID NO: 710593 - DNA, 20 bp, mouse
gaaaatctctccaattttca

SEQ ID NO: 710594 - DNA, 20 bp, mouse
gagtcctttaggaataaaat

SEQ ID NO: 710595 - DNA, 20 bp, mouse
gacgccagggccaaaaactg

SEQ ID NO: 710596 - DNA, 20 bp, mouse
gctgaggccaggtgcagcaa

SEQ ID NO: 710597 - DNA, 20 bp, mouse
ggagctggaggttccttctg

SEQ ID NO: 710598 - DNA, 20 bp, mouse
gagccggagccaacattaga

SEQ ID NO: 710599 - DNA, 20 bp, mouse
gtgtctggacaccagtgact

SEQ ID NO: 710600 - DNA, 20 bp, mouse
gttccctctaatgttggctc

SEQ ID NO: 710601 - DNA, 20 bp, mouse
gtgacgggaagggtgatgct

SEQ ID NO: 710602 - DNA, 20 bp, mouse
ggcaccaaaaccaggctcaa

SEQ ID NO: 710603 - DNA, 20 bp, mouse
gcagatggtgctctagaggg

SEQ ID NO: 710604 - DNA, 20 bp, mouse
gagacaggtcagtagatagg

SEQ ID NO: 710605 - DNA, 20 bp, mouse
gcctgcagatggtgctctag

SEQ ID NO: 710606 - DNA, 20 bp, mouse
gggtccatgcagagtctcgt

SEQ ID NO: 710607 - DNA, 20 bp, mouse
gagcgtggaatcaaggagtt

SEQ ID NO: 710608 - DNA, 20 bp, mouse
gcagagtctcgtcgggtcct

SEQ ID NO: 710609 - DNA, 20 bp, mouse
ggacccgacgagactctgca

SEQ ID NO: 710610 - DNA, 20 bp, mouse
gagtactcgcttccaaggca

SEQ ID NO: 710611 - DNA, 20 bp, mouse
gcttgggaacaaccctgcct

SEQ ID NO: 710612 - DNA, 20 bp, mouse
gggcaacaacttttttttaa

SEQ ID NO: 710613 - DNA, 20 bp, mouse
gatcaaggagttaggtcttt

SEQ ID NO: 710614 - DNA, 20 bp, mouse
gctccttgattccacgctct

SEQ ID NO: 710615 - DNA, 20 bp, mouse
gatttttataaccaagagcg

SEQ ID NO: 710616 - DNA, 20 bp, mouse
gtgtagaacagcttttggtg

SEQ ID NO: 710617 - DNA, 20 bp, mouse
gaaaagtgtagaacagcttt

SEQ ID NO: 710618 - DNA, 20 bp, mouse
gcatcctcttgatggcacta

SEQ ID NO: 710619 - DNA, 20 bp, mouse
gttaaatcataatataagat

SEQ ID NO: 710620 - DNA, 20 bp, mouse
gataccttagtgccatcaag

SEQ ID NO: 710621 - DNA, 20 bp, mouse
ggttaaagtgaaaggacaat

SEQ ID NO: 710622 - DNA, 20 bp, mouse
gattgaagaaccctatttta

SEQ ID NO: 710623 - DNA, 20 bp, mouse
gacaataatgaaaactacaa

SEQ ID NO: 710624 - DNA, 20 bp, mouse
gcaattggaaagttagagga

SEQ ID NO: 710625 - DNA, 20 bp, mouse
gaggacaattggaaagttag

SEQ ID NO: 710626 - DNA, 20 bp, mouse
ggtcatgtctagtggaggga

SEQ ID NO: 710627 - DNA, 20 bp, mouse
gagggagggtctaaattgag

SEQ ID NO: 710628 - DNA, 20 bp, mouse
gagctaatgagagtactaca

SEQ ID NO: 710629 - DNA, 20 bp, mouse
gaatgtaggtggcacaaatc

SEQ ID NO: 710630 - DNA, 20 bp, mouse
gagagtactacagggaatgt

SEQ ID NO: 710631 - DNA, 20 bp, mouse
gaaaggagggtcatgtctag

SEQ ID NO: 710632 - DNA, 20 bp, mouse
gggcacaaatcaggataggg

SEQ ID NO: 710633 - DNA, 20 bp, mouse
gcaagggcatccttgagtct

SEQ ID NO: 710634 - DNA, 20 bp, mouse
gggagggtcatgtctagtgg

SEQ ID NO: 710635 - DNA, 20 bp, mouse
gtattggcatgcagaaaagg

SEQ ID NO: 710636 - DNA, 20 bp, mouse
gaggacacggccccctcccc

SEQ ID NO: 710637 - DNA, 20 bp, mouse
gcgaaggcccacgaaccccc

SEQ ID NO: 710638 - DNA, 20 bp, mouse
gtggaagtcagaaatccaca

SEQ ID NO: 710639 - DNA, 20 bp, mouse
gggaacttgtaccctccatg

SEQ ID NO: 710640 - DNA, 20 bp, mouse
gtggatttctgacttccagg

SEQ ID NO: 710641 - DNA, 20 bp, mouse
gaagtcagaaatccacatgg

SEQ ID NO: 710642 - DNA, 20 bp, mouse
gtgacttccagggggttcgt

SEQ ID NO: 710643 - DNA, 20 bp, mouse
ggggacacagccacaggagt

SEQ ID NO: 710644 - DNA, 20 bp, mouse
gagaaagcataacttacatt

SEQ ID NO: 710645 - DNA, 20 bp, mouse
gaggctccttgcccagggga

SEQ ID NO: 710646 - DNA, 20 bp, mouse
ggggaggagaagatgaaggc

SEQ ID NO: 710647 - DNA, 20 bp, mouse
ggatgaaggcaggtcagtgc

SEQ ID NO: 710648 - DNA, 20 bp, mouse
ggtgggtaggaacagaaggc

SEQ ID NO: 710649 - DNA, 20 bp, mouse
ggtgagtgggtaggaacaga

SEQ ID NO: 710650 - DNA, 20 bp, mouse
gagtagggaggagaagatga

SEQ ID NO: 710651 - DNA, 20 bp, mouse
gaatgcaaatggattccagt

SEQ ID NO: 710652 - DNA, 20 bp, mouse
ggcagtccaggcaggggatt

SEQ ID NO: 710653 - DNA, 20 bp, mouse
gtggactgccatttccccat

SEQ ID NO: 710654 - DNA, 20 bp, mouse
gagctagcgaatagtatccg

SEQ ID NO: 710655 - DNA, 20 bp, mouse
ggggaaatggcagtccaggc

SEQ ID NO: 710656 - DNA, 20 bp, mouse
gagacaggtgaacagatctt

SEQ ID NO: 710657 - DNA, 20 bp, mouse
gtatgccaggttagttgact

SEQ ID NO: 710658 - DNA, 20 bp, mouse
gtgtgttcctggtgtttatg

SEQ ID NO: 710659 - DNA, 20 bp, mouse
gaattactcaaaatatagtg

SEQ ID NO: 710660 - DNA, 20 bp, mouse
ggatgctttatcaaacaaat

SEQ ID NO: 710661 - DNA, 20 bp, mouse
gctttatcaaacaaattgga

SEQ ID NO: 710662 - DNA, 20 bp, mouse
ggtttatgtggctaaactgg

SEQ ID NO: 710663 - DNA, 20 bp, mouse
gagatgtgcatctgtgttcc

SEQ ID NO: 710664 - DNA, 20 bp, mouse
ggacctccacacacatgcta

SEQ ID NO: 710665 - DNA, 20 bp, mouse
ggaggtcagagtacaaccac

SEQ ID NO: 710666 - DNA, 20 bp, mouse
gcactgcaaacgtacagaaa

SEQ ID NO: 710667 - DNA, 20 bp, mouse
ggaaatgtagagtgaatccg

SEQ ID NO: 710668 - DNA, 20 bp, mouse
gtacgtttgcagtgactttc

SEQ ID NO: 710669 - DNA, 20 bp, mouse
gcgtacagaaagggtttgcg

SEQ ID NO: 710670 - DNA, 20 bp, mouse
ggattcactctacatttcag

SEQ ID NO: 710671 - DNA, 20 bp, mouse
ggatgctatttttacttcaa

SEQ ID NO: 710672 - DNA, 20 bp, mouse
gagggatgagatgtgctata

SEQ ID NO: 710673 - DNA, 20 bp, mouse
gacctcaatgcgcatgtgcg

SEQ ID NO: 710674 - DNA, 20 bp, mouse
gtcttgtttatcagttctgc

SEQ ID NO: 710675 - DNA, 20 bp, mouse
gcactgaccatttctgttag

SEQ ID NO: 710676 - DNA, 20 bp, mouse
ggacctgcctatcacgttaa

SEQ ID NO: 710677 - DNA, 20 bp, mouse
gtgggtaagttggtttccag

SEQ ID NO: 710678 - DNA, 20 bp, mouse
gccacattaggcaacctgga

SEQ ID NO: 710679 - DNA, 20 bp, mouse
gaagccacaaacacccattc

SEQ ID NO: 710680 - DNA, 20 bp, mouse
gatgccagaatgggtgtttg

SEQ ID NO: 710681 - DNA, 20 bp, mouse
gggacttgaagatgccagaa

SEQ ID NO: 710682 - DNA, 20 bp, mouse
gtggcttcctttaacgtgat

SEQ ID NO: 710683 - DNA, 20 bp, mouse
gggcaggtcttgttcaatcc

SEQ ID NO: 710684 - DNA, 20 bp, mouse
ggccgccacattaggcaacc

SEQ ID NO: 710685 - DNA, 20 bp, mouse
gtgtgggatgccgccacatt

SEQ ID NO: 710686 - DNA, 20 bp, mouse
ggctctgggcagttgcactc

SEQ ID NO: 710687 - DNA, 20 bp, mouse
gttaatgctagacactggga

SEQ ID NO: 710688 - DNA, 20 bp, mouse
gctgcccaacaacaaccaac

SEQ ID NO: 710689 - DNA, 20 bp, mouse
gaggactatgggcctcgggg

SEQ ID NO: 710690 - DNA, 20 bp, mouse
gaaaatcaagctaccaggag

SEQ ID NO: 710691 - DNA, 20 bp, mouse
gacaacttaatgctagacac

SEQ ID NO: 710692 - DNA, 20 bp, mouse
gtggcttcccaaaattcaat

SEQ ID NO: 710693 - DNA, 20 bp, mouse
ggttcacttacagcagaaag

SEQ ID NO: 710694 - DNA, 20 bp, mouse
gacggccccaggtcggtgtc

SEQ ID NO: 710695 - DNA, 20 bp, mouse
gtcaacctgttggttgttgt

SEQ ID NO: 710696 - DNA, 20 bp, mouse
ggatgctcagtatcctttaa

SEQ ID NO: 710697 - DNA, 20 bp, mouse
gacacatctgtagtgagctt

SEQ ID NO: 710698 - DNA, 20 bp, mouse
gtgagctttggttcccttaa

SEQ ID NO: 710699 - DNA, 20 bp, mouse
gacagtccttcatgcactgg

SEQ ID NO: 710700 - DNA, 20 bp, mouse
ggaagagggtgacatgaaga

SEQ ID NO: 710701 - DNA, 20 bp, mouse
ggcccaccaccagtgcatga

SEQ ID NO: 710702 - DNA, 20 bp, mouse
ggagagagagtgcaaatggc

SEQ ID NO: 710703 - DNA, 20 bp, mouse
gagtgcatgaaggactgtta

SEQ ID NO: 710704 - DNA, 20 bp, mouse
gcaaatggctggaatagtgt

SEQ ID NO: 710705 - DNA, 20 bp, mouse
gtccttcatgcactggtggt

SEQ ID NO: 710706 - DNA, 20 bp, mouse
gactgacattaaagaggcag

SEQ ID NO: 710707 - DNA, 20 bp, mouse
gagtgccactgacattaaag

SEQ ID NO: 710708 - DNA, 20 bp, mouse
gaggacctcgaagtccctgt

SEQ ID NO: 710709 - DNA, 20 bp, mouse
ggcgagaggtgggaagtcct

SEQ ID NO: 710710 - DNA, 20 bp, mouse
gagaagtcatggcgagaggt

SEQ ID NO: 710711 - DNA, 20 bp, mouse
ggaagccaggggagaagtca

SEQ ID NO: 710712 - DNA, 20 bp, mouse
gagtactctctaaacaatgg

SEQ ID NO: 710713 - DNA, 20 bp, mouse
ggttcttcctaattaggaag

SEQ ID NO: 710714 - DNA, 20 bp, mouse
ggtgagaaatgtgtgatagt

SEQ ID NO: 710715 - DNA, 20 bp, mouse
gtctgaagttgtttcccaca

SEQ ID NO: 710716 - DNA, 20 bp, mouse
gtgggattgcagtcgtctaa

SEQ ID NO: 710717 - DNA, 20 bp, mouse
gctctagcttagagccctca

SEQ ID NO: 710718 - DNA, 20 bp, mouse
ggccatgcatagcccacagt

SEQ ID NO: 710719 - DNA, 20 bp, mouse
gcagtggctgggggtctgta

SEQ ID NO: 710720 - DNA, 20 bp, mouse
ggccaactgtgggctatgca

SEQ ID NO: 710721 - DNA, 20 bp, mouse
gtgcgcgtgtgcacacacac

SEQ ID NO: 710722 - DNA, 20 bp, mouse
gcaccccatcccacacccca

SEQ ID NO: 710723 - DNA, 20 bp, mouse
gatgagaggccaggaggcac

SEQ ID NO: 710724 - DNA, 20 bp, mouse
gggctcagaacgtgctgccc

SEQ ID NO: 710725 - DNA, 20 bp, mouse
gcgcgcacttgtggttcctc

SEQ ID NO: 710726 - DNA, 20 bp, mouse
ggtgatatatctttctattt

SEQ ID NO: 710727 - DNA, 20 bp, mouse
gcatgttcatctatacagac

SEQ ID NO: 710728 - DNA, 20 bp, mouse
gtcctgtataggttatagaa

SEQ ID NO: 710729 - DNA, 20 bp, mouse
ggaaataacattcctaaact

SEQ ID NO: 710730 - DNA, 20 bp, mouse
gttaaaatccattaataata

SEQ ID NO: 710731 - DNA, 20 bp, mouse
gttattatgtgaactgtgca

SEQ ID NO: 710732 - DNA, 20 bp, mouse
gtttcacatactcctagttt

SEQ ID NO: 710733 - DNA, 20 bp, mouse
gaggaaaatttattaaacgt

SEQ ID NO: 710734 - DNA, 20 bp, mouse
gaacgtgggctttcctgtat

SEQ ID NO: 710735 - DNA, 20 bp, mouse
gtgtgctagaaattcatata

SEQ ID NO: 710736 - DNA, 20 bp, mouse
ggccttatgaatacatggta

SEQ ID NO: 710737 - DNA, 20 bp, mouse
ggtgtcttagcagaaatgta

SEQ ID NO: 710738 - DNA, 20 bp, mouse
gcactgtagctcaggcttgt

SEQ ID NO: 710739 - DNA, 20 bp, mouse
gaagacagcagaataacaaa

SEQ ID NO: 710740 - DNA, 20 bp, mouse
gcctggttttacatccataa

SEQ ID NO: 710741 - DNA, 20 bp, mouse
gaggtgaacagtgaatcaag

SEQ ID NO: 710742 - DNA, 20 bp, mouse
gtacataaggtttatactaa

SEQ ID NO: 710743 - DNA, 20 bp, mouse
gagtgctgggattctataac

SEQ ID NO: 710744 - DNA, 20 bp, mouse
gctaatggcagtcccagtgc

SEQ ID NO: 710745 - DNA, 20 bp, mouse
gatagacacagttgaaggaa

SEQ ID NO: 710746 - DNA, 20 bp, mouse
gtagctagcaagctggcagc

SEQ ID NO: 710747 - DNA, 20 bp, mouse
ggaattctgaggtttctaga

SEQ ID NO: 710748 - DNA, 20 bp, mouse
gtaacataaatcaattacag

SEQ ID NO: 710749 - DNA, 20 bp, mouse
gaattgagacctagaagtag

SEQ ID NO: 710750 - DNA, 20 bp, mouse
gtagccactcctctacttct

SEQ ID NO: 710751 - DNA, 20 bp, mouse
gataactgcatcttttttca

SEQ ID NO: 710752 - DNA, 20 bp, mouse
gataaatcaattacagagga

SEQ ID NO: 710753 - DNA, 20 bp, mouse
gggcactgatttgatcacaa

SEQ ID NO: 710754 - DNA, 20 bp, mouse
gaaggagacaactcttcttc

SEQ ID NO: 710755 - DNA, 20 bp, mouse
ggcagcaggctggaattctg

SEQ ID NO: 710756 - DNA, 20 bp, mouse
gcaaaaggctattagagggc

SEQ ID NO: 710757 - DNA, 20 bp, mouse
gaaactaccaatgtacctag

SEQ ID NO: 710758 - DNA, 20 bp, mouse
gatggaaccactaggtacat

SEQ ID NO: 710759 - DNA, 20 bp, mouse
gagaccaaaaggctattaga

SEQ ID NO: 710760 - DNA, 20 bp, mouse
gtgtgggaggagagaccaaa

SEQ ID NO: 710761 - DNA, 20 bp, mouse
gagcatcctcttctcctgat

SEQ ID NO: 710762 - DNA, 20 bp, mouse
gtcctcttctcctgattggc

SEQ ID NO: 710763 - DNA, 20 bp, mouse
ggagctaccatatccttcct

SEQ ID NO: 710764 - DNA, 20 bp, mouse
gagggtcgctgcccataatg

SEQ ID NO: 710765 - DNA, 20 bp, mouse
gcatcagacagcactgcaga

SEQ ID NO: 710766 - DNA, 20 bp, mouse
gtcctctggggactggtctg

SEQ ID NO: 710767 - DNA, 20 bp, mouse
gctgaagcgtcctactgccc

SEQ ID NO: 710768 - DNA, 20 bp, mouse
gaggacgcttcagattcctc

SEQ ID NO: 710769 - DNA, 20 bp, mouse
gcagctgtgaccaacacccc

SEQ ID NO: 710770 - DNA, 20 bp, mouse
ggagccaagcaggcccactg

SEQ ID NO: 710771 - DNA, 20 bp, mouse
gactcagtcaggtgggaagc

SEQ ID NO: 710772 - DNA, 20 bp, mouse
gaggtaattgcagcatctac

SEQ ID NO: 710773 - DNA, 20 bp, mouse
gtcctactgccctggggtgt

SEQ ID NO: 710774 - DNA, 20 bp, mouse
gtggggctagggagccaagc

SEQ ID NO: 710775 - DNA, 20 bp, mouse
gacctggtgacacaccaagc

SEQ ID NO: 710776 - DNA, 20 bp, mouse
gacggaaggctattagaggc

SEQ ID NO: 710777 - DNA, 20 bp, mouse
gagagacggaaggctattag

SEQ ID NO: 710778 - DNA, 20 bp, mouse
ggtagctcacagccatctgc

SEQ ID NO: 710779 - DNA, 20 bp, mouse
gatcagacatcccctgcaga

SEQ ID NO: 710780 - DNA, 20 bp, mouse
gctgtgggaggagagacgga

SEQ ID NO: 710781 - DNA, 20 bp, mouse
gagggtcgctgcccataatg

SEQ ID NO: 710782 - DNA, 20 bp, mouse
gtggaaccactaggtacact

SEQ ID NO: 710783 - DNA, 20 bp, mouse
gaactacctagtgtacctag

SEQ ID NO: 710784 - DNA, 20 bp, mouse
gggaagtgactactgagtac

SEQ ID NO: 710785 - DNA, 20 bp, mouse
gagcgtcctcttctcctgag

SEQ ID NO: 710786 - DNA, 20 bp, mouse
gctttaatggctatagactc

SEQ ID NO: 710787 - DNA, 20 bp, mouse
gccattaaagcatagaggtt

SEQ ID NO: 710788 - DNA, 20 bp, mouse
gtatagccattaaagcatag

SEQ ID NO: 710789 - DNA, 20 bp, mouse
gggctatagactctggttgc

SEQ ID NO: 710790 - DNA, 20 bp, mouse
gtgagggaacagggaaagca

SEQ ID NO: 710791 - DNA, 20 bp, mouse
gcattctgttgcttctgctt

SEQ ID NO: 710792 - DNA, 20 bp, mouse
ggcaaaacatggaccaatga

SEQ ID NO: 710793 - DNA, 20 bp, mouse
gctgacctggcattggacat

SEQ ID NO: 710794 - DNA, 20 bp, mouse
gtagctggtaatactgtgaa

SEQ ID NO: 710795 - DNA, 20 bp, mouse
ggggaaagcatggtgtagag

SEQ ID NO: 710796 - DNA, 20 bp, mouse
ggataaaagggaagtagatg

SEQ ID NO: 710797 - DNA, 20 bp, mouse
gaatatggcagcatcctggc

SEQ ID NO: 710798 - DNA, 20 bp, mouse
ggctaatacaaacacaatag

SEQ ID NO: 710799 - DNA, 20 bp, mouse
gtcaaaacccacctggacag

SEQ ID NO: 710800 - DNA, 20 bp, mouse
ggtcttagtttggaattctt

SEQ ID NO: 710801 - DNA, 20 bp, mouse
gatagaggacaatacatatt

SEQ ID NO: 710802 - DNA, 20 bp, mouse
gagtgtgccactgtccaggt

SEQ ID NO: 710803 - DNA, 20 bp, mouse
gtaggagctcaaaacccacc

SEQ ID NO: 710804 - DNA, 20 bp, mouse
gatgaagtgtgccactgtcc

SEQ ID NO: 710805 - DNA, 20 bp, mouse
gatatttggagctgccttac

SEQ ID NO: 710806 - DNA, 20 bp, mouse
gccaaacctctatgctttag

SEQ ID NO: 710807 - DNA, 20 bp, mouse
gctttagtggctatagactc

SEQ ID NO: 710808 - DNA, 20 bp, mouse
gtatagccactaaagcatag

SEQ ID NO: 710809 - DNA, 20 bp, mouse
gggctatagactctggttgc

SEQ ID NO: 710810 - DNA, 20 bp, mouse
gtgagggaacagggaaagca

SEQ ID NO: 710811 - DNA, 20 bp, mouse
gcattctgttgcttctgctt

SEQ ID NO: 710812 - DNA, 20 bp, mouse
ggcaaaacatggaccaatga

SEQ ID NO: 710813 - DNA, 20 bp, mouse
gctgacctggcattggacat

SEQ ID NO: 710814 - DNA, 20 bp, mouse
gtagctggtaatactgtgaa

SEQ ID NO: 710815 - DNA, 20 bp, mouse
ggggaaagcatggtgtagag

SEQ ID NO: 710816 - DNA, 20 bp, mouse
gaggagagtggaccctagca

SEQ ID NO: 710817 - DNA, 20 bp, mouse
gtcaatgtaaataactactg

SEQ ID NO: 710818 - DNA, 20 bp, mouse
gattcatggctactcatgat

SEQ ID NO: 710819 - DNA, 20 bp, mouse
gagctcacacttaatgtttg

SEQ ID NO: 710820 - DNA, 20 bp, mouse
gtactctcctggatgactgt

SEQ ID NO: 710821 - DNA, 20 bp, mouse
gttaataagctgtactctcc

SEQ ID NO: 710822 - DNA, 20 bp, mouse
ggtgtcagatctcattagtc

SEQ ID NO: 710823 - DNA, 20 bp, mouse
gtctcttaaaagtcacggac

SEQ ID NO: 710824 - DNA, 20 bp, mouse
gatcatgggttgcaaattca

SEQ ID NO: 710825 - DNA, 20 bp, mouse
gtctcaggagtcagtactca

SEQ ID NO: 710826 - DNA, 20 bp, mouse
gagtcctcacccatcacgag

SEQ ID NO: 710827 - DNA, 20 bp, mouse
gatatgttgcctctcgtgat

SEQ ID NO: 710828 - DNA, 20 bp, mouse
gggctcacacttaatgattc

SEQ ID NO: 710829 - DNA, 20 bp, mouse
gtcaatgtcaataactacca

SEQ ID NO: 710830 - DNA, 20 bp, mouse
gacctccaatcatgagtatc

SEQ ID NO: 710831 - DNA, 20 bp, mouse
gaaagggctttgcatgtcct

SEQ ID NO: 710832 - DNA, 20 bp, mouse
gaccggatactcatgattgg

SEQ ID NO: 710833 - DNA, 20 bp, mouse
ggtattactcacagtcatac

SEQ ID NO: 710834 - DNA, 20 bp, mouse
ggcatgtccttggcttttaa

SEQ ID NO: 710835 - DNA, 20 bp, mouse
gtgtagctttacagagttga

SEQ ID NO: 710836 - DNA, 20 bp, mouse
gctacagaatagccatacca

SEQ ID NO: 710837 - DNA, 20 bp, mouse
gggctactgggcccttgaga

SEQ ID NO: 710838 - DNA, 20 bp, mouse
gcataaacaagagtgtgctg

SEQ ID NO: 710839 - DNA, 20 bp, mouse
gcatacttgggcatttgtcc

SEQ ID NO: 710840 - DNA, 20 bp, mouse
gcaataggcaagatgagttc

SEQ ID NO: 710841 - DNA, 20 bp, mouse
gaggtacttgctatcaaatc

SEQ ID NO: 710842 - DNA, 20 bp, mouse
ggaacttgtctgccatggta

SEQ ID NO: 710843 - DNA, 20 bp, mouse
gtgcccaagtatgcaatgac

SEQ ID NO: 710844 - DNA, 20 bp, mouse
gcattgaagttttaggctac

SEQ ID NO: 710845 - DNA, 20 bp, mouse
ggcatgcacatttcttttta

SEQ ID NO: 710846 - DNA, 20 bp, mouse
gtagccctccccacttcgag

SEQ ID NO: 710847 - DNA, 20 bp, mouse
ggtagtggctatggaggggt

SEQ ID NO: 710848 - DNA, 20 bp, mouse
gattcctctcgaagtgggga

SEQ ID NO: 710849 - DNA, 20 bp, mouse
gctatgtagtggctatggag

SEQ ID NO: 710850 - DNA, 20 bp, mouse
gtgagccagaagagtatgag

SEQ ID NO: 710851 - DNA, 20 bp, mouse
ggcttccgctcatactcttc

SEQ ID NO: 710852 - DNA, 20 bp, mouse
gctggctcaagcgagtcaca

SEQ ID NO: 710853 - DNA, 20 bp, mouse
gaagccttggtgagaggaca

SEQ ID NO: 710854 - DNA, 20 bp, mouse
gttgctctatgtagtggcta

SEQ ID NO: 710855 - DNA, 20 bp, mouse
gccaaggacaattgcttaag

SEQ ID NO: 710856 - DNA, 20 bp, mouse
gctaactgccaggctctgat

SEQ ID NO: 710857 - DNA, 20 bp, mouse
gtgtcccaacaatctgacca

SEQ ID NO: 710858 - DNA, 20 bp, mouse
ggatgggggtctcgtctctg

SEQ ID NO: 710859 - DNA, 20 bp, mouse
gcacttggggcttctgtcca

SEQ ID NO: 710860 - DNA, 20 bp, mouse
ggacagaagccccaagtggg

SEQ ID NO: 710861 - DNA, 20 bp, mouse
gggaggcatccgcccacttg

SEQ ID NO: 710862 - DNA, 20 bp, mouse
gggggcttctgtccaaggta

SEQ ID NO: 710863 - DNA, 20 bp, mouse
gacctgtgagtctaactgcc

SEQ ID NO: 710864 - DNA, 20 bp, mouse
ggcctggcagttagactcac

SEQ ID NO: 710865 - DNA, 20 bp, mouse
gctgttccaagttccagtga

SEQ ID NO: 710866 - DNA, 20 bp, mouse
ggactggcaggtcaacgtgg

SEQ ID NO: 710867 - DNA, 20 bp, mouse
gtttctccaaggggattgat

SEQ ID NO: 710868 - DNA, 20 bp, mouse
gtctgactggcaggtcaacg

SEQ ID NO: 710869 - DNA, 20 bp, mouse
gaatccccttggagaaagta

SEQ ID NO: 710870 - DNA, 20 bp, mouse
ggattgatgggaggacagat

SEQ ID NO: 710871 - DNA, 20 bp, mouse
gtgaagccttactttctcca

SEQ ID NO: 710872 - DNA, 20 bp, mouse
ggtagctgaacccagcctga

SEQ ID NO: 710873 - DNA, 20 bp, mouse
gctccaaggggattgatggg

SEQ ID NO: 710874 - DNA, 20 bp, mouse
ggtcctcccatcaatcccct

SEQ ID NO: 710875 - DNA, 20 bp, mouse
ggtgctgtgattggagctta

SEQ ID NO: 710876 - DNA, 20 bp, mouse
gcaaggccagccatggataa

SEQ ID NO: 710877 - DNA, 20 bp, mouse
gagcgggggcggaggatgga

SEQ ID NO: 710878 - DNA, 20 bp, mouse
gagggcttttagtgtggtta

SEQ ID NO: 710879 - DNA, 20 bp, mouse
gctacctacccacacctaga

SEQ ID NO: 710880 - DNA, 20 bp, mouse
ggtagagtgtacagagatat

SEQ ID NO: 710881 - DNA, 20 bp, mouse
gcatcaggcagctttgtgag

SEQ ID NO: 710882 - DNA, 20 bp, mouse
gtacccagccctctaggtgt

SEQ ID NO: 710883 - DNA, 20 bp, mouse
gtcaagaaagcccttatcca

SEQ ID NO: 710884 - DNA, 20 bp, mouse
gggtagccctggccttggtg

SEQ ID NO: 710885 - DNA, 20 bp, mouse
ggccgggccgggagctgggt

SEQ ID NO: 710886 - DNA, 20 bp, mouse
gtcaattgtcttccctttgt

SEQ ID NO: 710887 - DNA, 20 bp, mouse
gcaattaaagagacatttta

SEQ ID NO: 710888 - DNA, 20 bp, mouse
ggaaaacaattggcacaggt

SEQ ID NO: 710889 - DNA, 20 bp, mouse
gtctggaaaacaattggcac

SEQ ID NO: 710890 - DNA, 20 bp, mouse
gagggaggaagttgcaggct

SEQ ID NO: 710891 - DNA, 20 bp, mouse
gggaagacaattgagcagca

SEQ ID NO: 710892 - DNA, 20 bp, mouse
gtcaatgtaagttgattcat

SEQ ID NO: 710893 - DNA, 20 bp, mouse
gaccagaatctctacacagc

SEQ ID NO: 710894 - DNA, 20 bp, mouse
gactccctggggcttttagg

SEQ ID NO: 710895 - DNA, 20 bp, mouse
gcatcctcctaaaagcccca

SEQ ID NO: 710896 - DNA, 20 bp, mouse
gtcagggggcagtggactag

SEQ ID NO: 710897 - DNA, 20 bp, mouse
gtttccttgtggtgcatctg

SEQ ID NO: 710898 - DNA, 20 bp, mouse
ggaaatggaaatatacgttt

SEQ ID NO: 710899 - DNA, 20 bp, mouse
gctgaccaaactgctcttca

SEQ ID NO: 710900 - DNA, 20 bp, mouse
gtgctggcgggatagatggg

SEQ ID NO: 710901 - DNA, 20 bp, mouse
gcagaagaaaccctccccaa

SEQ ID NO: 710902 - DNA, 20 bp, mouse
ggccttgtagcctttccttg

SEQ ID NO: 710903 - DNA, 20 bp, mouse
gttgtggtgcatctgtggtt

SEQ ID NO: 710904 - DNA, 20 bp, mouse
gagtggactaggggactggg

SEQ ID NO: 710905 - DNA, 20 bp, mouse
gaaaacccacaagctttggg

SEQ ID NO: 710906 - DNA, 20 bp, mouse
gaggacacagttccaacctg

SEQ ID NO: 710907 - DNA, 20 bp, mouse
gcaattaaagagacatttta

SEQ ID NO: 710908 - DNA, 20 bp, mouse
gattttagggaacaagattt

SEQ ID NO: 710909 - DNA, 20 bp, mouse
gtctggaaaacaattgcccc

SEQ ID NO: 710910 - DNA, 20 bp, mouse
ggaaaacaattgccccaggt

SEQ ID NO: 710911 - DNA, 20 bp, mouse
gtcaatgtaagttgattcat

SEQ ID NO: 710912 - DNA, 20 bp, mouse
gaccagaatctctacacagc

SEQ ID NO: 710913 - DNA, 20 bp, mouse
gactccctggggcttttagg

SEQ ID NO: 710914 - DNA, 20 bp, mouse
ggaagtaggaggcatgcata

SEQ ID NO: 710915 - DNA, 20 bp, mouse
gcatcctcctaaaagcccca

SEQ ID NO: 710916 - DNA, 20 bp, mouse
gaacttcaaaaaagcagatc

SEQ ID NO: 710917 - DNA, 20 bp, mouse
ggtagctgaacccagcctga

SEQ ID NO: 710918 - DNA, 20 bp, mouse
gtgggttcagctacactgca

SEQ ID NO: 710919 - DNA, 20 bp, mouse
gggcttgtctcagaaacacc

SEQ ID NO: 710920 - DNA, 20 bp, mouse
gactgcaaggactgttcacc

SEQ ID NO: 710921 - DNA, 20 bp, mouse
ggactggcaggtccatgtag

SEQ ID NO: 710922 - DNA, 20 bp, mouse
ggccaatcagaacctctaca

SEQ ID NO: 710923 - DNA, 20 bp, mouse
gtgtttggtgccttcaggct

SEQ ID NO: 710924 - DNA, 20 bp, mouse
gttagaaagcaatatttgtt

SEQ ID NO: 710925 - DNA, 20 bp, mouse
gatatttgtttggtgccttc

SEQ ID NO: 710926 - DNA, 20 bp, mouse
gagctgccagtcaaaaaagt

SEQ ID NO: 710927 - DNA, 20 bp, mouse
gagctgcctacttttttgac

SEQ ID NO: 710928 - DNA, 20 bp, mouse
gactccaagaggcttttagg

SEQ ID NO: 710929 - DNA, 20 bp, mouse
ggttactccaagaggctttt

SEQ ID NO: 710930 - DNA, 20 bp, mouse
gcatcctcctaaaagcctct

SEQ ID NO: 710931 - DNA, 20 bp, mouse
gcaatcttagttactccaag

SEQ ID NO: 710932 - DNA, 20 bp, mouse
gcccatgtaagctgatttat

SEQ ID NO: 710933 - DNA, 20 bp, mouse
gtcaagctggatatcttaca

SEQ ID NO: 710934 - DNA, 20 bp, mouse
ggcccataaatcagcttaca

SEQ ID NO: 710935 - DNA, 20 bp, mouse
ggaagaaggaggcatgcaga

SEQ ID NO: 710936 - DNA, 20 bp, mouse
gtcttggggaaaactgtcta

SEQ ID NO: 710937 - DNA, 20 bp, mouse
gcaaggaacaataatgtgga

SEQ ID NO: 710938 - DNA, 20 bp, mouse
ggtctcaaggaacaataatg

SEQ ID NO: 710939 - DNA, 20 bp, mouse
gttgggggctaataagagaa

SEQ ID NO: 710940 - DNA, 20 bp, mouse
gctgtctatggttgagaaga

SEQ ID NO: 710941 - DNA, 20 bp, mouse
gaagagaactattacatatt

SEQ ID NO: 710942 - DNA, 20 bp, mouse
gtttttatgtacacacgttt

SEQ ID NO: 710943 - DNA, 20 bp, mouse
gatctacaggtgacatgggc

SEQ ID NO: 710944 - DNA, 20 bp, mouse
gtattacatatttggtctca

SEQ ID NO: 710945 - DNA, 20 bp, mouse
gttgtatctacaggtgacat

SEQ ID NO: 710946 - DNA, 20 bp, mouse
gatctgcaaatctctacatg

SEQ ID NO: 710947 - DNA, 20 bp, mouse
gtctacatgtggaaaacaat

SEQ ID NO: 710948 - DNA, 20 bp, mouse
ggatcagatgaattataggg

SEQ ID NO: 710949 - DNA, 20 bp, mouse
gaatgatcagatgaattata

SEQ ID NO: 710950 - DNA, 20 bp, mouse
gggcttttaggaggatgcgc

SEQ ID NO: 710951 - DNA, 20 bp, mouse
gccaatgtaagctgattcat

SEQ ID NO: 710952 - DNA, 20 bp, mouse
gcacagctgccagtcagaaa

SEQ ID NO: 710953 - DNA, 20 bp, mouse
gcctctactgagtgatgtga

SEQ ID NO: 710954 - DNA, 20 bp, mouse
gactccctggggcttttagg

SEQ ID NO: 710955 - DNA, 20 bp, mouse
ggaagtaggaggcatgcata

SEQ ID NO: 710956 - DNA, 20 bp, mouse
gaggggcactgcccacgaag

SEQ ID NO: 710957 - DNA, 20 bp, mouse
ggacagttggccaggatatt

SEQ ID NO: 710958 - DNA, 20 bp, mouse
gcccatcaatcagtttacat

SEQ ID NO: 710959 - DNA, 20 bp, mouse
gaaagctgcagatgtagaaa

SEQ ID NO: 710960 - DNA, 20 bp, mouse
gtgcagatgtagaaaaggat

SEQ ID NO: 710961 - DNA, 20 bp, mouse
gcagtggacctgaacccagt

SEQ ID NO: 710962 - DNA, 20 bp, mouse
ggtggcttccgactgggttc

SEQ ID NO: 710963 - DNA, 20 bp, mouse
gttgttctgtggcttccgac

SEQ ID NO: 710964 - DNA, 20 bp, mouse
gtccaatgtaaactgattga

SEQ ID NO: 710965 - DNA, 20 bp, mouse
ggaaacaatattttgttctg

SEQ ID NO: 710966 - DNA, 20 bp, mouse
gagctgccagtcaaaaaaag

SEQ ID NO: 710967 - DNA, 20 bp, mouse
gcctcacatcaattagtaga

SEQ ID NO: 710968 - DNA, 20 bp, mouse
gagctgcctctttttttgac

SEQ ID NO: 710969 - DNA, 20 bp, mouse
gactccaagaggcttttagg

SEQ ID NO: 710970 - DNA, 20 bp, mouse
ggttactccaagaggctttt

SEQ ID NO: 710971 - DNA, 20 bp, mouse
gcatcctcctaaaagcctct

SEQ ID NO: 710972 - DNA, 20 bp, mouse
gcccatgtaagctgatttat

SEQ ID NO: 710973 - DNA, 20 bp, mouse
gcaatcttagttactccaag

SEQ ID NO: 710974 - DNA, 20 bp, mouse
ggcccataaatcagcttaca

SEQ ID NO: 710975 - DNA, 20 bp, mouse
ggaagaaggaggcatgcaga

SEQ ID NO: 710976 - DNA, 20 bp, mouse
ggaagtatggtaggttggcc

SEQ ID NO: 710977 - DNA, 20 bp, mouse
gcttagtacaaagagataag

SEQ ID NO: 710978 - DNA, 20 bp, mouse
gcaacatacaaacaagcacc

SEQ ID NO: 710979 - DNA, 20 bp, mouse
gataaggggaatcactctta

SEQ ID NO: 710980 - DNA, 20 bp, mouse
gcaaggtatttatatagaga

SEQ ID NO: 710981 - DNA, 20 bp, mouse
gggtttcattttctgtaagt

SEQ ID NO: 710982 - DNA, 20 bp, mouse
gtataaggaggaagtatggt

SEQ ID NO: 710983 - DNA, 20 bp, mouse
gaggaggaagtatggtaggt

SEQ ID NO: 710984 - DNA, 20 bp, mouse
gagagcaaacagcactctgt

SEQ ID NO: 710985 - DNA, 20 bp, mouse
gtgctgtttgctcttttata

SEQ ID NO: 710986 - DNA, 20 bp, mouse
gagacagctcctgggtgctt

SEQ ID NO: 710987 - DNA, 20 bp, mouse
gagctcctgggtgcttaggg

SEQ ID NO: 710988 - DNA, 20 bp, mouse
ggaagtgtggtaggttggtc

SEQ ID NO: 710989 - DNA, 20 bp, mouse
gttaactaggcaaaaatggc

SEQ ID NO: 710990 - DNA, 20 bp, mouse
gagagagatggcaggagagc

SEQ ID NO: 710991 - DNA, 20 bp, mouse
gttgtgggtaggcagagaag

SEQ ID NO: 710992 - DNA, 20 bp, mouse
gtctcctggacgtgtggttc

SEQ ID NO: 710993 - DNA, 20 bp, mouse
ggtctgtccatcatgtactc

SEQ ID NO: 710994 - DNA, 20 bp, mouse
gcgtccaggagaaacacaat

SEQ ID NO: 710995 - DNA, 20 bp, mouse
ggagccagaaccacacgtcc

SEQ ID NO: 710996 - DNA, 20 bp, mouse
gcatcagtggaaatgcagag

SEQ ID NO: 710997 - DNA, 20 bp, mouse
gcagagggggcgggtataaa

SEQ ID NO: 710998 - DNA, 20 bp, mouse
gagtggaaatgcagaggggg

SEQ ID NO: 710999 - DNA, 20 bp, mouse
gtgagtgttgaagcccagtc

SEQ ID NO: 711000 - DNA, 20 bp, mouse
gagggcatcagtggaaagta

SEQ ID NO: 711001 - DNA, 20 bp, mouse
gagggaggggcgggcttcaa

SEQ ID NO: 711002 - DNA, 20 bp, mouse
gatgagcatcagcggaaatt

SEQ ID NO: 711003 - DNA, 20 bp, mouse
gcatcagcggaaattagggt

SEQ ID NO: 711004 - DNA, 20 bp, mouse
ggtgggcatcatcggaaatg

SEQ ID NO: 711005 - DNA, 20 bp, mouse
gcgggcttcaatggaaatga

SEQ ID NO: 711006 - DNA, 20 bp, mouse
ggatgatctcggggtgaaaa

SEQ ID NO: 711007 - DNA, 20 bp, mouse
gatgtctatgggagagtttg

SEQ ID NO: 711008 - DNA, 20 bp, mouse
gaatgcataaacatttatca

SEQ ID NO: 711009 - DNA, 20 bp, mouse
ggtaacacagggtagttggg

SEQ ID NO: 711010 - DNA, 20 bp, mouse
ggaggagttcagaagaaaaa

SEQ ID NO: 711011 - DNA, 20 bp, mouse
gctcttcagggcaactaatt

SEQ ID NO: 711012 - DNA, 20 bp, mouse
gaggcataagaagggaactc

SEQ ID NO: 711013 - DNA, 20 bp, mouse
gcctgtaacacagggtagtt

SEQ ID NO: 711014 - DNA, 20 bp, mouse
gtacctagggtgaggttgta

SEQ ID NO: 711015 - DNA, 20 bp, mouse
gtgtgttacaggcataagaa

SEQ ID NO: 711016 - DNA, 20 bp, mouse
gcccacccacaccttggatg

SEQ ID NO: 711017 - DNA, 20 bp, mouse
gctaaagggcagggcaagga

SEQ ID NO: 711018 - DNA, 20 bp, mouse
gagaactaggtattccagaa

SEQ ID NO: 711019 - DNA, 20 bp, mouse
gtggcctagcaaggctctaa

SEQ ID NO: 711020 - DNA, 20 bp, mouse
gaagacccccacccacacct

SEQ ID NO: 711021 - DNA, 20 bp, mouse
gacccactccggcagaggtt

SEQ ID NO: 711022 - DNA, 20 bp, mouse
ggatgaggcttgttggctcc

SEQ ID NO: 711023 - DNA, 20 bp, mouse
ggaagggccctggtcagagc

SEQ ID NO: 711024 - DNA, 20 bp, mouse
gaggccccaccaagacgcat

SEQ ID NO: 711025 - DNA, 20 bp, mouse
ggcagtgctgccacacgctt

SEQ ID NO: 711026 - DNA, 20 bp, mouse
gcctggtccaagctgtgcag

SEQ ID NO: 711027 - DNA, 20 bp, mouse
gaggcgttgtgtttagtcat

SEQ ID NO: 711028 - DNA, 20 bp, mouse
gcagttgcacatgaaacatt

SEQ ID NO: 711029 - DNA, 20 bp, mouse
gacggatgtgcatgaagtca

SEQ ID NO: 711030 - DNA, 20 bp, mouse
gaaccatattatgaacacaa

SEQ ID NO: 711031 - DNA, 20 bp, mouse
gtaaaaggtccatctcattc

SEQ ID NO: 711032 - DNA, 20 bp, mouse
gacacaacgcctgaatgaga

SEQ ID NO: 711033 - DNA, 20 bp, mouse
gatccattgtgttcataata

SEQ ID NO: 711034 - DNA, 20 bp, mouse
gaagtcatggcacccgagga

SEQ ID NO: 711035 - DNA, 20 bp, mouse
gcatgaagtcatggcacccg

SEQ ID NO: 711036 - DNA, 20 bp, mouse
gtcatggcacaacactgtgt

SEQ ID NO: 711037 - DNA, 20 bp, mouse
gctaggttttagaatctaat

SEQ ID NO: 711038 - DNA, 20 bp, mouse
gttttagaatctaataggat

SEQ ID NO: 711039 - DNA, 20 bp, mouse
gggataggtaacatttatca

SEQ ID NO: 711040 - DNA, 20 bp, mouse
ggccacacatatgattccta

SEQ ID NO: 711041 - DNA, 20 bp, mouse
gattcctaaggcctgaagtt

SEQ ID NO: 711042 - DNA, 20 bp, mouse
ggccttaggaatcatatgtg

SEQ ID NO: 711043 - DNA, 20 bp, mouse
ggttcccaacttcaggcctt

SEQ ID NO: 711044 - DNA, 20 bp, mouse
ggatatgatgaaatgtttct

SEQ ID NO: 711045 - DNA, 20 bp, mouse
ggagtctagttcccaacttc

SEQ ID NO: 711046 - DNA, 20 bp, mouse
gtggggcctcagccgaaatg

SEQ ID NO: 711047 - DNA, 20 bp, mouse
gcagcctcagggctaattgg

SEQ ID NO: 711048 - DNA, 20 bp, mouse
ggccccagggctaatgtaag

SEQ ID NO: 711049 - DNA, 20 bp, mouse
gtcagccgaaatgagggttg

SEQ ID NO: 711050 - DNA, 20 bp, mouse
gtcagggctaattggaggag

SEQ ID NO: 711051 - DNA, 20 bp, mouse
ggccccttacattagccctg

SEQ ID NO: 711052 - DNA, 20 bp, mouse
gcatcagtgttaatgagagt

SEQ ID NO: 711053 - DNA, 20 bp, mouse
gctgaatccatgtcatgagt

SEQ ID NO: 711054 - DNA, 20 bp, mouse
gtgggccccaaccctcattt

SEQ ID NO: 711055 - DNA, 20 bp, mouse
gcaggtctaatgggagagga

SEQ ID NO: 711056 - DNA, 20 bp, mouse
gagcagcagcgggaccagat

SEQ ID NO: 711057 - DNA, 20 bp, mouse
gctagtttatccaagcctgc

SEQ ID NO: 711058 - DNA, 20 bp, mouse
gcacagttataaagagagtg

SEQ ID NO: 711059 - DNA, 20 bp, mouse
ggtgtggagtacacactgaa

SEQ ID NO: 711060 - DNA, 20 bp, mouse
gaaagaggaggtctccgtat

SEQ ID NO: 711061 - DNA, 20 bp, mouse
ggcgggaccagatgggggca

SEQ ID NO: 711062 - DNA, 20 bp, mouse
ggagtggagagactcacaaa

SEQ ID NO: 711063 - DNA, 20 bp, mouse
gtgggaagaaggtggaagtt

SEQ ID NO: 711064 - DNA, 20 bp, mouse
gtctccgtatgggaagaagg

SEQ ID NO: 711065 - DNA, 20 bp, mouse
gaggggtatcaggtagtctc

SEQ ID NO: 711066 - DNA, 20 bp, mouse
gccatgagagtaatgagcac

SEQ ID NO: 711067 - DNA, 20 bp, mouse
gaacagtacaaatgtaagtg

SEQ ID NO: 711068 - DNA, 20 bp, mouse
gttttcccttccaattttaa

SEQ ID NO: 711069 - DNA, 20 bp, mouse
gaaatacgtacccttaaaat

SEQ ID NO: 711070 - DNA, 20 bp, mouse
gagagtaatgagcacaggtg

SEQ ID NO: 711071 - DNA, 20 bp, mouse
gcattgaggaagtcaaagca

SEQ ID NO: 711072 - DNA, 20 bp, mouse
gcgtacccttaaaattggaa

SEQ ID NO: 711073 - DNA, 20 bp, mouse
ggatatatgacattgtcatg

SEQ ID NO: 711074 - DNA, 20 bp, mouse
gtcaaagcatggtgctgagg

SEQ ID NO: 711075 - DNA, 20 bp, mouse
gaagtcaaagcatggtgctg

SEQ ID NO: 711076 - DNA, 20 bp, mouse
ggcttctcatagtggcactg

SEQ ID NO: 711077 - DNA, 20 bp, mouse
gccaacttacgaaagacaaa

SEQ ID NO: 711078 - DNA, 20 bp, mouse
gatagtggcactgaggttca

SEQ ID NO: 711079 - DNA, 20 bp, mouse
gagggcgttgccaggaatga

SEQ ID NO: 711080 - DNA, 20 bp, mouse
gaggaactacacagtcaagc

SEQ ID NO: 711081 - DNA, 20 bp, mouse
gtcctggtggtgatgtcggt

SEQ ID NO: 711082 - DNA, 20 bp, mouse
gctctcgcggggaccagcat

SEQ ID NO: 711083 - DNA, 20 bp, mouse
gagaaatatggggaggtaac

SEQ ID NO: 711084 - DNA, 20 bp, mouse
gggatcagttgaaggaaatg

SEQ ID NO: 711085 - DNA, 20 bp, mouse
gccccacagcagaaccgctc

SEQ ID NO: 711086 - DNA, 20 bp, mouse
gaggaataataatagctaat

SEQ ID NO: 711087 - DNA, 20 bp, mouse
gaggggtaaggttgtgggga

SEQ ID NO: 711088 - DNA, 20 bp, mouse
gagcacaggggctactgtgt

SEQ ID NO: 711089 - DNA, 20 bp, mouse
gctgcaggggtaaggttgtg

SEQ ID NO: 711090 - DNA, 20 bp, mouse
gcccatgtgcagacacctgc

SEQ ID NO: 711091 - DNA, 20 bp, mouse
gacaagaaggaaagagcaca

SEQ ID NO: 711092 - DNA, 20 bp, mouse
gaatggggaaaactagatga

SEQ ID NO: 711093 - DNA, 20 bp, mouse
ggaggaaaaggcttctgtac

SEQ ID NO: 711094 - DNA, 20 bp, mouse
gtggtggaagccttactact

SEQ ID NO: 711095 - DNA, 20 bp, mouse
gacaggtagagcagacaaga

SEQ ID NO: 711096 - DNA, 20 bp, mouse
gtgcgctcacaatgctcctc

SEQ ID NO: 711097 - DNA, 20 bp, mouse
ggccaatggcaagcttcggg

SEQ ID NO: 711098 - DNA, 20 bp, mouse
gggattggggtcccgttagt

SEQ ID NO: 711099 - DNA, 20 bp, mouse
gtctggccaatggcaagctt

SEQ ID NO: 711100 - DNA, 20 bp, mouse
gtgttccacaaaccaaccaa

SEQ ID NO: 711101 - DNA, 20 bp, mouse
ggcgcatgctgcgctcccat

SEQ ID NO: 711102 - DNA, 20 bp, mouse
ggacaattgtgacctactaa

SEQ ID NO: 711103 - DNA, 20 bp, mouse
ggggaccccaatcccagtca

SEQ ID NO: 711104 - DNA, 20 bp, mouse
gagcttcgggaggaaaaaca

SEQ ID NO: 711105 - DNA, 20 bp, mouse
gacaatgctcctctggccaa

SEQ ID NO: 711106 - DNA, 20 bp, mouse
ggaacagtgaataaatagtg

SEQ ID NO: 711107 - DNA, 20 bp, mouse
gactgttcattgtggaagat

SEQ ID NO: 711108 - DNA, 20 bp, mouse
gatttattcactgttcattg

SEQ ID NO: 711109 - DNA, 20 bp, mouse
ggatgcagagacactaagga

SEQ ID NO: 711110 - DNA, 20 bp, mouse
gcagctgtgaggaccctcga

SEQ ID NO: 711111 - DNA, 20 bp, mouse
ggaccctcgagggcaagagg

SEQ ID NO: 711112 - DNA, 20 bp, mouse
gaggctgaggccagtgagaa

SEQ ID NO: 711113 - DNA, 20 bp, mouse
gaggggaagagggtcttccc

SEQ ID NO: 711114 - DNA, 20 bp, mouse
gctggccctgggctcatcac

SEQ ID NO: 711115 - DNA, 20 bp, mouse
gtcgggatgcagagacacta

SEQ ID NO: 711116 - DNA, 20 bp, mouse
ggtgggagaaccaggtgaca

SEQ ID NO: 711117 - DNA, 20 bp, mouse
gcacacatgaaagtaagtaa

SEQ ID NO: 711118 - DNA, 20 bp, mouse
gttcatgtgtgcagctgcag

SEQ ID NO: 711119 - DNA, 20 bp, mouse
gaaggcctggcacactggaa

SEQ ID NO: 711120 - DNA, 20 bp, mouse
gccagggcccacatctgaga

SEQ ID NO: 711121 - DNA, 20 bp, mouse
gccctctgtggtcaagtcaa

SEQ ID NO: 711122 - DNA, 20 bp, mouse
gtcccctgccagaattcgga

SEQ ID NO: 711123 - DNA, 20 bp, mouse
gcacttacatccctgtcacc

SEQ ID NO: 711124 - DNA, 20 bp, mouse
gccacagagggtctgtgaca

SEQ ID NO: 711125 - DNA, 20 bp, mouse
gtgtggtcaagtcaaaggcc

SEQ ID NO: 711126 - DNA, 20 bp, mouse
gtgggtggagagaggggctc

SEQ ID NO: 711127 - DNA, 20 bp, mouse
gaggggctcagggaagctgt

SEQ ID NO: 711128 - DNA, 20 bp, mouse
ggtggggagggaaagagtgc

SEQ ID NO: 711129 - DNA, 20 bp, mouse
ggcacgggccactcccatcc

SEQ ID NO: 711130 - DNA, 20 bp, mouse
gtttctgccctttcccggat

SEQ ID NO: 711131 - DNA, 20 bp, mouse
ggccctttcccggatgggag

SEQ ID NO: 711132 - DNA, 20 bp, mouse
gagagcaggtaggttcatgg

SEQ ID NO: 711133 - DNA, 20 bp, mouse
ggccactcccatccgggaaa

SEQ ID NO: 711134 - DNA, 20 bp, mouse
ggaggataacaacagtggtg

SEQ ID NO: 711135 - DNA, 20 bp, mouse
gggagtggcccgtgcatgga

SEQ ID NO: 711136 - DNA, 20 bp, mouse
ggtaacacacccacattctt

SEQ ID NO: 711137 - DNA, 20 bp, mouse
gcctggaatcctaagaatgt

SEQ ID NO: 711138 - DNA, 20 bp, mouse
gcacaggagcccagaatcac

SEQ ID NO: 711139 - DNA, 20 bp, mouse
gtatctaggacttgctatgg

SEQ ID NO: 711140 - DNA, 20 bp, mouse
gacaaaaacaacagaaacta

SEQ ID NO: 711141 - DNA, 20 bp, mouse
ggattcaatcagatatcttg

SEQ ID NO: 711142 - DNA, 20 bp, mouse
ggaggagtccttaatcaacc

SEQ ID NO: 711143 - DNA, 20 bp, mouse
gacaggagctcggtcacaca

SEQ ID NO: 711144 - DNA, 20 bp, mouse
gctgttatacccaaaatctc

SEQ ID NO: 711145 - DNA, 20 bp, mouse
ggtgtatctaggacttgcta

SEQ ID NO: 711146 - DNA, 20 bp, mouse
gatgactggatgcttatctg

SEQ ID NO: 711147 - DNA, 20 bp, mouse
ggtagtaaaagacttatgac

SEQ ID NO: 711148 - DNA, 20 bp, mouse
gaaacattgaaaaaatgagg

SEQ ID NO: 711149 - DNA, 20 bp, mouse
gctgtccagtacttcccatt

SEQ ID NO: 711150 - DNA, 20 bp, mouse
gagggccaaatgggaagtac

SEQ ID NO: 711151 - DNA, 20 bp, mouse
gctttctgatggtgaatcat

SEQ ID NO: 711152 - DNA, 20 bp, mouse
gacttcccatttggccctga

SEQ ID NO: 711153 - DNA, 20 bp, mouse
gtggttaaatgggtcatata

SEQ ID NO: 711154 - DNA, 20 bp, mouse
gagagtaagcttattagttt

SEQ ID NO: 711155 - DNA, 20 bp, mouse
gttatccatcagggccaaat

SEQ ID NO: 711156 - DNA, 20 bp, mouse
gtgcaaattcctgcccagaa

SEQ ID NO: 711157 - DNA, 20 bp, mouse
gtatgctggaattttaccac

SEQ ID NO: 711158 - DNA, 20 bp, mouse
gttgatcacaggttaccata

SEQ ID NO: 711159 - DNA, 20 bp, mouse
gacagtacacttcttcacaa

SEQ ID NO: 711160 - DNA, 20 bp, mouse
gagtgtactgttttcctttc

SEQ ID NO: 711161 - DNA, 20 bp, mouse
gactgttttcctttctgggc

SEQ ID NO: 711162 - DNA, 20 bp, mouse
ggatcaaagggtctgattga

SEQ ID NO: 711163 - DNA, 20 bp, mouse
gaagtccacagaagtctaaa

SEQ ID NO: 711164 - DNA, 20 bp, mouse
gaatcagaccctttgatcac

SEQ ID NO: 711165 - DNA, 20 bp, mouse
gggcaatccatgccaatctc

SEQ ID NO: 711166 - DNA, 20 bp, mouse
gcaacttaatagctgcttat

SEQ ID NO: 711167 - DNA, 20 bp, mouse
ggaaaagaatcagtttttat

SEQ ID NO: 711168 - DNA, 20 bp, mouse
gaagagcagggaattaccta

SEQ ID NO: 711169 - DNA, 20 bp, mouse
gccctgctcttagagctgag

SEQ ID NO: 711170 - DNA, 20 bp, mouse
gttaggactgagacttcatg

SEQ ID NO: 711171 - DNA, 20 bp, mouse
ggggaattaagttgcagtta

SEQ ID NO: 711172 - DNA, 20 bp, mouse
gcccagtaatcagtattgcc

SEQ ID NO: 711173 - DNA, 20 bp, mouse
gtcccattactcgttatcca

SEQ ID NO: 711174 - DNA, 20 bp, mouse
gaaccctggataacgagtaa

SEQ ID NO: 711175 - DNA, 20 bp, mouse
gtcctctcagctctaagagc

SEQ ID NO: 711176 - DNA, 20 bp, mouse
gggaacactgaccatggtca

SEQ ID NO: 711177 - DNA, 20 bp, mouse
gacttctcgtgcttctgctc

SEQ ID NO: 711178 - DNA, 20 bp, mouse
gtctgctctggcttctgtag

SEQ ID NO: 711179 - DNA, 20 bp, mouse
gaagtaggctatgcaggagg

SEQ ID NO: 711180 - DNA, 20 bp, mouse
gttgaagtgagccctgacca

SEQ ID NO: 711181 - DNA, 20 bp, mouse
gggagggaagtaggctatgc

SEQ ID NO: 711182 - DNA, 20 bp, mouse
ggcaaacgggctgaagtgag

SEQ ID NO: 711183 - DNA, 20 bp, mouse
gtaaaagagattagtaaccc

SEQ ID NO: 711184 - DNA, 20 bp, mouse
gttctccaagttgccacgtc

SEQ ID NO: 711185 - DNA, 20 bp, mouse
gtcagggctcacttcaaagc

SEQ ID NO: 711186 - DNA, 20 bp, mouse
gacggtacaaagggagatgt

SEQ ID NO: 711187 - DNA, 20 bp, mouse
gagatgttgggcattggact

SEQ ID NO: 711188 - DNA, 20 bp, mouse
gcttccactgatgacatagc

SEQ ID NO: 711189 - DNA, 20 bp, mouse
gagactcattgtgtatccca

SEQ ID NO: 711190 - DNA, 20 bp, mouse
gtaagaaatacttgtgcata

SEQ ID NO: 711191 - DNA, 20 bp, mouse
gaaagggagatgttgggcat

SEQ ID NO: 711192 - DNA, 20 bp, mouse
gaattgaaacaaaaagaaaa

SEQ ID NO: 711193 - DNA, 20 bp, mouse
gggaccagctatgtcatcag

SEQ ID NO: 711194 - DNA, 20 bp, mouse
ggttgctaggatacatagta

SEQ ID NO: 711195 - DNA, 20 bp, mouse
gaacaccccccagagagctc

SEQ ID NO: 711196 - DNA, 20 bp, mouse
ggaaacacagcaaataaagt

SEQ ID NO: 711197 - DNA, 20 bp, mouse
gttaattgttgtctcttatt

SEQ ID NO: 711198 - DNA, 20 bp, mouse
gtgttgtctcttattggggc

SEQ ID NO: 711199 - DNA, 20 bp, mouse
gtgaggttattgtgtgtaca

SEQ ID NO: 711200 - DNA, 20 bp, mouse
gcaagttgtatgaacataca

SEQ ID NO: 711201 - DNA, 20 bp, mouse
gatgaaaatattaggggaga

SEQ ID NO: 711202 - DNA, 20 bp, mouse
gccaggcaaaacagtgatgt

SEQ ID NO: 711203 - DNA, 20 bp, mouse
ggtttattatgaaaatatta

SEQ ID NO: 711204 - DNA, 20 bp, mouse
gggtgtaagctgcccaatgc

SEQ ID NO: 711205 - DNA, 20 bp, mouse
gctactgactgctcttacgg

SEQ ID NO: 711206 - DNA, 20 bp, mouse
gtaagaagtgtcttgggaag

SEQ ID NO: 711207 - DNA, 20 bp, mouse
ggagagctgtcaaatatgtc

SEQ ID NO: 711208 - DNA, 20 bp, mouse
gtaagcctaacacagtcctt

SEQ ID NO: 711209 - DNA, 20 bp, mouse
gggaagaaccctgctgattc

SEQ ID NO: 711210 - DNA, 20 bp, mouse
gcattggtccatgtggggta

SEQ ID NO: 711211 - DNA, 20 bp, mouse
gtacataatcaagggagaag

SEQ ID NO: 711212 - DNA, 20 bp, mouse
gcagccttcacaagaacgaa

SEQ ID NO: 711213 - DNA, 20 bp, mouse
gtgggttcatgaaatctgag

SEQ ID NO: 711214 - DNA, 20 bp, mouse
gtgatagaatcttatgttct

SEQ ID NO: 711215 - DNA, 20 bp, mouse
gcaagaacgaatggaaaagg

SEQ ID NO: 711216 - DNA, 20 bp, mouse
gtatggagtcagatgtcatg

SEQ ID NO: 711217 - DNA, 20 bp, mouse
gtaccaaaagaaacaatata

SEQ ID NO: 711218 - DNA, 20 bp, mouse
gttccatatattgtttcttt

SEQ ID NO: 711219 - DNA, 20 bp, mouse
gttaacagagaaaaaaaagc

SEQ ID NO: 711220 - DNA, 20 bp, mouse
ggctatggtgcatatatgtg

SEQ ID NO: 711221 - DNA, 20 bp, mouse
gtggatccctgggaatggca

SEQ ID NO: 711222 - DNA, 20 bp, mouse
ggcatctaattcatgtctta

SEQ ID NO: 711223 - DNA, 20 bp, mouse
ggagcataaggtgcaggagt

SEQ ID NO: 711224 - DNA, 20 bp, mouse
gtttcaggttatatatttca

SEQ ID NO: 711225 - DNA, 20 bp, mouse
gtttcaccatgccattccca

SEQ ID NO: 711226 - DNA, 20 bp, mouse
gatgttcagggagtgaacga

SEQ ID NO: 711227 - DNA, 20 bp, mouse
gcagcagcaggattaagctg

SEQ ID NO: 711228 - DNA, 20 bp, mouse
gtggctgtgagcatgtgtga

SEQ ID NO: 711229 - DNA, 20 bp, mouse
ggaagtctatatgcaggcat

SEQ ID NO: 711230 - DNA, 20 bp, mouse
ggtgaacgaaggaaaggaat

SEQ ID NO: 711231 - DNA, 20 bp, mouse
gggattaagctgtggcttgt

SEQ ID NO: 711232 - DNA, 20 bp, mouse
gacgaaggaaaggaatgggc

SEQ ID NO: 711233 - DNA, 20 bp, mouse
gcagggagtgaacgaaggaa

SEQ ID NO: 711234 - DNA, 20 bp, mouse
gtcactccctgaacatttca

SEQ ID NO: 711235 - DNA, 20 bp, mouse
gataactgaagtctatatgc

SEQ ID NO: 711236 - DNA, 20 bp, mouse
gtatggagtcagatgtcatg

SEQ ID NO: 711237 - DNA, 20 bp, mouse
gtaccaaaagaaacaatata

SEQ ID NO: 711238 - DNA, 20 bp, mouse
gttccatatattgtttcttt

SEQ ID NO: 711239 - DNA, 20 bp, mouse
gttaacagagaaaaaaaagc

SEQ ID NO: 711240 - DNA, 20 bp, mouse
ggctatggtgcatatatgtg

SEQ ID NO: 711241 - DNA, 20 bp, mouse
gtggatccctgggaatggca

SEQ ID NO: 711242 - DNA, 20 bp, mouse
ggcatctaattcatgtctta

SEQ ID NO: 711243 - DNA, 20 bp, mouse
ggagcataaggtgcaggagt

SEQ ID NO: 711244 - DNA, 20 bp, mouse
gtttcaggttatatatttca

SEQ ID NO: 711245 - DNA, 20 bp, mouse
gtttcaccatgccattccca

SEQ ID NO: 711246 - DNA, 20 bp, mouse
gagagcctcagactggtccg

SEQ ID NO: 711247 - DNA, 20 bp, mouse
gtcttccccggaccagtctg

SEQ ID NO: 711248 - DNA, 20 bp, mouse
gttatgcataggctgaactc

SEQ ID NO: 711249 - DNA, 20 bp, mouse
gtgctgaggtgtgtcttccc

SEQ ID NO: 711250 - DNA, 20 bp, mouse
gtttcacataatttatgcat

SEQ ID NO: 711251 - DNA, 20 bp, mouse
gtctctgggctttgaggtgc

SEQ ID NO: 711252 - DNA, 20 bp, mouse
ggcatcaaattcatgtccta

SEQ ID NO: 711253 - DNA, 20 bp, mouse
gtggatccctgggaatggca

SEQ ID NO: 711254 - DNA, 20 bp, mouse
gactgttgagagcctcagac

SEQ ID NO: 711255 - DNA, 20 bp, mouse
ggagcatcaggtgcaggagt

SEQ ID NO: 711256 - DNA, 20 bp, mouse
gttcacaaggttcaacagtt

SEQ ID NO: 711257 - DNA, 20 bp, mouse
ggcaggcatgtgaagatagc

SEQ ID NO: 711258 - DNA, 20 bp, mouse
gccttgtgaaaatgcgcctc

SEQ ID NO: 711259 - DNA, 20 bp, mouse
gcaaggttcaacagttgggt

SEQ ID NO: 711260 - DNA, 20 bp, mouse
gacagttgggttggaaaacc

SEQ ID NO: 711261 - DNA, 20 bp, mouse
gacttgagtcacaggcaata

SEQ ID NO: 711262 - DNA, 20 bp, mouse
ggttcataaccatcaaatcc

SEQ ID NO: 711263 - DNA, 20 bp, mouse
ggggtgtttcctcaaacagc

SEQ ID NO: 711264 - DNA, 20 bp, mouse
gtcaattctcctggatttga

SEQ ID NO: 711265 - DNA, 20 bp, mouse
gtggttatgaaccatgtgct

SEQ ID NO: 711266 - DNA, 20 bp, mouse
ggaagcaaacattgaggaac

SEQ ID NO: 711267 - DNA, 20 bp, mouse
ggactaagttttatctttat

SEQ ID NO: 711268 - DNA, 20 bp, mouse
gcactgggagtattataaat

SEQ ID NO: 711269 - DNA, 20 bp, mouse
gaaaaaaagtaaataatggc

SEQ ID NO: 711270 - DNA, 20 bp, mouse
gagtttaataagtgcaaaat

SEQ ID NO: 711271 - DNA, 20 bp, mouse
gtgagtcttgaatatgcatc

SEQ ID NO: 711272 - DNA, 20 bp, mouse
gtttaagaattaaatgtatt

SEQ ID NO: 711273 - DNA, 20 bp, mouse
gaatttgaattaatttagaa

SEQ ID NO: 711274 - DNA, 20 bp, mouse
gttgaggaacaggtagacat

SEQ ID NO: 711275 - DNA, 20 bp, mouse
ggctgttaaaaacaaatatc

SEQ ID NO: 711276 - DNA, 20 bp, mouse
gcccccctgcgggtgtagac

SEQ ID NO: 711277 - DNA, 20 bp, mouse
gggtgtagactgggaaatgc

SEQ ID NO: 711278 - DNA, 20 bp, mouse
gtcccagtctacacccgcag

SEQ ID NO: 711279 - DNA, 20 bp, mouse
ggcgcgacagtgtgcgagta

SEQ ID NO: 711280 - DNA, 20 bp, mouse
gtagactgggaaatgctggt

SEQ ID NO: 711281 - DNA, 20 bp, mouse
gtcgtcattggcaggtctgg

SEQ ID NO: 711282 - DNA, 20 bp, mouse
gggatctggtgcggtggagc

SEQ ID NO: 711283 - DNA, 20 bp, mouse
gtgccaatgacgacagagag

SEQ ID NO: 711284 - DNA, 20 bp, mouse
gctgaaggcttggcaaagtt

SEQ ID NO: 711285 - DNA, 20 bp, mouse
gctcctctctctgtcgtcat

SEQ ID NO: 711286 - DNA, 20 bp, mouse
gaagaaaaagcacaggtaac

SEQ ID NO: 711287 - DNA, 20 bp, mouse
gtcaacactgccctcacgat

SEQ ID NO: 711288 - DNA, 20 bp, mouse
gtggaaacttccgatcgtga

SEQ ID NO: 711289 - DNA, 20 bp, mouse
ggtgttgaaccaacagcgaa

SEQ ID NO: 711290 - DNA, 20 bp, mouse
gtgactgcaaatccaaaatg

SEQ ID NO: 711291 - DNA, 20 bp, mouse
gacttaggaagtcagaagtt

SEQ ID NO: 711292 - DNA, 20 bp, mouse
gaacaacaacatgttcagtg

SEQ ID NO: 711293 - DNA, 20 bp, mouse
gttttcaggagctattccga

SEQ ID NO: 711294 - DNA, 20 bp, mouse
gggtaccttagcaacagcag

SEQ ID NO: 711295 - DNA, 20 bp, mouse
gcctgtcagccgttcgctgt

SEQ ID NO: 711296 - DNA, 20 bp, mouse
ggcccatgctataactgaca

SEQ ID NO: 711297 - DNA, 20 bp, mouse
gcccttgtcagttatagcat

SEQ ID NO: 711298 - DNA, 20 bp, mouse
gaagaattaggtattgagaa

SEQ ID NO: 711299 - DNA, 20 bp, mouse
gttgtgatgtcaagattcaa

SEQ ID NO: 711300 - DNA, 20 bp, mouse
gttaacaattgttgaaccat

SEQ ID NO: 711301 - DNA, 20 bp, mouse
gagaaagaaagattaatttc

SEQ ID NO: 711302 - DNA, 20 bp, mouse
gaatatatacatgaaaactc

SEQ ID NO: 711303 - DNA, 20 bp, mouse
gtatttaatatagataccta

SEQ ID NO: 711304 - DNA, 20 bp, mouse
gatagtttaaaaaaagaatt

SEQ ID NO: 711305 - DNA, 20 bp, mouse
gattctttctcttcttgaac

SEQ ID NO: 711306 - DNA, 20 bp, mouse
ggccccttcacctttatcag

SEQ ID NO: 711307 - DNA, 20 bp, mouse
gaaaaccctcccactgataa

SEQ ID NO: 711308 - DNA, 20 bp, mouse
gctcccactgataaaggtga

SEQ ID NO: 711309 - DNA, 20 bp, mouse
gccctttcactgtcctataa

SEQ ID NO: 711310 - DNA, 20 bp, mouse
gttcactgtcctataaaggc

SEQ ID NO: 711311 - DNA, 20 bp, mouse
gggaaatgggagaagaccgc

SEQ ID NO: 711312 - DNA, 20 bp, mouse
gtttgctgggaagttcgaaa

SEQ ID NO: 711313 - DNA, 20 bp, mouse
gcatcttactttctctatag

SEQ ID NO: 711314 - DNA, 20 bp, mouse
gacacagtgcaacacaatga

SEQ ID NO: 711315 - DNA, 20 bp, mouse
gtaaaggtgaaggggccctg

SEQ ID NO: 711316 - DNA, 20 bp, mouse
gtgggacccagcattctccc

SEQ ID NO: 711317 - DNA, 20 bp, mouse
ggggtcccacttgaagggcg

SEQ ID NO: 711318 - DNA, 20 bp, mouse
gaggccggtgctgagtatgt

SEQ ID NO: 711319 - DNA, 20 bp, mouse
gaacaaccaagtggagaacc

SEQ ID NO: 711320 - DNA, 20 bp, mouse
gactggcaacttcacaacca

SEQ ID NO: 711321 - DNA, 20 bp, mouse
ggtgtgcctggttctccact

SEQ ID NO: 711322 - DNA, 20 bp, mouse
gaccttcaccatttgtctat

SEQ ID NO: 711323 - DNA, 20 bp, mouse
ggttgatggcaacaaccaag

SEQ ID NO: 711324 - DNA, 20 bp, mouse
gaccatttgtctatgggact

SEQ ID NO: 711325 - DNA, 20 bp, mouse
gcttgaagggcggggccaag

SEQ ID NO: 711326 - DNA, 20 bp, mouse
gaattgggagagacaggtag

SEQ ID NO: 711327 - DNA, 20 bp, mouse
gagaggcaattgggagagac

SEQ ID NO: 711328 - DNA, 20 bp, mouse
ggagagacaggtagaggcat

SEQ ID NO: 711329 - DNA, 20 bp, mouse
gagcaggagggtttaataag

SEQ ID NO: 711330 - DNA, 20 bp, mouse
ggggtttaataagaggcaat

SEQ ID NO: 711331 - DNA, 20 bp, mouse
gaggccacataacatatttg

SEQ ID NO: 711332 - DNA, 20 bp, mouse
gttaaggatgttagtggtta

SEQ ID NO: 711333 - DNA, 20 bp, mouse
ggggagaatgctatctccca

SEQ ID NO: 711334 - DNA, 20 bp, mouse
gtacactacttgctcttcct

SEQ ID NO: 711335 - DNA, 20 bp, mouse
gggagatagcattctcccac

SEQ ID NO: 711336 - DNA, 20 bp, mouse
gtagaaggaatcacccacac

SEQ ID NO: 711337 - DNA, 20 bp, mouse
gcctaattagattaatgtta

SEQ ID NO: 711338 - DNA, 20 bp, mouse
gtgcaagcttcagtagttaa

SEQ ID NO: 711339 - DNA, 20 bp, mouse
gcatggggtaaaataactag

SEQ ID NO: 711340 - DNA, 20 bp, mouse
gtaattcagtgttgtctctc

SEQ ID NO: 711341 - DNA, 20 bp, mouse
gccacacaggcaaataattt

SEQ ID NO: 711342 - DNA, 20 bp, mouse
gtagaatagaaacaaatcac

SEQ ID NO: 711343 - DNA, 20 bp, mouse
gctattcactgatgattata

SEQ ID NO: 711344 - DNA, 20 bp, mouse
gtcatgtagctgtattttaa

SEQ ID NO: 711345 - DNA, 20 bp, mouse
gtcagtgaatagggaattcc

SEQ ID NO: 711346 - DNA, 20 bp, mouse
gtcagctgttaatgggttta

SEQ ID NO: 711347 - DNA, 20 bp, mouse
gaggactggcgataacgcag

SEQ ID NO: 711348 - DNA, 20 bp, mouse
gcaattagtgcgctggaata

SEQ ID NO: 711349 - DNA, 20 bp, mouse
gtaattgataagtggcgtga

SEQ ID NO: 711350 - DNA, 20 bp, mouse
gtctctgttcagattctgag

SEQ ID NO: 711351 - DNA, 20 bp, mouse
gtgggtgggtatcaggctca

SEQ ID NO: 711352 - DNA, 20 bp, mouse
gacagggatggcactgtgtg

SEQ ID NO: 711353 - DNA, 20 bp, mouse
ggctggaataaggttttctt

SEQ ID NO: 711354 - DNA, 20 bp, mouse
ggactggcgataacacagtg

SEQ ID NO: 711355 - DNA, 20 bp, mouse
gaggcgtgtttacatggtga

SEQ ID NO: 711356 - DNA, 20 bp, mouse
gcaggaggttgtaagaagcc

SEQ ID NO: 711357 - DNA, 20 bp, mouse
ggaggtgacatgcattgtcc

SEQ ID NO: 711358 - DNA, 20 bp, mouse
ggcctctgtcttggcaccag

SEQ ID NO: 711359 - DNA, 20 bp, mouse
ggctccagtgactcagtcct

SEQ ID NO: 711360 - DNA, 20 bp, mouse
gaacctcctgagaggacaga

SEQ ID NO: 711361 - DNA, 20 bp, mouse
ggaggacagaaggacctgtc

SEQ ID NO: 711362 - DNA, 20 bp, mouse
ggacctgtcaggcatcagcc

SEQ ID NO: 711363 - DNA, 20 bp, mouse
ggatagtaatattcaggctg

SEQ ID NO: 711364 - DNA, 20 bp, mouse
gcataccgctatgcacttgg

SEQ ID NO: 711365 - DNA, 20 bp, mouse
gtgaatattactatcctgtg

SEQ ID NO: 711366 - DNA, 20 bp, mouse
gatgttgcggtcaccatccg

SEQ ID NO: 711367 - DNA, 20 bp, mouse
ggtgaccgcaacatcccgtg

SEQ ID NO: 711368 - DNA, 20 bp, mouse
gagaaatgggttgggtagtt

SEQ ID NO: 711369 - DNA, 20 bp, mouse
gccgcccacacgggatgttg

SEQ ID NO: 711370 - DNA, 20 bp, mouse
gagtcaaggcggaagtccaa

SEQ ID NO: 711371 - DNA, 20 bp, mouse
gtggtcccacgaggggagga

SEQ ID NO: 711372 - DNA, 20 bp, mouse
ggtccatgaaagacagaaat

SEQ ID NO: 711373 - DNA, 20 bp, mouse
ggatggaagcaaggagagac

SEQ ID NO: 711374 - DNA, 20 bp, mouse
gtcaacgggtggtacgattc

SEQ ID NO: 711375 - DNA, 20 bp, mouse
gagcggccggccgcccacac

SEQ ID NO: 711376 - DNA, 20 bp, mouse
gtccctgcaattcaagtagt

SEQ ID NO: 711377 - DNA, 20 bp, mouse
ggcccactacttgaattgca

SEQ ID NO: 711378 - DNA, 20 bp, mouse
gtcaagacctggtcagcaca

SEQ ID NO: 711379 - DNA, 20 bp, mouse
ggcagcggcagatggagtgg

SEQ ID NO: 711380 - DNA, 20 bp, mouse
gcagtaaccctgtgctgacc

SEQ ID NO: 711381 - DNA, 20 bp, mouse
ggggtaggctatcggagaac

SEQ ID NO: 711382 - DNA, 20 bp, mouse
ggactggcaggtccgcctag

SEQ ID NO: 711383 - DNA, 20 bp, mouse
ggagtggtggagcctccctg

SEQ ID NO: 711384 - DNA, 20 bp, mouse
gggcactggacttgaagcta

SEQ ID NO: 711385 - DNA, 20 bp, mouse
gtacagagggagggaagctc

SEQ ID NO: 711386 - DNA, 20 bp, mouse
gatggacaatagaatattat

SEQ ID NO: 711387 - DNA, 20 bp, mouse
gctgtgtaaagagcaaattc

SEQ ID NO: 711388 - DNA, 20 bp, mouse
gaattaggaccaaatcttag

SEQ ID NO: 711389 - DNA, 20 bp, mouse
gtctttgactatgattgata

SEQ ID NO: 711390 - DNA, 20 bp, mouse
gcaatagaatattataggtt

SEQ ID NO: 711391 - DNA, 20 bp, mouse
ggttcagcctctaagtgata

SEQ ID NO: 711392 - DNA, 20 bp, mouse
gctaagtgatatggtgagct

SEQ ID NO: 711393 - DNA, 20 bp, mouse
gttctggaaacaaacacttc

SEQ ID NO: 711394 - DNA, 20 bp, mouse
gatttgctctttacacagga

SEQ ID NO: 711395 - DNA, 20 bp, mouse
gcatgcaaatctcatggata

SEQ ID NO: 711396 - DNA, 20 bp, mouse
gatgcgatgccaccacaggg

SEQ ID NO: 711397 - DNA, 20 bp, mouse
gttgcctgggcttcgttcaa

SEQ ID NO: 711398 - DNA, 20 bp, mouse
gtgtgattgtggtagttcgg

SEQ ID NO: 711399 - DNA, 20 bp, mouse
gaggatcccactgctctctg

SEQ ID NO: 711400 - DNA, 20 bp, mouse
gaagcagccccagagagcag

SEQ ID NO: 711401 - DNA, 20 bp, mouse
gggtctctacctccctgtgg

SEQ ID NO: 711402 - DNA, 20 bp, mouse
gagaacctttggggaggtgt

SEQ ID NO: 711403 - DNA, 20 bp, mouse
gctctggggctgcttgatca

SEQ ID NO: 711404 - DNA, 20 bp, mouse
gagagatgcgatgccaccac

SEQ ID NO: 711405 - DNA, 20 bp, mouse
gaagggtctctacctccctg

SEQ ID NO: 711406 - DNA, 20 bp, mouse
gtcagtgagacttttgatat

SEQ ID NO: 711407 - DNA, 20 bp, mouse
gcaaaagtctcactgaagtc

SEQ ID NO: 711408 - DNA, 20 bp, mouse
gtatctggacctgttctaag

SEQ ID NO: 711409 - DNA, 20 bp, mouse
ggggattacgttttccaatt

SEQ ID NO: 711410 - DNA, 20 bp, mouse
gtgtgctcgtacatcctgtc

SEQ ID NO: 711411 - DNA, 20 bp, mouse
gaatttcaaccacttagaac

SEQ ID NO: 711412 - DNA, 20 bp, mouse
gtgcatactaattaactcag

SEQ ID NO: 711413 - DNA, 20 bp, mouse
ggataggtgtcactgtctca

SEQ ID NO: 711414 - DNA, 20 bp, mouse
gtgcacagtgacattgggag

SEQ ID NO: 711415 - DNA, 20 bp, mouse
gttgggaggggcttactgat

SEQ ID NO: 711416 - DNA, 20 bp, mouse
gagcaagcctagggcgaagt

SEQ ID NO: 711417 - DNA, 20 bp, mouse
gggggggcaacagaccctgg

SEQ ID NO: 711418 - DNA, 20 bp, mouse
gtcgccctaggcttgctctc

SEQ ID NO: 711419 - DNA, 20 bp, mouse
gcaatgggcgaccgcctcca

SEQ ID NO: 711420 - DNA, 20 bp, mouse
gggcgcggggagcaatgtaa

SEQ ID NO: 711421 - DNA, 20 bp, mouse
gtggcccgcggcccagccaa

SEQ ID NO: 711422 - DNA, 20 bp, mouse
gtaggcttgctctcaggcca

SEQ ID NO: 711423 - DNA, 20 bp, mouse
gctgggccgcgggccaatga

SEQ ID NO: 711424 - DNA, 20 bp, mouse
gcctactggcttggtagcgg

SEQ ID NO: 711425 - DNA, 20 bp, mouse
ggggaggcgcgcgcgcctac

SEQ ID NO: 711426 - DNA, 20 bp, mouse
gagaagtgccttgctctctt

SEQ ID NO: 711427 - DNA, 20 bp, mouse
gggaacaagcaaatatctaa

SEQ ID NO: 711428 - DNA, 20 bp, mouse
ggccagaaataacaaggcat

SEQ ID NO: 711429 - DNA, 20 bp, mouse
gagtgaatattcagggtcca

SEQ ID NO: 711430 - DNA, 20 bp, mouse
ggccgatgccttgttatttc

SEQ ID NO: 711431 - DNA, 20 bp, mouse
gccaccagccagaaataaca

SEQ ID NO: 711432 - DNA, 20 bp, mouse
gctggtcaatccctgtcagc

SEQ ID NO: 711433 - DNA, 20 bp, mouse
gagactgaacatgagtcatg

SEQ ID NO: 711434 - DNA, 20 bp, mouse
gagctagaaaccagctgaca

SEQ ID NO: 711435 - DNA, 20 bp, mouse
gaaatcaaacctaggtcaag

SEQ ID NO: 711436 - DNA, 20 bp, mouse
gccaagagcaaactgggccc

SEQ ID NO: 711437 - DNA, 20 bp, mouse
gtccgagttcccagtagaag

SEQ ID NO: 711438 - DNA, 20 bp, mouse
gcagctgttccacttctact

SEQ ID NO: 711439 - DNA, 20 bp, mouse
gttaacacttagtgtatggg

SEQ ID NO: 711440 - DNA, 20 bp, mouse
gtatggggggagtgttagag

SEQ ID NO: 711441 - DNA, 20 bp, mouse
gtttaaagacagtatcagta

SEQ ID NO: 711442 - DNA, 20 bp, mouse
ggtctgtcgggtacatgtgg

SEQ ID NO: 711443 - DNA, 20 bp, mouse
gcagctttgtaactatgtct

SEQ ID NO: 711444 - DNA, 20 bp, mouse
gcagtatgggggtctgaaaa

SEQ ID NO: 711445 - DNA, 20 bp, mouse
ggctgtctgtcgggtacatg

SEQ ID NO: 711446 - DNA, 20 bp, mouse
gcccgcggggtggacaatac

SEQ ID NO: 711447 - DNA, 20 bp, mouse
gctccgggagaagaccaccc

SEQ ID NO: 711448 - DNA, 20 bp, mouse
ggaccagggtggtcttctcc

SEQ ID NO: 711449 - DNA, 20 bp, mouse
gcggggctagacggacagga

SEQ ID NO: 711450 - DNA, 20 bp, mouse
gctcagaggcatggcctctt

SEQ ID NO: 711451 - DNA, 20 bp, mouse
gtgggcggggctagacggac

SEQ ID NO: 711452 - DNA, 20 bp, mouse
gggtgcacaccggagtaagg

SEQ ID NO: 711453 - DNA, 20 bp, mouse
gtgaggaagtctaaggctcc

SEQ ID NO: 711454 - DNA, 20 bp, mouse
gaccggagtaaggaggaaag

SEQ ID NO: 711455 - DNA, 20 bp, mouse
gtcagatagcatgggaagca

SEQ ID NO: 711456 - DNA, 20 bp, mouse
gtgtacaggtggttctggtg

SEQ ID NO: 711457 - DNA, 20 bp, mouse
gctgttctcgggttctgtca

SEQ ID NO: 711458 - DNA, 20 bp, mouse
gcaagcatgacggggaggtg

SEQ ID NO: 711459 - DNA, 20 bp, mouse
gaggaggagcaagcatgacg

SEQ ID NO: 711460 - DNA, 20 bp, mouse
gcctgtgcagacgacttcat

SEQ ID NO: 711461 - DNA, 20 bp, mouse
gtgtgaggacgctcaagtga

SEQ ID NO: 711462 - DNA, 20 bp, mouse
gcagaacccgagaacagcac

SEQ ID NO: 711463 - DNA, 20 bp, mouse
gtcccgagaccaccctggca

SEQ ID NO: 711464 - DNA, 20 bp, mouse
gaggagcaagcatgacgggg

SEQ ID NO: 711465 - DNA, 20 bp, mouse
gccacctgtacagagcggaa

SEQ ID NO: 711466 - DNA, 20 bp, mouse
gtacaaggcagtcagcacaa

SEQ ID NO: 711467 - DNA, 20 bp, mouse
gaaagaagccgaaaagaaag

SEQ ID NO: 711468 - DNA, 20 bp, mouse
gaaggcagtcagcacaaggg

SEQ ID NO: 711469 - DNA, 20 bp, mouse
ggaaggaaatgaccgggaga

SEQ ID NO: 711470 - DNA, 20 bp, mouse
gatctgcagacgacagccaa

SEQ ID NO: 711471 - DNA, 20 bp, mouse
gtcacaggcatcttaattcc

SEQ ID NO: 711472 - DNA, 20 bp, mouse
ggaaacaagtcttttagaac

SEQ ID NO: 711473 - DNA, 20 bp, mouse
gcccagtgactaccgcttag

SEQ ID NO: 711474 - DNA, 20 bp, mouse
gtcaacaaaagcggagcaag

SEQ ID NO: 711475 - DNA, 20 bp, mouse
ggcacaagggtggatttcac

SEQ ID NO: 711476 - DNA, 20 bp, mouse
gaggggatactgaagagaga

SEQ ID NO: 711477 - DNA, 20 bp, mouse
gactgcagaaggaagctaac

SEQ ID NO: 711478 - DNA, 20 bp, mouse
ggaagctaactggcttcctt

SEQ ID NO: 711479 - DNA, 20 bp, mouse
gggggatggagcccagaatt

SEQ ID NO: 711480 - DNA, 20 bp, mouse
gtaactggcttccttgggga

SEQ ID NO: 711481 - DNA, 20 bp, mouse
ggtgaagtccggaatgtgat

SEQ ID NO: 711482 - DNA, 20 bp, mouse
gtccacaagacggcgaggag

SEQ ID NO: 711483 - DNA, 20 bp, mouse
gtcacacacaaatagctgaa

SEQ ID NO: 711484 - DNA, 20 bp, mouse
gcaaccaaccaatcacattc

SEQ ID NO: 711485 - DNA, 20 bp, mouse
gagccaagggttccacaaga

SEQ ID NO: 711486 - DNA, 20 bp, mouse
gcgggcggccgcgccaaccc

SEQ ID NO: 711487 - DNA, 20 bp, mouse
gggaccacggccactcggga

SEQ ID NO: 711488 - DNA, 20 bp, mouse
ggaaaaggtgcatgcgggtt

SEQ ID NO: 711489 - DNA, 20 bp, mouse
gtgcgggttgcgagtgttgg

SEQ ID NO: 711490 - DNA, 20 bp, mouse
gctcccgtggatttgattgg

SEQ ID NO: 711491 - DNA, 20 bp, mouse
gacccaccaatcaaatccac

SEQ ID NO: 711492 - DNA, 20 bp, mouse
gtggttcgctcgcaccgggc

SEQ ID NO: 711493 - DNA, 20 bp, mouse
gaagctggaaaaggtgcatg

SEQ ID NO: 711494 - DNA, 20 bp, mouse
gcgggttcgggcgagaggac

SEQ ID NO: 711495 - DNA, 20 bp, mouse
ggccactcgggaaggactgc

SEQ ID NO: 711496 - DNA, 20 bp, mouse
gtcagtgcaacccccaacgt

SEQ ID NO: 711497 - DNA, 20 bp, mouse
ggtttcagatacccacgttg

SEQ ID NO: 711498 - DNA, 20 bp, mouse
gaggcagtgtcgcagagctg

SEQ ID NO: 711499 - DNA, 20 bp, mouse
gagtgtcgcagagctgggga

SEQ ID NO: 711500 - DNA, 20 bp, mouse
gtctgccaggagttctgctg

SEQ ID NO: 711501 - DNA, 20 bp, mouse
gccggcctcagcagaactcc

SEQ ID NO: 711502 - DNA, 20 bp, mouse
ggagaaggaagtacccacac

SEQ ID NO: 711503 - DNA, 20 bp, mouse
gggtggtggtatagcgtccc

SEQ ID NO: 711504 - DNA, 20 bp, mouse
gagcccctgcatagaggaaa

SEQ ID NO: 711505 - DNA, 20 bp, mouse
ggagacacccctcaacatca

SEQ ID NO: 711506 - DNA, 20 bp, mouse
gaggcagtgtcgcagagctg

SEQ ID NO: 711507 - DNA, 20 bp, mouse
gagtgtcgcagagctgggga

SEQ ID NO: 711508 - DNA, 20 bp, mouse
gggtggtggtatagcgtccc

SEQ ID NO: 711509 - DNA, 20 bp, mouse
ggagcggagtggcaacgtaa

SEQ ID NO: 711510 - DNA, 20 bp, mouse
gcagccgcactgaagacctc

SEQ ID NO: 711511 - DNA, 20 bp, mouse
gctggagcagagagtgggaa

SEQ ID NO: 711512 - DNA, 20 bp, mouse
gcggcgtgatgggatgtcag

SEQ ID NO: 711513 - DNA, 20 bp, mouse
gagatctccagtgctggcaa

SEQ ID NO: 711514 - DNA, 20 bp, mouse
gagggtgaaagttgagtctg

SEQ ID NO: 711515 - DNA, 20 bp, mouse
ggccaggctggagcagagag

SEQ ID NO: 711516 - DNA, 20 bp, mouse
gaggaagcaaggtcgtggat

SEQ ID NO: 711517 - DNA, 20 bp, mouse
ggcgggaaaggagatgtcgt

SEQ ID NO: 711518 - DNA, 20 bp, mouse
ggctaacgtaatggttgtgg

SEQ ID NO: 711519 - DNA, 20 bp, mouse
ggatggggatggacaagaag

SEQ ID NO: 711520 - DNA, 20 bp, mouse
gaacgtaatggttgtggggg

SEQ ID NO: 711521 - DNA, 20 bp, mouse
gtatgggacggctaacgtaa

SEQ ID NO: 711522 - DNA, 20 bp, mouse
gacggaaggaagcaaggtcg

SEQ ID NO: 711523 - DNA, 20 bp, mouse
gacggctaacgtaatggttg

SEQ ID NO: 711524 - DNA, 20 bp, mouse
gcttgaggctacatccccac

SEQ ID NO: 711525 - DNA, 20 bp, mouse
gagtcacagtgcgctctcaa

SEQ ID NO: 711526 - DNA, 20 bp, mouse
gtgtgcggggcctgtgaaat

SEQ ID NO: 711527 - DNA, 20 bp, mouse
gaaataaaaaggtacttcgt

SEQ ID NO: 711528 - DNA, 20 bp, mouse
gccacagtgggaaagaataa

SEQ ID NO: 711529 - DNA, 20 bp, mouse
gacaaagcactgccttcatt

SEQ ID NO: 711530 - DNA, 20 bp, mouse
gcctaatgataagcaattat

SEQ ID NO: 711531 - DNA, 20 bp, mouse
gaggggatgaatcactgaaa

SEQ ID NO: 711532 - DNA, 20 bp, mouse
gagagagtagtaacgtcctc

SEQ ID NO: 711533 - DNA, 20 bp, mouse
gaggggcctagatgccacag

SEQ ID NO: 711534 - DNA, 20 bp, mouse
gctgcgtcacagaacagtct

SEQ ID NO: 711535 - DNA, 20 bp, mouse
gtccccttgctcatttcaga

SEQ ID NO: 711536 - DNA, 20 bp, mouse
gggggcctcccgtggtagca

SEQ ID NO: 711537 - DNA, 20 bp, mouse
gcacccaagggagcgctgtg

SEQ ID NO: 711538 - DNA, 20 bp, mouse
ggcacggcagatgtctctgc

SEQ ID NO: 711539 - DNA, 20 bp, mouse
gtctgattggcttctaagga

SEQ ID NO: 711540 - DNA, 20 bp, mouse
gatgctgtaggaaattcggt

SEQ ID NO: 711541 - DNA, 20 bp, mouse
gccagtatagaaacagagta

SEQ ID NO: 711542 - DNA, 20 bp, mouse
gacatctgccgtgctaccac

SEQ ID NO: 711543 - DNA, 20 bp, mouse
gaggggcttagactccatgg

SEQ ID NO: 711544 - DNA, 20 bp, mouse
gaagaggggcttagactcca

SEQ ID NO: 711545 - DNA, 20 bp, mouse
ggactatgaaatgctcagtg

SEQ ID NO: 711546 - DNA, 20 bp, mouse
gtgcgcaggcccagctcgct

SEQ ID NO: 711547 - DNA, 20 bp, mouse
gagctcgacgcgctcaccga

SEQ ID NO: 711548 - DNA, 20 bp, mouse
gttacgaggtggggacgctt

SEQ ID NO: 711549 - DNA, 20 bp, mouse
ggctgggcggcgaccagggg

SEQ ID NO: 711550 - DNA, 20 bp, mouse
gatccccgccccctcggcag

SEQ ID NO: 711551 - DNA, 20 bp, mouse
gtgagcgcgagattagactc

SEQ ID NO: 711552 - DNA, 20 bp, mouse
gaggcaccgagtcgccaaga

SEQ ID NO: 711553 - DNA, 20 bp, mouse
gcctgcgcagagcgagccgt

SEQ ID NO: 711554 - DNA, 20 bp, mouse
ggtggggaccaagaggccga

SEQ ID NO: 711555 - DNA, 20 bp, mouse
ggtaacgcgtctagtgttgt

SEQ ID NO: 711556 - DNA, 20 bp, mouse
gagagcgagccacccggtga

SEQ ID NO: 711557 - DNA, 20 bp, mouse
gacccagacggatgtctgga

SEQ ID NO: 711558 - DNA, 20 bp, mouse
ggaactctgacccctagcta

SEQ ID NO: 711559 - DNA, 20 bp, mouse
gagaataaacggaactgaat

SEQ ID NO: 711560 - DNA, 20 bp, mouse
ggatgacccagacggatgtc

SEQ ID NO: 711561 - DNA, 20 bp, mouse
gaagctcaaccctcaccggg

SEQ ID NO: 711562 - DNA, 20 bp, mouse
ggctaaggagctaacggccg

SEQ ID NO: 711563 - DNA, 20 bp, mouse
gttgtttgaccaaactgcag

SEQ ID NO: 711564 - DNA, 20 bp, mouse
ggtccttccagacatccgtc

SEQ ID NO: 711565 - DNA, 20 bp, mouse
gttgaagctcaaccctcacc

SEQ ID NO: 711566 - DNA, 20 bp, mouse
gcgccagcgcgccagcgcgg

SEQ ID NO: 711567 - DNA, 20 bp, mouse
gccgcgggaaggctaacttg

SEQ ID NO: 711568 - DNA, 20 bp, mouse
gctcccatcagcctccgcgc

SEQ ID NO: 711569 - DNA, 20 bp, mouse
gcgggcctctccacttagta

SEQ ID NO: 711570 - DNA, 20 bp, mouse
gcgcaccgtactaagtggag

SEQ ID NO: 711571 - DNA, 20 bp, mouse
gggtcccactggagcaggca

SEQ ID NO: 711572 - DNA, 20 bp, mouse
gccacccagcacctgcgcac

SEQ ID NO: 711573 - DNA, 20 bp, mouse
ggaggcctccatctcgcaga

SEQ ID NO: 711574 - DNA, 20 bp, mouse
ggccccctgcctgctccagt

SEQ ID NO: 711575 - DNA, 20 bp, mouse
ggccagagccggtacgtcgg

SEQ ID NO: 711576 - DNA, 20 bp, mouse
gaaaaggtcaaggctgagtc

SEQ ID NO: 711577 - DNA, 20 bp, mouse
gttttaaaaatctattaaaa

SEQ ID NO: 711578 - DNA, 20 bp, mouse
gtttttttgttaaaaggtca

SEQ ID NO: 711579 - DNA, 20 bp, mouse
gtatcagaggacaagactct

SEQ ID NO: 711580 - DNA, 20 bp, mouse
gtaactacaaaataattctt

SEQ ID NO: 711581 - DNA, 20 bp, mouse
gattattttgtagttatcag

SEQ ID NO: 711582 - DNA, 20 bp, mouse
gaaaaattttttttgttaaa

SEQ ID NO: 711583 - DNA, 20 bp, mouse
gtactactaggatgcgtgac

SEQ ID NO: 711584 - DNA, 20 bp, mouse
gcaagagctactatactact

SEQ ID NO: 711585 - DNA, 20 bp, mouse
gggacactgttggctgcctg

SEQ ID NO: 711586 - DNA, 20 bp, mouse
gtacaggcatgtacaattca

SEQ ID NO: 711587 - DNA, 20 bp, mouse
ggtactgaaaccagcttcag

SEQ ID NO: 711588 - DNA, 20 bp, mouse
gtctccagacatgagtactt

SEQ ID NO: 711589 - DNA, 20 bp, mouse
gtgtacaattcatggtctgt

SEQ ID NO: 711590 - DNA, 20 bp, mouse
gcttaagtgcaggaacaaac

SEQ ID NO: 711591 - DNA, 20 bp, mouse
gcagcttcagtggagagttg

SEQ ID NO: 711592 - DNA, 20 bp, mouse
ggaagctggtttcagtactc

SEQ ID NO: 711593 - DNA, 20 bp, mouse
gtagctcacacaaattcgta

SEQ ID NO: 711594 - DNA, 20 bp, mouse
gtagagctacacttactctc

SEQ ID NO: 711595 - DNA, 20 bp, mouse
gatgtgttgaatcagcttac

SEQ ID NO: 711596 - DNA, 20 bp, mouse
gcgtggggaagacccattaa

SEQ ID NO: 711597 - DNA, 20 bp, mouse
gtgagcctttgttgttgctt

SEQ ID NO: 711598 - DNA, 20 bp, mouse
ggacagatggtgggtatcac

SEQ ID NO: 711599 - DNA, 20 bp, mouse
gcaacaacaaaggctcacat

SEQ ID NO: 711600 - DNA, 20 bp, mouse
gtgtctcaatgcagaacaca

SEQ ID NO: 711601 - DNA, 20 bp, mouse
gatgggaaagttgccccgtg

SEQ ID NO: 711602 - DNA, 20 bp, mouse
gccaccatctgtcacagatt

SEQ ID NO: 711603 - DNA, 20 bp, mouse
gtttttggagagaatccctg

SEQ ID NO: 711604 - DNA, 20 bp, mouse
gaatatagaatgcagccaca

SEQ ID NO: 711605 - DNA, 20 bp, mouse
gacagactctggcctttaat

SEQ ID NO: 711606 - DNA, 20 bp, mouse
gatagtgtgggaaatcagaa

SEQ ID NO: 711607 - DNA, 20 bp, mouse
gatcttggcagcagattttg

SEQ ID NO: 711608 - DNA, 20 bp, mouse
gacattgaattcagtgtcct

SEQ ID NO: 711609 - DNA, 20 bp, mouse
gaactacaatccagaatggg

SEQ ID NO: 711610 - DNA, 20 bp, mouse
gtaccactatgcatggacct

SEQ ID NO: 711611 - DNA, 20 bp, mouse
ggcgagaagatacaactttc

SEQ ID NO: 711612 - DNA, 20 bp, mouse
ggtcccaggtccatgcatag

SEQ ID NO: 711613 - DNA, 20 bp, mouse
gtaatggccatgaaaaactt

SEQ ID NO: 711614 - DNA, 20 bp, mouse
gcctgggttgtaggattgaa

SEQ ID NO: 711615 - DNA, 20 bp, mouse
gacaccaaaacctgggttgt

SEQ ID NO: 711616 - DNA, 20 bp, mouse
gccagtgaagggtaataccc

SEQ ID NO: 711617 - DNA, 20 bp, mouse
gtaatacccaggccaggaat

SEQ ID NO: 711618 - DNA, 20 bp, mouse
gaagtgggtgagctagagac

SEQ ID NO: 711619 - DNA, 20 bp, mouse
gccacctgtatatgtaggaa

SEQ ID NO: 711620 - DNA, 20 bp, mouse
ggaagggtaatacccaggcc

SEQ ID NO: 711621 - DNA, 20 bp, mouse
gcttcctttcctacatatac

SEQ ID NO: 711622 - DNA, 20 bp, mouse
gcaggccaggaattgggagt

SEQ ID NO: 711623 - DNA, 20 bp, mouse
gtaaaccccttcatctcctt

SEQ ID NO: 711624 - DNA, 20 bp, mouse
gaaggggtttacagcctcat

SEQ ID NO: 711625 - DNA, 20 bp, mouse
gtaggaaaggaaggcctagt

SEQ ID NO: 711626 - DNA, 20 bp, mouse
ggagcctaagaggttcacgg

SEQ ID NO: 711627 - DNA, 20 bp, mouse
gagggtggaggggtccacaa

SEQ ID NO: 711628 - DNA, 20 bp, mouse
ggagccaccgtgaacctctt

SEQ ID NO: 711629 - DNA, 20 bp, mouse
gtgtctgcatggagcctaag

SEQ ID NO: 711630 - DNA, 20 bp, mouse
gggtctctagtgagttaggg

SEQ ID NO: 711631 - DNA, 20 bp, mouse
gctagtgagttagggtggag

SEQ ID NO: 711632 - DNA, 20 bp, mouse
gttgggtctctagtgagtta

SEQ ID NO: 711633 - DNA, 20 bp, mouse
gggtttgctcggcttcttgt

SEQ ID NO: 711634 - DNA, 20 bp, mouse
ggaacggttaaagtcctttg

SEQ ID NO: 711635 - DNA, 20 bp, mouse
ggctccgtagtgcttcaaag

SEQ ID NO: 711636 - DNA, 20 bp, mouse
gtgagcccgcctgcgtcttg

SEQ ID NO: 711637 - DNA, 20 bp, mouse
gcctgcgtcttgaggttctc

SEQ ID NO: 711638 - DNA, 20 bp, mouse
ggggatgtcaacctccctct

SEQ ID NO: 711639 - DNA, 20 bp, mouse
ggcaaaatccacaacctaga

SEQ ID NO: 711640 - DNA, 20 bp, mouse
gtcaacctccctctaggttg

SEQ ID NO: 711641 - DNA, 20 bp, mouse
gttcccaggatgtcatgcag

SEQ ID NO: 711642 - DNA, 20 bp, mouse
gcctgaccctattttccaac

SEQ ID NO: 711643 - DNA, 20 bp, mouse
gctgggagactacagttccc

SEQ ID NO: 711644 - DNA, 20 bp, mouse
ggggtttccgctctcctttc

SEQ ID NO: 711645 - DNA, 20 bp, mouse
gtgaggcaataaatggagga

SEQ ID NO: 711646 - DNA, 20 bp, mouse
ggtggctctgataccaggat

SEQ ID NO: 711647 - DNA, 20 bp, mouse
gcccaggtggctctgatacc

SEQ ID NO: 711648 - DNA, 20 bp, mouse
gttgaacggaagagaggtgc

SEQ ID NO: 711649 - DNA, 20 bp, mouse
gcattcatgtctttcccagg

SEQ ID NO: 711650 - DNA, 20 bp, mouse
gataagattgaacggaagag

SEQ ID NO: 711651 - DNA, 20 bp, mouse
ggacaatctaagcactagag

SEQ ID NO: 711652 - DNA, 20 bp, mouse
gctgagggaccctaaacaga

SEQ ID NO: 711653 - DNA, 20 bp, mouse
gaaacaatgaatgttagagc

SEQ ID NO: 711654 - DNA, 20 bp, mouse
gacatgaatgtgtgcactca

SEQ ID NO: 711655 - DNA, 20 bp, mouse
gcatggtgcactttgaaggg

SEQ ID NO: 711656 - DNA, 20 bp, mouse
gacgctaacacaggggacga

SEQ ID NO: 711657 - DNA, 20 bp, mouse
gagtgcaccaaagcaatccc

SEQ ID NO: 711658 - DNA, 20 bp, mouse
gtgtgttagcgtagaagcca

SEQ ID NO: 711659 - DNA, 20 bp, mouse
gttgaggtatatcaactcca

SEQ ID NO: 711660 - DNA, 20 bp, mouse
gcaaactaacagatgagatt

SEQ ID NO: 711661 - DNA, 20 bp, mouse
ggtcgcaaacagcagcactc

SEQ ID NO: 711662 - DNA, 20 bp, mouse
gtagcacttacttacattca

SEQ ID NO: 711663 - DNA, 20 bp, mouse
gtacttacattcagggcttg

SEQ ID NO: 711664 - DNA, 20 bp, mouse
gctaaaagttcagaaaaccc

SEQ ID NO: 711665 - DNA, 20 bp, mouse
gtcatggttacaccccttga

SEQ ID NO: 711666 - DNA, 20 bp, mouse
ggctccaagaaaaataagag

SEQ ID NO: 711667 - DNA, 20 bp, mouse
gactgagcaacatccatgac

SEQ ID NO: 711668 - DNA, 20 bp, mouse
gatgttgctcagtaattaag

SEQ ID NO: 711669 - DNA, 20 bp, mouse
ggaggaaacgtgtaagaact

SEQ ID NO: 711670 - DNA, 20 bp, mouse
ggtaagaacttggaaaaaag

SEQ ID NO: 711671 - DNA, 20 bp, mouse
gacccagtggagactgagca

SEQ ID NO: 711672 - DNA, 20 bp, mouse
gaccctgctcagtctccact

SEQ ID NO: 711673 - DNA, 20 bp, mouse
gtgaaaatgatggccgcaga

SEQ ID NO: 711674 - DNA, 20 bp, mouse
gtctgtttttgacagctata

SEQ ID NO: 711675 - DNA, 20 bp, mouse
gtatactgctattcactcgc

SEQ ID NO: 711676 - DNA, 20 bp, mouse
ggcaatgtaggagctgttga

SEQ ID NO: 711677 - DNA, 20 bp, mouse
gtcacaggttaacttggaat

SEQ ID NO: 711678 - DNA, 20 bp, mouse
gcttgtgtatacctgtgctt

SEQ ID NO: 711679 - DNA, 20 bp, mouse
gctttcctcaagttggtctc

SEQ ID NO: 711680 - DNA, 20 bp, mouse
ggagctgttgatggctctgt

SEQ ID NO: 711681 - DNA, 20 bp, mouse
gtacctgtgcttgggtgtgg

SEQ ID NO: 711682 - DNA, 20 bp, mouse
gtgctcttctagaggacaag

SEQ ID NO: 711683 - DNA, 20 bp, mouse
gctcagaatcacagttccct

SEQ ID NO: 711684 - DNA, 20 bp, mouse
gtagcatctctctgggtaaa

SEQ ID NO: 711685 - DNA, 20 bp, mouse
gattttactgatcccacttg

SEQ ID NO: 711686 - DNA, 20 bp, mouse
gtgaggcagcagccagtaag

SEQ ID NO: 711687 - DNA, 20 bp, mouse
ggagcagtcgcgtaacccgg

SEQ ID NO: 711688 - DNA, 20 bp, mouse
gcgattcggggtctcagtaa

SEQ ID NO: 711689 - DNA, 20 bp, mouse
gcaggcggcgcagtatggaa

SEQ ID NO: 711690 - DNA, 20 bp, mouse
gctaaaggatctgggagccc

SEQ ID NO: 711691 - DNA, 20 bp, mouse
ggggggcttggcaccaaaaa

SEQ ID NO: 711692 - DNA, 20 bp, mouse
gagtaaaggtgaagatctaa

SEQ ID NO: 711693 - DNA, 20 bp, mouse
ggctgggattaaccccttac

SEQ ID NO: 711694 - DNA, 20 bp, mouse
gttgctactagcaagatctg

SEQ ID NO: 711695 - DNA, 20 bp, mouse
gtatgagaatcccgggtgtt

SEQ ID NO: 711696 - DNA, 20 bp, mouse
ggggagaatacagaaataac

SEQ ID NO: 711697 - DNA, 20 bp, mouse
gtatactactgtaagatttt

SEQ ID NO: 711698 - DNA, 20 bp, mouse
ggaaaggaaatggtagttat

SEQ ID NO: 711699 - DNA, 20 bp, mouse
gacaataccttaaaaagagt

SEQ ID NO: 711700 - DNA, 20 bp, mouse
ggtatactaatacaaaacta

SEQ ID NO: 711701 - DNA, 20 bp, mouse
gtagttagttctagtacttt

SEQ ID NO: 711702 - DNA, 20 bp, mouse
gaagcagggagtttgagttt

SEQ ID NO: 711703 - DNA, 20 bp, mouse
ggtttcttgtcaatttaggg

SEQ ID NO: 711704 - DNA, 20 bp, mouse
ggttggttacaactttttaa

SEQ ID NO: 711705 - DNA, 20 bp, mouse
gttaaaattgattcctattg

SEQ ID NO: 711706 - DNA, 20 bp, mouse
gtgagtcgcgggtccttcga

SEQ ID NO: 711707 - DNA, 20 bp, mouse
gacgccaacggcaacgagat

SEQ ID NO: 711708 - DNA, 20 bp, mouse
gagattggacgcctgagtcg

SEQ ID NO: 711709 - DNA, 20 bp, mouse
gaaactctccaggccctcga

SEQ ID NO: 711710 - DNA, 20 bp, mouse
gtggccgcgtggcgcagaga

SEQ ID NO: 711711 - DNA, 20 bp, mouse
gggagagtttggtcaagcta

SEQ ID NO: 711712 - DNA, 20 bp, mouse
ggagaagctctcacgactag

SEQ ID NO: 711713 - DNA, 20 bp, mouse
gaacgtgctgggagcgctgc

SEQ ID NO: 711714 - DNA, 20 bp, mouse
gagagcttctcgaaggtctt

SEQ ID NO: 711715 - DNA, 20 bp, mouse
gagagagggttgcagctcgt

SEQ ID NO: 711716 - DNA, 20 bp, mouse
gtgaacacatagatcttgtc

SEQ ID NO: 711717 - DNA, 20 bp, mouse
gaaaaaggacatattaggta

SEQ ID NO: 711718 - DNA, 20 bp, mouse
gccaccaagcacacctcttt

SEQ ID NO: 711719 - DNA, 20 bp, mouse
gtttgcatgtgctcctgtgt

SEQ ID NO: 711720 - DNA, 20 bp, mouse
gcagaatctccctagcaagg

SEQ ID NO: 711721 - DNA, 20 bp, mouse
ggagtctagatatcaccctc

SEQ ID NO: 711722 - DNA, 20 bp, mouse
gagtacaaaaatacccattt

SEQ ID NO: 711723 - DNA, 20 bp, mouse
gctggccctctctgttggcc

SEQ ID NO: 711724 - DNA, 20 bp, mouse
gtggttatttggagaggccc

SEQ ID NO: 711725 - DNA, 20 bp, mouse
gcacacatataaaggcctga

SEQ ID NO: 711726 - DNA, 20 bp, mouse
gcagccagggcgagtagagg

SEQ ID NO: 711727 - DNA, 20 bp, mouse
ggggagctggtgaaaccggg

SEQ ID NO: 711728 - DNA, 20 bp, mouse
ggcgcagcgctcatccccag

SEQ ID NO: 711729 - DNA, 20 bp, mouse
gggaggggagctggtgaaac

SEQ ID NO: 711730 - DNA, 20 bp, mouse
gacctcttcctagcgaagac

SEQ ID NO: 711731 - DNA, 20 bp, mouse
gcagcggagaataacgaaat

SEQ ID NO: 711732 - DNA, 20 bp, mouse
gggagaaagtgtgactgccc

SEQ ID NO: 711733 - DNA, 20 bp, mouse
ggggtttctcggatagaaac

SEQ ID NO: 711734 - DNA, 20 bp, mouse
gatagaaaccggtcttcgct

SEQ ID NO: 711735 - DNA, 20 bp, mouse
gaccggtcttcgctaggaag

SEQ ID NO: 711736 - DNA, 20 bp, mouse
gaggaagcttggtggtatca

SEQ ID NO: 711737 - DNA, 20 bp, mouse
ggggaggggtgggccaatac

SEQ ID NO: 711738 - DNA, 20 bp, mouse
gcacggggaagcaggaagct

SEQ ID NO: 711739 - DNA, 20 bp, mouse
gggggaagcaggaagcttgg

SEQ ID NO: 711740 - DNA, 20 bp, mouse
ggtgggccaatacaggcaaa

SEQ ID NO: 711741 - DNA, 20 bp, mouse
gcttctccttttgcctgtat

SEQ ID NO: 711742 - DNA, 20 bp, mouse
ggcttggtggtatcagggtg

SEQ ID NO: 711743 - DNA, 20 bp, mouse
gagaagtacttatgggaggg

SEQ ID NO: 711744 - DNA, 20 bp, mouse
gagacacttatcagtgggag

SEQ ID NO: 711745 - DNA, 20 bp, mouse
ggcaaaaggagaagtactta

SEQ ID NO: 711746 - DNA, 20 bp, mouse
ggggcattcgggaggacaat

SEQ ID NO: 711747 - DNA, 20 bp, mouse
gggtcctaaaagtcattctg

SEQ ID NO: 711748 - DNA, 20 bp, mouse
gtcattctggggcattcggg

SEQ ID NO: 711749 - DNA, 20 bp, mouse
ggggaggacaatcggcgccc

SEQ ID NO: 711750 - DNA, 20 bp, mouse
ggcgctgcccgtttcgctcg

SEQ ID NO: 711751 - DNA, 20 bp, mouse
gaagtcattctggggcattc

SEQ ID NO: 711752 - DNA, 20 bp, mouse
gaaaacacgcaatgacctat

SEQ ID NO: 711753 - DNA, 20 bp, mouse
gtacagctgcccgagtgggt

SEQ ID NO: 711754 - DNA, 20 bp, mouse
gttaaatggctgtcgcgggg

SEQ ID NO: 711755 - DNA, 20 bp, mouse
gtgatgtgctggtccatcca

SEQ ID NO: 711756 - DNA, 20 bp, mouse
gtcaagaaaagtgtttctgg

SEQ ID NO: 711757 - DNA, 20 bp, mouse
gaggacggttgggtaggtag

SEQ ID NO: 711758 - DNA, 20 bp, mouse
gatctgcaggacggttgggt

SEQ ID NO: 711759 - DNA, 20 bp, mouse
gaaacacttttcttgagtaa

SEQ ID NO: 711760 - DNA, 20 bp, mouse
gaggaatctgcaggacggtt

SEQ ID NO: 711761 - DNA, 20 bp, mouse
gcttgagtaaaggaatctgc

SEQ ID NO: 711762 - DNA, 20 bp, mouse
gagttaagaacactgactgg

SEQ ID NO: 711763 - DNA, 20 bp, mouse
gttgatgctcagaaccccca

SEQ ID NO: 711764 - DNA, 20 bp, mouse
ggggttctgagcatcaaagc

SEQ ID NO: 711765 - DNA, 20 bp, mouse
gtcagaacccccatggttga

SEQ ID NO: 711766 - DNA, 20 bp, mouse
gaaactttgggggggggatg

SEQ ID NO: 711767 - DNA, 20 bp, mouse
gtcccccccccaaagtttca

SEQ ID NO: 711768 - DNA, 20 bp, mouse
gttatccatgaaactttggg

SEQ ID NO: 711769 - DNA, 20 bp, mouse
gcaaaggtattctttttagc

SEQ ID NO: 711770 - DNA, 20 bp, mouse
ggagacataccataattcaa

SEQ ID NO: 711771 - DNA, 20 bp, mouse
gtattctttttagctggatt

SEQ ID NO: 711772 - DNA, 20 bp, mouse
gaaagaatacctttgaatta

SEQ ID NO: 711773 - DNA, 20 bp, mouse
gatatttatccatgaaactt

SEQ ID NO: 711774 - DNA, 20 bp, mouse
gggagggtgtggctaaaata

SEQ ID NO: 711775 - DNA, 20 bp, mouse
ggtgtggctaaaatagggag

SEQ ID NO: 711776 - DNA, 20 bp, mouse
ggtcaccggggagacaagtt

SEQ ID NO: 711777 - DNA, 20 bp, mouse
gcgtgtgcgcacatatgtac

SEQ ID NO: 711778 - DNA, 20 bp, mouse
gagaggcagccaatccgcag

SEQ ID NO: 711779 - DNA, 20 bp, mouse
gtccccggtgaccgttgtta

SEQ ID NO: 711780 - DNA, 20 bp, mouse
gcacatatgtacaggatgtt

SEQ ID NO: 711781 - DNA, 20 bp, mouse
gtgggactaaaagactcgag

SEQ ID NO: 711782 - DNA, 20 bp, mouse
gcttgtaagggtgcttttga

SEQ ID NO: 711783 - DNA, 20 bp, mouse
ggttcgggagggctccgcgg

SEQ ID NO: 711784 - DNA, 20 bp, mouse
gccttctagtgtttcttcag

SEQ ID NO: 711785 - DNA, 20 bp, mouse
ggaagacgccctctgcggat

SEQ ID NO: 711786 - DNA, 20 bp, mouse
ggaggcgcgaagcgactccc

SEQ ID NO: 711787 - DNA, 20 bp, mouse
gactccctggttgctaggca

SEQ ID NO: 711788 - DNA, 20 bp, mouse
gaaactgcgggagttccggc

SEQ ID NO: 711789 - DNA, 20 bp, mouse
gggtcacagagtgcggctcg

SEQ ID NO: 711790 - DNA, 20 bp, mouse
gccccgccgaggtgaaactg

SEQ ID NO: 711791 - DNA, 20 bp, mouse
gaactcccgcagtttcacct

SEQ ID NO: 711792 - DNA, 20 bp, mouse
gtcggggattggacagcgct

SEQ ID NO: 711793 - DNA, 20 bp, mouse
ggggcggggcgcggttgcta

SEQ ID NO: 711794 - DNA, 20 bp, mouse
gaagacccgcaccttcacca

SEQ ID NO: 711795 - DNA, 20 bp, mouse
gtggggcccaaagacagtag

SEQ ID NO: 711796 - DNA, 20 bp, mouse
ggggagatgtccatggacca

SEQ ID NO: 711797 - DNA, 20 bp, mouse
gcacagatgggagatgtcca

SEQ ID NO: 711798 - DNA, 20 bp, mouse
gcggcccctggatgaggccc

SEQ ID NO: 711799 - DNA, 20 bp, mouse
gagatgtccatggaccacgg

SEQ ID NO: 711800 - DNA, 20 bp, mouse
ggctacccagaacccgtgac

SEQ ID NO: 711801 - DNA, 20 bp, mouse
gactgttcggcccctggatg

SEQ ID NO: 711802 - DNA, 20 bp, mouse
gtgctcaagaaaacctgaga

SEQ ID NO: 711803 - DNA, 20 bp, mouse
ggagcattttcgatcacaga

SEQ ID NO: 711804 - DNA, 20 bp, mouse
gtctttcctgtcacgggttc

SEQ ID NO: 711805 - DNA, 20 bp, mouse
ggcttcacctaagcagcagg

SEQ ID NO: 711806 - DNA, 20 bp, mouse
gtggccgcgcgctcagtcct

SEQ ID NO: 711807 - DNA, 20 bp, mouse
gggcaccctcaactgatctc

SEQ ID NO: 711808 - DNA, 20 bp, mouse
ggacaccggagatcagttga

SEQ ID NO: 711809 - DNA, 20 bp, mouse
gagagtgacaaggtcgcagt

SEQ ID NO: 711810 - DNA, 20 bp, mouse
gccgcgtaggggtgcagctg

SEQ ID NO: 711811 - DNA, 20 bp, mouse
gaggggagcatgtaggtcct

SEQ ID NO: 711812 - DNA, 20 bp, mouse
gctccgtggtgcatccgcgt

SEQ ID NO: 711813 - DNA, 20 bp, mouse
gcccctacgcggatgcacca

SEQ ID NO: 711814 - DNA, 20 bp, mouse
gaactgaacggtcactgtgg

SEQ ID NO: 711815 - DNA, 20 bp, mouse
ggtggtggagacaccgtgac

SEQ ID NO: 711816 - DNA, 20 bp, mouse
gcctctgaagtgtgttagga

SEQ ID NO: 711817 - DNA, 20 bp, mouse
ggggggcagcctaattgtcc

SEQ ID NO: 711818 - DNA, 20 bp, mouse
gaattcggtgaagacaatgg

SEQ ID NO: 711819 - DNA, 20 bp, mouse
gtcacgatgccggagtaggt

SEQ ID NO: 711820 - DNA, 20 bp, mouse
gtcagagtattgacctggaa

SEQ ID NO: 711821 - DNA, 20 bp, mouse
ggaattcacgatgccggagt

SEQ ID NO: 711822 - DNA, 20 bp, mouse
gaagaattcggtgaagacaa

SEQ ID NO: 711823 - DNA, 20 bp, mouse
gcaatggaaaaagtcatcca

SEQ ID NO: 711824 - DNA, 20 bp, mouse
ggcagcctaattgtccaggc

SEQ ID NO: 711825 - DNA, 20 bp, mouse
gcagctcatttatacattct

SEQ ID NO: 711826 - DNA, 20 bp, mouse
gcaaaaaaagacatactaag

SEQ ID NO: 711827 - DNA, 20 bp, mouse
gagacatactaagggggagt

SEQ ID NO: 711828 - DNA, 20 bp, mouse
gcacatgaaatcattcattc

SEQ ID NO: 711829 - DNA, 20 bp, mouse
gctttgaccattttatataa

SEQ ID NO: 711830 - DNA, 20 bp, mouse
gaagtctttgcttgtaacag

SEQ ID NO: 711831 - DNA, 20 bp, mouse
gctacattgcgtatattcat

SEQ ID NO: 711832 - DNA, 20 bp, mouse
ggtggcgccttttcatatta

SEQ ID NO: 711833 - DNA, 20 bp, mouse
gcatactaagggggagtggg

SEQ ID NO: 711834 - DNA, 20 bp, mouse
gatgagtataagcaatagtg

SEQ ID NO: 711835 - DNA, 20 bp, mouse
gagatataaaacttataaaa

SEQ ID NO: 711836 - DNA, 20 bp, mouse
ggactcctgatgatgtaacc

SEQ ID NO: 711837 - DNA, 20 bp, mouse
gagttgcaagaggtatcccc

SEQ ID NO: 711838 - DNA, 20 bp, mouse
gagttccaggttacatcatc

SEQ ID NO: 711839 - DNA, 20 bp, mouse
gattgttagtgccatggcat

SEQ ID NO: 711840 - DNA, 20 bp, mouse
ggagattttgtgaaaaccca

SEQ ID NO: 711841 - DNA, 20 bp, mouse
gagaaatctctagttttgga

SEQ ID NO: 711842 - DNA, 20 bp, mouse
ggaagattctagggttgtct

SEQ ID NO: 711843 - DNA, 20 bp, mouse
gtggatacaagagattttcc

SEQ ID NO: 711844 - DNA, 20 bp, mouse
gtggaaggagaagttgcaag

SEQ ID NO: 711845 - DNA, 20 bp, mouse
gtttcaatatagtgagccat

SEQ ID NO: 711846 - DNA, 20 bp, mouse
gacaagtccagtgtttgaat

SEQ ID NO: 711847 - DNA, 20 bp, mouse
ggctggtaggtagtaggcca

SEQ ID NO: 711848 - DNA, 20 bp, mouse
gtctctacccattcaaacac

SEQ ID NO: 711849 - DNA, 20 bp, mouse
ggggcaagctggtaggtagt

SEQ ID NO: 711850 - DNA, 20 bp, mouse
ggagattttgtgaaaaccca

SEQ ID NO: 711851 - DNA, 20 bp, mouse
gtcagaaactggtcaagata

SEQ ID NO: 711852 - DNA, 20 bp, mouse
gcaagatagggcaagctggt

SEQ ID NO: 711853 - DNA, 20 bp, mouse
gaggtgcaggagttggtttt

SEQ ID NO: 711854 - DNA, 20 bp, mouse
ggtagagattgttagtgctg

SEQ ID NO: 711855 - DNA, 20 bp, mouse
gattgttagtgctgtggcat

SEQ ID NO: 711856 - DNA, 20 bp, mouse
gacgggtcacaggtggacat

SEQ ID NO: 711857 - DNA, 20 bp, mouse
gaagccagttcacatcccaa

SEQ ID NO: 711858 - DNA, 20 bp, mouse
gggcaggtgtggactggtgt

SEQ ID NO: 711859 - DNA, 20 bp, mouse
gaggtgtggactggtgtcgg

SEQ ID NO: 711860 - DNA, 20 bp, mouse
gcactgtgctcacgggtcac

SEQ ID NO: 711861 - DNA, 20 bp, mouse
gaaacctttgggatgtgaac

SEQ ID NO: 711862 - DNA, 20 bp, mouse
ggtgagaacactgtgctcac

SEQ ID NO: 711863 - DNA, 20 bp, mouse
gaactagagagagctgactt

SEQ ID NO: 711864 - DNA, 20 bp, mouse
gtccagggctgtttgtgcaa

SEQ ID NO: 711865 - DNA, 20 bp, mouse
gtgtgctcacgggtcacagg

SEQ ID NO: 711866 - DNA, 20 bp, mouse
gcaagatggggcaagctgta

SEQ ID NO: 711867 - DNA, 20 bp, mouse
gcacgggcaaaagagactcc

SEQ ID NO: 711868 - DNA, 20 bp, mouse
ggctgtaaggcggtaggcca

SEQ ID NO: 711869 - DNA, 20 bp, mouse
ggggcaagctgtaaggcggt

SEQ ID NO: 711870 - DNA, 20 bp, mouse
gatattacctggatcttcca

SEQ ID NO: 711871 - DNA, 20 bp, mouse
gtggttagctcatattcgta

SEQ ID NO: 711872 - DNA, 20 bp, mouse
ggactactgatgatattacc

SEQ ID NO: 711873 - DNA, 20 bp, mouse
ggattgctagtgccgttgct

SEQ ID NO: 711874 - DNA, 20 bp, mouse
ggatggggcaagctgtaagg

SEQ ID NO: 711875 - DNA, 20 bp, mouse
gatatgagctaaccaagcaa

SEQ ID NO: 711876 - DNA, 20 bp, mouse
gattgaacttgagttgtaag

SEQ ID NO: 711877 - DNA, 20 bp, mouse
ggaaagcagagcagccgagg

SEQ ID NO: 711878 - DNA, 20 bp, mouse
gcatccattagacctagcac

SEQ ID NO: 711879 - DNA, 20 bp, mouse
ggaccctgtgctaggtctaa

SEQ ID NO: 711880 - DNA, 20 bp, mouse
gcagcacccccagatctcct

SEQ ID NO: 711881 - DNA, 20 bp, mouse
gccaacaagagcttgaggac

SEQ ID NO: 711882 - DNA, 20 bp, mouse
gtagatctccattttgagag

SEQ ID NO: 711883 - DNA, 20 bp, mouse
gtcaccaaactcaggcacta

SEQ ID NO: 711884 - DNA, 20 bp, mouse
gtgagtttggtgattattta

SEQ ID NO: 711885 - DNA, 20 bp, mouse
ggtctctgtaactgcatcca

SEQ ID NO: 711886 - DNA, 20 bp, mouse
gccagtggctggaaaggata

SEQ ID NO: 711887 - DNA, 20 bp, mouse
gagaccaggacctactgggg

SEQ ID NO: 711888 - DNA, 20 bp, mouse
gcaatgtggcagaattggtg

SEQ ID NO: 711889 - DNA, 20 bp, mouse
gaggactcagatgaagttat

SEQ ID NO: 711890 - DNA, 20 bp, mouse
gccacattgcaaagccaatt

SEQ ID NO: 711891 - DNA, 20 bp, mouse
gagctcggaagaaatgggat

SEQ ID NO: 711892 - DNA, 20 bp, mouse
gactggcagactgctaagtc

SEQ ID NO: 711893 - DNA, 20 bp, mouse
gtccgagcttctctcttaga

SEQ ID NO: 711894 - DNA, 20 bp, mouse
gggggctagaacaagttcac

SEQ ID NO: 711895 - DNA, 20 bp, mouse
gatagggcaagcttgagtcc

SEQ ID NO: 711896 - DNA, 20 bp, mouse
ggaacctgatcctgcactga

SEQ ID NO: 711897 - DNA, 20 bp, mouse
gacagttatgatggagaact

SEQ ID NO: 711898 - DNA, 20 bp, mouse
gaggacacccggcctaagtg

SEQ ID NO: 711899 - DNA, 20 bp, mouse
gacacccggcctaagtgggg

SEQ ID NO: 711900 - DNA, 20 bp, mouse
ggagacaaagagcctaggca

SEQ ID NO: 711901 - DNA, 20 bp, mouse
gggcaaggctgctcaagcaa

SEQ ID NO: 711902 - DNA, 20 bp, mouse
gtgcactgagggtgaggata

SEQ ID NO: 711903 - DNA, 20 bp, mouse
gaaaggccacagtgccaaca

SEQ ID NO: 711904 - DNA, 20 bp, mouse
gtctcgtcttgtcaccttgt

SEQ ID NO: 711905 - DNA, 20 bp, mouse
gcgagagattactaaagtca

SEQ ID NO: 711906 - DNA, 20 bp, mouse
ggacatctcggtggtagaag

SEQ ID NO: 711907 - DNA, 20 bp, mouse
ggagaagtacgcgagtttca

SEQ ID NO: 711908 - DNA, 20 bp, mouse
ggaagatcacgttgcccgag

SEQ ID NO: 711909 - DNA, 20 bp, mouse
gggctggaaagccgaccgct

SEQ ID NO: 711910 - DNA, 20 bp, mouse
gctgacttcgcactgatcaa

SEQ ID NO: 711911 - DNA, 20 bp, mouse
ggtgctctagcaggtagaag

SEQ ID NO: 711912 - DNA, 20 bp, mouse
gcggaacgctggtgcaggaa

SEQ ID NO: 711913 - DNA, 20 bp, mouse
gcgggcaacgtgatcttcag

SEQ ID NO: 711914 - DNA, 20 bp, mouse
gcggctctggagttccagga

SEQ ID NO: 711915 - DNA, 20 bp, mouse
ggtggccatcgggcgcgtac

SEQ ID NO: 711916 - DNA, 20 bp, mouse
ggtggaagagagactgacta

SEQ ID NO: 711917 - DNA, 20 bp, mouse
ggactgactagggaagtcct

SEQ ID NO: 711918 - DNA, 20 bp, mouse
gcacagagagatataatgac

SEQ ID NO: 711919 - DNA, 20 bp, mouse
gaaagtacacagaatagatc

SEQ ID NO: 711920 - DNA, 20 bp, mouse
ggatcaggattgtatcagca

SEQ ID NO: 711921 - DNA, 20 bp, mouse
gaaaggcgtaccctgatcct

SEQ ID NO: 711922 - DNA, 20 bp, mouse
gaatgacaggattacatagc

SEQ ID NO: 711923 - DNA, 20 bp, mouse
gaaaatcctgagagacatga

SEQ ID NO: 711924 - DNA, 20 bp, mouse
gtgcgcaggttcagagaatc

SEQ ID NO: 711925 - DNA, 20 bp, mouse
gcagtggcacgggtttcttt

SEQ ID NO: 711926 - DNA, 20 bp, mouse
gctagacctcacaccctctt

SEQ ID NO: 711927 - DNA, 20 bp, mouse
gtcagccaaagggtctggtc

SEQ ID NO: 711928 - DNA, 20 bp, mouse
ggtctctatcaatccagtgt

SEQ ID NO: 711929 - DNA, 20 bp, mouse
ggaagatgactcagtcactt

SEQ ID NO: 711930 - DNA, 20 bp, mouse
gaacacctcccctcccacac

SEQ ID NO: 711931 - DNA, 20 bp, mouse
gtctaactgagcagcagcaa

SEQ ID NO: 711932 - DNA, 20 bp, mouse
gtctatcaatccagtgtggg

SEQ ID NO: 711933 - DNA, 20 bp, mouse
gttggcaacatgaggtgctg

SEQ ID NO: 711934 - DNA, 20 bp, mouse
ggcacctcatgttgccaaag

SEQ ID NO: 711935 - DNA, 20 bp, mouse
gaggtgttgcagagatcaat

SEQ ID NO: 711936 - DNA, 20 bp, mouse
ggctgctgggcaggagtgct

SEQ ID NO: 711937 - DNA, 20 bp, mouse
ggctaaaggtacaagaccct

SEQ ID NO: 711938 - DNA, 20 bp, mouse
gcctcagagacggggagctg

SEQ ID NO: 711939 - DNA, 20 bp, mouse
gatcctggctatcaatcaca

SEQ ID NO: 711940 - DNA, 20 bp, mouse
gcctgcttggtgttcaccaa

SEQ ID NO: 711941 - DNA, 20 bp, mouse
gtggaagtgcctcagagacg

SEQ ID NO: 711942 - DNA, 20 bp, mouse
gaaaaactgcacaaatacat

SEQ ID NO: 711943 - DNA, 20 bp, mouse
gatggttaaaaaccaatggg

SEQ ID NO: 711944 - DNA, 20 bp, mouse
gcacatggttaaaaaccaat

SEQ ID NO: 711945 - DNA, 20 bp, mouse
ggattgatagccaggatccc

SEQ ID NO: 711946 - DNA, 20 bp, mouse
ggggcagggtatgtgtgggt

SEQ ID NO: 711947 - DNA, 20 bp, mouse
gacactcccaacaaagttga

SEQ ID NO: 711948 - DNA, 20 bp, mouse
gagtgcgcgtgcgcggcgag

SEQ ID NO: 711949 - DNA, 20 bp, mouse
gcactcgcgcttagggtggc

SEQ ID NO: 711950 - DNA, 20 bp, mouse
gaggttccttcaactttgtt

SEQ ID NO: 711951 - DNA, 20 bp, mouse
ggaagttcccgattggaaat

SEQ ID NO: 711952 - DNA, 20 bp, mouse
gcccggcataggaccgcata

SEQ ID NO: 711953 - DNA, 20 bp, mouse
gtggctcatcagcgactcgg

SEQ ID NO: 711954 - DNA, 20 bp, mouse
gcaatcgggaacttcggaac

SEQ ID NO: 711955 - DNA, 20 bp, mouse
gcgcacgcgcactcgcgctt

SEQ ID NO: 711956 - DNA, 20 bp, mouse
ggaagagcttgagagtgttg

SEQ ID NO: 711957 - DNA, 20 bp, mouse
ggatgcatggctccagaggt

SEQ ID NO: 711958 - DNA, 20 bp, mouse
ggggagtcagttctgaggtc

SEQ ID NO: 711959 - DNA, 20 bp, mouse
ggaacctgaaagtacaaaaa

SEQ ID NO: 711960 - DNA, 20 bp, mouse
ggtcagttctgaggtcaggt

SEQ ID NO: 711961 - DNA, 20 bp, mouse
gcttgagggagtcagttctg

SEQ ID NO: 711962 - DNA, 20 bp, mouse
gtgtccacggcagcatgaac

SEQ ID NO: 711963 - DNA, 20 bp, mouse
gcaaccccgcacttacgcac

SEQ ID NO: 711964 - DNA, 20 bp, mouse
ggcattgaacagatgatgca

SEQ ID NO: 711965 - DNA, 20 bp, mouse
ggtaagtgcggggttgtcca

SEQ ID NO: 711966 - DNA, 20 bp, mouse
ggatggggactggactacac

SEQ ID NO: 711967 - DNA, 20 bp, mouse
gccagagctgggctttgtaa

SEQ ID NO: 711968 - DNA, 20 bp, mouse
gtgagcacagagagtggcac

SEQ ID NO: 711969 - DNA, 20 bp, mouse
ggagggacattgccagagct

SEQ ID NO: 711970 - DNA, 20 bp, mouse
gcaggtcagaagcaaggttg

SEQ ID NO: 711971 - DNA, 20 bp, mouse
ggactggtggacactaacag

SEQ ID NO: 711972 - DNA, 20 bp, mouse
gtgctccacctgctgagtgg

SEQ ID NO: 711973 - DNA, 20 bp, mouse
gagagtggcacagggatgga

SEQ ID NO: 711974 - DNA, 20 bp, mouse
gacctggggcttagaggatg

SEQ ID NO: 711975 - DNA, 20 bp, mouse
gcaccagagctggactttgt

SEQ ID NO: 711976 - DNA, 20 bp, mouse
gctcgccagagcctagaagc

SEQ ID NO: 711977 - DNA, 20 bp, mouse
gtgatcccgcttctaggctc

SEQ ID NO: 711978 - DNA, 20 bp, mouse
gaaacgaggtgcgtaagctg

SEQ ID NO: 711979 - DNA, 20 bp, mouse
gtacagcgttgatagaacac

SEQ ID NO: 711980 - DNA, 20 bp, mouse
gtacggaacgcgacaagcgg

SEQ ID NO: 711981 - DNA, 20 bp, mouse
gttaggctgatcccgcttct

SEQ ID NO: 711982 - DNA, 20 bp, mouse
gccaaagtgatgaaggaagg

SEQ ID NO: 711983 - DNA, 20 bp, mouse
gtgtctaaaaaacatttcag

SEQ ID NO: 711984 - DNA, 20 bp, mouse
gatgtttatcaagtgtcgga

SEQ ID NO: 711985 - DNA, 20 bp, mouse
gcgcctgaccaaagtgatga

SEQ ID NO: 711986 - DNA, 20 bp, mouse
ggggcatcgcagcttacgag

SEQ ID NO: 711987 - DNA, 20 bp, mouse
gggcgcggaggcccgctcgg

SEQ ID NO: 711988 - DNA, 20 bp, mouse
gcccgccccgccccgccgag

SEQ ID NO: 711989 - DNA, 20 bp, mouse
ggagggcgcggaggcccgct

SEQ ID NO: 711990 - DNA, 20 bp, mouse
gactgtgcgtccccgcatct

SEQ ID NO: 711991 - DNA, 20 bp, mouse
gatgcggggacgcacagtca

SEQ ID NO: 711992 - DNA, 20 bp, mouse
ggcaaaggagcccagatgcg

SEQ ID NO: 711993 - DNA, 20 bp, mouse
gggcggccaggcctgcgccc

SEQ ID NO: 711994 - DNA, 20 bp, mouse
gcgcgccctcgaacccaagc

SEQ ID NO: 711995 - DNA, 20 bp, mouse
gcctcgaacccaagcaggtc

SEQ ID NO: 711996 - DNA, 20 bp, mouse
ggactgtgatatatatgcaa

SEQ ID NO: 711997 - DNA, 20 bp, mouse
gtggaaaacttcatagaaaa

SEQ ID NO: 711998 - DNA, 20 bp, mouse
ggaaaaaagctttatcatat

SEQ ID NO: 711999 - DNA, 20 bp, mouse
gcctgctttcttcaaatatg

SEQ ID NO: 712000 - DNA, 20 bp, mouse
gggtatgaaagaaatcttac

SEQ ID NO: 712001 - DNA, 20 bp, mouse
ggaattattttattcctttg

SEQ ID NO: 712002 - DNA, 20 bp, mouse
gcaaaaaacaccaaaattta

SEQ ID NO: 712003 - DNA, 20 bp, mouse
gattaattcaaacagataaa

SEQ ID NO: 712004 - DNA, 20 bp, mouse
gcatgatttcccctaaattt

SEQ ID NO: 712005 - DNA, 20 bp, mouse
gattttacaatttggtttaa

SEQ ID NO: 712006 - DNA, 20 bp, mouse
gcctcagtcccagtagtctc

SEQ ID NO: 712007 - DNA, 20 bp, mouse
gcccgaggacagttactaac

SEQ ID NO: 712008 - DNA, 20 bp, mouse
ggtacaagtgggcacagcgc

SEQ ID NO: 712009 - DNA, 20 bp, mouse
ggactgtgaaggactcaaat

SEQ ID NO: 712010 - DNA, 20 bp, mouse
gtcagcgcagttatggggga

SEQ ID NO: 712011 - DNA, 20 bp, mouse
ggacctaagccccatctggt

SEQ ID NO: 712012 - DNA, 20 bp, mouse
gcaggtctgaattggaatga

SEQ ID NO: 712013 - DNA, 20 bp, mouse
gcaagtcagcgcagttatgg

SEQ ID NO: 712014 - DNA, 20 bp, mouse
gtcagcagccagagactact

SEQ ID NO: 712015 - DNA, 20 bp, mouse
gccctgggctgggagaagaa

SEQ ID NO: 712016 - DNA, 20 bp, mouse
ggccgcctagaaaagagatg

SEQ ID NO: 712017 - DNA, 20 bp, mouse
gatcaccaaggacttaaaaa

SEQ ID NO: 712018 - DNA, 20 bp, mouse
ggaggccaatgtgtgaacct

SEQ ID NO: 712019 - DNA, 20 bp, mouse
gcatcctggggacttctttc

SEQ ID NO: 712020 - DNA, 20 bp, mouse
gtcacacattggcctctagg

SEQ ID NO: 712021 - DNA, 20 bp, mouse
ggtggcgtcatatttggaca

SEQ ID NO: 712022 - DNA, 20 bp, mouse
gcagttaccaagagctcctg

SEQ ID NO: 712023 - DNA, 20 bp, mouse
gtgcttggtggcgtcatatt

SEQ ID NO: 712024 - DNA, 20 bp, mouse
ggcgctagctgtgctgagtt

SEQ ID NO: 712025 - DNA, 20 bp, mouse
gccttaagaagcaatttcta

SEQ ID NO: 712026 - DNA, 20 bp, mouse
gtagacaagattcttctggt

SEQ ID NO: 712027 - DNA, 20 bp, mouse
ggacaagcacactgtgttag

SEQ ID NO: 712028 - DNA, 20 bp, mouse
gaagtcctacaacagcctaa

SEQ ID NO: 712029 - DNA, 20 bp, mouse
gacaggtgatagagcccttt

SEQ ID NO: 712030 - DNA, 20 bp, mouse
ggtggtgggatgcagctctt

SEQ ID NO: 712031 - DNA, 20 bp, mouse
gtcctacagggacaagtttc

SEQ ID NO: 712032 - DNA, 20 bp, mouse
gggttggctgtggacagtgg

SEQ ID NO: 712033 - DNA, 20 bp, mouse
gaaaccggaactcagagctc

SEQ ID NO: 712034 - DNA, 20 bp, mouse
gtctgagttccggtttccag

SEQ ID NO: 712035 - DNA, 20 bp, mouse
gtgtgcgaggatgctcacac

SEQ ID NO: 712036 - DNA, 20 bp, mouse
gcaagacctcaagagtacta

SEQ ID NO: 712037 - DNA, 20 bp, mouse
gaacataagtcctcatataa

SEQ ID NO: 712038 - DNA, 20 bp, mouse
gctagggcttgagaaagtac

SEQ ID NO: 712039 - DNA, 20 bp, mouse
gtaagtcctcatataaagga

SEQ ID NO: 712040 - DNA, 20 bp, mouse
gagagctgtcttctccttta

SEQ ID NO: 712041 - DNA, 20 bp, mouse
gtaaagaacaaggatgagga

SEQ ID NO: 712042 - DNA, 20 bp, mouse
gttgaagctcatttcccgta

SEQ ID NO: 712043 - DNA, 20 bp, mouse
gagttcgggtagaacaaaca

SEQ ID NO: 712044 - DNA, 20 bp, mouse
gatatgaggacttatgttct

SEQ ID NO: 712045 - DNA, 20 bp, mouse
gttttaggttaaacctattg

SEQ ID NO: 712046 - DNA, 20 bp, mouse
gagcttaggttcattgattg

SEQ ID NO: 712047 - DNA, 20 bp, mouse
gaagaggggtgccatggagg

SEQ ID NO: 712048 - DNA, 20 bp, mouse
ggctggagtacaggtgtatg

SEQ ID NO: 712049 - DNA, 20 bp, mouse
gagtacaggtgtatgtggaa

SEQ ID NO: 712050 - DNA, 20 bp, mouse
gggaggaaaaagcctgtccc

SEQ ID NO: 712051 - DNA, 20 bp, mouse
gatcaagaggggtgccatgg

SEQ ID NO: 712052 - DNA, 20 bp, mouse
gtaaaggagtactccttcct

SEQ ID NO: 712053 - DNA, 20 bp, mouse
gaaggggactcagtcccaca

SEQ ID NO: 712054 - DNA, 20 bp, mouse
ggaaggagtactcctttaca

SEQ ID NO: 712055 - DNA, 20 bp, mouse
ggattcttttggcccaaact

SEQ ID NO: 712056 - DNA, 20 bp, mouse
gttagccctatgttcaaagt

SEQ ID NO: 712057 - DNA, 20 bp, mouse
gttcaaagtaggaatgttgc

SEQ ID NO: 712058 - DNA, 20 bp, mouse
ggactttcttcgtttctaaa

SEQ ID NO: 712059 - DNA, 20 bp, mouse
ggatcaaactgagaccatca

SEQ ID NO: 712060 - DNA, 20 bp, mouse
gtactgggtgggtggatcct

SEQ ID NO: 712061 - DNA, 20 bp, mouse
gactctatgaaaattcatgt

SEQ ID NO: 712062 - DNA, 20 bp, mouse
gaaaattcatgttggttcat

SEQ ID NO: 712063 - DNA, 20 bp, mouse
gttctcctctactgggtggg

SEQ ID NO: 712064 - DNA, 20 bp, mouse
gtatgaaacacttaattaca

SEQ ID NO: 712065 - DNA, 20 bp, mouse
gtcgtttctaaatggtctgt

SEQ ID NO: 712066 - DNA, 20 bp, mouse
gtatgcttctatgtagatga

SEQ ID NO: 712067 - DNA, 20 bp, mouse
gtctatgtagatgaaggcaa

SEQ ID NO: 712068 - DNA, 20 bp, mouse
gttatgtaagtgttaaacaa

SEQ ID NO: 712069 - DNA, 20 bp, mouse
gtacctgaacacccctggac

SEQ ID NO: 712070 - DNA, 20 bp, mouse
gtgcctgtccaggggtgttc

SEQ ID NO: 712071 - DNA, 20 bp, mouse
gaagcatgctcatgcacaaa

SEQ ID NO: 712072 - DNA, 20 bp, mouse
gtagtatcacccaagacaaa

SEQ ID NO: 712073 - DNA, 20 bp, mouse
ggagagttttccctttgtct

SEQ ID NO: 712074 - DNA, 20 bp, mouse
gtgttgactccgtttttatt

SEQ ID NO: 712075 - DNA, 20 bp, mouse
gaactctcaaatatagcaaa

SEQ ID NO: 712076 - DNA, 20 bp, mouse
gcaaagcagaagggtgactt

SEQ ID NO: 712077 - DNA, 20 bp, mouse
gaggaaggcgttcattggtg

SEQ ID NO: 712078 - DNA, 20 bp, mouse
gaaaacccagtgtcttcctg

SEQ ID NO: 712079 - DNA, 20 bp, mouse
ggttaaaggaaggcgttcat

SEQ ID NO: 712080 - DNA, 20 bp, mouse
ggttcctgttttggtctcat

SEQ ID NO: 712081 - DNA, 20 bp, mouse
gcctcctatgagaccaaaac

SEQ ID NO: 712082 - DNA, 20 bp, mouse
gtaccttgcaagcaagttaa

SEQ ID NO: 712083 - DNA, 20 bp, mouse
gaggcgttcattggtggggt

SEQ ID NO: 712084 - DNA, 20 bp, mouse
gtcataggaggaattcttct

SEQ ID NO: 712085 - DNA, 20 bp, mouse
gttgcaagcaagttaatgga

SEQ ID NO: 712086 - DNA, 20 bp, mouse
gtgagctggctgcttcgaag

SEQ ID NO: 712087 - DNA, 20 bp, mouse
gctaagtaggagagttgagc

SEQ ID NO: 712088 - DNA, 20 bp, mouse
gcttgacagcactactaagt

SEQ ID NO: 712089 - DNA, 20 bp, mouse
gaactggccttgcttgggaa

SEQ ID NO: 712090 - DNA, 20 bp, mouse
gtacctgcctccagcagaac

SEQ ID NO: 712091 - DNA, 20 bp, mouse
gcaagcaaggccagttctgc

SEQ ID NO: 712092 - DNA, 20 bp, mouse
gaagtggttggacgttgcca

SEQ ID NO: 712093 - DNA, 20 bp, mouse
gagtgtgcaatgaacacctc

SEQ ID NO: 712094 - DNA, 20 bp, mouse
gctggctgcttcgaagtggt

SEQ ID NO: 712095 - DNA, 20 bp, mouse
gatgaacacctctggtaaca

SEQ ID NO: 712096 - DNA, 20 bp, mouse
gcaggggttaagagtcttgg

SEQ ID NO: 712097 - DNA, 20 bp, mouse
gcatttcttaagtcacccga

SEQ ID NO: 712098 - DNA, 20 bp, mouse
gtactgatgtaataatagaa

SEQ ID NO: 712099 - DNA, 20 bp, mouse
gagcttgccaagtgtgatcc

SEQ ID NO: 712100 - DNA, 20 bp, mouse
gagaagggtgtgtgctgcgt

SEQ ID NO: 712101 - DNA, 20 bp, mouse
gccaagtgtgatcctgggtt

SEQ ID NO: 712102 - DNA, 20 bp, mouse
ggattctagagtccgaaccc

SEQ ID NO: 712103 - DNA, 20 bp, mouse
gctgacactggtcagggtgt

SEQ ID NO: 712104 - DNA, 20 bp, mouse
gctaacttctgacactggtc

SEQ ID NO: 712105 - DNA, 20 bp, mouse
gagagtcttggaggctcttc

SEQ ID NO: 712106 - DNA, 20 bp, mouse
gtccccgcctacttattatg

SEQ ID NO: 712107 - DNA, 20 bp, mouse
gacaagaggattcaggtcag

SEQ ID NO: 712108 - DNA, 20 bp, mouse
gctcaagtgtgtctactgta

SEQ ID NO: 712109 - DNA, 20 bp, mouse
gcacacttgagcacagggct

SEQ ID NO: 712110 - DNA, 20 bp, mouse
gctgcgggcagcttcacagt

SEQ ID NO: 712111 - DNA, 20 bp, mouse
gtttcctcataataagtagg

SEQ ID NO: 712112 - DNA, 20 bp, mouse
gacaagaatatcatcgggaa

SEQ ID NO: 712113 - DNA, 20 bp, mouse
gaagttcatatagctttggt

SEQ ID NO: 712114 - DNA, 20 bp, mouse
gacccctatagaaagttcta

SEQ ID NO: 712115 - DNA, 20 bp, mouse
ggcctctatgtaatccacaa

SEQ ID NO: 712116 - DNA, 20 bp, mouse
gacagctgagggatctcctc

SEQ ID NO: 712117 - DNA, 20 bp, mouse
ggggatgacttgttaagaag

SEQ ID NO: 712118 - DNA, 20 bp, mouse
gcaagatttggggtctcatc

SEQ ID NO: 712119 - DNA, 20 bp, mouse
gagggctcggactcattgaa

SEQ ID NO: 712120 - DNA, 20 bp, mouse
ggccctggtggagacagctg

SEQ ID NO: 712121 - DNA, 20 bp, mouse
ggctcatggagtcgatgtgt

SEQ ID NO: 712122 - DNA, 20 bp, mouse
gcaatgagtccgagccctgg

SEQ ID NO: 712123 - DNA, 20 bp, mouse
gagtaagatctttgagaaca

SEQ ID NO: 712124 - DNA, 20 bp, mouse
gaaggaactcattagctgac

SEQ ID NO: 712125 - DNA, 20 bp, mouse
ggagtcgatgtgtgggctta

SEQ ID NO: 712126 - DNA, 20 bp, mouse
gtaggtggggtataggaacc

SEQ ID NO: 712127 - DNA, 20 bp, mouse
gtcaggagaggtaagggtat

SEQ ID NO: 712128 - DNA, 20 bp, mouse
gtggggaagctggggtacat

SEQ ID NO: 712129 - DNA, 20 bp, mouse
gaggttggagcatgggaaac

SEQ ID NO: 712130 - DNA, 20 bp, mouse
gtggagcatgggaaacaggc

SEQ ID NO: 712131 - DNA, 20 bp, mouse
gctagggtaggttggagcat

SEQ ID NO: 712132 - DNA, 20 bp, mouse
ggaccaggctgggcagctag

SEQ ID NO: 712133 - DNA, 20 bp, mouse
ggcagctctcaggtgaactg

SEQ ID NO: 712134 - DNA, 20 bp, mouse
gaccaggctgggaaactctt

SEQ ID NO: 712135 - DNA, 20 bp, mouse
gctctcaggtgaactggggt

SEQ ID NO: 712136 - DNA, 20 bp, mouse
gactacacaggaagatctct

SEQ ID NO: 712137 - DNA, 20 bp, mouse
gaagacctcagaacttggct

SEQ ID NO: 712138 - DNA, 20 bp, mouse
ggggttttgtggggaagagt

SEQ ID NO: 712139 - DNA, 20 bp, mouse
gtgtttgtacatatgtaggg

SEQ ID NO: 712140 - DNA, 20 bp, mouse
gctcttctgcaaggagcatc

SEQ ID NO: 712141 - DNA, 20 bp, mouse
gaggttagtactaagctttg

SEQ ID NO: 712142 - DNA, 20 bp, mouse
gggtgatcagctcttctgca

SEQ ID NO: 712143 - DNA, 20 bp, mouse
gtgcatttacaggtgcaaac

SEQ ID NO: 712144 - DNA, 20 bp, mouse
gttaccacactataagaggt

SEQ ID NO: 712145 - DNA, 20 bp, mouse
gtaacctacctcttatagtg

SEQ ID NO: 712146 - DNA, 20 bp, mouse
gcacgcgaatgcctgtctca

SEQ ID NO: 712147 - DNA, 20 bp, mouse
gcccagcaaataagagacta

SEQ ID NO: 712148 - DNA, 20 bp, mouse
gctgtctcatggctcagaaa

SEQ ID NO: 712149 - DNA, 20 bp, mouse
gcaagctgacctcaagttta

SEQ ID NO: 712150 - DNA, 20 bp, mouse
gagactggtaaataagtaaa

SEQ ID NO: 712151 - DNA, 20 bp, mouse
gtagtcaggtggtggcactt

SEQ ID NO: 712152 - DNA, 20 bp, mouse
gttaggttttagtcaggctt

SEQ ID NO: 712153 - DNA, 20 bp, mouse
gagcgaggacttctccaata

SEQ ID NO: 712154 - DNA, 20 bp, mouse
ggattactgaaataccttat

SEQ ID NO: 712155 - DNA, 20 bp, mouse
gcttgggagtcagcatctct

SEQ ID NO: 712156 - DNA, 20 bp, mouse
gcctctccctggtaacctga

SEQ ID NO: 712157 - DNA, 20 bp, mouse
ggaaacactggtcagggcag

SEQ ID NO: 712158 - DNA, 20 bp, mouse
gcagagagacacggggtggt

SEQ ID NO: 712159 - DNA, 20 bp, mouse
gtgtgcggaaacactggtca

SEQ ID NO: 712160 - DNA, 20 bp, mouse
gtgtagaagtagcaactgag

SEQ ID NO: 712161 - DNA, 20 bp, mouse
ggagagggttccaaggcgac

SEQ ID NO: 712162 - DNA, 20 bp, mouse
gtcactccagcctgtcgcct

SEQ ID NO: 712163 - DNA, 20 bp, mouse
gtcccaaggggggtggtgat

SEQ ID NO: 712164 - DNA, 20 bp, mouse
ggggttccaaggcgacaggc

SEQ ID NO: 712165 - DNA, 20 bp, mouse
gtccctggtaacctgatggc

SEQ ID NO: 712166 - DNA, 20 bp, mouse
gcaaaaacagtcatagggtg

SEQ ID NO: 712167 - DNA, 20 bp, mouse
ggccagaggtaagtgcgggt

SEQ ID NO: 712168 - DNA, 20 bp, mouse
gtacagaagaccaatatcaa

SEQ ID NO: 712169 - DNA, 20 bp, mouse
gtcccacccgcacttacctc

SEQ ID NO: 712170 - DNA, 20 bp, mouse
ggcaaagtgttatttctcta

SEQ ID NO: 712171 - DNA, 20 bp, mouse
gcagatgcaaaaacagtcat

SEQ ID NO: 712172 - DNA, 20 bp, mouse
gagtagccagaggtaagtgc

SEQ ID NO: 712173 - DNA, 20 bp, mouse
ggtggggtgttagcagttgt

SEQ ID NO: 712174 - DNA, 20 bp, mouse
gagcagtcacccattgatat

SEQ ID NO: 712175 - DNA, 20 bp, mouse
gacagtcatagggtggggcg

SEQ ID NO: 712176 - DNA, 20 bp, mouse
ggcccgggctccctccgcga

SEQ ID NO: 712177 - DNA, 20 bp, mouse
gctgaggagcccgcggtgtg

SEQ ID NO: 712178 - DNA, 20 bp, mouse
gagcccgcggtgtggggatt

SEQ ID NO: 712179 - DNA, 20 bp, mouse
gctcctcagcgctccagcgg

SEQ ID NO: 712180 - DNA, 20 bp, mouse
ggggctcctcagcgctccag

SEQ ID NO: 712181 - DNA, 20 bp, mouse
gcgtccgccccgcccggctt

SEQ ID NO: 712182 - DNA, 20 bp, mouse
ggggctgagagcgcgagcgg

SEQ ID NO: 712183 - DNA, 20 bp, mouse
ggaggagagcagtgcgcccg

SEQ ID NO: 712184 - DNA, 20 bp, mouse
gctacctcccaagccgggcg

SEQ ID NO: 712185 - DNA, 20 bp, mouse
ggagagcagtgcgcccgcgg

SEQ ID NO: 712186 - DNA, 20 bp, mouse
ggaacagagactatataaac

SEQ ID NO: 712187 - DNA, 20 bp, mouse
gggaccaggatttctgttta

SEQ ID NO: 712188 - DNA, 20 bp, mouse
ggtaggagctgagtagaagc

SEQ ID NO: 712189 - DNA, 20 bp, mouse
gaacagcaaatttgagcaga

SEQ ID NO: 712190 - DNA, 20 bp, mouse
gggcgacattgtgcctatag

SEQ ID NO: 712191 - DNA, 20 bp, mouse
gtatttttcagagcagattt

SEQ ID NO: 712192 - DNA, 20 bp, mouse
gaaggactaaccagattttt

SEQ ID NO: 712193 - DNA, 20 bp, mouse
gaggcacaatgtcgcctcta

SEQ ID NO: 712194 - DNA, 20 bp, mouse
gagctggcctgtggttatca

SEQ ID NO: 712195 - DNA, 20 bp, mouse
gctgctctttccctgagtgc

SEQ ID NO: 712196 - DNA, 20 bp, mouse
ggcggggcttgtaatgaatg

SEQ ID NO: 712197 - DNA, 20 bp, mouse
ggacccaccaagcagattct

SEQ ID NO: 712198 - DNA, 20 bp, mouse
gagaagtggttgtgcttcac

SEQ ID NO: 712199 - DNA, 20 bp, mouse
gtttcattgcgtggagggcg

SEQ ID NO: 712200 - DNA, 20 bp, mouse
gatatttaacagaatgacat

SEQ ID NO: 712201 - DNA, 20 bp, mouse
gtcagatttcattgcgtgga

SEQ ID NO: 712202 - DNA, 20 bp, mouse
ggtcattctgttaaatattc

SEQ ID NO: 712203 - DNA, 20 bp, mouse
gtctcaaaaaaaactctgct

SEQ ID NO: 712204 - DNA, 20 bp, mouse
gtgtttgtcaacacttctca

SEQ ID NO: 712205 - DNA, 20 bp, mouse
gttgctgtatttttctccag

SEQ ID NO: 712206 - DNA, 20 bp, mouse
gtaaagctcagtttgatcct

SEQ ID NO: 712207 - DNA, 20 bp, mouse
gtccgcatccgccgggtata

SEQ ID NO: 712208 - DNA, 20 bp, mouse
gtgggagctggtagtgagac

SEQ ID NO: 712209 - DNA, 20 bp, mouse
gagtgcgtgggtttgtgcgg

SEQ ID NO: 712210 - DNA, 20 bp, mouse
gttacccaaggaggaaacgt

SEQ ID NO: 712211 - DNA, 20 bp, mouse
gtcgctgtggctctaatgaa

SEQ ID NO: 712212 - DNA, 20 bp, mouse
gacgggatcatccctatacc

SEQ ID NO: 712213 - DNA, 20 bp, mouse
gggcgcaggcggctacggag

SEQ ID NO: 712214 - DNA, 20 bp, mouse
gacagggtcggatttttcct

SEQ ID NO: 712215 - DNA, 20 bp, mouse
gggatcatccctatacccgg

SEQ ID NO: 712216 - DNA, 20 bp, mouse
gcccaggcccgccaaacctc

SEQ ID NO: 712217 - DNA, 20 bp, mouse
gctggcgaatgcttgcccag

SEQ ID NO: 712218 - DNA, 20 bp, mouse
ggcttgcccagaggtcccag

SEQ ID NO: 712219 - DNA, 20 bp, mouse
gccaacaaagcagcacaaac

SEQ ID NO: 712220 - DNA, 20 bp, mouse
gtgtatatacggctgggtga

SEQ ID NO: 712221 - DNA, 20 bp, mouse
gcactggagccaacttgcag

SEQ ID NO: 712222 - DNA, 20 bp, mouse
gtaaaactaagaaactgagg

SEQ ID NO: 712223 - DNA, 20 bp, mouse
gtggagccaacttgcagagg

SEQ ID NO: 712224 - DNA, 20 bp, mouse
gtcagccctcctctgcaagt

SEQ ID NO: 712225 - DNA, 20 bp, mouse
gtagttttacttgtggtgtt

SEQ ID NO: 712226 - DNA, 20 bp, mouse
gaggaccccagactctctga

SEQ ID NO: 712227 - DNA, 20 bp, mouse
gcggttgggggacagtaaaa

SEQ ID NO: 712228 - DNA, 20 bp, mouse
gcttgtatcgagtcgatcta

SEQ ID NO: 712229 - DNA, 20 bp, mouse
gatcgactcgatacaagttc

SEQ ID NO: 712230 - DNA, 20 bp, mouse
gtggtcagagggtaaagtcg

SEQ ID NO: 712231 - DNA, 20 bp, mouse
gagatccttcagagagtctg

SEQ ID NO: 712232 - DNA, 20 bp, mouse
gtaaaaggggtcccaggcca

SEQ ID NO: 712233 - DNA, 20 bp, mouse
gaaggggtcccaggccatgg

SEQ ID NO: 712234 - DNA, 20 bp, mouse
ggagggtaaagtcggggctg

SEQ ID NO: 712235 - DNA, 20 bp, mouse
gggacagtaaaaggggtccc

SEQ ID NO: 712236 - DNA, 20 bp, mouse
gcccactgaaaagtggtcag

SEQ ID NO: 712237 - DNA, 20 bp, mouse
gcatccatcaggaatgacta

SEQ ID NO: 712238 - DNA, 20 bp, mouse
gaacagctcccactgaaaag

SEQ ID NO: 712239 - DNA, 20 bp, mouse
gaaagtagacgatgtgcaac

SEQ ID NO: 712240 - DNA, 20 bp, mouse
gttgtctgtgtcatagagtt

SEQ ID NO: 712241 - DNA, 20 bp, mouse
gaaattccctgttctgggac

SEQ ID NO: 712242 - DNA, 20 bp, mouse
gactcagcctgtcccagaac

SEQ ID NO: 712243 - DNA, 20 bp, mouse
gttaaaccacaccatgtcct

SEQ ID NO: 712244 - DNA, 20 bp, mouse
gtttccctagtcattcctga

SEQ ID NO: 712245 - DNA, 20 bp, mouse
gttcagtgggagctgttgca

SEQ ID NO: 712246 - DNA, 20 bp, mouse
gaatcccaaagtatcttcat

SEQ ID NO: 712247 - DNA, 20 bp, mouse
gtaaagagttatcaccagtc

SEQ ID NO: 712248 - DNA, 20 bp, mouse
gcatcccatgaagatacttt

SEQ ID NO: 712249 - DNA, 20 bp, mouse
gggcctctgtctccacactg

SEQ ID NO: 712250 - DNA, 20 bp, mouse
ggttatcaccagtctgggtg

SEQ ID NO: 712251 - DNA, 20 bp, mouse
gtcagtattgttgtctattc

SEQ ID NO: 712252 - DNA, 20 bp, mouse
gtagttgattctaatttttc

SEQ ID NO: 712253 - DNA, 20 bp, mouse
ggtctgggtgtggcagctca

SEQ ID NO: 712254 - DNA, 20 bp, mouse
ggggctacatagtgtatttt

SEQ ID NO: 712255 - DNA, 20 bp, mouse
gggacactgagaagaacggg

SEQ ID NO: 712256 - DNA, 20 bp, mouse
gcaatacaaggacactgtac

SEQ ID NO: 712257 - DNA, 20 bp, mouse
ggaactaattagaacagata

SEQ ID NO: 712258 - DNA, 20 bp, mouse
gaaactacaatctcatttaa

SEQ ID NO: 712259 - DNA, 20 bp, mouse
gacaattttgcaccaataca

SEQ ID NO: 712260 - DNA, 20 bp, mouse
gaattgtttataattgtatc

SEQ ID NO: 712261 - DNA, 20 bp, mouse
gacaaggacactgtactggc

SEQ ID NO: 712262 - DNA, 20 bp, mouse
gtgtgtcaactggaaacagc

SEQ ID NO: 712263 - DNA, 20 bp, mouse
gggagggggagagcccattg

SEQ ID NO: 712264 - DNA, 20 bp, mouse
gatccctggctggtagtctt

SEQ ID NO: 712265 - DNA, 20 bp, mouse
gtcaattagtgatcaaggag

SEQ ID NO: 712266 - DNA, 20 bp, mouse
gcacacctttgaatcttgtc

SEQ ID NO: 712267 - DNA, 20 bp, mouse
gaatgccctttctttatcaa

SEQ ID NO: 712268 - DNA, 20 bp, mouse
gttaatggatgaaaccgtga

SEQ ID NO: 712269 - DNA, 20 bp, mouse
gtggggttttacttacgact

SEQ ID NO: 712270 - DNA, 20 bp, mouse
gactacattttacgcagtgg

SEQ ID NO: 712271 - DNA, 20 bp, mouse
gaacggtatggccatcgaac

SEQ ID NO: 712272 - DNA, 20 bp, mouse
gttgaccctcattgctttct

SEQ ID NO: 712273 - DNA, 20 bp, mouse
gtgtaaacagtgacggagtg

SEQ ID NO: 712274 - DNA, 20 bp, mouse
gttcactacattttacgcag

SEQ ID NO: 712275 - DNA, 20 bp, mouse
gctccgtcactgtttacagt

SEQ ID NO: 712276 - DNA, 20 bp, mouse
gaagccggcagggatttgag

SEQ ID NO: 712277 - DNA, 20 bp, mouse
ggatccccaccccaaggtgc

SEQ ID NO: 712278 - DNA, 20 bp, mouse
gggaaccggaaatgcaggtc

SEQ ID NO: 712279 - DNA, 20 bp, mouse
gggaaccgatccccacccca

SEQ ID NO: 712280 - DNA, 20 bp, mouse
gtgggcgtcaaccttgggta

SEQ ID NO: 712281 - DNA, 20 bp, mouse
ggttaccaacgtgtaaacca

SEQ ID NO: 712282 - DNA, 20 bp, mouse
gaacactgggcgtcaacctt

SEQ ID NO: 712283 - DNA, 20 bp, mouse
gctggtgtgcagcaagagtc

SEQ ID NO: 712284 - DNA, 20 bp, mouse
ggggattttaagacggtctc

SEQ ID NO: 712285 - DNA, 20 bp, mouse
gcaccagcttgggaattttc

SEQ ID NO: 712286 - DNA, 20 bp, mouse
ggctgcacaaatggagtcat

SEQ ID NO: 712287 - DNA, 20 bp, mouse
gaggtgctttggtactgaag

SEQ ID NO: 712288 - DNA, 20 bp, mouse
gtggacgaagctgttcagtt

SEQ ID NO: 712289 - DNA, 20 bp, mouse
gagtgtcaagagaactagtc

SEQ ID NO: 712290 - DNA, 20 bp, mouse
gctacattctacaaagacta

SEQ ID NO: 712291 - DNA, 20 bp, mouse
gacaagatttttaggtgctt

SEQ ID NO: 712292 - DNA, 20 bp, mouse
gttggggtaacgaagcatcg

SEQ ID NO: 712293 - DNA, 20 bp, mouse
gaaaagcgatggcgagaagc

SEQ ID NO: 712294 - DNA, 20 bp, mouse
gtaagtcacatgaagaaaga

SEQ ID NO: 712295 - DNA, 20 bp, mouse
gtgaagaaagagggacaagt

SEQ ID NO: 712296 - DNA, 20 bp, mouse
gaggctaacaagtctgcagt

SEQ ID NO: 712297 - DNA, 20 bp, mouse
gtggtcagacttggatagaa

SEQ ID NO: 712298 - DNA, 20 bp, mouse
ggatagaagggctgatatag

SEQ ID NO: 712299 - DNA, 20 bp, mouse
ggcaaaggaactgagagagc

SEQ ID NO: 712300 - DNA, 20 bp, mouse
gaaaaaaatggtgactgtcg

SEQ ID NO: 712301 - DNA, 20 bp, mouse
gcaaacagacaaggggacta

SEQ ID NO: 712302 - DNA, 20 bp, mouse
gaaagctggaatgatgtggg

SEQ ID NO: 712303 - DNA, 20 bp, mouse
gggaaccaatccatcaacag

SEQ ID NO: 712304 - DNA, 20 bp, mouse
gaggggactatggtcagact

SEQ ID NO: 712305 - DNA, 20 bp, mouse
gatgctgtaaactaaaaaaa

SEQ ID NO: 712306 - DNA, 20 bp, mouse
gtgttaacacttgtctgcac

SEQ ID NO: 712307 - DNA, 20 bp, mouse
gagggtagagcctatcacct

SEQ ID NO: 712308 - DNA, 20 bp, mouse
gtgaaaagtaagatttactt

SEQ ID NO: 712309 - DNA, 20 bp, mouse
gctttggattatatcttgaa

SEQ ID NO: 712310 - DNA, 20 bp, mouse
gtgaacgtaaaaaaggagtg

SEQ ID NO: 712311 - DNA, 20 bp, mouse
gtaagttccagcaggatagt

SEQ ID NO: 712312 - DNA, 20 bp, mouse
gctggtagtagtattttgtg

SEQ ID NO: 712313 - DNA, 20 bp, mouse
gagaaattgtaagttccagc

SEQ ID NO: 712314 - DNA, 20 bp, mouse
gtggccttgtgaactagtat

SEQ ID NO: 712315 - DNA, 20 bp, mouse
gaaaaaggagtgtggtgact

SEQ ID NO: 712316 - DNA, 20 bp, mouse
gctggagtagactacctctc

SEQ ID NO: 712317 - DNA, 20 bp, mouse
gttcctgtcgctggagtctg

SEQ ID NO: 712318 - DNA, 20 bp, mouse
gctccaaaggccaattactg

SEQ ID NO: 712319 - DNA, 20 bp, mouse
gatcgcttacagccctgcta

SEQ ID NO: 712320 - DNA, 20 bp, mouse
gtgagctggtgaccatagca

SEQ ID NO: 712321 - DNA, 20 bp, mouse
gtccagagctacaattaaca

SEQ ID NO: 712322 - DNA, 20 bp, mouse
ggactccagcgacaggaacc

SEQ ID NO: 712323 - DNA, 20 bp, mouse
ggccaattactgaggggagc

SEQ ID NO: 712324 - DNA, 20 bp, mouse
gtaggccaggttcctgtcgc

SEQ ID NO: 712325 - DNA, 20 bp, mouse
gcccagctcccctcagtaat

SEQ ID NO: 712326 - DNA, 20 bp, mouse
gcacatgtgcgcactgtcca

SEQ ID NO: 712327 - DNA, 20 bp, mouse
gaaaaacttgttactaaggg

SEQ ID NO: 712328 - DNA, 20 bp, mouse
gactatttgtttgggcatag

SEQ ID NO: 712329 - DNA, 20 bp, mouse
ggactatgagactatttgtt

SEQ ID NO: 712330 - DNA, 20 bp, mouse
gggcctagccgtccatcact

SEQ ID NO: 712331 - DNA, 20 bp, mouse
gctctcttcccagtgatgga

SEQ ID NO: 712332 - DNA, 20 bp, mouse
gcttggccctggcattcccc

SEQ ID NO: 712333 - DNA, 20 bp, mouse
gttcccagtgatggacggct

SEQ ID NO: 712334 - DNA, 20 bp, mouse
ggtccatggagaccagaaat

SEQ ID NO: 712335 - DNA, 20 bp, mouse
gaaaaaaaaacttgttacta

SEQ ID NO: 712336 - DNA, 20 bp, mouse
gaacacagatgtaggacagg

SEQ ID NO: 712337 - DNA, 20 bp, mouse
gtagtgaaggaagaccctcg

SEQ ID NO: 712338 - DNA, 20 bp, mouse
ggggataaagtccaccccga

SEQ ID NO: 712339 - DNA, 20 bp, mouse
gttaccagttaggacagtgg

SEQ ID NO: 712340 - DNA, 20 bp, mouse
gccctcaatcaagatagaaa

SEQ ID NO: 712341 - DNA, 20 bp, mouse
gtgaaggaagaccctcgggg

SEQ ID NO: 712342 - DNA, 20 bp, mouse
ggggctatgccagtactcta

SEQ ID NO: 712343 - DNA, 20 bp, mouse
ggggtcttccttcactaaag

SEQ ID NO: 712344 - DNA, 20 bp, mouse
gattcccccactgtcctaac

SEQ ID NO: 712345 - DNA, 20 bp, mouse
ggctccctccccgtacggtg

SEQ ID NO: 712346 - DNA, 20 bp, mouse
ggtggctagtggctagcatt

SEQ ID NO: 712347 - DNA, 20 bp, mouse
gaggtgtgtactattaacta

SEQ ID NO: 712348 - DNA, 20 bp, mouse
gtttctgcactgctacttta

SEQ ID NO: 712349 - DNA, 20 bp, mouse
gggcactcttgttcaacaaa

SEQ ID NO: 712350 - DNA, 20 bp, mouse
gagaaaaactgataccatgc

SEQ ID NO: 712351 - DNA, 20 bp, mouse
gaatcttgttacagcaagta

SEQ ID NO: 712352 - DNA, 20 bp, mouse
gcaaaggttatagttactga

SEQ ID NO: 712353 - DNA, 20 bp, mouse
gtactgaaggcttaaaacct

SEQ ID NO: 712354 - DNA, 20 bp, mouse
gtaacacaattgaaatatga

SEQ ID NO: 712355 - DNA, 20 bp, mouse
gaattgaaatatgagggaaa

SEQ ID NO: 712356 - DNA, 20 bp, mouse
gactaggagcagtagaggta

SEQ ID NO: 712357 - DNA, 20 bp, mouse
gggcacagctacctgaccat

SEQ ID NO: 712358 - DNA, 20 bp, mouse
gcctgaaggggcccatggtc

SEQ ID NO: 712359 - DNA, 20 bp, mouse
gcatgggccccttcaggagg

SEQ ID NO: 712360 - DNA, 20 bp, mouse
gaggggaccagagaggtagg

SEQ ID NO: 712361 - DNA, 20 bp, mouse
gaggcctcggaacttcattc

SEQ ID NO: 712362 - DNA, 20 bp, mouse
gagaggtaggcgggacgaag

SEQ ID NO: 712363 - DNA, 20 bp, mouse
gagtggggaaacaggatagc

SEQ ID NO: 712364 - DNA, 20 bp, mouse
gaggaaggaaacggaggagt

SEQ ID NO: 712365 - DNA, 20 bp, mouse
gggagcagtagaggtaggga

SEQ ID NO: 712366 - DNA, 20 bp, mouse
gatggctcaggtcatacttg

SEQ ID NO: 712367 - DNA, 20 bp, mouse
gcctgctaaagaataatgta

SEQ ID NO: 712368 - DNA, 20 bp, mouse
gatcataaaaagaaagagtg

SEQ ID NO: 712369 - DNA, 20 bp, mouse
gtatgagatcttgcctcttt

SEQ ID NO: 712370 - DNA, 20 bp, mouse
gactctaaagggtctcatct

SEQ ID NO: 712371 - DNA, 20 bp, mouse
ggtctcatctaggaagacct

SEQ ID NO: 712372 - DNA, 20 bp, mouse
gggaacagagaatttctgag

SEQ ID NO: 712373 - DNA, 20 bp, mouse
gcttcctggagtagtgggta

SEQ ID NO: 712374 - DNA, 20 bp, mouse
ggtcacgcatgaacataaca

SEQ ID NO: 712375 - DNA, 20 bp, mouse
gccaaccttcctggagtagt

SEQ ID NO: 712376 - DNA, 20 bp, mouse
gcaaactggtagagtggatg

SEQ ID NO: 712377 - DNA, 20 bp, mouse
gagtcaaagtgaggaagttt

SEQ ID NO: 712378 - DNA, 20 bp, mouse
ggaggaagtttggggtctag

SEQ ID NO: 712379 - DNA, 20 bp, mouse
gtatcaatatctcacactag

SEQ ID NO: 712380 - DNA, 20 bp, mouse
ggacaatatgagtcaaagtg

SEQ ID NO: 712381 - DNA, 20 bp, mouse
gataggacaaactggtagag

SEQ ID NO: 712382 - DNA, 20 bp, mouse
gtgaactctactgaaaactg

SEQ ID NO: 712383 - DNA, 20 bp, mouse
gacaggggagttttagttct

SEQ ID NO: 712384 - DNA, 20 bp, mouse
gcaattaaccttaagtttac

SEQ ID NO: 712385 - DNA, 20 bp, mouse
gctaggactcaaaacagtaa

SEQ ID NO: 712386 - DNA, 20 bp, mouse
gctccagggcactcccttca

SEQ ID NO: 712387 - DNA, 20 bp, mouse
gcctggacatctaccctgaa

SEQ ID NO: 712388 - DNA, 20 bp, mouse
gtcactctggctactgagtg

SEQ ID NO: 712389 - DNA, 20 bp, mouse
gacttctaggaagactgctg

SEQ ID NO: 712390 - DNA, 20 bp, mouse
gcccaaggaccagtcggcct

SEQ ID NO: 712391 - DNA, 20 bp, mouse
gtgagtgggggactgcgaag

SEQ ID NO: 712392 - DNA, 20 bp, mouse
gctgggggatgaactgggtt

SEQ ID NO: 712393 - DNA, 20 bp, mouse
gacagctctttaagtggagt

SEQ ID NO: 712394 - DNA, 20 bp, mouse
gagtgtgctacaaggacctg

SEQ ID NO: 712395 - DNA, 20 bp, mouse
gctggagaccagcagcagta

SEQ ID NO: 712396 - DNA, 20 bp, mouse
gctctgggccacattcgccc

SEQ ID NO: 712397 - DNA, 20 bp, mouse
gggtagctgcggtctgtcac

SEQ ID NO: 712398 - DNA, 20 bp, mouse
gcgacaagcccgggcgaatg

SEQ ID NO: 712399 - DNA, 20 bp, mouse
ggacacacatgtagcgacat

SEQ ID NO: 712400 - DNA, 20 bp, mouse
gcagagcttggaggtagctg

SEQ ID NO: 712401 - DNA, 20 bp, mouse
gcccacactcccgacaagcc

SEQ ID NO: 712402 - DNA, 20 bp, mouse
gctcagaattagtcccccaa

SEQ ID NO: 712403 - DNA, 20 bp, mouse
ggtctgtcactggatgagca

SEQ ID NO: 712404 - DNA, 20 bp, mouse
gaattgatccacacaccatt

SEQ ID NO: 712405 - DNA, 20 bp, mouse
gcaaaaagacaatctacatg

SEQ ID NO: 712406 - DNA, 20 bp, mouse
gtcagcacccaggaagtctt

SEQ ID NO: 712407 - DNA, 20 bp, mouse
gaaaacctctgctgagatat

SEQ ID NO: 712408 - DNA, 20 bp, mouse
gttggccaatatctcagcag

SEQ ID NO: 712409 - DNA, 20 bp, mouse
ggtaaggccttaggattgtc

SEQ ID NO: 712410 - DNA, 20 bp, mouse
gactcccactgtaaggcctt

SEQ ID NO: 712411 - DNA, 20 bp, mouse
gctggtcattggaacaccat

SEQ ID NO: 712412 - DNA, 20 bp, mouse
gttaaacccggccccatcta

SEQ ID NO: 712413 - DNA, 20 bp, mouse
gcatcaggaaggctggggcc

SEQ ID NO: 712414 - DNA, 20 bp, mouse
gcattggaacaccatgggta

SEQ ID NO: 712415 - DNA, 20 bp, mouse
ggagatgctgtgtcacatgt

SEQ ID NO: 712416 - DNA, 20 bp, mouse
gcaggcgtccgccacttcct

SEQ ID NO: 712417 - DNA, 20 bp, mouse
ggccacgcgggtacctgcgt

SEQ ID NO: 712418 - DNA, 20 bp, mouse
ggtcggggccgaggaagtgg

SEQ ID NO: 712419 - DNA, 20 bp, mouse
gcgggtacctgcgtgggctg

SEQ ID NO: 712420 - DNA, 20 bp, mouse
gaggactcactgttggatag

SEQ ID NO: 712421 - DNA, 20 bp, mouse
gggtgcgggaccgccgggga

SEQ ID NO: 712422 - DNA, 20 bp, mouse
gacctcgtcgcgcagcagag

SEQ ID NO: 712423 - DNA, 20 bp, mouse
ggggcggccgagcaccgaca

SEQ ID NO: 712424 - DNA, 20 bp, mouse
ggggcagcacgacctccgct

SEQ ID NO: 712425 - DNA, 20 bp, mouse
ggcagtgccggggactccga

SEQ ID NO: 712426 - DNA, 20 bp, mouse
gcagactcagccaactggtg

SEQ ID NO: 712427 - DNA, 20 bp, mouse
gctgattcatgtgtgttatc

SEQ ID NO: 712428 - DNA, 20 bp, mouse
gaactatgagccccaccagt

SEQ ID NO: 712429 - DNA, 20 bp, mouse
gtggggctcatagtttcttc

SEQ ID NO: 712430 - DNA, 20 bp, mouse
gatgtgtgttatctggcgag

SEQ ID NO: 712431 - DNA, 20 bp, mouse
gatgagaagttcggtttttt

SEQ ID NO: 712432 - DNA, 20 bp, mouse
gatatgtgaatgcactgtca

SEQ ID NO: 712433 - DNA, 20 bp, mouse
ggcgactgctgattcgtgtt

SEQ ID NO: 712434 - DNA, 20 bp, mouse
gcaccacccatcagagatag

SEQ ID NO: 712435 - DNA, 20 bp, mouse
gcaaaaaaagggggtggagt

SEQ ID NO: 712436 - DNA, 20 bp, mouse
gagaggaccaagttgtgcat

SEQ ID NO: 712437 - DNA, 20 bp, mouse
gagtcgaagttgattatgag

SEQ ID NO: 712438 - DNA, 20 bp, mouse
gagttgatcacgataagcaa

SEQ ID NO: 712439 - DNA, 20 bp, mouse
ggtaaagcctatgcacaact

SEQ ID NO: 712440 - DNA, 20 bp, mouse
gttattttatgcattttgag

SEQ ID NO: 712441 - DNA, 20 bp, mouse
ggtaaaacctttgcttctca

SEQ ID NO: 712442 - DNA, 20 bp, mouse
gcttacacatgtagtcaatg

SEQ ID NO: 712443 - DNA, 20 bp, mouse
gagttgattatgagaggcaa

SEQ ID NO: 712444 - DNA, 20 bp, mouse
gagttgaccatgagaagcaa

SEQ ID NO: 712445 - DNA, 20 bp, mouse
gagatcatattgacgtacaa

SEQ ID NO: 712446 - DNA, 20 bp, mouse
gtggctggaaccacgttgtt

SEQ ID NO: 712447 - DNA, 20 bp, mouse
gagccatggtctaacctgag

SEQ ID NO: 712448 - DNA, 20 bp, mouse
gaagggataagtaggagaat

SEQ ID NO: 712449 - DNA, 20 bp, mouse
gaccccaaatcacgtggaaa

SEQ ID NO: 712450 - DNA, 20 bp, mouse
gagccactcaggttagacca

SEQ ID NO: 712451 - DNA, 20 bp, mouse
gaacgtggttccagccactc

SEQ ID NO: 712452 - DNA, 20 bp, mouse
gccggggtttcccaacaacg

SEQ ID NO: 712453 - DNA, 20 bp, mouse
gagtcccagttgtcactgta

SEQ ID NO: 712454 - DNA, 20 bp, mouse
ggtcactgtaaggtgatgaa

SEQ ID NO: 712455 - DNA, 20 bp, mouse
gggctcaagagtctgagcca

SEQ ID NO: 712456 - DNA, 20 bp, mouse
gctaatgcctacatggtcat

SEQ ID NO: 712457 - DNA, 20 bp, mouse
ggctcggttcagcattgaat

SEQ ID NO: 712458 - DNA, 20 bp, mouse
gtctataattgtgatctttg

SEQ ID NO: 712459 - DNA, 20 bp, mouse
gctagcttttaataatcagt

SEQ ID NO: 712460 - DNA, 20 bp, mouse
ggagcaattggcttcagacc

SEQ ID NO: 712461 - DNA, 20 bp, mouse
gagcacattcgtgttcatgg

SEQ ID NO: 712462 - DNA, 20 bp, mouse
gcaatgctgaaccgagcaat

SEQ ID NO: 712463 - DNA, 20 bp, mouse
gtgtcttctaggtctggatg

SEQ ID NO: 712464 - DNA, 20 bp, mouse
gtaaaaatgcttcaaaaata

SEQ ID NO: 712465 - DNA, 20 bp, mouse
gtgtatcactaatgcctaca

SEQ ID NO: 712466 - DNA, 20 bp, mouse
gttaacagatgactaaagtg

SEQ ID NO: 712467 - DNA, 20 bp, mouse
gttaactggcttctatgctt

SEQ ID NO: 712468 - DNA, 20 bp, mouse
gtctgtggcactaatttaac

SEQ ID NO: 712469 - DNA, 20 bp, mouse
gctgaaagactaggtggact

SEQ ID NO: 712470 - DNA, 20 bp, mouse
gtaggcaatgctgaaagact

SEQ ID NO: 712471 - DNA, 20 bp, mouse
gtgttaagttacagggtaat

SEQ ID NO: 712472 - DNA, 20 bp, mouse
gagaacatactgtagtcagt

SEQ ID NO: 712473 - DNA, 20 bp, mouse
gattctgtgtagctaactct

SEQ ID NO: 712474 - DNA, 20 bp, mouse
gccctggggttccctcaagt

SEQ ID NO: 712475 - DNA, 20 bp, mouse
gtagtcagtaggttgagagg

SEQ ID NO: 712476 - DNA, 20 bp, mouse
ggcaggttgtaggcaggtta

SEQ ID NO: 712477 - DNA, 20 bp, mouse
gaaggcaaatcactcaatta

SEQ ID NO: 712478 - DNA, 20 bp, mouse
gatgtgagagacaacggcag

SEQ ID NO: 712479 - DNA, 20 bp, mouse
gcctgcctacaacctgctaa

SEQ ID NO: 712480 - DNA, 20 bp, mouse
gcactgtaagcaggtgtttt

SEQ ID NO: 712481 - DNA, 20 bp, mouse
gtctacgatgtgagagacaa

SEQ ID NO: 712482 - DNA, 20 bp, mouse
gtttgcctttagcaggttgt

SEQ ID NO: 712483 - DNA, 20 bp, mouse
gtgagtgatttgcctttagc

SEQ ID NO: 712484 - DNA, 20 bp, mouse
gttgaggctcatccatgata

SEQ ID NO: 712485 - DNA, 20 bp, mouse
gacacctgcttacagtggac

SEQ ID NO: 712486 - DNA, 20 bp, mouse
gaacctgtatagacctagag

SEQ ID NO: 712487 - DNA, 20 bp, mouse
gaacccctctaggtctatac

SEQ ID NO: 712488 - DNA, 20 bp, mouse
gtggtagcagaggtggtaag

SEQ ID NO: 712489 - DNA, 20 bp, mouse
gaggggtttgttgtaacaaa

SEQ ID NO: 712490 - DNA, 20 bp, mouse
gttgttgattggcagctcac

SEQ ID NO: 712491 - DNA, 20 bp, mouse
gttggggcacagctggactg

SEQ ID NO: 712492 - DNA, 20 bp, mouse
gtaggatataagggctcctg

SEQ ID NO: 712493 - DNA, 20 bp, mouse
gccagctgtgccccaagtcc

SEQ ID NO: 712494 - DNA, 20 bp, mouse
gagcttctgtgaatggaatt

SEQ ID NO: 712495 - DNA, 20 bp, mouse
ggtggttggctcttcttggt

SEQ ID NO: 712496 - DNA, 20 bp, mouse
gagatcactcacagagtggg

SEQ ID NO: 712497 - DNA, 20 bp, mouse
gagcaaactgggatgttgaa

SEQ ID NO: 712498 - DNA, 20 bp, mouse
ggaaacaatcccaggttcaa

SEQ ID NO: 712499 - DNA, 20 bp, mouse
gggctcttcctgtggagagt

SEQ ID NO: 712500 - DNA, 20 bp, mouse
gtcccaggttcaagggatgg

SEQ ID NO: 712501 - DNA, 20 bp, mouse
gtacatgtgtgccatgcact

SEQ ID NO: 712502 - DNA, 20 bp, mouse
ggagcctaccagcaataaat

SEQ ID NO: 712503 - DNA, 20 bp, mouse
gctcctccatcccttgaacc

SEQ ID NO: 712504 - DNA, 20 bp, mouse
gagtttgctaaaagggtgag

SEQ ID NO: 712505 - DNA, 20 bp, mouse
gggttgctcaatatgatatg

SEQ ID NO: 712506 - DNA, 20 bp, mouse
gaaaaggcagacattctcca

SEQ ID NO: 712507 - DNA, 20 bp, mouse
gtctagaaaaggaccctgtt

SEQ ID NO: 712508 - DNA, 20 bp, mouse
gtgacagtccagagggtaat

SEQ ID NO: 712509 - DNA, 20 bp, mouse
gagggaacaatcttttactt

SEQ ID NO: 712510 - DNA, 20 bp, mouse
gacatctctctagcccaaca

SEQ ID NO: 712511 - DNA, 20 bp, mouse
gaaagaggaggacctgtgcc

SEQ ID NO: 712512 - DNA, 20 bp, mouse
gcaaagtgaggaggagggac

SEQ ID NO: 712513 - DNA, 20 bp, mouse
ggagagattgacagtccaga

SEQ ID NO: 712514 - DNA, 20 bp, mouse
gtcaaaaggcattttaggaa

SEQ ID NO: 712515 - DNA, 20 bp, mouse
gagaccccaatttctgatca

SEQ ID NO: 712516 - DNA, 20 bp, mouse
gtgatctgacctagtcaaac

SEQ ID NO: 712517 - DNA, 20 bp, mouse
gtgggtgtatatgtataggc

SEQ ID NO: 712518 - DNA, 20 bp, mouse
gagactgggtgtatatgtat

SEQ ID NO: 712519 - DNA, 20 bp, mouse
gggtgcatgcctgtttgact

SEQ ID NO: 712520 - DNA, 20 bp, mouse
gggcatctgcggttgtctcc

SEQ ID NO: 712521 - DNA, 20 bp, mouse
gctgacagtccagatctccc

SEQ ID NO: 712522 - DNA, 20 bp, mouse
gtggtacaaattcttatatg

SEQ ID NO: 712523 - DNA, 20 bp, mouse
gtaagactgggtgtgcagcc

SEQ ID NO: 712524 - DNA, 20 bp, mouse
gatctggactgtcagctcta

SEQ ID NO: 712525 - DNA, 20 bp, mouse
gagggaggaagtataaagaa

SEQ ID NO: 712526 - DNA, 20 bp, mouse
gtaggatagccagcctctag

SEQ ID NO: 712527 - DNA, 20 bp, mouse
gtctgagagactaccatagt

SEQ ID NO: 712528 - DNA, 20 bp, mouse
ggaggctggctatcctacta

SEQ ID NO: 712529 - DNA, 20 bp, mouse
gtttctaggtactgaaatat

SEQ ID NO: 712530 - DNA, 20 bp, mouse
ggtgtttagtcatctctctt

SEQ ID NO: 712531 - DNA, 20 bp, mouse
gagattgaaaagaacatctc

SEQ ID NO: 712532 - DNA, 20 bp, mouse
gtgtaatatacctgaagcat

SEQ ID NO: 712533 - DNA, 20 bp, mouse
gaaaatatagaagcacaaac

SEQ ID NO: 712534 - DNA, 20 bp, mouse
gattccttttcctatgcttc

SEQ ID NO: 712535 - DNA, 20 bp, mouse
ggacaatatgtctccactag

SEQ ID NO: 712536 - DNA, 20 bp, mouse
gggaaccccaagggccttat

SEQ ID NO: 712537 - DNA, 20 bp, mouse
gtccacccataaggcccttg

SEQ ID NO: 712538 - DNA, 20 bp, mouse
ggaactacctaggaacccca

SEQ ID NO: 712539 - DNA, 20 bp, mouse
gaaggtgtaccccagctggt

SEQ ID NO: 712540 - DNA, 20 bp, mouse
gaccccaagggccttatggg

SEQ ID NO: 712541 - DNA, 20 bp, mouse
ggggagactgaagaggggta

SEQ ID NO: 712542 - DNA, 20 bp, mouse
gtggtgggttaacccctagg

SEQ ID NO: 712543 - DNA, 20 bp, mouse
ggctctctagtgaactacct

SEQ ID NO: 712544 - DNA, 20 bp, mouse
ggactgtattccctgggcaa

SEQ ID NO: 712545 - DNA, 20 bp, mouse
gatctgcaggccagtgttct

SEQ ID NO: 712546 - DNA, 20 bp, mouse
gtaaagatacatgactcacc

SEQ ID NO: 712547 - DNA, 20 bp, mouse
gatggcccttccttaagtag

SEQ ID NO: 712548 - DNA, 20 bp, mouse
gggtatgttgccagtgtggg

SEQ ID NO: 712549 - DNA, 20 bp, mouse
gtactttgagatttgcttct

SEQ ID NO: 712550 - DNA, 20 bp, mouse
gtactgatggtaagattacc

SEQ ID NO: 712551 - DNA, 20 bp, mouse
ggctgcctgaggacatcttt

SEQ ID NO: 712552 - DNA, 20 bp, mouse
gtagaaagtcctaaacaatc

SEQ ID NO: 712553 - DNA, 20 bp, mouse
ggctgtgagtggtactatca

SEQ ID NO: 712554 - DNA, 20 bp, mouse
gtttagtgccacctgaaaca

SEQ ID NO: 712555 - DNA, 20 bp, mouse
gtttccctctacttaaggaa

SEQ ID NO: 712556 - DNA, 20 bp, mouse
gtccagcttgttagactcga

SEQ ID NO: 712557 - DNA, 20 bp, mouse
gtccctcgagtctaacaagc

SEQ ID NO: 712558 - DNA, 20 bp, mouse
gaccccttgccacttgcaac

SEQ ID NO: 712559 - DNA, 20 bp, mouse
ggcaactggctttatggagc

SEQ ID NO: 712560 - DNA, 20 bp, mouse
gaagccagttgcaagtggca

SEQ ID NO: 712561 - DNA, 20 bp, mouse
gacatcacaaatctttgatt

SEQ ID NO: 712562 - DNA, 20 bp, mouse
gacacacttaaacagtcttc

SEQ ID NO: 712563 - DNA, 20 bp, mouse
gctggagtccttagtacctc

SEQ ID NO: 712564 - DNA, 20 bp, mouse
gccacttgcaactggcttta

SEQ ID NO: 712565 - DNA, 20 bp, mouse
gatttagtcccgaggtacta

SEQ ID NO: 712566 - DNA, 20 bp, mouse
gccatggccaatgatggggt

SEQ ID NO: 712567 - DNA, 20 bp, mouse
gtgatacacgggaattaggt

SEQ ID NO: 712568 - DNA, 20 bp, mouse
gtgtcatcggacagaatctg

SEQ ID NO: 712569 - DNA, 20 bp, mouse
gagagtccatggccaatgat

SEQ ID NO: 712570 - DNA, 20 bp, mouse
ggtagagacgaaaaatgggg

SEQ ID NO: 712571 - DNA, 20 bp, mouse
ggttgcagagtaagagtcca

SEQ ID NO: 712572 - DNA, 20 bp, mouse
gtgcctgagtcatggtgctt

SEQ ID NO: 712573 - DNA, 20 bp, mouse
gttggtagaacatttgagga

SEQ ID NO: 712574 - DNA, 20 bp, mouse
ggaccaaagcaccatgactc

SEQ ID NO: 712575 - DNA, 20 bp, mouse
ggtaggtagagacgaaaaat

SEQ ID NO: 712576 - DNA, 20 bp, mouse
gaaatggtgactttaggggc

SEQ ID NO: 712577 - DNA, 20 bp, mouse
gatactctaccacaccatac

SEQ ID NO: 712578 - DNA, 20 bp, mouse
gtgaagataggatctcagtc

SEQ ID NO: 712579 - DNA, 20 bp, mouse
gcagctcttcctgtatggtg

SEQ ID NO: 712580 - DNA, 20 bp, mouse
gaatagtgcagcttcttctt

SEQ ID NO: 712581 - DNA, 20 bp, mouse
gtgaagctgagtcagacaaa

SEQ ID NO: 712582 - DNA, 20 bp, mouse
gagacaaatggtgactttag

SEQ ID NO: 712583 - DNA, 20 bp, mouse
gtacaattagttttcagagg

SEQ ID NO: 712584 - DNA, 20 bp, mouse
ggaaatcagctcttcctgta

SEQ ID NO: 712585 - DNA, 20 bp, mouse
gttgatttgtgtctcaatgt

SEQ ID NO: 712586 - DNA, 20 bp, mouse
ggagtgttggtatcttataa

SEQ ID NO: 712587 - DNA, 20 bp, mouse
gctctgagaaaagagagcat

SEQ ID NO: 712588 - DNA, 20 bp, mouse
gcctcaactgttggacattg

SEQ ID NO: 712589 - DNA, 20 bp, mouse
ggagagagagattgtaacca

SEQ ID NO: 712590 - DNA, 20 bp, mouse
gtgaacattcataacctgtt

SEQ ID NO: 712591 - DNA, 20 bp, mouse
gtcatcaaggtttagtgcct

SEQ ID NO: 712592 - DNA, 20 bp, mouse
gaatgcattaattgccaaac

SEQ ID NO: 712593 - DNA, 20 bp, mouse
gctgttggacattgcggcta

SEQ ID NO: 712594 - DNA, 20 bp, mouse
ggtaactctgataaagattt

SEQ ID NO: 712595 - DNA, 20 bp, mouse
gtttatacaggtacaaatta

SEQ ID NO: 712596 - DNA, 20 bp, mouse
gacaatcctaacatcagtag

SEQ ID NO: 712597 - DNA, 20 bp, mouse
ggcagttactggtttggatg

SEQ ID NO: 712598 - DNA, 20 bp, mouse
gctttctgattgttataagt

SEQ ID NO: 712599 - DNA, 20 bp, mouse
ggagttatgtcaaaatgttt

SEQ ID NO: 712600 - DNA, 20 bp, mouse
gacataactctaatcaagcc

SEQ ID NO: 712601 - DNA, 20 bp, mouse
gactgtcaataggaaaaaat

SEQ ID NO: 712602 - DNA, 20 bp, mouse
gaaggcaaataactgtcaat

SEQ ID NO: 712603 - DNA, 20 bp, mouse
ggacaagaacatcaagtctc

SEQ ID NO: 712604 - DNA, 20 bp, mouse
gttcagttttatgaggtccc

SEQ ID NO: 712605 - DNA, 20 bp, mouse
gacactcctctactgatgtt

SEQ ID NO: 712606 - DNA, 20 bp, mouse
gcaaggttgctaagggtgga

SEQ ID NO: 712607 - DNA, 20 bp, mouse
gacaactaacattggtatac

SEQ ID NO: 712608 - DNA, 20 bp, mouse
gaaatatgtacaactaacat

SEQ ID NO: 712609 - DNA, 20 bp, mouse
gagattttcaaggttgctaa

SEQ ID NO: 712610 - DNA, 20 bp, mouse
gaatttccagtgaggaaata

SEQ ID NO: 712611 - DNA, 20 bp, mouse
ggccactatgatgtggtagt

SEQ ID NO: 712612 - DNA, 20 bp, mouse
gttttcaaggttgctaaggg

SEQ ID NO: 712613 - DNA, 20 bp, mouse
gcgaacttcgaaatgtgata

SEQ ID NO: 712614 - DNA, 20 bp, mouse
gaccaactaccacatcatag

SEQ ID NO: 712615 - DNA, 20 bp, mouse
gagtggctaaatttccagtg

SEQ ID NO: 712616 - DNA, 20 bp, mouse
ggggccctctccaaaaagtg

SEQ ID NO: 712617 - DNA, 20 bp, mouse
gctgccttagggtaggatga

SEQ ID NO: 712618 - DNA, 20 bp, mouse
gctgccttcatcctacccta

SEQ ID NO: 712619 - DNA, 20 bp, mouse
gtcccccagtggattaagga

SEQ ID NO: 712620 - DNA, 20 bp, mouse
gcataggtgtgcagttcaca

SEQ ID NO: 712621 - DNA, 20 bp, mouse
gggcccatccttaatccact

SEQ ID NO: 712622 - DNA, 20 bp, mouse
ggggaagtaactctgcctta

SEQ ID NO: 712623 - DNA, 20 bp, mouse
gagtaactctgccttagggt

SEQ ID NO: 712624 - DNA, 20 bp, mouse
ggagcctggcacctttgcat

SEQ ID NO: 712625 - DNA, 20 bp, mouse
gcaggagttactcagtgagg

SEQ ID NO: 712626 - DNA, 20 bp, mouse
gaatggagaggggatcccgg

SEQ ID NO: 712627 - DNA, 20 bp, mouse
ggggtctgggctcccttggc

SEQ ID NO: 712628 - DNA, 20 bp, mouse
gtagcactcctaatggagag

SEQ ID NO: 712629 - DNA, 20 bp, mouse
ggatccaattaccctgccaa

SEQ ID NO: 712630 - DNA, 20 bp, mouse
ggagtgctagccaaggtccc

SEQ ID NO: 712631 - DNA, 20 bp, mouse
ggacagtgttggccaggggt

SEQ ID NO: 712632 - DNA, 20 bp, mouse
ggccaacactgtctcccacc

SEQ ID NO: 712633 - DNA, 20 bp, mouse
gaggacatttacaagcaggg

SEQ ID NO: 712634 - DNA, 20 bp, mouse
gtctggttcctggagagtgc

SEQ ID NO: 712635 - DNA, 20 bp, mouse
gccttggctagcactcctaa

SEQ ID NO: 712636 - DNA, 20 bp, mouse
gcgctcccccaggctctcat

SEQ ID NO: 712637 - DNA, 20 bp, mouse
ggacctcgagggctgtcgag

SEQ ID NO: 712638 - DNA, 20 bp, mouse
gaggctagcgggatacgaga

SEQ ID NO: 712639 - DNA, 20 bp, mouse
gggaagagccagatctgtag

SEQ ID NO: 712640 - DNA, 20 bp, mouse
gggggagcgccctgacctcg

SEQ ID NO: 712641 - DNA, 20 bp, mouse
gtcgagaggcggagaggatg

SEQ ID NO: 712642 - DNA, 20 bp, mouse
gctaaaatggggtaggagta

SEQ ID NO: 712643 - DNA, 20 bp, mouse
ggaggactcgagcctggcgg

SEQ ID NO: 712644 - DNA, 20 bp, mouse
gaggggagcctggcagccaa

SEQ ID NO: 712645 - DNA, 20 bp, mouse
gatacgagagggcgtgagaa

SEQ ID NO: 712646 - DNA, 20 bp, mouse
ggtcctgggtaaccacagtt

SEQ ID NO: 712647 - DNA, 20 bp, mouse
gggaggaggagggaccacga

SEQ ID NO: 712648 - DNA, 20 bp, mouse
gtgaagtgtactggatggag

SEQ ID NO: 712649 - DNA, 20 bp, mouse
gggagaaggctgtttcttag

SEQ ID NO: 712650 - DNA, 20 bp, mouse
gtggagaaggatctgaggtc

SEQ ID NO: 712651 - DNA, 20 bp, mouse
gccagcgactatccaaactg

SEQ ID NO: 712652 - DNA, 20 bp, mouse
gtacgcaggacagatggcaa

SEQ ID NO: 712653 - DNA, 20 bp, mouse
gtaaggaggatctggtgcat

SEQ ID NO: 712654 - DNA, 20 bp, mouse
ggaggagggaccacgagggc

SEQ ID NO: 712655 - DNA, 20 bp, mouse
gaaggaagagcaactggagg

SEQ ID NO: 712656 - DNA, 20 bp, mouse
ggtgtcacatggtcactctc

SEQ ID NO: 712657 - DNA, 20 bp, mouse
gggcaggaggagaagttcac

SEQ ID NO: 712658 - DNA, 20 bp, mouse
gcactgcaggctggagataa

SEQ ID NO: 712659 - DNA, 20 bp, mouse
gactgtctgcaggaacagaa

SEQ ID NO: 712660 - DNA, 20 bp, mouse
gccatgggaaccatgtctga

SEQ ID NO: 712661 - DNA, 20 bp, mouse
gagggaccggctgaatccga

SEQ ID NO: 712662 - DNA, 20 bp, mouse
gcatggaagggcatgacaat

SEQ ID NO: 712663 - DNA, 20 bp, mouse
gacccaatcaaggtgtcaca

SEQ ID NO: 712664 - DNA, 20 bp, mouse
gtcaggataaggatgtgcct

SEQ ID NO: 712665 - DNA, 20 bp, mouse
gaagggtggtcactgtctgc

SEQ ID NO: 712666 - DNA, 20 bp, mouse
ggaaaataaaacccggtctg

SEQ ID NO: 712667 - DNA, 20 bp, mouse
gggggtggctacagcatcca

SEQ ID NO: 712668 - DNA, 20 bp, mouse
ggcagaggggaggcagtgga

SEQ ID NO: 712669 - DNA, 20 bp, mouse
gtaaaacccggtctgggggg

SEQ ID NO: 712670 - DNA, 20 bp, mouse
gtcctggggtgacctagcgt

SEQ ID NO: 712671 - DNA, 20 bp, mouse
gtaccacaagggtaggacaa

SEQ ID NO: 712672 - DNA, 20 bp, mouse
gagcgtggggctgaccgtga

SEQ ID NO: 712673 - DNA, 20 bp, mouse
ggtaggacaaaggactgtgt

SEQ ID NO: 712674 - DNA, 20 bp, mouse
gcccagctgtttatgttaaa

SEQ ID NO: 712675 - DNA, 20 bp, mouse
gctaaaaaaaaggagggcga

SEQ ID NO: 712676 - DNA, 20 bp, mouse
gagagagcaaggcggtaaaa

SEQ ID NO: 712677 - DNA, 20 bp, mouse
ggaaaggaagtcatgacgaa

SEQ ID NO: 712678 - DNA, 20 bp, mouse
gaaaaactcaagagaggttg

SEQ ID NO: 712679 - DNA, 20 bp, mouse
gtaagatgaaaaggcgagaa

SEQ ID NO: 712680 - DNA, 20 bp, mouse
gctagttctcactctctgta

SEQ ID NO: 712681 - DNA, 20 bp, mouse
gattagccaatcaagtaatt

SEQ ID NO: 712682 - DNA, 20 bp, mouse
gaccctgcctggggagagga

SEQ ID NO: 712683 - DNA, 20 bp, mouse
gagctgggagagtccctaat

SEQ ID NO: 712684 - DNA, 20 bp, mouse
ggcaagaaggtgcaggatgt

SEQ ID NO: 712685 - DNA, 20 bp, mouse
gacgacaagaagccaatcgc

SEQ ID NO: 712686 - DNA, 20 bp, mouse
gcaatactggccacacccca

SEQ ID NO: 712687 - DNA, 20 bp, mouse
gtcaggcaactatatggaat

SEQ ID NO: 712688 - DNA, 20 bp, mouse
gaccccatggcttgtgccaa

SEQ ID NO: 712689 - DNA, 20 bp, mouse
gagaagagacgagcttctac

SEQ ID NO: 712690 - DNA, 20 bp, mouse
gtcctttggcacaagccatg

SEQ ID NO: 712691 - DNA, 20 bp, mouse
gctcttcttcatatctcctt

SEQ ID NO: 712692 - DNA, 20 bp, mouse
gtgaagtatcaccagctaaa

SEQ ID NO: 712693 - DNA, 20 bp, mouse
gtgttgcttctacatgcaga

SEQ ID NO: 712694 - DNA, 20 bp, mouse
gtaaaataccacaatttcga

SEQ ID NO: 712695 - DNA, 20 bp, mouse
gttcaatttttctataaaca

SEQ ID NO: 712696 - DNA, 20 bp, mouse
gagtataaaaatctaggcga

SEQ ID NO: 712697 - DNA, 20 bp, mouse
ggttccatgtccatgccctc

SEQ ID NO: 712698 - DNA, 20 bp, mouse
ggggtacttgagaataatca

SEQ ID NO: 712699 - DNA, 20 bp, mouse
ggtgttttgagcatctcttg

SEQ ID NO: 712700 - DNA, 20 bp, mouse
gtcaagtacccactgaagag

SEQ ID NO: 712701 - DNA, 20 bp, mouse
ggattcggttccagagggca

SEQ ID NO: 712702 - DNA, 20 bp, mouse
gcaccccaaggagaaaggcc

SEQ ID NO: 712703 - DNA, 20 bp, mouse
gcaatagagtataaaaatct

SEQ ID NO: 712704 - DNA, 20 bp, mouse
gtgctgaaaacttgatcttt

SEQ ID NO: 712705 - DNA, 20 bp, mouse
gacctggcgcgtaagttccc

SEQ ID NO: 712706 - DNA, 20 bp, mouse
gggccaaaagagtcttgaaa

SEQ ID NO: 712707 - DNA, 20 bp, mouse
gggtgaccttcccacaacga

SEQ ID NO: 712708 - DNA, 20 bp, mouse
gtcccacaacgacggttcaa

SEQ ID NO: 712709 - DNA, 20 bp, mouse
gaggccttaagctgtcccaa

SEQ ID NO: 712710 - DNA, 20 bp, mouse
gtgcaacttcagactccaga

SEQ ID NO: 712711 - DNA, 20 bp, mouse
gaaatggggtgttcagagca

SEQ ID NO: 712712 - DNA, 20 bp, mouse
gtgctggtctatcgttagga

SEQ ID NO: 712713 - DNA, 20 bp, mouse
ggcccttttcaagactcttt

SEQ ID NO: 712714 - DNA, 20 bp, mouse
gaggcctgaaatgtggtaaa

SEQ ID NO: 712715 - DNA, 20 bp, mouse
gagccattgaaccgtcgttg

SEQ ID NO: 712716 - DNA, 20 bp, mouse
gttaactcaggaccttcaaa

SEQ ID NO: 712717 - DNA, 20 bp, mouse
gatggttgtgagcatctatg

SEQ ID NO: 712718 - DNA, 20 bp, mouse
ggattttgtgattttaactc

SEQ ID NO: 712719 - DNA, 20 bp, mouse
gaggtgtgtcattgtagaga

SEQ ID NO: 712720 - DNA, 20 bp, mouse
gagcaaggtgtggtattatt

SEQ ID NO: 712721 - DNA, 20 bp, mouse
ggatgtagggttgattgaaa

SEQ ID NO: 712722 - DNA, 20 bp, mouse
gggaaatcagaaacacatag

SEQ ID NO: 712723 - DNA, 20 bp, mouse
gtgattgaaagggatggtgc

SEQ ID NO: 712724 - DNA, 20 bp, mouse
gaacacatagaggaaaacct

SEQ ID NO: 712725 - DNA, 20 bp, mouse
gtagggttgattgaaaggga

SEQ ID NO: 712726 - DNA, 20 bp, mouse
ggcacccatcctaaaactgt

SEQ ID NO: 712727 - DNA, 20 bp, mouse
gagttccaacagttttagga

SEQ ID NO: 712728 - DNA, 20 bp, mouse
gactcagttccaacagtttt

SEQ ID NO: 712729 - DNA, 20 bp, mouse
gaatgcattggccagtatgc

SEQ ID NO: 712730 - DNA, 20 bp, mouse
gaaaataaaacttgtaaaat

SEQ ID NO: 712731 - DNA, 20 bp, mouse
gttgtaaaataggttttcat

SEQ ID NO: 712732 - DNA, 20 bp, mouse
gattggccagtatgcaggag

SEQ ID NO: 712733 - DNA, 20 bp, mouse
gggcagacactgactgacag

SEQ ID NO: 712734 - DNA, 20 bp, mouse
gtgcttagggagcagcagga

SEQ ID NO: 712735 - DNA, 20 bp, mouse
gcagtagtgacaaaatgcac

SEQ ID NO: 712736 - DNA, 20 bp, mouse
gtgactggccacaattccct

SEQ ID NO: 712737 - DNA, 20 bp, mouse
gtcacaggaggctggaaaaa

SEQ ID NO: 712738 - DNA, 20 bp, mouse
gtagtccaggacacaaacca

SEQ ID NO: 712739 - DNA, 20 bp, mouse
gctagataagtgtagagaag

SEQ ID NO: 712740 - DNA, 20 bp, mouse
gaggcattctactatgggaa

SEQ ID NO: 712741 - DNA, 20 bp, mouse
gtgtgacctacactcaatgt

SEQ ID NO: 712742 - DNA, 20 bp, mouse
gaatcctcacaattagatgc

SEQ ID NO: 712743 - DNA, 20 bp, mouse
gattcccttggtttgtgtcc

SEQ ID NO: 712744 - DNA, 20 bp, mouse
gattgtggccagtcatattc

SEQ ID NO: 712745 - DNA, 20 bp, mouse
ggccccagcatctaattgtg

SEQ ID NO: 712746 - DNA, 20 bp, mouse
ggggctgcaaggtggagttc

SEQ ID NO: 712747 - DNA, 20 bp, mouse
gccaggcgagggcgtgagga

SEQ ID NO: 712748 - DNA, 20 bp, mouse
ggcaaggtggagttccggag

SEQ ID NO: 712749 - DNA, 20 bp, mouse
ggggcggctgctccaggcga

SEQ ID NO: 712750 - DNA, 20 bp, mouse
ggagcgcgctccatagggta

SEQ ID NO: 712751 - DNA, 20 bp, mouse
gtgctccaggcgagggcgtg

SEQ ID NO: 712752 - DNA, 20 bp, mouse
gactccaccttgcagcccca

SEQ ID NO: 712753 - DNA, 20 bp, mouse
gcagaagagcgcgctccata

SEQ ID NO: 712754 - DNA, 20 bp, mouse
gacgccgcctggctctcccg

SEQ ID NO: 712755 - DNA, 20 bp, mouse
gctggggacagaagggtcgc

SEQ ID NO: 712756 - DNA, 20 bp, mouse
ggtaggggagaaacagaaga

SEQ ID NO: 712757 - DNA, 20 bp, mouse
gccggtccccgcttcttctg

SEQ ID NO: 712758 - DNA, 20 bp, mouse
gcccgcttcttctggggagt

SEQ ID NO: 712759 - DNA, 20 bp, mouse
gcggcggtgtaccgctaaaa

SEQ ID NO: 712760 - DNA, 20 bp, mouse
gaagatggccgccagacagg

SEQ ID NO: 712761 - DNA, 20 bp, mouse
gggagtcggatgtcattcta

SEQ ID NO: 712762 - DNA, 20 bp, mouse
gaagggaaggtggaatgaca

SEQ ID NO: 712763 - DNA, 20 bp, mouse
gtaaaagggctcccctgaat

SEQ ID NO: 712764 - DNA, 20 bp, mouse
ggagtcacaggcagccgtag

SEQ ID NO: 712765 - DNA, 20 bp, mouse
gtgctcgcacggaacctttt

SEQ ID NO: 712766 - DNA, 20 bp, mouse
gcagctattgagttgaaaag

SEQ ID NO: 712767 - DNA, 20 bp, mouse
gctagtgttccttaaacaca

SEQ ID NO: 712768 - DNA, 20 bp, mouse
gtggccgataatctcaaaca

SEQ ID NO: 712769 - DNA, 20 bp, mouse
gctgggcgctggtggcccat

SEQ ID NO: 712770 - DNA, 20 bp, mouse
ggcgctttccccagatcttc

SEQ ID NO: 712771 - DNA, 20 bp, mouse
gtacagcctgtcactgatac

SEQ ID NO: 712772 - DNA, 20 bp, mouse
gtcaaagagtttgatagctc

SEQ ID NO: 712773 - DNA, 20 bp, mouse
ggcttctgattcctcacgag

SEQ ID NO: 712774 - DNA, 20 bp, mouse
gaatggagcaacccctcgtg

SEQ ID NO: 712775 - DNA, 20 bp, mouse
gaaagttctttctttcaaga

SEQ ID NO: 712776 - DNA, 20 bp, mouse
ggggttgaaaaaggtataga

SEQ ID NO: 712777 - DNA, 20 bp, mouse
gtacatctctgggttgaaaa

SEQ ID NO: 712778 - DNA, 20 bp, mouse
ggcttggcacgtagggaaaa

SEQ ID NO: 712779 - DNA, 20 bp, mouse
ggatgtaggtaagagactca

SEQ ID NO: 712780 - DNA, 20 bp, mouse
gaagatatgcttggcacgta

SEQ ID NO: 712781 - DNA, 20 bp, mouse
gggtatagaaggaaatctcc

SEQ ID NO: 712782 - DNA, 20 bp, mouse
ggtctcttacctacatctct

SEQ ID NO: 712783 - DNA, 20 bp, mouse
gagacgtggttatcctgcat

SEQ ID NO: 712784 - DNA, 20 bp, mouse
gcagaaaattgaattaattg

SEQ ID NO: 712785 - DNA, 20 bp, mouse
gagtttacataataaatttt

SEQ ID NO: 712786 - DNA, 20 bp, mouse
ggtaaaagggtggcaggaaa

SEQ ID NO: 712787 - DNA, 20 bp, mouse
gtaggactggggagaattcc

SEQ ID NO: 712788 - DNA, 20 bp, mouse
gccagctgagaatctataat

SEQ ID NO: 712789 - DNA, 20 bp, mouse
gcatgaacagaaagtactta

SEQ ID NO: 712790 - DNA, 20 bp, mouse
gttaaggaaagaatatttgg

SEQ ID NO: 712791 - DNA, 20 bp, mouse
gcccagccaagaatagcaaa

SEQ ID NO: 712792 - DNA, 20 bp, mouse
gctattcttggctgggtaca

SEQ ID NO: 712793 - DNA, 20 bp, mouse
ggaatctataataggatgtg

SEQ ID NO: 712794 - DNA, 20 bp, mouse
ggccatttgctattcttggc

SEQ ID NO: 712795 - DNA, 20 bp, mouse
gtcaaatgagagacagggag

SEQ ID NO: 712796 - DNA, 20 bp, mouse
gagacactgctctcaagatg

SEQ ID NO: 712797 - DNA, 20 bp, mouse
gagtctggtccagagttata

SEQ ID NO: 712798 - DNA, 20 bp, mouse
gactctctgccacgtctgaa

SEQ ID NO: 712799 - DNA, 20 bp, mouse
ggtttcacaccattcagacg

SEQ ID NO: 712800 - DNA, 20 bp, mouse
gcattgactgcttattatca

SEQ ID NO: 712801 - DNA, 20 bp, mouse
gtgaatggtgtgaaactaca

SEQ ID NO: 712802 - DNA, 20 bp, mouse
gctgcttattatcaaggtgt

SEQ ID NO: 712803 - DNA, 20 bp, mouse
gaaatctcatgatttaacac

SEQ ID NO: 712804 - DNA, 20 bp, mouse
gcagtattagattattgctc

SEQ ID NO: 712805 - DNA, 20 bp, mouse
ggtttgcagcacactttact

SEQ ID NO: 712806 - DNA, 20 bp, mouse
gcagttctgtcccacagctc

SEQ ID NO: 712807 - DNA, 20 bp, mouse
gggggtggatgcggggtgat

SEQ ID NO: 712808 - DNA, 20 bp, mouse
ggtgatcatcagggcaagaa

SEQ ID NO: 712809 - DNA, 20 bp, mouse
gacagctgcttgggcgggag

SEQ ID NO: 712810 - DNA, 20 bp, mouse
gagactgaggcttgagcgga

SEQ ID NO: 712811 - DNA, 20 bp, mouse
gtgtgggacagaactgcgca

SEQ ID NO: 712812 - DNA, 20 bp, mouse
gcccctccctccgtgcataa

SEQ ID NO: 712813 - DNA, 20 bp, mouse
gcaaccttataggggggcgg

SEQ ID NO: 712814 - DNA, 20 bp, mouse
gtggactgcgcaaacacaag

SEQ ID NO: 712815 - DNA, 20 bp, mouse
ggatcccagcaacagtccgg

SEQ ID NO: 712816 - DNA, 20 bp, mouse
gaactcgcgtaccgcgctgg

SEQ ID NO: 712817 - DNA, 20 bp, mouse
gcagctggacgcggaaggca

SEQ ID NO: 712818 - DNA, 20 bp, mouse
gggacgcagctggacgcgga

SEQ ID NO: 712819 - DNA, 20 bp, mouse
ggccgcgcccggccaatcgc

SEQ ID NO: 712820 - DNA, 20 bp, mouse
gaggcccgaaggcctgcgat

SEQ ID NO: 712821 - DNA, 20 bp, mouse
ggccccgcgtcacagccaat

SEQ ID NO: 712822 - DNA, 20 bp, mouse
gcgccccccggcgccgcggt

SEQ ID NO: 712823 - DNA, 20 bp, mouse
ggctggacggggcagcacat

SEQ ID NO: 712824 - DNA, 20 bp, mouse
gccggccaatcgcaggcctt

SEQ ID NO: 712825 - DNA, 20 bp, mouse
gcctcagccaaccgcggcgc

SEQ ID NO: 712826 - DNA, 20 bp, mouse
gctaggtccacaccccgtga

SEQ ID NO: 712827 - DNA, 20 bp, mouse
gagtcctgggcccaaggaac

SEQ ID NO: 712828 - DNA, 20 bp, mouse
gctgctagagggattagctg

SEQ ID NO: 712829 - DNA, 20 bp, mouse
gaatccctctagcaggaggg

SEQ ID NO: 712830 - DNA, 20 bp, mouse
gctgaagcacggaggtacag

SEQ ID NO: 712831 - DNA, 20 bp, mouse
gccccgtgagggaaatgatc

SEQ ID NO: 712832 - DNA, 20 bp, mouse
gtccgtgcttcagccaaatg

SEQ ID NO: 712833 - DNA, 20 bp, mouse
gaatttgagggcagttagca

SEQ ID NO: 712834 - DNA, 20 bp, mouse
ggaggaacggaacccagtaa

SEQ ID NO: 712835 - DNA, 20 bp, mouse
gacacaaccggcgtctctat

SEQ ID NO: 712836 - DNA, 20 bp, mouse
gagtacctccctgagggtta

SEQ ID NO: 712837 - DNA, 20 bp, mouse
gaaaaggtctggtactgtac

SEQ ID NO: 712838 - DNA, 20 bp, mouse
gcggcaggagctgaggtgat

SEQ ID NO: 712839 - DNA, 20 bp, mouse
gaacgcgagtacctccctga

SEQ ID NO: 712840 - DNA, 20 bp, mouse
gggtccttcccggtgcggga

SEQ ID NO: 712841 - DNA, 20 bp, mouse
gctgcacaccctaaccctca

SEQ ID NO: 712842 - DNA, 20 bp, mouse
gtatgtatctggaaaaggtc

SEQ ID NO: 712843 - DNA, 20 bp, mouse
gcagatgagactccgcatga

SEQ ID NO: 712844 - DNA, 20 bp, mouse
gcacaccctaaccctcaggg

SEQ ID NO: 712845 - DNA, 20 bp, mouse
gtgatgggtccttcccggtg

SEQ ID NO: 712846 - DNA, 20 bp, mouse
ggggcattgcgcagacgcag

SEQ ID NO: 712847 - DNA, 20 bp, mouse
gagagggcgcgcaagaccca

SEQ ID NO: 712848 - DNA, 20 bp, mouse
gaaccctacacgccatccaa

SEQ ID NO: 712849 - DNA, 20 bp, mouse
gaggacccgccggcctagag

SEQ ID NO: 712850 - DNA, 20 bp, mouse
gctgctcgcaagggcccctt

SEQ ID NO: 712851 - DNA, 20 bp, mouse
gtccggggacggcaaccgag

SEQ ID NO: 712852 - DNA, 20 bp, mouse
gctgcacatgcgtaagatga

SEQ ID NO: 712853 - DNA, 20 bp, mouse
gcatgtgcagagtttatttc

SEQ ID NO: 712854 - DNA, 20 bp, mouse
gaaatgaggcacaaaaccgt

SEQ ID NO: 712855 - DNA, 20 bp, mouse
gtgcgtaagatgaaggatga

SEQ ID NO: 712856 - DNA, 20 bp, mouse
gccgccgtcgctcgcgagtg

SEQ ID NO: 712857 - DNA, 20 bp, mouse
gctcgcgagtggggcacctg

SEQ ID NO: 712858 - DNA, 20 bp, mouse
ggccgcgcgcgctacgctct

SEQ ID NO: 712859 - DNA, 20 bp, mouse
gcctgtaaggacacgtgctg

SEQ ID NO: 712860 - DNA, 20 bp, mouse
ggcgaggcgcggagacgtca

SEQ ID NO: 712861 - DNA, 20 bp, mouse
gtcgctccgcccctggggtg

SEQ ID NO: 712862 - DNA, 20 bp, mouse
ggtgccccactcgcgagcga

SEQ ID NO: 712863 - DNA, 20 bp, mouse
ggggtctagacaagaccagg

SEQ ID NO: 712864 - DNA, 20 bp, mouse
gcttgtgattagtgagctgg

SEQ ID NO: 712865 - DNA, 20 bp, mouse
ggtagcgcgcgcggccacca

SEQ ID NO: 712866 - DNA, 20 bp, mouse
gtgcttagggagcagcagga

SEQ ID NO: 712867 - DNA, 20 bp, mouse
ggtagtgacaaaatgaagca

SEQ ID NO: 712868 - DNA, 20 bp, mouse
gaagcaggagtgggttgctt

SEQ ID NO: 712869 - DNA, 20 bp, mouse
ggggttgcttagggagcagc

SEQ ID NO: 712870 - DNA, 20 bp, mouse
gcaaatgcattcccctctac

SEQ ID NO: 712871 - DNA, 20 bp, mouse
ggcaacccactcctgcttac

SEQ ID NO: 712872 - DNA, 20 bp, mouse
gtttgccagtaagcaggagt

SEQ ID NO: 712873 - DNA, 20 bp, mouse
gaatgcatttgccagtaagc

SEQ ID NO: 712874 - DNA, 20 bp, mouse
gagtacttcagcttcgggcc

SEQ ID NO: 712875 - DNA, 20 bp, mouse
gacttatttaatttttttaa

SEQ ID NO: 712876 - DNA, 20 bp, mouse
gtcctctctaagcacttctg

SEQ ID NO: 712877 - DNA, 20 bp, mouse
gtaacaggaaagtgaagcta

SEQ ID NO: 712878 - DNA, 20 bp, mouse
gagtgcttagagaggagtct

SEQ ID NO: 712879 - DNA, 20 bp, mouse
gaatgcaaatgaagtactgg

SEQ ID NO: 712880 - DNA, 20 bp, mouse
gggaaggagagtgctgactc

SEQ ID NO: 712881 - DNA, 20 bp, mouse
gcacccaaggcacagcacat

SEQ ID NO: 712882 - DNA, 20 bp, mouse
gaagaggaccgggtaaacaa

SEQ ID NO: 712883 - DNA, 20 bp, mouse
gggagagtgctgactcagga

SEQ ID NO: 712884 - DNA, 20 bp, mouse
gcaccaggcctcttgctcat

SEQ ID NO: 712885 - DNA, 20 bp, mouse
gcacccatgtgctgtgcctt

SEQ ID NO: 712886 - DNA, 20 bp, mouse
ggcaaaacaaatcacatcag

SEQ ID NO: 712887 - DNA, 20 bp, mouse
gtatcaacaatgtggcccag

SEQ ID NO: 712888 - DNA, 20 bp, mouse
gcaagcatgtatcaacaatg

SEQ ID NO: 712889 - DNA, 20 bp, mouse
ggctgtcagtaatccagccc

SEQ ID NO: 712890 - DNA, 20 bp, mouse
gcttgtgtcgggtccttcag

SEQ ID NO: 712891 - DNA, 20 bp, mouse
gcttgcagtgttaattaaca

SEQ ID NO: 712892 - DNA, 20 bp, mouse
gaactcgggtcaatttttac

SEQ ID NO: 712893 - DNA, 20 bp, mouse
gtccaggttggtgaacttgg

SEQ ID NO: 712894 - DNA, 20 bp, mouse
gaattgacccgagttcagga

SEQ ID NO: 712895 - DNA, 20 bp, mouse
gttgtgtttggactctcccc

SEQ ID NO: 712896 - DNA, 20 bp, mouse
gtagaagctcagagataagt

SEQ ID NO: 712897 - DNA, 20 bp, mouse
gagagtagcaaatcaggcag

SEQ ID NO: 712898 - DNA, 20 bp, mouse
gatggaaagaggatagttca

SEQ ID NO: 712899 - DNA, 20 bp, mouse
ggagttctacagcatagatg

SEQ ID NO: 712900 - DNA, 20 bp, mouse
ggaaaatagagtagcaaatc

SEQ ID NO: 712901 - DNA, 20 bp, mouse
gttaaagactcaataaatgt

SEQ ID NO: 712902 - DNA, 20 bp, mouse
gtcaaacttggtaagcaatg

SEQ ID NO: 712903 - DNA, 20 bp, mouse
gccaaaacacagttaaacaa

SEQ ID NO: 712904 - DNA, 20 bp, mouse
gctcagagcacagggttgat

SEQ ID NO: 712905 - DNA, 20 bp, mouse
gactctctcccccagaaaaa

SEQ ID NO: 712906 - DNA, 20 bp, mouse
gggtaccggaaaacgctggt

SEQ ID NO: 712907 - DNA, 20 bp, mouse
ggaaggagagagggtaataa

SEQ ID NO: 712908 - DNA, 20 bp, mouse
gtgggaacgtggaggatgct

SEQ ID NO: 712909 - DNA, 20 bp, mouse
ggtacctcgcactgttctca

SEQ ID NO: 712910 - DNA, 20 bp, mouse
gtgcccgcggtttccttttc

SEQ ID NO: 712911 - DNA, 20 bp, mouse
gcggccttgagaacagtgcg

SEQ ID NO: 712912 - DNA, 20 bp, mouse
gaccgcgggcactgggaacg

SEQ ID NO: 712913 - DNA, 20 bp, mouse
ggcgggcactgggaacgtgg

SEQ ID NO: 712914 - DNA, 20 bp, mouse
ggcgaggtaccggaaaacgc

SEQ ID NO: 712915 - DNA, 20 bp, mouse
gctgacccggggtttccggc

SEQ ID NO: 712916 - DNA, 20 bp, mouse
gaggaccggtaagggggcga

SEQ ID NO: 712917 - DNA, 20 bp, mouse
gagccatcctgaccaacttt

SEQ ID NO: 712918 - DNA, 20 bp, mouse
gggaaacaggaccggtaagg

SEQ ID NO: 712919 - DNA, 20 bp, mouse
gcacggaaacaggaccggta

SEQ ID NO: 712920 - DNA, 20 bp, mouse
ggcggagggttccaaaactg

SEQ ID NO: 712921 - DNA, 20 bp, mouse
gggagtgggcggacctgggg

SEQ ID NO: 712922 - DNA, 20 bp, mouse
gagcggagtgggcggacctg

SEQ ID NO: 712923 - DNA, 20 bp, mouse
gcccccaaagttggtcagga

SEQ ID NO: 712924 - DNA, 20 bp, mouse
gaattatggttgcgcgcgga

SEQ ID NO: 712925 - DNA, 20 bp, mouse
gaccatcccacccccaaagt

SEQ ID NO: 712926 - DNA, 20 bp, mouse
gaggtcgagaaggtggcgtg

SEQ ID NO: 712927 - DNA, 20 bp, mouse
gcgccgaggccctggtggaa

SEQ ID NO: 712928 - DNA, 20 bp, mouse
gccagtgcccagagttccta

SEQ ID NO: 712929 - DNA, 20 bp, mouse
gtctgccagcacagcggccg

SEQ ID NO: 712930 - DNA, 20 bp, mouse
ggggcggcttctgtgtgttg

SEQ ID NO: 712931 - DNA, 20 bp, mouse
gtgaagtagcgaggtcgaga

SEQ ID NO: 712932 - DNA, 20 bp, mouse
gcagaagccgcccgaggcta

SEQ ID NO: 712933 - DNA, 20 bp, mouse
gcagcagcagccatgggcgc

SEQ ID NO: 712934 - DNA, 20 bp, mouse
gcgcgcgttgctaggagaga

SEQ ID NO: 712935 - DNA, 20 bp, mouse
gcggcctgctgacgtggacc

SEQ ID NO: 712936 - DNA, 20 bp, mouse
gtcactggctgcacctgggg

SEQ ID NO: 712937 - DNA, 20 bp, mouse
gtctccctgtggtcatactt

SEQ ID NO: 712938 - DNA, 20 bp, mouse
gcctctgctcaaggcctcac

SEQ ID NO: 712939 - DNA, 20 bp, mouse
ggcctcactggctgcacctg

SEQ ID NO: 712940 - DNA, 20 bp, mouse
gacatcctaagtatgaccac

SEQ ID NO: 712941 - DNA, 20 bp, mouse
gaacactctgtcccaatgtt

SEQ ID NO: 712942 - DNA, 20 bp, mouse
gatgacagtagacccaacat

SEQ ID NO: 712943 - DNA, 20 bp, mouse
gaggtggggcttctgggagg

SEQ ID NO: 712944 - DNA, 20 bp, mouse
ggggaggttactcagagcta

SEQ ID NO: 712945 - DNA, 20 bp, mouse
gccactcaagtccttccaat

SEQ ID NO: 712946 - DNA, 20 bp, mouse
ggggagaccgagggtcctac

SEQ ID NO: 712947 - DNA, 20 bp, mouse
ggcagaacacggaaacgaga

SEQ ID NO: 712948 - DNA, 20 bp, mouse
ggaagccgatcgggttgcta

SEQ ID NO: 712949 - DNA, 20 bp, mouse
gtgacccggaaggaccctaa

SEQ ID NO: 712950 - DNA, 20 bp, mouse
gcaacatagtgggagaccga

SEQ ID NO: 712951 - DNA, 20 bp, mouse
gacaggagactgccgtgcgc

SEQ ID NO: 712952 - DNA, 20 bp, mouse
gtagggaagcggggattgcg

SEQ ID NO: 712953 - DNA, 20 bp, mouse
gtccgggtcaggggtccagt

SEQ ID NO: 712954 - DNA, 20 bp, mouse
ggcggggttgccatcacttc

SEQ ID NO: 712955 - DNA, 20 bp, mouse
gccggaaggaccctaagggc

SEQ ID NO: 712956 - DNA, 20 bp, mouse
gaaacaacccagaggtaggt

SEQ ID NO: 712957 - DNA, 20 bp, mouse
gaaacaaacaacccagaggt

SEQ ID NO: 712958 - DNA, 20 bp, mouse
gatataagacacttgatctc

SEQ ID NO: 712959 - DNA, 20 bp, mouse
gttgattgaaatgtttatct

SEQ ID NO: 712960 - DNA, 20 bp, mouse
gtcaaatgagagacaaggaa

SEQ ID NO: 712961 - DNA, 20 bp, mouse
gtactgtttctctttcctca

SEQ ID NO: 712962 - DNA, 20 bp, mouse
ggcatggcaaactaatactg

SEQ ID NO: 712963 - DNA, 20 bp, mouse
ggaaattggtctttctttgt

SEQ ID NO: 712964 - DNA, 20 bp, mouse
gaataaacccacctacctct

SEQ ID NO: 712965 - DNA, 20 bp, mouse
gtagagttggaattctttga

SEQ ID NO: 712966 - DNA, 20 bp, mouse
gcgcccccaaggcgtccaac

SEQ ID NO: 712967 - DNA, 20 bp, mouse
gtcaacccgttggacgcctt

SEQ ID NO: 712968 - DNA, 20 bp, mouse
ggggcgtcctgtcaacccgt

SEQ ID NO: 712969 - DNA, 20 bp, mouse
ggggcactgtgatctctcag

SEQ ID NO: 712970 - DNA, 20 bp, mouse
gccacagggagcgccatctc

SEQ ID NO: 712971 - DNA, 20 bp, mouse
ggacccgagaaaaacggcgg

SEQ ID NO: 712972 - DNA, 20 bp, mouse
gccccccagcgttaggaggc

SEQ ID NO: 712973 - DNA, 20 bp, mouse
gttctagaacgtcatcgact

SEQ ID NO: 712974 - DNA, 20 bp, mouse
gccctgtgggcgtgtcgccg

SEQ ID NO: 712975 - DNA, 20 bp, mouse
gaattcatgaaagtagccta

SEQ ID NO: 712976 - DNA, 20 bp, mouse
ggcggggctagcaggaaatg

SEQ ID NO: 712977 - DNA, 20 bp, mouse
gcatgagcacgagaggccta

SEQ ID NO: 712978 - DNA, 20 bp, mouse
gaggacccgagctccagacg

SEQ ID NO: 712979 - DNA, 20 bp, mouse
gccgagctccagacgcgggg

SEQ ID NO: 712980 - DNA, 20 bp, mouse
gggcggggcatgagcacgag

SEQ ID NO: 712981 - DNA, 20 bp, mouse
ggcctagggaatgagcgagt

SEQ ID NO: 712982 - DNA, 20 bp, mouse
gtggcagcgaggtaccaaaa

SEQ ID NO: 712983 - DNA, 20 bp, mouse
gtagggaatgagcgagtggg

SEQ ID NO: 712984 - DNA, 20 bp, mouse
gaaggctgcgtcccacctct

SEQ ID NO: 712985 - DNA, 20 bp, mouse
gggggtccctagtgctggta

SEQ ID NO: 712986 - DNA, 20 bp, mouse
gtgggaagagccacaactcc

SEQ ID NO: 712987 - DNA, 20 bp, mouse
gcccggcgccgggtgatgat

SEQ ID NO: 712988 - DNA, 20 bp, mouse
gaggcccggtgtgtttctct

SEQ ID NO: 712989 - DNA, 20 bp, mouse
gcctctgaacagcccttcaa

SEQ ID NO: 712990 - DNA, 20 bp, mouse
gaggccatagtgacctgtgc

SEQ ID NO: 712991 - DNA, 20 bp, mouse
gaggaagagagggccattga

SEQ ID NO: 712992 - DNA, 20 bp, mouse
ggaagagcccactgcattaa

SEQ ID NO: 712993 - DNA, 20 bp, mouse
gcagccggcacaggtcacta

SEQ ID NO: 712994 - DNA, 20 bp, mouse
gtgtccccagagaaacacac

SEQ ID NO: 712995 - DNA, 20 bp, mouse
gaggttgttcccagcttaat

SEQ ID NO: 712996 - DNA, 20 bp, mouse
gagcacatcggggagcccgt

SEQ ID NO: 712997 - DNA, 20 bp, mouse
gctcgcaaggcggcacttag

SEQ ID NO: 712998 - DNA, 20 bp, mouse
ggtacatcctgactgatccc

SEQ ID NO: 712999 - DNA, 20 bp, mouse
ggatcagtcaggatgtacaa

SEQ ID NO: 713000 - DNA, 20 bp, mouse
ggcagctatcaggtggggcg

SEQ ID NO: 713001 - DNA, 20 bp, mouse
gcaaggcggcacttagaggc

SEQ ID NO: 713002 - DNA, 20 bp, mouse
gccccacctgatagctgcgt

SEQ ID NO: 713003 - DNA, 20 bp, mouse
gggatcacgtgactgatggg

SEQ ID NO: 713004 - DNA, 20 bp, mouse
gaaatggggacgagcacatc

SEQ ID NO: 713005 - DNA, 20 bp, mouse
gtgtgctcgtccccatttcg

SEQ ID NO: 713006 - DNA, 20 bp, mouse
ggtaatactggaggtgtagc

SEQ ID NO: 713007 - DNA, 20 bp, mouse
gatgtcgtcagttaatatct

SEQ ID NO: 713008 - DNA, 20 bp, mouse
gctcccccaacaagaggtcg

SEQ ID NO: 713009 - DNA, 20 bp, mouse
gcaaattagtgagttggctt

SEQ ID NO: 713010 - DNA, 20 bp, mouse
gataaatcaaattagtgagt

SEQ ID NO: 713011 - DNA, 20 bp, mouse
gatgatgattactactatta

SEQ ID NO: 713012 - DNA, 20 bp, mouse
gacaatttttacaaacgggt

SEQ ID NO: 713013 - DNA, 20 bp, mouse
gctgtagatttgtgaattct

SEQ ID NO: 713014 - DNA, 20 bp, mouse
gcgtttgtaaaaattgttgc

SEQ ID NO: 713015 - DNA, 20 bp, mouse
gtgtattagaattgtaatac

SEQ ID NO: 713016 - DNA, 20 bp, mouse
gaaaagatgaaccgtgatat

SEQ ID NO: 713017 - DNA, 20 bp, mouse
gatcacggttcatcttttaa

SEQ ID NO: 713018 - DNA, 20 bp, mouse
gagaacacctgtcttttgca

SEQ ID NO: 713019 - DNA, 20 bp, mouse
gaagaagcaatacccttctt

SEQ ID NO: 713020 - DNA, 20 bp, mouse
gatggacagagcctgataca

SEQ ID NO: 713021 - DNA, 20 bp, mouse
gttcatcttttaagggagtc

SEQ ID NO: 713022 - DNA, 20 bp, mouse
gttctttgaagccttgtatc

SEQ ID NO: 713023 - DNA, 20 bp, mouse
ggtccattccagattgcctg

SEQ ID NO: 713024 - DNA, 20 bp, mouse
gcctagagttatctgaaaga

SEQ ID NO: 713025 - DNA, 20 bp, mouse
gagagctgatgcagacgcca

SEQ ID NO: 713026 - DNA, 20 bp, mouse
gggcaaggggatggtaccag

SEQ ID NO: 713027 - DNA, 20 bp, mouse
gagtggcggggagtggcaag

SEQ ID NO: 713028 - DNA, 20 bp, mouse
gttccccagaatagcttctg

SEQ ID NO: 713029 - DNA, 20 bp, mouse
gctcgctcgctagaggggag

SEQ ID NO: 713030 - DNA, 20 bp, mouse
gcgctcgctcgctcgctaga

SEQ ID NO: 713031 - DNA, 20 bp, mouse
gaagagagagaaacccgcca

SEQ ID NO: 713032 - DNA, 20 bp, mouse
gtcgctagaggggagtggcg

SEQ ID NO: 713033 - DNA, 20 bp, mouse
gcagtggaccccaatgcatg

SEQ ID NO: 713034 - DNA, 20 bp, mouse
gggattctgaactcagcttt

SEQ ID NO: 713035 - DNA, 20 bp, mouse
gtgagttcagaatccctggc

SEQ ID NO: 713036 - DNA, 20 bp, mouse
gttgttaaaaggtcaagcct

SEQ ID NO: 713037 - DNA, 20 bp, mouse
gactttactcttccagcccc

SEQ ID NO: 713038 - DNA, 20 bp, mouse
gttttaaaaatctattaaaa

SEQ ID NO: 713039 - DNA, 20 bp, mouse
gtactactaggatgtgtgac

SEQ ID NO: 713040 - DNA, 20 bp, mouse
gtatcagaggacaagactct

SEQ ID NO: 713041 - DNA, 20 bp, mouse
gcaagagctacaatactact

SEQ ID NO: 713042 - DNA, 20 bp, mouse
gtaactacaaaataattctt

SEQ ID NO: 713043 - DNA, 20 bp, mouse
gaaaaggtcaagcctggggc

SEQ ID NO: 713044 - DNA, 20 bp, mouse
gattattttgtagttatcag

SEQ ID NO: 713045 - DNA, 20 bp, mouse
gaaaatttttttttgttaaa

SEQ ID NO: 713046 - DNA, 20 bp, mouse
ggagaaggggagcaaaagtt

SEQ ID NO: 713047 - DNA, 20 bp, mouse
gaatgtcacacaaccacgac

SEQ ID NO: 713048 - DNA, 20 bp, mouse
gtgttgtcttcctgttctga

SEQ ID NO: 713049 - DNA, 20 bp, mouse
ggacccaacaatcacatgca

SEQ ID NO: 713050 - DNA, 20 bp, mouse
gtaattgaagtgtttttctt

SEQ ID NO: 713051 - DNA, 20 bp, mouse
gttccctgcatgtgattgtt

SEQ ID NO: 713052 - DNA, 20 bp, mouse
gtcaaataagagatatgtag

SEQ ID NO: 713053 - DNA, 20 bp, mouse
gcctgagattatatggtctg

SEQ ID NO: 713054 - DNA, 20 bp, mouse
ggctgctcttcttagcaaag

SEQ ID NO: 713055 - DNA, 20 bp, mouse
gagagatttgaagcctgtcg

SEQ ID NO: 713056 - DNA, 20 bp, mouse
gatgacacattttagctttg

SEQ ID NO: 713057 - DNA, 20 bp, mouse
gataaaacaaactagtagca

SEQ ID NO: 713058 - DNA, 20 bp, mouse
gataaccacttggggaggct

SEQ ID NO: 713059 - DNA, 20 bp, mouse
gttaattaaaaataaccact

SEQ ID NO: 713060 - DNA, 20 bp, mouse
gtaaaaataaccacttgggg

SEQ ID NO: 713061 - DNA, 20 bp, mouse
gctaccctagcctccccaag

SEQ ID NO: 713062 - DNA, 20 bp, mouse
ggggaccgaggcgcccgcta

SEQ ID NO: 713063 - DNA, 20 bp, mouse
gggaccccacgggaccgcgt

SEQ ID NO: 713064 - DNA, 20 bp, mouse
gagtcggagggcagccctag

SEQ ID NO: 713065 - DNA, 20 bp, mouse
gtgccccgccgagtggggac

SEQ ID NO: 713066 - DNA, 20 bp, mouse
gggaccagcaagcagatgct

SEQ ID NO: 713067 - DNA, 20 bp, mouse
gtgggaacagaaggcaatga

SEQ ID NO: 713068 - DNA, 20 bp, mouse
gtgtcccagcatctgcttgc

SEQ ID NO: 713069 - DNA, 20 bp, mouse
gaaactgtgaccaaaagtga

SEQ ID NO: 713070 - DNA, 20 bp, mouse
ggactcactaataacatgaa

SEQ ID NO: 713071 - DNA, 20 bp, mouse
ggcccagaccttactttaaa

SEQ ID NO: 713072 - DNA, 20 bp, mouse
gatagttatgagagtgatag

SEQ ID NO: 713073 - DNA, 20 bp, mouse
gacaattaatccactctttt

SEQ ID NO: 713074 - DNA, 20 bp, mouse
gccttctgttcccaaaagag

SEQ ID NO: 713075 - DNA, 20 bp, mouse
gcttactttaaaagggacaa

SEQ ID NO: 713076 - DNA, 20 bp, mouse
ggggaaagctatatacacat

SEQ ID NO: 713077 - DNA, 20 bp, mouse
ggggtcaacagtctactatt

SEQ ID NO: 713078 - DNA, 20 bp, mouse
gttacccacacatgtttgtt

SEQ ID NO: 713079 - DNA, 20 bp, mouse
gtgacccaacaaacatgtgt

SEQ ID NO: 713080 - DNA, 20 bp, mouse
gggtttatataatcagtttc

SEQ ID NO: 713081 - DNA, 20 bp, mouse
gtgtgtgggtaaattacact

SEQ ID NO: 713082 - DNA, 20 bp, mouse
gcatttctcttgcctgagaa

SEQ ID NO: 713083 - DNA, 20 bp, mouse
gaaaatgtgagagcaacaaa

SEQ ID NO: 713084 - DNA, 20 bp, mouse
gctctcacattttgatgaca

SEQ ID NO: 713085 - DNA, 20 bp, mouse
gagataaaacagtagtacaa

SEQ ID NO: 713086 - DNA, 20 bp, mouse
gcaggtagaaggagattccc

SEQ ID NO: 713087 - DNA, 20 bp, mouse
gccaacacaggaatacctta

SEQ ID NO: 713088 - DNA, 20 bp, mouse
gacagggagaatcaattcgt

SEQ ID NO: 713089 - DNA, 20 bp, mouse
gtactctgttaatccaacac

SEQ ID NO: 713090 - DNA, 20 bp, mouse
gacaaagacttcctcaggaa

SEQ ID NO: 713091 - DNA, 20 bp, mouse
gattccctggcatgcaggta

SEQ ID NO: 713092 - DNA, 20 bp, mouse
gtcttagttaatcaggctat

SEQ ID NO: 713093 - DNA, 20 bp, mouse
ggtgccctacctgcatgcca

SEQ ID NO: 713094 - DNA, 20 bp, mouse
gattagcaggaacatgtcaa

SEQ ID NO: 713095 - DNA, 20 bp, mouse
gcctgtcttgaatatagtta

SEQ ID NO: 713096 - DNA, 20 bp, mouse
ggggacttggagttatggtg

SEQ ID NO: 713097 - DNA, 20 bp, mouse
gagactggggtaggagtgaa

SEQ ID NO: 713098 - DNA, 20 bp, mouse
gagaattggtggaaggaaac

SEQ ID NO: 713099 - DNA, 20 bp, mouse
gagaaccaggaggccaccat

SEQ ID NO: 713100 - DNA, 20 bp, mouse
ggtgaagggacttggagtta

SEQ ID NO: 713101 - DNA, 20 bp, mouse
gagtctcccactccacccat

SEQ ID NO: 713102 - DNA, 20 bp, mouse
gacaggctaactatgcccat

SEQ ID NO: 713103 - DNA, 20 bp, mouse
gagtcccggaagggacagaa

SEQ ID NO: 713104 - DNA, 20 bp, mouse
ggggtaggagtgaagggact

SEQ ID NO: 713105 - DNA, 20 bp, mouse
gaaggatgagaattggtgga

SEQ ID NO: 713106 - DNA, 20 bp, mouse
gctagattacactgagggaa

SEQ ID NO: 713107 - DNA, 20 bp, mouse
gcctcctgggcgggtctcat

SEQ ID NO: 713108 - DNA, 20 bp, mouse
gagcaccccgccaacggccg

SEQ ID NO: 713109 - DNA, 20 bp, mouse
gaacggccgcggttcctggt

SEQ ID NO: 713110 - DNA, 20 bp, mouse
gggcacttctaacgcgtctc

SEQ ID NO: 713111 - DNA, 20 bp, mouse
ggaagtgcccaatcagaaaa

SEQ ID NO: 713112 - DNA, 20 bp, mouse
gcgccgtagtccccactgaa

SEQ ID NO: 713113 - DNA, 20 bp, mouse
gaggaaccgcggccgttggc

SEQ ID NO: 713114 - DNA, 20 bp, mouse
ggcccaatcagaaaacggca

SEQ ID NO: 713115 - DNA, 20 bp, mouse
ggcgggccgaccaggaaccg

SEQ ID NO: 713116 - DNA, 20 bp, mouse
ggtgctgggtgcaggggcga

SEQ ID NO: 713117 - DNA, 20 bp, mouse
gcccgggtgtccagcaacgg

SEQ ID NO: 713118 - DNA, 20 bp, mouse
gcggccggacggggtgggtg

SEQ ID NO: 713119 - DNA, 20 bp, mouse
gtccccgaggccgacgcgtg

SEQ ID NO: 713120 - DNA, 20 bp, mouse
gggccccgggtgtccagcaa

SEQ ID NO: 713121 - DNA, 20 bp, mouse
ggggtgtccagcaacggcgg

SEQ ID NO: 713122 - DNA, 20 bp, mouse
gcgcagcggccggacggggt

SEQ ID NO: 713123 - DNA, 20 bp, mouse
ggaactggtgctgggtgcag

SEQ ID NO: 713124 - DNA, 20 bp, mouse
gtcgatccgcgcgcgagtga

SEQ ID NO: 713125 - DNA, 20 bp, mouse
gcgtgagccgcgggaggacg

SEQ ID NO: 713126 - DNA, 20 bp, mouse
gcagagggagaagggtgtgt

SEQ ID NO: 713127 - DNA, 20 bp, mouse
ggacagaatgagatgagtca

SEQ ID NO: 713128 - DNA, 20 bp, mouse
ggagttgcacctctagatta

SEQ ID NO: 713129 - DNA, 20 bp, mouse
gcctgaggtaaaatggattt

SEQ ID NO: 713130 - DNA, 20 bp, mouse
gtccttcatctggaaacctt

SEQ ID NO: 713131 - DNA, 20 bp, mouse
gggtaaaatggatttaggta

SEQ ID NO: 713132 - DNA, 20 bp, mouse
gaaatgctgccttaatctag

SEQ ID NO: 713133 - DNA, 20 bp, mouse
gggaggaggaggtggagcac

SEQ ID NO: 713134 - DNA, 20 bp, mouse
ggtctgcagtccttccccaa

SEQ ID NO: 713135 - DNA, 20 bp, mouse
gcctccaggcaccacagtcc

SEQ ID NO: 713136 - DNA, 20 bp, mouse
ggagctatggggccctgtat

SEQ ID NO: 713137 - DNA, 20 bp, mouse
gggggcggaaggtgggatct

SEQ ID NO: 713138 - DNA, 20 bp, mouse
ggggagggggctgagactct

SEQ ID NO: 713139 - DNA, 20 bp, mouse
gagactggggctgcttcctg

SEQ ID NO: 713140 - DNA, 20 bp, mouse
gagctgcggccaaggggtgg

SEQ ID NO: 713141 - DNA, 20 bp, mouse
gcccaggctggggccagcac

SEQ ID NO: 713142 - DNA, 20 bp, mouse
gcgcacaggccagctggaga

SEQ ID NO: 713143 - DNA, 20 bp, mouse
ggaagctggagctgcgtcgc

SEQ ID NO: 713144 - DNA, 20 bp, mouse
gaggcaggaagctgcggcca

SEQ ID NO: 713145 - DNA, 20 bp, mouse
gcacaggaaatggagctatg

SEQ ID NO: 713146 - DNA, 20 bp, mouse
gttgggagagaggatcttga

SEQ ID NO: 713147 - DNA, 20 bp, mouse
ggtgaggtatcccactccat

SEQ ID NO: 713148 - DNA, 20 bp, mouse
gccagctttcaaattcccta

SEQ ID NO: 713149 - DNA, 20 bp, mouse
gagatgcaaaaataaatcag

SEQ ID NO: 713150 - DNA, 20 bp, mouse
gttcaaattccctatggagt

SEQ ID NO: 713151 - DNA, 20 bp, mouse
ggttgaggacacctgaaagg

SEQ ID NO: 713152 - DNA, 20 bp, mouse
gagtctgtgaccctcctttc

SEQ ID NO: 713153 - DNA, 20 bp, mouse
ggcacagtgagggagttctc

SEQ ID NO: 713154 - DNA, 20 bp, mouse
ggctgaggtggggtatggaa

SEQ ID NO: 713155 - DNA, 20 bp, mouse
gggagttctcaggcccttgg

SEQ ID NO: 713156 - DNA, 20 bp, mouse
gagtagtcagacacacactc

SEQ ID NO: 713157 - DNA, 20 bp, mouse
gtccagattcggtaacatcc

SEQ ID NO: 713158 - DNA, 20 bp, mouse
gacccggatgttaccgaatc

SEQ ID NO: 713159 - DNA, 20 bp, mouse
gccgtctttttgtccagatt

SEQ ID NO: 713160 - DNA, 20 bp, mouse
gttctagcactttgttcacc

SEQ ID NO: 713161 - DNA, 20 bp, mouse
gagatgccatcactgctgtt

SEQ ID NO: 713162 - DNA, 20 bp, mouse
gggcagtgcctccatattct

SEQ ID NO: 713163 - DNA, 20 bp, mouse
gccctgggatggccacattc

SEQ ID NO: 713164 - DNA, 20 bp, mouse
gcaagagaataaagtgccaa

SEQ ID NO: 713165 - DNA, 20 bp, mouse
ggaatagagggtctaacagt

SEQ ID NO: 713166 - DNA, 20 bp, mouse
gaggccaaacaggtaagtag

SEQ ID NO: 713167 - DNA, 20 bp, mouse
ggggacccatgacagatcta

SEQ ID NO: 713168 - DNA, 20 bp, mouse
gctcgaaggcccatccatgt

SEQ ID NO: 713169 - DNA, 20 bp, mouse
gtggcctcagggtcataaag

SEQ ID NO: 713170 - DNA, 20 bp, mouse
gaatacgcgtaccgacaggg

SEQ ID NO: 713171 - DNA, 20 bp, mouse
gcggccggggagtaccatgg

SEQ ID NO: 713172 - DNA, 20 bp, mouse
gtacttgtactccttatcca

SEQ ID NO: 713173 - DNA, 20 bp, mouse
gaagatgcgtgtgagcgcct

SEQ ID NO: 713174 - DNA, 20 bp, mouse
gggatgggccttcgagaaat

SEQ ID NO: 713175 - DNA, 20 bp, mouse
ggaacactggacaagggtga

SEQ ID NO: 713176 - DNA, 20 bp, mouse
ggcgcagcccggaagatcat

SEQ ID NO: 713177 - DNA, 20 bp, mouse
gaagcctcccgcactggcgg

SEQ ID NO: 713178 - DNA, 20 bp, mouse
gcatgcacgcaagggcagct

SEQ ID NO: 713179 - DNA, 20 bp, mouse
gccgaagcctcccgcactgg

SEQ ID NO: 713180 - DNA, 20 bp, mouse
gaggtcccgccagcggccag

SEQ ID NO: 713181 - DNA, 20 bp, mouse
ggcacgcaagggcagctggg

SEQ ID NO: 713182 - DNA, 20 bp, mouse
gcatgcgtggacaccggcgg

SEQ ID NO: 713183 - DNA, 20 bp, mouse
gctcccgaagcctcccgcac

SEQ ID NO: 713184 - DNA, 20 bp, mouse
gtgtccacgcatgcacgcaa

SEQ ID NO: 713185 - DNA, 20 bp, mouse
gcttccgccgccagtgcggg

SEQ ID NO: 713186 - DNA, 20 bp, mouse
gccgggagcagaggacccga

SEQ ID NO: 713187 - DNA, 20 bp, mouse
gcagaggacccgagggagaa

SEQ ID NO: 713188 - DNA, 20 bp, mouse
gccaacagggcgagagagga

SEQ ID NO: 713189 - DNA, 20 bp, mouse
gcggcaagcccctgcagctg

SEQ ID NO: 713190 - DNA, 20 bp, mouse
ggggcagaggaacagtcacc

SEQ ID NO: 713191 - DNA, 20 bp, mouse
gggcggaggccggtcggggt

SEQ ID NO: 713192 - DNA, 20 bp, mouse
gccctgccccagtccaacaa

SEQ ID NO: 713193 - DNA, 20 bp, mouse
gcaaggacagatggaaggtc

SEQ ID NO: 713194 - DNA, 20 bp, mouse
gctggcgccgggagactact

SEQ ID NO: 713195 - DNA, 20 bp, mouse
gcccggcctttgttggactg

SEQ ID NO: 713196 - DNA, 20 bp, mouse
gggcgccagggtgcggaagg

SEQ ID NO: 713197 - DNA, 20 bp, mouse
ggagctcgcaggaggcgcca

SEQ ID NO: 713198 - DNA, 20 bp, mouse
gcgcaggaggcgccagggtg

SEQ ID NO: 713199 - DNA, 20 bp, mouse
gtgggcggggcggggcaatc

SEQ ID NO: 713200 - DNA, 20 bp, mouse
ggggaggaaaagctcacccc

SEQ ID NO: 713201 - DNA, 20 bp, mouse
gcggccggacccgcccccgt

SEQ ID NO: 713202 - DNA, 20 bp, mouse
gccccaagaagagacatcct

SEQ ID NO: 713203 - DNA, 20 bp, mouse
gaaagccaaagggctctgaa

SEQ ID NO: 713204 - DNA, 20 bp, mouse
gcaagaagagacatcctagg

SEQ ID NO: 713205 - DNA, 20 bp, mouse
ggccagggtgcggaaggggg

SEQ ID NO: 713206 - DNA, 20 bp, mouse
gttgaggtgtctgtattgga

SEQ ID NO: 713207 - DNA, 20 bp, mouse
gtgaaggtggagtgtacttg

SEQ ID NO: 713208 - DNA, 20 bp, mouse
gagtaactggtctgaggtta

SEQ ID NO: 713209 - DNA, 20 bp, mouse
gttacttgaggtgtctgtat

SEQ ID NO: 713210 - DNA, 20 bp, mouse
ggtgtctgtattggagggta

SEQ ID NO: 713211 - DNA, 20 bp, mouse
gtcttggagacacagctctc

SEQ ID NO: 713212 - DNA, 20 bp, mouse
gtcatgtagtaactggtctg

SEQ ID NO: 713213 - DNA, 20 bp, mouse
gacgccgtgaatcagaaccg

SEQ ID NO: 713214 - DNA, 20 bp, mouse
gctcaagtaacaacctgctt

SEQ ID NO: 713215 - DNA, 20 bp, mouse
gtgtacttgagggagtcatc

SEQ ID NO: 713216 - DNA, 20 bp, mouse
gggacccggagcggacgctc

SEQ ID NO: 713217 - DNA, 20 bp, mouse
gccccgggccgcgctgtcgc

SEQ ID NO: 713218 - DNA, 20 bp, mouse
ggggaagggacttccgtttc

SEQ ID NO: 713219 - DNA, 20 bp, mouse
gcggcggcggtgctcgtggt

SEQ ID NO: 713220 - DNA, 20 bp, mouse
gaaggcagctacgtcctccg

SEQ ID NO: 713221 - DNA, 20 bp, mouse
gccggggaagccgtcacgat

SEQ ID NO: 713222 - DNA, 20 bp, mouse
gggagcccgagcgtccgctc

SEQ ID NO: 713223 - DNA, 20 bp, mouse
gctcaagcggaggctggccg

SEQ ID NO: 713224 - DNA, 20 bp, mouse
gggctccggctcggctgtca

SEQ ID NO: 713225 - DNA, 20 bp, mouse
gggccggcgtaggcaggctg

SEQ ID NO: 713226 - DNA, 20 bp, mouse
gaggtcccagggctaaaagt

SEQ ID NO: 713227 - DNA, 20 bp, mouse
gaagtgggtcccagggtcca

SEQ ID NO: 713228 - DNA, 20 bp, mouse
gtgcctgggggcaggataat

SEQ ID NO: 713229 - DNA, 20 bp, mouse
gcggggaagtaattggtcaa

SEQ ID NO: 713230 - DNA, 20 bp, mouse
gagaaggctggggatgtgat

SEQ ID NO: 713231 - DNA, 20 bp, mouse
gaggggtttttcagaatcac

SEQ ID NO: 713232 - DNA, 20 bp, mouse
ggctggggatgtgatgggtg

SEQ ID NO: 713233 - DNA, 20 bp, mouse
gcagttggtcacccaccata

SEQ ID NO: 713234 - DNA, 20 bp, mouse
ggggtcccagggtccatggg

SEQ ID NO: 713235 - DNA, 20 bp, mouse
gtaaaagtgggctgaggagt

SEQ ID NO: 713236 - DNA, 20 bp, mouse
gtccctgggctcgggcagtg

SEQ ID NO: 713237 - DNA, 20 bp, mouse
gtggccctgccgctgcgctg

SEQ ID NO: 713238 - DNA, 20 bp, mouse
gccgagccactggacgactg

SEQ ID NO: 713239 - DNA, 20 bp, mouse
gctgccagagtgcggaagag

SEQ ID NO: 713240 - DNA, 20 bp, mouse
ggggccagggccggcctcag

SEQ ID NO: 713241 - DNA, 20 bp, mouse
gtgcaggtgtacggctatga

SEQ ID NO: 713242 - DNA, 20 bp, mouse
gactctggcagagctgtatg

SEQ ID NO: 713243 - DNA, 20 bp, mouse
ggtggaccccagtcgtccag

SEQ ID NO: 713244 - DNA, 20 bp, mouse
gcacctgcaccgagtcatac

SEQ ID NO: 713245 - DNA, 20 bp, mouse
gagcctcactgcccgagccc

SEQ ID NO: 713246 - DNA, 20 bp, mouse
gcaggaagggaagtctcaga

SEQ ID NO: 713247 - DNA, 20 bp, mouse
ggggtcagctctccctaggt

SEQ ID NO: 713248 - DNA, 20 bp, mouse
gaaacctttgtccttgacac

SEQ ID NO: 713249 - DNA, 20 bp, mouse
gggccggccaggtcacttcc

SEQ ID NO: 713250 - DNA, 20 bp, mouse
ggaagcatgagagattggac

SEQ ID NO: 713251 - DNA, 20 bp, mouse
gttatcctgcctcccaccta

SEQ ID NO: 713252 - DNA, 20 bp, mouse
gaatctgcctgccaacaccc

SEQ ID NO: 713253 - DNA, 20 bp, mouse
ggctgatgagataacttggg

SEQ ID NO: 713254 - DNA, 20 bp, mouse
gccccccccaacctgggtgt

SEQ ID NO: 713255 - DNA, 20 bp, mouse
gtgctctcaaccccagaggc

SEQ ID NO: 713256 - DNA, 20 bp, mouse
ggcaagggcctagctggctg

SEQ ID NO: 713257 - DNA, 20 bp, mouse
ggaagtatctgcaggctgga

SEQ ID NO: 713258 - DNA, 20 bp, mouse
ggccgcagccagtgccaagg

SEQ ID NO: 713259 - DNA, 20 bp, mouse
gaggaagctaccccagaaga

SEQ ID NO: 713260 - DNA, 20 bp, mouse
gtaaaggtgagtgggactgt

SEQ ID NO: 713261 - DNA, 20 bp, mouse
gcccagagatccatcttctg

SEQ ID NO: 713262 - DNA, 20 bp, mouse
gcctgagctgaagtatctgc

SEQ ID NO: 713263 - DNA, 20 bp, mouse
gggcctagctggctgtggag

SEQ ID NO: 713264 - DNA, 20 bp, mouse
gtcaccagcctccttggcac

SEQ ID NO: 713265 - DNA, 20 bp, mouse
gtgggtcaggtgacagtaaa

SEQ ID NO: 713266 - DNA, 20 bp, mouse
gtgcttagggagcagtagga

SEQ ID NO: 713267 - DNA, 20 bp, mouse
gaggttgcttagggagcagt

SEQ ID NO: 713268 - DNA, 20 bp, mouse
gcaaatgcattcccatctac

SEQ ID NO: 713269 - DNA, 20 bp, mouse
gagcaggagtaggttgctta

SEQ ID NO: 713270 - DNA, 20 bp, mouse
ggcaacctactcctgcttac

SEQ ID NO: 713271 - DNA, 20 bp, mouse
gtttgccagtaagcaggagt

SEQ ID NO: 713272 - DNA, 20 bp, mouse
gaatgcatttgccagtaagc

SEQ ID NO: 713273 - DNA, 20 bp, mouse
ggcattaactgcaaagataa

SEQ ID NO: 713274 - DNA, 20 bp, mouse
gtatcagaagccagtactct

SEQ ID NO: 713275 - DNA, 20 bp, mouse
gagtaggagggtagagaata

SEQ ID NO: 713276 - DNA, 20 bp, mouse
gtactctctctttcttggca

SEQ ID NO: 713277 - DNA, 20 bp, mouse
ggcgacgactagacagacaa

SEQ ID NO: 713278 - DNA, 20 bp, mouse
ggacacgattctgccaaatc

SEQ ID NO: 713279 - DNA, 20 bp, mouse
gtctttcatcccagaacctt

SEQ ID NO: 713280 - DNA, 20 bp, mouse
ggaaactaggcttgacatcc

SEQ ID NO: 713281 - DNA, 20 bp, mouse
gggcacccaagtagattgga

SEQ ID NO: 713282 - DNA, 20 bp, mouse
gacaatgggaaaagttctaa

SEQ ID NO: 713283 - DNA, 20 bp, mouse
gctaggcttgacatccaggc

SEQ ID NO: 713284 - DNA, 20 bp, mouse
gactaggcacccaagtagat

SEQ ID NO: 713285 - DNA, 20 bp, mouse
ggtctacacttaaacactat

SEQ ID NO: 713286 - DNA, 20 bp, mouse
gcgaccgctctgtaacggag

SEQ ID NO: 713287 - DNA, 20 bp, mouse
gtgccccaccaggggaaggg

SEQ ID NO: 713288 - DNA, 20 bp, mouse
gcctggtggggcagccatgg

SEQ ID NO: 713289 - DNA, 20 bp, mouse
gcaggcacactgccccgcca

SEQ ID NO: 713290 - DNA, 20 bp, mouse
ggtgcctgcgagctttctca

SEQ ID NO: 713291 - DNA, 20 bp, mouse
gtggctgccccaccagggga

SEQ ID NO: 713292 - DNA, 20 bp, mouse
gaccctcccttcccctggtg

SEQ ID NO: 713293 - DNA, 20 bp, mouse
gctctgctgtgaggatgagg

SEQ ID NO: 713294 - DNA, 20 bp, mouse
gcagtgaccctcccttcccc

SEQ ID NO: 713295 - DNA, 20 bp, mouse
gtttttcatatggtggtttt

SEQ ID NO: 713296 - DNA, 20 bp, mouse
gaaataattctcatatatta

SEQ ID NO: 713297 - DNA, 20 bp, mouse
gaatattattgaatattcca

SEQ ID NO: 713298 - DNA, 20 bp, mouse
gattataaggggaatctgtt

SEQ ID NO: 713299 - DNA, 20 bp, mouse
gaagactgtaatttagttca

SEQ ID NO: 713300 - DNA, 20 bp, mouse
gctgtaatttagttcaagga

SEQ ID NO: 713301 - DNA, 20 bp, mouse
gttgaatattccagggatgc

SEQ ID NO: 713302 - DNA, 20 bp, mouse
gaatttaaataaaaattata

SEQ ID NO: 713303 - DNA, 20 bp, mouse
ggactgctataaaataatct

SEQ ID NO: 713304 - DNA, 20 bp, mouse
gatactcttttatatatctg

SEQ ID NO: 713305 - DNA, 20 bp, mouse
gattttgtcgaatgcttttt

SEQ ID NO: 713306 - DNA, 20 bp, mouse
gtggctgggcatgggtctcg

SEQ ID NO: 713307 - DNA, 20 bp, mouse
gggcatgggtctcggggatg

SEQ ID NO: 713308 - DNA, 20 bp, mouse
gcacggtgacttccagtggg

SEQ ID NO: 713309 - DNA, 20 bp, mouse
gcagccacggtgacttccag

SEQ ID NO: 713310 - DNA, 20 bp, mouse
gacttccagtgggcggaccg

SEQ ID NO: 713311 - DNA, 20 bp, mouse
gagccaagatgaagtaaggc

SEQ ID NO: 713312 - DNA, 20 bp, mouse
gggccagccttacttcatct

SEQ ID NO: 713313 - DNA, 20 bp, mouse
gaagtcaccgtggctgggca

SEQ ID NO: 713314 - DNA, 20 bp, mouse
gctgtagccaagatgaagta

SEQ ID NO: 713315 - DNA, 20 bp, mouse
gtgggtctcggggatggggg

SEQ ID NO: 713316 - DNA, 20 bp, mouse
gtaaagataaccaagggaaa

SEQ ID NO: 713317 - DNA, 20 bp, mouse
gactctttgaggctgcgcac

SEQ ID NO: 713318 - DNA, 20 bp, mouse
gaaagaatttcaccctagca

SEQ ID NO: 713319 - DNA, 20 bp, mouse
gaacaaacctggaatttgac

SEQ ID NO: 713320 - DNA, 20 bp, mouse
gatttttatgcaaacaaacc

SEQ ID NO: 713321 - DNA, 20 bp, mouse
gatagtcctcctctatctgt

SEQ ID NO: 713322 - DNA, 20 bp, mouse
ggaaaacccacagatagagg

SEQ ID NO: 713323 - DNA, 20 bp, mouse
gtgttgaatttttatttatt

SEQ ID NO: 713324 - DNA, 20 bp, mouse
gcatgttctaccctttccct

SEQ ID NO: 713325 - DNA, 20 bp, mouse
gtttaatcctgtcaaattcc

SEQ ID NO: 713326 - DNA, 20 bp, mouse
gcagttgcaaccttgaatca

SEQ ID NO: 713327 - DNA, 20 bp, mouse
gtgcaactgacttcaataca

SEQ ID NO: 713328 - DNA, 20 bp, mouse
gacaaacaatccatgattca

SEQ ID NO: 713329 - DNA, 20 bp, mouse
gtattttattcaaacaaagc

SEQ ID NO: 713330 - DNA, 20 bp, mouse
gagaaactgaaggctttcac

SEQ ID NO: 713331 - DNA, 20 bp, mouse
gaatgtgactcaggtcatca

SEQ ID NO: 713332 - DNA, 20 bp, mouse
gtgaaaaggtaaagcctaga

SEQ ID NO: 713333 - DNA, 20 bp, mouse
gttggtgaatcagaaactga

SEQ ID NO: 713334 - DNA, 20 bp, mouse
gggaaggaaccagcatgagt

SEQ ID NO: 713335 - DNA, 20 bp, mouse
gtcatcagggcatttctgta

SEQ ID NO: 713336 - DNA, 20 bp, mouse
gttacatcagaaaccctctc

SEQ ID NO: 713337 - DNA, 20 bp, mouse
gatcagaaaccctctcaggc

SEQ ID NO: 713338 - DNA, 20 bp, mouse
gtctgacttgacatcattca

SEQ ID NO: 713339 - DNA, 20 bp, mouse
gtgatgtaagttgaactagt

SEQ ID NO: 713340 - DNA, 20 bp, mouse
gagaaagctggaatttgaca

SEQ ID NO: 713341 - DNA, 20 bp, mouse
ggacttgacatcattcatgg

SEQ ID NO: 713342 - DNA, 20 bp, mouse
gttcattttttatttctatc

SEQ ID NO: 713343 - DNA, 20 bp, mouse
gatttttactcaaagaaagc

SEQ ID NO: 713344 - DNA, 20 bp, mouse
ggaaaacccacagttagtgg

SEQ ID NO: 713345 - DNA, 20 bp, mouse
gatagtcctccactaactgt

SEQ ID NO: 713346 - DNA, 20 bp, mouse
gctgccctaagagttcagaa

SEQ ID NO: 713347 - DNA, 20 bp, mouse
gcaccctgcgcatgcgttca

SEQ ID NO: 713348 - DNA, 20 bp, mouse
gaccaaagaactgttctgat

SEQ ID NO: 713349 - DNA, 20 bp, mouse
gcatcacaaaggatcctctg

SEQ ID NO: 713350 - DNA, 20 bp, mouse
gggaataccaagtactttga

SEQ ID NO: 713351 - DNA, 20 bp, mouse
gacccggacagaagcctcag

SEQ ID NO: 713352 - DNA, 20 bp, mouse
gaagggagattttagaaggt

SEQ ID NO: 713353 - DNA, 20 bp, mouse
gagagagaggagagtaccag

SEQ ID NO: 713354 - DNA, 20 bp, mouse
ggccaatcagaacagttctt

SEQ ID NO: 713355 - DNA, 20 bp, mouse
gtcctctgaggcttctgtcc

SEQ ID NO: 713356 - DNA, 20 bp, mouse
gtggttgctaaaggttgcat

SEQ ID NO: 713357 - DNA, 20 bp, mouse
gggaggaatttggttgctaa

SEQ ID NO: 713358 - DNA, 20 bp, mouse
gattaagagaaggaggaatt

SEQ ID NO: 713359 - DNA, 20 bp, mouse
gcttttatggaattaagaga

SEQ ID NO: 713360 - DNA, 20 bp, mouse
gttatggaattaagagaagg

SEQ ID NO: 713361 - DNA, 20 bp, mouse
gaccgtgggccactgactaa

SEQ ID NO: 713362 - DNA, 20 bp, mouse
gtggttaaaatagtgaccgt

SEQ ID NO: 713363 - DNA, 20 bp, mouse
gcactgactaaaggtcccca

SEQ ID NO: 713364 - DNA, 20 bp, mouse
ggaaatgccagacagtcctt

SEQ ID NO: 713365 - DNA, 20 bp, mouse
gaaggtccccaaggactgtc

SEQ ID NO: 713366 - DNA, 20 bp, mouse
gaactccagtaaaatacctc

SEQ ID NO: 713367 - DNA, 20 bp, mouse
gggacccagaggtattttac

SEQ ID NO: 713368 - DNA, 20 bp, mouse
ggattattaaagaggataca

SEQ ID NO: 713369 - DNA, 20 bp, mouse
gcaatatatttatacaattc

SEQ ID NO: 713370 - DNA, 20 bp, mouse
gagaagaaaactgagtaaca

SEQ ID NO: 713371 - DNA, 20 bp, mouse
gaattaggatttctcttaca

SEQ ID NO: 713372 - DNA, 20 bp, mouse
ggcagaggcaggtatatttc

SEQ ID NO: 713373 - DNA, 20 bp, mouse
gaaagatagaaaggacccag

SEQ ID NO: 713374 - DNA, 20 bp, mouse
ggtctatccaggacatccag

SEQ ID NO: 713375 - DNA, 20 bp, mouse
gacaaacaagaaagatagaa

SEQ ID NO: 713376 - DNA, 20 bp, mouse
ggcaggagggtttaataaga

SEQ ID NO: 713377 - DNA, 20 bp, mouse
gggtttaataagagggaatt

SEQ ID NO: 713378 - DNA, 20 bp, mouse
gaattgggagagacaggtag

SEQ ID NO: 713379 - DNA, 20 bp, mouse
ggagagacaggtagaggcat

SEQ ID NO: 713380 - DNA, 20 bp, mouse
gagagggaattgggagagac

SEQ ID NO: 713381 - DNA, 20 bp, mouse
gaggccacataacatatttg

SEQ ID NO: 713382 - DNA, 20 bp, mouse
ggggagaatgctatctccca

SEQ ID NO: 713383 - DNA, 20 bp, mouse
gtacactacttgctcttcct

SEQ ID NO: 713384 - DNA, 20 bp, mouse
gttaaggatgttagtggtta

SEQ ID NO: 713385 - DNA, 20 bp, mouse
gggagatagcattctcccac

SEQ ID NO: 713386 - DNA, 20 bp, mouse
gtgctcttctgcattatgat

SEQ ID NO: 713387 - DNA, 20 bp, mouse
gcacgtcaatgatgtttgga

SEQ ID NO: 713388 - DNA, 20 bp, mouse
gtcatcacgtcaatgatgtt

SEQ ID NO: 713389 - DNA, 20 bp, mouse
gctggagagaaacagtactg

SEQ ID NO: 713390 - DNA, 20 bp, mouse
gtcgtctttgcttgttacag

SEQ ID NO: 713391 - DNA, 20 bp, mouse
gctacattgcttatattcgt

SEQ ID NO: 713392 - DNA, 20 bp, mouse
ggtaacaccttttcacatta

SEQ ID NO: 713393 - DNA, 20 bp, mouse
gtttttaccttaatgtgaaa

SEQ ID NO: 713394 - DNA, 20 bp, mouse
gaacatgaaaccactcatac

SEQ ID NO: 713395 - DNA, 20 bp, mouse
gggtaaaaaaatatatgctc

SEQ ID NO: 713396 - DNA, 20 bp, mouse
gtctatgaatgtaatcacag

SEQ ID NO: 713397 - DNA, 20 bp, mouse
gggcatgaaagaagtcgtaa

SEQ ID NO: 713398 - DNA, 20 bp, mouse
gtgcacatgcactaaaccag

SEQ ID NO: 713399 - DNA, 20 bp, mouse
gtctatgaaggcattcagta

SEQ ID NO: 713400 - DNA, 20 bp, mouse
gatggagagaacctctatga

SEQ ID NO: 713401 - DNA, 20 bp, mouse
gcccctgaaaatactcagtg

SEQ ID NO: 713402 - DNA, 20 bp, mouse
gagactagtatgatatgcaa

SEQ ID NO: 713403 - DNA, 20 bp, mouse
gtgcataaaataatacacac

SEQ ID NO: 713404 - DNA, 20 bp, mouse
gatgtcacagttatcctcca

SEQ ID NO: 713405 - DNA, 20 bp, mouse
gagaatacttttttgtgaat

SEQ ID NO: 713406 - DNA, 20 bp, mouse
gggctcagaagaacgatcag

SEQ ID NO: 713407 - DNA, 20 bp, mouse
gtcaacagggcttgtggtgc

SEQ ID NO: 713408 - DNA, 20 bp, mouse
gtcaacttcaacagggcttg

SEQ ID NO: 713409 - DNA, 20 bp, mouse
gcagagggctcaacttcaac

SEQ ID NO: 713410 - DNA, 20 bp, mouse
gatcgttcttctgagccagc

SEQ ID NO: 713411 - DNA, 20 bp, mouse
gtgggaagaggcttattgtt

SEQ ID NO: 713412 - DNA, 20 bp, mouse
ggaggcttattgttaggcgt

SEQ ID NO: 713413 - DNA, 20 bp, mouse
gagtacttggaaaggactgg

SEQ ID NO: 713414 - DNA, 20 bp, mouse
gccctctcttgagagcctgt

SEQ ID NO: 713415 - DNA, 20 bp, mouse
gagaagtacttggaaaggac

SEQ ID NO: 713416 - DNA, 20 bp, mouse
ggccaccagagggagcgagg

SEQ ID NO: 713417 - DNA, 20 bp, mouse
gggggccaccagagggagcg

SEQ ID NO: 713418 - DNA, 20 bp, mouse
gacaggaaaagtcctcagtg

SEQ ID NO: 713419 - DNA, 20 bp, mouse
gccatccgcctcgctccctc

SEQ ID NO: 713420 - DNA, 20 bp, mouse
ggagcccacagcccagatct

SEQ ID NO: 713421 - DNA, 20 bp, mouse
gggatgggtttcccgcactg

SEQ ID NO: 713422 - DNA, 20 bp, mouse
ggggctgggcgcctggccat

SEQ ID NO: 713423 - DNA, 20 bp, mouse
gttgggcggggcctatggcc

SEQ ID NO: 713424 - DNA, 20 bp, mouse
gctgtggcaccgcattgggc

SEQ ID NO: 713425 - DNA, 20 bp, mouse
gcctgccttggcctgcctgg

SEQ ID NO: 713426 - DNA, 20 bp, mouse
ggggcatgagaagttgtctc

SEQ ID NO: 713427 - DNA, 20 bp, mouse
gaggcactgattgcccacac

SEQ ID NO: 713428 - DNA, 20 bp, mouse
gcaaaacagggcaaagttag

SEQ ID NO: 713429 - DNA, 20 bp, mouse
ggctccaggtcctactgtct

SEQ ID NO: 713430 - DNA, 20 bp, mouse
gaacatttggaaatattcga

SEQ ID NO: 713431 - DNA, 20 bp, mouse
gaaccactctcccagacagt

SEQ ID NO: 713432 - DNA, 20 bp, mouse
ggaaatattcgagggaacac

SEQ ID NO: 713433 - DNA, 20 bp, mouse
gaaaggttaccaagtcaact

SEQ ID NO: 713434 - DNA, 20 bp, mouse
gaacaaaagtgttcaggggt

SEQ ID NO: 713435 - DNA, 20 bp, mouse
ggatatctgttcttcctgtg

SEQ ID NO: 713436 - DNA, 20 bp, mouse
gtacaaggcagtgatggcaa

SEQ ID NO: 713437 - DNA, 20 bp, mouse
gacgggggggggaacacact

SEQ ID NO: 713438 - DNA, 20 bp, mouse
gaaacactacaaggcagtga

SEQ ID NO: 713439 - DNA, 20 bp, mouse
gaaggcagtgatggcaaggg

SEQ ID NO: 713440 - DNA, 20 bp, mouse
gcacacggggggggaacaca

SEQ ID NO: 713441 - DNA, 20 bp, mouse
gtgaggttagaaacactaca

SEQ ID NO: 713442 - DNA, 20 bp, mouse
ggcagtgcttgcaccagtgt

SEQ ID NO: 713443 - DNA, 20 bp, mouse
gggggggaacacactggggg

SEQ ID NO: 713444 - DNA, 20 bp, mouse
gagggcggggttgggtgaag

SEQ ID NO: 713445 - DNA, 20 bp, mouse
ggggcagaagagtcttctgt

SEQ ID NO: 713446 - DNA, 20 bp, mouse
gtgtgattttgtcttctatt

SEQ ID NO: 713447 - DNA, 20 bp, mouse
gtgaaggctgaggtgttagc

SEQ ID NO: 713448 - DNA, 20 bp, mouse
ggggaaaatgtcataggaag

SEQ ID NO: 713449 - DNA, 20 bp, mouse
gagtagccaatgacaaggta

SEQ ID NO: 713450 - DNA, 20 bp, mouse
ggtagaagctatgaaggctg

SEQ ID NO: 713451 - DNA, 20 bp, mouse
gtgaggtaaaagacaagatt

SEQ ID NO: 713452 - DNA, 20 bp, mouse
gatgacaaggtaaggatctg

SEQ ID NO: 713453 - DNA, 20 bp, mouse
gcagggagtagccaatgaca

SEQ ID NO: 713454 - DNA, 20 bp, mouse
gtgaggtgttagctggctaa

SEQ ID NO: 713455 - DNA, 20 bp, mouse
gggaagtaatattttggcat

SEQ ID NO: 713456 - DNA, 20 bp, mouse
gaatctgagcacttgcaatt

SEQ ID NO: 713457 - DNA, 20 bp, mouse
gaggaatcccacacccacag

SEQ ID NO: 713458 - DNA, 20 bp, mouse
gagatcaggtagcttatcaa

SEQ ID NO: 713459 - DNA, 20 bp, mouse
gctacctgatcttcctctgt

SEQ ID NO: 713460 - DNA, 20 bp, mouse
gacacccacagaggaagatc

SEQ ID NO: 713461 - DNA, 20 bp, mouse
gactgtaggacagagattga

SEQ ID NO: 713462 - DNA, 20 bp, mouse
gagacaaagcagggcaaaga

SEQ ID NO: 713463 - DNA, 20 bp, mouse
gatgagagcaagacaaagca

SEQ ID NO: 713464 - DNA, 20 bp, mouse
gtagcttgagaagctatcta

SEQ ID NO: 713465 - DNA, 20 bp, mouse
gagtagctgtgtttagaggt

SEQ ID NO: 713466 - DNA, 20 bp, mouse
gagtagttgcagttgttcta

SEQ ID NO: 713467 - DNA, 20 bp, mouse
gtgagtaaggtattttgaac

SEQ ID NO: 713468 - DNA, 20 bp, mouse
ggatctacccttatagaact

SEQ ID NO: 713469 - DNA, 20 bp, mouse
gtaaggtattttgaactggc

SEQ ID NO: 713470 - DNA, 20 bp, mouse
gaaaatagtcaaaagtaaaa

SEQ ID NO: 713471 - DNA, 20 bp, mouse
gagatatgtatagtgtagtg

SEQ ID NO: 713472 - DNA, 20 bp, mouse
gttttggaaaaattagctaa

SEQ ID NO: 713473 - DNA, 20 bp, mouse
gtttctagttttaaaataat

SEQ ID NO: 713474 - DNA, 20 bp, mouse
gttctaagtttcaccaatgc

SEQ ID NO: 713475 - DNA, 20 bp, mouse
gactggcggaagtccagcat

SEQ ID NO: 713476 - DNA, 20 bp, mouse
ggatgcactttaatccaaca

SEQ ID NO: 713477 - DNA, 20 bp, mouse
gctgcttggctttatctacc

SEQ ID NO: 713478 - DNA, 20 bp, mouse
ggagacaaaagagaccactg

SEQ ID NO: 713479 - DNA, 20 bp, mouse
gaaagccaagcagatctctg

SEQ ID NO: 713480 - DNA, 20 bp, mouse
gcatgcagatctctgagtca

SEQ ID NO: 713481 - DNA, 20 bp, mouse
gagggtatggtactatctgg

SEQ ID NO: 713482 - DNA, 20 bp, mouse
gaggattgaaagaaagagat

SEQ ID NO: 713483 - DNA, 20 bp, mouse
gactatagaaaatcagtatg

SEQ ID NO: 713484 - DNA, 20 bp, mouse
gagacaaaaatctggcacaa

SEQ ID NO: 713485 - DNA, 20 bp, mouse
gagcagggtatggtactatc

SEQ ID NO: 713486 - DNA, 20 bp, mouse
gggcagtgatggcgagggga

SEQ ID NO: 713487 - DNA, 20 bp, mouse
gtacaggcagtgatggcgag

SEQ ID NO: 713488 - DNA, 20 bp, mouse
ggaaacactacaggcagtga

SEQ ID NO: 713489 - DNA, 20 bp, mouse
gaatcccacaggagcctgac

SEQ ID NO: 713490 - DNA, 20 bp, mouse
gggttcttagagaatcccac

SEQ ID NO: 713491 - DNA, 20 bp, mouse
gttctgataccaagtactca

SEQ ID NO: 713492 - DNA, 20 bp, mouse
gtacttggtatcagaacagt

SEQ ID NO: 713493 - DNA, 20 bp, mouse
gttgccagtcaggctcctgt

SEQ ID NO: 713494 - DNA, 20 bp, mouse
gagatcagaatttgccagtc

SEQ ID NO: 713495 - DNA, 20 bp, mouse
gattgcattccctgagtact

SEQ ID NO: 713496 - DNA, 20 bp, mouse
gcaaagttgaaacatcctac

SEQ ID NO: 713497 - DNA, 20 bp, mouse
gaggaaaacaaaatgtctat

SEQ ID NO: 713498 - DNA, 20 bp, mouse
gagacattttgttttcctgt

SEQ ID NO: 713499 - DNA, 20 bp, mouse
ggaggaggggcggtgcccgg

SEQ ID NO: 713500 - DNA, 20 bp, mouse
gggggggcgtaaggagggtg

SEQ ID NO: 713501 - DNA, 20 bp, mouse
gtacgcccccccctcagttt

SEQ ID NO: 713502 - DNA, 20 bp, mouse
gggcaggcctgctttataca

SEQ ID NO: 713503 - DNA, 20 bp, mouse
gcagccgtcctcagggagga

SEQ ID NO: 713504 - DNA, 20 bp, mouse
gcgtatcctaaactgagggg

SEQ ID NO: 713505 - DNA, 20 bp, mouse
ggcttcgtatcctaaactga

SEQ ID NO: 713506 - DNA, 20 bp, mouse
gtattgtattcaaacaaagc

SEQ ID NO: 713507 - DNA, 20 bp, mouse
gtgaaaaggtaaagcctaga

SEQ ID NO: 713508 - DNA, 20 bp, mouse
gaatgtgactcaggtcatca

SEQ ID NO: 713509 - DNA, 20 bp, mouse
gagaaactgaaggctttcac

SEQ ID NO: 713510 - DNA, 20 bp, mouse
gtcatcagggcatttctgta

SEQ ID NO: 713511 - DNA, 20 bp, mouse
ggaaggaaccagcatgagtg

SEQ ID NO: 713512 - DNA, 20 bp, mouse
gttggtgaatcagaaactga

SEQ ID NO: 713513 - DNA, 20 bp, mouse
gatacaagagtgatttactt

SEQ ID NO: 713514 - DNA, 20 bp, mouse
gttctgtagggatttcattt

SEQ ID NO: 713515 - DNA, 20 bp, mouse
gaccagggaaagtttggaac

SEQ ID NO: 713516 - DNA, 20 bp, mouse
ggggaataatcttggagatt

SEQ ID NO: 713517 - DNA, 20 bp, mouse
ggggtggtgaccatctgcaa

SEQ ID NO: 713518 - DNA, 20 bp, mouse
gggaagttgtactacctaga

SEQ ID NO: 713519 - DNA, 20 bp, mouse
gcgggggcgagagcagacat

SEQ ID NO: 713520 - DNA, 20 bp, mouse
gcgacgtcacacagagaggt

SEQ ID NO: 713521 - DNA, 20 bp, mouse
ggcccggcgcaccaatagcg

SEQ ID NO: 713522 - DNA, 20 bp, mouse
gggccagaagcaccaatagc

SEQ ID NO: 713523 - DNA, 20 bp, mouse
gagcagacattggggtgtcc

SEQ ID NO: 713524 - DNA, 20 bp, mouse
ggtctgctctcgcccccgtc

SEQ ID NO: 713525 - DNA, 20 bp, mouse
gcgcaccaatagcgcggcca

SEQ ID NO: 713526 - DNA, 20 bp, mouse
ggggaattcatggacgaagg

SEQ ID NO: 713527 - DNA, 20 bp, mouse
gtggacaacctcttaagctt

SEQ ID NO: 713528 - DNA, 20 bp, mouse
gtaagaggttgtccagcaga

SEQ ID NO: 713529 - DNA, 20 bp, mouse
gaatctaggttcagtaaagt

SEQ ID NO: 713530 - DNA, 20 bp, mouse
gcttgggaattcatggacga

SEQ ID NO: 713531 - DNA, 20 bp, mouse
ggggttgattgccctttaag

SEQ ID NO: 713532 - DNA, 20 bp, mouse
gaggtctttacaacttcctt

SEQ ID NO: 713533 - DNA, 20 bp, mouse
gtgtgtgccatgtatgtctc

SEQ ID NO: 713534 - DNA, 20 bp, mouse
gctagatttgtcaagctttg

SEQ ID NO: 713535 - DNA, 20 bp, mouse
ggacattcttaagaggctga

SEQ ID NO: 713536 - DNA, 20 bp, mouse
gaaacctaccctagctccca

SEQ ID NO: 713537 - DNA, 20 bp, mouse
gaaaccctgggagctagggt

SEQ ID NO: 713538 - DNA, 20 bp, mouse
ggagctagggtaggtttctg

SEQ ID NO: 713539 - DNA, 20 bp, mouse
gcaacctaggacagtgccga

SEQ ID NO: 713540 - DNA, 20 bp, mouse
gacagtgccgagggcaatgg

SEQ ID NO: 713541 - DNA, 20 bp, mouse
gacttctcagaggacgatct

SEQ ID NO: 713542 - DNA, 20 bp, mouse
gaagctgccgggagcgaggc

SEQ ID NO: 713543 - DNA, 20 bp, mouse
ggccatcactgacttctcag

SEQ ID NO: 713544 - DNA, 20 bp, mouse
gatatggggagcagttaata

SEQ ID NO: 713545 - DNA, 20 bp, mouse
gtggggagcagttaataagg

SEQ ID NO: 713546 - DNA, 20 bp, mouse
ggagcctagcaggagtcggg

SEQ ID NO: 713547 - DNA, 20 bp, mouse
gagggagcctagcaggagtc

SEQ ID NO: 713548 - DNA, 20 bp, mouse
ggcagggcctaccggatgat

SEQ ID NO: 713549 - DNA, 20 bp, mouse
gtagcctcccgactcctgct

SEQ ID NO: 713550 - DNA, 20 bp, mouse
gagcaccgagggagcctagc

SEQ ID NO: 713551 - DNA, 20 bp, mouse
ggggaaaaacggacctgcgt

SEQ ID NO: 713552 - DNA, 20 bp, mouse
gctcgttcactcagcaccga

SEQ ID NO: 713553 - DNA, 20 bp, mouse
gcaaggtgatggtgagaccg

SEQ ID NO: 713554 - DNA, 20 bp, mouse
gacaaggcctagaccttggt

SEQ ID NO: 713555 - DNA, 20 bp, mouse
gcgccgcgtggctcccggaa

SEQ ID NO: 713556 - DNA, 20 bp, mouse
gaggaatagaatccccctgt

SEQ ID NO: 713557 - DNA, 20 bp, mouse
gaatgcctgccccctacaat

SEQ ID NO: 713558 - DNA, 20 bp, mouse
gcagttgatagacccacagg

SEQ ID NO: 713559 - DNA, 20 bp, mouse
gatgttttgtgtttaggggc

SEQ ID NO: 713560 - DNA, 20 bp, mouse
gtgggatgttttgtgtttag

SEQ ID NO: 713561 - DNA, 20 bp, mouse
gtttgtgtttaggggcgggt

SEQ ID NO: 713562 - DNA, 20 bp, mouse
gctttatcaccaattgtagg

SEQ ID NO: 713563 - DNA, 20 bp, mouse
gatcaccaattgtagggggc

SEQ ID NO: 713564 - DNA, 20 bp, mouse
gtttctttatcaccaattgt

SEQ ID NO: 713565 - DNA, 20 bp, mouse
ggagatcaggcgatgtaagt

SEQ ID NO: 713566 - DNA, 20 bp, mouse
gcacgtacgcacagggttgc

SEQ ID NO: 713567 - DNA, 20 bp, mouse
ggactggctggttgaggggt

SEQ ID NO: 713568 - DNA, 20 bp, mouse
gaaaggaagtagggatgatg

SEQ ID NO: 713569 - DNA, 20 bp, mouse
gtgggcttcagagtcagaaa

SEQ ID NO: 713570 - DNA, 20 bp, mouse
gtgaatggagggagttgtta

SEQ ID NO: 713571 - DNA, 20 bp, mouse
ggctatctcgggtgtaatgg

SEQ ID NO: 713572 - DNA, 20 bp, mouse
ggatgtgcttgctatatccc

SEQ ID NO: 713573 - DNA, 20 bp, mouse
gggtgggcgtagtgtggtat

SEQ ID NO: 713574 - DNA, 20 bp, mouse
gcaagagactggctggttga

SEQ ID NO: 713575 - DNA, 20 bp, mouse
ggaggattgaaccaagagac

SEQ ID NO: 713576 - DNA, 20 bp, mouse
gagcagagatgcccactctc

SEQ ID NO: 713577 - DNA, 20 bp, mouse
gcttctgttcacaataggta

SEQ ID NO: 713578 - DNA, 20 bp, mouse
gagatgcccactctcaggag

SEQ ID NO: 713579 - DNA, 20 bp, mouse
gatgtgcttctgttcacaat

SEQ ID NO: 713580 - DNA, 20 bp, mouse
gtcacaataggtaaggaatg

SEQ ID NO: 713581 - DNA, 20 bp, mouse
gagaaagaccaagtgctcaa

SEQ ID NO: 713582 - DNA, 20 bp, mouse
gcagaagcacatgtgtaggc

SEQ ID NO: 713583 - DNA, 20 bp, mouse
gggttcctacttatctgaat

SEQ ID NO: 713584 - DNA, 20 bp, mouse
gtcctacttatctgaatggg

SEQ ID NO: 713585 - DNA, 20 bp, mouse
gattcacattgcagctgttt

SEQ ID NO: 713586 - DNA, 20 bp, mouse
gacccacaagacatctaccc

SEQ ID NO: 713587 - DNA, 20 bp, mouse
gcatgcctgtagctctggtg

SEQ ID NO: 713588 - DNA, 20 bp, mouse
gtctaccacaccagagctac

SEQ ID NO: 713589 - DNA, 20 bp, mouse
gaccctgggtagatgtcttg

SEQ ID NO: 713590 - DNA, 20 bp, mouse
ggttgctactgtcatatata

SEQ ID NO: 713591 - DNA, 20 bp, mouse
gcatctacccagggttggtg

SEQ ID NO: 713592 - DNA, 20 bp, mouse
gggtagaccacaccaaccct

SEQ ID NO: 713593 - DNA, 20 bp, mouse
ggcattcagaaggcaggata

SEQ ID NO: 713594 - DNA, 20 bp, mouse
ggagaaattctcttctctaa

SEQ ID NO: 713595 - DNA, 20 bp, mouse
gaactcagcattcagaaggc

SEQ ID NO: 713596 - DNA, 20 bp, mouse
gaacagcaatgtcccatgta

SEQ ID NO: 713597 - DNA, 20 bp, mouse
gaaaactcaaactctggata

SEQ ID NO: 713598 - DNA, 20 bp, mouse
gtcaaactctggataaggtt

SEQ ID NO: 713599 - DNA, 20 bp, mouse
gtaagtcttggtggggaagt

SEQ ID NO: 713600 - DNA, 20 bp, mouse
gatgctctctaagtcttggt

SEQ ID NO: 713601 - DNA, 20 bp, mouse
ggttgactgctgatcaccaa

SEQ ID NO: 713602 - DNA, 20 bp, mouse
gagcctctcaataatggatg

SEQ ID NO: 713603 - DNA, 20 bp, mouse
ggagaaccattgtttgtttg

SEQ ID NO: 713604 - DNA, 20 bp, mouse
gtcagtacttcaacaagtta

SEQ ID NO: 713605 - DNA, 20 bp, mouse
gagcctacacaaggccaata

SEQ ID NO: 713606 - DNA, 20 bp, mouse
gctgtggccttcagtcaagt

SEQ ID NO: 713607 - DNA, 20 bp, mouse
ggggcaatgctccaaactcc

SEQ ID NO: 713608 - DNA, 20 bp, mouse
gcattgccctacttgactga

SEQ ID NO: 713609 - DNA, 20 bp, mouse
gtcggaacagagacgcagtc

SEQ ID NO: 713610 - DNA, 20 bp, mouse
gaaaggagctgctagggttg

SEQ ID NO: 713611 - DNA, 20 bp, mouse
gaaggagtgaagcttcttgt

SEQ ID NO: 713612 - DNA, 20 bp, mouse
gtgcctccttaggcaatgaa

SEQ ID NO: 713613 - DNA, 20 bp, mouse
gtggtctcagacctagtttc

SEQ ID NO: 713614 - DNA, 20 bp, mouse
gccttaggtgcttggactaa

SEQ ID NO: 713615 - DNA, 20 bp, mouse
gcagcagaataactctgcaa

SEQ ID NO: 713616 - DNA, 20 bp, mouse
gttgtcttgcttatgctcag

SEQ ID NO: 713617 - DNA, 20 bp, mouse
gttaagaagcaaggaagctt

SEQ ID NO: 713618 - DNA, 20 bp, mouse
gtaagggcctattcttccgg

SEQ ID NO: 713619 - DNA, 20 bp, mouse
gatggcagctaatcaactta

SEQ ID NO: 713620 - DNA, 20 bp, mouse
gctgtactgtaggacagtgg

SEQ ID NO: 713621 - DNA, 20 bp, mouse
ggaggagggcgcaagcaccc

SEQ ID NO: 713622 - DNA, 20 bp, mouse
gcaagcacccaggcttcagt

SEQ ID NO: 713623 - DNA, 20 bp, mouse
gtctctctgacccgtgctcc

SEQ ID NO: 713624 - DNA, 20 bp, mouse
ggtcgaagtcctgtgagata

SEQ ID NO: 713625 - DNA, 20 bp, mouse
gagataagggcctattcttc

SEQ ID NO: 713626 - DNA, 20 bp, mouse
gtctaatggcagggttaagt

SEQ ID NO: 713627 - DNA, 20 bp, mouse
gctacttaaagaatgtttca

SEQ ID NO: 713628 - DNA, 20 bp, mouse
gtacatccgctctaatggca

SEQ ID NO: 713629 - DNA, 20 bp, mouse
gtctctaatcgtgggagcgt

SEQ ID NO: 713630 - DNA, 20 bp, mouse
gacattatgaaagtctgcca

SEQ ID NO: 713631 - DNA, 20 bp, mouse
gatcagagaaaaagtaacca

SEQ ID NO: 713632 - DNA, 20 bp, mouse
ggtggaaatcttactaatca

SEQ ID NO: 713633 - DNA, 20 bp, mouse
gatgtcattctcatttggta

SEQ ID NO: 713634 - DNA, 20 bp, mouse
gtctcatttggtagggggtg

SEQ ID NO: 713635 - DNA, 20 bp, mouse
gactataggatcgacatttt

SEQ ID NO: 713636 - DNA, 20 bp, mouse
gctccctgagacactgggga

SEQ ID NO: 713637 - DNA, 20 bp, mouse
gggcctcttaatcactgctg

SEQ ID NO: 713638 - DNA, 20 bp, mouse
gggagattatgggccttcca

SEQ ID NO: 713639 - DNA, 20 bp, mouse
gatgacatgctgggagatta

SEQ ID NO: 713640 - DNA, 20 bp, mouse
gtaaagagccggggtgacga

SEQ ID NO: 713641 - DNA, 20 bp, mouse
gtgggagggagatgccaaag

SEQ ID NO: 713642 - DNA, 20 bp, mouse
gttcctcagcagtgattaag

SEQ ID NO: 713643 - DNA, 20 bp, mouse
gtggacacagggacttgacc

SEQ ID NO: 713644 - DNA, 20 bp, mouse
gactgtgctttaatcctctt

SEQ ID NO: 713645 - DNA, 20 bp, mouse
gattatgggccttccatggg

SEQ ID NO: 713646 - DNA, 20 bp, mouse
ggaatgcaatcaataagttt

SEQ ID NO: 713647 - DNA, 20 bp, mouse
gtgcaatcaataagttttgg

SEQ ID NO: 713648 - DNA, 20 bp, mouse
gcaggagtccacagtgagat

SEQ ID NO: 713649 - DNA, 20 bp, mouse
gtgtctctgaggcacctgtc

SEQ ID NO: 713650 - DNA, 20 bp, mouse
gagagacacagagatgagac

SEQ ID NO: 713651 - DNA, 20 bp, mouse
gctgcaatccaatctcactg

SEQ ID NO: 713652 - DNA, 20 bp, mouse
gaatagaatgagtggagtac

SEQ ID NO: 713653 - DNA, 20 bp, mouse
ggaacaagtcagtcgttaag

SEQ ID NO: 713654 - DNA, 20 bp, mouse
gggtgtgataatagaatgag

SEQ ID NO: 713655 - DNA, 20 bp, mouse
gttggcagacttcagttctg

SEQ ID NO: 713656 - DNA, 20 bp, mouse
gctcctactcctaacttcta

SEQ ID NO: 713657 - DNA, 20 bp, mouse
gtaagactatggcagcatac

SEQ ID NO: 713658 - DNA, 20 bp, mouse
gttagcaggtgtcaccttgt

SEQ ID NO: 713659 - DNA, 20 bp, mouse
gactatggcagcatactggc

SEQ ID NO: 713660 - DNA, 20 bp, mouse
gtcaaaacccacctggacag

SEQ ID NO: 713661 - DNA, 20 bp, mouse
gagtgtgccactgtccaggt

SEQ ID NO: 713662 - DNA, 20 bp, mouse
gtaggagctcaaaacccacc

SEQ ID NO: 713663 - DNA, 20 bp, mouse
gatgaagtgtgccactgtcc

SEQ ID NO: 713664 - DNA, 20 bp, mouse
gacgcatttgaaacatgttc

SEQ ID NO: 713665 - DNA, 20 bp, mouse
gatttggacaacttttgtgt

SEQ ID NO: 713666 - DNA, 20 bp, mouse
gacaggaaagcctcaaaaac

SEQ ID NO: 713667 - DNA, 20 bp, mouse
gatttttgagcctgtttttg

SEQ ID NO: 713668 - DNA, 20 bp, mouse
gtactctctctttcttggca

SEQ ID NO: 713669 - DNA, 20 bp, mouse
ggacacgattctgccaaatc

SEQ ID NO: 713670 - DNA, 20 bp, mouse
gctataggcgacgactagac

SEQ ID NO: 713671 - DNA, 20 bp, mouse
gtctttcatcccagaacctt

SEQ ID NO: 713672 - DNA, 20 bp, mouse
ggaaactaggcttgacatcc

SEQ ID NO: 713673 - DNA, 20 bp, mouse
gggcacccaagtagattgga

SEQ ID NO: 713674 - DNA, 20 bp, mouse
ggcaatgggaaaagttctaa

SEQ ID NO: 713675 - DNA, 20 bp, mouse
gctaggcttgacatccaggc

SEQ ID NO: 713676 - DNA, 20 bp, mouse
gccctcccaaccatgatact

SEQ ID NO: 713677 - DNA, 20 bp, mouse
gcaaaggggaaagtgctaat

SEQ ID NO: 713678 - DNA, 20 bp, mouse
gactcagcttcccagtatca

SEQ ID NO: 713679 - DNA, 20 bp, mouse
gtgggtcagaaaatctactt

SEQ ID NO: 713680 - DNA, 20 bp, mouse
gtgatctgcttctctccttt

SEQ ID NO: 713681 - DNA, 20 bp, mouse
ggcttctctcctttaggttc

SEQ ID NO: 713682 - DNA, 20 bp, mouse
gaaggcttttgccaccagac

SEQ ID NO: 713683 - DNA, 20 bp, mouse
gaactgactagacaggcaaa

SEQ ID NO: 713684 - DNA, 20 bp, mouse
ggagtcttctctcaatcaaa

SEQ ID NO: 713685 - DNA, 20 bp, mouse
gcttccaagaaagagagtga

SEQ ID NO: 713686 - DNA, 20 bp, mouse
gagtccgaaactaaagatca

SEQ ID NO: 713687 - DNA, 20 bp, mouse
gcagaaatatccattctgag

SEQ ID NO: 713688 - DNA, 20 bp, mouse
ggatgtcatgtattgaacac

SEQ ID NO: 713689 - DNA, 20 bp, mouse
gcacagcacttgtcacataa

SEQ ID NO: 713690 - DNA, 20 bp, mouse
gtacccataagagtaaacta

SEQ ID NO: 713691 - DNA, 20 bp, mouse
gttacactgacatatattcc

SEQ ID NO: 713692 - DNA, 20 bp, mouse
ggtattgtatattccttaag

SEQ ID NO: 713693 - DNA, 20 bp, mouse
ggtaacacaataaagtaaga

SEQ ID NO: 713694 - DNA, 20 bp, mouse
gccataagagtaaactaagg

SEQ ID NO: 713695 - DNA, 20 bp, mouse
gcacagaatgcactgtagcc

SEQ ID NO: 713696 - DNA, 20 bp, mouse
gaacaggagggtctcagttt

SEQ ID NO: 713697 - DNA, 20 bp, mouse
gagggtctcagtttgggctg

SEQ ID NO: 713698 - DNA, 20 bp, mouse
ggcaggcagtgatacagaaa

SEQ ID NO: 713699 - DNA, 20 bp, mouse
gtggtgaggttgctgaactc

SEQ ID NO: 713700 - DNA, 20 bp, mouse
gcagaatgcacctactggtg

SEQ ID NO: 713701 - DNA, 20 bp, mouse
gaaggacagaatgcacctac

SEQ ID NO: 713702 - DNA, 20 bp, mouse
ggttcagcaacctcaccagt

SEQ ID NO: 713703 - DNA, 20 bp, mouse
gtgctgctgtcacctctctc

SEQ ID NO: 713704 - DNA, 20 bp, mouse
gccccagtgaaagagactcc

SEQ ID NO: 713705 - DNA, 20 bp, mouse
gaccctggagtctctttcac

SEQ ID NO: 713706 - DNA, 20 bp, mouse
gcaggccctttgatctacag

SEQ ID NO: 713707 - DNA, 20 bp, mouse
gcttccaagtatgcagaaaa

SEQ ID NO: 713708 - DNA, 20 bp, mouse
gccccgcaccttctaatttg

SEQ ID NO: 713709 - DNA, 20 bp, mouse
gtcctcaaattagaaggtgc

SEQ ID NO: 713710 - DNA, 20 bp, mouse
gttttgagcgctcatatttc

SEQ ID NO: 713711 - DNA, 20 bp, mouse
gactgtccctttgtgcagaa

SEQ ID NO: 713712 - DNA, 20 bp, mouse
ggccattcttccaaaatttg

SEQ ID NO: 713713 - DNA, 20 bp, mouse
gatgtccccttctgcacaaa

SEQ ID NO: 713714 - DNA, 20 bp, mouse
gccctgaaactctgttgaaa

SEQ ID NO: 713715 - DNA, 20 bp, mouse
gtccttttcaacagagtttc

SEQ ID NO: 713716 - DNA, 20 bp, mouse
gcatgtagggcattctactc

SEQ ID NO: 713717 - DNA, 20 bp, mouse
gtagaatgccctacatgtgc

SEQ ID NO: 713718 - DNA, 20 bp, mouse
gtggagagaagcaagtccta

SEQ ID NO: 713719 - DNA, 20 bp, mouse
gaagtgcactggtggcacag

SEQ ID NO: 713720 - DNA, 20 bp, mouse
gtggtgtggtagagctctta

SEQ ID NO: 713721 - DNA, 20 bp, mouse
ggcctgcagctcctggtact

SEQ ID NO: 713722 - DNA, 20 bp, mouse
gggcctcccaacaggcaggt

SEQ ID NO: 713723 - DNA, 20 bp, mouse
gggaggatgaagtgcactgg

SEQ ID NO: 713724 - DNA, 20 bp, mouse
gaaactgcctctattaccca

SEQ ID NO: 713725 - DNA, 20 bp, mouse
gtgagtgtagtgtgaactcc

SEQ ID NO: 713726 - DNA, 20 bp, mouse
gcccagggggactcttcaat

SEQ ID NO: 713727 - DNA, 20 bp, mouse
gggactcttcaatgggctga

SEQ ID NO: 713728 - DNA, 20 bp, mouse
gcacacctttagcacccagg

SEQ ID NO: 713729 - DNA, 20 bp, mouse
ggagtcacaaaagcaaacat

SEQ ID NO: 713730 - DNA, 20 bp, mouse
gacactgaggtctgaaaccc

SEQ ID NO: 713731 - DNA, 20 bp, mouse
ggagtccccctgggtgctaa

SEQ ID NO: 713732 - DNA, 20 bp, mouse
ggccagagaattgtgtttgc

SEQ ID NO: 713733 - DNA, 20 bp, mouse
ggactgatggtaaagccatg

SEQ ID NO: 713734 - DNA, 20 bp, mouse
gtggagtatgatctgaaaga

SEQ ID NO: 713735 - DNA, 20 bp, mouse
gcagacatgactcagcccca

SEQ ID NO: 713736 - DNA, 20 bp, mouse
gatgagcagattgggtgtat

SEQ ID NO: 713737 - DNA, 20 bp, mouse
gaagctgtatcttattgagt

SEQ ID NO: 713738 - DNA, 20 bp, mouse
gaaaagatgatgagcagatt

SEQ ID NO: 713739 - DNA, 20 bp, mouse
ggggacttaatatatacctt

SEQ ID NO: 713740 - DNA, 20 bp, mouse
gaataagatacagcttcctc

SEQ ID NO: 713741 - DNA, 20 bp, mouse
gtgtcctggatagactatgc

SEQ ID NO: 713742 - DNA, 20 bp, mouse
gacaccagcatagtctatcc

SEQ ID NO: 713743 - DNA, 20 bp, mouse
gtttctttatatcagttaat

SEQ ID NO: 713744 - DNA, 20 bp, mouse
ggttctaatgtcattttaga

SEQ ID NO: 713745 - DNA, 20 bp, mouse
gcaaggaagacagaattcag

SEQ ID NO: 713746 - DNA, 20 bp, mouse
gaagagtccagttaattaat

SEQ ID NO: 713747 - DNA, 20 bp, mouse
gcacagcttccaataaaaaa

SEQ ID NO: 713748 - DNA, 20 bp, mouse
gttactggttttgatttttg

SEQ ID NO: 713749 - DNA, 20 bp, mouse
gcataggcagctgactaaac

SEQ ID NO: 713750 - DNA, 20 bp, mouse
gagagtgataacatcttact

SEQ ID NO: 713751 - DNA, 20 bp, mouse
ggtctacagttaaacatcat

SEQ ID NO: 713752 - DNA, 20 bp, mouse
gtcaaaaccagtaaacaaaa

SEQ ID NO: 713753 - DNA, 20 bp, mouse
gcaaatctacttgggctgcc

SEQ ID NO: 713754 - DNA, 20 bp, mouse
gttcactcctttttgtttac

SEQ ID NO: 713755 - DNA, 20 bp, mouse
gatattttactctctacacc

SEQ ID NO: 713756 - DNA, 20 bp, mouse
gggacccatggtaatttatc

SEQ ID NO: 713757 - DNA, 20 bp, mouse
gtgtccaatgcttcaccagg

SEQ ID NO: 713758 - DNA, 20 bp, mouse
gtcatccagataaattacca

SEQ ID NO: 713759 - DNA, 20 bp, mouse
gtgaaatttcaaaaacctcc

SEQ ID NO: 713760 - DNA, 20 bp, mouse
ggtgaagcattggacattac

SEQ ID NO: 713761 - DNA, 20 bp, mouse
gcagcagataacaaagctcc

SEQ ID NO: 713762 - DNA, 20 bp, mouse
gagttccagaggtgagtcat

SEQ ID NO: 713763 - DNA, 20 bp, mouse
gagaaagggaaaaatccaaa

SEQ ID NO: 713764 - DNA, 20 bp, mouse
gttggatattacatatcctg

SEQ ID NO: 713765 - DNA, 20 bp, mouse
gcagaaattgcaagttccag

SEQ ID NO: 713766 - DNA, 20 bp, mouse
gtactggttcacatcaatgg

SEQ ID NO: 713767 - DNA, 20 bp, mouse
ggtttggtggatctgtttta

SEQ ID NO: 713768 - DNA, 20 bp, mouse
gcatacttgtaaatatattc

SEQ ID NO: 713769 - DNA, 20 bp, mouse
gttctggtgtctctacagaa

SEQ ID NO: 713770 - DNA, 20 bp, mouse
gtaaactttcacagggttcc

SEQ ID NO: 713771 - DNA, 20 bp, mouse
ggaaactcttgtgaactcag

SEQ ID NO: 713772 - DNA, 20 bp, mouse
gctgtactggttcacatcaa

SEQ ID NO: 713773 - DNA, 20 bp, mouse
gtttcctcttcagacatttc

SEQ ID NO: 713774 - DNA, 20 bp, mouse
gtgtgtgcttaaaaaggcct

SEQ ID NO: 713775 - DNA, 20 bp, mouse
ggtgggaggaagcttctcta

SEQ ID NO: 713776 - DNA, 20 bp, mouse
gtggggacctacaggatatt

SEQ ID NO: 713777 - DNA, 20 bp, mouse
ggccaaccccaatatcctgt

SEQ ID NO: 713778 - DNA, 20 bp, mouse
gacctacaggatattggggt

SEQ ID NO: 713779 - DNA, 20 bp, mouse
gagtctatgctaatgctggg

SEQ ID NO: 713780 - DNA, 20 bp, mouse
gcactgagtgacattacaga

SEQ ID NO: 713781 - DNA, 20 bp, mouse
gggttatagtaatattgcaa

SEQ ID NO: 713782 - DNA, 20 bp, mouse
gcagatgtaggccaaacctg

SEQ ID NO: 713783 - DNA, 20 bp, mouse
gtggacttacaaagcagctg

SEQ ID NO: 713784 - DNA, 20 bp, mouse
gctgctaaaagtatcaccag

SEQ ID NO: 713785 - DNA, 20 bp, mouse
ggggatggcatcctcaggtt

SEQ ID NO: 713786 - DNA, 20 bp, mouse
gctgggaatggcacaatgtc

SEQ ID NO: 713787 - DNA, 20 bp, mouse
gagcaggactctttggatgt

SEQ ID NO: 713788 - DNA, 20 bp, mouse
gtgtaggtagtcaaatgagg

SEQ ID NO: 713789 - DNA, 20 bp, mouse
gagccatcagcaggactctt

SEQ ID NO: 713790 - DNA, 20 bp, mouse
gaaatgaggaggtacagaag

SEQ ID NO: 713791 - DNA, 20 bp, mouse
gtggcacaatgtctggctca

SEQ ID NO: 713792 - DNA, 20 bp, mouse
gggatgtaggtagtcaaatg

SEQ ID NO: 713793 - DNA, 20 bp, mouse
ggctcagtggtgatctagac

SEQ ID NO: 713794 - DNA, 20 bp, mouse
gcaaggatcccctatgtatt

SEQ ID NO: 713795 - DNA, 20 bp, mouse
ggaaagtccacagcattatg

SEQ ID NO: 713796 - DNA, 20 bp, mouse
gccaggatggcactgttagg

SEQ ID NO: 713797 - DNA, 20 bp, mouse
gtagacaagtagtagtgtgg

SEQ ID NO: 713798 - DNA, 20 bp, mouse
ggctcagggtgctggctcct

SEQ ID NO: 713799 - DNA, 20 bp, mouse
gaaggccagttggagaagac

SEQ ID NO: 713800 - DNA, 20 bp, mouse
gagggcaggcatggttcagg

SEQ ID NO: 713801 - DNA, 20 bp, mouse
gactacttgtctataatccc

SEQ ID NO: 713802 - DNA, 20 bp, mouse
gaggaggtatggagtaggta

SEQ ID NO: 713803 - DNA, 20 bp, mouse
gctgttaggaggtatggagt

SEQ ID NO: 713804 - DNA, 20 bp, mouse
gttccaggaagctaggaggg

SEQ ID NO: 713805 - DNA, 20 bp, mouse
ggccagggcaggcatggttc

SEQ ID NO: 713806 - DNA, 20 bp, mouse
gttaccttcctatgagacag

SEQ ID NO: 713807 - DNA, 20 bp, mouse
ggcacctctgtctcatagga

SEQ ID NO: 713808 - DNA, 20 bp, mouse
ggaggtgcttctgttcctaa

SEQ ID NO: 713809 - DNA, 20 bp, mouse
ggtgaaattgggagatagcc

SEQ ID NO: 713810 - DNA, 20 bp, mouse
gagacatacaagtggatcaa

SEQ ID NO: 713811 - DNA, 20 bp, mouse
gtctctgtaccaataccatt

SEQ ID NO: 713812 - DNA, 20 bp, mouse
gagaagcacctctgtctcat

SEQ ID NO: 713813 - DNA, 20 bp, mouse
gcttctgttcctaatggtat

SEQ ID NO: 713814 - DNA, 20 bp, mouse
gtggtacagagacatacaag

SEQ ID NO: 713815 - DNA, 20 bp, mouse
gttgtcaaagatgtatttat

SEQ ID NO: 713816 - DNA, 20 bp, mouse
gaaaaaaaaacttcctccga

SEQ ID NO: 713817 - DNA, 20 bp, mouse
gggaggaagtttttttttcc

SEQ ID NO: 713818 - DNA, 20 bp, mouse
ggctggggttcgatgtgacc

SEQ ID NO: 713819 - DNA, 20 bp, mouse
gcattgatgcgcttcttgct

SEQ ID NO: 713820 - DNA, 20 bp, mouse
gccgtgagcgttgattcttt

SEQ ID NO: 713821 - DNA, 20 bp, mouse
gggttcgatgtgaccgggcc

SEQ ID NO: 713822 - DNA, 20 bp, mouse
ggggcaatccgacccctcgg

SEQ ID NO: 713823 - DNA, 20 bp, mouse
gaaaacttcctccgaggggt

SEQ ID NO: 713824 - DNA, 20 bp, mouse
gcaagtgtcctttgaaaaaa

SEQ ID NO: 713825 - DNA, 20 bp, mouse
gaacagctacagaagaaatt

SEQ ID NO: 713826 - DNA, 20 bp, mouse
ggaatgcaatcaataagttt

SEQ ID NO: 713827 - DNA, 20 bp, mouse
gtgcaatcaataagttttgg

SEQ ID NO: 713828 - DNA, 20 bp, mouse
gcaggagtccacagtgagat

SEQ ID NO: 713829 - DNA, 20 bp, mouse
gtgtctctgaggcacctgtc

SEQ ID NO: 713830 - DNA, 20 bp, mouse
gagagacacagagatgagac

SEQ ID NO: 713831 - DNA, 20 bp, mouse
gctgcaatccaatctcactg

SEQ ID NO: 713832 - DNA, 20 bp, mouse
gaatagaatgagtggagtac

SEQ ID NO: 713833 - DNA, 20 bp, mouse
ggaacaagtcagtcgttaag

SEQ ID NO: 713834 - DNA, 20 bp, mouse
gggtgtgataatagaatgag

SEQ ID NO: 713835 - DNA, 20 bp, mouse
gttggcagacttcagttctg

SEQ ID NO: 713836 - DNA, 20 bp, mouse
ggggctcgatctagaggacg

SEQ ID NO: 713837 - DNA, 20 bp, mouse
ggccgcccctgccgccgctt

SEQ ID NO: 713838 - DNA, 20 bp, mouse
gcgcttggggactttgacaa

SEQ ID NO: 713839 - DNA, 20 bp, mouse
ggcatcagggctcgatctag

SEQ ID NO: 713840 - DNA, 20 bp, mouse
gggtggccggccaggcgagg

SEQ ID NO: 713841 - DNA, 20 bp, mouse
gccccaagcggcggcagggg

SEQ ID NO: 713842 - DNA, 20 bp, mouse
gaagtccccaagcggcggca

SEQ ID NO: 713843 - DNA, 20 bp, mouse
ggcctttgccccgcctcgcc

SEQ ID NO: 713844 - DNA, 20 bp, mouse
gtctacgtgctgtggttcga

SEQ ID NO: 713845 - DNA, 20 bp, mouse
gaaccacagcacgtagagaa

SEQ ID NO: 713846 - DNA, 20 bp, mouse
gaagaggaacgagagataag

SEQ ID NO: 713847 - DNA, 20 bp, mouse
gcagccattctcaggtacta

SEQ ID NO: 713848 - DNA, 20 bp, mouse
gcacttcaggggacctagtc

SEQ ID NO: 713849 - DNA, 20 bp, mouse
gaatatgtactagacatctc

SEQ ID NO: 713850 - DNA, 20 bp, mouse
gctctcgttcctcttatctc

SEQ ID NO: 713851 - DNA, 20 bp, mouse
ggacccttagtacctgagaa

SEQ ID NO: 713852 - DNA, 20 bp, mouse
ggtagaagaagatagtgtgg

SEQ ID NO: 713853 - DNA, 20 bp, mouse
gtggggagaagtatggcatg

SEQ ID NO: 713854 - DNA, 20 bp, mouse
ggttgcactcataacttgga

SEQ ID NO: 713855 - DNA, 20 bp, mouse
ggtcacttcatacatgccga

SEQ ID NO: 713856 - DNA, 20 bp, mouse
gcatgcttcaccaggagcat

SEQ ID NO: 713857 - DNA, 20 bp, mouse
ggtgaagcatgggacattcc

SEQ ID NO: 713858 - DNA, 20 bp, mouse
gcccttgcctgtctttacag

SEQ ID NO: 713859 - DNA, 20 bp, mouse
gggcctccagcagataacaa

SEQ ID NO: 713860 - DNA, 20 bp, mouse
gaatctatgcattctttcaa

SEQ ID NO: 713861 - DNA, 20 bp, mouse
gagttccagaggtgagtcat

SEQ ID NO: 713862 - DNA, 20 bp, mouse
gttggatattacatatcctg

SEQ ID NO: 713863 - DNA, 20 bp, mouse
gcagaaattgcaagttccag

SEQ ID NO: 713864 - DNA, 20 bp, mouse
gatatccaatgactcacctc

SEQ ID NO: 713865 - DNA, 20 bp, mouse
gctgaaatttccaatgctcc

SEQ ID NO: 713866 - DNA, 20 bp, mouse
ggccaggtgggcacaaacta

SEQ ID NO: 713867 - DNA, 20 bp, mouse
gatgccagccagtctttcca

SEQ ID NO: 713868 - DNA, 20 bp, mouse
gtagtccccagtccagacac

SEQ ID NO: 713869 - DNA, 20 bp, mouse
gtattagtagttggccaggt

SEQ ID NO: 713870 - DNA, 20 bp, mouse
gaccgtagtttgtgcccacc

SEQ ID NO: 713871 - DNA, 20 bp, mouse
gaaacacaccttggaaagac

SEQ ID NO: 713872 - DNA, 20 bp, mouse
ggggtgcttacagctcttcc

SEQ ID NO: 713873 - DNA, 20 bp, mouse
gaatctattagtagttggcc

SEQ ID NO: 713874 - DNA, 20 bp, mouse
gtgccagatgagaaccaaac

SEQ ID NO: 713875 - DNA, 20 bp, mouse
ggagagatggctcagaaagc

SEQ ID NO: 713876 - DNA, 20 bp, mouse
gcccaacttcaggtagtcac

SEQ ID NO: 713877 - DNA, 20 bp, mouse
gtagcccagcagctgcacat

SEQ ID NO: 713878 - DNA, 20 bp, mouse
gaaaaggagctcaggtggag

SEQ ID NO: 713879 - DNA, 20 bp, mouse
gggctctagtcagtccccag

SEQ ID NO: 713880 - DNA, 20 bp, mouse
gcacatgggcgcataataaa

SEQ ID NO: 713881 - DNA, 20 bp, mouse
gtcagagaaggcagaatgtg

SEQ ID NO: 713882 - DNA, 20 bp, mouse
gcgcataataaaaggagctc

SEQ ID NO: 713883 - DNA, 20 bp, mouse
gctcccgctgacctgttgtg

SEQ ID NO: 713884 - DNA, 20 bp, mouse
ggagctccgaccagttctcc

SEQ ID NO: 713885 - DNA, 20 bp, mouse
gccttgaattgggacatctg

SEQ ID NO: 713886 - DNA, 20 bp, mouse
gagggcagaaaccatagctg

SEQ ID NO: 713887 - DNA, 20 bp, mouse
gaggctgaacagagaaacac

SEQ ID NO: 713888 - DNA, 20 bp, mouse
gaagaattaaattacaaata

SEQ ID NO: 713889 - DNA, 20 bp, mouse
gaataaggacaagaataatt

SEQ ID NO: 713890 - DNA, 20 bp, mouse
gtgggggcggcggccgtgac

SEQ ID NO: 713891 - DNA, 20 bp, mouse
ggtgtgggtgacgtcgctgg

SEQ ID NO: 713892 - DNA, 20 bp, mouse
gtctcttttagccgcagcta

SEQ ID NO: 713893 - DNA, 20 bp, mouse
gtttgttgtaagtttttctg

SEQ ID NO: 713894 - DNA, 20 bp, mouse
gttctctgttcagcctccgc

SEQ ID NO: 713895 - DNA, 20 bp, mouse
ggttcagcctccgccggtca

SEQ ID NO: 713896 - DNA, 20 bp, mouse
ggcagctccgcggacgtccc

SEQ ID NO: 713897 - DNA, 20 bp, mouse
gaccccgcccctggcgggag

SEQ ID NO: 713898 - DNA, 20 bp, mouse
gtcaccccgcgggactcggg

SEQ ID NO: 713899 - DNA, 20 bp, mouse
gggggagccggggacgtccg

SEQ ID NO: 713900 - DNA, 20 bp, mouse
gcgggccccgggctcccgat

SEQ ID NO: 713901 - DNA, 20 bp, mouse
gcggcctcccgagtcccgcg

SEQ ID NO: 713902 - DNA, 20 bp, mouse
gcgatcgcggggagacggcg

SEQ ID NO: 713903 - DNA, 20 bp, mouse
ggcggccaatcgggagcccg

SEQ ID NO: 713904 - DNA, 20 bp, mouse
gcccgcgtgacgtcaccccg

SEQ ID NO: 713905 - DNA, 20 bp, mouse
gagccgctcccgccaggggc

SEQ ID NO: 713906 - DNA, 20 bp, mouse
ggaaccggggaccctggagg

SEQ ID NO: 713907 - DNA, 20 bp, mouse
gcgggcctcacgtcacgcgg

SEQ ID NO: 713908 - DNA, 20 bp, mouse
ggccgccgccgcgtgacgtg

SEQ ID NO: 713909 - DNA, 20 bp, mouse
ggaaccgtgacgtacaattg

SEQ ID NO: 713910 - DNA, 20 bp, mouse
gcggtggcggctggggatcc

SEQ ID NO: 713911 - DNA, 20 bp, mouse
gcgaccgtgcggacttaaga

SEQ ID NO: 713912 - DNA, 20 bp, mouse
gctgcagccggggccccggg

SEQ ID NO: 713913 - DNA, 20 bp, mouse
ggacgtacaattggggtctg

SEQ ID NO: 713914 - DNA, 20 bp, mouse
ggaagagagcggggctgaga

SEQ ID NO: 713915 - DNA, 20 bp, mouse
ggggcgggcctcacgtcacg

SEQ ID NO: 713916 - DNA, 20 bp, mouse
gcttcgtctgaagacaccag

SEQ ID NO: 713917 - DNA, 20 bp, mouse
gagaaatgcaattgtgaggc

SEQ ID NO: 713918 - DNA, 20 bp, mouse
gtggatctaatgcactcctc

SEQ ID NO: 713919 - DNA, 20 bp, mouse
ggaaatttaggttcaacata

SEQ ID NO: 713920 - DNA, 20 bp, mouse
gttgtaaaaattttcttttt

SEQ ID NO: 713921 - DNA, 20 bp, mouse
gattttaataatttgtacaa

SEQ ID NO: 713922 - DNA, 20 bp, mouse
gttttagaaatgcaattgtg

SEQ ID NO: 713923 - DNA, 20 bp, mouse
gttttaatcttcactgtgtg

SEQ ID NO: 713924 - DNA, 20 bp, mouse
gatttctaaaatgaaatcat

SEQ ID NO: 713925 - DNA, 20 bp, mouse
gtaaaaattttcttttttgg

SEQ ID NO: 713926 - DNA, 20 bp, mouse
ggatactcacagggagaata

SEQ ID NO: 713927 - DNA, 20 bp, mouse
gctgtggtagcagatctctg

SEQ ID NO: 713928 - DNA, 20 bp, mouse
gcattgaccacatgagaagt

SEQ ID NO: 713929 - DNA, 20 bp, mouse
gaatagctgctgatactcac

SEQ ID NO: 713930 - DNA, 20 bp, mouse
ggtgatctcagttagacaag

SEQ ID NO: 713931 - DNA, 20 bp, mouse
gtcatattttgatcttctcc

SEQ ID NO: 713932 - DNA, 20 bp, mouse
gtgaccacatgagaagtagg

SEQ ID NO: 713933 - DNA, 20 bp, mouse
gagcccacctacttctcatg

SEQ ID NO: 713934 - DNA, 20 bp, mouse
gctcagttagacaagaggag

SEQ ID NO: 713935 - DNA, 20 bp, mouse
gaacactttgataaatgctg

SEQ ID NO: 713936 - DNA, 20 bp, mouse
ggggtgagggagtcttttgc

SEQ ID NO: 713937 - DNA, 20 bp, mouse
gagtagttcctgtggggtga

SEQ ID NO: 713938 - DNA, 20 bp, mouse
gaaagactccctcaccccac

SEQ ID NO: 713939 - DNA, 20 bp, mouse
gagtccaattcttgcaatat

SEQ ID NO: 713940 - DNA, 20 bp, mouse
gaattcttgcaatattggta

SEQ ID NO: 713941 - DNA, 20 bp, mouse
ggccaatggtcccaaggact

SEQ ID NO: 713942 - DNA, 20 bp, mouse
ggcaatatgcattgtatcat

SEQ ID NO: 713943 - DNA, 20 bp, mouse
ggtggatagtcttacacata

SEQ ID NO: 713944 - DNA, 20 bp, mouse
gttcatagtagtagttcctg

SEQ ID NO: 713945 - DNA, 20 bp, mouse
gtccaccaaagagtaagatg

SEQ ID NO: 713946 - DNA, 20 bp, mouse
gtctgggtcacatcttcagc

SEQ ID NO: 713947 - DNA, 20 bp, mouse
gcaaaaggacattgaaataa

SEQ ID NO: 713948 - DNA, 20 bp, mouse
gtcagctggagacctacaaa

SEQ ID NO: 713949 - DNA, 20 bp, mouse
gtcatcttggattaagggcg

SEQ ID NO: 713950 - DNA, 20 bp, mouse
gggtagtatctatatagtat

SEQ ID NO: 713951 - DNA, 20 bp, mouse
gtcttggattaagggcgtgg

SEQ ID NO: 713952 - DNA, 20 bp, mouse
ggaacatttctgtattagtc

SEQ ID NO: 713953 - DNA, 20 bp, mouse
gacacttaaagaaattgtag

SEQ ID NO: 713954 - DNA, 20 bp, mouse
gtcttcacctgcttgcctcg

SEQ ID NO: 713955 - DNA, 20 bp, mouse
gtcaaggtcatcttggatta

SEQ ID NO: 713956 - DNA, 20 bp, mouse
gagggtgtggtactaatgag

SEQ ID NO: 713957 - DNA, 20 bp, mouse
gtccacaaggcatatcataa

SEQ ID NO: 713958 - DNA, 20 bp, mouse
ggtatcatgatgatccctat

SEQ ID NO: 713959 - DNA, 20 bp, mouse
ggatgatccctattggacta

SEQ ID NO: 713960 - DNA, 20 bp, mouse
gtagtcaagcatggcagcaa

SEQ ID NO: 713961 - DNA, 20 bp, mouse
gtcaaggctcattatccaca

SEQ ID NO: 713962 - DNA, 20 bp, mouse
gttggtgtcacagtgggtaa

SEQ ID NO: 713963 - DNA, 20 bp, mouse
gtcccttatgatatgccttg

SEQ ID NO: 713964 - DNA, 20 bp, mouse
gatagaaccatagtccaata

SEQ ID NO: 713965 - DNA, 20 bp, mouse
ggctgatttggtgtcacagt

SEQ ID NO: 713966 - DNA, 20 bp, mouse
gtgacccaccaagtcaatgt

SEQ ID NO: 713967 - DNA, 20 bp, mouse
ggaagtggaaggaatggtat

SEQ ID NO: 713968 - DNA, 20 bp, mouse
gacaggaaagcaaggtaaca

SEQ ID NO: 713969 - DNA, 20 bp, mouse
gtttggtgtattgacactgg

SEQ ID NO: 713970 - DNA, 20 bp, mouse
ggctcatcagaagagataac

SEQ ID NO: 713971 - DNA, 20 bp, mouse
gaagagataacagggtgaca

SEQ ID NO: 713972 - DNA, 20 bp, mouse
ggtgttcaatccacttttca

SEQ ID NO: 713973 - DNA, 20 bp, mouse
gactcttaacagtttctctt

SEQ ID NO: 713974 - DNA, 20 bp, mouse
gggaggtgtttgtgcttcat

SEQ ID NO: 713975 - DNA, 20 bp, mouse
gtgggtgcagtgttggtatt

SEQ ID NO: 713976 - DNA, 20 bp, mouse
gttatttaatggtaaaacaa

SEQ ID NO: 713977 - DNA, 20 bp, mouse
gttgcaaatatacacttgat

SEQ ID NO: 713978 - DNA, 20 bp, mouse
gtacatgaatttgtgtgcca

SEQ ID NO: 713979 - DNA, 20 bp, mouse
gccctataaaaggcaaggtt

SEQ ID NO: 713980 - DNA, 20 bp, mouse
gtatgtgtctgccctataaa

SEQ ID NO: 713981 - DNA, 20 bp, mouse
ggtctgccctataaaaggca

SEQ ID NO: 713982 - DNA, 20 bp, mouse
gttgctacataatgttgctt

SEQ ID NO: 713983 - DNA, 20 bp, mouse
gagtaatagacttgttcaga

SEQ ID NO: 713984 - DNA, 20 bp, mouse
gacttgttcagaaggaagtt

SEQ ID NO: 713985 - DNA, 20 bp, mouse
gtatgtagcaaattatttaa

SEQ ID NO: 713986 - DNA, 20 bp, mouse
gcaaaggagagataacatgt

SEQ ID NO: 713987 - DNA, 20 bp, mouse
gagtaaagttgtttagccac

SEQ ID NO: 713988 - DNA, 20 bp, mouse
ggttgtttagccactggtag

SEQ ID NO: 713989 - DNA, 20 bp, mouse
gcaggtttgtatttgcaaaa

SEQ ID NO: 713990 - DNA, 20 bp, mouse
gaaaattttgcctctaccag

SEQ ID NO: 713991 - DNA, 20 bp, mouse
ggtcagggttttgattatgc

SEQ ID NO: 713992 - DNA, 20 bp, mouse
gttgaagcaggaagattatg

SEQ ID NO: 713993 - DNA, 20 bp, mouse
gacaactttactgatgcctc

SEQ ID NO: 713994 - DNA, 20 bp, mouse
ggacataaataagtgtgtca

SEQ ID NO: 713995 - DNA, 20 bp, mouse
gtattactctgtcatcaaaa

SEQ ID NO: 713996 - DNA, 20 bp, mouse
ggaattggtctgctgatagg

SEQ ID NO: 713997 - DNA, 20 bp, mouse
gtttggctgtacagtgtaat

SEQ ID NO: 713998 - DNA, 20 bp, mouse
gcgggaattggtctgctgat

SEQ ID NO: 713999 - DNA, 20 bp, mouse
gagaaggctgaggcaccaat

SEQ ID NO: 714000 - DNA, 20 bp, mouse
gagctcatggacaggggctt

SEQ ID NO: 714001 - DNA, 20 bp, mouse
ggtgagtagctcatggacag

SEQ ID NO: 714002 - DNA, 20 bp, mouse
gtgtacagtgtaatgggctc

SEQ ID NO: 714003 - DNA, 20 bp, mouse
gtatttgctagaaagaccat

SEQ ID NO: 714004 - DNA, 20 bp, mouse
ggcactcttggaaataagac

SEQ ID NO: 714005 - DNA, 20 bp, mouse
gtagtctccaatgtcccaca

SEQ ID NO: 714006 - DNA, 20 bp, mouse
ggcaaaagctaatgactcag

SEQ ID NO: 714007 - DNA, 20 bp, mouse
gtggaaggccacagaataac

SEQ ID NO: 714008 - DNA, 20 bp, mouse
gtcatgaaggtgaacatcta

SEQ ID NO: 714009 - DNA, 20 bp, mouse
gctcactgtgaagagatgga

SEQ ID NO: 714010 - DNA, 20 bp, mouse
ggggcaagcaagtatgaatt

SEQ ID NO: 714011 - DNA, 20 bp, mouse
gaatttctatccactcccca

SEQ ID NO: 714012 - DNA, 20 bp, mouse
ggagtcattagcttttgccc

SEQ ID NO: 714013 - DNA, 20 bp, mouse
gcttgcttgccctctcatga

SEQ ID NO: 714014 - DNA, 20 bp, mouse
gtagcttttgccctggggag

SEQ ID NO: 714015 - DNA, 20 bp, mouse
gccagggccttccttgttgc

SEQ ID NO: 714016 - DNA, 20 bp, mouse
gacctaaaggagatcatcac

SEQ ID NO: 714017 - DNA, 20 bp, mouse
gtcacttagaagactcactt

SEQ ID NO: 714018 - DNA, 20 bp, mouse
ggcctgtgatgatctccttt

SEQ ID NO: 714019 - DNA, 20 bp, mouse
gagaaactcaaaaaaaaggg

SEQ ID NO: 714020 - DNA, 20 bp, mouse
gacagagaaactcaaaaaaa

SEQ ID NO: 714021 - DNA, 20 bp, mouse
gttaaagagattatttgccg

SEQ ID NO: 714022 - DNA, 20 bp, mouse
ggtcaagaagaggttatctg

SEQ ID NO: 714023 - DNA, 20 bp, mouse
gcacacgtcacaccaccatc

SEQ ID NO: 714024 - DNA, 20 bp, mouse
gtcagaaggcaggtgtgttg

SEQ ID NO: 714025 - DNA, 20 bp, mouse
gtgaccccactgggaggtag

SEQ ID NO: 714026 - DNA, 20 bp, mouse
gggcgagagtggctcatatc

SEQ ID NO: 714027 - DNA, 20 bp, mouse
ggactcagctctggcgagag

SEQ ID NO: 714028 - DNA, 20 bp, mouse
ggtccagttcgatagaatca

SEQ ID NO: 714029 - DNA, 20 bp, mouse
gtaccctgattctatcgaac

SEQ ID NO: 714030 - DNA, 20 bp, mouse
gaagaaaagatatggagaag

SEQ ID NO: 714031 - DNA, 20 bp, mouse
gactggatggatagtgatgg

SEQ ID NO: 714032 - DNA, 20 bp, mouse
gggagccaaagctgaggcag

SEQ ID NO: 714033 - DNA, 20 bp, mouse
gtaggcctctgcctcagctt

SEQ ID NO: 714034 - DNA, 20 bp, mouse
gaagaaccagcaggaatacc

SEQ ID NO: 714035 - DNA, 20 bp, mouse
gtccgtgaagtgtttgctag

SEQ ID NO: 714036 - DNA, 20 bp, mouse
gaacttgtggttggcagtta

SEQ ID NO: 714037 - DNA, 20 bp, mouse
gacagctggcctgtgctatg

SEQ ID NO: 714038 - DNA, 20 bp, mouse
gctcatcagccacatagcac

SEQ ID NO: 714039 - DNA, 20 bp, mouse
gtcctcccctggactgagag

SEQ ID NO: 714040 - DNA, 20 bp, mouse
gaggtcttggaacttgtggt

SEQ ID NO: 714041 - DNA, 20 bp, mouse
gaggaaaaataggtaaggat

SEQ ID NO: 714042 - DNA, 20 bp, mouse
gagactcctcgacaaacaat

SEQ ID NO: 714043 - DNA, 20 bp, mouse
gaccttgaggctctaggttt

SEQ ID NO: 714044 - DNA, 20 bp, mouse
gaggcagaagtatgttgaca

SEQ ID NO: 714045 - DNA, 20 bp, mouse
gacgttaggaaaaataggta

SEQ ID NO: 714046 - DNA, 20 bp, mouse
gtggcagtgcgcagtgtgca

SEQ ID NO: 714047 - DNA, 20 bp, mouse
gcctaagaaccagcagttgg

SEQ ID NO: 714048 - DNA, 20 bp, mouse
gtgctggttcttaggcagta

SEQ ID NO: 714049 - DNA, 20 bp, mouse
gcggcctccattctgctttc

SEQ ID NO: 714050 - DNA, 20 bp, mouse
gtgcgcagtgtgcagggcat

SEQ ID NO: 714051 - DNA, 20 bp, mouse
ggaaatgaaagacgaagtgc

SEQ ID NO: 714052 - DNA, 20 bp, mouse
gctgcctaagaaccagcagt

SEQ ID NO: 714053 - DNA, 20 bp, mouse
gatgcaggactgttccttag

SEQ ID NO: 714054 - DNA, 20 bp, mouse
gacaatatagtattagatgc

SEQ ID NO: 714055 - DNA, 20 bp, mouse
gctgtcttgtgcgatgagaa

SEQ ID NO: 714056 - DNA, 20 bp, mouse
ggcccacagggtaacttcta

SEQ ID NO: 714057 - DNA, 20 bp, mouse
gtctatgggcgatatgactt

SEQ ID NO: 714058 - DNA, 20 bp, mouse
gcccatagaagttaccctgt

SEQ ID NO: 714059 - DNA, 20 bp, mouse
ggccaccctacctaagagaa

SEQ ID NO: 714060 - DNA, 20 bp, mouse
gggaaagaacaatgatgcct

SEQ ID NO: 714061 - DNA, 20 bp, mouse
gcacttctctattagagggt

SEQ ID NO: 714062 - DNA, 20 bp, mouse
ggcaccacttctctattaga

SEQ ID NO: 714063 - DNA, 20 bp, mouse
ggaagacaatgttgctaaga

SEQ ID NO: 714064 - DNA, 20 bp, mouse
ggcccaagctggatccaaga

SEQ ID NO: 714065 - DNA, 20 bp, mouse
gctttcctttctcttaggta

SEQ ID NO: 714066 - DNA, 20 bp, mouse
gcaaagctaagaggattgat

SEQ ID NO: 714067 - DNA, 20 bp, mouse
gagctttctgaaattctcct

SEQ ID NO: 714068 - DNA, 20 bp, mouse
gaatgttatttattctggcc

SEQ ID NO: 714069 - DNA, 20 bp, mouse
gattacatctgagacttttt

SEQ ID NO: 714070 - DNA, 20 bp, mouse
gaaaaacagtgtcccttaca

SEQ ID NO: 714071 - DNA, 20 bp, mouse
ggagaatttcagaaagctca

SEQ ID NO: 714072 - DNA, 20 bp, mouse
ggtgtcacgtaactgtgctg

SEQ ID NO: 714073 - DNA, 20 bp, mouse
gagccagtgcacagatacaa

SEQ ID NO: 714074 - DNA, 20 bp, mouse
gccgtcaggatgtatacgat

SEQ ID NO: 714075 - DNA, 20 bp, mouse
gtggcatacagtatactgtc

SEQ ID NO: 714076 - DNA, 20 bp, mouse
gctcaagcatagtactgtag

SEQ ID NO: 714077 - DNA, 20 bp, mouse
ggggccagcagttttcgtgg

SEQ ID NO: 714078 - DNA, 20 bp, mouse
ggtgctcccagcctcgagat

SEQ ID NO: 714079 - DNA, 20 bp, mouse
gcaccctcatcatccacgca

SEQ ID NO: 714080 - DNA, 20 bp, mouse
ggccgcaaatgctacctttg

SEQ ID NO: 714081 - DNA, 20 bp, mouse
gtactatgcttgagcctcaa

SEQ ID NO: 714082 - DNA, 20 bp, mouse
ggtacctgcacaggcctgta

SEQ ID NO: 714083 - DNA, 20 bp, mouse
ggctgggccagcagttttcg

SEQ ID NO: 714084 - DNA, 20 bp, mouse
ggacagatgcggattttctg

SEQ ID NO: 714085 - DNA, 20 bp, mouse
ggctctgcagcacaccctac

SEQ ID NO: 714086 - DNA, 20 bp, mouse
gtgattcattagcattccta

SEQ ID NO: 714087 - DNA, 20 bp, mouse
gttgacatccatctcaagtc

SEQ ID NO: 714088 - DNA, 20 bp, mouse
gacaatccagcctgagaatt

SEQ ID NO: 714089 - DNA, 20 bp, mouse
gtgacactgtctctgacaac

SEQ ID NO: 714090 - DNA, 20 bp, mouse
gtgtcatttcctttaaagaa

SEQ ID NO: 714091 - DNA, 20 bp, mouse
gtccagcctgagaattggga

SEQ ID NO: 714092 - DNA, 20 bp, mouse
gagaattagcctttctttaa

SEQ ID NO: 714093 - DNA, 20 bp, mouse
gtattcttacatattaattg

SEQ ID NO: 714094 - DNA, 20 bp, mouse
gaaaaacattgtgggataga

SEQ ID NO: 714095 - DNA, 20 bp, mouse
gtcagggtaccatgtgccat

SEQ ID NO: 714096 - DNA, 20 bp, mouse
gacaccaagtaatgtgggac

SEQ ID NO: 714097 - DNA, 20 bp, mouse
ggacagacaccaagtaatgt

SEQ ID NO: 714098 - DNA, 20 bp, mouse
gaggagaaatgcaatcaatg

SEQ ID NO: 714099 - DNA, 20 bp, mouse
gttgagaccaactctactta

SEQ ID NO: 714100 - DNA, 20 bp, mouse
ggaacactgtcaggtgcaaa

SEQ ID NO: 714101 - DNA, 20 bp, mouse
gactcctgtcccacattact

SEQ ID NO: 714102 - DNA, 20 bp, mouse
gttcttctctgcttcatcct

SEQ ID NO: 714103 - DNA, 20 bp, mouse
ggcttcgggaagatgaatga

SEQ ID NO: 714104 - DNA, 20 bp, mouse
gacttgatgaagaaaggctt

SEQ ID NO: 714105 - DNA, 20 bp, mouse
gtatccaacagctggaagtt

SEQ ID NO: 714106 - DNA, 20 bp, mouse
ggacctgtgaagtggatcta

SEQ ID NO: 714107 - DNA, 20 bp, mouse
gctgtgaagtggatctaagg

SEQ ID NO: 714108 - DNA, 20 bp, mouse
ggcactgtctaaatagagct

SEQ ID NO: 714109 - DNA, 20 bp, mouse
ggaatagagtggtgcaaaca

SEQ ID NO: 714110 - DNA, 20 bp, mouse
gagtggatctaaggaggaac

SEQ ID NO: 714111 - DNA, 20 bp, mouse
gcagaaaggatagaatagag

SEQ ID NO: 714112 - DNA, 20 bp, mouse
gacacaagtattggagattt

SEQ ID NO: 714113 - DNA, 20 bp, mouse
gacttctgaattttgttaca

SEQ ID NO: 714114 - DNA, 20 bp, mouse
ggtcaccaagtatcctgttg

SEQ ID NO: 714115 - DNA, 20 bp, mouse
gcaaaccacaacaggatact

SEQ ID NO: 714116 - DNA, 20 bp, mouse
gacagctaggaatgctgggc

SEQ ID NO: 714117 - DNA, 20 bp, mouse
ggggctggtaaacaggattt

SEQ ID NO: 714118 - DNA, 20 bp, mouse
ggtcaccacgcccctcctac

SEQ ID NO: 714119 - DNA, 20 bp, mouse
ggagaggctgcaagacatta

SEQ ID NO: 714120 - DNA, 20 bp, mouse
gaattcaattggttattctt

SEQ ID NO: 714121 - DNA, 20 bp, mouse
ggaatgctgggctggtaaac

SEQ ID NO: 714122 - DNA, 20 bp, mouse
gcggaggccgaccaatcttc

SEQ ID NO: 714123 - DNA, 20 bp, mouse
ggaagaatcgccacggggca

SEQ ID NO: 714124 - DNA, 20 bp, mouse
ggcatgacagctaggaatgc

SEQ ID NO: 714125 - DNA, 20 bp, mouse
gcgcagctgccgggcatgat

SEQ ID NO: 714126 - DNA, 20 bp, mouse
gaggaggatcaccgagtccg

SEQ ID NO: 714127 - DNA, 20 bp, mouse
ggggccagagaatgcttgta

SEQ ID NO: 714128 - DNA, 20 bp, mouse
gggaaagccctccccattca

SEQ ID NO: 714129 - DNA, 20 bp, mouse
gataaacaataagccatagg

SEQ ID NO: 714130 - DNA, 20 bp, mouse
gcagtctccaccccctgaat

SEQ ID NO: 714131 - DNA, 20 bp, mouse
gaacagacgtgtctaatctg

SEQ ID NO: 714132 - DNA, 20 bp, mouse
gagagaatgcttgtagggtg

SEQ ID NO: 714133 - DNA, 20 bp, mouse
gaggatcaccgagtccgtgg

SEQ ID NO: 714134 - DNA, 20 bp, mouse
gggcataaacaataagccat

SEQ ID NO: 714135 - DNA, 20 bp, mouse
gacaaacacctccacggact

SEQ ID NO: 714136 - DNA, 20 bp, mouse
gaggcccccagaggactatc

SEQ ID NO: 714137 - DNA, 20 bp, mouse
gaaatcacaagtcacatcag

SEQ ID NO: 714138 - DNA, 20 bp, mouse
gcaaagcatggctgaagtta

SEQ ID NO: 714139 - DNA, 20 bp, mouse
gagaagggagattaattacc

SEQ ID NO: 714140 - DNA, 20 bp, mouse
gctttgctcaaagtcttaac

SEQ ID NO: 714141 - DNA, 20 bp, mouse
gtttccagatagtcctctgg

SEQ ID NO: 714142 - DNA, 20 bp, mouse
gtaagactttgagcaaagca

SEQ ID NO: 714143 - DNA, 20 bp, mouse
gttcctcagctgatgaaaga

SEQ ID NO: 714144 - DNA, 20 bp, mouse
gtcagcagttagaggaccta

SEQ ID NO: 714145 - DNA, 20 bp, mouse
gttaatgtcatatggaacaa

SEQ ID NO: 714146 - DNA, 20 bp, mouse
gcgggacggggacagaggta

SEQ ID NO: 714147 - DNA, 20 bp, mouse
gtcctccaaagggaccttct

SEQ ID NO: 714148 - DNA, 20 bp, mouse
gcccgcgactaggactcctg

SEQ ID NO: 714149 - DNA, 20 bp, mouse
gccaggaggggaagtggcga

SEQ ID NO: 714150 - DNA, 20 bp, mouse
gcgacccgagccggggcaac

SEQ ID NO: 714151 - DNA, 20 bp, mouse
ggcgtggcctgtctggagaa

SEQ ID NO: 714152 - DNA, 20 bp, mouse
gagcatgcgcagacgccaga

SEQ ID NO: 714153 - DNA, 20 bp, mouse
gtccgcccgcagcgtctcgt

SEQ ID NO: 714154 - DNA, 20 bp, mouse
gggcggaccgacccgagccg

SEQ ID NO: 714155 - DNA, 20 bp, mouse
ggcgctcggggcccgcgact

SEQ ID NO: 714156 - DNA, 20 bp, mouse
gccaagtagcgatcaccccc

SEQ ID NO: 714157 - DNA, 20 bp, mouse
gtgcgtctctagttatccag

SEQ ID NO: 714158 - DNA, 20 bp, mouse
ggataactagagacgcagat

SEQ ID NO: 714159 - DNA, 20 bp, mouse
gggagaacaaccttggggag

SEQ ID NO: 714160 - DNA, 20 bp, mouse
gtacctgggaaccctggctg

SEQ ID NO: 714161 - DNA, 20 bp, mouse
ggctcctctagcttggtctc

SEQ ID NO: 714162 - DNA, 20 bp, mouse
gctcgagtaggcattttctt

SEQ ID NO: 714163 - DNA, 20 bp, mouse
gactagagacgcagataggc

SEQ ID NO: 714164 - DNA, 20 bp, mouse
gccagggtggttttctatac

SEQ ID NO: 714165 - DNA, 20 bp, mouse
gtctctaaaatggtactggc

SEQ ID NO: 714166 - DNA, 20 bp, mouse
gcccactgcagggtcgtggc

SEQ ID NO: 714167 - DNA, 20 bp, mouse
gaaacacggcgagcggtcgt

SEQ ID NO: 714168 - DNA, 20 bp, mouse
gaggcggcggctagcggatc

SEQ ID NO: 714169 - DNA, 20 bp, mouse
gagaggatgccgaagcagag

SEQ ID NO: 714170 - DNA, 20 bp, mouse
ggcagtgcaaacacggcgag

SEQ ID NO: 714171 - DNA, 20 bp, mouse
ggagccacccgatgtttttg

SEQ ID NO: 714172 - DNA, 20 bp, mouse
gcctcccagaggtctcgtcc

SEQ ID NO: 714173 - DNA, 20 bp, mouse
gcacccgcatcagctggcgc

SEQ ID NO: 714174 - DNA, 20 bp, mouse
gcgagcggtcgtgggcttga

SEQ ID NO: 714175 - DNA, 20 bp, mouse
gagcccgcgccagctgatgc

SEQ ID NO: 714176 - DNA, 20 bp, mouse
ggtacaaggcctcgctccaa

SEQ ID NO: 714177 - DNA, 20 bp, mouse
gagcgcgtgcgcaaaagaag

SEQ ID NO: 714178 - DNA, 20 bp, mouse
gcacttccgcagtcaatcga

SEQ ID NO: 714179 - DNA, 20 bp, mouse
gcgctggcgcaaaggttaaa

SEQ ID NO: 714180 - DNA, 20 bp, mouse
gacaggaagtcccgcctctc

SEQ ID NO: 714181 - DNA, 20 bp, mouse
ggcgcaaaagaagtggtaca

SEQ ID NO: 714182 - DNA, 20 bp, mouse
gggcgtcagcgctggcgcaa

SEQ ID NO: 714183 - DNA, 20 bp, mouse
gagcgctgacgccacgccct

SEQ ID NO: 714184 - DNA, 20 bp, mouse
gaggcctcgctccaagggcg

SEQ ID NO: 714185 - DNA, 20 bp, mouse
gacagacggctcagggtagt

SEQ ID NO: 714186 - DNA, 20 bp, mouse
gcgggcgccgaccactctga

SEQ ID NO: 714187 - DNA, 20 bp, mouse
ggcgtggtgggccaagcttg

SEQ ID NO: 714188 - DNA, 20 bp, mouse
ggagtggcagaagtgttgag

SEQ ID NO: 714189 - DNA, 20 bp, mouse
gtaacgctgtgacgcgtggt

SEQ ID NO: 714190 - DNA, 20 bp, mouse
gttgagtggtgcagacgcta

SEQ ID NO: 714191 - DNA, 20 bp, mouse
gtaccccggcttggaatgga

SEQ ID NO: 714192 - DNA, 20 bp, mouse
ggcgacaagtgataacactc

SEQ ID NO: 714193 - DNA, 20 bp, mouse
gcggcgcagagcgacggggg

SEQ ID NO: 714194 - DNA, 20 bp, mouse
gaagtcttgcttgaaccgag

SEQ ID NO: 714195 - DNA, 20 bp, mouse
gtcatgtgatccaacaaagt

SEQ ID NO: 714196 - DNA, 20 bp, mouse
gaccaaccgccaccttcggg

SEQ ID NO: 714197 - DNA, 20 bp, mouse
ggctccaggccctctgggat

SEQ ID NO: 714198 - DNA, 20 bp, mouse
ggagccccttgttaacggag

SEQ ID NO: 714199 - DNA, 20 bp, mouse
gggatagcagccaatcaaac

SEQ ID NO: 714200 - DNA, 20 bp, mouse
gccaccccctccgttaacaa

SEQ ID NO: 714201 - DNA, 20 bp, mouse
ggctgccatcacaacaccca

SEQ ID NO: 714202 - DNA, 20 bp, mouse
ggctccggccgagtccgcag

SEQ ID NO: 714203 - DNA, 20 bp, mouse
ggcgaccaaccgccaccttc

SEQ ID NO: 714204 - DNA, 20 bp, mouse
gatgccgcctccaattggtt

SEQ ID NO: 714205 - DNA, 20 bp, mouse
gaaggggctccaggccctct

SEQ ID NO: 714206 - DNA, 20 bp, mouse
gcagaaaatggctgagtact

SEQ ID NO: 714207 - DNA, 20 bp, mouse
gtagaagtctactcaaagtg

SEQ ID NO: 714208 - DNA, 20 bp, mouse
gctccatggatgtaaacgaa

SEQ ID NO: 714209 - DNA, 20 bp, mouse
gatacaagccatgtgaacaa

SEQ ID NO: 714210 - DNA, 20 bp, mouse
gaaacagaataagtggtata

SEQ ID NO: 714211 - DNA, 20 bp, mouse
gcagcttgttctttacaatt

SEQ ID NO: 714212 - DNA, 20 bp, mouse
gcttctaattgtgctggaag

SEQ ID NO: 714213 - DNA, 20 bp, mouse
gctattaaaaacagaataag

SEQ ID NO: 714214 - DNA, 20 bp, mouse
gagttttccaactttaatgt

SEQ ID NO: 714215 - DNA, 20 bp, mouse
ggagatgtcattagttagaa

SEQ ID NO: 714216 - DNA, 20 bp, mouse
gcggtcacccccagccaaga

SEQ ID NO: 714217 - DNA, 20 bp, mouse
gcacccgggcaggtctccta

SEQ ID NO: 714218 - DNA, 20 bp, mouse
gaagcgcaaggcacgtgcct

SEQ ID NO: 714219 - DNA, 20 bp, mouse
gactgctggtcagaacggat

SEQ ID NO: 714220 - DNA, 20 bp, mouse
gggactcgccgtgggaccaa

SEQ ID NO: 714221 - DNA, 20 bp, mouse
gtcggcgccatcttggctgg

SEQ ID NO: 714222 - DNA, 20 bp, mouse
ggccaggcgcggcgagcctt

SEQ ID NO: 714223 - DNA, 20 bp, mouse
gctcgatcggcaaagacagt

SEQ ID NO: 714224 - DNA, 20 bp, mouse
gcaagggtctggggacgggg

SEQ ID NO: 714225 - DNA, 20 bp, mouse
gagtagggagccatcagagc

SEQ ID NO: 714226 - DNA, 20 bp, mouse
gggtataactgagaagacat

SEQ ID NO: 714227 - DNA, 20 bp, mouse
gtggtgagaacactacagtc

SEQ ID NO: 714228 - DNA, 20 bp, mouse
gagtgtaagccattaatcgg

SEQ ID NO: 714229 - DNA, 20 bp, mouse
gtcagaccctagaaatttga

SEQ ID NO: 714230 - DNA, 20 bp, mouse
gaccaaacaagcccaaagag

SEQ ID NO: 714231 - DNA, 20 bp, mouse
gatggcttacactgtccccc

SEQ ID NO: 714232 - DNA, 20 bp, mouse
gcccctccttcttttgggac

SEQ ID NO: 714233 - DNA, 20 bp, mouse
gtagtgttctcaccactctt

SEQ ID NO: 714234 - DNA, 20 bp, mouse
ggcttcccttcaaatttcta

SEQ ID NO: 714235 - DNA, 20 bp, mouse
gaccactctttgggcttgtt

SEQ ID NO: 714236 - DNA, 20 bp, mouse
gctggaaaagggttggatat

SEQ ID NO: 714237 - DNA, 20 bp, mouse
gtctggaaaaggtctccctc

SEQ ID NO: 714238 - DNA, 20 bp, mouse
ggaaagtgctggaaacaaga

SEQ ID NO: 714239 - DNA, 20 bp, mouse
gtaccaggcttccattccag

SEQ ID NO: 714240 - DNA, 20 bp, mouse
gaaagggttggatatgggcc

SEQ ID NO: 714241 - DNA, 20 bp, mouse
gcttgattacaggagagaaa

SEQ ID NO: 714242 - DNA, 20 bp, mouse
gtcactgcaagttaaatagt

SEQ ID NO: 714243 - DNA, 20 bp, mouse
gacctgcctccacttcagac

SEQ ID NO: 714244 - DNA, 20 bp, mouse
gaaaaggtctccctctggaa

SEQ ID NO: 714245 - DNA, 20 bp, mouse
ggcaaggtgtttgctgtacc

SEQ ID NO: 714246 - DNA, 20 bp, mouse
gtatgatgtatacgcatgtc

SEQ ID NO: 714247 - DNA, 20 bp, mouse
gcttggttcctcctggtcaa

SEQ ID NO: 714248 - DNA, 20 bp, mouse
gaatgttttatccattgacc

SEQ ID NO: 714249 - DNA, 20 bp, mouse
ggttttatccattgaccagg

SEQ ID NO: 714250 - DNA, 20 bp, mouse
gggaacatccatctccagaa

SEQ ID NO: 714251 - DNA, 20 bp, mouse
ggagatggatgttccctctc

SEQ ID NO: 714252 - DNA, 20 bp, mouse
gtctgcagagggtctaacaa

SEQ ID NO: 714253 - DNA, 20 bp, mouse
gcagtccccagctatcaagc

SEQ ID NO: 714254 - DNA, 20 bp, mouse
gccttcctgcttgatagctg

SEQ ID NO: 714255 - DNA, 20 bp, mouse
gtatcaagcaggaagggtca

SEQ ID NO: 714256 - DNA, 20 bp, mouse
gggaacccagaatcaggaac

SEQ ID NO: 714257 - DNA, 20 bp, mouse
gtctgggttccttaagttat

SEQ ID NO: 714258 - DNA, 20 bp, mouse
gtgcggaatcctataactta

SEQ ID NO: 714259 - DNA, 20 bp, mouse
gacttaaggaacccagaatc

SEQ ID NO: 714260 - DNA, 20 bp, mouse
gttttccagttcctgattct

SEQ ID NO: 714261 - DNA, 20 bp, mouse
gagggactgcggaggggagt

SEQ ID NO: 714262 - DNA, 20 bp, mouse
ggtccccacccctggaaatg

SEQ ID NO: 714263 - DNA, 20 bp, mouse
ggaaatggggaggagaaccg

SEQ ID NO: 714264 - DNA, 20 bp, mouse
gcgcctgtcccgtctaccaa

SEQ ID NO: 714265 - DNA, 20 bp, mouse
ggagaaccgaggggctatgg

SEQ ID NO: 714266 - DNA, 20 bp, mouse
gtcggcttgggaaaggcata

SEQ ID NO: 714267 - DNA, 20 bp, mouse
ggtcacagtcggcttgggaa

SEQ ID NO: 714268 - DNA, 20 bp, mouse
gaagatgtcacagtcggctt

SEQ ID NO: 714269 - DNA, 20 bp, mouse
gggacccttcagacagttat

SEQ ID NO: 714270 - DNA, 20 bp, mouse
gacacaagccatcattgcct

SEQ ID NO: 714271 - DNA, 20 bp, mouse
ggtccagtccccttctgtac

SEQ ID NO: 714272 - DNA, 20 bp, mouse
gagccagtacagaaggggac

SEQ ID NO: 714273 - DNA, 20 bp, mouse
gtaccactttgcagaaacca

SEQ ID NO: 714274 - DNA, 20 bp, mouse
gtttcccataactgtctgaa

SEQ ID NO: 714275 - DNA, 20 bp, mouse
gtttttttacaatgaattgt

SEQ ID NO: 714276 - DNA, 20 bp, mouse
gaggcctgggccctctcctt

SEQ ID NO: 714277 - DNA, 20 bp, mouse
gctggaagggaaggttccta

SEQ ID NO: 714278 - DNA, 20 bp, mouse
ggggaaggttcctaaggaga

SEQ ID NO: 714279 - DNA, 20 bp, mouse
gacctgagctgtgggctagg

SEQ ID NO: 714280 - DNA, 20 bp, mouse
ggttcctaaggagagggccc

SEQ ID NO: 714281 - DNA, 20 bp, mouse
ggctgtgggctaggaggcct

SEQ ID NO: 714282 - DNA, 20 bp, mouse
ggcctcctagcccacagctc

SEQ ID NO: 714283 - DNA, 20 bp, mouse
gtgggtagttagagcccagt

SEQ ID NO: 714284 - DNA, 20 bp, mouse
gagggtgtagagaagcccac

SEQ ID NO: 714285 - DNA, 20 bp, mouse
gccagtccctctcttggaac

SEQ ID NO: 714286 - DNA, 20 bp, mouse
gagcctagtgctgggtctat

SEQ ID NO: 714287 - DNA, 20 bp, mouse
ggtggctacagaagcattag

SEQ ID NO: 714288 - DNA, 20 bp, mouse
gcttccccaacgtttgaacc

SEQ ID NO: 714289 - DNA, 20 bp, mouse
gaatgcttctgtagccaccg

SEQ ID NO: 714290 - DNA, 20 bp, mouse
gagcgcctcgctcttagatg

SEQ ID NO: 714291 - DNA, 20 bp, mouse
gtcagcctggttcaaacgtt

SEQ ID NO: 714292 - DNA, 20 bp, mouse
gtaggcatgcgtcccttgtc

SEQ ID NO: 714293 - DNA, 20 bp, mouse
gagcttctacagaaagacga

SEQ ID NO: 714294 - DNA, 20 bp, mouse
gaccagtgtcattaatttac

SEQ ID NO: 714295 - DNA, 20 bp, mouse
gcattagcggtgcttggcgt

SEQ ID NO: 714296 - DNA, 20 bp, mouse
ggaggcggcaagaacctgga

SEQ ID NO: 714297 - DNA, 20 bp, mouse
gcggaggaacatgtccgaga

SEQ ID NO: 714298 - DNA, 20 bp, mouse
gggccgggcgtgcttgacgg

SEQ ID NO: 714299 - DNA, 20 bp, mouse
gtcgggccgggcgtgcttga

SEQ ID NO: 714300 - DNA, 20 bp, mouse
ggcgccggcagctttgcggc

SEQ ID NO: 714301 - DNA, 20 bp, mouse
gcttgacggcggtgtggcgg

SEQ ID NO: 714302 - DNA, 20 bp, mouse
ggcccgaggcggcaagaacc

SEQ ID NO: 714303 - DNA, 20 bp, mouse
gggcgtgcttgacggcggtg

SEQ ID NO: 714304 - DNA, 20 bp, mouse
ggcacgcacgcccgcctcgg

SEQ ID NO: 714305 - DNA, 20 bp, mouse
gcgcgatttgcgacagtggg

SEQ ID NO: 714306 - DNA, 20 bp, mouse
gggaaaggaccgttcacagg

SEQ ID NO: 714307 - DNA, 20 bp, mouse
ggaaatagtcggggagattg

SEQ ID NO: 714308 - DNA, 20 bp, mouse
gcctgtgtgagtgctaacat

SEQ ID NO: 714309 - DNA, 20 bp, mouse
gcgaggaaaggaccgttcac

SEQ ID NO: 714310 - DNA, 20 bp, mouse
ggtcggggagattgaggttt

SEQ ID NO: 714311 - DNA, 20 bp, mouse
gaaacgcagcgccagacacc

SEQ ID NO: 714312 - DNA, 20 bp, mouse
gttgaggtttaggtccgcgg

SEQ ID NO: 714313 - DNA, 20 bp, mouse
gcctcgtggaaccaggaatg

SEQ ID NO: 714314 - DNA, 20 bp, mouse
gggaagggtcaggagcgacc

SEQ ID NO: 714315 - DNA, 20 bp, mouse
gttcctggttccacgaggaa

SEQ ID NO: 714316 - DNA, 20 bp, mouse
ggatgtgcatcaagcttcat

SEQ ID NO: 714317 - DNA, 20 bp, mouse
gtctgccagtgattatttca

SEQ ID NO: 714318 - DNA, 20 bp, mouse
gtgacgctggtacctggcga

SEQ ID NO: 714319 - DNA, 20 bp, mouse
gctggtacctggcgatggag

SEQ ID NO: 714320 - DNA, 20 bp, mouse
gttcatggggtgaacaaagt

SEQ ID NO: 714321 - DNA, 20 bp, mouse
gatttcaaggccatgttcac

SEQ ID NO: 714322 - DNA, 20 bp, mouse
gcatcatggctctatgaacc

SEQ ID NO: 714323 - DNA, 20 bp, mouse
gtcactggcagacgccatca

SEQ ID NO: 714324 - DNA, 20 bp, mouse
ggtgacgtgacgctggtacc

SEQ ID NO: 714325 - DNA, 20 bp, mouse
gacaaaggcaagccgttcaa

SEQ ID NO: 714326 - DNA, 20 bp, mouse
ggcaaagccctgcgagtccg

SEQ ID NO: 714327 - DNA, 20 bp, mouse
gtcacgcccccggactcgca

SEQ ID NO: 714328 - DNA, 20 bp, mouse
gagaacgtggagttccgcag

SEQ ID NO: 714329 - DNA, 20 bp, mouse
gcgaccgcgggacccgagtg

SEQ ID NO: 714330 - DNA, 20 bp, mouse
gtacaaggaccacgcggcgg

SEQ ID NO: 714331 - DNA, 20 bp, mouse
gagcagtttggcagcatggc

SEQ ID NO: 714332 - DNA, 20 bp, mouse
ggggggcgtgaggtagacgt

SEQ ID NO: 714333 - DNA, 20 bp, mouse
ggctggaaggtcggaaactc

SEQ ID NO: 714334 - DNA, 20 bp, mouse
ggccagaaactgccacacgg

SEQ ID NO: 714335 - DNA, 20 bp, mouse
gcctcgatgtcatcgtagtg

SEQ ID NO: 714336 - DNA, 20 bp, mouse
gaatcccggtccatttgaaa

SEQ ID NO: 714337 - DNA, 20 bp, mouse
gtctggaccttcttctgccc

SEQ ID NO: 714338 - DNA, 20 bp, mouse
gcacccaaagaggagaattt

SEQ ID NO: 714339 - DNA, 20 bp, mouse
ggaaggaggcccatgacatc

SEQ ID NO: 714340 - DNA, 20 bp, mouse
gacgaacaaaacacccaaag

SEQ ID NO: 714341 - DNA, 20 bp, mouse
gagaccctttcaaatggacc

SEQ ID NO: 714342 - DNA, 20 bp, mouse
gaatgctaagatcttgaagg

SEQ ID NO: 714343 - DNA, 20 bp, mouse
gtgtgtaccgaggacagttc

SEQ ID NO: 714344 - DNA, 20 bp, mouse
ggaaacaaatagaattgtat

SEQ ID NO: 714345 - DNA, 20 bp, mouse
gccaccgaagctgactgatc

SEQ ID NO: 714346 - DNA, 20 bp, mouse
gctaggcgaagagactcgtg

SEQ ID NO: 714347 - DNA, 20 bp, mouse
ggggcagggctgggaaccta

SEQ ID NO: 714348 - DNA, 20 bp, mouse
gaggggccccagctggtctg

SEQ ID NO: 714349 - DNA, 20 bp, mouse
gctcgggcgaggtgctagta

SEQ ID NO: 714350 - DNA, 20 bp, mouse
gagcgtggggcggtgggatc

SEQ ID NO: 714351 - DNA, 20 bp, mouse
gcgtccccgtggcgcccgag

SEQ ID NO: 714352 - DNA, 20 bp, mouse
gctggtctgcggggtgtggg

SEQ ID NO: 714353 - DNA, 20 bp, mouse
gaggaccccaattccctctt

SEQ ID NO: 714354 - DNA, 20 bp, mouse
gagtagggcaggcgcagcgt

SEQ ID NO: 714355 - DNA, 20 bp, mouse
gactcgtggggccgagaccc

SEQ ID NO: 714356 - DNA, 20 bp, mouse
gaaacatggagggtcaggca

SEQ ID NO: 714357 - DNA, 20 bp, mouse
gacaagaaagtgtcctgggg

SEQ ID NO: 714358 - DNA, 20 bp, mouse
gtggacaagcattgtctcaa

SEQ ID NO: 714359 - DNA, 20 bp, mouse
gtcacaacagagcccactac

SEQ ID NO: 714360 - DNA, 20 bp, mouse
gcctagcgccagccggtagt

SEQ ID NO: 714361 - DNA, 20 bp, mouse
gaagttcattaaaactgatt

SEQ ID NO: 714362 - DNA, 20 bp, mouse
gggactctgcagacctcccc

SEQ ID NO: 714363 - DNA, 20 bp, mouse
gacacacaagaaagtgtcct

SEQ ID NO: 714364 - DNA, 20 bp, mouse
gagctgaaacatggagggtc

SEQ ID NO: 714365 - DNA, 20 bp, mouse
gtctgcagagtcctagagag

SEQ ID NO: 714366 - DNA, 20 bp, mouse
gtgagacagcgtccagaagg

SEQ ID NO: 714367 - DNA, 20 bp, mouse
gctggacgctgtctcactta

SEQ ID NO: 714368 - DNA, 20 bp, mouse
gaggagtaatagcaaatcgt

SEQ ID NO: 714369 - DNA, 20 bp, mouse
gcaaatacccggcccccttc

SEQ ID NO: 714370 - DNA, 20 bp, mouse
gtggaaacctaaggcacggg

SEQ ID NO: 714371 - DNA, 20 bp, mouse
ggaccgtggaagtttccaga

SEQ ID NO: 714372 - DNA, 20 bp, mouse
gggacagcaaagcaaatacc

SEQ ID NO: 714373 - DNA, 20 bp, mouse
gagtaaactaggccccccct

SEQ ID NO: 714374 - DNA, 20 bp, mouse
gagtaatagcaaatcgtcgg

SEQ ID NO: 714375 - DNA, 20 bp, mouse
gggagagattcatcaccgag

SEQ ID NO: 714376 - DNA, 20 bp, mouse
gcgagcgtcggaccaggtac

SEQ ID NO: 714377 - DNA, 20 bp, mouse
gtctgcccgagcgtcggacc

SEQ ID NO: 714378 - DNA, 20 bp, mouse
gtagccatctggtaggaatc

SEQ ID NO: 714379 - DNA, 20 bp, mouse
gtcactgcggctggactctt

SEQ ID NO: 714380 - DNA, 20 bp, mouse
gagagctttgagaggacggg

SEQ ID NO: 714381 - DNA, 20 bp, mouse
gttcctctcgacaaaatccc

SEQ ID NO: 714382 - DNA, 20 bp, mouse
gcgtgcgatcgccgaaggaa

SEQ ID NO: 714383 - DNA, 20 bp, mouse
ggctccaaagcagcagcttc

SEQ ID NO: 714384 - DNA, 20 bp, mouse
gaatcaggcccccgaaaagc

SEQ ID NO: 714385 - DNA, 20 bp, mouse
ggctttggagccagcttttc

SEQ ID NO: 714386 - DNA, 20 bp, mouse
gggggtgtgtggttccaatg

SEQ ID NO: 714387 - DNA, 20 bp, mouse
gttggaaccacacaccccaa

SEQ ID NO: 714388 - DNA, 20 bp, mouse
gagacaagcagatagaacga

SEQ ID NO: 714389 - DNA, 20 bp, mouse
gcagccctctggacagaagc

SEQ ID NO: 714390 - DNA, 20 bp, mouse
gtcgttcctcatcttccctt

SEQ ID NO: 714391 - DNA, 20 bp, mouse
gtctgcagagaggcgagacc

SEQ ID NO: 714392 - DNA, 20 bp, mouse
gagaagtcagacactcaagc

SEQ ID NO: 714393 - DNA, 20 bp, mouse
gctgcagaggcgcccaaaag

SEQ ID NO: 714394 - DNA, 20 bp, mouse
gaagccggcgaatgtaatac

SEQ ID NO: 714395 - DNA, 20 bp, mouse
ggcccaaaagtggaggttcc

SEQ ID NO: 714396 - DNA, 20 bp, mouse
ggaatggaaggaacaactgc

SEQ ID NO: 714397 - DNA, 20 bp, mouse
ggatctttctaatttatcat

SEQ ID NO: 714398 - DNA, 20 bp, mouse
gtcaaaactacaaattcaaa

SEQ ID NO: 714399 - DNA, 20 bp, mouse
gatattgccttaggtagttc

SEQ ID NO: 714400 - DNA, 20 bp, mouse
gtggcaacctgaactaccta

SEQ ID NO: 714401 - DNA, 20 bp, mouse
gcatagaatcatattgcctt

SEQ ID NO: 714402 - DNA, 20 bp, mouse
gattaagaacataagggctt

SEQ ID NO: 714403 - DNA, 20 bp, mouse
gactgctttgtgtctcagat

SEQ ID NO: 714404 - DNA, 20 bp, mouse
gggcttgggtcaaagcacac

SEQ ID NO: 714405 - DNA, 20 bp, mouse
gattgaaattaagaacataa

SEQ ID NO: 714406 - DNA, 20 bp, mouse
gagaaagtacggctcacatc

SEQ ID NO: 714407 - DNA, 20 bp, mouse
gtggccctccgtcactgagt

SEQ ID NO: 714408 - DNA, 20 bp, mouse
ggactgagtcacattcactc

SEQ ID NO: 714409 - DNA, 20 bp, mouse
gaggggccaagtttagggag

SEQ ID NO: 714410 - DNA, 20 bp, mouse
gttcaagctgccttcctctc

SEQ ID NO: 714411 - DNA, 20 bp, mouse
gtcgaatctgatagcggggt

SEQ ID NO: 714412 - DNA, 20 bp, mouse
ggtgagccgtactttctcct

SEQ ID NO: 714413 - DNA, 20 bp, mouse
gcatccccactcagtgacgg

SEQ ID NO: 714414 - DNA, 20 bp, mouse
gtactggctcagagacctga

SEQ ID NO: 714415 - DNA, 20 bp, mouse
gaacctgtaacggtcatgtc

SEQ ID NO: 714416 - DNA, 20 bp, mouse
gtctaggagtaggtaagagc

SEQ ID NO: 714417 - DNA, 20 bp, mouse
gcccatgcctgggacccgta

SEQ ID NO: 714418 - DNA, 20 bp, mouse
ggggctcttggcgacaggcg

SEQ ID NO: 714419 - DNA, 20 bp, mouse
gtgaaggggctcttggcgac

SEQ ID NO: 714420 - DNA, 20 bp, mouse
gtctaacgggtagaataaaa

SEQ ID NO: 714421 - DNA, 20 bp, mouse
gtcgctggatactgcgcggt

SEQ ID NO: 714422 - DNA, 20 bp, mouse
gcagtgcccagatacctcgc

SEQ ID NO: 714423 - DNA, 20 bp, mouse
ggtcggcgctgtagctacag

SEQ ID NO: 714424 - DNA, 20 bp, mouse
ggaccccaagctaaagccaa

SEQ ID NO: 714425 - DNA, 20 bp, mouse
gcgcggtgggacagctccac

SEQ ID NO: 714426 - DNA, 20 bp, mouse
gtcctgacaatagtactcca

SEQ ID NO: 714427 - DNA, 20 bp, mouse
ggccttggagtactattgtc

SEQ ID NO: 714428 - DNA, 20 bp, mouse
gtccaaggcacatttcagtt

SEQ ID NO: 714429 - DNA, 20 bp, mouse
gacctaactgaaatgtgcct

SEQ ID NO: 714430 - DNA, 20 bp, mouse
gatacaaataacaaagagtt

SEQ ID NO: 714431 - DNA, 20 bp, mouse
gcacaatctgttgattctaa

SEQ ID NO: 714432 - DNA, 20 bp, mouse
gacagaaactttcaaactaa

SEQ ID NO: 714433 - DNA, 20 bp, mouse
gcttgggtgtgtttaggacc

SEQ ID NO: 714434 - DNA, 20 bp, mouse
ggagttatatgtatttgtcc

SEQ ID NO: 714435 - DNA, 20 bp, mouse
gatattgtaaacattataaa

SEQ ID NO: 714436 - DNA, 20 bp, mouse
gggtggagaggtgattccta

SEQ ID NO: 714437 - DNA, 20 bp, mouse
gtctgtgtctagttaggaac

SEQ ID NO: 714438 - DNA, 20 bp, mouse
gactcctagtacatgtagag

SEQ ID NO: 714439 - DNA, 20 bp, mouse
gaggagttaaggttcttgtt

SEQ ID NO: 714440 - DNA, 20 bp, mouse
gaacaatctcaatgctactc

SEQ ID NO: 714441 - DNA, 20 bp, mouse
ggccttcctcaggttagttg

SEQ ID NO: 714442 - DNA, 20 bp, mouse
gtgatcttatcagatgctat

SEQ ID NO: 714443 - DNA, 20 bp, mouse
gtcctcaactaacctgagga

SEQ ID NO: 714444 - DNA, 20 bp, mouse
gctcatgtctgtgtctagtt

SEQ ID NO: 714445 - DNA, 20 bp, mouse
gctacatgtactaggagtta

SEQ ID NO: 714446 - DNA, 20 bp, mouse
gagcagaagaggcccatggg

SEQ ID NO: 714447 - DNA, 20 bp, mouse
gggtaggaacaggagtcatg

SEQ ID NO: 714448 - DNA, 20 bp, mouse
ggactcctgttcctaccatt

SEQ ID NO: 714449 - DNA, 20 bp, mouse
ggatagcagaagaggcccat

SEQ ID NO: 714450 - DNA, 20 bp, mouse
ggggtacaatgaatgaagta

SEQ ID NO: 714451 - DNA, 20 bp, mouse
gtttccagggggtatggggt

SEQ ID NO: 714452 - DNA, 20 bp, mouse
gattgtacccagaaggggtg

SEQ ID NO: 714453 - DNA, 20 bp, mouse
gctgttcctaccattgggct

SEQ ID NO: 714454 - DNA, 20 bp, mouse
gagtgaggctcagggaatct

SEQ ID NO: 714455 - DNA, 20 bp, mouse
gcattcattgtacccagaag

SEQ ID NO: 714456 - DNA, 20 bp, mouse
ggttccttctacatgtagat

SEQ ID NO: 714457 - DNA, 20 bp, mouse
gatgtagatgggtttctgga

SEQ ID NO: 714458 - DNA, 20 bp, mouse
gaaacccatctacatgtaga

SEQ ID NO: 714459 - DNA, 20 bp, mouse
ggaagcaagtcactgttaaa

SEQ ID NO: 714460 - DNA, 20 bp, mouse
gggtgatacttctaactttc

SEQ ID NO: 714461 - DNA, 20 bp, mouse
gacacagatttttttgataa

SEQ ID NO: 714462 - DNA, 20 bp, mouse
gaaaattaagagtaggaagc

SEQ ID NO: 714463 - DNA, 20 bp, mouse
gaggtttttaaggaagtccc

SEQ ID NO: 714464 - DNA, 20 bp, mouse
gttaaaaaccttggcattgt

SEQ ID NO: 714465 - DNA, 20 bp, mouse
gtcttactcccacaatgcca

SEQ ID NO: 714466 - DNA, 20 bp, mouse
gcctcagtgtggtggacgag

SEQ ID NO: 714467 - DNA, 20 bp, mouse
ggggaacgcggcagacaaga

SEQ ID NO: 714468 - DNA, 20 bp, mouse
ggggaaatgtagtcagtccg

SEQ ID NO: 714469 - DNA, 20 bp, mouse
ggggctccctggcttctcgc

SEQ ID NO: 714470 - DNA, 20 bp, mouse
gtagtcagtccgagggaacg

SEQ ID NO: 714471 - DNA, 20 bp, mouse
gaaggggcggagaactggta

SEQ ID NO: 714472 - DNA, 20 bp, mouse
gatagactgcatcaggaaag

SEQ ID NO: 714473 - DNA, 20 bp, mouse
ggagaagccagggagccctc

SEQ ID NO: 714474 - DNA, 20 bp, mouse
gcagtagtggaagctgatat

SEQ ID NO: 714475 - DNA, 20 bp, mouse
gcaagatggctcccgatggg

SEQ ID NO: 714476 - DNA, 20 bp, mouse
gagctccaggatctcggtgg

SEQ ID NO: 714477 - DNA, 20 bp, mouse
gtctccgagctccaggatct

SEQ ID NO: 714478 - DNA, 20 bp, mouse
ggacacaaagctccctacac

SEQ ID NO: 714479 - DNA, 20 bp, mouse
gccgagctccaggatctcgg

SEQ ID NO: 714480 - DNA, 20 bp, mouse
gggtgcttgaccacctgtgt

SEQ ID NO: 714481 - DNA, 20 bp, mouse
gtgctgcaaaggagccgtcc

SEQ ID NO: 714482 - DNA, 20 bp, mouse
gcgtccaggcttcgtgttaa

SEQ ID NO: 714483 - DNA, 20 bp, mouse
gctaaggttccgtgctgcaa

SEQ ID NO: 714484 - DNA, 20 bp, mouse
gacggcagtcccagggccta

SEQ ID NO: 714485 - DNA, 20 bp, mouse
gaggcccaacggacaggaac

SEQ ID NO: 714486 - DNA, 20 bp, mouse
gcgtgctagaacatccgttg

SEQ ID NO: 714487 - DNA, 20 bp, mouse
gaaaggagaggtgtcagcac

SEQ ID NO: 714488 - DNA, 20 bp, mouse
gccctactgacagcggagga

SEQ ID NO: 714489 - DNA, 20 bp, mouse
ggctgcttgtgacgtcacag

SEQ ID NO: 714490 - DNA, 20 bp, mouse
gcatccgttgaggctttgat

SEQ ID NO: 714491 - DNA, 20 bp, mouse
gaaaagttccggttgtaaaa

SEQ ID NO: 714492 - DNA, 20 bp, mouse
gcaggctgctttaaaagttc

SEQ ID NO: 714493 - DNA, 20 bp, mouse
gccgttgaggctttgatagg

SEQ ID NO: 714494 - DNA, 20 bp, mouse
gaggggttattagttgtatc

SEQ ID NO: 714495 - DNA, 20 bp, mouse
gagcacgtccgttttacaac

SEQ ID NO: 714496 - DNA, 20 bp, mouse
gtggaagtggcaatgtggtg

SEQ ID NO: 714497 - DNA, 20 bp, mouse
gcagactgctggtgggataa

SEQ ID NO: 714498 - DNA, 20 bp, mouse
gtacatagtggcttctaggc

SEQ ID NO: 714499 - DNA, 20 bp, mouse
gaaatctggaagtggcaatg

SEQ ID NO: 714500 - DNA, 20 bp, mouse
ggatttacatagtggcttct

SEQ ID NO: 714501 - DNA, 20 bp, mouse
gctgctggtgggataaaggc

SEQ ID NO: 714502 - DNA, 20 bp, mouse
gggtgaggtagagacggtga

SEQ ID NO: 714503 - DNA, 20 bp, mouse
ggcctgtctcaaagaaggtg

SEQ ID NO: 714504 - DNA, 20 bp, mouse
ggacggtgatggagagctca

SEQ ID NO: 714505 - DNA, 20 bp, mouse
gagtgtaatcaattgtcaat

SEQ ID NO: 714506 - DNA, 20 bp, mouse
gcccgcgctctgaaacggac

SEQ ID NO: 714507 - DNA, 20 bp, mouse
gcccgccccgcgctctgaaa

SEQ ID NO: 714508 - DNA, 20 bp, mouse
gcaccccagggtgtagaggg

SEQ ID NO: 714509 - DNA, 20 bp, mouse
ggcgaagcatcgcgggaatc

SEQ ID NO: 714510 - DNA, 20 bp, mouse
gcggagccgcgaagcatcgc

SEQ ID NO: 714511 - DNA, 20 bp, mouse
gcgcaaccggaagaccaaga

SEQ ID NO: 714512 - DNA, 20 bp, mouse
ggagcaccccagggtgtaga

SEQ ID NO: 714513 - DNA, 20 bp, mouse
ggggcggtaactgtcgcgaa

SEQ ID NO: 714514 - DNA, 20 bp, mouse
gaccctggggtgctcgcgac

SEQ ID NO: 714515 - DNA, 20 bp, mouse
ggcgaccgccctctacaccc

SEQ ID NO: 714516 - DNA, 20 bp, mouse
gaagtcagcgggtttctgag

SEQ ID NO: 714517 - DNA, 20 bp, mouse
gctgaagcaagtctgaaggc

SEQ ID NO: 714518 - DNA, 20 bp, mouse
gtatgctgaagcaagtctga

SEQ ID NO: 714519 - DNA, 20 bp, mouse
ggggcaatgcaataaacaga

SEQ ID NO: 714520 - DNA, 20 bp, mouse
gaatgccaggatgttcacgg

SEQ ID NO: 714521 - DNA, 20 bp, mouse
gtgcttcagcatagagatag

SEQ ID NO: 714522 - DNA, 20 bp, mouse
gagccccactgcccctttta

SEQ ID NO: 714523 - DNA, 20 bp, mouse
gtgccctaaaaggggcagtg

SEQ ID NO: 714524 - DNA, 20 bp, mouse
gctcatggatccacacaccc

SEQ ID NO: 714525 - DNA, 20 bp, mouse
gaggatgttcacggtggttc

SEQ ID NO: 714526 - DNA, 20 bp, mouse
ggggcgggccctcccgagat

SEQ ID NO: 714527 - DNA, 20 bp, mouse
ggtaggaggaagggttgcga

SEQ ID NO: 714528 - DNA, 20 bp, mouse
gcgggccctcccgagattgg

SEQ ID NO: 714529 - DNA, 20 bp, mouse
gtactctctatccagggaaa

SEQ ID NO: 714530 - DNA, 20 bp, mouse
gcactcctccaatctcggga

SEQ ID NO: 714531 - DNA, 20 bp, mouse
gacccgcccaccactcgtcc

SEQ ID NO: 714532 - DNA, 20 bp, mouse
gaacgctcccggtgtccttc

SEQ ID NO: 714533 - DNA, 20 bp, mouse
gtggactccagaaggacacc

SEQ ID NO: 714534 - DNA, 20 bp, mouse
gaacgccgcccgcacgtcag

SEQ ID NO: 714535 - DNA, 20 bp, mouse
gggaagcctggacgagtggt

SEQ ID NO: 714536 - DNA, 20 bp, mouse
gggttggaaggggatgtttg

SEQ ID NO: 714537 - DNA, 20 bp, mouse
ggagctgtgggggaataggt

SEQ ID NO: 714538 - DNA, 20 bp, mouse
gcagtgggggtgaagagtag

SEQ ID NO: 714539 - DNA, 20 bp, mouse
gaggggaggtgtttgaagtg

SEQ ID NO: 714540 - DNA, 20 bp, mouse
gggaagaaaatctctgattc

SEQ ID NO: 714541 - DNA, 20 bp, mouse
ggaagtgggtatttgcagtg

SEQ ID NO: 714542 - DNA, 20 bp, mouse
ggtgggggaataggttggaa

SEQ ID NO: 714543 - DNA, 20 bp, mouse
gggtggtggagaattgaagt

SEQ ID NO: 714544 - DNA, 20 bp, mouse
gcctgctccaagactaccaa

SEQ ID NO: 714545 - DNA, 20 bp, mouse
gcaagcagaagagaacaatg

SEQ ID NO: 714546 - DNA, 20 bp, mouse
gtgagaagaagtgtttcagt

SEQ ID NO: 714547 - DNA, 20 bp, mouse
gaaggcatgaaaccaggagt

SEQ ID NO: 714548 - DNA, 20 bp, mouse
gaaagagaagctcaggtcgt

SEQ ID NO: 714549 - DNA, 20 bp, mouse
gggtagggtaaggcagtaga

SEQ ID NO: 714550 - DNA, 20 bp, mouse
ggtcgtggggatggaggcat

SEQ ID NO: 714551 - DNA, 20 bp, mouse
gcagtagaagggtgggaccg

SEQ ID NO: 714552 - DNA, 20 bp, mouse
gaagcgaatggttgccgggt

SEQ ID NO: 714553 - DNA, 20 bp, mouse
gtgtgagtcactttcttcaa

SEQ ID NO: 714554 - DNA, 20 bp, mouse
gggttgccgggtagggtggt

SEQ ID NO: 714555 - DNA, 20 bp, mouse
ggaggcatgggttcacatca

SEQ ID NO: 714556 - DNA, 20 bp, mouse
gcgagtgcagctccttggca

SEQ ID NO: 714557 - DNA, 20 bp, mouse
gcccgggctgcctgcctgga

SEQ ID NO: 714558 - DNA, 20 bp, mouse
gagggctcaccaccgtgcca

SEQ ID NO: 714559 - DNA, 20 bp, mouse
gaggcttgacaggagcatta

SEQ ID NO: 714560 - DNA, 20 bp, mouse
ggacctggcaccttaccttt

SEQ ID NO: 714561 - DNA, 20 bp, mouse
gcaaggaatgcctaaaggta

SEQ ID NO: 714562 - DNA, 20 bp, mouse
ggcatcccgggctgcctgcc

SEQ ID NO: 714563 - DNA, 20 bp, mouse
gaggccatgggaggtggcaa

SEQ ID NO: 714564 - DNA, 20 bp, mouse
ggctgcggaggtggtgacaa

SEQ ID NO: 714565 - DNA, 20 bp, mouse
gccttgaccctgccctccgt

SEQ ID NO: 714566 - DNA, 20 bp, mouse
gggctcaacaggagcatcag

SEQ ID NO: 714567 - DNA, 20 bp, mouse
gggtgcttggaagcggctca

SEQ ID NO: 714568 - DNA, 20 bp, mouse
ggtgaaaagaaaaccagcta

SEQ ID NO: 714569 - DNA, 20 bp, mouse
gtgcttttgttcattttcta

SEQ ID NO: 714570 - DNA, 20 bp, mouse
ggcagacggcgggagaacag

SEQ ID NO: 714571 - DNA, 20 bp, mouse
gaggagcatcaggggtgtca

SEQ ID NO: 714572 - DNA, 20 bp, mouse
gcccgggccgccggcccgga

SEQ ID NO: 714573 - DNA, 20 bp, mouse
gcccagcgacccctccgggc

SEQ ID NO: 714574 - DNA, 20 bp, mouse
ggcagctgggatgtctggct

SEQ ID NO: 714575 - DNA, 20 bp, mouse
gcagaataggtgcttggaag

SEQ ID NO: 714576 - DNA, 20 bp, mouse
gaggctaagaggacggagaa

SEQ ID NO: 714577 - DNA, 20 bp, mouse
gaggcggggtcgattgaggg

SEQ ID NO: 714578 - DNA, 20 bp, mouse
gaagaggcggggtcgattga

SEQ ID NO: 714579 - DNA, 20 bp, mouse
gcctcaacggcctactgcag

SEQ ID NO: 714580 - DNA, 20 bp, mouse
gctaagaggcgggagggaca

SEQ ID NO: 714581 - DNA, 20 bp, mouse
ggggcagagccagcggagga

SEQ ID NO: 714582 - DNA, 20 bp, mouse
gacagggccgagtgctaggg

SEQ ID NO: 714583 - DNA, 20 bp, mouse
ggggacagggccgagtgcta

SEQ ID NO: 714584 - DNA, 20 bp, mouse
ggcagtaggccgttgagggt

SEQ ID NO: 714585 - DNA, 20 bp, mouse
ggcttcagccccaccctcaa

SEQ ID NO: 714586 - DNA, 20 bp, mouse
gcatacgggaagctctcgga

SEQ ID NO: 714587 - DNA, 20 bp, mouse
gtgcggtgtaagtgtgacta

SEQ ID NO: 714588 - DNA, 20 bp, mouse
gcgggccctcagtatctcag

SEQ ID NO: 714589 - DNA, 20 bp, mouse
ggagcttcccgtatgacgaa

SEQ ID NO: 714590 - DNA, 20 bp, mouse
gagcacccccttcgtcatac

SEQ ID NO: 714591 - DNA, 20 bp, mouse
gcctggccagtcaagtgcat

SEQ ID NO: 714592 - DNA, 20 bp, mouse
ggtcaagtgcataggtgttc

SEQ ID NO: 714593 - DNA, 20 bp, mouse
gtgcactccgtgtcctgctg

SEQ ID NO: 714594 - DNA, 20 bp, mouse
gagggagcggttccctttcc

SEQ ID NO: 714595 - DNA, 20 bp, mouse
gggcaaaatgaatgcgaacc

SEQ ID NO: 714596 - DNA, 20 bp, mouse
gaggcagggagatttccagt

SEQ ID NO: 714597 - DNA, 20 bp, mouse
gggggcacaggcatgatatg

SEQ ID NO: 714598 - DNA, 20 bp, mouse
gggtatggttggtcagacac

SEQ ID NO: 714599 - DNA, 20 bp, mouse
ggtcttccggaaaatcaggc

SEQ ID NO: 714600 - DNA, 20 bp, mouse
gcttggagacttcatttgaa

SEQ ID NO: 714601 - DNA, 20 bp, mouse
gtatgaagcactcagcattc

SEQ ID NO: 714602 - DNA, 20 bp, mouse
gaataacagtgcaggttctt

SEQ ID NO: 714603 - DNA, 20 bp, mouse
gacacaggaatggacatcac

SEQ ID NO: 714604 - DNA, 20 bp, mouse
gtgccgttagtgacagcaga

SEQ ID NO: 714605 - DNA, 20 bp, mouse
gaggaatcacaatggtcttc

SEQ ID NO: 714606 - DNA, 20 bp, mouse
gtcagagcctactcaacaac

SEQ ID NO: 714607 - DNA, 20 bp, mouse
gaggctctgacttgggtgca

SEQ ID NO: 714608 - DNA, 20 bp, mouse
gaagcagagggattatggat

SEQ ID NO: 714609 - DNA, 20 bp, mouse
ggcctagaatataagaacca

SEQ ID NO: 714610 - DNA, 20 bp, mouse
gagggaaagcttggtgacac

SEQ ID NO: 714611 - DNA, 20 bp, mouse
ggttgagtaggctctgactt

SEQ ID NO: 714612 - DNA, 20 bp, mouse
gataatgtggagagcattaa

SEQ ID NO: 714613 - DNA, 20 bp, mouse
ggcagagtctctcaccagtt

SEQ ID NO: 714614 - DNA, 20 bp, mouse
gcctgtgtgtcttctaaccc

SEQ ID NO: 714615 - DNA, 20 bp, mouse
gcttgggtgcagggaaagct

SEQ ID NO: 714616 - DNA, 20 bp, mouse
ggtcagaagggcagtgatca

SEQ ID NO: 714617 - DNA, 20 bp, mouse
gaatctacgtgggaacataa

SEQ ID NO: 714618 - DNA, 20 bp, mouse
ggcacccagcacagacctac

SEQ ID NO: 714619 - DNA, 20 bp, mouse
gttgcctgtaggtctgtgct

SEQ ID NO: 714620 - DNA, 20 bp, mouse
ggggcagtgatcagggagac

SEQ ID NO: 714621 - DNA, 20 bp, mouse
gaaagataagaaatctacgt

SEQ ID NO: 714622 - DNA, 20 bp, mouse
gtcactgcccttctgacact

SEQ ID NO: 714623 - DNA, 20 bp, mouse
gctgggtgcttaagaaattg

SEQ ID NO: 714624 - DNA, 20 bp, mouse
ggggacatgttagcaccatc

SEQ ID NO: 714625 - DNA, 20 bp, mouse
gagaaaagaatcaggggggc

SEQ ID NO: 714626 - DNA, 20 bp, mouse
gtgggcctgaggtatgctag

SEQ ID NO: 714627 - DNA, 20 bp, mouse
gctgacttggaatttatggc

SEQ ID NO: 714628 - DNA, 20 bp, mouse
ggagtcccctagcatacctc

SEQ ID NO: 714629 - DNA, 20 bp, mouse
gcctcaggcccaatctgact

SEQ ID NO: 714630 - DNA, 20 bp, mouse
ggagaaatagagtttgatgc

SEQ ID NO: 714631 - DNA, 20 bp, mouse
gacagtggttctctgaccta

SEQ ID NO: 714632 - DNA, 20 bp, mouse
gataaattccaagtcagatt

SEQ ID NO: 714633 - DNA, 20 bp, mouse
ggggaattcgtgagcagcag

SEQ ID NO: 714634 - DNA, 20 bp, mouse
gcatggcatattgtcttatt

SEQ ID NO: 714635 - DNA, 20 bp, mouse
gcaaactctatttctcgaaa

SEQ ID NO: 714636 - DNA, 20 bp, mouse
gcacaacaacgcatcttgaa

SEQ ID NO: 714637 - DNA, 20 bp, mouse
gactacaaaaggctatactc

SEQ ID NO: 714638 - DNA, 20 bp, mouse
gggaatcaggtcttcttcga

SEQ ID NO: 714639 - DNA, 20 bp, mouse
gaaaaagtccaggacctgac

SEQ ID NO: 714640 - DNA, 20 bp, mouse
gtcccagccccaaaaagtcc

SEQ ID NO: 714641 - DNA, 20 bp, mouse
ggtgttcttagctcttatga

SEQ ID NO: 714642 - DNA, 20 bp, mouse
ggtcctggactttttggggc

SEQ ID NO: 714643 - DNA, 20 bp, mouse
gcactaaacccgtcaggtcc

SEQ ID NO: 714644 - DNA, 20 bp, mouse
ggaagttgtttatttcatac

SEQ ID NO: 714645 - DNA, 20 bp, mouse
gtctttcttggatctttgtg

SEQ ID NO: 714646 - DNA, 20 bp, mouse
gcccagacagcaatagacag

SEQ ID NO: 714647 - DNA, 20 bp, mouse
gctggggcaccactgaacca

SEQ ID NO: 714648 - DNA, 20 bp, mouse
gaccaaggatactggagagc

SEQ ID NO: 714649 - DNA, 20 bp, mouse
gtcctgctctccagtatcct

SEQ ID NO: 714650 - DNA, 20 bp, mouse
gacctctgtctattgctgtc

SEQ ID NO: 714651 - DNA, 20 bp, mouse
gaagtgtacagagtcttctg

SEQ ID NO: 714652 - DNA, 20 bp, mouse
ggtcagaagccttggttcag

SEQ ID NO: 714653 - DNA, 20 bp, mouse
gaggcttgaccaccccttga

SEQ ID NO: 714654 - DNA, 20 bp, mouse
gtggtgcctgccagggtaac

SEQ ID NO: 714655 - DNA, 20 bp, mouse
gcaccccttgaaggatgaca

SEQ ID NO: 714656 - DNA, 20 bp, mouse
gcccagacagcaatagacag

SEQ ID NO: 714657 - DNA, 20 bp, mouse
gacctctgtctattgctgtc

SEQ ID NO: 714658 - DNA, 20 bp, mouse
gcaggctggaccacccttga

SEQ ID NO: 714659 - DNA, 20 bp, mouse
gccacccttgaaggacgaca

SEQ ID NO: 714660 - DNA, 20 bp, mouse
ggggctgaaccactgaacca

SEQ ID NO: 714661 - DNA, 20 bp, mouse
gaagtgtacagagtcttctg

SEQ ID NO: 714662 - DNA, 20 bp, mouse
ggtcagaagccttggttcag

SEQ ID NO: 714663 - DNA, 20 bp, mouse
gtgaggcaaaacatgcctga

SEQ ID NO: 714664 - DNA, 20 bp, mouse
gagcactcagcatcatcacc

SEQ ID NO: 714665 - DNA, 20 bp, mouse
gtgatgcctgccagggtacc

SEQ ID NO: 714666 - DNA, 20 bp, mouse
gccaggcaggcggcccagga

SEQ ID NO: 714667 - DNA, 20 bp, mouse
gaggtgcttgggagcggccc

SEQ ID NO: 714668 - DNA, 20 bp, mouse
gaggctgtgctttgcacccc

SEQ ID NO: 714669 - DNA, 20 bp, mouse
gagtgggtcacatccatcct

SEQ ID NO: 714670 - DNA, 20 bp, mouse
gtggagctacaggcaccctg

SEQ ID NO: 714671 - DNA, 20 bp, mouse
gggtgcctgtgaccaactgg

SEQ ID NO: 714672 - DNA, 20 bp, mouse
gaaggaaagcagccaccagt

SEQ ID NO: 714673 - DNA, 20 bp, mouse
gccaggtgcctgtgaccaac

SEQ ID NO: 714674 - DNA, 20 bp, mouse
gttaggcattccttgcccca

SEQ ID NO: 714675 - DNA, 20 bp, mouse
gctacaggcaccctggggca

SEQ ID NO: 714676 - DNA, 20 bp, mouse
gacaccccagtcgatatgcg

SEQ ID NO: 714677 - DNA, 20 bp, mouse
gtggtggtgtaaagacagac

SEQ ID NO: 714678 - DNA, 20 bp, mouse
gaaagacagactggcatcat

SEQ ID NO: 714679 - DNA, 20 bp, mouse
ggagccacgcatatcgactg

SEQ ID NO: 714680 - DNA, 20 bp, mouse
gagaatgaaaggaaccaaaa

SEQ ID NO: 714681 - DNA, 20 bp, mouse
ggatgatcctagctgaaata

SEQ ID NO: 714682 - DNA, 20 bp, mouse
gatcatctgtactgggtcct

SEQ ID NO: 714683 - DNA, 20 bp, mouse
gcagctaggatcatctgtac

SEQ ID NO: 714684 - DNA, 20 bp, mouse
ggaggagatagaacttgaag

SEQ ID NO: 714685 - DNA, 20 bp, mouse
gggttcagagactgaagatt

SEQ ID NO: 714686 - DNA, 20 bp, mouse
gcccagggataccccttcta

SEQ ID NO: 714687 - DNA, 20 bp, mouse
gggcggatcgcaggaatgac

SEQ ID NO: 714688 - DNA, 20 bp, mouse
ggcccctgccggcggatcgc

SEQ ID NO: 714689 - DNA, 20 bp, mouse
ggccatagaaggggtatccc

SEQ ID NO: 714690 - DNA, 20 bp, mouse
gctggtggccagagagacat

SEQ ID NO: 714691 - DNA, 20 bp, mouse
gagacatgggtattcaagtc

SEQ ID NO: 714692 - DNA, 20 bp, mouse
gaagctaaggaagtcgaagt

SEQ ID NO: 714693 - DNA, 20 bp, mouse
gaggaatgacgggctgcttg

SEQ ID NO: 714694 - DNA, 20 bp, mouse
gtccctgggtgtctggggac

SEQ ID NO: 714695 - DNA, 20 bp, mouse
gttgaatacccatgtctctc

SEQ ID NO: 714696 - DNA, 20 bp, mouse
gggacgagttggaaggaaca

SEQ ID NO: 714697 - DNA, 20 bp, mouse
gaacttattatcttgggtag

SEQ ID NO: 714698 - DNA, 20 bp, mouse
gcataggattctcctggaat

SEQ ID NO: 714699 - DNA, 20 bp, mouse
gctcacctaagagttcttga

SEQ ID NO: 714700 - DNA, 20 bp, mouse
gagggtcagctatctccatt

SEQ ID NO: 714701 - DNA, 20 bp, mouse
gctgaccctcaagaactctt

SEQ ID NO: 714702 - DNA, 20 bp, mouse
ggtagaggacagagagccag

SEQ ID NO: 714703 - DNA, 20 bp, mouse
gaactcttaggtgagcctga

SEQ ID NO: 714704 - DNA, 20 bp, mouse
gagaactagtgtattccttc

SEQ ID NO: 714705 - DNA, 20 bp, mouse
gggtcctttgatggggtctt

SEQ ID NO: 714706 - DNA, 20 bp, mouse
gcacaacaacgcatcttgaa

SEQ ID NO: 714707 - DNA, 20 bp, mouse
gactacaaaaggctatactc

SEQ ID NO: 714708 - DNA, 20 bp, mouse
gggaatcaggtcttcttcga

SEQ ID NO: 714709 - DNA, 20 bp, mouse
gaaaaagtccaggacctgac

SEQ ID NO: 714710 - DNA, 20 bp, mouse
gtcccagccccaaaaagtcc

SEQ ID NO: 714711 - DNA, 20 bp, mouse
ggtgttcttagctcttatga

SEQ ID NO: 714712 - DNA, 20 bp, mouse
ggtcctggactttttggggc

SEQ ID NO: 714713 - DNA, 20 bp, mouse
gcactaaacccgtcaggtcc

SEQ ID NO: 714714 - DNA, 20 bp, mouse
ggaagttgtttatttcatac

SEQ ID NO: 714715 - DNA, 20 bp, mouse
gtctttcttggatctttgtg

SEQ ID NO: 714716 - DNA, 20 bp, mouse
gtcaggaggtggttccttca

SEQ ID NO: 714717 - DNA, 20 bp, mouse
gcgggctgtgcccagctgag

SEQ ID NO: 714718 - DNA, 20 bp, mouse
gttcagggagctaggagaac

SEQ ID NO: 714719 - DNA, 20 bp, mouse
gtgagacagactctgtagat

SEQ ID NO: 714720 - DNA, 20 bp, mouse
ggacgtctccgcttgcgatt

SEQ ID NO: 714721 - DNA, 20 bp, mouse
ggctgcagggcctcagaacc

SEQ ID NO: 714722 - DNA, 20 bp, mouse
ggaaaaggatgattgtctcg

SEQ ID NO: 714723 - DNA, 20 bp, mouse
gcaagcggagacgtccatca

SEQ ID NO: 714724 - DNA, 20 bp, mouse
ggcacagcccgaatcgcaag

SEQ ID NO: 714725 - DNA, 20 bp, mouse
ggctcgagcgctgtccagaa

SEQ ID NO: 714726 - DNA, 20 bp, mouse
ggaacagcaactcagaataa

SEQ ID NO: 714727 - DNA, 20 bp, mouse
ggtcacgcgatagtgtgggt

SEQ ID NO: 714728 - DNA, 20 bp, mouse
ggccggaagcgatggaggta

SEQ ID NO: 714729 - DNA, 20 bp, mouse
gagagcgccgcgacccgagc

SEQ ID NO: 714730 - DNA, 20 bp, mouse
ggctgcgggcctgccaggac

SEQ ID NO: 714731 - DNA, 20 bp, mouse
gcccgagccggaagcgatgg

SEQ ID NO: 714732 - DNA, 20 bp, mouse
gcgacccgagccggaagcga

SEQ ID NO: 714733 - DNA, 20 bp, mouse
ggcgtgacagtattgcgctg

SEQ ID NO: 714734 - DNA, 20 bp, mouse
ggcaactcagaataagggat

SEQ ID NO: 714735 - DNA, 20 bp, mouse
gatactgtcacgcgatagtg

SEQ ID NO: 714736 - DNA, 20 bp, mouse
ggggccgttgggcagttaca

SEQ ID NO: 714737 - DNA, 20 bp, mouse
gtgagccgatcaagatggag

SEQ ID NO: 714738 - DNA, 20 bp, mouse
gcggccctgctcagatgccg

SEQ ID NO: 714739 - DNA, 20 bp, mouse
gtgggcagttacacggcgga

SEQ ID NO: 714740 - DNA, 20 bp, mouse
gccgttgggcagttacacgg

SEQ ID NO: 714741 - DNA, 20 bp, mouse
gttacacggcggagggcgga

SEQ ID NO: 714742 - DNA, 20 bp, mouse
gtgctccgcggcatctgagc

SEQ ID NO: 714743 - DNA, 20 bp, mouse
ggcgcgagccctgtgctccg

SEQ ID NO: 714744 - DNA, 20 bp, mouse
ggcagccgcgtcccggaagc

SEQ ID NO: 714745 - DNA, 20 bp, mouse
gatggagcggcgaggccgaa

SEQ ID NO: 714746 - DNA, 20 bp, mouse
gctagctgtgagtatgtgtc

SEQ ID NO: 714747 - DNA, 20 bp, mouse
gtcatcttgagaatttaatg

SEQ ID NO: 714748 - DNA, 20 bp, mouse
gtgaaattgctgttttaatt

SEQ ID NO: 714749 - DNA, 20 bp, mouse
gttctgattcctgtcagttc

SEQ ID NO: 714750 - DNA, 20 bp, mouse
gatgtataacatactacact

SEQ ID NO: 714751 - DNA, 20 bp, mouse
gtaacatactacactgggct

SEQ ID NO: 714752 - DNA, 20 bp, mouse
ggagcaagaggggggagtga

SEQ ID NO: 714753 - DNA, 20 bp, mouse
ggagtgaggggggagggagt

SEQ ID NO: 714754 - DNA, 20 bp, mouse
gggggaggggatggagagat

SEQ ID NO: 714755 - DNA, 20 bp, mouse
gtggggagggggagcaagag

SEQ ID NO: 714756 - DNA, 20 bp, mouse
gagagcgccgcgacccgagc

SEQ ID NO: 714757 - DNA, 20 bp, mouse
ggccggaagcgatggaggta

SEQ ID NO: 714758 - DNA, 20 bp, mouse
ggaacagcaactcagaataa

SEQ ID NO: 714759 - DNA, 20 bp, mouse
gcccgagccggaagcgatgg

SEQ ID NO: 714760 - DNA, 20 bp, mouse
gcgacccgagccggaagcga

SEQ ID NO: 714761 - DNA, 20 bp, mouse
ggcaactcagaataagggat

SEQ ID NO: 714762 - DNA, 20 bp, mouse
ggccctacctccatcgcttc

SEQ ID NO: 714763 - DNA, 20 bp, mouse
ggctgcgggcctgccaggac

SEQ ID NO: 714764 - DNA, 20 bp, mouse
gctcacgcgcccctccttcc

SEQ ID NO: 714765 - DNA, 20 bp, mouse
ggaggcacgtgagtcatcag

SEQ ID NO: 714766 - DNA, 20 bp, mouse
gagagcgccgcgacccgagc

SEQ ID NO: 714767 - DNA, 20 bp, mouse
ggccggaagcgatggaggta

SEQ ID NO: 714768 - DNA, 20 bp, mouse
ggaacagcaactcagaataa

SEQ ID NO: 714769 - DNA, 20 bp, mouse
gcccgagccggaagcgatgg

SEQ ID NO: 714770 - DNA, 20 bp, mouse
gcgacccgagccggaagcga

SEQ ID NO: 714771 - DNA, 20 bp, mouse
ggcaactcagaataagggat

SEQ ID NO: 714772 - DNA, 20 bp, mouse
ggccctacctccatcgcttc

SEQ ID NO: 714773 - DNA, 20 bp, mouse
ggctgcgggcctgccaggac

SEQ ID NO: 714774 - DNA, 20 bp, mouse
gcccggaagccggggaagag

SEQ ID NO: 714775 - DNA, 20 bp, mouse
gctcacgcgcccctccttcc

SEQ ID NO: 714776 - DNA, 20 bp, mouse
gcagctaaggagcaggtctg

SEQ ID NO: 714777 - DNA, 20 bp, mouse
gggtgcttgggagcagctca

SEQ ID NO: 714778 - DNA, 20 bp, mouse
gtgagtgctcaactcaaatt

SEQ ID NO: 714779 - DNA, 20 bp, mouse
gctcaactcaaattagggac

SEQ ID NO: 714780 - DNA, 20 bp, mouse
ggtctaatctgctgctctct

SEQ ID NO: 714781 - DNA, 20 bp, mouse
ggtgaaaagaaaaccagcta

SEQ ID NO: 714782 - DNA, 20 bp, mouse
gatagaaaatgaataaaagc

SEQ ID NO: 714783 - DNA, 20 bp, mouse
gtttgagttgagcactcaca

SEQ ID NO: 714784 - DNA, 20 bp, mouse
gggtgcctgtgaccgccctg

SEQ ID NO: 714785 - DNA, 20 bp, mouse
ggcagctgggatgtctggct

SEQ ID NO: 714786 - DNA, 20 bp, mouse
gaacattagcagtgacccaa

SEQ ID NO: 714787 - DNA, 20 bp, mouse
gatcaagcctagaaaaaccc

SEQ ID NO: 714788 - DNA, 20 bp, mouse
gtggaatacatagagccttt

SEQ ID NO: 714789 - DNA, 20 bp, mouse
gccaaagccagggtttttct

SEQ ID NO: 714790 - DNA, 20 bp, mouse
gatggctatgccctagaaaa

SEQ ID NO: 714791 - DNA, 20 bp, mouse
gactgcatgtctccctccta

SEQ ID NO: 714792 - DNA, 20 bp, mouse
gattgaggaaaatttaagat

SEQ ID NO: 714793 - DNA, 20 bp, mouse
gcttctcagtagttgtttaa

SEQ ID NO: 714794 - DNA, 20 bp, mouse
gtctctccaggaggcaagaa

SEQ ID NO: 714795 - DNA, 20 bp, mouse
gtgctaagaactctctctcc

SEQ ID NO: 714796 - DNA, 20 bp, mouse
gaacaggccatgggcatcca

SEQ ID NO: 714797 - DNA, 20 bp, mouse
ggatgcatgcctgtcccctc

SEQ ID NO: 714798 - DNA, 20 bp, mouse
gtgcccatggcctgttcctc

SEQ ID NO: 714799 - DNA, 20 bp, mouse
gagagcaggttctgacggaa

SEQ ID NO: 714800 - DNA, 20 bp, mouse
gttgattgtccagaggggac

SEQ ID NO: 714801 - DNA, 20 bp, mouse
gtccctgataaattcttttt

SEQ ID NO: 714802 - DNA, 20 bp, mouse
gagcccaaaaagaatttatc

SEQ ID NO: 714803 - DNA, 20 bp, mouse
gcctccctggggtactgaac

SEQ ID NO: 714804 - DNA, 20 bp, mouse
gtgtgcacagctttgtacta

SEQ ID NO: 714805 - DNA, 20 bp, mouse
gatcacttgattgtccagag

SEQ ID NO: 714806 - DNA, 20 bp, mouse
gacaactcaaacatccatta

SEQ ID NO: 714807 - DNA, 20 bp, mouse
gaaaatctatgttattttaa

SEQ ID NO: 714808 - DNA, 20 bp, mouse
ggcagttaggagttagggcc

SEQ ID NO: 714809 - DNA, 20 bp, mouse
gagagttcggagctatcctc

SEQ ID NO: 714810 - DNA, 20 bp, mouse
gtacaaagttctctatagaa

SEQ ID NO: 714811 - DNA, 20 bp, mouse
gaattatcttagcattgtct

SEQ ID NO: 714812 - DNA, 20 bp, mouse
gactcaaacatccattaagg

SEQ ID NO: 714813 - DNA, 20 bp, mouse
ggttaggagttagggccggg

SEQ ID NO: 714814 - DNA, 20 bp, mouse
ggccgggaggatcaagagtt

SEQ ID NO: 714815 - DNA, 20 bp, mouse
gtcccagcagttaggagtta

SEQ ID NO: 714816 - DNA, 20 bp, mouse
gactctaaccctaagggagg

SEQ ID NO: 714817 - DNA, 20 bp, mouse
ggcatggattccaatcacta

SEQ ID NO: 714818 - DNA, 20 bp, mouse
gttgaataatgtacttttca

SEQ ID NO: 714819 - DNA, 20 bp, mouse
gatgagactccaaataaccc

SEQ ID NO: 714820 - DNA, 20 bp, mouse
gtaatgtacttttcaaggtg

SEQ ID NO: 714821 - DNA, 20 bp, mouse
gcaattaaagagagattttc

SEQ ID NO: 714822 - DNA, 20 bp, mouse
gggcccgccaacagaagtag

SEQ ID NO: 714823 - DNA, 20 bp, mouse
gcagctcgggtttcttatct

SEQ ID NO: 714824 - DNA, 20 bp, mouse
gaacacgcctctacttctgt

SEQ ID NO: 714825 - DNA, 20 bp, mouse
gctgggagaaaagcagggca

SEQ ID NO: 714826 - DNA, 20 bp, mouse
gagagcccagcagccgtgac

SEQ ID NO: 714827 - DNA, 20 bp, mouse
gcccgcgcgctcctcgacac

SEQ ID NO: 714828 - DNA, 20 bp, mouse
gctgacgactgacccggcgg

SEQ ID NO: 714829 - DNA, 20 bp, mouse
gggcctgacgactgacccgg

SEQ ID NO: 714830 - DNA, 20 bp, mouse
ggcctccgcaggaagccggg

SEQ ID NO: 714831 - DNA, 20 bp, mouse
gctcctcgacaccggcgcgt

SEQ ID NO: 714832 - DNA, 20 bp, mouse
gggagcgcgcggggtcgcgc

SEQ ID NO: 714833 - DNA, 20 bp, mouse
ggggcggggaggcgagcgac

SEQ ID NO: 714834 - DNA, 20 bp, mouse
gctgcgcaacaggttcgctg

SEQ ID NO: 714835 - DNA, 20 bp, mouse
gggcgggccgctcctctcag

SEQ ID NO: 714836 - DNA, 20 bp, mouse
gtatcatgtgatatatcctg

SEQ ID NO: 714837 - DNA, 20 bp, mouse
ggaaccggtaacaagcagct

SEQ ID NO: 714838 - DNA, 20 bp, mouse
gttccaggaatctgagtcac

SEQ ID NO: 714839 - DNA, 20 bp, mouse
gtggagtcaggcacaacctc

SEQ ID NO: 714840 - DNA, 20 bp, mouse
gctgcctcagctccctgtag

SEQ ID NO: 714841 - DNA, 20 bp, mouse
gggcctgtgactcagattcc

SEQ ID NO: 714842 - DNA, 20 bp, mouse
gtattctttcaaacccctac

SEQ ID NO: 714843 - DNA, 20 bp, mouse
gtgatgtagcaatagagcca

SEQ ID NO: 714844 - DNA, 20 bp, mouse
gattgcctggaaatggagtc

SEQ ID NO: 714845 - DNA, 20 bp, mouse
gacatggaattgacaatcct

SEQ ID NO: 714846 - DNA, 20 bp, mouse
gcctgtgaggcagttggata

SEQ ID NO: 714847 - DNA, 20 bp, mouse
gttggcagtggctaaaatgg

SEQ ID NO: 714848 - DNA, 20 bp, mouse
gtgccggaaaagataggggt

SEQ ID NO: 714849 - DNA, 20 bp, mouse
ggtgaaccgtgcctggaaac

SEQ ID NO: 714850 - DNA, 20 bp, mouse
gtcacgtggtacattaatgc

SEQ ID NO: 714851 - DNA, 20 bp, mouse
gctaggacacctggcagctg

SEQ ID NO: 714852 - DNA, 20 bp, mouse
gtggataaggcagttggcag

SEQ ID NO: 714853 - DNA, 20 bp, mouse
ggccaggtgtcctagcaacg

SEQ ID NO: 714854 - DNA, 20 bp, mouse
gcctcccccacgcccctgtg

SEQ ID NO: 714855 - DNA, 20 bp, mouse
gaggaaatgaagcaatgagt

SEQ ID NO: 714856 - DNA, 20 bp, mouse
ggagagggtgaccctagctt

SEQ ID NO: 714857 - DNA, 20 bp, mouse
gtgaaggatatcaggcagca

SEQ ID NO: 714858 - DNA, 20 bp, mouse
gaccctagctttggatctga

SEQ ID NO: 714859 - DNA, 20 bp, mouse
gcagaagccaaatctattga

SEQ ID NO: 714860 - DNA, 20 bp, mouse
ggaagcagattcccacccca

SEQ ID NO: 714861 - DNA, 20 bp, mouse
gcctgcccgggcaaccctcc

SEQ ID NO: 714862 - DNA, 20 bp, mouse
gtctatatatagcagccagg

SEQ ID NO: 714863 - DNA, 20 bp, mouse
gatatagcagccaggaggag

SEQ ID NO: 714864 - DNA, 20 bp, mouse
gacacagccctcaatagatt

SEQ ID NO: 714865 - DNA, 20 bp, mouse
gaccaagctgggtgcagtgt

SEQ ID NO: 714866 - DNA, 20 bp, mouse
ggagaggggtggggtgattc

SEQ ID NO: 714867 - DNA, 20 bp, mouse
gggggtgtcacatgcatccg

SEQ ID NO: 714868 - DNA, 20 bp, mouse
gatcgctcgccactgtgcca

SEQ ID NO: 714869 - DNA, 20 bp, mouse
gtgcatccggggcctccggc

SEQ ID NO: 714870 - DNA, 20 bp, mouse
gcacatgcatccggggcctc

SEQ ID NO: 714871 - DNA, 20 bp, mouse
gtgcatgtgacacccctgcc

SEQ ID NO: 714872 - DNA, 20 bp, mouse
gggcgaccgcctggagttac

SEQ ID NO: 714873 - DNA, 20 bp, mouse
ggtgcagctccatggcacag

SEQ ID NO: 714874 - DNA, 20 bp, mouse
ggttacaggcacctgaggca

SEQ ID NO: 714875 - DNA, 20 bp, mouse
gtggggtgattctggggcca

SEQ ID NO: 714876 - DNA, 20 bp, mouse
ggtcactgaactgtttattc

SEQ ID NO: 714877 - DNA, 20 bp, mouse
gaaacagttcagtgacctgt

SEQ ID NO: 714878 - DNA, 20 bp, mouse
ggaactgtttattcaggatg

SEQ ID NO: 714879 - DNA, 20 bp, mouse
gcgtacttcaaggactacag

SEQ ID NO: 714880 - DNA, 20 bp, mouse
gaaacaatgacaaagccaac

SEQ ID NO: 714881 - DNA, 20 bp, mouse
gtctggtggtataggaagtc

SEQ ID NO: 714882 - DNA, 20 bp, mouse
gcccctggatgcaatgctgt

SEQ ID NO: 714883 - DNA, 20 bp, mouse
gtcaaggaaggtaagcaagt

SEQ ID NO: 714884 - DNA, 20 bp, mouse
gattcaggatgaggagtgtc

SEQ ID NO: 714885 - DNA, 20 bp, mouse
ggtcaggtggtaaagcacac

SEQ ID NO: 714886 - DNA, 20 bp, mouse
gggataaaatacttaaaatt

SEQ ID NO: 714887 - DNA, 20 bp, mouse
gtatgacaactgaattgtga

SEQ ID NO: 714888 - DNA, 20 bp, mouse
gatgggctagagttgtagtc

SEQ ID NO: 714889 - DNA, 20 bp, mouse
gtgcccataaagtgaaaaga

SEQ ID NO: 714890 - DNA, 20 bp, mouse
ggagttgtagtctggataaa

SEQ ID NO: 714891 - DNA, 20 bp, mouse
gattttatccatatattaat

SEQ ID NO: 714892 - DNA, 20 bp, mouse
gtctagtcatgcagatcatg

SEQ ID NO: 714893 - DNA, 20 bp, mouse
ggttatgtagaaattctaag

SEQ ID NO: 714894 - DNA, 20 bp, mouse
gtattgctgacatacaatgt

SEQ ID NO: 714895 - DNA, 20 bp, mouse
gacatttgcctattaatata

SEQ ID NO: 714896 - DNA, 20 bp, mouse
ggggatccagagttgactga

SEQ ID NO: 714897 - DNA, 20 bp, mouse
gcggagtgacagttctggga

SEQ ID NO: 714898 - DNA, 20 bp, mouse
gcgggccggagtgacagttc

SEQ ID NO: 714899 - DNA, 20 bp, mouse
ggcagtctagtgtaggaggg

SEQ ID NO: 714900 - DNA, 20 bp, mouse
gagtcagatgtcagacccgg

SEQ ID NO: 714901 - DNA, 20 bp, mouse
gagggccagaaatggaacga

SEQ ID NO: 714902 - DNA, 20 bp, mouse
gtgggacatagaagcatggg

SEQ ID NO: 714903 - DNA, 20 bp, mouse
gcactgcagtctagtgtagg

SEQ ID NO: 714904 - DNA, 20 bp, mouse
gccccactgcagtctagtgt

SEQ ID NO: 714905 - DNA, 20 bp, mouse
ggagcaccctcagtcaactc

SEQ ID NO: 714906 - DNA, 20 bp, mouse
ggctagagtcatagggcagg

SEQ ID NO: 714907 - DNA, 20 bp, mouse
gcaggctagagtcatagggc

SEQ ID NO: 714908 - DNA, 20 bp, mouse
gtacttattgcctaatctaa

SEQ ID NO: 714909 - DNA, 20 bp, mouse
gttaggcaaatagatatatc

SEQ ID NO: 714910 - DNA, 20 bp, mouse
gggcaaatagatatatctgg

SEQ ID NO: 714911 - DNA, 20 bp, mouse
gttctctgttaggaacatct

SEQ ID NO: 714912 - DNA, 20 bp, mouse
gaaaatgcctccattagatt

SEQ ID NO: 714913 - DNA, 20 bp, mouse
gatagtgaacaaaatacaca

SEQ ID NO: 714914 - DNA, 20 bp, mouse
ggatccagaaatatctctcc

SEQ ID NO: 714915 - DNA, 20 bp, mouse
gttattgcctaatctaatgg

SEQ ID NO: 714916 - DNA, 20 bp, mouse
gactgtgcgcgccctcgtct

SEQ ID NO: 714917 - DNA, 20 bp, mouse
gtgcaaaggagcccagacga

SEQ ID NO: 714918 - DNA, 20 bp, mouse
gggctcctttgcagagtact

SEQ ID NO: 714919 - DNA, 20 bp, mouse
gaggaccgcccggcagtgcc

SEQ ID NO: 714920 - DNA, 20 bp, mouse
gtgcgcccggcactgccggg

SEQ ID NO: 714921 - DNA, 20 bp, mouse
gggcctgcgcccggcactgc

SEQ ID NO: 714922 - DNA, 20 bp, mouse
ggtccgggacagcgggttgg

SEQ ID NO: 714923 - DNA, 20 bp, mouse
ggggaggcgtccgggacagc

SEQ ID NO: 714924 - DNA, 20 bp, mouse
gggcgtccgggacagcgggt

SEQ ID NO: 714925 - DNA, 20 bp, mouse
ggatggcgcggaggaccgcc

SEQ ID NO: 714926 - DNA, 20 bp, mouse
gccgcgccgccaggaaggga

SEQ ID NO: 714927 - DNA, 20 bp, mouse
gcgctaccgcgccgccagga

SEQ ID NO: 714928 - DNA, 20 bp, mouse
gccaggccttcccttcctgg

SEQ ID NO: 714929 - DNA, 20 bp, mouse
gtgcccaggccttcccttcc

SEQ ID NO: 714930 - DNA, 20 bp, mouse
gccgccgctcggggaacaaa

SEQ ID NO: 714931 - DNA, 20 bp, mouse
ggtgtcggagcccgcgtcct

SEQ ID NO: 714932 - DNA, 20 bp, mouse
gctctgcccgctgtgctctg

SEQ ID NO: 714933 - DNA, 20 bp, mouse
gtagcggcgggcaacccgtt

SEQ ID NO: 714934 - DNA, 20 bp, mouse
gtgcaaaggagccaagaggg

SEQ ID NO: 714935 - DNA, 20 bp, mouse
gagggcgcggagtccccgcc

SEQ ID NO: 714936 - DNA, 20 bp, mouse
ggaagcgtcagaactattta

SEQ ID NO: 714937 - DNA, 20 bp, mouse
gcgtcagaactatttatgga

SEQ ID NO: 714938 - DNA, 20 bp, mouse
gtagttctgacgcttccttg

SEQ ID NO: 714939 - DNA, 20 bp, mouse
gtgtctttagaaacaccaca

SEQ ID NO: 714940 - DNA, 20 bp, mouse
gcctctgactcctgtgttct

SEQ ID NO: 714941 - DNA, 20 bp, mouse
gtgaactccggaccgtccca

SEQ ID NO: 714942 - DNA, 20 bp, mouse
gtagagttgcatcactatgg

SEQ ID NO: 714943 - DNA, 20 bp, mouse
gagttgcatcactatggagg

SEQ ID NO: 714944 - DNA, 20 bp, mouse
ggattagagttgcatcacta

SEQ ID NO: 714945 - DNA, 20 bp, mouse
gtgaatgccctgggacggtc

SEQ ID NO: 714946 - DNA, 20 bp, mouse
gctgtgaaacagcactatgt

SEQ ID NO: 714947 - DNA, 20 bp, mouse
gctgtaccatagcaggtttt

SEQ ID NO: 714948 - DNA, 20 bp, mouse
gcagatcctaaaacctgcta

SEQ ID NO: 714949 - DNA, 20 bp, mouse
gtctgtgaacagggaagaac

SEQ ID NO: 714950 - DNA, 20 bp, mouse
gtagctgccaagtggggaca

SEQ ID NO: 714951 - DNA, 20 bp, mouse
gtgaacagggaagaacagga

SEQ ID NO: 714952 - DNA, 20 bp, mouse
ggccaagtggggacagggtg

SEQ ID NO: 714953 - DNA, 20 bp, mouse
gccactgaggcaggagtaga

SEQ ID NO: 714954 - DNA, 20 bp, mouse
ggaggtttcgtttctttctt

SEQ ID NO: 714955 - DNA, 20 bp, mouse
gaaacgaaacctctgtgaac

SEQ ID NO: 714956 - DNA, 20 bp, mouse
ggttagtcaaaaaaccacaa

SEQ ID NO: 714957 - DNA, 20 bp, mouse
ggtttcaaaggagtcctttt

SEQ ID NO: 714958 - DNA, 20 bp, mouse
gaaaggagtccttttaggct

SEQ ID NO: 714959 - DNA, 20 bp, mouse
gtccttttaggctgggtgca

SEQ ID NO: 714960 - DNA, 20 bp, mouse
gcacaagggaaatgagcctg

SEQ ID NO: 714961 - DNA, 20 bp, mouse
ggagcctgaggccagcactc

SEQ ID NO: 714962 - DNA, 20 bp, mouse
gggagtggcactgtttaaga

SEQ ID NO: 714963 - DNA, 20 bp, mouse
gaccatgcacccagcctaaa

SEQ ID NO: 714964 - DNA, 20 bp, mouse
gcatgtgccagacacggtgc

SEQ ID NO: 714965 - DNA, 20 bp, mouse
gtggttgcatgtgccagaca

SEQ ID NO: 714966 - DNA, 20 bp, mouse
gaaagaacccatcagaatac

SEQ ID NO: 714967 - DNA, 20 bp, mouse
gccaaagtgtcacttgtgtg

SEQ ID NO: 714968 - DNA, 20 bp, mouse
gctgaagcccgtattctgat

SEQ ID NO: 714969 - DNA, 20 bp, mouse
gcagaatacgggcttcagta

SEQ ID NO: 714970 - DNA, 20 bp, mouse
ggcacacttgacaatggcca

SEQ ID NO: 714971 - DNA, 20 bp, mouse
ggtgataaattcaaaagtca

SEQ ID NO: 714972 - DNA, 20 bp, mouse
gactttgtgtacttgttctc

SEQ ID NO: 714973 - DNA, 20 bp, mouse
gcaagtacacaaagttgtta

SEQ ID NO: 714974 - DNA, 20 bp, mouse
ggtgtgtccaatcctgccat

SEQ ID NO: 714975 - DNA, 20 bp, mouse
gtctctgtaaaacgtctgca

SEQ ID NO: 714976 - DNA, 20 bp, mouse
ggcaagttcaatagcaaaca

SEQ ID NO: 714977 - DNA, 20 bp, mouse
gcagagatctgcctacctat

SEQ ID NO: 714978 - DNA, 20 bp, mouse
gcccagctgagagtatcaaa

SEQ ID NO: 714979 - DNA, 20 bp, mouse
gctctcctgccagtcaatgg

SEQ ID NO: 714980 - DNA, 20 bp, mouse
gttggtctttataatatcca

SEQ ID NO: 714981 - DNA, 20 bp, mouse
gctgcctacctatggggtgc

SEQ ID NO: 714982 - DNA, 20 bp, mouse
gaaaacaaaacattcggttg

SEQ ID NO: 714983 - DNA, 20 bp, mouse
gatctcaaaaacaaaacatt

SEQ ID NO: 714984 - DNA, 20 bp, mouse
gtgcaccaccattgactggc

SEQ ID NO: 714985 - DNA, 20 bp, mouse
gagactctcctgccagtcaa

SEQ ID NO: 714986 - DNA, 20 bp, mouse
ggagagtgggaaaggtatat

SEQ ID NO: 714987 - DNA, 20 bp, mouse
gtgggctttgcatttttact

SEQ ID NO: 714988 - DNA, 20 bp, mouse
gctccagccataatagaagc

SEQ ID NO: 714989 - DNA, 20 bp, mouse
gtacctgcttctattatggc

SEQ ID NO: 714990 - DNA, 20 bp, mouse
ggataatcaagattacagag

SEQ ID NO: 714991 - DNA, 20 bp, mouse
ggtcgtcgtcaaactgaagg

SEQ ID NO: 714992 - DNA, 20 bp, mouse
ggatgtcgtcgtcaaactga

SEQ ID NO: 714993 - DNA, 20 bp, mouse
ggataacaatttagaaaaag

SEQ ID NO: 714994 - DNA, 20 bp, mouse
gtctgtctgatcagtgtaat

SEQ ID NO: 714995 - DNA, 20 bp, mouse
gaatcaagattacagagagg

SEQ ID NO: 714996 - DNA, 20 bp, mouse
gattcaggtgtataaaaaag

SEQ ID NO: 714997 - DNA, 20 bp, mouse
ggtatgtattaaatattctg

SEQ ID NO: 714998 - DNA, 20 bp, mouse
gtactgcttgagctgagaga

SEQ ID NO: 714999 - DNA, 20 bp, mouse
gaatagaaacaaaatctcca

SEQ ID NO: 715000 - DNA, 20 bp, mouse
gatggaattcttacagaaac

SEQ ID NO: 715001 - DNA, 20 bp, mouse
gcaattgaagtgtttttcgt

SEQ ID NO: 715002 - DNA, 20 bp, mouse
gtgcaagcaagagataggtc

SEQ ID NO: 715003 - DNA, 20 bp, mouse
gaatacatacacgtaattgg

SEQ ID NO: 715004 - DNA, 20 bp, mouse
ggctgctatttctagcaaag

SEQ ID NO: 715005 - DNA, 20 bp, mouse
gagagatttgaagactgacg

SEQ ID NO: 715006 - DNA, 20 bp, mouse
gacagcttatgattaatatg

SEQ ID NO: 715007 - DNA, 20 bp, mouse
gtacagtttcggtaagaatt

SEQ ID NO: 715008 - DNA, 20 bp, mouse
gtgaaaagaatacacaaggc

SEQ ID NO: 715009 - DNA, 20 bp, mouse
gaatacacaaggccgggaga

SEQ ID NO: 715010 - DNA, 20 bp, mouse
gatcataagctgtttcttca

SEQ ID NO: 715011 - DNA, 20 bp, mouse
gtcactatctccataataaa

SEQ ID NO: 715012 - DNA, 20 bp, mouse
gtaaaatattattctgagcc

SEQ ID NO: 715013 - DNA, 20 bp, mouse
gtttttctatagctatacta

SEQ ID NO: 715014 - DNA, 20 bp, mouse
gctatggaaagtaaaaagat

SEQ ID NO: 715015 - DNA, 20 bp, mouse
ggagttgaaaagaatacaca

SEQ ID NO: 715016 - DNA, 20 bp, mouse
gggtctcaagtccaccttaa

SEQ ID NO: 715017 - DNA, 20 bp, mouse
gcagacaagaagcacgtgtg

SEQ ID NO: 715018 - DNA, 20 bp, mouse
gtggcttatgcaagtatcta

SEQ ID NO: 715019 - DNA, 20 bp, mouse
gtcaagaaaggggtttgaca

SEQ ID NO: 715020 - DNA, 20 bp, mouse
ggctcaccttagatagtctc

SEQ ID NO: 715021 - DNA, 20 bp, mouse
gtagtctctggtgtagaaga

SEQ ID NO: 715022 - DNA, 20 bp, mouse
gcatatctgaaccattaagg

SEQ ID NO: 715023 - DNA, 20 bp, mouse
gacaagttgagtcaggacaa

SEQ ID NO: 715024 - DNA, 20 bp, mouse
ggcaactgagaattcaagaa

SEQ ID NO: 715025 - DNA, 20 bp, mouse
gaatcatatctgaaccatta

SEQ ID NO: 715026 - DNA, 20 bp, mouse
ggtcagaggattgtgtcaga

SEQ ID NO: 715027 - DNA, 20 bp, mouse
gtaagctcatacaagtaaga

SEQ ID NO: 715028 - DNA, 20 bp, mouse
ggcagcagtaaaactggatc

SEQ ID NO: 715029 - DNA, 20 bp, mouse
gtggtttatctgtctctaat

SEQ ID NO: 715030 - DNA, 20 bp, mouse
gagaggattgtgtcagaggg

SEQ ID NO: 715031 - DNA, 20 bp, mouse
gggattgtgtcagagggtgg

SEQ ID NO: 715032 - DNA, 20 bp, mouse
gagtgaaatagtaaacacat

SEQ ID NO: 715033 - DNA, 20 bp, mouse
ggtgtaattttagtgttcta

SEQ ID NO: 715034 - DNA, 20 bp, mouse
gagaatataaaattttgcca

SEQ ID NO: 715035 - DNA, 20 bp, mouse
gattattcttagaggtttaa

SEQ ID NO: 715036 - DNA, 20 bp, mouse
gtctataaaaatactgatct

SEQ ID NO: 715037 - DNA, 20 bp, mouse
gtagagatgtaggtacctaa

SEQ ID NO: 715038 - DNA, 20 bp, mouse
ggctcatattcagttgagta

SEQ ID NO: 715039 - DNA, 20 bp, mouse
gaggaatgataggctgataa

SEQ ID NO: 715040 - DNA, 20 bp, mouse
ggtaagggaaagtgcatttt

SEQ ID NO: 715041 - DNA, 20 bp, mouse
gtactgatctaggaacatag

SEQ ID NO: 715042 - DNA, 20 bp, mouse
gtgtcaagggagcttaggta

SEQ ID NO: 715043 - DNA, 20 bp, mouse
gtggtgacaaagatcaacag

SEQ ID NO: 715044 - DNA, 20 bp, mouse
gacacaagggggcctcctcc

SEQ ID NO: 715045 - DNA, 20 bp, mouse
gtagcatgagcaactttacc

SEQ ID NO: 715046 - DNA, 20 bp, mouse
gttgtgttgggctgcattta

SEQ ID NO: 715047 - DNA, 20 bp, mouse
gaaattctcaattttgtgtt

SEQ ID NO: 715048 - DNA, 20 bp, mouse
gcttgaccacataggtacat

SEQ ID NO: 715049 - DNA, 20 bp, mouse
gcctctttctagatggcttc

SEQ ID NO: 715050 - DNA, 20 bp, mouse
gaaactgatatatcaaacaa

SEQ ID NO: 715051 - DNA, 20 bp, mouse
gaaaagaacactctttagct

SEQ ID NO: 715052 - DNA, 20 bp, mouse
gtaagaaaaggatttaaaat

SEQ ID NO: 715053 - DNA, 20 bp, mouse
gtattgcccatgtacctatg

SEQ ID NO: 715054 - DNA, 20 bp, mouse
gaggtacatgggcaataggt

SEQ ID NO: 715055 - DNA, 20 bp, mouse
gacaacagtagatgagtaaa

SEQ ID NO: 715056 - DNA, 20 bp, mouse
gcaccaccatgcaccatctt

SEQ ID NO: 715057 - DNA, 20 bp, mouse
ggcactagagtagccaaaga

SEQ ID NO: 715058 - DNA, 20 bp, mouse
gtcttagaaggatatctgag

SEQ ID NO: 715059 - DNA, 20 bp, mouse
gagccaaagatggtgcatgg

SEQ ID NO: 715060 - DNA, 20 bp, mouse
gaggcttctttaactttctc

SEQ ID NO: 715061 - DNA, 20 bp, mouse
gtctgggtttacttggaagg

SEQ ID NO: 715062 - DNA, 20 bp, mouse
gatctctgggtttacttgga

SEQ ID NO: 715063 - DNA, 20 bp, mouse
ggggtttacttggaaggtgg

SEQ ID NO: 715064 - DNA, 20 bp, mouse
gctacaacccatatttaaaa

SEQ ID NO: 715065 - DNA, 20 bp, mouse
gagaagaataataaggctct

SEQ ID NO: 715066 - DNA, 20 bp, mouse
gaagggcaggttgtcatcct

SEQ ID NO: 715067 - DNA, 20 bp, mouse
ggtgtgtgtcatcaccagtg

SEQ ID NO: 715068 - DNA, 20 bp, mouse
gcgtgggggcgctctttcct

SEQ ID NO: 715069 - DNA, 20 bp, mouse
gtgctaagggcgctactggc

SEQ ID NO: 715070 - DNA, 20 bp, mouse
gattgcaaaagcaattgcta

SEQ ID NO: 715071 - DNA, 20 bp, mouse
gcaattgctaagggcgctac

SEQ ID NO: 715072 - DNA, 20 bp, mouse
gcttgtgctaatcgttccaa

SEQ ID NO: 715073 - DNA, 20 bp, mouse
gcaagagcgtcgggaagggc

SEQ ID NO: 715074 - DNA, 20 bp, mouse
gaaagcaagagcgtcgggaa

SEQ ID NO: 715075 - DNA, 20 bp, mouse
gtatcccaaagcaagagcgt

SEQ ID NO: 715076 - DNA, 20 bp, mouse
ggcaagctgggaacttagtt

SEQ ID NO: 715077 - DNA, 20 bp, mouse
gcatgcacatgtgacctaag

SEQ ID NO: 715078 - DNA, 20 bp, mouse
gacacagacacatgttgaat

SEQ ID NO: 715079 - DNA, 20 bp, mouse
gcacagctgcttctgactgt

SEQ ID NO: 715080 - DNA, 20 bp, mouse
gtatacattctctctgttaa

SEQ ID NO: 715081 - DNA, 20 bp, mouse
gcacatgttgaataggttaa

SEQ ID NO: 715082 - DNA, 20 bp, mouse
gtcagaagcagctgtgtctt

SEQ ID NO: 715083 - DNA, 20 bp, mouse
gctgttaatggtttcctctt

SEQ ID NO: 715084 - DNA, 20 bp, mouse
gcaatgtctcacttccagac

SEQ ID NO: 715085 - DNA, 20 bp, mouse
gaataggttaatggcaagct

SEQ ID NO: 715086 - DNA, 20 bp, mouse
gcattcacctagtagtccta

SEQ ID NO: 715087 - DNA, 20 bp, mouse
gttcctgcctgccagtactg

SEQ ID NO: 715088 - DNA, 20 bp, mouse
gcttggagtccctacggtaa

SEQ ID NO: 715089 - DNA, 20 bp, mouse
gcttcctaacccttaccgta

SEQ ID NO: 715090 - DNA, 20 bp, mouse
gagaacccataaacgtgtgt

SEQ ID NO: 715091 - DNA, 20 bp, mouse
gggctggccaaggccttttc

SEQ ID NO: 715092 - DNA, 20 bp, mouse
gaaccgcagtactggcaggc

SEQ ID NO: 715093 - DNA, 20 bp, mouse
gcccaccccctaggactact

SEQ ID NO: 715094 - DNA, 20 bp, mouse
ggcccaggagcaggctggaa

SEQ ID NO: 715095 - DNA, 20 bp, mouse
gcccacaagtcctcctgaaa

SEQ ID NO: 715096 - DNA, 20 bp, mouse
gccagctggctctattacag

SEQ ID NO: 715097 - DNA, 20 bp, mouse
gtcccagtaaccattactgc

SEQ ID NO: 715098 - DNA, 20 bp, mouse
gtgggagcacagaagtcctt

SEQ ID NO: 715099 - DNA, 20 bp, mouse
gtggtggaaggtgggtcatg

SEQ ID NO: 715100 - DNA, 20 bp, mouse
gattacagaggtgctgaggg

SEQ ID NO: 715101 - DNA, 20 bp, mouse
gaagtggatagagcacagaa

SEQ ID NO: 715102 - DNA, 20 bp, mouse
ggcatctgataaagtggggt

SEQ ID NO: 715103 - DNA, 20 bp, mouse
gtatccacttggcagtggaa

SEQ ID NO: 715104 - DNA, 20 bp, mouse
gatggggcatctgataaagt

SEQ ID NO: 715105 - DNA, 20 bp, mouse
gttcagtgagcctgcagtaa

SEQ ID NO: 715106 - DNA, 20 bp, mouse
gaacacatgagcttccattt

SEQ ID NO: 715107 - DNA, 20 bp, mouse
gacaaacaggatttccctgg

SEQ ID NO: 715108 - DNA, 20 bp, mouse
gttccacatgacctgggcag

SEQ ID NO: 715109 - DNA, 20 bp, mouse
gtgcagccttccacatgacc

SEQ ID NO: 715110 - DNA, 20 bp, mouse
ggaagaagacatgatcttgg

SEQ ID NO: 715111 - DNA, 20 bp, mouse
gaggatttccctgggggaaa

SEQ ID NO: 715112 - DNA, 20 bp, mouse
gaagcatgtgtctgggggtc

SEQ ID NO: 715113 - DNA, 20 bp, mouse
ggtttgttccatttccccca

SEQ ID NO: 715114 - DNA, 20 bp, mouse
gtacccctgcccaggtcatg

SEQ ID NO: 715115 - DNA, 20 bp, mouse
gtgggaagaagacatgatct

SEQ ID NO: 715116 - DNA, 20 bp, mouse
gccaaggtctggcatagccc

SEQ ID NO: 715117 - DNA, 20 bp, mouse
gcaagtgacctgtgagtcac

SEQ ID NO: 715118 - DNA, 20 bp, mouse
gttggttatcttcttctcct

SEQ ID NO: 715119 - DNA, 20 bp, mouse
gtctgcttgagaaaggaata

SEQ ID NO: 715120 - DNA, 20 bp, mouse
gaatgggaacatctgtggga

SEQ ID NO: 715121 - DNA, 20 bp, mouse
gagggaaacaagtaatatat

SEQ ID NO: 715122 - DNA, 20 bp, mouse
ggaggtagtctgcttgagaa

SEQ ID NO: 715123 - DNA, 20 bp, mouse
gagcaggaagtgctagtgat

SEQ ID NO: 715124 - DNA, 20 bp, mouse
gaagttaatgggaacatctg

SEQ ID NO: 715125 - DNA, 20 bp, mouse
gcttaggattctcttgtgca

SEQ ID NO: 715126 - DNA, 20 bp, mouse
gggtgggtctgcaccaacaa

SEQ ID NO: 715127 - DNA, 20 bp, mouse
gtcaaggaggaggtatcctg

SEQ ID NO: 715128 - DNA, 20 bp, mouse
ggacttggggtgagaactca

SEQ ID NO: 715129 - DNA, 20 bp, mouse
gatcctgaggtaggccacag

SEQ ID NO: 715130 - DNA, 20 bp, mouse
gggaggaggtatcctgaggt

SEQ ID NO: 715131 - DNA, 20 bp, mouse
gttggggtgagaactcaagg

SEQ ID NO: 715132 - DNA, 20 bp, mouse
gccactgttatccacctctg

SEQ ID NO: 715133 - DNA, 20 bp, mouse
ggtaggggtgaaaagacttg

SEQ ID NO: 715134 - DNA, 20 bp, mouse
gtggctgtggtccttgagta

SEQ ID NO: 715135 - DNA, 20 bp, mouse
gttgctgggcagcgaatcaa

SEQ ID NO: 715136 - DNA, 20 bp, mouse
gggaagtggcccagcattta

SEQ ID NO: 715137 - DNA, 20 bp, mouse
ggccctggaagttcatggca

SEQ ID NO: 715138 - DNA, 20 bp, mouse
gcctgtggcagcaccgcaaa

SEQ ID NO: 715139 - DNA, 20 bp, mouse
gtccctgccatgaacttcca

SEQ ID NO: 715140 - DNA, 20 bp, mouse
gaaggcaggcaccgccactg

SEQ ID NO: 715141 - DNA, 20 bp, mouse
gcaccgccactggggaattg

SEQ ID NO: 715142 - DNA, 20 bp, mouse
gcacaaggccccagaggcta

SEQ ID NO: 715143 - DNA, 20 bp, mouse
gtggcaagatggaccctgga

SEQ ID NO: 715144 - DNA, 20 bp, mouse
gaggtgtctgcgggccccga

SEQ ID NO: 715145 - DNA, 20 bp, mouse
gatggacagaattgttgcta

SEQ ID NO: 715146 - DNA, 20 bp, mouse
gggttgggaagtaggacatt

SEQ ID NO: 715147 - DNA, 20 bp, mouse
ggagattatagtcgtttttc

SEQ ID NO: 715148 - DNA, 20 bp, mouse
gtgggaacacagggacccag

SEQ ID NO: 715149 - DNA, 20 bp, mouse
ggaacacagggacccagtgg

SEQ ID NO: 715150 - DNA, 20 bp, mouse
gtccctgtgttcccaccaat

SEQ ID NO: 715151 - DNA, 20 bp, mouse
gcacctattggtgggaacac

SEQ ID NO: 715152 - DNA, 20 bp, mouse
gagcctagcaggatgcagta

SEQ ID NO: 715153 - DNA, 20 bp, mouse
gaagaaatgggagtgtgtgt

SEQ ID NO: 715154 - DNA, 20 bp, mouse
gacaagtgtgttctacagta

SEQ ID NO: 715155 - DNA, 20 bp, mouse
gaccctccttataaagactg

SEQ ID NO: 715156 - DNA, 20 bp, mouse
gcatgctggctgttgttctg

SEQ ID NO: 715157 - DNA, 20 bp, mouse
ggttcaggcaaaactcccat

SEQ ID NO: 715158 - DNA, 20 bp, mouse
gagtctatgcattatacctg

SEQ ID NO: 715159 - DNA, 20 bp, mouse
gctatgcattatacctgtgg

SEQ ID NO: 715160 - DNA, 20 bp, mouse
gaatgcatagacttatgttc

SEQ ID NO: 715161 - DNA, 20 bp, mouse
gttattgaacttgtcactag

SEQ ID NO: 715162 - DNA, 20 bp, mouse
gtcattctaagttgaatctt

SEQ ID NO: 715163 - DNA, 20 bp, mouse
gcactagtggagcatttgcc

SEQ ID NO: 715164 - DNA, 20 bp, mouse
gagcaagtcttagtttcaaa

SEQ ID NO: 715165 - DNA, 20 bp, mouse
ggctgttgttctgagggacc

SEQ ID NO: 715166 - DNA, 20 bp, mouse
gcaaggcatgtcaatgtgat

SEQ ID NO: 715167 - DNA, 20 bp, mouse
gcagctgtgagagaagagtt

SEQ ID NO: 715168 - DNA, 20 bp, mouse
gacacagaggcatatctttc

SEQ ID NO: 715169 - DNA, 20 bp, mouse
ggacccagagtgaacaaact

SEQ ID NO: 715170 - DNA, 20 bp, mouse
gttctgcaattagacctcta

SEQ ID NO: 715171 - DNA, 20 bp, mouse
gacatggtagagccatgtaa

SEQ ID NO: 715172 - DNA, 20 bp, mouse
gcaggccagcttccctaaca

SEQ ID NO: 715173 - DNA, 20 bp, mouse
gccaaagaaagttgcaacca

SEQ ID NO: 715174 - DNA, 20 bp, mouse
ggacagagctggtggtcatc

SEQ ID NO: 715175 - DNA, 20 bp, mouse
ggatgtagtcaaccttgtta

SEQ ID NO: 715176 - DNA, 20 bp, mouse
gaaaacattgggatacacaa

SEQ ID NO: 715177 - DNA, 20 bp, mouse
gtgggatacacaaaggttct

SEQ ID NO: 715178 - DNA, 20 bp, mouse
gctcgaggggaaagaggtca

SEQ ID NO: 715179 - DNA, 20 bp, mouse
gtagcaactcaggattgggc

SEQ ID NO: 715180 - DNA, 20 bp, mouse
gtgggcgggctgtggttgca

SEQ ID NO: 715181 - DNA, 20 bp, mouse
gtgggtatgggaaggttaca

SEQ ID NO: 715182 - DNA, 20 bp, mouse
gaaggtttttatagaccctc

SEQ ID NO: 715183 - DNA, 20 bp, mouse
gtttcagagcatcaaatgtt

SEQ ID NO: 715184 - DNA, 20 bp, mouse
gtacacaaaggttcttggaa

SEQ ID NO: 715185 - DNA, 20 bp, mouse
gctcaggattgggcgggctg

SEQ ID NO: 715186 - DNA, 20 bp, mouse
ggtagagaggacgacctcga

SEQ ID NO: 715187 - DNA, 20 bp, mouse
gtacccgttcacagctgtgc

SEQ ID NO: 715188 - DNA, 20 bp, mouse
gtagcaactcaggattgggc

SEQ ID NO: 715189 - DNA, 20 bp, mouse
gtgggtatgggaaggttaca

SEQ ID NO: 715190 - DNA, 20 bp, mouse
gctcgaggggaaagaggtca

SEQ ID NO: 715191 - DNA, 20 bp, mouse
gtgggcgggctgtggttgca

SEQ ID NO: 715192 - DNA, 20 bp, mouse
gtacgtgaccagccatgacc

SEQ ID NO: 715193 - DNA, 20 bp, mouse
gctggtcacgtagatcactt

SEQ ID NO: 715194 - DNA, 20 bp, mouse
gaaggtttttatagaccctc

SEQ ID NO: 715195 - DNA, 20 bp, mouse
gggtaggaattgtccatttc

SEQ ID NO: 715196 - DNA, 20 bp, mouse
gaatgctgagtggagttgaa

SEQ ID NO: 715197 - DNA, 20 bp, mouse
gaggaaatgagtgtagcctt

SEQ ID NO: 715198 - DNA, 20 bp, mouse
ggtcttactacatcccgtag

SEQ ID NO: 715199 - DNA, 20 bp, mouse
gataataaaactgtctacga

SEQ ID NO: 715200 - DNA, 20 bp, mouse
gttgaagggaaatgtggtga

SEQ ID NO: 715201 - DNA, 20 bp, mouse
ggtggagttgaagggaaatg

SEQ ID NO: 715202 - DNA, 20 bp, mouse
gaagagaatacttaatatca

SEQ ID NO: 715203 - DNA, 20 bp, mouse
gatatcaaggctggttgctt

SEQ ID NO: 715204 - DNA, 20 bp, mouse
ggaatacttaatatcaaggc

SEQ ID NO: 715205 - DNA, 20 bp, mouse
gttaacgtatttagaaagtc

SEQ ID NO: 715206 - DNA, 20 bp, mouse
gcacggagaccggagattcc

SEQ ID NO: 715207 - DNA, 20 bp, mouse
gccggagattccaggattgt

SEQ ID NO: 715208 - DNA, 20 bp, mouse
ggctgggcttgacctggtat

SEQ ID NO: 715209 - DNA, 20 bp, mouse
gggcagatgggcagaaacgc

SEQ ID NO: 715210 - DNA, 20 bp, mouse
gtctcctgacatatctcctc

SEQ ID NO: 715211 - DNA, 20 bp, mouse
gcactgctgctcatagatgt

SEQ ID NO: 715212 - DNA, 20 bp, mouse
gcctgcagcttctggactaa

SEQ ID NO: 715213 - DNA, 20 bp, mouse
gcagaacaaggcacggagac

SEQ ID NO: 715214 - DNA, 20 bp, mouse
gacgcagggaatagaactca

SEQ ID NO: 715215 - DNA, 20 bp, mouse
ggcacctgaggagatatgtc

SEQ ID NO: 715216 - DNA, 20 bp, mouse
gacaactgacacagcaacaa

SEQ ID NO: 715217 - DNA, 20 bp, mouse
gagatctcagacaggtttaa

SEQ ID NO: 715218 - DNA, 20 bp, mouse
ggtaccctgcagatgatgca

SEQ ID NO: 715219 - DNA, 20 bp, mouse
gagcaacaaaggactccacc

SEQ ID NO: 715220 - DNA, 20 bp, mouse
gtggccatgcatcatctgca

SEQ ID NO: 715221 - DNA, 20 bp, mouse
gtatcatgacagagactctt

SEQ ID NO: 715222 - DNA, 20 bp, mouse
gaaggactccacctggattg

SEQ ID NO: 715223 - DNA, 20 bp, mouse
ggctgtgtcagttgtctttt

SEQ ID NO: 715224 - DNA, 20 bp, mouse
ggtctgagatctgctgagta

SEQ ID NO: 715225 - DNA, 20 bp, mouse
gaatgttaccacaatccagg

SEQ ID NO: 715226 - DNA, 20 bp, mouse
ggggctggttggtatatcat

SEQ ID NO: 715227 - DNA, 20 bp, mouse
gaatctaaggaggaacctgt

SEQ ID NO: 715228 - DNA, 20 bp, mouse
ggggtagagcacagcattaa

SEQ ID NO: 715229 - DNA, 20 bp, mouse
gtgttcaatcatatcagacc

SEQ ID NO: 715230 - DNA, 20 bp, mouse
gcaaccagcccatctaaagg

SEQ ID NO: 715231 - DNA, 20 bp, mouse
gtaagaaagaaccttgactg

SEQ ID NO: 715232 - DNA, 20 bp, mouse
gagtggtgtcattccaaggg

SEQ ID NO: 715233 - DNA, 20 bp, mouse
gcagtgcaaacgatggtttt

SEQ ID NO: 715234 - DNA, 20 bp, mouse
ggtgtcattccaagggaggt

SEQ ID NO: 715235 - DNA, 20 bp, mouse
gagaacattgatgcagtaac

SEQ ID NO: 715236 - DNA, 20 bp, mouse
gaggcagcggagtgccttgg

SEQ ID NO: 715237 - DNA, 20 bp, mouse
gattctgggaacaaagtgtc

SEQ ID NO: 715238 - DNA, 20 bp, mouse
gaagtctcagaatcctattc

SEQ ID NO: 715239 - DNA, 20 bp, mouse
gatttggccttttaaggatt

SEQ ID NO: 715240 - DNA, 20 bp, mouse
gggcattattaggcagaatc

SEQ ID NO: 715241 - DNA, 20 bp, mouse
gatggcattattaattaatg

SEQ ID NO: 715242 - DNA, 20 bp, mouse
ggcatttcattctgtagggt

SEQ ID NO: 715243 - DNA, 20 bp, mouse
gatgcctagagcataagctt

SEQ ID NO: 715244 - DNA, 20 bp, mouse
gattatgcatttcattctgt

SEQ ID NO: 715245 - DNA, 20 bp, mouse
gtaattaatgaggcattatt

SEQ ID NO: 715246 - DNA, 20 bp, mouse
gcagcccagattatccagac

SEQ ID NO: 715247 - DNA, 20 bp, mouse
ggtaagtaacagatgtgcag

SEQ ID NO: 715248 - DNA, 20 bp, mouse
gagttcaaatacagacccat

SEQ ID NO: 715249 - DNA, 20 bp, mouse
gtgtgtgtttttctacccca

SEQ ID NO: 715250 - DNA, 20 bp, mouse
gcaaaaccccaaacctctta

SEQ ID NO: 715251 - DNA, 20 bp, mouse
gtctaatcagaataacacac

SEQ ID NO: 715252 - DNA, 20 bp, mouse
gaaaagaaagtcaccttaag

SEQ ID NO: 715253 - DNA, 20 bp, mouse
gaaagtcaccttaagaggtt

SEQ ID NO: 715254 - DNA, 20 bp, mouse
gcttcctgtctggataatct

SEQ ID NO: 715255 - DNA, 20 bp, mouse
gttaatctgagtcttgagac

SEQ ID NO: 715256 - DNA, 20 bp, mouse
ggaatatcagtcatagtcct

SEQ ID NO: 715257 - DNA, 20 bp, mouse
gtcaggatattacatcatta

SEQ ID NO: 715258 - DNA, 20 bp, mouse
gaatttacatctttcgtttc

SEQ ID NO: 715259 - DNA, 20 bp, mouse
gattgtgttcatttggatcc

SEQ ID NO: 715260 - DNA, 20 bp, mouse
gtagtccttggtgatcagat

SEQ ID NO: 715261 - DNA, 20 bp, mouse
gagttctcttatttgcagta

SEQ ID NO: 715262 - DNA, 20 bp, mouse
gtattgttaggagcaaaacc

SEQ ID NO: 715263 - DNA, 20 bp, mouse
gatttctgattgtgttcatt

SEQ ID NO: 715264 - DNA, 20 bp, mouse
gctgatttcatccttgacca

SEQ ID NO: 715265 - DNA, 20 bp, mouse
gactctactcaatgattcct

SEQ ID NO: 715266 - DNA, 20 bp, mouse
gtgtcaaggtggatatatct

SEQ ID NO: 715267 - DNA, 20 bp, mouse
gtatatccaccttgacaacc

SEQ ID NO: 715268 - DNA, 20 bp, mouse
gctattcctggttgtcaagg

SEQ ID NO: 715269 - DNA, 20 bp, mouse
gggggaacgcagcgagtccc

SEQ ID NO: 715270 - DNA, 20 bp, mouse
gtctgggactggttgatccc

SEQ ID NO: 715271 - DNA, 20 bp, mouse
gcattccacttctggataaa

SEQ ID NO: 715272 - DNA, 20 bp, mouse
gtggctattcctggttgtca

SEQ ID NO: 715273 - DNA, 20 bp, mouse
gaagacacaggtttcagatc

SEQ ID NO: 715274 - DNA, 20 bp, mouse
gggaatagccattccacttc

SEQ ID NO: 715275 - DNA, 20 bp, mouse
gtcctttccaacagcagtgc

SEQ ID NO: 715276 - DNA, 20 bp, mouse
gccctggggcttctgccata

SEQ ID NO: 715277 - DNA, 20 bp, mouse
gaccctatggcagaagcccc

SEQ ID NO: 715278 - DNA, 20 bp, mouse
gcactttttgctcttccctg

SEQ ID NO: 715279 - DNA, 20 bp, mouse
gagtgggaaaaagaaatttg

SEQ ID NO: 715280 - DNA, 20 bp, mouse
gcctctatcagagatcatgt

SEQ ID NO: 715281 - DNA, 20 bp, mouse
ggtacagtatatactttatg

SEQ ID NO: 715282 - DNA, 20 bp, mouse
gacaaatattagtaaaacat

SEQ ID NO: 715283 - DNA, 20 bp, mouse
gcatcttatattatatatta

SEQ ID NO: 715284 - DNA, 20 bp, mouse
ggtttttggatatagttaaa

SEQ ID NO: 715285 - DNA, 20 bp, mouse
gcagcgatctggagacccta

SEQ ID NO: 715286 - DNA, 20 bp, mouse
gggcgtataggcacaatagt

SEQ ID NO: 715287 - DNA, 20 bp, mouse
ggcacaatagttggttaggg

SEQ ID NO: 715288 - DNA, 20 bp, mouse
gataggcacaatagttggtt

SEQ ID NO: 715289 - DNA, 20 bp, mouse
gtgagagaataaattactct

SEQ ID NO: 715290 - DNA, 20 bp, mouse
gcaacagatgacatcaagaa

SEQ ID NO: 715291 - DNA, 20 bp, mouse
gaaaatgaatgctatacatc

SEQ ID NO: 715292 - DNA, 20 bp, mouse
gaatagttggttagggtggt

SEQ ID NO: 715293 - DNA, 20 bp, mouse
gtgaatgctatacatcaggt

SEQ ID NO: 715294 - DNA, 20 bp, mouse
gtaaattactcttggcgtat

SEQ ID NO: 715295 - DNA, 20 bp, mouse
ggattaagcttagaatcatt

SEQ ID NO: 715296 - DNA, 20 bp, mouse
gtcgggtgaaatatgagatg

SEQ ID NO: 715297 - DNA, 20 bp, mouse
ggaagacattggttgtgttg

SEQ ID NO: 715298 - DNA, 20 bp, mouse
ggcatcagatgactcacctt

SEQ ID NO: 715299 - DNA, 20 bp, mouse
gctgtggggcaggtggtgtc

SEQ ID NO: 715300 - DNA, 20 bp, mouse
gtgaacttctaaactgactg

SEQ ID NO: 715301 - DNA, 20 bp, mouse
gatatgagatgaggagtgga

SEQ ID NO: 715302 - DNA, 20 bp, mouse
gagggtcaggtctctccaag

SEQ ID NO: 715303 - DNA, 20 bp, mouse
gtctaaactgactgtggggc

SEQ ID NO: 715304 - DNA, 20 bp, mouse
ggacaggtgcagggcacagg

SEQ ID NO: 715305 - DNA, 20 bp, mouse
gctggcacaacccctcccag

SEQ ID NO: 715306 - DNA, 20 bp, mouse
ggggtagaggcttatttctc

SEQ ID NO: 715307 - DNA, 20 bp, mouse
gtggcagcttacgtaaccct

SEQ ID NO: 715308 - DNA, 20 bp, mouse
gggtcccgacatcaaagttt

SEQ ID NO: 715309 - DNA, 20 bp, mouse
gtaccacatggcactgactg

SEQ ID NO: 715310 - DNA, 20 bp, mouse
ggctagaatgacaggtcttg

SEQ ID NO: 715311 - DNA, 20 bp, mouse
gctctgggagcttagggtag

SEQ ID NO: 715312 - DNA, 20 bp, mouse
ggatcccaaactttgatgtc

SEQ ID NO: 715313 - DNA, 20 bp, mouse
gtgtcattctagctgctatt

SEQ ID NO: 715314 - DNA, 20 bp, mouse
gctgggtcctagttgctgga

SEQ ID NO: 715315 - DNA, 20 bp, mouse
gttaaggactggaaactccg

SEQ ID NO: 715316 - DNA, 20 bp, mouse
ggtaagcgatgatggcaaat

SEQ ID NO: 715317 - DNA, 20 bp, mouse
ggccagacacagctggaggt

SEQ ID NO: 715318 - DNA, 20 bp, mouse
gctaaagcgcaaaagggctc

SEQ ID NO: 715319 - DNA, 20 bp, mouse
gaggcagcggtaagcgatga

SEQ ID NO: 715320 - DNA, 20 bp, mouse
gtaggccagctctgcacatc

SEQ ID NO: 715321 - DNA, 20 bp, mouse
ggatcactggccaggttagg

SEQ ID NO: 715322 - DNA, 20 bp, mouse
gcccgcccctggttttctcc

SEQ ID NO: 715323 - DNA, 20 bp, mouse
ggccagtgatcggtatagaa

SEQ ID NO: 715324 - DNA, 20 bp, mouse
gctggccaggagaaaaccag

SEQ ID NO: 715325 - DNA, 20 bp, mouse
gagggtggacaatggagacg

SEQ ID NO: 715326 - DNA, 20 bp, mouse
gtagtgacatcattcttcta

SEQ ID NO: 715327 - DNA, 20 bp, mouse
ggtaatataattttgaacag

SEQ ID NO: 715328 - DNA, 20 bp, mouse
gattactgagtggcctacat

SEQ ID NO: 715329 - DNA, 20 bp, mouse
gtgaacaacgttgaataact

SEQ ID NO: 715330 - DNA, 20 bp, mouse
gtgggtgtttcttctaaact

SEQ ID NO: 715331 - DNA, 20 bp, mouse
gagtggtgcttgtcccatgt

SEQ ID NO: 715332 - DNA, 20 bp, mouse
gaaaatttggcatggcattc

SEQ ID NO: 715333 - DNA, 20 bp, mouse
gttattcaacgttgttcaga

SEQ ID NO: 715334 - DNA, 20 bp, mouse
gagacaataaaaatttggca

SEQ ID NO: 715335 - DNA, 20 bp, mouse
gagaaggtgatttgtactgt

SEQ ID NO: 715336 - DNA, 20 bp, mouse
ggtcagctgtgctcttaaat

SEQ ID NO: 715337 - DNA, 20 bp, mouse
ggcttgcttgaatttactgt

SEQ ID NO: 715338 - DNA, 20 bp, mouse
gtcggccatgaaataggtcc

SEQ ID NO: 715339 - DNA, 20 bp, mouse
gatggagaagtgtaatgttc

SEQ ID NO: 715340 - DNA, 20 bp, mouse
gggcatatcggccatgaaat

SEQ ID NO: 715341 - DNA, 20 bp, mouse
gctcttaaattggtgtgtaa

SEQ ID NO: 715342 - DNA, 20 bp, mouse
ggtaatgttctggactgtaa

SEQ ID NO: 715343 - DNA, 20 bp, mouse
gaatttccatcccaagttcc

SEQ ID NO: 715344 - DNA, 20 bp, mouse
gagtttcctacctggaactt

SEQ ID NO: 715345 - DNA, 20 bp, mouse
gtcctacctggaacttggga

SEQ ID NO: 715346 - DNA, 20 bp, mouse
gtcacggcgagttgcatccc

SEQ ID NO: 715347 - DNA, 20 bp, mouse
ggcgggctgcatggtctcgt

SEQ ID NO: 715348 - DNA, 20 bp, mouse
gagcccggaggttccgttcc

SEQ ID NO: 715349 - DNA, 20 bp, mouse
gggggctcgcatgtagaagt

SEQ ID NO: 715350 - DNA, 20 bp, mouse
ggccatcgtggtccaggggt

SEQ ID NO: 715351 - DNA, 20 bp, mouse
gccgctgccatcgtggtcca

SEQ ID NO: 715352 - DNA, 20 bp, mouse
gtccctggaacggaacctcc

SEQ ID NO: 715353 - DNA, 20 bp, mouse
gcatgcagcccgcagcccgg

SEQ ID NO: 715354 - DNA, 20 bp, mouse
ggcgagttgcatccctggaa

SEQ ID NO: 715355 - DNA, 20 bp, mouse
ggagagtggtctaaagtcgc

SEQ ID NO: 715356 - DNA, 20 bp, mouse
gtgttggccaatcatggagg

SEQ ID NO: 715357 - DNA, 20 bp, mouse
gaaaataacagtgggagacg

SEQ ID NO: 715358 - DNA, 20 bp, mouse
gaacatgttgtcagggtgtt

SEQ ID NO: 715359 - DNA, 20 bp, mouse
ggtaagacctgtcaagccct

SEQ ID NO: 715360 - DNA, 20 bp, mouse
gagtcacacaacatgttgtc

SEQ ID NO: 715361 - DNA, 20 bp, mouse
ggggaggggcataagccaga

SEQ ID NO: 715362 - DNA, 20 bp, mouse
gtaggatgtacaaatccttc

SEQ ID NO: 715363 - DNA, 20 bp, mouse
gcctctttcctgttgggatt

SEQ ID NO: 715364 - DNA, 20 bp, mouse
gggtctgcctagggcttgac

SEQ ID NO: 715365 - DNA, 20 bp, mouse
gaggcagaccaaatcccaac

SEQ ID NO: 715366 - DNA, 20 bp, mouse
gaataaaagcagtaactcgt

SEQ ID NO: 715367 - DNA, 20 bp, mouse
gaagctgctcacaggcaggc

SEQ ID NO: 715368 - DNA, 20 bp, mouse
gaagttaagaagctgctcac

SEQ ID NO: 715369 - DNA, 20 bp, mouse
gagaaaatgttaagtcttat

SEQ ID NO: 715370 - DNA, 20 bp, mouse
gtacttttatatgttcttta

SEQ ID NO: 715371 - DNA, 20 bp, mouse
gtctgcttaagtctatgcac

SEQ ID NO: 715372 - DNA, 20 bp, mouse
gaaatgttaagtcttatggg

SEQ ID NO: 715373 - DNA, 20 bp, mouse
gttttctcatcactcaaact

SEQ ID NO: 715374 - DNA, 20 bp, mouse
ggcagatacttttagtgcag

SEQ ID NO: 715375 - DNA, 20 bp, mouse
gaatctgagataattaccca

SEQ ID NO: 715376 - DNA, 20 bp, mouse
gctccaaaaggggaagttgg

SEQ ID NO: 715377 - DNA, 20 bp, mouse
gaaaaaggatgggtccttct

SEQ ID NO: 715378 - DNA, 20 bp, mouse
gactccgtgatgcttggttc

SEQ ID NO: 715379 - DNA, 20 bp, mouse
gacttctaaaccaggaggta

SEQ ID NO: 715380 - DNA, 20 bp, mouse
gtggagacttctaaaccagg

SEQ ID NO: 715381 - DNA, 20 bp, mouse
gggcaacactgcgtggtctc

SEQ ID NO: 715382 - DNA, 20 bp, mouse
gaggacaaggttaatataaa

SEQ ID NO: 715383 - DNA, 20 bp, mouse
ggtgcttgaaatctccaaaa

SEQ ID NO: 715384 - DNA, 20 bp, mouse
ggtttcttggaagtgatttt

SEQ ID NO: 715385 - DNA, 20 bp, mouse
gcaggacaaggtgttcatcc

SEQ ID NO: 715386 - DNA, 20 bp, mouse
gggaaagttcatatggcagc

SEQ ID NO: 715387 - DNA, 20 bp, mouse
ggaaattaatactgaattct

SEQ ID NO: 715388 - DNA, 20 bp, mouse
ggttagctggaaagttcata

SEQ ID NO: 715389 - DNA, 20 bp, mouse
gtagcaagcgatctgttagc

SEQ ID NO: 715390 - DNA, 20 bp, mouse
gtgctctaacaaacatgtcc

SEQ ID NO: 715391 - DNA, 20 bp, mouse
ggtagggatgagaagagaga

SEQ ID NO: 715392 - DNA, 20 bp, mouse
ggcagaaatgtcaggggaac

SEQ ID NO: 715393 - DNA, 20 bp, mouse
ggagggtgagagtggtgcca

SEQ ID NO: 715394 - DNA, 20 bp, mouse
gggtgagagtggtgccacgg

SEQ ID NO: 715395 - DNA, 20 bp, mouse
gcctcaacatgggtccgccg

SEQ ID NO: 715396 - DNA, 20 bp, mouse
gtctgtctagtcttggaccc

SEQ ID NO: 715397 - DNA, 20 bp, mouse
gtaaatagatcctgttcttg

SEQ ID NO: 715398 - DNA, 20 bp, mouse
ggtctgcaatattttggcac

SEQ ID NO: 715399 - DNA, 20 bp, mouse
gtgggaattgagtggcatcc

SEQ ID NO: 715400 - DNA, 20 bp, mouse
gtgataggctgggaattgag

SEQ ID NO: 715401 - DNA, 20 bp, mouse
gctagtcttggaccctggcc

SEQ ID NO: 715402 - DNA, 20 bp, mouse
gccttctttcccacaagaac

SEQ ID NO: 715403 - DNA, 20 bp, mouse
gttattcagtaacaattttg

SEQ ID NO: 715404 - DNA, 20 bp, mouse
gggcaagattaagaaatagc

SEQ ID NO: 715405 - DNA, 20 bp, mouse
ggtgggtcgagtgataggct

SEQ ID NO: 715406 - DNA, 20 bp, mouse
gggtgtctgcgatgaacgat

SEQ ID NO: 715407 - DNA, 20 bp, mouse
gcacacatacattcgagaca

SEQ ID NO: 715408 - DNA, 20 bp, mouse
ggggagaccatgtgcgaaga

SEQ ID NO: 715409 - DNA, 20 bp, mouse
ggggttttgagttgctgaat

SEQ ID NO: 715410 - DNA, 20 bp, mouse
ggaccatgtgcgaagagggg

SEQ ID NO: 715411 - DNA, 20 bp, mouse
gtggctagcccaaagcctca

SEQ ID NO: 715412 - DNA, 20 bp, mouse
ggcccaaagcctcaaggatg

SEQ ID NO: 715413 - DNA, 20 bp, mouse
gcgttcataaatccagtgct

SEQ ID NO: 715414 - DNA, 20 bp, mouse
gcacacacatacaagcgact

SEQ ID NO: 715415 - DNA, 20 bp, mouse
gattaagcatcttttaagcc

SEQ ID NO: 715416 - DNA, 20 bp, mouse
gtgcaagagcaatgggttcg

SEQ ID NO: 715417 - DNA, 20 bp, mouse
gaagagcaatgggttcgggg

SEQ ID NO: 715418 - DNA, 20 bp, mouse
gtgagtgcctgcaagagcaa

SEQ ID NO: 715419 - DNA, 20 bp, mouse
ggtcataataagaagttagt

SEQ ID NO: 715420 - DNA, 20 bp, mouse
gcttctctaagaaaactttg

SEQ ID NO: 715421 - DNA, 20 bp, mouse
gaagaagttagtaggagggc

SEQ ID NO: 715422 - DNA, 20 bp, mouse
ggaggcaacagtgttgtatc

SEQ ID NO: 715423 - DNA, 20 bp, mouse
gctatcaaggagaggttact

SEQ ID NO: 715424 - DNA, 20 bp, mouse
gaggagaggttactcggcag

SEQ ID NO: 715425 - DNA, 20 bp, mouse
ggacctagcctatcaaggag

SEQ ID NO: 715426 - DNA, 20 bp, mouse
gcagggagcaagtcaggact

SEQ ID NO: 715427 - DNA, 20 bp, mouse
gggagcaagtcaggactggg

SEQ ID NO: 715428 - DNA, 20 bp, mouse
ggagactctcatttttaaga

SEQ ID NO: 715429 - DNA, 20 bp, mouse
gtgatacagagggaatggtt

SEQ ID NO: 715430 - DNA, 20 bp, mouse
gcctctggtaacactattca

SEQ ID NO: 715431 - DNA, 20 bp, mouse
gacactattcaaggttttca

SEQ ID NO: 715432 - DNA, 20 bp, mouse
gctgtgcacatgtgtatcca

SEQ ID NO: 715433 - DNA, 20 bp, mouse
gacatagctatttgtgtcca

SEQ ID NO: 715434 - DNA, 20 bp, mouse
ggcatgtgatacagagggaa

SEQ ID NO: 715435 - DNA, 20 bp, mouse
ggggatgcatgtgatacaga

SEQ ID NO: 715436 - DNA, 20 bp, mouse
gtcgcggtctgggaatgaaa

SEQ ID NO: 715437 - DNA, 20 bp, mouse
gtctgggctacaaggggaat

SEQ ID NO: 715438 - DNA, 20 bp, mouse
gaccgcgaatgtgtctgtct

SEQ ID NO: 715439 - DNA, 20 bp, mouse
gctgcagagctggagaagat

SEQ ID NO: 715440 - DNA, 20 bp, mouse
gcaaggaattagcatttcaa

SEQ ID NO: 715441 - DNA, 20 bp, mouse
gaaaggcagcaccagggaac

SEQ ID NO: 715442 - DNA, 20 bp, mouse
gtggattgcagccatccaaa

SEQ ID NO: 715443 - DNA, 20 bp, mouse
gtaaaagaaaaggcagcacc

SEQ ID NO: 715444 - DNA, 20 bp, mouse
gacagacacattcgcggtct

SEQ ID NO: 715445 - DNA, 20 bp, mouse
ggggtctggaatctgagcag

SEQ ID NO: 715446 - DNA, 20 bp, mouse
ggattgagtgggcaagatca

SEQ ID NO: 715447 - DNA, 20 bp, mouse
ggtgactatgttgaagggca

SEQ ID NO: 715448 - DNA, 20 bp, mouse
gaggaaggagagggttaccg

SEQ ID NO: 715449 - DNA, 20 bp, mouse
gattgtgaatcccaagactg

SEQ ID NO: 715450 - DNA, 20 bp, mouse
gatcaacacacattaatcat

SEQ ID NO: 715451 - DNA, 20 bp, mouse
gtgcattgaaagcaccttgt

SEQ ID NO: 715452 - DNA, 20 bp, mouse
gggattcacaatctcctaca

SEQ ID NO: 715453 - DNA, 20 bp, mouse
gtaaatcagtcagcggccaa

SEQ ID NO: 715454 - DNA, 20 bp, mouse
gccaggattctactagatgc

SEQ ID NO: 715455 - DNA, 20 bp, mouse
gctgcaagacaggattgagt

SEQ ID NO: 715456 - DNA, 20 bp, mouse
ggtactgtggggaaactata

SEQ ID NO: 715457 - DNA, 20 bp, mouse
gtccaccttggagtactgtg

SEQ ID NO: 715458 - DNA, 20 bp, mouse
gtagcgcaaaaactcgggga

SEQ ID NO: 715459 - DNA, 20 bp, mouse
gaaaaagcagccctttatat

SEQ ID NO: 715460 - DNA, 20 bp, mouse
gtccccacagtactccaagg

SEQ ID NO: 715461 - DNA, 20 bp, mouse
gcctttatatggggagtgaa

SEQ ID NO: 715462 - DNA, 20 bp, mouse
ggtttccccacagtactcca

SEQ ID NO: 715463 - DNA, 20 bp, mouse
gactatggagagttctggag

SEQ ID NO: 715464 - DNA, 20 bp, mouse
gtaggcctagcgcaaaaact

SEQ ID NO: 715465 - DNA, 20 bp, mouse
ggctaggcctagccgagtac

SEQ ID NO: 715466 - DNA, 20 bp, mouse
gtgaacagccagcctgtcaa

SEQ ID NO: 715467 - DNA, 20 bp, mouse
gtgagtgcaatgccttgaag

SEQ ID NO: 715468 - DNA, 20 bp, mouse
gcctggaacagcagatccaa

SEQ ID NO: 715469 - DNA, 20 bp, mouse
gagtcaggctaggctatctg

SEQ ID NO: 715470 - DNA, 20 bp, mouse
ggactatgggagcccttgac

SEQ ID NO: 715471 - DNA, 20 bp, mouse
ggatagcctagcctgactat

SEQ ID NO: 715472 - DNA, 20 bp, mouse
gaaaacaagactttctagga

SEQ ID NO: 715473 - DNA, 20 bp, mouse
gcaaatgagaggctcttagg

SEQ ID NO: 715474 - DNA, 20 bp, mouse
gtaagtgggtcacacctgcc

SEQ ID NO: 715475 - DNA, 20 bp, mouse
gagactttctaggaaggggc

SEQ ID NO: 715476 - DNA, 20 bp, mouse
gaaggggtctaataccctga

SEQ ID NO: 715477 - DNA, 20 bp, mouse
gttcagaagatgttccatca

SEQ ID NO: 715478 - DNA, 20 bp, mouse
gaagactttatggagttatt

SEQ ID NO: 715479 - DNA, 20 bp, mouse
ggttctgattctacaaggat

SEQ ID NO: 715480 - DNA, 20 bp, mouse
gtgaaatcattggattgttc

SEQ ID NO: 715481 - DNA, 20 bp, mouse
gagaagtacctatgcaatgt

SEQ ID NO: 715482 - DNA, 20 bp, mouse
gcctatgcaatgttggtaaa

SEQ ID NO: 715483 - DNA, 20 bp, mouse
gtttgtgattagctgtttga

SEQ ID NO: 715484 - DNA, 20 bp, mouse
gatgtttgagatatactcct

SEQ ID NO: 715485 - DNA, 20 bp, mouse
ggtaagagtaaatatgtcta

SEQ ID NO: 715486 - DNA, 20 bp, mouse
gaatgtgccttccccattta

SEQ ID NO: 715487 - DNA, 20 bp, mouse
gagatcaattgtactattca

SEQ ID NO: 715488 - DNA, 20 bp, mouse
gttctttgttagttttaatt

SEQ ID NO: 715489 - DNA, 20 bp, mouse
gttttatttggattatcaaa

SEQ ID NO: 715490 - DNA, 20 bp, mouse
gaactcaccctaaatgggga

SEQ ID NO: 715491 - DNA, 20 bp, mouse
gaaggcacattttatggccc

SEQ ID NO: 715492 - DNA, 20 bp, mouse
gttcctggactgaattaaaa

SEQ ID NO: 715493 - DNA, 20 bp, mouse
gaggcaaactcaccctaaat

SEQ ID NO: 715494 - DNA, 20 bp, mouse
gatggggaaggcacatttta

SEQ ID NO: 715495 - DNA, 20 bp, mouse
gactgtggacatgcctttga

SEQ ID NO: 715496 - DNA, 20 bp, mouse
gcatagttgtgcaaactcct

SEQ ID NO: 715497 - DNA, 20 bp, mouse
gggacccattgtgagatata

SEQ ID NO: 715498 - DNA, 20 bp, mouse
gttaccttatatctcacaat

SEQ ID NO: 715499 - DNA, 20 bp, mouse
gcaaagcttctggttcaggt

SEQ ID NO: 715500 - DNA, 20 bp, mouse
gcaactatgatctgcctaat

SEQ ID NO: 715501 - DNA, 20 bp, mouse
gtcttgaggggttctggttt

SEQ ID NO: 715502 - DNA, 20 bp, mouse
gctcacaatgggtcctcatg

SEQ ID NO: 715503 - DNA, 20 bp, mouse
gtgaaggccttttggatcct

SEQ ID NO: 715504 - DNA, 20 bp, mouse
gccttcaaagcttctggttc

SEQ ID NO: 715505 - DNA, 20 bp, mouse
gaattggatgtagctagttc

SEQ ID NO: 715506 - DNA, 20 bp, mouse
gagattactataatgcccaa

SEQ ID NO: 715507 - DNA, 20 bp, mouse
gggcatgaaagaaatcacac

SEQ ID NO: 715508 - DNA, 20 bp, mouse
gatataacagtcaacttcaa

SEQ ID NO: 715509 - DNA, 20 bp, mouse
gagtacagtttatttcatga

SEQ ID NO: 715510 - DNA, 20 bp, mouse
gataaatgtggtaaagcctt

SEQ ID NO: 715511 - DNA, 20 bp, mouse
gcctatggatgtagtcaatg

SEQ ID NO: 715512 - DNA, 20 bp, mouse
ggcattatagtaatcttcaa

SEQ ID NO: 715513 - DNA, 20 bp, mouse
gcttatgaatgtaagaaatg

SEQ ID NO: 715514 - DNA, 20 bp, mouse
ggtactcaagaaaaatccta

SEQ ID NO: 715515 - DNA, 20 bp, mouse
ggcatgaaagaagtcatact

SEQ ID NO: 715516 - DNA, 20 bp, mouse
gtgggtgggttggtgatctg

SEQ ID NO: 715517 - DNA, 20 bp, mouse
gtgaactcaggggtattgga

SEQ ID NO: 715518 - DNA, 20 bp, mouse
gtgggggaggtggagtagat

SEQ ID NO: 715519 - DNA, 20 bp, mouse
gcctgtgaactcaggggtat

SEQ ID NO: 715520 - DNA, 20 bp, mouse
gttacacatgaagggatgta

SEQ ID NO: 715521 - DNA, 20 bp, mouse
gagggatgtatggctccacc

SEQ ID NO: 715522 - DNA, 20 bp, mouse
gtaaagaaaactcaaaagaa

SEQ ID NO: 715523 - DNA, 20 bp, mouse
gtgggttggtgatctggggg

SEQ ID NO: 715524 - DNA, 20 bp, mouse
gttagtgcctgtgaactcag

SEQ ID NO: 715525 - DNA, 20 bp, mouse
gactctgctgcatatccagg

SEQ ID NO: 715526 - DNA, 20 bp, mouse
gaggaagccaatgactgagt

SEQ ID NO: 715527 - DNA, 20 bp, mouse
gaccctaagtatggtttatt

SEQ ID NO: 715528 - DNA, 20 bp, mouse
gttccctcccactcagtcat

SEQ ID NO: 715529 - DNA, 20 bp, mouse
gaagccaatgactgagtggg

SEQ ID NO: 715530 - DNA, 20 bp, mouse
gagttcctgtcactccggcc

SEQ ID NO: 715531 - DNA, 20 bp, mouse
gctaagtatggtttattggg

SEQ ID NO: 715532 - DNA, 20 bp, mouse
gaccaggacattgaccagac

SEQ ID NO: 715533 - DNA, 20 bp, mouse
gctgcactctgacatctgag

SEQ ID NO: 715534 - DNA, 20 bp, mouse
ggcacagcaaaatataacct

SEQ ID NO: 715535 - DNA, 20 bp, mouse
gtccgggtccagagacagct

SEQ ID NO: 715536 - DNA, 20 bp, mouse
gtagttagatagaatgctct

SEQ ID NO: 715537 - DNA, 20 bp, mouse
gttgcaggggattagatttt

SEQ ID NO: 715538 - DNA, 20 bp, mouse
gttagaccttccagtggcgt

SEQ ID NO: 715539 - DNA, 20 bp, mouse
gtctttaaaaagaatgtagg

SEQ ID NO: 715540 - DNA, 20 bp, mouse
gtaggaccgacgccactgga

SEQ ID NO: 715541 - DNA, 20 bp, mouse
gcttcaaggtccaggcttgc

SEQ ID NO: 715542 - DNA, 20 bp, mouse
gatctaatcccctgcaagcc

SEQ ID NO: 715543 - DNA, 20 bp, mouse
ggatgcttttatttcctcag

SEQ ID NO: 715544 - DNA, 20 bp, mouse
gctgtgcagatacaaatctt

SEQ ID NO: 715545 - DNA, 20 bp, mouse
gtgtctcatcccatcctctg

SEQ ID NO: 715546 - DNA, 20 bp, mouse
gcctactggaacatggtgga

SEQ ID NO: 715547 - DNA, 20 bp, mouse
gagcctgaaacacagaccac

SEQ ID NO: 715548 - DNA, 20 bp, mouse
gtctttgtggaatattcctg

SEQ ID NO: 715549 - DNA, 20 bp, mouse
gagaataatagaggcaggtg

SEQ ID NO: 715550 - DNA, 20 bp, mouse
ggatgaagcctactggaaca

SEQ ID NO: 715551 - DNA, 20 bp, mouse
ggacaaataaattgaatcca

SEQ ID NO: 715552 - DNA, 20 bp, mouse
gcttagattagggatgcaat

SEQ ID NO: 715553 - DNA, 20 bp, mouse
gtgataaaggtcttagatta

SEQ ID NO: 715554 - DNA, 20 bp, mouse
gacctaagaataatagaggc

SEQ ID NO: 715555 - DNA, 20 bp, mouse
ggaagcctactggaacatgg

SEQ ID NO: 715556 - DNA, 20 bp, mouse
gaggcagttaagttgtttgt

SEQ ID NO: 715557 - DNA, 20 bp, mouse
gatggaggatcttccaacct

SEQ ID NO: 715558 - DNA, 20 bp, mouse
gctggagtctataatatagt

SEQ ID NO: 715559 - DNA, 20 bp, mouse
gatgcacactcccctgtgat

SEQ ID NO: 715560 - DNA, 20 bp, mouse
gaacatgttttcctaagact

SEQ ID NO: 715561 - DNA, 20 bp, mouse
gttcctgttcttggaaatcc

SEQ ID NO: 715562 - DNA, 20 bp, mouse
ggagttctaaggggccatgg

SEQ ID NO: 715563 - DNA, 20 bp, mouse
gtgggctgcaggcaaccctg

SEQ ID NO: 715564 - DNA, 20 bp, mouse
gctaccgtcactcactaaag

SEQ ID NO: 715565 - DNA, 20 bp, mouse
gaagaagaaaatgagttcta

SEQ ID NO: 715566 - DNA, 20 bp, mouse
gccagctgaccaggagttag

SEQ ID NO: 715567 - DNA, 20 bp, mouse
ggacagggacggtagaatag

SEQ ID NO: 715568 - DNA, 20 bp, mouse
ggggttaccaagagctcagt

SEQ ID NO: 715569 - DNA, 20 bp, mouse
ggagcaaggaccccagaggg

SEQ ID NO: 715570 - DNA, 20 bp, mouse
ggggaatgatgatatagttg

SEQ ID NO: 715571 - DNA, 20 bp, mouse
gaggtaaagaggtcacatta

SEQ ID NO: 715572 - DNA, 20 bp, mouse
gagttcactgtgtacatttg

SEQ ID NO: 715573 - DNA, 20 bp, mouse
gtcacacaaccactaactcc

SEQ ID NO: 715574 - DNA, 20 bp, mouse
ggaagaagcaaattcagaca

SEQ ID NO: 715575 - DNA, 20 bp, mouse
gctacactgatctcctatgt

SEQ ID NO: 715576 - DNA, 20 bp, mouse
gccccaggaaggggctagct

SEQ ID NO: 715577 - DNA, 20 bp, mouse
ggaaaggatgccaatggcta

SEQ ID NO: 715578 - DNA, 20 bp, mouse
ggatccatctgtgtctccta

SEQ ID NO: 715579 - DNA, 20 bp, mouse
gcaagtcttcatgcttatat

SEQ ID NO: 715580 - DNA, 20 bp, mouse
gccccagctagccccttcct

SEQ ID NO: 715581 - DNA, 20 bp, mouse
gtatttctaagccccaggaa

SEQ ID NO: 715582 - DNA, 20 bp, mouse
gggttacacaacaacttgaa

SEQ ID NO: 715583 - DNA, 20 bp, mouse
gtcaatgtatacagtgcaga

SEQ ID NO: 715584 - DNA, 20 bp, mouse
gctataacacacataaacca

SEQ ID NO: 715585 - DNA, 20 bp, mouse
gtaaaacagtccctagccat

SEQ ID NO: 715586 - DNA, 20 bp, mouse
gcaacctcaaatagctagaa

SEQ ID NO: 715587 - DNA, 20 bp, mouse
gtctgctcagactcagtgtc

SEQ ID NO: 715588 - DNA, 20 bp, mouse
gagttctataatcaagaggg

SEQ ID NO: 715589 - DNA, 20 bp, mouse
gtgggtgacttggctttttt

SEQ ID NO: 715590 - DNA, 20 bp, mouse
gtctataatcaagagggagg

SEQ ID NO: 715591 - DNA, 20 bp, mouse
gcttagttctataatcaaga

SEQ ID NO: 715592 - DNA, 20 bp, mouse
gatgcctttctagctatttg

SEQ ID NO: 715593 - DNA, 20 bp, mouse
gtgtttgtaacattatgctg

SEQ ID NO: 715594 - DNA, 20 bp, mouse
gcagaaaagaaagaagagac

SEQ ID NO: 715595 - DNA, 20 bp, mouse
gaagaagagactgggtgact

SEQ ID NO: 715596 - DNA, 20 bp, mouse
gagtgtgtgcagcactcggg

SEQ ID NO: 715597 - DNA, 20 bp, mouse
gggaggggaaaataccatat

SEQ ID NO: 715598 - DNA, 20 bp, mouse
gaccgtgacacactgtaccc

SEQ ID NO: 715599 - DNA, 20 bp, mouse
ggcttagtcaggtaatttta

SEQ ID NO: 715600 - DNA, 20 bp, mouse
gtgatgccgtgctagaggag

SEQ ID NO: 715601 - DNA, 20 bp, mouse
gaaaagtgtgtgcagcactc

SEQ ID NO: 715602 - DNA, 20 bp, mouse
gctagcacggcatcaagtct

SEQ ID NO: 715603 - DNA, 20 bp, mouse
gctgtcattgctgttggtac

SEQ ID NO: 715604 - DNA, 20 bp, mouse
gactccaaataagtcctata

SEQ ID NO: 715605 - DNA, 20 bp, mouse
gctgttggagatgcttagtc

SEQ ID NO: 715606 - DNA, 20 bp, mouse
gcgggagcgggagcacgtgt

SEQ ID NO: 715607 - DNA, 20 bp, mouse
gcgcacgcgcacccggggca

SEQ ID NO: 715608 - DNA, 20 bp, mouse
gcgcacccggggcagggcac

SEQ ID NO: 715609 - DNA, 20 bp, mouse
ggcagaggagcgttggaaaa

SEQ ID NO: 715610 - DNA, 20 bp, mouse
gcggtgccaggcacgagcag

SEQ ID NO: 715611 - DNA, 20 bp, mouse
gggcacgagcagaggagcgt

SEQ ID NO: 715612 - DNA, 20 bp, mouse
gcgtgcctggcaccgcgtgg

SEQ ID NO: 715613 - DNA, 20 bp, mouse
ggcaccgcgtggcgggaacg

SEQ ID NO: 715614 - DNA, 20 bp, mouse
gcgcgtggcgggaacgtgga

SEQ ID NO: 715615 - DNA, 20 bp, mouse
gccgcggctcgcggggtccc

SEQ ID NO: 715616 - DNA, 20 bp, mouse
ggataagtctgacaccctaa

SEQ ID NO: 715617 - DNA, 20 bp, mouse
ggcggcagcgggtagcatcc

SEQ ID NO: 715618 - DNA, 20 bp, mouse
gtagcatcccggctcggctc

SEQ ID NO: 715619 - DNA, 20 bp, mouse
gggctatcacaggttcagag

SEQ ID NO: 715620 - DNA, 20 bp, mouse
gcataggtgaaagatgtaag

SEQ ID NO: 715621 - DNA, 20 bp, mouse
gtggtggagatggctatcac

SEQ ID NO: 715622 - DNA, 20 bp, mouse
ggagatgcctgtcaaccctt

SEQ ID NO: 715623 - DNA, 20 bp, mouse
gggtgctccctgagccgagc

SEQ ID NO: 715624 - DNA, 20 bp, mouse
gatgccctgtaagctctgag

SEQ ID NO: 715625 - DNA, 20 bp, mouse
gagggtgtcagacttatcca

SEQ ID NO: 715626 - DNA, 20 bp, mouse
ggacacactgcagtttccat

SEQ ID NO: 715627 - DNA, 20 bp, mouse
gctgaggtagcccagaccta

SEQ ID NO: 715628 - DNA, 20 bp, mouse
gcactgcagtttccataggg

SEQ ID NO: 715629 - DNA, 20 bp, mouse
ggcaggacaggccctgcatg

SEQ ID NO: 715630 - DNA, 20 bp, mouse
gccagacacagggcatctac

SEQ ID NO: 715631 - DNA, 20 bp, mouse
gcgcagaaacttccagacac

SEQ ID NO: 715632 - DNA, 20 bp, mouse
gcagctttcactatagattc

SEQ ID NO: 715633 - DNA, 20 bp, mouse
gctggaagtttctgcggctt

SEQ ID NO: 715634 - DNA, 20 bp, mouse
gagggacagggagatgagtg

SEQ ID NO: 715635 - DNA, 20 bp, mouse
gcctgcatgaggtagatgtt

SEQ ID NO: 715636 - DNA, 20 bp, mouse
gcactctgtaggtgctgttc

SEQ ID NO: 715637 - DNA, 20 bp, mouse
gtgagcgagagccactctgt

SEQ ID NO: 715638 - DNA, 20 bp, mouse
ggctcaggctgtgggtctgc

SEQ ID NO: 715639 - DNA, 20 bp, mouse
gcaaagctacagcccaggag

SEQ ID NO: 715640 - DNA, 20 bp, mouse
gtgggtgtgagcctcaccgt

SEQ ID NO: 715641 - DNA, 20 bp, mouse
ggtgggtctgcaggatgact

SEQ ID NO: 715642 - DNA, 20 bp, mouse
gcaaactgggatagaccctg

SEQ ID NO: 715643 - DNA, 20 bp, mouse
gtgcaggatgactgggtgca

SEQ ID NO: 715644 - DNA, 20 bp, mouse
gtgggatagaccctgtggta

SEQ ID NO: 715645 - DNA, 20 bp, mouse
gaccaggcagacccacggtg

SEQ ID NO: 715646 - DNA, 20 bp, mouse
gggccctaagcctgcatctc

SEQ ID NO: 715647 - DNA, 20 bp, mouse
gacgtggggcggggccctca

SEQ ID NO: 715648 - DNA, 20 bp, mouse
ggctccggagatgcaggctt

SEQ ID NO: 715649 - DNA, 20 bp, mouse
gtctccgcacctcctcgcaa

SEQ ID NO: 715650 - DNA, 20 bp, mouse
gctgcctaaacgaagggggt

SEQ ID NO: 715651 - DNA, 20 bp, mouse
gcacctcctcgcaagggagg

SEQ ID NO: 715652 - DNA, 20 bp, mouse
ggaggtgcggagactccgct

SEQ ID NO: 715653 - DNA, 20 bp, mouse
gtccctccgaagcacacgtg

SEQ ID NO: 715654 - DNA, 20 bp, mouse
gagctcgtgaactagagagc

SEQ ID NO: 715655 - DNA, 20 bp, mouse
ggccccacgtgtgcttcgga

SEQ ID NO: 715656 - DNA, 20 bp, mouse
gtggaagcaccgcgaggaag

SEQ ID NO: 715657 - DNA, 20 bp, mouse
gctcccaaggtgagtacttc

SEQ ID NO: 715658 - DNA, 20 bp, mouse
gagcaccgcgaggaaggggt

SEQ ID NO: 715659 - DNA, 20 bp, mouse
gtgccagaagtactcacctt

SEQ ID NO: 715660 - DNA, 20 bp, mouse
ggcaggcatggcaaggatgc

SEQ ID NO: 715661 - DNA, 20 bp, mouse
gtgacgtcagggcaccagga

SEQ ID NO: 715662 - DNA, 20 bp, mouse
ggcttcttggaagcaccgcg

SEQ ID NO: 715663 - DNA, 20 bp, mouse
gcatgcctaccccttcctcg

SEQ ID NO: 715664 - DNA, 20 bp, mouse
gagagatatttaaggggtag

SEQ ID NO: 715665 - DNA, 20 bp, mouse
gtggcaggtgtggtgcttct

SEQ ID NO: 715666 - DNA, 20 bp, mouse
gtagaagtgtgatctatcga

SEQ ID NO: 715667 - DNA, 20 bp, mouse
ggccttgaatgcctcggcat

SEQ ID NO: 715668 - DNA, 20 bp, mouse
gtacatcaacgagcattaag

SEQ ID NO: 715669 - DNA, 20 bp, mouse
gcggtcaatcttagtgtctg

SEQ ID NO: 715670 - DNA, 20 bp, mouse
gatatacttggtgtcataat

SEQ ID NO: 715671 - DNA, 20 bp, mouse
gtttactgtgtcccatgccg

SEQ ID NO: 715672 - DNA, 20 bp, mouse
gatcttagtgtctgtggcat

SEQ ID NO: 715673 - DNA, 20 bp, mouse
ggtcatattttcatgagctt

SEQ ID NO: 715674 - DNA, 20 bp, mouse
gatgaaaatatgacttgagt

SEQ ID NO: 715675 - DNA, 20 bp, mouse
gaaaaatgctagaaattagc

SEQ ID NO: 715676 - DNA, 20 bp, mouse
gaatgcattgaccagtaagc

SEQ ID NO: 715677 - DNA, 20 bp, mouse
gtgtttagggagcagcagga

SEQ ID NO: 715678 - DNA, 20 bp, mouse
gttgaccagtaagcaggagt

SEQ ID NO: 715679 - DNA, 20 bp, mouse
gaggatggtagagaataggg

SEQ ID NO: 715680 - DNA, 20 bp, mouse
gaagcaggagtgggttgttt

SEQ ID NO: 715681 - DNA, 20 bp, mouse
ggggttgtttagggagcagc

SEQ ID NO: 715682 - DNA, 20 bp, mouse
gacaacccactcctgcttac

SEQ ID NO: 715683 - DNA, 20 bp, mouse
gtcaatgcattcgcctatac

SEQ ID NO: 715684 - DNA, 20 bp, mouse
gcttctttaatctttttaaa

SEQ ID NO: 715685 - DNA, 20 bp, mouse
gctgcattttgtcactactt

SEQ ID NO: 715686 - DNA, 20 bp, mouse
gtccccccaaaagaagatgg

SEQ ID NO: 715687 - DNA, 20 bp, mouse
gaggtgctgtgcatagcttt

SEQ ID NO: 715688 - DNA, 20 bp, mouse
gagacatagtccacaatgcc

SEQ ID NO: 715689 - DNA, 20 bp, mouse
gcagcagagcaaacgaatct

SEQ ID NO: 715690 - DNA, 20 bp, mouse
gtgctgtgcatagctttggg

SEQ ID NO: 715691 - DNA, 20 bp, mouse
gcagatacatgcaggttaag

SEQ ID NO: 715692 - DNA, 20 bp, mouse
gtccatcacattttgtccat

SEQ ID NO: 715693 - DNA, 20 bp, mouse
ggaaagttacagtttcataa

SEQ ID NO: 715694 - DNA, 20 bp, mouse
gtcccatgcaggcaacaact

SEQ ID NO: 715695 - DNA, 20 bp, mouse
gggttttcaagaggctagcc

SEQ ID NO: 715696 - DNA, 20 bp, mouse
gtgtctggggttgaactcag

SEQ ID NO: 715697 - DNA, 20 bp, mouse
ggggactaggcgatcccgga

SEQ ID NO: 715698 - DNA, 20 bp, mouse
gggcagagaggcgggggctt

SEQ ID NO: 715699 - DNA, 20 bp, mouse
gaggaagttgtgagcctgtc

SEQ ID NO: 715700 - DNA, 20 bp, mouse
ggggcttgggggaggaaagc

SEQ ID NO: 715701 - DNA, 20 bp, mouse
gtacgagcccggagtccccg

SEQ ID NO: 715702 - DNA, 20 bp, mouse
gcgcagggactaggcgatcc

SEQ ID NO: 715703 - DNA, 20 bp, mouse
ggcaacgaagctgaatgtac

SEQ ID NO: 715704 - DNA, 20 bp, mouse
gggcctggcggtgtcccctc

SEQ ID NO: 715705 - DNA, 20 bp, mouse
gctattgcttggcaaaccga

SEQ ID NO: 715706 - DNA, 20 bp, mouse
gacgaaagatggtaaagata

SEQ ID NO: 715707 - DNA, 20 bp, mouse
gtcatggcttactcaaacag

SEQ ID NO: 715708 - DNA, 20 bp, mouse
gtataggtaggaagcaacat

SEQ ID NO: 715709 - DNA, 20 bp, mouse
ggatagtgggtcttataggt

SEQ ID NO: 715710 - DNA, 20 bp, mouse
gacttgccaagtgaaagaga

SEQ ID NO: 715711 - DNA, 20 bp, mouse
gagcggccttctctttcact

SEQ ID NO: 715712 - DNA, 20 bp, mouse
gttagaaagataacgaaaga

SEQ ID NO: 715713 - DNA, 20 bp, mouse
gacacactttggggcttaaa

SEQ ID NO: 715714 - DNA, 20 bp, mouse
ggatttccattcttagaaaa

SEQ ID NO: 715715 - DNA, 20 bp, mouse
gcccttaaagaaacacactt

SEQ ID NO: 715716 - DNA, 20 bp, mouse
gggaaaggaaatggagtgtt

SEQ ID NO: 715717 - DNA, 20 bp, mouse
ggggggcattacaaaagcat

SEQ ID NO: 715718 - DNA, 20 bp, mouse
gagaagaggtgggaaattaa

SEQ ID NO: 715719 - DNA, 20 bp, mouse
gaccatttctggaaaggaaa

SEQ ID NO: 715720 - DNA, 20 bp, mouse
gaattaatggataccatttc

SEQ ID NO: 715721 - DNA, 20 bp, mouse
gcctttgaaaaagaagaggt

SEQ ID NO: 715722 - DNA, 20 bp, mouse
ggaattttatcagacatcga

SEQ ID NO: 715723 - DNA, 20 bp, mouse
gtccatttcctttccagaaa

SEQ ID NO: 715724 - DNA, 20 bp, mouse
gatggataccatttctggaa

SEQ ID NO: 715725 - DNA, 20 bp, mouse
gaaggaaatggagtgttggg

SEQ ID NO: 715726 - DNA, 20 bp, mouse
ggggggacagggttaattca

SEQ ID NO: 715727 - DNA, 20 bp, mouse
ggacagggttaattcagggc

SEQ ID NO: 715728 - DNA, 20 bp, mouse
ggaatgggagaggatcggtc

SEQ ID NO: 715729 - DNA, 20 bp, mouse
gggtctctgcatttccacac

SEQ ID NO: 715730 - DNA, 20 bp, mouse
gggaatattggaagatggtt

SEQ ID NO: 715731 - DNA, 20 bp, mouse
gtggaagatggttgggggac

SEQ ID NO: 715732 - DNA, 20 bp, mouse
gctggaagctccagcctgtg

SEQ ID NO: 715733 - DNA, 20 bp, mouse
gttgtaggaatattggaaga

SEQ ID NO: 715734 - DNA, 20 bp, mouse
gtctgcatttccacacaggc

SEQ ID NO: 715735 - DNA, 20 bp, mouse
gacttgagaaaagtaaggga

SEQ ID NO: 715736 - DNA, 20 bp, mouse
gcaagagccaaaagcatcac

SEQ ID NO: 715737 - DNA, 20 bp, mouse
ggtcaggtcagatacggagg

SEQ ID NO: 715738 - DNA, 20 bp, mouse
gcctgtcaggtcagatacgg

SEQ ID NO: 715739 - DNA, 20 bp, mouse
ggaagtttctgtgacagtgg

SEQ ID NO: 715740 - DNA, 20 bp, mouse
gtaggtcatcggaagctagt

SEQ ID NO: 715741 - DNA, 20 bp, mouse
ggagagctgacatattccat

SEQ ID NO: 715742 - DNA, 20 bp, mouse
gttctgtgacagtggaggac

SEQ ID NO: 715743 - DNA, 20 bp, mouse
gctgacaggctttaactatc

SEQ ID NO: 715744 - DNA, 20 bp, mouse
ggggtgggctcagaaaggct

SEQ ID NO: 715745 - DNA, 20 bp, mouse
gactgcagcgccgcccaaca

SEQ ID NO: 715746 - DNA, 20 bp, mouse
gaaaagcccaagtggagaaa

SEQ ID NO: 715747 - DNA, 20 bp, mouse
gcgacagaatgatgtcccaa

SEQ ID NO: 715748 - DNA, 20 bp, mouse
gaaactgagcaaggccacac

SEQ ID NO: 715749 - DNA, 20 bp, mouse
ggacccacatgtctatggag

SEQ ID NO: 715750 - DNA, 20 bp, mouse
gcacatgtctatggagaggt

SEQ ID NO: 715751 - DNA, 20 bp, mouse
gcacatgacccacatgtcta

SEQ ID NO: 715752 - DNA, 20 bp, mouse
gaggggacacatacatgagc

SEQ ID NO: 715753 - DNA, 20 bp, mouse
gtctgtcgctaggtgatcag

SEQ ID NO: 715754 - DNA, 20 bp, mouse
gacaatccttttctccactt

SEQ ID NO: 715755 - DNA, 20 bp, mouse
gctgtatgttcttgacaatc

SEQ ID NO: 715756 - DNA, 20 bp, mouse
gaggcaagccgagctagaga

SEQ ID NO: 715757 - DNA, 20 bp, mouse
gagctagagaggggtgggcg

SEQ ID NO: 715758 - DNA, 20 bp, mouse
gagccgagctagagaggggt

SEQ ID NO: 715759 - DNA, 20 bp, mouse
gtcagtgtagagcgctgtgc

SEQ ID NO: 715760 - DNA, 20 bp, mouse
gaatgacagcctggccctga

SEQ ID NO: 715761 - DNA, 20 bp, mouse
gacccgggacccggggtgag

SEQ ID NO: 715762 - DNA, 20 bp, mouse
gtggctagccgcaagctcca

SEQ ID NO: 715763 - DNA, 20 bp, mouse
gagtggggagcgccggctgt

SEQ ID NO: 715764 - DNA, 20 bp, mouse
gtgcccgcagaggccaccta

SEQ ID NO: 715765 - DNA, 20 bp, mouse
gccctcccccgtggagcttg

SEQ ID NO: 715766 - DNA, 20 bp, mouse
gggtgtgtgtagttgtgctt

SEQ ID NO: 715767 - DNA, 20 bp, mouse
gtgcgtgcccagtgcactga

SEQ ID NO: 715768 - DNA, 20 bp, mouse
gagcgcgcgggcaccctgca

SEQ ID NO: 715769 - DNA, 20 bp, mouse
gaggtcccagggctgggtaa

SEQ ID NO: 715770 - DNA, 20 bp, mouse
ggtgcccagtgcactgacgg

SEQ ID NO: 715771 - DNA, 20 bp, mouse
gtgcccgcgcgctcttggca

SEQ ID NO: 715772 - DNA, 20 bp, mouse
gctgggtaagggactaagaa

SEQ ID NO: 715773 - DNA, 20 bp, mouse
gccgcccccgtcagtgcact

SEQ ID NO: 715774 - DNA, 20 bp, mouse
gctgccctgcagctaccaca

SEQ ID NO: 715775 - DNA, 20 bp, mouse
gttcctgcaagaagtggcgg

SEQ ID NO: 715776 - DNA, 20 bp, mouse
gcaggaagagtgcacatccc

SEQ ID NO: 715777 - DNA, 20 bp, mouse
gggcttctgaaatttgtaca

SEQ ID NO: 715778 - DNA, 20 bp, mouse
gtgatcctggcactcggggt

SEQ ID NO: 715779 - DNA, 20 bp, mouse
gtcaggactcgtgtggtaga

SEQ ID NO: 715780 - DNA, 20 bp, mouse
gtacaggcacttgcagagaa

SEQ ID NO: 715781 - DNA, 20 bp, mouse
gcctgaggttataaattctc

SEQ ID NO: 715782 - DNA, 20 bp, mouse
gccaccccaccccgagtgcc

SEQ ID NO: 715783 - DNA, 20 bp, mouse
gacgaacagttttgaaatgg

SEQ ID NO: 715784 - DNA, 20 bp, mouse
gtctttgtgtagctgtgctg

SEQ ID NO: 715785 - DNA, 20 bp, mouse
ggatttgatcctggcactcg

SEQ ID NO: 715786 - DNA, 20 bp, mouse
gagcacaccaggcttataaa

SEQ ID NO: 715787 - DNA, 20 bp, mouse
gaccaggcttataaaggggg

SEQ ID NO: 715788 - DNA, 20 bp, mouse
gactcaaaagagatggaatg

SEQ ID NO: 715789 - DNA, 20 bp, mouse
gctgaggcacctgagacaac

SEQ ID NO: 715790 - DNA, 20 bp, mouse
gagacttgactgagcacacc

SEQ ID NO: 715791 - DNA, 20 bp, mouse
gtgtccatccctgttgtctc

SEQ ID NO: 715792 - DNA, 20 bp, mouse
gtatacactgttatgagaaa

SEQ ID NO: 715793 - DNA, 20 bp, mouse
gtccaccccctttataagcc

SEQ ID NO: 715794 - DNA, 20 bp, mouse
gcagggatggacagtagatt

SEQ ID NO: 715795 - DNA, 20 bp, mouse
gagtgtatacttattcaaaa

SEQ ID NO: 715796 - DNA, 20 bp, mouse
gttaggaactgctaagaaac

SEQ ID NO: 715797 - DNA, 20 bp, mouse
ggatgcaaaaaaaaaactaa

SEQ ID NO: 715798 - DNA, 20 bp, mouse
ggttgaagatatgtattaca

SEQ ID NO: 715799 - DNA, 20 bp, mouse
ggaatgaaaaaccaggtgaa

SEQ ID NO: 715800 - DNA, 20 bp, mouse
gaatacatatcttcaacatg

SEQ ID NO: 715801 - DNA, 20 bp, mouse
gtatttgaggtttacccgaa

SEQ ID NO: 715802 - DNA, 20 bp, mouse
gtactaatcttagtcctttc

SEQ ID NO: 715803 - DNA, 20 bp, mouse
gaaatacagcagaaaactat

SEQ ID NO: 715804 - DNA, 20 bp, mouse
gagtgaaggaaggctgcata

SEQ ID NO: 715805 - DNA, 20 bp, mouse
gcctcactgatgcctatttg

SEQ ID NO: 715806 - DNA, 20 bp, mouse
ggagacagagggacctcctg

SEQ ID NO: 715807 - DNA, 20 bp, mouse
gtgtctccttcgtgctgggg

SEQ ID NO: 715808 - DNA, 20 bp, mouse
gtctgcagaccccgctccca

SEQ ID NO: 715809 - DNA, 20 bp, mouse
gccgagaagccgtgggagcg

SEQ ID NO: 715810 - DNA, 20 bp, mouse
gcgcaaaggtggggactgga

SEQ ID NO: 715811 - DNA, 20 bp, mouse
gaacccgtgtggctctctcg

SEQ ID NO: 715812 - DNA, 20 bp, mouse
gtggctctctcgaggagtac

SEQ ID NO: 715813 - DNA, 20 bp, mouse
gcgtaacccccccagcacga

SEQ ID NO: 715814 - DNA, 20 bp, mouse
gtggtcagtgtgtctgatgc

SEQ ID NO: 715815 - DNA, 20 bp, mouse
gcccacggcttctcggcccc

SEQ ID NO: 715816 - DNA, 20 bp, mouse
ggaaagagagagtaaggtag

SEQ ID NO: 715817 - DNA, 20 bp, mouse
gtgagaagtgagagcgtaat

SEQ ID NO: 715818 - DNA, 20 bp, mouse
gctgctgcatacactcttac

SEQ ID NO: 715819 - DNA, 20 bp, mouse
gcgtaataggtaagaaagca

SEQ ID NO: 715820 - DNA, 20 bp, mouse
gtaccttgctaaaaccaccg

SEQ ID NO: 715821 - DNA, 20 bp, mouse
gccccaggtagggttgccct

SEQ ID NO: 715822 - DNA, 20 bp, mouse
gagagtaaggtagaggagag

SEQ ID NO: 715823 - DNA, 20 bp, mouse
gaaaagacaaagagtaagta

SEQ ID NO: 715824 - DNA, 20 bp, mouse
gggagagaaggcaaagaaag

SEQ ID NO: 715825 - DNA, 20 bp, mouse
gaaagagtaagtaaggagag

SEQ ID NO: 715826 - DNA, 20 bp, mouse
gggaaacctgaggtacctgc

SEQ ID NO: 715827 - DNA, 20 bp, mouse
gacaggggaggcatggggtt

SEQ ID NO: 715828 - DNA, 20 bp, mouse
gatactgcacgggaaaggga

SEQ ID NO: 715829 - DNA, 20 bp, mouse
gagaatagactccaggaatt

SEQ ID NO: 715830 - DNA, 20 bp, mouse
gagagaggagcagctgcttg

SEQ ID NO: 715831 - DNA, 20 bp, mouse
gcctgcttgagagcagtaaa

SEQ ID NO: 715832 - DNA, 20 bp, mouse
gcagaatacagttggtagga

SEQ ID NO: 715833 - DNA, 20 bp, mouse
gtccagccttgggtggagat

SEQ ID NO: 715834 - DNA, 20 bp, mouse
gaaaagaaacagaatacagt

SEQ ID NO: 715835 - DNA, 20 bp, mouse
gggtgggtagcagagcctcg

SEQ ID NO: 715836 - DNA, 20 bp, mouse
gcctgagtgcgcagacgcag

SEQ ID NO: 715837 - DNA, 20 bp, mouse
gaagtctccgcgacatctca

SEQ ID NO: 715838 - DNA, 20 bp, mouse
gtggcgccaaagtaggaggt

SEQ ID NO: 715839 - DNA, 20 bp, mouse
gcgcccgtgaagtaccaaag

SEQ ID NO: 715840 - DNA, 20 bp, mouse
gaaagtaggaggtgggatct

SEQ ID NO: 715841 - DNA, 20 bp, mouse
gtggcgccacgtggacacga

SEQ ID NO: 715842 - DNA, 20 bp, mouse
gcgtctcccacgcacaaacc

SEQ ID NO: 715843 - DNA, 20 bp, mouse
gtcacgcctggtaagatgtt

SEQ ID NO: 715844 - DNA, 20 bp, mouse
gaacaagccctgagatgtcg

SEQ ID NO: 715845 - DNA, 20 bp, mouse
gaggcggccaggtttgtgcg

SEQ ID NO: 715846 - DNA, 20 bp, mouse
ggtgactatgttgaagggca

SEQ ID NO: 715847 - DNA, 20 bp, mouse
gtgcattgaaagcaccttgt

SEQ ID NO: 715848 - DNA, 20 bp, mouse
gggattcacaatctcctaca

SEQ ID NO: 715849 - DNA, 20 bp, mouse
ggcacctatctcagcattaa

SEQ ID NO: 715850 - DNA, 20 bp, mouse
ggccttgggcaggacggaga

SEQ ID NO: 715851 - DNA, 20 bp, mouse
gagattctgagctgaaagac

SEQ ID NO: 715852 - DNA, 20 bp, mouse
gtgagataggtgctggtgaa

SEQ ID NO: 715853 - DNA, 20 bp, mouse
ggataggtgctggtgaaagg

SEQ ID NO: 715854 - DNA, 20 bp, mouse
gtcaacacacattaaacaca

SEQ ID NO: 715855 - DNA, 20 bp, mouse
gtagcccttaatgctgagat

SEQ ID NO: 715856 - DNA, 20 bp, mouse
gcgagcccggagcccaacca

SEQ ID NO: 715857 - DNA, 20 bp, mouse
ggtgtaactcgtgaggacag

SEQ ID NO: 715858 - DNA, 20 bp, mouse
gaaatgccatggttgggctc

SEQ ID NO: 715859 - DNA, 20 bp, mouse
ggaggaactgaacgcacctg

SEQ ID NO: 715860 - DNA, 20 bp, mouse
gaggaaggactttctacact

SEQ ID NO: 715861 - DNA, 20 bp, mouse
gatgcaggaagacttggaac

SEQ ID NO: 715862 - DNA, 20 bp, mouse
gtgtagaaagtccttcctcc

SEQ ID NO: 715863 - DNA, 20 bp, mouse
gcagaaaggtgtaactcgtg

SEQ ID NO: 715864 - DNA, 20 bp, mouse
gtccgggctcgagcatcccc

SEQ ID NO: 715865 - DNA, 20 bp, mouse
ggtcctattccttgattcaa

SEQ ID NO: 715866 - DNA, 20 bp, mouse
gaaaaagtggccagcctctg

SEQ ID NO: 715867 - DNA, 20 bp, mouse
gtgccagcaagattccccag

SEQ ID NO: 715868 - DNA, 20 bp, mouse
ggagtctggggatctagttg

SEQ ID NO: 715869 - DNA, 20 bp, mouse
ggcaggctggaactttccaa

SEQ ID NO: 715870 - DNA, 20 bp, mouse
gacaaaaattgagaggtgtc

SEQ ID NO: 715871 - DNA, 20 bp, mouse
gctactttataaaaataaac

SEQ ID NO: 715872 - DNA, 20 bp, mouse
ggtcaggttgctattgcctc

SEQ ID NO: 715873 - DNA, 20 bp, mouse
gtgtttattttattagcact

SEQ ID NO: 715874 - DNA, 20 bp, mouse
gataaagaaaggctttcccg

SEQ ID NO: 715875 - DNA, 20 bp, mouse
ggtctactaacaaaaaaaag

SEQ ID NO: 715876 - DNA, 20 bp, mouse
gggctcgcggaccctcaccg

SEQ ID NO: 715877 - DNA, 20 bp, mouse
ggccgccgtgtcctcggtga

SEQ ID NO: 715878 - DNA, 20 bp, mouse
gaccctcaccgaggacacgg

SEQ ID NO: 715879 - DNA, 20 bp, mouse
gcgaaaagcagggttgacta

SEQ ID NO: 715880 - DNA, 20 bp, mouse
gtgactacggcgggagggga

SEQ ID NO: 715881 - DNA, 20 bp, mouse
gcggaccctcaccgaggaca

SEQ ID NO: 715882 - DNA, 20 bp, mouse
ggaggggaaggcctgcgaat

SEQ ID NO: 715883 - DNA, 20 bp, mouse
gcgagccgcggcgaaaagca

SEQ ID NO: 715884 - DNA, 20 bp, mouse
gtcaaccctgcttttcgccg

SEQ ID NO: 715885 - DNA, 20 bp, mouse
gaaagcagggttgactacgg

SEQ ID NO: 715886 - DNA, 20 bp, mouse
gggtgtgcgggaggaggtca

SEQ ID NO: 715887 - DNA, 20 bp, mouse
gtgcgggaggaggtcagggg

SEQ ID NO: 715888 - DNA, 20 bp, mouse
gctgccaccaaattcttccc

SEQ ID NO: 715889 - DNA, 20 bp, mouse
gggaggtcatgagttcaata

SEQ ID NO: 715890 - DNA, 20 bp, mouse
ggctaaagactacttcccac

SEQ ID NO: 715891 - DNA, 20 bp, mouse
ggcgcaggtgggactaatgt

SEQ ID NO: 715892 - DNA, 20 bp, mouse
ggagttcaatagggaatgga

SEQ ID NO: 715893 - DNA, 20 bp, mouse
ggttgacgttgttgtttcga

SEQ ID NO: 715894 - DNA, 20 bp, mouse
gagagagacggagacatacc

SEQ ID NO: 715895 - DNA, 20 bp, mouse
gaaagactacttcccactgg

SEQ ID NO: 715896 - DNA, 20 bp, mouse
gaagagtagcaggccgttgg

SEQ ID NO: 715897 - DNA, 20 bp, mouse
gggagcaattggataaatac

SEQ ID NO: 715898 - DNA, 20 bp, mouse
gaggaagagtagcaggccgt

SEQ ID NO: 715899 - DNA, 20 bp, mouse
gatccctagtaccgacacgg

SEQ ID NO: 715900 - DNA, 20 bp, mouse
gagccgccgtgtcggtacta

SEQ ID NO: 715901 - DNA, 20 bp, mouse
gtacttaagtgttcctccaa

SEQ ID NO: 715902 - DNA, 20 bp, mouse
gcgagactaacaggagcaat

SEQ ID NO: 715903 - DNA, 20 bp, mouse
gggacttgtgcgagactaac

SEQ ID NO: 715904 - DNA, 20 bp, mouse
ggtaatcaatctagggttag

SEQ ID NO: 715905 - DNA, 20 bp, mouse
gttcctgagcttgtgctgtc

SEQ ID NO: 715906 - DNA, 20 bp, mouse
gaatgtgttcatataactgt

SEQ ID NO: 715907 - DNA, 20 bp, mouse
gggcatcagatgcctattac

SEQ ID NO: 715908 - DNA, 20 bp, mouse
gatcagatgcctattacagg

SEQ ID NO: 715909 - DNA, 20 bp, mouse
ggtgagtaaataagtgggac

SEQ ID NO: 715910 - DNA, 20 bp, mouse
gaatattaatacaatttctt

SEQ ID NO: 715911 - DNA, 20 bp, mouse
gtcagtgttctttagctctg

SEQ ID NO: 715912 - DNA, 20 bp, mouse
gaattgacatttttttaaaa

SEQ ID NO: 715913 - DNA, 20 bp, mouse
gcatctgatgccctcatctt

SEQ ID NO: 715914 - DNA, 20 bp, mouse
gtgggtgtgagtaaataagt

SEQ ID NO: 715915 - DNA, 20 bp, mouse
gaaagggctgagaaatgaca

SEQ ID NO: 715916 - DNA, 20 bp, mouse
ggcaaatggcactgagcatt

SEQ ID NO: 715917 - DNA, 20 bp, mouse
gcatggtgtaagagtggcca

SEQ ID NO: 715918 - DNA, 20 bp, mouse
gcaccatgagcccatttctc

SEQ ID NO: 715919 - DNA, 20 bp, mouse
gttctctggggggtgagcct

SEQ ID NO: 715920 - DNA, 20 bp, mouse
ggggcagcagccctaaaatc

SEQ ID NO: 715921 - DNA, 20 bp, mouse
gtcattgcattgatggcgag

SEQ ID NO: 715922 - DNA, 20 bp, mouse
gggttacatgccgtttttaa

SEQ ID NO: 715923 - DNA, 20 bp, mouse
gtgggctcatggtgtaagag

SEQ ID NO: 715924 - DNA, 20 bp, mouse
ggagcagtagccaagagcag

SEQ ID NO: 715925 - DNA, 20 bp, mouse
ggccctaaaatcaggaaatg

SEQ ID NO: 715926 - DNA, 20 bp, mouse
gagagagggggttcctatgc

SEQ ID NO: 715927 - DNA, 20 bp, mouse
gaccttagttgaaacactaa

SEQ ID NO: 715928 - DNA, 20 bp, mouse
ggactaaataaattatttgt

SEQ ID NO: 715929 - DNA, 20 bp, mouse
gagttgaaacactaaaggag

SEQ ID NO: 715930 - DNA, 20 bp, mouse
gcattcatacacatataatg

SEQ ID NO: 715931 - DNA, 20 bp, mouse
ggaatatttatttatatcca

SEQ ID NO: 715932 - DNA, 20 bp, mouse
gacagttatgtgagttaccc

SEQ ID NO: 715933 - DNA, 20 bp, mouse
gaggtgaaagatgagatgat

SEQ ID NO: 715934 - DNA, 20 bp, mouse
ggaaaatagaaagatattaa

SEQ ID NO: 715935 - DNA, 20 bp, mouse
gtgtacacaaatatttggat

SEQ ID NO: 715936 - DNA, 20 bp, mouse
gggtactgcaagtctcacgg

SEQ ID NO: 715937 - DNA, 20 bp, mouse
ggaaggatgctcgttttggg

SEQ ID NO: 715938 - DNA, 20 bp, mouse
gcctcccattcggaagatga

SEQ ID NO: 715939 - DNA, 20 bp, mouse
gcatccttcatcttccgaat

SEQ ID NO: 715940 - DNA, 20 bp, mouse
gctcgctgccccctcccatt

SEQ ID NO: 715941 - DNA, 20 bp, mouse
ggcaggtactgcaagtctca

SEQ ID NO: 715942 - DNA, 20 bp, mouse
gtgaaccgcagcattccagc

SEQ ID NO: 715943 - DNA, 20 bp, mouse
gaggagagacctgtgaagaa

SEQ ID NO: 715944 - DNA, 20 bp, mouse
gtggaggtttctctgacggt

SEQ ID NO: 715945 - DNA, 20 bp, mouse
gagagagggtatcacagtgc

SEQ ID NO: 715946 - DNA, 20 bp, mouse
gttgcatgtagctgctggga

SEQ ID NO: 715947 - DNA, 20 bp, mouse
ggtgatactgggaaaaaaca

SEQ ID NO: 715948 - DNA, 20 bp, mouse
gcagttttgcatgtagctgc

SEQ ID NO: 715949 - DNA, 20 bp, mouse
gggttcttatatgtacaaaa

SEQ ID NO: 715950 - DNA, 20 bp, mouse
gatcagtccaagagaacagc

SEQ ID NO: 715951 - DNA, 20 bp, mouse
ggagaacttttatgtgatac

SEQ ID NO: 715952 - DNA, 20 bp, mouse
gtcacataaaagttctcaat

SEQ ID NO: 715953 - DNA, 20 bp, mouse
gggatatcctttattgatat

SEQ ID NO: 715954 - DNA, 20 bp, mouse
gagtaagccagctgttctct

SEQ ID NO: 715955 - DNA, 20 bp, mouse
gtgtctcaagtattttgtct

SEQ ID NO: 715956 - DNA, 20 bp, mouse
ggaggtgacaaagatgtctc

SEQ ID NO: 715957 - DNA, 20 bp, mouse
ggggagtctccatcccgctt

SEQ ID NO: 715958 - DNA, 20 bp, mouse
ggtccaaagggcacctaagc

SEQ ID NO: 715959 - DNA, 20 bp, mouse
gaaagggcacctaagcggga

SEQ ID NO: 715960 - DNA, 20 bp, mouse
gcccagagctgtgagtacac

SEQ ID NO: 715961 - DNA, 20 bp, mouse
gctgagtctctttgtccaaa

SEQ ID NO: 715962 - DNA, 20 bp, mouse
ggtcttcagtgttgttaaag

SEQ ID NO: 715963 - DNA, 20 bp, mouse
gagaagaccatagaggaaat

SEQ ID NO: 715964 - DNA, 20 bp, mouse
ggatgagcccatttcctcta

SEQ ID NO: 715965 - DNA, 20 bp, mouse
gcatctttgtcacctcctgc

SEQ ID NO: 715966 - DNA, 20 bp, mouse
ggctgtaggacagagtatca

SEQ ID NO: 715967 - DNA, 20 bp, mouse
ggagcagccttgttccacca

SEQ ID NO: 715968 - DNA, 20 bp, mouse
gttgtctcctggccgccatg

SEQ ID NO: 715969 - DNA, 20 bp, mouse
gtgctcaccccatggcggcc

SEQ ID NO: 715970 - DNA, 20 bp, mouse
ggacgtctatctaggctttt

SEQ ID NO: 715971 - DNA, 20 bp, mouse
gccctcagggcactgagcca

SEQ ID NO: 715972 - DNA, 20 bp, mouse
gtgaagaagtaagcccctca

SEQ ID NO: 715973 - DNA, 20 bp, mouse
gtgggttatgacgtctatct

SEQ ID NO: 715974 - DNA, 20 bp, mouse
gtgcatggagcaaaggctgt

SEQ ID NO: 715975 - DNA, 20 bp, mouse
gctctcctatgtggcagctg

SEQ ID NO: 715976 - DNA, 20 bp, mouse
gtaaaagtgtattgatgcac

SEQ ID NO: 715977 - DNA, 20 bp, mouse
gaatacacttttatttcttc

SEQ ID NO: 715978 - DNA, 20 bp, mouse
ggatatgagagttgcaacca

SEQ ID NO: 715979 - DNA, 20 bp, mouse
gcagtgctaaggcagttgaa

SEQ ID NO: 715980 - DNA, 20 bp, mouse
gtatatacccataaaagaga

SEQ ID NO: 715981 - DNA, 20 bp, mouse
gttgggggggggtaggtttt

SEQ ID NO: 715982 - DNA, 20 bp, mouse
gttacatagaatctctttgg

SEQ ID NO: 715983 - DNA, 20 bp, mouse
gcaagagtcattgttaacaa

SEQ ID NO: 715984 - DNA, 20 bp, mouse
gaatgactcttggctattat

SEQ ID NO: 715985 - DNA, 20 bp, mouse
gactctgtggacatgggcca

SEQ ID NO: 715986 - DNA, 20 bp, mouse
gcttgaacaagagattagaa

SEQ ID NO: 715987 - DNA, 20 bp, mouse
ggcacaaaacacccacatcg

SEQ ID NO: 715988 - DNA, 20 bp, mouse
gaagagcacaaaacagtggt

SEQ ID NO: 715989 - DNA, 20 bp, mouse
gatgcctctgttgcctacag

SEQ ID NO: 715990 - DNA, 20 bp, mouse
gcagcctctgtaggcaacag

SEQ ID NO: 715991 - DNA, 20 bp, mouse
gctgttctatgcagatgacc

SEQ ID NO: 715992 - DNA, 20 bp, mouse
ggcactcctatggcctcttc

SEQ ID NO: 715993 - DNA, 20 bp, mouse
ggctcttatttgcactccta

SEQ ID NO: 715994 - DNA, 20 bp, mouse
gaaataagagcacaaaacag

SEQ ID NO: 715995 - DNA, 20 bp, mouse
gaaattgtgagccacgatgt

SEQ ID NO: 715996 - DNA, 20 bp, mouse
gaactgggaacttttctacc

SEQ ID NO: 715997 - DNA, 20 bp, mouse
gttctgttatcaaagtggcc

SEQ ID NO: 715998 - DNA, 20 bp, mouse
ggataacagaatagactctg

SEQ ID NO: 715999 - DNA, 20 bp, mouse
ggtctattctgttatcaaag

SEQ ID NO: 716000 - DNA, 20 bp, mouse
gtgtcctcactctgagccag

SEQ ID NO: 716001 - DNA, 20 bp, mouse
gggttataaccttctctact

SEQ ID NO: 716002 - DNA, 20 bp, mouse
gagagtgaggacagccacta

SEQ ID NO: 716003 - DNA, 20 bp, mouse
gcagagcagggagctacttt

SEQ ID NO: 716004 - DNA, 20 bp, mouse
gctgaagaggaagttgagag

SEQ ID NO: 716005 - DNA, 20 bp, mouse
gtctgtataagactgtggac

SEQ ID NO: 716006 - DNA, 20 bp, mouse
gaggatgcctatttggtcat

SEQ ID NO: 716007 - DNA, 20 bp, mouse
gatcacccccatgaccaaat

SEQ ID NO: 716008 - DNA, 20 bp, mouse
gctctgagaggatgcctatt

SEQ ID NO: 716009 - DNA, 20 bp, mouse
gatagccactacaacctcta

SEQ ID NO: 716010 - DNA, 20 bp, mouse
gaaaatcatcggaccctggg

SEQ ID NO: 716011 - DNA, 20 bp, mouse
gtgctaaaatcatcggaccc

SEQ ID NO: 716012 - DNA, 20 bp, mouse
gatagctcagtttgttgata

SEQ ID NO: 716013 - DNA, 20 bp, mouse
gatcatcggaccctgggtgg

SEQ ID NO: 716014 - DNA, 20 bp, mouse
gatttccttagaggttgtag

SEQ ID NO: 716015 - DNA, 20 bp, mouse
gtcgcccctgcatctctgag

SEQ ID NO: 716016 - DNA, 20 bp, mouse
ggggcaagagcgggacatgt

SEQ ID NO: 716017 - DNA, 20 bp, mouse
gttagaggccatgattgcat

SEQ ID NO: 716018 - DNA, 20 bp, mouse
gctgagatcttggaaataaa

SEQ ID NO: 716019 - DNA, 20 bp, mouse
gcctctagggcagagcctac

SEQ ID NO: 716020 - DNA, 20 bp, mouse
gtgattgcatgggcaagagc

SEQ ID NO: 716021 - DNA, 20 bp, mouse
gtagccttcccagccaggcg

SEQ ID NO: 716022 - DNA, 20 bp, mouse
gcagagtccttcttctcaaa

SEQ ID NO: 716023 - DNA, 20 bp, mouse
gtagtgtatcaaaatgacaa

SEQ ID NO: 716024 - DNA, 20 bp, mouse
gttccatcagatttcccagt

SEQ ID NO: 716025 - DNA, 20 bp, mouse
gggcaaccagacttcagcag

SEQ ID NO: 716026 - DNA, 20 bp, mouse
ggagtagagatgatatcagt

SEQ ID NO: 716027 - DNA, 20 bp, mouse
gtgctgtagttaagacaagt

SEQ ID NO: 716028 - DNA, 20 bp, mouse
gtctgtgtctcacaatctct

SEQ ID NO: 716029 - DNA, 20 bp, mouse
gtcatgtggtcgtatatctg

SEQ ID NO: 716030 - DNA, 20 bp, mouse
gtagagatgatatcagtggg

SEQ ID NO: 716031 - DNA, 20 bp, mouse
gtatatctgtggattgtgag

SEQ ID NO: 716032 - DNA, 20 bp, mouse
gatcagagggagagttatct

SEQ ID NO: 716033 - DNA, 20 bp, mouse
gttgtcttaactacagcact

SEQ ID NO: 716034 - DNA, 20 bp, mouse
gagaggagctaatctttgag

SEQ ID NO: 716035 - DNA, 20 bp, mouse
ggaaacggaataatctaaaa

SEQ ID NO: 716036 - DNA, 20 bp, mouse
gcaagcaagctttttagagg

SEQ ID NO: 716037 - DNA, 20 bp, mouse
gaagctttttagagggggac

SEQ ID NO: 716038 - DNA, 20 bp, mouse
gtagtctttcagagtttata

SEQ ID NO: 716039 - DNA, 20 bp, mouse
ggtttatagggcattcactt

SEQ ID NO: 716040 - DNA, 20 bp, mouse
gaccctttgtagcaattgat

SEQ ID NO: 716041 - DNA, 20 bp, mouse
gttgctacaaagggtacaag

SEQ ID NO: 716042 - DNA, 20 bp, mouse
gattgattggtagacagatt

SEQ ID NO: 716043 - DNA, 20 bp, mouse
gtaccaatcaattgctacaa

SEQ ID NO: 716044 - DNA, 20 bp, mouse
gaccataacaacaaagcatc

SEQ ID NO: 716045 - DNA, 20 bp, mouse
gttcttttgatttactactt

SEQ ID NO: 716046 - DNA, 20 bp, mouse
gaaaattcgcaggaattcgg

SEQ ID NO: 716047 - DNA, 20 bp, mouse
gaggtcacatttcctgtctc

SEQ ID NO: 716048 - DNA, 20 bp, mouse
gtgacctcctgagtgcggct

SEQ ID NO: 716049 - DNA, 20 bp, mouse
gtctcaggatgaaaattcgc

SEQ ID NO: 716050 - DNA, 20 bp, mouse
gtgctctccaagccgcactc

SEQ ID NO: 716051 - DNA, 20 bp, mouse
gcctacctacttaaaagcgg

SEQ ID NO: 716052 - DNA, 20 bp, mouse
ggacttatgtccttccatgg

SEQ ID NO: 716053 - DNA, 20 bp, mouse
gatgaaaattcgcaggaatt

SEQ ID NO: 716054 - DNA, 20 bp, mouse
gtaacacagtctgccttgtg

SEQ ID NO: 716055 - DNA, 20 bp, mouse
gaagtcaggggccagtttgt

SEQ ID NO: 716056 - DNA, 20 bp, mouse
gccggaagacacctgtgtgt

SEQ ID NO: 716057 - DNA, 20 bp, mouse
gagggcggcctccaacacac

SEQ ID NO: 716058 - DNA, 20 bp, mouse
ggaagacacctgtgtgttgg

SEQ ID NO: 716059 - DNA, 20 bp, mouse
gcaggtgacaattgacaagg

SEQ ID NO: 716060 - DNA, 20 bp, mouse
gagaagtgggcttaatatcg

SEQ ID NO: 716061 - DNA, 20 bp, mouse
gtaggagcaatgactgggtg

SEQ ID NO: 716062 - DNA, 20 bp, mouse
gggtacccaaggactactga

SEQ ID NO: 716063 - DNA, 20 bp, mouse
gtgtgtctgggtatgttctg

SEQ ID NO: 716064 - DNA, 20 bp, mouse
ggacaccttcagtagtcctt

SEQ ID NO: 716065 - DNA, 20 bp, mouse
gccagacttcaaggaagact

SEQ ID NO: 716066 - DNA, 20 bp, mouse
gaagttaagacagattaaag

SEQ ID NO: 716067 - DNA, 20 bp, mouse
gcacatgagactggggttag

SEQ ID NO: 716068 - DNA, 20 bp, mouse
gctgatgtctgtactgggaa

SEQ ID NO: 716069 - DNA, 20 bp, mouse
ggacaaatataagtaccgtg

SEQ ID NO: 716070 - DNA, 20 bp, mouse
gagccatcacttcagcctca

SEQ ID NO: 716071 - DNA, 20 bp, mouse
gataccaaatttaacagatg

SEQ ID NO: 716072 - DNA, 20 bp, mouse
gcatcctcatctgttaaatt

SEQ ID NO: 716073 - DNA, 20 bp, mouse
ggactacctgatgtctgtac

SEQ ID NO: 716074 - DNA, 20 bp, mouse
gggctttctctcgaaccacg

SEQ ID NO: 716075 - DNA, 20 bp, mouse
ggttaaatttggtatatgtc

SEQ ID NO: 716076 - DNA, 20 bp, mouse
gcggtggcggtgtggtaccc

SEQ ID NO: 716077 - DNA, 20 bp, mouse
gtggcggtgtggtacccggg

SEQ ID NO: 716078 - DNA, 20 bp, mouse
gtggtacccgggcggagttc

SEQ ID NO: 716079 - DNA, 20 bp, mouse
gttcgggcatgcgggcaaat

SEQ ID NO: 716080 - DNA, 20 bp, mouse
ggggcggagttcgggcatgc

SEQ ID NO: 716081 - DNA, 20 bp, mouse
gttgacatcttaacaatgaa

SEQ ID NO: 716082 - DNA, 20 bp, mouse
gtacagtcctccccaaatca

SEQ ID NO: 716083 - DNA, 20 bp, mouse
gatttggggaggactgtaga

SEQ ID NO: 716084 - DNA, 20 bp, mouse
gagcaagtgctgttggagtg

SEQ ID NO: 716085 - DNA, 20 bp, mouse
gggagctaagaaattagcag

SEQ ID NO: 716086 - DNA, 20 bp, mouse
gtctgtgcacagctgttaat

SEQ ID NO: 716087 - DNA, 20 bp, mouse
ggtggtcttgcattcattca

SEQ ID NO: 716088 - DNA, 20 bp, mouse
gcaagtggcacaaccaaaac

SEQ ID NO: 716089 - DNA, 20 bp, mouse
ggctctgaaatgtctaggtg

SEQ ID NO: 716090 - DNA, 20 bp, mouse
gggcacaaccaaaacaggtt

SEQ ID NO: 716091 - DNA, 20 bp, mouse
gctgaagaacctcacctacg

SEQ ID NO: 716092 - DNA, 20 bp, mouse
gtagctgtccaaacctgttt

SEQ ID NO: 716093 - DNA, 20 bp, mouse
gcaaaataacctcgtaggtg

SEQ ID NO: 716094 - DNA, 20 bp, mouse
gccagaccagcctaactgaa

SEQ ID NO: 716095 - DNA, 20 bp, mouse
ggaattctttcccttcagtt

SEQ ID NO: 716096 - DNA, 20 bp, mouse
gagtgacaaggtgacaaggt

SEQ ID NO: 716097 - DNA, 20 bp, mouse
gccgcccagcgtgcgcgtgt

SEQ ID NO: 716098 - DNA, 20 bp, mouse
ggggtggggcagccggaaat

SEQ ID NO: 716099 - DNA, 20 bp, mouse
ggcggggccccagagtgaca

SEQ ID NO: 716100 - DNA, 20 bp, mouse
gagggcgggtcctggcagag

SEQ ID NO: 716101 - DNA, 20 bp, mouse
gggaaaacccagcccatttc

SEQ ID NO: 716102 - DNA, 20 bp, mouse
gccctgaggcgcagctgtct

SEQ ID NO: 716103 - DNA, 20 bp, mouse
gagaatcaagtgtaggaggg

SEQ ID NO: 716104 - DNA, 20 bp, mouse
gtcggattgggcaagtccga

SEQ ID NO: 716105 - DNA, 20 bp, mouse
ggccagaatcaagtgtagga

SEQ ID NO: 716106 - DNA, 20 bp, mouse
gtgaaggctggacttagtgg

SEQ ID NO: 716107 - DNA, 20 bp, mouse
gaggggcagaagttagataa

SEQ ID NO: 716108 - DNA, 20 bp, mouse
gtaaaggtgactgtgaaggc

SEQ ID NO: 716109 - DNA, 20 bp, mouse
ggtgacccccgactggaagg

SEQ ID NO: 716110 - DNA, 20 bp, mouse
gaagatgcaagtgtgagtaa

SEQ ID NO: 716111 - DNA, 20 bp, mouse
gtgccaacacagaccagtga

SEQ ID NO: 716112 - DNA, 20 bp, mouse
gcaagcccccttccagtcgg

SEQ ID NO: 716113 - DNA, 20 bp, mouse
gagtaactctgagcaagtag

SEQ ID NO: 716114 - DNA, 20 bp, mouse
gctggtgttgaggtgcctag

SEQ ID NO: 716115 - DNA, 20 bp, mouse
ggccatgtttcctagcatcc

SEQ ID NO: 716116 - DNA, 20 bp, mouse
gtcatcaagtatggattcat

SEQ ID NO: 716117 - DNA, 20 bp, mouse
gagaagattctcatcaagta

SEQ ID NO: 716118 - DNA, 20 bp, mouse
gagcagttctgtaaaatcag

SEQ ID NO: 716119 - DNA, 20 bp, mouse
gattgtggacattgttaggt

SEQ ID NO: 716120 - DNA, 20 bp, mouse
gacacactcagaaggcccct

SEQ ID NO: 716121 - DNA, 20 bp, mouse
gtatgaaggaactgtaacat

SEQ ID NO: 716122 - DNA, 20 bp, mouse
ggattggctcttatatatga

SEQ ID NO: 716123 - DNA, 20 bp, mouse
gtaaaatctatttaacctag

SEQ ID NO: 716124 - DNA, 20 bp, mouse
gatttcaaataaaacaaatt

SEQ ID NO: 716125 - DNA, 20 bp, mouse
ggttctattgttcagatgat

SEQ ID NO: 716126 - DNA, 20 bp, mouse
gaagtccggagtatccagac

SEQ ID NO: 716127 - DNA, 20 bp, mouse
gagctcaaatacagacacgt

SEQ ID NO: 716128 - DNA, 20 bp, mouse
ggtcactcgtccataaatgt

SEQ ID NO: 716129 - DNA, 20 bp, mouse
gcaaaatcccaaacctctta

SEQ ID NO: 716130 - DNA, 20 bp, mouse
gtttgtatgttatgtaagtc

SEQ ID NO: 716131 - DNA, 20 bp, mouse
gtctaatcagaataacacac

SEQ ID NO: 716132 - DNA, 20 bp, mouse
gaaaagaaagtcaccttaag

SEQ ID NO: 716133 - DNA, 20 bp, mouse
gaaagtcaccttaagaggtt

SEQ ID NO: 716134 - DNA, 20 bp, mouse
gtgagtgctcacaaaatgga

SEQ ID NO: 716135 - DNA, 20 bp, mouse
gcggggccataccatctgat

SEQ ID NO: 716136 - DNA, 20 bp, mouse
gcctgctccgcctggttctc

SEQ ID NO: 716137 - DNA, 20 bp, mouse
gacaacccccgcactgggat

SEQ ID NO: 716138 - DNA, 20 bp, mouse
gagagtgggaagcacagttg

SEQ ID NO: 716139 - DNA, 20 bp, mouse
ggaaccaggcggagcaggcg

SEQ ID NO: 716140 - DNA, 20 bp, mouse
ggcgtccaatcccagtgcgg

SEQ ID NO: 716141 - DNA, 20 bp, mouse
ggcccagcactaggttctct

SEQ ID NO: 716142 - DNA, 20 bp, mouse
gtgggaacaacccccgcact

SEQ ID NO: 716143 - DNA, 20 bp, mouse
gctcaggggaggacggagag

SEQ ID NO: 716144 - DNA, 20 bp, mouse
gacaacagcgtttgagtgca

SEQ ID NO: 716145 - DNA, 20 bp, mouse
gtcccttgcctgaaggtcag

SEQ ID NO: 716146 - DNA, 20 bp, mouse
gtgggcgccgtcggatcagt

SEQ ID NO: 716147 - DNA, 20 bp, mouse
gtaccagcctataccggctt

SEQ ID NO: 716148 - DNA, 20 bp, mouse
gacggcgcccaagccggtat

SEQ ID NO: 716149 - DNA, 20 bp, mouse
gagacccagagatggctaag

SEQ ID NO: 716150 - DNA, 20 bp, mouse
gtctccgtggcgccgccggt

SEQ ID NO: 716151 - DNA, 20 bp, mouse
gaagactgctcccgggaagg

SEQ ID NO: 716152 - DNA, 20 bp, mouse
ggggacaggccagagccagc

SEQ ID NO: 716153 - DNA, 20 bp, mouse
gcgcccaagccggtataggc

SEQ ID NO: 716154 - DNA, 20 bp, mouse
gggatcagtaggtagctggg

SEQ ID NO: 716155 - DNA, 20 bp, mouse
gcagtcttaccagcctatac

SEQ ID NO: 716156 - DNA, 20 bp, mouse
gaaacggcactttgcagaat

SEQ ID NO: 716157 - DNA, 20 bp, mouse
ggggcctcagaattcagact

SEQ ID NO: 716158 - DNA, 20 bp, mouse
gaagatcaacaactcatata

SEQ ID NO: 716159 - DNA, 20 bp, mouse
gaacaatccaattaaagcat

SEQ ID NO: 716160 - DNA, 20 bp, mouse
gcaactctccatctgataaa

SEQ ID NO: 716161 - DNA, 20 bp, mouse
ggctgtgaatgcacttgcac

SEQ ID NO: 716162 - DNA, 20 bp, mouse
gaaactaaaatttttctgta

SEQ ID NO: 716163 - DNA, 20 bp, mouse
gcggtaccccatgctttaat

SEQ ID NO: 716164 - DNA, 20 bp, mouse
gaaaaaggctagacatggaa

SEQ ID NO: 716165 - DNA, 20 bp, mouse
gaaggctagacatggaaagg

SEQ ID NO: 716166 - DNA, 20 bp, mouse
gtcccgccctgacatgtcac

SEQ ID NO: 716167 - DNA, 20 bp, mouse
ggccagctgcaagagggcta

SEQ ID NO: 716168 - DNA, 20 bp, mouse
gggtctgagcaggtgtagat

SEQ ID NO: 716169 - DNA, 20 bp, mouse
ggatcaccacacataggtgc

SEQ ID NO: 716170 - DNA, 20 bp, mouse
gtggcagaggcaaagcaact

SEQ ID NO: 716171 - DNA, 20 bp, mouse
gtcagggcgggacaatgaga

SEQ ID NO: 716172 - DNA, 20 bp, mouse
ggaaaggaggaggtctgagc

SEQ ID NO: 716173 - DNA, 20 bp, mouse
gaacctgtgacatgtcaggg

SEQ ID NO: 716174 - DNA, 20 bp, mouse
gtagatggccagctgcaaga

SEQ ID NO: 716175 - DNA, 20 bp, mouse
gctctgccagcacctatgtg

SEQ ID NO: 716176 - DNA, 20 bp, mouse
gcaccgacaattaacttaga

SEQ ID NO: 716177 - DNA, 20 bp, mouse
ggcagatttttgaaacatct

SEQ ID NO: 716178 - DNA, 20 bp, mouse
gtaagtaagtcatatgacca

SEQ ID NO: 716179 - DNA, 20 bp, mouse
gtgccatctaagttaattgt

SEQ ID NO: 716180 - DNA, 20 bp, mouse
gaaattcaatctgaacaaat

SEQ ID NO: 716181 - DNA, 20 bp, mouse
gatggcagtaaacttgctca

SEQ ID NO: 716182 - DNA, 20 bp, mouse
gaaatgagatttattcccac

SEQ ID NO: 716183 - DNA, 20 bp, mouse
gtagatactatattactaga

SEQ ID NO: 716184 - DNA, 20 bp, mouse
gacataaacattagaaatat

SEQ ID NO: 716185 - DNA, 20 bp, mouse
gtgagcaacgaactggtcta

SEQ ID NO: 716186 - DNA, 20 bp, mouse
gtggtgaggtgagtggtcat

SEQ ID NO: 716187 - DNA, 20 bp, mouse
gtgagcttgaaagtgacttg

SEQ ID NO: 716188 - DNA, 20 bp, mouse
gttaagagcatcctccaaga

SEQ ID NO: 716189 - DNA, 20 bp, mouse
gggtctcactattcagtcag

SEQ ID NO: 716190 - DNA, 20 bp, mouse
gacttcatcctcagggtgaa

SEQ ID NO: 716191 - DNA, 20 bp, mouse
gtaagagtccagaaattcgg

SEQ ID NO: 716192 - DNA, 20 bp, mouse
gtcttgctggattttgcctc

SEQ ID NO: 716193 - DNA, 20 bp, mouse
gaggcatcaagccttcttgg

SEQ ID NO: 716194 - DNA, 20 bp, mouse
gtgcttgaataccattgcct

SEQ ID NO: 716195 - DNA, 20 bp, mouse
gacttccagggctcaagctt

SEQ ID NO: 716196 - DNA, 20 bp, mouse
ggtagccatgggagtacaca

SEQ ID NO: 716197 - DNA, 20 bp, mouse
gacacaaggctagttccctc

SEQ ID NO: 716198 - DNA, 20 bp, mouse
gctagccttgtgtactccca

SEQ ID NO: 716199 - DNA, 20 bp, mouse
ggtgcttgatgatcactttg

SEQ ID NO: 716200 - DNA, 20 bp, mouse
gcaaggctagttccctcagg

SEQ ID NO: 716201 - DNA, 20 bp, mouse
gaagtgatcatcaagcactg

SEQ ID NO: 716202 - DNA, 20 bp, mouse
gctcagagcaatagtagcca

SEQ ID NO: 716203 - DNA, 20 bp, mouse
ggctatttctgcttccagta

SEQ ID NO: 716204 - DNA, 20 bp, mouse
gtaaatttcagcacggattt

SEQ ID NO: 716205 - DNA, 20 bp, mouse
gcagtaacaatgtaccatac

SEQ ID NO: 716206 - DNA, 20 bp, mouse
ggcgagtcaggagacagtaa

SEQ ID NO: 716207 - DNA, 20 bp, mouse
ggcttggagcctgatttaca

SEQ ID NO: 716208 - DNA, 20 bp, mouse
gcacctggaagatcaaaggg

SEQ ID NO: 716209 - DNA, 20 bp, mouse
ggatcaaaggggggcgagtc

SEQ ID NO: 716210 - DNA, 20 bp, mouse
gcctgtgttccctgtaaatc

SEQ ID NO: 716211 - DNA, 20 bp, mouse
gttagagccataacagtaga

SEQ ID NO: 716212 - DNA, 20 bp, mouse
gcgagaaccatctactgtta

SEQ ID NO: 716213 - DNA, 20 bp, mouse
gcggccctattccatcatgg

SEQ ID NO: 716214 - DNA, 20 bp, mouse
gttttcctccatgatggaat

SEQ ID NO: 716215 - DNA, 20 bp, mouse
gtaaagggtgaaggatgaag

SEQ ID NO: 716216 - DNA, 20 bp, mouse
ggcagcaaggtatctcatta

SEQ ID NO: 716217 - DNA, 20 bp, mouse
ggggtctccagtatctccac

SEQ ID NO: 716218 - DNA, 20 bp, mouse
gatggtcttcctgttggcat

SEQ ID NO: 716219 - DNA, 20 bp, mouse
gtcagcaatggtcttcctgt

SEQ ID NO: 716220 - DNA, 20 bp, mouse
gaggatgactatccgtgact

SEQ ID NO: 716221 - DNA, 20 bp, mouse
ggtgagtttacagagtggaa

SEQ ID NO: 716222 - DNA, 20 bp, mouse
gtgcctgctcttctctcccg

SEQ ID NO: 716223 - DNA, 20 bp, mouse
ggttggcataggatgatagt

SEQ ID NO: 716224 - DNA, 20 bp, mouse
gaaactggtcacacaggtat

SEQ ID NO: 716225 - DNA, 20 bp, mouse
gaatcacggaaggtcagcaa

SEQ ID NO: 716226 - DNA, 20 bp, mouse
gaaaattgccactggggcaa

SEQ ID NO: 716227 - DNA, 20 bp, mouse
gttctatagttgaccatggt

SEQ ID NO: 716228 - DNA, 20 bp, mouse
gttagaaaactgtcccacca

SEQ ID NO: 716229 - DNA, 20 bp, mouse
gtcctaggctccttacgcag

SEQ ID NO: 716230 - DNA, 20 bp, mouse
gtcctctgcgtaaggagcct

SEQ ID NO: 716231 - DNA, 20 bp, mouse
gaagcattcctttgccccag

SEQ ID NO: 716232 - DNA, 20 bp, mouse
gatacattcaaaattgccac

SEQ ID NO: 716233 - DNA, 20 bp, mouse
ggtgaactgataagttgtat

SEQ ID NO: 716234 - DNA, 20 bp, mouse
gtttgtttctcctctgcgta

SEQ ID NO: 716235 - DNA, 20 bp, mouse
gaaatttctatagttgacca

SEQ ID NO: 716236 - DNA, 20 bp, mouse
ggacactattagcacagaga

SEQ ID NO: 716237 - DNA, 20 bp, mouse
gagaatacctagtaatgtca

SEQ ID NO: 716238 - DNA, 20 bp, mouse
gtattagcacagagatggca

SEQ ID NO: 716239 - DNA, 20 bp, mouse
gaaccagccttgacattact

SEQ ID NO: 716240 - DNA, 20 bp, mouse
gctgcaaatagtgtgtggag

SEQ ID NO: 716241 - DNA, 20 bp, mouse
gatgtcaaggctggttgtgc

SEQ ID NO: 716242 - DNA, 20 bp, mouse
gtcttattcttcatgtttgg

SEQ ID NO: 716243 - DNA, 20 bp, mouse
gtgtggagataaataattat

SEQ ID NO: 716244 - DNA, 20 bp, mouse
gggagataaataattatagg

SEQ ID NO: 716245 - DNA, 20 bp, mouse
gtgagcaagcatgtgtgccc

SEQ ID NO: 716246 - DNA, 20 bp, mouse
gagagtgatcggggtacttg

SEQ ID NO: 716247 - DNA, 20 bp, mouse
ggggagcgaagaagagtgat

SEQ ID NO: 716248 - DNA, 20 bp, mouse
gggaatacagtgatatcaga

SEQ ID NO: 716249 - DNA, 20 bp, mouse
gcacgtggggggtcggaacc

SEQ ID NO: 716250 - DNA, 20 bp, mouse
ggagagaaagagcacgtggg

SEQ ID NO: 716251 - DNA, 20 bp, mouse
ggatgagagaaagagcacgt

SEQ ID NO: 716252 - DNA, 20 bp, mouse
gtgggtgttatcaggggcac

SEQ ID NO: 716253 - DNA, 20 bp, mouse
gaagatgtgggtgttatcag

SEQ ID NO: 716254 - DNA, 20 bp, mouse
gaagggcctgattccaaaac

SEQ ID NO: 716255 - DNA, 20 bp, mouse
gagaagaggtcgaactgtgg

SEQ ID NO: 716256 - DNA, 20 bp, mouse
ggaagaacaggagctgtctg

SEQ ID NO: 716257 - DNA, 20 bp, mouse
gcagctgcgtggacgagaag

SEQ ID NO: 716258 - DNA, 20 bp, mouse
gctggagcgactccgagaga

SEQ ID NO: 716259 - DNA, 20 bp, mouse
gcgaagggatgcgggggcgg

SEQ ID NO: 716260 - DNA, 20 bp, mouse
gtagagatgtatccttctct

SEQ ID NO: 716261 - DNA, 20 bp, mouse
gaaaacacttattctcccca

SEQ ID NO: 716262 - DNA, 20 bp, mouse
ggaacaggagctgtctgagg

SEQ ID NO: 716263 - DNA, 20 bp, mouse
ggcgaccacccccagctgcg

SEQ ID NO: 716264 - DNA, 20 bp, mouse
ggcgtggacgagaagtggca

SEQ ID NO: 716265 - DNA, 20 bp, mouse
gaaatggggggcagtagtgg

SEQ ID NO: 716266 - DNA, 20 bp, mouse
gacacatgaaagccaccctt

SEQ ID NO: 716267 - DNA, 20 bp, mouse
gttaattcttgactggccga

SEQ ID NO: 716268 - DNA, 20 bp, mouse
gctggtcttcagggtacatc

SEQ ID NO: 716269 - DNA, 20 bp, mouse
gttgtggactgaaaagctat

SEQ ID NO: 716270 - DNA, 20 bp, mouse
gttcttgactggccgaaggg

SEQ ID NO: 716271 - DNA, 20 bp, mouse
ggttaggagatagccatctc

SEQ ID NO: 716272 - DNA, 20 bp, mouse
gtcccaatttaaccttgtct

SEQ ID NO: 716273 - DNA, 20 bp, mouse
ggatgtcttgcctggtcttc

SEQ ID NO: 716274 - DNA, 20 bp, mouse
gatacatgaaagtcattctt

SEQ ID NO: 716275 - DNA, 20 bp, mouse
gctcctatttgagtccaggg

SEQ ID NO: 716276 - DNA, 20 bp, mouse
gcgccagcagagatcaggga

SEQ ID NO: 716277 - DNA, 20 bp, mouse
gggatggacacaaccatcta

SEQ ID NO: 716278 - DNA, 20 bp, mouse
gccagggagtggccagaact

SEQ ID NO: 716279 - DNA, 20 bp, mouse
gcccacgccagcagagatca

SEQ ID NO: 716280 - DNA, 20 bp, mouse
gcaagccagcgccttcgaga

SEQ ID NO: 716281 - DNA, 20 bp, mouse
gtaccctccctgatctctgc

SEQ ID NO: 716282 - DNA, 20 bp, mouse
gcagaacggctttccctaga

SEQ ID NO: 716283 - DNA, 20 bp, mouse
gttgggcaggtcccagaaag

SEQ ID NO: 716284 - DNA, 20 bp, mouse
gaaaataagaggcgccccaa

SEQ ID NO: 716285 - DNA, 20 bp, mouse
gaagataggaccctggcaag

SEQ ID NO: 716286 - DNA, 20 bp, mouse
gacagaaggtagcgttgtta

SEQ ID NO: 716287 - DNA, 20 bp, mouse
gcatcctcctaaggccactt

SEQ ID NO: 716288 - DNA, 20 bp, mouse
gcctgcttccaaactatctc

SEQ ID NO: 716289 - DNA, 20 bp, mouse
gaggcactgccattgattgc

SEQ ID NO: 716290 - DNA, 20 bp, mouse
gaggacagttcatcctccta

SEQ ID NO: 716291 - DNA, 20 bp, mouse
gcaagaaagaggccagtgcg

SEQ ID NO: 716292 - DNA, 20 bp, mouse
ggccctgtaggctgtaagtg

SEQ ID NO: 716293 - DNA, 20 bp, mouse
ggacccagtcattcctcgac

SEQ ID NO: 716294 - DNA, 20 bp, mouse
gctggcttccttttctaatt

SEQ ID NO: 716295 - DNA, 20 bp, mouse
gcctgggtaccagcaatcaa

SEQ ID NO: 716296 - DNA, 20 bp, mouse
gttccactccccatgtgcta

SEQ ID NO: 716297 - DNA, 20 bp, mouse
gcttataaccctagcacatg

SEQ ID NO: 716298 - DNA, 20 bp, mouse
gctagggttataagcgtttg

SEQ ID NO: 716299 - DNA, 20 bp, mouse
gaccaagtttggcaccggtt

SEQ ID NO: 716300 - DNA, 20 bp, mouse
gtcttaaactacatgagttc

SEQ ID NO: 716301 - DNA, 20 bp, mouse
gccggttaggcagctcttgg

SEQ ID NO: 716302 - DNA, 20 bp, mouse
gctcttggtggttcagaaaa

SEQ ID NO: 716303 - DNA, 20 bp, mouse
gtggaactccgtctgctcaa

SEQ ID NO: 716304 - DNA, 20 bp, mouse
gattctgagaatcagaactg

SEQ ID NO: 716305 - DNA, 20 bp, mouse
gtatgagctgaatagaacag

SEQ ID NO: 716306 - DNA, 20 bp, mouse
ggtagcctagtcctgtctca

SEQ ID NO: 716307 - DNA, 20 bp, mouse
ggctgaagtggacaactcca

SEQ ID NO: 716308 - DNA, 20 bp, mouse
gaggcaaaatgatcagttag

SEQ ID NO: 716309 - DNA, 20 bp, mouse
gccacctccctctatgccga

SEQ ID NO: 716310 - DNA, 20 bp, mouse
ggatctgaaaagatgtagga

SEQ ID NO: 716311 - DNA, 20 bp, mouse
gacatgatctgaaaagatgt

SEQ ID NO: 716312 - DNA, 20 bp, mouse
gagagctctagtcagtactt

SEQ ID NO: 716313 - DNA, 20 bp, mouse
gaacagaatacgcacagagc

SEQ ID NO: 716314 - DNA, 20 bp, mouse
gcatccttcggcatagaggg

SEQ ID NO: 716315 - DNA, 20 bp, mouse
gactgaaccatggacacatt

SEQ ID NO: 716316 - DNA, 20 bp, mouse
gttacaagggctcaggtggg

SEQ ID NO: 716317 - DNA, 20 bp, mouse
ggtattacaagggctcaggt

SEQ ID NO: 716318 - DNA, 20 bp, mouse
ggcaacattgaggctggttt

SEQ ID NO: 716319 - DNA, 20 bp, mouse
gattgcagcaacattgaggc

SEQ ID NO: 716320 - DNA, 20 bp, mouse
gtacacgtctctaagctccc

SEQ ID NO: 716321 - DNA, 20 bp, mouse
gtataatcccagtattacaa

SEQ ID NO: 716322 - DNA, 20 bp, mouse
ggaaatgcttctgaccattt

SEQ ID NO: 716323 - DNA, 20 bp, mouse
gagtaacttcgaggcgttcc

SEQ ID NO: 716324 - DNA, 20 bp, mouse
ggctcccaggagcttatgca

SEQ ID NO: 716325 - DNA, 20 bp, mouse
gacagctgttagtaacttcg

SEQ ID NO: 716326 - DNA, 20 bp, mouse
gcccacttgggtgccgagga

SEQ ID NO: 716327 - DNA, 20 bp, mouse
gaaaccgatccagaagtaag

SEQ ID NO: 716328 - DNA, 20 bp, mouse
gctgcctcttacttctggat

SEQ ID NO: 716329 - DNA, 20 bp, mouse
gttagggagtatccccactt

SEQ ID NO: 716330 - DNA, 20 bp, mouse
gcactcttggaaggtgactt

SEQ ID NO: 716331 - DNA, 20 bp, mouse
gcagctggtggcggcgtcag

SEQ ID NO: 716332 - DNA, 20 bp, mouse
gtggcagcggcggtggcacc

SEQ ID NO: 716333 - DNA, 20 bp, mouse
gcgggggcggtgaccggcgt

SEQ ID NO: 716334 - DNA, 20 bp, mouse
gtatccccacttgggtgccg

SEQ ID NO: 716335 - DNA, 20 bp, mouse
gtccctcctcggcacccaag

SEQ ID NO: 716336 - DNA, 20 bp, mouse
ggtcacttcagggtagtgta

SEQ ID NO: 716337 - DNA, 20 bp, mouse
ggacaaatcgcataatgaca

SEQ ID NO: 716338 - DNA, 20 bp, mouse
gtatgcgatttgtcacttca

SEQ ID NO: 716339 - DNA, 20 bp, mouse
gtcctgaggcaacagctaag

SEQ ID NO: 716340 - DNA, 20 bp, mouse
gagctgatccagttacagtt

SEQ ID NO: 716341 - DNA, 20 bp, mouse
gagcagagccaaagagtaac

SEQ ID NO: 716342 - DNA, 20 bp, mouse
gttacagttgggggatcagc

SEQ ID NO: 716343 - DNA, 20 bp, mouse
ggtgtagggaacaccagact

SEQ ID NO: 716344 - DNA, 20 bp, mouse
gtcagcaggattcaaacaag

SEQ ID NO: 716345 - DNA, 20 bp, mouse
gctaggtttcactgacttct

SEQ ID NO: 716346 - DNA, 20 bp, mouse
gccaccgcggaattccactc

SEQ ID NO: 716347 - DNA, 20 bp, mouse
gacccggggcgtcctcaccc

SEQ ID NO: 716348 - DNA, 20 bp, mouse
ggccctagtgctggctgcgg

SEQ ID NO: 716349 - DNA, 20 bp, mouse
ggcggcggcctggaaccggt

SEQ ID NO: 716350 - DNA, 20 bp, mouse
ggtcccagccaaccggttcc

SEQ ID NO: 716351 - DNA, 20 bp, mouse
gccaggtcgcccagccccga

SEQ ID NO: 716352 - DNA, 20 bp, mouse
gcaggtgagtgtcgcgtcct

SEQ ID NO: 716353 - DNA, 20 bp, mouse
gggcctggaaccggttggct

SEQ ID NO: 716354 - DNA, 20 bp, mouse
gggtccggagtggaattccg

SEQ ID NO: 716355 - DNA, 20 bp, mouse
gggggctgggcgacctgggg

SEQ ID NO: 716356 - DNA, 20 bp, mouse
gaggccagatgtggcaatgc

SEQ ID NO: 716357 - DNA, 20 bp, mouse
gtcaggatcgtgtgtgagtt

SEQ ID NO: 716358 - DNA, 20 bp, mouse
gccgccttgttccagagctc

SEQ ID NO: 716359 - DNA, 20 bp, mouse
ggaagaaagcacggaggacc

SEQ ID NO: 716360 - DNA, 20 bp, mouse
gcccagagaagaaagcacgg

SEQ ID NO: 716361 - DNA, 20 bp, mouse
gccccaaagccaaataaacc

SEQ ID NO: 716362 - DNA, 20 bp, mouse
gggcctggtttatttggctt

SEQ ID NO: 716363 - DNA, 20 bp, mouse
gtctggaacaaggcgggcct

SEQ ID NO: 716364 - DNA, 20 bp, mouse
gtgagaggaaaaataagcag

SEQ ID NO: 716365 - DNA, 20 bp, mouse
gtagcctgcattgccacatc

SEQ ID NO: 716366 - DNA, 20 bp, mouse
gaatctggtagaactggcat

SEQ ID NO: 716367 - DNA, 20 bp, mouse
gacactgatgtggcagaatc

SEQ ID NO: 716368 - DNA, 20 bp, mouse
gtgaaccacgtgctcatagg

SEQ ID NO: 716369 - DNA, 20 bp, mouse
gcataggaggcatcaccaca

SEQ ID NO: 716370 - DNA, 20 bp, mouse
gacagccatattggtgttca

SEQ ID NO: 716371 - DNA, 20 bp, mouse
gacaccaatatggctgtaaa

SEQ ID NO: 716372 - DNA, 20 bp, mouse
ggatgcctcctatgagcacg

SEQ ID NO: 716373 - DNA, 20 bp, mouse
gtatggctgtaaaaggaaga

SEQ ID NO: 716374 - DNA, 20 bp, mouse
ggtagtcaatgatgtcttgc

SEQ ID NO: 716375 - DNA, 20 bp, mouse
gatctgaaccacgtgctcat

SEQ ID NO: 716376 - DNA, 20 bp, mouse
gtagcagtaggctataaaca

SEQ ID NO: 716377 - DNA, 20 bp, mouse
gcccatggggatcaccaaca

SEQ ID NO: 716378 - DNA, 20 bp, mouse
ggggcactggtcaatcccat

SEQ ID NO: 716379 - DNA, 20 bp, mouse
gcaattctctggacttataa

SEQ ID NO: 716380 - DNA, 20 bp, mouse
gatggcaaagtggatggttc

SEQ ID NO: 716381 - DNA, 20 bp, mouse
gcatgctctgtacaattctc

SEQ ID NO: 716382 - DNA, 20 bp, mouse
ggatcaccaacaaggccagg

SEQ ID NO: 716383 - DNA, 20 bp, mouse
gctcaactgtccactctgag

SEQ ID NO: 716384 - DNA, 20 bp, mouse
ggccttgttggtgatcccca

SEQ ID NO: 716385 - DNA, 20 bp, mouse
ggcacttgggcctctcagag

SEQ ID NO: 716386 - DNA, 20 bp, mouse
gggcggcgcaggcgcgatcg

SEQ ID NO: 716387 - DNA, 20 bp, mouse
gtcgaggccgactggaacca

SEQ ID NO: 716388 - DNA, 20 bp, mouse
gaacacagatccagctaggg

SEQ ID NO: 716389 - DNA, 20 bp, mouse
gctagctggatctgtgttgg

SEQ ID NO: 716390 - DNA, 20 bp, mouse
gtggatctgtgttggaggag

SEQ ID NO: 716391 - DNA, 20 bp, mouse
gaggcgcgatcgaggccgac

SEQ ID NO: 716392 - DNA, 20 bp, mouse
gtaaaagccttggttccagt

SEQ ID NO: 716393 - DNA, 20 bp, mouse
ggcgagaggcgctcactgat

SEQ ID NO: 716394 - DNA, 20 bp, mouse
gcggagagatgtcttatcag

SEQ ID NO: 716395 - DNA, 20 bp, mouse
ggaagcggatggcttttgcc

SEQ ID NO: 716396 - DNA, 20 bp, mouse
ggggctgacagagactgttg

SEQ ID NO: 716397 - DNA, 20 bp, mouse
gctgacagagactgttgggg

SEQ ID NO: 716398 - DNA, 20 bp, mouse
gcgggtaagggatctggatg

SEQ ID NO: 716399 - DNA, 20 bp, mouse
gactgtgcgggtgtggtgac

SEQ ID NO: 716400 - DNA, 20 bp, mouse
ggggaatggaggggcgtgta

SEQ ID NO: 716401 - DNA, 20 bp, mouse
gggcgcgaaaggagcgggag

SEQ ID NO: 716402 - DNA, 20 bp, mouse
gggggggggcgctggatcac

SEQ ID NO: 716403 - DNA, 20 bp, mouse
gtggcggggcgcgaaaggag

SEQ ID NO: 716404 - DNA, 20 bp, mouse
gctggatcacggggcgtctc

SEQ ID NO: 716405 - DNA, 20 bp, mouse
gcgcgccccgccacccagga

SEQ ID NO: 716406 - DNA, 20 bp, mouse
gcggccggccaatcacggga

SEQ ID NO: 716407 - DNA, 20 bp, mouse
gggagcccccctctcctgat

SEQ ID NO: 716408 - DNA, 20 bp, mouse
gcgcccggccggccaatcac

SEQ ID NO: 716409 - DNA, 20 bp, mouse
gagtccagccaatcaggaga

SEQ ID NO: 716410 - DNA, 20 bp, mouse
gtgcaggagtccagccaatc

SEQ ID NO: 716411 - DNA, 20 bp, mouse
gcccaggcagctcggatggg

SEQ ID NO: 716412 - DNA, 20 bp, mouse
gccaatcacgggagggcagg

SEQ ID NO: 716413 - DNA, 20 bp, mouse
ggcagggtcaggggttacgg

SEQ ID NO: 716414 - DNA, 20 bp, mouse
gagccgaggcccgtgatcgt

SEQ ID NO: 716415 - DNA, 20 bp, mouse
ggtggccggcggaccgggaa

SEQ ID NO: 716416 - DNA, 20 bp, mouse
ggagtcatgagcattgtccc

SEQ ID NO: 716417 - DNA, 20 bp, mouse
gcagacagtgaggtaactcc

SEQ ID NO: 716418 - DNA, 20 bp, mouse
gaaggcgagcttgcagaatt

SEQ ID NO: 716419 - DNA, 20 bp, mouse
gattgactctagctgtatac

SEQ ID NO: 716420 - DNA, 20 bp, mouse
gtggtctccagtatctccat

SEQ ID NO: 716421 - DNA, 20 bp, mouse
gaaaatgttatgaaacattg

SEQ ID NO: 716422 - DNA, 20 bp, mouse
gaaaacggtcacacaggtgt

SEQ ID NO: 716423 - DNA, 20 bp, mouse
ggttacagataggctgtgct

SEQ ID NO: 716424 - DNA, 20 bp, mouse
ggaacatgaaagcaaatggc

SEQ ID NO: 716425 - DNA, 20 bp, mouse
gttttggcattctttagcca

SEQ ID NO: 716426 - DNA, 20 bp, mouse
gaaggtttatagtgaacccc

SEQ ID NO: 716427 - DNA, 20 bp, mouse
gttccaaatatgtaatcaat

SEQ ID NO: 716428 - DNA, 20 bp, mouse
gattcagacttttttcaggc

SEQ ID NO: 716429 - DNA, 20 bp, mouse
gtgcagagggctaaggttac

SEQ ID NO: 716430 - DNA, 20 bp, mouse
gcaggagacccagaagctca

SEQ ID NO: 716431 - DNA, 20 bp, mouse
gagggctaaggttacaggca

SEQ ID NO: 716432 - DNA, 20 bp, mouse
gtggaattcagacttttttc

SEQ ID NO: 716433 - DNA, 20 bp, mouse
gtcctgcatctgcctgcaga

SEQ ID NO: 716434 - DNA, 20 bp, mouse
gaggatgacattatgacaca

SEQ ID NO: 716435 - DNA, 20 bp, mouse
gatctgcctgcagagggcta

SEQ ID NO: 716436 - DNA, 20 bp, mouse
ggcgtctggaactgcagcac

SEQ ID NO: 716437 - DNA, 20 bp, mouse
gggggacaccggaacctccc

SEQ ID NO: 716438 - DNA, 20 bp, mouse
gaactgcagcacggggacac

SEQ ID NO: 716439 - DNA, 20 bp, mouse
gccgtccttaagagcagatg

SEQ ID NO: 716440 - DNA, 20 bp, mouse
ggcgccctcacaactgtgtt

SEQ ID NO: 716441 - DNA, 20 bp, mouse
gatcccaaacacagttgtga

SEQ ID NO: 716442 - DNA, 20 bp, mouse
gcacacgttctgctcccgtc

SEQ ID NO: 716443 - DNA, 20 bp, mouse
ggaggcagcagtgagcagcg

SEQ ID NO: 716444 - DNA, 20 bp, mouse
ggtgtcaattacaaagctcc

SEQ ID NO: 716445 - DNA, 20 bp, mouse
gggaaatcttcatcaatctt

SEQ ID NO: 716446 - DNA, 20 bp, mouse
gaatgccgagaagttactca

SEQ ID NO: 716447 - DNA, 20 bp, mouse
gtagacaaaaagggaggcaa

SEQ ID NO: 716448 - DNA, 20 bp, mouse
gcgtgccaggaataggtgag

SEQ ID NO: 716449 - DNA, 20 bp, mouse
gtgtttctaggcaagagatg

SEQ ID NO: 716450 - DNA, 20 bp, mouse
gttggagggaaacccgagaa

SEQ ID NO: 716451 - DNA, 20 bp, mouse
ggcagccctgagtaacttct

SEQ ID NO: 716452 - DNA, 20 bp, mouse
ggtaggggcgtgccaggaat

SEQ ID NO: 716453 - DNA, 20 bp, mouse
gtagttaacagagagacatg

SEQ ID NO: 716454 - DNA, 20 bp, mouse
gaatggggctggagttttgg

SEQ ID NO: 716455 - DNA, 20 bp, mouse
gcccaaaatgctagacaaaa

SEQ ID NO: 716456 - DNA, 20 bp, mouse
gggccacagccaaagcataa

SEQ ID NO: 716457 - DNA, 20 bp, mouse
gctatggaacttttgatgtt

SEQ ID NO: 716458 - DNA, 20 bp, mouse
gaatagcaactattgatgga

SEQ ID NO: 716459 - DNA, 20 bp, mouse
gaatctgacatataaatatg

SEQ ID NO: 716460 - DNA, 20 bp, mouse
gaggattgtttaaacacatg

SEQ ID NO: 716461 - DNA, 20 bp, mouse
ggctgtgaacaccataacca

SEQ ID NO: 716462 - DNA, 20 bp, mouse
gtaaaatagacttctgtctt

SEQ ID NO: 716463 - DNA, 20 bp, mouse
gaacaatcctatgggggcca

SEQ ID NO: 716464 - DNA, 20 bp, mouse
gtgtcactgtggggtgggct

SEQ ID NO: 716465 - DNA, 20 bp, mouse
gtggcttcttggcagctagg

SEQ ID NO: 716466 - DNA, 20 bp, mouse
gaaagaaagtcaatctccgg

SEQ ID NO: 716467 - DNA, 20 bp, mouse
ggcttaggtattaggaattg

SEQ ID NO: 716468 - DNA, 20 bp, mouse
gagaagcacaccaagtagac

SEQ ID NO: 716469 - DNA, 20 bp, mouse
ggatcattatgtgtcactgg

SEQ ID NO: 716470 - DNA, 20 bp, mouse
gggcttttcaaaatctcctc

SEQ ID NO: 716471 - DNA, 20 bp, mouse
gtcactgggggtttcttttc

SEQ ID NO: 716472 - DNA, 20 bp, mouse
gtccaaccaaaaggagccca

SEQ ID NO: 716473 - DNA, 20 bp, mouse
gtgggatcataaaaagaaat

SEQ ID NO: 716474 - DNA, 20 bp, mouse
gaacaaagaaagtcaatctc

SEQ ID NO: 716475 - DNA, 20 bp, mouse
gaaaggagcccagggccaga

SEQ ID NO: 716476 - DNA, 20 bp, mouse
ggggagcgagagaggtgcca

SEQ ID NO: 716477 - DNA, 20 bp, mouse
ggggcgatacaagtaaaggt

SEQ ID NO: 716478 - DNA, 20 bp, mouse
ggctcccaataaaccacatg

SEQ ID NO: 716479 - DNA, 20 bp, mouse
gtcaccacccagctcgacaa

SEQ ID NO: 716480 - DNA, 20 bp, mouse
gagaaccaatgtcaggtgga

SEQ ID NO: 716481 - DNA, 20 bp, mouse
gatggccgtccacctgacat

SEQ ID NO: 716482 - DNA, 20 bp, mouse
ggtcccagagaaccaatgtc

SEQ ID NO: 716483 - DNA, 20 bp, mouse
gaacccgagaattgttacat

SEQ ID NO: 716484 - DNA, 20 bp, mouse
gtatgatcttgaacgttgtg

SEQ ID NO: 716485 - DNA, 20 bp, mouse
gatatgggcgatacaagtaa

SEQ ID NO: 716486 - DNA, 20 bp, mouse
ggactgctgccaaaggaggt

SEQ ID NO: 716487 - DNA, 20 bp, mouse
gggcagcagtcaattcacca

SEQ ID NO: 716488 - DNA, 20 bp, mouse
gagaacggaaagttccagac

SEQ ID NO: 716489 - DNA, 20 bp, mouse
gaggagccctcttgagtgag

SEQ ID NO: 716490 - DNA, 20 bp, mouse
ggtgaattgactgctgccaa

SEQ ID NO: 716491 - DNA, 20 bp, mouse
ggaggcacccctcactcaag

SEQ ID NO: 716492 - DNA, 20 bp, mouse
gagaagggaacgagatgatg

SEQ ID NO: 716493 - DNA, 20 bp, mouse
gctcgttcccttctagtcca

SEQ ID NO: 716494 - DNA, 20 bp, mouse
gtgagagtacacaatcccac

SEQ ID NO: 716495 - DNA, 20 bp, mouse
gtttctgagagtgcgcctgt

SEQ ID NO: 716496 - DNA, 20 bp, mouse
gggaggggttcccagcaata

SEQ ID NO: 716497 - DNA, 20 bp, mouse
gcagcaatgcacaattaagt

SEQ ID NO: 716498 - DNA, 20 bp, mouse
gttgctaaatggttttttat

SEQ ID NO: 716499 - DNA, 20 bp, mouse
gattgtgcattgctgatgta

SEQ ID NO: 716500 - DNA, 20 bp, mouse
gctccacaggttcaaggctg

SEQ ID NO: 716501 - DNA, 20 bp, mouse
gtagcaacactgacctttag

SEQ ID NO: 716502 - DNA, 20 bp, mouse
ggaagataatttttcgattc

SEQ ID NO: 716503 - DNA, 20 bp, mouse
gccgtctactgccaagcatg

SEQ ID NO: 716504 - DNA, 20 bp, mouse
gaaacacaaaatgcgactga

SEQ ID NO: 716505 - DNA, 20 bp, mouse
gcattaaatattaagtcaaa

SEQ ID NO: 716506 - DNA, 20 bp, mouse
gagggctgttgaagtgcata

SEQ ID NO: 716507 - DNA, 20 bp, mouse
gaagacagcaatgccctcga

SEQ ID NO: 716508 - DNA, 20 bp, mouse
ggcacttcaacagccctcga

SEQ ID NO: 716509 - DNA, 20 bp, mouse
gggtgagccttgagtatata

SEQ ID NO: 716510 - DNA, 20 bp, mouse
gtcgggagtcagtaaccaag

SEQ ID NO: 716511 - DNA, 20 bp, mouse
ggccttgagtatataaggta

SEQ ID NO: 716512 - DNA, 20 bp, mouse
gtcaaatagcacagtagcct

SEQ ID NO: 716513 - DNA, 20 bp, mouse
ggtgtcagtgggcaaccctc

SEQ ID NO: 716514 - DNA, 20 bp, mouse
gtaaaaatgaatgtgtcagt

SEQ ID NO: 716515 - DNA, 20 bp, mouse
gctacattgtaagtggtccc

SEQ ID NO: 716516 - DNA, 20 bp, mouse
gtgtccctcagtgtctatgt

SEQ ID NO: 716517 - DNA, 20 bp, mouse
gaggccagaggctttacatt

SEQ ID NO: 716518 - DNA, 20 bp, mouse
gcataatgggttacagaatt

SEQ ID NO: 716519 - DNA, 20 bp, mouse
gaacaggttttgataaattc

SEQ ID NO: 716520 - DNA, 20 bp, mouse
gaagtaggttgaatatgaac

SEQ ID NO: 716521 - DNA, 20 bp, mouse
gtcatcccacatagacactg

SEQ ID NO: 716522 - DNA, 20 bp, mouse
gttacccaatgtaaagcctc

SEQ ID NO: 716523 - DNA, 20 bp, mouse
gtggtttagagtattataaa

SEQ ID NO: 716524 - DNA, 20 bp, mouse
gtacacaaaatatcctggcc

SEQ ID NO: 716525 - DNA, 20 bp, mouse
gaagggtcttagaaccccaa

SEQ ID NO: 716526 - DNA, 20 bp, mouse
ggggccggtaaccatggcga

SEQ ID NO: 716527 - DNA, 20 bp, mouse
gtggctctcacccttggcaa

SEQ ID NO: 716528 - DNA, 20 bp, mouse
ggccctggcgacgcccccat

SEQ ID NO: 716529 - DNA, 20 bp, mouse
gtgggccaggcggaacccta

SEQ ID NO: 716530 - DNA, 20 bp, mouse
ggcgcctggtggccatcagc

SEQ ID NO: 716531 - DNA, 20 bp, mouse
ggccgccgggccggtaacca

SEQ ID NO: 716532 - DNA, 20 bp, mouse
ggccaagggtgagagccaat

SEQ ID NO: 716533 - DNA, 20 bp, mouse
gggaaccggtacaccgaggg

SEQ ID NO: 716534 - DNA, 20 bp, mouse
ggcccacaagacaacgacaa

SEQ ID NO: 716535 - DNA, 20 bp, mouse
gtgcctactgtgcccgctga

SEQ ID NO: 716536 - DNA, 20 bp, mouse
ggtaaatgcctgtttcacca

SEQ ID NO: 716537 - DNA, 20 bp, mouse
gacaagatgcaagaagttgt

SEQ ID NO: 716538 - DNA, 20 bp, mouse
gcaggtgaaagggctaaaag

SEQ ID NO: 716539 - DNA, 20 bp, mouse
gaagggctaaaagtggtgca

SEQ ID NO: 716540 - DNA, 20 bp, mouse
gttagccctttcacctgtaa

SEQ ID NO: 716541 - DNA, 20 bp, mouse
gctgaagggatttctcctgc

SEQ ID NO: 716542 - DNA, 20 bp, mouse
gggaaggatcaccagctgaa

SEQ ID NO: 716543 - DNA, 20 bp, mouse
gcttactcccacaatttcat

SEQ ID NO: 716544 - DNA, 20 bp, mouse
gatgcaatgtcactgttaat

SEQ ID NO: 716545 - DNA, 20 bp, mouse
ggtcactattgactgataag

SEQ ID NO: 716546 - DNA, 20 bp, mouse
gtgagctctaagacaggatt

SEQ ID NO: 716547 - DNA, 20 bp, mouse
gctaaaagtcatgtcaagga

SEQ ID NO: 716548 - DNA, 20 bp, mouse
ggctctaagacaggattggg

SEQ ID NO: 716549 - DNA, 20 bp, mouse
gaggtgctggtaggctggga

SEQ ID NO: 716550 - DNA, 20 bp, mouse
ggaggctaaaagtcatgtca

SEQ ID NO: 716551 - DNA, 20 bp, mouse
gtatggcagtgcttttgata

SEQ ID NO: 716552 - DNA, 20 bp, mouse
ggcacacaactcagacttca

SEQ ID NO: 716553 - DNA, 20 bp, mouse
gatggatgaagctgatcttc

SEQ ID NO: 716554 - DNA, 20 bp, mouse
gcaagcagtagccaattgga

SEQ ID NO: 716555 - DNA, 20 bp, mouse
gttagctgtgttgaagggca

SEQ ID NO: 716556 - DNA, 20 bp, mouse
gagtctttcaaggtgctaca

SEQ ID NO: 716557 - DNA, 20 bp, mouse
ggttgatggatacagtttgt

SEQ ID NO: 716558 - DNA, 20 bp, mouse
ggtgactatgttgaagggca

SEQ ID NO: 716559 - DNA, 20 bp, mouse
gagataggtgctagtgaaag

SEQ ID NO: 716560 - DNA, 20 bp, mouse
gtcaacacacattaaacaca

SEQ ID NO: 716561 - DNA, 20 bp, mouse
gctgcaagacaggattgagt

SEQ ID NO: 716562 - DNA, 20 bp, mouse
gaacaaatgaagagatcaaa

SEQ ID NO: 716563 - DNA, 20 bp, mouse
gaggaaggagagggtcacct

SEQ ID NO: 716564 - DNA, 20 bp, mouse
gcccttcaacatagtcacaa

SEQ ID NO: 716565 - DNA, 20 bp, mouse
gtgatctcttcatttgttca

SEQ ID NO: 716566 - DNA, 20 bp, mouse
gggccatggaacagcagcat

SEQ ID NO: 716567 - DNA, 20 bp, mouse
gagatcgctgcaatggcgag

SEQ ID NO: 716568 - DNA, 20 bp, mouse
gtctggaaaacggtaggcca

SEQ ID NO: 716569 - DNA, 20 bp, mouse
gtgacagtttctgacatcgc

SEQ ID NO: 716570 - DNA, 20 bp, mouse
gcagaaactgtcagcaaggt

SEQ ID NO: 716571 - DNA, 20 bp, mouse
gatgtcagaaactgtcagca

SEQ ID NO: 716572 - DNA, 20 bp, mouse
gagaggtttttattccgatg

SEQ ID NO: 716573 - DNA, 20 bp, mouse
gtttttattccgatgcggac

SEQ ID NO: 716574 - DNA, 20 bp, mouse
gcccagattgcttacagtaa

SEQ ID NO: 716575 - DNA, 20 bp, mouse
gctcttcatttgcggggctt

SEQ ID NO: 716576 - DNA, 20 bp, mouse
gtacaatggagttgaaccac

SEQ ID NO: 716577 - DNA, 20 bp, mouse
ggttcaactccattgtacat

SEQ ID NO: 716578 - DNA, 20 bp, mouse
gggagttgaaccacgggtta

SEQ ID NO: 716579 - DNA, 20 bp, mouse
gacaagtcatgtctggatga

SEQ ID NO: 716580 - DNA, 20 bp, mouse
gggaacttccccttaacccg

SEQ ID NO: 716581 - DNA, 20 bp, mouse
gacccatcagaggaccagga

SEQ ID NO: 716582 - DNA, 20 bp, mouse
gggaataaagggaatgatta

SEQ ID NO: 716583 - DNA, 20 bp, mouse
gtccctcctggtcctctgat

SEQ ID NO: 716584 - DNA, 20 bp, mouse
gcctcctggtggtgtcttcc

SEQ ID NO: 716585 - DNA, 20 bp, mouse
gatactgtctgagactgacc

SEQ ID NO: 716586 - DNA, 20 bp, mouse
gctggggagcggctagagga

SEQ ID NO: 716587 - DNA, 20 bp, mouse
gggcgccggcgaatagggag

SEQ ID NO: 716588 - DNA, 20 bp, mouse
gtgctcggcagtgaatagaa

SEQ ID NO: 716589 - DNA, 20 bp, mouse
gtggcccgaccgcagaggtt

SEQ ID NO: 716590 - DNA, 20 bp, mouse
gccagctgctcgcgaagcaa

SEQ ID NO: 716591 - DNA, 20 bp, mouse
gcggcgggcgccggcgaata

SEQ ID NO: 716592 - DNA, 20 bp, mouse
gcccgctggcccgaccgcag

SEQ ID NO: 716593 - DNA, 20 bp, mouse
ggctagaggagggcgagcag

SEQ ID NO: 716594 - DNA, 20 bp, mouse
gtaatgaagcgccttttgtg

SEQ ID NO: 716595 - DNA, 20 bp, mouse
gtgactgctgacagggatag

SEQ ID NO: 716596 - DNA, 20 bp, mouse
gaggacgaagattttcatca

SEQ ID NO: 716597 - DNA, 20 bp, mouse
gtgggcgacagggtgtaatt

SEQ ID NO: 716598 - DNA, 20 bp, mouse
ggcactgtgtactatatgct

SEQ ID NO: 716599 - DNA, 20 bp, mouse
gcctaagctacgtcctactc

SEQ ID NO: 716600 - DNA, 20 bp, mouse
gtccttgccgggattaacta

SEQ ID NO: 716601 - DNA, 20 bp, mouse
gctatatgctggggagcaga

SEQ ID NO: 716602 - DNA, 20 bp, mouse
gtcaaatactgtctgacaaa

SEQ ID NO: 716603 - DNA, 20 bp, mouse
gtgtaattgggaaaggacca

SEQ ID NO: 716604 - DNA, 20 bp, mouse
gagacagaatggtgggcgac

SEQ ID NO: 716605 - DNA, 20 bp, mouse
gatcaaggagaccataggtt

SEQ ID NO: 716606 - DNA, 20 bp, mouse
gttactgcgagtctgttctg

SEQ ID NO: 716607 - DNA, 20 bp, mouse
ggtaagtagtcctcaattta

SEQ ID NO: 716608 - DNA, 20 bp, mouse
gtagctaatgacagtggaaa

SEQ ID NO: 716609 - DNA, 20 bp, mouse
gaaagcgtagccttaaattg

SEQ ID NO: 716610 - DNA, 20 bp, mouse
gaaaaagatcatagcttcag

SEQ ID NO: 716611 - DNA, 20 bp, mouse
gttaaaacttgaattctatc

SEQ ID NO: 716612 - DNA, 20 bp, mouse
gagaggacagctcacgctaa

SEQ ID NO: 716613 - DNA, 20 bp, mouse
ggtggaaaggggtggcagag

SEQ ID NO: 716614 - DNA, 20 bp, mouse
gtgtaagagtaaagagctga

SEQ ID NO: 716615 - DNA, 20 bp, mouse
ggatgcctttttataaagtg

SEQ ID NO: 716616 - DNA, 20 bp, mouse
gatacaagaaacatcccgct

SEQ ID NO: 716617 - DNA, 20 bp, mouse
gtgaaagtcagatgtctggg

SEQ ID NO: 716618 - DNA, 20 bp, mouse
gctctgaaagtcagatgtct

SEQ ID NO: 716619 - DNA, 20 bp, mouse
gagaaacatcccgctgggcg

SEQ ID NO: 716620 - DNA, 20 bp, mouse
gtagtttgtgctgatacctg

SEQ ID NO: 716621 - DNA, 20 bp, mouse
gtacctatcaagaatagcaa

SEQ ID NO: 716622 - DNA, 20 bp, mouse
gtaatatatactacttgatc

SEQ ID NO: 716623 - DNA, 20 bp, mouse
gatagcaatggcaataaata

SEQ ID NO: 716624 - DNA, 20 bp, mouse
gtcccaaacactaaataaac

SEQ ID NO: 716625 - DNA, 20 bp, mouse
gaacatcccgctgggcgtgg

SEQ ID NO: 716626 - DNA, 20 bp, mouse
gcacatgcaagaagagataa

SEQ ID NO: 716627 - DNA, 20 bp, mouse
gatgcaagaagagataaggg

SEQ ID NO: 716628 - DNA, 20 bp, mouse
gcatctatagctagatagct

SEQ ID NO: 716629 - DNA, 20 bp, mouse
gatagagctaaagaccagga

SEQ ID NO: 716630 - DNA, 20 bp, mouse
gggaaatatctactcactct

SEQ ID NO: 716631 - DNA, 20 bp, mouse
ggtgtgtagtgtagtttttc

SEQ ID NO: 716632 - DNA, 20 bp, mouse
gtttcagatagatgataatg

SEQ ID NO: 716633 - DNA, 20 bp, mouse
gctcacgcactcctgcaacc

SEQ ID NO: 716634 - DNA, 20 bp, mouse
gggcctagtcagaaatcaaa

SEQ ID NO: 716635 - DNA, 20 bp, mouse
gtgcaggagtgcgtgagttg

SEQ ID NO: 716636 - DNA, 20 bp, mouse
ggggccaatgagaaggtgtc

SEQ ID NO: 716637 - DNA, 20 bp, mouse
ggcttctcccagcagtgcaa

SEQ ID NO: 716638 - DNA, 20 bp, mouse
gccaatgagaaggtgtcggg

SEQ ID NO: 716639 - DNA, 20 bp, mouse
gagtgaggccatatcagcac

SEQ ID NO: 716640 - DNA, 20 bp, mouse
gaagctgccccttgcactgc

SEQ ID NO: 716641 - DNA, 20 bp, mouse
gaagagcctacctgcttcag

SEQ ID NO: 716642 - DNA, 20 bp, mouse
ggcaacgcacacagtccatg

SEQ ID NO: 716643 - DNA, 20 bp, mouse
gtctcactcatgcaagagtg

SEQ ID NO: 716644 - DNA, 20 bp, mouse
gcaggaagccacttcagaag

SEQ ID NO: 716645 - DNA, 20 bp, mouse
gcttgcatgagtgagacgac

SEQ ID NO: 716646 - DNA, 20 bp, mouse
gtgagggtgcgcagtagggt

SEQ ID NO: 716647 - DNA, 20 bp, mouse
gtccgcgctgttccagtccc

SEQ ID NO: 716648 - DNA, 20 bp, mouse
gctgttccagtcccaggcct

SEQ ID NO: 716649 - DNA, 20 bp, mouse
gggtgcgcagtagggtcggt

SEQ ID NO: 716650 - DNA, 20 bp, mouse
gttcgggccgaaagtgacgt

SEQ ID NO: 716651 - DNA, 20 bp, mouse
ggactggaacagcgcggaga

SEQ ID NO: 716652 - DNA, 20 bp, mouse
gaaggggcgggcacggtcct

SEQ ID NO: 716653 - DNA, 20 bp, mouse
gggcgggcacggtcctaggg

SEQ ID NO: 716654 - DNA, 20 bp, mouse
gtttctgagggtgcgcagta

SEQ ID NO: 716655 - DNA, 20 bp, mouse
ggtgcccgccccttacctgg

SEQ ID NO: 716656 - DNA, 20 bp, mouse
gtcagctagtgctagcaccg

SEQ ID NO: 716657 - DNA, 20 bp, mouse
gagagtgaactccctgatga

SEQ ID NO: 716658 - DNA, 20 bp, mouse
gtagttgccctgggtctcca

SEQ ID NO: 716659 - DNA, 20 bp, mouse
ggtgctagcactagctgaga

SEQ ID NO: 716660 - DNA, 20 bp, mouse
ggaacggcccccatgaaaat

SEQ ID NO: 716661 - DNA, 20 bp, mouse
ggctggagtcagttcaaccg

SEQ ID NO: 716662 - DNA, 20 bp, mouse
gcacctggcacctcaccctc

SEQ ID NO: 716663 - DNA, 20 bp, mouse
ggcctcccgcagagcagggt

SEQ ID NO: 716664 - DNA, 20 bp, mouse
ggaaagccaaccctgctctg

SEQ ID NO: 716665 - DNA, 20 bp, mouse
gggagaaagagtcaaactgg

SEQ ID NO: 716666 - DNA, 20 bp, mouse
gttgggcccgatccactcct

SEQ ID NO: 716667 - DNA, 20 bp, mouse
gacactcattaaattccagg

SEQ ID NO: 716668 - DNA, 20 bp, mouse
gtctgtcctaggagtggatc

SEQ ID NO: 716669 - DNA, 20 bp, mouse
gctcacattatccctattcc

SEQ ID NO: 716670 - DNA, 20 bp, mouse
gggttatcttagtgcaagga

SEQ ID NO: 716671 - DNA, 20 bp, mouse
gtctcagagcagagctcctt

SEQ ID NO: 716672 - DNA, 20 bp, mouse
gcttagtgcaaggaaggaaa

SEQ ID NO: 716673 - DNA, 20 bp, mouse
gagcaaaacaaagtcagcaa

SEQ ID NO: 716674 - DNA, 20 bp, mouse
gtgttcttctgtcctaggag

SEQ ID NO: 716675 - DNA, 20 bp, mouse
gtgaggggaaaccaggaata

SEQ ID NO: 716676 - DNA, 20 bp, mouse
gtccttgtccctaagggaga

SEQ ID NO: 716677 - DNA, 20 bp, mouse
ggggaggtctcatgtcaccc

SEQ ID NO: 716678 - DNA, 20 bp, mouse
gttgtccctaagggagatgg

SEQ ID NO: 716679 - DNA, 20 bp, mouse
ggtctcgtatgtatgtctgg

SEQ ID NO: 716680 - DNA, 20 bp, mouse
gctctccaccatctccctta

SEQ ID NO: 716681 - DNA, 20 bp, mouse
gccggaaggtaagtaaaggt

SEQ ID NO: 716682 - DNA, 20 bp, mouse
gatgtctggtgggaggtaaa

SEQ ID NO: 716683 - DNA, 20 bp, mouse
gtggctttccttgtccctaa

SEQ ID NO: 716684 - DNA, 20 bp, mouse
gaaggtaagtaaaggtagga

SEQ ID NO: 716685 - DNA, 20 bp, mouse
gtggcatgccagctgcttcg

SEQ ID NO: 716686 - DNA, 20 bp, mouse
gccagggctaatgagagtgg

SEQ ID NO: 716687 - DNA, 20 bp, mouse
ggttggtgcccaatcaggac

SEQ ID NO: 716688 - DNA, 20 bp, mouse
ggccccagggctaatgtaag

SEQ ID NO: 716689 - DNA, 20 bp, mouse
gcatcagtgttaatgagagt

SEQ ID NO: 716690 - DNA, 20 bp, mouse
ggccccttacattagccctg

SEQ ID NO: 716691 - DNA, 20 bp, mouse
ggctgaatccctgtcctgat

SEQ ID NO: 716692 - DNA, 20 bp, mouse
ggccccagggctaatgagag

SEQ ID NO: 716693 - DNA, 20 bp, mouse
gcgggcctcagcagaaatga

SEQ ID NO: 716694 - DNA, 20 bp, mouse
gcaggtctaatgggagagga

SEQ ID NO: 716695 - DNA, 20 bp, mouse
gaggacagggattcagcccc

SEQ ID NO: 716696 - DNA, 20 bp, mouse
gtgggagtggtgagcatcat

SEQ ID NO: 716697 - DNA, 20 bp, mouse
ggcaggcatcagtggcaaat

SEQ ID NO: 716698 - DNA, 20 bp, mouse
gggcatcagtggcaaatggg

SEQ ID NO: 716699 - DNA, 20 bp, mouse
gcagtggcaaatgggaggag

SEQ ID NO: 716700 - DNA, 20 bp, mouse
gcagcctcagggctaatgag

SEQ ID NO: 716701 - DNA, 20 bp, mouse
gtcagggctaatgagagggg

SEQ ID NO: 716702 - DNA, 20 bp, mouse
ggcaggagagcttaatggag

SEQ ID NO: 716703 - DNA, 20 bp, mouse
gcagtggaaatgagtgttag

SEQ ID NO: 716704 - DNA, 20 bp, mouse
gtgagaggggtggccatcag

SEQ ID NO: 716705 - DNA, 20 bp, mouse
gcaaccctcatttccactga

SEQ ID NO: 716706 - DNA, 20 bp, mouse
ggtatgcacatggttggtag

SEQ ID NO: 716707 - DNA, 20 bp, mouse
ggtgtgtgtatgcacatggt

SEQ ID NO: 716708 - DNA, 20 bp, mouse
gtcacaagcaggttgactgc

SEQ ID NO: 716709 - DNA, 20 bp, mouse
ggggacaagtcattctttcc

SEQ ID NO: 716710 - DNA, 20 bp, mouse
gagactcagctctcacaagc

SEQ ID NO: 716711 - DNA, 20 bp, mouse
gggagggggcagcgggcttt

SEQ ID NO: 716712 - DNA, 20 bp, mouse
gaaaatgtttcactgggagg

SEQ ID NO: 716713 - DNA, 20 bp, mouse
ggagtctgcaagtgtgcctt

SEQ ID NO: 716714 - DNA, 20 bp, mouse
gcagcgggctttggggtgac

SEQ ID NO: 716715 - DNA, 20 bp, mouse
gcaaaatagcaccatctact

SEQ ID NO: 716716 - DNA, 20 bp, mouse
gctccagcaaccaatagact

SEQ ID NO: 716717 - DNA, 20 bp, mouse
gcagacaagcctgtaagcgc

SEQ ID NO: 716718 - DNA, 20 bp, mouse
gagctccgggtcagtgtccc

SEQ ID NO: 716719 - DNA, 20 bp, mouse
gagagtgtttagaggaacca

SEQ ID NO: 716720 - DNA, 20 bp, mouse
gttcctagtctattggttgc

SEQ ID NO: 716721 - DNA, 20 bp, mouse
gcatttgaggagtgcaattt

SEQ ID NO: 716722 - DNA, 20 bp, mouse
gttatccctcttagtcagga

SEQ ID NO: 716723 - DNA, 20 bp, mouse
gattgaagcagagtgtttag

SEQ ID NO: 716724 - DNA, 20 bp, mouse
gctttccctcctgactaaga

SEQ ID NO: 716725 - DNA, 20 bp, mouse
gctgcttcaatatgagttat

SEQ ID NO: 716726 - DNA, 20 bp, mouse
gttaactcaggaccttcaaa

SEQ ID NO: 716727 - DNA, 20 bp, mouse
gatggttgtgagcatctatg

SEQ ID NO: 716728 - DNA, 20 bp, mouse
ggattttgtgattttaactc

SEQ ID NO: 716729 - DNA, 20 bp, mouse
gagcaaggtgtggtattatt

SEQ ID NO: 716730 - DNA, 20 bp, mouse
gtagaggtgtgtcattgtag

SEQ ID NO: 716731 - DNA, 20 bp, mouse
ggatgtagggttgattgaaa

SEQ ID NO: 716732 - DNA, 20 bp, mouse
gggaaatcagaaacacatag

SEQ ID NO: 716733 - DNA, 20 bp, mouse
gtgattgaaagggatggtgc

SEQ ID NO: 716734 - DNA, 20 bp, mouse
gaacacatagaggaaaacct

SEQ ID NO: 716735 - DNA, 20 bp, mouse
gtagggttgattgaaaggga

SEQ ID NO: 716736 - DNA, 20 bp, mouse
gtgatgattatacatttgat

SEQ ID NO: 716737 - DNA, 20 bp, mouse
gtgattatacatttgatagg

SEQ ID NO: 716738 - DNA, 20 bp, mouse
gatttgataggaggagatta

SEQ ID NO: 716739 - DNA, 20 bp, mouse
gagcttgaggtcagagatgg

SEQ ID NO: 716740 - DNA, 20 bp, mouse
gggtgctaatccatgagcgt

SEQ ID NO: 716741 - DNA, 20 bp, mouse
gctgtgttggaatttttatg

SEQ ID NO: 716742 - DNA, 20 bp, mouse
gaaaaattccaacacagaca

SEQ ID NO: 716743 - DNA, 20 bp, mouse
gaaccattctcaacttcaca

SEQ ID NO: 716744 - DNA, 20 bp, mouse
gtgaagaagacctcaaaaaa

SEQ ID NO: 716745 - DNA, 20 bp, mouse
gggtaggatagtcattttta

SEQ ID NO: 716746 - DNA, 20 bp, mouse
gagagaacaaatgccttgta

SEQ ID NO: 716747 - DNA, 20 bp, mouse
gagaataattctcccataca

SEQ ID NO: 716748 - DNA, 20 bp, mouse
gagtttgttcatgtctacat

SEQ ID NO: 716749 - DNA, 20 bp, mouse
ggtgttaaggaacttagttt

SEQ ID NO: 716750 - DNA, 20 bp, mouse
gggaagagttcctgagaact

SEQ ID NO: 716751 - DNA, 20 bp, mouse
gagttcctgagaacttggtt

SEQ ID NO: 716752 - DNA, 20 bp, mouse
gtgattaagttcaaacttct

SEQ ID NO: 716753 - DNA, 20 bp, mouse
gaactagttaaatagcgttc

SEQ ID NO: 716754 - DNA, 20 bp, mouse
gggtattgtgtttctgtagc

SEQ ID NO: 716755 - DNA, 20 bp, mouse
gtattttttttttgaaactg

SEQ ID NO: 716756 - DNA, 20 bp, mouse
gaaaaatggtcacgatatac

SEQ ID NO: 716757 - DNA, 20 bp, mouse
gaggataggcttatctaggg

SEQ ID NO: 716758 - DNA, 20 bp, mouse
gtctatgactgcaacagaca

SEQ ID NO: 716759 - DNA, 20 bp, mouse
ggagcagagatggcctccaa

SEQ ID NO: 716760 - DNA, 20 bp, mouse
gaatatgaagaaaacaacaa

SEQ ID NO: 716761 - DNA, 20 bp, mouse
gatttgtttttattatcaac

SEQ ID NO: 716762 - DNA, 20 bp, mouse
gaacagactggctaattcag

SEQ ID NO: 716763 - DNA, 20 bp, mouse
gtagggagggggaggtcctt

SEQ ID NO: 716764 - DNA, 20 bp, mouse
gagagaggataggcttatct

SEQ ID NO: 716765 - DNA, 20 bp, mouse
gaaacttttagtctgaatat

SEQ ID NO: 716766 - DNA, 20 bp, mouse
gggaacagtaagacaacggt

SEQ ID NO: 716767 - DNA, 20 bp, mouse
gccaatgatggtattagcaa

SEQ ID NO: 716768 - DNA, 20 bp, mouse
ggtgaacagcatcccatata

SEQ ID NO: 716769 - DNA, 20 bp, mouse
ggctgcgggcgttagcctta

SEQ ID NO: 716770 - DNA, 20 bp, mouse
gcaacatttgctcatcctta

SEQ ID NO: 716771 - DNA, 20 bp, mouse
gttctaaatgaactgcgctg

SEQ ID NO: 716772 - DNA, 20 bp, mouse
gcgtttatgtttaatatgtg

SEQ ID NO: 716773 - DNA, 20 bp, mouse
gcagaagagcagaagcatta

SEQ ID NO: 716774 - DNA, 20 bp, mouse
gacggtaggtaaactgtgtg

SEQ ID NO: 716775 - DNA, 20 bp, mouse
gtggtgacctgtggtgaact

SEQ ID NO: 716776 - DNA, 20 bp, mouse
gggggcacaaagcaatggag

SEQ ID NO: 716777 - DNA, 20 bp, mouse
gacagcaccccctttttttg

SEQ ID NO: 716778 - DNA, 20 bp, mouse
gctggcacctgagtaactct

SEQ ID NO: 716779 - DNA, 20 bp, mouse
gctggaggcaggaacggagc

SEQ ID NO: 716780 - DNA, 20 bp, mouse
gcattgctttgtgcccccta

SEQ ID NO: 716781 - DNA, 20 bp, mouse
gtcttggcaaccaagggaag

SEQ ID NO: 716782 - DNA, 20 bp, mouse
gacactaggtagatgcaagc

SEQ ID NO: 716783 - DNA, 20 bp, mouse
ggtaattaatgtcaccctag

SEQ ID NO: 716784 - DNA, 20 bp, mouse
gtccttcagacctcaaaaaa

SEQ ID NO: 716785 - DNA, 20 bp, mouse
ggacacacatctgtgcattc

SEQ ID NO: 716786 - DNA, 20 bp, mouse
gtcatgacaatcaaagaagg

SEQ ID NO: 716787 - DNA, 20 bp, mouse
gtcaccgagacaaccagggc

SEQ ID NO: 716788 - DNA, 20 bp, mouse
ggatccatgtaactgtgggt

SEQ ID NO: 716789 - DNA, 20 bp, mouse
gaaataacaaaaactctctt

SEQ ID NO: 716790 - DNA, 20 bp, mouse
gggtcctgccctggttgtct

SEQ ID NO: 716791 - DNA, 20 bp, mouse
gtaccccacccacagttaca

SEQ ID NO: 716792 - DNA, 20 bp, mouse
gagaggatccatgtaactgt

SEQ ID NO: 716793 - DNA, 20 bp, mouse
gctgtgggtggggtaatccc

SEQ ID NO: 716794 - DNA, 20 bp, mouse
ggacaatcaaagaaggaggc

SEQ ID NO: 716795 - DNA, 20 bp, mouse
gcccaatgagagataaccaa

SEQ ID NO: 716796 - DNA, 20 bp, mouse
gcatgcagccaagtccccca

SEQ ID NO: 716797 - DNA, 20 bp, mouse
gtcagagtcccacatccccc

SEQ ID NO: 716798 - DNA, 20 bp, mouse
ggggacttggctgcatgcct

SEQ ID NO: 716799 - DNA, 20 bp, mouse
gctgacttgctggatatctg

SEQ ID NO: 716800 - DNA, 20 bp, mouse
gcccaggggagccaagaaac

SEQ ID NO: 716801 - DNA, 20 bp, mouse
gtgttccccaggaggcccag

SEQ ID NO: 716802 - DNA, 20 bp, mouse
gtatagccttagggggcaga

SEQ ID NO: 716803 - DNA, 20 bp, mouse
ggcagagaaggaggtgtctg

SEQ ID NO: 716804 - DNA, 20 bp, mouse
ggggagtgaacgtggtaaga

SEQ ID NO: 716805 - DNA, 20 bp, mouse
ggtgacaccaaagcagccac

SEQ ID NO: 716806 - DNA, 20 bp, mouse
gagtaagcaatgcaggggat

SEQ ID NO: 716807 - DNA, 20 bp, mouse
gggaaagctcaggtatccag

SEQ ID NO: 716808 - DNA, 20 bp, mouse
gccgggagtaagcaatgcag

SEQ ID NO: 716809 - DNA, 20 bp, mouse
ggaggaatgcaagtatcagc

SEQ ID NO: 716810 - DNA, 20 bp, mouse
gggaatcatcatactatagt

SEQ ID NO: 716811 - DNA, 20 bp, mouse
ggatactgggaatggagtgt

SEQ ID NO: 716812 - DNA, 20 bp, mouse
gggaactgatggaggaaatg

SEQ ID NO: 716813 - DNA, 20 bp, mouse
gggaggaaatgcggtaagaa

SEQ ID NO: 716814 - DNA, 20 bp, mouse
ggttgctgagtctctagtaa

SEQ ID NO: 716815 - DNA, 20 bp, mouse
gacacaattgatactgggaa

SEQ ID NO: 716816 - DNA, 20 bp, mouse
gacacaaagtctatggttcc

SEQ ID NO: 716817 - DNA, 20 bp, mouse
gcagacacgatttctattgt

SEQ ID NO: 716818 - DNA, 20 bp, mouse
ggaaggagggactaaggaga

SEQ ID NO: 716819 - DNA, 20 bp, mouse
gataaaatatgaagcaatat

SEQ ID NO: 716820 - DNA, 20 bp, mouse
gattttattactgcttacca

SEQ ID NO: 716821 - DNA, 20 bp, mouse
gaaagcaggtgattcttgaa

SEQ ID NO: 716822 - DNA, 20 bp, mouse
gctgggaaggggaaacccac

SEQ ID NO: 716823 - DNA, 20 bp, mouse
gtgggtaggtgataaggaca

SEQ ID NO: 716824 - DNA, 20 bp, mouse
gtaggggaaagatagtgtaa

SEQ ID NO: 716825 - DNA, 20 bp, mouse
gccacagagtagacaaatag

SEQ ID NO: 716826 - DNA, 20 bp, mouse
ggtgggagtgttaccctggt

SEQ ID NO: 716827 - DNA, 20 bp, mouse
ggcctcagcgtggacccacc

SEQ ID NO: 716828 - DNA, 20 bp, mouse
gatcttggatggtacctgag

SEQ ID NO: 716829 - DNA, 20 bp, mouse
gggtctagcgagaagttggc

SEQ ID NO: 716830 - DNA, 20 bp, mouse
gcatccaaacaaaagcaaat

SEQ ID NO: 716831 - DNA, 20 bp, mouse
gattctatactaatcttgga

SEQ ID NO: 716832 - DNA, 20 bp, mouse
ggtatcagtaaatatgggag

SEQ ID NO: 716833 - DNA, 20 bp, mouse
gagtaagtatcagtaaatat

SEQ ID NO: 716834 - DNA, 20 bp, mouse
ggagggtgggagtgttaccc

SEQ ID NO: 716835 - DNA, 20 bp, mouse
gtcctgttggatacaagtat

SEQ ID NO: 716836 - DNA, 20 bp, mouse
gcaactcaggctggagtgtg

SEQ ID NO: 716837 - DNA, 20 bp, mouse
ggcacgaagctgcctgacac

SEQ ID NO: 716838 - DNA, 20 bp, mouse
gcggcaggatccagtttctc

SEQ ID NO: 716839 - DNA, 20 bp, mouse
ggccggcagctattcaactc

SEQ ID NO: 716840 - DNA, 20 bp, mouse
gcaagcaaacagtctgaaca

SEQ ID NO: 716841 - DNA, 20 bp, mouse
gtgggctaagtgcaacacat

SEQ ID NO: 716842 - DNA, 20 bp, mouse
gcctctgtaggcacacgtac

SEQ ID NO: 716843 - DNA, 20 bp, mouse
gatggttcagggttaagagc

SEQ ID NO: 716844 - DNA, 20 bp, mouse
gaagaaggcttgtatggcgc

SEQ ID NO: 716845 - DNA, 20 bp, mouse
gcagtctgaacatggggcac

SEQ ID NO: 716846 - DNA, 20 bp, mouse
gctggtaagcaggtaagtca

SEQ ID NO: 716847 - DNA, 20 bp, mouse
gttgccaagaggtaaaccct

SEQ ID NO: 716848 - DNA, 20 bp, mouse
gggagcttcctagaaaaggt

SEQ ID NO: 716849 - DNA, 20 bp, mouse
gtgacccagggtttacctct

SEQ ID NO: 716850 - DNA, 20 bp, mouse
ggacatcaccaaagattcta

SEQ ID NO: 716851 - DNA, 20 bp, mouse
gtcaaaaattcgtcaagatg

SEQ ID NO: 716852 - DNA, 20 bp, mouse
gagcttggacttccaataat

SEQ ID NO: 716853 - DNA, 20 bp, mouse
gataatgggaagttgccaag

SEQ ID NO: 716854 - DNA, 20 bp, mouse
gccaggttacaatacatcta

SEQ ID NO: 716855 - DNA, 20 bp, mouse
gctagggttccctggataca

SEQ ID NO: 716856 - DNA, 20 bp, mouse
gaacaggctgggattcttaa

SEQ ID NO: 716857 - DNA, 20 bp, mouse
ggcacctgaccccctccctg

SEQ ID NO: 716858 - DNA, 20 bp, mouse
gtggcatggtgtgatgatac

SEQ ID NO: 716859 - DNA, 20 bp, mouse
gacataggatctcatcgata

SEQ ID NO: 716860 - DNA, 20 bp, mouse
gatcctgagagcatagcaac

SEQ ID NO: 716861 - DNA, 20 bp, mouse
gacaggcagtagggtcccag

SEQ ID NO: 716862 - DNA, 20 bp, mouse
gggtgtgatgatacaggcct

SEQ ID NO: 716863 - DNA, 20 bp, mouse
gctcatcgataaggtagaaa

SEQ ID NO: 716864 - DNA, 20 bp, mouse
gtgggatccctgctcgcaga

SEQ ID NO: 716865 - DNA, 20 bp, mouse
gtctctttgcagtgagggtt

SEQ ID NO: 716866 - DNA, 20 bp, mouse
gagcgcacctgggtgcatca

SEQ ID NO: 716867 - DNA, 20 bp, mouse
gaggtgctggagcacgagga

SEQ ID NO: 716868 - DNA, 20 bp, mouse
gtagctgcacacaggagtcg

SEQ ID NO: 716869 - DNA, 20 bp, mouse
gaggagtcgaggctggtgta

SEQ ID NO: 716870 - DNA, 20 bp, mouse
gccagagtcgctcgtctccg

SEQ ID NO: 716871 - DNA, 20 bp, mouse
ggagcagccctgatgcaccc

SEQ ID NO: 716872 - DNA, 20 bp, mouse
ggctgccagctgtttgtgat

SEQ ID NO: 716873 - DNA, 20 bp, mouse
gggtataagtgatctcatga

SEQ ID NO: 716874 - DNA, 20 bp, mouse
gacagaaaggaccccagaga

SEQ ID NO: 716875 - DNA, 20 bp, mouse
ggtcactgaaatcacagaat

SEQ ID NO: 716876 - DNA, 20 bp, mouse
gaatggaccttggtaggcag

SEQ ID NO: 716877 - DNA, 20 bp, mouse
gaaagcaaatggaccttggt

SEQ ID NO: 716878 - DNA, 20 bp, mouse
gctctgctaagagttggtta

SEQ ID NO: 716879 - DNA, 20 bp, mouse
gtaatccttgagcatgactt

SEQ ID NO: 716880 - DNA, 20 bp, mouse
gccaaactgtttcaacttcc

SEQ ID NO: 716881 - DNA, 20 bp, mouse
gagaaaaagcaaatggacct

SEQ ID NO: 716882 - DNA, 20 bp, mouse
gtcagttcctagcaaagtat

SEQ ID NO: 716883 - DNA, 20 bp, mouse
gacaacacctatactttgct

SEQ ID NO: 716884 - DNA, 20 bp, mouse
gttatggatgatgatgatag

SEQ ID NO: 716885 - DNA, 20 bp, mouse
ggaccttaagaaaaagcaaa

SEQ ID NO: 716886 - DNA, 20 bp, mouse
gattacagaggtgagagaca

SEQ ID NO: 716887 - DNA, 20 bp, mouse
gtaggagtgggggattacag

SEQ ID NO: 716888 - DNA, 20 bp, mouse
ggaggtaaggactccagtac

SEQ ID NO: 716889 - DNA, 20 bp, mouse
gagaggaaatcttagatagt

SEQ ID NO: 716890 - DNA, 20 bp, mouse
gtactggagagttatttgag

SEQ ID NO: 716891 - DNA, 20 bp, mouse
gaaatcttagatagtaggag

SEQ ID NO: 716892 - DNA, 20 bp, mouse
gtcttagatagtaggagtgg

SEQ ID NO: 716893 - DNA, 20 bp, mouse
gcaaactaaggccacagttc

SEQ ID NO: 716894 - DNA, 20 bp, mouse
gtacctcagtctccatgttt

SEQ ID NO: 716895 - DNA, 20 bp, mouse
ggaacagtttcattagaagc

SEQ ID NO: 716896 - DNA, 20 bp, mouse
gccttctatcaggctagaaa

SEQ ID NO: 716897 - DNA, 20 bp, mouse
gtatcaggctagaaagggag

SEQ ID NO: 716898 - DNA, 20 bp, mouse
gtcacacatgtgtgacagaa

SEQ ID NO: 716899 - DNA, 20 bp, mouse
ggaaaagacagtgtgtcact

SEQ ID NO: 716900 - DNA, 20 bp, mouse
gaaggagggagccaatagaa

SEQ ID NO: 716901 - DNA, 20 bp, mouse
gagaagctgcaacactgtca

SEQ ID NO: 716902 - DNA, 20 bp, mouse
gagacagtgtgtcacttggt

SEQ ID NO: 716903 - DNA, 20 bp, mouse
ggggagagcactaccctccc

SEQ ID NO: 716904 - DNA, 20 bp, mouse
gtggcacaggatcatctcca

SEQ ID NO: 716905 - DNA, 20 bp, mouse
gtcatctccaaggctatccc

SEQ ID NO: 716906 - DNA, 20 bp, mouse
gaaacctagagaaaaaaata

SEQ ID NO: 716907 - DNA, 20 bp, mouse
gctaccatatttttttctct

SEQ ID NO: 716908 - DNA, 20 bp, mouse
gctatttctttagggattac

SEQ ID NO: 716909 - DNA, 20 bp, mouse
gagagcaggagagagagcgg

SEQ ID NO: 716910 - DNA, 20 bp, mouse
gataatagaaggggcaattt

SEQ ID NO: 716911 - DNA, 20 bp, mouse
gagtttccaacataatagaa

SEQ ID NO: 716912 - DNA, 20 bp, mouse
gtgtatctaacaggatcaaa

SEQ ID NO: 716913 - DNA, 20 bp, mouse
gggatagaatagccaaaact

SEQ ID NO: 716914 - DNA, 20 bp, mouse
gatctataattgtatctaac

SEQ ID NO: 716915 - DNA, 20 bp, mouse
ggactgtttagatgatttgc

SEQ ID NO: 716916 - DNA, 20 bp, mouse
gagtgctaagaacagtgcat

SEQ ID NO: 716917 - DNA, 20 bp, mouse
ggggaaggagtctagggtgc

SEQ ID NO: 716918 - DNA, 20 bp, mouse
gagtggacaggaagagcaat

SEQ ID NO: 716919 - DNA, 20 bp, mouse
ggcgccttctccctcctggc

SEQ ID NO: 716920 - DNA, 20 bp, mouse
gggccacctagggtctgggg

SEQ ID NO: 716921 - DNA, 20 bp, mouse
gaattcatgacccatagttt

SEQ ID NO: 716922 - DNA, 20 bp, mouse
gccgcccaagacaggctcgc

SEQ ID NO: 716923 - DNA, 20 bp, mouse
gggtccagcgagcctgtctt

SEQ ID NO: 716924 - DNA, 20 bp, mouse
gtagctagcaagggacagag

SEQ ID NO: 716925 - DNA, 20 bp, mouse
ggggccatgagtgtagaaga

SEQ ID NO: 716926 - DNA, 20 bp, mouse
gcggacaaagcccaagaggg

SEQ ID NO: 716927 - DNA, 20 bp, mouse
gccaggggcggaacaaagac

SEQ ID NO: 716928 - DNA, 20 bp, mouse
gggcctgcggtgcgggaagg

SEQ ID NO: 716929 - DNA, 20 bp, mouse
gaaagtcccatgtgaggttt

SEQ ID NO: 716930 - DNA, 20 bp, mouse
gtacacaattatctttagtc

SEQ ID NO: 716931 - DNA, 20 bp, mouse
ggaccggacaaagcccaaga

SEQ ID NO: 716932 - DNA, 20 bp, mouse
gcctggtgcctctatgggta

SEQ ID NO: 716933 - DNA, 20 bp, mouse
gatgaagcctggtgcctcta

SEQ ID NO: 716934 - DNA, 20 bp, mouse
ggcctctatgggtagggctg

SEQ ID NO: 716935 - DNA, 20 bp, mouse
ggactggctcacatgaagcc

SEQ ID NO: 716936 - DNA, 20 bp, mouse
ggccccaaagagggtgggtg

SEQ ID NO: 716937 - DNA, 20 bp, mouse
gctactgagaacctcttctg

SEQ ID NO: 716938 - DNA, 20 bp, mouse
gctgctgccccaaagagggt

SEQ ID NO: 716939 - DNA, 20 bp, mouse
gcaaccggcgagccgagcgt

SEQ ID NO: 716940 - DNA, 20 bp, mouse
gctctctgctgccccaaaga

SEQ ID NO: 716941 - DNA, 20 bp, mouse
ggggcgaggcgatggattgc

SEQ ID NO: 716942 - DNA, 20 bp, mouse
ggaagggaggggatcaacta

SEQ ID NO: 716943 - DNA, 20 bp, mouse
gccccccacccaccctcttt

SEQ ID NO: 716944 - DNA, 20 bp, mouse
gtgtgccccctcagactcga

SEQ ID NO: 716945 - DNA, 20 bp, mouse
ggcggcacctgcccaacgct

SEQ ID NO: 716946 - DNA, 20 bp, mouse
gtctgcggcaatcaggcttc

SEQ ID NO: 716947 - DNA, 20 bp, mouse
ggtgcaagacacttaagatg

SEQ ID NO: 716948 - DNA, 20 bp, mouse
ggagaaatgctggtccctca

SEQ ID NO: 716949 - DNA, 20 bp, mouse
gaatgctggtccctcaagga

SEQ ID NO: 716950 - DNA, 20 bp, mouse
gccctctagacccctttgtc

SEQ ID NO: 716951 - DNA, 20 bp, mouse
gaaggtacctagagagctaa

SEQ ID NO: 716952 - DNA, 20 bp, mouse
gcaaacaaacaagtctggaa

SEQ ID NO: 716953 - DNA, 20 bp, mouse
gtctaaaactccctccttga

SEQ ID NO: 716954 - DNA, 20 bp, mouse
gctagtgataaatgtcttaa

SEQ ID NO: 716955 - DNA, 20 bp, mouse
gtttctaccgttttgtttgg

SEQ ID NO: 716956 - DNA, 20 bp, mouse
gcccccacactccaccacgc

SEQ ID NO: 716957 - DNA, 20 bp, mouse
gtggattatagccagcgtgg

SEQ ID NO: 716958 - DNA, 20 bp, mouse
gctttggattatagccagcg

SEQ ID NO: 716959 - DNA, 20 bp, mouse
gcccccattcattttttttg

SEQ ID NO: 716960 - DNA, 20 bp, mouse
gatacttgtcagaatagtga

SEQ ID NO: 716961 - DNA, 20 bp, mouse
gatagtgaaggttaagaaaa

SEQ ID NO: 716962 - DNA, 20 bp, mouse
gcccacaaaaaaaatgaatg

SEQ ID NO: 716963 - DNA, 20 bp, mouse
gttcattttttttgtgggaa

SEQ ID NO: 716964 - DNA, 20 bp, mouse
gcctgactggattaagaatg

SEQ ID NO: 716965 - DNA, 20 bp, mouse
gaatgtggtgatgatgttaa

SEQ ID NO: 716966 - DNA, 20 bp, mouse
gtgtgacacggagtgatcac

SEQ ID NO: 716967 - DNA, 20 bp, mouse
ggctcaagggatgtgtgaca

SEQ ID NO: 716968 - DNA, 20 bp, mouse
ggggccatctagcatgaatg

SEQ ID NO: 716969 - DNA, 20 bp, mouse
ggcaccccattcatgctaga

SEQ ID NO: 716970 - DNA, 20 bp, mouse
gcaagctccgaacttctgaa

SEQ ID NO: 716971 - DNA, 20 bp, mouse
ggtttgagccttctgctcaa

SEQ ID NO: 716972 - DNA, 20 bp, mouse
gcagaagttcggagcttgtc

SEQ ID NO: 716973 - DNA, 20 bp, mouse
gagagacagggtctctgggc

SEQ ID NO: 716974 - DNA, 20 bp, mouse
gggccctcattttcacttta

SEQ ID NO: 716975 - DNA, 20 bp, mouse
gacaaacacctagctgtttt

SEQ ID NO: 716976 - DNA, 20 bp, mouse
gtaggcgggcctaatctctc

SEQ ID NO: 716977 - DNA, 20 bp, mouse
gtgacccacagactgcaatg

SEQ ID NO: 716978 - DNA, 20 bp, mouse
gaggtcatagaggccctaat

SEQ ID NO: 716979 - DNA, 20 bp, mouse
gctagcctcattgcagtctg

SEQ ID NO: 716980 - DNA, 20 bp, mouse
gcaaggctctatcacctatt

SEQ ID NO: 716981 - DNA, 20 bp, mouse
ggacaaacagtaatagaatt

SEQ ID NO: 716982 - DNA, 20 bp, mouse
gtgctgtttaaagacagggc

SEQ ID NO: 716983 - DNA, 20 bp, mouse
gggcctctatgacctcatgc

SEQ ID NO: 716984 - DNA, 20 bp, mouse
gtctctttgaggctacactg

SEQ ID NO: 716985 - DNA, 20 bp, mouse
ggtggtcattatattgcttc

SEQ ID NO: 716986 - DNA, 20 bp, mouse
gtactacaaagcaggcataa

SEQ ID NO: 716987 - DNA, 20 bp, mouse
gctaaggttaaatggagagc

SEQ ID NO: 716988 - DNA, 20 bp, mouse
gtgagcttcctaaggttaaa

SEQ ID NO: 716989 - DNA, 20 bp, mouse
gttcctaagtgagcttccta

SEQ ID NO: 716990 - DNA, 20 bp, mouse
gtgggacacttccctaagtc

SEQ ID NO: 716991 - DNA, 20 bp, mouse
gtctgtaggagtggttctgt

SEQ ID NO: 716992 - DNA, 20 bp, mouse
gaaccttaggaagctcactt

SEQ ID NO: 716993 - DNA, 20 bp, mouse
gctagtcttgacaatggtga

SEQ ID NO: 716994 - DNA, 20 bp, mouse
gctgagatctactacaaagc

SEQ ID NO: 716995 - DNA, 20 bp, mouse
gagaagctaagtctgtgatt

SEQ ID NO: 716996 - DNA, 20 bp, mouse
gagctggcaggagacgtagg

SEQ ID NO: 716997 - DNA, 20 bp, mouse
ggcgagctggcaggagacgt

SEQ ID NO: 716998 - DNA, 20 bp, mouse
gagaccctggggcgcaggtc

SEQ ID NO: 716999 - DNA, 20 bp, mouse
ggggctgccacactggaaga

SEQ ID NO: 717000 - DNA, 20 bp, mouse
gtgccaccgcttccccgctg

SEQ ID NO: 717001 - DNA, 20 bp, mouse
gtgctcgcaggcgtccgcag

SEQ ID NO: 717002 - DNA, 20 bp, mouse
gacgccgccacggtgacagc

SEQ ID NO: 717003 - DNA, 20 bp, mouse
ggcggaagaggcgctgtctt

SEQ ID NO: 717004 - DNA, 20 bp, mouse
gcagcttccggtagcctcag

SEQ ID NO: 717005 - DNA, 20 bp, mouse
gcgaggtcgcccgaggacca

SEQ ID NO: 717006 - DNA, 20 bp, mouse
ggggatgctccactggagag

SEQ ID NO: 717007 - DNA, 20 bp, mouse
gctccagtggagcatcccca

SEQ ID NO: 717008 - DNA, 20 bp, mouse
gtctactctgttgccaacaa

SEQ ID NO: 717009 - DNA, 20 bp, mouse
gagaggaggactccagtcta

SEQ ID NO: 717010 - DNA, 20 bp, mouse
ggaagtatgaaagaaccctt

SEQ ID NO: 717011 - DNA, 20 bp, mouse
gggtactatgcagaattggg

SEQ ID NO: 717012 - DNA, 20 bp, mouse
ggaacacccccttcccttgt

SEQ ID NO: 717013 - DNA, 20 bp, mouse
gtctgttgccaacaagggaa

SEQ ID NO: 717014 - DNA, 20 bp, mouse
ggggctggaatggcatcccc

SEQ ID NO: 717015 - DNA, 20 bp, mouse
ggtgtacctgcagttctgag

SEQ ID NO: 717016 - DNA, 20 bp, mouse
ggtatgcacatggttggtag

SEQ ID NO: 717017 - DNA, 20 bp, mouse
ggtgtgtgtatgcacatggt

SEQ ID NO: 717018 - DNA, 20 bp, mouse
gtcagctctcacaagcaggt

SEQ ID NO: 717019 - DNA, 20 bp, mouse
ggggacaaaccattctttcc

SEQ ID NO: 717020 - DNA, 20 bp, mouse
gagactcagctctcacaagc

SEQ ID NO: 717021 - DNA, 20 bp, mouse
gggagggggcagcgggcttt

SEQ ID NO: 717022 - DNA, 20 bp, mouse
gaaaatgtttcactgggagg

SEQ ID NO: 717023 - DNA, 20 bp, mouse
gatctgtaaccaggaaagaa

SEQ ID NO: 717024 - DNA, 20 bp, mouse
ggagtctgcaagtgtgcctt

SEQ ID NO: 717025 - DNA, 20 bp, mouse
gcagcgggctttggggtgac

SEQ ID NO: 717026 - DNA, 20 bp, mouse
gtgcaagcatgtggttgctt

SEQ ID NO: 717027 - DNA, 20 bp, mouse
gggctccagaactatagtcg

SEQ ID NO: 717028 - DNA, 20 bp, mouse
ggtatgaagtcatatcctta

SEQ ID NO: 717029 - DNA, 20 bp, mouse
gaaataatctaataccctta

SEQ ID NO: 717030 - DNA, 20 bp, mouse
gaaaggcttaattgtagaag

SEQ ID NO: 717031 - DNA, 20 bp, mouse
gggataaagaactcaatata

SEQ ID NO: 717032 - DNA, 20 bp, mouse
gttaactgagcattcctatt

SEQ ID NO: 717033 - DNA, 20 bp, mouse
ggggtattagattatttttc

SEQ ID NO: 717034 - DNA, 20 bp, mouse
gtctttaactgcatagtatt

SEQ ID NO: 717035 - DNA, 20 bp, mouse
gaagaactcaatatatggaa

SEQ ID NO: 717036 - DNA, 20 bp, mouse
gaactgacattttggttaca

SEQ ID NO: 717037 - DNA, 20 bp, mouse
ggcattcaaaactgacattt

SEQ ID NO: 717038 - DNA, 20 bp, mouse
gacagaatgaaccactgaat

SEQ ID NO: 717039 - DNA, 20 bp, mouse
gctcccccatccccattcag

SEQ ID NO: 717040 - DNA, 20 bp, mouse
gaaccactgaatggggatgg

SEQ ID NO: 717041 - DNA, 20 bp, mouse
gttctatcacacttgaagat

SEQ ID NO: 717042 - DNA, 20 bp, mouse
gatgaaccactgaatgggga

SEQ ID NO: 717043 - DNA, 20 bp, mouse
gtcaagtgtgatagaacatg

SEQ ID NO: 717044 - DNA, 20 bp, mouse
ggaatgagtatcttcctacc

SEQ ID NO: 717045 - DNA, 20 bp, mouse
gaagaatttgaaattaaatt

SEQ ID NO: 717046 - DNA, 20 bp, mouse
gatgccacatcgacagttgt

SEQ ID NO: 717047 - DNA, 20 bp, mouse
ggccttcagggcacctactg

SEQ ID NO: 717048 - DNA, 20 bp, mouse
gccctgaaggccacgcccaa

SEQ ID NO: 717049 - DNA, 20 bp, mouse
ggggcgacgcccattgggcg

SEQ ID NO: 717050 - DNA, 20 bp, mouse
gtatgaaggcgatgtcaatt

SEQ ID NO: 717051 - DNA, 20 bp, mouse
gtcctcagtaggtgccctga

SEQ ID NO: 717052 - DNA, 20 bp, mouse
gccactagaagtttccataa

SEQ ID NO: 717053 - DNA, 20 bp, mouse
gagacacgtcacaccagcag

SEQ ID NO: 717054 - DNA, 20 bp, mouse
gctggtgtgacgtgtcttag

SEQ ID NO: 717055 - DNA, 20 bp, mouse
gccactggggcgacatctgt

SEQ ID NO: 717056 - DNA, 20 bp, mouse
ggcacacaaacatgtcagga

SEQ ID NO: 717057 - DNA, 20 bp, mouse
gtaattgcattgcatttgca

SEQ ID NO: 717058 - DNA, 20 bp, mouse
gttctgcacatcatgtttat

SEQ ID NO: 717059 - DNA, 20 bp, mouse
ggtcatggcatctctggcat

SEQ ID NO: 717060 - DNA, 20 bp, mouse
gcctatgtggtttaactcta

SEQ ID NO: 717061 - DNA, 20 bp, mouse
gcatgtcaggacggctctgt

SEQ ID NO: 717062 - DNA, 20 bp, mouse
gttgggggatgtgatagaat

SEQ ID NO: 717063 - DNA, 20 bp, mouse
gggaagcacacaaacatgtc

SEQ ID NO: 717064 - DNA, 20 bp, mouse
gtcccaattcattaacaaga

SEQ ID NO: 717065 - DNA, 20 bp, mouse
gattactgtcataccacaca

SEQ ID NO: 717066 - DNA, 20 bp, mouse
ggctcctggggtggaggcta

SEQ ID NO: 717067 - DNA, 20 bp, mouse
ggaaagccaagagttgggtg

SEQ ID NO: 717068 - DNA, 20 bp, mouse
gtgcagcagcaggatttaga

SEQ ID NO: 717069 - DNA, 20 bp, mouse
ggtagagaaagccaagagtt

SEQ ID NO: 717070 - DNA, 20 bp, mouse
gcaaagggccacaggtagga

SEQ ID NO: 717071 - DNA, 20 bp, mouse
gaggagccccacccaactct

SEQ ID NO: 717072 - DNA, 20 bp, mouse
gagacactgaagcacacaag

SEQ ID NO: 717073 - DNA, 20 bp, mouse
gcagaaggcagaagaacttt

SEQ ID NO: 717074 - DNA, 20 bp, mouse
gatcacaaagggccacaggt

SEQ ID NO: 717075 - DNA, 20 bp, mouse
gagaagaactttgggactca

SEQ ID NO: 717076 - DNA, 20 bp, mouse
gacaatacaatactctcaga

SEQ ID NO: 717077 - DNA, 20 bp, mouse
gagtttaccattatctgcaa

SEQ ID NO: 717078 - DNA, 20 bp, mouse
ggtaaagcctttgcagataa

SEQ ID NO: 717079 - DNA, 20 bp, mouse
gatgaatgtggtaaagtctt

SEQ ID NO: 717080 - DNA, 20 bp, mouse
ggtaaatcctttgcctctca

SEQ ID NO: 717081 - DNA, 20 bp, mouse
ggttcaaagttgaccatgag

SEQ ID NO: 717082 - DNA, 20 bp, mouse
gttctgaagttgaccatgag

SEQ ID NO: 717083 - DNA, 20 bp, mouse
gagagtattgtattgtgaaa

SEQ ID NO: 717084 - DNA, 20 bp, mouse
gatgcatttgaagattacga

SEQ ID NO: 717085 - DNA, 20 bp, mouse
gagattacgatggcatgcaa

SEQ ID NO: 717086 - DNA, 20 bp, mouse
gtgaacacatagatcttgtc

SEQ ID NO: 717087 - DNA, 20 bp, mouse
gaaaaaggacatattaggta

SEQ ID NO: 717088 - DNA, 20 bp, mouse
gccaccaagcacacctcttt

SEQ ID NO: 717089 - DNA, 20 bp, mouse
gtttgcatgtgctcctgtgt

SEQ ID NO: 717090 - DNA, 20 bp, mouse
gcagaatctccctagcaagg

SEQ ID NO: 717091 - DNA, 20 bp, mouse
ggagtctagatatcaccctc

SEQ ID NO: 717092 - DNA, 20 bp, mouse
gagtacaaaaatacccattt

SEQ ID NO: 717093 - DNA, 20 bp, mouse
gctggccctctctgttggcc

SEQ ID NO: 717094 - DNA, 20 bp, mouse
gtggttatttggagaggccc

SEQ ID NO: 717095 - DNA, 20 bp, mouse
gcacacatataaaggcctga

SEQ ID NO: 717096 - DNA, 20 bp, mouse
gagaaaggaagtcatgacgt

SEQ ID NO: 717097 - DNA, 20 bp, mouse
gaagtcatgacgtgggagaa

SEQ ID NO: 717098 - DNA, 20 bp, mouse
gggtcgcagagagagcaggg

SEQ ID NO: 717099 - DNA, 20 bp, mouse
gaaaaactcaagagaagttg

SEQ ID NO: 717100 - DNA, 20 bp, mouse
gggagggtcgcagagagagc

SEQ ID NO: 717101 - DNA, 20 bp, mouse
gctagttctcactttctgta

SEQ ID NO: 717102 - DNA, 20 bp, mouse
gcagtggcggcttttgccac

SEQ ID NO: 717103 - DNA, 20 bp, mouse
gttttaaaattcagattttc

SEQ ID NO: 717104 - DNA, 20 bp, mouse
gaccctgcctggggagagga

SEQ ID NO: 717105 - DNA, 20 bp, mouse
gagctgggagagtccctaat

SEQ ID NO: 717106 - DNA, 20 bp, mouse
gtgggagcatactccggtga

SEQ ID NO: 717107 - DNA, 20 bp, mouse
gccggagtatgctcccatta

SEQ ID NO: 717108 - DNA, 20 bp, mouse
gctccggtgaaggatcatag

SEQ ID NO: 717109 - DNA, 20 bp, mouse
gcaactcatgcattaagcac

SEQ ID NO: 717110 - DNA, 20 bp, mouse
gtgcctctatgatccttcac

SEQ ID NO: 717111 - DNA, 20 bp, mouse
gaacagagtcacatcgtttc

SEQ ID NO: 717112 - DNA, 20 bp, mouse
gatcgtttctggaccctaat

SEQ ID NO: 717113 - DNA, 20 bp, mouse
ggaaggatcatagaggcagc

SEQ ID NO: 717114 - DNA, 20 bp, mouse
gtgagaacatagggaaagtg

SEQ ID NO: 717115 - DNA, 20 bp, mouse
gttaatatctgaaacccaga

SEQ ID NO: 717116 - DNA, 20 bp, mouse
gagaaaggaaagccagtagg

SEQ ID NO: 717117 - DNA, 20 bp, mouse
gcggaatcccggcttctgac

SEQ ID NO: 717118 - DNA, 20 bp, mouse
ggccccccggccttggtcat

SEQ ID NO: 717119 - DNA, 20 bp, mouse
gagcctccccagcaccggat

SEQ ID NO: 717120 - DNA, 20 bp, mouse
gcccgccccgaccaaccggc

SEQ ID NO: 717121 - DNA, 20 bp, mouse
gtcgggcggcccaatgacca

SEQ ID NO: 717122 - DNA, 20 bp, mouse
gaccaaccggccggccaatc

SEQ ID NO: 717123 - DNA, 20 bp, mouse
gcggccggccaatccggtgc

SEQ ID NO: 717124 - DNA, 20 bp, mouse
gaccgtggccagtcagaagc

SEQ ID NO: 717125 - DNA, 20 bp, mouse
gggcccaatgaccaaggccg

SEQ ID NO: 717126 - DNA, 20 bp, mouse
gaacaagaatcacaacccat

SEQ ID NO: 717127 - DNA, 20 bp, mouse
gtcaggaaagagatggtgag

SEQ ID NO: 717128 - DNA, 20 bp, mouse
gtgatttcatgctttcccat

SEQ ID NO: 717129 - DNA, 20 bp, mouse
gggcaacactgcgatcaata

SEQ ID NO: 717130 - DNA, 20 bp, mouse
ggaaatcaatccactcttca

SEQ ID NO: 717131 - DNA, 20 bp, mouse
gaaagcaaaggaatatctct

SEQ ID NO: 717132 - DNA, 20 bp, mouse
gctgcgatcaataaggaagg

SEQ ID NO: 717133 - DNA, 20 bp, mouse
gacactgcgatcaataagga

SEQ ID NO: 717134 - DNA, 20 bp, mouse
gcgacccacaaaacagatgc

SEQ ID NO: 717135 - DNA, 20 bp, mouse
gtgtgtagagggcgggtatt

SEQ ID NO: 717136 - DNA, 20 bp, mouse
gacacatcccacaagtcttc

SEQ ID NO: 717137 - DNA, 20 bp, mouse
ggcgcgcaagaagaaccaac

SEQ ID NO: 717138 - DNA, 20 bp, mouse
gcgcaagaagaaccaacagg

SEQ ID NO: 717139 - DNA, 20 bp, mouse
gaccgtgcatttaactgggt

SEQ ID NO: 717140 - DNA, 20 bp, mouse
gatacatcccagaagacttg

SEQ ID NO: 717141 - DNA, 20 bp, mouse
gtcccacccagttaaatgca

SEQ ID NO: 717142 - DNA, 20 bp, mouse
gaccaacaggaggacctatc

SEQ ID NO: 717143 - DNA, 20 bp, mouse
ggacctatctggatgctaat

SEQ ID NO: 717144 - DNA, 20 bp, mouse
gtgcctccaactctggaaaa

SEQ ID NO: 717145 - DNA, 20 bp, mouse
gaacccattagcatccagat

SEQ ID NO: 717146 - DNA, 20 bp, mouse
gctcaagacctccagctcaa

SEQ ID NO: 717147 - DNA, 20 bp, mouse
gtcatgtgaaacaaataagt

SEQ ID NO: 717148 - DNA, 20 bp, mouse
gagttggcagatccgctcca

SEQ ID NO: 717149 - DNA, 20 bp, mouse
gtaacggaaaactttgtgat

SEQ ID NO: 717150 - DNA, 20 bp, mouse
gtaaaaggttattcattaac

SEQ ID NO: 717151 - DNA, 20 bp, mouse
gtcactaaaacaattacaat

SEQ ID NO: 717152 - DNA, 20 bp, mouse
gcacaaagttttccgttaaa

SEQ ID NO: 717153 - DNA, 20 bp, mouse
gaagacctccagctcaaggg

SEQ ID NO: 717154 - DNA, 20 bp, mouse
gagggtggaaccactcacaa

SEQ ID NO: 717155 - DNA, 20 bp, mouse
gttgaggtctataagagacc

SEQ ID NO: 717156 - DNA, 20 bp, mouse
gtttgggccagagagagcgg

SEQ ID NO: 717157 - DNA, 20 bp, mouse
ggcatgtcatagcgcagcat

SEQ ID NO: 717158 - DNA, 20 bp, mouse
gtaaagcacctaatgagtga

SEQ ID NO: 717159 - DNA, 20 bp, mouse
gacacatgtatgtgttggtc

SEQ ID NO: 717160 - DNA, 20 bp, mouse
gatgacttttggatgatgag

SEQ ID NO: 717161 - DNA, 20 bp, mouse
gctgctgttatgtcatatat

SEQ ID NO: 717162 - DNA, 20 bp, mouse
ggccactctcacatgggtac

SEQ ID NO: 717163 - DNA, 20 bp, mouse
gacccatgtgagagtggcca

SEQ ID NO: 717164 - DNA, 20 bp, mouse
gtccttggccactctcacat

SEQ ID NO: 717165 - DNA, 20 bp, mouse
ggcctgtacccatgtgagag

SEQ ID NO: 717166 - DNA, 20 bp, mouse
gggcttaccaactatcattg

SEQ ID NO: 717167 - DNA, 20 bp, mouse
gaaaagaaagcaaatagcca

SEQ ID NO: 717168 - DNA, 20 bp, mouse
gagaagtaaggcggctctcg

SEQ ID NO: 717169 - DNA, 20 bp, mouse
gaggtaggaccggacatatt

SEQ ID NO: 717170 - DNA, 20 bp, mouse
ggctttccctcaatgatagt

SEQ ID NO: 717171 - DNA, 20 bp, mouse
gttggtaagccaaatatgtc

SEQ ID NO: 717172 - DNA, 20 bp, mouse
ggttaacttgatgcacgcta

SEQ ID NO: 717173 - DNA, 20 bp, mouse
gccgattctagactagatac

SEQ ID NO: 717174 - DNA, 20 bp, mouse
gctttctaatttgctctccg

SEQ ID NO: 717175 - DNA, 20 bp, mouse
gattctagactagatactgg

SEQ ID NO: 717176 - DNA, 20 bp, mouse
gtgaaggggcagtagagacc

SEQ ID NO: 717177 - DNA, 20 bp, mouse
gtgagcaaagtagttgggaa

SEQ ID NO: 717178 - DNA, 20 bp, mouse
ggcaatatgagcaaagtagt

SEQ ID NO: 717179 - DNA, 20 bp, mouse
gtggagacagggcacagtgt

SEQ ID NO: 717180 - DNA, 20 bp, mouse
gttgaactctcataggtcaa

SEQ ID NO: 717181 - DNA, 20 bp, mouse
gctcatgcctaggaataagt

SEQ ID NO: 717182 - DNA, 20 bp, mouse
gaggaagcaagcttttccca

SEQ ID NO: 717183 - DNA, 20 bp, mouse
gccccactgctcttagttct

SEQ ID NO: 717184 - DNA, 20 bp, mouse
gggcttccagaatggagaca

SEQ ID NO: 717185 - DNA, 20 bp, mouse
ggtcaatcccacttattcct

SEQ ID NO: 717186 - DNA, 20 bp, mouse
gttgtccttggcaacaagtg

SEQ ID NO: 717187 - DNA, 20 bp, mouse
gtaattctacgcatgcccca

SEQ ID NO: 717188 - DNA, 20 bp, mouse
gcaagtgggggcaagccatg

SEQ ID NO: 717189 - DNA, 20 bp, mouse
gaactgggattgtaaaacgg

SEQ ID NO: 717190 - DNA, 20 bp, mouse
gaaggaaactcccttgtcct

SEQ ID NO: 717191 - DNA, 20 bp, mouse
gttgcccccacttgttgcca

SEQ ID NO: 717192 - DNA, 20 bp, mouse
gggaaactgggattgtaaaa

SEQ ID NO: 717193 - DNA, 20 bp, mouse
gacaatcccagtttccacaa

SEQ ID NO: 717194 - DNA, 20 bp, mouse
gaggaaaatagggggaaacc

SEQ ID NO: 717195 - DNA, 20 bp, mouse
gctggcctttaggaaaatag

SEQ ID NO: 717196 - DNA, 20 bp, mouse
ggggtgggatagtcatactg

SEQ ID NO: 717197 - DNA, 20 bp, mouse
gagaaggcagagtaaggcca

SEQ ID NO: 717198 - DNA, 20 bp, mouse
ggggagagaagacactggat

SEQ ID NO: 717199 - DNA, 20 bp, mouse
gcactggatgggatctgtaa

SEQ ID NO: 717200 - DNA, 20 bp, mouse
gtcgaggaattgggccaaca

SEQ ID NO: 717201 - DNA, 20 bp, mouse
gataactctaaactgacccc

SEQ ID NO: 717202 - DNA, 20 bp, mouse
gtgcaatagaaggcagagta

SEQ ID NO: 717203 - DNA, 20 bp, mouse
gaaaggagcttcgaggaatt

SEQ ID NO: 717204 - DNA, 20 bp, mouse
ggggatagtcatactgagga

SEQ ID NO: 717205 - DNA, 20 bp, mouse
gggggtgagggtaggccaaa

SEQ ID NO: 717206 - DNA, 20 bp, mouse
gagacacatcaaatgaagaa

SEQ ID NO: 717207 - DNA, 20 bp, mouse
ggtgggcctcccttctcttc

SEQ ID NO: 717208 - DNA, 20 bp, mouse
gcgtgcgtgctgaaattcgc

SEQ ID NO: 717209 - DNA, 20 bp, mouse
gttcatttgatgtgtctcgt

SEQ ID NO: 717210 - DNA, 20 bp, mouse
gatcagtaagagtagagccc

SEQ ID NO: 717211 - DNA, 20 bp, mouse
gaaattcgcaggagctggcc

SEQ ID NO: 717212 - DNA, 20 bp, mouse
gcaattagaaagaaggaggt

SEQ ID NO: 717213 - DNA, 20 bp, mouse
gtctactcttactgatctgg

SEQ ID NO: 717214 - DNA, 20 bp, mouse
gtccctctgctgggtagtag

SEQ ID NO: 717215 - DNA, 20 bp, mouse
ggctgggtagtagtggaaca

SEQ ID NO: 717216 - DNA, 20 bp, mouse
gggtgtaaagactctcaaac

SEQ ID NO: 717217 - DNA, 20 bp, mouse
gtaaccagtacagctggccc

SEQ ID NO: 717218 - DNA, 20 bp, mouse
gcagccagggccagctgtac

SEQ ID NO: 717219 - DNA, 20 bp, mouse
gggtggctttatgactgtca

SEQ ID NO: 717220 - DNA, 20 bp, mouse
gggatgaagaggtaaattgg

SEQ ID NO: 717221 - DNA, 20 bp, mouse
gttaggatgaagaggtaaat

SEQ ID NO: 717222 - DNA, 20 bp, mouse
ggagccatgcatattcattg

SEQ ID NO: 717223 - DNA, 20 bp, mouse
gaatctctctattactctaa

SEQ ID NO: 717224 - DNA, 20 bp, mouse
ggccagctgtactggttact

SEQ ID NO: 717225 - DNA, 20 bp, mouse
gagaatgaaagaatgcaaaa

SEQ ID NO: 717226 - DNA, 20 bp, mouse
gtgaatgctacacaattccc

SEQ ID NO: 717227 - DNA, 20 bp, mouse
gaaactctgacgggtgggtg

SEQ ID NO: 717228 - DNA, 20 bp, mouse
gtgaaggtgatatcaaacca

SEQ ID NO: 717229 - DNA, 20 bp, mouse
gacaaaaagctaggcagtaa

SEQ ID NO: 717230 - DNA, 20 bp, mouse
gttgggaaactctgacgggt

SEQ ID NO: 717231 - DNA, 20 bp, mouse
gggaactcactgcataaatg

SEQ ID NO: 717232 - DNA, 20 bp, mouse
gacacctgtaacttcttgtg

SEQ ID NO: 717233 - DNA, 20 bp, mouse
gctgctgggataaactcatg

SEQ ID NO: 717234 - DNA, 20 bp, mouse
gggcttatgctttcccagga

SEQ ID NO: 717235 - DNA, 20 bp, mouse
gcaggtgtcatcatgataac

SEQ ID NO: 717236 - DNA, 20 bp, mouse
gtcagacgccagaagtgtaa

SEQ ID NO: 717237 - DNA, 20 bp, mouse
gcatagcatgaacactgaga

SEQ ID NO: 717238 - DNA, 20 bp, mouse
gaagatgagacgattgatga

SEQ ID NO: 717239 - DNA, 20 bp, mouse
gcgccagaagtgtaagggct

SEQ ID NO: 717240 - DNA, 20 bp, mouse
gcttctgctgtcgtcttcaa

SEQ ID NO: 717241 - DNA, 20 bp, mouse
gtcgcaaaagtagatgtgta

SEQ ID NO: 717242 - DNA, 20 bp, mouse
gaactacaaaaatagtagtt

SEQ ID NO: 717243 - DNA, 20 bp, mouse
gctgaggtgtaatggatgca

SEQ ID NO: 717244 - DNA, 20 bp, mouse
gtccctagcccttacacttc

SEQ ID NO: 717245 - DNA, 20 bp, mouse
gtgtgtatggtactattgat

SEQ ID NO: 717246 - DNA, 20 bp, mouse
gaacctctgtgtgtatgctt

SEQ ID NO: 717247 - DNA, 20 bp, mouse
gaaggtcaatgctaatgtac

SEQ ID NO: 717248 - DNA, 20 bp, mouse
gcctgttagctgattgagga

SEQ ID NO: 717249 - DNA, 20 bp, mouse
gcagaccacccctactatac

SEQ ID NO: 717250 - DNA, 20 bp, mouse
gtattcctgtatagtagggg

SEQ ID NO: 717251 - DNA, 20 bp, mouse
gactttaaccattaccaaac

SEQ ID NO: 717252 - DNA, 20 bp, mouse
gttttatgacgctattatat

SEQ ID NO: 717253 - DNA, 20 bp, mouse
gtttttttccggtttggtaa

SEQ ID NO: 717254 - DNA, 20 bp, mouse
gttctattcctgtatagtag

SEQ ID NO: 717255 - DNA, 20 bp, mouse
gatttctctacaatttattg

SEQ ID NO: 717256 - DNA, 20 bp, mouse
gggcaagggtccgtggtggg

SEQ ID NO: 717257 - DNA, 20 bp, mouse
gctgggcaagggtccgtggt

SEQ ID NO: 717258 - DNA, 20 bp, mouse
gttcttgggcccccccacca

SEQ ID NO: 717259 - DNA, 20 bp, mouse
gtgggcagtactggcttctt

SEQ ID NO: 717260 - DNA, 20 bp, mouse
gagagccttttatacaaaag

SEQ ID NO: 717261 - DNA, 20 bp, mouse
gctttccccttttgtataaa

SEQ ID NO: 717262 - DNA, 20 bp, mouse
gatcccgtgaaagtcagata

SEQ ID NO: 717263 - DNA, 20 bp, mouse
gggaactgggcaagggtccg

SEQ ID NO: 717264 - DNA, 20 bp, mouse
gggccctatctgactttcac

SEQ ID NO: 717265 - DNA, 20 bp, mouse
gtctgactttcacgggatta

SEQ ID NO: 717266 - DNA, 20 bp, mouse
gaatgatagatagggatgaa

SEQ ID NO: 717267 - DNA, 20 bp, mouse
ggtgtttagctttgggtgtt

SEQ ID NO: 717268 - DNA, 20 bp, mouse
ggatagatagggatgaaggg

SEQ ID NO: 717269 - DNA, 20 bp, mouse
gggtaggtaagtagatatgt

SEQ ID NO: 717270 - DNA, 20 bp, mouse
gtgtaggtaaatgatagata

SEQ ID NO: 717271 - DNA, 20 bp, mouse
gaggatagataggtataggt

SEQ ID NO: 717272 - DNA, 20 bp, mouse
ggtagaggatagataggtat

SEQ ID NO: 717273 - DNA, 20 bp, mouse
gtaggtagataggtaggtag

SEQ ID NO: 717274 - DNA, 20 bp, mouse
ggacaaacaggtagatagga

SEQ ID NO: 717275 - DNA, 20 bp, mouse
gcaaagctaaacacacacaa

SEQ ID NO: 717276 - DNA, 20 bp, mouse
gtactccatgaagaattaac

SEQ ID NO: 717277 - DNA, 20 bp, mouse
gagaacactagatgaagagt

SEQ ID NO: 717278 - DNA, 20 bp, mouse
gcatggtcaaataaagaatt

SEQ ID NO: 717279 - DNA, 20 bp, mouse
gatctccagttaattcttca

SEQ ID NO: 717280 - DNA, 20 bp, mouse
gaactgaccttgttttgtcg

SEQ ID NO: 717281 - DNA, 20 bp, mouse
gttcattccccgacaaaaca

SEQ ID NO: 717282 - DNA, 20 bp, mouse
gatacttgtcctcctacctc

SEQ ID NO: 717283 - DNA, 20 bp, mouse
gtgtgacactacaatacctg

SEQ ID NO: 717284 - DNA, 20 bp, mouse
gcaggagtattgagagttat

SEQ ID NO: 717285 - DNA, 20 bp, mouse
gcatgagatcctgaggtagg

SEQ ID NO: 717286 - DNA, 20 bp, mouse
gaatgaccatgtaccaaaag

SEQ ID NO: 717287 - DNA, 20 bp, mouse
ggttcccaatgaaaatgggt

SEQ ID NO: 717288 - DNA, 20 bp, mouse
gcctaataggaaaatgatgt

SEQ ID NO: 717289 - DNA, 20 bp, mouse
gttttcccacccattttcat

SEQ ID NO: 717290 - DNA, 20 bp, mouse
gccaggactgcaaacctaat

SEQ ID NO: 717291 - DNA, 20 bp, mouse
gtcaagttcccaatgaaaat

SEQ ID NO: 717292 - DNA, 20 bp, mouse
gataggaaaatgatgtgggc

SEQ ID NO: 717293 - DNA, 20 bp, mouse
gtcaatagatcttcagttat

SEQ ID NO: 717294 - DNA, 20 bp, mouse
gaagatcctcttttggtaca

SEQ ID NO: 717295 - DNA, 20 bp, mouse
gcttttaagtaggacagagg

SEQ ID NO: 717296 - DNA, 20 bp, mouse
gcggaggctccacccaggag

SEQ ID NO: 717297 - DNA, 20 bp, mouse
gctgggtggagcctccgaaa

SEQ ID NO: 717298 - DNA, 20 bp, mouse
gctagtatgccactcctggg

SEQ ID NO: 717299 - DNA, 20 bp, mouse
gaacacttctgtggcctgta

SEQ ID NO: 717300 - DNA, 20 bp, mouse
gcctcttgcctccatttcgg

SEQ ID NO: 717301 - DNA, 20 bp, mouse
gaagcataggctaggctatt

SEQ ID NO: 717302 - DNA, 20 bp, mouse
gcaggaatagaattcgaaga

SEQ ID NO: 717303 - DNA, 20 bp, mouse
gaagcctagtatgccactcc

SEQ ID NO: 717304 - DNA, 20 bp, mouse
gggtggagcctccgaaatgg

SEQ ID NO: 717305 - DNA, 20 bp, mouse
gcacacctcaagagatgcac

SEQ ID NO: 717306 - DNA, 20 bp, mouse
gcctcatatgctctatctag

SEQ ID NO: 717307 - DNA, 20 bp, mouse
gaagctcaggcctctacact

SEQ ID NO: 717308 - DNA, 20 bp, mouse
gccagatggaactcaggtta

SEQ ID NO: 717309 - DNA, 20 bp, mouse
ggccaggcttcccagtgtag

SEQ ID NO: 717310 - DNA, 20 bp, mouse
ggcctctacactgggaagcc

SEQ ID NO: 717311 - DNA, 20 bp, mouse
gtacacacaagcccaggccc

SEQ ID NO: 717312 - DNA, 20 bp, mouse
gcacacatacacacaagccc

SEQ ID NO: 717313 - DNA, 20 bp, mouse
gaacattccagatggaactc

SEQ ID NO: 717314 - DNA, 20 bp, mouse
gtctcttccatgtgcacaat

SEQ ID NO: 717315 - DNA, 20 bp, mouse
gctgtgtcccattgtgcaca

SEQ ID NO: 717316 - DNA, 20 bp, mouse
gtggggagccggcttcggga

SEQ ID NO: 717317 - DNA, 20 bp, mouse
gacgcggggacggtatccgt

SEQ ID NO: 717318 - DNA, 20 bp, mouse
ggggagaacaaatacaagtg

SEQ ID NO: 717319 - DNA, 20 bp, mouse
gcgcaggcgctcgagctcgc

SEQ ID NO: 717320 - DNA, 20 bp, mouse
ggcgggccccgtcccgaagc

SEQ ID NO: 717321 - DNA, 20 bp, mouse
gctcacgcctcgggccgcgc

SEQ ID NO: 717322 - DNA, 20 bp, mouse
ggctttggggagccggcttc

SEQ ID NO: 717323 - DNA, 20 bp, mouse
ggcgagccgggaaaagtttg

SEQ ID NO: 717324 - DNA, 20 bp, mouse
gaaaggctctcctcacgcct

SEQ ID NO: 717325 - DNA, 20 bp, mouse
ggataccgtccccgcgtcag

SEQ ID NO: 717326 - DNA, 20 bp, mouse
gcgccgagcaaacaaagcac

SEQ ID NO: 717327 - DNA, 20 bp, mouse
gttgctcggcggggggatgg

SEQ ID NO: 717328 - DNA, 20 bp, mouse
ggctttgtttgctcggcggg

SEQ ID NO: 717329 - DNA, 20 bp, mouse
gggtacaaaagttaaatttc

SEQ ID NO: 717330 - DNA, 20 bp, mouse
gtgtttgctcggcgggggga

SEQ ID NO: 717331 - DNA, 20 bp, mouse
gtcaacacttttggaaactt

SEQ ID NO: 717332 - DNA, 20 bp, mouse
gatcctacactcaacacttt

SEQ ID NO: 717333 - DNA, 20 bp, mouse
gtgacctcatagattgaatt

SEQ ID NO: 717334 - DNA, 20 bp, mouse
gctacccaattcaatctatg

SEQ ID NO: 717335 - DNA, 20 bp, mouse
gacaaagcacaggacctgat

SEQ ID NO: 717336 - DNA, 20 bp, mouse
gtcaccccagcaacggagtc

SEQ ID NO: 717337 - DNA, 20 bp, mouse
gtcggggtacaggctgagga

SEQ ID NO: 717338 - DNA, 20 bp, mouse
ggtgcctgactccgttgctg

SEQ ID NO: 717339 - DNA, 20 bp, mouse
gtgggtagggccaggaacga

SEQ ID NO: 717340 - DNA, 20 bp, mouse
ggggtgggacttgatgatgt

SEQ ID NO: 717341 - DNA, 20 bp, mouse
gtccgttgctggggtgagct

SEQ ID NO: 717342 - DNA, 20 bp, mouse
gttagacagctacatgggta

SEQ ID NO: 717343 - DNA, 20 bp, mouse
gtgtgcgttgctcacagggt

SEQ ID NO: 717344 - DNA, 20 bp, mouse
ggtaaatctgctcgtgaagt

SEQ ID NO: 717345 - DNA, 20 bp, mouse
gtcaggttagacagctacat

SEQ ID NO: 717346 - DNA, 20 bp, mouse
gaacaccgccagaccttcca

SEQ ID NO: 717347 - DNA, 20 bp, mouse
gtgtgccttggaaggtctgg

SEQ ID NO: 717348 - DNA, 20 bp, mouse
gaagaagctggactggaggg

SEQ ID NO: 717349 - DNA, 20 bp, mouse
ggctcaagaagctggactgg

SEQ ID NO: 717350 - DNA, 20 bp, mouse
gaaagctcaagaagctggac

SEQ ID NO: 717351 - DNA, 20 bp, mouse
gtcaggtcgaaagggagaag

SEQ ID NO: 717352 - DNA, 20 bp, mouse
gagaagctttgcaatttatg

SEQ ID NO: 717353 - DNA, 20 bp, mouse
gaaagggagaagaggcttgc

SEQ ID NO: 717354 - DNA, 20 bp, mouse
gtgctgtgccttggaaggtc

SEQ ID NO: 717355 - DNA, 20 bp, mouse
ggagctgtctcaggtcgaaa

SEQ ID NO: 717356 - DNA, 20 bp, mouse
ggcaatatcggggttgtggt

SEQ ID NO: 717357 - DNA, 20 bp, mouse
ggagggcaatatcggggttg

SEQ ID NO: 717358 - DNA, 20 bp, mouse
gaagaacagggacaagaaat

SEQ ID NO: 717359 - DNA, 20 bp, mouse
gtcggggttgtggtaggcag

SEQ ID NO: 717360 - DNA, 20 bp, mouse
gtgtaaccaacccttgacag

SEQ ID NO: 717361 - DNA, 20 bp, mouse
ggaggggagagaggtacaaa

SEQ ID NO: 717362 - DNA, 20 bp, mouse
gcaagtataaggtactgaaa

SEQ ID NO: 717363 - DNA, 20 bp, mouse
gtcagaaatgcacagcgaag

SEQ ID NO: 717364 - DNA, 20 bp, mouse
gtcaagaggtgcttgtggac

SEQ ID NO: 717365 - DNA, 20 bp, mouse
gttgacagagggcaatatcg

SEQ ID NO: 717366 - DNA, 20 bp, mouse
ggctaaactggttaactctt

SEQ ID NO: 717367 - DNA, 20 bp, mouse
gagtcagggaagatagggca

SEQ ID NO: 717368 - DNA, 20 bp, mouse
gcatagagtcagggaagata

SEQ ID NO: 717369 - DNA, 20 bp, mouse
gaattagcaagaagcctttc

SEQ ID NO: 717370 - DNA, 20 bp, mouse
gggtggggggattaagtaaa

SEQ ID NO: 717371 - DNA, 20 bp, mouse
gtaagtaaagggtgcatcat

SEQ ID NO: 717372 - DNA, 20 bp, mouse
gacttattattatgtggagt

SEQ ID NO: 717373 - DNA, 20 bp, mouse
gtagggggtttgtggaaact

SEQ ID NO: 717374 - DNA, 20 bp, mouse
gaactctttggggaccagag

SEQ ID NO: 717375 - DNA, 20 bp, mouse
gctttggggaccagagagga

SEQ ID NO: 717376 - DNA, 20 bp, mouse
gtcttgctcggctactagag

SEQ ID NO: 717377 - DNA, 20 bp, mouse
ggcggtcatcaagaagcatg

SEQ ID NO: 717378 - DNA, 20 bp, mouse
gtgcttcttgatgaccgcag

SEQ ID NO: 717379 - DNA, 20 bp, mouse
gttgatgaccgcaggggccg

SEQ ID NO: 717380 - DNA, 20 bp, mouse
gaaggtggccccggcccctg

SEQ ID NO: 717381 - DNA, 20 bp, mouse
gttctctggtgggattatta

SEQ ID NO: 717382 - DNA, 20 bp, mouse
gatcaggtgtaggaattctc

SEQ ID NO: 717383 - DNA, 20 bp, mouse
gactagttagagtcacccca

SEQ ID NO: 717384 - DNA, 20 bp, mouse
gagcaatctcaccaaaatca

SEQ ID NO: 717385 - DNA, 20 bp, mouse
gtcaagtactatattgaata

SEQ ID NO: 717386 - DNA, 20 bp, mouse
ggacatggacctcactgttc

SEQ ID NO: 717387 - DNA, 20 bp, mouse
gaactagtgtagaaggcact

SEQ ID NO: 717388 - DNA, 20 bp, mouse
ggccttaaaactagtgtaga

SEQ ID NO: 717389 - DNA, 20 bp, mouse
gtgctggtcagattgcctca

SEQ ID NO: 717390 - DNA, 20 bp, mouse
ggactctgagataagtgtct

SEQ ID NO: 717391 - DNA, 20 bp, mouse
ggccttctacactagtttta

SEQ ID NO: 717392 - DNA, 20 bp, mouse
ggagagacgtggtgaactca

SEQ ID NO: 717393 - DNA, 20 bp, mouse
gactgcgcaggacattttct

SEQ ID NO: 717394 - DNA, 20 bp, mouse
gcaggacattttctaggccc

SEQ ID NO: 717395 - DNA, 20 bp, mouse
gactccgggagcaagtctct

SEQ ID NO: 717396 - DNA, 20 bp, mouse
gctctgtagacaggcataga

SEQ ID NO: 717397 - DNA, 20 bp, mouse
gtgtgggaggggtacaggta

SEQ ID NO: 717398 - DNA, 20 bp, mouse
gaatgactaaggtatgtgtg

SEQ ID NO: 717399 - DNA, 20 bp, mouse
ggaaagacaaggcagacctc

SEQ ID NO: 717400 - DNA, 20 bp, mouse
gagacctcaggaaatgatga

SEQ ID NO: 717401 - DNA, 20 bp, mouse
gatgtgtgtgggaggggtac

SEQ ID NO: 717402 - DNA, 20 bp, mouse
gtatgtcatagtctgtgaga

SEQ ID NO: 717403 - DNA, 20 bp, mouse
gtaagtcttggtttatgctg

SEQ ID NO: 717404 - DNA, 20 bp, mouse
gtcttggtttatgctgtggt

SEQ ID NO: 717405 - DNA, 20 bp, mouse
gatgcctgtctacagagctc

SEQ ID NO: 717406 - DNA, 20 bp, mouse
gtgggtggcccagcaatact

SEQ ID NO: 717407 - DNA, 20 bp, mouse
gacactggcgctgagagctc

SEQ ID NO: 717408 - DNA, 20 bp, mouse
ggccggttaaccattgacca

SEQ ID NO: 717409 - DNA, 20 bp, mouse
gccacccaaagggccatcca

SEQ ID NO: 717410 - DNA, 20 bp, mouse
gttgcacaagggcctggcgg

SEQ ID NO: 717411 - DNA, 20 bp, mouse
gtgggtgtggccaatagctg

SEQ ID NO: 717412 - DNA, 20 bp, mouse
gatcacgctgctagaactca

SEQ ID NO: 717413 - DNA, 20 bp, mouse
gaccggccatggttgcacaa

SEQ ID NO: 717414 - DNA, 20 bp, mouse
gccaggcccttgtgcaacca

SEQ ID NO: 717415 - DNA, 20 bp, mouse
gctgctgtgttggatgtgaa

SEQ ID NO: 717416 - DNA, 20 bp, mouse
gtttttgttcatgtctacat

SEQ ID NO: 717417 - DNA, 20 bp, mouse
gggaagagttcctaagaact

SEQ ID NO: 717418 - DNA, 20 bp, mouse
gttttcctaaccaagttctt

SEQ ID NO: 717419 - DNA, 20 bp, mouse
gaactagttaaatagcgtta

SEQ ID NO: 717420 - DNA, 20 bp, mouse
gagttcctaagaacttggtt

SEQ ID NO: 717421 - DNA, 20 bp, mouse
gagaggacaaatgtcttgta

SEQ ID NO: 717422 - DNA, 20 bp, mouse
gtgattaagttcaaacttct

SEQ ID NO: 717423 - DNA, 20 bp, mouse
gttctatagcaggcaggcag

SEQ ID NO: 717424 - DNA, 20 bp, mouse
gggtattgtgtttctatagc

SEQ ID NO: 717425 - DNA, 20 bp, mouse
gttgtgtttctatagcaggc

SEQ ID NO: 717426 - DNA, 20 bp, mouse
gaaaatgtgcagttggttgg

SEQ ID NO: 717427 - DNA, 20 bp, mouse
gatcctcatgacccactact

SEQ ID NO: 717428 - DNA, 20 bp, mouse
gtacagctatctatcacata

SEQ ID NO: 717429 - DNA, 20 bp, mouse
gatcctagtagtgggtcatg

SEQ ID NO: 717430 - DNA, 20 bp, mouse
gtttggcttaaaagatgatt

SEQ ID NO: 717431 - DNA, 20 bp, mouse
gttgccctgtttgctgttta

SEQ ID NO: 717432 - DNA, 20 bp, mouse
gttttccctaaacagcaaac

SEQ ID NO: 717433 - DNA, 20 bp, mouse
gtcgtaaagatttgccacca

SEQ ID NO: 717434 - DNA, 20 bp, mouse
gaggatctaggaagagacca

SEQ ID NO: 717435 - DNA, 20 bp, mouse
gtctaggaagagaccaggga

SEQ ID NO: 717436 - DNA, 20 bp, mouse
gtggtcatacagacgtccga

SEQ ID NO: 717437 - DNA, 20 bp, mouse
gccgaagggagagaaagaac

SEQ ID NO: 717438 - DNA, 20 bp, mouse
gtgtacaacaactgtacaag

SEQ ID NO: 717439 - DNA, 20 bp, mouse
gtaagagcaatctctatagg

SEQ ID NO: 717440 - DNA, 20 bp, mouse
gggtgggtataatctttttg

SEQ ID NO: 717441 - DNA, 20 bp, mouse
gacaacaactgtacaagggg

SEQ ID NO: 717442 - DNA, 20 bp, mouse
gtagcattagcatgttattt

SEQ ID NO: 717443 - DNA, 20 bp, mouse
gtaaaaaagaattgaggtcc

SEQ ID NO: 717444 - DNA, 20 bp, mouse
gctcttaatgattttacaga

SEQ ID NO: 717445 - DNA, 20 bp, mouse
ggcagcataatgattttcat

SEQ ID NO: 717446 - DNA, 20 bp, mouse
gggggtgcatgcttaagtgt

SEQ ID NO: 717447 - DNA, 20 bp, mouse
gcctgagccagaagcccaga

SEQ ID NO: 717448 - DNA, 20 bp, mouse
gtctcctcagagactcacgt

SEQ ID NO: 717449 - DNA, 20 bp, mouse
gcttaagcatgcacccctct

SEQ ID NO: 717450 - DNA, 20 bp, mouse
gtggctcaggagcacgggct

SEQ ID NO: 717451 - DNA, 20 bp, mouse
ggctcccacgtgagtctctg

SEQ ID NO: 717452 - DNA, 20 bp, mouse
ggacagctgtggggcactct

SEQ ID NO: 717453 - DNA, 20 bp, mouse
gacgtcatccccccttgcgg

SEQ ID NO: 717454 - DNA, 20 bp, mouse
gggttctggagcagggactt

SEQ ID NO: 717455 - DNA, 20 bp, mouse
ggcggtgctgggaacttcac

SEQ ID NO: 717456 - DNA, 20 bp, mouse
ggaaacagcggatcagggtc

SEQ ID NO: 717457 - DNA, 20 bp, mouse
gggaagccattcagaacgat

SEQ ID NO: 717458 - DNA, 20 bp, mouse
ggaatacccatcgttctgaa

SEQ ID NO: 717459 - DNA, 20 bp, mouse
gtattcaatcagcaactcaa

SEQ ID NO: 717460 - DNA, 20 bp, mouse
gtggtccttcattcctatga

SEQ ID NO: 717461 - DNA, 20 bp, mouse
gggcgagcctgtttggatcc

SEQ ID NO: 717462 - DNA, 20 bp, mouse
gcactctaggcgagcctgtt

SEQ ID NO: 717463 - DNA, 20 bp, mouse
gtccagatcagcttgcatgg

SEQ ID NO: 717464 - DNA, 20 bp, mouse
ggtacttgaaacagcggatc

SEQ ID NO: 717465 - DNA, 20 bp, mouse
gctctgtgacacatgtgata

SEQ ID NO: 717466 - DNA, 20 bp, mouse
gcaagactcaggggtgtcgg

SEQ ID NO: 717467 - DNA, 20 bp, mouse
ggggaatgctcctgcctggt

SEQ ID NO: 717468 - DNA, 20 bp, mouse
gtactgaaaagcaagactca

SEQ ID NO: 717469 - DNA, 20 bp, mouse
gacggacagcttgccatggg

SEQ ID NO: 717470 - DNA, 20 bp, mouse
gactagaaacctaggctgtg

SEQ ID NO: 717471 - DNA, 20 bp, mouse
gtgaaagcagggcaggagtt

SEQ ID NO: 717472 - DNA, 20 bp, mouse
ggtgcggtcagagccaccca

SEQ ID NO: 717473 - DNA, 20 bp, mouse
gggctctgaccgcacagcct

SEQ ID NO: 717474 - DNA, 20 bp, mouse
gctggtgggtgaagtgtgac

SEQ ID NO: 717475 - DNA, 20 bp, mouse
gagaacggacagcttgccat

SEQ ID NO: 717476 - DNA, 20 bp, mouse
gtgagtggatgctggtcaaa

SEQ ID NO: 717477 - DNA, 20 bp, mouse
gatacacggtaaatgcttgt

SEQ ID NO: 717478 - DNA, 20 bp, mouse
ggggacacaaaggttcagtt

SEQ ID NO: 717479 - DNA, 20 bp, mouse
gcagggacggcgaggctgag

SEQ ID NO: 717480 - DNA, 20 bp, mouse
ggctggtcaaagggacacaa

SEQ ID NO: 717481 - DNA, 20 bp, mouse
gggcgaggctgagtggatgc

SEQ ID NO: 717482 - DNA, 20 bp, mouse
gacatgtagaacaaagagat

SEQ ID NO: 717483 - DNA, 20 bp, mouse
ggattggttctgtaaaggtg

SEQ ID NO: 717484 - DNA, 20 bp, mouse
gggatactgccgttaaaaaa

SEQ ID NO: 717485 - DNA, 20 bp, mouse
gccatgttgttaaacatgtc

SEQ ID NO: 717486 - DNA, 20 bp, mouse
ggactttggggcaataagta

SEQ ID NO: 717487 - DNA, 20 bp, mouse
gaggtgttagcgctgacttt

SEQ ID NO: 717488 - DNA, 20 bp, mouse
gcaaggtcacagagatataa

SEQ ID NO: 717489 - DNA, 20 bp, mouse
ggcaataagtagggcactca

SEQ ID NO: 717490 - DNA, 20 bp, mouse
gtacctacctcaatttcatt

SEQ ID NO: 717491 - DNA, 20 bp, mouse
gaacttgtgcacctacaaag

SEQ ID NO: 717492 - DNA, 20 bp, mouse
gttgtaggtgcacaagttgc

SEQ ID NO: 717493 - DNA, 20 bp, mouse
ggtctatcccaatgaaattg

SEQ ID NO: 717494 - DNA, 20 bp, mouse
ggagtggtgcatgtgcatct

SEQ ID NO: 717495 - DNA, 20 bp, mouse
gtgagaataaactcaagttt

SEQ ID NO: 717496 - DNA, 20 bp, mouse
gctcccagccgacacagtgt

SEQ ID NO: 717497 - DNA, 20 bp, mouse
gtgtaggtcacgggtgcaaa

SEQ ID NO: 717498 - DNA, 20 bp, mouse
gcgggtgcaaagggtcttca

SEQ ID NO: 717499 - DNA, 20 bp, mouse
gagtctggagacacgcgagg

SEQ ID NO: 717500 - DNA, 20 bp, mouse
gggtcttcaaggcaggactg

SEQ ID NO: 717501 - DNA, 20 bp, mouse
gtgcaaagggtcttcaaggc

SEQ ID NO: 717502 - DNA, 20 bp, mouse
gcctgtggtggacagcatct

SEQ ID NO: 717503 - DNA, 20 bp, mouse
gcttctcaacactgtaactg

SEQ ID NO: 717504 - DNA, 20 bp, mouse
ggaagggaggaaaggtaccg

SEQ ID NO: 717505 - DNA, 20 bp, mouse
gaggaaaggtaccgagggcc

SEQ ID NO: 717506 - DNA, 20 bp, mouse
gtcgagggagggtcctgtaa

SEQ ID NO: 717507 - DNA, 20 bp, mouse
ggcctgtgggtgggactcga

SEQ ID NO: 717508 - DNA, 20 bp, mouse
ggacagggcggggccagata

SEQ ID NO: 717509 - DNA, 20 bp, mouse
ggggtggggagtctatgggg

SEQ ID NO: 717510 - DNA, 20 bp, mouse
ggggccagacctgccaagag

SEQ ID NO: 717511 - DNA, 20 bp, mouse
gcagacctgccaagagaggt

SEQ ID NO: 717512 - DNA, 20 bp, mouse
gggcggggccagataggggg

SEQ ID NO: 717513 - DNA, 20 bp, mouse
ggacccaggaagaggatttc

SEQ ID NO: 717514 - DNA, 20 bp, mouse
gaaagtgctgtgggacaggg

SEQ ID NO: 717515 - DNA, 20 bp, mouse
gagaggatttcagggatcga

SEQ ID NO: 717516 - DNA, 20 bp, mouse
ggatccactctcaaagtctc

SEQ ID NO: 717517 - DNA, 20 bp, mouse
gtcacaggacatttagtttt

SEQ ID NO: 717518 - DNA, 20 bp, mouse
gttgtactcctcttcaccct

SEQ ID NO: 717519 - DNA, 20 bp, mouse
gtcagttgtcactagaaaat

SEQ ID NO: 717520 - DNA, 20 bp, mouse
ggcaccaaatacaagcagag

SEQ ID NO: 717521 - DNA, 20 bp, mouse
gaaacttcagggaattaatc

SEQ ID NO: 717522 - DNA, 20 bp, mouse
gtcaaggaaagatgatccca

SEQ ID NO: 717523 - DNA, 20 bp, mouse
gagatgatcccagggtgaag

SEQ ID NO: 717524 - DNA, 20 bp, mouse
gcactagaaaatgggttgtg

SEQ ID NO: 717525 - DNA, 20 bp, mouse
gcaattagactctatcaaca

SEQ ID NO: 717526 - DNA, 20 bp, mouse
gtagcaccatcttgttgctt

SEQ ID NO: 717527 - DNA, 20 bp, mouse
gctgtccgtgctttactgtg

SEQ ID NO: 717528 - DNA, 20 bp, mouse
ggggagatttcacttcattc

SEQ ID NO: 717529 - DNA, 20 bp, mouse
gactgtcagtataatcaacc

SEQ ID NO: 717530 - DNA, 20 bp, mouse
gctacaggcataaatgcaca

SEQ ID NO: 717531 - DNA, 20 bp, mouse
gtgaagtgaaatctcccatc

SEQ ID NO: 717532 - DNA, 20 bp, mouse
gtgaccaagttcagaaaagg

SEQ ID NO: 717533 - DNA, 20 bp, mouse
ggtattctgtgtaaatggaa

SEQ ID NO: 717534 - DNA, 20 bp, mouse
gctctctgaacagtataaca

SEQ ID NO: 717535 - DNA, 20 bp, mouse
gtgcttagaactttacctga

SEQ ID NO: 717536 - DNA, 20 bp, mouse
gtaaaagtgtattgatgcac

SEQ ID NO: 717537 - DNA, 20 bp, mouse
gatgatatgatgtctttctt

SEQ ID NO: 717538 - DNA, 20 bp, mouse
gcagtgctaaggcagttgaa

SEQ ID NO: 717539 - DNA, 20 bp, mouse
gtatatacccataaaagaga

SEQ ID NO: 717540 - DNA, 20 bp, mouse
gcaagagtcattgttaacaa

SEQ ID NO: 717541 - DNA, 20 bp, mouse
gttacatagaatctcttttg

SEQ ID NO: 717542 - DNA, 20 bp, mouse
gaatgactcttggctattat

SEQ ID NO: 717543 - DNA, 20 bp, mouse
gtttggggggggtaggtttt

SEQ ID NO: 717544 - DNA, 20 bp, mouse
gaattcagattctagagact

SEQ ID NO: 717545 - DNA, 20 bp, mouse
gactctgtggacatgggcca

SEQ ID NO: 717546 - DNA, 20 bp, mouse
gctgcaagaaaggattgatt

SEQ ID NO: 717547 - DNA, 20 bp, mouse
gtcaacgcacattaaacata

SEQ ID NO: 717548 - DNA, 20 bp, mouse
gtgaatgctgagatatgtgc

SEQ ID NO: 717549 - DNA, 20 bp, mouse
ggatatgtgctggtgaaagg

SEQ ID NO: 717550 - DNA, 20 bp, mouse
gtgagatatgtgctggtgaa

SEQ ID NO: 717551 - DNA, 20 bp, mouse
gaacaaaggaagagatcaaa

SEQ ID NO: 717552 - DNA, 20 bp, mouse
gagattctgagctgcaagaa

SEQ ID NO: 717553 - DNA, 20 bp, mouse
gaggaaggagagggtcacct

SEQ ID NO: 717554 - DNA, 20 bp, mouse
gtgcatctgtccatgaacaa

SEQ ID NO: 717555 - DNA, 20 bp, mouse
gcccttcaacatagacacaa

SEQ ID NO: 717556 - DNA, 20 bp, mouse
gagaagggaggctgagtaaa

SEQ ID NO: 717557 - DNA, 20 bp, mouse
gttgatttatcagagaaggg

SEQ ID NO: 717558 - DNA, 20 bp, mouse
gaaagaaggcaactcagtat

SEQ ID NO: 717559 - DNA, 20 bp, mouse
gtagagtgaacactgttttt

SEQ ID NO: 717560 - DNA, 20 bp, mouse
gggactgagccagtcgatgg

SEQ ID NO: 717561 - DNA, 20 bp, mouse
ggctagcacttctcttttga

SEQ ID NO: 717562 - DNA, 20 bp, mouse
gggagttgatttatcagaga

SEQ ID NO: 717563 - DNA, 20 bp, mouse
gagagaagtgctagcctccc

SEQ ID NO: 717564 - DNA, 20 bp, mouse
ggttacaatgaaactagaaa

SEQ ID NO: 717565 - DNA, 20 bp, mouse
ggtaaagggactgtgacaag

SEQ ID NO: 717566 - DNA, 20 bp, mouse
gagagaagcacagttataag

SEQ ID NO: 717567 - DNA, 20 bp, mouse
gaaggtgatattgtttgcct

SEQ ID NO: 717568 - DNA, 20 bp, mouse
gttctgttggctcattttat

SEQ ID NO: 717569 - DNA, 20 bp, mouse
gacgagatgtgttcttcaaa

SEQ ID NO: 717570 - DNA, 20 bp, mouse
gcaagtcacaaattagataa

SEQ ID NO: 717571 - DNA, 20 bp, mouse
gggtggaagtgcccatccca

SEQ ID NO: 717572 - DNA, 20 bp, mouse
gaaaacaaaaacaaaatcat

SEQ ID NO: 717573 - DNA, 20 bp, mouse
gtacaagttctttgaaacaa

SEQ ID NO: 717574 - DNA, 20 bp, mouse
gcaccttgaagaccatggga

SEQ ID NO: 717575 - DNA, 20 bp, mouse
ggtcacaaattagataaggg

SEQ ID NO: 717576 - DNA, 20 bp, mouse
gaaggggcctcaggcatagc

SEQ ID NO: 717577 - DNA, 20 bp, mouse
gtctcactctggaaccgtgc

SEQ ID NO: 717578 - DNA, 20 bp, mouse
gggttccagagtgagaaaag

SEQ ID NO: 717579 - DNA, 20 bp, mouse
gtagctggatcccggagctc

SEQ ID NO: 717580 - DNA, 20 bp, mouse
gtttagagtctgactcacgt

SEQ ID NO: 717581 - DNA, 20 bp, mouse
gccccattggatggcaaaga

SEQ ID NO: 717582 - DNA, 20 bp, mouse
gtgatatgttgcctgagctc

SEQ ID NO: 717583 - DNA, 20 bp, mouse
gcaaagaaggtctttagcaa

SEQ ID NO: 717584 - DNA, 20 bp, mouse
gaccttctttgccatccaat

SEQ ID NO: 717585 - DNA, 20 bp, mouse
gttagacatacgctccccat

SEQ ID NO: 717586 - DNA, 20 bp, mouse
gaaagtacggagagcctaaa

SEQ ID NO: 717587 - DNA, 20 bp, mouse
ggagggggttccttcacgag

SEQ ID NO: 717588 - DNA, 20 bp, mouse
gagactgctatacaggaagt

SEQ ID NO: 717589 - DNA, 20 bp, mouse
gtatgtccgtggttacccaa

SEQ ID NO: 717590 - DNA, 20 bp, mouse
gagggtaggggccttgttaa

SEQ ID NO: 717591 - DNA, 20 bp, mouse
gtgtatagcagtctccttga

SEQ ID NO: 717592 - DNA, 20 bp, mouse
gccttgttgagtctccttca

SEQ ID NO: 717593 - DNA, 20 bp, mouse
gtgggctgttgaaaactaca

SEQ ID NO: 717594 - DNA, 20 bp, mouse
gccctctgatttgataaaat

SEQ ID NO: 717595 - DNA, 20 bp, mouse
gaaatagtttggattcgagc

SEQ ID NO: 717596 - DNA, 20 bp, mouse
gtgaaccgggccaatcaggc

SEQ ID NO: 717597 - DNA, 20 bp, mouse
gggagtgaaccgggccaatc

SEQ ID NO: 717598 - DNA, 20 bp, mouse
gtcccggccgggcgctgaca

SEQ ID NO: 717599 - DNA, 20 bp, mouse
gcggccgggcgctgacaggg

SEQ ID NO: 717600 - DNA, 20 bp, mouse
gggctggtggggtcgcgctg

SEQ ID NO: 717601 - DNA, 20 bp, mouse
gcgaaggagggaggcgagca

SEQ ID NO: 717602 - DNA, 20 bp, mouse
gggcgtggggaggacacccg

SEQ ID NO: 717603 - DNA, 20 bp, mouse
gcgccacgcacccgcctgat

SEQ ID NO: 717604 - DNA, 20 bp, mouse
gaggcgggtgcgtggcgcgc

SEQ ID NO: 717605 - DNA, 20 bp, mouse
gcgcgcgtgtcagtgtaaga

SEQ ID NO: 717606 - DNA, 20 bp, mouse
gtatgtagtggtattcccat

SEQ ID NO: 717607 - DNA, 20 bp, mouse
gaggggttaacagatagatc

SEQ ID NO: 717608 - DNA, 20 bp, mouse
gaaacaaaaaccagttcaga

SEQ ID NO: 717609 - DNA, 20 bp, mouse
ggggaataccactacataca

SEQ ID NO: 717610 - DNA, 20 bp, mouse
gcctgcctgcccgcccagga

SEQ ID NO: 717611 - DNA, 20 bp, mouse
gctatctgttaacccctcct

SEQ ID NO: 717612 - DNA, 20 bp, mouse
gcaatacagtctgaccccat

SEQ ID NO: 717613 - DNA, 20 bp, mouse
gaggctctaggagtagaacc

SEQ ID NO: 717614 - DNA, 20 bp, mouse
gtgattgtgaactgttatat

SEQ ID NO: 717615 - DNA, 20 bp, mouse
ggaactgttatataggctct

SEQ ID NO: 717616 - DNA, 20 bp, mouse
gaagcattccggattccggc

SEQ ID NO: 717617 - DNA, 20 bp, mouse
gctcgaagccagccggaatc

SEQ ID NO: 717618 - DNA, 20 bp, mouse
gtgtggacggtggctggaaa

SEQ ID NO: 717619 - DNA, 20 bp, mouse
gcagtaggctcgaagccagc

SEQ ID NO: 717620 - DNA, 20 bp, mouse
ggttatacgtatgcagggcg

SEQ ID NO: 717621 - DNA, 20 bp, mouse
gagtagatgcaaaccatata

SEQ ID NO: 717622 - DNA, 20 bp, mouse
gtagttagttatacgtatgc

SEQ ID NO: 717623 - DNA, 20 bp, mouse
gtagttaacacagttctaga

SEQ ID NO: 717624 - DNA, 20 bp, mouse
gctctgatgtctcgcagacc

SEQ ID NO: 717625 - DNA, 20 bp, mouse
gtataattatcttcatgttc

SEQ ID NO: 717626 - DNA, 20 bp, mouse
gtctcctgccactattatgt

SEQ ID NO: 717627 - DNA, 20 bp, mouse
gctcctgcatggcccagtgg

SEQ ID NO: 717628 - DNA, 20 bp, mouse
gaagtcagtcatagagagtc

SEQ ID NO: 717629 - DNA, 20 bp, mouse
ggttctcctgcatggcccag

SEQ ID NO: 717630 - DNA, 20 bp, mouse
gtcacttgccgagattgtct

SEQ ID NO: 717631 - DNA, 20 bp, mouse
ggggctccgaatttggactc

SEQ ID NO: 717632 - DNA, 20 bp, mouse
gttgatgacccacataatag

SEQ ID NO: 717633 - DNA, 20 bp, mouse
gagactgggggctccgaatt

SEQ ID NO: 717634 - DNA, 20 bp, mouse
gtgacccacataatagtggc

SEQ ID NO: 717635 - DNA, 20 bp, mouse
gagtctgaactgctatgttt

SEQ ID NO: 717636 - DNA, 20 bp, mouse
ggtataggcaatgagttcta

SEQ ID NO: 717637 - DNA, 20 bp, mouse
gtttttttggtaaggaatac

SEQ ID NO: 717638 - DNA, 20 bp, mouse
gtctgtgtcaggaaacaagt

SEQ ID NO: 717639 - DNA, 20 bp, mouse
gaagactttctccaactcaa

SEQ ID NO: 717640 - DNA, 20 bp, mouse
gtacagcactgaggatacag

SEQ ID NO: 717641 - DNA, 20 bp, mouse
gtctctttatgtgtattcat

SEQ ID NO: 717642 - DNA, 20 bp, mouse
gatttcttcaccctttgagt

SEQ ID NO: 717643 - DNA, 20 bp, mouse
gcttgatgccagcttggtat

SEQ ID NO: 717644 - DNA, 20 bp, mouse
gcattataaacttctgtgtc

SEQ ID NO: 717645 - DNA, 20 bp, mouse
gctcattgcctataccaagc

SEQ ID NO: 717646 - DNA, 20 bp, mouse
ggtgacctgtgggactactt

SEQ ID NO: 717647 - DNA, 20 bp, mouse
ggataacagaatagactctg

SEQ ID NO: 717648 - DNA, 20 bp, mouse
ggtctattctgttatcaacg

SEQ ID NO: 717649 - DNA, 20 bp, mouse
gttctgttatcaacgtggct

SEQ ID NO: 717650 - DNA, 20 bp, mouse
gtgttatcaacgtggctggg

SEQ ID NO: 717651 - DNA, 20 bp, mouse
gcagagcagggagctacttt

SEQ ID NO: 717652 - DNA, 20 bp, mouse
gctgaagaggaagttgagag

SEQ ID NO: 717653 - DNA, 20 bp, mouse
gagagtgaggacagccacta

SEQ ID NO: 717654 - DNA, 20 bp, mouse
gtcacagagaacctctgtga

SEQ ID NO: 717655 - DNA, 20 bp, mouse
gagctccaaagtagtcccac

SEQ ID NO: 717656 - DNA, 20 bp, mouse
gtctactggaaggctatcta

SEQ ID NO: 717657 - DNA, 20 bp, mouse
gggccttacttgcaaggtga

SEQ ID NO: 717658 - DNA, 20 bp, mouse
gttgcaaggtgagggcaaat

SEQ ID NO: 717659 - DNA, 20 bp, mouse
gtgccctcaccttgcaagta

SEQ ID NO: 717660 - DNA, 20 bp, mouse
gaagacatatacgttcaatc

SEQ ID NO: 717661 - DNA, 20 bp, mouse
gataaatggccttacttgca

SEQ ID NO: 717662 - DNA, 20 bp, mouse
gggatataccttctactgga

SEQ ID NO: 717663 - DNA, 20 bp, mouse
gggacagaatcatgtaattc

SEQ ID NO: 717664 - DNA, 20 bp, mouse
gctgaagaattccaatgtca

SEQ ID NO: 717665 - DNA, 20 bp, mouse
gtgtccatctaatccaagta

SEQ ID NO: 717666 - DNA, 20 bp, mouse
gggaagacaaggtgctgtcg

SEQ ID NO: 717667 - DNA, 20 bp, mouse
gcacacccttaaggattgtt

SEQ ID NO: 717668 - DNA, 20 bp, mouse
gatgggaagccacaccctta

SEQ ID NO: 717669 - DNA, 20 bp, mouse
gagggactccaggcagtatc

SEQ ID NO: 717670 - DNA, 20 bp, mouse
gggtaggctgggggaaagta

SEQ ID NO: 717671 - DNA, 20 bp, mouse
gcttatagctgacacattca

SEQ ID NO: 717672 - DNA, 20 bp, mouse
gtgccctaggaaaggtttga

SEQ ID NO: 717673 - DNA, 20 bp, mouse
gtggtgctctctgctgggtt

SEQ ID NO: 717674 - DNA, 20 bp, mouse
gggttaccaaacaatcctta

SEQ ID NO: 717675 - DNA, 20 bp, mouse
gatacctactacagcataat

SEQ ID NO: 717676 - DNA, 20 bp, mouse
ggactgaggggtcaggaaaa

SEQ ID NO: 717677 - DNA, 20 bp, mouse
ggatgccaaaggctctcagt

SEQ ID NO: 717678 - DNA, 20 bp, mouse
gaattagggactgaggggtc

SEQ ID NO: 717679 - DNA, 20 bp, mouse
gaacaacaatatctagaatt

SEQ ID NO: 717680 - DNA, 20 bp, mouse
gacaggctaagtacaggtca

SEQ ID NO: 717681 - DNA, 20 bp, mouse
gtatctagaattagggactg

SEQ ID NO: 717682 - DNA, 20 bp, mouse
gagagtctagaatcactcac

SEQ ID NO: 717683 - DNA, 20 bp, mouse
gacttcttactcagctttaa

SEQ ID NO: 717684 - DNA, 20 bp, mouse
gcctctacatgtatctggaa

SEQ ID NO: 717685 - DNA, 20 bp, mouse
gagcctgttctgcactggca

SEQ ID NO: 717686 - DNA, 20 bp, mouse
gaccaccagagccaccaaaa

SEQ ID NO: 717687 - DNA, 20 bp, mouse
gagggtggacccggcaacag

SEQ ID NO: 717688 - DNA, 20 bp, mouse
ggttgccgggtccaccctcg

SEQ ID NO: 717689 - DNA, 20 bp, mouse
gagcgggtctcccacccttt

SEQ ID NO: 717690 - DNA, 20 bp, mouse
gcagtcattgtgatccacga

SEQ ID NO: 717691 - DNA, 20 bp, mouse
gaccagagccaccaaaaggg

SEQ ID NO: 717692 - DNA, 20 bp, mouse
gaatcgtggtgataggacat

SEQ ID NO: 717693 - DNA, 20 bp, mouse
gtcacctgactaagagcctt

SEQ ID NO: 717694 - DNA, 20 bp, mouse
ggaaataggctgtcactaag

SEQ ID NO: 717695 - DNA, 20 bp, mouse
ggagtgctcaggtgctgtag

SEQ ID NO: 717696 - DNA, 20 bp, mouse
gaaaaatagcaggtgccagt

SEQ ID NO: 717697 - DNA, 20 bp, mouse
gggtcgctggagggcatcta

SEQ ID NO: 717698 - DNA, 20 bp, mouse
ggggccagcagttgtttgtg

SEQ ID NO: 717699 - DNA, 20 bp, mouse
gtcaaatgcaacatcttgtc

SEQ ID NO: 717700 - DNA, 20 bp, mouse
gctggctgcctccaggtcgc

SEQ ID NO: 717701 - DNA, 20 bp, mouse
gccactggaatacaagcaag

SEQ ID NO: 717702 - DNA, 20 bp, mouse
gtgcccacacaaacaactgc

SEQ ID NO: 717703 - DNA, 20 bp, mouse
gtttttaaagtatcactcta

SEQ ID NO: 717704 - DNA, 20 bp, mouse
gagcaggtgccagtgggaag

SEQ ID NO: 717705 - DNA, 20 bp, mouse
ggtgggaaggggcagtggct

SEQ ID NO: 717706 - DNA, 20 bp, mouse
ggacccgggagcacgacgca

SEQ ID NO: 717707 - DNA, 20 bp, mouse
gcgtcgtgctcccgggtcct

SEQ ID NO: 717708 - DNA, 20 bp, mouse
gctggcgctctcttgttctg

SEQ ID NO: 717709 - DNA, 20 bp, mouse
gagagcgccagacttgcctg

SEQ ID NO: 717710 - DNA, 20 bp, mouse
gcgggagcacgacgcaagga

SEQ ID NO: 717711 - DNA, 20 bp, mouse
gtgcacagaactgatgcaga

SEQ ID NO: 717712 - DNA, 20 bp, mouse
gctgaggaggagtgtgtgaa

SEQ ID NO: 717713 - DNA, 20 bp, mouse
gaaccactactcccaggacc

SEQ ID NO: 717714 - DNA, 20 bp, mouse
gaggccaaatgaaataaatg

SEQ ID NO: 717715 - DNA, 20 bp, mouse
gaggaaggttttgagttaag

SEQ ID NO: 717716 - DNA, 20 bp, mouse
gcgggtgcggggtgggagca

SEQ ID NO: 717717 - DNA, 20 bp, mouse
gtagcggcgggcaacccgtt

SEQ ID NO: 717718 - DNA, 20 bp, mouse
gagggcgcggagtccccgcc

SEQ ID NO: 717719 - DNA, 20 bp, mouse
ggagtccccgcccggcgggg

SEQ ID NO: 717720 - DNA, 20 bp, mouse
gcggcgggcaacccgtttgg

SEQ ID NO: 717721 - DNA, 20 bp, mouse
ggcgcggagtccccgcccgg

SEQ ID NO: 717722 - DNA, 20 bp, mouse
gcacatagccctccttgccc

SEQ ID NO: 717723 - DNA, 20 bp, mouse
gggcgtccggtacagcggct

SEQ ID NO: 717724 - DNA, 20 bp, mouse
ggtctgccttccggaggtgc

SEQ ID NO: 717725 - DNA, 20 bp, mouse
ggggaaccgcagctcatgag

SEQ ID NO: 717726 - DNA, 20 bp, mouse
gcaagagctactatacgctt

SEQ ID NO: 717727 - DNA, 20 bp, mouse
ggcaacaggaggatagaaag

SEQ ID NO: 717728 - DNA, 20 bp, mouse
gggatagaaagaggggggtt

SEQ ID NO: 717729 - DNA, 20 bp, mouse
gattggcctgtaagcaggaa

SEQ ID NO: 717730 - DNA, 20 bp, mouse
gcaggaggatagaaagaggg

SEQ ID NO: 717731 - DNA, 20 bp, mouse
ggggttgcttagggagcaac

SEQ ID NO: 717732 - DNA, 20 bp, mouse
ggctactatacgcttaggat

SEQ ID NO: 717733 - DNA, 20 bp, mouse
gccaatataggggaatgcat

SEQ ID NO: 717734 - DNA, 20 bp, mouse
gaagcaggaatgggttgctt

SEQ ID NO: 717735 - DNA, 20 bp, mouse
gagaaagaggggggtttgga

SEQ ID NO: 717736 - DNA, 20 bp, mouse
gcacacatactaaatacaga

SEQ ID NO: 717737 - DNA, 20 bp, mouse
gataaccataaacaataaga

SEQ ID NO: 717738 - DNA, 20 bp, mouse
gttttaatcataagacagtg

SEQ ID NO: 717739 - DNA, 20 bp, mouse
gtttaccttcttattgttta

SEQ ID NO: 717740 - DNA, 20 bp, mouse
gacctaaaataaacaaagaa

SEQ ID NO: 717741 - DNA, 20 bp, mouse
gttttcataatttttattct

SEQ ID NO: 717742 - DNA, 20 bp, mouse
gggttttgttgtggacaacg

SEQ ID NO: 717743 - DNA, 20 bp, mouse
gaaaataatgaaaaagatgt

SEQ ID NO: 717744 - DNA, 20 bp, mouse
gtagtttggggttggttttg

SEQ ID NO: 717745 - DNA, 20 bp, mouse
gttggggttggttttgtggt

SEQ ID NO: 717746 - DNA, 20 bp, mouse
gagcccacactcctcctaca

SEQ ID NO: 717747 - DNA, 20 bp, mouse
gtggtctagttagagaagag

SEQ ID NO: 717748 - DNA, 20 bp, mouse
ggcatttccttagcttccta

SEQ ID NO: 717749 - DNA, 20 bp, mouse
gggccctgtaggaggagtgt

SEQ ID NO: 717750 - DNA, 20 bp, mouse
gtcacgtggggaaatgagaa

SEQ ID NO: 717751 - DNA, 20 bp, mouse
gatgggtgggcaggacagta

SEQ ID NO: 717752 - DNA, 20 bp, mouse
gggaagaccctaggaagcta

SEQ ID NO: 717753 - DNA, 20 bp, mouse
gggacagtatggaagaccct

SEQ ID NO: 717754 - DNA, 20 bp, mouse
gggtgggggaagggcttaaa

SEQ ID NO: 717755 - DNA, 20 bp, mouse
gacggggctagactaggtag

SEQ ID NO: 717756 - DNA, 20 bp, mouse
ggtgtcagcaccaagtgcta

SEQ ID NO: 717757 - DNA, 20 bp, mouse
gagaacttgttgtgttctcc

SEQ ID NO: 717758 - DNA, 20 bp, mouse
gagtttctcaagtacaatga

SEQ ID NO: 717759 - DNA, 20 bp, mouse
gcacaccgtaaagctctcat

SEQ ID NO: 717760 - DNA, 20 bp, mouse
gtgaacaaaacctagtagaa

SEQ ID NO: 717761 - DNA, 20 bp, mouse
ggccaaggcttgaaatttga

SEQ ID NO: 717762 - DNA, 20 bp, mouse
ggtgtgtgcaggaacgcaaa

SEQ ID NO: 717763 - DNA, 20 bp, mouse
gaactcctatgagagcttta

SEQ ID NO: 717764 - DNA, 20 bp, mouse
gtctgataggatataaattc

SEQ ID NO: 717765 - DNA, 20 bp, mouse
gagaaggcttttaaatgcca

SEQ ID NO: 717766 - DNA, 20 bp, mouse
gaataaggaagcacacaatt

SEQ ID NO: 717767 - DNA, 20 bp, mouse
ggaagcacacaattgggctg

SEQ ID NO: 717768 - DNA, 20 bp, mouse
ggatacctggtcggtgaata

SEQ ID NO: 717769 - DNA, 20 bp, mouse
ggcacacaattgggctgggg

SEQ ID NO: 717770 - DNA, 20 bp, mouse
ggcttccttattcaccgacc

SEQ ID NO: 717771 - DNA, 20 bp, mouse
gtcctgactcccaagttcaa

SEQ ID NO: 717772 - DNA, 20 bp, mouse
ggcatggagcccttgaactt

SEQ ID NO: 717773 - DNA, 20 bp, mouse
gagatgcagtactgacaggc

SEQ ID NO: 717774 - DNA, 20 bp, mouse
ggggcatctgtttccattac

SEQ ID NO: 717775 - DNA, 20 bp, mouse
gagtgagatgcagtactgac

SEQ ID NO: 717776 - DNA, 20 bp, mouse
ggacccccgcctagcacagc

SEQ ID NO: 717777 - DNA, 20 bp, mouse
gctgggagagcccaagtagc

SEQ ID NO: 717778 - DNA, 20 bp, mouse
gaggcgggggtcggctggga

SEQ ID NO: 717779 - DNA, 20 bp, mouse
gcgggaccccaggcggtcac

SEQ ID NO: 717780 - DNA, 20 bp, mouse
gagccggctgtgctaggcgg

SEQ ID NO: 717781 - DNA, 20 bp, mouse
gagggaccggtgaccgcctg

SEQ ID NO: 717782 - DNA, 20 bp, mouse
gccggcagagcgcagtgagt

SEQ ID NO: 717783 - DNA, 20 bp, mouse
gtctcccggcccagctctgc

SEQ ID NO: 717784 - DNA, 20 bp, mouse
gctagcacagccggctactt

SEQ ID NO: 717785 - DNA, 20 bp, mouse
gcaggggcggccccttccgg

SEQ ID NO: 717786 - DNA, 20 bp, mouse
ggcttccaggcccctgctgc

SEQ ID NO: 717787 - DNA, 20 bp, mouse
ggcaaagtggttccagtacc

SEQ ID NO: 717788 - DNA, 20 bp, mouse
gaacccagcccacatgagaa

SEQ ID NO: 717789 - DNA, 20 bp, mouse
gtggaatggacgcctggtac

SEQ ID NO: 717790 - DNA, 20 bp, mouse
ggacatgaacgcctccctta

SEQ ID NO: 717791 - DNA, 20 bp, mouse
gctgggcacccttctcatgt

SEQ ID NO: 717792 - DNA, 20 bp, mouse
gtagctctggaatggacgcc

SEQ ID NO: 717793 - DNA, 20 bp, mouse
gtctggaaaagggttggtcc

SEQ ID NO: 717794 - DNA, 20 bp, mouse
gtcaatgccaatagctttca

SEQ ID NO: 717795 - DNA, 20 bp, mouse
gattggcattgattccagga

SEQ ID NO: 717796 - DNA, 20 bp, mouse
gcggttgccagaaataatat

SEQ ID NO: 717797 - DNA, 20 bp, mouse
gtatacgtcgagatctatca

SEQ ID NO: 717798 - DNA, 20 bp, mouse
gtctgcatagtctttgtgag

SEQ ID NO: 717799 - DNA, 20 bp, mouse
ggaaatgctgacaagtttgg

SEQ ID NO: 717800 - DNA, 20 bp, mouse
gtttgtgagaggactagctg

SEQ ID NO: 717801 - DNA, 20 bp, mouse
gtcagcatttctgtgcatgg

SEQ ID NO: 717802 - DNA, 20 bp, mouse
ggggaaatagaatttcgtgt

SEQ ID NO: 717803 - DNA, 20 bp, mouse
gcaagtaaacatcgctctga

SEQ ID NO: 717804 - DNA, 20 bp, mouse
gacagaaatgctgacaagtt

SEQ ID NO: 717805 - DNA, 20 bp, mouse
gttacttggctttactttgc

SEQ ID NO: 717806 - DNA, 20 bp, mouse
gttgttctgtctagaatctg

SEQ ID NO: 717807 - DNA, 20 bp, mouse
gtatggaacacagtaattga

SEQ ID NO: 717808 - DNA, 20 bp, mouse
ggtcagggtgttaggcacgc

SEQ ID NO: 717809 - DNA, 20 bp, mouse
ggatatgcccaccctgctta

SEQ ID NO: 717810 - DNA, 20 bp, mouse
gttactgtgttccataagca

SEQ ID NO: 717811 - DNA, 20 bp, mouse
gtgtgttccataagcagggt

SEQ ID NO: 717812 - DNA, 20 bp, mouse
ggacttgtataggttttata

SEQ ID NO: 717813 - DNA, 20 bp, mouse
gatctgtggggagggcgggg

SEQ ID NO: 717814 - DNA, 20 bp, mouse
gtgtctagaatctgtgggga

SEQ ID NO: 717815 - DNA, 20 bp, mouse
gagtcaatgcagaaacgttt

SEQ ID NO: 717816 - DNA, 20 bp, mouse
ggcattccaaatacaagatt

SEQ ID NO: 717817 - DNA, 20 bp, mouse
ggacaacctaatcttgtatt

SEQ ID NO: 717818 - DNA, 20 bp, mouse
gcacttggttctcaagaccc

SEQ ID NO: 717819 - DNA, 20 bp, mouse
gtctcaagacccaggtcaga

SEQ ID NO: 717820 - DNA, 20 bp, mouse
gctggacttagggcagttgt

SEQ ID NO: 717821 - DNA, 20 bp, mouse
ggttgtgggccatctgacct

SEQ ID NO: 717822 - DNA, 20 bp, mouse
gacaaactatgacatagatc

SEQ ID NO: 717823 - DNA, 20 bp, mouse
ggacagtaagagctgctcac

SEQ ID NO: 717824 - DNA, 20 bp, mouse
gagaacaaaacaagggatca

SEQ ID NO: 717825 - DNA, 20 bp, mouse
gtactttctcattgcaaggt

SEQ ID NO: 717826 - DNA, 20 bp, mouse
ggatatgcccaccctgctta

SEQ ID NO: 717827 - DNA, 20 bp, mouse
gtatggaacagtgtaattga

SEQ ID NO: 717828 - DNA, 20 bp, mouse
gttacactgttccataagca

SEQ ID NO: 717829 - DNA, 20 bp, mouse
gactgttccataagcagggt

SEQ ID NO: 717830 - DNA, 20 bp, mouse
gtttaacctagtgttctgtc

SEQ ID NO: 717831 - DNA, 20 bp, mouse
ggactctgtggggagggcgg

SEQ ID NO: 717832 - DNA, 20 bp, mouse
gggggggtgaggggaaggtg

SEQ ID NO: 717833 - DNA, 20 bp, mouse
gttgggaagctcagtcaggc

SEQ ID NO: 717834 - DNA, 20 bp, mouse
gtgttctgtctggactctgt

SEQ ID NO: 717835 - DNA, 20 bp, mouse
gtgaaagggtaagcttatca

SEQ ID NO: 717836 - DNA, 20 bp, mouse
ggaacccagtgcctccgagg

SEQ ID NO: 717837 - DNA, 20 bp, mouse
ggggttcagtaagcgaagga

SEQ ID NO: 717838 - DNA, 20 bp, mouse
gtctccatgcagggccatct

SEQ ID NO: 717839 - DNA, 20 bp, mouse
gactgaacccagtgcctccg

SEQ ID NO: 717840 - DNA, 20 bp, mouse
gaacagagcccggaggagag

SEQ ID NO: 717841 - DNA, 20 bp, mouse
gcactgggttcagtaagcga

SEQ ID NO: 717842 - DNA, 20 bp, mouse
gtgggctgaacagagcccgg

SEQ ID NO: 717843 - DNA, 20 bp, mouse
gacaacagcaaaatctaacc

SEQ ID NO: 717844 - DNA, 20 bp, mouse
gagagcgggaaatctaaacc

SEQ ID NO: 717845 - DNA, 20 bp, mouse
gaaactacttaagcatagat

SEQ ID NO: 717846 - DNA, 20 bp, mouse
gtggtcattggggcagtaga

SEQ ID NO: 717847 - DNA, 20 bp, mouse
gtagcaggacgaagggtcac

SEQ ID NO: 717848 - DNA, 20 bp, mouse
ggtgtccaggcacaacccac

SEQ ID NO: 717849 - DNA, 20 bp, mouse
gaaagccagtgggttgtgcc

SEQ ID NO: 717850 - DNA, 20 bp, mouse
ggatgtctgatcttggtcat

SEQ ID NO: 717851 - DNA, 20 bp, mouse
ggtggacctagcaggacgaa

SEQ ID NO: 717852 - DNA, 20 bp, mouse
ggggtcactgggcaacactg

SEQ ID NO: 717853 - DNA, 20 bp, mouse
gcattggggcagtagagggc

SEQ ID NO: 717854 - DNA, 20 bp, mouse
gaaaccatgaaattgatcaa

SEQ ID NO: 717855 - DNA, 20 bp, mouse
gctgctaggtccactgccga

SEQ ID NO: 717856 - DNA, 20 bp, mouse
gagacccttcagggtcctca

SEQ ID NO: 717857 - DNA, 20 bp, mouse
gaagtgatgtaataaagcac

SEQ ID NO: 717858 - DNA, 20 bp, mouse
gtgttttttctaaatgaagg

SEQ ID NO: 717859 - DNA, 20 bp, mouse
gtttctaaatgaagggggct

SEQ ID NO: 717860 - DNA, 20 bp, mouse
gaagccctgaggaccctgaa

SEQ ID NO: 717861 - DNA, 20 bp, mouse
gcaccctgagaagtggggta

SEQ ID NO: 717862 - DNA, 20 bp, mouse
gcaggccaccctgagaagtg

SEQ ID NO: 717863 - DNA, 20 bp, mouse
gcttgtctcaaccaagtacc

SEQ ID NO: 717864 - DNA, 20 bp, mouse
ggacaaggctagaagccctg

SEQ ID NO: 717865 - DNA, 20 bp, mouse
gaaaccataccccacttctc

SEQ ID NO: 717866 - DNA, 20 bp, mouse
gacaacaggttgttggctgt

SEQ ID NO: 717867 - DNA, 20 bp, mouse
gaactggggggattgaggcc

SEQ ID NO: 717868 - DNA, 20 bp, mouse
gtccaggaaggagctgcact

SEQ ID NO: 717869 - DNA, 20 bp, mouse
gcccagttccagtcattaca

SEQ ID NO: 717870 - DNA, 20 bp, mouse
gttgaagagccttcctaccc

SEQ ID NO: 717871 - DNA, 20 bp, mouse
ggggtcctaatgactactaa

SEQ ID NO: 717872 - DNA, 20 bp, mouse
gagagcttccaaagagctcc

SEQ ID NO: 717873 - DNA, 20 bp, mouse
gcttccaaagagctccagga

SEQ ID NO: 717874 - DNA, 20 bp, mouse
gctaatgactactaagggtt

SEQ ID NO: 717875 - DNA, 20 bp, mouse
gtactataacaacaggttgt

SEQ ID NO: 717876 - DNA, 20 bp, mouse
gttaagaatcatgtactgag

SEQ ID NO: 717877 - DNA, 20 bp, mouse
ggaatcatgtactgaggggc

SEQ ID NO: 717878 - DNA, 20 bp, mouse
ggagctcatactggattgtt

SEQ ID NO: 717879 - DNA, 20 bp, mouse
gcatgtactgagctgggcag

SEQ ID NO: 717880 - DNA, 20 bp, mouse
gctgctgtggcattgcccag

SEQ ID NO: 717881 - DNA, 20 bp, mouse
gatggctaagtgttcctgta

SEQ ID NO: 717882 - DNA, 20 bp, mouse
gaaaaatcatgtactgagct

SEQ ID NO: 717883 - DNA, 20 bp, mouse
gctggtatacaattctgctg

SEQ ID NO: 717884 - DNA, 20 bp, mouse
gaagaatgagattgtatgta

SEQ ID NO: 717885 - DNA, 20 bp, mouse
ggtactgttccttactttat

SEQ ID NO: 717886 - DNA, 20 bp, mouse
gcagcaaaggttctagtgga

SEQ ID NO: 717887 - DNA, 20 bp, mouse
gagcaagcacaatacagtgc

SEQ ID NO: 717888 - DNA, 20 bp, mouse
ggctttgaatagcttaaagg

SEQ ID NO: 717889 - DNA, 20 bp, mouse
gtctcctgccttctcctgta

SEQ ID NO: 717890 - DNA, 20 bp, mouse
gatgataatagagataccct

SEQ ID NO: 717891 - DNA, 20 bp, mouse
gttaagtctggtaaatatac

SEQ ID NO: 717892 - DNA, 20 bp, mouse
ggagtgccataggaggatag

SEQ ID NO: 717893 - DNA, 20 bp, mouse
gtctagtcaactataagttc

SEQ ID NO: 717894 - DNA, 20 bp, mouse
ggtgcttgctaccttcaggg

SEQ ID NO: 717895 - DNA, 20 bp, mouse
gctagagagtggttctaaag

SEQ ID NO: 717896 - DNA, 20 bp, mouse
gcggctgagaggcgagtctc

SEQ ID NO: 717897 - DNA, 20 bp, mouse
ggccttaagtagccagacgg

SEQ ID NO: 717898 - DNA, 20 bp, mouse
ggagcggcgcgggtgagaag

SEQ ID NO: 717899 - DNA, 20 bp, mouse
ggtagacagtgcagctccat

SEQ ID NO: 717900 - DNA, 20 bp, mouse
gcgtgcgtctgtgcggcggg

SEQ ID NO: 717901 - DNA, 20 bp, mouse
gtacttaaggcgtcgtggtc

SEQ ID NO: 717902 - DNA, 20 bp, mouse
gagtctcgggctaacaagag

SEQ ID NO: 717903 - DNA, 20 bp, mouse
gccccagtggacgccgcggt

SEQ ID NO: 717904 - DNA, 20 bp, mouse
ggtgacgacaagccgccgtc

SEQ ID NO: 717905 - DNA, 20 bp, mouse
gatagcagcccaggcaccga

SEQ ID NO: 717906 - DNA, 20 bp, mouse
gtatacacagggctatgtac

SEQ ID NO: 717907 - DNA, 20 bp, mouse
gacacagggctatgtacagg

SEQ ID NO: 717908 - DNA, 20 bp, mouse
gaacctcctctcaatgggcc

SEQ ID NO: 717909 - DNA, 20 bp, mouse
gcttgtgctagatccacagc

SEQ ID NO: 717910 - DNA, 20 bp, mouse
ggatctagcacaaggcagtt

SEQ ID NO: 717911 - DNA, 20 bp, mouse
gtctaaatacataaataaac

SEQ ID NO: 717912 - DNA, 20 bp, mouse
ggctatgtacaggaggagtc

SEQ ID NO: 717913 - DNA, 20 bp, mouse
gctgagggcagggcttgaat

SEQ ID NO: 717914 - DNA, 20 bp, mouse
gatcacattggggtcaggta

SEQ ID NO: 717915 - DNA, 20 bp, mouse
ggggctgagagctgggctga

SEQ ID NO: 717916 - DNA, 20 bp, mouse
ggggaaaatgtcctttacat

SEQ ID NO: 717917 - DNA, 20 bp, mouse
gcacaattgatgactattct

SEQ ID NO: 717918 - DNA, 20 bp, mouse
ggtgtaatccagcttaaatg

SEQ ID NO: 717919 - DNA, 20 bp, mouse
gattgtggttttaaagttgg

SEQ ID NO: 717920 - DNA, 20 bp, mouse
gtaatctgaatcttgggagc

SEQ ID NO: 717921 - DNA, 20 bp, mouse
gcagctggaaaaacttgtga

SEQ ID NO: 717922 - DNA, 20 bp, mouse
gcaagattcagattagaaat

SEQ ID NO: 717923 - DNA, 20 bp, mouse
gtaaaggacattttccccaa

SEQ ID NO: 717924 - DNA, 20 bp, mouse
gggaagatccacatttaagc

SEQ ID NO: 717925 - DNA, 20 bp, mouse
gtacataggctgctagcaga

SEQ ID NO: 717926 - DNA, 20 bp, mouse
ggtccccagggaactgaggt

SEQ ID NO: 717927 - DNA, 20 bp, mouse
gtcagatacaggaaataaca

SEQ ID NO: 717928 - DNA, 20 bp, mouse
gtggtgtctgtagttctata

SEQ ID NO: 717929 - DNA, 20 bp, mouse
ggcactcaaagcgtattact

SEQ ID NO: 717930 - DNA, 20 bp, mouse
gccctggggactcaacttct

SEQ ID NO: 717931 - DNA, 20 bp, mouse
gccagggaactgaggttgga

SEQ ID NO: 717932 - DNA, 20 bp, mouse
gctgtagttctataaggctt

SEQ ID NO: 717933 - DNA, 20 bp, mouse
gacaggtactctatttgggg

SEQ ID NO: 717934 - DNA, 20 bp, mouse
gagaagaacatctagttatc

SEQ ID NO: 717935 - DNA, 20 bp, mouse
gtagattcatattcagatac

SEQ ID NO: 717936 - DNA, 20 bp, mouse
gcacctggcttcacgagtgc

SEQ ID NO: 717937 - DNA, 20 bp, mouse
gagagggactgcgatcttct

SEQ ID NO: 717938 - DNA, 20 bp, mouse
gagtgcacatacgtatgcgc

SEQ ID NO: 717939 - DNA, 20 bp, mouse
gtaaatcatcttgctgtgcg

SEQ ID NO: 717940 - DNA, 20 bp, mouse
ggactgcgatcttctgggat

SEQ ID NO: 717941 - DNA, 20 bp, mouse
gatcatcttgctgtgcgtgg

SEQ ID NO: 717942 - DNA, 20 bp, mouse
ggtctgaacatttctgtaca

SEQ ID NO: 717943 - DNA, 20 bp, mouse
gtgtgcactctgtgcacgcc

SEQ ID NO: 717944 - DNA, 20 bp, mouse
gtttaaaatcatcttggtgc

SEQ ID NO: 717945 - DNA, 20 bp, mouse
gactgtgtgagagctgggaa

SEQ ID NO: 717946 - DNA, 20 bp, mouse
ggaaccctgtgagatcatgg

SEQ ID NO: 717947 - DNA, 20 bp, mouse
gtatcctaagcaggagtgtg

SEQ ID NO: 717948 - DNA, 20 bp, mouse
gccaacctccatgatctcac

SEQ ID NO: 717949 - DNA, 20 bp, mouse
gtgtcagcctgaggggcaac

SEQ ID NO: 717950 - DNA, 20 bp, mouse
gccacagctccccaggggac

SEQ ID NO: 717951 - DNA, 20 bp, mouse
gtggggagctgtgggatgca

SEQ ID NO: 717952 - DNA, 20 bp, mouse
gccaagtgacccagtcccct

SEQ ID NO: 717953 - DNA, 20 bp, mouse
ggacagacaaggaccgggtt

SEQ ID NO: 717954 - DNA, 20 bp, mouse
gtggtgctcagtacctgtag

SEQ ID NO: 717955 - DNA, 20 bp, mouse
gggaaggctggcaacaggga

SEQ ID NO: 717956 - DNA, 20 bp, mouse
ggagagagaaggctagggtg

SEQ ID NO: 717957 - DNA, 20 bp, mouse
gagggtgaggatggacaaac

SEQ ID NO: 717958 - DNA, 20 bp, mouse
gcaaacaggatgttggaagg

SEQ ID NO: 717959 - DNA, 20 bp, mouse
gcagtccccaggagaggcgt

SEQ ID NO: 717960 - DNA, 20 bp, mouse
gcagaaggattcgcaggcaa

SEQ ID NO: 717961 - DNA, 20 bp, mouse
gagcaaacgcgcgccctgga

SEQ ID NO: 717962 - DNA, 20 bp, mouse
gtgctcctacgcctctcctg

SEQ ID NO: 717963 - DNA, 20 bp, mouse
gcaaaggggttgttttgagt

SEQ ID NO: 717964 - DNA, 20 bp, mouse
ggcactgtcagcaagacaca

SEQ ID NO: 717965 - DNA, 20 bp, mouse
ggagggccagaaggattcgc

SEQ ID NO: 717966 - DNA, 20 bp, mouse
gcttagttctggttgcacaa

SEQ ID NO: 717967 - DNA, 20 bp, mouse
ggcagttgatcgctgaggtt

SEQ ID NO: 717968 - DNA, 20 bp, mouse
gagttgaggcgttcggtgtt

SEQ ID NO: 717969 - DNA, 20 bp, mouse
gagactaaatttggtgaggt

SEQ ID NO: 717970 - DNA, 20 bp, mouse
gttggacttcagactaaatt

SEQ ID NO: 717971 - DNA, 20 bp, mouse
gttctggcagttgatcgctg

SEQ ID NO: 717972 - DNA, 20 bp, mouse
gaactcaatgtagaattgga

SEQ ID NO: 717973 - DNA, 20 bp, mouse
gcgctgaggttcggcagttg

SEQ ID NO: 717974 - DNA, 20 bp, mouse
ggtgttcggcgttcagcgtt

SEQ ID NO: 717975 - DNA, 20 bp, mouse
ggttcggcagttgaggcgtt

SEQ ID NO: 717976 - DNA, 20 bp, mouse
gagggtgaagatgtaggaca

SEQ ID NO: 717977 - DNA, 20 bp, mouse
gtccaacagggtgaagatgt

SEQ ID NO: 717978 - DNA, 20 bp, mouse
ggatcttcaccgagtccaac

SEQ ID NO: 717979 - DNA, 20 bp, mouse
ggggcctctgcccccttgcc

SEQ ID NO: 717980 - DNA, 20 bp, mouse
gaatggggagggcattgcag

SEQ ID NO: 717981 - DNA, 20 bp, mouse
gtctcctgaggacagcgagg

SEQ ID NO: 717982 - DNA, 20 bp, mouse
gtcctacatcttcaccctgt

SEQ ID NO: 717983 - DNA, 20 bp, mouse
gatcttcaccctgttggact

SEQ ID NO: 717984 - DNA, 20 bp, mouse
ggcattgcaggggtcacagg

SEQ ID NO: 717985 - DNA, 20 bp, mouse
gagggtcggggccagacctg

SEQ ID NO: 717986 - DNA, 20 bp, mouse
ggggccgcaagtactacggg

SEQ ID NO: 717987 - DNA, 20 bp, mouse
gggcggggccgcaagtacta

SEQ ID NO: 717988 - DNA, 20 bp, mouse
ggggccccggtgtgttgggt

SEQ ID NO: 717989 - DNA, 20 bp, mouse
gtagcactttggctcgtaca

SEQ ID NO: 717990 - DNA, 20 bp, mouse
gcagacacgccccgggttga

SEQ ID NO: 717991 - DNA, 20 bp, mouse
gagaatagggagccgtgttt

SEQ ID NO: 717992 - DNA, 20 bp, mouse
gctgcccttcgtccgaaaca

SEQ ID NO: 717993 - DNA, 20 bp, mouse
gtctctgtggcttctttaag

SEQ ID NO: 717994 - DNA, 20 bp, mouse
ggagccgtgtttcggacgaa

SEQ ID NO: 717995 - DNA, 20 bp, mouse
ggggctaggggtggtccgta

SEQ ID NO: 717996 - DNA, 20 bp, mouse
gtcagggcggccaccggctc

SEQ ID NO: 717997 - DNA, 20 bp, mouse
gcgcgcgcgtctctatggtg

SEQ ID NO: 717998 - DNA, 20 bp, mouse
gacccgcatcccggcgtccg

SEQ ID NO: 717999 - DNA, 20 bp, mouse
gccgtcgagcccccgaccca

SEQ ID NO: 718000 - DNA, 20 bp, mouse
gcagagcggccgagtcctcc

SEQ ID NO: 718001 - DNA, 20 bp, mouse
gcgacacgggcgatgggagg

SEQ ID NO: 718002 - DNA, 20 bp, mouse
gaggactcggccgctctggc

SEQ ID NO: 718003 - DNA, 20 bp, mouse
gcggctgcagggcacaccgt

SEQ ID NO: 718004 - DNA, 20 bp, mouse
gaacgtggaaaacgtcccgt

SEQ ID NO: 718005 - DNA, 20 bp, mouse
gggcggcgcgcgcgtctcta

SEQ ID NO: 718006 - DNA, 20 bp, mouse
gacctgacaaacaacatccc

SEQ ID NO: 718007 - DNA, 20 bp, mouse
gcatctctgcagccatagga

SEQ ID NO: 718008 - DNA, 20 bp, mouse
gagtgaggttgggatatcat

SEQ ID NO: 718009 - DNA, 20 bp, mouse
ggctgaggacagtgctcccc

SEQ ID NO: 718010 - DNA, 20 bp, mouse
gacttgtcccagccatccta

SEQ ID NO: 718011 - DNA, 20 bp, mouse
gagggaggggtactaggctg

SEQ ID NO: 718012 - DNA, 20 bp, mouse
gcctggaagccagccacggc

SEQ ID NO: 718013 - DNA, 20 bp, mouse
gtgcagagctggactcaggg

SEQ ID NO: 718014 - DNA, 20 bp, mouse
gctcaccaacaaggaaggga

SEQ ID NO: 718015 - DNA, 20 bp, mouse
gaggttgggatatcataggt

SEQ ID NO: 718016 - DNA, 20 bp, mouse
gtcctgcagcaaaacatgcc

SEQ ID NO: 718017 - DNA, 20 bp, mouse
gggtgccttcacagtaacaa

SEQ ID NO: 718018 - DNA, 20 bp, mouse
ggcagaaagcccacactgtg

SEQ ID NO: 718019 - DNA, 20 bp, mouse
gcccagacagcaatagacag

SEQ ID NO: 718020 - DNA, 20 bp, mouse
gcttctgtgccacacagtgt

SEQ ID NO: 718021 - DNA, 20 bp, mouse
gtgctcccttgttactgtga

SEQ ID NO: 718022 - DNA, 20 bp, mouse
ggcatttgctgcactgagta

SEQ ID NO: 718023 - DNA, 20 bp, mouse
gacctctgtctattgctgtc

SEQ ID NO: 718024 - DNA, 20 bp, mouse
gatcacaaggcaggaggcac

SEQ ID NO: 718025 - DNA, 20 bp, mouse
gtgcagcaaaacatgcctgg

SEQ ID NO: 718026 - DNA, 20 bp, mouse
gtaaagaataaattctgatg

SEQ ID NO: 718027 - DNA, 20 bp, mouse
gtgcatcagtagtgaatggg

SEQ ID NO: 718028 - DNA, 20 bp, mouse
gtacttaatgattttactaa

SEQ ID NO: 718029 - DNA, 20 bp, mouse
gaatactgaataaattatta

SEQ ID NO: 718030 - DNA, 20 bp, mouse
gtattgcatcagtagtgaat

SEQ ID NO: 718031 - DNA, 20 bp, mouse
gggagtgttaacgaagaaaa

SEQ ID NO: 718032 - DNA, 20 bp, mouse
gaaatttttaaaataatgag

SEQ ID NO: 718033 - DNA, 20 bp, mouse
gtaatgtattttgaagaaga

SEQ ID NO: 718034 - DNA, 20 bp, mouse
gtctgagaaaaatttgcatc

SEQ ID NO: 718035 - DNA, 20 bp, mouse
gtatggaaccaattaaactg

SEQ ID NO: 718036 - DNA, 20 bp, mouse
gtgttctcgaaactgttatt

SEQ ID NO: 718037 - DNA, 20 bp, mouse
gtgggtaactagtaacagga

SEQ ID NO: 718038 - DNA, 20 bp, mouse
gagcctggggcactgtcagt

SEQ ID NO: 718039 - DNA, 20 bp, mouse
ggaaactgttattgggaatg

SEQ ID NO: 718040 - DNA, 20 bp, mouse
gctgaaccagcagtcagaaa

SEQ ID NO: 718041 - DNA, 20 bp, mouse
gcagttgggtaactagtaac

SEQ ID NO: 718042 - DNA, 20 bp, mouse
gcttctagaaatatttacta

SEQ ID NO: 718043 - DNA, 20 bp, mouse
gctagtaacaggagggaata

SEQ ID NO: 718044 - DNA, 20 bp, mouse
gaagacaggctcctcaagcc

SEQ ID NO: 718045 - DNA, 20 bp, mouse
gatcttctcatagtttgctc

SEQ ID NO: 718046 - DNA, 20 bp, mouse
ggaaagggtgcttgaaataa

SEQ ID NO: 718047 - DNA, 20 bp, mouse
gtaaccataaacaataagaa

SEQ ID NO: 718048 - DNA, 20 bp, mouse
gttacctttcttattgttta

SEQ ID NO: 718049 - DNA, 20 bp, mouse
gttttcaatattttgtactt

SEQ ID NO: 718050 - DNA, 20 bp, mouse
gcgtaaaataaacaaagaaa

SEQ ID NO: 718051 - DNA, 20 bp, mouse
gttttcataatttttattct

SEQ ID NO: 718052 - DNA, 20 bp, mouse
gaaaataatgaaaaagatgc

SEQ ID NO: 718053 - DNA, 20 bp, mouse
gtagtttggggttggttttt

SEQ ID NO: 718054 - DNA, 20 bp, mouse
gttggggttggttttttggt

SEQ ID NO: 718055 - DNA, 20 bp, mouse
gattttgtacttgggaagta

SEQ ID NO: 718056 - DNA, 20 bp, mouse
ggcaagcggcagatccacgt

SEQ ID NO: 718057 - DNA, 20 bp, mouse
gagcggcagatccacgtggg

SEQ ID NO: 718058 - DNA, 20 bp, mouse
ggtcccgcccacgcgcacgt

SEQ ID NO: 718059 - DNA, 20 bp, mouse
gcccgaccaggccccccacg

SEQ ID NO: 718060 - DNA, 20 bp, mouse
gacaagcactggagacttct

SEQ ID NO: 718061 - DNA, 20 bp, mouse
ggacagaggagagggtttta

SEQ ID NO: 718062 - DNA, 20 bp, mouse
gccgcttgctccatctacaa

SEQ ID NO: 718063 - DNA, 20 bp, mouse
gaggctgaggacagcgcgaa

SEQ ID NO: 718064 - DNA, 20 bp, mouse
gagtaaccccgccccttcaa

SEQ ID NO: 718065 - DNA, 20 bp, mouse
gtccacgtggggggcctggt

SEQ ID NO: 718066 - DNA, 20 bp, mouse
gggtcctggaacagcaacat

SEQ ID NO: 718067 - DNA, 20 bp, mouse
gacgcgacccccagagacgc

SEQ ID NO: 718068 - DNA, 20 bp, mouse
gggacacagcttagtgattc

SEQ ID NO: 718069 - DNA, 20 bp, mouse
gtctggaaaaaggtcggtcc

SEQ ID NO: 718070 - DNA, 20 bp, mouse
gtattgtcaacctgcgtctc

SEQ ID NO: 718071 - DNA, 20 bp, mouse
ggcttacagtacagttttgt

SEQ ID NO: 718072 - DNA, 20 bp, mouse
ggttacacaactatgattgt

SEQ ID NO: 718073 - DNA, 20 bp, mouse
gctctttttttagtggggaa

SEQ ID NO: 718074 - DNA, 20 bp, mouse
ggaaactttgtcagcaaggt

SEQ ID NO: 718075 - DNA, 20 bp, mouse
gtacagtacagttttgttgg

SEQ ID NO: 718076 - DNA, 20 bp, mouse
ggtacaacagcccacataca

SEQ ID NO: 718077 - DNA, 20 bp, mouse
gccaggcttagggtaatagt

SEQ ID NO: 718078 - DNA, 20 bp, mouse
ggtaatagtgggaataggtt

SEQ ID NO: 718079 - DNA, 20 bp, mouse
gttaactttgccatgtatgt

SEQ ID NO: 718080 - DNA, 20 bp, mouse
gctcgtagatttgtacgcac

SEQ ID NO: 718081 - DNA, 20 bp, mouse
gaaaaataagtccctggcgc

SEQ ID NO: 718082 - DNA, 20 bp, mouse
gcaaatttggagaaatttaa

SEQ ID NO: 718083 - DNA, 20 bp, mouse
gatctacgagtattcagata

SEQ ID NO: 718084 - DNA, 20 bp, mouse
gtttaggtactccagcgcca

SEQ ID NO: 718085 - DNA, 20 bp, mouse
gttagggtaatagtgggaat

SEQ ID NO: 718086 - DNA, 20 bp, mouse
gttgtagcctaggttaggaa

SEQ ID NO: 718087 - DNA, 20 bp, mouse
gatctggaaagcatccacta

SEQ ID NO: 718088 - DNA, 20 bp, mouse
gactgagcatatagccaggg

SEQ ID NO: 718089 - DNA, 20 bp, mouse
gtaaacttgccttgcctata

SEQ ID NO: 718090 - DNA, 20 bp, mouse
ggacgtttggaaaaaatctg

SEQ ID NO: 718091 - DNA, 20 bp, mouse
ggcctgcagatactttttat

SEQ ID NO: 718092 - DNA, 20 bp, mouse
ggccttatctagagtttcaa

SEQ ID NO: 718093 - DNA, 20 bp, mouse
gtgtctgcccttcctaacct

SEQ ID NO: 718094 - DNA, 20 bp, mouse
gggtgttataacaaatcatc

SEQ ID NO: 718095 - DNA, 20 bp, mouse
gagggggagggatgcggcat

SEQ ID NO: 718096 - DNA, 20 bp, mouse
gtcctcaccccatacttcac

SEQ ID NO: 718097 - DNA, 20 bp, mouse
gacctgtgaagtatggggtg

SEQ ID NO: 718098 - DNA, 20 bp, mouse
gaaacttagctgcatcagta

SEQ ID NO: 718099 - DNA, 20 bp, mouse
gtggaacattagggaggcaa

SEQ ID NO: 718100 - DNA, 20 bp, mouse
gcttcaacctgtgaagtatg

SEQ ID NO: 718101 - DNA, 20 bp, mouse
gacattagagagaggtttag

SEQ ID NO: 718102 - DNA, 20 bp, mouse
gagctacccacattagagag

SEQ ID NO: 718103 - DNA, 20 bp, mouse
gcgattgtgtttccatactg

SEQ ID NO: 718104 - DNA, 20 bp, mouse
ggtctctggcctcctcagta

SEQ ID NO: 718105 - DNA, 20 bp, mouse
gctgacagaatggaacatta

SEQ ID NO: 718106 - DNA, 20 bp, mouse
ggctagagtacattgcagga

SEQ ID NO: 718107 - DNA, 20 bp, mouse
gctgtctggcgctattgatt

SEQ ID NO: 718108 - DNA, 20 bp, mouse
ggagacttgttggaagtctt

SEQ ID NO: 718109 - DNA, 20 bp, mouse
gaaaggctagagtacattgc

SEQ ID NO: 718110 - DNA, 20 bp, mouse
gtgcagactcttggatgcaa

SEQ ID NO: 718111 - DNA, 20 bp, mouse
gaaccctgaaagtaagaacg

SEQ ID NO: 718112 - DNA, 20 bp, mouse
gagagtctgcaccaatctct

SEQ ID NO: 718113 - DNA, 20 bp, mouse
gataattgagacccagagat

SEQ ID NO: 718114 - DNA, 20 bp, mouse
gggcacaaatagaattaaag

SEQ ID NO: 718115 - DNA, 20 bp, mouse
ggtgaaagcaaagttcttaa

SEQ ID NO: 718116 - DNA, 20 bp, mouse
ggattggctgaggcctgtga

SEQ ID NO: 718117 - DNA, 20 bp, mouse
gtggccctattctgccacgg

SEQ ID NO: 718118 - DNA, 20 bp, mouse
gaccacttctctctttccta

SEQ ID NO: 718119 - DNA, 20 bp, mouse
ggcctagcaagggttaggta

SEQ ID NO: 718120 - DNA, 20 bp, mouse
gagagagaagtggtgtacta

SEQ ID NO: 718121 - DNA, 20 bp, mouse
gtgatctgagtccgtgttcc

SEQ ID NO: 718122 - DNA, 20 bp, mouse
gagagcaggctgtaacttgg

SEQ ID NO: 718123 - DNA, 20 bp, mouse
gttagagcaacaaccgtaga

SEQ ID NO: 718124 - DNA, 20 bp, mouse
gtgtttgtaaggattggctg

SEQ ID NO: 718125 - DNA, 20 bp, mouse
ggaacagcctagcaagggtt

SEQ ID NO: 718126 - DNA, 20 bp, mouse
gttgtagcagacagaagggg

SEQ ID NO: 718127 - DNA, 20 bp, mouse
ggggacaacagcacagcttt

SEQ ID NO: 718128 - DNA, 20 bp, mouse
gcgcagctggcgctgtcctc

SEQ ID NO: 718129 - DNA, 20 bp, mouse
gggccacggaaatgtagatt

SEQ ID NO: 718130 - DNA, 20 bp, mouse
ggcctgtcctggtgcagtta

SEQ ID NO: 718131 - DNA, 20 bp, mouse
gcacggaaatgtagatttgg

SEQ ID NO: 718132 - DNA, 20 bp, mouse
gccagctgcgttgcctgtcc

SEQ ID NO: 718133 - DNA, 20 bp, mouse
gcacagaggtgtccctgcta

SEQ ID NO: 718134 - DNA, 20 bp, mouse
gacctctgtggtgtgcccta

SEQ ID NO: 718135 - DNA, 20 bp, mouse
ggggcatacacatgtattta

SEQ ID NO: 718136 - DNA, 20 bp, mouse
gaaagtgagtgtgcagacaa

SEQ ID NO: 718137 - DNA, 20 bp, mouse
gtgcacatctgtatcatctt

SEQ ID NO: 718138 - DNA, 20 bp, mouse
gcaggccaccatctcggcca

SEQ ID NO: 718139 - DNA, 20 bp, mouse
gagtccagagccactttcac

SEQ ID NO: 718140 - DNA, 20 bp, mouse
gcgggatgttctccttgaag

SEQ ID NO: 718141 - DNA, 20 bp, mouse
gagtccaaggctggcagcag

SEQ ID NO: 718142 - DNA, 20 bp, mouse
gaaggctggcagcagaggta

SEQ ID NO: 718143 - DNA, 20 bp, mouse
ggtacactgagtaataaggt

SEQ ID NO: 718144 - DNA, 20 bp, mouse
ggatgccctggccgagatgg

SEQ ID NO: 718145 - DNA, 20 bp, mouse
gctggatgtgaacccaaccg

SEQ ID NO: 718146 - DNA, 20 bp, mouse
gagcaagagggatgggtcac

SEQ ID NO: 718147 - DNA, 20 bp, mouse
gctaggatagcaagagggat

SEQ ID NO: 718148 - DNA, 20 bp, mouse
gatacaaatagagcatatat

SEQ ID NO: 718149 - DNA, 20 bp, mouse
gctatctgcaatctatctat

SEQ ID NO: 718150 - DNA, 20 bp, mouse
gggtagactaggatagcaag

SEQ ID NO: 718151 - DNA, 20 bp, mouse
gtcagaagtgctgagatatt

SEQ ID NO: 718152 - DNA, 20 bp, mouse
ggaactcaagttgttttcga

SEQ ID NO: 718153 - DNA, 20 bp, mouse
gatcatttgtctgtctatga

SEQ ID NO: 718154 - DNA, 20 bp, mouse
gttttaaaatattggtatta

SEQ ID NO: 718155 - DNA, 20 bp, mouse
gaatgaaggtagagagatat

SEQ ID NO: 718156 - DNA, 20 bp, mouse
gaagaagtgaagtgcactaa

SEQ ID NO: 718157 - DNA, 20 bp, mouse
gggccagagtggtaggaaat

SEQ ID NO: 718158 - DNA, 20 bp, mouse
gagggagggcggaggcagta

SEQ ID NO: 718159 - DNA, 20 bp, mouse
gggaagaggaattcccaggg

SEQ ID NO: 718160 - DNA, 20 bp, mouse
ggaagtgcactaagggcaga

SEQ ID NO: 718161 - DNA, 20 bp, mouse
gcaggagcaagtaaaggggc

SEQ ID NO: 718162 - DNA, 20 bp, mouse
gaaaatcaggagcaagtaaa

SEQ ID NO: 718163 - DNA, 20 bp, mouse
ggatggaagaggaattccca

SEQ ID NO: 718164 - DNA, 20 bp, mouse
ggaagactgcaagcaggcag

SEQ ID NO: 718165 - DNA, 20 bp, mouse
ggggtagagagaggaatgta

SEQ ID NO: 718166 - DNA, 20 bp, mouse
gtgctccctcttgccatctt

SEQ ID NO: 718167 - DNA, 20 bp, mouse
gttaggaggagaagacaaga

SEQ ID NO: 718168 - DNA, 20 bp, mouse
gggagcggggcggacaagga

SEQ ID NO: 718169 - DNA, 20 bp, mouse
ggcaggaattccccatgggg

SEQ ID NO: 718170 - DNA, 20 bp, mouse
gtccctcttgccatcttagg

SEQ ID NO: 718171 - DNA, 20 bp, mouse
gcatgtgcaggaattcccca

SEQ ID NO: 718172 - DNA, 20 bp, mouse
gggagggaacagctgtgttc

SEQ ID NO: 718173 - DNA, 20 bp, mouse
gtcagcttgggtgtggagcg

SEQ ID NO: 718174 - DNA, 20 bp, mouse
gcagctggaccgaatatacc

SEQ ID NO: 718175 - DNA, 20 bp, mouse
gtccacacgcttcaggtcac

SEQ ID NO: 718176 - DNA, 20 bp, mouse
ggaggaattatgatgaaaaa

SEQ ID NO: 718177 - DNA, 20 bp, mouse
gaaactccattctgttgaag

SEQ ID NO: 718178 - DNA, 20 bp, mouse
gaatgtgcaccatgacgaca

SEQ ID NO: 718179 - DNA, 20 bp, mouse
gttaggacaccatgtcgtca

SEQ ID NO: 718180 - DNA, 20 bp, mouse
gattatgatgaaaaacggca

SEQ ID NO: 718181 - DNA, 20 bp, mouse
gtactggtacagcgacagat

SEQ ID NO: 718182 - DNA, 20 bp, mouse
gacctcaagctgtactacag

SEQ ID NO: 718183 - DNA, 20 bp, mouse
gcattcttagggagcagggt

SEQ ID NO: 718184 - DNA, 20 bp, mouse
gcagttaagaattgtgttgg

SEQ ID NO: 718185 - DNA, 20 bp, mouse
ggtgacaataaataggtgtg

SEQ ID NO: 718186 - DNA, 20 bp, mouse
gggaacaggagacataagag

SEQ ID NO: 718187 - DNA, 20 bp, mouse
gagacactctgctgacaacg

SEQ ID NO: 718188 - DNA, 20 bp, mouse
gctagaaccagaaatggaac

SEQ ID NO: 718189 - DNA, 20 bp, mouse
ggccccttccagttctaaga

SEQ ID NO: 718190 - DNA, 20 bp, mouse
gttagaactggaaggggcct

SEQ ID NO: 718191 - DNA, 20 bp, mouse
gggacagattagactggtaa

SEQ ID NO: 718192 - DNA, 20 bp, mouse
gtgccaagatactactatag

SEQ ID NO: 718193 - DNA, 20 bp, mouse
gcaagactggttgtcaagaa

SEQ ID NO: 718194 - DNA, 20 bp, mouse
gtccatcttagaactggaag

SEQ ID NO: 718195 - DNA, 20 bp, mouse
gaagatactactatagtggt

SEQ ID NO: 718196 - DNA, 20 bp, mouse
ggattggcaggcaaagatca

SEQ ID NO: 718197 - DNA, 20 bp, mouse
gttcctgaagaatatgagag

SEQ ID NO: 718198 - DNA, 20 bp, mouse
gggaaatatatcatgtgcag

SEQ ID NO: 718199 - DNA, 20 bp, mouse
gtaaaggctgaaaaggctga

SEQ ID NO: 718200 - DNA, 20 bp, mouse
gcaatcagaaagtagttaga

SEQ ID NO: 718201 - DNA, 20 bp, mouse
gaatatgagagaggttgaac

SEQ ID NO: 718202 - DNA, 20 bp, mouse
gatcctataggagtcatctg

SEQ ID NO: 718203 - DNA, 20 bp, mouse
gttggttaatggggtgacaa

SEQ ID NO: 718204 - DNA, 20 bp, mouse
gaacctctctcatattcttc

SEQ ID NO: 718205 - DNA, 20 bp, mouse
gttggtggatttcttttgta

SEQ ID NO: 718206 - DNA, 20 bp, mouse
gggtcgcggcagttaccgtt

SEQ ID NO: 718207 - DNA, 20 bp, mouse
ggaccggggcgcatgggtcg

SEQ ID NO: 718208 - DNA, 20 bp, mouse
ggtgacctaccacgtcacgg

SEQ ID NO: 718209 - DNA, 20 bp, mouse
gtggggtcaccgagcgaccg

SEQ ID NO: 718210 - DNA, 20 bp, mouse
ggaggcgtctgactgacatt

SEQ ID NO: 718211 - DNA, 20 bp, mouse
ggcagggcatgaagctgtgt

SEQ ID NO: 718212 - DNA, 20 bp, mouse
gcccatgcgccccggtcgct

SEQ ID NO: 718213 - DNA, 20 bp, mouse
gatgccggctctgacgtcac

SEQ ID NO: 718214 - DNA, 20 bp, mouse
gcctaaagatgtgtgggagg

SEQ ID NO: 718215 - DNA, 20 bp, mouse
gggcagttaccgttgggacg

SEQ ID NO: 718216 - DNA, 20 bp, mouse
gatgggaacgagtctctagg

SEQ ID NO: 718217 - DNA, 20 bp, mouse
gagaagcacaaaaatgactt

SEQ ID NO: 718218 - DNA, 20 bp, mouse
gagagactcgttcccatctg

SEQ ID NO: 718219 - DNA, 20 bp, mouse
gtacctgaaggttcctcaga

SEQ ID NO: 718220 - DNA, 20 bp, mouse
gatccttagagaaaagaagg

SEQ ID NO: 718221 - DNA, 20 bp, mouse
gacgagtctctaggtggctg

SEQ ID NO: 718222 - DNA, 20 bp, mouse
gagtgagtcacagcatgtca

SEQ ID NO: 718223 - DNA, 20 bp, mouse
gttaacagcaccattttact

SEQ ID NO: 718224 - DNA, 20 bp, mouse
gtgcccgtgtcattcagcca

SEQ ID NO: 718225 - DNA, 20 bp, mouse
gtgaatgacacgggcaatac

SEQ ID NO: 718226 - DNA, 20 bp, mouse
gtggcttgctcgtcattgtg

SEQ ID NO: 718227 - DNA, 20 bp, mouse
gacggcggccatgacaacta

SEQ ID NO: 718228 - DNA, 20 bp, mouse
gcattgtggggcttgttgct

SEQ ID NO: 718229 - DNA, 20 bp, mouse
ggctttgtccggtgttggtg

SEQ ID NO: 718230 - DNA, 20 bp, mouse
gaccaatcacagctaacctg

SEQ ID NO: 718231 - DNA, 20 bp, mouse
gactccaccctcaccaacac

SEQ ID NO: 718232 - DNA, 20 bp, mouse
gtactgctttggggtgatgt

SEQ ID NO: 718233 - DNA, 20 bp, mouse
gtcatggccgccgtgtgtaa

SEQ ID NO: 718234 - DNA, 20 bp, mouse
gactgagcagacggtacaca

SEQ ID NO: 718235 - DNA, 20 bp, mouse
gtcctcaggttagctgtgat

SEQ ID NO: 718236 - DNA, 20 bp, mouse
gtaacataaagcagcctcag

SEQ ID NO: 718237 - DNA, 20 bp, mouse
gggagccataccccatgtcc

SEQ ID NO: 718238 - DNA, 20 bp, mouse
gcagatggcccagcgctcag

SEQ ID NO: 718239 - DNA, 20 bp, mouse
gggctctagagcaaccttca

SEQ ID NO: 718240 - DNA, 20 bp, mouse
gggctgctcgtcagcgtcct

SEQ ID NO: 718241 - DNA, 20 bp, mouse
ggatggagcagagcccctga

SEQ ID NO: 718242 - DNA, 20 bp, mouse
gagcgtcctcgggatctttc

SEQ ID NO: 718243 - DNA, 20 bp, mouse
gcactctgctgtgaggtcct

SEQ ID NO: 718244 - DNA, 20 bp, mouse
gagatgtcaagtacaggaac

SEQ ID NO: 718245 - DNA, 20 bp, mouse
gcgggcaccacaggtttcac

SEQ ID NO: 718246 - DNA, 20 bp, mouse
gggaaaggtgatggctatag

SEQ ID NO: 718247 - DNA, 20 bp, mouse
gtagtaggtagcaatgggaa

SEQ ID NO: 718248 - DNA, 20 bp, mouse
gccgtatagtaggtagcaat

SEQ ID NO: 718249 - DNA, 20 bp, mouse
gctatagtggattctaccag

SEQ ID NO: 718250 - DNA, 20 bp, mouse
gaaagatcgtgagcaaattt

SEQ ID NO: 718251 - DNA, 20 bp, mouse
gtactatacggagcttcata

SEQ ID NO: 718252 - DNA, 20 bp, mouse
gaaacacttcaacacggcca

SEQ ID NO: 718253 - DNA, 20 bp, mouse
gatacacacattgaagccac

SEQ ID NO: 718254 - DNA, 20 bp, mouse
gtgtttcaaatcaggtactt

SEQ ID NO: 718255 - DNA, 20 bp, mouse
gtgttgaagtgtttcaaatc

SEQ ID NO: 718256 - DNA, 20 bp, mouse
gacgagaagaggctgatcct

SEQ ID NO: 718257 - DNA, 20 bp, mouse
ggtggggatcggacgagaag

SEQ ID NO: 718258 - DNA, 20 bp, mouse
ggggagaagagtacaagaac

SEQ ID NO: 718259 - DNA, 20 bp, mouse
gtgagctgaggctaaagagt

SEQ ID NO: 718260 - DNA, 20 bp, mouse
gtacaagaacgggaggactt

SEQ ID NO: 718261 - DNA, 20 bp, mouse
gagaagagtacaagaacggg

SEQ ID NO: 718262 - DNA, 20 bp, mouse
gagccagcccactgcatgac

SEQ ID NO: 718263 - DNA, 20 bp, mouse
gcagcatccggtcatgcagt

SEQ ID NO: 718264 - DNA, 20 bp, mouse
gaagtctttaggagttacag

SEQ ID NO: 718265 - DNA, 20 bp, mouse
gaggaagatattacaatgtg

SEQ ID NO: 718266 - DNA, 20 bp, mouse
gtgaggttctggtatggcta

SEQ ID NO: 718267 - DNA, 20 bp, mouse
ggacataaggaagagaccgt

SEQ ID NO: 718268 - DNA, 20 bp, mouse
ggctatggtacattgctggg

SEQ ID NO: 718269 - DNA, 20 bp, mouse
gggatgaaaactgtatgtgt

SEQ ID NO: 718270 - DNA, 20 bp, mouse
gcgctgggaagaatctacac

SEQ ID NO: 718271 - DNA, 20 bp, mouse
gcctcaaattgggtaattga

SEQ ID NO: 718272 - DNA, 20 bp, mouse
gccataccagaacctcaaat

SEQ ID NO: 718273 - DNA, 20 bp, mouse
gccaatcagtcaactaggac

SEQ ID NO: 718274 - DNA, 20 bp, mouse
gtgggaagaatctacacagg

SEQ ID NO: 718275 - DNA, 20 bp, mouse
gatcacaggcaatgtccctg

SEQ ID NO: 718276 - DNA, 20 bp, mouse
gaaagagaagtccatggaca

SEQ ID NO: 718277 - DNA, 20 bp, mouse
ggagtagaaagagaagtcca

SEQ ID NO: 718278 - DNA, 20 bp, mouse
gcattcagaaagctatctgc

SEQ ID NO: 718279 - DNA, 20 bp, mouse
ggctatacttccagagtcta

SEQ ID NO: 718280 - DNA, 20 bp, mouse
gtggccacaactccgagttg

SEQ ID NO: 718281 - DNA, 20 bp, mouse
gagtaggtatagagtatggc

SEQ ID NO: 718282 - DNA, 20 bp, mouse
ggtgcctcaactcggagttg

SEQ ID NO: 718283 - DNA, 20 bp, mouse
ggaagtatagctatacttga

SEQ ID NO: 718284 - DNA, 20 bp, mouse
ggatgagtaggtatagagta

SEQ ID NO: 718285 - DNA, 20 bp, mouse
gtctctatggatcaacctgt

SEQ ID NO: 718286 - DNA, 20 bp, mouse
gaagactaagtcacgaatgg

SEQ ID NO: 718287 - DNA, 20 bp, mouse
gtaagtcacgaatggtgggt

SEQ ID NO: 718288 - DNA, 20 bp, mouse
ggggtggtgctagatttgtg

SEQ ID NO: 718289 - DNA, 20 bp, mouse
gtaaataagtgttagcttgg

SEQ ID NO: 718290 - DNA, 20 bp, mouse
ggccagagaatgaacatgta

SEQ ID NO: 718291 - DNA, 20 bp, mouse
gaaatgacactctagcaaac

SEQ ID NO: 718292 - DNA, 20 bp, mouse
gaatctagcaccacccaggg

SEQ ID NO: 718293 - DNA, 20 bp, mouse
gcccctacatgttcattctc

SEQ ID NO: 718294 - DNA, 20 bp, mouse
ggactcggacttagcttccg

SEQ ID NO: 718295 - DNA, 20 bp, mouse
gaacacactccctccctggg

SEQ ID NO: 718296 - DNA, 20 bp, mouse
gttaacacagtgattactcc

SEQ ID NO: 718297 - DNA, 20 bp, mouse
gcaaatgagcctgaactgag

SEQ ID NO: 718298 - DNA, 20 bp, mouse
gtgagcctgaactgagtgga

SEQ ID NO: 718299 - DNA, 20 bp, mouse
ggggaaataagaatgtctcc

SEQ ID NO: 718300 - DNA, 20 bp, mouse
gtcttctagagagctgcaaa

SEQ ID NO: 718301 - DNA, 20 bp, mouse
gatagacattggctcagttg

SEQ ID NO: 718302 - DNA, 20 bp, mouse
gacaggaatctgtagagaga

SEQ ID NO: 718303 - DNA, 20 bp, mouse
gtaagaatgtctccaggaat

SEQ ID NO: 718304 - DNA, 20 bp, mouse
gcaaatcctttgtcctaaat

SEQ ID NO: 718305 - DNA, 20 bp, mouse
gtcagtatttaaagtttgag

SEQ ID NO: 718306 - DNA, 20 bp, mouse
gaagttgctagagcatgatc

SEQ ID NO: 718307 - DNA, 20 bp, mouse
ggtagaagctaacatgatga

SEQ ID NO: 718308 - DNA, 20 bp, mouse
gtaggcgctgctctcctcac

SEQ ID NO: 718309 - DNA, 20 bp, mouse
ggctcaccctggtctcctgc

SEQ ID NO: 718310 - DNA, 20 bp, mouse
ggcaagctgtgctcgagcgg

SEQ ID NO: 718311 - DNA, 20 bp, mouse
ggcaggtttaagaaggtttg

SEQ ID NO: 718312 - DNA, 20 bp, mouse
gaaagtaccctggcagaggg

SEQ ID NO: 718313 - DNA, 20 bp, mouse
ggaaaacacagttgctaaag

SEQ ID NO: 718314 - DNA, 20 bp, mouse
gtagtgctgaggttagggct

SEQ ID NO: 718315 - DNA, 20 bp, mouse
gctggcaagctgtgctcgag

SEQ ID NO: 718316 - DNA, 20 bp, mouse
gtaaagggggcacagaatat

SEQ ID NO: 718317 - DNA, 20 bp, mouse
gaagatggagttcttgtaaa

SEQ ID NO: 718318 - DNA, 20 bp, mouse
gccagtatctaagtcaaaac

SEQ ID NO: 718319 - DNA, 20 bp, mouse
gagaatattgggagggaagt

SEQ ID NO: 718320 - DNA, 20 bp, mouse
gaaactgctagactgtggtt

SEQ ID NO: 718321 - DNA, 20 bp, mouse
gtggagagttcatgggaact

SEQ ID NO: 718322 - DNA, 20 bp, mouse
gccaagggacttagaagtgt

SEQ ID NO: 718323 - DNA, 20 bp, mouse
ggggggcacagaatattggg

SEQ ID NO: 718324 - DNA, 20 bp, mouse
ggtgttggctgttgtcaact

SEQ ID NO: 718325 - DNA, 20 bp, mouse
gctgttgtcaactaggaaga

SEQ ID NO: 718326 - DNA, 20 bp, mouse
gtccaaagataaagcaactt

SEQ ID NO: 718327 - DNA, 20 bp, mouse
gataaaaaaaagtgcacccc

SEQ ID NO: 718328 - DNA, 20 bp, mouse
gtccttctgtgttaatctta

SEQ ID NO: 718329 - DNA, 20 bp, mouse
gagataaatacagggggacc

SEQ ID NO: 718330 - DNA, 20 bp, mouse
gtggctgatgctttacagac

SEQ ID NO: 718331 - DNA, 20 bp, mouse
gactaaggagtgctgagagt

SEQ ID NO: 718332 - DNA, 20 bp, mouse
gttcagaaataaacacatgc

SEQ ID NO: 718333 - DNA, 20 bp, mouse
gagcacatgaaccctgatat

SEQ ID NO: 718334 - DNA, 20 bp, mouse
ggccaaagttgctttatctt

SEQ ID NO: 718335 - DNA, 20 bp, mouse
gaaagaactacagaaaacta

SEQ ID NO: 718336 - DNA, 20 bp, mouse
gtcaacgtggaagtacaaga

SEQ ID NO: 718337 - DNA, 20 bp, mouse
ggcagaacctagcacgcagt

SEQ ID NO: 718338 - DNA, 20 bp, mouse
gaaagaggacagcatcaacg

SEQ ID NO: 718339 - DNA, 20 bp, mouse
gaagtcctgtctctcttgtc

SEQ ID NO: 718340 - DNA, 20 bp, mouse
gaagcactagacactcactc

SEQ ID NO: 718341 - DNA, 20 bp, mouse
gtgagtgtgtactatcagat

SEQ ID NO: 718342 - DNA, 20 bp, mouse
gtcagagctgaactgtgccc

SEQ ID NO: 718343 - DNA, 20 bp, mouse
gtctagtgcttttctaagta

SEQ ID NO: 718344 - DNA, 20 bp, mouse
gtaagtatggttatcaagct

SEQ ID NO: 718345 - DNA, 20 bp, mouse
gactgtgccctggaactgaa

SEQ ID NO: 718346 - DNA, 20 bp, mouse
ggggcccaagggttgtcaca

SEQ ID NO: 718347 - DNA, 20 bp, mouse
gggcccatgtgcctcttcta

SEQ ID NO: 718348 - DNA, 20 bp, mouse
gggacctaggggaagtgcat

SEQ ID NO: 718349 - DNA, 20 bp, mouse
gagggcccgtcagtcacagc

SEQ ID NO: 718350 - DNA, 20 bp, mouse
ggatccatgtgacaaccctt

SEQ ID NO: 718351 - DNA, 20 bp, mouse
gggatcctgctgtgactgac

SEQ ID NO: 718352 - DNA, 20 bp, mouse
gacgggcccaggggggtcat

SEQ ID NO: 718353 - DNA, 20 bp, mouse
gaggggaagtgcatagggcc

SEQ ID NO: 718354 - DNA, 20 bp, mouse
gggcatcatacataggaaga

SEQ ID NO: 718355 - DNA, 20 bp, mouse
gatggtgcgacgggcccagg

SEQ ID NO: 718356 - DNA, 20 bp, mouse
gaaaacacaacatatgtaaa

SEQ ID NO: 718357 - DNA, 20 bp, mouse
gcatcatctgacaaaagtat

SEQ ID NO: 718358 - DNA, 20 bp, mouse
gtggatctgatacaattttc

SEQ ID NO: 718359 - DNA, 20 bp, mouse
ggatattttgttcctacctc

SEQ ID NO: 718360 - DNA, 20 bp, mouse
gaaatgacctcctttgacag

SEQ ID NO: 718361 - DNA, 20 bp, mouse
gtgattacctctgtcaaagg

SEQ ID NO: 718362 - DNA, 20 bp, mouse
gtcttgtgtctttatctgtt

SEQ ID NO: 718363 - DNA, 20 bp, mouse
gggatctcatggtcacataa

SEQ ID NO: 718364 - DNA, 20 bp, mouse
gcatgagtgtagagagttac

SEQ ID NO: 718365 - DNA, 20 bp, mouse
ggaccatgagatcctgaggt

SEQ ID NO: 718366 - DNA, 20 bp, mouse
gggaatgaaaaggacaaata

SEQ ID NO: 718367 - DNA, 20 bp, mouse
gggagcagtatgtacagcca

SEQ ID NO: 718368 - DNA, 20 bp, mouse
gaggctgataaggcccatgg

SEQ ID NO: 718369 - DNA, 20 bp, mouse
ggctgtacatactgctccca

SEQ ID NO: 718370 - DNA, 20 bp, mouse
gtggatagagtcatctgccc

SEQ ID NO: 718371 - DNA, 20 bp, mouse
ggatgagtacagtaatccag

SEQ ID NO: 718372 - DNA, 20 bp, mouse
ggactctatccaggctgata

SEQ ID NO: 718373 - DNA, 20 bp, mouse
gcatggaaacttgtaagatt

SEQ ID NO: 718374 - DNA, 20 bp, mouse
gcttgctttgcaatgtactc

SEQ ID NO: 718375 - DNA, 20 bp, mouse
gtgtactctggctaaaacaa

SEQ ID NO: 718376 - DNA, 20 bp, mouse
gaacacaggaatgataattt

SEQ ID NO: 718377 - DNA, 20 bp, mouse
gctgatatagctgatctcat

SEQ ID NO: 718378 - DNA, 20 bp, mouse
gcagtggggtggtctctgaa

SEQ ID NO: 718379 - DNA, 20 bp, mouse
gcctatggaaggagttatag

SEQ ID NO: 718380 - DNA, 20 bp, mouse
gggatggatccccagtgggg

SEQ ID NO: 718381 - DNA, 20 bp, mouse
gtgctgtgagatagaacctt

SEQ ID NO: 718382 - DNA, 20 bp, mouse
gcttcattcctccttaccat

SEQ ID NO: 718383 - DNA, 20 bp, mouse
gatatgcaaacactgagaag

SEQ ID NO: 718384 - DNA, 20 bp, mouse
gataggtattttgttcccta

SEQ ID NO: 718385 - DNA, 20 bp, mouse
gtattttgttccctatggta

SEQ ID NO: 718386 - DNA, 20 bp, mouse
gggtgtgtaccggaatcagg

SEQ ID NO: 718387 - DNA, 20 bp, mouse
gctcctagatgtctcgacat

SEQ ID NO: 718388 - DNA, 20 bp, mouse
gtctcgacatgggtgtgtac

SEQ ID NO: 718389 - DNA, 20 bp, mouse
ggccacccaaaatctgcctt

SEQ ID NO: 718390 - DNA, 20 bp, mouse
gccaaggcgcccttgaatct

SEQ ID NO: 718391 - DNA, 20 bp, mouse
gcacccatgtcgagacatct

SEQ ID NO: 718392 - DNA, 20 bp, mouse
gcacctgcagccgcacccgc

SEQ ID NO: 718393 - DNA, 20 bp, mouse
gaccgaggggaccagaactg

SEQ ID NO: 718394 - DNA, 20 bp, mouse
gtccgcccaaggcagatttt

SEQ ID NO: 718395 - DNA, 20 bp, mouse
gaccgcataccccctgattc

SEQ ID NO: 718396 - DNA, 20 bp, mouse
gttcggggccagtgagaact

SEQ ID NO: 718397 - DNA, 20 bp, mouse
ggggaggtcacaatgggctg

SEQ ID NO: 718398 - DNA, 20 bp, mouse
ggtcctgagggcataatcaa

SEQ ID NO: 718399 - DNA, 20 bp, mouse
gaaaggcctgggtacagtca

SEQ ID NO: 718400 - DNA, 20 bp, mouse
gcatagtggcagagatttcg

SEQ ID NO: 718401 - DNA, 20 bp, mouse
gacacagagggccttgaacc

SEQ ID NO: 718402 - DNA, 20 bp, mouse
gtctggaaaaagccgagccc

SEQ ID NO: 718403 - DNA, 20 bp, mouse
gagctcattggcaacttcac

SEQ ID NO: 718404 - DNA, 20 bp, mouse
gccacacatgatttctccca

SEQ ID NO: 718405 - DNA, 20 bp, mouse
gatcctcacagggacacaga

SEQ ID NO: 718406 - DNA, 20 bp, mouse
gaaccccaaacccaacagca

SEQ ID NO: 718407 - DNA, 20 bp, mouse
gctatagcctgcacacacta

SEQ ID NO: 718408 - DNA, 20 bp, mouse
gaaagcccacttcactatga

SEQ ID NO: 718409 - DNA, 20 bp, mouse
gagggcagtaagtatcttgc

SEQ ID NO: 718410 - DNA, 20 bp, mouse
gtactccctcatagtgaagt

SEQ ID NO: 718411 - DNA, 20 bp, mouse
gtgccagggggccggaaaca

SEQ ID NO: 718412 - DNA, 20 bp, mouse
gcaaccttgctgttgggttt

SEQ ID NO: 718413 - DNA, 20 bp, mouse
gcagcgccgccttgtgtccg

SEQ ID NO: 718414 - DNA, 20 bp, mouse
gtgtccgaggtgcagcttca

SEQ ID NO: 718415 - DNA, 20 bp, mouse
gtaacagccaataaagacat

SEQ ID NO: 718416 - DNA, 20 bp, mouse
ggtctctacatcaaacccag

SEQ ID NO: 718417 - DNA, 20 bp, mouse
gggggaggttatggaacaaa

SEQ ID NO: 718418 - DNA, 20 bp, mouse
gtcatttgacagctcatgtg

SEQ ID NO: 718419 - DNA, 20 bp, mouse
gatgaagctaaaacttcatt

SEQ ID NO: 718420 - DNA, 20 bp, mouse
gtttgacagctcatgtgggg

SEQ ID NO: 718421 - DNA, 20 bp, mouse
ggggaacacatctctattgt

SEQ ID NO: 718422 - DNA, 20 bp, mouse
gaccacttgtaagatcaatc

SEQ ID NO: 718423 - DNA, 20 bp, mouse
ggccagattgatcttacaag

SEQ ID NO: 718424 - DNA, 20 bp, mouse
gggtgggtgtggctacaaaa

SEQ ID NO: 718425 - DNA, 20 bp, mouse
gtaggtaatgatattcccct

SEQ ID NO: 718426 - DNA, 20 bp, mouse
gaaatgtagaatatagaagt

SEQ ID NO: 718427 - DNA, 20 bp, mouse
gagtgggtgagggagcctgt

SEQ ID NO: 718428 - DNA, 20 bp, mouse
gctagagaaagtaaccaagg

SEQ ID NO: 718429 - DNA, 20 bp, mouse
gttagagacacgagctccgt

SEQ ID NO: 718430 - DNA, 20 bp, mouse
gagcagtgaccgaccgtcgg

SEQ ID NO: 718431 - DNA, 20 bp, mouse
gttcagcagtgaccgaccgt

SEQ ID NO: 718432 - DNA, 20 bp, mouse
gagtgaccgaccgtcggagg

SEQ ID NO: 718433 - DNA, 20 bp, mouse
gaagataaagaaaacacaaa

SEQ ID NO: 718434 - DNA, 20 bp, mouse
gtatcccaaaagttccccac

SEQ ID NO: 718435 - DNA, 20 bp, mouse
gggagcctgtggggaacttt

SEQ ID NO: 718436 - DNA, 20 bp, mouse
gtagttgtgaccaacagtgg

SEQ ID NO: 718437 - DNA, 20 bp, mouse
ggtgaccaacagtggtggtt

SEQ ID NO: 718438 - DNA, 20 bp, mouse
gaacagtggtggttgggaag

SEQ ID NO: 718439 - DNA, 20 bp, mouse
gagtcctaaagagaaggttg

SEQ ID NO: 718440 - DNA, 20 bp, mouse
gggcaaggggaaatgctata

SEQ ID NO: 718441 - DNA, 20 bp, mouse
ggaagagaaaagctagagac

SEQ ID NO: 718442 - DNA, 20 bp, mouse
gaatgctataaggagtgtgg

SEQ ID NO: 718443 - DNA, 20 bp, mouse
gaggcagcttttggatttca

SEQ ID NO: 718444 - DNA, 20 bp, mouse
gaatcactgaaaaagcagaa

SEQ ID NO: 718445 - DNA, 20 bp, mouse
gttctctttaggactcagaa

SEQ ID NO: 718446 - DNA, 20 bp, mouse
gaagaggagtacgtgagttc

SEQ ID NO: 718447 - DNA, 20 bp, mouse
gagagcctaccctctgtcga

SEQ ID NO: 718448 - DNA, 20 bp, mouse
ggaacaaggtctactgaaga

SEQ ID NO: 718449 - DNA, 20 bp, mouse
ggaacattccgagaggggtt

SEQ ID NO: 718450 - DNA, 20 bp, mouse
gtcgaagggatggagacctc

SEQ ID NO: 718451 - DNA, 20 bp, mouse
gtcaaatgatgcacccttct

SEQ ID NO: 718452 - DNA, 20 bp, mouse
gctgggggaacattccgaga

SEQ ID NO: 718453 - DNA, 20 bp, mouse
gctaccctctgtcgaaggga

SEQ ID NO: 718454 - DNA, 20 bp, mouse
gatggagacctcaggatgaa

SEQ ID NO: 718455 - DNA, 20 bp, mouse
gggaagtaaaacaggactgg

SEQ ID NO: 718456 - DNA, 20 bp, mouse
gtgcatgtcagtctctcccg

SEQ ID NO: 718457 - DNA, 20 bp, mouse
ggacaaagccttatctccta

SEQ ID NO: 718458 - DNA, 20 bp, mouse
gcgtggcttatgaagacccc

SEQ ID NO: 718459 - DNA, 20 bp, mouse
gtgctggcaggactccttgt

SEQ ID NO: 718460 - DNA, 20 bp, mouse
gataaattaatgcttgcaag

SEQ ID NO: 718461 - DNA, 20 bp, mouse
gagccttatctcctaaggaa

SEQ ID NO: 718462 - DNA, 20 bp, mouse
gtctcctaaggaatggaggg

SEQ ID NO: 718463 - DNA, 20 bp, mouse
gaacaggaagaatgaagtcc

SEQ ID NO: 718464 - DNA, 20 bp, mouse
gatgtgggagtgctgagtta

SEQ ID NO: 718465 - DNA, 20 bp, mouse
gaggggctggagaacccaca

SEQ ID NO: 718466 - DNA, 20 bp, mouse
gtggtgactttggcgggctg

SEQ ID NO: 718467 - DNA, 20 bp, mouse
gcaataaacgtaaactgtaa

SEQ ID NO: 718468 - DNA, 20 bp, mouse
gctcaaaaaacagacgagcc

SEQ ID NO: 718469 - DNA, 20 bp, mouse
ggacctcacacagtgtgctg

SEQ ID NO: 718470 - DNA, 20 bp, mouse
gaaagccctgggagacggac

SEQ ID NO: 718471 - DNA, 20 bp, mouse
gaatccatatggcagaaggt

SEQ ID NO: 718472 - DNA, 20 bp, mouse
gtaccacagcacactgtgtg

SEQ ID NO: 718473 - DNA, 20 bp, mouse
gttgagctgcagaatccata

SEQ ID NO: 718474 - DNA, 20 bp, mouse
gttatcacagcagtgataaa

SEQ ID NO: 718475 - DNA, 20 bp, mouse
ggcagaatccatatggcaga

SEQ ID NO: 718476 - DNA, 20 bp, mouse
gccaacaaggacactgtgtc

SEQ ID NO: 718477 - DNA, 20 bp, mouse
gtcaacttgttacaaggggt

SEQ ID NO: 718478 - DNA, 20 bp, mouse
gttctcaatactcgttctga

SEQ ID NO: 718479 - DNA, 20 bp, mouse
ggagagacaatgtatcaaag

SEQ ID NO: 718480 - DNA, 20 bp, mouse
gcttgtgagcagacagaaga

SEQ ID NO: 718481 - DNA, 20 bp, mouse
gttgatatacatcaaatcta

SEQ ID NO: 718482 - DNA, 20 bp, mouse
gtacataattgagctgactg

SEQ ID NO: 718483 - DNA, 20 bp, mouse
gaagaggcatacagattttg

SEQ ID NO: 718484 - DNA, 20 bp, mouse
gagctcaattatgtacgaag

SEQ ID NO: 718485 - DNA, 20 bp, mouse
gattatgtacgaagagggaa

SEQ ID NO: 718486 - DNA, 20 bp, mouse
gggtactcccgcaggcatcc

SEQ ID NO: 718487 - DNA, 20 bp, mouse
ggagtggtatgtgcctcaag

SEQ ID NO: 718488 - DNA, 20 bp, mouse
gcctcaaagcacaccacttg

SEQ ID NO: 718489 - DNA, 20 bp, mouse
gaggtgttccctcctgctgg

SEQ ID NO: 718490 - DNA, 20 bp, mouse
gaccaggtgggtactcccgc

SEQ ID NO: 718491 - DNA, 20 bp, mouse
gcctgctggaggatctgagc

SEQ ID NO: 718492 - DNA, 20 bp, mouse
gggcaggtgttccctcctgc

SEQ ID NO: 718493 - DNA, 20 bp, mouse
ggtgtgtaataagaccaggt

SEQ ID NO: 718494 - DNA, 20 bp, mouse
gacccaaggatcatgcccaa

SEQ ID NO: 718495 - DNA, 20 bp, mouse
gtacccttgggcatgatcct

SEQ ID NO: 718496 - DNA, 20 bp, mouse
gtaaaccaaaccatgtctcc

SEQ ID NO: 718497 - DNA, 20 bp, mouse
gaataagagggctggagacc

SEQ ID NO: 718498 - DNA, 20 bp, mouse
gtcccaaatgttgggagcgc

SEQ ID NO: 718499 - DNA, 20 bp, mouse
gaatgtggagtcttgcctgg

SEQ ID NO: 718500 - DNA, 20 bp, mouse
gagccagcgctcccaacatt

SEQ ID NO: 718501 - DNA, 20 bp, mouse
gagcgctggcttgcaccacc

SEQ ID NO: 718502 - DNA, 20 bp, mouse
gaagaataataattaccgcc

SEQ ID NO: 718503 - DNA, 20 bp, mouse
gaaaaatcttcccaaatgtt

SEQ ID NO: 718504 - DNA, 20 bp, mouse
gatcaatgtggagtcttgcc

SEQ ID NO: 718505 - DNA, 20 bp, mouse
gtaataattaccgccaggct

SEQ ID NO: 718506 - DNA, 20 bp, mouse
gaaaaaaatgccccgtatca

SEQ ID NO: 718507 - DNA, 20 bp, mouse
gggtttaattgtacaaaata

SEQ ID NO: 718508 - DNA, 20 bp, mouse
gatgagttttacaaaatctc

SEQ ID NO: 718509 - DNA, 20 bp, mouse
gaacggtgtattccttgata

SEQ ID NO: 718510 - DNA, 20 bp, mouse
gcaacctctccttcctaagt

SEQ ID NO: 718511 - DNA, 20 bp, mouse
gagaattctcctacttagga

SEQ ID NO: 718512 - DNA, 20 bp, mouse
gtctcctacttaggaaggag

SEQ ID NO: 718513 - DNA, 20 bp, mouse
gtctctaggaattgtggatt

SEQ ID NO: 718514 - DNA, 20 bp, mouse
gcccaaatctctaggaattg

SEQ ID NO: 718515 - DNA, 20 bp, mouse
gagttagaattctcctactt

SEQ ID NO: 718516 - DNA, 20 bp, mouse
ggtaccacttcgctcccctg

SEQ ID NO: 718517 - DNA, 20 bp, mouse
gtggatccagggaaatcgta

SEQ ID NO: 718518 - DNA, 20 bp, mouse
gacttcattacattcatggc

SEQ ID NO: 718519 - DNA, 20 bp, mouse
gagcactgtttctgcctaga

SEQ ID NO: 718520 - DNA, 20 bp, mouse
gcatgaatgtaatgaagtaa

SEQ ID NO: 718521 - DNA, 20 bp, mouse
gattccccaggggagcgaag

SEQ ID NO: 718522 - DNA, 20 bp, mouse
gagctgccctacgatttccc

SEQ ID NO: 718523 - DNA, 20 bp, mouse
ggtgattgaaaagtggatcc

SEQ ID NO: 718524 - DNA, 20 bp, mouse
gacgtgttttcatatgtcca

SEQ ID NO: 718525 - DNA, 20 bp, mouse
gttaatttgattgttttgat

SEQ ID NO: 718526 - DNA, 20 bp, mouse
ggggatgagtactaagtcgt

SEQ ID NO: 718527 - DNA, 20 bp, mouse
gaactcccaggtcttcaagg

SEQ ID NO: 718528 - DNA, 20 bp, mouse
gccgaaatggcacacggtga

SEQ ID NO: 718529 - DNA, 20 bp, mouse
gcaactcagcagtaactccc

SEQ ID NO: 718530 - DNA, 20 bp, mouse
gctgaaggccagttttatag

SEQ ID NO: 718531 - DNA, 20 bp, mouse
gtcgggaagatggaaaggtc

SEQ ID NO: 718532 - DNA, 20 bp, mouse
ggagttggcacagtttcagt

SEQ ID NO: 718533 - DNA, 20 bp, mouse
gaagaagccgaaatggcaca

SEQ ID NO: 718534 - DNA, 20 bp, mouse
ggaaagcagaatggtgggtg

SEQ ID NO: 718535 - DNA, 20 bp, mouse
gttgtgaccacaacacattt

SEQ ID NO: 718536 - DNA, 20 bp, mouse
gggaaaaaatccagaataat

SEQ ID NO: 718537 - DNA, 20 bp, mouse
ggagcaagaccctattattc

SEQ ID NO: 718538 - DNA, 20 bp, mouse
ggtactcctcaatttgagct

SEQ ID NO: 718539 - DNA, 20 bp, mouse
gtgcatctctacccatgtgc

SEQ ID NO: 718540 - DNA, 20 bp, mouse
gtcctcaatttgagcttgga

SEQ ID NO: 718541 - DNA, 20 bp, mouse
ggccttacaaagttagcaca

SEQ ID NO: 718542 - DNA, 20 bp, mouse
gaccttccaagctcaaattg

SEQ ID NO: 718543 - DNA, 20 bp, mouse
gacccatgtgctggctaaaa

SEQ ID NO: 718544 - DNA, 20 bp, mouse
gactgctgtaactcaatata

SEQ ID NO: 718545 - DNA, 20 bp, mouse
ggaccattttagccagcaca

SEQ ID NO: 718546 - DNA, 20 bp, mouse
gaggccatggggggccgcaa

SEQ ID NO: 718547 - DNA, 20 bp, mouse
gtgcaggagtgcagctcctt

SEQ ID NO: 718548 - DNA, 20 bp, mouse
gtcaaggggcaaacaggacc

SEQ ID NO: 718549 - DNA, 20 bp, mouse
gaagcctttgcggcccccca

SEQ ID NO: 718550 - DNA, 20 bp, mouse
gggcggattctgaggccatg

SEQ ID NO: 718551 - DNA, 20 bp, mouse
gtgcactcctgcacctgcgg

SEQ ID NO: 718552 - DNA, 20 bp, mouse
gagctgcactcctgcacctg

SEQ ID NO: 718553 - DNA, 20 bp, mouse
gtagctctcaaggggcaaac

SEQ ID NO: 718554 - DNA, 20 bp, mouse
gaggtgcttgggagcggccc

SEQ ID NO: 718555 - DNA, 20 bp, mouse
gaggctgtgctttgcacccc

SEQ ID NO: 718556 - DNA, 20 bp, mouse
gctaggtcgagtgacatata

SEQ ID NO: 718557 - DNA, 20 bp, mouse
gtagcaatagagcaaaggat

SEQ ID NO: 718558 - DNA, 20 bp, mouse
gtgatttagcaatagagcaa

SEQ ID NO: 718559 - DNA, 20 bp, mouse
gctgcttcagctccctgaaa

SEQ ID NO: 718560 - DNA, 20 bp, mouse
gctactcaaaatgacctccc

SEQ ID NO: 718561 - DNA, 20 bp, mouse
gtgcacacacaggaacacac

SEQ ID NO: 718562 - DNA, 20 bp, mouse
gtattctttcaaaccctttc

SEQ ID NO: 718563 - DNA, 20 bp, mouse
gtgtcatgtgatatattctt

SEQ ID NO: 718564 - DNA, 20 bp, mouse
gaggtcattttgagtagcac

SEQ ID NO: 718565 - DNA, 20 bp, mouse
ggatcttaagctgcacacac

SEQ ID NO: 718566 - DNA, 20 bp, mouse
gaaaaaacatgcataaaaat

SEQ ID NO: 718567 - DNA, 20 bp, mouse
gtctctgcactcacagagta

SEQ ID NO: 718568 - DNA, 20 bp, mouse
gaaggggacacaggagtaag

SEQ ID NO: 718569 - DNA, 20 bp, mouse
ggacacaggagtaagtggag

SEQ ID NO: 718570 - DNA, 20 bp, mouse
gagctagacgtcaaagagag

SEQ ID NO: 718571 - DNA, 20 bp, mouse
gacagatgtaaatgaaaact

SEQ ID NO: 718572 - DNA, 20 bp, mouse
gctaggtgagagtttagcct

SEQ ID NO: 718573 - DNA, 20 bp, mouse
gttctggattacagattcca

SEQ ID NO: 718574 - DNA, 20 bp, mouse
gtgtgtccatgtgctggtat

SEQ ID NO: 718575 - DNA, 20 bp, mouse
gtgagccatgactagaagat

SEQ ID NO: 718576 - DNA, 20 bp, mouse
gcattttaaaaataaaactt

SEQ ID NO: 718577 - DNA, 20 bp, mouse
gctgccatagagaagattag

SEQ ID NO: 718578 - DNA, 20 bp, mouse
gtcgggcccaatacactcct

SEQ ID NO: 718579 - DNA, 20 bp, mouse
gtctcagagcagagcttctc

SEQ ID NO: 718580 - DNA, 20 bp, mouse
gagcaaaacaacatcagcaa

SEQ ID NO: 718581 - DNA, 20 bp, mouse
gtctgtcctaggagtgtatt

SEQ ID NO: 718582 - DNA, 20 bp, mouse
gaatctaatgagtgtcttac

SEQ ID NO: 718583 - DNA, 20 bp, mouse
gggtcctctaatcttctcta

SEQ ID NO: 718584 - DNA, 20 bp, mouse
gcttagtgcaatgaaggcaa

SEQ ID NO: 718585 - DNA, 20 bp, mouse
ggtttatcttagtgcaatga

SEQ ID NO: 718586 - DNA, 20 bp, mouse
gcaagagatggagggtactg

SEQ ID NO: 718587 - DNA, 20 bp, mouse
ggagggcggacggggcggac

SEQ ID NO: 718588 - DNA, 20 bp, mouse
ggagatggagggtactgagg

SEQ ID NO: 718589 - DNA, 20 bp, mouse
gaatctgggtctaggttttt

SEQ ID NO: 718590 - DNA, 20 bp, mouse
gaagaggaaaacatacaaac

SEQ ID NO: 718591 - DNA, 20 bp, mouse
ggtactgaggaggctagtga

SEQ ID NO: 718592 - DNA, 20 bp, mouse
gaggctagtgagggcggacg

SEQ ID NO: 718593 - DNA, 20 bp, mouse
ggatagttggggagcaggtg

SEQ ID NO: 718594 - DNA, 20 bp, mouse
gctgaggaggctagtgaggg

SEQ ID NO: 718595 - DNA, 20 bp, mouse
gagaagagtgacgatagttg

SEQ ID NO: 718596 - DNA, 20 bp, mouse
gagggaagggaagttgtcag

SEQ ID NO: 718597 - DNA, 20 bp, mouse
gttactaccgaggttataca

SEQ ID NO: 718598 - DNA, 20 bp, mouse
gataagaggacattcgacct

SEQ ID NO: 718599 - DNA, 20 bp, mouse
gaccacgtccagaaacagtg

SEQ ID NO: 718600 - DNA, 20 bp, mouse
gggctatgcaagagttaatg

SEQ ID NO: 718601 - DNA, 20 bp, mouse
gtgcttccaacacctctagg

SEQ ID NO: 718602 - DNA, 20 bp, mouse
gtcatcagcctgctataaat

SEQ ID NO: 718603 - DNA, 20 bp, mouse
gtcaagcctcctagaggtgt

SEQ ID NO: 718604 - DNA, 20 bp, mouse
gggtggctgctgacagcagt

SEQ ID NO: 718605 - DNA, 20 bp, mouse
gctgagaccaaggtcctctc

SEQ ID NO: 718606 - DNA, 20 bp, mouse
ggtagaagacatatctgtct

SEQ ID NO: 718607 - DNA, 20 bp, mouse
ggggactctcagaacagcac

SEQ ID NO: 718608 - DNA, 20 bp, mouse
ggaggtgagcaatgtactgt

SEQ ID NO: 718609 - DNA, 20 bp, mouse
gaagtgaaacacatcttaat

SEQ ID NO: 718610 - DNA, 20 bp, mouse
gggttatgcaactgtgtttt

SEQ ID NO: 718611 - DNA, 20 bp, mouse
gcatagtgcttaaacttcac

SEQ ID NO: 718612 - DNA, 20 bp, mouse
ggagcaatgtactgtaggac

SEQ ID NO: 718613 - DNA, 20 bp, mouse
ggcataacctgttgtaatta

SEQ ID NO: 718614 - DNA, 20 bp, mouse
gatcagtccataattacaac

SEQ ID NO: 718615 - DNA, 20 bp, mouse
gaacttacttgttggaggtt

SEQ ID NO: 718616 - DNA, 20 bp, mouse
gttgaactcaggactgtcca

SEQ ID NO: 718617 - DNA, 20 bp, mouse
gtaggcagtaagaagtgtcc

SEQ ID NO: 718618 - DNA, 20 bp, mouse
gtagagtttcatcactgtgg

SEQ ID NO: 718619 - DNA, 20 bp, mouse
ggaagtgtcagaactattta

SEQ ID NO: 718620 - DNA, 20 bp, mouse
gtagttctgacacttcattg

SEQ ID NO: 718621 - DNA, 20 bp, mouse
ggattagagtttcatcactg

SEQ ID NO: 718622 - DNA, 20 bp, mouse
gtgtcagaactatttatgga

SEQ ID NO: 718623 - DNA, 20 bp, mouse
ggacagaaaggggatgatgc

SEQ ID NO: 718624 - DNA, 20 bp, mouse
gagtttcatcactgtggagg

SEQ ID NO: 718625 - DNA, 20 bp, mouse
gattcagtgctaacaatcac

SEQ ID NO: 718626 - DNA, 20 bp, mouse
gtaagagaatatggcttcca

SEQ ID NO: 718627 - DNA, 20 bp, mouse
gcaggattttcaagcagcgg

SEQ ID NO: 718628 - DNA, 20 bp, mouse
gtctgattctaggcatgttg

SEQ ID NO: 718629 - DNA, 20 bp, mouse
gctggcagaagctgggttta

SEQ ID NO: 718630 - DNA, 20 bp, mouse
gtgagtctaaatctgattct

SEQ ID NO: 718631 - DNA, 20 bp, mouse
gggcatgttggggtttgcag

SEQ ID NO: 718632 - DNA, 20 bp, mouse
gagagtgatgttctgatgtt

SEQ ID NO: 718633 - DNA, 20 bp, mouse
gtgtgttaggataaaggaaa

SEQ ID NO: 718634 - DNA, 20 bp, mouse
gcagctaatacctagatcct

SEQ ID NO: 718635 - DNA, 20 bp, mouse
ggacaccaattagttgtgtt

SEQ ID NO: 718636 - DNA, 20 bp, mouse
gaagctatacaattcaatgt

SEQ ID NO: 718637 - DNA, 20 bp, mouse
gtgcttagggagcagcagga

SEQ ID NO: 718638 - DNA, 20 bp, mouse
gaagcaggagtgggttgctt

SEQ ID NO: 718639 - DNA, 20 bp, mouse
gttggccactaagcaggagt

SEQ ID NO: 718640 - DNA, 20 bp, mouse
ggggttgcttagggagcagc

SEQ ID NO: 718641 - DNA, 20 bp, mouse
ggcaacccactcctgcttag

SEQ ID NO: 718642 - DNA, 20 bp, mouse
gaatgcattggccactaagc

SEQ ID NO: 718643 - DNA, 20 bp, mouse
ggccaggaagtatttaacag

SEQ ID NO: 718644 - DNA, 20 bp, mouse
gacaatatgttccagagtct

SEQ ID NO: 718645 - DNA, 20 bp, mouse
gcaactgatataagtataga

SEQ ID NO: 718646 - DNA, 20 bp, mouse
gcagggaactgtgttttctc

SEQ ID NO: 718647 - DNA, 20 bp, mouse
gtgtggctttgacaggtaaa

SEQ ID NO: 718648 - DNA, 20 bp, mouse
ggggagaaatggcttctctg

SEQ ID NO: 718649 - DNA, 20 bp, mouse
ggctgactccagggacggac

SEQ ID NO: 718650 - DNA, 20 bp, mouse
gccagggacggactggctca

SEQ ID NO: 718651 - DNA, 20 bp, mouse
ggtctcagatttggagagtg

SEQ ID NO: 718652 - DNA, 20 bp, mouse
gggaatgaagtcaagaaaaa

SEQ ID NO: 718653 - DNA, 20 bp, mouse
gagactgcatatggaacatt

SEQ ID NO: 718654 - DNA, 20 bp, mouse
gggactggctcagggcagtg

SEQ ID NO: 718655 - DNA, 20 bp, mouse
gttgacaggtaaatggcttc

SEQ ID NO: 718656 - DNA, 20 bp, mouse
gtgtcagagtgatgaccagg

SEQ ID NO: 718657 - DNA, 20 bp, mouse
gtctgcctctaagtcaattg

SEQ ID NO: 718658 - DNA, 20 bp, mouse
gaccactccgatatctacaa

SEQ ID NO: 718659 - DNA, 20 bp, mouse
gacatacactagctagtcta

SEQ ID NO: 718660 - DNA, 20 bp, mouse
gacctttgtagatatcggag

SEQ ID NO: 718661 - DNA, 20 bp, mouse
gctagctagtgtatgtggcc

SEQ ID NO: 718662 - DNA, 20 bp, mouse
gcggagtggttgattgtgcc

SEQ ID NO: 718663 - DNA, 20 bp, mouse
ggggaggtctggtgggtggg

SEQ ID NO: 718664 - DNA, 20 bp, mouse
ggggacatcctctttgagaa

SEQ ID NO: 718665 - DNA, 20 bp, mouse
gaactgtcagagtgatgacc

SEQ ID NO: 718666 - DNA, 20 bp, mouse
gaaaaggaaaacgtaaatga

SEQ ID NO: 718667 - DNA, 20 bp, mouse
gtaaggaaatgcattcagaa

SEQ ID NO: 718668 - DNA, 20 bp, mouse
gtgtttgggtttagaattcc

SEQ ID NO: 718669 - DNA, 20 bp, mouse
gaacttcgccaaagaataaa

SEQ ID NO: 718670 - DNA, 20 bp, mouse
gagggcaaagactctgcacc

SEQ ID NO: 718671 - DNA, 20 bp, mouse
gtttaattgacaatctgttt

SEQ ID NO: 718672 - DNA, 20 bp, mouse
gttctttggcgaagttggaa

SEQ ID NO: 718673 - DNA, 20 bp, mouse
ggtagcagaacaacccctgc

SEQ ID NO: 718674 - DNA, 20 bp, mouse
ggctgaagaagaaaatttta

SEQ ID NO: 718675 - DNA, 20 bp, mouse
ggaaaaacagagtatttata

SEQ ID NO: 718676 - DNA, 20 bp, mouse
ggtgtgtcatagcacgaatg

SEQ ID NO: 718677 - DNA, 20 bp, mouse
ggtagcctcacctagcaata

SEQ ID NO: 718678 - DNA, 20 bp, mouse
gtacctggagcctgtctctt

SEQ ID NO: 718679 - DNA, 20 bp, mouse
gtggttggtgtggtaggtaa

SEQ ID NO: 718680 - DNA, 20 bp, mouse
gtaggggaagctactgcatt

SEQ ID NO: 718681 - DNA, 20 bp, mouse
gtggagcctgtctctttggt

SEQ ID NO: 718682 - DNA, 20 bp, mouse
gatagaattaaactagaaag

SEQ ID NO: 718683 - DNA, 20 bp, mouse
ggtagccatattgctaggtg

SEQ ID NO: 718684 - DNA, 20 bp, mouse
gtctctttggttggtgtggt

SEQ ID NO: 718685 - DNA, 20 bp, mouse
gcctgtctctttggttggtg

SEQ ID NO: 718686 - DNA, 20 bp, mouse
gtgaggtccagcaactcaaa

SEQ ID NO: 718687 - DNA, 20 bp, mouse
ggacactggtcacatataac

SEQ ID NO: 718688 - DNA, 20 bp, mouse
gagccccagcctcaccctaa

SEQ ID NO: 718689 - DNA, 20 bp, mouse
gctcaccctaagggcataca

SEQ ID NO: 718690 - DNA, 20 bp, mouse
gactcaaagggctgattgga

SEQ ID NO: 718691 - DNA, 20 bp, mouse
ggagttccctgtatgccctt

SEQ ID NO: 718692 - DNA, 20 bp, mouse
gcatataacgggcttcggaa

SEQ ID NO: 718693 - DNA, 20 bp, mouse
gtatgcccttagggtgaggc

SEQ ID NO: 718694 - DNA, 20 bp, mouse
gaagcagaatagggcactct

SEQ ID NO: 718695 - DNA, 20 bp, mouse
gcagaagacactttgatagc

SEQ ID NO: 718696 - DNA, 20 bp, mouse
gtagtcatcttgtaaccagg

SEQ ID NO: 718697 - DNA, 20 bp, mouse
gcaagagaggaacagcaagg

SEQ ID NO: 718698 - DNA, 20 bp, mouse
gggccccaggttcacattcc

SEQ ID NO: 718699 - DNA, 20 bp, mouse
gttgcctggaatgtgaacct

SEQ ID NO: 718700 - DNA, 20 bp, mouse
ggtctagagctaggcatccc

SEQ ID NO: 718701 - DNA, 20 bp, mouse
ggctgtcacagaactccatg

SEQ ID NO: 718702 - DNA, 20 bp, mouse
gacacacagagtctagagct

SEQ ID NO: 718703 - DNA, 20 bp, mouse
gagaagactcaagctcctca

SEQ ID NO: 718704 - DNA, 20 bp, mouse
gaggcaagagaggaacagca

SEQ ID NO: 718705 - DNA, 20 bp, mouse
gcagacatacgctctttgga

SEQ ID NO: 718706 - DNA, 20 bp, mouse
gctcagtgatggggagacaa

SEQ ID NO: 718707 - DNA, 20 bp, mouse
gcccctacctttaatctcaa

SEQ ID NO: 718708 - DNA, 20 bp, mouse
gctcctggaactgtgccact

SEQ ID NO: 718709 - DNA, 20 bp, mouse
gagtcgaaacaagctgagaa

SEQ ID NO: 718710 - DNA, 20 bp, mouse
gcctgagctaacatagatac

SEQ ID NO: 718711 - DNA, 20 bp, mouse
gcagaggcattagattccgc

SEQ ID NO: 718712 - DNA, 20 bp, mouse
gaattgaacctagttcctcc

SEQ ID NO: 718713 - DNA, 20 bp, mouse
gaaaaaaaagataattacag

SEQ ID NO: 718714 - DNA, 20 bp, mouse
gtgcctttgagattaaaggt

SEQ ID NO: 718715 - DNA, 20 bp, mouse
gggggatctctgttagttta

SEQ ID NO: 718716 - DNA, 20 bp, mouse
gagccacaatacagtggact

SEQ ID NO: 718717 - DNA, 20 bp, mouse
gctatccctcttcttcttga

SEQ ID NO: 718718 - DNA, 20 bp, mouse
gcctggaggtcaatgggtat

SEQ ID NO: 718719 - DNA, 20 bp, mouse
gaatgctagccacaatacag

SEQ ID NO: 718720 - DNA, 20 bp, mouse
ggggagagaatattggacca

SEQ ID NO: 718721 - DNA, 20 bp, mouse
gtgagttcctggaggtcaat

SEQ ID NO: 718722 - DNA, 20 bp, mouse
gtatcatacttgcccatttt

SEQ ID NO: 718723 - DNA, 20 bp, mouse
ggaagaagacaattctaaac

SEQ ID NO: 718724 - DNA, 20 bp, mouse
gtgtcatatatatgagttcc

SEQ ID NO: 718725 - DNA, 20 bp, mouse
gttctctttgagaggagcct

SEQ ID NO: 718726 - DNA, 20 bp, mouse
gaatgcacagaaatcatgtc

SEQ ID NO: 718727 - DNA, 20 bp, mouse
ggtaactgagagagcaacgg

SEQ ID NO: 718728 - DNA, 20 bp, mouse
gattaaaggggtggaattaa

SEQ ID NO: 718729 - DNA, 20 bp, mouse
gaatctctttaatccgattt

SEQ ID NO: 718730 - DNA, 20 bp, mouse
gaactgagtaagggattaac

SEQ ID NO: 718731 - DNA, 20 bp, mouse
ggtaatgaccagtaatagaa

SEQ ID NO: 718732 - DNA, 20 bp, mouse
gaggctttctgtttcagatt

SEQ ID NO: 718733 - DNA, 20 bp, mouse
ggtaactgagtaactgagta

SEQ ID NO: 718734 - DNA, 20 bp, mouse
ggaccagtaatagaaggggt

SEQ ID NO: 718735 - DNA, 20 bp, mouse
ggaacaagagttgtcaatct

SEQ ID NO: 718736 - DNA, 20 bp, mouse
gtcgagcataaggtggactc

SEQ ID NO: 718737 - DNA, 20 bp, mouse
gggagcatgggaaatggcac

SEQ ID NO: 718738 - DNA, 20 bp, mouse
gaacatggagaaacatgcag

SEQ ID NO: 718739 - DNA, 20 bp, mouse
ggctccaattggtttctctt

SEQ ID NO: 718740 - DNA, 20 bp, mouse
gcgatctctaggaaaggtta

SEQ ID NO: 718741 - DNA, 20 bp, mouse
gctagagatcgagcataagg

SEQ ID NO: 718742 - DNA, 20 bp, mouse
ggcaccactggcaacttctc

SEQ ID NO: 718743 - DNA, 20 bp, mouse
gctccctaagagaaaccaat

SEQ ID NO: 718744 - DNA, 20 bp, mouse
gtgtccagagaagttgccag

SEQ ID NO: 718745 - DNA, 20 bp, mouse
gctaactcagagatgatgct

SEQ ID NO: 718746 - DNA, 20 bp, mouse
gcccgagtggggggattaaa

SEQ ID NO: 718747 - DNA, 20 bp, mouse
gaacaaaaaaaaactctacc

SEQ ID NO: 718748 - DNA, 20 bp, mouse
gagtgaggagccaagtgtgt

SEQ ID NO: 718749 - DNA, 20 bp, mouse
gaggggtacgccaacacact

SEQ ID NO: 718750 - DNA, 20 bp, mouse
gtaatcatttatatatttcc

SEQ ID NO: 718751 - DNA, 20 bp, mouse
gctgcctcggcctcccgagt

SEQ ID NO: 718752 - DNA, 20 bp, mouse
gtgcaagtccctaggagaga

SEQ ID NO: 718753 - DNA, 20 bp, mouse
gagctgtgcccctctctcct

SEQ ID NO: 718754 - DNA, 20 bp, mouse
gtatttctccccgccccctt

SEQ ID NO: 718755 - DNA, 20 bp, mouse
ggctgttattattttttgtt

SEQ ID NO: 718756 - DNA, 20 bp, mouse
gagactgaagtccctaggtg

SEQ ID NO: 718757 - DNA, 20 bp, mouse
gctggtcagacccatagcct

SEQ ID NO: 718758 - DNA, 20 bp, mouse
gggaccttcaagtgacgctc

SEQ ID NO: 718759 - DNA, 20 bp, mouse
ggggagctgccaagacatct

SEQ ID NO: 718760 - DNA, 20 bp, mouse
gggtaactggacctacgggg

SEQ ID NO: 718761 - DNA, 20 bp, mouse
gacttgaaggtccgccccgt

SEQ ID NO: 718762 - DNA, 20 bp, mouse
gatcctggtaactggaccta

SEQ ID NO: 718763 - DNA, 20 bp, mouse
gcagtggtctccatgacact

SEQ ID NO: 718764 - DNA, 20 bp, mouse
gtgaccagagcgtcacttga

SEQ ID NO: 718765 - DNA, 20 bp, mouse
ggagacctaactaagtcact

SEQ ID NO: 718766 - DNA, 20 bp, mouse
gagcaacagaatatggaagg

SEQ ID NO: 718767 - DNA, 20 bp, mouse
gaggacacatcacacatctg

SEQ ID NO: 718768 - DNA, 20 bp, mouse
gctgactcagcaacagaata

SEQ ID NO: 718769 - DNA, 20 bp, mouse
gagcatgtgacttttaaaga

SEQ ID NO: 718770 - DNA, 20 bp, mouse
gaatatggaaggagggagaa

SEQ ID NO: 718771 - DNA, 20 bp, mouse
ggaagggaaaggacacaaga

SEQ ID NO: 718772 - DNA, 20 bp, mouse
gagagggcatgctgggatgg

SEQ ID NO: 718773 - DNA, 20 bp, mouse
gagggctcctggctggggag

SEQ ID NO: 718774 - DNA, 20 bp, mouse
gaggacacaagagggcatgc

SEQ ID NO: 718775 - DNA, 20 bp, mouse
gaagaacaaaagatagacag

SEQ ID NO: 718776 - DNA, 20 bp, mouse
gaagcacagcggcccctaga

SEQ ID NO: 718777 - DNA, 20 bp, mouse
gaaaggcaggatgctctgaa

SEQ ID NO: 718778 - DNA, 20 bp, mouse
gacaaacagcctggaaaggc

SEQ ID NO: 718779 - DNA, 20 bp, mouse
ggcaggatgctctgaatggc

SEQ ID NO: 718780 - DNA, 20 bp, mouse
gcagagcatcctgcctttcc

SEQ ID NO: 718781 - DNA, 20 bp, mouse
gaagccacctgcacgctctc

SEQ ID NO: 718782 - DNA, 20 bp, mouse
gcttccggagagcgtgcagg

SEQ ID NO: 718783 - DNA, 20 bp, mouse
gttagtaggtggtccaaata

SEQ ID NO: 718784 - DNA, 20 bp, mouse
ggccctctctcaagcggcgt

SEQ ID NO: 718785 - DNA, 20 bp, mouse
gttgccaagcaacgatctcc

SEQ ID NO: 718786 - DNA, 20 bp, mouse
gactcaggggacattgatgc

SEQ ID NO: 718787 - DNA, 20 bp, mouse
gccaatggttggatgaggtc

SEQ ID NO: 718788 - DNA, 20 bp, mouse
ggatgaggtcggggtcccta

SEQ ID NO: 718789 - DNA, 20 bp, mouse
gggggacattgatgctggtg

SEQ ID NO: 718790 - DNA, 20 bp, mouse
gtcaactaatccagatcccg

SEQ ID NO: 718791 - DNA, 20 bp, mouse
gtaaagccaatggttggatg

SEQ ID NO: 718792 - DNA, 20 bp, mouse
gccaggcacaggtatggcaa

SEQ ID NO: 718793 - DNA, 20 bp, mouse
ggtttggtgccggcccagag

SEQ ID NO: 718794 - DNA, 20 bp, mouse
gccattggctttaagtatct

SEQ ID NO: 718795 - DNA, 20 bp, mouse
gcattgatgctggtgaggat

SEQ ID NO: 718796 - DNA, 20 bp, mouse
ggaatgcagacgaatctgtg

SEQ ID NO: 718797 - DNA, 20 bp, mouse
gccaatgaggtctgagtcca

SEQ ID NO: 718798 - DNA, 20 bp, mouse
gatctgtgaggctgccaatg

SEQ ID NO: 718799 - DNA, 20 bp, mouse
ggcactgatactcaggtata

SEQ ID NO: 718800 - DNA, 20 bp, mouse
gaggtataaggaacaaaacg

SEQ ID NO: 718801 - DNA, 20 bp, mouse
ggatttggaaaaaagaaagc

SEQ ID NO: 718802 - DNA, 20 bp, mouse
gctgtctcagcagcaggatt

SEQ ID NO: 718803 - DNA, 20 bp, mouse
ggcccttgctgactcttgtg

SEQ ID NO: 718804 - DNA, 20 bp, mouse
gcaccacacaagagtcagca

SEQ ID NO: 718805 - DNA, 20 bp, mouse
gttttgcctgtctcagcagc

SEQ ID NO: 718806 - DNA, 20 bp, mouse
ggacacaggcgccagtcaga

SEQ ID NO: 718807 - DNA, 20 bp, mouse
gcagagggagaagatagctt

SEQ ID NO: 718808 - DNA, 20 bp, mouse
ggggtcccgggaacccccga

SEQ ID NO: 718809 - DNA, 20 bp, mouse
gaagtcaagcctgggaaggc

SEQ ID NO: 718810 - DNA, 20 bp, mouse
gggtggccacgccccctcgg

SEQ ID NO: 718811 - DNA, 20 bp, mouse
ggactggcgcctgtgtccac

SEQ ID NO: 718812 - DNA, 20 bp, mouse
ggagcaagccgtagagtggg

SEQ ID NO: 718813 - DNA, 20 bp, mouse
gtcagacttgagtttgtcaa

SEQ ID NO: 718814 - DNA, 20 bp, mouse
gacagagcaagccgtagagt

SEQ ID NO: 718815 - DNA, 20 bp, mouse
ggatgaagtcaagcctggga

SEQ ID NO: 718816 - DNA, 20 bp, mouse
gtgccccagggctgaataaa

SEQ ID NO: 718817 - DNA, 20 bp, mouse
gtattgcaaaaggctgacta

SEQ ID NO: 718818 - DNA, 20 bp, mouse
ggtctgtctttgctgcccca

SEQ ID NO: 718819 - DNA, 20 bp, mouse
gaaccttttattcagccctg

SEQ ID NO: 718820 - DNA, 20 bp, mouse
gaaaaagtcattatatgcca

SEQ ID NO: 718821 - DNA, 20 bp, mouse
ggtcagccttttgcaataca

SEQ ID NO: 718822 - DNA, 20 bp, mouse
gatgcaacagtttgaaattt

SEQ ID NO: 718823 - DNA, 20 bp, mouse
ggctgactagggctggtcca

SEQ ID NO: 718824 - DNA, 20 bp, mouse
gggaaattagggttctggac

SEQ ID NO: 718825 - DNA, 20 bp, mouse
gcatgaagttggtgacaaaa

SEQ ID NO: 718826 - DNA, 20 bp, mouse
ggaaaggccccttggtgggt

SEQ ID NO: 718827 - DNA, 20 bp, mouse
gtatgtaatgccttatgtac

SEQ ID NO: 718828 - DNA, 20 bp, mouse
ggatggtcccacccaccaag

SEQ ID NO: 718829 - DNA, 20 bp, mouse
gagttctagttgtcaacatg

SEQ ID NO: 718830 - DNA, 20 bp, mouse
gagtaatagcacaggatatt

SEQ ID NO: 718831 - DNA, 20 bp, mouse
gaacttaaaatgaacaataa

SEQ ID NO: 718832 - DNA, 20 bp, mouse
gttaagcttcatttttcatg

SEQ ID NO: 718833 - DNA, 20 bp, mouse
gtcattttaagtttgaagaa

SEQ ID NO: 718834 - DNA, 20 bp, mouse
gtgaaaaaatgccttacaat

SEQ ID NO: 718835 - DNA, 20 bp, mouse
gaagaattgtagagtaaata

SEQ ID NO: 718836 - DNA, 20 bp, mouse
ggaaagagagatagtccaaa

SEQ ID NO: 718837 - DNA, 20 bp, mouse
ggcccaggaaaaaagattac

SEQ ID NO: 718838 - DNA, 20 bp, mouse
ggagatagtccaaaaggccc

SEQ ID NO: 718839 - DNA, 20 bp, mouse
ggaacaagcagaatctaatt

SEQ ID NO: 718840 - DNA, 20 bp, mouse
gtgctacagaagcaagaaac

SEQ ID NO: 718841 - DNA, 20 bp, mouse
gataaataaagggcggggca

SEQ ID NO: 718842 - DNA, 20 bp, mouse
gcctagaagcctcttaaagg

SEQ ID NO: 718843 - DNA, 20 bp, mouse
gtcagtctactgtggacaca

SEQ ID NO: 718844 - DNA, 20 bp, mouse
ggaatggaactctgatcatg

SEQ ID NO: 718845 - DNA, 20 bp, mouse
gtacaaaaccattactgggc

SEQ ID NO: 718846 - DNA, 20 bp, mouse
ggcaatacaaagtcaactcc

SEQ ID NO: 718847 - DNA, 20 bp, mouse
gaagtcaactccaggtcaag

SEQ ID NO: 718848 - DNA, 20 bp, mouse
ggaacttaaagaccttccat

SEQ ID NO: 718849 - DNA, 20 bp, mouse
ggaagaattaaccagttgag

SEQ ID NO: 718850 - DNA, 20 bp, mouse
gtgactttgtattgcaataa

SEQ ID NO: 718851 - DNA, 20 bp, mouse
gaaacaactaaaccaatgga

SEQ ID NO: 718852 - DNA, 20 bp, mouse
gatgaaaacaactaaaccaa

SEQ ID NO: 718853 - DNA, 20 bp, mouse
ggttttcattccctctcaac

SEQ ID NO: 718854 - DNA, 20 bp, mouse
gaaggatatttaagacagtg

SEQ ID NO: 718855 - DNA, 20 bp, mouse
gattcttctgcctcttgacc

SEQ ID NO: 718856 - DNA, 20 bp, mouse
gtagtctggaacccaatagg

SEQ ID NO: 718857 - DNA, 20 bp, mouse
gaagtagtctggaacccaat

SEQ ID NO: 718858 - DNA, 20 bp, mouse
gttctctagctcatcccctg

SEQ ID NO: 718859 - DNA, 20 bp, mouse
gagggcattggggagagtat

SEQ ID NO: 718860 - DNA, 20 bp, mouse
ggcaggatgcagtaggactg

SEQ ID NO: 718861 - DNA, 20 bp, mouse
gccaaggagctgaagtagtc

SEQ ID NO: 718862 - DNA, 20 bp, mouse
gcacacagtcacctattggc

SEQ ID NO: 718863 - DNA, 20 bp, mouse
gctggaacacagggccccag

SEQ ID NO: 718864 - DNA, 20 bp, mouse
ggccctgtgttccagccaat

SEQ ID NO: 718865 - DNA, 20 bp, mouse
gggtagggaagtagggcatt

SEQ ID NO: 718866 - DNA, 20 bp, mouse
gaaacggggagagtggtgta

SEQ ID NO: 718867 - DNA, 20 bp, mouse
ggcccccagccctctctgtt

SEQ ID NO: 718868 - DNA, 20 bp, mouse
gagggtagaggcctggaaac

SEQ ID NO: 718869 - DNA, 20 bp, mouse
gtccctcaaccgaacagaga

SEQ ID NO: 718870 - DNA, 20 bp, mouse
gggcctggaaacggggagag

SEQ ID NO: 718871 - DNA, 20 bp, mouse
gtccttgggcaccagggtag

SEQ ID NO: 718872 - DNA, 20 bp, mouse
gttagtcagggcctgtggtg

SEQ ID NO: 718873 - DNA, 20 bp, mouse
ggtcactgtgacaagatagc

SEQ ID NO: 718874 - DNA, 20 bp, mouse
gtcctgtgcgaccgaagctc

SEQ ID NO: 718875 - DNA, 20 bp, mouse
ggaattgaacctgttagtca

SEQ ID NO: 718876 - DNA, 20 bp, mouse
ggcccactggagttggtctt

SEQ ID NO: 718877 - DNA, 20 bp, mouse
gcacccaagaccaactccag

SEQ ID NO: 718878 - DNA, 20 bp, mouse
gggaaccaacagctcctccg

SEQ ID NO: 718879 - DNA, 20 bp, mouse
gagctgttggttccttcccc

SEQ ID NO: 718880 - DNA, 20 bp, mouse
gatgaatgatcagtatggaa

SEQ ID NO: 718881 - DNA, 20 bp, mouse
gctaatagctttgtagttta

SEQ ID NO: 718882 - DNA, 20 bp, mouse
gttataaccagcgcccgcgg

SEQ ID NO: 718883 - DNA, 20 bp, mouse
gtaaagtccaagcagcctga

SEQ ID NO: 718884 - DNA, 20 bp, mouse
gtacttagaatcctctctca

SEQ ID NO: 718885 - DNA, 20 bp, mouse
gttattatgaatgatcagta

SEQ ID NO: 718886 - DNA, 20 bp, mouse
gtccacttatcagacatcga

SEQ ID NO: 718887 - DNA, 20 bp, mouse
gagcggcactagaaagttca

SEQ ID NO: 718888 - DNA, 20 bp, mouse
gggcactagaaagttcaggg

SEQ ID NO: 718889 - DNA, 20 bp, mouse
gaccatcgatgtctgataag

SEQ ID NO: 718890 - DNA, 20 bp, mouse
gaaaggtgcccagagaaaag

SEQ ID NO: 718891 - DNA, 20 bp, mouse
gtgaacaggagaacagcaac

SEQ ID NO: 718892 - DNA, 20 bp, mouse
ggaaaagcggcttgtgggtg

SEQ ID NO: 718893 - DNA, 20 bp, mouse
gcccacaagccgcttttctc

SEQ ID NO: 718894 - DNA, 20 bp, mouse
gagctgactagggtgaaaga

SEQ ID NO: 718895 - DNA, 20 bp, mouse
gcagagcagcagaataatgt

SEQ ID NO: 718896 - DNA, 20 bp, mouse
ggccaccaggaggttcacct

SEQ ID NO: 718897 - DNA, 20 bp, mouse
ggagtgaattaggacagtca

SEQ ID NO: 718898 - DNA, 20 bp, mouse
gaaaaatcagaaaatagccg

SEQ ID NO: 718899 - DNA, 20 bp, mouse
gagctgcacaagccaccagg

SEQ ID NO: 718900 - DNA, 20 bp, mouse
gctatgcgattgaaaagtga

SEQ ID NO: 718901 - DNA, 20 bp, mouse
gctgggtctcctggtctttg

SEQ ID NO: 718902 - DNA, 20 bp, mouse
ggcttagggccagatggtat

SEQ ID NO: 718903 - DNA, 20 bp, mouse
gtcagaaaatagccggggcg

SEQ ID NO: 718904 - DNA, 20 bp, mouse
gacctcaggcctcaaagacc

SEQ ID NO: 718905 - DNA, 20 bp, mouse
gggcttgcaccaataccatc

SEQ ID NO: 718906 - DNA, 20 bp, mouse
gaaagttatggtggctacac

SEQ ID NO: 718907 - DNA, 20 bp, mouse
ggttgaagatgtgcatttta

SEQ ID NO: 718908 - DNA, 20 bp, mouse
gaatgcacatcttcaacatg

SEQ ID NO: 718909 - DNA, 20 bp, mouse
gtttgcataagactgaggat

SEQ ID NO: 718910 - DNA, 20 bp, mouse
ggcataagactgaggatagg

SEQ ID NO: 718911 - DNA, 20 bp, mouse
gactgacagcagaaatctac

SEQ ID NO: 718912 - DNA, 20 bp, mouse
gtaagaaattacatactcaa

SEQ ID NO: 718913 - DNA, 20 bp, mouse
gtaaatgtcaaatagtcatc

SEQ ID NO: 718914 - DNA, 20 bp, mouse
gagtttaaaaattgatatca

SEQ ID NO: 718915 - DNA, 20 bp, mouse
gcagggatgaatgaaaagcc

SEQ ID NO: 718916 - DNA, 20 bp, mouse
gggacagtgcacttctgtaa

SEQ ID NO: 718917 - DNA, 20 bp, mouse
ggggtcagaaaaatgtgtga

SEQ ID NO: 718918 - DNA, 20 bp, mouse
gaaagcaaaaagagcttgaa

SEQ ID NO: 718919 - DNA, 20 bp, mouse
gagtgtgatgtgaactgccc

SEQ ID NO: 718920 - DNA, 20 bp, mouse
ggcatccctgtgaagaaaac

SEQ ID NO: 718921 - DNA, 20 bp, mouse
gcaggataggacttatggag

SEQ ID NO: 718922 - DNA, 20 bp, mouse
ggggcttatcaattctaaca

SEQ ID NO: 718923 - DNA, 20 bp, mouse
gtgtccctgttttcttcaca

SEQ ID NO: 718924 - DNA, 20 bp, mouse
gctcatctaagtcttgtgtc

SEQ ID NO: 718925 - DNA, 20 bp, mouse
gcataaaatgagggattaga

SEQ ID NO: 718926 - DNA, 20 bp, mouse
gtaaaacgttggagcagggt

SEQ ID NO: 718927 - DNA, 20 bp, mouse
gtggtcccatccctcaagcg

SEQ ID NO: 718928 - DNA, 20 bp, mouse
ggggttaaaacgttggagca

SEQ ID NO: 718929 - DNA, 20 bp, mouse
gctgcgagcatcggtattat

SEQ ID NO: 718930 - DNA, 20 bp, mouse
gcacaccccgcttgagggat

SEQ ID NO: 718931 - DNA, 20 bp, mouse
ggatgcttggctgcgagcat

SEQ ID NO: 718932 - DNA, 20 bp, mouse
gaacgttggagcagggtggg

SEQ ID NO: 718933 - DNA, 20 bp, mouse
gcaattctgggttaaaacgt

SEQ ID NO: 718934 - DNA, 20 bp, mouse
gcaagcatcgaactgatcca

SEQ ID NO: 718935 - DNA, 20 bp, mouse
gggtattattggtcgagagc

SEQ ID NO: 718936 - DNA, 20 bp, mouse
gctaaggtttgtgactggat

SEQ ID NO: 718937 - DNA, 20 bp, mouse
ggtgacaggcaggacagtgg

SEQ ID NO: 718938 - DNA, 20 bp, mouse
gacgtccacgggctgatgat

SEQ ID NO: 718939 - DNA, 20 bp, mouse
ggagctgcagattggactaa

SEQ ID NO: 718940 - DNA, 20 bp, mouse
gcatgcctaaggtttgtgac

SEQ ID NO: 718941 - DNA, 20 bp, mouse
gcctgtccctgggctttgaa

SEQ ID NO: 718942 - DNA, 20 bp, mouse
gactaagggatcctgtccct

SEQ ID NO: 718943 - DNA, 20 bp, mouse
gggagcactacactggtgat

SEQ ID NO: 718944 - DNA, 20 bp, mouse
gctgtccaatcatcagcccg

SEQ ID NO: 718945 - DNA, 20 bp, mouse
ggtagcgactatgacgtcca

SEQ ID NO: 718946 - DNA, 20 bp, mouse
gacggtggacactgagtagc

SEQ ID NO: 718947 - DNA, 20 bp, mouse
gttattccaggccctttctg

SEQ ID NO: 718948 - DNA, 20 bp, mouse
ggtgtcttgtgaatgttttg

SEQ ID NO: 718949 - DNA, 20 bp, mouse
gtggagtggtaaggcgggaa

SEQ ID NO: 718950 - DNA, 20 bp, mouse
gtactgaatagtggtataga

SEQ ID NO: 718951 - DNA, 20 bp, mouse
gtagagaagttactgaatag

SEQ ID NO: 718952 - DNA, 20 bp, mouse
ggattttggagtggtaaggc

SEQ ID NO: 718953 - DNA, 20 bp, mouse
ggagatcatatgagaacact

SEQ ID NO: 718954 - DNA, 20 bp, mouse
gtgactgtgggccccagaaa

SEQ ID NO: 718955 - DNA, 20 bp, mouse
gacactgagtagctggggaa

SEQ ID NO: 718956 - DNA, 20 bp, mouse
ggccctcactgactattatg

SEQ ID NO: 718957 - DNA, 20 bp, mouse
gtgactcagcagcatgattt

SEQ ID NO: 718958 - DNA, 20 bp, mouse
gccaacaaggtctgagttca

SEQ ID NO: 718959 - DNA, 20 bp, mouse
ggaatgcagatgaatctgtg

SEQ ID NO: 718960 - DNA, 20 bp, mouse
ggcagcatgatttgggaaaa

SEQ ID NO: 718961 - DNA, 20 bp, mouse
gcaccacataatagtcagtg

SEQ ID NO: 718962 - DNA, 20 bp, mouse
gaggaagcagcaaaatcctc

SEQ ID NO: 718963 - DNA, 20 bp, mouse
gtgttcagcctactttaaca

SEQ ID NO: 718964 - DNA, 20 bp, mouse
gatctgtgaggctgccaaca

SEQ ID NO: 718965 - DNA, 20 bp, mouse
gtctttcccacttcatctag

SEQ ID NO: 718966 - DNA, 20 bp, mouse
ggtatgtatcaaatatactg

SEQ ID NO: 718967 - DNA, 20 bp, mouse
gtcaggtgtataaaaaaaag

SEQ ID NO: 718968 - DNA, 20 bp, mouse
gtgtttctgtaacaattcca

SEQ ID NO: 718969 - DNA, 20 bp, mouse
gaatagaaacaaattctcca

SEQ ID NO: 718970 - DNA, 20 bp, mouse
gcaattgaagtgtttttcgt

SEQ ID NO: 718971 - DNA, 20 bp, mouse
ggtagtaaaaagaaatattc

SEQ ID NO: 718972 - DNA, 20 bp, mouse
ggatacatacacgtaattgg

SEQ ID NO: 718973 - DNA, 20 bp, mouse
gtgcaagcaagagataggtc

SEQ ID NO: 718974 - DNA, 20 bp, mouse
ggctgctatttctagcaaag

SEQ ID NO: 718975 - DNA, 20 bp, mouse
gagagatttgaagactgacg

SEQ ID NO: 718976 - DNA, 20 bp, mouse
gaggtggtgtgacactatat

SEQ ID NO: 718977 - DNA, 20 bp, mouse
ggggcatagcaagtggacag

SEQ ID NO: 718978 - DNA, 20 bp, mouse
ggctgagtgggcatagcaag

SEQ ID NO: 718979 - DNA, 20 bp, mouse
ggtgggtggctgccctggga

SEQ ID NO: 718980 - DNA, 20 bp, mouse
gtcacaccacctaccccaca

SEQ ID NO: 718981 - DNA, 20 bp, mouse
ggccccagaaaaggtaacct

SEQ ID NO: 718982 - DNA, 20 bp, mouse
gagcctggggcctacaggtc

SEQ ID NO: 718983 - DNA, 20 bp, mouse
gtgtttcctccgtggctagg

SEQ ID NO: 718984 - DNA, 20 bp, mouse
gactttcctcctagccacgg

SEQ ID NO: 718985 - DNA, 20 bp, mouse
gccctgctctacatagagcc

SEQ ID NO: 718986 - DNA, 20 bp, mouse
ggaatgcagacgaatctgtg

SEQ ID NO: 718987 - DNA, 20 bp, mouse
gccaatgaggtctgagtcca

SEQ ID NO: 718988 - DNA, 20 bp, mouse
ggcagcaggatttggaaaaa

SEQ ID NO: 718989 - DNA, 20 bp, mouse
gaggaagcagcaaaatcctc

SEQ ID NO: 718990 - DNA, 20 bp, mouse
gatctgtgaggctgccaatg

SEQ ID NO: 718991 - DNA, 20 bp, mouse
gagaggagcactgatactca

SEQ ID NO: 718992 - DNA, 20 bp, mouse
ggcccttgctgactcttgtg

SEQ ID NO: 718993 - DNA, 20 bp, mouse
gcaccacacaagagtcagca

SEQ ID NO: 718994 - DNA, 20 bp, mouse
gtgtcctggaggcttgggag

SEQ ID NO: 718995 - DNA, 20 bp, mouse
gagggctgctggcagtagag

SEQ ID NO: 718996 - DNA, 20 bp, mouse
ggggctgagagctaaggacg

SEQ ID NO: 718997 - DNA, 20 bp, mouse
gagggaggaaccaggtgatt

SEQ ID NO: 718998 - DNA, 20 bp, mouse
ggctctcagccccaatcacc

SEQ ID NO: 718999 - DNA, 20 bp, mouse
gctgagagctaaggacgggg

SEQ ID NO: 719000 - DNA, 20 bp, mouse
gtgattggggctgagagcta

SEQ ID NO: 719001 - DNA, 20 bp, mouse
gagtaataagacagttcgga

SEQ ID NO: 719002 - DNA, 20 bp, mouse
gggactaggctgaaacaggg

SEQ ID NO: 719003 - DNA, 20 bp, mouse
gggtgagtggcccttctgag

SEQ ID NO: 719004 - DNA, 20 bp, mouse
ggctggactaggctgaaaca

SEQ ID NO: 719005 - DNA, 20 bp, mouse
ggtccagcgtgctcaaccag

SEQ ID NO: 719006 - DNA, 20 bp, mouse
gaacctagagaaaaaaaata

SEQ ID NO: 719007 - DNA, 20 bp, mouse
gtaccatattttttttctct

SEQ ID NO: 719008 - DNA, 20 bp, mouse
gctatttctttagggattac

SEQ ID NO: 719009 - DNA, 20 bp, mouse
gagagcaggagagagagcgg

SEQ ID NO: 719010 - DNA, 20 bp, mouse
gataatagaaggggcaattt

SEQ ID NO: 719011 - DNA, 20 bp, mouse
gagtttccaacataatagaa

SEQ ID NO: 719012 - DNA, 20 bp, mouse
gtgtatctaacaggatcaaa

SEQ ID NO: 719013 - DNA, 20 bp, mouse
gggatagaatagccaaaact

SEQ ID NO: 719014 - DNA, 20 bp, mouse
gatctataattgtatctaac

SEQ ID NO: 719015 - DNA, 20 bp, mouse
gtttcaaactctcacaaaag

SEQ ID NO: 719016 - DNA, 20 bp, mouse
gtagggagtggtaccctggt

SEQ ID NO: 719017 - DNA, 20 bp, mouse
gacactgaccagtgtgggag

SEQ ID NO: 719018 - DNA, 20 bp, mouse
gcttatagcatgggaagtgg

SEQ ID NO: 719019 - DNA, 20 bp, mouse
gtaaatatcacctggtccca

SEQ ID NO: 719020 - DNA, 20 bp, mouse
gcatataacaggattagtag

SEQ ID NO: 719021 - DNA, 20 bp, mouse
gtatcacctggtcccaaggg

SEQ ID NO: 719022 - DNA, 20 bp, mouse
gaaagctccctctcccacac

SEQ ID NO: 719023 - DNA, 20 bp, mouse
gggtcagtgtaaatatcacc

SEQ ID NO: 719024 - DNA, 20 bp, mouse
gtatttacactgaccagtgt

SEQ ID NO: 719025 - DNA, 20 bp, mouse
gatatccctcccttgggacc

SEQ ID NO: 719026 - DNA, 20 bp, mouse
ggggactgtctccatccaca

SEQ ID NO: 719027 - DNA, 20 bp, mouse
gctaaaatgaggagtcagca

SEQ ID NO: 719028 - DNA, 20 bp, mouse
gcatccacaaggacaccaca

SEQ ID NO: 719029 - DNA, 20 bp, mouse
ggaggacaatcataaagact

SEQ ID NO: 719030 - DNA, 20 bp, mouse
gagctcaatatccctccctt

SEQ ID NO: 719031 - DNA, 20 bp, mouse
gccacaaggacaccacaggg

SEQ ID NO: 719032 - DNA, 20 bp, mouse
gaaatgaggagtcagcaagg

SEQ ID NO: 719033 - DNA, 20 bp, mouse
gtagggagtggtaccctggt

SEQ ID NO: 719034 - DNA, 20 bp, mouse
gcatataacaggattagtag

SEQ ID NO: 719035 - DNA, 20 bp, mouse
gacactgaccagtgtgggag

SEQ ID NO: 719036 - DNA, 20 bp, mouse
gaacacgaaggaaagaagaa

SEQ ID NO: 719037 - DNA, 20 bp, mouse
gcagagccccaaaactatta

SEQ ID NO: 719038 - DNA, 20 bp, mouse
gaggcaccttaatagttttg

SEQ ID NO: 719039 - DNA, 20 bp, mouse
gtctgattagaataacacga

SEQ ID NO: 719040 - DNA, 20 bp, mouse
ggggaagagctcctatatgg

SEQ ID NO: 719041 - DNA, 20 bp, mouse
gagtctcaaagctggattaa

SEQ ID NO: 719042 - DNA, 20 bp, mouse
gagtccaaaggtagtaacac

SEQ ID NO: 719043 - DNA, 20 bp, mouse
gtataggcttagagcaggtg

SEQ ID NO: 719044 - DNA, 20 bp, mouse
ggcaggtgtggcccagttga

SEQ ID NO: 719045 - DNA, 20 bp, mouse
gttaacctgagttttgaggc

SEQ ID NO: 719046 - DNA, 20 bp, mouse
gtcccaaaggacaaacactt

SEQ ID NO: 719047 - DNA, 20 bp, mouse
gctgctgccttcctcacttc

SEQ ID NO: 719048 - DNA, 20 bp, mouse
ggcaagaaaattgaatctga

SEQ ID NO: 719049 - DNA, 20 bp, mouse
gcaagtgtaagataccccta

SEQ ID NO: 719050 - DNA, 20 bp, mouse
ggaaaccacaaaggtagttt

SEQ ID NO: 719051 - DNA, 20 bp, mouse
ggtctccaacggtgatccac

SEQ ID NO: 719052 - DNA, 20 bp, mouse
gccaacctaaactacctttg

SEQ ID NO: 719053 - DNA, 20 bp, mouse
gtgctgtggttataggatta

SEQ ID NO: 719054 - DNA, 20 bp, mouse
ggctacaagactgtcaggaa

SEQ ID NO: 719055 - DNA, 20 bp, mouse
ggatacaaagcctcctcagc

SEQ ID NO: 719056 - DNA, 20 bp, mouse
gcacacttcctactgacaat

SEQ ID NO: 719057 - DNA, 20 bp, mouse
gttagatacctattgtcagt

SEQ ID NO: 719058 - DNA, 20 bp, mouse
ggcagtgcctaagggaattc

SEQ ID NO: 719059 - DNA, 20 bp, mouse
gcataggttgccagagtagg

SEQ ID NO: 719060 - DNA, 20 bp, mouse
gtaggaacaacttcctgatt

SEQ ID NO: 719061 - DNA, 20 bp, mouse
gtgttctgcttgaaaacaaa

SEQ ID NO: 719062 - DNA, 20 bp, mouse
ggttgccagagtaggtggca

SEQ ID NO: 719063 - DNA, 20 bp, mouse
gatttccatgccacctactc

SEQ ID NO: 719064 - DNA, 20 bp, mouse
ggtcactaggaacttgagaa

SEQ ID NO: 719065 - DNA, 20 bp, mouse
gctagagctgtctgtcttct

SEQ ID NO: 719066 - DNA, 20 bp, mouse
gcgaaggagcccaggcgcgg

SEQ ID NO: 719067 - DNA, 20 bp, mouse
gactgtgcgcccccgcgcct

SEQ ID NO: 719068 - DNA, 20 bp, mouse
ggtcctctgcgaaggagccc

SEQ ID NO: 719069 - DNA, 20 bp, mouse
gctgcgaaggagcccaggcg

SEQ ID NO: 719070 - DNA, 20 bp, mouse
ggaacccaagcacatccgga

SEQ ID NO: 719071 - DNA, 20 bp, mouse
gaggagggctacctgggctc

SEQ ID NO: 719072 - DNA, 20 bp, mouse
gcctcgaacccaagcacatc

SEQ ID NO: 719073 - DNA, 20 bp, mouse
gccaccagaacctcagaaaa

SEQ ID NO: 719074 - DNA, 20 bp, mouse
gctgccttccggatgtgctt

SEQ ID NO: 719075 - DNA, 20 bp, mouse
gtggatactagcttcctggc

SEQ ID NO: 719076 - DNA, 20 bp, mouse
ggacacctggtgattggcaa

SEQ ID NO: 719077 - DNA, 20 bp, mouse
gaggcgcagggtctctgcaa

SEQ ID NO: 719078 - DNA, 20 bp, mouse
ggggtggcaccgtggctgtg

SEQ ID NO: 719079 - DNA, 20 bp, mouse
gtggcaagggggtggcaccg

SEQ ID NO: 719080 - DNA, 20 bp, mouse
ggaaatgccaaagtggcaga

SEQ ID NO: 719081 - DNA, 20 bp, mouse
ggaaggtcagatacgcacgg

SEQ ID NO: 719082 - DNA, 20 bp, mouse
gcacctgtgccacacagcca

SEQ ID NO: 719083 - DNA, 20 bp, mouse
gctcctctgtgtggagacac

SEQ ID NO: 719084 - DNA, 20 bp, mouse
ggtccagtgtctccacacag

SEQ ID NO: 719085 - DNA, 20 bp, mouse
gagaatctgaaatgccaaag

SEQ ID NO: 719086 - DNA, 20 bp, mouse
gtctcagaaggccatacaac

SEQ ID NO: 719087 - DNA, 20 bp, mouse
ggagctgatgagcaggttat

SEQ ID NO: 719088 - DNA, 20 bp, mouse
gatcaacattatacaacagc

SEQ ID NO: 719089 - DNA, 20 bp, mouse
gcttaggggtctcattctta

SEQ ID NO: 719090 - DNA, 20 bp, mouse
gttaacatgccttcgtgcat

SEQ ID NO: 719091 - DNA, 20 bp, mouse
ggagaaattcccatgcacga

SEQ ID NO: 719092 - DNA, 20 bp, mouse
gagttcttcatccagttgta

SEQ ID NO: 719093 - DNA, 20 bp, mouse
gagaaggtcaagacatctgc

SEQ ID NO: 719094 - DNA, 20 bp, mouse
ggctcaggaaacatggaaga

SEQ ID NO: 719095 - DNA, 20 bp, mouse
ggaaagtaggaagaaggctt

SEQ ID NO: 719096 - DNA, 20 bp, mouse
gttcctacggactggcaaga

SEQ ID NO: 719097 - DNA, 20 bp, mouse
gaaaagctgttcctacggac

SEQ ID NO: 719098 - DNA, 20 bp, mouse
gtcaaagacctcaacgtaat

SEQ ID NO: 719099 - DNA, 20 bp, mouse
gaactcaacggcactgggaa

SEQ ID NO: 719100 - DNA, 20 bp, mouse
ggaaactaaaaagctctgcc

SEQ ID NO: 719101 - DNA, 20 bp, mouse
ggctaccatgtgatattgct

SEQ ID NO: 719102 - DNA, 20 bp, mouse
gacagtgaacccgatagaag

SEQ ID NO: 719103 - DNA, 20 bp, mouse
gagataaaaagctgttccta

SEQ ID NO: 719104 - DNA, 20 bp, mouse
gcccagtgccgttgagttta

SEQ ID NO: 719105 - DNA, 20 bp, mouse
gtccttatttcctcttctat

SEQ ID NO: 719106 - DNA, 20 bp, mouse
gaacgtaatgagaaagtgga

SEQ ID NO: 719107 - DNA, 20 bp, mouse
ggttgcacaagacatctaca

SEQ ID NO: 719108 - DNA, 20 bp, mouse
gatcaactatgaaacttgat

SEQ ID NO: 719109 - DNA, 20 bp, mouse
ggtttacatgaatgtaaatg

SEQ ID NO: 719110 - DNA, 20 bp, mouse
gcaagagaaaatggagaaga

SEQ ID NO: 719111 - DNA, 20 bp, mouse
ggaagcagaacaagagaaaa

SEQ ID NO: 719112 - DNA, 20 bp, mouse
gtgggtggaatggggagcag

SEQ ID NO: 719113 - DNA, 20 bp, mouse
gaagtggaaggaaacgaaaa

SEQ ID NO: 719114 - DNA, 20 bp, mouse
gctcttgttctgcttctgat

SEQ ID NO: 719115 - DNA, 20 bp, mouse
gaagacagggcagagctcat

SEQ ID NO: 719116 - DNA, 20 bp, mouse
gacctgacaaacaacatccc

SEQ ID NO: 719117 - DNA, 20 bp, mouse
gcatctctgcagccatagga

SEQ ID NO: 719118 - DNA, 20 bp, mouse
gagtgaggttgggatatcat

SEQ ID NO: 719119 - DNA, 20 bp, mouse
ggctgaggacagtgctcccc

SEQ ID NO: 719120 - DNA, 20 bp, mouse
gacttgtcccagccatccta

SEQ ID NO: 719121 - DNA, 20 bp, mouse
gagggaggggtactaggctg

SEQ ID NO: 719122 - DNA, 20 bp, mouse
gcctggaagccagccacggc

SEQ ID NO: 719123 - DNA, 20 bp, mouse
gtgcagagctggactcaggg

SEQ ID NO: 719124 - DNA, 20 bp, mouse
gctcaccaacaaggaaggga

SEQ ID NO: 719125 - DNA, 20 bp, mouse
gaggttgggatatcataggt

SEQ ID NO: 719126 - DNA, 20 bp, mouse
gtggctgcccctcctaactt

SEQ ID NO: 719127 - DNA, 20 bp, mouse
ggggcagccaatgggatatt

SEQ ID NO: 719128 - DNA, 20 bp, mouse
gttgtagcctaagttaggag

SEQ ID NO: 719129 - DNA, 20 bp, mouse
gtggtgctatacaagtcatc

SEQ ID NO: 719130 - DNA, 20 bp, mouse
gagggtagtagttttgtgga

SEQ ID NO: 719131 - DNA, 20 bp, mouse
gccaatgggatattaggaaa

SEQ ID NO: 719132 - DNA, 20 bp, mouse
gatctggaaagcttccatta

SEQ ID NO: 719133 - DNA, 20 bp, mouse
ggcctttcctagaatttcaa

SEQ ID NO: 719134 - DNA, 20 bp, mouse
ggccttcaggtactttttgt

SEQ ID NO: 719135 - DNA, 20 bp, mouse
gtgaagttcgtaaaaatctg

SEQ ID NO: 719136 - DNA, 20 bp, mouse
ggcaacggcctaggggtcaa

SEQ ID NO: 719137 - DNA, 20 bp, mouse
ggaccccatccctgcctcag

SEQ ID NO: 719138 - DNA, 20 bp, mouse
gcactgcgctgggttgaaac

SEQ ID NO: 719139 - DNA, 20 bp, mouse
gtctgggaaggcaacggcct

SEQ ID NO: 719140 - DNA, 20 bp, mouse
gagaggatcaagattgtcag

SEQ ID NO: 719141 - DNA, 20 bp, mouse
gatggtacttaggcaaagaa

SEQ ID NO: 719142 - DNA, 20 bp, mouse
gaacggggcgcctagatagt

SEQ ID NO: 719143 - DNA, 20 bp, mouse
gaggaaacagtactgagtct

SEQ ID NO: 719144 - DNA, 20 bp, mouse
gtggcatgatcacactgcgc

SEQ ID NO: 719145 - DNA, 20 bp, mouse
gtcaagattgtcagaggcaa

SEQ ID NO: 719146 - DNA, 20 bp, mouse
gcagccctggaaaacgccga

SEQ ID NO: 719147 - DNA, 20 bp, mouse
gggacagagcgctttgaaaa

SEQ ID NO: 719148 - DNA, 20 bp, mouse
gtcgccgcccggcctcttcc

SEQ ID NO: 719149 - DNA, 20 bp, mouse
gccgccctcggcgttttcca

SEQ ID NO: 719150 - DNA, 20 bp, mouse
gccgcagtgcgcaggcgcga

SEQ ID NO: 719151 - DNA, 20 bp, mouse
ggcaccgcccgcagaacaga

SEQ ID NO: 719152 - DNA, 20 bp, mouse
gcgtgtcttggcgagaccgt

SEQ ID NO: 719153 - DNA, 20 bp, mouse
gccaggcggcccgcatccgt

SEQ ID NO: 719154 - DNA, 20 bp, mouse
gttggaggcgagccgggaag

SEQ ID NO: 719155 - DNA, 20 bp, mouse
ggcggcccgcatccgtaggc

SEQ ID NO: 719156 - DNA, 20 bp, mouse
ggtaacaaggagctaggtca

SEQ ID NO: 719157 - DNA, 20 bp, mouse
gtatcatgtgatatatcctg

SEQ ID NO: 719158 - DNA, 20 bp, mouse
gtggagtcaggcacaacctc

SEQ ID NO: 719159 - DNA, 20 bp, mouse
gctgcctcagctccctgtag

SEQ ID NO: 719160 - DNA, 20 bp, mouse
gtattctttcaaacccctac

SEQ ID NO: 719161 - DNA, 20 bp, mouse
gtgatgtagcaatagagcca

SEQ ID NO: 719162 - DNA, 20 bp, mouse
gattgcctggaaatggagtc

SEQ ID NO: 719163 - DNA, 20 bp, mouse
gttgacctctgtgctcactg

SEQ ID NO: 719164 - DNA, 20 bp, mouse
gaaagcctctataacctacc

SEQ ID NO: 719165 - DNA, 20 bp, mouse
gttgctacatcaattcctaa

SEQ ID NO: 719166 - DNA, 20 bp, mouse
gtgtctcagaagttaggaat

SEQ ID NO: 719167 - DNA, 20 bp, mouse
gatcctggaaggcaagcagg

SEQ ID NO: 719168 - DNA, 20 bp, mouse
gagggagtggcacaattaac

SEQ ID NO: 719169 - DNA, 20 bp, mouse
gtaggagctcaaaagccacc

SEQ ID NO: 719170 - DNA, 20 bp, mouse
gaccacttttatgtttgtat

SEQ ID NO: 719171 - DNA, 20 bp, mouse
gtatatggcagcatcctgga

SEQ ID NO: 719172 - DNA, 20 bp, mouse
gttaacaggtgtcaccttgt

SEQ ID NO: 719173 - DNA, 20 bp, mouse
ggccaatacaaacataaaag

SEQ ID NO: 719174 - DNA, 20 bp, mouse
gctgaattcctgaacctgtg

SEQ ID NO: 719175 - DNA, 20 bp, mouse
gtcaaaagccacctggacag

SEQ ID NO: 719176 - DNA, 20 bp, mouse
gttaacaagctatgctggaa

SEQ ID NO: 719177 - DNA, 20 bp, mouse
gagggctcaaatacaagcat

SEQ ID NO: 719178 - DNA, 20 bp, mouse
gagagtgaagaaacactaca

SEQ ID NO: 719179 - DNA, 20 bp, mouse
ggatgatattagcatatatt

SEQ ID NO: 719180 - DNA, 20 bp, mouse
gaaatagttttaggaaatca

SEQ ID NO: 719181 - DNA, 20 bp, mouse
gcagcatagcttgttaacat

SEQ ID NO: 719182 - DNA, 20 bp, mouse
gtattagcatatatttggac

SEQ ID NO: 719183 - DNA, 20 bp, mouse
ggggaatttaaattacattt

SEQ ID NO: 719184 - DNA, 20 bp, mouse
gcagaattaccagaaagttc

SEQ ID NO: 719185 - DNA, 20 bp, mouse
gcaacacaaacatcctcttc

SEQ ID NO: 719186 - DNA, 20 bp, mouse
gccagtttttggcattgtat

SEQ ID NO: 719187 - DNA, 20 bp, mouse
gctgaatatgcttgtctagg

SEQ ID NO: 719188 - DNA, 20 bp, mouse
gagagttaatggtatgttaa

SEQ ID NO: 719189 - DNA, 20 bp, mouse
gagtacagccatacattatg

SEQ ID NO: 719190 - DNA, 20 bp, mouse
ggcattgtatgggtagattt

SEQ ID NO: 719191 - DNA, 20 bp, mouse
gacaatgccaaaaactggcc

SEQ ID NO: 719192 - DNA, 20 bp, mouse
gtattcaatgaacccaattc

SEQ ID NO: 719193 - DNA, 20 bp, mouse
gagtctatatgataaagact

SEQ ID NO: 719194 - DNA, 20 bp, mouse
gtagctaaatattacaaact

SEQ ID NO: 719195 - DNA, 20 bp, mouse
ggtctaggtggctaatttcc

SEQ ID NO: 719196 - DNA, 20 bp, mouse
gaagttgggcaggaccagac

SEQ ID NO: 719197 - DNA, 20 bp, mouse
gggtcctgcccaacttgatt

SEQ ID NO: 719198 - DNA, 20 bp, mouse
gaggaagaagtactggtgcc

SEQ ID NO: 719199 - DNA, 20 bp, mouse
gtggagtggaggggagactc

SEQ ID NO: 719200 - DNA, 20 bp, mouse
gactgaagagatagatgtcc

SEQ ID NO: 719201 - DNA, 20 bp, mouse
gctggctgggaaaatacacc

SEQ ID NO: 719202 - DNA, 20 bp, mouse
gtatctcttcagtctgacca

SEQ ID NO: 719203 - DNA, 20 bp, mouse
gaagagatagatgtcctggc

SEQ ID NO: 719204 - DNA, 20 bp, mouse
gtcttcagtctgaccatggc

SEQ ID NO: 719205 - DNA, 20 bp, mouse
gaaatacacctggcaactaa

SEQ ID NO: 719206 - DNA, 20 bp, mouse
ggaggcgtcagggatctcag

SEQ ID NO: 719207 - DNA, 20 bp, mouse
gtggagccggaatttcaggg

SEQ ID NO: 719208 - DNA, 20 bp, mouse
ggatgtgaggtcctgtgtcc

SEQ ID NO: 719209 - DNA, 20 bp, mouse
gacactgctcacctggacac

SEQ ID NO: 719210 - DNA, 20 bp, mouse
ggatgtggagcgaggcgtca

SEQ ID NO: 719211 - DNA, 20 bp, mouse
gacaggacctcacatctcga

SEQ ID NO: 719212 - DNA, 20 bp, mouse
ggcctcgctccacatcagga

SEQ ID NO: 719213 - DNA, 20 bp, mouse
gaggtcccaccctgaaattc

SEQ ID NO: 719214 - DNA, 20 bp, mouse
gagactcaagatcctgtatg

SEQ ID NO: 719215 - DNA, 20 bp, mouse
gcgcctccagcgccctgagg

SEQ ID NO: 719216 - DNA, 20 bp, mouse
gggctctgcgctctgacgag

SEQ ID NO: 719217 - DNA, 20 bp, mouse
gtatccctggttgctcctga

SEQ ID NO: 719218 - DNA, 20 bp, mouse
ggacttagccagtgaatcac

SEQ ID NO: 719219 - DNA, 20 bp, mouse
gcactggctaagtcctgggc

SEQ ID NO: 719220 - DNA, 20 bp, mouse
gtccgctgggaccgagggaa

SEQ ID NO: 719221 - DNA, 20 bp, mouse
gctggtctgtgctgtgactt

SEQ ID NO: 719222 - DNA, 20 bp, mouse
gctgagttcccgtgattcac

SEQ ID NO: 719223 - DNA, 20 bp, mouse
gtgcgctctgacgaggggcg

SEQ ID NO: 719224 - DNA, 20 bp, mouse
gcaggcgctgggaaactttc

SEQ ID NO: 719225 - DNA, 20 bp, mouse
ggctctgacgaggggcgtgg

SEQ ID NO: 719226 - DNA, 20 bp, mouse
gtactaaaaagtgcagtgct

SEQ ID NO: 719227 - DNA, 20 bp, mouse
gcagcaataaactattctgg

SEQ ID NO: 719228 - DNA, 20 bp, mouse
gccacagcaataaactattc

SEQ ID NO: 719229 - DNA, 20 bp, mouse
gtttagtagactgttctgtg

SEQ ID NO: 719230 - DNA, 20 bp, mouse
gtaaatattgactcaaaaga

SEQ ID NO: 719231 - DNA, 20 bp, mouse
gttactctataacagagtac

SEQ ID NO: 719232 - DNA, 20 bp, mouse
gataaactattctggtggta

SEQ ID NO: 719233 - DNA, 20 bp, mouse
gatacaatgtcttgagtgaa

SEQ ID NO: 719234 - DNA, 20 bp, mouse
gacactcaggtgtatgtaaa

SEQ ID NO: 719235 - DNA, 20 bp, mouse
ggttaccacataaaacttaa

SEQ ID NO: 719236 - DNA, 20 bp, mouse
ggaaaatgatatatagactt

SEQ ID NO: 719237 - DNA, 20 bp, mouse
gaacctgtcttggattcctg

SEQ ID NO: 719238 - DNA, 20 bp, mouse
gtgggaaacactcttttttg

SEQ ID NO: 719239 - DNA, 20 bp, mouse
gggagaaacaggaacaatac

SEQ ID NO: 719240 - DNA, 20 bp, mouse
gttaactgtgaagttttatg

SEQ ID NO: 719241 - DNA, 20 bp, mouse
gtttttggggattctaactg

SEQ ID NO: 719242 - DNA, 20 bp, mouse
gtgagctgttctcacaaata

SEQ ID NO: 719243 - DNA, 20 bp, mouse
gggcctgtttcttgtatgcc

SEQ ID NO: 719244 - DNA, 20 bp, mouse
gacaggatatgtcagtgtta

SEQ ID NO: 719245 - DNA, 20 bp, mouse
gattagtaaaagacattcaa

SEQ ID NO: 719246 - DNA, 20 bp, mouse
gctcgctctaagtactggca

SEQ ID NO: 719247 - DNA, 20 bp, mouse
gctgatctcgctctaagtac

SEQ ID NO: 719248 - DNA, 20 bp, mouse
gggagttgattacaaggtca

SEQ ID NO: 719249 - DNA, 20 bp, mouse
gaagataggagttgattaca

SEQ ID NO: 719250 - DNA, 20 bp, mouse
gaagctgctggctgtgatgg

SEQ ID NO: 719251 - DNA, 20 bp, mouse
gaatccctgtgtggtgagat

SEQ ID NO: 719252 - DNA, 20 bp, mouse
gtgtaaccattacatggaga

SEQ ID NO: 719253 - DNA, 20 bp, mouse
gagaaagcataagggaaaag

SEQ ID NO: 719254 - DNA, 20 bp, mouse
gagacccatctcaccacaca

SEQ ID NO: 719255 - DNA, 20 bp, mouse
gcattacatggagaaggatg

SEQ ID NO: 719256 - DNA, 20 bp, mouse
gcgcttctatagttgctctt

SEQ ID NO: 719257 - DNA, 20 bp, mouse
gtggtggtaccaaaggataa

SEQ ID NO: 719258 - DNA, 20 bp, mouse
ggtaccaaaggataaaggtg

SEQ ID NO: 719259 - DNA, 20 bp, mouse
gtgggccattggttggttat

SEQ ID NO: 719260 - DNA, 20 bp, mouse
ggtaccaccagctatcaagc

SEQ ID NO: 719261 - DNA, 20 bp, mouse
gaacagagggatctgtgtgc

SEQ ID NO: 719262 - DNA, 20 bp, mouse
gattgaacactgaccaagaa

SEQ ID NO: 719263 - DNA, 20 bp, mouse
gacagagatgggccattggt

SEQ ID NO: 719264 - DNA, 20 bp, mouse
gtgatagctggtggtaccaa

SEQ ID NO: 719265 - DNA, 20 bp, mouse
gtgggacagagatgggccat

SEQ ID NO: 719266 - DNA, 20 bp, mouse
ggctgagtgtcccaccactc

SEQ ID NO: 719267 - DNA, 20 bp, mouse
gggcctcagtggctgggtgg

SEQ ID NO: 719268 - DNA, 20 bp, mouse
gtcagtggctgggtggaggt

SEQ ID NO: 719269 - DNA, 20 bp, mouse
gagtaacaggacagtactgt

SEQ ID NO: 719270 - DNA, 20 bp, mouse
ggagctggggcctcagtggc

SEQ ID NO: 719271 - DNA, 20 bp, mouse
gaccccacggcccactggtg

SEQ ID NO: 719272 - DNA, 20 bp, mouse
gggctcgtgtcacacagcga

SEQ ID NO: 719273 - DNA, 20 bp, mouse
gagaatcaattgtcagtaac

SEQ ID NO: 719274 - DNA, 20 bp, mouse
gaggtctggctgcacagggg

SEQ ID NO: 719275 - DNA, 20 bp, mouse
gagctcctcagcagtagcct

SEQ ID NO: 719276 - DNA, 20 bp, mouse
gtgaaggggaagtccctggt

SEQ ID NO: 719277 - DNA, 20 bp, mouse
gcttgtgaaggggaagtccc

SEQ ID NO: 719278 - DNA, 20 bp, mouse
gagttggggtgaatggttct

SEQ ID NO: 719279 - DNA, 20 bp, mouse
gtttctgggccctccataaa

SEQ ID NO: 719280 - DNA, 20 bp, mouse
gtgaaggtcgagacctacca

SEQ ID NO: 719281 - DNA, 20 bp, mouse
gaaagaattccttttatgga

SEQ ID NO: 719282 - DNA, 20 bp, mouse
gcacagcaaagcttgtgaag

SEQ ID NO: 719283 - DNA, 20 bp, mouse
gactaattatagttttggat

SEQ ID NO: 719284 - DNA, 20 bp, mouse
gttgatctgttgctatttat

SEQ ID NO: 719285 - DNA, 20 bp, mouse
gtggaggaattagaagtatg

SEQ ID NO: 719286 - DNA, 20 bp, mouse
ggccaggggcctcaggaatt

SEQ ID NO: 719287 - DNA, 20 bp, mouse
gtacccagcctctgcagcca

SEQ ID NO: 719288 - DNA, 20 bp, mouse
gagacaagtaatgaccccaa

SEQ ID NO: 719289 - DNA, 20 bp, mouse
gctcctctgcatggggaaga

SEQ ID NO: 719290 - DNA, 20 bp, mouse
gtaggatggtagtaactgag

SEQ ID NO: 719291 - DNA, 20 bp, mouse
gagaggggtgggtactattt

SEQ ID NO: 719292 - DNA, 20 bp, mouse
gtgtctctagctagaggtgt

SEQ ID NO: 719293 - DNA, 20 bp, mouse
gtctagctagaggtgtagga

SEQ ID NO: 719294 - DNA, 20 bp, mouse
ggagctcttggatggtgaca

SEQ ID NO: 719295 - DNA, 20 bp, mouse
gctatgatgtctctagctag

SEQ ID NO: 719296 - DNA, 20 bp, mouse
gaagaggggtaattgtctat

SEQ ID NO: 719297 - DNA, 20 bp, mouse
gggtctacggcgttaattta

SEQ ID NO: 719298 - DNA, 20 bp, mouse
ggtagacaaaagtgtgaaca

SEQ ID NO: 719299 - DNA, 20 bp, mouse
gactctgcgggctaaagcgg

SEQ ID NO: 719300 - DNA, 20 bp, mouse
ggtacaggagaggtggtgcg

SEQ ID NO: 719301 - DNA, 20 bp, mouse
gcgcctccggggaccagcga

SEQ ID NO: 719302 - DNA, 20 bp, mouse
gtcagaagccggctgctcac

SEQ ID NO: 719303 - DNA, 20 bp, mouse
gcccacagactgcctaagaa

SEQ ID NO: 719304 - DNA, 20 bp, mouse
gggtctccagagtacaggag

SEQ ID NO: 719305 - DNA, 20 bp, mouse
ggccccgagaccaggcgctc

SEQ ID NO: 719306 - DNA, 20 bp, mouse
gtccaagagaaaccttatga

SEQ ID NO: 719307 - DNA, 20 bp, mouse
gacaaggcagagcatgaaga

SEQ ID NO: 719308 - DNA, 20 bp, mouse
gaggaaaaacgaacacaaca

SEQ ID NO: 719309 - DNA, 20 bp, mouse
gccttgtaaaacgaataatg

SEQ ID NO: 719310 - DNA, 20 bp, mouse
gttggacattcacatgatct

SEQ ID NO: 719311 - DNA, 20 bp, mouse
gcttatgaaggtaacaaatg

SEQ ID NO: 719312 - DNA, 20 bp, mouse
gaggtaacaaatgtggcaaa

SEQ ID NO: 719313 - DNA, 20 bp, mouse
gcgttttacaaggtgtactt

SEQ ID NO: 719314 - DNA, 20 bp, mouse
gtgctctagctagaccttgt

SEQ ID NO: 719315 - DNA, 20 bp, mouse
gaaaagaaagtagggatggc

SEQ ID NO: 719316 - DNA, 20 bp, mouse
gtaagcagtaactctaaagg

SEQ ID NO: 719317 - DNA, 20 bp, mouse
gttaccttgtcatgctgacc

SEQ ID NO: 719318 - DNA, 20 bp, mouse
gaggagtatcaccttcttgg

SEQ ID NO: 719319 - DNA, 20 bp, mouse
gaataggagtatcaccttct

SEQ ID NO: 719320 - DNA, 20 bp, mouse
ggttgaggcattatgtatgt

SEQ ID NO: 719321 - DNA, 20 bp, mouse
gtgtcatgctgaccaggcta

SEQ ID NO: 719322 - DNA, 20 bp, mouse
gagttactgcttaaagcagt

SEQ ID NO: 719323 - DNA, 20 bp, mouse
gttcttggtggcctccaaga

SEQ ID NO: 719324 - DNA, 20 bp, mouse
gggtgatactcctattgttg

SEQ ID NO: 719325 - DNA, 20 bp, mouse
gtttagatttcaccttagcc

SEQ ID NO: 719326 - DNA, 20 bp, mouse
ggagcgtgcggggtcctcta

SEQ ID NO: 719327 - DNA, 20 bp, mouse
ggaacgccagccatccgtag

SEQ ID NO: 719328 - DNA, 20 bp, mouse
gcctcccgactgctcgttgt

SEQ ID NO: 719329 - DNA, 20 bp, mouse
ggtgcggggtcctctacgga

SEQ ID NO: 719330 - DNA, 20 bp, mouse
ggctggccagcaggcgggtg

SEQ ID NO: 719331 - DNA, 20 bp, mouse
ggtgcgggagagagcgtgcg

SEQ ID NO: 719332 - DNA, 20 bp, mouse
gaagaggccgaaggcgcccg

SEQ ID NO: 719333 - DNA, 20 bp, mouse
gctccgccccagaactagtt

SEQ ID NO: 719334 - DNA, 20 bp, mouse
gaacgagcagtcgggaggag

SEQ ID NO: 719335 - DNA, 20 bp, mouse
ggtcgcgctccgggtgttag

SEQ ID NO: 719336 - DNA, 20 bp, mouse
gtgtctcagggtcaaataat

SEQ ID NO: 719337 - DNA, 20 bp, mouse
ggctcctatctcagtgtctc

SEQ ID NO: 719338 - DNA, 20 bp, mouse
gaactacatgaagaatgacc

SEQ ID NO: 719339 - DNA, 20 bp, mouse
gataaagatttcaggtctcc

SEQ ID NO: 719340 - DNA, 20 bp, mouse
gtgggtctgataaagatttc

SEQ ID NO: 719341 - DNA, 20 bp, mouse
gcacaaatgttgtgacttac

SEQ ID NO: 719342 - DNA, 20 bp, mouse
gtaatggtttatatcacttg

SEQ ID NO: 719343 - DNA, 20 bp, mouse
gacaacatttgtgaggtttt

SEQ ID NO: 719344 - DNA, 20 bp, mouse
gataataaaacaagttacta

SEQ ID NO: 719345 - DNA, 20 bp, mouse
gaaaatcaatagaaaagata

SEQ ID NO: 719346 - DNA, 20 bp, mouse
gtggctctcactagatgatc

SEQ ID NO: 719347 - DNA, 20 bp, mouse
gtggacaccattgtccactt

SEQ ID NO: 719348 - DNA, 20 bp, mouse
gttgagactgagtgacatgt

SEQ ID NO: 719349 - DNA, 20 bp, mouse
gagacaagacattaatgtct

SEQ ID NO: 719350 - DNA, 20 bp, mouse
gagtcccagcacttgtcaac

SEQ ID NO: 719351 - DNA, 20 bp, mouse
gaatgccaagctaggcactc

SEQ ID NO: 719352 - DNA, 20 bp, mouse
gactagaatcaatcagctca

SEQ ID NO: 719353 - DNA, 20 bp, mouse
gtacccagttgacaagtgct

SEQ ID NO: 719354 - DNA, 20 bp, mouse
gcctaacacgtacaaagatt

SEQ ID NO: 719355 - DNA, 20 bp, mouse
gagttgtgtttcttgtgtaa

SEQ ID NO: 719356 - DNA, 20 bp, mouse
gttgctcttccgttgggcgt

SEQ ID NO: 719357 - DNA, 20 bp, mouse
ggatcttagtacttgatctt

SEQ ID NO: 719358 - DNA, 20 bp, mouse
gcattgagcagagtgtaact

SEQ ID NO: 719359 - DNA, 20 bp, mouse
gggtgagtgtgcacaacaga

SEQ ID NO: 719360 - DNA, 20 bp, mouse
ggaattgaacccacgcccaa

SEQ ID NO: 719361 - DNA, 20 bp, mouse
gaacaatgacattgtacaaa

SEQ ID NO: 719362 - DNA, 20 bp, mouse
gctcaccaaacatcatgtat

SEQ ID NO: 719363 - DNA, 20 bp, mouse
gatcagaagtgtgagctact

SEQ ID NO: 719364 - DNA, 20 bp, mouse
gtctcatagaaaattggagg

SEQ ID NO: 719365 - DNA, 20 bp, mouse
gggtacctatacatgatgtt

SEQ ID NO: 719366 - DNA, 20 bp, mouse
gactgggcacccactgggga

SEQ ID NO: 719367 - DNA, 20 bp, mouse
gtctgacttcaagggaaagt

SEQ ID NO: 719368 - DNA, 20 bp, mouse
gccagtgcccatggcctatt

SEQ ID NO: 719369 - DNA, 20 bp, mouse
ggcccactgggcacccactg

SEQ ID NO: 719370 - DNA, 20 bp, mouse
gagtcagaagatggttccag

SEQ ID NO: 719371 - DNA, 20 bp, mouse
ggaaccatcttctgacttca

SEQ ID NO: 719372 - DNA, 20 bp, mouse
ggagcggtccaatagtctgc

SEQ ID NO: 719373 - DNA, 20 bp, mouse
gtcaacaccgaataggccat

SEQ ID NO: 719374 - DNA, 20 bp, mouse
gagcctccacgagcgatccc

SEQ ID NO: 719375 - DNA, 20 bp, mouse
gtactctctcagcgacaggc

SEQ ID NO: 719376 - DNA, 20 bp, mouse
gagattagcgagtgtcagtg

SEQ ID NO: 719377 - DNA, 20 bp, mouse
gtcaatcgatccagccaagt

SEQ ID NO: 719378 - DNA, 20 bp, mouse
gaatctagtagacaccaact

SEQ ID NO: 719379 - DNA, 20 bp, mouse
gtagtagacaccaacttggc

SEQ ID NO: 719380 - DNA, 20 bp, mouse
ggttttccatatgccttcat

SEQ ID NO: 719381 - DNA, 20 bp, mouse
gaagaataacaaaccaatga

SEQ ID NO: 719382 - DNA, 20 bp, mouse
gaacacaatgaagagcactg

SEQ ID NO: 719383 - DNA, 20 bp, mouse
ggctgaagctattattaaat

SEQ ID NO: 719384 - DNA, 20 bp, mouse
gcagaccgaaagagcaactg

SEQ ID NO: 719385 - DNA, 20 bp, mouse
gtcaatcaatatttggctct

SEQ ID NO: 719386 - DNA, 20 bp, mouse
gtcaggagcgcagacccaac

SEQ ID NO: 719387 - DNA, 20 bp, mouse
gtggcagagacgacgctgac

SEQ ID NO: 719388 - DNA, 20 bp, mouse
gccctccaatgcagagtttg

SEQ ID NO: 719389 - DNA, 20 bp, mouse
gtgtacactggcccattccc

SEQ ID NO: 719390 - DNA, 20 bp, mouse
gagggactccaactaagact

SEQ ID NO: 719391 - DNA, 20 bp, mouse
ggactcccaagcctgggaat

SEQ ID NO: 719392 - DNA, 20 bp, mouse
gaacagaagtatctttctgc

SEQ ID NO: 719393 - DNA, 20 bp, mouse
gggcccctgttcctccagtg

SEQ ID NO: 719394 - DNA, 20 bp, mouse
gtctgccacaaactctgcat

SEQ ID NO: 719395 - DNA, 20 bp, mouse
gggtggcttacactgtacac

SEQ ID NO: 719396 - DNA, 20 bp, mouse
ggcaataatagactaaaccg

SEQ ID NO: 719397 - DNA, 20 bp, mouse
gaatagactaaaccgggggc

SEQ ID NO: 719398 - DNA, 20 bp, mouse
ggtcaccgaaactcttataa

SEQ ID NO: 719399 - DNA, 20 bp, mouse
ggccatggcaggaaacatgg

SEQ ID NO: 719400 - DNA, 20 bp, mouse
ggggcatcagatcacattaa

SEQ ID NO: 719401 - DNA, 20 bp, mouse
gattgccatggcaggaaaca

SEQ ID NO: 719402 - DNA, 20 bp, mouse
gtttcatgtgctcacaaaag

SEQ ID NO: 719403 - DNA, 20 bp, mouse
ggtttagtctattattgcca

SEQ ID NO: 719404 - DNA, 20 bp, mouse
gagtctattattgccatggc

SEQ ID NO: 719405 - DNA, 20 bp, mouse
gcagctcaagggttgctggt

SEQ ID NO: 719406 - DNA, 20 bp, mouse
gcctgaaccgagctagtgaa

SEQ ID NO: 719407 - DNA, 20 bp, mouse
gcgagctagtgaagggtgtg

SEQ ID NO: 719408 - DNA, 20 bp, mouse
gtactggggcttagttaata

SEQ ID NO: 719409 - DNA, 20 bp, mouse
gtcagggtagggcggggcga

SEQ ID NO: 719410 - DNA, 20 bp, mouse
gagcctgcccagcgcaggag

SEQ ID NO: 719411 - DNA, 20 bp, mouse
gggggctcttggcgatcctc

SEQ ID NO: 719412 - DNA, 20 bp, mouse
gagagggttgctgaaaggaa

SEQ ID NO: 719413 - DNA, 20 bp, mouse
ggaccccaggggtctgccaa

SEQ ID NO: 719414 - DNA, 20 bp, mouse
gataagccaatcatctactg

SEQ ID NO: 719415 - DNA, 20 bp, mouse
ggccaagcctaatgacccca

SEQ ID NO: 719416 - DNA, 20 bp, mouse
gacaggttgaaagaatgtac

SEQ ID NO: 719417 - DNA, 20 bp, mouse
gctgaagcaaacacttacaa

SEQ ID NO: 719418 - DNA, 20 bp, mouse
gaacatcagaaaattcttgg

SEQ ID NO: 719419 - DNA, 20 bp, mouse
gaatccttcatctactactc

SEQ ID NO: 719420 - DNA, 20 bp, mouse
gagacctgagtagtagatga

SEQ ID NO: 719421 - DNA, 20 bp, mouse
gagtccttgattacatttgt

SEQ ID NO: 719422 - DNA, 20 bp, mouse
gagctgtctgatgtctactg

SEQ ID NO: 719423 - DNA, 20 bp, mouse
gatggtctacaatagtatac

SEQ ID NO: 719424 - DNA, 20 bp, mouse
gcttacaaatgtacagaata

SEQ ID NO: 719425 - DNA, 20 bp, mouse
gaggtttagaaagacattac

SEQ ID NO: 719426 - DNA, 20 bp, mouse
gtgagccagagataggacga

SEQ ID NO: 719427 - DNA, 20 bp, mouse
gtgcctggaacagctcactg

SEQ ID NO: 719428 - DNA, 20 bp, mouse
gcttgctttagccaagtcct

SEQ ID NO: 719429 - DNA, 20 bp, mouse
gccacccctcgtcctatctc

SEQ ID NO: 719430 - DNA, 20 bp, mouse
gcagagagatagaccgttat

SEQ ID NO: 719431 - DNA, 20 bp, mouse
ggaaacaagggaatgtctgg

SEQ ID NO: 719432 - DNA, 20 bp, mouse
ggtctgggagagcgactcaa

SEQ ID NO: 719433 - DNA, 20 bp, mouse
ggaggaatggacccagctga

SEQ ID NO: 719434 - DNA, 20 bp, mouse
gtatagttgaggttaagacc

SEQ ID NO: 719435 - DNA, 20 bp, mouse
gaagaccgggacttatgtat

SEQ ID NO: 719436 - DNA, 20 bp, mouse
gcgcgggcctcgaaagtgat

SEQ ID NO: 719437 - DNA, 20 bp, mouse
ggcctcgaaagtgatcggaa

SEQ ID NO: 719438 - DNA, 20 bp, mouse
ggtagaggaaaacctcttat

SEQ ID NO: 719439 - DNA, 20 bp, mouse
gggaaatacacgctccctcc

SEQ ID NO: 719440 - DNA, 20 bp, mouse
gtgtgctagcttgagttcaa

SEQ ID NO: 719441 - DNA, 20 bp, mouse
gcaccggtgctgcagcatca

SEQ ID NO: 719442 - DNA, 20 bp, mouse
gcggtgcagggctctgtctg

SEQ ID NO: 719443 - DNA, 20 bp, mouse
gcccaacagacatggcctga

SEQ ID NO: 719444 - DNA, 20 bp, mouse
gtcaggaaggcaaacctgat

SEQ ID NO: 719445 - DNA, 20 bp, mouse
gaaggcaaacctgatggggc

SEQ ID NO: 719446 - DNA, 20 bp, mouse
ggggctcacaagcatgaagg

SEQ ID NO: 719447 - DNA, 20 bp, mouse
gaggtgccctggtgtgagaa

SEQ ID NO: 719448 - DNA, 20 bp, mouse
gaagcagtggccaggtgccc

SEQ ID NO: 719449 - DNA, 20 bp, mouse
gtgcacccctgctgttggct

SEQ ID NO: 719450 - DNA, 20 bp, mouse
gaggctcgacgcaggcagcg

SEQ ID NO: 719451 - DNA, 20 bp, mouse
gcacacgggccggtatcatg

SEQ ID NO: 719452 - DNA, 20 bp, mouse
gcaggggtgcacccagaagc

SEQ ID NO: 719453 - DNA, 20 bp, mouse
ggacgcaggcagcggggcat

SEQ ID NO: 719454 - DNA, 20 bp, mouse
ggtgtgagaagggcgttgtc

SEQ ID NO: 719455 - DNA, 20 bp, mouse
gtcagccagcggtggccctc

SEQ ID NO: 719456 - DNA, 20 bp, mouse
gtggggtgatgagtgaaact

SEQ ID NO: 719457 - DNA, 20 bp, mouse
gacggtggcggggaacaaga

SEQ ID NO: 719458 - DNA, 20 bp, mouse
gcagtcatgcatctcgggat

SEQ ID NO: 719459 - DNA, 20 bp, mouse
ggtggcggggaacaagaggg

SEQ ID NO: 719460 - DNA, 20 bp, mouse
ggcatcatgaattagtgtgt

SEQ ID NO: 719461 - DNA, 20 bp, mouse
ggcccgttggactcaatcca

SEQ ID NO: 719462 - DNA, 20 bp, mouse
ggtggcgccagagcgaacgg

SEQ ID NO: 719463 - DNA, 20 bp, mouse
ggcgccagagcgaacggtgg

SEQ ID NO: 719464 - DNA, 20 bp, mouse
ggaattcagtcatgcatctc

SEQ ID NO: 719465 - DNA, 20 bp, mouse
gtgaggactgagcgtctata

SEQ ID NO: 719466 - DNA, 20 bp, mouse
gaacccccatatcatgggtc

SEQ ID NO: 719467 - DNA, 20 bp, mouse
gctgaagcatgtgatacctc

SEQ ID NO: 719468 - DNA, 20 bp, mouse
gctcaggtccagacccacac

SEQ ID NO: 719469 - DNA, 20 bp, mouse
gagggatctgcctatctcaa

SEQ ID NO: 719470 - DNA, 20 bp, mouse
gcggcacatacccttgagat

SEQ ID NO: 719471 - DNA, 20 bp, mouse
gtataaaggtggtacaggga

SEQ ID NO: 719472 - DNA, 20 bp, mouse
gctcccagacccatgatatg

SEQ ID NO: 719473 - DNA, 20 bp, mouse
gaccaaaacccccatatcat

SEQ ID NO: 719474 - DNA, 20 bp, mouse
gaaggtggtacagggatgga

SEQ ID NO: 719475 - DNA, 20 bp, mouse
gtaagtaacagcaaatagca

SEQ ID NO: 719476 - DNA, 20 bp, mouse
gcacccgagcccaagggcag

SEQ ID NO: 719477 - DNA, 20 bp, mouse
gtggggatcctcccagtaag

SEQ ID NO: 719478 - DNA, 20 bp, mouse
gcatctccggggtatctctg

SEQ ID NO: 719479 - DNA, 20 bp, mouse
ggatccccacccgagcccaa

SEQ ID NO: 719480 - DNA, 20 bp, mouse
gagaggaagtggaaccccac

SEQ ID NO: 719481 - DNA, 20 bp, mouse
gagtgtgagttgagtaccta

SEQ ID NO: 719482 - DNA, 20 bp, mouse
gtggagtaagggcatctccg

SEQ ID NO: 719483 - DNA, 20 bp, mouse
gatctgctgggcagccccgt

SEQ ID NO: 719484 - DNA, 20 bp, mouse
gtcacactgcccctgccctt

SEQ ID NO: 719485 - DNA, 20 bp, mouse
ggcatctggtggctccttac

SEQ ID NO: 719486 - DNA, 20 bp, mouse
gaggctcccagggaaggtta

SEQ ID NO: 719487 - DNA, 20 bp, mouse
gcagatggcagaggctccca

SEQ ID NO: 719488 - DNA, 20 bp, mouse
gggagcctctgccatctgaa

SEQ ID NO: 719489 - DNA, 20 bp, mouse
gtcctcacagatactgatgg

SEQ ID NO: 719490 - DNA, 20 bp, mouse
ggcctccatcagtatctgtg

SEQ ID NO: 719491 - DNA, 20 bp, mouse
gagaatgttctcgacagctt

SEQ ID NO: 719492 - DNA, 20 bp, mouse
gacccagaagaggtgaatgg

SEQ ID NO: 719493 - DNA, 20 bp, mouse
gttcctcagtcagtaactag

SEQ ID NO: 719494 - DNA, 20 bp, mouse
gagtaactagcggaaactct

SEQ ID NO: 719495 - DNA, 20 bp, mouse
ggtaaattggaaatggaatg

SEQ ID NO: 719496 - DNA, 20 bp, mouse
gatgcgcttaagcatcttgt

SEQ ID NO: 719497 - DNA, 20 bp, mouse
gtaagcgcatgatgttgtca

SEQ ID NO: 719498 - DNA, 20 bp, mouse
gcagaagtgcaaattacagc

SEQ ID NO: 719499 - DNA, 20 bp, mouse
gggcgtttctcagtaagtgt

SEQ ID NO: 719500 - DNA, 20 bp, mouse
gcagcaggctgcggcggaga

SEQ ID NO: 719501 - DNA, 20 bp, mouse
gtaagcagaaaatgctgcag

SEQ ID NO: 719502 - DNA, 20 bp, mouse
ggaaggctttgtcccatttg

SEQ ID NO: 719503 - DNA, 20 bp, mouse
gctggatctgagcttctaga

SEQ ID NO: 719504 - DNA, 20 bp, mouse
ggctcaccggtgtcagtttc

SEQ ID NO: 719505 - DNA, 20 bp, mouse
gaaattacagcaggctgcgg

SEQ ID NO: 719506 - DNA, 20 bp, mouse
gcagtgcgggaggcaataga

SEQ ID NO: 719507 - DNA, 20 bp, mouse
gggaggcaatagagggctcg

SEQ ID NO: 719508 - DNA, 20 bp, mouse
gaatagagggctcgtggcag

SEQ ID NO: 719509 - DNA, 20 bp, mouse
gtaaaaaggagtgtacatag

SEQ ID NO: 719510 - DNA, 20 bp, mouse
gttaagctcacaatgttcgc

SEQ ID NO: 719511 - DNA, 20 bp, mouse
ggacctaatcatgcccttga

SEQ ID NO: 719512 - DNA, 20 bp, mouse
gtaccatcaagggcatgatt

SEQ ID NO: 719513 - DNA, 20 bp, mouse
ggtgagcttaagaccattac

SEQ ID NO: 719514 - DNA, 20 bp, mouse
gcatgtcttcatgtccctga

SEQ ID NO: 719515 - DNA, 20 bp, mouse
gcacaatgttcgcagggtga

SEQ ID NO: 719516 - DNA, 20 bp, mouse
gcatctgtacactatccatg

SEQ ID NO: 719517 - DNA, 20 bp, mouse
gctggtttcaaattctggtc

SEQ ID NO: 719518 - DNA, 20 bp, mouse
gtatgggaaacgatgtgtac

SEQ ID NO: 719519 - DNA, 20 bp, mouse
gtgcactcttggacctttgg

SEQ ID NO: 719520 - DNA, 20 bp, mouse
gaggccacctcaaccgccaa

SEQ ID NO: 719521 - DNA, 20 bp, mouse
gtggtacgagcgaagtggta

SEQ ID NO: 719522 - DNA, 20 bp, mouse
gctcaaatgtcacagaaact

SEQ ID NO: 719523 - DNA, 20 bp, mouse
ggatagtggtacgagcgaag

SEQ ID NO: 719524 - DNA, 20 bp, mouse
gactatatgcttcatcctca

SEQ ID NO: 719525 - DNA, 20 bp, mouse
gggacctttggcggttgagg

SEQ ID NO: 719526 - DNA, 20 bp, mouse
ggctggagacaggcgtttgt

SEQ ID NO: 719527 - DNA, 20 bp, mouse
ggacggcttgtgggagtctg

SEQ ID NO: 719528 - DNA, 20 bp, mouse
gagggtacacaagagagcag

SEQ ID NO: 719529 - DNA, 20 bp, mouse
gagagcagagaaagaaggcg

SEQ ID NO: 719530 - DNA, 20 bp, mouse
gagaacttttggagacggac

SEQ ID NO: 719531 - DNA, 20 bp, mouse
gttttggagacggacaggaa

SEQ ID NO: 719532 - DNA, 20 bp, mouse
gctggcgcctacccacacca

SEQ ID NO: 719533 - DNA, 20 bp, mouse
ggaactcagcaccttaggct

SEQ ID NO: 719534 - DNA, 20 bp, mouse
gaaaatgtggactagttatg

SEQ ID NO: 719535 - DNA, 20 bp, mouse
ggagagcagaggacggcttg

SEQ ID NO: 719536 - DNA, 20 bp, mouse
gcagaccatcatataggtat

SEQ ID NO: 719537 - DNA, 20 bp, mouse
gcgattctgaattaattctt

SEQ ID NO: 719538 - DNA, 20 bp, mouse
gaaagatacaccctacagac

SEQ ID NO: 719539 - DNA, 20 bp, mouse
gggaaagcagaccatcatat

SEQ ID NO: 719540 - DNA, 20 bp, mouse
gctgaaatggaggaaagcac

SEQ ID NO: 719541 - DNA, 20 bp, mouse
gaccttaaactctgaaatgg

SEQ ID NO: 719542 - DNA, 20 bp, mouse
gcttgccaatacctatatga

SEQ ID NO: 719543 - DNA, 20 bp, mouse
gtgggattatcatctgcatt

SEQ ID NO: 719544 - DNA, 20 bp, mouse
gaatccatgtgttgtatagc

SEQ ID NO: 719545 - DNA, 20 bp, mouse
gatcatctgcattaggaagg

SEQ ID NO: 719546 - DNA, 20 bp, mouse
gcaaggcaggaattagcatt

SEQ ID NO: 719547 - DNA, 20 bp, mouse
ggggttaggctggaagtatg

SEQ ID NO: 719548 - DNA, 20 bp, mouse
gaggtggggtgatatgtgtg

SEQ ID NO: 719549 - DNA, 20 bp, mouse
ggggtgtgcgcgtgctttcc

SEQ ID NO: 719550 - DNA, 20 bp, mouse
gaacagcaagtgctacactg

SEQ ID NO: 719551 - DNA, 20 bp, mouse
gaccaaggaaagagttggga

SEQ ID NO: 719552 - DNA, 20 bp, mouse
gctttccttggtaacacttc

SEQ ID NO: 719553 - DNA, 20 bp, mouse
gtttggatgagaggtgactc

SEQ ID NO: 719554 - DNA, 20 bp, mouse
gccaaacagcattgtcccta

SEQ ID NO: 719555 - DNA, 20 bp, mouse
gttgcttcttggatggcggg

SEQ ID NO: 719556 - DNA, 20 bp, mouse
gagggtgcagggggtaacta

SEQ ID NO: 719557 - DNA, 20 bp, mouse
gcaccctaaccccccaaccg

SEQ ID NO: 719558 - DNA, 20 bp, mouse
gaacctcggttggggggtta

SEQ ID NO: 719559 - DNA, 20 bp, mouse
gggttgatgaggactagaga

SEQ ID NO: 719560 - DNA, 20 bp, mouse
gggcaagaagcaaacccatc

SEQ ID NO: 719561 - DNA, 20 bp, mouse
gtcgactaccagcttttcgg

SEQ ID NO: 719562 - DNA, 20 bp, mouse
gagtaactcagcacacggaa

SEQ ID NO: 719563 - DNA, 20 bp, mouse
gtccgcagccacacggttct

SEQ ID NO: 719564 - DNA, 20 bp, mouse
gcccagcatcactcacccat

SEQ ID NO: 719565 - DNA, 20 bp, mouse
gtcgcgggggcgtcgggggg

SEQ ID NO: 719566 - DNA, 20 bp, mouse
gggagtaggtggcttgtgtc

SEQ ID NO: 719567 - DNA, 20 bp, mouse
ggggtgatgtcataagtgtg

SEQ ID NO: 719568 - DNA, 20 bp, mouse
gtcctgtggtcgccctaacc

SEQ ID NO: 719569 - DNA, 20 bp, mouse
gagactgctgtagtagtggg

SEQ ID NO: 719570 - DNA, 20 bp, mouse
gccaaagtgatcagagccag

SEQ ID NO: 719571 - DNA, 20 bp, mouse
gggaggagttgatctcaccc

SEQ ID NO: 719572 - DNA, 20 bp, mouse
gtggaggcccacggaagctg

SEQ ID NO: 719573 - DNA, 20 bp, mouse
ggcatcctggaatgcactca

SEQ ID NO: 719574 - DNA, 20 bp, mouse
gactttggagacatggccct

SEQ ID NO: 719575 - DNA, 20 bp, mouse
ggtgagatcaactcctccaa

SEQ ID NO: 719576 - DNA, 20 bp, mouse
gtagtgctgttaactgactt

SEQ ID NO: 719577 - DNA, 20 bp, mouse
gcagctgttgttaatactgt

SEQ ID NO: 719578 - DNA, 20 bp, mouse
gaaagctctacaaaccccac

SEQ ID NO: 719579 - DNA, 20 bp, mouse
gcagggctgttgtaagtctg

SEQ ID NO: 719580 - DNA, 20 bp, mouse
gggaagcctttcaaaagagg

SEQ ID NO: 719581 - DNA, 20 bp, mouse
ggagcgtgacctaaccctcc

SEQ ID NO: 719582 - DNA, 20 bp, mouse
ggtcagatgccaggagggtt

SEQ ID NO: 719583 - DNA, 20 bp, mouse
gaaatggtgcttaatgatgt

SEQ ID NO: 719584 - DNA, 20 bp, mouse
gaggataaactaatcagtta

SEQ ID NO: 719585 - DNA, 20 bp, mouse
ggatccccaaagaaacttgc

SEQ ID NO: 719586 - DNA, 20 bp, mouse
gccgtccgatgcccaagctc

SEQ ID NO: 719587 - DNA, 20 bp, mouse
gtcggttcatggaacacata

SEQ ID NO: 719588 - DNA, 20 bp, mouse
gaaccgagactggcccagta

SEQ ID NO: 719589 - DNA, 20 bp, mouse
gcatcggacgggagctgctc

SEQ ID NO: 719590 - DNA, 20 bp, mouse
gcacagggcttgcccttact

SEQ ID NO: 719591 - DNA, 20 bp, mouse
gagctgctcgggttcccaca

SEQ ID NO: 719592 - DNA, 20 bp, mouse
ggtgttccatgaaccgagac

SEQ ID NO: 719593 - DNA, 20 bp, mouse
gctgggccagtctcggttca

SEQ ID NO: 719594 - DNA, 20 bp, mouse
gtcacaggaggctttgaagc

SEQ ID NO: 719595 - DNA, 20 bp, mouse
gtcttcagctggatccgtgt

SEQ ID NO: 719596 - DNA, 20 bp, mouse
ggggcgtaggctatttatgg

SEQ ID NO: 719597 - DNA, 20 bp, mouse
gtgcacagggcagagggcgt

SEQ ID NO: 719598 - DNA, 20 bp, mouse
ggggccttgccttcccggtg

SEQ ID NO: 719599 - DNA, 20 bp, mouse
gtggaccacctgagtttcat

SEQ ID NO: 719600 - DNA, 20 bp, mouse
gtgttctagtggaggaagac

SEQ ID NO: 719601 - DNA, 20 bp, mouse
gtggcagtttctagtaggtg

SEQ ID NO: 719602 - DNA, 20 bp, mouse
gtaaaataaagaagtgcaca

SEQ ID NO: 719603 - DNA, 20 bp, mouse
gcaggagcacaggatgtaat

SEQ ID NO: 719604 - DNA, 20 bp, mouse
gtgttcccatgaaactcagg

SEQ ID NO: 719605 - DNA, 20 bp, mouse
gacagcataacaattttcat

SEQ ID NO: 719606 - DNA, 20 bp, mouse
ggcttcagatggcaagactc

SEQ ID NO: 719607 - DNA, 20 bp, mouse
gagctacgaaagcacgctta

SEQ ID NO: 719608 - DNA, 20 bp, mouse
gaaagcacgcttagggggtg

SEQ ID NO: 719609 - DNA, 20 bp, mouse
gagtgagaagccaagtcata

SEQ ID NO: 719610 - DNA, 20 bp, mouse
gcgaggagatgccagtagag

SEQ ID NO: 719611 - DNA, 20 bp, mouse
ggtgggggatgctagtacag

SEQ ID NO: 719612 - DNA, 20 bp, mouse
gctcactggactcttctatc

SEQ ID NO: 719613 - DNA, 20 bp, mouse
gagaagcagaaaagagttac

SEQ ID NO: 719614 - DNA, 20 bp, mouse
gctccagaaagtgcttcaga

SEQ ID NO: 719615 - DNA, 20 bp, mouse
ggactggaaagttttgaaag

SEQ ID NO: 719616 - DNA, 20 bp, mouse
ggtaacataccccacaatgg

SEQ ID NO: 719617 - DNA, 20 bp, mouse
gcagctccgtcctccattgt

SEQ ID NO: 719618 - DNA, 20 bp, mouse
ggtatgttacctggcttata

SEQ ID NO: 719619 - DNA, 20 bp, mouse
gacacactaccttataagcc

SEQ ID NO: 719620 - DNA, 20 bp, mouse
gtcaagcagtcttcatatta

SEQ ID NO: 719621 - DNA, 20 bp, mouse
gtggaatcatataaaacaag

SEQ ID NO: 719622 - DNA, 20 bp, mouse
gtgtgtgtaggtaggtcaga

SEQ ID NO: 719623 - DNA, 20 bp, mouse
gcataccccacaatggagga

SEQ ID NO: 719624 - DNA, 20 bp, mouse
gcaggtaacataccccacaa

SEQ ID NO: 719625 - DNA, 20 bp, mouse
gaaaatcagaaaaagagggc

SEQ ID NO: 719626 - DNA, 20 bp, mouse
gtgggtgcgcgcgtccccgg

SEQ ID NO: 719627 - DNA, 20 bp, mouse
gctcccgcgcgcgtgctcgt

SEQ ID NO: 719628 - DNA, 20 bp, mouse
ggggaggccggactctggtc

SEQ ID NO: 719629 - DNA, 20 bp, mouse
gggcgggcgcgggctcctcg

SEQ ID NO: 719630 - DNA, 20 bp, mouse
gctgcgcccggaccagagtc

SEQ ID NO: 719631 - DNA, 20 bp, mouse
gcagagtccggcctcccccg

SEQ ID NO: 719632 - DNA, 20 bp, mouse
gcacccacgagcacgcgcgc

SEQ ID NO: 719633 - DNA, 20 bp, mouse
gcgggagggttgcccagcgg

SEQ ID NO: 719634 - DNA, 20 bp, mouse
gcgcggcgctcgctctcccc

SEQ ID NO: 719635 - DNA, 20 bp, mouse
gtccccgggctgcgcgcgaa

SEQ ID NO: 719636 - DNA, 20 bp, mouse
gggggaggaggccgcgagga

SEQ ID NO: 719637 - DNA, 20 bp, mouse
gataacccgtgcgtttcgta

SEQ ID NO: 719638 - DNA, 20 bp, mouse
gcacgcgcggagctggagga

SEQ ID NO: 719639 - DNA, 20 bp, mouse
gctgcagcagtcgcggcgaa

SEQ ID NO: 719640 - DNA, 20 bp, mouse
gtcaccaagtcccacctcct

SEQ ID NO: 719641 - DNA, 20 bp, mouse
gctgcctctcccagcccggg

SEQ ID NO: 719642 - DNA, 20 bp, mouse
gcaggagggagaggacgggc

SEQ ID NO: 719643 - DNA, 20 bp, mouse
ggtcagagctgcagcagtcg

SEQ ID NO: 719644 - DNA, 20 bp, mouse
ggttatcggagcgtcttcct

SEQ ID NO: 719645 - DNA, 20 bp, mouse
gccgagagccggcgagtggg

SEQ ID NO: 719646 - DNA, 20 bp, mouse
gccgctgcgaggacgccctg

SEQ ID NO: 719647 - DNA, 20 bp, mouse
ggcgatgcccgagtgagcgc

SEQ ID NO: 719648 - DNA, 20 bp, mouse
gctctcccggcgcagacgca

SEQ ID NO: 719649 - DNA, 20 bp, mouse
gcggggccctgcgtctgcgc

SEQ ID NO: 719650 - DNA, 20 bp, mouse
gcggctggaggtaacctcaa

SEQ ID NO: 719651 - DNA, 20 bp, mouse
gtgcgcgaagctgccggcta

SEQ ID NO: 719652 - DNA, 20 bp, mouse
gccgccgccctgctcaagcg

SEQ ID NO: 719653 - DNA, 20 bp, mouse
gggcctgcgagcaccggact

SEQ ID NO: 719654 - DNA, 20 bp, mouse
ggggaagggcagttccgggc

SEQ ID NO: 719655 - DNA, 20 bp, mouse
ggcctcgcctcgcttgagca

SEQ ID NO: 719656 - DNA, 20 bp, mouse
gcatgtgaccacttcaggaa

SEQ ID NO: 719657 - DNA, 20 bp, mouse
gggcacatgatgtctgtgtt

SEQ ID NO: 719658 - DNA, 20 bp, mouse
ggaaaggaaagtttccacgt

SEQ ID NO: 719659 - DNA, 20 bp, mouse
gaccacttcaggaagggctg

SEQ ID NO: 719660 - DNA, 20 bp, mouse
gacactggcccccatcttca

SEQ ID NO: 719661 - DNA, 20 bp, mouse
gtggtcacatgatctcacac

SEQ ID NO: 719662 - DNA, 20 bp, mouse
gaagtggctctatatggtac

SEQ ID NO: 719663 - DNA, 20 bp, mouse
gcctttcagcttacaacttc

SEQ ID NO: 719664 - DNA, 20 bp, mouse
gctgggcaagtggctctata

SEQ ID NO: 719665 - DNA, 20 bp, mouse
gcacagacatcatgtgccca

SEQ ID NO: 719666 - DNA, 20 bp, mouse
gcgaacctgttctttggtgc

SEQ ID NO: 719667 - DNA, 20 bp, mouse
ggttacggtccagaaggccg

SEQ ID NO: 719668 - DNA, 20 bp, mouse
gcaagacaacctcggccttc

SEQ ID NO: 719669 - DNA, 20 bp, mouse
gctggcagaagcgagaccat

SEQ ID NO: 719670 - DNA, 20 bp, mouse
ggcggaaagcaagacaacct

SEQ ID NO: 719671 - DNA, 20 bp, mouse
gacggtgcacgtgtggcttg

SEQ ID NO: 719672 - DNA, 20 bp, mouse
gttctggaccgtaactccca

SEQ ID NO: 719673 - DNA, 20 bp, mouse
gagcgagaccatgggagtta

SEQ ID NO: 719674 - DNA, 20 bp, mouse
gtgaccgcgggagcccagca

SEQ ID NO: 719675 - DNA, 20 bp, mouse
gaagccttggcgccgccctg

SEQ ID NO: 719676 - DNA, 20 bp, mouse
gaagaacatgttgacgtctc

SEQ ID NO: 719677 - DNA, 20 bp, mouse
gcccctggaggcaggatgta

SEQ ID NO: 719678 - DNA, 20 bp, mouse
gcagtcggggacttcaccgt

SEQ ID NO: 719679 - DNA, 20 bp, mouse
gcagctgccagggagcacgt

SEQ ID NO: 719680 - DNA, 20 bp, mouse
gcagagggtcacatctagtg

SEQ ID NO: 719681 - DNA, 20 bp, mouse
gccctccatggcagctcagt

SEQ ID NO: 719682 - DNA, 20 bp, mouse
gctggctgagacagctgcca

SEQ ID NO: 719683 - DNA, 20 bp, mouse
gtggaaacccacgtgctccc

SEQ ID NO: 719684 - DNA, 20 bp, mouse
gccaccccatggtaattgag

SEQ ID NO: 719685 - DNA, 20 bp, mouse
gtatgggtgagtcggccctg

SEQ ID NO: 719686 - DNA, 20 bp, mouse
gtcggcgtgctaaacgttca

SEQ ID NO: 719687 - DNA, 20 bp, mouse
gctagcaatagtgtcgtacg

SEQ ID NO: 719688 - DNA, 20 bp, mouse
ggagctaggaaaggcgacgt

SEQ ID NO: 719689 - DNA, 20 bp, mouse
gcaaaaacgccctggcagag

SEQ ID NO: 719690 - DNA, 20 bp, mouse
gagcatttctcgaattggga

SEQ ID NO: 719691 - DNA, 20 bp, mouse
gcggtcttgttgcggaggga

SEQ ID NO: 719692 - DNA, 20 bp, mouse
gtgtcactgcctggcgcgac

SEQ ID NO: 719693 - DNA, 20 bp, mouse
gtctgttcctaaagcaacga

SEQ ID NO: 719694 - DNA, 20 bp, mouse
ggccgagcgtgagcttacat

SEQ ID NO: 719695 - DNA, 20 bp, mouse
gccggaagttgcatcacctc

SEQ ID NO: 719696 - DNA, 20 bp, mouse
ggacacgtctcataggcaga

SEQ ID NO: 719697 - DNA, 20 bp, mouse
gccaaccggtagaaccccca

SEQ ID NO: 719698 - DNA, 20 bp, mouse
gcgaatctctggatatacaa

SEQ ID NO: 719699 - DNA, 20 bp, mouse
gttgaaaggacacgtctcat

SEQ ID NO: 719700 - DNA, 20 bp, mouse
gagacgtgtcctttcaactt

SEQ ID NO: 719701 - DNA, 20 bp, mouse
gccctcgggggggtagagga

SEQ ID NO: 719702 - DNA, 20 bp, mouse
gctgggcctcgtgaacattt

SEQ ID NO: 719703 - DNA, 20 bp, mouse
gtcactaaacccaagttgaa

SEQ ID NO: 719704 - DNA, 20 bp, mouse
gggaggagagttcctaggct

SEQ ID NO: 719705 - DNA, 20 bp, mouse
ggttctaaagacattaaact

SEQ ID NO: 719706 - DNA, 20 bp, mouse
gaggagcaagcatgggtaac

SEQ ID NO: 719707 - DNA, 20 bp, mouse
gagcaagcatgggtaacagg

SEQ ID NO: 719708 - DNA, 20 bp, mouse
ggagctaacaggagaagtaa

SEQ ID NO: 719709 - DNA, 20 bp, mouse
gaaactgccagactccttga

SEQ ID NO: 719710 - DNA, 20 bp, mouse
gttagcttaagatggcatgt

SEQ ID NO: 719711 - DNA, 20 bp, mouse
ggttctcattaatgtgggtg

SEQ ID NO: 719712 - DNA, 20 bp, mouse
gcgaaggctcctttcataat

SEQ ID NO: 719713 - DNA, 20 bp, mouse
gagccactgctagcatacca

SEQ ID NO: 719714 - DNA, 20 bp, mouse
gagtgagtatctgcccacga

SEQ ID NO: 719715 - DNA, 20 bp, mouse
gaaccttggtatgctagcag

SEQ ID NO: 719716 - DNA, 20 bp, mouse
gtctcccggggatctcaccc

SEQ ID NO: 719717 - DNA, 20 bp, mouse
gggtaagcagcagaagcagt

SEQ ID NO: 719718 - DNA, 20 bp, mouse
ggaccctgggtgagatcccc

SEQ ID NO: 719719 - DNA, 20 bp, mouse
gacttccaggctgtctcccg

SEQ ID NO: 719720 - DNA, 20 bp, mouse
gtctggcccgtagaggaccc

SEQ ID NO: 719721 - DNA, 20 bp, mouse
gttgggaggcatcgctgaaa

SEQ ID NO: 719722 - DNA, 20 bp, mouse
gcaactgacagggcaggttc

SEQ ID NO: 719723 - DNA, 20 bp, mouse
gaaagtcccaagaagggcga

SEQ ID NO: 719724 - DNA, 20 bp, mouse
gctcacccagggtcctctac

SEQ ID NO: 719725 - DNA, 20 bp, mouse
gctcctctgggccaggaaca

SEQ ID NO: 719726 - DNA, 20 bp, mouse
gtgacagcaacacttggcaa

SEQ ID NO: 719727 - DNA, 20 bp, mouse
ggaatctcagaattctgaga

SEQ ID NO: 719728 - DNA, 20 bp, mouse
ggtggcgcgcagggaaagca

SEQ ID NO: 719729 - DNA, 20 bp, mouse
gagaattctgagattctcta

SEQ ID NO: 719730 - DNA, 20 bp, mouse
gcagccaagggcccatgaaa

SEQ ID NO: 719731 - DNA, 20 bp, mouse
gctgagattctctacggctt

SEQ ID NO: 719732 - DNA, 20 bp, mouse
ggaggggcagccaatctcag

SEQ ID NO: 719733 - DNA, 20 bp, mouse
gctcgtctgaacacatactc

SEQ ID NO: 719734 - DNA, 20 bp, mouse
gaagtgttgctgtcaaatag

SEQ ID NO: 719735 - DNA, 20 bp, mouse
ggctgcgacgttgttgtaac

SEQ ID NO: 719736 - DNA, 20 bp, mouse
gtcaggagcagttatcgaga

SEQ ID NO: 719737 - DNA, 20 bp, mouse
gacacagttgagatttaacg

SEQ ID NO: 719738 - DNA, 20 bp, mouse
ggcaaggccaggattctgtc

SEQ ID NO: 719739 - DNA, 20 bp, mouse
gaaagcctgcgagcgctcag

SEQ ID NO: 719740 - DNA, 20 bp, mouse
gtctacactagccaagtcaa

SEQ ID NO: 719741 - DNA, 20 bp, mouse
ggcctgcgagcgctcagggg

SEQ ID NO: 719742 - DNA, 20 bp, mouse
gaggtctgcagatttgtggt

SEQ ID NO: 719743 - DNA, 20 bp, mouse
gactgtgtggccaaaattga

SEQ ID NO: 719744 - DNA, 20 bp, mouse
gtacaaaatactcttgatga

SEQ ID NO: 719745 - DNA, 20 bp, mouse
gcgtgactctgttttgagga

SEQ ID NO: 719746 - DNA, 20 bp, mouse
gggggcggggctactgtcga

SEQ ID NO: 719747 - DNA, 20 bp, mouse
gtcagcctgactggagcagg

SEQ ID NO: 719748 - DNA, 20 bp, mouse
gggctcaagttcagcctgac

SEQ ID NO: 719749 - DNA, 20 bp, mouse
gactggaagcggtgtgcaga

SEQ ID NO: 719750 - DNA, 20 bp, mouse
gggcgggggacgcgtggcgt

SEQ ID NO: 719751 - DNA, 20 bp, mouse
gacaaagggcgggggacgcg

SEQ ID NO: 719752 - DNA, 20 bp, mouse
gtgctctgttgcattcgcag

SEQ ID NO: 719753 - DNA, 20 bp, mouse
gtgcacgtcgctacaaaggg

SEQ ID NO: 719754 - DNA, 20 bp, mouse
gcgccccggcccacccccta

SEQ ID NO: 719755 - DNA, 20 bp, mouse
gacctcctcctgctccagtc

SEQ ID NO: 719756 - DNA, 20 bp, mouse
gtattctcaggatatgatgg

SEQ ID NO: 719757 - DNA, 20 bp, mouse
gtggggttctacttacattg

SEQ ID NO: 719758 - DNA, 20 bp, mouse
ggaaggctattcaaatgcag

SEQ ID NO: 719759 - DNA, 20 bp, mouse
ggtgtattctcaggatatga

SEQ ID NO: 719760 - DNA, 20 bp, mouse
gagtacggagatttaagaca

SEQ ID NO: 719761 - DNA, 20 bp, mouse
gtggtctacatggccaggta

SEQ ID NO: 719762 - DNA, 20 bp, mouse
ggaaagcttaataggcatgg

SEQ ID NO: 719763 - DNA, 20 bp, mouse
gaacatactgaaagcttaat

SEQ ID NO: 719764 - DNA, 20 bp, mouse
gactgaaagcttaataggca

SEQ ID NO: 719765 - DNA, 20 bp, mouse
gattgtggtaatgctttgga

SEQ ID NO: 719766 - DNA, 20 bp, mouse
gaggaggtgaggcttaaaac

SEQ ID NO: 719767 - DNA, 20 bp, mouse
gttaaggcgggagagcttcg

SEQ ID NO: 719768 - DNA, 20 bp, mouse
gacagtgtctggaaatgatg

SEQ ID NO: 719769 - DNA, 20 bp, mouse
gcgggagagcttcgcggagg

SEQ ID NO: 719770 - DNA, 20 bp, mouse
gactgtgtgtggcgcgctcg

SEQ ID NO: 719771 - DNA, 20 bp, mouse
gtctggaaatgatggggtta

SEQ ID NO: 719772 - DNA, 20 bp, mouse
ggaaatgatggggttaaggc

SEQ ID NO: 719773 - DNA, 20 bp, mouse
ggacggaaagagcgctttgg

SEQ ID NO: 719774 - DNA, 20 bp, mouse
gaaagctcggtgtgttccaa

SEQ ID NO: 719775 - DNA, 20 bp, mouse
gagggcaggtattcaatccc

SEQ ID NO: 719776 - DNA, 20 bp, mouse
gagcccgagtcggactgtcg

SEQ ID NO: 719777 - DNA, 20 bp, mouse
gctccccgacagtccgactc

SEQ ID NO: 719778 - DNA, 20 bp, mouse
gcgggagctcggccgcgcca

SEQ ID NO: 719779 - DNA, 20 bp, mouse
gcgcggcggccctttgtctg

SEQ ID NO: 719780 - DNA, 20 bp, mouse
gcgcccggttgcaccagccc

SEQ ID NO: 719781 - DNA, 20 bp, mouse
gcggactgtcggggagccgg

SEQ ID NO: 719782 - DNA, 20 bp, mouse
ggccgggctcgagcccgagt

SEQ ID NO: 719783 - DNA, 20 bp, mouse
gcgccgcggccgcagacaaa

SEQ ID NO: 719784 - DNA, 20 bp, mouse
gggagccccagcaaccgcac

SEQ ID NO: 719785 - DNA, 20 bp, mouse
ggcaaccgggcggagagcgc

SEQ ID NO: 719786 - DNA, 20 bp, mouse
ggggagggattgtttttcat

SEQ ID NO: 719787 - DNA, 20 bp, mouse
ggcaaaagcctgcgaaggta

SEQ ID NO: 719788 - DNA, 20 bp, mouse
gtttgccaaagagtaaatta

SEQ ID NO: 719789 - DNA, 20 bp, mouse
gttgaaagccttaccttcgc

SEQ ID NO: 719790 - DNA, 20 bp, mouse
gcaaagagtaaattaaggca

SEQ ID NO: 719791 - DNA, 20 bp, mouse
gctttggcaaaagcctgcga

SEQ ID NO: 719792 - DNA, 20 bp, mouse
gtttgatctataatgacagc

SEQ ID NO: 719793 - DNA, 20 bp, mouse
gatctgttaaatcttaagac

SEQ ID NO: 719794 - DNA, 20 bp, mouse
gttcttggttgttcttttac

SEQ ID NO: 719795 - DNA, 20 bp, mouse
gattgattatcttgcctgtt

SEQ ID NO: 719796 - DNA, 20 bp, mouse
ggaggctaatatgacaccat

SEQ ID NO: 719797 - DNA, 20 bp, mouse
gaaaggagaaaaattcattc

SEQ ID NO: 719798 - DNA, 20 bp, mouse
gatttggggtatggatatga

SEQ ID NO: 719799 - DNA, 20 bp, mouse
gttaagcaatgctattccca

SEQ ID NO: 719800 - DNA, 20 bp, mouse
ggcctcaaagatatggacaa

SEQ ID NO: 719801 - DNA, 20 bp, mouse
ggattttgcttttattaatt

SEQ ID NO: 719802 - DNA, 20 bp, mouse
gttacataaatataaagtag

SEQ ID NO: 719803 - DNA, 20 bp, mouse
gcttttattaatttggggta

SEQ ID NO: 719804 - DNA, 20 bp, mouse
gttagatatcattttaaaaa

SEQ ID NO: 719805 - DNA, 20 bp, mouse
ggagagactgaaattaatag

SEQ ID NO: 719806 - DNA, 20 bp, mouse
ggacttgcagcagctatctc

SEQ ID NO: 719807 - DNA, 20 bp, mouse
gcatcacagttagtctatgg

SEQ ID NO: 719808 - DNA, 20 bp, mouse
gcacacctagtgccaggagg

SEQ ID NO: 719809 - DNA, 20 bp, mouse
gattcatcacagttagtcta

SEQ ID NO: 719810 - DNA, 20 bp, mouse
ggtaacccacacctagtgcc

SEQ ID NO: 719811 - DNA, 20 bp, mouse
gtgacaccgcagttacttgc

SEQ ID NO: 719812 - DNA, 20 bp, mouse
ggcggtgtcacttttcccac

SEQ ID NO: 719813 - DNA, 20 bp, mouse
gtgcaagtcgcctctgcttt

SEQ ID NO: 719814 - DNA, 20 bp, mouse
gctattgattcaagcccgct

SEQ ID NO: 719815 - DNA, 20 bp, mouse
gaagaccttcaaatcctagc

SEQ ID NO: 719816 - DNA, 20 bp, mouse
gaagccagcagggctacgga

SEQ ID NO: 719817 - DNA, 20 bp, mouse
gtctaggagtggggaagtaa

SEQ ID NO: 719818 - DNA, 20 bp, mouse
gcctccctgttctaggagtg

SEQ ID NO: 719819 - DNA, 20 bp, mouse
gtcctagaacagggagggtg

SEQ ID NO: 719820 - DNA, 20 bp, mouse
ggttccgaggtcagaggagt

SEQ ID NO: 719821 - DNA, 20 bp, mouse
gttcccaggagcaaaagaac

SEQ ID NO: 719822 - DNA, 20 bp, mouse
gaacctattaccagaggtgg

SEQ ID NO: 719823 - DNA, 20 bp, mouse
gttctaagccagcagggcta

SEQ ID NO: 719824 - DNA, 20 bp, mouse
gatcctcctgcagccttccc

SEQ ID NO: 719825 - DNA, 20 bp, mouse
gcttccccactcctagaaca

SEQ ID NO: 719826 - DNA, 20 bp, mouse
gtagcccgcgctgtaatcat

SEQ ID NO: 719827 - DNA, 20 bp, mouse
gcggcggcaacgcacaatct

SEQ ID NO: 719828 - DNA, 20 bp, mouse
gaatcataggacacctgatg

SEQ ID NO: 719829 - DNA, 20 bp, mouse
ggaggctggggtaaaccgcg

SEQ ID NO: 719830 - DNA, 20 bp, mouse
gtggagaccagatggggtct

SEQ ID NO: 719831 - DNA, 20 bp, mouse
gcataggacacctgatgggg

SEQ ID NO: 719832 - DNA, 20 bp, mouse
ggaccagatggggtctggga

SEQ ID NO: 719833 - DNA, 20 bp, mouse
gaggacacctgatggggcgg

SEQ ID NO: 719834 - DNA, 20 bp, mouse
gtgtcctatgattacagcgc

SEQ ID NO: 719835 - DNA, 20 bp, mouse
gaacgcacaatctgggaaga

SEQ ID NO: 719836 - DNA, 20 bp, mouse
gcatctgggtcgggagtact

SEQ ID NO: 719837 - DNA, 20 bp, mouse
gagagctagccgctacttag

SEQ ID NO: 719838 - DNA, 20 bp, mouse
gagcggctagctctatcagt

SEQ ID NO: 719839 - DNA, 20 bp, mouse
gcatcagaacgatctgctaa

SEQ ID NO: 719840 - DNA, 20 bp, mouse
gctcccgacccagatgaacc

SEQ ID NO: 719841 - DNA, 20 bp, mouse
gaaggtcaaactccgaatga

SEQ ID NO: 719842 - DNA, 20 bp, mouse
gacgatgggaagcagaagac

SEQ ID NO: 719843 - DNA, 20 bp, mouse
gatccctggttcatctgggt

SEQ ID NO: 719844 - DNA, 20 bp, mouse
ggatcgttctgatggattat

SEQ ID NO: 719845 - DNA, 20 bp, mouse
gctcagagacaaatagctca

SEQ ID NO: 719846 - DNA, 20 bp, mouse
gtgggccgagccttagaaga

SEQ ID NO: 719847 - DNA, 20 bp, mouse
gtgtcagctgccttcttcta

SEQ ID NO: 719848 - DNA, 20 bp, mouse
gactgagtcgagatagggtc

SEQ ID NO: 719849 - DNA, 20 bp, mouse
gttagaggactctacggctt

SEQ ID NO: 719850 - DNA, 20 bp, mouse
ggtaagactgagtcgagata

SEQ ID NO: 719851 - DNA, 20 bp, mouse
gtacggctttgggaaggtgt

SEQ ID NO: 719852 - DNA, 20 bp, mouse
gggtgaatgccaaacgcgta

SEQ ID NO: 719853 - DNA, 20 bp, mouse
gtgcaatcacggtatattag

SEQ ID NO: 719854 - DNA, 20 bp, mouse
gggactctacggctttggga

SEQ ID NO: 719855 - DNA, 20 bp, mouse
gaaagatcctgtttctgtgt

SEQ ID NO: 719856 - DNA, 20 bp, mouse
gggaccccagccatctacta

SEQ ID NO: 719857 - DNA, 20 bp, mouse
gaggatcaccatggatgtaa

SEQ ID NO: 719858 - DNA, 20 bp, mouse
gcaggctgcccttacatcca

SEQ ID NO: 719859 - DNA, 20 bp, mouse
ggttccctcctcttaaagat

SEQ ID NO: 719860 - DNA, 20 bp, mouse
ggaactcaggtaaagaacaa

SEQ ID NO: 719861 - DNA, 20 bp, mouse
gaaacccatctttaagagga

SEQ ID NO: 719862 - DNA, 20 bp, mouse
gaagccaagcataaagcaag

SEQ ID NO: 719863 - DNA, 20 bp, mouse
gtgtgatcactttcaagatc

SEQ ID NO: 719864 - DNA, 20 bp, mouse
ggatcctcttgctttatgct

SEQ ID NO: 719865 - DNA, 20 bp, mouse
ggctgactttgagttgaact

SEQ ID NO: 719866 - DNA, 20 bp, mouse
gctgagaagtctccgggcga

SEQ ID NO: 719867 - DNA, 20 bp, mouse
ggccgtgctgagaagtctcc

SEQ ID NO: 719868 - DNA, 20 bp, mouse
ggcctggcccccagactggg

SEQ ID NO: 719869 - DNA, 20 bp, mouse
gcgcccagccgggctcacct

SEQ ID NO: 719870 - DNA, 20 bp, mouse
gagtcccaggtgagcccggc

SEQ ID NO: 719871 - DNA, 20 bp, mouse
ggagtcgcagacaccgagaa

SEQ ID NO: 719872 - DNA, 20 bp, mouse
gtgagccaggcggcggtgtt

SEQ ID NO: 719873 - DNA, 20 bp, mouse
ggcccggagacttctcagca

SEQ ID NO: 719874 - DNA, 20 bp, mouse
gcctggcgcaggcggaggat

SEQ ID NO: 719875 - DNA, 20 bp, mouse
gggcggaggataggagtccc

SEQ ID NO: 719876 - DNA, 20 bp, mouse
gtgcaccctgtgaacctggt

SEQ ID NO: 719877 - DNA, 20 bp, mouse
gcatccctaccaggttcaca

SEQ ID NO: 719878 - DNA, 20 bp, mouse
gcgagcgcagcatccctacc

SEQ ID NO: 719879 - DNA, 20 bp, mouse
gaggcgcagcgtgtccagtt

SEQ ID NO: 719880 - DNA, 20 bp, mouse
gctgggcccgggtagcgctc

SEQ ID NO: 719881 - DNA, 20 bp, mouse
ggggatgctgcgctcgaggc

SEQ ID NO: 719882 - DNA, 20 bp, mouse
gcctcttggctcttcgtctg

SEQ ID NO: 719883 - DNA, 20 bp, mouse
gcgcaggtgcgcgatgtagc

SEQ ID NO: 719884 - DNA, 20 bp, mouse
ggacgaagagccaagagggg

SEQ ID NO: 719885 - DNA, 20 bp, mouse
gatgctgcgctcgaggccgg

SEQ ID NO: 719886 - DNA, 20 bp, mouse
gcggaggggcgaggcaccaa

SEQ ID NO: 719887 - DNA, 20 bp, mouse
ggggcccagcggctccccgg

SEQ ID NO: 719888 - DNA, 20 bp, mouse
gctggtgcacataacgggca

SEQ ID NO: 719889 - DNA, 20 bp, mouse
ggagccgctgggccccgccc

SEQ ID NO: 719890 - DNA, 20 bp, mouse
ggggcaattcccctaaagtc

SEQ ID NO: 719891 - DNA, 20 bp, mouse
ggccgtaggtggctgtgctg

SEQ ID NO: 719892 - DNA, 20 bp, mouse
gtcagcgggtgcacctccga

SEQ ID NO: 719893 - DNA, 20 bp, mouse
gccgggctaaccccaggagg

SEQ ID NO: 719894 - DNA, 20 bp, mouse
gaaagtctggtgcacataac

SEQ ID NO: 719895 - DNA, 20 bp, mouse
ggggacgaagcgtgggttgt

SEQ ID NO: 719896 - DNA, 20 bp, mouse
gctagtagtcagcaggggag

SEQ ID NO: 719897 - DNA, 20 bp, mouse
ggtgtcctagtagtcagcag

SEQ ID NO: 719898 - DNA, 20 bp, mouse
gtggtggcctgtgactgaaa

SEQ ID NO: 719899 - DNA, 20 bp, mouse
ggggaacccctttcagtcac

SEQ ID NO: 719900 - DNA, 20 bp, mouse
gaaaggcgatggagtagtag

SEQ ID NO: 719901 - DNA, 20 bp, mouse
ggcagggagcgcagggaagc

SEQ ID NO: 719902 - DNA, 20 bp, mouse
gtcggacccgcgcagatcaa

SEQ ID NO: 719903 - DNA, 20 bp, mouse
gctcaagaaaattaagggat

SEQ ID NO: 719904 - DNA, 20 bp, mouse
gagggcgtaccccgctgtgc

SEQ ID NO: 719905 - DNA, 20 bp, mouse
gtgcgggccccatacacttt

SEQ ID NO: 719906 - DNA, 20 bp, mouse
gcagctgtgcctgtcggggt

SEQ ID NO: 719907 - DNA, 20 bp, mouse
gaaccggcgggataggtagg

SEQ ID NO: 719908 - DNA, 20 bp, mouse
gcgctgcagacgggctgaac

SEQ ID NO: 719909 - DNA, 20 bp, mouse
gcctcagtggcactgccctt

SEQ ID NO: 719910 - DNA, 20 bp, mouse
gaagaaccggcgggataggt

SEQ ID NO: 719911 - DNA, 20 bp, mouse
ggcagcgcccccaccccgac

SEQ ID NO: 719912 - DNA, 20 bp, mouse
gtgaactggctgaggcccgg

SEQ ID NO: 719913 - DNA, 20 bp, mouse
gcccttgggcgcgtgtcccc

SEQ ID NO: 719914 - DNA, 20 bp, mouse
gcccgacaggcacagctgca

SEQ ID NO: 719915 - DNA, 20 bp, mouse
ggcccagagccaggtcctcg

SEQ ID NO: 719916 - DNA, 20 bp, mouse
gtgaactacagacaatggga

SEQ ID NO: 719917 - DNA, 20 bp, mouse
gggaaggttcctttagatga

SEQ ID NO: 719918 - DNA, 20 bp, mouse
gggcacccagagaactttga

SEQ ID NO: 719919 - DNA, 20 bp, mouse
gatgagaggcattgatggaa

SEQ ID NO: 719920 - DNA, 20 bp, mouse
gagagatgtcccagaataac

SEQ ID NO: 719921 - DNA, 20 bp, mouse
gctgattgaagacatcagca

SEQ ID NO: 719922 - DNA, 20 bp, mouse
gcactgtgaactacagacaa

SEQ ID NO: 719923 - DNA, 20 bp, mouse
gggcattgatggaaaggttt

SEQ ID NO: 719924 - DNA, 20 bp, mouse
gtccaccttcaaagttctct

SEQ ID NO: 719925 - DNA, 20 bp, mouse
gcaaatagataataaggtat

SEQ ID NO: 719926 - DNA, 20 bp, mouse
gcgcccgcggtccctgcttg

SEQ ID NO: 719927 - DNA, 20 bp, mouse
ggggagaccgagtctgagcg

SEQ ID NO: 719928 - DNA, 20 bp, mouse
gggcgggcgaacgagcgcct

SEQ ID NO: 719929 - DNA, 20 bp, mouse
ggaccgcaagcagggaccgc

SEQ ID NO: 719930 - DNA, 20 bp, mouse
gcggagaagacaagccaccc

SEQ ID NO: 719931 - DNA, 20 bp, mouse
gtcagactcggtctccccag

SEQ ID NO: 719932 - DNA, 20 bp, mouse
gtccaggcgcactcccccgg

SEQ ID NO: 719933 - DNA, 20 bp, mouse
gtgagcggggaccgcaagca

SEQ ID NO: 719934 - DNA, 20 bp, mouse
gagggcggggagcttggcgg

SEQ ID NO: 719935 - DNA, 20 bp, mouse
gggaaagccgagcaggcgtc

SEQ ID NO: 719936 - DNA, 20 bp, mouse
gcctgcctgccgactaggct

SEQ ID NO: 719937 - DNA, 20 bp, mouse
gtaggacctcatcgagttga

SEQ ID NO: 719938 - DNA, 20 bp, mouse
gtcccaggtgagtcaatgaa

SEQ ID NO: 719939 - DNA, 20 bp, mouse
gtaaaaaggacttgagtgct

SEQ ID NO: 719940 - DNA, 20 bp, mouse
gtgagacccaagaaaactct

SEQ ID NO: 719941 - DNA, 20 bp, mouse
gtctgcccagcctagtcggc

SEQ ID NO: 719942 - DNA, 20 bp, mouse
ggccctctggtgcctacagt

SEQ ID NO: 719943 - DNA, 20 bp, mouse
gtgggactctgcattatcag

SEQ ID NO: 719944 - DNA, 20 bp, mouse
gaagcttgctggaacagaga

SEQ ID NO: 719945 - DNA, 20 bp, mouse
gaagtcccctcaactcgatg

SEQ ID NO: 719946 - DNA, 20 bp, mouse
gagggcttcccacattctgg

SEQ ID NO: 719947 - DNA, 20 bp, mouse
gtgacaccgtggagctgttg

SEQ ID NO: 719948 - DNA, 20 bp, mouse
ggtgtcactgaggaagtggc

SEQ ID NO: 719949 - DNA, 20 bp, mouse
gtggccacgcccaggtcacc

SEQ ID NO: 719950 - DNA, 20 bp, mouse
gtggggcagaaacacatgtg

SEQ ID NO: 719951 - DNA, 20 bp, mouse
gcacggtgtcactgaggaag

SEQ ID NO: 719952 - DNA, 20 bp, mouse
gagtgcatgcataaagttgc

SEQ ID NO: 719953 - DNA, 20 bp, mouse
ggggtcagtcccaggtgacc

SEQ ID NO: 719954 - DNA, 20 bp, mouse
gacctagtgggggccggaga

SEQ ID NO: 719955 - DNA, 20 bp, mouse
ggtggccagggtgcttgtgg

SEQ ID NO: 719956 - DNA, 20 bp, mouse
gccggctcggggctctgcgc

SEQ ID NO: 719957 - DNA, 20 bp, mouse
ggagcgatcagcacggggaa

SEQ ID NO: 719958 - DNA, 20 bp, mouse
gcggccggcgggcaccaccg

SEQ ID NO: 719959 - DNA, 20 bp, mouse
ggcggggcgcacacgagctg

SEQ ID NO: 719960 - DNA, 20 bp, mouse
ggcgacctcccgccacgctt

SEQ ID NO: 719961 - DNA, 20 bp, mouse
gccgcagagccggaccgtcg

SEQ ID NO: 719962 - DNA, 20 bp, mouse
gctcgggagcgatcagcacg

SEQ ID NO: 719963 - DNA, 20 bp, mouse
gcagcccgtgggagtctagt

SEQ ID NO: 719964 - DNA, 20 bp, mouse
gctggggtgcgtccgctctc

SEQ ID NO: 719965 - DNA, 20 bp, mouse
gccgagccggcccgggaggt

SEQ ID NO: 719966 - DNA, 20 bp, mouse
gatgaggaaagggtggttca

SEQ ID NO: 719967 - DNA, 20 bp, mouse
gcactaacccagcataagca

SEQ ID NO: 719968 - DNA, 20 bp, mouse
gtacacacacgaaaggaaag

SEQ ID NO: 719969 - DNA, 20 bp, mouse
gttcagaagaggttgttttg

SEQ ID NO: 719970 - DNA, 20 bp, mouse
gtatgtaaacagctgagtct

SEQ ID NO: 719971 - DNA, 20 bp, mouse
ggctcactgcatgtacatgt

SEQ ID NO: 719972 - DNA, 20 bp, mouse
gggtctaaatctctcttttt

SEQ ID NO: 719973 - DNA, 20 bp, mouse
ggggtcagagggttgtgatc

SEQ ID NO: 719974 - DNA, 20 bp, mouse
gtaggaagaaatgttggcag

SEQ ID NO: 719975 - DNA, 20 bp, mouse
gactctaaaattctgacttt

SEQ ID NO: 719976 - DNA, 20 bp, mouse
gagctgtgatggggcccacg

SEQ ID NO: 719977 - DNA, 20 bp, mouse
gctccccaccccacaagatg

SEQ ID NO: 719978 - DNA, 20 bp, mouse
gcatgcctgtgggagccacg

SEQ ID NO: 719979 - DNA, 20 bp, mouse
gtcaggctccgcatcttgtg

SEQ ID NO: 719980 - DNA, 20 bp, mouse
gtcaggaagcccatgcctgt

SEQ ID NO: 719981 - DNA, 20 bp, mouse
gctccgcatcttgtggggtg

SEQ ID NO: 719982 - DNA, 20 bp, mouse
gttactcatggggcttctaa

SEQ ID NO: 719983 - DNA, 20 bp, mouse
gaggtcaatagccagcttgc

SEQ ID NO: 719984 - DNA, 20 bp, mouse
gaaggtagaacctagtgtga

SEQ ID NO: 719985 - DNA, 20 bp, mouse
gaatctgtgtgtatcaggag

SEQ ID NO: 719986 - DNA, 20 bp, mouse
ggggcaacgcgcagagacgt

SEQ ID NO: 719987 - DNA, 20 bp, mouse
gcacgcgcccaggcgaggtg

SEQ ID NO: 719988 - DNA, 20 bp, mouse
gcggtgtaaacaagtcgagg

SEQ ID NO: 719989 - DNA, 20 bp, mouse
gggagcgcctcatgcaaatg

SEQ ID NO: 719990 - DNA, 20 bp, mouse
gggcgccgtcccccccggcc

SEQ ID NO: 719991 - DNA, 20 bp, mouse
gagtcgaggcggctgtgaac

SEQ ID NO: 719992 - DNA, 20 bp, mouse
gaggcggctgtgaaccgggc

SEQ ID NO: 719993 - DNA, 20 bp, mouse
gagtggggggcgctcctgat

SEQ ID NO: 719994 - DNA, 20 bp, mouse
gggccggcctcctgtcccgg

SEQ ID NO: 719995 - DNA, 20 bp, mouse
gcggctgtgaaccgggccgg

SEQ ID NO: 719996 - DNA, 20 bp, mouse
gcagtttagttcatcctgcc

SEQ ID NO: 719997 - DNA, 20 bp, mouse
gaaggggctggtgcagatat

SEQ ID NO: 719998 - DNA, 20 bp, mouse
ggtgaggcacgtggtgaaaa

SEQ ID NO: 719999 - DNA, 20 bp, mouse
gggagtgtgaccagaggtga

SEQ ID NO: 720000 - DNA, 20 bp, mouse
gccaccgaaagagaaggggc

SEQ ID NO: 720001 - DNA, 20 bp, mouse
gtgaggcacggtttgagtga

SEQ ID NO: 720002 - DNA, 20 bp, mouse
ggtaaggtagaccacactca

SEQ ID NO: 720003 - DNA, 20 bp, mouse
gggctggtgcagatatgggc

SEQ ID NO: 720004 - DNA, 20 bp, mouse
gcagaggtgaaggcctgtct

SEQ ID NO: 720005 - DNA, 20 bp, mouse
ggtgaaaacgggttccactg

SEQ ID NO: 720006 - DNA, 20 bp, mouse
gagtatctggaaggaagcgg

SEQ ID NO: 720007 - DNA, 20 bp, mouse
ggaagcgcggcgtccgggcc

SEQ ID NO: 720008 - DNA, 20 bp, mouse
gaggtcgcccggccagtatc

SEQ ID NO: 720009 - DNA, 20 bp, mouse
gccgggccgggcctgctcgc

SEQ ID NO: 720010 - DNA, 20 bp, mouse
gcgcccggccagtatctgga

SEQ ID NO: 720011 - DNA, 20 bp, mouse
gagaatgcaagctcggaggg

SEQ ID NO: 720012 - DNA, 20 bp, mouse
ggggcctgcggaaggaagcg

SEQ ID NO: 720013 - DNA, 20 bp, mouse
ggggcccgagggcctgcgga

SEQ ID NO: 720014 - DNA, 20 bp, mouse
ggccgggcctgctcgcgggg

SEQ ID NO: 720015 - DNA, 20 bp, mouse
gacgccgcgcttccttccgc

SEQ ID NO: 720016 - DNA, 20 bp, mouse
gaaggtacaaatactgttga

SEQ ID NO: 720017 - DNA, 20 bp, mouse
gataagttttcccatttgtt

SEQ ID NO: 720018 - DNA, 20 bp, mouse
gaggtaagaattcaacttat

SEQ ID NO: 720019 - DNA, 20 bp, mouse
gtgttcacatataaatacag

SEQ ID NO: 720020 - DNA, 20 bp, mouse
ggctaggggcccacttctaa

SEQ ID NO: 720021 - DNA, 20 bp, mouse
gcccatttgttgggatacta

SEQ ID NO: 720022 - DNA, 20 bp, mouse
gtctaagggaaacataccag

SEQ ID NO: 720023 - DNA, 20 bp, mouse
gcatggaagactggtacaaa

SEQ ID NO: 720024 - DNA, 20 bp, mouse
gagtgggcccctagcttttc

SEQ ID NO: 720025 - DNA, 20 bp, mouse
ggtatgtttcccttagaagt

SEQ ID NO: 720026 - DNA, 20 bp, mouse
gactggcgtctcaacaacag

SEQ ID NO: 720027 - DNA, 20 bp, mouse
ggtggggagggctcacttgc

SEQ ID NO: 720028 - DNA, 20 bp, mouse
ggtgtgaggcactgcagtac

SEQ ID NO: 720029 - DNA, 20 bp, mouse
gggctggagagctgcaggtc

SEQ ID NO: 720030 - DNA, 20 bp, mouse
gagtgactgctcgctgaacg

SEQ ID NO: 720031 - DNA, 20 bp, mouse
gcaaaacagtagaccgaaac

SEQ ID NO: 720032 - DNA, 20 bp, mouse
gaggtctctgtagggattaa

SEQ ID NO: 720033 - DNA, 20 bp, mouse
gaactcagggattcaagttt

SEQ ID NO: 720034 - DNA, 20 bp, mouse
gtgaatccctgagttatgtg

SEQ ID NO: 720035 - DNA, 20 bp, mouse
gattgactgagcacctgttt

SEQ ID NO: 720036 - DNA, 20 bp, mouse
gaaaaaaagtacacggggag

SEQ ID NO: 720037 - DNA, 20 bp, mouse
gagacagaggctatgggcag

SEQ ID NO: 720038 - DNA, 20 bp, mouse
gcgtgacgggccctacgtct

SEQ ID NO: 720039 - DNA, 20 bp, mouse
gggcagagggtgctagctca

SEQ ID NO: 720040 - DNA, 20 bp, mouse
gtgggtaagtcctttatcgg

SEQ ID NO: 720041 - DNA, 20 bp, mouse
gcgcgccttcgggcaacgga

SEQ ID NO: 720042 - DNA, 20 bp, mouse
gcggggagggggggcgtgac

SEQ ID NO: 720043 - DNA, 20 bp, mouse
ggtaatcagctcccagacgt

SEQ ID NO: 720044 - DNA, 20 bp, mouse
gttcgggcaacggatggctg

SEQ ID NO: 720045 - DNA, 20 bp, mouse
gaaaggacttacccaccgtg

SEQ ID NO: 720046 - DNA, 20 bp, mouse
ggggggaaatatgtgggtta

SEQ ID NO: 720047 - DNA, 20 bp, mouse
gaggactgagtaggaggtgc

SEQ ID NO: 720048 - DNA, 20 bp, mouse
gtgctggcaaggtgccaaga

SEQ ID NO: 720049 - DNA, 20 bp, mouse
gtggtctagtaataggtcta

SEQ ID NO: 720050 - DNA, 20 bp, mouse
gggaaatatgtgggttaggg

SEQ ID NO: 720051 - DNA, 20 bp, mouse
gaatgggatttggtgtgaga

SEQ ID NO: 720052 - DNA, 20 bp, mouse
gagttgctggcaatgggatt

SEQ ID NO: 720053 - DNA, 20 bp, mouse
gatttctggccattaacttt

SEQ ID NO: 720054 - DNA, 20 bp, mouse
gggggaaatgacttagttgc

SEQ ID NO: 720055 - DNA, 20 bp, mouse
ggagttccaggacagttatg

SEQ ID NO: 720056 - DNA, 20 bp, mouse
gcctccgtgccctgttcccg

SEQ ID NO: 720057 - DNA, 20 bp, mouse
ggtgaagcgtgtaattctga

SEQ ID NO: 720058 - DNA, 20 bp, mouse
gaaccggcaacctcgggaac

SEQ ID NO: 720059 - DNA, 20 bp, mouse
gtctttctcggagacaatga

SEQ ID NO: 720060 - DNA, 20 bp, mouse
gcaacctcgggaacagggca

SEQ ID NO: 720061 - DNA, 20 bp, mouse
ggagaaagaaccggcaacct

SEQ ID NO: 720062 - DNA, 20 bp, mouse
gataaaaatgagaaatgtcg

SEQ ID NO: 720063 - DNA, 20 bp, mouse
gtatgttatataacaaggtg

SEQ ID NO: 720064 - DNA, 20 bp, mouse
gctgaaggaattgaggtcca

SEQ ID NO: 720065 - DNA, 20 bp, mouse
gacacaattgatgtctttga

SEQ ID NO: 720066 - DNA, 20 bp, mouse
gcaggacctagcagctaatc

SEQ ID NO: 720067 - DNA, 20 bp, mouse
gtatggaaactctatagtga

SEQ ID NO: 720068 - DNA, 20 bp, mouse
gaggtcctgctgacagcctc

SEQ ID NO: 720069 - DNA, 20 bp, mouse
gtgtgtacctggactttctg

SEQ ID NO: 720070 - DNA, 20 bp, mouse
gcgggcctgaggctgtcagc

SEQ ID NO: 720071 - DNA, 20 bp, mouse
gaaaactgctacaacaacca

SEQ ID NO: 720072 - DNA, 20 bp, mouse
ggcatagaaccttctttcaa

SEQ ID NO: 720073 - DNA, 20 bp, mouse
ggaaggttctatgcacaatt

SEQ ID NO: 720074 - DNA, 20 bp, mouse
gccctagcaagtctttcata

SEQ ID NO: 720075 - DNA, 20 bp, mouse
gagaccttgctgatgctgcc

SEQ ID NO: 720076 - DNA, 20 bp, mouse
gttgtgaggtagagagagta

SEQ ID NO: 720077 - DNA, 20 bp, mouse
gagatggccaggaaaccctt

SEQ ID NO: 720078 - DNA, 20 bp, mouse
gaaggagagaagagatcagg

SEQ ID NO: 720079 - DNA, 20 bp, mouse
gggcttaagactgagcccaa

SEQ ID NO: 720080 - DNA, 20 bp, mouse
gacaaagccaccaagggcac

SEQ ID NO: 720081 - DNA, 20 bp, mouse
gtcgtcagcaaccaacaaca

SEQ ID NO: 720082 - DNA, 20 bp, mouse
gaccaagcagagaagctcgt

SEQ ID NO: 720083 - DNA, 20 bp, mouse
gactgagcccaagggtttcc

SEQ ID NO: 720084 - DNA, 20 bp, mouse
ggagcttctctgcttggtgg

SEQ ID NO: 720085 - DNA, 20 bp, mouse
ggagagaagagatcaggagg

SEQ ID NO: 720086 - DNA, 20 bp, mouse
gcggcccacccagcagaaaa

SEQ ID NO: 720087 - DNA, 20 bp, mouse
gcccagcagaaaaaggaaaa

SEQ ID NO: 720088 - DNA, 20 bp, mouse
ggtctcggccatctcagcct

SEQ ID NO: 720089 - DNA, 20 bp, mouse
gaaaagggattccaagcccc

SEQ ID NO: 720090 - DNA, 20 bp, mouse
gtacaatctgctgtgtggct

SEQ ID NO: 720091 - DNA, 20 bp, mouse
gtggacactgaactcagctg

SEQ ID NO: 720092 - DNA, 20 bp, mouse
gcactgcaggggctgtggga

SEQ ID NO: 720093 - DNA, 20 bp, mouse
gagctctgctctcactgcag

SEQ ID NO: 720094 - DNA, 20 bp, mouse
gcaggggctgtgggagggac

SEQ ID NO: 720095 - DNA, 20 bp, mouse
gtgaggaagaagtcaggctg

SEQ ID NO: 720096 - DNA, 20 bp, mouse
gtagatgtgtaactaaatgt

SEQ ID NO: 720097 - DNA, 20 bp, mouse
gtttaatctgaatactctgg

SEQ ID NO: 720098 - DNA, 20 bp, mouse
gtaccagacagggtatgcct

SEQ ID NO: 720099 - DNA, 20 bp, mouse
gggccaaggcataccctgtc

SEQ ID NO: 720100 - DNA, 20 bp, mouse
ggcttttaatctgaatactc

SEQ ID NO: 720101 - DNA, 20 bp, mouse
gagggctaacatggatggtg

SEQ ID NO: 720102 - DNA, 20 bp, mouse
gcaccaggcgggcggagccc

SEQ ID NO: 720103 - DNA, 20 bp, mouse
gtccgcccgcctggtgatac

SEQ ID NO: 720104 - DNA, 20 bp, mouse
gccttcctgtatcaccaggc

SEQ ID NO: 720105 - DNA, 20 bp, mouse
gtcctgtatcaccaggcggg

SEQ ID NO: 720106 - DNA, 20 bp, mouse
gaataccgctgcacttcctg

SEQ ID NO: 720107 - DNA, 20 bp, mouse
gctagccggcggtgcttggc

SEQ ID NO: 720108 - DNA, 20 bp, mouse
gttgttcggagaaacagagt

SEQ ID NO: 720109 - DNA, 20 bp, mouse
ggaaagagggcgggattgaa

SEQ ID NO: 720110 - DNA, 20 bp, mouse
gacacgaagagaaacggggt

SEQ ID NO: 720111 - DNA, 20 bp, mouse
gaatgcagcaggcaataccc

SEQ ID NO: 720112 - DNA, 20 bp, mouse
gccggactgggctggaaaga

SEQ ID NO: 720113 - DNA, 20 bp, mouse
gactcctagccggcggtgct

SEQ ID NO: 720114 - DNA, 20 bp, mouse
gggtgggtcctgggacagat

SEQ ID NO: 720115 - DNA, 20 bp, mouse
gcatccaagcaatgatagta

SEQ ID NO: 720116 - DNA, 20 bp, mouse
gcaaggctggccaggatgtt

SEQ ID NO: 720117 - DNA, 20 bp, mouse
ggcccccagatcaacccagg

SEQ ID NO: 720118 - DNA, 20 bp, mouse
gtaaggttctaaacaggagt

SEQ ID NO: 720119 - DNA, 20 bp, mouse
gtcaagggttagagcggcca

SEQ ID NO: 720120 - DNA, 20 bp, mouse
ggggggctcaagggttagag

SEQ ID NO: 720121 - DNA, 20 bp, mouse
gatggcccccagatcaaccc

SEQ ID NO: 720122 - DNA, 20 bp, mouse
ggggttagagcggccaaggc

SEQ ID NO: 720123 - DNA, 20 bp, mouse
gtgctgctggggctctttca

SEQ ID NO: 720124 - DNA, 20 bp, mouse
ggatgaaagaaagttggaaa

SEQ ID NO: 720125 - DNA, 20 bp, mouse
gagaaccacctgggttgatc

SEQ ID NO: 720126 - DNA, 20 bp, mouse
gcatgcgcaacctgcagcgc

SEQ ID NO: 720127 - DNA, 20 bp, mouse
gcaggcgcaaggcgagcctc

SEQ ID NO: 720128 - DNA, 20 bp, mouse
gcctccggaaaaggcggggc

SEQ ID NO: 720129 - DNA, 20 bp, mouse
gggctgctggcccgtccctg

SEQ ID NO: 720130 - DNA, 20 bp, mouse
gggaagtcagacacgcaccg

SEQ ID NO: 720131 - DNA, 20 bp, mouse
gcaaggcgagcctccggaaa

SEQ ID NO: 720132 - DNA, 20 bp, mouse
gggcttcaacggaggggcgt

SEQ ID NO: 720133 - DNA, 20 bp, mouse
gcgagcctccggaaaaggcg

SEQ ID NO: 720134 - DNA, 20 bp, mouse
gacagggctggatgagaccc

SEQ ID NO: 720135 - DNA, 20 bp, mouse
gcccgcccgtagcgcctcag

SEQ ID NO: 720136 - DNA, 20 bp, mouse
ggcaggggcggagctgtcgg

SEQ ID NO: 720137 - DNA, 20 bp, mouse
gcggccgccacggtctgaca

SEQ ID NO: 720138 - DNA, 20 bp, mouse
ggaggccgggcgtggagcga

SEQ ID NO: 720139 - DNA, 20 bp, mouse
gaggggcgggccagcttagt

SEQ ID NO: 720140 - DNA, 20 bp, mouse
ggcgccctgtcagaccgtgg

SEQ ID NO: 720141 - DNA, 20 bp, mouse
gcgcgagccgggctgaggcc

SEQ ID NO: 720142 - DNA, 20 bp, mouse
gtgctgacgcgtcgctgctt

SEQ ID NO: 720143 - DNA, 20 bp, mouse
ggacagctccgcccctgccg

SEQ ID NO: 720144 - DNA, 20 bp, mouse
gcgggccagcttagtcgggg

SEQ ID NO: 720145 - DNA, 20 bp, mouse
ggggcggggcctgagggcgc

SEQ ID NO: 720146 - DNA, 20 bp, mouse
gggccccaggggactgaata

SEQ ID NO: 720147 - DNA, 20 bp, mouse
gaagtcgcgggaggccccag

SEQ ID NO: 720148 - DNA, 20 bp, mouse
gaccgaaggcctaagctctc

SEQ ID NO: 720149 - DNA, 20 bp, mouse
gtaggccttcggtcctagaa

SEQ ID NO: 720150 - DNA, 20 bp, mouse
gccctgcgcggcccgcaata

SEQ ID NO: 720151 - DNA, 20 bp, mouse
gcaggctcccctaaatcgct

SEQ ID NO: 720152 - DNA, 20 bp, mouse
ggcagtgttggagaagtcgc

SEQ ID NO: 720153 - DNA, 20 bp, mouse
gcccctcagcctagcgattt

SEQ ID NO: 720154 - DNA, 20 bp, mouse
ggggaggtgtatcccctgcg

SEQ ID NO: 720155 - DNA, 20 bp, mouse
gggcgagccggcgccttaaa

SEQ ID NO: 720156 - DNA, 20 bp, mouse
gtgcccaattaggtgttctg

SEQ ID NO: 720157 - DNA, 20 bp, mouse
gcaggcgcacaagagtccta

SEQ ID NO: 720158 - DNA, 20 bp, mouse
ggcgcacaagagtcctacgg

SEQ ID NO: 720159 - DNA, 20 bp, mouse
ggcacgcagaccacacgcgc

SEQ ID NO: 720160 - DNA, 20 bp, mouse
gtggcgtttgggctccacta

SEQ ID NO: 720161 - DNA, 20 bp, mouse
ggggatactcggttccctag

SEQ ID NO: 720162 - DNA, 20 bp, mouse
gtgttctgtggttcaggccg

SEQ ID NO: 720163 - DNA, 20 bp, mouse
gtctgcgtgcctgcccaatt

SEQ ID NO: 720164 - DNA, 20 bp, mouse
gtcttgtgcgcctgcgcgtg

SEQ ID NO: 720165 - DNA, 20 bp, mouse
gggtgagatactgcccccgt

SEQ ID NO: 720166 - DNA, 20 bp, mouse
gaatctgcgcaccgcttggc

SEQ ID NO: 720167 - DNA, 20 bp, mouse
ggcggccgcgtccttaggtg

SEQ ID NO: 720168 - DNA, 20 bp, mouse
gctctggtgcctgttaagta

SEQ ID NO: 720169 - DNA, 20 bp, mouse
gccacggcggccgcgtcctt

SEQ ID NO: 720170 - DNA, 20 bp, mouse
gcaagcggtgcgcagattct

SEQ ID NO: 720171 - DNA, 20 bp, mouse
gcgcacgtgacagcggacgg

SEQ ID NO: 720172 - DNA, 20 bp, mouse
ggcgccagccgaaacaggaa

SEQ ID NO: 720173 - DNA, 20 bp, mouse
ggcttggctggctcattcct

SEQ ID NO: 720174 - DNA, 20 bp, mouse
gcgtgacagcggacggcggg

SEQ ID NO: 720175 - DNA, 20 bp, mouse
gcgtggcccgcacgtgacag

SEQ ID NO: 720176 - DNA, 20 bp, mouse
gaccccaggctgagagggat

SEQ ID NO: 720177 - DNA, 20 bp, mouse
ggttctgacagatgcaggga

SEQ ID NO: 720178 - DNA, 20 bp, mouse
gagggatgggctatgaaagg

SEQ ID NO: 720179 - DNA, 20 bp, mouse
ggctaggcataaacaggatg

SEQ ID NO: 720180 - DNA, 20 bp, mouse
gggaaataagtctggtactg

SEQ ID NO: 720181 - DNA, 20 bp, mouse
gcacaggttctgacagatgc

SEQ ID NO: 720182 - DNA, 20 bp, mouse
gcctaggacaactgtcacaa

SEQ ID NO: 720183 - DNA, 20 bp, mouse
gctactaactccattctccc

SEQ ID NO: 720184 - DNA, 20 bp, mouse
gcttttcagtcactaagatg

SEQ ID NO: 720185 - DNA, 20 bp, mouse
gtagcctgtcactgctctag

SEQ ID NO: 720186 - DNA, 20 bp, mouse
gcgctggggctcctctactg

SEQ ID NO: 720187 - DNA, 20 bp, mouse
ggctacagaaatctacagaa

SEQ ID NO: 720188 - DNA, 20 bp, mouse
gttgctggaagagtgctaca

SEQ ID NO: 720189 - DNA, 20 bp, mouse
gagggacccctggctcgctg

SEQ ID NO: 720190 - DNA, 20 bp, mouse
gcggggcgacaccactgggt

SEQ ID NO: 720191 - DNA, 20 bp, mouse
gggaagctagtcaaatgcga

SEQ ID NO: 720192 - DNA, 20 bp, mouse
ggggagttaaatctagtcgc

SEQ ID NO: 720193 - DNA, 20 bp, mouse
gaagagtgctacagggactt

SEQ ID NO: 720194 - DNA, 20 bp, mouse
gagaggagccccagcgagcc

SEQ ID NO: 720195 - DNA, 20 bp, mouse
ggcgatggcgacttccggga

SEQ ID NO: 720196 - DNA, 20 bp, mouse
gagaggttgggaaaccttga

SEQ ID NO: 720197 - DNA, 20 bp, mouse
gaggccggaacactgatgaa

SEQ ID NO: 720198 - DNA, 20 bp, mouse
gaaaggttgggaatacttga

SEQ ID NO: 720199 - DNA, 20 bp, mouse
ggggttccgggccctttctt

SEQ ID NO: 720200 - DNA, 20 bp, mouse
ggagggaagaagaaacggcc

SEQ ID NO: 720201 - DNA, 20 bp, mouse
gataccgagagatgtcttaa

SEQ ID NO: 720202 - DNA, 20 bp, mouse
gtcaaaggtttcccaagaaa

SEQ ID NO: 720203 - DNA, 20 bp, mouse
gtttcccttaagacatctct

SEQ ID NO: 720204 - DNA, 20 bp, mouse
gaggccggaacactgaagag

SEQ ID NO: 720205 - DNA, 20 bp, mouse
gggaacactgaagagaggtt

SEQ ID NO: 720206 - DNA, 20 bp, mouse
gaggaggtgcagattagaca

SEQ ID NO: 720207 - DNA, 20 bp, mouse
gtataaccaggaacataagg

SEQ ID NO: 720208 - DNA, 20 bp, mouse
gtttgcgaggtcatagtggg

SEQ ID NO: 720209 - DNA, 20 bp, mouse
gtaccccctgtggggcaaac

SEQ ID NO: 720210 - DNA, 20 bp, mouse
gttatttgcgaggtcatagt

SEQ ID NO: 720211 - DNA, 20 bp, mouse
gaaattacattgattagaca

SEQ ID NO: 720212 - DNA, 20 bp, mouse
gcacacccaaataagaatgt

SEQ ID NO: 720213 - DNA, 20 bp, mouse
gaaccagtttgccccacagg

SEQ ID NO: 720214 - DNA, 20 bp, mouse
gaaaagtgactcgctgaaga

SEQ ID NO: 720215 - DNA, 20 bp, mouse
gtattgtgaatattataacc

SEQ ID NO: 720216 - DNA, 20 bp, mouse
gtccggctccaagtgtctgc

SEQ ID NO: 720217 - DNA, 20 bp, mouse
ggtcagacggcaaggtcaga

SEQ ID NO: 720218 - DNA, 20 bp, mouse
gtctctggaagaggtcaccg

SEQ ID NO: 720219 - DNA, 20 bp, mouse
gcctaaggcaagaggaacct

SEQ ID NO: 720220 - DNA, 20 bp, mouse
gacttggagccggaagcgga

SEQ ID NO: 720221 - DNA, 20 bp, mouse
gcaaaagagactctcactag

SEQ ID NO: 720222 - DNA, 20 bp, mouse
gccagagactgcacgcacct

SEQ ID NO: 720223 - DNA, 20 bp, mouse
gggcggcggcgagaggcgat

SEQ ID NO: 720224 - DNA, 20 bp, mouse
gagacacttggagccggaag

SEQ ID NO: 720225 - DNA, 20 bp, mouse
gccgtctgaccctccgcttc

SEQ ID NO: 720226 - DNA, 20 bp, mouse
gttgtcctacggtgacttga

SEQ ID NO: 720227 - DNA, 20 bp, mouse
gcagcggagcactaagtcac

SEQ ID NO: 720228 - DNA, 20 bp, mouse
ggtaggacaaggcttaactg

SEQ ID NO: 720229 - DNA, 20 bp, mouse
gcccgcgaaagagctctcgc

SEQ ID NO: 720230 - DNA, 20 bp, mouse
gtgacttgacggaacgcacc

SEQ ID NO: 720231 - DNA, 20 bp, mouse
gcgttccgtcaagtcaccgt

SEQ ID NO: 720232 - DNA, 20 bp, mouse
gcaactccaataagacactt

SEQ ID NO: 720233 - DNA, 20 bp, mouse
gagtcacaggacaatcccct

SEQ ID NO: 720234 - DNA, 20 bp, mouse
gggatgggggctaagaagtt

SEQ ID NO: 720235 - DNA, 20 bp, mouse
gagtatgggctcaggggcag

SEQ ID NO: 720236 - DNA, 20 bp, mouse
gtggcggactgggttccgat

SEQ ID NO: 720237 - DNA, 20 bp, mouse
ggcgcagccagtgacgtaac

SEQ ID NO: 720238 - DNA, 20 bp, mouse
gtcgcgagtcagatgcccat

SEQ ID NO: 720239 - DNA, 20 bp, mouse
gagggcgttggaaatctaat

SEQ ID NO: 720240 - DNA, 20 bp, mouse
gcgaggaactggttggagac

SEQ ID NO: 720241 - DNA, 20 bp, mouse
gtgcgcggcaggggtcggtc

SEQ ID NO: 720242 - DNA, 20 bp, mouse
gctaaaggcggaaccgaaag

SEQ ID NO: 720243 - DNA, 20 bp, mouse
gagcgtcagactttacgctg

SEQ ID NO: 720244 - DNA, 20 bp, mouse
gccgcctccggccggaactc

SEQ ID NO: 720245 - DNA, 20 bp, mouse
gacgggaggggttggatata

SEQ ID NO: 720246 - DNA, 20 bp, mouse
ggtgctgcatggcagaatcc

SEQ ID NO: 720247 - DNA, 20 bp, mouse
gcccaggtcagagctctcta

SEQ ID NO: 720248 - DNA, 20 bp, mouse
ggcagaaggagggggcgctt

SEQ ID NO: 720249 - DNA, 20 bp, mouse
ggcagagagaactgggcccg

SEQ ID NO: 720250 - DNA, 20 bp, mouse
ggagagaactgggcccgggg

SEQ ID NO: 720251 - DNA, 20 bp, mouse
gccaacgccaggcgccccaa

SEQ ID NO: 720252 - DNA, 20 bp, mouse
gagggtataccccggggaat

SEQ ID NO: 720253 - DNA, 20 bp, mouse
gtaggggtgaccaaaggaga

SEQ ID NO: 720254 - DNA, 20 bp, mouse
ggcgcttaggcagagagaac

SEQ ID NO: 720255 - DNA, 20 bp, mouse
gtactcataggggtgaccaa

SEQ ID NO: 720256 - DNA, 20 bp, mouse
gctcgccgctaacaccagtt

SEQ ID NO: 720257 - DNA, 20 bp, mouse
gtggccacgcgcggggtctc

SEQ ID NO: 720258 - DNA, 20 bp, mouse
gtgtaaagagaaaggcaagt

SEQ ID NO: 720259 - DNA, 20 bp, mouse
ggagctgcctccaggcatga

SEQ ID NO: 720260 - DNA, 20 bp, mouse
gtcggctaggaacagccaga

SEQ ID NO: 720261 - DNA, 20 bp, mouse
ggccgctaacaccagttcgg

SEQ ID NO: 720262 - DNA, 20 bp, mouse
gtgttagcggcgagctggaa

SEQ ID NO: 720263 - DNA, 20 bp, mouse
ggccgcttcccagcactcca

SEQ ID NO: 720264 - DNA, 20 bp, mouse
gccactgacacagaacacga

SEQ ID NO: 720265 - DNA, 20 bp, mouse
gcagttcggtggccacgcgc

SEQ ID NO: 720266 - DNA, 20 bp, mouse
gccgccctcgtcgtcacccc

SEQ ID NO: 720267 - DNA, 20 bp, mouse
gcttcccggggtgacgacga

SEQ ID NO: 720268 - DNA, 20 bp, mouse
gccagtctgggcaatagaac

SEQ ID NO: 720269 - DNA, 20 bp, mouse
gaggcggggccggttagagg

SEQ ID NO: 720270 - DNA, 20 bp, mouse
gaaccggccccgcctcttag

SEQ ID NO: 720271 - DNA, 20 bp, mouse
ggggccggttagaggaggtc

SEQ ID NO: 720272 - DNA, 20 bp, mouse
gaagaggcggggccggttag

SEQ ID NO: 720273 - DNA, 20 bp, mouse
gggccccgcctcttagaggc

SEQ ID NO: 720274 - DNA, 20 bp, mouse
gtgatgctttcctttctggt

SEQ ID NO: 720275 - DNA, 20 bp, mouse
ggacgagggcggggcttgca

SEQ ID NO: 720276 - DNA, 20 bp, mouse
ggggttgcgtcgacgtggga

SEQ ID NO: 720277 - DNA, 20 bp, mouse
gcgcggacgccgaggattgt

SEQ ID NO: 720278 - DNA, 20 bp, mouse
gcgtggggttgcgtcgacgt

SEQ ID NO: 720279 - DNA, 20 bp, mouse
ggcggggcctcgccgctcgg

SEQ ID NO: 720280 - DNA, 20 bp, mouse
ggggcctcgccgctcggggg

SEQ ID NO: 720281 - DNA, 20 bp, mouse
gacgccgaggattgtgggaa

SEQ ID NO: 720282 - DNA, 20 bp, mouse
gcctcgcttcgcctcccgaa

SEQ ID NO: 720283 - DNA, 20 bp, mouse
ggcgcagcgcaagcgcgcgt

SEQ ID NO: 720284 - DNA, 20 bp, mouse
gcccgagctcggttcctttc

SEQ ID NO: 720285 - DNA, 20 bp, mouse
gggcgcctgcccgagccgag

SEQ ID NO: 720286 - DNA, 20 bp, mouse
ggacaagcgtgccttggagg

SEQ ID NO: 720287 - DNA, 20 bp, mouse
ggagccggtgccgaaaaagg

SEQ ID NO: 720288 - DNA, 20 bp, mouse
ggggcagcgcgcttttttac

SEQ ID NO: 720289 - DNA, 20 bp, mouse
gcgccgggccggctgagggg

SEQ ID NO: 720290 - DNA, 20 bp, mouse
gatcccgcctttttcggcac

SEQ ID NO: 720291 - DNA, 20 bp, mouse
gcagccggcccggcgagtga

SEQ ID NO: 720292 - DNA, 20 bp, mouse
ggcggaggggaaggcgcgga

SEQ ID NO: 720293 - DNA, 20 bp, mouse
ggaggaggcgggcactcctg

SEQ ID NO: 720294 - DNA, 20 bp, mouse
ggcggagccggtgccgaaaa

SEQ ID NO: 720295 - DNA, 20 bp, mouse
gcggacgcagcctgagggag

SEQ ID NO: 720296 - DNA, 20 bp, mouse
gcgcacgcaggcacgccgag

SEQ ID NO: 720297 - DNA, 20 bp, mouse
gagcgcgctcccggctgcac

SEQ ID NO: 720298 - DNA, 20 bp, mouse
ggggaagcggtggcactaaa

SEQ ID NO: 720299 - DNA, 20 bp, mouse
gacgcaggcacgccgagcgg

SEQ ID NO: 720300 - DNA, 20 bp, mouse
ggggcacgcgcacgcccaga

SEQ ID NO: 720301 - DNA, 20 bp, mouse
gcgcgtgcccgctgcctttc

SEQ ID NO: 720302 - DNA, 20 bp, mouse
gaggcacgccgagcggagga

SEQ ID NO: 720303 - DNA, 20 bp, mouse
gggaggggcggcggccctct

SEQ ID NO: 720304 - DNA, 20 bp, mouse
ggcccgagcgcgcccgggga

SEQ ID NO: 720305 - DNA, 20 bp, mouse
gggcggagcccgggtcacgt

SEQ ID NO: 720306 - DNA, 20 bp, mouse
gctggcatgcggtgtgtgaa

SEQ ID NO: 720307 - DNA, 20 bp, mouse
ggcctccacccctggcactg

SEQ ID NO: 720308 - DNA, 20 bp, mouse
gactcccagcctcagtgcca

SEQ ID NO: 720309 - DNA, 20 bp, mouse
gcggaacccggatctggcag

SEQ ID NO: 720310 - DNA, 20 bp, mouse
ggccagatccgggttccgac

SEQ ID NO: 720311 - DNA, 20 bp, mouse
gacctgtcggaacccggatc

SEQ ID NO: 720312 - DNA, 20 bp, mouse
gtagaaaccccaagtgtgag

SEQ ID NO: 720313 - DNA, 20 bp, mouse
gtggcgccctagtgcaggca

SEQ ID NO: 720314 - DNA, 20 bp, mouse
gtgaacgggctgcagacgtt

SEQ ID NO: 720315 - DNA, 20 bp, mouse
gtccgggttccgacaggtga

SEQ ID NO: 720316 - DNA, 20 bp, mouse
gtgggcacagctattgctca

SEQ ID NO: 720317 - DNA, 20 bp, mouse
gctccagcagatgaggaggg

SEQ ID NO: 720318 - DNA, 20 bp, mouse
gcagaactgctgaggcggga

SEQ ID NO: 720319 - DNA, 20 bp, mouse
gggggtgaggccactctctt

SEQ ID NO: 720320 - DNA, 20 bp, mouse
ggaagctccagcagatgagg

SEQ ID NO: 720321 - DNA, 20 bp, mouse
gtgcccgccagacaggtcgg

SEQ ID NO: 720322 - DNA, 20 bp, mouse
gccgccagacaggtcggtgg

SEQ ID NO: 720323 - DNA, 20 bp, mouse
gaggtctgggcaagttggag

SEQ ID NO: 720324 - DNA, 20 bp, mouse
gtctgggagcacagtcctcg

SEQ ID NO: 720325 - DNA, 20 bp, mouse
gagactaaggcatggagtaa

SEQ ID NO: 720326 - DNA, 20 bp, mouse
ggccgcacggggcacctcgt

SEQ ID NO: 720327 - DNA, 20 bp, mouse
gggcgcgcggcggtcggagg

SEQ ID NO: 720328 - DNA, 20 bp, mouse
gccgcccgcgcacgtgccgt

SEQ ID NO: 720329 - DNA, 20 bp, mouse
ggcacggggcacctcgtggg

SEQ ID NO: 720330 - DNA, 20 bp, mouse
gctgtccgacggcacgtgcg

SEQ ID NO: 720331 - DNA, 20 bp, mouse
gctgggctcggcgatcacgc

SEQ ID NO: 720332 - DNA, 20 bp, mouse
ggagaagtcagcggccgcac

SEQ ID NO: 720333 - DNA, 20 bp, mouse
gcggagggggcgctgtccga

SEQ ID NO: 720334 - DNA, 20 bp, mouse
ggacttctccagctccgcct

SEQ ID NO: 720335 - DNA, 20 bp, mouse
gggagcctgcagccacccaa

SEQ ID NO: 720336 - DNA, 20 bp, mouse
ggagagcggggccgcaacga

SEQ ID NO: 720337 - DNA, 20 bp, mouse
gcggagccaagggagaagtt

SEQ ID NO: 720338 - DNA, 20 bp, mouse
gcccgccccggcccagtcgc

SEQ ID NO: 720339 - DNA, 20 bp, mouse
gccggggcgggtctggagga

SEQ ID NO: 720340 - DNA, 20 bp, mouse
gaggggccgaaggaaattta

SEQ ID NO: 720341 - DNA, 20 bp, mouse
gttaggcgcaagctgagagc

SEQ ID NO: 720342 - DNA, 20 bp, mouse
gcaagcccgcgactgggccg

SEQ ID NO: 720343 - DNA, 20 bp, mouse
ggtagagctaacacaggctt

SEQ ID NO: 720344 - DNA, 20 bp, mouse
ggactgggccggggcgggtc

SEQ ID NO: 720345 - DNA, 20 bp, mouse
ggcaggtagtcctgaccctt

SEQ ID NO: 720346 - DNA, 20 bp, mouse
gaaggctcgccatcactcca

SEQ ID NO: 720347 - DNA, 20 bp, mouse
gcggggacagtcaggtacca

SEQ ID NO: 720348 - DNA, 20 bp, mouse
gacggagagcggaagttccc

SEQ ID NO: 720349 - DNA, 20 bp, mouse
ggctgggaggtgcggagcga

SEQ ID NO: 720350 - DNA, 20 bp, mouse
ggactgtccccgtggagtga

SEQ ID NO: 720351 - DNA, 20 bp, mouse
ggcggaggtggtacggagag

SEQ ID NO: 720352 - DNA, 20 bp, mouse
ggagaagtaaaagggtatta

SEQ ID NO: 720353 - DNA, 20 bp, mouse
gaggagccggagaagtaaaa

SEQ ID NO: 720354 - DNA, 20 bp, mouse
ggtattaaggctgggaggtg

SEQ ID NO: 720355 - DNA, 20 bp, mouse
gctgtgccagtgggaggcgg

SEQ ID NO: 720356 - DNA, 20 bp, mouse
ggccccacggagatgctgag

SEQ ID NO: 720357 - DNA, 20 bp, mouse
gtctccgtggggcggtgctg

SEQ ID NO: 720358 - DNA, 20 bp, mouse
gaccccctcagcatctccgt

SEQ ID NO: 720359 - DNA, 20 bp, mouse
gcgattgtggccatcagcta

SEQ ID NO: 720360 - DNA, 20 bp, mouse
gcgtaccaaagggtcctcac

SEQ ID NO: 720361 - DNA, 20 bp, mouse
gggccagagctcgtaccaaa

SEQ ID NO: 720362 - DNA, 20 bp, mouse
gcggggatctgcgatcgcac

SEQ ID NO: 720363 - DNA, 20 bp, mouse
gcgctcccggctaacggcgc

SEQ ID NO: 720364 - DNA, 20 bp, mouse
gagagcggagacgccgtcgc

SEQ ID NO: 720365 - DNA, 20 bp, mouse
gtctgctggagacagccggg

SEQ ID NO: 720366 - DNA, 20 bp, mouse
gcggccctgctgacgtcagc

SEQ ID NO: 720367 - DNA, 20 bp, mouse
ggggctctgggtcgtgtctc

SEQ ID NO: 720368 - DNA, 20 bp, mouse
ggggcggcgcgcatgcccgc

SEQ ID NO: 720369 - DNA, 20 bp, mouse
gccgcccgctgacgtcagca

SEQ ID NO: 720370 - DNA, 20 bp, mouse
gcgcggcgccgcccactctc

SEQ ID NO: 720371 - DNA, 20 bp, mouse
ggggagggggacccgagagt

SEQ ID NO: 720372 - DNA, 20 bp, mouse
gagacccgccggggtggggc

SEQ ID NO: 720373 - DNA, 20 bp, mouse
gagggggacccgagagtggg

SEQ ID NO: 720374 - DNA, 20 bp, mouse
gcgcgcgagacccgccgggg

SEQ ID NO: 720375 - DNA, 20 bp, mouse
ggggcgcgcgagacccgccg

SEQ ID NO: 720376 - DNA, 20 bp, mouse
ggagcggggcgggcagtcgg

SEQ ID NO: 720377 - DNA, 20 bp, mouse
gccggagctcgcacagaggg

SEQ ID NO: 720378 - DNA, 20 bp, mouse
ggcgccggagctcgcacaga

SEQ ID NO: 720379 - DNA, 20 bp, mouse
gcctgccggacccgctccaa

SEQ ID NO: 720380 - DNA, 20 bp, mouse
gggcgagcggggcgggcagt

SEQ ID NO: 720381 - DNA, 20 bp, mouse
gcccagcggcagccgaaggt

SEQ ID NO: 720382 - DNA, 20 bp, mouse
gagagcgcgagctgtccagg

SEQ ID NO: 720383 - DNA, 20 bp, mouse
gagctccggcgcggcggtca

SEQ ID NO: 720384 - DNA, 20 bp, mouse
gggggcgggcacagcgcaag

SEQ ID NO: 720385 - DNA, 20 bp, mouse
gggcgtggtcggcgagaata

SEQ ID NO: 720386 - DNA, 20 bp, mouse
gaggccccggccccgaactg

SEQ ID NO: 720387 - DNA, 20 bp, mouse
gaggagggccgcggctggga

SEQ ID NO: 720388 - DNA, 20 bp, mouse
gcgacggcggcgaggggggt

SEQ ID NO: 720389 - DNA, 20 bp, mouse
gcgagccggacgtgggtgct

SEQ ID NO: 720390 - DNA, 20 bp, mouse
gcccacccgcagttcggggc

SEQ ID NO: 720391 - DNA, 20 bp, mouse
ggggacccctgcccggcctc

SEQ ID NO: 720392 - DNA, 20 bp, mouse
gtcgggccggctccacggag

SEQ ID NO: 720393 - DNA, 20 bp, mouse
gcgaactgcgggtggggcga

SEQ ID NO: 720394 - DNA, 20 bp, mouse
gggtgcccagaggccgggca

SEQ ID NO: 720395 - DNA, 20 bp, mouse
ggggccggggtgggcggaaa

SEQ ID NO: 720396 - DNA, 20 bp, mouse
gcacctctagtgtgggtagg

SEQ ID NO: 720397 - DNA, 20 bp, mouse
ggtcgggtgcccaccgtctt

SEQ ID NO: 720398 - DNA, 20 bp, mouse
gggacctcaccccccgcctg

SEQ ID NO: 720399 - DNA, 20 bp, mouse
gaggaccgacccataggcaa

SEQ ID NO: 720400 - DNA, 20 bp, mouse
gaaggggacgcgcaaaaaat

SEQ ID NO: 720401 - DNA, 20 bp, mouse
ggcgcgggcacctctagtgt

SEQ ID NO: 720402 - DNA, 20 bp, mouse
gggggtgaggtccaatgcgc

SEQ ID NO: 720403 - DNA, 20 bp, mouse
gcggagaacaatctattgag

SEQ ID NO: 720404 - DNA, 20 bp, mouse
ggacgccccaacctcttcag

SEQ ID NO: 720405 - DNA, 20 bp, mouse
gcactgaggacgtgctcaaa

SEQ ID NO: 720406 - DNA, 20 bp, mouse
ggagtggaagaggactctct

SEQ ID NO: 720407 - DNA, 20 bp, mouse
ggtgccaagtcagcagttga

SEQ ID NO: 720408 - DNA, 20 bp, mouse
ggggagctagggatgcccga

SEQ ID NO: 720409 - DNA, 20 bp, mouse
gcgagggccaatcagagaca

SEQ ID NO: 720410 - DNA, 20 bp, mouse
gtagaagagtggggtgtctc

SEQ ID NO: 720411 - DNA, 20 bp, mouse
gatctcatctggagacctgg

SEQ ID NO: 720412 - DNA, 20 bp, mouse
gccccactcccgggactaaa

SEQ ID NO: 720413 - DNA, 20 bp, mouse
gtataggacaggagtggaag

SEQ ID NO: 720414 - DNA, 20 bp, mouse
gaatgtatataggacaggag

SEQ ID NO: 720415 - DNA, 20 bp, mouse
gcggtgggatttgggagcta

SEQ ID NO: 720416 - DNA, 20 bp, mouse
gaatgcaggtgctggagctc

SEQ ID NO: 720417 - DNA, 20 bp, mouse
gagtgagtccacaggaccgg

SEQ ID NO: 720418 - DNA, 20 bp, mouse
ggccagaagaatgcaggtgc

SEQ ID NO: 720419 - DNA, 20 bp, mouse
gtgagatgagcttttcagaa

SEQ ID NO: 720420 - DNA, 20 bp, mouse
ggcaagtgagtccacaggac

SEQ ID NO: 720421 - DNA, 20 bp, mouse
gggaaggagctctccagctc

SEQ ID NO: 720422 - DNA, 20 bp, mouse
gagagctccttcctaatccg

SEQ ID NO: 720423 - DNA, 20 bp, mouse
gatcgtgctaaggacaagat

SEQ ID NO: 720424 - DNA, 20 bp, mouse
ggagctctccagctcgggta

SEQ ID NO: 720425 - DNA, 20 bp, mouse
ggctttgccaggcagataaa

SEQ ID NO: 720426 - DNA, 20 bp, mouse
gtgttttgtgctaaactctc

SEQ ID NO: 720427 - DNA, 20 bp, mouse
gcaggtaagcatgattttga

SEQ ID NO: 720428 - DNA, 20 bp, mouse
ggtaagcatgattttgaagg

SEQ ID NO: 720429 - DNA, 20 bp, mouse
gactccaatggaagcttaag

SEQ ID NO: 720430 - DNA, 20 bp, mouse
gaattaaagaaaatctgtga

SEQ ID NO: 720431 - DNA, 20 bp, mouse
gcataatctttttgaggcta

SEQ ID NO: 720432 - DNA, 20 bp, mouse
gtttgtaccaaccttagaat

SEQ ID NO: 720433 - DNA, 20 bp, mouse
gaaccttagaataggcaaaa

SEQ ID NO: 720434 - DNA, 20 bp, mouse
gagcttccattggagttgca

SEQ ID NO: 720435 - DNA, 20 bp, mouse
gcatggatttttattctcat

SEQ ID NO: 720436 - DNA, 20 bp, mouse
ggccgcccgaccactagctc

SEQ ID NO: 720437 - DNA, 20 bp, mouse
gtagtccaataacgacagac

SEQ ID NO: 720438 - DNA, 20 bp, mouse
ggctagaagtagcttcggga

SEQ ID NO: 720439 - DNA, 20 bp, mouse
gggactactcgcacgtccgt

SEQ ID NO: 720440 - DNA, 20 bp, mouse
ggaaaacgagccggagctag

SEQ ID NO: 720441 - DNA, 20 bp, mouse
gggcggcagcgcgtggtgcg

SEQ ID NO: 720442 - DNA, 20 bp, mouse
gctcccgcgccgcctgcaag

SEQ ID NO: 720443 - DNA, 20 bp, mouse
gagcagcgcgtgcggtaagg

SEQ ID NO: 720444 - DNA, 20 bp, mouse
gctcccctgtctgtcgttat

SEQ ID NO: 720445 - DNA, 20 bp, mouse
ggccagcagcgcgtgcggta

SEQ ID NO: 720446 - DNA, 20 bp, mouse
gtccctggaagacccttgcg

SEQ ID NO: 720447 - DNA, 20 bp, mouse
gaccccgcaagggtcttcca

SEQ ID NO: 720448 - DNA, 20 bp, mouse
gaagacccttgcggggtgtg

SEQ ID NO: 720449 - DNA, 20 bp, mouse
gggctctgacctgacggtgt

SEQ ID NO: 720450 - DNA, 20 bp, mouse
gtcagagccagaggccaccg

SEQ ID NO: 720451 - DNA, 20 bp, mouse
gagaggccaccgaggccgat

SEQ ID NO: 720452 - DNA, 20 bp, mouse
gctgaatgaccagcccggga

SEQ ID NO: 720453 - DNA, 20 bp, mouse
gcacaggagccgacaccgtc

SEQ ID NO: 720454 - DNA, 20 bp, mouse
gtcgcgcacgcgcagaggga

SEQ ID NO: 720455 - DNA, 20 bp, mouse
gcacaccgccctctggcttg

SEQ ID NO: 720456 - DNA, 20 bp, mouse
gcgccagcgcgccagcgcgg

SEQ ID NO: 720457 - DNA, 20 bp, mouse
gccgcgggaaggctaacttg

SEQ ID NO: 720458 - DNA, 20 bp, mouse
gctcccatcagcctccgcgc

SEQ ID NO: 720459 - DNA, 20 bp, mouse
gcgggcctctccacttagta

SEQ ID NO: 720460 - DNA, 20 bp, mouse
gcgcaccgtactaagtggag

SEQ ID NO: 720461 - DNA, 20 bp, mouse
gggtcccactggagcaggca

SEQ ID NO: 720462 - DNA, 20 bp, mouse
gccacccagcacctgcgcac

SEQ ID NO: 720463 - DNA, 20 bp, mouse
ggaggcctccatctcgcaga

SEQ ID NO: 720464 - DNA, 20 bp, mouse
ggccccctgcctgctccagt

SEQ ID NO: 720465 - DNA, 20 bp, mouse
ggccagagccggtacgtcgg

SEQ ID NO: 720466 - DNA, 20 bp, mouse
gcagctctccccagagcgga

SEQ ID NO: 720467 - DNA, 20 bp, mouse
ggcgctggacggttgagttg

SEQ ID NO: 720468 - DNA, 20 bp, mouse
ggagcaagacatcctctcta

SEQ ID NO: 720469 - DNA, 20 bp, mouse
ggggacagcagaagtggtat

SEQ ID NO: 720470 - DNA, 20 bp, mouse
gtggggagagctgcgctgga

SEQ ID NO: 720471 - DNA, 20 bp, mouse
ggcgacggccgcgtcactgg

SEQ ID NO: 720472 - DNA, 20 bp, mouse
ggccgcccaatccggagggg

SEQ ID NO: 720473 - DNA, 20 bp, mouse
ggccgtcgccgccgcgccca

SEQ ID NO: 720474 - DNA, 20 bp, mouse
ggaagcgaaaacaccactcc

SEQ ID NO: 720475 - DNA, 20 bp, mouse
gatcccgcccgccagtgacg

SEQ ID NO: 720476 - DNA, 20 bp, mouse
gccgcgtctctgccacgtaa

SEQ ID NO: 720477 - DNA, 20 bp, mouse
gtggcctctccgcccttacg

SEQ ID NO: 720478 - DNA, 20 bp, mouse
gtgtacagcgctgccaaact

SEQ ID NO: 720479 - DNA, 20 bp, mouse
gttgagcagcagtgaatcat

SEQ ID NO: 720480 - DNA, 20 bp, mouse
gatgcgccagggttttagaa

SEQ ID NO: 720481 - DNA, 20 bp, mouse
gtgaacagaagcggaaaggg

SEQ ID NO: 720482 - DNA, 20 bp, mouse
ggcacacaagcaaactacag

SEQ ID NO: 720483 - DNA, 20 bp, mouse
ggaactgaacagaagcggaa

SEQ ID NO: 720484 - DNA, 20 bp, mouse
ggctgccaaactaggttgcg

SEQ ID NO: 720485 - DNA, 20 bp, mouse
gtctgaagccagatgcgcca

SEQ ID NO: 720486 - DNA, 20 bp, mouse
ggccagggaggggaggtatg

SEQ ID NO: 720487 - DNA, 20 bp, mouse
gggccaggagccagaacagg

SEQ ID NO: 720488 - DNA, 20 bp, mouse
ggcctggaggggtgggaaac

SEQ ID NO: 720489 - DNA, 20 bp, mouse
gtggcctggccctgactgag

SEQ ID NO: 720490 - DNA, 20 bp, mouse
gcaaatgaaatcagctggca

SEQ ID NO: 720491 - DNA, 20 bp, mouse
gtctgctggcggactgaccg

SEQ ID NO: 720492 - DNA, 20 bp, mouse
ggcccaagggcagctggtcg

SEQ ID NO: 720493 - DNA, 20 bp, mouse
gggggtgggaaacaggcccg

SEQ ID NO: 720494 - DNA, 20 bp, mouse
gtgaccacaggttggggcta

SEQ ID NO: 720495 - DNA, 20 bp, mouse
gggccctgactgagagggag

SEQ ID NO: 720496 - DNA, 20 bp, mouse
gtgggaacgcgccgagagag

SEQ ID NO: 720497 - DNA, 20 bp, mouse
gagagcggcgcgcgtggctc

SEQ ID NO: 720498 - DNA, 20 bp, mouse
gcccgggtccccgccccgtc

SEQ ID NO: 720499 - DNA, 20 bp, mouse
ggcgcgcgtggctcgggtcg

SEQ ID NO: 720500 - DNA, 20 bp, mouse
gcgttcccagaccctctccc

SEQ ID NO: 720501 - DNA, 20 bp, mouse
ggggcgcttgcaggggctcg

SEQ ID NO: 720502 - DNA, 20 bp, mouse
gacgcgcttggcctgggtgg

SEQ ID NO: 720503 - DNA, 20 bp, mouse
gtggcgggagcgagcgcggt

SEQ ID NO: 720504 - DNA, 20 bp, mouse
gcccaggccaagcgcgttct

SEQ ID NO: 720505 - DNA, 20 bp, mouse
gaacctcgggcatccaccga

SEQ ID NO: 720506 - DNA, 20 bp, mouse
gcggaggtgggacagtagag

SEQ ID NO: 720507 - DNA, 20 bp, mouse
gtggccccaactctagtccc

SEQ ID NO: 720508 - DNA, 20 bp, mouse
ggttgtgaggggatgggagt

SEQ ID NO: 720509 - DNA, 20 bp, mouse
gagagccagggactagagtt

SEQ ID NO: 720510 - DNA, 20 bp, mouse
gcatcgccggttctcaggga

SEQ ID NO: 720511 - DNA, 20 bp, mouse
gaccggcgatgctcggaggt

SEQ ID NO: 720512 - DNA, 20 bp, mouse
gagactgtgagtcgatgcgg

SEQ ID NO: 720513 - DNA, 20 bp, mouse
gtcccacctccgagcatcgc

SEQ ID NO: 720514 - DNA, 20 bp, mouse
gggcggcgttggggtcacgg

SEQ ID NO: 720515 - DNA, 20 bp, mouse
ggagaaccggcgatgctcgg

SEQ ID NO: 720516 - DNA, 20 bp, mouse
gaggggctgggacccggtgc

SEQ ID NO: 720517 - DNA, 20 bp, mouse
ggctccggctccgcctgcac

SEQ ID NO: 720518 - DNA, 20 bp, mouse
ggctcccgcggagcgccgaa

SEQ ID NO: 720519 - DNA, 20 bp, mouse
gagaactcgggcttaactgt

SEQ ID NO: 720520 - DNA, 20 bp, mouse
gcaccctcaggcgagaataa

SEQ ID NO: 720521 - DNA, 20 bp, mouse
ggccgaacggtcgatcgctc

SEQ ID NO: 720522 - DNA, 20 bp, mouse
gtctggtagtggcatccact

SEQ ID NO: 720523 - DNA, 20 bp, mouse
ggtcgtgtcgcctctggtag

SEQ ID NO: 720524 - DNA, 20 bp, mouse
gaccagaggcgacacgacag

SEQ ID NO: 720525 - DNA, 20 bp, mouse
gcacccctgccacgaggctc

SEQ ID NO: 720526 - DNA, 20 bp, mouse
gtctcgatagatgactgaac

SEQ ID NO: 720527 - DNA, 20 bp, mouse
ggaggacagctggcacctga

SEQ ID NO: 720528 - DNA, 20 bp, mouse
gcagtcatctatcgagaaca

SEQ ID NO: 720529 - DNA, 20 bp, mouse
ggaagacgggaagacttagt

SEQ ID NO: 720530 - DNA, 20 bp, mouse
gcggggcttgagagttagtc

SEQ ID NO: 720531 - DNA, 20 bp, mouse
gtctcgttgtagaatctgtc

SEQ ID NO: 720532 - DNA, 20 bp, mouse
gaagccccgcctctttgaaa

SEQ ID NO: 720533 - DNA, 20 bp, mouse
gtgagtctctgaatgctcac

SEQ ID NO: 720534 - DNA, 20 bp, mouse
gtgaacaaagcaacgaagac

SEQ ID NO: 720535 - DNA, 20 bp, mouse
gaagctgaggtttctaaaca

SEQ ID NO: 720536 - DNA, 20 bp, mouse
ggccatagatagtgggtgag

SEQ ID NO: 720537 - DNA, 20 bp, mouse
ggctgcccggccccggtcgc

SEQ ID NO: 720538 - DNA, 20 bp, mouse
ggcctcggaacaaacctagg

SEQ ID NO: 720539 - DNA, 20 bp, mouse
ggaccccagcgcggggacag

SEQ ID NO: 720540 - DNA, 20 bp, mouse
gaggctgcgcgaggctggtt

SEQ ID NO: 720541 - DNA, 20 bp, mouse
gctggccccggaagacatgg

SEQ ID NO: 720542 - DNA, 20 bp, mouse
gccggaagacatggcggcta

SEQ ID NO: 720543 - DNA, 20 bp, mouse
ggggccgctcggtcgcccgt

SEQ ID NO: 720544 - DNA, 20 bp, mouse
gaaacaatggccatagatag

SEQ ID NO: 720545 - DNA, 20 bp, mouse
gcgcctgcgctgcgaaggga

SEQ ID NO: 720546 - DNA, 20 bp, mouse
gcccgcgcgcaggacgtgac

SEQ ID NO: 720547 - DNA, 20 bp, mouse
ggcagctcccagctccccgg

SEQ ID NO: 720548 - DNA, 20 bp, mouse
ggggaaaggccatcgggagc

SEQ ID NO: 720549 - DNA, 20 bp, mouse
gaagccgccctgaagttggt

SEQ ID NO: 720550 - DNA, 20 bp, mouse
gtggagaggtgaaggatcta

SEQ ID NO: 720551 - DNA, 20 bp, mouse
gctgaagttggttggagtct

SEQ ID NO: 720552 - DNA, 20 bp, mouse
gggagaagccgccctgaagt

SEQ ID NO: 720553 - DNA, 20 bp, mouse
gaggaggatgtcccatattt

SEQ ID NO: 720554 - DNA, 20 bp, mouse
gtgcccaagcctgctcccga

SEQ ID NO: 720555 - DNA, 20 bp, mouse
gaggcagtctgcctaaatat

SEQ ID NO: 720556 - DNA, 20 bp, mouse
gcgctctggcccacgggcat

SEQ ID NO: 720557 - DNA, 20 bp, mouse
ggggcccgggcaaccacgcg

SEQ ID NO: 720558 - DNA, 20 bp, mouse
gtggtcgccgcgcccaactg

SEQ ID NO: 720559 - DNA, 20 bp, mouse
gacccccgacggccgcagtt

SEQ ID NO: 720560 - DNA, 20 bp, mouse
gcccgtgggccagagcggag

SEQ ID NO: 720561 - DNA, 20 bp, mouse
ggcccaactgcggccgtcgg

SEQ ID NO: 720562 - DNA, 20 bp, mouse
ggaccacgtcccatgcccgt

SEQ ID NO: 720563 - DNA, 20 bp, mouse
gaccacacaccgcagtcccc

SEQ ID NO: 720564 - DNA, 20 bp, mouse
ggggttggtgcagctcgctg

SEQ ID NO: 720565 - DNA, 20 bp, mouse
gcgccccgcccacgcgcgag

SEQ ID NO: 720566 - DNA, 20 bp, mouse
gacaagggccgagggatctg

SEQ ID NO: 720567 - DNA, 20 bp, mouse
ggtaccgcctttacagggtt

SEQ ID NO: 720568 - DNA, 20 bp, mouse
gagctagtcccgtctctcct

SEQ ID NO: 720569 - DNA, 20 bp, mouse
ggggtgggacatgcagcagt

SEQ ID NO: 720570 - DNA, 20 bp, mouse
gggagacctgccaaagctgt

SEQ ID NO: 720571 - DNA, 20 bp, mouse
gtggcaggtctcccctgggg

SEQ ID NO: 720572 - DNA, 20 bp, mouse
ggcagcccagggagctcttg

SEQ ID NO: 720573 - DNA, 20 bp, mouse
gcataagtggacaacactga

SEQ ID NO: 720574 - DNA, 20 bp, mouse
gggccccaggtggcaagagt

SEQ ID NO: 720575 - DNA, 20 bp, mouse
ggcaaaagcagagatgacaa

SEQ ID NO: 720576 - DNA, 20 bp, mouse
gcaaagctgggtggggactc

SEQ ID NO: 720577 - DNA, 20 bp, mouse
gacacacgacgcctctcggt

SEQ ID NO: 720578 - DNA, 20 bp, mouse
gtgggtggggactcaggctt

SEQ ID NO: 720579 - DNA, 20 bp, mouse
gcggtgggcaactcctacta

SEQ ID NO: 720580 - DNA, 20 bp, mouse
gactcaggcttgggcttcag

SEQ ID NO: 720581 - DNA, 20 bp, mouse
gagaggaagccctgaagtgg

SEQ ID NO: 720582 - DNA, 20 bp, mouse
ggtaggagttgcccaccgag

SEQ ID NO: 720583 - DNA, 20 bp, mouse
gagcgctgggagataagaaa

SEQ ID NO: 720584 - DNA, 20 bp, mouse
gtggaagggcgctggaaaaa

SEQ ID NO: 720585 - DNA, 20 bp, mouse
gctggctggccccggatctc

SEQ ID NO: 720586 - DNA, 20 bp, mouse
ggggacagactctaatgcag

SEQ ID NO: 720587 - DNA, 20 bp, mouse
gaggacttgtacaatggcag

SEQ ID NO: 720588 - DNA, 20 bp, mouse
gcaggctcccctctcaaatg

SEQ ID NO: 720589 - DNA, 20 bp, mouse
gctaatgcaggggctgtcac

SEQ ID NO: 720590 - DNA, 20 bp, mouse
gagactaaggacttgtacaa

SEQ ID NO: 720591 - DNA, 20 bp, mouse
ggctcccctctcaaatgggg

SEQ ID NO: 720592 - DNA, 20 bp, mouse
gaaactagatagctccccaa

SEQ ID NO: 720593 - DNA, 20 bp, mouse
gagcagtgagggtgtgcaca

SEQ ID NO: 720594 - DNA, 20 bp, mouse
gcagaccaccccatttgaga

SEQ ID NO: 720595 - DNA, 20 bp, mouse
gctggcgcataccaactgcc

SEQ ID NO: 720596 - DNA, 20 bp, mouse
gtcactggggctcccactcc

SEQ ID NO: 720597 - DNA, 20 bp, mouse
ggacgcaccagtgacgtcgg

SEQ ID NO: 720598 - DNA, 20 bp, mouse
gaggctgcgcactccccggg

SEQ ID NO: 720599 - DNA, 20 bp, mouse
ggacgtcactggtgcgtcac

SEQ ID NO: 720600 - DNA, 20 bp, mouse
gtccgcgcgccccaaatccc

SEQ ID NO: 720601 - DNA, 20 bp, mouse
gtaacagcgcccaccttcct

SEQ ID NO: 720602 - DNA, 20 bp, mouse
gctccccgggagggcgggtt

SEQ ID NO: 720603 - DNA, 20 bp, mouse
gaggcaccctaggtgtcccc

SEQ ID NO: 720604 - DNA, 20 bp, mouse
ggcctcacgccgaggaaggt

SEQ ID NO: 720605 - DNA, 20 bp, mouse
gtcccggcccctcccggcgc

SEQ ID NO: 720606 - DNA, 20 bp, mouse
ggcgccttccgcctctggag

SEQ ID NO: 720607 - DNA, 20 bp, mouse
gcctctggaggggctgggta

SEQ ID NO: 720608 - DNA, 20 bp, mouse
gggtgggcgcggtggcgacg

SEQ ID NO: 720609 - DNA, 20 bp, mouse
ggaggtaagaggacgccccg

SEQ ID NO: 720610 - DNA, 20 bp, mouse
ggtaagaggacgccccgggg

SEQ ID NO: 720611 - DNA, 20 bp, mouse
gagcccgcggccgtcccggg

SEQ ID NO: 720612 - DNA, 20 bp, mouse
ggacgccccggggcggactc

SEQ ID NO: 720613 - DNA, 20 bp, mouse
gcccgagggcgcctcacaca

SEQ ID NO: 720614 - DNA, 20 bp, mouse
ggagggaggtccgcgaccga

SEQ ID NO: 720615 - DNA, 20 bp, mouse
ggggagcccgcggccgtccc

SEQ ID NO: 720616 - DNA, 20 bp, mouse
gctagggccgacagtctggt

SEQ ID NO: 720617 - DNA, 20 bp, mouse
ggagcctagggccgacagtc

SEQ ID NO: 720618 - DNA, 20 bp, mouse
gcggggcttcgggctcgagt

SEQ ID NO: 720619 - DNA, 20 bp, mouse
gaagccaaggtggcggaggt

SEQ ID NO: 720620 - DNA, 20 bp, mouse
ggggtctcccgcgatgaggg

SEQ ID NO: 720621 - DNA, 20 bp, mouse
gtcagaagccaaggtggcgg

SEQ ID NO: 720622 - DNA, 20 bp, mouse
ggcggaggttggtccagagg

SEQ ID NO: 720623 - DNA, 20 bp, mouse
gtggtccagaggaggagcct

SEQ ID NO: 720624 - DNA, 20 bp, mouse
gcctagagagggctcttcca

SEQ ID NO: 720625 - DNA, 20 bp, mouse
ggggttatgcgtctaaagat

SEQ ID NO: 720626 - DNA, 20 bp, mouse
gagggcaggctgtgaaaata

SEQ ID NO: 720627 - DNA, 20 bp, mouse
ggccaggtgggaactatcag

SEQ ID NO: 720628 - DNA, 20 bp, mouse
gcctgggaagccaaactggt

SEQ ID NO: 720629 - DNA, 20 bp, mouse
gtagggagagagcatgctgt

SEQ ID NO: 720630 - DNA, 20 bp, mouse
gatgctgtgggtgtgatcaa

SEQ ID NO: 720631 - DNA, 20 bp, mouse
gcctgtgaacccacgaggga

SEQ ID NO: 720632 - DNA, 20 bp, mouse
gctctgggatgctggaaccc

SEQ ID NO: 720633 - DNA, 20 bp, mouse
ggatgctggaaccctgggca

SEQ ID NO: 720634 - DNA, 20 bp, mouse
gggcggaggccgtgcctata

SEQ ID NO: 720635 - DNA, 20 bp, mouse
gcctccgccgtgtggtccag

SEQ ID NO: 720636 - DNA, 20 bp, mouse
gggtggctttgatgcaagag

SEQ ID NO: 720637 - DNA, 20 bp, mouse
ggccagaagagttgagggga

SEQ ID NO: 720638 - DNA, 20 bp, mouse
gaacctctgactcaactaag

SEQ ID NO: 720639 - DNA, 20 bp, mouse
gacctgccagaagagttgag

SEQ ID NO: 720640 - DNA, 20 bp, mouse
gagttgagtcagaggttatt

SEQ ID NO: 720641 - DNA, 20 bp, mouse
gctaagtggcatcgattctt

SEQ ID NO: 720642 - DNA, 20 bp, mouse
gcctttcttctgggcttttg

SEQ ID NO: 720643 - DNA, 20 bp, mouse
gagtggcatcgattctttgg

SEQ ID NO: 720644 - DNA, 20 bp, mouse
ggcatcgattctttggcggg

SEQ ID NO: 720645 - DNA, 20 bp, mouse
gctgcagcacattgaacaaa

SEQ ID NO: 720646 - DNA, 20 bp, mouse
gaggcagagcggccaatcag

SEQ ID NO: 720647 - DNA, 20 bp, mouse
gtggcctcggtggggttccc

SEQ ID NO: 720648 - DNA, 20 bp, mouse
ggaaaccaaaagcagaggga

SEQ ID NO: 720649 - DNA, 20 bp, mouse
gtccccagggaaccccaccg

SEQ ID NO: 720650 - DNA, 20 bp, mouse
ggagcggccaatcaggggca

SEQ ID NO: 720651 - DNA, 20 bp, mouse
gaaccacagcgccctgctac

SEQ ID NO: 720652 - DNA, 20 bp, mouse
gacctgcagcatagtccctc

SEQ ID NO: 720653 - DNA, 20 bp, mouse
gtagttggccacccgtagca

SEQ ID NO: 720654 - DNA, 20 bp, mouse
ggttccctggggagcctgct

SEQ ID NO: 720655 - DNA, 20 bp, mouse
gcaccgaggccaagccatgg

SEQ ID NO: 720656 - DNA, 20 bp, mouse
gccggcccccgccaggtgag

SEQ ID NO: 720657 - DNA, 20 bp, mouse
gccgtcgcccggcccccgcc

SEQ ID NO: 720658 - DNA, 20 bp, mouse
gccaagtggcagtcgcggga

SEQ ID NO: 720659 - DNA, 20 bp, mouse
gtgccgcaggccagtccacg

SEQ ID NO: 720660 - DNA, 20 bp, mouse
gtctccaggcggccgcgcgg

SEQ ID NO: 720661 - DNA, 20 bp, mouse
gggcctgcggcaacaggact

SEQ ID NO: 720662 - DNA, 20 bp, mouse
ggcggaagaggcaggttcac

SEQ ID NO: 720663 - DNA, 20 bp, mouse
gggactcggtaaggagattg

SEQ ID NO: 720664 - DNA, 20 bp, mouse
gaggggccatcctctccagg

SEQ ID NO: 720665 - DNA, 20 bp, mouse
ggactgcgctggctgcccgg

SEQ ID NO: 720666 - DNA, 20 bp, mouse
gccttccatagcaacgtcca

SEQ ID NO: 720667 - DNA, 20 bp, mouse
gagcgcgcggcgcttgccta

SEQ ID NO: 720668 - DNA, 20 bp, mouse
gggcgggagcaggacagagg

SEQ ID NO: 720669 - DNA, 20 bp, mouse
gcatgcactgggccgagaac

SEQ ID NO: 720670 - DNA, 20 bp, mouse
gtgacggttgctagacccgg

SEQ ID NO: 720671 - DNA, 20 bp, mouse
gggtgccctggacgttgcta

SEQ ID NO: 720672 - DNA, 20 bp, mouse
gtcccatcagctcatgcact

SEQ ID NO: 720673 - DNA, 20 bp, mouse
gctatggaagggacgcttga

SEQ ID NO: 720674 - DNA, 20 bp, mouse
ggcggagccgggtcagcctt

SEQ ID NO: 720675 - DNA, 20 bp, mouse
gcgcttgcctaaggctgacc

SEQ ID NO: 720676 - DNA, 20 bp, mouse
ggggcggggctcggcggtcg

SEQ ID NO: 720677 - DNA, 20 bp, mouse
gacggctgctagcgctcctc

SEQ ID NO: 720678 - DNA, 20 bp, mouse
gctggccgcggccgtctctc

SEQ ID NO: 720679 - DNA, 20 bp, mouse
gggagcgctagcagccgtgg

SEQ ID NO: 720680 - DNA, 20 bp, mouse
ggggcggggccgcccctcct

SEQ ID NO: 720681 - DNA, 20 bp, mouse
gcggtcggggaccgcagccg

SEQ ID NO: 720682 - DNA, 20 bp, mouse
gtgtgcgcgcgcactcggcc

SEQ ID NO: 720683 - DNA, 20 bp, mouse
ggcggcggagcggcggggta

SEQ ID NO: 720684 - DNA, 20 bp, mouse
gctgccgtaaatccaacctg

SEQ ID NO: 720685 - DNA, 20 bp, mouse
gtcgcctggcggccacaggt

SEQ ID NO: 720686 - DNA, 20 bp, mouse
gggtaaagaaatagcgaaga

SEQ ID NO: 720687 - DNA, 20 bp, mouse
gagcctggcgatgggagggg

SEQ ID NO: 720688 - DNA, 20 bp, mouse
gcgggagcctggcgatggga

SEQ ID NO: 720689 - DNA, 20 bp, mouse
gccgcctcctggctgccggc

SEQ ID NO: 720690 - DNA, 20 bp, mouse
gcaggaggcggggccagcgt

SEQ ID NO: 720691 - DNA, 20 bp, mouse
gggggcgggagcctggcgat

SEQ ID NO: 720692 - DNA, 20 bp, mouse
gaaagaaatagcgaagaggg

SEQ ID NO: 720693 - DNA, 20 bp, mouse
gcggggccagcgtgggagcg

SEQ ID NO: 720694 - DNA, 20 bp, mouse
ggagcctagctgcgcactcc

SEQ ID NO: 720695 - DNA, 20 bp, mouse
gtaggctccgcccagacttc

SEQ ID NO: 720696 - DNA, 20 bp, mouse
gttagtaagacaggtcagat

SEQ ID NO: 720697 - DNA, 20 bp, mouse
ggctgcctctgccttgagga

SEQ ID NO: 720698 - DNA, 20 bp, mouse
gaggtcagataggactcgcc

SEQ ID NO: 720699 - DNA, 20 bp, mouse
gcagataggactcgccaggg

SEQ ID NO: 720700 - DNA, 20 bp, mouse
gccccttcctccttgggtag

SEQ ID NO: 720701 - DNA, 20 bp, mouse
gggacctggcttagtaagac

SEQ ID NO: 720702 - DNA, 20 bp, mouse
gtgacctgtcttactaagcc

SEQ ID NO: 720703 - DNA, 20 bp, mouse
gtgtactcttgtacttggat

SEQ ID NO: 720704 - DNA, 20 bp, mouse
gaggctcctggctggtatgg

SEQ ID NO: 720705 - DNA, 20 bp, mouse
gtaggactcgccagggtggc

SEQ ID NO: 720706 - DNA, 20 bp, mouse
gccacttaggggcttttgta

SEQ ID NO: 720707 - DNA, 20 bp, mouse
ggaggtgtacgtcaagtcac

SEQ ID NO: 720708 - DNA, 20 bp, mouse
gagacacatggggactcatt

SEQ ID NO: 720709 - DNA, 20 bp, mouse
gcctgtctaacagagtctag

SEQ ID NO: 720710 - DNA, 20 bp, mouse
gcatggggactcattaggga

SEQ ID NO: 720711 - DNA, 20 bp, mouse
gcaagtagacccttgatcac

SEQ ID NO: 720712 - DNA, 20 bp, mouse
gaagccagccctccacttag

SEQ ID NO: 720713 - DNA, 20 bp, mouse
gtagccaagccaggcaacac

SEQ ID NO: 720714 - DNA, 20 bp, mouse
gtggcatcagagtaggattc

SEQ ID NO: 720715 - DNA, 20 bp, mouse
ggggctggctttgccaactg

SEQ ID NO: 720716 - DNA, 20 bp, mouse
gcgctcacccaggtcgtaga

SEQ ID NO: 720717 - DNA, 20 bp, mouse
gggtgagcgtagctcctggg

SEQ ID NO: 720718 - DNA, 20 bp, mouse
gggtccgcagaacggcgtcc

SEQ ID NO: 720719 - DNA, 20 bp, mouse
gtcgtagagggtccgcagaa

SEQ ID NO: 720720 - DNA, 20 bp, mouse
gactcctggacgccgttctg

SEQ ID NO: 720721 - DNA, 20 bp, mouse
gctgcggaccctctacgacc

SEQ ID NO: 720722 - DNA, 20 bp, mouse
gggagtgcctccgaaccagg

SEQ ID NO: 720723 - DNA, 20 bp, mouse
gcggactccgttgagcctcc

SEQ ID NO: 720724 - DNA, 20 bp, mouse
gggggagaaggtcccggaga

SEQ ID NO: 720725 - DNA, 20 bp, mouse
gaagcggaagtggtgggcac

SEQ ID NO: 720726 - DNA, 20 bp, mouse
gacaggaggccacacctcgg

SEQ ID NO: 720727 - DNA, 20 bp, mouse
ggctcccctcagcccggcgt

SEQ ID NO: 720728 - DNA, 20 bp, mouse
gcaccccacgccgggctgag

SEQ ID NO: 720729 - DNA, 20 bp, mouse
ggccccaggcggagccgcca

SEQ ID NO: 720730 - DNA, 20 bp, mouse
gcgcgccgccagctgactca

SEQ ID NO: 720731 - DNA, 20 bp, mouse
ggccccggcatcttgtttca

SEQ ID NO: 720732 - DNA, 20 bp, mouse
gggcgcgcgcaccccgtgac

SEQ ID NO: 720733 - DNA, 20 bp, mouse
gaaacaagatgccggggcgt

SEQ ID NO: 720734 - DNA, 20 bp, mouse
ggtgtctgtgcaccccacgc

SEQ ID NO: 720735 - DNA, 20 bp, mouse
gcgccctggcggctccgcct

SEQ ID NO: 720736 - DNA, 20 bp, mouse
ggtgacaggtgactgaccca

SEQ ID NO: 720737 - DNA, 20 bp, mouse
gactgcccagcacatccctt

SEQ ID NO: 720738 - DNA, 20 bp, mouse
ggcccagcacatcccttagg

SEQ ID NO: 720739 - DNA, 20 bp, mouse
gcatgcgtactgccaaaggt

SEQ ID NO: 720740 - DNA, 20 bp, mouse
gctgggcagtctacagtcct

SEQ ID NO: 720741 - DNA, 20 bp, mouse
gtggggtgaagtgatcgagt

SEQ ID NO: 720742 - DNA, 20 bp, mouse
gcggatgcaaacacaaacac

SEQ ID NO: 720743 - DNA, 20 bp, mouse
gagtgaatagcaaatatctg

SEQ ID NO: 720744 - DNA, 20 bp, mouse
gtccttcagaagctgaattg

SEQ ID NO: 720745 - DNA, 20 bp, mouse
gacacaggaagggactcggg

SEQ ID NO: 720746 - DNA, 20 bp, mouse
gggcgtggggcaaagaccag

SEQ ID NO: 720747 - DNA, 20 bp, mouse
gcgcctccggagcccaggag

SEQ ID NO: 720748 - DNA, 20 bp, mouse
gcgtgcgcagcggtgcgtga

SEQ ID NO: 720749 - DNA, 20 bp, mouse
ggcacaccactcctgggctc

SEQ ID NO: 720750 - DNA, 20 bp, mouse
gcgtgcctccgcgtgcgcag

SEQ ID NO: 720751 - DNA, 20 bp, mouse
ggcgcagcggtgcgtgaggg

SEQ ID NO: 720752 - DNA, 20 bp, mouse
gcagggcagaggcgttggtc

SEQ ID NO: 720753 - DNA, 20 bp, mouse
gcgcaccgctgcgcacgcgg

SEQ ID NO: 720754 - DNA, 20 bp, mouse
gcaccactcctgggctccgg

SEQ ID NO: 720755 - DNA, 20 bp, mouse
gggaaccgccaggccaaacg

SEQ ID NO: 720756 - DNA, 20 bp, mouse
gctagagggcggaggggcaa

SEQ ID NO: 720757 - DNA, 20 bp, mouse
gggcgcacgcgcagatggga

SEQ ID NO: 720758 - DNA, 20 bp, mouse
ggtcgccagcgccacctaga

SEQ ID NO: 720759 - DNA, 20 bp, mouse
gagggcggaggggcaagggc

SEQ ID NO: 720760 - DNA, 20 bp, mouse
gtggctagggaatgcatatt

SEQ ID NO: 720761 - DNA, 20 bp, mouse
ggcagagggcccaaagggca

SEQ ID NO: 720762 - DNA, 20 bp, mouse
gcgccacccggggttggcct

SEQ ID NO: 720763 - DNA, 20 bp, mouse
ggcgccacctagagggcgga

SEQ ID NO: 720764 - DNA, 20 bp, mouse
gactcgccgccgcctctccg

SEQ ID NO: 720765 - DNA, 20 bp, mouse
gccacggcgcacgcgcagat

SEQ ID NO: 720766 - DNA, 20 bp, mouse
gctgcgctgcgtggtgagtt

SEQ ID NO: 720767 - DNA, 20 bp, mouse
ggggctgcacggatgctaca

SEQ ID NO: 720768 - DNA, 20 bp, mouse
gatcggggaggggtcggaga

SEQ ID NO: 720769 - DNA, 20 bp, mouse
ggcagtcggagcagcgggtc

SEQ ID NO: 720770 - DNA, 20 bp, mouse
gtgcgcgctcgcacagcttc

SEQ ID NO: 720771 - DNA, 20 bp, mouse
gtgaacaaacgctggagctg

SEQ ID NO: 720772 - DNA, 20 bp, mouse
gtccgcgagcaactttcttg

SEQ ID NO: 720773 - DNA, 20 bp, mouse
gccgaggaggccgaggacca

SEQ ID NO: 720774 - DNA, 20 bp, mouse
ggcagcgcaccagacccaga

SEQ ID NO: 720775 - DNA, 20 bp, mouse
ggtcctcagcgcctgctccc

SEQ ID NO: 720776 - DNA, 20 bp, mouse
gtcctcaggggaattcaaca

SEQ ID NO: 720777 - DNA, 20 bp, mouse
ggcaactgtgctcaccagcg

SEQ ID NO: 720778 - DNA, 20 bp, mouse
gctcacaaaaagcctcttaa

SEQ ID NO: 720779 - DNA, 20 bp, mouse
gacactgatgtcttccccgc

SEQ ID NO: 720780 - DNA, 20 bp, mouse
gacacactgaaaaactcaca

SEQ ID NO: 720781 - DNA, 20 bp, mouse
ggggttttaatcccttagaa

SEQ ID NO: 720782 - DNA, 20 bp, mouse
gaggggaattcaacatggct

SEQ ID NO: 720783 - DNA, 20 bp, mouse
gaaactaactattaagacta

SEQ ID NO: 720784 - DNA, 20 bp, mouse
gagctgaagctaccattcta

SEQ ID NO: 720785 - DNA, 20 bp, mouse
gataatccatgacctaagtt

SEQ ID NO: 720786 - DNA, 20 bp, mouse
gttacacttggccttcagga

SEQ ID NO: 720787 - DNA, 20 bp, mouse
gagacgggccatctgctgag

SEQ ID NO: 720788 - DNA, 20 bp, mouse
gtggcccgtctttttatcgt

SEQ ID NO: 720789 - DNA, 20 bp, mouse
ggaggggctacggttacact

SEQ ID NO: 720790 - DNA, 20 bp, mouse
gctcacctacgataaaaaga

SEQ ID NO: 720791 - DNA, 20 bp, mouse
ggccatctgctgaggggcta

SEQ ID NO: 720792 - DNA, 20 bp, mouse
gtcaaggtaaacttgttttt

SEQ ID NO: 720793 - DNA, 20 bp, mouse
ggacttaacgtgaaagatca

SEQ ID NO: 720794 - DNA, 20 bp, mouse
ggttaagtccagagtatctt

SEQ ID NO: 720795 - DNA, 20 bp, mouse
gaccgtagcccctcagcaga

SEQ ID NO: 720796 - DNA, 20 bp, mouse
ggggcgcgtcgtcacgtgac

SEQ ID NO: 720797 - DNA, 20 bp, mouse
gtggcggccaagctccgcgg

SEQ ID NO: 720798 - DNA, 20 bp, mouse
gccggggcccggctgccgaa

SEQ ID NO: 720799 - DNA, 20 bp, mouse
gactctggagggaagatgag

SEQ ID NO: 720800 - DNA, 20 bp, mouse
gtgcgctgcttcactctgga

SEQ ID NO: 720801 - DNA, 20 bp, mouse
gcaggagcaggcctaaccag

SEQ ID NO: 720802 - DNA, 20 bp, mouse
gcctggcctcgccactggtt

SEQ ID NO: 720803 - DNA, 20 bp, mouse
ggagagacgccggtgagcgc

SEQ ID NO: 720804 - DNA, 20 bp, mouse
gggacagagctaggaccgcg

SEQ ID NO: 720805 - DNA, 20 bp, mouse
gcacgtgcgctgcttcactc

SEQ ID NO: 720806 - DNA, 20 bp, mouse
ggcgcccgtgtgcgattcag

SEQ ID NO: 720807 - DNA, 20 bp, mouse
ggccggaagtggcagcgcgt

SEQ ID NO: 720808 - DNA, 20 bp, mouse
gggctcctccctcttcagaa

SEQ ID NO: 720809 - DNA, 20 bp, mouse
gaagggaaggtgccgatcca

SEQ ID NO: 720810 - DNA, 20 bp, mouse
gccggcgcgcggcaaacgtg

SEQ ID NO: 720811 - DNA, 20 bp, mouse
gcgccctcgagagtccgcgg

SEQ ID NO: 720812 - DNA, 20 bp, mouse
gcaaacgtgcggttccgggt

SEQ ID NO: 720813 - DNA, 20 bp, mouse
gggccggccaacacaggtag

SEQ ID NO: 720814 - DNA, 20 bp, mouse
gcctccctcttcagaaggga

SEQ ID NO: 720815 - DNA, 20 bp, mouse
gggaaggtgccgatccaggg

SEQ ID NO: 720816 - DNA, 20 bp, mouse
gagaacgatgaacgacaggg

SEQ ID NO: 720817 - DNA, 20 bp, mouse
gacccctcacagcggcctat

SEQ ID NO: 720818 - DNA, 20 bp, mouse
gaggccgctgtgaggggtca

SEQ ID NO: 720819 - DNA, 20 bp, mouse
gaaactgcttccggaagcta

SEQ ID NO: 720820 - DNA, 20 bp, mouse
gcagccatgacccctcacag

SEQ ID NO: 720821 - DNA, 20 bp, mouse
ggggtcggggtgcgcatcgt

SEQ ID NO: 720822 - DNA, 20 bp, mouse
gggagaaggtaggtcacgct

SEQ ID NO: 720823 - DNA, 20 bp, mouse
gacagggaggcgtggccacg

SEQ ID NO: 720824 - DNA, 20 bp, mouse
gggcgtgaggggtcgggcaa

SEQ ID NO: 720825 - DNA, 20 bp, mouse
gttaactccacccgtcgctc

SEQ ID NO: 720826 - DNA, 20 bp, mouse
gtggggttggtatggatctc

SEQ ID NO: 720827 - DNA, 20 bp, mouse
ggtccgcgaggtcttcgttc

SEQ ID NO: 720828 - DNA, 20 bp, mouse
gagtccaacgtcactaccac

SEQ ID NO: 720829 - DNA, 20 bp, mouse
gcccctcgcggccttctgac

SEQ ID NO: 720830 - DNA, 20 bp, mouse
gtgtcctgatttcgtctctt

SEQ ID NO: 720831 - DNA, 20 bp, mouse
gcggaccgtttgtttccggg

SEQ ID NO: 720832 - DNA, 20 bp, mouse
ggccactttcaaattggggt

SEQ ID NO: 720833 - DNA, 20 bp, mouse
ggcaaccccccggaaacaaa

SEQ ID NO: 720834 - DNA, 20 bp, mouse
gcggggaagccacgccccgg

SEQ ID NO: 720835 - DNA, 20 bp, mouse
ggcaacagggtaccagtctc

SEQ ID NO: 720836 - DNA, 20 bp, mouse
gggagctgtgctgtcaaata

SEQ ID NO: 720837 - DNA, 20 bp, mouse
gaccccagccttcttcactg

SEQ ID NO: 720838 - DNA, 20 bp, mouse
gctgactctagcgggagtct

SEQ ID NO: 720839 - DNA, 20 bp, mouse
gggtgaacgcgcgtgcacag

SEQ ID NO: 720840 - DNA, 20 bp, mouse
ggcggcggacaatatggagg

SEQ ID NO: 720841 - DNA, 20 bp, mouse
gtcgacgtggagcttgccag

SEQ ID NO: 720842 - DNA, 20 bp, mouse
ggcgtctgcgctgactctag

SEQ ID NO: 720843 - DNA, 20 bp, mouse
ggcgctccgtagcaagcccc

SEQ ID NO: 720844 - DNA, 20 bp, mouse
gagcgccgcggcggacaata

SEQ ID NO: 720845 - DNA, 20 bp, mouse
gggtgagagaggatagagct

SEQ ID NO: 720846 - DNA, 20 bp, mouse
gggaccctgccccccgttgt

SEQ ID NO: 720847 - DNA, 20 bp, mouse
gtagcaggtcactcaggcgg

SEQ ID NO: 720848 - DNA, 20 bp, mouse
gggcgcggcacccggttcgg

SEQ ID NO: 720849 - DNA, 20 bp, mouse
gttcggcggcagacggaagg

SEQ ID NO: 720850 - DNA, 20 bp, mouse
ggccgcggggccctagcgcc

SEQ ID NO: 720851 - DNA, 20 bp, mouse
gggagcacgcccacaacggg

SEQ ID NO: 720852 - DNA, 20 bp, mouse
ggccgcctagcaggtcactc

SEQ ID NO: 720853 - DNA, 20 bp, mouse
gtcttccgggagacgtggaa

SEQ ID NO: 720854 - DNA, 20 bp, mouse
gcggttcggcggcagacgga

SEQ ID NO: 720855 - DNA, 20 bp, mouse
ggcctagcaggtcactcagg

SEQ ID NO: 720856 - DNA, 20 bp, mouse
gatgaggtggacgtgatcgg

SEQ ID NO: 720857 - DNA, 20 bp, mouse
gatgatgaggtggacgtgat

SEQ ID NO: 720858 - DNA, 20 bp, mouse
gcctccgcggctgcgcgttg

SEQ ID NO: 720859 - DNA, 20 bp, mouse
gcgaatgaaacccttccggg

SEQ ID NO: 720860 - DNA, 20 bp, mouse
gggggcggggtgtcaacgtg

SEQ ID NO: 720861 - DNA, 20 bp, mouse
gcacagaaggtgttcgggag

SEQ ID NO: 720862 - DNA, 20 bp, mouse
gccgtaaagcgacgcctccg

SEQ ID NO: 720863 - DNA, 20 bp, mouse
gtcaccgcaacgcgcagccg

SEQ ID NO: 720864 - DNA, 20 bp, mouse
gtggacgtgatcggtggatc

SEQ ID NO: 720865 - DNA, 20 bp, mouse
gtgcggcacagaaggtgttc

SEQ ID NO: 720866 - DNA, 20 bp, mouse
gcgcgggcggggctcctctc

SEQ ID NO: 720867 - DNA, 20 bp, mouse
ggaagctagcgcaacgctct

SEQ ID NO: 720868 - DNA, 20 bp, mouse
ggtggggccttccgtattgc

SEQ ID NO: 720869 - DNA, 20 bp, mouse
gggaaggccccaccatccac

SEQ ID NO: 720870 - DNA, 20 bp, mouse
gaggcacccggcctgcaata

SEQ ID NO: 720871 - DNA, 20 bp, mouse
ggctctaggcactcctgctg

SEQ ID NO: 720872 - DNA, 20 bp, mouse
gtggaagtccccggaggcgg

SEQ ID NO: 720873 - DNA, 20 bp, mouse
gggaagggaatgttcccata

SEQ ID NO: 720874 - DNA, 20 bp, mouse
gggcggggctcctctccggc

SEQ ID NO: 720875 - DNA, 20 bp, mouse
ggggtgggacctggactagg

SEQ ID NO: 720876 - DNA, 20 bp, mouse
gtgacccggaagaagatcca

SEQ ID NO: 720877 - DNA, 20 bp, mouse
gactcccaggggcgcgtcga

SEQ ID NO: 720878 - DNA, 20 bp, mouse
ggagacggaaggctgaatca

SEQ ID NO: 720879 - DNA, 20 bp, mouse
ggagccaatggattctaaga

SEQ ID NO: 720880 - DNA, 20 bp, mouse
ggtgctcagggcgttgctat

SEQ ID NO: 720881 - DNA, 20 bp, mouse
gccactcgccgtgagacgga

SEQ ID NO: 720882 - DNA, 20 bp, mouse
gggcgagtggctgactccca

SEQ ID NO: 720883 - DNA, 20 bp, mouse
gccctgagcaccgctccgat

SEQ ID NO: 720884 - DNA, 20 bp, mouse
gcccaccatgtgattccacc

SEQ ID NO: 720885 - DNA, 20 bp, mouse
gaaggctttagggcattggt

SEQ ID NO: 720886 - DNA, 20 bp, mouse
gggagcctggatgggtgcgg

SEQ ID NO: 720887 - DNA, 20 bp, mouse
gccgggaggaagtcccactc

SEQ ID NO: 720888 - DNA, 20 bp, mouse
gtggaggagcctggttggga

SEQ ID NO: 720889 - DNA, 20 bp, mouse
gcacccctccgcacccatcc

SEQ ID NO: 720890 - DNA, 20 bp, mouse
gacccatccaggctccacgt

SEQ ID NO: 720891 - DNA, 20 bp, mouse
gtgcgcgggcccaatgagcg

SEQ ID NO: 720892 - DNA, 20 bp, mouse
gggacaaagctggcgtccaa

SEQ ID NO: 720893 - DNA, 20 bp, mouse
gggggcgggacggacaaagc

SEQ ID NO: 720894 - DNA, 20 bp, mouse
gcgcccacgtggagcctgga

SEQ ID NO: 720895 - DNA, 20 bp, mouse
gccgtgggtgacacgtaagt

SEQ ID NO: 720896 - DNA, 20 bp, mouse
gtctccgcaagtaacctcag

SEQ ID NO: 720897 - DNA, 20 bp, mouse
gtggcggacagggaagactg

SEQ ID NO: 720898 - DNA, 20 bp, mouse
gggagctcgctgtatggaac

SEQ ID NO: 720899 - DNA, 20 bp, mouse
gtcggaggcagaggtcggaa

SEQ ID NO: 720900 - DNA, 20 bp, mouse
ggtcagagttaagaattcgg

SEQ ID NO: 720901 - DNA, 20 bp, mouse
gagactgcggggcggagagc

SEQ ID NO: 720902 - DNA, 20 bp, mouse
gggcgggcgggcacttccgg

SEQ ID NO: 720903 - DNA, 20 bp, mouse
gcatggcaataaccaatgat

SEQ ID NO: 720904 - DNA, 20 bp, mouse
ggtcaccattggcagtgtgg

SEQ ID NO: 720905 - DNA, 20 bp, mouse
gattggcagtgtggcggaca

SEQ ID NO: 720906 - DNA, 20 bp, mouse
gtagccgcctcccacttcgg

SEQ ID NO: 720907 - DNA, 20 bp, mouse
ggagacgaaaggtttgcgat

SEQ ID NO: 720908 - DNA, 20 bp, mouse
gccggcgctgccacatcctc

SEQ ID NO: 720909 - DNA, 20 bp, mouse
gcggcgcgcgctgacgtcac

SEQ ID NO: 720910 - DNA, 20 bp, mouse
gtcgctagtggccctgagtc

SEQ ID NO: 720911 - DNA, 20 bp, mouse
gtgtccgccgaagtgggagg

SEQ ID NO: 720912 - DNA, 20 bp, mouse
gggctagccgcctcccactt

SEQ ID NO: 720913 - DNA, 20 bp, mouse
gctagcctggcctcggcttc

SEQ ID NO: 720914 - DNA, 20 bp, mouse
gccctgagtctggagacgaa

SEQ ID NO: 720915 - DNA, 20 bp, mouse
ggatcccagaagccgaggcc

SEQ ID NO: 720916 - DNA, 20 bp, mouse
gtggctagagtcaaacttgg

SEQ ID NO: 720917 - DNA, 20 bp, mouse
ggccaccgaggttccttcat

SEQ ID NO: 720918 - DNA, 20 bp, mouse
gaatcggagcttacgagggg

SEQ ID NO: 720919 - DNA, 20 bp, mouse
ggccaatcggagcttacgag

SEQ ID NO: 720920 - DNA, 20 bp, mouse
gttgggttcaacctgacagc

SEQ ID NO: 720921 - DNA, 20 bp, mouse
gttacgaggggaggtcctcc

SEQ ID NO: 720922 - DNA, 20 bp, mouse
gctcggtggctgcgaggaaa

SEQ ID NO: 720923 - DNA, 20 bp, mouse
gctgtccaatgaaggaacct

SEQ ID NO: 720924 - DNA, 20 bp, mouse
gtcgcaacacaatagcccgg

SEQ ID NO: 720925 - DNA, 20 bp, mouse
gtgggtaatttcatcggggt

SEQ ID NO: 720926 - DNA, 20 bp, mouse
gcacctcctctgaacaacgt

SEQ ID NO: 720927 - DNA, 20 bp, mouse
gtgggcacagctggttttct

SEQ ID NO: 720928 - DNA, 20 bp, mouse
gccattcccacgttgttcag

SEQ ID NO: 720929 - DNA, 20 bp, mouse
gacagctggttttctcggag

SEQ ID NO: 720930 - DNA, 20 bp, mouse
ggagaggtggaatggcgccc

SEQ ID NO: 720931 - DNA, 20 bp, mouse
ggctggttttctcggagagg

SEQ ID NO: 720932 - DNA, 20 bp, mouse
gttttctcggagaggtggaa

SEQ ID NO: 720933 - DNA, 20 bp, mouse
gaataaaatccgaagggccg

SEQ ID NO: 720934 - DNA, 20 bp, mouse
ggaatggcgccccggccctt

SEQ ID NO: 720935 - DNA, 20 bp, mouse
gttcccacgttgttcagagg

SEQ ID NO: 720936 - DNA, 20 bp, mouse
gcatgcagcgcccacccttc

SEQ ID NO: 720937 - DNA, 20 bp, mouse
gagccaatcagagaaggcaa

SEQ ID NO: 720938 - DNA, 20 bp, mouse
gccgcaaggccgcgctccat

SEQ ID NO: 720939 - DNA, 20 bp, mouse
ggaggcagaagcgcaagctg

SEQ ID NO: 720940 - DNA, 20 bp, mouse
gggcaatggcttgtgattgg

SEQ ID NO: 720941 - DNA, 20 bp, mouse
gcccgagccgccacgtcttc

SEQ ID NO: 720942 - DNA, 20 bp, mouse
gccacgcagccaatcagaga

SEQ ID NO: 720943 - DNA, 20 bp, mouse
ggggtggagggatgcgctca

SEQ ID NO: 720944 - DNA, 20 bp, mouse
ggcggctgacaggttcgtgg

SEQ ID NO: 720945 - DNA, 20 bp, mouse
gtccgcggctgtctgctggg

SEQ ID NO: 720946 - DNA, 20 bp, mouse
gcatgctcatgattgaactt

SEQ ID NO: 720947 - DNA, 20 bp, mouse
ggatccacctgcctcttcct

SEQ ID NO: 720948 - DNA, 20 bp, mouse
gcaagccctgatcacttcag

SEQ ID NO: 720949 - DNA, 20 bp, mouse
gcagcctaggaagaggcagg

SEQ ID NO: 720950 - DNA, 20 bp, mouse
ggaacttggggtgcgtgaaa

SEQ ID NO: 720951 - DNA, 20 bp, mouse
gactaccactgaagtgatca

SEQ ID NO: 720952 - DNA, 20 bp, mouse
gagtgcaggtggccagttcc

SEQ ID NO: 720953 - DNA, 20 bp, mouse
gttaaggtatcgcttagtca

SEQ ID NO: 720954 - DNA, 20 bp, mouse
gctcttcccagcctaggaag

SEQ ID NO: 720955 - DNA, 20 bp, mouse
ggctaaaagtcctaggcatt

SEQ ID NO: 720956 - DNA, 20 bp, mouse
gatgaggaggaggcagacgt

SEQ ID NO: 720957 - DNA, 20 bp, mouse
gagacgtaggcctgatttcg

SEQ ID NO: 720958 - DNA, 20 bp, mouse
gtaggcctgatttcgaggcc

SEQ ID NO: 720959 - DNA, 20 bp, mouse
gaccgaccaaactcaaaacc

SEQ ID NO: 720960 - DNA, 20 bp, mouse
gtatacctcgagttcaaatc

SEQ ID NO: 720961 - DNA, 20 bp, mouse
gaaagccagatttgaactcg

SEQ ID NO: 720962 - DNA, 20 bp, mouse
gtagttgtcaacttacgcta

SEQ ID NO: 720963 - DNA, 20 bp, mouse
gtccatgaactgacgtacca

SEQ ID NO: 720964 - DNA, 20 bp, mouse
ggaccaaactcaaaacctgg

SEQ ID NO: 720965 - DNA, 20 bp, mouse
gagtctacaggacgagcttt

SEQ ID NO: 720966 - DNA, 20 bp, mouse
gtgcaagtggggaagaccgg

SEQ ID NO: 720967 - DNA, 20 bp, mouse
gagggaagggaggggaccgg

SEQ ID NO: 720968 - DNA, 20 bp, mouse
gcgtcaaaatggtcgcagac

SEQ ID NO: 720969 - DNA, 20 bp, mouse
gccccgccgcgcgtgcgtag

SEQ ID NO: 720970 - DNA, 20 bp, mouse
gggaggcgaaggcttttcat

SEQ ID NO: 720971 - DNA, 20 bp, mouse
gcgttggcggcgcgagggaa

SEQ ID NO: 720972 - DNA, 20 bp, mouse
gcgccctaagagctggaaat

SEQ ID NO: 720973 - DNA, 20 bp, mouse
ggacaggcttgtggaggcga

SEQ ID NO: 720974 - DNA, 20 bp, mouse
gaggtggccccttgcaagtg

SEQ ID NO: 720975 - DNA, 20 bp, mouse
gcagagcaggcgcagcccag

SEQ ID NO: 720976 - DNA, 20 bp, mouse
gcagggacccggtacctgtg

SEQ ID NO: 720977 - DNA, 20 bp, mouse
ggaactggaacgtgtagcag

SEQ ID NO: 720978 - DNA, 20 bp, mouse
ggcctgaaagcctgactcgg

SEQ ID NO: 720979 - DNA, 20 bp, mouse
gttgaggaaaacaggtagag

SEQ ID NO: 720980 - DNA, 20 bp, mouse
gaggaagggttgaggaaaac

SEQ ID NO: 720981 - DNA, 20 bp, mouse
ggatgcctgaaagcctgact

SEQ ID NO: 720982 - DNA, 20 bp, mouse
gtcgctcggggcagccccac

SEQ ID NO: 720983 - DNA, 20 bp, mouse
gggcctgtgagtggaagcga

SEQ ID NO: 720984 - DNA, 20 bp, mouse
gggggcagccccacaggtac

SEQ ID NO: 720985 - DNA, 20 bp, mouse
gaggcctccctctgcattca

SEQ ID NO: 720986 - DNA, 20 bp, mouse
ggcccggctcaggtgatgac

SEQ ID NO: 720987 - DNA, 20 bp, mouse
gcatggctgcagcccggctc

SEQ ID NO: 720988 - DNA, 20 bp, mouse
ggtgagctgggctgcgaatt

SEQ ID NO: 720989 - DNA, 20 bp, mouse
ggtggcagagggtggcccaa

SEQ ID NO: 720990 - DNA, 20 bp, mouse
gtcgcagcccagctcacggc

SEQ ID NO: 720991 - DNA, 20 bp, mouse
gaggggaaatgctttggtta

SEQ ID NO: 720992 - DNA, 20 bp, mouse
gagttcacgcaccatgagag

SEQ ID NO: 720993 - DNA, 20 bp, mouse
gcgggactacttctgcagtc

SEQ ID NO: 720994 - DNA, 20 bp, mouse
gagccggtcatcacctgagc

SEQ ID NO: 720995 - DNA, 20 bp, mouse
gagaactgtgacatccggga

SEQ ID NO: 720996 - DNA, 20 bp, mouse
ggggagccggagggaacgat

SEQ ID NO: 720997 - DNA, 20 bp, mouse
gccccctgacgggagccgga

SEQ ID NO: 720998 - DNA, 20 bp, mouse
gaagacagcccggaacgcga

SEQ ID NO: 720999 - DNA, 20 bp, mouse
gtccctccggctcccgtcag

SEQ ID NO: 721000 - DNA, 20 bp, mouse
gacggctcgctacggggccc

SEQ ID NO: 721001 - DNA, 20 bp, mouse
gggaacgcgacggctcgcta

SEQ ID NO: 721002 - DNA, 20 bp, mouse
gcgcagacagcgccccctga

SEQ ID NO: 721003 - DNA, 20 bp, mouse
gaccaaatacccttctgcga

SEQ ID NO: 721004 - DNA, 20 bp, mouse
gagaaagcggaaagacagcc

SEQ ID NO: 721005 - DNA, 20 bp, mouse
gctcttccgatcgttccctc

SEQ ID NO: 721006 - DNA, 20 bp, mouse
gggcgctcgggggtggaaga

SEQ ID NO: 721007 - DNA, 20 bp, mouse
gcccgagcgccgaggctgat

SEQ ID NO: 721008 - DNA, 20 bp, mouse
gcaggtggcagtgtctaagg

SEQ ID NO: 721009 - DNA, 20 bp, mouse
gcccaagacatcctatttaa

SEQ ID NO: 721010 - DNA, 20 bp, mouse
gggggtggaagaaggcgtgg

SEQ ID NO: 721011 - DNA, 20 bp, mouse
gactgaagactgaaaagatg

SEQ ID NO: 721012 - DNA, 20 bp, mouse
gatgtcttgggaccggaggt

SEQ ID NO: 721013 - DNA, 20 bp, mouse
ggtgtcaagcttaatggggc

SEQ ID NO: 721014 - DNA, 20 bp, mouse
gtagcgtatcccatcagcct

SEQ ID NO: 721015 - DNA, 20 bp, mouse
gaaataggatgtcttgggac

SEQ ID NO: 721016 - DNA, 20 bp, mouse
ggaaggaaagcgggacgcga

SEQ ID NO: 721017 - DNA, 20 bp, mouse
gaaagcgggacgcgagggat

SEQ ID NO: 721018 - DNA, 20 bp, mouse
ggggttgcgcggaaggaaag

SEQ ID NO: 721019 - DNA, 20 bp, mouse
gagctcgcggagagcggcgg

SEQ ID NO: 721020 - DNA, 20 bp, mouse
ggtcgccggcgacttctcgg

SEQ ID NO: 721021 - DNA, 20 bp, mouse
ggagaagccaagcccgaccg

SEQ ID NO: 721022 - DNA, 20 bp, mouse
gcggagctcgcggagagcgg

SEQ ID NO: 721023 - DNA, 20 bp, mouse
ggcctcccccgagaagtcgc

SEQ ID NO: 721024 - DNA, 20 bp, mouse
gcggagatgggaagactagt

SEQ ID NO: 721025 - DNA, 20 bp, mouse
ggggcccgccctgctgagta

SEQ ID NO: 721026 - DNA, 20 bp, mouse
ggagaagaggatcttatcgg

SEQ ID NO: 721027 - DNA, 20 bp, mouse
gccgcctaacccttcttagt

SEQ ID NO: 721028 - DNA, 20 bp, mouse
gctaacccttcttagtcgga

SEQ ID NO: 721029 - DNA, 20 bp, mouse
gacaaccttccgactaagaa

SEQ ID NO: 721030 - DNA, 20 bp, mouse
ggggcagaggctaggatgat

SEQ ID NO: 721031 - DNA, 20 bp, mouse
gggtgcgcacgttcctgcgt

SEQ ID NO: 721032 - DNA, 20 bp, mouse
gacacactgtacccaatcgt

SEQ ID NO: 721033 - DNA, 20 bp, mouse
gggaggtgtgggcagaggct

SEQ ID NO: 721034 - DNA, 20 bp, mouse
ggggcggtggcccgcccgtg

SEQ ID NO: 721035 - DNA, 20 bp, mouse
gcggtgcggggtccggtgac

SEQ ID NO: 721036 - DNA, 20 bp, mouse
ggcagccctgtctagctcac

SEQ ID NO: 721037 - DNA, 20 bp, mouse
ggaagagtaaacaaacacat

SEQ ID NO: 721038 - DNA, 20 bp, mouse
gcctggaggaaaagtgccca

SEQ ID NO: 721039 - DNA, 20 bp, mouse
ggagttgggaggaagtgcct

SEQ ID NO: 721040 - DNA, 20 bp, mouse
ggggactgcagagacgggat

SEQ ID NO: 721041 - DNA, 20 bp, mouse
gtcaggactcccagtctcca

SEQ ID NO: 721042 - DNA, 20 bp, mouse
gagggtgtttgcttctgttg

SEQ ID NO: 721043 - DNA, 20 bp, mouse
gagcaatgttcaggacgtac

SEQ ID NO: 721044 - DNA, 20 bp, mouse
ggacgtacaggaacattcca

SEQ ID NO: 721045 - DNA, 20 bp, mouse
ggagactgacttgttatttc

SEQ ID NO: 721046 - DNA, 20 bp, mouse
gaggtcatggaaactcgcaa

SEQ ID NO: 721047 - DNA, 20 bp, mouse
gcaagcttcacaggatttat

SEQ ID NO: 721048 - DNA, 20 bp, mouse
gtgcacttggggaaactagt

SEQ ID NO: 721049 - DNA, 20 bp, mouse
gaacgacgacgcctccacgg

SEQ ID NO: 721050 - DNA, 20 bp, mouse
gggagcgaatcatgtcgcag

SEQ ID NO: 721051 - DNA, 20 bp, mouse
ggacgcctccacggaggtca

SEQ ID NO: 721052 - DNA, 20 bp, mouse
gtagaacgacgacgcctcca

SEQ ID NO: 721053 - DNA, 20 bp, mouse
ggcagctgcctctagcgtag

SEQ ID NO: 721054 - DNA, 20 bp, mouse
gcagcggccccttgcggtcg

SEQ ID NO: 721055 - DNA, 20 bp, mouse
gatgtcgcagcggccccttg

SEQ ID NO: 721056 - DNA, 20 bp, mouse
gtgagcccctcccgaatctg

SEQ ID NO: 721057 - DNA, 20 bp, mouse
gtcagcttagggtaggaagg

SEQ ID NO: 721058 - DNA, 20 bp, mouse
gagactgttccctgggtcac

SEQ ID NO: 721059 - DNA, 20 bp, mouse
gaatcagctcctgtgaccca

SEQ ID NO: 721060 - DNA, 20 bp, mouse
gacatctctaagaactgcta

SEQ ID NO: 721061 - DNA, 20 bp, mouse
gagcaggaaggagatagagt

SEQ ID NO: 721062 - DNA, 20 bp, mouse
gaagtctctagatctctccg

SEQ ID NO: 721063 - DNA, 20 bp, mouse
gtagatctctccggggtgga

SEQ ID NO: 721064 - DNA, 20 bp, mouse
ggaaggtggcatggagtgta

SEQ ID NO: 721065 - DNA, 20 bp, mouse
gcagtccccagattcgggag

SEQ ID NO: 721066 - DNA, 20 bp, mouse
gtccccccgcccgctcccag

SEQ ID NO: 721067 - DNA, 20 bp, mouse
gaatcatgcgggtggagata

SEQ ID NO: 721068 - DNA, 20 bp, mouse
gaaacggagcatggggtgtg

SEQ ID NO: 721069 - DNA, 20 bp, mouse
gggtgacaggagaacaaagt

SEQ ID NO: 721070 - DNA, 20 bp, mouse
gggcggggggacggaagccc

SEQ ID NO: 721071 - DNA, 20 bp, mouse
gtgtgtggggaggaatcatg

SEQ ID NO: 721072 - DNA, 20 bp, mouse
ggcgcgcaagggcgttgcga

SEQ ID NO: 721073 - DNA, 20 bp, mouse
gactccaagggcggtagaga

SEQ ID NO: 721074 - DNA, 20 bp, mouse
ggggcgttgcgaaggcagat

SEQ ID NO: 721075 - DNA, 20 bp, mouse
gtgaatgccgcgtcctgtcc

SEQ ID NO: 721076 - DNA, 20 bp, mouse
gataagccattgaccatcaa

SEQ ID NO: 721077 - DNA, 20 bp, mouse
gcactacccttgatggtcaa

SEQ ID NO: 721078 - DNA, 20 bp, mouse
ggtggggagtgtcagtataa

SEQ ID NO: 721079 - DNA, 20 bp, mouse
gcgtgtgaaacagcaccttc

SEQ ID NO: 721080 - DNA, 20 bp, mouse
gcatgaagagccacatgggt

SEQ ID NO: 721081 - DNA, 20 bp, mouse
gcaatcatgaagagccacat

SEQ ID NO: 721082 - DNA, 20 bp, mouse
ggtgggaacaggcatgacat

SEQ ID NO: 721083 - DNA, 20 bp, mouse
gggaagagtttccatgccgg

SEQ ID NO: 721084 - DNA, 20 bp, mouse
gcaactgcaatatgtactta

SEQ ID NO: 721085 - DNA, 20 bp, mouse
gggctttgtgggtttcctgg

SEQ ID NO: 721086 - DNA, 20 bp, mouse
gaactcctctgtgaagaatc

SEQ ID NO: 721087 - DNA, 20 bp, mouse
gtataaaggtgtttaacccc

SEQ ID NO: 721088 - DNA, 20 bp, mouse
gactatctctttttctgctg

SEQ ID NO: 721089 - DNA, 20 bp, mouse
gtatgacacatgtgatatct

SEQ ID NO: 721090 - DNA, 20 bp, mouse
gacatcctgattcttcacag

SEQ ID NO: 721091 - DNA, 20 bp, mouse
gataaatgtttaaaatataa

SEQ ID NO: 721092 - DNA, 20 bp, mouse
gaagacagagaatgtgataa

SEQ ID NO: 721093 - DNA, 20 bp, mouse
gggatgtcagagttgcagtg

SEQ ID NO: 721094 - DNA, 20 bp, mouse
gcccaggatatgtgtcctaa

SEQ ID NO: 721095 - DNA, 20 bp, mouse
gtgctcttaggaaattacag

SEQ ID NO: 721096 - DNA, 20 bp, mouse
gcacccacatactcctgcac

SEQ ID NO: 721097 - DNA, 20 bp, mouse
ggtgacttggcacttcagag

SEQ ID NO: 721098 - DNA, 20 bp, mouse
gacaaaaggacttttaacta

SEQ ID NO: 721099 - DNA, 20 bp, mouse
gtctccatagggcatattct

SEQ ID NO: 721100 - DNA, 20 bp, mouse
gaaacctagaatatgcccta

SEQ ID NO: 721101 - DNA, 20 bp, mouse
gtccttgggaacctacgtgg

SEQ ID NO: 721102 - DNA, 20 bp, mouse
gaagacatggtgtgagtcct

SEQ ID NO: 721103 - DNA, 20 bp, mouse
gtagcaggctgtcattacat

SEQ ID NO: 721104 - DNA, 20 bp, mouse
ggaaaaagactatctccata

SEQ ID NO: 721105 - DNA, 20 bp, mouse
gttcctgtgcaggagtatgt

SEQ ID NO: 721106 - DNA, 20 bp, mouse
gccaaggcaaacagacatac

SEQ ID NO: 721107 - DNA, 20 bp, mouse
gggcaagaagagataagtgg

SEQ ID NO: 721108 - DNA, 20 bp, mouse
gacagggtcatctcctcagt

SEQ ID NO: 721109 - DNA, 20 bp, mouse
gactcccataaaatccctaa

SEQ ID NO: 721110 - DNA, 20 bp, mouse
gtctggggctggtagaagca

SEQ ID NO: 721111 - DNA, 20 bp, mouse
gggggctggtagaagcaggg

SEQ ID NO: 721112 - DNA, 20 bp, mouse
gaaatccctaatggttacta

SEQ ID NO: 721113 - DNA, 20 bp, mouse
gtaggaacaggatgcgctga

SEQ ID NO: 721114 - DNA, 20 bp, mouse
gtaaccattagggattttat

SEQ ID NO: 721115 - DNA, 20 bp, mouse
gggagcctggagacaagcct

SEQ ID NO: 721116 - DNA, 20 bp, mouse
gtagaccaaccccaccttaa

SEQ ID NO: 721117 - DNA, 20 bp, mouse
ggtacccctcccttaaggtg

SEQ ID NO: 721118 - DNA, 20 bp, mouse
gacccatcacacaagaccac

SEQ ID NO: 721119 - DNA, 20 bp, mouse
gtccaaggccctaggactct

SEQ ID NO: 721120 - DNA, 20 bp, mouse
gtggccctgacaggccctcg

SEQ ID NO: 721121 - DNA, 20 bp, mouse
gcccctaaagacagccccga

SEQ ID NO: 721122 - DNA, 20 bp, mouse
gcagccccgagggcctgtca

SEQ ID NO: 721123 - DNA, 20 bp, mouse
gccaaccccaccttaaggga

SEQ ID NO: 721124 - DNA, 20 bp, mouse
gaggaggcacccagagtcct

SEQ ID NO: 721125 - DNA, 20 bp, mouse
gcagaggtacccctccctta

SEQ ID NO: 721126 - DNA, 20 bp, mouse
gcagtctggcccaggtgagc

SEQ ID NO: 721127 - DNA, 20 bp, mouse
gaaggaagaagactcttgtt

SEQ ID NO: 721128 - DNA, 20 bp, mouse
gtgctgaagagggagaaggc

SEQ ID NO: 721129 - DNA, 20 bp, mouse
gtggacctctcataactgat

SEQ ID NO: 721130 - DNA, 20 bp, mouse
gcaggaagatggctggctcc

SEQ ID NO: 721131 - DNA, 20 bp, mouse
gcatagagtaggtggagcag

SEQ ID NO: 721132 - DNA, 20 bp, mouse
gctcctgctgaagagggaga

SEQ ID NO: 721133 - DNA, 20 bp, mouse
gccccacccagtcaacggac

SEQ ID NO: 721134 - DNA, 20 bp, mouse
ggtgttgcccacacttgctg

SEQ ID NO: 721135 - DNA, 20 bp, mouse
gggcaggtgagctcacctat

SEQ ID NO: 721136 - DNA, 20 bp, mouse
gtgggcggaactggaacctg

SEQ ID NO: 721137 - DNA, 20 bp, mouse
gcgggcgagcagctggaagg

SEQ ID NO: 721138 - DNA, 20 bp, mouse
gcagctggaaggcgggacgc

SEQ ID NO: 721139 - DNA, 20 bp, mouse
gtgcctgcctaaaggttctc

SEQ ID NO: 721140 - DNA, 20 bp, mouse
gctgcgcgtgctcaaaactg

SEQ ID NO: 721141 - DNA, 20 bp, mouse
gggtagcggcagacggagtt

SEQ ID NO: 721142 - DNA, 20 bp, mouse
gaccaagagtagtggcgcga

SEQ ID NO: 721143 - DNA, 20 bp, mouse
ggcgtgctcaaaactgaggt

SEQ ID NO: 721144 - DNA, 20 bp, mouse
ggaagtacgggatgcagtca

SEQ ID NO: 721145 - DNA, 20 bp, mouse
gtagtggcgcgatggatcct

SEQ ID NO: 721146 - DNA, 20 bp, mouse
gcgggcgcgggagtcagatc

SEQ ID NO: 721147 - DNA, 20 bp, mouse
gggggccgaaggccacacgg

SEQ ID NO: 721148 - DNA, 20 bp, mouse
ggcgccgccgcgggacaact

SEQ ID NO: 721149 - DNA, 20 bp, mouse
gccactggggacgacagagg

SEQ ID NO: 721150 - DNA, 20 bp, mouse
ggggctcgctgcttgctagg

SEQ ID NO: 721151 - DNA, 20 bp, mouse
gccgccactggggacgacag

SEQ ID NO: 721152 - DNA, 20 bp, mouse
ggagtcagatccggggccga

SEQ ID NO: 721153 - DNA, 20 bp, mouse
gacacccagttgtcccgcgg

SEQ ID NO: 721154 - DNA, 20 bp, mouse
gtgctccgagcccgccactg

SEQ ID NO: 721155 - DNA, 20 bp, mouse
gtggccaatgagcccatcgc

SEQ ID NO: 721156 - DNA, 20 bp, mouse
gaggaaggggacggtgggga

SEQ ID NO: 721157 - DNA, 20 bp, mouse
gcggtggggacggagagcat

SEQ ID NO: 721158 - DNA, 20 bp, mouse
gtgaggtcacgcaagggaga

SEQ ID NO: 721159 - DNA, 20 bp, mouse
ggtaaggcgcttggaggaag

SEQ ID NO: 721160 - DNA, 20 bp, mouse
ggcgcgcggcagtgacgtcg

SEQ ID NO: 721161 - DNA, 20 bp, mouse
gttggaggaaggggacggtg

SEQ ID NO: 721162 - DNA, 20 bp, mouse
gcttgggcagtgtagacatc

SEQ ID NO: 721163 - DNA, 20 bp, mouse
ggctagctgaggtcacgcaa

SEQ ID NO: 721164 - DNA, 20 bp, mouse
ggcttcgtgcatcggccggt

SEQ ID NO: 721165 - DNA, 20 bp, mouse
gcctgtggcggaatgcattc

SEQ ID NO: 721166 - DNA, 20 bp, mouse
gctgcactggggtgagttgg

SEQ ID NO: 721167 - DNA, 20 bp, mouse
ggcttccggagccagtttta

SEQ ID NO: 721168 - DNA, 20 bp, mouse
gatgctgcactggggtgagt

SEQ ID NO: 721169 - DNA, 20 bp, mouse
gatgctctgaagctttcgat

SEQ ID NO: 721170 - DNA, 20 bp, mouse
gccggtagaaaatccccacc

SEQ ID NO: 721171 - DNA, 20 bp, mouse
ggcctagcagaccttatctc

SEQ ID NO: 721172 - DNA, 20 bp, mouse
ggtgcagctctctgctggtg

SEQ ID NO: 721173 - DNA, 20 bp, mouse
gggtgtgagaaccccctcaa

SEQ ID NO: 721174 - DNA, 20 bp, mouse
ggaacatcccaggggtcaca

SEQ ID NO: 721175 - DNA, 20 bp, mouse
gtggctgtattgaacatccc

SEQ ID NO: 721176 - DNA, 20 bp, mouse
gcccgcgcatgactctctaa

SEQ ID NO: 721177 - DNA, 20 bp, mouse
gccccaggcggcttcctcta

SEQ ID NO: 721178 - DNA, 20 bp, mouse
gcggccgcagcagacgaagt

SEQ ID NO: 721179 - DNA, 20 bp, mouse
ggagagaaactgacgaaatg

SEQ ID NO: 721180 - DNA, 20 bp, mouse
ggtcatgcgcgggtcctctt

SEQ ID NO: 721181 - DNA, 20 bp, mouse
ggcagcagacgaagtaggga

SEQ ID NO: 721182 - DNA, 20 bp, mouse
gtcccggcgtccacggaggt

SEQ ID NO: 721183 - DNA, 20 bp, mouse
gggggggggccactggaaac

SEQ ID NO: 721184 - DNA, 20 bp, mouse
gggttcgccccgcccccagg

SEQ ID NO: 721185 - DNA, 20 bp, mouse
ggggacaaccccacactcac

SEQ ID NO: 721186 - DNA, 20 bp, mouse
ggcagcgagttgtgggtgat

SEQ ID NO: 721187 - DNA, 20 bp, mouse
gagagcatatagggtgtcaa

SEQ ID NO: 721188 - DNA, 20 bp, mouse
gcacatgtgtggtcagaaga

SEQ ID NO: 721189 - DNA, 20 bp, mouse
gcaagtgttgagagtttgtt

SEQ ID NO: 721190 - DNA, 20 bp, mouse
gaacacttgcagcgagttgt

SEQ ID NO: 721191 - DNA, 20 bp, mouse
gtatagggtgtcaagggatg

SEQ ID NO: 721192 - DNA, 20 bp, mouse
ggggagtcttaaaaaggatg

SEQ ID NO: 721193 - DNA, 20 bp, mouse
gagcagtgatcatgtggtac

SEQ ID NO: 721194 - DNA, 20 bp, mouse
ggaacctgcttgtcctaatc

SEQ ID NO: 721195 - DNA, 20 bp, mouse
gcacgagaggcaaaggcgga

SEQ ID NO: 721196 - DNA, 20 bp, mouse
ggggcgaaggagccagtcgc

SEQ ID NO: 721197 - DNA, 20 bp, mouse
gaggactatgatttgcgagg

SEQ ID NO: 721198 - DNA, 20 bp, mouse
gagaggctcccgtagcgagg

SEQ ID NO: 721199 - DNA, 20 bp, mouse
gtctgcagtcggacttgcat

SEQ ID NO: 721200 - DNA, 20 bp, mouse
gaaggagccagtcgcaggac

SEQ ID NO: 721201 - DNA, 20 bp, mouse
gggctgaggcaattaagcag

SEQ ID NO: 721202 - DNA, 20 bp, mouse
gcataggactatgatttgcg

SEQ ID NO: 721203 - DNA, 20 bp, mouse
gtcgctacgggagcctctat

SEQ ID NO: 721204 - DNA, 20 bp, mouse
gtctataaagacttgtttga

SEQ ID NO: 721205 - DNA, 20 bp, mouse
gactatgatttgcgaggagg

SEQ ID NO: 721206 - DNA, 20 bp, mouse
gggcggggctaagaggacgt

SEQ ID NO: 721207 - DNA, 20 bp, mouse
gtcgtctcccggcttcctga

SEQ ID NO: 721208 - DNA, 20 bp, mouse
ggcgcgagacacaggtcctg

SEQ ID NO: 721209 - DNA, 20 bp, mouse
gcggactagaccaggaggtg

SEQ ID NO: 721210 - DNA, 20 bp, mouse
gtcgcgcatgcgtcgtctcc

SEQ ID NO: 721211 - DNA, 20 bp, mouse
gtcgcttcgaaacttggggt

SEQ ID NO: 721212 - DNA, 20 bp, mouse
gctccggccctcaggaagcc

SEQ ID NO: 721213 - DNA, 20 bp, mouse
ggtcccaggacattttccga

SEQ ID NO: 721214 - DNA, 20 bp, mouse
ggggacgagtgggatgtttg

SEQ ID NO: 721215 - DNA, 20 bp, mouse
ggcggggcatccgggtccct

SEQ ID NO: 721216 - DNA, 20 bp, mouse
ggggcgagtcgactcaagtc

SEQ ID NO: 721217 - DNA, 20 bp, mouse
gaaaggaaaggccgataagt

SEQ ID NO: 721218 - DNA, 20 bp, mouse
gctcgaaattccaggagaaa

SEQ ID NO: 721219 - DNA, 20 bp, mouse
gtggttcagcccagttgcca

SEQ ID NO: 721220 - DNA, 20 bp, mouse
ggtaggctaaggtgagcgaa

SEQ ID NO: 721221 - DNA, 20 bp, mouse
gggtgcccgcgccagcagct

SEQ ID NO: 721222 - DNA, 20 bp, mouse
ggataagtcggaagtgacct

SEQ ID NO: 721223 - DNA, 20 bp, mouse
gccggtgagtagtgaagaga

SEQ ID NO: 721224 - DNA, 20 bp, mouse
ggctgctgatgggaagggtc

SEQ ID NO: 721225 - DNA, 20 bp, mouse
ggccggctggaggcggaaac

SEQ ID NO: 721226 - DNA, 20 bp, mouse
gcggaagtgggcgcgcagga

SEQ ID NO: 721227 - DNA, 20 bp, mouse
gcctaccgtggagcggaagt

SEQ ID NO: 721228 - DNA, 20 bp, mouse
gggccccgcctaccgtggag

SEQ ID NO: 721229 - DNA, 20 bp, mouse
gggacagaataggcgagtgt

SEQ ID NO: 721230 - DNA, 20 bp, mouse
ggcggggcccccgggaaact

SEQ ID NO: 721231 - DNA, 20 bp, mouse
gaagtgggcgcgcaggaggg

SEQ ID NO: 721232 - DNA, 20 bp, mouse
gggtctgggcctaagaggtg

SEQ ID NO: 721233 - DNA, 20 bp, mouse
ggaaactaggaagtggtgcc

SEQ ID NO: 721234 - DNA, 20 bp, mouse
gggtggggctgaagtggtaa

SEQ ID NO: 721235 - DNA, 20 bp, mouse
gccacggtaggcggggcccc

SEQ ID NO: 721236 - DNA, 20 bp, mouse
ggaaaactcgtgcgatgggc

SEQ ID NO: 721237 - DNA, 20 bp, mouse
gcgtgtgagaggctctaagg

SEQ ID NO: 721238 - DNA, 20 bp, mouse
gaggaaccagtgtagagcac

SEQ ID NO: 721239 - DNA, 20 bp, mouse
ggatggaaaactcgtgcgat

SEQ ID NO: 721240 - DNA, 20 bp, mouse
gtcgcgagagcaccacgtct

SEQ ID NO: 721241 - DNA, 20 bp, mouse
gcggaggtctgatgcaaaac

SEQ ID NO: 721242 - DNA, 20 bp, mouse
ggcatcccggtgctctacac

SEQ ID NO: 721243 - DNA, 20 bp, mouse
gctacagtaccaacccagcc

SEQ ID NO: 721244 - DNA, 20 bp, mouse
gccgtcccgcgccctgagaa

SEQ ID NO: 721245 - DNA, 20 bp, mouse
gggagagttccctcgtacgt

SEQ ID NO: 721246 - DNA, 20 bp, mouse
gaagctcaggatagggtcgg

SEQ ID NO: 721247 - DNA, 20 bp, mouse
gggacccgaaacagaggtta

SEQ ID NO: 721248 - DNA, 20 bp, mouse
gtcaagggaggcactaactc

SEQ ID NO: 721249 - DNA, 20 bp, mouse
gactccggaaagctcaggat

SEQ ID NO: 721250 - DNA, 20 bp, mouse
gggtgggggacccgaaacag

SEQ ID NO: 721251 - DNA, 20 bp, mouse
gccgccctaacctctgtttc

SEQ ID NO: 721252 - DNA, 20 bp, mouse
gagaggttagggcggcgcat

SEQ ID NO: 721253 - DNA, 20 bp, mouse
gccttgaggcaaggacactc

SEQ ID NO: 721254 - DNA, 20 bp, mouse
ggaagcctacaactgctggt

SEQ ID NO: 721255 - DNA, 20 bp, mouse
ggccacggaaactgagttcc

SEQ ID NO: 721256 - DNA, 20 bp, mouse
ggggaatcccgaaggcgcgc

SEQ ID NO: 721257 - DNA, 20 bp, mouse
ggcgcagcaggcgtggggag

SEQ ID NO: 721258 - DNA, 20 bp, mouse
ggcgccttcgggattcccgt

SEQ ID NO: 721259 - DNA, 20 bp, mouse
gcctgctgcgcgcgcccggt

SEQ ID NO: 721260 - DNA, 20 bp, mouse
ggaggatgtgtgcttggcga

SEQ ID NO: 721261 - DNA, 20 bp, mouse
ggggcgcgcgcagcaggcgt

SEQ ID NO: 721262 - DNA, 20 bp, mouse
gtgaaaccgagcgatgtgag

SEQ ID NO: 721263 - DNA, 20 bp, mouse
gtgcttggcgagggattgtt

SEQ ID NO: 721264 - DNA, 20 bp, mouse
gtgcgcatgcgcggcccgct

SEQ ID NO: 721265 - DNA, 20 bp, mouse
gtccaggcctgcgcgccttc

SEQ ID NO: 721266 - DNA, 20 bp, mouse
ggagaggcgaagctgcctgt

SEQ ID NO: 721267 - DNA, 20 bp, mouse
gtggccagccactgggtgag

SEQ ID NO: 721268 - DNA, 20 bp, mouse
ggctcccgaaggccaggtct

SEQ ID NO: 721269 - DNA, 20 bp, mouse
gcataaacatagctgcccag

SEQ ID NO: 721270 - DNA, 20 bp, mouse
gggacagcacattatcactg

SEQ ID NO: 721271 - DNA, 20 bp, mouse
gcatagggaagtcttgcttt

SEQ ID NO: 721272 - DNA, 20 bp, mouse
gccacctgggcagtgactgc

SEQ ID NO: 721273 - DNA, 20 bp, mouse
gataatgtgctgtccccacc

SEQ ID NO: 721274 - DNA, 20 bp, mouse
gggctggaagtcctacccgg

SEQ ID NO: 721275 - DNA, 20 bp, mouse
gcgataaccacagttcccac

SEQ ID NO: 721276 - DNA, 20 bp, mouse
ggggccagaaggttctgtgg

SEQ ID NO: 721277 - DNA, 20 bp, mouse
gccccaggcgccgacgtaga

SEQ ID NO: 721278 - DNA, 20 bp, mouse
gcgaacccactgggcggagc

SEQ ID NO: 721279 - DNA, 20 bp, mouse
gtgcaaacgaacccactggg

SEQ ID NO: 721280 - DNA, 20 bp, mouse
ggcggagcttccctgacctg

SEQ ID NO: 721281 - DNA, 20 bp, mouse
ggaagctccgccctctacgt

SEQ ID NO: 721282 - DNA, 20 bp, mouse
gggtggaggccctcctcctc

SEQ ID NO: 721283 - DNA, 20 bp, mouse
gctcctccggctccgcccag

SEQ ID NO: 721284 - DNA, 20 bp, mouse
gcccgagctcgggaacggtg

SEQ ID NO: 721285 - DNA, 20 bp, mouse
gaaggggcggggctagaccg

SEQ ID NO: 721286 - DNA, 20 bp, mouse
gcgggcggggtcacgaaagc

SEQ ID NO: 721287 - DNA, 20 bp, mouse
ggggcgcccgcggctcgctc

SEQ ID NO: 721288 - DNA, 20 bp, mouse
gcggcccacaaggcccagga

SEQ ID NO: 721289 - DNA, 20 bp, mouse
gaggcgaaggctttgcggaa

SEQ ID NO: 721290 - DNA, 20 bp, mouse
gccggctgggagctttaaag

SEQ ID NO: 721291 - DNA, 20 bp, mouse
gcgcgtgcgccggtgctagt

SEQ ID NO: 721292 - DNA, 20 bp, mouse
gggctcgctctggaaacgtt

SEQ ID NO: 721293 - DNA, 20 bp, mouse
gcctgggagcacgtgaatat

SEQ ID NO: 721294 - DNA, 20 bp, mouse
gaggcgggccgaagcggcag

SEQ ID NO: 721295 - DNA, 20 bp, mouse
gccggtgctagtgggcgtga

SEQ ID NO: 721296 - DNA, 20 bp, mouse
ggcaacggagcacatcgcct

SEQ ID NO: 721297 - DNA, 20 bp, mouse
ggcgaggcggggcacgatcg

SEQ ID NO: 721298 - DNA, 20 bp, mouse
gcgccccttcgctctccgga

SEQ ID NO: 721299 - DNA, 20 bp, mouse
gggagcgcgggcgggaagag

SEQ ID NO: 721300 - DNA, 20 bp, mouse
gcccacggcggccgcggaga

SEQ ID NO: 721301 - DNA, 20 bp, mouse
gcgggaagaggggagcgccc

SEQ ID NO: 721302 - DNA, 20 bp, mouse
gtctccctccggagagcgaa

SEQ ID NO: 721303 - DNA, 20 bp, mouse
ggggcacgatcggggcgcac

SEQ ID NO: 721304 - DNA, 20 bp, mouse
gcgggcgccccttcgctctc

SEQ ID NO: 721305 - DNA, 20 bp, mouse
gaagaggggagcgcccgggc

SEQ ID NO: 721306 - DNA, 20 bp, mouse
gaacacggcccgcacggcgg

SEQ ID NO: 721307 - DNA, 20 bp, mouse
gtggaacggcaactcggcag

SEQ ID NO: 721308 - DNA, 20 bp, mouse
gactcggcaggggcggaaca

SEQ ID NO: 721309 - DNA, 20 bp, mouse
gccgagttgccgttccacat

SEQ ID NO: 721310 - DNA, 20 bp, mouse
ggcgctggagcccacgtgac

SEQ ID NO: 721311 - DNA, 20 bp, mouse
gaacggcaactcggcagggg

SEQ ID NO: 721312 - DNA, 20 bp, mouse
gcggaacacggcccgcacgg

SEQ ID NO: 721313 - DNA, 20 bp, mouse
ggggcggaacacggcccgca

SEQ ID NO: 721314 - DNA, 20 bp, mouse
gaggggttgtggtcttgaga

SEQ ID NO: 721315 - DNA, 20 bp, mouse
gttgctcgaaaggcggggtt

SEQ ID NO: 721316 - DNA, 20 bp, mouse
gagccgcgctgcctggagga

SEQ ID NO: 721317 - DNA, 20 bp, mouse
ggctgcctggaggacggcgt

SEQ ID NO: 721318 - DNA, 20 bp, mouse
ggccacgccccgcatcccgc

SEQ ID NO: 721319 - DNA, 20 bp, mouse
ggcccggggcggagccttgt

SEQ ID NO: 721320 - DNA, 20 bp, mouse
ggtggcgggcaagccttggt

SEQ ID NO: 721321 - DNA, 20 bp, mouse
gcagcggcgagcgagtgtca

SEQ ID NO: 721322 - DNA, 20 bp, mouse
gctacctgggcgctgggcga

SEQ ID NO: 721323 - DNA, 20 bp, mouse
gtgggagattgggtttacca

SEQ ID NO: 721324 - DNA, 20 bp, mouse
gctcccagagccagtcagag

SEQ ID NO: 721325 - DNA, 20 bp, mouse
gggcgagcgagtgtcagggc

SEQ ID NO: 721326 - DNA, 20 bp, mouse
ggggccaaatccacttccta

SEQ ID NO: 721327 - DNA, 20 bp, mouse
gcgccccgtgcgggccccct

SEQ ID NO: 721328 - DNA, 20 bp, mouse
gagcgccgcgcgccccgtgc

SEQ ID NO: 721329 - DNA, 20 bp, mouse
ggccccctaggaagtggatt

SEQ ID NO: 721330 - DNA, 20 bp, mouse
gccaagcggggcggccctaa

SEQ ID NO: 721331 - DNA, 20 bp, mouse
ggccgggccgggagaaaacc

SEQ ID NO: 721332 - DNA, 20 bp, mouse
gggcggccctaagggaggga

SEQ ID NO: 721333 - DNA, 20 bp, mouse
gggggcgagcccgagacagg

SEQ ID NO: 721334 - DNA, 20 bp, mouse
gagcagggcgtgtcgcaaga

SEQ ID NO: 721335 - DNA, 20 bp, mouse
gagacaggcgggagcacgca

SEQ ID NO: 721336 - DNA, 20 bp, mouse
gcgcccaagcccagatcctg

SEQ ID NO: 721337 - DNA, 20 bp, mouse
ggctgtgctccgcaggatct

SEQ ID NO: 721338 - DNA, 20 bp, mouse
gcggagccggcggactgctg

SEQ ID NO: 721339 - DNA, 20 bp, mouse
gctccgcaggatctgggctt

SEQ ID NO: 721340 - DNA, 20 bp, mouse
ggcggagcacagcaagcgcc

SEQ ID NO: 721341 - DNA, 20 bp, mouse
gctttccgaaatcaacccgg

SEQ ID NO: 721342 - DNA, 20 bp, mouse
gaggggcgtggcctgttcgc

SEQ ID NO: 721343 - DNA, 20 bp, mouse
ggggttggcgaaccgggctc

SEQ ID NO: 721344 - DNA, 20 bp, mouse
gtcttcctccgggttgattt

SEQ ID NO: 721345 - DNA, 20 bp, mouse
gaacgaaagtatgtataaag

SEQ ID NO: 721346 - DNA, 20 bp, mouse
gggaacatctcggaagtgtg

SEQ ID NO: 721347 - DNA, 20 bp, mouse
gcgcgagccactaggcagga

SEQ ID NO: 721348 - DNA, 20 bp, mouse
gggatcgcgagccactaggc

SEQ ID NO: 721349 - DNA, 20 bp, mouse
gcagagtcggccgcaaaacc

SEQ ID NO: 721350 - DNA, 20 bp, mouse
ggtgcacagccgaaattcag

SEQ ID NO: 721351 - DNA, 20 bp, mouse
gacacaggaggcaagaggga

SEQ ID NO: 721352 - DNA, 20 bp, mouse
gcgatccattccaggttttg

SEQ ID NO: 721353 - DNA, 20 bp, mouse
ggggccaaagccacctctct

SEQ ID NO: 721354 - DNA, 20 bp, mouse
ggggaaagattaccagcaaa

SEQ ID NO: 721355 - DNA, 20 bp, mouse
gatcaggaaagggaacatct

SEQ ID NO: 721356 - DNA, 20 bp, mouse
ggggctgcgtgttcctggaa

SEQ ID NO: 721357 - DNA, 20 bp, mouse
ggggcggggtcgaagggcgg

SEQ ID NO: 721358 - DNA, 20 bp, mouse
ggggtcagctgaggtactga

SEQ ID NO: 721359 - DNA, 20 bp, mouse
ggggctggcagtttagtcta

SEQ ID NO: 721360 - DNA, 20 bp, mouse
gcccgcggggcggggtcgaa

SEQ ID NO: 721361 - DNA, 20 bp, mouse
gtccggtcctggccaatcgg

SEQ ID NO: 721362 - DNA, 20 bp, mouse
gttgagaggcggctgtaact

SEQ ID NO: 721363 - DNA, 20 bp, mouse
gcagctgaccccagccagat

SEQ ID NO: 721364 - DNA, 20 bp, mouse
ggattggccaggaccggacc

SEQ ID NO: 721365 - DNA, 20 bp, mouse
gcagatgggctaaggctgtc

SEQ ID NO: 721366 - DNA, 20 bp, mouse
gctgcagaaagggtagtaaa

SEQ ID NO: 721367 - DNA, 20 bp, mouse
gcgcccctgaggtggcccag

SEQ ID NO: 721368 - DNA, 20 bp, mouse
gtgtcagctgggaactcgag

SEQ ID NO: 721369 - DNA, 20 bp, mouse
gactgaaggcatagctgggg

SEQ ID NO: 721370 - DNA, 20 bp, mouse
gggaactcgagaggaaaagc

SEQ ID NO: 721371 - DNA, 20 bp, mouse
ggccaaacgagggaagaagc

SEQ ID NO: 721372 - DNA, 20 bp, mouse
gtacgtattggtattgagtc

SEQ ID NO: 721373 - DNA, 20 bp, mouse
gtggctgcacccacgtgtgg

SEQ ID NO: 721374 - DNA, 20 bp, mouse
gtaggtggagaactaagccg

SEQ ID NO: 721375 - DNA, 20 bp, mouse
gccagcctctgggccacctc

SEQ ID NO: 721376 - DNA, 20 bp, mouse
gggcccgcctggaactgaaa

SEQ ID NO: 721377 - DNA, 20 bp, mouse
gggcgtgcgcagtggttcct

SEQ ID NO: 721378 - DNA, 20 bp, mouse
gaggggtggggcgacaccgg

SEQ ID NO: 721379 - DNA, 20 bp, mouse
gcacgcctggtccgggtggg

SEQ ID NO: 721380 - DNA, 20 bp, mouse
ggcgcacgcctggtccgggt

SEQ ID NO: 721381 - DNA, 20 bp, mouse
gccggaccaggcgtgcgcag

SEQ ID NO: 721382 - DNA, 20 bp, mouse
gccagtctgcgcaataacat

SEQ ID NO: 721383 - DNA, 20 bp, mouse
ggggtggccgggtcagcctc

SEQ ID NO: 721384 - DNA, 20 bp, mouse
gtgaaagggagcccgcaggg

SEQ ID NO: 721385 - DNA, 20 bp, mouse
gggccaccgccaccctgcct

SEQ ID NO: 721386 - DNA, 20 bp, mouse
gtgcgcctccgcctccccgg

SEQ ID NO: 721387 - DNA, 20 bp, mouse
gcggcccgggcgactctgcc

SEQ ID NO: 721388 - DNA, 20 bp, mouse
gaagtgcagccggtgggaaa

SEQ ID NO: 721389 - DNA, 20 bp, mouse
gtctgcccggcagggaaatg

SEQ ID NO: 721390 - DNA, 20 bp, mouse
gtggccgggaggggcgtcgg

SEQ ID NO: 721391 - DNA, 20 bp, mouse
gaaggcggtggctgagttgc

SEQ ID NO: 721392 - DNA, 20 bp, mouse
gtgcagccggtgggaaaggg

SEQ ID NO: 721393 - DNA, 20 bp, mouse
ggggcaggatcgataacctc

SEQ ID NO: 721394 - DNA, 20 bp, mouse
gggaggcggaggcgcacgag

SEQ ID NO: 721395 - DNA, 20 bp, mouse
gctgggtctcgcagggacgt

SEQ ID NO: 721396 - DNA, 20 bp, mouse
gtgaaaatcagcagtcacac

SEQ ID NO: 721397 - DNA, 20 bp, mouse
gacagtgaaaacgaccctgc

SEQ ID NO: 721398 - DNA, 20 bp, mouse
gctgctggatgtgtatttta

SEQ ID NO: 721399 - DNA, 20 bp, mouse
gaaggaggcgctgtgccaag

SEQ ID NO: 721400 - DNA, 20 bp, mouse
gcacaagctaaaacaggcaa

SEQ ID NO: 721401 - DNA, 20 bp, mouse
ggtaagctatagttttccta

SEQ ID NO: 721402 - DNA, 20 bp, mouse
gagagctgacccctgggtag

SEQ ID NO: 721403 - DNA, 20 bp, mouse
gtctggccagcctcccttta

SEQ ID NO: 721404 - DNA, 20 bp, mouse
gcttcccaagcctactcact

SEQ ID NO: 721405 - DNA, 20 bp, mouse
gaggcttgggaagtctataa

SEQ ID NO: 721406 - DNA, 20 bp, mouse
gctagacagcctaaagagaa

SEQ ID NO: 721407 - DNA, 20 bp, mouse
gtccaggtgggactgtgcgg

SEQ ID NO: 721408 - DNA, 20 bp, mouse
gcagaccctgatctccaggt

SEQ ID NO: 721409 - DNA, 20 bp, mouse
gtctagtgctgaatactaga

SEQ ID NO: 721410 - DNA, 20 bp, mouse
ggctgcccacaggtcacact

SEQ ID NO: 721411 - DNA, 20 bp, mouse
ggggactgtgcggaggcttc

SEQ ID NO: 721412 - DNA, 20 bp, mouse
ggtggcccagtgtgacctgt

SEQ ID NO: 721413 - DNA, 20 bp, mouse
ggggcctgaaatctgatatc

SEQ ID NO: 721414 - DNA, 20 bp, mouse
gctgaatactagagggagtg

SEQ ID NO: 721415 - DNA, 20 bp, mouse
gatctccaggtgggactgtg

SEQ ID NO: 721416 - DNA, 20 bp, mouse
ggtgggggtgacataatccc

SEQ ID NO: 721417 - DNA, 20 bp, mouse
gagactggcttcatactccg

SEQ ID NO: 721418 - DNA, 20 bp, mouse
gaagagaggcagatccttac

SEQ ID NO: 721419 - DNA, 20 bp, mouse
gacagaaagttgccttggtg

SEQ ID NO: 721420 - DNA, 20 bp, mouse
ggcaggccatggttactatg

SEQ ID NO: 721421 - DNA, 20 bp, mouse
gtacctctgactgtctcccc

SEQ ID NO: 721422 - DNA, 20 bp, mouse
gccttgaagtgaatcagttt

SEQ ID NO: 721423 - DNA, 20 bp, mouse
gcagtggcttactgtctcaa

SEQ ID NO: 721424 - DNA, 20 bp, mouse
gtcttgagaagaagcgccca

SEQ ID NO: 721425 - DNA, 20 bp, mouse
gacttgccagaagctgccag

SEQ ID NO: 721426 - DNA, 20 bp, mouse
gcggtggcctgcgtggggtg

SEQ ID NO: 721427 - DNA, 20 bp, mouse
ggcgaggcgagcgggaagga

SEQ ID NO: 721428 - DNA, 20 bp, mouse
ggagcgcgcgggtccgcgga

SEQ ID NO: 721429 - DNA, 20 bp, mouse
ggcaactcgtggagagtgag

SEQ ID NO: 721430 - DNA, 20 bp, mouse
ggccgggaggaagcgatccc

SEQ ID NO: 721431 - DNA, 20 bp, mouse
gcaaggccggcgagacccag

SEQ ID NO: 721432 - DNA, 20 bp, mouse
ggaccccgagtccggccggg

SEQ ID NO: 721433 - DNA, 20 bp, mouse
ggcgcccggtggcctgcgtg

SEQ ID NO: 721434 - DNA, 20 bp, mouse
ggagcgcgaggcgagcggga

SEQ ID NO: 721435 - DNA, 20 bp, mouse
gcccggggtgggagtagcgg

SEQ ID NO: 721436 - DNA, 20 bp, mouse
gtgttcggaagtgacttgaa

SEQ ID NO: 721437 - DNA, 20 bp, mouse
gcctctctgtaacacaagtg

SEQ ID NO: 721438 - DNA, 20 bp, mouse
gccggcagctgtagatctgg

SEQ ID NO: 721439 - DNA, 20 bp, mouse
gcaaggtcgcctagcggacg

SEQ ID NO: 721440 - DNA, 20 bp, mouse
gtccgaacagaagccagcca

SEQ ID NO: 721441 - DNA, 20 bp, mouse
gttgccggcagctgtagatc

SEQ ID NO: 721442 - DNA, 20 bp, mouse
gagccaaggttcatcgcaag

SEQ ID NO: 721443 - DNA, 20 bp, mouse
gaccttggctggcttctgtt

SEQ ID NO: 721444 - DNA, 20 bp, mouse
gtagcggacgcggaggacag

SEQ ID NO: 721445 - DNA, 20 bp, mouse
gtgccggcaaggtcgcctag

SEQ ID NO: 721446 - DNA, 20 bp, mouse
gtggagggaaatgatgtccc

SEQ ID NO: 721447 - DNA, 20 bp, mouse
gagaacctccggggatagag

SEQ ID NO: 721448 - DNA, 20 bp, mouse
gcaggtgaccaggacaccca

SEQ ID NO: 721449 - DNA, 20 bp, mouse
gggacataggacattcctgg

SEQ ID NO: 721450 - DNA, 20 bp, mouse
gagctggtggggactacaaa

SEQ ID NO: 721451 - DNA, 20 bp, mouse
gctccccagaggtttgagat

SEQ ID NO: 721452 - DNA, 20 bp, mouse
gcctggaggtgtaaagagcc

SEQ ID NO: 721453 - DNA, 20 bp, mouse
gctatccccggaggttctgg

SEQ ID NO: 721454 - DNA, 20 bp, mouse
gctggcctggtgcctgtagc

SEQ ID NO: 721455 - DNA, 20 bp, mouse
gtaaacaatgggtctcgcat

SEQ ID NO: 721456 - DNA, 20 bp, mouse
gccgtgggaaacaggaatca

SEQ ID NO: 721457 - DNA, 20 bp, mouse
gaaactctttgaaacgtcat

SEQ ID NO: 721458 - DNA, 20 bp, mouse
gtgggaaatgtagttctcag

SEQ ID NO: 721459 - DNA, 20 bp, mouse
gacaagtgccttgtagccgt

SEQ ID NO: 721460 - DNA, 20 bp, mouse
gccgctgtggaagattgatt

SEQ ID NO: 721461 - DNA, 20 bp, mouse
gtgcctgaggatgtcgggaa

SEQ ID NO: 721462 - DNA, 20 bp, mouse
gacgtgccatacggcatcct

SEQ ID NO: 721463 - DNA, 20 bp, mouse
ggtcataggaacgtgccata

SEQ ID NO: 721464 - DNA, 20 bp, mouse
gctcagtggtatagccgctg

SEQ ID NO: 721465 - DNA, 20 bp, mouse
gccttgtagccgtgggaaac

SEQ ID NO: 721466 - DNA, 20 bp, mouse
gacaaactgtccacctggga

SEQ ID NO: 721467 - DNA, 20 bp, mouse
ggggagagaaagcaatctgc

SEQ ID NO: 721468 - DNA, 20 bp, mouse
ggcgtgttgaggggaaatct

SEQ ID NO: 721469 - DNA, 20 bp, mouse
ggtggacagcaaggtagtat

SEQ ID NO: 721470 - DNA, 20 bp, mouse
gtgctgggatctaaaagcct

SEQ ID NO: 721471 - DNA, 20 bp, mouse
ggcaaacaaactgtccacct

SEQ ID NO: 721472 - DNA, 20 bp, mouse
gcgatccccgtcgacttcat

SEQ ID NO: 721473 - DNA, 20 bp, mouse
gactggcataggtaagtgtc

SEQ ID NO: 721474 - DNA, 20 bp, mouse
gcactcctggccatctactc

SEQ ID NO: 721475 - DNA, 20 bp, mouse
gtgagccaattgcgtgttga

SEQ ID NO: 721476 - DNA, 20 bp, mouse
gcggaattggcagcttttgt

SEQ ID NO: 721477 - DNA, 20 bp, mouse
gccgagtgggaattttgtga

SEQ ID NO: 721478 - DNA, 20 bp, mouse
gcacttggtgaggaggtaaa

SEQ ID NO: 721479 - DNA, 20 bp, mouse
gtctgaaagacgtgaaataa

SEQ ID NO: 721480 - DNA, 20 bp, mouse
gagtggcgtaggacctttac

SEQ ID NO: 721481 - DNA, 20 bp, mouse
gttcacgtctttcagaatca

SEQ ID NO: 721482 - DNA, 20 bp, mouse
gaaagctgccaattccgagt

SEQ ID NO: 721483 - DNA, 20 bp, mouse
gaacgaaaggattctggata

SEQ ID NO: 721484 - DNA, 20 bp, mouse
gaagggtgattattggagaa

SEQ ID NO: 721485 - DNA, 20 bp, mouse
gtgatttaaaggtgccaagg

SEQ ID NO: 721486 - DNA, 20 bp, mouse
gggaggaaaaggagcttggt

SEQ ID NO: 721487 - DNA, 20 bp, mouse
gaatagacttgtgacatcag

SEQ ID NO: 721488 - DNA, 20 bp, mouse
gcccactcccagtgcacccc

SEQ ID NO: 721489 - DNA, 20 bp, mouse
gggagcttcccggggtgcac

SEQ ID NO: 721490 - DNA, 20 bp, mouse
gggagagcaggagcttcccg

SEQ ID NO: 721491 - DNA, 20 bp, mouse
gtcccggggtgcactgggag

SEQ ID NO: 721492 - DNA, 20 bp, mouse
ggaccaagtcacgtggtggg

SEQ ID NO: 721493 - DNA, 20 bp, mouse
gtctgaccaagtcacgtggt

SEQ ID NO: 721494 - DNA, 20 bp, mouse
gcccctcccaccacgtgact

SEQ ID NO: 721495 - DNA, 20 bp, mouse
gatcagaggaagggatgtgg

SEQ ID NO: 721496 - DNA, 20 bp, mouse
gcacaagtgaggggtagtgt

SEQ ID NO: 721497 - DNA, 20 bp, mouse
gccactgcagtaggttcgag

SEQ ID NO: 721498 - DNA, 20 bp, mouse
ggtagtgtagggaaccagga

SEQ ID NO: 721499 - DNA, 20 bp, mouse
ggcagtaggttcgagcggtt

SEQ ID NO: 721500 - DNA, 20 bp, mouse
gcagatgccaaaagccggtc

SEQ ID NO: 721501 - DNA, 20 bp, mouse
gggaaccaggaagggttgac

SEQ ID NO: 721502 - DNA, 20 bp, mouse
ggtcaggcacccactgcagt

SEQ ID NO: 721503 - DNA, 20 bp, mouse
gccgccgggcgatccctgag

SEQ ID NO: 721504 - DNA, 20 bp, mouse
gaccctaaactcagagaggc

SEQ ID NO: 721505 - DNA, 20 bp, mouse
gaggggtagtgtagggaacc

SEQ ID NO: 721506 - DNA, 20 bp, mouse
gtctaccctctgcctagaga

SEQ ID NO: 721507 - DNA, 20 bp, mouse
gcagagggtagacgtggtaa

SEQ ID NO: 721508 - DNA, 20 bp, mouse
gcctctgcctagagacggat

SEQ ID NO: 721509 - DNA, 20 bp, mouse
gtctaggcagagggtagacg

SEQ ID NO: 721510 - DNA, 20 bp, mouse
gcctggggaaatcttaaaac

SEQ ID NO: 721511 - DNA, 20 bp, mouse
ggctctctggatcaattctc

SEQ ID NO: 721512 - DNA, 20 bp, mouse
gctcgcaccgatccgtctct

SEQ ID NO: 721513 - DNA, 20 bp, mouse
gacggccacggcataggctg

SEQ ID NO: 721514 - DNA, 20 bp, mouse
gctaaggcagatctccatgc

SEQ ID NO: 721515 - DNA, 20 bp, mouse
gacccacacggccacggcat

SEQ ID NO: 721516 - DNA, 20 bp, mouse
gcgtgccgtgctcagagagg

SEQ ID NO: 721517 - DNA, 20 bp, mouse
gccggaggcccaaccgataa

SEQ ID NO: 721518 - DNA, 20 bp, mouse
ggtgctgaacgagcgatctg

SEQ ID NO: 721519 - DNA, 20 bp, mouse
gcaccggtgctgcggcccgg

SEQ ID NO: 721520 - DNA, 20 bp, mouse
gcgttccggggaatgtgcgt

SEQ ID NO: 721521 - DNA, 20 bp, mouse
gctgtcgcgcgaaggctgaa

SEQ ID NO: 721522 - DNA, 20 bp, mouse
gagactacggagcgtcccca

SEQ ID NO: 721523 - DNA, 20 bp, mouse
gagggtctagaatactgagg

SEQ ID NO: 721524 - DNA, 20 bp, mouse
gccgagagccgttatcggtt

SEQ ID NO: 721525 - DNA, 20 bp, mouse
gtggccgccggatggtgcgg

SEQ ID NO: 721526 - DNA, 20 bp, mouse
gagcacgagttgttaagcga

SEQ ID NO: 721527 - DNA, 20 bp, mouse
gccaaacgaaacctggtcgt

SEQ ID NO: 721528 - DNA, 20 bp, mouse
gctcatgagtcacttgcccc

SEQ ID NO: 721529 - DNA, 20 bp, mouse
gaaggggggaggagcaaatg

SEQ ID NO: 721530 - DNA, 20 bp, mouse
gttctgggggaagagaacgc

SEQ ID NO: 721531 - DNA, 20 bp, mouse
gagtcaataaatagatgcca

SEQ ID NO: 721532 - DNA, 20 bp, mouse
gtggtcgttggtggactttg

SEQ ID NO: 721533 - DNA, 20 bp, mouse
gttgttaagcgatggaattt

SEQ ID NO: 721534 - DNA, 20 bp, mouse
gtcctctgcttgaagcccgt

SEQ ID NO: 721535 - DNA, 20 bp, mouse
gccatctttcctagcttaaa

SEQ ID NO: 721536 - DNA, 20 bp, mouse
gctctcttagtaagcaaggg

SEQ ID NO: 721537 - DNA, 20 bp, mouse
ggcggctgtgacatgtcccc

SEQ ID NO: 721538 - DNA, 20 bp, mouse
gtcttctaactcaactgccc

SEQ ID NO: 721539 - DNA, 20 bp, mouse
gttcctctcttagtaagcaa

SEQ ID NO: 721540 - DNA, 20 bp, mouse
gcatcatttgagtaggtagt

SEQ ID NO: 721541 - DNA, 20 bp, mouse
gaatacttcttcctctactc

SEQ ID NO: 721542 - DNA, 20 bp, mouse
ggctaaactagccccaccag

SEQ ID NO: 721543 - DNA, 20 bp, mouse
gaatatgatgtcagcgtatc

SEQ ID NO: 721544 - DNA, 20 bp, mouse
gagttaggtgacagtatccc

SEQ ID NO: 721545 - DNA, 20 bp, mouse
gcagtgtaactagaatgcag

SEQ ID NO: 721546 - DNA, 20 bp, mouse
gagtgcctgcagttggatgc

SEQ ID NO: 721547 - DNA, 20 bp, mouse
gcagggtgacagaatctgtg

SEQ ID NO: 721548 - DNA, 20 bp, mouse
ggccaccagcctagctcctc

SEQ ID NO: 721549 - DNA, 20 bp, mouse
ggcacgaggcccgaacccag

SEQ ID NO: 721550 - DNA, 20 bp, mouse
gggggggcgcctcaaggtga

SEQ ID NO: 721551 - DNA, 20 bp, mouse
gcctgcgctggtgacgcacg

SEQ ID NO: 721552 - DNA, 20 bp, mouse
gatccaggggctaggcgcta

SEQ ID NO: 721553 - DNA, 20 bp, mouse
gaagctctgagctgtggcgg

SEQ ID NO: 721554 - DNA, 20 bp, mouse
ggagggaggatgactcgcga

SEQ ID NO: 721555 - DNA, 20 bp, mouse
ggaccctgtctaaaatccag

SEQ ID NO: 721556 - DNA, 20 bp, mouse
gggacctgagcggaccacct

SEQ ID NO: 721557 - DNA, 20 bp, mouse
ggccgggcttggggattgag

SEQ ID NO: 721558 - DNA, 20 bp, mouse
ggccggaagtccgtcctggg

SEQ ID NO: 721559 - DNA, 20 bp, mouse
gggtcacgcagggacctgag

SEQ ID NO: 721560 - DNA, 20 bp, mouse
gtgtccgccactgaccctgg

SEQ ID NO: 721561 - DNA, 20 bp, mouse
gaacgcttcagggtcctcac

SEQ ID NO: 721562 - DNA, 20 bp, mouse
gtcaaagtgcgtcgtcccgg

SEQ ID NO: 721563 - DNA, 20 bp, mouse
gactgaccctggcggatgat

SEQ ID NO: 721564 - DNA, 20 bp, mouse
gcaattgaagagtgccgagg

SEQ ID NO: 721565 - DNA, 20 bp, mouse
gttccggcaaagcccctgtg

SEQ ID NO: 721566 - DNA, 20 bp, mouse
ggtcagaaggcctcccaaat

SEQ ID NO: 721567 - DNA, 20 bp, mouse
gttggagagtatgaaagccg

SEQ ID NO: 721568 - DNA, 20 bp, mouse
gatgaaagccggggctgaaa

SEQ ID NO: 721569 - DNA, 20 bp, mouse
gccgctttaagggacggata

SEQ ID NO: 721570 - DNA, 20 bp, mouse
ggtatcggggaagtgagggg

SEQ ID NO: 721571 - DNA, 20 bp, mouse
gaggccttatcaggcgtcag

SEQ ID NO: 721572 - DNA, 20 bp, mouse
ggacgattcaccaatgatcc

SEQ ID NO: 721573 - DNA, 20 bp, mouse
gataagcacgcccatttggg

SEQ ID NO: 721574 - DNA, 20 bp, mouse
gagggtatcggggaagtgag

SEQ ID NO: 721575 - DNA, 20 bp, mouse
ggaccacgtcgtgcgactat

SEQ ID NO: 721576 - DNA, 20 bp, mouse
gggcagaaacgggaagtctt

SEQ ID NO: 721577 - DNA, 20 bp, mouse
gaatctcagcctcacatctc

SEQ ID NO: 721578 - DNA, 20 bp, mouse
gaggctgagattgactacaa

SEQ ID NO: 721579 - DNA, 20 bp, mouse
gaggggacaaatatgctctt

SEQ ID NO: 721580 - DNA, 20 bp, mouse
gcctccctgcggaagttctg

SEQ ID NO: 721581 - DNA, 20 bp, mouse
gtaagggaatatgttttgta

SEQ ID NO: 721582 - DNA, 20 bp, mouse
gacgggaagtctttggtctc

SEQ ID NO: 721583 - DNA, 20 bp, mouse
gagaagcaggtgagttctgt

SEQ ID NO: 721584 - DNA, 20 bp, mouse
gtctgatgttggttctgagt

SEQ ID NO: 721585 - DNA, 20 bp, mouse
ggggacacaccccctgcaga

SEQ ID NO: 721586 - DNA, 20 bp, mouse
gtgccaggatgagaaggtat

SEQ ID NO: 721587 - DNA, 20 bp, mouse
ggaagcacccagcacggcgg

SEQ ID NO: 721588 - DNA, 20 bp, mouse
gtgactcgggtagacttgcc

SEQ ID NO: 721589 - DNA, 20 bp, mouse
gtagacttgccaggatgaga

SEQ ID NO: 721590 - DNA, 20 bp, mouse
gggcggtggcatgagaattg

SEQ ID NO: 721591 - DNA, 20 bp, mouse
gtgggaggaagcacccagca

SEQ ID NO: 721592 - DNA, 20 bp, mouse
gctgagagtagcatctgtac

SEQ ID NO: 721593 - DNA, 20 bp, mouse
gcacaggagctgtaaccctc

SEQ ID NO: 721594 - DNA, 20 bp, mouse
gtggcagtgggcataagaaa

SEQ ID NO: 721595 - DNA, 20 bp, mouse
ggtagcatctgtactgggag

SEQ ID NO: 721596 - DNA, 20 bp, mouse
gtgaaggggcagaattgaaa

SEQ ID NO: 721597 - DNA, 20 bp, mouse
gaccttgacaaagacatagt

SEQ ID NO: 721598 - DNA, 20 bp, mouse
ggaattgagcggctgttaac

SEQ ID NO: 721599 - DNA, 20 bp, mouse
gaaagacatagtgggaatga

SEQ ID NO: 721600 - DNA, 20 bp, mouse
gcatgatgggagtatgggta

SEQ ID NO: 721601 - DNA, 20 bp, mouse
gtaatgaaggctgcagttga

SEQ ID NO: 721602 - DNA, 20 bp, mouse
gtcaagcatgatgggagtat

SEQ ID NO: 721603 - DNA, 20 bp, mouse
gtgagaggaaacgcttcaag

SEQ ID NO: 721604 - DNA, 20 bp, mouse
gcaaggtcaccttggaggaa

SEQ ID NO: 721605 - DNA, 20 bp, mouse
gatagtgtggctgaattgag

SEQ ID NO: 721606 - DNA, 20 bp, mouse
gaagcccaactctgcctcta

SEQ ID NO: 721607 - DNA, 20 bp, mouse
gggtactagaagtagggctc

SEQ ID NO: 721608 - DNA, 20 bp, mouse
ggggacccgactaaagtccc

SEQ ID NO: 721609 - DNA, 20 bp, mouse
gggtctgaatatccttagct

SEQ ID NO: 721610 - DNA, 20 bp, mouse
gttctcggggaaatttactg

SEQ ID NO: 721611 - DNA, 20 bp, mouse
ggttcactcatagcccgtag

SEQ ID NO: 721612 - DNA, 20 bp, mouse
ggtggggaggagagctcctt

SEQ ID NO: 721613 - DNA, 20 bp, mouse
gctgaccagggactttagtc

SEQ ID NO: 721614 - DNA, 20 bp, mouse
gtagcccgtagaggcagagt

SEQ ID NO: 721615 - DNA, 20 bp, mouse
ggtcagcttcatccaagcta

SEQ ID NO: 721616 - DNA, 20 bp, mouse
gatgccttctggcaacagtg

SEQ ID NO: 721617 - DNA, 20 bp, mouse
gtgaatgtgaagtcttgtgt

SEQ ID NO: 721618 - DNA, 20 bp, mouse
gagtttgggaagaagttgtt

SEQ ID NO: 721619 - DNA, 20 bp, mouse
gcatccacactgttgccaga

SEQ ID NO: 721620 - DNA, 20 bp, mouse
ggggttaagtccagtagttt

SEQ ID NO: 721621 - DNA, 20 bp, mouse
gttactgttgctagaggtga

SEQ ID NO: 721622 - DNA, 20 bp, mouse
gccctgggtaaataactagt

SEQ ID NO: 721623 - DNA, 20 bp, mouse
gactgtattagcatatgata

SEQ ID NO: 721624 - DNA, 20 bp, mouse
ggaattgtccctaatttcca

SEQ ID NO: 721625 - DNA, 20 bp, mouse
ggattcagccttggaaatta

SEQ ID NO: 721626 - DNA, 20 bp, mouse
gctggcagggctattactga

SEQ ID NO: 721627 - DNA, 20 bp, mouse
gcgcctgcccaggagaacca

SEQ ID NO: 721628 - DNA, 20 bp, mouse
gagggctattactgaaggaa

SEQ ID NO: 721629 - DNA, 20 bp, mouse
gctctcacagaatcatgtgg

SEQ ID NO: 721630 - DNA, 20 bp, mouse
ggccctgccagctggggcgg

SEQ ID NO: 721631 - DNA, 20 bp, mouse
gagtgtgccttggttctcct

SEQ ID NO: 721632 - DNA, 20 bp, mouse
ggcatatctgcccgaatcac

SEQ ID NO: 721633 - DNA, 20 bp, mouse
gaatcatgtgggggtccagg

SEQ ID NO: 721634 - DNA, 20 bp, mouse
gagtgtcacagcctgtgatt

SEQ ID NO: 721635 - DNA, 20 bp, mouse
gccaggtggccccagtgacc

SEQ ID NO: 721636 - DNA, 20 bp, mouse
gccccccagagtgtgaccaa

SEQ ID NO: 721637 - DNA, 20 bp, mouse
gcccgggagtaagtaggccg

SEQ ID NO: 721638 - DNA, 20 bp, mouse
ggaaaagcccgggagtaagt

SEQ ID NO: 721639 - DNA, 20 bp, mouse
ggtccccttggtcacactct

SEQ ID NO: 721640 - DNA, 20 bp, mouse
gggcaggagcatagggtgaa

SEQ ID NO: 721641 - DNA, 20 bp, mouse
ggatctagccgacagctcag

SEQ ID NO: 721642 - DNA, 20 bp, mouse
gaggagcatagggtgaaggg

SEQ ID NO: 721643 - DNA, 20 bp, mouse
gagacagcatggtgttgtgg

SEQ ID NO: 721644 - DNA, 20 bp, mouse
gggagctatagcttgcccaa

SEQ ID NO: 721645 - DNA, 20 bp, mouse
ggacagacagcatggtgttg

SEQ ID NO: 721646 - DNA, 20 bp, mouse
gataaagatgaagaaccgaa

SEQ ID NO: 721647 - DNA, 20 bp, mouse
gcacgcctaagagaaattac

SEQ ID NO: 721648 - DNA, 20 bp, mouse
gcagcttcgaggattgtgta

SEQ ID NO: 721649 - DNA, 20 bp, mouse
gccaaggcacatgtggaagt

SEQ ID NO: 721650 - DNA, 20 bp, mouse
ggtgcttgacagacccactg

SEQ ID NO: 721651 - DNA, 20 bp, mouse
gtgtgattcacccccacagt

SEQ ID NO: 721652 - DNA, 20 bp, mouse
ggagtcacttgtttgccctt

SEQ ID NO: 721653 - DNA, 20 bp, mouse
ggtctgtgttgtatcttctc

SEQ ID NO: 721654 - DNA, 20 bp, mouse
ggaaaaccatactgagaaag

SEQ ID NO: 721655 - DNA, 20 bp, mouse
gaatgagccacaaatccctc

SEQ ID NO: 721656 - DNA, 20 bp, mouse
ggagaagcctctcctccaag

SEQ ID NO: 721657 - DNA, 20 bp, mouse
gtaacagcaaagaggctcta

SEQ ID NO: 721658 - DNA, 20 bp, mouse
gggacctgaaggacttccca

SEQ ID NO: 721659 - DNA, 20 bp, mouse
gcgcccatgggaagtccttc

SEQ ID NO: 721660 - DNA, 20 bp, mouse
gggaaatcgcacacgccatc

SEQ ID NO: 721661 - DNA, 20 bp, mouse
gtatatggtcaatgtgttgg

SEQ ID NO: 721662 - DNA, 20 bp, mouse
gagtccttcaggtcctctta

SEQ ID NO: 721663 - DNA, 20 bp, mouse
gtaaaaatatcccagaggat

SEQ ID NO: 721664 - DNA, 20 bp, mouse
gccatccggggaagtggacc

SEQ ID NO: 721665 - DNA, 20 bp, mouse
gcacacgccatccggggaag

SEQ ID NO: 721666 - DNA, 20 bp, mouse
gcccttcattgatgcttcaa

SEQ ID NO: 721667 - DNA, 20 bp, mouse
gttgaatacggagctggggg

SEQ ID NO: 721668 - DNA, 20 bp, mouse
gaggatagggacttttcgtc

SEQ ID NO: 721669 - DNA, 20 bp, mouse
gagaggggagggactagctc

SEQ ID NO: 721670 - DNA, 20 bp, mouse
ggcccttgaagcatcaatga

SEQ ID NO: 721671 - DNA, 20 bp, mouse
gtgaagggagggggccccta

SEQ ID NO: 721672 - DNA, 20 bp, mouse
gatgttgaatacggagctgg

SEQ ID NO: 721673 - DNA, 20 bp, mouse
gcctggcacacactgtccat

SEQ ID NO: 721674 - DNA, 20 bp, mouse
gtgggagttgtctagtaact

SEQ ID NO: 721675 - DNA, 20 bp, mouse
ggaagcagataagctatttg

SEQ ID NO: 721676 - DNA, 20 bp, mouse
gagccgagccccagggtcaa

SEQ ID NO: 721677 - DNA, 20 bp, mouse
gcatccgcgggaaccccacg

SEQ ID NO: 721678 - DNA, 20 bp, mouse
gggcgcctcggggaagccac

SEQ ID NO: 721679 - DNA, 20 bp, mouse
ggcaggtcgcagctgcgtga

SEQ ID NO: 721680 - DNA, 20 bp, mouse
gcagcctcgtggggttcccg

SEQ ID NO: 721681 - DNA, 20 bp, mouse
gccgaggcgcccttgaccct

SEQ ID NO: 721682 - DNA, 20 bp, mouse
gggggcgcgcgcagcctcgt

SEQ ID NO: 721683 - DNA, 20 bp, mouse
ggggcgggagcccgccaccg

SEQ ID NO: 721684 - DNA, 20 bp, mouse
gaatgcggggtaagcaggtt

SEQ ID NO: 721685 - DNA, 20 bp, mouse
gagtaggtcgccagactctc

SEQ ID NO: 721686 - DNA, 20 bp, mouse
gaagcaggagctgtaaccat

SEQ ID NO: 721687 - DNA, 20 bp, mouse
ggagctgtaaccatggggac

SEQ ID NO: 721688 - DNA, 20 bp, mouse
gtaaccatggggactggggg

SEQ ID NO: 721689 - DNA, 20 bp, mouse
gaggggaatgaaggaccggc

SEQ ID NO: 721690 - DNA, 20 bp, mouse
gccagggcacggcgctgccg

SEQ ID NO: 721691 - DNA, 20 bp, mouse
ggcgcctcccccagtcccca

SEQ ID NO: 721692 - DNA, 20 bp, mouse
gtggctccctgcggcagagc

SEQ ID NO: 721693 - DNA, 20 bp, mouse
gacgccagccgcctgcgcgc

SEQ ID NO: 721694 - DNA, 20 bp, mouse
gttaaagagacaaccgacca

SEQ ID NO: 721695 - DNA, 20 bp, mouse
gctgtaaccatggggactgg

SEQ ID NO: 721696 - DNA, 20 bp, mouse
gagggcctcgcagagtgacg

SEQ ID NO: 721697 - DNA, 20 bp, mouse
gtctgctcaagctgtcttct

SEQ ID NO: 721698 - DNA, 20 bp, mouse
gtaggcttgcacttgaagga

SEQ ID NO: 721699 - DNA, 20 bp, mouse
gcgcctggcagggtatcagg

SEQ ID NO: 721700 - DNA, 20 bp, mouse
gggtgatggggtataggagt

SEQ ID NO: 721701 - DNA, 20 bp, mouse
gagacctagcggatcgtgcc

SEQ ID NO: 721702 - DNA, 20 bp, mouse
gagggtaggtgatggggtat

SEQ ID NO: 721703 - DNA, 20 bp, mouse
gaccgcctcgtcactctgcg

SEQ ID NO: 721704 - DNA, 20 bp, mouse
ggcctcgcagagtgacgagg

SEQ ID NO: 721705 - DNA, 20 bp, mouse
gagtgacgaggcggtgatgg

SEQ ID NO: 721706 - DNA, 20 bp, mouse
gggcgtgcccgggtcgaggt

SEQ ID NO: 721707 - DNA, 20 bp, mouse
gtccaggagcagcggagttc

SEQ ID NO: 721708 - DNA, 20 bp, mouse
gcacgcccccaggtcctggc

SEQ ID NO: 721709 - DNA, 20 bp, mouse
gcgggcacgcccccaggtcc

SEQ ID NO: 721710 - DNA, 20 bp, mouse
gccgctgctcctggacccag

SEQ ID NO: 721711 - DNA, 20 bp, mouse
gtcgacccgggcacgccccc

SEQ ID NO: 721712 - DNA, 20 bp, mouse
ggtcgaggtcgggtcggctg

SEQ ID NO: 721713 - DNA, 20 bp, mouse
ggagttccggccaggacctg

SEQ ID NO: 721714 - DNA, 20 bp, mouse
ggccgacccgacctcgaccc

SEQ ID NO: 721715 - DNA, 20 bp, mouse
ggcggcggcgccaggaaacg

SEQ ID NO: 721716 - DNA, 20 bp, mouse
gcggcccgcgggtgacctcg

SEQ ID NO: 721717 - DNA, 20 bp, mouse
gggcggcggggttggaagac

SEQ ID NO: 721718 - DNA, 20 bp, mouse
gctgaccccgaggtcacccg

SEQ ID NO: 721719 - DNA, 20 bp, mouse
gagagccagaagcagctccg

SEQ ID NO: 721720 - DNA, 20 bp, mouse
ggtcagcggggtcccctccc

SEQ ID NO: 721721 - DNA, 20 bp, mouse
gcgaacgcaggcgcgccagt

SEQ ID NO: 721722 - DNA, 20 bp, mouse
ggcagaaacccgcagagctt

SEQ ID NO: 721723 - DNA, 20 bp, mouse
gggtgacctcggggtcagcg

SEQ ID NO: 721724 - DNA, 20 bp, mouse
gcagaagcagctccggggag

SEQ ID NO: 721725 - DNA, 20 bp, mouse
gtcgccacgcggggcgggac

SEQ ID NO: 721726 - DNA, 20 bp, mouse
gaactcagggcaataaagga

SEQ ID NO: 721727 - DNA, 20 bp, mouse
gccttcctggcttcctcttt

SEQ ID NO: 721728 - DNA, 20 bp, mouse
ggactctaacacatgaacgt

SEQ ID NO: 721729 - DNA, 20 bp, mouse
ggtcaaacaccctcttggat

SEQ ID NO: 721730 - DNA, 20 bp, mouse
gtcccttaagaccaaagtac

SEQ ID NO: 721731 - DNA, 20 bp, mouse
gtgatctgtagataaccaga

SEQ ID NO: 721732 - DNA, 20 bp, mouse
gcctccttccttgaccctca

SEQ ID NO: 721733 - DNA, 20 bp, mouse
gagacaagggttctcagaaa

SEQ ID NO: 721734 - DNA, 20 bp, mouse
ggcaagagtgaaatcttatg

SEQ ID NO: 721735 - DNA, 20 bp, mouse
gggggcgggattagccttga

SEQ ID NO: 721736 - DNA, 20 bp, mouse
gcatccgagcaaggtcagac

SEQ ID NO: 721737 - DNA, 20 bp, mouse
gcacaacgcaggctagcgtc

SEQ ID NO: 721738 - DNA, 20 bp, mouse
gctgactcgggatcaggtgg

SEQ ID NO: 721739 - DNA, 20 bp, mouse
ggagcaaggtcagacaggtc

SEQ ID NO: 721740 - DNA, 20 bp, mouse
gaccgagaactgaaagatgg

SEQ ID NO: 721741 - DNA, 20 bp, mouse
gccggccgatctcttcctgg

SEQ ID NO: 721742 - DNA, 20 bp, mouse
gtggtgctggaacacccacc

SEQ ID NO: 721743 - DNA, 20 bp, mouse
gtgaaagatggaggctcaaa

SEQ ID NO: 721744 - DNA, 20 bp, mouse
gtgggcagctccgggaggac

SEQ ID NO: 721745 - DNA, 20 bp, mouse
gtcttctgggcagctccggg

SEQ ID NO: 721746 - DNA, 20 bp, mouse
gtggcctggggctttatact

SEQ ID NO: 721747 - DNA, 20 bp, mouse
gggtgagagtataagtgtat

SEQ ID NO: 721748 - DNA, 20 bp, mouse
ggagctccgccacacctcgt

SEQ ID NO: 721749 - DNA, 20 bp, mouse
gacccaggaaaggccagagt

SEQ ID NO: 721750 - DNA, 20 bp, mouse
ggctgtgaggaactgtgcga

SEQ ID NO: 721751 - DNA, 20 bp, mouse
gccaggactttcccatcaaa

SEQ ID NO: 721752 - DNA, 20 bp, mouse
gcagtctggccaccctttga

SEQ ID NO: 721753 - DNA, 20 bp, mouse
gaggcccgctgacatcactc

SEQ ID NO: 721754 - DNA, 20 bp, mouse
gtggcccagagtccagcccg

SEQ ID NO: 721755 - DNA, 20 bp, mouse
gttgttaacagactggtgtt

SEQ ID NO: 721756 - DNA, 20 bp, mouse
gccgtggcttggtcaccctc

SEQ ID NO: 721757 - DNA, 20 bp, mouse
ggacgctagcggtgtacccc

SEQ ID NO: 721758 - DNA, 20 bp, mouse
gaggtgggccggctctcctg

SEQ ID NO: 721759 - DNA, 20 bp, mouse
gacgcggggcgggacgctag

SEQ ID NO: 721760 - DNA, 20 bp, mouse
gcccaccagggcatctgtgc

SEQ ID NO: 721761 - DNA, 20 bp, mouse
gtctcagactagcagacccg

SEQ ID NO: 721762 - DNA, 20 bp, mouse
gtgggactcggtcaccactc

SEQ ID NO: 721763 - DNA, 20 bp, mouse
gactggtggaaccttgacgt

SEQ ID NO: 721764 - DNA, 20 bp, mouse
gagaccaccccgcaaacgaa

SEQ ID NO: 721765 - DNA, 20 bp, mouse
gaacggcagctgcggggagt

SEQ ID NO: 721766 - DNA, 20 bp, mouse
ggggatctggaacatactct

SEQ ID NO: 721767 - DNA, 20 bp, mouse
gacgctagtgctacagatag

SEQ ID NO: 721768 - DNA, 20 bp, mouse
gcgggcgcggcgcatggctt

SEQ ID NO: 721769 - DNA, 20 bp, mouse
gcgtgtgcaggagccagcga

SEQ ID NO: 721770 - DNA, 20 bp, mouse
gcgctgccggcgggtgtccc

SEQ ID NO: 721771 - DNA, 20 bp, mouse
ggggcctcgagatcgggctt

SEQ ID NO: 721772 - DNA, 20 bp, mouse
gcgtaacccgggacacccgc

SEQ ID NO: 721773 - DNA, 20 bp, mouse
ggggtgtcccgggttacgga

SEQ ID NO: 721774 - DNA, 20 bp, mouse
gccgcacgcagcaagcacct

SEQ ID NO: 721775 - DNA, 20 bp, mouse
ggggcgcccttagaactgga

SEQ ID NO: 721776 - DNA, 20 bp, mouse
ggcaccatcattaggatctt

SEQ ID NO: 721777 - DNA, 20 bp, mouse
gactcccaagatcctaatga

SEQ ID NO: 721778 - DNA, 20 bp, mouse
gacttcccagcaccatcatt

SEQ ID NO: 721779 - DNA, 20 bp, mouse
gcgcaggcttgtggggtcag

SEQ ID NO: 721780 - DNA, 20 bp, mouse
gcaaagagatgcactgatca

SEQ ID NO: 721781 - DNA, 20 bp, mouse
gaggggtgtgtgctatgagg

SEQ ID NO: 721782 - DNA, 20 bp, mouse
gctggcgcgcgcaggcttgt

SEQ ID NO: 721783 - DNA, 20 bp, mouse
gtgtgagaaaggggatgctc

SEQ ID NO: 721784 - DNA, 20 bp, mouse
gaaggggatgctcaggtcag

SEQ ID NO: 721785 - DNA, 20 bp, mouse
gatcaggggtgtgtgctatg

SEQ ID NO: 721786 - DNA, 20 bp, mouse
ggcagcgtgggtgggaagag

SEQ ID NO: 721787 - DNA, 20 bp, mouse
ggctgggccaatcagcagcg

SEQ ID NO: 721788 - DNA, 20 bp, mouse
gggccaatcagcagcgtggg

SEQ ID NO: 721789 - DNA, 20 bp, mouse
gtctggagtgacaggctctg

SEQ ID NO: 721790 - DNA, 20 bp, mouse
gtccgagtgaggcgcccgga

SEQ ID NO: 721791 - DNA, 20 bp, mouse
gcaggggctggtccctacgg

SEQ ID NO: 721792 - DNA, 20 bp, mouse
gaggaagtcttgcagttgct

SEQ ID NO: 721793 - DNA, 20 bp, mouse
ggcctcactcggaataccac

SEQ ID NO: 721794 - DNA, 20 bp, mouse
gcccctgaccgtccattggt

SEQ ID NO: 721795 - DNA, 20 bp, mouse
gcagaagcctttgatctgat

SEQ ID NO: 721796 - DNA, 20 bp, mouse
gagagctcgcggtgcaggtt

SEQ ID NO: 721797 - DNA, 20 bp, mouse
ggggaacggcgtcccggccc

SEQ ID NO: 721798 - DNA, 20 bp, mouse
gagctcccgcctcagaaccc

SEQ ID NO: 721799 - DNA, 20 bp, mouse
gcccggcccgggttctgagg

SEQ ID NO: 721800 - DNA, 20 bp, mouse
gccatcccggtcttcctccg

SEQ ID NO: 721801 - DNA, 20 bp, mouse
gacgcaactgggactgggtt

SEQ ID NO: 721802 - DNA, 20 bp, mouse
gaggagggaggtgcacactc

SEQ ID NO: 721803 - DNA, 20 bp, mouse
ggaaaagaccgggttaactt

SEQ ID NO: 721804 - DNA, 20 bp, mouse
gcacacacacagagagctcg

SEQ ID NO: 721805 - DNA, 20 bp, mouse
gaggacatactggaggggaa

SEQ ID NO: 721806 - DNA, 20 bp, mouse
gtcacccttaacataataca

SEQ ID NO: 721807 - DNA, 20 bp, mouse
gcgtgctagtgtgcttgaaa

SEQ ID NO: 721808 - DNA, 20 bp, mouse
gttagaagagaaggagccct

SEQ ID NO: 721809 - DNA, 20 bp, mouse
gataaacatttcttgacagt

SEQ ID NO: 721810 - DNA, 20 bp, mouse
gtttctacacaggtgaccca

SEQ ID NO: 721811 - DNA, 20 bp, mouse
gccttctcttctaactttgg

SEQ ID NO: 721812 - DNA, 20 bp, mouse
ggctccttctcttctaactt

SEQ ID NO: 721813 - DNA, 20 bp, mouse
gtgtaaaatattttctacac

SEQ ID NO: 721814 - DNA, 20 bp, mouse
gctattcatccttaaatgct

SEQ ID NO: 721815 - DNA, 20 bp, mouse
gtgtcaagaaatgtttatta

SEQ ID NO: 721816 - DNA, 20 bp, mouse
gggcgtgatcaggggtgaac

SEQ ID NO: 721817 - DNA, 20 bp, mouse
gggagagaggtctgtggatc

SEQ ID NO: 721818 - DNA, 20 bp, mouse
gatggggaagggcgtgatca

SEQ ID NO: 721819 - DNA, 20 bp, mouse
gggtctgtggatcaggtggc

SEQ ID NO: 721820 - DNA, 20 bp, mouse
gtggccggctgtgttggatg

SEQ ID NO: 721821 - DNA, 20 bp, mouse
gtaagagattgggctcaaaa

SEQ ID NO: 721822 - DNA, 20 bp, mouse
gactgtaagctgcagctcca

SEQ ID NO: 721823 - DNA, 20 bp, mouse
ggaggctgctaggtaggggc

SEQ ID NO: 721824 - DNA, 20 bp, mouse
gtaaggaggctgctaggtag

SEQ ID NO: 721825 - DNA, 20 bp, mouse
ggttgctcatatgctgtgga

SEQ ID NO: 721826 - DNA, 20 bp, mouse
gaaggccacgaggtctcacg

SEQ ID NO: 721827 - DNA, 20 bp, mouse
ggctaatgctggatatgcag

SEQ ID NO: 721828 - DNA, 20 bp, mouse
gggcggtgtgccctcctcaa

SEQ ID NO: 721829 - DNA, 20 bp, mouse
gaccagcccagcacctgatc

SEQ ID NO: 721830 - DNA, 20 bp, mouse
gcagcctaagggctgaggtt

SEQ ID NO: 721831 - DNA, 20 bp, mouse
gtggagcctttgcagcctaa

SEQ ID NO: 721832 - DNA, 20 bp, mouse
ggggggaggagcaccagaag

SEQ ID NO: 721833 - DNA, 20 bp, mouse
gggctgcaaaggctccagct

SEQ ID NO: 721834 - DNA, 20 bp, mouse
gtgcaaaggctccagctggg

SEQ ID NO: 721835 - DNA, 20 bp, mouse
gtgagacctcgtggcctttg

SEQ ID NO: 721836 - DNA, 20 bp, mouse
ggagccaccgagctgtgggt

SEQ ID NO: 721837 - DNA, 20 bp, mouse
ggctccgcccccagtccgaa

SEQ ID NO: 721838 - DNA, 20 bp, mouse
ggccaaggggattgtccgtt

SEQ ID NO: 721839 - DNA, 20 bp, mouse
gccgccctccagcattaagg

SEQ ID NO: 721840 - DNA, 20 bp, mouse
gagctgtgggtcgggagaga

SEQ ID NO: 721841 - DNA, 20 bp, mouse
gagcaccggttccaagaaaa

SEQ ID NO: 721842 - DNA, 20 bp, mouse
gctcccgacccacagctcgg

SEQ ID NO: 721843 - DNA, 20 bp, mouse
gggcggagccaccgagctgt

SEQ ID NO: 721844 - DNA, 20 bp, mouse
gaccacgcgagcagcccccg

SEQ ID NO: 721845 - DNA, 20 bp, mouse
ggggattgtccgttcggact

SEQ ID NO: 721846 - DNA, 20 bp, mouse
gtgagcacacttgatctgga

SEQ ID NO: 721847 - DNA, 20 bp, mouse
ggatgtgagcacacttgatc

SEQ ID NO: 721848 - DNA, 20 bp, mouse
gccctcccttgcccaggggc

SEQ ID NO: 721849 - DNA, 20 bp, mouse
gtacaggcagctcaggtcct

SEQ ID NO: 721850 - DNA, 20 bp, mouse
gtgtaaacacagatagggag

SEQ ID NO: 721851 - DNA, 20 bp, mouse
ggggcctccgtgcctgccaa

SEQ ID NO: 721852 - DNA, 20 bp, mouse
gcctcccttggcaggcacgg

SEQ ID NO: 721853 - DNA, 20 bp, mouse
gtcaagggaaaatggaactc

SEQ ID NO: 721854 - DNA, 20 bp, mouse
gctgaagagcatccagcccc

SEQ ID NO: 721855 - DNA, 20 bp, mouse
ggtctggggccacaagaaca

SEQ ID NO: 721856 - DNA, 20 bp, mouse
ggtagcttctactctcagct

SEQ ID NO: 721857 - DNA, 20 bp, mouse
gttggcttgatgtgaactgt

SEQ ID NO: 721858 - DNA, 20 bp, mouse
gcgaaacagaaacctagatg

SEQ ID NO: 721859 - DNA, 20 bp, mouse
gttaatcagcctgtgatcct

SEQ ID NO: 721860 - DNA, 20 bp, mouse
ggcaatcctcaccctcatct

SEQ ID NO: 721861 - DNA, 20 bp, mouse
gctagttcaaatacttgctt

SEQ ID NO: 721862 - DNA, 20 bp, mouse
gcctgggatctgcaggaagg

SEQ ID NO: 721863 - DNA, 20 bp, mouse
ggggtgaggattgcagctac

SEQ ID NO: 721864 - DNA, 20 bp, mouse
gatgacaaaatcaaaagaca

SEQ ID NO: 721865 - DNA, 20 bp, mouse
gataactggtcacctatgtt

SEQ ID NO: 721866 - DNA, 20 bp, mouse
gagcaccctgtgattggtat

SEQ ID NO: 721867 - DNA, 20 bp, mouse
gacagccaataccaatcaca

SEQ ID NO: 721868 - DNA, 20 bp, mouse
gatcacagggtgcttcttgt

SEQ ID NO: 721869 - DNA, 20 bp, mouse
ggccttagagtcaaataatt

SEQ ID NO: 721870 - DNA, 20 bp, mouse
gttgtgggccttcagaagac

SEQ ID NO: 721871 - DNA, 20 bp, mouse
gtgctatggtacaaagacat

SEQ ID NO: 721872 - DNA, 20 bp, mouse
gaaaaacacctaagtttcac

SEQ ID NO: 721873 - DNA, 20 bp, mouse
gtcacttcttttaagaatca

SEQ ID NO: 721874 - DNA, 20 bp, mouse
gtttttaccttcacctgcta

SEQ ID NO: 721875 - DNA, 20 bp, mouse
gtttgtaccatagcaggtga

SEQ ID NO: 721876 - DNA, 20 bp, mouse
gggtccacggatgccactga

SEQ ID NO: 721877 - DNA, 20 bp, mouse
gcctccctcagtggcatccg

SEQ ID NO: 721878 - DNA, 20 bp, mouse
gactgagggaggcggctgtg

SEQ ID NO: 721879 - DNA, 20 bp, mouse
gaagcgaaaagcggagaagg

SEQ ID NO: 721880 - DNA, 20 bp, mouse
gatgctctgctgggatgggg

SEQ ID NO: 721881 - DNA, 20 bp, mouse
ggtggcatccgtggacctct

SEQ ID NO: 721882 - DNA, 20 bp, mouse
gagcggagaaggtggagaat

SEQ ID NO: 721883 - DNA, 20 bp, mouse
ggtgcatgtgaccactgcaa

SEQ ID NO: 721884 - DNA, 20 bp, mouse
gagggggaggaagcgaaaag

SEQ ID NO: 721885 - DNA, 20 bp, mouse
gtatgagatagatagttcct

SEQ ID NO: 721886 - DNA, 20 bp, mouse
gggatgttcccctggggtga

SEQ ID NO: 721887 - DNA, 20 bp, mouse
gtcagtaggatgttcccctg

SEQ ID NO: 721888 - DNA, 20 bp, mouse
gggaactgatgtggtagtga

SEQ ID NO: 721889 - DNA, 20 bp, mouse
gactaagagaacatactctt

SEQ ID NO: 721890 - DNA, 20 bp, mouse
gcccgtctatacattaagct

SEQ ID NO: 721891 - DNA, 20 bp, mouse
gttagtctactgaattagac

SEQ ID NO: 721892 - DNA, 20 bp, mouse
gcagctgtgccagttgttcc

SEQ ID NO: 721893 - DNA, 20 bp, mouse
gatgtaccagccccataaag

SEQ ID NO: 721894 - DNA, 20 bp, mouse
gtgttatctaccactttatg

SEQ ID NO: 721895 - DNA, 20 bp, mouse
gtgatgtggtagtgagggtt

SEQ ID NO: 721896 - DNA, 20 bp, mouse
ggggccctcagcagcactcc

SEQ ID NO: 721897 - DNA, 20 bp, mouse
ggggaccagtcctctagcca

SEQ ID NO: 721898 - DNA, 20 bp, mouse
gaagctgcttatggccccct

SEQ ID NO: 721899 - DNA, 20 bp, mouse
ggagaagcaagggcactcca

SEQ ID NO: 721900 - DNA, 20 bp, mouse
gtgagacgctggcctggcgg

SEQ ID NO: 721901 - DNA, 20 bp, mouse
gagtcctgttatcttctcca

SEQ ID NO: 721902 - DNA, 20 bp, mouse
gaccctaatccgcctcactg

SEQ ID NO: 721903 - DNA, 20 bp, mouse
gaccccccaaggaccaaagt

SEQ ID NO: 721904 - DNA, 20 bp, mouse
gttgccatggagaagataac

SEQ ID NO: 721905 - DNA, 20 bp, mouse
gtaaaggagttgtatctccc

SEQ ID NO: 721906 - DNA, 20 bp, mouse
ggctccaaggggcatcactg

SEQ ID NO: 721907 - DNA, 20 bp, mouse
gacccgaggggccccggcgt

SEQ ID NO: 721908 - DNA, 20 bp, mouse
gggttcgtgggccagagaaa

SEQ ID NO: 721909 - DNA, 20 bp, mouse
gcagccgcagtgatgcccct

SEQ ID NO: 721910 - DNA, 20 bp, mouse
gggtcctgtcgcacgctcca

SEQ ID NO: 721911 - DNA, 20 bp, mouse
gcggaggcggcgcccaggga

SEQ ID NO: 721912 - DNA, 20 bp, mouse
gacccagacccgaggggccc

SEQ ID NO: 721913 - DNA, 20 bp, mouse
gactccaggcggtttagagg

SEQ ID NO: 721914 - DNA, 20 bp, mouse
ggcgacgcggccgggaaggc

SEQ ID NO: 721915 - DNA, 20 bp, mouse
gtgagtgacccagacccgag

SEQ ID NO: 721916 - DNA, 20 bp, mouse
gtaggggtgtggcctgacgg

SEQ ID NO: 721917 - DNA, 20 bp, mouse
gggcacacgccgctacaaga

SEQ ID NO: 721918 - DNA, 20 bp, mouse
ggggccatgtcctgagcttg

SEQ ID NO: 721919 - DNA, 20 bp, mouse
ggtagctgacaggaccgcag

SEQ ID NO: 721920 - DNA, 20 bp, mouse
ggcggagtgcagtgtagcac

SEQ ID NO: 721921 - DNA, 20 bp, mouse
ggcggggcctcacggcagaa

SEQ ID NO: 721922 - DNA, 20 bp, mouse
gggggcggggcctaaaggcg

SEQ ID NO: 721923 - DNA, 20 bp, mouse
gtggcggaggcgaagcataa

SEQ ID NO: 721924 - DNA, 20 bp, mouse
ggcggagcctgaaggcgggg

SEQ ID NO: 721925 - DNA, 20 bp, mouse
gcgcccccaagctcaggaca

SEQ ID NO: 721926 - DNA, 20 bp, mouse
gaaacaggagtggacgtctt

SEQ ID NO: 721927 - DNA, 20 bp, mouse
gagaaccgctcaaacaggag

SEQ ID NO: 721928 - DNA, 20 bp, mouse
gtggaggatgcgggagtaaa

SEQ ID NO: 721929 - DNA, 20 bp, mouse
gtgcgggagtaaagggactc

SEQ ID NO: 721930 - DNA, 20 bp, mouse
gcaggagtggacgtctttgg

SEQ ID NO: 721931 - DNA, 20 bp, mouse
ggctgcaggcctctctactc

SEQ ID NO: 721932 - DNA, 20 bp, mouse
gagggacggcggtcagacag

SEQ ID NO: 721933 - DNA, 20 bp, mouse
gcccagagaaccgctcaaac

SEQ ID NO: 721934 - DNA, 20 bp, mouse
gcgcttgcagcgccggtctg

SEQ ID NO: 721935 - DNA, 20 bp, mouse
gacgtccactcctgtttgag

SEQ ID NO: 721936 - DNA, 20 bp, mouse
ggcgtggagtgctcaaggga

SEQ ID NO: 721937 - DNA, 20 bp, mouse
ggggctctggggctacaggg

SEQ ID NO: 721938 - DNA, 20 bp, mouse
ggcgggcgtggagtgctcaa

SEQ ID NO: 721939 - DNA, 20 bp, mouse
gagcgctggagcttcagatt

SEQ ID NO: 721940 - DNA, 20 bp, mouse
ggggaagcgtagaggcgcag

SEQ ID NO: 721941 - DNA, 20 bp, mouse
gtgcgcaggggcggggtgca

SEQ ID NO: 721942 - DNA, 20 bp, mouse
ggacgcaggcgggacccgtg

SEQ ID NO: 721943 - DNA, 20 bp, mouse
ggacgagattagagtgctca

SEQ ID NO: 721944 - DNA, 20 bp, mouse
ggattagagtgctcaggggc

SEQ ID NO: 721945 - DNA, 20 bp, mouse
ggcgcgcagggttacagagt

SEQ ID NO: 721946 - DNA, 20 bp, mouse
gaacccgaggcgcactgagg

SEQ ID NO: 721947 - DNA, 20 bp, mouse
gtgcgcctcgggttcagcac

SEQ ID NO: 721948 - DNA, 20 bp, mouse
ggcagtcagctgattgacag

SEQ ID NO: 721949 - DNA, 20 bp, mouse
ggaaacttggactactgagg

SEQ ID NO: 721950 - DNA, 20 bp, mouse
gttcaggggtggcaaggagt

SEQ ID NO: 721951 - DNA, 20 bp, mouse
gagtcatcagggaacacgag

SEQ ID NO: 721952 - DNA, 20 bp, mouse
gaaggagtgggtgggaaata

SEQ ID NO: 721953 - DNA, 20 bp, mouse
gctgaacccgaggcgcactg

SEQ ID NO: 721954 - DNA, 20 bp, mouse
gaaggaaacttggactactg

SEQ ID NO: 721955 - DNA, 20 bp, mouse
gacttgaagccgccctacaa

SEQ ID NO: 721956 - DNA, 20 bp, mouse
gcccaggtgagtcccctcga

SEQ ID NO: 721957 - DNA, 20 bp, mouse
gaggacgccccctgcgggtt

SEQ ID NO: 721958 - DNA, 20 bp, mouse
ggcccagactgctcagggta

SEQ ID NO: 721959 - DNA, 20 bp, mouse
gggttactgcgggagtaatc

SEQ ID NO: 721960 - DNA, 20 bp, mouse
ggaaagaaaagaagagcatc

SEQ ID NO: 721961 - DNA, 20 bp, mouse
ggtcctacgcactgtcaact

SEQ ID NO: 721962 - DNA, 20 bp, mouse
gttgtcgcccaacccgcagg

SEQ ID NO: 721963 - DNA, 20 bp, mouse
gcccctcgaggggactcacc

SEQ ID NO: 721964 - DNA, 20 bp, mouse
gaaagacaggaggcggggcg

SEQ ID NO: 721965 - DNA, 20 bp, mouse
gtgcgtaggacgccccctgc

SEQ ID NO: 721966 - DNA, 20 bp, mouse
gtccccgactccagcagtaa

SEQ ID NO: 721967 - DNA, 20 bp, mouse
ggagtcggggaggatgacaa

SEQ ID NO: 721968 - DNA, 20 bp, mouse
gaaaatgagcagtgatgatg

SEQ ID NO: 721969 - DNA, 20 bp, mouse
gagtgatgatgaggattcta

SEQ ID NO: 721970 - DNA, 20 bp, mouse
gagcctggtgtcaaagtctg

SEQ ID NO: 721971 - DNA, 20 bp, mouse
ggacagaatgaccatggttg

SEQ ID NO: 721972 - DNA, 20 bp, mouse
gctgtccttagcttgggcct

SEQ ID NO: 721973 - DNA, 20 bp, mouse
gttacctacagtctgggacc

SEQ ID NO: 721974 - DNA, 20 bp, mouse
ggggcctcggaatgtttaac

SEQ ID NO: 721975 - DNA, 20 bp, mouse
gtccattactgctggagtcg

SEQ ID NO: 721976 - DNA, 20 bp, mouse
gtgaggagttggcataaact

SEQ ID NO: 721977 - DNA, 20 bp, mouse
gaaggaaattagcataagta

SEQ ID NO: 721978 - DNA, 20 bp, mouse
gggtagcagagtcatgtctg

SEQ ID NO: 721979 - DNA, 20 bp, mouse
gtcgtgaatccaaaaaggga

SEQ ID NO: 721980 - DNA, 20 bp, mouse
gtgctcttgcacgaaagtat

SEQ ID NO: 721981 - DNA, 20 bp, mouse
gttagcataagtagggggtg

SEQ ID NO: 721982 - DNA, 20 bp, mouse
gcacatgcaccgtgagacaa

SEQ ID NO: 721983 - DNA, 20 bp, mouse
gatgtgttaggaaattagtc

SEQ ID NO: 721984 - DNA, 20 bp, mouse
gacgcagatcataatgtgtt

SEQ ID NO: 721985 - DNA, 20 bp, mouse
ggcaattcgtgaatccaaaa

SEQ ID NO: 721986 - DNA, 20 bp, mouse
gggcggggagcgggcttcat

SEQ ID NO: 721987 - DNA, 20 bp, mouse
ggaggcagctggtgttgtta

SEQ ID NO: 721988 - DNA, 20 bp, mouse
ggaaaatccgggatggggtg

SEQ ID NO: 721989 - DNA, 20 bp, mouse
gagactacacggtgatgtat

SEQ ID NO: 721990 - DNA, 20 bp, mouse
ggggcggggaaactggacgg

SEQ ID NO: 721991 - DNA, 20 bp, mouse
gggaggggcaaggaaggcgc

SEQ ID NO: 721992 - DNA, 20 bp, mouse
gcgtgttgaaaatccgggat

SEQ ID NO: 721993 - DNA, 20 bp, mouse
gtgaccagtcttggggtcgg

SEQ ID NO: 721994 - DNA, 20 bp, mouse
gagggggcgaggaggacggc

SEQ ID NO: 721995 - DNA, 20 bp, mouse
gctggacggcggtgacttag

SEQ ID NO: 721996 - DNA, 20 bp, mouse
gggcccgcgctggagccaat

SEQ ID NO: 721997 - DNA, 20 bp, mouse
gcaactgcaggattagaaaa

SEQ ID NO: 721998 - DNA, 20 bp, mouse
ggcccagaaggacagggcgg

SEQ ID NO: 721999 - DNA, 20 bp, mouse
gaaaggagagcagcgaaagg

SEQ ID NO: 722000 - DNA, 20 bp, mouse
gtcagactccccagcccaga

SEQ ID NO: 722001 - DNA, 20 bp, mouse
gctccccattggctccagcg

SEQ ID NO: 722002 - DNA, 20 bp, mouse
ggcccctggactttctataa

SEQ ID NO: 722003 - DNA, 20 bp, mouse
gtgacacaggtactgaatgg

SEQ ID NO: 722004 - DNA, 20 bp, mouse
gctccccagcccagaaggac

SEQ ID NO: 722005 - DNA, 20 bp, mouse
ggccaaaggagagcagcgaa

SEQ ID NO: 722006 - DNA, 20 bp, mouse
gaggccactgagtatcacag

SEQ ID NO: 722007 - DNA, 20 bp, mouse
gccagcccttgcccactccc

SEQ ID NO: 722008 - DNA, 20 bp, mouse
gtggcctctgtgatactcag

SEQ ID NO: 722009 - DNA, 20 bp, mouse
gcacgccagggttggagctg

SEQ ID NO: 722010 - DNA, 20 bp, mouse
ggccaagtgtgtgactgtcc

SEQ ID NO: 722011 - DNA, 20 bp, mouse
gagggaggggtcagctacca

SEQ ID NO: 722012 - DNA, 20 bp, mouse
gccagctgggtgtgcttcca

SEQ ID NO: 722013 - DNA, 20 bp, mouse
gaccccagcccagtaagctt

SEQ ID NO: 722014 - DNA, 20 bp, mouse
gaccccacaaaggacccctc

SEQ ID NO: 722015 - DNA, 20 bp, mouse
gaggaatgaagcagcttttc

SEQ ID NO: 722016 - DNA, 20 bp, mouse
gatgaggcaagacgttatca

SEQ ID NO: 722017 - DNA, 20 bp, mouse
gagcaggcgaccctgcaaaa

SEQ ID NO: 722018 - DNA, 20 bp, mouse
gtatgaaacagaacagtatg

SEQ ID NO: 722019 - DNA, 20 bp, mouse
gccaggctgcctcagatttg

SEQ ID NO: 722020 - DNA, 20 bp, mouse
gactaaaaaactatctgctt

SEQ ID NO: 722021 - DNA, 20 bp, mouse
gagtgttaaactcttgaaac

SEQ ID NO: 722022 - DNA, 20 bp, mouse
gaggaaattcttagttcagc

SEQ ID NO: 722023 - DNA, 20 bp, mouse
gattgacgtagatgaaactg

SEQ ID NO: 722024 - DNA, 20 bp, mouse
gcatttgggaggctgagtca

SEQ ID NO: 722025 - DNA, 20 bp, mouse
ggtgtctgccagccacaatg

SEQ ID NO: 722026 - DNA, 20 bp, mouse
ggggtcctgaagcgagacga

SEQ ID NO: 722027 - DNA, 20 bp, mouse
gggctcagagcatccaaggg

SEQ ID NO: 722028 - DNA, 20 bp, mouse
ggtgaagcggggtgattccc

SEQ ID NO: 722029 - DNA, 20 bp, mouse
gaagcgagacgaaggtacag

SEQ ID NO: 722030 - DNA, 20 bp, mouse
ggtacagtggacctgctgga

SEQ ID NO: 722031 - DNA, 20 bp, mouse
ggaaacacctagcttggata

SEQ ID NO: 722032 - DNA, 20 bp, mouse
gactgtgcaaatcgaggaga

SEQ ID NO: 722033 - DNA, 20 bp, mouse
gtacacagggtctagctaag

SEQ ID NO: 722034 - DNA, 20 bp, mouse
gaatctggatttgtgtgaag

SEQ ID NO: 722035 - DNA, 20 bp, mouse
ggggtggctcagagcatcca

SEQ ID NO: 722036 - DNA, 20 bp, mouse
ggggaaaggcatcatactga

SEQ ID NO: 722037 - DNA, 20 bp, mouse
gtggtctggtatctataaaa

SEQ ID NO: 722038 - DNA, 20 bp, mouse
gaaacaaaagtgcagagctg

SEQ ID NO: 722039 - DNA, 20 bp, mouse
gctgctcacccacttgaaaa

SEQ ID NO: 722040 - DNA, 20 bp, mouse
gtgatacaaggctattcaac

SEQ ID NO: 722041 - DNA, 20 bp, mouse
ggaagatttccgttttcaag

SEQ ID NO: 722042 - DNA, 20 bp, mouse
gaacactcctttctaattat

SEQ ID NO: 722043 - DNA, 20 bp, mouse
ggattctaatagtaaatgtc

SEQ ID NO: 722044 - DNA, 20 bp, mouse
gatctataaaagggaccaga

SEQ ID NO: 722045 - DNA, 20 bp, mouse
gatttcagtgtcaatgtcac

SEQ ID NO: 722046 - DNA, 20 bp, mouse
gcacccagcacacacatcgg

SEQ ID NO: 722047 - DNA, 20 bp, mouse
ggggccctcctcccgagggg

SEQ ID NO: 722048 - DNA, 20 bp, mouse
ggctgggccctcctcccgag

SEQ ID NO: 722049 - DNA, 20 bp, mouse
gcctctctccctagtgggat

SEQ ID NO: 722050 - DNA, 20 bp, mouse
gtccccccccctcgggagga

SEQ ID NO: 722051 - DNA, 20 bp, mouse
gcaaatgctcccatcccact

SEQ ID NO: 722052 - DNA, 20 bp, mouse
gcacacatcggtggctgcgg

SEQ ID NO: 722053 - DNA, 20 bp, mouse
gaaggtgggggctaaaccaa

SEQ ID NO: 722054 - DNA, 20 bp, mouse
gccgctagtagcttcgaagc

SEQ ID NO: 722055 - DNA, 20 bp, mouse
gtggttgctgacgggcccag

SEQ ID NO: 722056 - DNA, 20 bp, mouse
ggaggccaagtggggcagag

SEQ ID NO: 722057 - DNA, 20 bp, mouse
gtctcctaatggagcaagga

SEQ ID NO: 722058 - DNA, 20 bp, mouse
gtgtcaggggtgcaggcatc

SEQ ID NO: 722059 - DNA, 20 bp, mouse
gctaatggagcaaggagggg

SEQ ID NO: 722060 - DNA, 20 bp, mouse
gtaggagagatgggcaaatc

SEQ ID NO: 722061 - DNA, 20 bp, mouse
gaatgagcataataaagagc

SEQ ID NO: 722062 - DNA, 20 bp, mouse
ggcggtagggagagaacaac

SEQ ID NO: 722063 - DNA, 20 bp, mouse
gtgctgccaggaggccaagt

SEQ ID NO: 722064 - DNA, 20 bp, mouse
ggctcattgcagttgctgcc

SEQ ID NO: 722065 - DNA, 20 bp, mouse
ggaacagccagtctgttaac

SEQ ID NO: 722066 - DNA, 20 bp, mouse
gcgggctgctcttgaaacaa

SEQ ID NO: 722067 - DNA, 20 bp, mouse
gaatggcatatcttgaagaa

SEQ ID NO: 722068 - DNA, 20 bp, mouse
ggtagtaccgatagtggggt

SEQ ID NO: 722069 - DNA, 20 bp, mouse
gtgggactttaccctggatg

SEQ ID NO: 722070 - DNA, 20 bp, mouse
gagagcagcccgagatgagc

SEQ ID NO: 722071 - DNA, 20 bp, mouse
ggaaatgagacactcagcgt

SEQ ID NO: 722072 - DNA, 20 bp, mouse
gaaaaggctagacaaagtcg

SEQ ID NO: 722073 - DNA, 20 bp, mouse
ggagtgctatgcatttcaac

SEQ ID NO: 722074 - DNA, 20 bp, mouse
gaggagcttagaaagcagct

SEQ ID NO: 722075 - DNA, 20 bp, mouse
ggagatgtagtaccgatagt

SEQ ID NO: 722076 - DNA, 20 bp, mouse
gcgtaaacagcatccctgga

SEQ ID NO: 722077 - DNA, 20 bp, mouse
gggggacagtaaccaatcat

SEQ ID NO: 722078 - DNA, 20 bp, mouse
ggggaattagcagcatggct

SEQ ID NO: 722079 - DNA, 20 bp, mouse
gcagcatggctggggagcgc

SEQ ID NO: 722080 - DNA, 20 bp, mouse
ggcgggacgtgcagcagtgc

SEQ ID NO: 722081 - DNA, 20 bp, mouse
ggatcgccttccatgagccg

SEQ ID NO: 722082 - DNA, 20 bp, mouse
gaatcatcggccgtggtggg

SEQ ID NO: 722083 - DNA, 20 bp, mouse
ggggcggggcgggacttagg

SEQ ID NO: 722084 - DNA, 20 bp, mouse
gccgccctctgctgccgacg

SEQ ID NO: 722085 - DNA, 20 bp, mouse
gaattcccgcctgttttaaa

SEQ ID NO: 722086 - DNA, 20 bp, mouse
gacagtgtgtgtatgtgtca

SEQ ID NO: 722087 - DNA, 20 bp, mouse
gttaaggaggctaatctgta

SEQ ID NO: 722088 - DNA, 20 bp, mouse
gtggtcaccgaggaagtcag

SEQ ID NO: 722089 - DNA, 20 bp, mouse
gtgagaagaaccgagactta

SEQ ID NO: 722090 - DNA, 20 bp, mouse
gctgtacggctactgagtct

SEQ ID NO: 722091 - DNA, 20 bp, mouse
ggaagaaccgagacttaagg

SEQ ID NO: 722092 - DNA, 20 bp, mouse
gacacacactgtcagtctct

SEQ ID NO: 722093 - DNA, 20 bp, mouse
ggactggattgggaggatac

SEQ ID NO: 722094 - DNA, 20 bp, mouse
gcctcccaatccagtcaaag

SEQ ID NO: 722095 - DNA, 20 bp, mouse
gtcacttgctgaggctctgt

SEQ ID NO: 722096 - DNA, 20 bp, mouse
gcacggctatgctcagtcac

SEQ ID NO: 722097 - DNA, 20 bp, mouse
gaaagcacgtagcatatgtg

SEQ ID NO: 722098 - DNA, 20 bp, mouse
gaaaaaggcaccaccataaa

SEQ ID NO: 722099 - DNA, 20 bp, mouse
gagcaggcgtccttttatgg

SEQ ID NO: 722100 - DNA, 20 bp, mouse
gtgaacagctgtgtcaaaga

SEQ ID NO: 722101 - DNA, 20 bp, mouse
ggagagataggtatagttac

SEQ ID NO: 722102 - DNA, 20 bp, mouse
gatgtgaggttaactgatca

SEQ ID NO: 722103 - DNA, 20 bp, mouse
gctgataccaccacgcctcc

SEQ ID NO: 722104 - DNA, 20 bp, mouse
gagcatttcacaaagtccaa

SEQ ID NO: 722105 - DNA, 20 bp, mouse
gtgtgaaatgctcatatcta

SEQ ID NO: 722106 - DNA, 20 bp, mouse
gtcgcgttgtctggggaaag

SEQ ID NO: 722107 - DNA, 20 bp, mouse
gggcacagaggtctttacgg

SEQ ID NO: 722108 - DNA, 20 bp, mouse
gcaggatctcgcgttgtctg

SEQ ID NO: 722109 - DNA, 20 bp, mouse
gcctcctagtcccgggacta

SEQ ID NO: 722110 - DNA, 20 bp, mouse
gacagccacgggcggggcgg

SEQ ID NO: 722111 - DNA, 20 bp, mouse
ggcggagtcccggctggcac

SEQ ID NO: 722112 - DNA, 20 bp, mouse
gaggcgcaggcgcaggatct

SEQ ID NO: 722113 - DNA, 20 bp, mouse
gagaaagaaagaagatttaa

SEQ ID NO: 722114 - DNA, 20 bp, mouse
gcacacagccacgggcgggg

SEQ ID NO: 722115 - DNA, 20 bp, mouse
ggtctttacggtggcgttgt

SEQ ID NO: 722116 - DNA, 20 bp, mouse
gctcctgaaaagaggagtgg

SEQ ID NO: 722117 - DNA, 20 bp, mouse
ggaaacggatcatgtggctt

SEQ ID NO: 722118 - DNA, 20 bp, mouse
gcagaaatctctgacctgat

SEQ ID NO: 722119 - DNA, 20 bp, mouse
gggaggggcactgagagagt

SEQ ID NO: 722120 - DNA, 20 bp, mouse
ggtggcttgggggggaaatg

SEQ ID NO: 722121 - DNA, 20 bp, mouse
ggaatgtgtcacatgggaaa

SEQ ID NO: 722122 - DNA, 20 bp, mouse
gacatgggaaacggatcatg

SEQ ID NO: 722123 - DNA, 20 bp, mouse
ggtaaaatgaccagattgaa

SEQ ID NO: 722124 - DNA, 20 bp, mouse
gactcgggcacacaggcctc

SEQ ID NO: 722125 - DNA, 20 bp, mouse
gtaccccccaaaatagagta

SEQ ID NO: 722126 - DNA, 20 bp, mouse
gaggccagcaggggttggga

SEQ ID NO: 722127 - DNA, 20 bp, mouse
gtcacccctctgtctaggga

SEQ ID NO: 722128 - DNA, 20 bp, mouse
gcacaccttccctagacaga

SEQ ID NO: 722129 - DNA, 20 bp, mouse
gcggaccaggaagagtggag

SEQ ID NO: 722130 - DNA, 20 bp, mouse
gagccacagctgttcggacc

SEQ ID NO: 722131 - DNA, 20 bp, mouse
gctgttcggaccaggaagag

SEQ ID NO: 722132 - DNA, 20 bp, mouse
gctggctgcctagaggaagg

SEQ ID NO: 722133 - DNA, 20 bp, mouse
gttcctggtccgaacagctg

SEQ ID NO: 722134 - DNA, 20 bp, mouse
gcaagggctgaatgtctctg

SEQ ID NO: 722135 - DNA, 20 bp, mouse
gcactgtggtatgactgaag

SEQ ID NO: 722136 - DNA, 20 bp, mouse
gcagggcaacttgtgtgcta

SEQ ID NO: 722137 - DNA, 20 bp, mouse
gccgacggcacagtaggcgc

SEQ ID NO: 722138 - DNA, 20 bp, mouse
gccgtcgggaattcctctat

SEQ ID NO: 722139 - DNA, 20 bp, mouse
gggtcggcaatcttcctcat

SEQ ID NO: 722140 - DNA, 20 bp, mouse
gcacacacactctagcgtgc

SEQ ID NO: 722141 - DNA, 20 bp, mouse
ggcacagagggaggggctaa

SEQ ID NO: 722142 - DNA, 20 bp, mouse
gggcacagtaggcgctggct

SEQ ID NO: 722143 - DNA, 20 bp, mouse
gcagtaagaaacatgggcag

SEQ ID NO: 722144 - DNA, 20 bp, mouse
ggaattcccgacggcacagt

SEQ ID NO: 722145 - DNA, 20 bp, mouse
ggctggcttggtgcgcccac

SEQ ID NO: 722146 - DNA, 20 bp, mouse
gtggggagaagcgacaaggt

SEQ ID NO: 722147 - DNA, 20 bp, mouse
gtatataaagccattgggga

SEQ ID NO: 722148 - DNA, 20 bp, mouse
ggcactgcatctctctgcag

SEQ ID NO: 722149 - DNA, 20 bp, mouse
gataaagccattggggaggg

SEQ ID NO: 722150 - DNA, 20 bp, mouse
gcaaccagttaaaaaaactt

SEQ ID NO: 722151 - DNA, 20 bp, mouse
gcatccttatataaagccat

SEQ ID NO: 722152 - DNA, 20 bp, mouse
gtgcttcatatgtatggcag

SEQ ID NO: 722153 - DNA, 20 bp, mouse
gaagcctaagtttttttaac

SEQ ID NO: 722154 - DNA, 20 bp, mouse
gttaaactgcttcatatgta

SEQ ID NO: 722155 - DNA, 20 bp, mouse
gtttgattggccagttgtat

SEQ ID NO: 722156 - DNA, 20 bp, mouse
gggggctgacccaaagggaa

SEQ ID NO: 722157 - DNA, 20 bp, mouse
ggggtcagccccaacttgga

SEQ ID NO: 722158 - DNA, 20 bp, mouse
gcaaagggaagggcacaact

SEQ ID NO: 722159 - DNA, 20 bp, mouse
ggtattgtgagatgtcctta

SEQ ID NO: 722160 - DNA, 20 bp, mouse
gcaccccaaagcctcggcct

SEQ ID NO: 722161 - DNA, 20 bp, mouse
gaagttggggctgacccaaa

SEQ ID NO: 722162 - DNA, 20 bp, mouse
gcaccctaggccgaggcttt

SEQ ID NO: 722163 - DNA, 20 bp, mouse
gtggcctagtatctggggga

SEQ ID NO: 722164 - DNA, 20 bp, mouse
ggtgatgttaccttccaagt

SEQ ID NO: 722165 - DNA, 20 bp, mouse
ggagaatcgagaacaggtta

SEQ ID NO: 722166 - DNA, 20 bp, mouse
gggagccagccattctgcaa

SEQ ID NO: 722167 - DNA, 20 bp, mouse
gtggagggaaggagccctac

SEQ ID NO: 722168 - DNA, 20 bp, mouse
ggggcaggtggactgggtca

SEQ ID NO: 722169 - DNA, 20 bp, mouse
gtaccggctcccttgcagaa

SEQ ID NO: 722170 - DNA, 20 bp, mouse
gcatataggggaggatagaa

SEQ ID NO: 722171 - DNA, 20 bp, mouse
gggctcccttgcagaatggc

SEQ ID NO: 722172 - DNA, 20 bp, mouse
gcctgtctccagctcatata

SEQ ID NO: 722173 - DNA, 20 bp, mouse
gaagcagcactgggacatga

SEQ ID NO: 722174 - DNA, 20 bp, mouse
ggcagaaagtgagagcacac

SEQ ID NO: 722175 - DNA, 20 bp, mouse
gtctccagctcatatagggg

SEQ ID NO: 722176 - DNA, 20 bp, mouse
gaggcagggcccaggacgcg

SEQ ID NO: 722177 - DNA, 20 bp, mouse
ggccacgctgcgcgctccgg

SEQ ID NO: 722178 - DNA, 20 bp, mouse
ggtaaacgggggtccggcgg

SEQ ID NO: 722179 - DNA, 20 bp, mouse
gccgttgcgacagccgggag

SEQ ID NO: 722180 - DNA, 20 bp, mouse
gcgctccggcggaggggagg

SEQ ID NO: 722181 - DNA, 20 bp, mouse
gccggacccccgtttacctg

SEQ ID NO: 722182 - DNA, 20 bp, mouse
gcgggagctgggggcacggt

SEQ ID NO: 722183 - DNA, 20 bp, mouse
gtgggcggtagcacgcgggg

SEQ ID NO: 722184 - DNA, 20 bp, mouse
gaccgggcctgactgggctg

SEQ ID NO: 722185 - DNA, 20 bp, mouse
gacaagtcgcgtttggcccc

SEQ ID NO: 722186 - DNA, 20 bp, mouse
gccgcccccggccaccggtt

SEQ ID NO: 722187 - DNA, 20 bp, mouse
gagactcggggaggtcacag

SEQ ID NO: 722188 - DNA, 20 bp, mouse
gagaagcccagcaggccaat

SEQ ID NO: 722189 - DNA, 20 bp, mouse
ggggttttggggacactagt

SEQ ID NO: 722190 - DNA, 20 bp, mouse
gaagggattgggatagtctg

SEQ ID NO: 722191 - DNA, 20 bp, mouse
ggcggcgccctctgcgggtc

SEQ ID NO: 722192 - DNA, 20 bp, mouse
gaaggacagagagccggctc

SEQ ID NO: 722193 - DNA, 20 bp, mouse
gcgcagagggcgccgcgtca

SEQ ID NO: 722194 - DNA, 20 bp, mouse
ggggaagaggtcaagggatt

SEQ ID NO: 722195 - DNA, 20 bp, mouse
ggccaatgggcgctgcgcgc

SEQ ID NO: 722196 - DNA, 20 bp, mouse
gagccagcagaatttgtttg

SEQ ID NO: 722197 - DNA, 20 bp, mouse
ggatgaatggacacagggga

SEQ ID NO: 722198 - DNA, 20 bp, mouse
ggggccctagtgttccagga

SEQ ID NO: 722199 - DNA, 20 bp, mouse
gtgttccaggaaggcttagt

SEQ ID NO: 722200 - DNA, 20 bp, mouse
gggctacttggttcagattc

SEQ ID NO: 722201 - DNA, 20 bp, mouse
gttccccaaacaaattctgc

SEQ ID NO: 722202 - DNA, 20 bp, mouse
gaaagaggatgaatggacac

SEQ ID NO: 722203 - DNA, 20 bp, mouse
gaagccttcctggaacacta

SEQ ID NO: 722204 - DNA, 20 bp, mouse
gtttggggaaagaggatgaa

SEQ ID NO: 722205 - DNA, 20 bp, mouse
gaaacaggcaggctgttctg

SEQ ID NO: 722206 - DNA, 20 bp, mouse
ggtgctgtaagataatgact

SEQ ID NO: 722207 - DNA, 20 bp, mouse
gaaaatcaaacctgcctggt

SEQ ID NO: 722208 - DNA, 20 bp, mouse
gagacggtaggcacgagccc

SEQ ID NO: 722209 - DNA, 20 bp, mouse
gttggcttatgggccatcaa

SEQ ID NO: 722210 - DNA, 20 bp, mouse
gatgtcaggtgttaagacac

SEQ ID NO: 722211 - DNA, 20 bp, mouse
ggtagaacatactgctgtgg

SEQ ID NO: 722212 - DNA, 20 bp, mouse
ggctgtgtatctaccgttga

SEQ ID NO: 722213 - DNA, 20 bp, mouse
gccagattctataacaccca

SEQ ID NO: 722214 - DNA, 20 bp, mouse
gcaggtctgttcatcccacc

SEQ ID NO: 722215 - DNA, 20 bp, mouse
ggaacatactgctgtggagg

SEQ ID NO: 722216 - DNA, 20 bp, mouse
gacagcccttgggtcccgtt

SEQ ID NO: 722217 - DNA, 20 bp, mouse
gagctccaaacgggacccaa

SEQ ID NO: 722218 - DNA, 20 bp, mouse
gataaaatacaatcagaagt

SEQ ID NO: 722219 - DNA, 20 bp, mouse
gctgctcagagattctcagg

SEQ ID NO: 722220 - DNA, 20 bp, mouse
gttgaagctgttgctaagag

SEQ ID NO: 722221 - DNA, 20 bp, mouse
gagagtcaaaactggctatg

SEQ ID NO: 722222 - DNA, 20 bp, mouse
gagagcacttcggcttactt

SEQ ID NO: 722223 - DNA, 20 bp, mouse
gtcacaaaaaggttttataa

SEQ ID NO: 722224 - DNA, 20 bp, mouse
gtgcatgatagagtcaaaac

SEQ ID NO: 722225 - DNA, 20 bp, mouse
gctctttagtttaggctaga

SEQ ID NO: 722226 - DNA, 20 bp, mouse
gggtgactggagtgctgtgg

SEQ ID NO: 722227 - DNA, 20 bp, mouse
gggggaaggcagctggtgac

SEQ ID NO: 722228 - DNA, 20 bp, mouse
ggggagtggggtagctagag

SEQ ID NO: 722229 - DNA, 20 bp, mouse
gaaggctctggattaggggt

SEQ ID NO: 722230 - DNA, 20 bp, mouse
gctgtcaaggctctggatta

SEQ ID NO: 722231 - DNA, 20 bp, mouse
gtgttcttgaaacccccttg

SEQ ID NO: 722232 - DNA, 20 bp, mouse
gtgaaacccccttgaggctg

SEQ ID NO: 722233 - DNA, 20 bp, mouse
gggagacagcattgccagta

SEQ ID NO: 722234 - DNA, 20 bp, mouse
ggctcacaggtcctgaactg

SEQ ID NO: 722235 - DNA, 20 bp, mouse
gagcaatctgagggcagtaa

SEQ ID NO: 722236 - DNA, 20 bp, mouse
gtggagtgaagcccgcgcag

SEQ ID NO: 722237 - DNA, 20 bp, mouse
ggcaacccgggtggagagcg

SEQ ID NO: 722238 - DNA, 20 bp, mouse
gcagatgctctgctagaagg

SEQ ID NO: 722239 - DNA, 20 bp, mouse
ggtggcccggcctctcccag

SEQ ID NO: 722240 - DNA, 20 bp, mouse
gaccaccatcgcaacccggg

SEQ ID NO: 722241 - DNA, 20 bp, mouse
gctgctagaaggaggacgag

SEQ ID NO: 722242 - DNA, 20 bp, mouse
ggccaccaccatcgcaaccc

SEQ ID NO: 722243 - DNA, 20 bp, mouse
gcgggcggagcggtgcatgg

SEQ ID NO: 722244 - DNA, 20 bp, mouse
ggacccgggaacaagggcgg

SEQ ID NO: 722245 - DNA, 20 bp, mouse
gaggagcgacccgggaacaa

SEQ ID NO: 722246 - DNA, 20 bp, mouse
ggtcgggaatgcaatgtgtg

SEQ ID NO: 722247 - DNA, 20 bp, mouse
gcctgaaaacggatgtggtc

SEQ ID NO: 722248 - DNA, 20 bp, mouse
gtggtctcagagcctgaaaa

SEQ ID NO: 722249 - DNA, 20 bp, mouse
gaccacagcggggcagattg

SEQ ID NO: 722250 - DNA, 20 bp, mouse
gcagagcctgaaaacggatg

SEQ ID NO: 722251 - DNA, 20 bp, mouse
gaggctcggtatggtgacta

SEQ ID NO: 722252 - DNA, 20 bp, mouse
gaggttttcaggtgatggag

SEQ ID NO: 722253 - DNA, 20 bp, mouse
gtctagccagggccctctgc

SEQ ID NO: 722254 - DNA, 20 bp, mouse
ggagggccctggctagacca

SEQ ID NO: 722255 - DNA, 20 bp, mouse
gaggctctgagaccacagcg

SEQ ID NO: 722256 - DNA, 20 bp, mouse
gagaaggctgcaagagcgag

SEQ ID NO: 722257 - DNA, 20 bp, mouse
gaccctgaggctggctgggc

SEQ ID NO: 722258 - DNA, 20 bp, mouse
gaagggaagaggtctcacac

SEQ ID NO: 722259 - DNA, 20 bp, mouse
ggctgggctggttctgctgc

SEQ ID NO: 722260 - DNA, 20 bp, mouse
gtgggaccggcaaaccgagt

SEQ ID NO: 722261 - DNA, 20 bp, mouse
gccccgactgcctttcagaa

SEQ ID NO: 722262 - DNA, 20 bp, mouse
gttgagtcagaccctgaggc

SEQ ID NO: 722263 - DNA, 20 bp, mouse
gactcaacacagattgtggc

SEQ ID NO: 722264 - DNA, 20 bp, mouse
gctgcaagagcgagggggtg

SEQ ID NO: 722265 - DNA, 20 bp, mouse
gggaaggcggaggtctctcc

SEQ ID NO: 722266 - DNA, 20 bp, mouse
gtggggggggaggacgcggt

SEQ ID NO: 722267 - DNA, 20 bp, mouse
gggaggacgcggtggggtgc

SEQ ID NO: 722268 - DNA, 20 bp, mouse
gacaacccctggcccggggc

SEQ ID NO: 722269 - DNA, 20 bp, mouse
ggcggcagaggaggggttaa

SEQ ID NO: 722270 - DNA, 20 bp, mouse
gacccggcgggcgcccccgc

SEQ ID NO: 722271 - DNA, 20 bp, mouse
gggagggggctcttcaaaga

SEQ ID NO: 722272 - DNA, 20 bp, mouse
gcagcgacaacccctggccc

SEQ ID NO: 722273 - DNA, 20 bp, mouse
ggggtcccttagagggatag

SEQ ID NO: 722274 - DNA, 20 bp, mouse
gtggagaaggttattaacag

SEQ ID NO: 722275 - DNA, 20 bp, mouse
gagcagcaggtgagatttcc

SEQ ID NO: 722276 - DNA, 20 bp, mouse
gccacgaagaggagcttcca

SEQ ID NO: 722277 - DNA, 20 bp, mouse
gtggagaatcgtggtgtctg

SEQ ID NO: 722278 - DNA, 20 bp, mouse
ggtccccgcccctactcttg

SEQ ID NO: 722279 - DNA, 20 bp, mouse
gaatcgtggtgtctggggat

SEQ ID NO: 722280 - DNA, 20 bp, mouse
gagaactagaggaaacgtag

SEQ ID NO: 722281 - DNA, 20 bp, mouse
ggctgtcagccccaagagta

SEQ ID NO: 722282 - DNA, 20 bp, mouse
gcatgctgcctcagaagagc

SEQ ID NO: 722283 - DNA, 20 bp, mouse
ggagctggagtgcttctcct

SEQ ID NO: 722284 - DNA, 20 bp, mouse
ggacttaaaacactgtcctc

SEQ ID NO: 722285 - DNA, 20 bp, mouse
gagcacagagacccttggtc

SEQ ID NO: 722286 - DNA, 20 bp, mouse
ggtaccctggtccctagggg

SEQ ID NO: 722287 - DNA, 20 bp, mouse
ggggtggcggcccccgagga

SEQ ID NO: 722288 - DNA, 20 bp, mouse
gcccgaggagggctggggtt

SEQ ID NO: 722289 - DNA, 20 bp, mouse
ggggaggtctgcacccccgg

SEQ ID NO: 722290 - DNA, 20 bp, mouse
gggtaccgccccccctgggg

SEQ ID NO: 722291 - DNA, 20 bp, mouse
ggggttgcccgcagacgcgg

SEQ ID NO: 722292 - DNA, 20 bp, mouse
ggggagccgcgcagttgagg

SEQ ID NO: 722293 - DNA, 20 bp, mouse
ggcggtaccctggtccctag

SEQ ID NO: 722294 - DNA, 20 bp, mouse
ggagacgatcacgattgagt

SEQ ID NO: 722295 - DNA, 20 bp, mouse
gggggtgcagacctccccta

SEQ ID NO: 722296 - DNA, 20 bp, mouse
gaggaggggaagcacaaaca

SEQ ID NO: 722297 - DNA, 20 bp, mouse
gcagagggggctgactagag

SEQ ID NO: 722298 - DNA, 20 bp, mouse
gtggtcaaggggagtggtta

SEQ ID NO: 722299 - DNA, 20 bp, mouse
gacgaagcaaaggttcctga

SEQ ID NO: 722300 - DNA, 20 bp, mouse
gaaggcaaggtggtgactaa

SEQ ID NO: 722301 - DNA, 20 bp, mouse
gcaaggtggtgactaagggg

SEQ ID NO: 722302 - DNA, 20 bp, mouse
gggttcctgagggattcaga

SEQ ID NO: 722303 - DNA, 20 bp, mouse
gtgagctagtcacgaagcaa

SEQ ID NO: 722304 - DNA, 20 bp, mouse
ggcaagctgacaccacatag

SEQ ID NO: 722305 - DNA, 20 bp, mouse
ggggggctgactagagagga

SEQ ID NO: 722306 - DNA, 20 bp, mouse
gagaggcggggcattctaag

SEQ ID NO: 722307 - DNA, 20 bp, mouse
gaagccagtggtgttaatgc

SEQ ID NO: 722308 - DNA, 20 bp, mouse
gaatgcaggagcctgaatgc

SEQ ID NO: 722309 - DNA, 20 bp, mouse
gactgagagctcaaagaagg

SEQ ID NO: 722310 - DNA, 20 bp, mouse
gagctctcagtcaactttcc

SEQ ID NO: 722311 - DNA, 20 bp, mouse
gggagtcactggttcagtcc

SEQ ID NO: 722312 - DNA, 20 bp, mouse
gtgtctttgggcaatgttaa

SEQ ID NO: 722313 - DNA, 20 bp, mouse
ggagttggtggctgtgtctt

SEQ ID NO: 722314 - DNA, 20 bp, mouse
gtcggtttctactggagctg

SEQ ID NO: 722315 - DNA, 20 bp, mouse
gtgttggatagttcatgtca

SEQ ID NO: 722316 - DNA, 20 bp, mouse
ggggctgactgacggaggtg

SEQ ID NO: 722317 - DNA, 20 bp, mouse
gggtgaggcggggaccctaa

SEQ ID NO: 722318 - DNA, 20 bp, mouse
gaggcagggctgactgacgg

SEQ ID NO: 722319 - DNA, 20 bp, mouse
gctgactgacggaggtgagg

SEQ ID NO: 722320 - DNA, 20 bp, mouse
gaggctagagatgagatgac

SEQ ID NO: 722321 - DNA, 20 bp, mouse
gtgagtcatggctttctcag

SEQ ID NO: 722322 - DNA, 20 bp, mouse
gtcaaaaatgggtatgagct

SEQ ID NO: 722323 - DNA, 20 bp, mouse
ggagtcacgggcatccctta

SEQ ID NO: 722324 - DNA, 20 bp, mouse
ggaaactggcaccagggtct

SEQ ID NO: 722325 - DNA, 20 bp, mouse
gcccccagggacttaatgat

SEQ ID NO: 722326 - DNA, 20 bp, mouse
gtacctccaggaatgggatg

SEQ ID NO: 722327 - DNA, 20 bp, mouse
ggggtggggaaatgtcaaga

SEQ ID NO: 722328 - DNA, 20 bp, mouse
ggaccccgcctgtcaatctc

SEQ ID NO: 722329 - DNA, 20 bp, mouse
gaggattggcctggcgggtg

SEQ ID NO: 722330 - DNA, 20 bp, mouse
ggacgtcaggctctgggttc

SEQ ID NO: 722331 - DNA, 20 bp, mouse
gagccccatcccattcctgg

SEQ ID NO: 722332 - DNA, 20 bp, mouse
gtctctgaaatgtttctgtg

SEQ ID NO: 722333 - DNA, 20 bp, mouse
gtcaagaaggattggcctgg

SEQ ID NO: 722334 - DNA, 20 bp, mouse
gtaccagtccagatacctcc

SEQ ID NO: 722335 - DNA, 20 bp, mouse
gtgcccgagattgacaggcg

SEQ ID NO: 722336 - DNA, 20 bp, mouse
ggaaagaagtatgaggaact

SEQ ID NO: 722337 - DNA, 20 bp, mouse
gaaaggggctggcagatagc

SEQ ID NO: 722338 - DNA, 20 bp, mouse
ggaaaccctcccagttagcc

SEQ ID NO: 722339 - DNA, 20 bp, mouse
gcagctgtatgctccagaag

SEQ ID NO: 722340 - DNA, 20 bp, mouse
ggctccagaagtggctcaaa

SEQ ID NO: 722341 - DNA, 20 bp, mouse
gggagcatacagctgggcct

SEQ ID NO: 722342 - DNA, 20 bp, mouse
gctattgtctgggaacccca

SEQ ID NO: 722343 - DNA, 20 bp, mouse
gtatgaggaactgggctttc

SEQ ID NO: 722344 - DNA, 20 bp, mouse
gaagctgctagaaatcttgg

SEQ ID NO: 722345 - DNA, 20 bp, mouse
gtttctggacactattgtct

SEQ ID NO: 722346 - DNA, 20 bp, mouse
gtcctgagcaaggtgggtat

SEQ ID NO: 722347 - DNA, 20 bp, mouse
ggcaaggtgggtatgggtct

SEQ ID NO: 722348 - DNA, 20 bp, mouse
gacccccaggaggtcttgag

SEQ ID NO: 722349 - DNA, 20 bp, mouse
gttgctcaggagtgcgacgt

SEQ ID NO: 722350 - DNA, 20 bp, mouse
ggcagctgttagagccaagg

SEQ ID NO: 722351 - DNA, 20 bp, mouse
gcttctgtgaaactgcccga

SEQ ID NO: 722352 - DNA, 20 bp, mouse
gggcctggtgccagccccct

SEQ ID NO: 722353 - DNA, 20 bp, mouse
gacccatacccaccttgctc

SEQ ID NO: 722354 - DNA, 20 bp, mouse
gtcccctcaagacctcctgg

SEQ ID NO: 722355 - DNA, 20 bp, mouse
gacacagcttagtaagggag

SEQ ID NO: 722356 - DNA, 20 bp, mouse
gaggctgcccaatcagcgga

SEQ ID NO: 722357 - DNA, 20 bp, mouse
ggctacacatctttggtgta

SEQ ID NO: 722358 - DNA, 20 bp, mouse
gtcaccccaccccctaaaac

SEQ ID NO: 722359 - DNA, 20 bp, mouse
gggtaagtgtggcccaggca

SEQ ID NO: 722360 - DNA, 20 bp, mouse
ggggagggggcagctcagac

SEQ ID NO: 722361 - DNA, 20 bp, mouse
gccaccgggcaggtgagcat

SEQ ID NO: 722362 - DNA, 20 bp, mouse
ggagggaagcatggtcccat

SEQ ID NO: 722363 - DNA, 20 bp, mouse
gcacttaactcccgttttag

SEQ ID NO: 722364 - DNA, 20 bp, mouse
gggcagttcaagcaaatgtg

SEQ ID NO: 722365 - DNA, 20 bp, mouse
ggagcccctcctcacagtgt

SEQ ID NO: 722366 - DNA, 20 bp, mouse
ggaacccctaggatgctggg

SEQ ID NO: 722367 - DNA, 20 bp, mouse
gggcgagcgctcagtgtggc

SEQ ID NO: 722368 - DNA, 20 bp, mouse
gctagccgcccagcatccta

SEQ ID NO: 722369 - DNA, 20 bp, mouse
gcgtggaggtggggagcggg

SEQ ID NO: 722370 - DNA, 20 bp, mouse
ggcggggcgagcgctcagtg

SEQ ID NO: 722371 - DNA, 20 bp, mouse
gacaccgggaagcagcctcg

SEQ ID NO: 722372 - DNA, 20 bp, mouse
gagcgctcgccccgccacgc

SEQ ID NO: 722373 - DNA, 20 bp, mouse
ggcgggcggggcgctgacac

SEQ ID NO: 722374 - DNA, 20 bp, mouse
gtaggggttccccactgtct

SEQ ID NO: 722375 - DNA, 20 bp, mouse
gtaggctgaagctctccacg

SEQ ID NO: 722376 - DNA, 20 bp, mouse
gtaaaaggctgcttcctcat

SEQ ID NO: 722377 - DNA, 20 bp, mouse
gagaaaccagcagtgttgtg

SEQ ID NO: 722378 - DNA, 20 bp, mouse
gggccctgtgcagaggcata

SEQ ID NO: 722379 - DNA, 20 bp, mouse
gtgtacttttaagcgatgtt

SEQ ID NO: 722380 - DNA, 20 bp, mouse
ggtgtagagatgaaaatctg

SEQ ID NO: 722381 - DNA, 20 bp, mouse
gtcaccagtatgcactcttt

SEQ ID NO: 722382 - DNA, 20 bp, mouse
gcagttccaggatcagtaag

SEQ ID NO: 722383 - DNA, 20 bp, mouse
gcatcgcttaaaagtacaga

SEQ ID NO: 722384 - DNA, 20 bp, mouse
gcttactttgtctgagttca

SEQ ID NO: 722385 - DNA, 20 bp, mouse
gagtaagccttctcattaaa

SEQ ID NO: 722386 - DNA, 20 bp, mouse
gggtaagagcctagccggaa

SEQ ID NO: 722387 - DNA, 20 bp, mouse
gtacagctggcggaggactg

SEQ ID NO: 722388 - DNA, 20 bp, mouse
gtgagctgtaggagtacagc

SEQ ID NO: 722389 - DNA, 20 bp, mouse
gtgaactccaatctggtgtc

SEQ ID NO: 722390 - DNA, 20 bp, mouse
gtcctctgattcagcccttc

SEQ ID NO: 722391 - DNA, 20 bp, mouse
gctctcgcagagaactctca

SEQ ID NO: 722392 - DNA, 20 bp, mouse
gagaatggagggtgtgtaaa

SEQ ID NO: 722393 - DNA, 20 bp, mouse
ggtactcctacagctcaact

SEQ ID NO: 722394 - DNA, 20 bp, mouse
gtccttgcaggattgagaga

SEQ ID NO: 722395 - DNA, 20 bp, mouse
ggtaggagtacagctggcgg

SEQ ID NO: 722396 - DNA, 20 bp, mouse
gagtgcgctccgatatgcca

SEQ ID NO: 722397 - DNA, 20 bp, mouse
gcggtcagtggccaattcac

SEQ ID NO: 722398 - DNA, 20 bp, mouse
gcggccacggtcagagggag

SEQ ID NO: 722399 - DNA, 20 bp, mouse
ggcggggcggccacggtcag

SEQ ID NO: 722400 - DNA, 20 bp, mouse
gatcggagcgcactcccact

SEQ ID NO: 722401 - DNA, 20 bp, mouse
ggccagggctgcctgtgaat

SEQ ID NO: 722402 - DNA, 20 bp, mouse
gacaggcagccctggcatat

SEQ ID NO: 722403 - DNA, 20 bp, mouse
gtgaccgctgatacacagca

SEQ ID NO: 722404 - DNA, 20 bp, mouse
gcggcgcagtcaccgaaccc

SEQ ID NO: 722405 - DNA, 20 bp, mouse
gaggggccgcgccccgggtt

SEQ ID NO: 722406 - DNA, 20 bp, mouse
gaggacgggtagtcaggcaa

SEQ ID NO: 722407 - DNA, 20 bp, mouse
gggtagtcaggcaaaggtta

SEQ ID NO: 722408 - DNA, 20 bp, mouse
ggagcacagtctcccctctc

SEQ ID NO: 722409 - DNA, 20 bp, mouse
ggaggggagactgtgctctg

SEQ ID NO: 722410 - DNA, 20 bp, mouse
gaggctgtgcttctgggtgt

SEQ ID NO: 722411 - DNA, 20 bp, mouse
gcaccggaagtggccccgag

SEQ ID NO: 722412 - DNA, 20 bp, mouse
gagtcaggcaaaggttaggg

SEQ ID NO: 722413 - DNA, 20 bp, mouse
gtgagggaggacgggtagtc

SEQ ID NO: 722414 - DNA, 20 bp, mouse
gctcccatgcagtgccagag

SEQ ID NO: 722415 - DNA, 20 bp, mouse
gtcccctctctggcactgca

SEQ ID NO: 722416 - DNA, 20 bp, mouse
gaacacacagtgggacagta

SEQ ID NO: 722417 - DNA, 20 bp, mouse
ggcaggggattaaaagaaca

SEQ ID NO: 722418 - DNA, 20 bp, mouse
gcagtcgaacgatgggcagg

SEQ ID NO: 722419 - DNA, 20 bp, mouse
gggaactcaggtctaggaaa

SEQ ID NO: 722420 - DNA, 20 bp, mouse
ggggttatacagtcgaacga

SEQ ID NO: 722421 - DNA, 20 bp, mouse
gtctagccagaggcgggcag

SEQ ID NO: 722422 - DNA, 20 bp, mouse
ggtcaccaggagttggaggt

SEQ ID NO: 722423 - DNA, 20 bp, mouse
gggccacaatgaacacacag

SEQ ID NO: 722424 - DNA, 20 bp, mouse
gttaaggaattgtccatctt

SEQ ID NO: 722425 - DNA, 20 bp, mouse
gatacagtcgaacgatgggc

SEQ ID NO: 722426 - DNA, 20 bp, mouse
gctggtgagcgtgagggagg

SEQ ID NO: 722427 - DNA, 20 bp, mouse
gtgagctgcgctgggaactg

SEQ ID NO: 722428 - DNA, 20 bp, mouse
ggaagccaacgtgggatcct

SEQ ID NO: 722429 - DNA, 20 bp, mouse
gggtgcttgcacctgtctgc

SEQ ID NO: 722430 - DNA, 20 bp, mouse
gcagtccgaggatcccacgt

SEQ ID NO: 722431 - DNA, 20 bp, mouse
ggaactgcggtgctgcgaga

SEQ ID NO: 722432 - DNA, 20 bp, mouse
gtgactccacacggtctcta

SEQ ID NO: 722433 - DNA, 20 bp, mouse
gttcccagcgcagctcacac

SEQ ID NO: 722434 - DNA, 20 bp, mouse
gtcacaccggctctgctacc

SEQ ID NO: 722435 - DNA, 20 bp, mouse
gtactgtagggaatgtgcgg

SEQ ID NO: 722436 - DNA, 20 bp, mouse
gagtaggactagctggaggt

SEQ ID NO: 722437 - DNA, 20 bp, mouse
gagtcctactaattttaccg

SEQ ID NO: 722438 - DNA, 20 bp, mouse
gcaactctagagtaagttgc

SEQ ID NO: 722439 - DNA, 20 bp, mouse
gctgaggcagaacctctcta

SEQ ID NO: 722440 - DNA, 20 bp, mouse
gtggagatgggttacctcag

SEQ ID NO: 722441 - DNA, 20 bp, mouse
ggaggttctgcctcagagaa

SEQ ID NO: 722442 - DNA, 20 bp, mouse
gtaacatttgggtttcagga

SEQ ID NO: 722443 - DNA, 20 bp, mouse
gcagccacggtaaaattagt

SEQ ID NO: 722444 - DNA, 20 bp, mouse
gtgctcaagtggctgatgca

SEQ ID NO: 722445 - DNA, 20 bp, mouse
gaaggaaggaaataacattt

SEQ ID NO: 722446 - DNA, 20 bp, mouse
gtgccctaggggaagaggat

SEQ ID NO: 722447 - DNA, 20 bp, mouse
gaggaacccctgcctgtctc

SEQ ID NO: 722448 - DNA, 20 bp, mouse
ggccgcggcccctgcgttac

SEQ ID NO: 722449 - DNA, 20 bp, mouse
gggcggcggcgcggtggcga

SEQ ID NO: 722450 - DNA, 20 bp, mouse
ggacaggcaggggttcctgc

SEQ ID NO: 722451 - DNA, 20 bp, mouse
ggcggcccctgcgttactgg

SEQ ID NO: 722452 - DNA, 20 bp, mouse
ggcggcggcgaggcttgctc

SEQ ID NO: 722453 - DNA, 20 bp, mouse
ggttcctgctggctcggcgg

SEQ ID NO: 722454 - DNA, 20 bp, mouse
gctgccaatgcatgcgggga

SEQ ID NO: 722455 - DNA, 20 bp, mouse
gaagcaaagccagcctgctc

SEQ ID NO: 722456 - DNA, 20 bp, mouse
gcagtgtcagaagccagggt

SEQ ID NO: 722457 - DNA, 20 bp, mouse
gctgccctctggataccttc

SEQ ID NO: 722458 - DNA, 20 bp, mouse
gtcacctgaaggtatccaga

SEQ ID NO: 722459 - DNA, 20 bp, mouse
gtgcagagggagatttagac

SEQ ID NO: 722460 - DNA, 20 bp, mouse
gcctgaaccggcaggaatct

SEQ ID NO: 722461 - DNA, 20 bp, mouse
gttgtcccccactcctaccc

SEQ ID NO: 722462 - DNA, 20 bp, mouse
gtatatgactcacattgcag

SEQ ID NO: 722463 - DNA, 20 bp, mouse
gcgacctgcccatgaacaac

SEQ ID NO: 722464 - DNA, 20 bp, mouse
gcacactcatagcattctag

SEQ ID NO: 722465 - DNA, 20 bp, mouse
gaagttgctccagttgttca

SEQ ID NO: 722466 - DNA, 20 bp, mouse
gagcaggagaggctccaagt

SEQ ID NO: 722467 - DNA, 20 bp, mouse
gctcagttatccatcaccca

SEQ ID NO: 722468 - DNA, 20 bp, mouse
gctgtcttctccctgggtga

SEQ ID NO: 722469 - DNA, 20 bp, mouse
gaggagaggtgtctagcgat

SEQ ID NO: 722470 - DNA, 20 bp, mouse
ggtgctccaagcaagagcgc

SEQ ID NO: 722471 - DNA, 20 bp, mouse
gctgatgtggcaaacccact

SEQ ID NO: 722472 - DNA, 20 bp, mouse
gaaacacaagccaagaggag

SEQ ID NO: 722473 - DNA, 20 bp, mouse
gatggataactgagcaggag

SEQ ID NO: 722474 - DNA, 20 bp, mouse
ggcaagagcgctggctgatg

SEQ ID NO: 722475 - DNA, 20 bp, mouse
gacctccaggatgattcaga

SEQ ID NO: 722476 - DNA, 20 bp, mouse
gttgcctggaaggtgagggt

SEQ ID NO: 722477 - DNA, 20 bp, mouse
gggagaatgcggccgctgat

SEQ ID NO: 722478 - DNA, 20 bp, mouse
ggccgctgattggctggcta

SEQ ID NO: 722479 - DNA, 20 bp, mouse
gctgctttgagtctacccag

SEQ ID NO: 722480 - DNA, 20 bp, mouse
gggcagggctggaagccgct

SEQ ID NO: 722481 - DNA, 20 bp, mouse
gctggggtgagagttgtgcg

SEQ ID NO: 722482 - DNA, 20 bp, mouse
gtccaggcaaacggagaatg

SEQ ID NO: 722483 - DNA, 20 bp, mouse
gcttcttagtaggcacaagg

SEQ ID NO: 722484 - DNA, 20 bp, mouse
ggccctagccagccaatcag

SEQ ID NO: 722485 - DNA, 20 bp, mouse
gtataagagtgtgcactcat

SEQ ID NO: 722486 - DNA, 20 bp, mouse
gaccacctgcagagggaact

SEQ ID NO: 722487 - DNA, 20 bp, mouse
ggccatcgaggggttgtgaa

SEQ ID NO: 722488 - DNA, 20 bp, mouse
gacacccttgctagggagat

SEQ ID NO: 722489 - DNA, 20 bp, mouse
gcctcgatggcgccattcat

SEQ ID NO: 722490 - DNA, 20 bp, mouse
gaacagtggccgcacgtcag

SEQ ID NO: 722491 - DNA, 20 bp, mouse
ggggcaggaagaaggtcagt

SEQ ID NO: 722492 - DNA, 20 bp, mouse
gttagcccagttccctctgc

SEQ ID NO: 722493 - DNA, 20 bp, mouse
gccactcatacagtggtgga

SEQ ID NO: 722494 - DNA, 20 bp, mouse
gcaagtcttagggtttcgct

SEQ ID NO: 722495 - DNA, 20 bp, mouse
gagtctcagacacccttgct

SEQ ID NO: 722496 - DNA, 20 bp, mouse
gccccgggccagagtcctat

SEQ ID NO: 722497 - DNA, 20 bp, mouse
gctggctgcccgctgcgcag

SEQ ID NO: 722498 - DNA, 20 bp, mouse
gggcggggagttcaccacga

SEQ ID NO: 722499 - DNA, 20 bp, mouse
gggagcagaggagcgctagg

SEQ ID NO: 722500 - DNA, 20 bp, mouse
gtcacctggtcggtggagcg

SEQ ID NO: 722501 - DNA, 20 bp, mouse
gccgccttggccatgactaa

SEQ ID NO: 722502 - DNA, 20 bp, mouse
ggatgggctcacctggtcgg

SEQ ID NO: 722503 - DNA, 20 bp, mouse
gccacgacggagtgcggacc

SEQ ID NO: 722504 - DNA, 20 bp, mouse
gggactctggcccgggggat

SEQ ID NO: 722505 - DNA, 20 bp, mouse
gggagcgggggtgactgtcc

SEQ ID NO: 722506 - DNA, 20 bp, mouse
gaagcggagtgatactactg

SEQ ID NO: 722507 - DNA, 20 bp, mouse
gaggttctgatcccgaacta

SEQ ID NO: 722508 - DNA, 20 bp, mouse
gtggaaagacatgtctaaga

SEQ ID NO: 722509 - DNA, 20 bp, mouse
ggcgcggttttccctagttc

SEQ ID NO: 722510 - DNA, 20 bp, mouse
ggaagtgagctggttaggta

SEQ ID NO: 722511 - DNA, 20 bp, mouse
gggcgcacactgcgacactt

SEQ ID NO: 722512 - DNA, 20 bp, mouse
ggtggcgtcagaagaaaaag

SEQ ID NO: 722513 - DNA, 20 bp, mouse
gctaaccagctcacttcagt

SEQ ID NO: 722514 - DNA, 20 bp, mouse
gcgcggctacgtcattacgg

SEQ ID NO: 722515 - DNA, 20 bp, mouse
gtgcttgcgggtgcttggcg

SEQ ID NO: 722516 - DNA, 20 bp, mouse
gggcgccaaaaaaaaagtgg

SEQ ID NO: 722517 - DNA, 20 bp, mouse
gagagtctatgagggttttg

SEQ ID NO: 722518 - DNA, 20 bp, mouse
gcctcctcatatgacgccaa

SEQ ID NO: 722519 - DNA, 20 bp, mouse
ggcaaagagggagtacaggg

SEQ ID NO: 722520 - DNA, 20 bp, mouse
ggagggcactcctgtctcta

SEQ ID NO: 722521 - DNA, 20 bp, mouse
gctgaaatacagatgtatca

SEQ ID NO: 722522 - DNA, 20 bp, mouse
gcatatgacgccaatggaag

SEQ ID NO: 722523 - DNA, 20 bp, mouse
ggcttgtactgcagcctgag

SEQ ID NO: 722524 - DNA, 20 bp, mouse
gtggttcatgcaaccatgaa

SEQ ID NO: 722525 - DNA, 20 bp, mouse
gttcatgcaaccatgaaggg

SEQ ID NO: 722526 - DNA, 20 bp, mouse
ggcagcggagggatactgag

SEQ ID NO: 722527 - DNA, 20 bp, mouse
gttgggagggagtacagagt

SEQ ID NO: 722528 - DNA, 20 bp, mouse
gagtgggtgctgtgatgggt

SEQ ID NO: 722529 - DNA, 20 bp, mouse
gcattggcgacagaaagggg

SEQ ID NO: 722530 - DNA, 20 bp, mouse
gcaaaaccctcatagactct

SEQ ID NO: 722531 - DNA, 20 bp, mouse
ggaagggggggactataagg

SEQ ID NO: 722532 - DNA, 20 bp, mouse
ggttctgaagtgcaaatcta

SEQ ID NO: 722533 - DNA, 20 bp, mouse
gggctcatgcaaccatgaag

SEQ ID NO: 722534 - DNA, 20 bp, mouse
ggttagtaatgcagcctgag

SEQ ID NO: 722535 - DNA, 20 bp, mouse
gagagcatttttgaatctaa

SEQ ID NO: 722536 - DNA, 20 bp, mouse
ggggccctatagtgccctca

SEQ ID NO: 722537 - DNA, 20 bp, mouse
gtgtgcttctgacgtcaggg

SEQ ID NO: 722538 - DNA, 20 bp, mouse
ggagggagagggtgaaccga

SEQ ID NO: 722539 - DNA, 20 bp, mouse
gcacacggtgaacccagcta

SEQ ID NO: 722540 - DNA, 20 bp, mouse
gagggtgaaccgagggacaa

SEQ ID NO: 722541 - DNA, 20 bp, mouse
gtgactgtgcttctgacgtc

SEQ ID NO: 722542 - DNA, 20 bp, mouse
gagctacgcctggcagtcta

SEQ ID NO: 722543 - DNA, 20 bp, mouse
ggcgagaagtgccgcggaac

SEQ ID NO: 722544 - DNA, 20 bp, mouse
gagtgccgcggaactggatt

SEQ ID NO: 722545 - DNA, 20 bp, mouse
gtcactcatgaaataggtgg

SEQ ID NO: 722546 - DNA, 20 bp, mouse
gcaagccaggaaggcgcctg

SEQ ID NO: 722547 - DNA, 20 bp, mouse
gtggggatgcgagcaagctg

SEQ ID NO: 722548 - DNA, 20 bp, mouse
ggcccctctaggatcctcgt

SEQ ID NO: 722549 - DNA, 20 bp, mouse
gtgcgtctggactcttaata

SEQ ID NO: 722550 - DNA, 20 bp, mouse
gtggactcttaatagggagg

SEQ ID NO: 722551 - DNA, 20 bp, mouse
ggctggagcagggtggaaga

SEQ ID NO: 722552 - DNA, 20 bp, mouse
gacctgctgccggtgtgtga

SEQ ID NO: 722553 - DNA, 20 bp, mouse
gttggggcaccaggagtttt

SEQ ID NO: 722554 - DNA, 20 bp, mouse
gcaagctgtggctctggtcc

SEQ ID NO: 722555 - DNA, 20 bp, mouse
ggggcactcccctcacacac

SEQ ID NO: 722556 - DNA, 20 bp, mouse
gtgtgggtgcgtgcgatcgc

SEQ ID NO: 722557 - DNA, 20 bp, mouse
gcgctgggagatgcagccta

SEQ ID NO: 722558 - DNA, 20 bp, mouse
gcgcacccacagactcacgg

SEQ ID NO: 722559 - DNA, 20 bp, mouse
ggtggccaccgtgagtctgt

SEQ ID NO: 722560 - DNA, 20 bp, mouse
gtgcagctcagtacacccct

SEQ ID NO: 722561 - DNA, 20 bp, mouse
gtgtgcaagctcgctagggg

SEQ ID NO: 722562 - DNA, 20 bp, mouse
gcctggaggtgagtcggagg

SEQ ID NO: 722563 - DNA, 20 bp, mouse
gctctcccgaaagaggttcg

SEQ ID NO: 722564 - DNA, 20 bp, mouse
gtcggccgacgcgcactttc

SEQ ID NO: 722565 - DNA, 20 bp, mouse
gccaacccgaaagtgcgcgt

SEQ ID NO: 722566 - DNA, 20 bp, mouse
ggggtaaggccctgcagcaa

SEQ ID NO: 722567 - DNA, 20 bp, mouse
gcgagagaggtgtgacttta

SEQ ID NO: 722568 - DNA, 20 bp, mouse
gaggtgccttggcccgagag

SEQ ID NO: 722569 - DNA, 20 bp, mouse
gtcacacctctctcgggcca

SEQ ID NO: 722570 - DNA, 20 bp, mouse
gaacctgagtgaggtcctgc

SEQ ID NO: 722571 - DNA, 20 bp, mouse
ggttctcaccaaagaaatct

SEQ ID NO: 722572 - DNA, 20 bp, mouse
gaaaatcagagtttggggta

SEQ ID NO: 722573 - DNA, 20 bp, mouse
ggaaaaagcccactcagaga

SEQ ID NO: 722574 - DNA, 20 bp, mouse
gcacacctagtccagtttca

SEQ ID NO: 722575 - DNA, 20 bp, mouse
gtaatctctcctcaaatggg

SEQ ID NO: 722576 - DNA, 20 bp, mouse
gacagtgggcatctgagagc

SEQ ID NO: 722577 - DNA, 20 bp, mouse
gacggccgagcccgtactac

SEQ ID NO: 722578 - DNA, 20 bp, mouse
gtttctgaaagaagcagact

SEQ ID NO: 722579 - DNA, 20 bp, mouse
ggtacgggctcggccgttaa

SEQ ID NO: 722580 - DNA, 20 bp, mouse
ggccgagcccgtactactgg

SEQ ID NO: 722581 - DNA, 20 bp, mouse
gtcctccagtagtacgggct

SEQ ID NO: 722582 - DNA, 20 bp, mouse
gatcaactactgtaattctt

SEQ ID NO: 722583 - DNA, 20 bp, mouse
gaaatcccttaactttgctc

SEQ ID NO: 722584 - DNA, 20 bp, mouse
gtgactccagagcaaagtta

SEQ ID NO: 722585 - DNA, 20 bp, mouse
gaaatccttctgcttaaaaa

SEQ ID NO: 722586 - DNA, 20 bp, mouse
ggaagaccggggtttcggtg

SEQ ID NO: 722587 - DNA, 20 bp, mouse
gtgggcagcagcgagacaaa

SEQ ID NO: 722588 - DNA, 20 bp, mouse
ggcgcccagccgaccaggga

SEQ ID NO: 722589 - DNA, 20 bp, mouse
gcagacgccgcccggccctg

SEQ ID NO: 722590 - DNA, 20 bp, mouse
gtacccagaccagagagggt

SEQ ID NO: 722591 - DNA, 20 bp, mouse
gctccggcgagtggcggccc

SEQ ID NO: 722592 - DNA, 20 bp, mouse
gccgccactcgccggagcgt

SEQ ID NO: 722593 - DNA, 20 bp, mouse
ggccggaagtgcggccgaga

SEQ ID NO: 722594 - DNA, 20 bp, mouse
gagtgcggccgagagggacg

SEQ ID NO: 722595 - DNA, 20 bp, mouse
gtccctctcggccgcacttc

SEQ ID NO: 722596 - DNA, 20 bp, mouse
gagggactggggcaggacga

SEQ ID NO: 722597 - DNA, 20 bp, mouse
ggggccacagggaatgtcaa

SEQ ID NO: 722598 - DNA, 20 bp, mouse
gccgcccatgtcattccctt

SEQ ID NO: 722599 - DNA, 20 bp, mouse
gcgatggcgccctttagggg

SEQ ID NO: 722600 - DNA, 20 bp, mouse
gtcgggaaggttgcacaaaa

SEQ ID NO: 722601 - DNA, 20 bp, mouse
ggtggggcacggagggactg

SEQ ID NO: 722602 - DNA, 20 bp, mouse
gagggtcaggaaggggggat

SEQ ID NO: 722603 - DNA, 20 bp, mouse
gaggacgatggcgcccttta

SEQ ID NO: 722604 - DNA, 20 bp, mouse
gacacagcggccggctctgt

SEQ ID NO: 722605 - DNA, 20 bp, mouse
gtgagaaaacagccttgctg

SEQ ID NO: 722606 - DNA, 20 bp, mouse
ggggcctggtcacagcggag

SEQ ID NO: 722607 - DNA, 20 bp, mouse
gcgctgtgaccaggccccag

SEQ ID NO: 722608 - DNA, 20 bp, mouse
gcctgagctgtgggcctcga

SEQ ID NO: 722609 - DNA, 20 bp, mouse
gtggctgggtaggagctcgc

SEQ ID NO: 722610 - DNA, 20 bp, mouse
gagtcccctaagctccccca

SEQ ID NO: 722611 - DNA, 20 bp, mouse
gcctacccagccagccctcg

SEQ ID NO: 722612 - DNA, 20 bp, mouse
gagctgtgggcctcgagggc

SEQ ID NO: 722613 - DNA, 20 bp, mouse
gtgggtaggagctcgcaggg

SEQ ID NO: 722614 - DNA, 20 bp, mouse
gagggagcctagcgccctgg

SEQ ID NO: 722615 - DNA, 20 bp, mouse
gttaactttccatctgtcac

SEQ ID NO: 722616 - DNA, 20 bp, mouse
gtggccgttcggtccggagc

SEQ ID NO: 722617 - DNA, 20 bp, mouse
gaggcccgctccggaccgaa

SEQ ID NO: 722618 - DNA, 20 bp, mouse
ggcgacgttcgcttccgggg

SEQ ID NO: 722619 - DNA, 20 bp, mouse
gcgcccgcctgcgaccgcgg

SEQ ID NO: 722620 - DNA, 20 bp, mouse
gccgcccaccaggcccgctc

SEQ ID NO: 722621 - DNA, 20 bp, mouse
gcgctcgccgcgtggccgtt

SEQ ID NO: 722622 - DNA, 20 bp, mouse
gcccggagcctgaccctcga

SEQ ID NO: 722623 - DNA, 20 bp, mouse
ggggcgcccgcctgcgaccg

SEQ ID NO: 722624 - DNA, 20 bp, mouse
gactgcaatgaagacgtcgt

SEQ ID NO: 722625 - DNA, 20 bp, mouse
ggcgcccaggccagagccgc

SEQ ID NO: 722626 - DNA, 20 bp, mouse
gccgacaaggcgggttgcgg

SEQ ID NO: 722627 - DNA, 20 bp, mouse
gggcggaagcgcttagagac

SEQ ID NO: 722628 - DNA, 20 bp, mouse
gtggatttacagagcggcct

SEQ ID NO: 722629 - DNA, 20 bp, mouse
gagcgcttagagacgggtgc

SEQ ID NO: 722630 - DNA, 20 bp, mouse
gtcgcgagtgaagagttcta

SEQ ID NO: 722631 - DNA, 20 bp, mouse
ggcgaggccgcgggagacag

SEQ ID NO: 722632 - DNA, 20 bp, mouse
ggcacagccgattggaggaa

SEQ ID NO: 722633 - DNA, 20 bp, mouse
gctgaggcagagaccccgga

SEQ ID NO: 722634 - DNA, 20 bp, mouse
ggggcgcgtgcgagggtctt

SEQ ID NO: 722635 - DNA, 20 bp, mouse
gggaaaaagcagcttcatgt

SEQ ID NO: 722636 - DNA, 20 bp, mouse
ggtcccgcctaccgtggggt

SEQ ID NO: 722637 - DNA, 20 bp, mouse
gcggcggtcccgcctaccgt

SEQ ID NO: 722638 - DNA, 20 bp, mouse
gcgcccaccggccaccactg

SEQ ID NO: 722639 - DNA, 20 bp, mouse
gggaccgccgcagtggtggc

SEQ ID NO: 722640 - DNA, 20 bp, mouse
gccaccggccaccactgcgg

SEQ ID NO: 722641 - DNA, 20 bp, mouse
gccgccgccaggcggaggga

SEQ ID NO: 722642 - DNA, 20 bp, mouse
gccgcctaccgtggggtggg

SEQ ID NO: 722643 - DNA, 20 bp, mouse
gccaccctccctccgcctgg

SEQ ID NO: 722644 - DNA, 20 bp, mouse
gccgaggaagtgatgtgctg

SEQ ID NO: 722645 - DNA, 20 bp, mouse
gccacaagaggtgacaggaa

SEQ ID NO: 722646 - DNA, 20 bp, mouse
gggcggggctagacgagcca

SEQ ID NO: 722647 - DNA, 20 bp, mouse
ggcggggctaggcgggtgga

SEQ ID NO: 722648 - DNA, 20 bp, mouse
ggggaaagaggcagtggact

SEQ ID NO: 722649 - DNA, 20 bp, mouse
gcgcccccggcaggtcacgt

SEQ ID NO: 722650 - DNA, 20 bp, mouse
gacaataagcttctagttgg

SEQ ID NO: 722651 - DNA, 20 bp, mouse
gaggacaataagcttctagt

SEQ ID NO: 722652 - DNA, 20 bp, mouse
ggggcgttgtcagtttgaat

SEQ ID NO: 722653 - DNA, 20 bp, mouse
gcaatggcaccggtggggcg

SEQ ID NO: 722654 - DNA, 20 bp, mouse
gcagaggagtacaggcgctg

SEQ ID NO: 722655 - DNA, 20 bp, mouse
gacacagatctttagaagga

SEQ ID NO: 722656 - DNA, 20 bp, mouse
ggagcaagctcctgacaggg

SEQ ID NO: 722657 - DNA, 20 bp, mouse
gccgacggtggagagtatga

SEQ ID NO: 722658 - DNA, 20 bp, mouse
gtgacagggcggattcctgc

SEQ ID NO: 722659 - DNA, 20 bp, mouse
gctgccccaagcattgccga

SEQ ID NO: 722660 - DNA, 20 bp, mouse
gtagggggttactgaggctc

SEQ ID NO: 722661 - DNA, 20 bp, mouse
gagtggagcaagctcctgac

SEQ ID NO: 722662 - DNA, 20 bp, mouse
gggggggctgaccaggaacc

SEQ ID NO: 722663 - DNA, 20 bp, mouse
ggaaagacatggttctggtg

SEQ ID NO: 722664 - DNA, 20 bp, mouse
gttgacctctcttgccccag

SEQ ID NO: 722665 - DNA, 20 bp, mouse
ggagcagtgtggccggctag

SEQ ID NO: 722666 - DNA, 20 bp, mouse
gccgcctagtgtccccacga

SEQ ID NO: 722667 - DNA, 20 bp, mouse
ggggtctcttgctccctcgt

SEQ ID NO: 722668 - DNA, 20 bp, mouse
ggctccctcgtggggacact

SEQ ID NO: 722669 - DNA, 20 bp, mouse
gggccccgccccatcaggct

SEQ ID NO: 722670 - DNA, 20 bp, mouse
ggagacccacttggggagta

SEQ ID NO: 722671 - DNA, 20 bp, mouse
gtggggacactaggcggcac

SEQ ID NO: 722672 - DNA, 20 bp, mouse
ggtgccagagggagttggta

SEQ ID NO: 722673 - DNA, 20 bp, mouse
gggagtgtgtatcaggtctg

SEQ ID NO: 722674 - DNA, 20 bp, mouse
ggtaaatctccagtagtccc

SEQ ID NO: 722675 - DNA, 20 bp, mouse
gctgccttaccaactccctc

SEQ ID NO: 722676 - DNA, 20 bp, mouse
ggaggcggggtgtgcatcta

SEQ ID NO: 722677 - DNA, 20 bp, mouse
ggggtggggagcggtcgtct

SEQ ID NO: 722678 - DNA, 20 bp, mouse
ggggacacctacagtgacgt

SEQ ID NO: 722679 - DNA, 20 bp, mouse
gaggcccgaggcggagtcgg

SEQ ID NO: 722680 - DNA, 20 bp, mouse
ggcggtgggtgtgcgaatac

SEQ ID NO: 722681 - DNA, 20 bp, mouse
gggcctgcgcgctgacttct

SEQ ID NO: 722682 - DNA, 20 bp, mouse
gtggggagcggtcgtctggg

SEQ ID NO: 722683 - DNA, 20 bp, mouse
ggcctggcgcaggccagact

SEQ ID NO: 722684 - DNA, 20 bp, mouse
gtgtaggtgtcccgaggtga

SEQ ID NO: 722685 - DNA, 20 bp, mouse
gcatcactgcagtgttgata

SEQ ID NO: 722686 - DNA, 20 bp, mouse
ggtaaagttacacaatataa

SEQ ID NO: 722687 - DNA, 20 bp, mouse
gcttatgactagaaacgtgt

SEQ ID NO: 722688 - DNA, 20 bp, mouse
gcggttgagtaagacagagc

SEQ ID NO: 722689 - DNA, 20 bp, mouse
gggaaggaagctgcttgctt

SEQ ID NO: 722690 - DNA, 20 bp, mouse
gtgccagaggccatcttcct

SEQ ID NO: 722691 - DNA, 20 bp, mouse
gcgaaggagcatgcatgttg

SEQ ID NO: 722692 - DNA, 20 bp, mouse
gttagtctagagtcccgcct

SEQ ID NO: 722693 - DNA, 20 bp, mouse
gtagccgttgttattgccag

SEQ ID NO: 722694 - DNA, 20 bp, mouse
gagaggagctgcgtcgcatc

SEQ ID NO: 722695 - DNA, 20 bp, mouse
gctctagactaattaagaaa

SEQ ID NO: 722696 - DNA, 20 bp, mouse
gcccactggcaacctggaaa

SEQ ID NO: 722697 - DNA, 20 bp, mouse
gctggaaaccagagccataa

SEQ ID NO: 722698 - DNA, 20 bp, mouse
gtgaataattcactccttgc

SEQ ID NO: 722699 - DNA, 20 bp, mouse
gaggcaaaatcaacttgctg

SEQ ID NO: 722700 - DNA, 20 bp, mouse
gttcagtggcagtaagtggg

SEQ ID NO: 722701 - DNA, 20 bp, mouse
ggccctttccaggttgccag

SEQ ID NO: 722702 - DNA, 20 bp, mouse
gagagccataaaggtcaagt

SEQ ID NO: 722703 - DNA, 20 bp, mouse
gccataaaggtcaagtgggg

SEQ ID NO: 722704 - DNA, 20 bp, mouse
gtcatcccgggaatgctcaa

SEQ ID NO: 722705 - DNA, 20 bp, mouse
gtgggagacaagatatgctt

SEQ ID NO: 722706 - DNA, 20 bp, mouse
gtcaccgtcgccccggtctg

SEQ ID NO: 722707 - DNA, 20 bp, mouse
gacggtgacacaagcctagg

SEQ ID NO: 722708 - DNA, 20 bp, mouse
ggcgacggtgacacaagcct

SEQ ID NO: 722709 - DNA, 20 bp, mouse
gtcctcctctccccagaccg

SEQ ID NO: 722710 - DNA, 20 bp, mouse
gtgaaacaggaggattgcgt

SEQ ID NO: 722711 - DNA, 20 bp, mouse
ggcggattggccacagtgga

SEQ ID NO: 722712 - DNA, 20 bp, mouse
gtctccccagaccggggcga

SEQ ID NO: 722713 - DNA, 20 bp, mouse
gccaatccgcagccaggcgg

SEQ ID NO: 722714 - DNA, 20 bp, mouse
ggggttctatgttaagtcct

SEQ ID NO: 722715 - DNA, 20 bp, mouse
gagaagggggcccggctgcc

SEQ ID NO: 722716 - DNA, 20 bp, mouse
ggggcctcgcgtcttagcgc

SEQ ID NO: 722717 - DNA, 20 bp, mouse
gctgaatgaagggacggctt

SEQ ID NO: 722718 - DNA, 20 bp, mouse
gtgaagggacggcttgggcg

SEQ ID NO: 722719 - DNA, 20 bp, mouse
gggacgcgcgaggccgagta

SEQ ID NO: 722720 - DNA, 20 bp, mouse
gtggtcggctgcgtgagggg

SEQ ID NO: 722721 - DNA, 20 bp, mouse
gaggttgcctgcagcggagc

SEQ ID NO: 722722 - DNA, 20 bp, mouse
gagggcgggcaagccatact

SEQ ID NO: 722723 - DNA, 20 bp, mouse
ggcgcctgcgctaagacgcg

SEQ ID NO: 722724 - DNA, 20 bp, mouse
gcgtcagtgggcgtgcccga

SEQ ID NO: 722725 - DNA, 20 bp, mouse
gctcccgcgtccctatcact

SEQ ID NO: 722726 - DNA, 20 bp, mouse
gcaatagtgtggtgaggccc

SEQ ID NO: 722727 - DNA, 20 bp, mouse
ggaattcggagtgctcgtgg

SEQ ID NO: 722728 - DNA, 20 bp, mouse
gtgctcgtgggggcgtgtgt

SEQ ID NO: 722729 - DNA, 20 bp, mouse
gctcaccacactattgaatt

SEQ ID NO: 722730 - DNA, 20 bp, mouse
gaggattcatatgagttcca

SEQ ID NO: 722731 - DNA, 20 bp, mouse
gtatgctgctatactgcgta

SEQ ID NO: 722732 - DNA, 20 bp, mouse
ggattggtcttaataggtgt

SEQ ID NO: 722733 - DNA, 20 bp, mouse
gctcacaagggaatcgagct

SEQ ID NO: 722734 - DNA, 20 bp, mouse
gcagaattatcagacagttg

SEQ ID NO: 722735 - DNA, 20 bp, mouse
gagccaccagatgtaggtgg

SEQ ID NO: 722736 - DNA, 20 bp, mouse
gagtggcttgagttggaaaa

SEQ ID NO: 722737 - DNA, 20 bp, mouse
gtcctgtatcaggagagcaa

SEQ ID NO: 722738 - DNA, 20 bp, mouse
gcacatgctctgacaggtga

SEQ ID NO: 722739 - DNA, 20 bp, mouse
gggtaagcacatgctctgac

SEQ ID NO: 722740 - DNA, 20 bp, mouse
ggtgagagcagcactgtgat

SEQ ID NO: 722741 - DNA, 20 bp, mouse
gggtgaaggtgacatgaagg

SEQ ID NO: 722742 - DNA, 20 bp, mouse
gggagccagtactcaggtaa

SEQ ID NO: 722743 - DNA, 20 bp, mouse
gggcttgagttggaaaaggg

SEQ ID NO: 722744 - DNA, 20 bp, mouse
gctgatacaggagacacacg

SEQ ID NO: 722745 - DNA, 20 bp, mouse
ggtaaatcagtggcttgagt

SEQ ID NO: 722746 - DNA, 20 bp, mouse
gaaccagcgcagagcagcta

SEQ ID NO: 722747 - DNA, 20 bp, mouse
gaaactggggctcagagtgg

SEQ ID NO: 722748 - DNA, 20 bp, mouse
gtgcagagacgactgagaag

SEQ ID NO: 722749 - DNA, 20 bp, mouse
gagggcgcagagacttaata

SEQ ID NO: 722750 - DNA, 20 bp, mouse
gttccctagctgctctgcgc

SEQ ID NO: 722751 - DNA, 20 bp, mouse
gtcgctcaaactcaagctca

SEQ ID NO: 722752 - DNA, 20 bp, mouse
gagggcaaagacaaggcgga

SEQ ID NO: 722753 - DNA, 20 bp, mouse
gaggcgcagagtcccggctc

SEQ ID NO: 722754 - DNA, 20 bp, mouse
gagacttaatagggagatag

SEQ ID NO: 722755 - DNA, 20 bp, mouse
gtagcggagaaaaatctgtg

SEQ ID NO: 722756 - DNA, 20 bp, mouse
ggaaggggttacagaccctt

SEQ ID NO: 722757 - DNA, 20 bp, mouse
gagcttaaggagagccggaa

SEQ ID NO: 722758 - DNA, 20 bp, mouse
gcaggctggaatgcaaggcg

SEQ ID NO: 722759 - DNA, 20 bp, mouse
gtcggctgctgaagagcagg

SEQ ID NO: 722760 - DNA, 20 bp, mouse
gaaaacgttttcgtagaagg

SEQ ID NO: 722761 - DNA, 20 bp, mouse
gactgaataacacccagaaa

SEQ ID NO: 722762 - DNA, 20 bp, mouse
gtattgctcagtgaacacac

SEQ ID NO: 722763 - DNA, 20 bp, mouse
gttacaagagcaccaccttc

SEQ ID NO: 722764 - DNA, 20 bp, mouse
gtgttcactgagcaatagat

SEQ ID NO: 722765 - DNA, 20 bp, mouse
gcgtttgattcttctgggaa

SEQ ID NO: 722766 - DNA, 20 bp, mouse
ggctggggaaagagtccggc

SEQ ID NO: 722767 - DNA, 20 bp, mouse
gcgagcgcgggcctaggcct

SEQ ID NO: 722768 - DNA, 20 bp, mouse
gacgccgaggcggcctccgg

SEQ ID NO: 722769 - DNA, 20 bp, mouse
ggggtccaggggagaagccc

SEQ ID NO: 722770 - DNA, 20 bp, mouse
ggggacatggacgcgagcgc

SEQ ID NO: 722771 - DNA, 20 bp, mouse
ggcctggggcggaagtctgg

SEQ ID NO: 722772 - DNA, 20 bp, mouse
ggcttctaaggcaggaactg

SEQ ID NO: 722773 - DNA, 20 bp, mouse
gggtctgcacgattaggctg

SEQ ID NO: 722774 - DNA, 20 bp, mouse
ggcgctatcacgccccgccc

SEQ ID NO: 722775 - DNA, 20 bp, mouse
gtggacgcgagcgcgggcct

SEQ ID NO: 722776 - DNA, 20 bp, mouse
gagaagaggcggtggtagga

SEQ ID NO: 722777 - DNA, 20 bp, mouse
gtggagcagccttgactcgg

SEQ ID NO: 722778 - DNA, 20 bp, mouse
gaggtatagtccctccccaa

SEQ ID NO: 722779 - DNA, 20 bp, mouse
gtacacggaatcccttgggg

SEQ ID NO: 722780 - DNA, 20 bp, mouse
gggactatacctccgagtca

SEQ ID NO: 722781 - DNA, 20 bp, mouse
gagcctgaaaggacacgcac

SEQ ID NO: 722782 - DNA, 20 bp, mouse
gactgtacacggaatccctt

SEQ ID NO: 722783 - DNA, 20 bp, mouse
gccaatcagcctaatgaaat

SEQ ID NO: 722784 - DNA, 20 bp, mouse
gtatcttgggtggtctgcga

SEQ ID NO: 722785 - DNA, 20 bp, mouse
gacagccttgtaactgtaca

SEQ ID NO: 722786 - DNA, 20 bp, mouse
gacgcccactggaagaggct

SEQ ID NO: 722787 - DNA, 20 bp, mouse
ggaccggccccctggaaaga

SEQ ID NO: 722788 - DNA, 20 bp, mouse
gaagtcacacctcactcgac

SEQ ID NO: 722789 - DNA, 20 bp, mouse
gagcaccagccctctttcca

SEQ ID NO: 722790 - DNA, 20 bp, mouse
gagggctggtgctcagaacc

SEQ ID NO: 722791 - DNA, 20 bp, mouse
gtacacgctgattagcgaca

SEQ ID NO: 722792 - DNA, 20 bp, mouse
ggtgtacagtagaagaaatt

SEQ ID NO: 722793 - DNA, 20 bp, mouse
gattagcgacagggtgcaaa

SEQ ID NO: 722794 - DNA, 20 bp, mouse
gcttaggaacctgtcgagtg

SEQ ID NO: 722795 - DNA, 20 bp, mouse
gctatcctgagtaccctaaa

SEQ ID NO: 722796 - DNA, 20 bp, mouse
gaggactcaaacggcgaaaa

SEQ ID NO: 722797 - DNA, 20 bp, mouse
ggaagtaagaggttagcttg

SEQ ID NO: 722798 - DNA, 20 bp, mouse
ggtggcgggcacgtgcatat

SEQ ID NO: 722799 - DNA, 20 bp, mouse
gcacacgcatacggaggccg

SEQ ID NO: 722800 - DNA, 20 bp, mouse
gtacttctacatacacatcg

SEQ ID NO: 722801 - DNA, 20 bp, mouse
gacactcctacataactaga

SEQ ID NO: 722802 - DNA, 20 bp, mouse
ggttaaaaggggtttcgtgg

SEQ ID NO: 722803 - DNA, 20 bp, mouse
gacgcacacgcacacgcata

SEQ ID NO: 722804 - DNA, 20 bp, mouse
gcttatccatctagttatgt

SEQ ID NO: 722805 - DNA, 20 bp, mouse
ggtgaattatagcagttaaa

SEQ ID NO: 722806 - DNA, 20 bp, mouse
ggggacccatcagggcggtc

SEQ ID NO: 722807 - DNA, 20 bp, mouse
ggtagaatgaagagccctga

SEQ ID NO: 722808 - DNA, 20 bp, mouse
gcctgcagctgggacccatc

SEQ ID NO: 722809 - DNA, 20 bp, mouse
gggaccgcccaccccgggaa

SEQ ID NO: 722810 - DNA, 20 bp, mouse
gcatcagggcggtctgggag

SEQ ID NO: 722811 - DNA, 20 bp, mouse
gggcctgggtcctcaattat

SEQ ID NO: 722812 - DNA, 20 bp, mouse
gcccgcccccacacgcctat

SEQ ID NO: 722813 - DNA, 20 bp, mouse
gtgtgaggtcgaggaaacca

SEQ ID NO: 722814 - DNA, 20 bp, mouse
gcgctcgcgcagaatgagcc

SEQ ID NO: 722815 - DNA, 20 bp, mouse
ggggctgatccctgtggtag

SEQ ID NO: 722816 - DNA, 20 bp, mouse
gtgctcctcctctgtctcgt

SEQ ID NO: 722817 - DNA, 20 bp, mouse
gggctactgtgttgtgtctt

SEQ ID NO: 722818 - DNA, 20 bp, mouse
ggaaccgcattgtgtggtgg

SEQ ID NO: 722819 - DNA, 20 bp, mouse
gccccgcccctaatactcgc

SEQ ID NO: 722820 - DNA, 20 bp, mouse
gctgttgaacccgtctttct

SEQ ID NO: 722821 - DNA, 20 bp, mouse
gacccagcgagtattagggg

SEQ ID NO: 722822 - DNA, 20 bp, mouse
gtctgggagaggacgctaat

SEQ ID NO: 722823 - DNA, 20 bp, mouse
gccgcagctcccggctaccc

SEQ ID NO: 722824 - DNA, 20 bp, mouse
gaggaagtgggccggtcctc

SEQ ID NO: 722825 - DNA, 20 bp, mouse
gcgtcctctcccagaaagac

SEQ ID NO: 722826 - DNA, 20 bp, mouse
gcgcacacaccgggcaggga

SEQ ID NO: 722827 - DNA, 20 bp, mouse
gcgcgcgcacacaccgggca

SEQ ID NO: 722828 - DNA, 20 bp, mouse
ggcgcggcgaggacccacgt

SEQ ID NO: 722829 - DNA, 20 bp, mouse
gtgggtcacccaaacaaagg

SEQ ID NO: 722830 - DNA, 20 bp, mouse
gacgcggcgccgcctttgtt

SEQ ID NO: 722831 - DNA, 20 bp, mouse
gacaccgggcagggagggcg

SEQ ID NO: 722832 - DNA, 20 bp, mouse
gaaaggcggcgccgcgtgat

SEQ ID NO: 722833 - DNA, 20 bp, mouse
gggcggccacgcgtgcgcgt

SEQ ID NO: 722834 - DNA, 20 bp, mouse
gcgtggctgcgactggcagg

SEQ ID NO: 722835 - DNA, 20 bp, mouse
ggccgggagagaggtgacag

SEQ ID NO: 722836 - DNA, 20 bp, mouse
gactcccccacagccaaagt

SEQ ID NO: 722837 - DNA, 20 bp, mouse
gcctctctgagctatgacaa

SEQ ID NO: 722838 - DNA, 20 bp, mouse
gtgtgctcataaacccactt

SEQ ID NO: 722839 - DNA, 20 bp, mouse
ggctctgcatcgtcctaatg

SEQ ID NO: 722840 - DNA, 20 bp, mouse
gcccttgatgggggagaaac

SEQ ID NO: 722841 - DNA, 20 bp, mouse
gaaacagataagaaatgtga

SEQ ID NO: 722842 - DNA, 20 bp, mouse
gacacccagagcatctgccc

SEQ ID NO: 722843 - DNA, 20 bp, mouse
gccggaaactgcccttgatg

SEQ ID NO: 722844 - DNA, 20 bp, mouse
gggcagcttgagttgagaat

SEQ ID NO: 722845 - DNA, 20 bp, mouse
gctgtgggggagtccccatt

SEQ ID NO: 722846 - DNA, 20 bp, mouse
gacagaactcaggacggggt

SEQ ID NO: 722847 - DNA, 20 bp, mouse
gcaaatgaggcctgctccca

SEQ ID NO: 722848 - DNA, 20 bp, mouse
gctgtggagggcctccaggt

SEQ ID NO: 722849 - DNA, 20 bp, mouse
gcggggttggtctctctgga

SEQ ID NO: 722850 - DNA, 20 bp, mouse
gctggggagagactgagctg

SEQ ID NO: 722851 - DNA, 20 bp, mouse
gggcagttgtcactcccttt

SEQ ID NO: 722852 - DNA, 20 bp, mouse
gtctctggagggcgcagccc

SEQ ID NO: 722853 - DNA, 20 bp, mouse
gctgggacatattgtcccaa

SEQ ID NO: 722854 - DNA, 20 bp, mouse
gggggctacagaactcagga

SEQ ID NO: 722855 - DNA, 20 bp, mouse
gaggcctcatttggcatatc

SEQ ID NO: 722856 - DNA, 20 bp, mouse
gctcagtaaacactgtcctg

SEQ ID NO: 722857 - DNA, 20 bp, mouse
gtggttaaatatagctgccg

SEQ ID NO: 722858 - DNA, 20 bp, mouse
gaggatgccgagttccccat

SEQ ID NO: 722859 - DNA, 20 bp, mouse
gagttggggagtgaggggct

SEQ ID NO: 722860 - DNA, 20 bp, mouse
gaactggaacttgaggccca

SEQ ID NO: 722861 - DNA, 20 bp, mouse
gtattggccaatggggaact

SEQ ID NO: 722862 - DNA, 20 bp, mouse
gcagtcttttctagccccct

SEQ ID NO: 722863 - DNA, 20 bp, mouse
gtgctatcaactggaacttg

SEQ ID NO: 722864 - DNA, 20 bp, mouse
gcacagtggtcagtacatgg

SEQ ID NO: 722865 - DNA, 20 bp, mouse
gtaagagaattagacagtat

SEQ ID NO: 722866 - DNA, 20 bp, mouse
ggggagggacaggacatttg

SEQ ID NO: 722867 - DNA, 20 bp, mouse
ggggacttgggcgctcagtg

SEQ ID NO: 722868 - DNA, 20 bp, mouse
ggaagctcccggggagtgag

SEQ ID NO: 722869 - DNA, 20 bp, mouse
gccaggctctgggacactct

SEQ ID NO: 722870 - DNA, 20 bp, mouse
ggatggctgcgcactgtggg

SEQ ID NO: 722871 - DNA, 20 bp, mouse
gtggagatgggggcacaata

SEQ ID NO: 722872 - DNA, 20 bp, mouse
gcacgcaggcaccgcctcca

SEQ ID NO: 722873 - DNA, 20 bp, mouse
gtgggcggggctccccatag

SEQ ID NO: 722874 - DNA, 20 bp, mouse
ggctgcccacggcagcggga

SEQ ID NO: 722875 - DNA, 20 bp, mouse
gactgcaggaagccctagac

SEQ ID NO: 722876 - DNA, 20 bp, mouse
gacgccctgcgcccaggccg

SEQ ID NO: 722877 - DNA, 20 bp, mouse
gtgggcgcagggcgtggcgc

SEQ ID NO: 722878 - DNA, 20 bp, mouse
ggtcccgcgcgctgcaagca

SEQ ID NO: 722879 - DNA, 20 bp, mouse
gcgggctcgcggggttggcg

SEQ ID NO: 722880 - DNA, 20 bp, mouse
ggctcggcggccgccagcgc

SEQ ID NO: 722881 - DNA, 20 bp, mouse
gcgcgcgctgcaagcatggt

SEQ ID NO: 722882 - DNA, 20 bp, mouse
gggcccggacaaggaaactc

SEQ ID NO: 722883 - DNA, 20 bp, mouse
gggcggccgccgagcggtcc

SEQ ID NO: 722884 - DNA, 20 bp, mouse
ggcggctcctcccgcgctgg

SEQ ID NO: 722885 - DNA, 20 bp, mouse
gtcccgagggccattcggaa

SEQ ID NO: 722886 - DNA, 20 bp, mouse
gaggagggtggggacgtaga

SEQ ID NO: 722887 - DNA, 20 bp, mouse
gcgcgtagcccgggcactcg

SEQ ID NO: 722888 - DNA, 20 bp, mouse
gcgggaagagcggtgctggg

SEQ ID NO: 722889 - DNA, 20 bp, mouse
gaaagcggcggtgggactta

SEQ ID NO: 722890 - DNA, 20 bp, mouse
gccgccctggccgtgagcgc

SEQ ID NO: 722891 - DNA, 20 bp, mouse
gagggtggggacgtagaggg

SEQ ID NO: 722892 - DNA, 20 bp, mouse
gcgggccctgcgcgtagccc

SEQ ID NO: 722893 - DNA, 20 bp, mouse
gagtgcccgggctacgcgca

SEQ ID NO: 722894 - DNA, 20 bp, mouse
gcacccacttgggaaagcgg

SEQ ID NO: 722895 - DNA, 20 bp, mouse
ggatggagcgccagcctggc

SEQ ID NO: 722896 - DNA, 20 bp, mouse
gcggcaggtagcctagaggg

SEQ ID NO: 722897 - DNA, 20 bp, mouse
gaggagcggggagagatctc

SEQ ID NO: 722898 - DNA, 20 bp, mouse
gcggcccgcagcaggtggca

SEQ ID NO: 722899 - DNA, 20 bp, mouse
ggcccggcaggtagcctaga

SEQ ID NO: 722900 - DNA, 20 bp, mouse
gtagagggttacaacggccc

SEQ ID NO: 722901 - DNA, 20 bp, mouse
gggttacaacggcccagggg

SEQ ID NO: 722902 - DNA, 20 bp, mouse
ggcagcaggtggcacggact

SEQ ID NO: 722903 - DNA, 20 bp, mouse
gatgcgcgaagcccccctct

SEQ ID NO: 722904 - DNA, 20 bp, mouse
gcccgcgagacttcccccgg

SEQ ID NO: 722905 - DNA, 20 bp, mouse
gcgtcagctcggcccgcagc

SEQ ID NO: 722906 - DNA, 20 bp, mouse
gtggacctgtcagtcgcctg

SEQ ID NO: 722907 - DNA, 20 bp, mouse
gtggggctgagattgaaaag

SEQ ID NO: 722908 - DNA, 20 bp, mouse
gggtgccggagatgtgtgaa

SEQ ID NO: 722909 - DNA, 20 bp, mouse
gtcagccccaggcgactgac

SEQ ID NO: 722910 - DNA, 20 bp, mouse
ggagctgttgcctggaaggg

SEQ ID NO: 722911 - DNA, 20 bp, mouse
ggtaaagcagctgatgctat

SEQ ID NO: 722912 - DNA, 20 bp, mouse
ggactgaaggaggctctcac

SEQ ID NO: 722913 - DNA, 20 bp, mouse
gaggaagaggaagtgtattc

SEQ ID NO: 722914 - DNA, 20 bp, mouse
ggggcagcagctggtggcga

SEQ ID NO: 722915 - DNA, 20 bp, mouse
gggagagctgttgcctggaa

SEQ ID NO: 722916 - DNA, 20 bp, mouse
gcaggtgccccggagagaac

SEQ ID NO: 722917 - DNA, 20 bp, mouse
ggcagcaggtgctaggagag

SEQ ID NO: 722918 - DNA, 20 bp, mouse
ggggcaagagcaattcgagg

SEQ ID NO: 722919 - DNA, 20 bp, mouse
gggaatgggacgagtaggag

SEQ ID NO: 722920 - DNA, 20 bp, mouse
ggctcggatctcacccccta

SEQ ID NO: 722921 - DNA, 20 bp, mouse
gcacctgctgctcagtagga

SEQ ID NO: 722922 - DNA, 20 bp, mouse
gaactgaccatcattggaat

SEQ ID NO: 722923 - DNA, 20 bp, mouse
ggggacgagtaggagtgggc

SEQ ID NO: 722924 - DNA, 20 bp, mouse
gccaatgatggtcagttcat

SEQ ID NO: 722925 - DNA, 20 bp, mouse
gctccccttcccatgtagtc

SEQ ID NO: 722926 - DNA, 20 bp, mouse
ggctccccggtgtgtgagag

SEQ ID NO: 722927 - DNA, 20 bp, mouse
gaaacccctcccaatttcac

SEQ ID NO: 722928 - DNA, 20 bp, mouse
gcaaatgagtcagtgctgat

SEQ ID NO: 722929 - DNA, 20 bp, mouse
gaggcggaagtctcagagcg

SEQ ID NO: 722930 - DNA, 20 bp, mouse
gtagaccagtgaaattggga

SEQ ID NO: 722931 - DNA, 20 bp, mouse
gaagcccctctcacacaccg

SEQ ID NO: 722932 - DNA, 20 bp, mouse
gttcgatgagggtgagatca

SEQ ID NO: 722933 - DNA, 20 bp, mouse
gtagcacatacgcgtttcct

SEQ ID NO: 722934 - DNA, 20 bp, mouse
ggaagcgggaccgcacgagg

SEQ ID NO: 722935 - DNA, 20 bp, mouse
gagttctcttccccgctccc

SEQ ID NO: 722936 - DNA, 20 bp, mouse
ggctccacccgctagtatta

SEQ ID NO: 722937 - DNA, 20 bp, mouse
gggcccctgtaacacagagg

SEQ ID NO: 722938 - DNA, 20 bp, mouse
gcgggtggagacatctggga

SEQ ID NO: 722939 - DNA, 20 bp, mouse
gtggagacatctgggagggg

SEQ ID NO: 722940 - DNA, 20 bp, mouse
gaggcaacttccttattgta

SEQ ID NO: 722941 - DNA, 20 bp, mouse
ggcgccgggtggagacatct

SEQ ID NO: 722942 - DNA, 20 bp, mouse
gttcaagccgacagaggtag

SEQ ID NO: 722943 - DNA, 20 bp, mouse
ggggcgtgtctgtggaccgc

SEQ ID NO: 722944 - DNA, 20 bp, mouse
gtggaacccctaatactagc

SEQ ID NO: 722945 - DNA, 20 bp, mouse
ggcagccagcagagaaagtg

SEQ ID NO: 722946 - DNA, 20 bp, mouse
gcctggggacccttggaggc

SEQ ID NO: 722947 - DNA, 20 bp, mouse
gaacgtgagagcatgagccc

SEQ ID NO: 722948 - DNA, 20 bp, mouse
ggataggatcctgcctccaa

SEQ ID NO: 722949 - DNA, 20 bp, mouse
ggggatacgctaagaggcag

SEQ ID NO: 722950 - DNA, 20 bp, mouse
gggcaggatcctatctctgg

SEQ ID NO: 722951 - DNA, 20 bp, mouse
gtttgcctggggacccttgg

SEQ ID NO: 722952 - DNA, 20 bp, mouse
gatcccacaaagaagagttt

SEQ ID NO: 722953 - DNA, 20 bp, mouse
gtggtcttaggcaacctata

SEQ ID NO: 722954 - DNA, 20 bp, mouse
ggctcctgccaggcaattac

SEQ ID NO: 722955 - DNA, 20 bp, mouse
gagcctaaactcttctttgt

SEQ ID NO: 722956 - DNA, 20 bp, mouse
gccaccagggcgctcaggcc

SEQ ID NO: 722957 - DNA, 20 bp, mouse
gccaccctggagctccaagc

SEQ ID NO: 722958 - DNA, 20 bp, mouse
gactctaaggttgaaggcaa

SEQ ID NO: 722959 - DNA, 20 bp, mouse
ggtagggctccgcagcacgt

SEQ ID NO: 722960 - DNA, 20 bp, mouse
gtgtgtggccactctgggat

SEQ ID NO: 722961 - DNA, 20 bp, mouse
gcagggcgctcaggccagga

SEQ ID NO: 722962 - DNA, 20 bp, mouse
gtccaggaggatgatgtgtg

SEQ ID NO: 722963 - DNA, 20 bp, mouse
gccggtggctggcgtctctg

SEQ ID NO: 722964 - DNA, 20 bp, mouse
gaatacacgcccacgtgctg

SEQ ID NO: 722965 - DNA, 20 bp, mouse
gtgcatgagaccgggttgta

SEQ ID NO: 722966 - DNA, 20 bp, mouse
gtgcccctgcccgtctgggt

SEQ ID NO: 722967 - DNA, 20 bp, mouse
gggcggagaggggaccccgc

SEQ ID NO: 722968 - DNA, 20 bp, mouse
gaggggctagaagccggggt

SEQ ID NO: 722969 - DNA, 20 bp, mouse
gctcccctctccaacgggag

SEQ ID NO: 722970 - DNA, 20 bp, mouse
gggggcactaccgggaaagg

SEQ ID NO: 722971 - DNA, 20 bp, mouse
gggggtgggtgtagacaaag

SEQ ID NO: 722972 - DNA, 20 bp, mouse
gggaggggtgcagtgggcgg

SEQ ID NO: 722973 - DNA, 20 bp, mouse
ggtgacctctcccacccaga

SEQ ID NO: 722974 - DNA, 20 bp, mouse
gtctcccacccagacgggca

SEQ ID NO: 722975 - DNA, 20 bp, mouse
gggggaccccgcagggaagc

SEQ ID NO: 722976 - DNA, 20 bp, mouse
ggagtgaagcccgagaagga

SEQ ID NO: 722977 - DNA, 20 bp, mouse
ggaaatacagagagcgactg

SEQ ID NO: 722978 - DNA, 20 bp, mouse
gtgtggatttacaaccttgt

SEQ ID NO: 722979 - DNA, 20 bp, mouse
gcccgagaaggaggggtgac

SEQ ID NO: 722980 - DNA, 20 bp, mouse
gagtcctctaggcgctgcat

SEQ ID NO: 722981 - DNA, 20 bp, mouse
gtgcatggggatattatcac

SEQ ID NO: 722982 - DNA, 20 bp, mouse
gaaggcgtgaatggggtttg

SEQ ID NO: 722983 - DNA, 20 bp, mouse
gaaatccacagtctgcaaag

SEQ ID NO: 722984 - DNA, 20 bp, mouse
gtgatctgaaggcgtgaatg

SEQ ID NO: 722985 - DNA, 20 bp, mouse
gtgaaggcaagctgatccca

SEQ ID NO: 722986 - DNA, 20 bp, mouse
gagcctgggggcggaccgga

SEQ ID NO: 722987 - DNA, 20 bp, mouse
gggtgctcggcggtgctcag

SEQ ID NO: 722988 - DNA, 20 bp, mouse
gggggccacgcggtgctcgg

SEQ ID NO: 722989 - DNA, 20 bp, mouse
ggagctccatctcaccaatc

SEQ ID NO: 722990 - DNA, 20 bp, mouse
ggcggcggccccgacgggtt

SEQ ID NO: 722991 - DNA, 20 bp, mouse
gcggcggcaggcggtgggtc

SEQ ID NO: 722992 - DNA, 20 bp, mouse
ggcgcgcggcggcaggcggt

SEQ ID NO: 722993 - DNA, 20 bp, mouse
ggctgggctcggcctcccat

SEQ ID NO: 722994 - DNA, 20 bp, mouse
ggcaggcggtgggtccggag

SEQ ID NO: 722995 - DNA, 20 bp, mouse
gcttcggcgcacacccgcgt

SEQ ID NO: 722996 - DNA, 20 bp, mouse
gaccgcgcagctcggccctc

SEQ ID NO: 722997 - DNA, 20 bp, mouse
ggtaccgtgggtcaaaccga

SEQ ID NO: 722998 - DNA, 20 bp, mouse
gactgcgaagtttacctgag

SEQ ID NO: 722999 - DNA, 20 bp, mouse
ggcagaggcgcgctcaggta

SEQ ID NO: 723000 - DNA, 20 bp, mouse
ggcgtgccaccgctccactc

SEQ ID NO: 723001 - DNA, 20 bp, mouse
gggccgagctgcgcggtgat

SEQ ID NO: 723002 - DNA, 20 bp, mouse
gctaaagggtacaagcccga

SEQ ID NO: 723003 - DNA, 20 bp, mouse
gccaatggcagctcacctga

SEQ ID NO: 723004 - DNA, 20 bp, mouse
ggggacgaaaactgtgtggc

SEQ ID NO: 723005 - DNA, 20 bp, mouse
ggtgacctgcacttggagaa

SEQ ID NO: 723006 - DNA, 20 bp, mouse
ggggtggagacgagggaaaa

SEQ ID NO: 723007 - DNA, 20 bp, mouse
gacaaacgttgggaaggaac

SEQ ID NO: 723008 - DNA, 20 bp, mouse
gaagagatatggtgtctgtg

SEQ ID NO: 723009 - DNA, 20 bp, mouse
ggaaggaacgggagaactag

SEQ ID NO: 723010 - DNA, 20 bp, mouse
gtctgtggggagatgtttgt

SEQ ID NO: 723011 - DNA, 20 bp, mouse
ggagctccggggggctgact

SEQ ID NO: 723012 - DNA, 20 bp, mouse
gaagggaggagacaaacgtt

SEQ ID NO: 723013 - DNA, 20 bp, mouse
gcagctaagaaggaattggc

SEQ ID NO: 723014 - DNA, 20 bp, mouse
gcatctcatcgctcggatcc

SEQ ID NO: 723015 - DNA, 20 bp, mouse
gctagaggaaaaatacagac

SEQ ID NO: 723016 - DNA, 20 bp, mouse
ggccgagcccgggacctcta

SEQ ID NO: 723017 - DNA, 20 bp, mouse
gagaggctctgtgttagtgt

SEQ ID NO: 723018 - DNA, 20 bp, mouse
ggtgaggggcattatgagga

SEQ ID NO: 723019 - DNA, 20 bp, mouse
gtaacacagagcctctatcc

SEQ ID NO: 723020 - DNA, 20 bp, mouse
gagcctctatccgggacact

SEQ ID NO: 723021 - DNA, 20 bp, mouse
gtgggcggggccggcgttag

SEQ ID NO: 723022 - DNA, 20 bp, mouse
gaccgacagcatagtcagag

SEQ ID NO: 723023 - DNA, 20 bp, mouse
ggaccaagtgtcccggatag

SEQ ID NO: 723024 - DNA, 20 bp, mouse
gtcagagaggtctctctcac

SEQ ID NO: 723025 - DNA, 20 bp, mouse
gctggccttgcaggagacga

SEQ ID NO: 723026 - DNA, 20 bp, mouse
gaggcaggggtgatgggttg

SEQ ID NO: 723027 - DNA, 20 bp, mouse
gagtctgtgagagtgtgagg

SEQ ID NO: 723028 - DNA, 20 bp, mouse
gctggctgctagagaagagg

SEQ ID NO: 723029 - DNA, 20 bp, mouse
ggggttggggagaccaatgc

SEQ ID NO: 723030 - DNA, 20 bp, mouse
ggggaaaagtgaggtgagga

SEQ ID NO: 723031 - DNA, 20 bp, mouse
ggggtatcagcatagtgagc

SEQ ID NO: 723032 - DNA, 20 bp, mouse
gcatgaggacgggctgctcc

SEQ ID NO: 723033 - DNA, 20 bp, mouse
gcaagcagctggtgaatcca

SEQ ID NO: 723034 - DNA, 20 bp, mouse
ggaactccgagctggctcct

SEQ ID NO: 723035 - DNA, 20 bp, mouse
ggtgggtgcagaggatggag

SEQ ID NO: 723036 - DNA, 20 bp, mouse
gcgcgtgcgcgactcgaggc

SEQ ID NO: 723037 - DNA, 20 bp, mouse
gcaccgcgcagaagctgcca

SEQ ID NO: 723038 - DNA, 20 bp, mouse
gagccctggcagcttctgcg

SEQ ID NO: 723039 - DNA, 20 bp, mouse
gaagctgccagggctgtgcg

SEQ ID NO: 723040 - DNA, 20 bp, mouse
ggggaccaaagcgctgtccg

SEQ ID NO: 723041 - DNA, 20 bp, mouse
gagaaagcgcggctcagagc

SEQ ID NO: 723042 - DNA, 20 bp, mouse
ggcgcggtgccgagaaagcg

SEQ ID NO: 723043 - DNA, 20 bp, mouse
ggggtgcggggcgctgtgcg

SEQ ID NO: 723044 - DNA, 20 bp, mouse
ggaaagtcacagagaggggc

SEQ ID NO: 723045 - DNA, 20 bp, mouse
gaagactggaggtctctaag

SEQ ID NO: 723046 - DNA, 20 bp, mouse
ggcggaggaggattagtgtg

SEQ ID NO: 723047 - DNA, 20 bp, mouse
ggaggaggattagtgtgggg

SEQ ID NO: 723048 - DNA, 20 bp, mouse
gggggtgtgagagagatcct

SEQ ID NO: 723049 - DNA, 20 bp, mouse
ggagagagatcctgggaggg

SEQ ID NO: 723050 - DNA, 20 bp, mouse
gtggtgtgaagacagaagtg

SEQ ID NO: 723051 - DNA, 20 bp, mouse
gtgaagacagaagtgaggtg

SEQ ID NO: 723052 - DNA, 20 bp, mouse
ggcgagcgagagcaagttga

SEQ ID NO: 723053 - DNA, 20 bp, mouse
gatctggaaggcgggttcat

SEQ ID NO: 723054 - DNA, 20 bp, mouse
gtctctctcagaaatcgctt

SEQ ID NO: 723055 - DNA, 20 bp, mouse
gaagagcatgggcgcaactc

SEQ ID NO: 723056 - DNA, 20 bp, mouse
gaggcagccccgaggtgatg

SEQ ID NO: 723057 - DNA, 20 bp, mouse
gatgcggatggatgcggtaa

SEQ ID NO: 723058 - DNA, 20 bp, mouse
gccccagcctcatcacctcg

SEQ ID NO: 723059 - DNA, 20 bp, mouse
ggatgaggctggggtctaga

SEQ ID NO: 723060 - DNA, 20 bp, mouse
gcccttgatgcggatggatg

SEQ ID NO: 723061 - DNA, 20 bp, mouse
gagccccgaggtgatgaggc

SEQ ID NO: 723062 - DNA, 20 bp, mouse
ggcaaagcccttgatgcgga

SEQ ID NO: 723063 - DNA, 20 bp, mouse
gtctcaccagcaaacaacca

SEQ ID NO: 723064 - DNA, 20 bp, mouse
gaagtttacaggatagaaaa

SEQ ID NO: 723065 - DNA, 20 bp, mouse
ggaggaagaggagaccagag

SEQ ID NO: 723066 - DNA, 20 bp, mouse
ggccgctcgcccgctcggag

SEQ ID NO: 723067 - DNA, 20 bp, mouse
gtacgaggacggcaccacgg

SEQ ID NO: 723068 - DNA, 20 bp, mouse
gaccgggcgccccctccgag

SEQ ID NO: 723069 - DNA, 20 bp, mouse
ggcggcgcgcggctaggcta

SEQ ID NO: 723070 - DNA, 20 bp, mouse
gccggccgggggatgctacg

SEQ ID NO: 723071 - DNA, 20 bp, mouse
gccgggggatgctacgagga

SEQ ID NO: 723072 - DNA, 20 bp, mouse
gagtcacgtggtggagagga

SEQ ID NO: 723073 - DNA, 20 bp, mouse
gtgcaggctgcatgagtcgg

SEQ ID NO: 723074 - DNA, 20 bp, mouse
gaggctccgcagtcacgtgg

SEQ ID NO: 723075 - DNA, 20 bp, mouse
gctaaggctccgcagtcacg

SEQ ID NO: 723076 - DNA, 20 bp, mouse
gaaaaaagtccggtacctgt

SEQ ID NO: 723077 - DNA, 20 bp, mouse
gaaaccgtcaaggcaggtgg

SEQ ID NO: 723078 - DNA, 20 bp, mouse
gcacccggactgagaaaggc

SEQ ID NO: 723079 - DNA, 20 bp, mouse
gcgtctggaattagtcacat

SEQ ID NO: 723080 - DNA, 20 bp, mouse
gagggacacctagtcactta

SEQ ID NO: 723081 - DNA, 20 bp, mouse
gtcccagggaattgagagcg

SEQ ID NO: 723082 - DNA, 20 bp, mouse
gtcttcacccggactgagaa

SEQ ID NO: 723083 - DNA, 20 bp, mouse
gtccccctatctgcaataca

SEQ ID NO: 723084 - DNA, 20 bp, mouse
gaccgcgctctcaattccct

SEQ ID NO: 723085 - DNA, 20 bp, mouse
gcaaggttaaataagtgggg

SEQ ID NO: 723086 - DNA, 20 bp, mouse
gtggccaggcccagagggag

SEQ ID NO: 723087 - DNA, 20 bp, mouse
ggggcagactgagcccggaa

SEQ ID NO: 723088 - DNA, 20 bp, mouse
gcagactgagcccggaaagg

SEQ ID NO: 723089 - DNA, 20 bp, mouse
ggggcagaccgcggggtgaa

SEQ ID NO: 723090 - DNA, 20 bp, mouse
ggcggggtgaatggcagcga

SEQ ID NO: 723091 - DNA, 20 bp, mouse
gcgtgtatgtaaactcccag

SEQ ID NO: 723092 - DNA, 20 bp, mouse
gtgaatggcagcgaggggag

SEQ ID NO: 723093 - DNA, 20 bp, mouse
ggccctcagtcaaggagcca

SEQ ID NO: 723094 - DNA, 20 bp, mouse
gtccctggctccttgactga

SEQ ID NO: 723095 - DNA, 20 bp, mouse
ggagggtgcgggcaagaggc

SEQ ID NO: 723096 - DNA, 20 bp, mouse
ggggacccttcaattagctg

SEQ ID NO: 723097 - DNA, 20 bp, mouse
ggggcggagcttccaagaat

SEQ ID NO: 723098 - DNA, 20 bp, mouse
gatccggaggagtgaagatc

SEQ ID NO: 723099 - DNA, 20 bp, mouse
gtgaagatccgggtgattca

SEQ ID NO: 723100 - DNA, 20 bp, mouse
gacccggatcttcactcctc

SEQ ID NO: 723101 - DNA, 20 bp, mouse
ggatgccccagctaattgaa

SEQ ID NO: 723102 - DNA, 20 bp, mouse
gcgccctgatccccttacag

SEQ ID NO: 723103 - DNA, 20 bp, mouse
gtggggccacggtgcgggac

SEQ ID NO: 723104 - DNA, 20 bp, mouse
gggagcttccaagaatgggc

SEQ ID NO: 723105 - DNA, 20 bp, mouse
gagatcccagacaagactcc

SEQ ID NO: 723106 - DNA, 20 bp, mouse
ggcagagctaggtagacctg

SEQ ID NO: 723107 - DNA, 20 bp, mouse
gccagcagggttagcctgag

SEQ ID NO: 723108 - DNA, 20 bp, mouse
gagaccctgaatagtgctgg

SEQ ID NO: 723109 - DNA, 20 bp, mouse
gcatgggggccccacctcta

SEQ ID NO: 723110 - DNA, 20 bp, mouse
gggctaaccctgctggagag

SEQ ID NO: 723111 - DNA, 20 bp, mouse
gtacaccctccctacaaaga

SEQ ID NO: 723112 - DNA, 20 bp, mouse
gtgtagggagggtgtaacca

SEQ ID NO: 723113 - DNA, 20 bp, mouse
gaggtcagccagggttctat

SEQ ID NO: 723114 - DNA, 20 bp, mouse
ggggccttgtctgggtcaca

SEQ ID NO: 723115 - DNA, 20 bp, mouse
ggtattcactgatgaaccca

SEQ ID NO: 723116 - DNA, 20 bp, mouse
gaggcattatgcatccagta

SEQ ID NO: 723117 - DNA, 20 bp, mouse
gataaatactgggatgacca

SEQ ID NO: 723118 - DNA, 20 bp, mouse
gaccaggctgaattaagatg

SEQ ID NO: 723119 - DNA, 20 bp, mouse
gcaaggtagatacagaaacc

SEQ ID NO: 723120 - DNA, 20 bp, mouse
gggtaataactcagcagttg

SEQ ID NO: 723121 - DNA, 20 bp, mouse
gatacccaaaccataaatac

SEQ ID NO: 723122 - DNA, 20 bp, mouse
gagcagactagtgtgggttc

SEQ ID NO: 723123 - DNA, 20 bp, mouse
gaacgttagacgggatgcta

SEQ ID NO: 723124 - DNA, 20 bp, mouse
gctctgtggtatgcaatatt

SEQ ID NO: 723125 - DNA, 20 bp, mouse
gcatcccagtatttatggtt

SEQ ID NO: 723126 - DNA, 20 bp, mouse
gactccagggagagaattcc

SEQ ID NO: 723127 - DNA, 20 bp, mouse
ggtacccggaattctctccc

SEQ ID NO: 723128 - DNA, 20 bp, mouse
gagtgcaccgtgctcttggg

SEQ ID NO: 723129 - DNA, 20 bp, mouse
ggggttccggaagcactagg

SEQ ID NO: 723130 - DNA, 20 bp, mouse
gcgtgctcttgggtgggcct

SEQ ID NO: 723131 - DNA, 20 bp, mouse
gggagctagtaacagcagcg

SEQ ID NO: 723132 - DNA, 20 bp, mouse
gcttgcaggagacgaaatca

SEQ ID NO: 723133 - DNA, 20 bp, mouse
gaaatcagggccgagggttc

SEQ ID NO: 723134 - DNA, 20 bp, mouse
ggagaggaacccccgccagg

SEQ ID NO: 723135 - DNA, 20 bp, mouse
ggcactaggtggtcagtacc

SEQ ID NO: 723136 - DNA, 20 bp, mouse
gcacccgggcgagtgtgagt

SEQ ID NO: 723137 - DNA, 20 bp, mouse
ggggaagcgtgtgtgcgcgg

SEQ ID NO: 723138 - DNA, 20 bp, mouse
gagtgggaagcgtgtgtgcg

SEQ ID NO: 723139 - DNA, 20 bp, mouse
gtgggaggggggacacccgg

SEQ ID NO: 723140 - DNA, 20 bp, mouse
gagcgcgcaagtgtgcaccc

SEQ ID NO: 723141 - DNA, 20 bp, mouse
gcgcgtgcaactccactccg

SEQ ID NO: 723142 - DNA, 20 bp, mouse
gggagccaagcgtaaagcgg

SEQ ID NO: 723143 - DNA, 20 bp, mouse
gagggcaaggcactgagccg

SEQ ID NO: 723144 - DNA, 20 bp, mouse
ggggaccctggacaggattt

SEQ ID NO: 723145 - DNA, 20 bp, mouse
gaccctggacaggatttggg

SEQ ID NO: 723146 - DNA, 20 bp, mouse
gcgccggcggggtctttagc

SEQ ID NO: 723147 - DNA, 20 bp, mouse
gcggcgagcggagactccgg

SEQ ID NO: 723148 - DNA, 20 bp, mouse
gcgctcggctacctaggtcc

SEQ ID NO: 723149 - DNA, 20 bp, mouse
gtagctggggacccggacct

SEQ ID NO: 723150 - DNA, 20 bp, mouse
gcggacgatcgggagacggc

SEQ ID NO: 723151 - DNA, 20 bp, mouse
ggccgcccggcgggcagtga

SEQ ID NO: 723152 - DNA, 20 bp, mouse
gtaaagaccccgccggcgag

SEQ ID NO: 723153 - DNA, 20 bp, mouse
gtctcccgatcgtccggatc

SEQ ID NO: 723154 - DNA, 20 bp, mouse
gccccagctaaagaccccgc

SEQ ID NO: 723155 - DNA, 20 bp, mouse
ggagacggcgggccggggat

SEQ ID NO: 723156 - DNA, 20 bp, mouse
gcacaggggaccagagtgtg

SEQ ID NO: 723157 - DNA, 20 bp, mouse
ggggcccgccggctctcggt

SEQ ID NO: 723158 - DNA, 20 bp, mouse
ggaggagggtggggtgtccc

SEQ ID NO: 723159 - DNA, 20 bp, mouse
gggcaggcggcggcctagga

SEQ ID NO: 723160 - DNA, 20 bp, mouse
gaaggaggcaggcccggctg

SEQ ID NO: 723161 - DNA, 20 bp, mouse
gaggtggaacgggaaggcgg

SEQ ID NO: 723162 - DNA, 20 bp, mouse
ggccagcggctgccgctcac

SEQ ID NO: 723163 - DNA, 20 bp, mouse
ggagaggccggtcaatgaag

SEQ ID NO: 723164 - DNA, 20 bp, mouse
ggagctgagaggcattggtg

SEQ ID NO: 723165 - DNA, 20 bp, mouse
gagaagcaggtggaacggga

SEQ ID NO: 723166 - DNA, 20 bp, mouse
gcgcgtgcacatgcccacgt

SEQ ID NO: 723167 - DNA, 20 bp, mouse
ggagtgagacgcgcccacgt

SEQ ID NO: 723168 - DNA, 20 bp, mouse
gatcgcaagtcgggaccaca

SEQ ID NO: 723169 - DNA, 20 bp, mouse
gactccgcgtcaggaagcgg

SEQ ID NO: 723170 - DNA, 20 bp, mouse
gtgggaggggtagaacgcgt

SEQ ID NO: 723171 - DNA, 20 bp, mouse
gcgttagcatacagagaacc

SEQ ID NO: 723172 - DNA, 20 bp, mouse
gcacgtggtgataagaaacc

SEQ ID NO: 723173 - DNA, 20 bp, mouse
gaacgcaggcgcgcgtcagg

SEQ ID NO: 723174 - DNA, 20 bp, mouse
gcttcccccagcggtataga

SEQ ID NO: 723175 - DNA, 20 bp, mouse
gagtctaagtcacggatcca

SEQ ID NO: 723176 - DNA, 20 bp, mouse
gcggtcgcctaggaggatag

SEQ ID NO: 723177 - DNA, 20 bp, mouse
gttgctgcgttgcgtctcgc

SEQ ID NO: 723178 - DNA, 20 bp, mouse
gggctcccgctgaccaagtg

SEQ ID NO: 723179 - DNA, 20 bp, mouse
gctagggcacgcttctgctg

SEQ ID NO: 723180 - DNA, 20 bp, mouse
gccaccgcggttcacaacac

SEQ ID NO: 723181 - DNA, 20 bp, mouse
ggaagcgtgccctaggatcc

SEQ ID NO: 723182 - DNA, 20 bp, mouse
gagctggcccttcagcgaaa

SEQ ID NO: 723183 - DNA, 20 bp, mouse
ggcgcccaccacagcaactt

SEQ ID NO: 723184 - DNA, 20 bp, mouse
gtcgccgcctagggactgcg

SEQ ID NO: 723185 - DNA, 20 bp, mouse
gtctccagtgttgtgaaccg

SEQ ID NO: 723186 - DNA, 20 bp, mouse
gtgggaggaggctccgctgc

SEQ ID NO: 723187 - DNA, 20 bp, mouse
gccccgggctcgtgctcaat

SEQ ID NO: 723188 - DNA, 20 bp, mouse
gcgggggcgcgtgcgcgtcg

SEQ ID NO: 723189 - DNA, 20 bp, mouse
gccaagaaatgcccagtgtg

SEQ ID NO: 723190 - DNA, 20 bp, mouse
ggcaatgctgctgacacgtc

SEQ ID NO: 723191 - DNA, 20 bp, mouse
gtccgctgctggaggagatg

SEQ ID NO: 723192 - DNA, 20 bp, mouse
gacccattgagcacgagccc

SEQ ID NO: 723193 - DNA, 20 bp, mouse
gccggcggcgtgagtgtgcg

SEQ ID NO: 723194 - DNA, 20 bp, mouse
gactcactggcgagttaagt

SEQ ID NO: 723195 - DNA, 20 bp, mouse
ggaaatgcccagtgtgcggc

SEQ ID NO: 723196 - DNA, 20 bp, mouse
gactcgacgctcagaatcaa

SEQ ID NO: 723197 - DNA, 20 bp, mouse
ggcggggcggaggcgaccgg

SEQ ID NO: 723198 - DNA, 20 bp, mouse
gcacacagctagggaaccga

SEQ ID NO: 723199 - DNA, 20 bp, mouse
gtggcgagctccatctcagt

SEQ ID NO: 723200 - DNA, 20 bp, mouse
ggggcggaggcgaccggcgg

SEQ ID NO: 723201 - DNA, 20 bp, mouse
ggggcaccggtggccggctg

SEQ ID NO: 723202 - DNA, 20 bp, mouse
ggagcacaggctgtcaggga

SEQ ID NO: 723203 - DNA, 20 bp, mouse
gcgggccagaggggcaccgg

SEQ ID NO: 723204 - DNA, 20 bp, mouse
gctaggagcacaggctgtca

SEQ ID NO: 723205 - DNA, 20 bp, mouse
ggattctgagcgtcgagtct

SEQ ID NO: 723206 - DNA, 20 bp, mouse
ggggaaagagacccagagat

SEQ ID NO: 723207 - DNA, 20 bp, mouse
gacagcgagagagatggtca

SEQ ID NO: 723208 - DNA, 20 bp, mouse
gccagtgagagcaaaggaga

SEQ ID NO: 723209 - DNA, 20 bp, mouse
ggggcagtgatcgaacagat

SEQ ID NO: 723210 - DNA, 20 bp, mouse
gaggagagggagcacggcag

SEQ ID NO: 723211 - DNA, 20 bp, mouse
ggatgcagaggtaagaggtg

SEQ ID NO: 723212 - DNA, 20 bp, mouse
gggaacccaaatagagggag

SEQ ID NO: 723213 - DNA, 20 bp, mouse
gcagagatgggacaaagacc

SEQ ID NO: 723214 - DNA, 20 bp, mouse
gacggcagaggatggtagtg

SEQ ID NO: 723215 - DNA, 20 bp, mouse
ggatgaaaggccaggctcac

SEQ ID NO: 723216 - DNA, 20 bp, mouse
gcccctccctcagacctaat

SEQ ID NO: 723217 - DNA, 20 bp, mouse
gcccccctcacgcttcccta

SEQ ID NO: 723218 - DNA, 20 bp, mouse
gcgaggggctgcgacgaaat

SEQ ID NO: 723219 - DNA, 20 bp, mouse
gggtccctagggaagcgtga

SEQ ID NO: 723220 - DNA, 20 bp, mouse
gtcccattaggtctgaggga

SEQ ID NO: 723221 - DNA, 20 bp, mouse
gtgttcccgcacactcactc

SEQ ID NO: 723222 - DNA, 20 bp, mouse
gagggacccctcttcccatt

SEQ ID NO: 723223 - DNA, 20 bp, mouse
gccacctccctcatacccaa

SEQ ID NO: 723224 - DNA, 20 bp, mouse
ggcagcccctcggtcccatg

SEQ ID NO: 723225 - DNA, 20 bp, mouse
gatttcctcatgggaccgag

SEQ ID NO: 723226 - DNA, 20 bp, mouse
gcaaacgcagagtctgtagt

SEQ ID NO: 723227 - DNA, 20 bp, mouse
gaggggcgaggactttgcag

SEQ ID NO: 723228 - DNA, 20 bp, mouse
gcctcccagtagcagagccc

SEQ ID NO: 723229 - DNA, 20 bp, mouse
ggctgaggcggggagaactt

SEQ ID NO: 723230 - DNA, 20 bp, mouse
gcgaaaagcccggcagaaaa

SEQ ID NO: 723231 - DNA, 20 bp, mouse
gctctgctactgggaggcgc

SEQ ID NO: 723232 - DNA, 20 bp, mouse
ggggcgcgggactgtgcggc

SEQ ID NO: 723233 - DNA, 20 bp, mouse
gaagcgacaggctggcgcca

SEQ ID NO: 723234 - DNA, 20 bp, mouse
gtagttggcacaattccctt

SEQ ID NO: 723235 - DNA, 20 bp, mouse
ggacgcggcgaagtggtcac

SEQ ID NO: 723236 - DNA, 20 bp, mouse
gaagctcccagagcagtctg

SEQ ID NO: 723237 - DNA, 20 bp, mouse
gacatctggtagaaatctgt

SEQ ID NO: 723238 - DNA, 20 bp, mouse
gtgcagcctgggggtaagtg

SEQ ID NO: 723239 - DNA, 20 bp, mouse
gacaacactgtgtgcagcct

SEQ ID NO: 723240 - DNA, 20 bp, mouse
ggttgaccgggctggagaac

SEQ ID NO: 723241 - DNA, 20 bp, mouse
gtactggccacagactgctc

SEQ ID NO: 723242 - DNA, 20 bp, mouse
ggggtcttgctgatcagatc

SEQ ID NO: 723243 - DNA, 20 bp, mouse
gtcaataatgttgaccgggc

SEQ ID NO: 723244 - DNA, 20 bp, mouse
gtccaaaaactgtccgagtg

SEQ ID NO: 723245 - DNA, 20 bp, mouse
gtctgatcagcaagacccac

SEQ ID NO: 723246 - DNA, 20 bp, mouse
gtggaccaagcagtttctgt

SEQ ID NO: 723247 - DNA, 20 bp, mouse
gggggcggggccttgatgta

SEQ ID NO: 723248 - DNA, 20 bp, mouse
gggctcagaagctccgggac

SEQ ID NO: 723249 - DNA, 20 bp, mouse
gagacaatagcagactgcct

SEQ ID NO: 723250 - DNA, 20 bp, mouse
ggcagtctgctattgtctgt

SEQ ID NO: 723251 - DNA, 20 bp, mouse
ggtggggtggggtcttgggc

SEQ ID NO: 723252 - DNA, 20 bp, mouse
gactgggcgggccttatgat

SEQ ID NO: 723253 - DNA, 20 bp, mouse
gggcgggccttatgatgggg

SEQ ID NO: 723254 - DNA, 20 bp, mouse
gatcagagatggttgggttc

SEQ ID NO: 723255 - DNA, 20 bp, mouse
ggggtgctaacgacttcggg

SEQ ID NO: 723256 - DNA, 20 bp, mouse
ggggtctcatgtcacaggaa

SEQ ID NO: 723257 - DNA, 20 bp, mouse
gaggtccgctacatgtcatc

SEQ ID NO: 723258 - DNA, 20 bp, mouse
ggggactgtagttttggcta

SEQ ID NO: 723259 - DNA, 20 bp, mouse
gagcagataggagaactagg

SEQ ID NO: 723260 - DNA, 20 bp, mouse
gaggagaaaggtagtcccag

SEQ ID NO: 723261 - DNA, 20 bp, mouse
gctgtgcattctagccagtg

SEQ ID NO: 723262 - DNA, 20 bp, mouse
gtgcaatgtatgctgtttca

SEQ ID NO: 723263 - DNA, 20 bp, mouse
gcggcacagggagccctgcg

SEQ ID NO: 723264 - DNA, 20 bp, mouse
gtgccgagggactgtagttt

SEQ ID NO: 723265 - DNA, 20 bp, mouse
gggagaactaggaggaagcg

SEQ ID NO: 723266 - DNA, 20 bp, mouse
gtctccaagatcactatctg

SEQ ID NO: 723267 - DNA, 20 bp, mouse
ggggcctcagatagtgatct

SEQ ID NO: 723268 - DNA, 20 bp, mouse
ggagtgctgccgtatgcccc

SEQ ID NO: 723269 - DNA, 20 bp, mouse
ggcactcagactctgagaag

SEQ ID NO: 723270 - DNA, 20 bp, mouse
gaggagctccctcccactgg

SEQ ID NO: 723271 - DNA, 20 bp, mouse
gcagcctgctcgctccttaa

SEQ ID NO: 723272 - DNA, 20 bp, mouse
gcgtatgcccccggctgagg

SEQ ID NO: 723273 - DNA, 20 bp, mouse
ggattctcttctaagagtct

SEQ ID NO: 723274 - DNA, 20 bp, mouse
gagggccctccccagtctcc

SEQ ID NO: 723275 - DNA, 20 bp, mouse
gctaaagtgccctagggctt

SEQ ID NO: 723276 - DNA, 20 bp, mouse
gaagaggaaatagaggatcg

SEQ ID NO: 723277 - DNA, 20 bp, mouse
gggatcggggtgctgaatat

SEQ ID NO: 723278 - DNA, 20 bp, mouse
gtggcaagatagatctgctc

SEQ ID NO: 723279 - DNA, 20 bp, mouse
ggaagaggtgtggaggctca

SEQ ID NO: 723280 - DNA, 20 bp, mouse
ggtgggctaggcagcacttt

SEQ ID NO: 723281 - DNA, 20 bp, mouse
gagctaggatgggtatccaa

SEQ ID NO: 723282 - DNA, 20 bp, mouse
ggctaggcagcacttttggc

SEQ ID NO: 723283 - DNA, 20 bp, mouse
ggagggggggtacccactag

SEQ ID NO: 723284 - DNA, 20 bp, mouse
ggatctatcttgccaggttc

SEQ ID NO: 723285 - DNA, 20 bp, mouse
ggagacccaacagctggcag

SEQ ID NO: 723286 - DNA, 20 bp, mouse
gcgaaccactgaccagtaat

SEQ ID NO: 723287 - DNA, 20 bp, mouse
gagggccggaacaagacccg

SEQ ID NO: 723288 - DNA, 20 bp, mouse
gtgcgcagccgcagcttctg

SEQ ID NO: 723289 - DNA, 20 bp, mouse
gctcctacgggtgaccccaa

SEQ ID NO: 723290 - DNA, 20 bp, mouse
ggtatcttgggtggactcgt

SEQ ID NO: 723291 - DNA, 20 bp, mouse
gaccactgaccagtaattgg

SEQ ID NO: 723292 - DNA, 20 bp, mouse
ggagggaagtaatcctctga

SEQ ID NO: 723293 - DNA, 20 bp, mouse
gttgggtggactcgtcggga

SEQ ID NO: 723294 - DNA, 20 bp, mouse
gcccctttggggtcacccgt

SEQ ID NO: 723295 - DNA, 20 bp, mouse
gaagggtaattttccgtcag

SEQ ID NO: 723296 - DNA, 20 bp, mouse
gggtcactgaggacacctta

SEQ ID NO: 723297 - DNA, 20 bp, mouse
gtgcttgggaacccactgag

SEQ ID NO: 723298 - DNA, 20 bp, mouse
gtgagaggcccagggagacc

SEQ ID NO: 723299 - DNA, 20 bp, mouse
gtccctgcccttgtaggaca

SEQ ID NO: 723300 - DNA, 20 bp, mouse
gtatctcccttgtcctacaa

SEQ ID NO: 723301 - DNA, 20 bp, mouse
gctaactaaatcccagccct

SEQ ID NO: 723302 - DNA, 20 bp, mouse
gaccctacgcccttggccta

SEQ ID NO: 723303 - DNA, 20 bp, mouse
ggctgccttcttgctcccta

SEQ ID NO: 723304 - DNA, 20 bp, mouse
gctcccctggccttggcagg

SEQ ID NO: 723305 - DNA, 20 bp, mouse
gagccttggccagggtgctt

SEQ ID NO: 723306 - DNA, 20 bp, mouse
gccaggaagtcgaggaagtg

SEQ ID NO: 723307 - DNA, 20 bp, mouse
ggcccagcgccaggaagtcg

SEQ ID NO: 723308 - DNA, 20 bp, mouse
ggcgtctgaggatactgtgg

SEQ ID NO: 723309 - DNA, 20 bp, mouse
gcccctcggggcggcgtctg

SEQ ID NO: 723310 - DNA, 20 bp, mouse
gcgccccgaggggagctctc

SEQ ID NO: 723311 - DNA, 20 bp, mouse
ggcgagaagtacacaagtcc

SEQ ID NO: 723312 - DNA, 20 bp, mouse
ggcggcgtctgaggatactg

SEQ ID NO: 723313 - DNA, 20 bp, mouse
gagcccgagagctcccctcg

SEQ ID NO: 723314 - DNA, 20 bp, mouse
gtcctggcgctgggccttat

SEQ ID NO: 723315 - DNA, 20 bp, mouse
ggggaaagccaagcggactg

SEQ ID NO: 723316 - DNA, 20 bp, mouse
gtatgcgcgccccctggcga

SEQ ID NO: 723317 - DNA, 20 bp, mouse
gtgcaccgggactgtggagc

SEQ ID NO: 723318 - DNA, 20 bp, mouse
gggaccagatctggagtccg

SEQ ID NO: 723319 - DNA, 20 bp, mouse
gccaggcggcccagcctcgc

SEQ ID NO: 723320 - DNA, 20 bp, mouse
gtgagctgagacccgagcga

SEQ ID NO: 723321 - DNA, 20 bp, mouse
gaggagtgggggtttcgttt

SEQ ID NO: 723322 - DNA, 20 bp, mouse
gcgtgtgagcggcagacggc

SEQ ID NO: 723323 - DNA, 20 bp, mouse
gggcgagggctctattgcac

SEQ ID NO: 723324 - DNA, 20 bp, mouse
ggatcttggcgggacaggaa

SEQ ID NO: 723325 - DNA, 20 bp, mouse
gcccgcgtctgacggggcga

SEQ ID NO: 723326 - DNA, 20 bp, mouse
gaactcgctccctgcggaga

SEQ ID NO: 723327 - DNA, 20 bp, mouse
gtccgcagggagcgagttcc

SEQ ID NO: 723328 - DNA, 20 bp, mouse
gagttcccggctccgtgggc

SEQ ID NO: 723329 - DNA, 20 bp, mouse
ggggaggggcgcagagtacg

SEQ ID NO: 723330 - DNA, 20 bp, mouse
gggcgccggtggaccgggag

SEQ ID NO: 723331 - DNA, 20 bp, mouse
gccccgcgccggactactat

SEQ ID NO: 723332 - DNA, 20 bp, mouse
gaggctgaccaatagtagtc

SEQ ID NO: 723333 - DNA, 20 bp, mouse
gaggggcgcagagtacgcgg

SEQ ID NO: 723334 - DNA, 20 bp, mouse
gagcgagttcccggctccgt

SEQ ID NO: 723335 - DNA, 20 bp, mouse
gggccctccccctctccgca

SEQ ID NO: 723336 - DNA, 20 bp, mouse
gccgcggctctccctcgggg

SEQ ID NO: 723337 - DNA, 20 bp, mouse
ggcgccgcggctctccctcg

SEQ ID NO: 723338 - DNA, 20 bp, mouse
gaactggcacaggagggcgc

SEQ ID NO: 723339 - DNA, 20 bp, mouse
gtgaggggcgagagatgctg

SEQ ID NO: 723340 - DNA, 20 bp, mouse
ggaaaacgccgctacctcag

SEQ ID NO: 723341 - DNA, 20 bp, mouse
gccctcctgtgccagttcgc

SEQ ID NO: 723342 - DNA, 20 bp, mouse
gggctcctccctcccttcgg

SEQ ID NO: 723343 - DNA, 20 bp, mouse
gccctcccgcgcaatggcgg

SEQ ID NO: 723344 - DNA, 20 bp, mouse
ggacacccgcgaactggcac

SEQ ID NO: 723345 - DNA, 20 bp, mouse
gctcccttcggtggcttcgc

SEQ ID NO: 723346 - DNA, 20 bp, mouse
gcaagggaaaaaaaacgggg

SEQ ID NO: 723347 - DNA, 20 bp, mouse
gtctctgagaggacttaaag

SEQ ID NO: 723348 - DNA, 20 bp, mouse
ggggttcctaggctgttttg

SEQ ID NO: 723349 - DNA, 20 bp, mouse
gccgcaagggaaaaaaaacg

SEQ ID NO: 723350 - DNA, 20 bp, mouse
gaggagaagctagagaatat

SEQ ID NO: 723351 - DNA, 20 bp, mouse
ggggacaaggctctgttgtc

SEQ ID NO: 723352 - DNA, 20 bp, mouse
gacggtgcaaggctgccatc

SEQ ID NO: 723353 - DNA, 20 bp, mouse
gagaggaatgaggggttcct

SEQ ID NO: 723354 - DNA, 20 bp, mouse
ggtcaggttgcaaagaggat

SEQ ID NO: 723355 - DNA, 20 bp, mouse
gcactagtgtacagcccaga

SEQ ID NO: 723356 - DNA, 20 bp, mouse
gtctgactgaggggcagagg

SEQ ID NO: 723357 - DNA, 20 bp, mouse
ggacccggagtccggaggaa

SEQ ID NO: 723358 - DNA, 20 bp, mouse
gagtccggaggaacggagga

SEQ ID NO: 723359 - DNA, 20 bp, mouse
ggcgctgggctgggaaccct

SEQ ID NO: 723360 - DNA, 20 bp, mouse
ggggaagaggacccggagtc

SEQ ID NO: 723361 - DNA, 20 bp, mouse
gaagaggacccggagtccgg

SEQ ID NO: 723362 - DNA, 20 bp, mouse
gggaagctgctggaggcgct

SEQ ID NO: 723363 - DNA, 20 bp, mouse
gggaggtgcaggccaaattg

SEQ ID NO: 723364 - DNA, 20 bp, mouse
gtggtcgcagtctgactgag

SEQ ID NO: 723365 - DNA, 20 bp, mouse
gccggagtccggaggaacgg

SEQ ID NO: 723366 - DNA, 20 bp, mouse
ggtggggcaaagctgcgtat

SEQ ID NO: 723367 - DNA, 20 bp, mouse
gaaggctcacggcacgcggg

SEQ ID NO: 723368 - DNA, 20 bp, mouse
gtggaggagacggcgaaaga

SEQ ID NO: 723369 - DNA, 20 bp, mouse
ggtgagcgagtgaacccagg

SEQ ID NO: 723370 - DNA, 20 bp, mouse
gcagtggcgtgaaggggcgt

SEQ ID NO: 723371 - DNA, 20 bp, mouse
gcctgtggtccctatgtaaa

SEQ ID NO: 723372 - DNA, 20 bp, mouse
gtcggagcagtggcgtgaag

SEQ ID NO: 723373 - DNA, 20 bp, mouse
ggtagtcagccttttacata

SEQ ID NO: 723374 - DNA, 20 bp, mouse
ggctgcacaagcctccccag

SEQ ID NO: 723375 - DNA, 20 bp, mouse
gtgcagttgaaccgcgtgtg

SEQ ID NO: 723376 - DNA, 20 bp, mouse
gcgctcacggggctgattgg

SEQ ID NO: 723377 - DNA, 20 bp, mouse
ggggtaggaggagtgtaaga

SEQ ID NO: 723378 - DNA, 20 bp, mouse
ggggtgcccgggtagtgaga

SEQ ID NO: 723379 - DNA, 20 bp, mouse
gggcgacaaccgggtgcgga

SEQ ID NO: 723380 - DNA, 20 bp, mouse
gtgtaagaggggaggcttcc

SEQ ID NO: 723381 - DNA, 20 bp, mouse
gagcgggcgacaaccgggtg

SEQ ID NO: 723382 - DNA, 20 bp, mouse
gaggggaggcttccgggagc

SEQ ID NO: 723383 - DNA, 20 bp, mouse
gtagtgagatggcgcgctca

SEQ ID NO: 723384 - DNA, 20 bp, mouse
gtccgggagcgggcgacaac

SEQ ID NO: 723385 - DNA, 20 bp, mouse
gcacggggctgattgggggg

SEQ ID NO: 723386 - DNA, 20 bp, mouse
gtggaagcgcaacgctgggt

SEQ ID NO: 723387 - DNA, 20 bp, mouse
ggagctgtgctgggaggcgt

SEQ ID NO: 723388 - DNA, 20 bp, mouse
gaggaagtccaagactgccc

SEQ ID NO: 723389 - DNA, 20 bp, mouse
ggcagctggaagcgcaacgc

SEQ ID NO: 723390 - DNA, 20 bp, mouse
ggagaagcaggagctgtgct

SEQ ID NO: 723391 - DNA, 20 bp, mouse
gctagagcctcttggtctca

SEQ ID NO: 723392 - DNA, 20 bp, mouse
gggagaaggggtattattgc

SEQ ID NO: 723393 - DNA, 20 bp, mouse
gctcttgcagagtgcaattg

SEQ ID NO: 723394 - DNA, 20 bp, mouse
gctgtgctgggaggcgtggg

SEQ ID NO: 723395 - DNA, 20 bp, mouse
ggcgcccgggcagacgcagc

SEQ ID NO: 723396 - DNA, 20 bp, mouse
gaagcctggtgcagtcagag

SEQ ID NO: 723397 - DNA, 20 bp, mouse
gcggctgcaaggctcttgtt

SEQ ID NO: 723398 - DNA, 20 bp, mouse
gacaatttaaaggcagtcta

SEQ ID NO: 723399 - DNA, 20 bp, mouse
ggaccagagcagcgtcagac

SEQ ID NO: 723400 - DNA, 20 bp, mouse
gccactctcaagctctggag

SEQ ID NO: 723401 - DNA, 20 bp, mouse
gggtagggagacactacgag

SEQ ID NO: 723402 - DNA, 20 bp, mouse
gaaactgtgtcatctctgtc

SEQ ID NO: 723403 - DNA, 20 bp, mouse
gctgactgcaccaggcttcc

SEQ ID NO: 723404 - DNA, 20 bp, mouse
gaagaggaacaaagaagtcc

SEQ ID NO: 723405 - DNA, 20 bp, mouse
ggtcccggtcccaaaccaaa

SEQ ID NO: 723406 - DNA, 20 bp, mouse
gggcgggcgctgggaagggt

SEQ ID NO: 723407 - DNA, 20 bp, mouse
ggctgcgtgctgaggtaagg

SEQ ID NO: 723408 - DNA, 20 bp, mouse
gagggaggggctgcgtgctg

SEQ ID NO: 723409 - DNA, 20 bp, mouse
gcgtgatgatgcaaaccggt

SEQ ID NO: 723410 - DNA, 20 bp, mouse
gccctgaacaggcaacctct

SEQ ID NO: 723411 - DNA, 20 bp, mouse
gtgcatcatcacgcagggag

SEQ ID NO: 723412 - DNA, 20 bp, mouse
gggggctgcgtgctgaggta

SEQ ID NO: 723413 - DNA, 20 bp, mouse
gtctgcagttcctagaacat

SEQ ID NO: 723414 - DNA, 20 bp, mouse
gggtggggagggcgggcgct

SEQ ID NO: 723415 - DNA, 20 bp, mouse
gatgatgcaaaccggtgggg

SEQ ID NO: 723416 - DNA, 20 bp, mouse
ggcggctccccgcgccgcgt

SEQ ID NO: 723417 - DNA, 20 bp, mouse
gtgaaggggtcctgtcactg

SEQ ID NO: 723418 - DNA, 20 bp, mouse
gacttcccggggtgaatggt

SEQ ID NO: 723419 - DNA, 20 bp, mouse
gccgggcgcgatccccgccg

SEQ ID NO: 723420 - DNA, 20 bp, mouse
gacccccctctcacttcccg

SEQ ID NO: 723421 - DNA, 20 bp, mouse
gccgccttggccaccgagag

SEQ ID NO: 723422 - DNA, 20 bp, mouse
gtcaccccgggaagtgagag

SEQ ID NO: 723423 - DNA, 20 bp, mouse
gcgaagcgattggtgatccc

SEQ ID NO: 723424 - DNA, 20 bp, mouse
gcgcaccaaccattcacccc

SEQ ID NO: 723425 - DNA, 20 bp, mouse
gccgcgccgcgtggggtgaa

SEQ ID NO: 723426 - DNA, 20 bp, mouse
gtccctagaaatggggtgtg

SEQ ID NO: 723427 - DNA, 20 bp, mouse
gcgtagaggcgggactctcc

SEQ ID NO: 723428 - DNA, 20 bp, mouse
gcacatgatccctagaaatg

SEQ ID NO: 723429 - DNA, 20 bp, mouse
gccagcaagctctgccctgg

SEQ ID NO: 723430 - DNA, 20 bp, mouse
gagggcagctctcctaactg

SEQ ID NO: 723431 - DNA, 20 bp, mouse
gctgccaggcgtgaagagac

SEQ ID NO: 723432 - DNA, 20 bp, mouse
gaaaccagcaagctctgccc

SEQ ID NO: 723433 - DNA, 20 bp, mouse
ggccctggatctccgagcaa

SEQ ID NO: 723434 - DNA, 20 bp, mouse
gaccttgaacgcgtgccctc

SEQ ID NO: 723435 - DNA, 20 bp, mouse
gtacgtagacaagtaaccaa

SEQ ID NO: 723436 - DNA, 20 bp, mouse
gagccgcgctcccagatgcc

SEQ ID NO: 723437 - DNA, 20 bp, mouse
gctaggagaaaaagggagat

SEQ ID NO: 723438 - DNA, 20 bp, mouse
gttggagaggacgtctaaga

SEQ ID NO: 723439 - DNA, 20 bp, mouse
ggagagacgtcagtgcgctc

SEQ ID NO: 723440 - DNA, 20 bp, mouse
gggtgttcatgatatctcgt

SEQ ID NO: 723441 - DNA, 20 bp, mouse
gatggtagaaattagtccga

SEQ ID NO: 723442 - DNA, 20 bp, mouse
gctgctgctggggattgcca

SEQ ID NO: 723443 - DNA, 20 bp, mouse
ggatgggactaggagaaaaa

SEQ ID NO: 723444 - DNA, 20 bp, mouse
gaggggcaaagcaaagcgcg

SEQ ID NO: 723445 - DNA, 20 bp, mouse
ggcatctggcagagcaagtg

SEQ ID NO: 723446 - DNA, 20 bp, mouse
gaagaggaagagcgtcaggg

SEQ ID NO: 723447 - DNA, 20 bp, mouse
gcgtcagggcgggcagaagg

SEQ ID NO: 723448 - DNA, 20 bp, mouse
gttcacctcctcaccttccg

SEQ ID NO: 723449 - DNA, 20 bp, mouse
gctccggtgggcggagactg

SEQ ID NO: 723450 - DNA, 20 bp, mouse
gcaggggacagccaatgaag

SEQ ID NO: 723451 - DNA, 20 bp, mouse
gtccgcccgcagaaggtagc

SEQ ID NO: 723452 - DNA, 20 bp, mouse
gggcggaacgtgggtgtccc

SEQ ID NO: 723453 - DNA, 20 bp, mouse
gaacgtgggtgtcccgggaa

SEQ ID NO: 723454 - DNA, 20 bp, mouse
gttgcggcatagtagagatg

SEQ ID NO: 723455 - DNA, 20 bp, mouse
ggggcggagactgaggcttc

SEQ ID NO: 723456 - DNA, 20 bp, mouse
ggaagctcgtagtaggtatg

SEQ ID NO: 723457 - DNA, 20 bp, mouse
ggtctcacgaagctcgtagt

SEQ ID NO: 723458 - DNA, 20 bp, mouse
ggcgctactctgctgtccgg

SEQ ID NO: 723459 - DNA, 20 bp, mouse
gctactctgctgtccggtgg

SEQ ID NO: 723460 - DNA, 20 bp, mouse
gcgatcgcttctcgaggatg

SEQ ID NO: 723461 - DNA, 20 bp, mouse
gacggcgctgcgaaagttta

SEQ ID NO: 723462 - DNA, 20 bp, mouse
ggctgtccggtggtggatgt

SEQ ID NO: 723463 - DNA, 20 bp, mouse
ggcttctcgaggatgaggcg

SEQ ID NO: 723464 - DNA, 20 bp, mouse
gaccgcgcgatcgcttctcg

SEQ ID NO: 723465 - DNA, 20 bp, mouse
gctagcaggcacgggacttc

SEQ ID NO: 723466 - DNA, 20 bp, mouse
ggattgaagcgtccagcagg

SEQ ID NO: 723467 - DNA, 20 bp, mouse
gtccaaagcatcctgcctat

SEQ ID NO: 723468 - DNA, 20 bp, mouse
gaggatgctttggacgtcac

SEQ ID NO: 723469 - DNA, 20 bp, mouse
ggcgaatgccagccccctgc

SEQ ID NO: 723470 - DNA, 20 bp, mouse
ggaagcgtccagcagggggc

SEQ ID NO: 723471 - DNA, 20 bp, mouse
gagaaagcctccaatcctat

SEQ ID NO: 723472 - DNA, 20 bp, mouse
gggagagctgccgtttgcta

SEQ ID NO: 723473 - DNA, 20 bp, mouse
ggccgctctgaagtggagcc

SEQ ID NO: 723474 - DNA, 20 bp, mouse
gcactggcttccctagcaaa

SEQ ID NO: 723475 - DNA, 20 bp, mouse
gagtgattgaagcgtccagc

SEQ ID NO: 723476 - DNA, 20 bp, mouse
gccatgacaaccattgaaca

SEQ ID NO: 723477 - DNA, 20 bp, mouse
gttgcaggaacacggctcac

SEQ ID NO: 723478 - DNA, 20 bp, mouse
gggcagaaatgggtgctatg

SEQ ID NO: 723479 - DNA, 20 bp, mouse
ggtcagcaagagttaaccta

SEQ ID NO: 723480 - DNA, 20 bp, mouse
gtgccccgaggtaggacaaa

SEQ ID NO: 723481 - DNA, 20 bp, mouse
gtagtctctgccctgttcaa

SEQ ID NO: 723482 - DNA, 20 bp, mouse
gcggagagcctccaccccct

SEQ ID NO: 723483 - DNA, 20 bp, mouse
gggggcatgggtacttcaga

SEQ ID NO: 723484 - DNA, 20 bp, mouse
gaggctctccgcttttcctg

SEQ ID NO: 723485 - DNA, 20 bp, mouse
gcaggtgtgcagggaacgtg

SEQ ID NO: 723486 - DNA, 20 bp, mouse
gcgcacccggggctgagacg

SEQ ID NO: 723487 - DNA, 20 bp, mouse
gttcccgccggtaagggtgt

SEQ ID NO: 723488 - DNA, 20 bp, mouse
ggcccggcgaagtttccgga

SEQ ID NO: 723489 - DNA, 20 bp, mouse
gcatgcgccgcgcgcacccg

SEQ ID NO: 723490 - DNA, 20 bp, mouse
ggacctgagcgcctccagag

SEQ ID NO: 723491 - DNA, 20 bp, mouse
ggggctgagacgaggctcgg

SEQ ID NO: 723492 - DNA, 20 bp, mouse
gaacctgagcaggagagcct

SEQ ID NO: 723493 - DNA, 20 bp, mouse
gcgccggtaagggtgtgggt

SEQ ID NO: 723494 - DNA, 20 bp, mouse
gctgagacgaggctcggagg

SEQ ID NO: 723495 - DNA, 20 bp, mouse
gccagagtggaagttgtccc

SEQ ID NO: 723496 - DNA, 20 bp, mouse
gtgggggcggtgtcggagat

SEQ ID NO: 723497 - DNA, 20 bp, mouse
gtcggagatgggagcgccta

SEQ ID NO: 723498 - DNA, 20 bp, mouse
ggcagcaggtgcactcggtt

SEQ ID NO: 723499 - DNA, 20 bp, mouse
gctgctgcagcctggcacta

SEQ ID NO: 723500 - DNA, 20 bp, mouse
ggacgaggggcggagtcagt

SEQ ID NO: 723501 - DNA, 20 bp, mouse
gaggctgcagcaggtgcact

SEQ ID NO: 723502 - DNA, 20 bp, mouse
ggagatggaaacctatgccg

SEQ ID NO: 723503 - DNA, 20 bp, mouse
gggggtagagtggacggagc

SEQ ID NO: 723504 - DNA, 20 bp, mouse
ggctggggtgggggcggtgt

SEQ ID NO: 723505 - DNA, 20 bp, mouse
ggggggcgtggccgagacgg

SEQ ID NO: 723506 - DNA, 20 bp, mouse
gtgggcagagtggccatcta

SEQ ID NO: 723507 - DNA, 20 bp, mouse
gtggctagacagtgcagtag

SEQ ID NO: 723508 - DNA, 20 bp, mouse
gtgggtctaaccaacatggt

SEQ ID NO: 723509 - DNA, 20 bp, mouse
gccaacggaaagcgtccaca

SEQ ID NO: 723510 - DNA, 20 bp, mouse
gttcagggatggcggtagag

SEQ ID NO: 723511 - DNA, 20 bp, mouse
gcagggacagactaggactg

SEQ ID NO: 723512 - DNA, 20 bp, mouse
ggccactctgcccaccatgt

SEQ ID NO: 723513 - DNA, 20 bp, mouse
gggtatgtatgtagctttca

SEQ ID NO: 723514 - DNA, 20 bp, mouse
ggtagtgggtctaaccaaca

SEQ ID NO: 723515 - DNA, 20 bp, mouse
ggatcggagcataggatcca

SEQ ID NO: 723516 - DNA, 20 bp, mouse
ggggacgggtcttagactgt

SEQ ID NO: 723517 - DNA, 20 bp, mouse
gcaaccctgggaatgaaagg

SEQ ID NO: 723518 - DNA, 20 bp, mouse
gaaggtaatgcgcagagaga

SEQ ID NO: 723519 - DNA, 20 bp, mouse
gccaggacgcggttactttg

SEQ ID NO: 723520 - DNA, 20 bp, mouse
ggggcaagaaggttcgaaga

SEQ ID NO: 723521 - DNA, 20 bp, mouse
ggactgtgggaggtgaaacc

SEQ ID NO: 723522 - DNA, 20 bp, mouse
gtaaatggaaagacaaccct

SEQ ID NO: 723523 - DNA, 20 bp, mouse
gggaatgcctggttgggaaa

SEQ ID NO: 723524 - DNA, 20 bp, mouse
gtctgcgcattaccttcttc

SEQ ID NO: 723525 - DNA, 20 bp, mouse
gcaagaaggttcgaagatgg

SEQ ID NO: 723526 - DNA, 20 bp, mouse
gcagaacaagtgcaagaaag

SEQ ID NO: 723527 - DNA, 20 bp, mouse
gagaaagtaggtacgtgaca

SEQ ID NO: 723528 - DNA, 20 bp, mouse
gccgtgaaggagagaccttc

SEQ ID NO: 723529 - DNA, 20 bp, mouse
gcaaatggttagagatgatt

SEQ ID NO: 723530 - DNA, 20 bp, mouse
gaatctagaatcaaatgtgt

SEQ ID NO: 723531 - DNA, 20 bp, mouse
gcaaagcttgcctttagcga

SEQ ID NO: 723532 - DNA, 20 bp, mouse
gtttaaatattaaacgtcca

SEQ ID NO: 723533 - DNA, 20 bp, mouse
gaggcacactgcacatcctt

SEQ ID NO: 723534 - DNA, 20 bp, mouse
gtgccctttgaaagattatc

SEQ ID NO: 723535 - DNA, 20 bp, mouse
gaaatattaaacgtccatgg

SEQ ID NO: 723536 - DNA, 20 bp, mouse
gcacggttatgtggagtgga

SEQ ID NO: 723537 - DNA, 20 bp, mouse
ggcaggtgatcacggttatg

SEQ ID NO: 723538 - DNA, 20 bp, mouse
gagaagatgaagtctctgtc

SEQ ID NO: 723539 - DNA, 20 bp, mouse
gagacttaagatggagtcag

SEQ ID NO: 723540 - DNA, 20 bp, mouse
gtgatcacggttatgtggag

SEQ ID NO: 723541 - DNA, 20 bp, mouse
gctggcttctcttaccctgg

SEQ ID NO: 723542 - DNA, 20 bp, mouse
gttgaaaacgcaggtgatca

SEQ ID NO: 723543 - DNA, 20 bp, mouse
gggtgccaacccttcaaggt

SEQ ID NO: 723544 - DNA, 20 bp, mouse
gtcttggggcttcttagagt

SEQ ID NO: 723545 - DNA, 20 bp, mouse
ggtaataatattcacccccc

SEQ ID NO: 723546 - DNA, 20 bp, mouse
gaactgtggcagggcccgaa

SEQ ID NO: 723547 - DNA, 20 bp, mouse
ggcaggggaggcgttgtctc

SEQ ID NO: 723548 - DNA, 20 bp, mouse
gaggcgttgtctctggggta

SEQ ID NO: 723549 - DNA, 20 bp, mouse
gctggcagggaactgtggca

SEQ ID NO: 723550 - DNA, 20 bp, mouse
gtggcgctggcagggaactg

SEQ ID NO: 723551 - DNA, 20 bp, mouse
gcctcccctgccgctggcgc

SEQ ID NO: 723552 - DNA, 20 bp, mouse
gacaacgcctcccctgccgc

SEQ ID NO: 723553 - DNA, 20 bp, mouse
gccccggcgtaggcctggaa

SEQ ID NO: 723554 - DNA, 20 bp, mouse
ggagactcgaggttacacaa

SEQ ID NO: 723555 - DNA, 20 bp, mouse
ggcggtgctcgggatcctcg

SEQ ID NO: 723556 - DNA, 20 bp, mouse
ggggggcgcttgcaggggag

SEQ ID NO: 723557 - DNA, 20 bp, mouse
gccgcgccggggctgccgaa

SEQ ID NO: 723558 - DNA, 20 bp, mouse
gggagctgcgtcctacccgc

SEQ ID NO: 723559 - DNA, 20 bp, mouse
gctgccgaatggaaaagatt

SEQ ID NO: 723560 - DNA, 20 bp, mouse
ggtcggggcggagaggtcgg

SEQ ID NO: 723561 - DNA, 20 bp, mouse
gtcatcctggatttagttcc

SEQ ID NO: 723562 - DNA, 20 bp, mouse
gcctagctgaactcaacccg

SEQ ID NO: 723563 - DNA, 20 bp, mouse
gcggccccggccttgctggg

SEQ ID NO: 723564 - DNA, 20 bp, mouse
ggagggggagagatgccaag

SEQ ID NO: 723565 - DNA, 20 bp, mouse
gaatagagagaaaagggtcg

SEQ ID NO: 723566 - DNA, 20 bp, mouse
gaatccccggccatggagga

SEQ ID NO: 723567 - DNA, 20 bp, mouse
gccccggtacccagacgaag

SEQ ID NO: 723568 - DNA, 20 bp, mouse
ggccggggattagctctctg

SEQ ID NO: 723569 - DNA, 20 bp, mouse
gagggcaagccccttcgtct

SEQ ID NO: 723570 - DNA, 20 bp, mouse
gcggggaccctgtgagttag

SEQ ID NO: 723571 - DNA, 20 bp, mouse
gactctgccacgtctagagc

SEQ ID NO: 723572 - DNA, 20 bp, mouse
gcgaacgcggcgcccggtct

SEQ ID NO: 723573 - DNA, 20 bp, mouse
gctgctcccagcgcagtccc

SEQ ID NO: 723574 - DNA, 20 bp, mouse
gagccccttcgtctgggtac

SEQ ID NO: 723575 - DNA, 20 bp, mouse
gtgggtaccggggactgcgc

SEQ ID NO: 723576 - DNA, 20 bp, mouse
ggaggcggggcacttcaaac

SEQ ID NO: 723577 - DNA, 20 bp, mouse
ggccccgcctcaggtcctgt

SEQ ID NO: 723578 - DNA, 20 bp, mouse
gtgtgtgcaggggtgataca

SEQ ID NO: 723579 - DNA, 20 bp, mouse
gaagtggaacaaaaaggggt

SEQ ID NO: 723580 - DNA, 20 bp, mouse
gaaaaggggtggggtcattg

SEQ ID NO: 723581 - DNA, 20 bp, mouse
gcccacccccacaggacctg

SEQ ID NO: 723582 - DNA, 20 bp, mouse
gaggcaggtgtctgtgttgc

SEQ ID NO: 723583 - DNA, 20 bp, mouse
ggcctcaggtcctgtggggg

SEQ ID NO: 723584 - DNA, 20 bp, mouse
ggggtgggtaaaaagatgcc

SEQ ID NO: 723585 - DNA, 20 bp, mouse
ggggtaaaaagatgccaggc

SEQ ID NO: 723586 - DNA, 20 bp, mouse
gctggcctgagacgagaaga

SEQ ID NO: 723587 - DNA, 20 bp, mouse
gcgagaagagggtttgggta

SEQ ID NO: 723588 - DNA, 20 bp, mouse
gcaaaccctcttctcgtctc

SEQ ID NO: 723589 - DNA, 20 bp, mouse
gaagcaggatataggataag

SEQ ID NO: 723590 - DNA, 20 bp, mouse
gcagggcccagtgcctgagg

SEQ ID NO: 723591 - DNA, 20 bp, mouse
gcagggttggggagatcacc

SEQ ID NO: 723592 - DNA, 20 bp, mouse
ggggacagttaacagggaca

SEQ ID NO: 723593 - DNA, 20 bp, mouse
gggaacaagggacagttaac

SEQ ID NO: 723594 - DNA, 20 bp, mouse
gtcaaacagactgatactgg

SEQ ID NO: 723595 - DNA, 20 bp, mouse
gacttcaaacagactgatac

SEQ ID NO: 723596 - DNA, 20 bp, mouse
gggcctgctaagagatgagg

SEQ ID NO: 723597 - DNA, 20 bp, mouse
gggatctcctggaacaaaaa

SEQ ID NO: 723598 - DNA, 20 bp, mouse
ggaggtgaggcacttctaac

SEQ ID NO: 723599 - DNA, 20 bp, mouse
gcctggcctgctaagagatg

SEQ ID NO: 723600 - DNA, 20 bp, mouse
gacttctaacaggttgatgc

SEQ ID NO: 723601 - DNA, 20 bp, mouse
gcaccccctcatctcttagc

SEQ ID NO: 723602 - DNA, 20 bp, mouse
ggaactctggggagcaaggg

SEQ ID NO: 723603 - DNA, 20 bp, mouse
gagtgcctcacctcaggccc

SEQ ID NO: 723604 - DNA, 20 bp, mouse
ggagatcatcaagagaggtg

SEQ ID NO: 723605 - DNA, 20 bp, mouse
gaatgtgtacaggagtgata

SEQ ID NO: 723606 - DNA, 20 bp, mouse
gagtgctgggtgtgactgtc

SEQ ID NO: 723607 - DNA, 20 bp, mouse
ggtgactgtcaggctgcaat

SEQ ID NO: 723608 - DNA, 20 bp, mouse
gagccaggacagccctccag

SEQ ID NO: 723609 - DNA, 20 bp, mouse
gtcctgtcaggcactggtta

SEQ ID NO: 723610 - DNA, 20 bp, mouse
gtcaggcactggttatggca

SEQ ID NO: 723611 - DNA, 20 bp, mouse
ggagggctgtcctggctcag

SEQ ID NO: 723612 - DNA, 20 bp, mouse
gcactagcgaaaacaaaatc

SEQ ID NO: 723613 - DNA, 20 bp, mouse
ggttgcttcctgtcaggcac

SEQ ID NO: 723614 - DNA, 20 bp, mouse
ggaaatcatttggacaatct

SEQ ID NO: 723615 - DNA, 20 bp, mouse
gacaggaagcaactccatga

SEQ ID NO: 723616 - DNA, 20 bp, mouse
gccaagtacaggaaaatgga

SEQ ID NO: 723617 - DNA, 20 bp, mouse
gaggaaaatggatggaattc

SEQ ID NO: 723618 - DNA, 20 bp, mouse
ggagtttagtctatttcatt

SEQ ID NO: 723619 - DNA, 20 bp, mouse
gtgatgaggtcccctggaaa

SEQ ID NO: 723620 - DNA, 20 bp, mouse
gtgcaccaagtacaggaaaa

SEQ ID NO: 723621 - DNA, 20 bp, mouse
gggtgcctgatgaggtcccc

SEQ ID NO: 723622 - DNA, 20 bp, mouse
gcagaagatgaatgggggca

SEQ ID NO: 723623 - DNA, 20 bp, mouse
ggtgcccaccagaagatgaa

SEQ ID NO: 723624 - DNA, 20 bp, mouse
gtatacatccaagttagccc

SEQ ID NO: 723625 - DNA, 20 bp, mouse
ggagttctctcacacatcgc

SEQ ID NO: 723626 - DNA, 20 bp, mouse
gccaagtacaggaaaatgga

SEQ ID NO: 723627 - DNA, 20 bp, mouse
gaggaaaatggatggaattc

SEQ ID NO: 723628 - DNA, 20 bp, mouse
ggagtttagtctatttcatt

SEQ ID NO: 723629 - DNA, 20 bp, mouse
gtgcaccaagtacaggaaaa

SEQ ID NO: 723630 - DNA, 20 bp, mouse
gtctgtaattgcatttccag

SEQ ID NO: 723631 - DNA, 20 bp, mouse
gatttccaggggacctcatc

SEQ ID NO: 723632 - DNA, 20 bp, mouse
gggtgcctgatgaggtcccc

SEQ ID NO: 723633 - DNA, 20 bp, mouse
gcagaagatgaatgggggca

SEQ ID NO: 723634 - DNA, 20 bp, mouse
ggagttctctcacacatcgc

SEQ ID NO: 723635 - DNA, 20 bp, mouse
gtatacatccaagttagccc

SEQ ID NO: 723636 - DNA, 20 bp, mouse
ggccagttgtcgactatatc

SEQ ID NO: 723637 - DNA, 20 bp, mouse
gcaagcttaggcccatgcca

SEQ ID NO: 723638 - DNA, 20 bp, mouse
ggcttaggcccatgccaagg

SEQ ID NO: 723639 - DNA, 20 bp, mouse
gttcgcacttgtgatgacca

SEQ ID NO: 723640 - DNA, 20 bp, mouse
gtccagatatagtcgacaac

SEQ ID NO: 723641 - DNA, 20 bp, mouse
gcaagtgcgaagtggtgttt

SEQ ID NO: 723642 - DNA, 20 bp, mouse
gtaaagaagaggttaggtcc

SEQ ID NO: 723643 - DNA, 20 bp, mouse
ggctttacatccagaccgag

SEQ ID NO: 723644 - DNA, 20 bp, mouse
ggtcactgtgcctctcggtc

SEQ ID NO: 723645 - DNA, 20 bp, mouse
ggcagaaagggtcaagttca

SEQ ID NO: 723646 - DNA, 20 bp, mouse
gtcccatctgatacacatgg

SEQ ID NO: 723647 - DNA, 20 bp, mouse
gtcttcccatctgatacaca

SEQ ID NO: 723648 - DNA, 20 bp, mouse
ggagggaggtgtggcaagga

SEQ ID NO: 723649 - DNA, 20 bp, mouse
ggagggagggaggtgtggca

SEQ ID NO: 723650 - DNA, 20 bp, mouse
gcccactcacagtaggattg

SEQ ID NO: 723651 - DNA, 20 bp, mouse
gagccaccatgtgtatcaga

SEQ ID NO: 723652 - DNA, 20 bp, mouse
gagagagaactgagggaggg

SEQ ID NO: 723653 - DNA, 20 bp, mouse
gaggatagaagcaatagctg

SEQ ID NO: 723654 - DNA, 20 bp, mouse
gaccaacccccactcacagt

SEQ ID NO: 723655 - DNA, 20 bp, mouse
gagaagcaatagctgtggct

SEQ ID NO: 723656 - DNA, 20 bp, mouse
ggagggagatgtggcgagga

SEQ ID NO: 723657 - DNA, 20 bp, mouse
gctactgagtgggggttggt

SEQ ID NO: 723658 - DNA, 20 bp, mouse
gtcccccatcctactgagtg

SEQ ID NO: 723659 - DNA, 20 bp, mouse
ggggaagaggtgaacgggag

SEQ ID NO: 723660 - DNA, 20 bp, mouse
gatcctggagaagagagaac

SEQ ID NO: 723661 - DNA, 20 bp, mouse
gaacccccactcagtaggat

SEQ ID NO: 723662 - DNA, 20 bp, mouse
ggggtcaggatagaaggaat

SEQ ID NO: 723663 - DNA, 20 bp, mouse
ggccaccacatgtatcagaa

SEQ ID NO: 723664 - DNA, 20 bp, mouse
gttggtgggaagaggtgaac

SEQ ID NO: 723665 - DNA, 20 bp, mouse
gaggatagaaggaatcggtg

SEQ ID NO: 723666 - DNA, 20 bp, mouse
gtcctccccggagcccgcct

SEQ ID NO: 723667 - DNA, 20 bp, mouse
ggcaggctgcgcagctgttc

SEQ ID NO: 723668 - DNA, 20 bp, mouse
gggaagcgctgcgaacttgg

SEQ ID NO: 723669 - DNA, 20 bp, mouse
gccgaagcccaggcgggctc

SEQ ID NO: 723670 - DNA, 20 bp, mouse
gtagaagaaagcgaagctcc

SEQ ID NO: 723671 - DNA, 20 bp, mouse
ggggggaagcgctgcgaact

SEQ ID NO: 723672 - DNA, 20 bp, mouse
gctgcgcagctgttccggga

SEQ ID NO: 723673 - DNA, 20 bp, mouse
gtcgggaattccctgcgatc

SEQ ID NO: 723674 - DNA, 20 bp, mouse
gagcgggcgcggtgctttca

SEQ ID NO: 723675 - DNA, 20 bp, mouse
gcagggaattcccgaagccc

SEQ ID NO: 723676 - DNA, 20 bp, mouse
ggaaacccgacacctcccgc

SEQ ID NO: 723677 - DNA, 20 bp, mouse
gagtgggcggcgttgcgctt

SEQ ID NO: 723678 - DNA, 20 bp, mouse
gcggggaggtggagcttccg

SEQ ID NO: 723679 - DNA, 20 bp, mouse
gcgagccggggccggggagt

SEQ ID NO: 723680 - DNA, 20 bp, mouse
gagccgccgccgcacagccc

SEQ ID NO: 723681 - DNA, 20 bp, mouse
gccggctgaggtcagggcgc

SEQ ID NO: 723682 - DNA, 20 bp, mouse
gtcagccggcgggaggtgtc

SEQ ID NO: 723683 - DNA, 20 bp, mouse
gcggtcacaacccgccgggt

SEQ ID NO: 723684 - DNA, 20 bp, mouse
gcgcaacgccgcccactccc

SEQ ID NO: 723685 - DNA, 20 bp, mouse
ggggggcggcacctacccgg

SEQ ID NO: 723686 - DNA, 20 bp, mouse
gtctcaacctggtctttcta

SEQ ID NO: 723687 - DNA, 20 bp, mouse
gggagtgggcggggcatccg

SEQ ID NO: 723688 - DNA, 20 bp, mouse
gcacgccgccagcttgggta

SEQ ID NO: 723689 - DNA, 20 bp, mouse
gtctcctgaggtctttcaat

SEQ ID NO: 723690 - DNA, 20 bp, mouse
gcaaatctgaaggttaggga

SEQ ID NO: 723691 - DNA, 20 bp, mouse
gcaggcagggctctctcccc

SEQ ID NO: 723692 - DNA, 20 bp, mouse
gggtgccaaccagatcacat

SEQ ID NO: 723693 - DNA, 20 bp, mouse
gcaagctggcggcgtgcctg

SEQ ID NO: 723694 - DNA, 20 bp, mouse
gctcacaagccaatgtgatc

SEQ ID NO: 723695 - DNA, 20 bp, mouse
ggcaccgattgaaagacctc

SEQ ID NO: 723696 - DNA, 20 bp, mouse
ggggacaagtgagagatccc

SEQ ID NO: 723697 - DNA, 20 bp, mouse
gatccgcgcgggagtggaga

SEQ ID NO: 723698 - DNA, 20 bp, mouse
ggggcgctgaacagtgtcgc

SEQ ID NO: 723699 - DNA, 20 bp, mouse
gggacagatccgcgcgggag

SEQ ID NO: 723700 - DNA, 20 bp, mouse
ggcgggggacagatccgcgc

SEQ ID NO: 723701 - DNA, 20 bp, mouse
gtgcacaaggaagcgagcat

SEQ ID NO: 723702 - DNA, 20 bp, mouse
ggcccgcccgcgcgcggaga

SEQ ID NO: 723703 - DNA, 20 bp, mouse
ggtccctctccactcccgcg

SEQ ID NO: 723704 - DNA, 20 bp, mouse
gggacgcgcgcccctccgtg

SEQ ID NO: 723705 - DNA, 20 bp, mouse
gtgggtctttagactgtcag

SEQ ID NO: 723706 - DNA, 20 bp, mouse
gactctgggtgcactcagtg

SEQ ID NO: 723707 - DNA, 20 bp, mouse
gaggctgcgcagccgagggc

SEQ ID NO: 723708 - DNA, 20 bp, mouse
gacctcccggaagccggcag

SEQ ID NO: 723709 - DNA, 20 bp, mouse
gcgtctcaagagcccgagag

SEQ ID NO: 723710 - DNA, 20 bp, mouse
ggggtcctagcgccggccct

SEQ ID NO: 723711 - DNA, 20 bp, mouse
gcacgcaggctcttgactct

SEQ ID NO: 723712 - DNA, 20 bp, mouse
gctagcgggacttggagctc

SEQ ID NO: 723713 - DNA, 20 bp, mouse
gtgtggaagcgatcctgtgc

SEQ ID NO: 723714 - DNA, 20 bp, mouse
gtggccgcagagatctccgt

SEQ ID NO: 723715 - DNA, 20 bp, mouse
gcagcaaaggctctcttttc

SEQ ID NO: 723716 - DNA, 20 bp, mouse
gccagcagtcagctactctg

SEQ ID NO: 723717 - DNA, 20 bp, mouse
gtagccaggactctatttcc

SEQ ID NO: 723718 - DNA, 20 bp, mouse
gacaccgggaaatagagtcc

SEQ ID NO: 723719 - DNA, 20 bp, mouse
ggtgctgtgcgggtcgaggg

SEQ ID NO: 723720 - DNA, 20 bp, mouse
gtcgacccgcacagcactct

SEQ ID NO: 723721 - DNA, 20 bp, mouse
gtcccggcgtgcatcattct

SEQ ID NO: 723722 - DNA, 20 bp, mouse
gtacacctgcaatgcggtga

SEQ ID NO: 723723 - DNA, 20 bp, mouse
gagccggagcccgaacggcg

SEQ ID NO: 723724 - DNA, 20 bp, mouse
ggacggctcgcgctgcacac

SEQ ID NO: 723725 - DNA, 20 bp, mouse
ggtggtgacaacgaagccga

SEQ ID NO: 723726 - DNA, 20 bp, mouse
gggggcgctgggcggtgtaa

SEQ ID NO: 723727 - DNA, 20 bp, mouse
ggccccgccgcccgcgttac

SEQ ID NO: 723728 - DNA, 20 bp, mouse
ggggcggtgtaagggctggg

SEQ ID NO: 723729 - DNA, 20 bp, mouse
gagaccacgccccagcaacg

SEQ ID NO: 723730 - DNA, 20 bp, mouse
gcagacgcctgtaacgcggg

SEQ ID NO: 723731 - DNA, 20 bp, mouse
gctggggcgtggtctcccag

SEQ ID NO: 723732 - DNA, 20 bp, mouse
ggcgacctggataaccaatg

SEQ ID NO: 723733 - DNA, 20 bp, mouse
ggtagagccgaaacccaagc

SEQ ID NO: 723734 - DNA, 20 bp, mouse
gcgaaggtagccgaacagaa

SEQ ID NO: 723735 - DNA, 20 bp, mouse
gagcaagcgacgtctctgat

SEQ ID NO: 723736 - DNA, 20 bp, mouse
gcccgcctgagacacgctcc

SEQ ID NO: 723737 - DNA, 20 bp, mouse
ggggttgccctgagggacgg

SEQ ID NO: 723738 - DNA, 20 bp, mouse
gtccgtcggtagggagacag

SEQ ID NO: 723739 - DNA, 20 bp, mouse
gggaagtgacgccatattgc

SEQ ID NO: 723740 - DNA, 20 bp, mouse
gagcttccgaagcgctccgt

SEQ ID NO: 723741 - DNA, 20 bp, mouse
gactaggcccggcggggact

SEQ ID NO: 723742 - DNA, 20 bp, mouse
gccgaagcgctccgtcggta

SEQ ID NO: 723743 - DNA, 20 bp, mouse
gcgcgccaggagcgtgtctc

SEQ ID NO: 723744 - DNA, 20 bp, mouse
ggcgagacaagactccgacg

SEQ ID NO: 723745 - DNA, 20 bp, mouse
ggccaggagcgtgtctcagg

SEQ ID NO: 723746 - DNA, 20 bp, mouse
gaagcgaagcggttgtgcac

SEQ ID NO: 723747 - DNA, 20 bp, mouse
gaacatggaaggcagatccg

SEQ ID NO: 723748 - DNA, 20 bp, mouse
ggggacctgaggtagtggga

SEQ ID NO: 723749 - DNA, 20 bp, mouse
ggctgggaggatgtagactc

SEQ ID NO: 723750 - DNA, 20 bp, mouse
gcctgccccgcccgcctcga

SEQ ID NO: 723751 - DNA, 20 bp, mouse
gccgaggggacctgaggtag

SEQ ID NO: 723752 - DNA, 20 bp, mouse
ggacactttcctcgggacag

SEQ ID NO: 723753 - DNA, 20 bp, mouse
gctgagtctcggaacatgga

SEQ ID NO: 723754 - DNA, 20 bp, mouse
gccggagccgccctcgaggc

SEQ ID NO: 723755 - DNA, 20 bp, mouse
ggagactcaggattacacca

SEQ ID NO: 723756 - DNA, 20 bp, mouse
ggggaggcgggtatctgtcc

SEQ ID NO: 723757 - DNA, 20 bp, mouse
gccactgggaccaacccgac

SEQ ID NO: 723758 - DNA, 20 bp, mouse
gaggggcgaccgcacccagt

SEQ ID NO: 723759 - DNA, 20 bp, mouse
gcgaccgcacccagtcgggt

SEQ ID NO: 723760 - DNA, 20 bp, mouse
gggaccaacccgactgggtg

SEQ ID NO: 723761 - DNA, 20 bp, mouse
ggggacggccggttacttaa

SEQ ID NO: 723762 - DNA, 20 bp, mouse
ggaggaccgcccagcaggga

SEQ ID NO: 723763 - DNA, 20 bp, mouse
ggggcggtcctcagctaggg

SEQ ID NO: 723764 - DNA, 20 bp, mouse
gacaggccggatcttctgat

SEQ ID NO: 723765 - DNA, 20 bp, mouse
gcgggatctctgagacatct

SEQ ID NO: 723766 - DNA, 20 bp, mouse
gaacgcgggcggacacagac

SEQ ID NO: 723767 - DNA, 20 bp, mouse
gaccgaggcgaaggtacggg

SEQ ID NO: 723768 - DNA, 20 bp, mouse
gcccggtgcggttttctcgg

SEQ ID NO: 723769 - DNA, 20 bp, mouse
gtacccgcgaagacccggtg

SEQ ID NO: 723770 - DNA, 20 bp, mouse
gactcactcgccggcgtcct

SEQ ID NO: 723771 - DNA, 20 bp, mouse
gaggccggcggcggtagttg

SEQ ID NO: 723772 - DNA, 20 bp, mouse
gaccacccgtaccttcgcct

SEQ ID NO: 723773 - DNA, 20 bp, mouse
ggcttcgtaggcggaaacgc

SEQ ID NO: 723774 - DNA, 20 bp, mouse
gacgggaactaccgaggcga

SEQ ID NO: 723775 - DNA, 20 bp, mouse
gagcaggccgcgctgacccg

SEQ ID NO: 723776 - DNA, 20 bp, mouse
gacccctgacccaacgcctg

SEQ ID NO: 723777 - DNA, 20 bp, mouse
gcaccacaggcgttgggtca

SEQ ID NO: 723778 - DNA, 20 bp, mouse
gacccctcgctgccatccgt

SEQ ID NO: 723779 - DNA, 20 bp, mouse
gcccgttagttctcagtcag

SEQ ID NO: 723780 - DNA, 20 bp, mouse
gaacctacggatggcagcga

SEQ ID NO: 723781 - DNA, 20 bp, mouse
gactaacggggacaaaccta

SEQ ID NO: 723782 - DNA, 20 bp, mouse
ggtatctaaggcttaatcat

SEQ ID NO: 723783 - DNA, 20 bp, mouse
gacggggacaaacctacgga

SEQ ID NO: 723784 - DNA, 20 bp, mouse
gaggagattcgctcacacat

SEQ ID NO: 723785 - DNA, 20 bp, mouse
gtcggaagtgattgggattt

SEQ ID NO: 723786 - DNA, 20 bp, mouse
gccccgcagcgcgtggaccg

SEQ ID NO: 723787 - DNA, 20 bp, mouse
gggcggggacaggggccctc

SEQ ID NO: 723788 - DNA, 20 bp, mouse
gaccgagggcgagaacgtgc

SEQ ID NO: 723789 - DNA, 20 bp, mouse
gggacaggggccctcgggcg

SEQ ID NO: 723790 - DNA, 20 bp, mouse
gcgggcgcggtgcttagtca

SEQ ID NO: 723791 - DNA, 20 bp, mouse
gtgttctcggggatcttggc

SEQ ID NO: 723792 - DNA, 20 bp, mouse
ggcaggaatccgagaagctg

SEQ ID NO: 723793 - DNA, 20 bp, mouse
gatggagctgccaactaaac

SEQ ID NO: 723794 - DNA, 20 bp, mouse
ggccccacggctaagaaatg

SEQ ID NO: 723795 - DNA, 20 bp, mouse
ggctggaataatgagtggag

SEQ ID NO: 723796 - DNA, 20 bp, mouse
gccgcaaggctaaagaggag

SEQ ID NO: 723797 - DNA, 20 bp, mouse
gggaaggagccctgtgttta

SEQ ID NO: 723798 - DNA, 20 bp, mouse
gccgccccgcaaggctaaag

SEQ ID NO: 723799 - DNA, 20 bp, mouse
ggtgagatggggacactcaa

SEQ ID NO: 723800 - DNA, 20 bp, mouse
gtgtttatggaactggacgg

SEQ ID NO: 723801 - DNA, 20 bp, mouse
gtgggctttaaggaatacgt

SEQ ID NO: 723802 - DNA, 20 bp, mouse
ggccactagctctaactctc

SEQ ID NO: 723803 - DNA, 20 bp, mouse
gggaatacgtcggtactcta

SEQ ID NO: 723804 - DNA, 20 bp, mouse
gtagtggcacgctgtgagat

SEQ ID NO: 723805 - DNA, 20 bp, mouse
gacaacgagcgagtaagtcg

SEQ ID NO: 723806 - DNA, 20 bp, mouse
gtaacctgaaagagacatct

SEQ ID NO: 723807 - DNA, 20 bp, mouse
ggagacatcttggctaagaa

SEQ ID NO: 723808 - DNA, 20 bp, mouse
ggttctcagggttgactctg

SEQ ID NO: 723809 - DNA, 20 bp, mouse
gaggtgacaattcttaccca

SEQ ID NO: 723810 - DNA, 20 bp, mouse
gaggctaagttaaacacaac

SEQ ID NO: 723811 - DNA, 20 bp, mouse
gtaagatagatatcatgcta

SEQ ID NO: 723812 - DNA, 20 bp, mouse
gagaattgtcaccttactaa

SEQ ID NO: 723813 - DNA, 20 bp, mouse
gatagatatcatgctatggc

SEQ ID NO: 723814 - DNA, 20 bp, mouse
gtgagttttttaatcaaagc

SEQ ID NO: 723815 - DNA, 20 bp, mouse
gttcttggtgtcatgcttat

SEQ ID NO: 723816 - DNA, 20 bp, mouse
gactagaaaggtgacaaatc

SEQ ID NO: 723817 - DNA, 20 bp, mouse
gcaggaactggctatattag

SEQ ID NO: 723818 - DNA, 20 bp, mouse
gaaggtgacaaatcaggaag

SEQ ID NO: 723819 - DNA, 20 bp, mouse
ggggaggggctgatccctat

SEQ ID NO: 723820 - DNA, 20 bp, mouse
gggctcagaggaaccttatc

SEQ ID NO: 723821 - DNA, 20 bp, mouse
gcgtctataaagaactctat

SEQ ID NO: 723822 - DNA, 20 bp, mouse
gacccagtatagggaccaat

SEQ ID NO: 723823 - DNA, 20 bp, mouse
gactctaaattttcaggaag

SEQ ID NO: 723824 - DNA, 20 bp, mouse
gtagaggactctaaattttc

SEQ ID NO: 723825 - DNA, 20 bp, mouse
ggaggaaccttatcaggaac

SEQ ID NO: 723826 - DNA, 20 bp, mouse
gccaagcagagttaactctt

SEQ ID NO: 723827 - DNA, 20 bp, mouse
gacaccagggagtacttctg

SEQ ID NO: 723828 - DNA, 20 bp, mouse
gaggatgggctaaagcaagt

SEQ ID NO: 723829 - DNA, 20 bp, mouse
gaactcttcggctgtcaatg

SEQ ID NO: 723830 - DNA, 20 bp, mouse
gttcggctgtcaatgaggat

SEQ ID NO: 723831 - DNA, 20 bp, mouse
ggcctgagttgctaaagagt

SEQ ID NO: 723832 - DNA, 20 bp, mouse
gaaggggagacaatccaata

SEQ ID NO: 723833 - DNA, 20 bp, mouse
gggaagttcccagctcccta

SEQ ID NO: 723834 - DNA, 20 bp, mouse
ggtctccccttaactgggaa

SEQ ID NO: 723835 - DNA, 20 bp, mouse
gcagcttgccattggcattg

SEQ ID NO: 723836 - DNA, 20 bp, mouse
gaggactccgattcctgtgc

SEQ ID NO: 723837 - DNA, 20 bp, mouse
ggtttcccggggagaagaac

SEQ ID NO: 723838 - DNA, 20 bp, mouse
gcattactgagtacactctt

SEQ ID NO: 723839 - DNA, 20 bp, mouse
gcaaacctgttcttctcccc

SEQ ID NO: 723840 - DNA, 20 bp, mouse
gtagagaggaatcagcgact

SEQ ID NO: 723841 - DNA, 20 bp, mouse
gcaagctctaacctttcaat

SEQ ID NO: 723842 - DNA, 20 bp, mouse
gtagagacgtacagttctgg

SEQ ID NO: 723843 - DNA, 20 bp, mouse
gtgggcaagccaaaattgag

SEQ ID NO: 723844 - DNA, 20 bp, mouse
gacacgccccctaggcacgt

SEQ ID NO: 723845 - DNA, 20 bp, mouse
gtggttaacgctttgtttcc

SEQ ID NO: 723846 - DNA, 20 bp, mouse
gcccccgaggcgccaggaag

SEQ ID NO: 723847 - DNA, 20 bp, mouse
ggagcggtgagtggtgacga

SEQ ID NO: 723848 - DNA, 20 bp, mouse
gagcccacggagctccgctc

SEQ ID NO: 723849 - DNA, 20 bp, mouse
gtcccccgggccaccgtcct

SEQ ID NO: 723850 - DNA, 20 bp, mouse
gccgccactcggtcggttcc

SEQ ID NO: 723851 - DNA, 20 bp, mouse
gctaccgggaaccgaccgag

SEQ ID NO: 723852 - DNA, 20 bp, mouse
ggaggctcgagaccccgcga

SEQ ID NO: 723853 - DNA, 20 bp, mouse
gctccgccccgccactcggt

SEQ ID NO: 723854 - DNA, 20 bp, mouse
gggccggagcggagctccgt

SEQ ID NO: 723855 - DNA, 20 bp, mouse
gggtctcgagcctccccccg

SEQ ID NO: 723856 - DNA, 20 bp, mouse
gtacacgggtagaccaagag

SEQ ID NO: 723857 - DNA, 20 bp, mouse
gctggcccaggggtgtacac

SEQ ID NO: 723858 - DNA, 20 bp, mouse
gggagaggccccgccctata

SEQ ID NO: 723859 - DNA, 20 bp, mouse
gggtagaccaagagcggatg

SEQ ID NO: 723860 - DNA, 20 bp, mouse
gcacacttgagatccttctc

SEQ ID NO: 723861 - DNA, 20 bp, mouse
ggaccaagagcggatgagga

SEQ ID NO: 723862 - DNA, 20 bp, mouse
gggccctagtgcgcagtctc

SEQ ID NO: 723863 - DNA, 20 bp, mouse
gcccctgggccagccctata

SEQ ID NO: 723864 - DNA, 20 bp, mouse
ggtagtccgcgaattgcagg

SEQ ID NO: 723865 - DNA, 20 bp, mouse
ggggccagccctatagggcg

SEQ ID NO: 723866 - DNA, 20 bp, mouse
ggccacaccctctccgggag

SEQ ID NO: 723867 - DNA, 20 bp, mouse
gaccccgcctctcccggaga

SEQ ID NO: 723868 - DNA, 20 bp, mouse
ggcggggttaagatccttag

SEQ ID NO: 723869 - DNA, 20 bp, mouse
gatggcggcagtcgctaaga

SEQ ID NO: 723870 - DNA, 20 bp, mouse
gggaaggggagtgcctaatt

SEQ ID NO: 723871 - DNA, 20 bp, mouse
gagagcagcagaccctaaag

SEQ ID NO: 723872 - DNA, 20 bp, mouse
gagtctagggagcatccagc

SEQ ID NO: 723873 - DNA, 20 bp, mouse
gcccgggacagaggccgcta

SEQ ID NO: 723874 - DNA, 20 bp, mouse
ggcctctgccttccgcttta

SEQ ID NO: 723875 - DNA, 20 bp, mouse
gtggttacagacctaggaag

SEQ ID NO: 723876 - DNA, 20 bp, mouse
gggaaggagccagggatcca

SEQ ID NO: 723877 - DNA, 20 bp, mouse
ggcaagatatagctaatctc

SEQ ID NO: 723878 - DNA, 20 bp, mouse
gagccagggatccaggggca

SEQ ID NO: 723879 - DNA, 20 bp, mouse
gaagaggcgggacctggata

SEQ ID NO: 723880 - DNA, 20 bp, mouse
gtgccctgcccctggatccc

SEQ ID NO: 723881 - DNA, 20 bp, mouse
ggagaacagttgtgcagcta

SEQ ID NO: 723882 - DNA, 20 bp, mouse
gatgaagaagggacaatgtc

SEQ ID NO: 723883 - DNA, 20 bp, mouse
gaagagggagttgctgacac

SEQ ID NO: 723884 - DNA, 20 bp, mouse
gcctggctccttccttcaac

SEQ ID NO: 723885 - DNA, 20 bp, mouse
gagacattccagttgaagga

SEQ ID NO: 723886 - DNA, 20 bp, mouse
ggcccgggagagggagaagt

SEQ ID NO: 723887 - DNA, 20 bp, mouse
ggtgacaggaagcactaaag

SEQ ID NO: 723888 - DNA, 20 bp, mouse
gtgaacctgctcagaatcca

SEQ ID NO: 723889 - DNA, 20 bp, mouse
gagtggggttagggcattga

SEQ ID NO: 723890 - DNA, 20 bp, mouse
gttcgggttcaaagtctctg

SEQ ID NO: 723891 - DNA, 20 bp, mouse
ggggttagggcattgagggc

SEQ ID NO: 723892 - DNA, 20 bp, mouse
gcctatgcaccttcaggcct

SEQ ID NO: 723893 - DNA, 20 bp, mouse
ggcagtgcctgagtggggtt

SEQ ID NO: 723894 - DNA, 20 bp, mouse
gggaaaggcagtgcctgagt

SEQ ID NO: 723895 - DNA, 20 bp, mouse
gggtgaagccaaagggcttc

SEQ ID NO: 723896 - DNA, 20 bp, mouse
gaggcagagcggtacggcaa

SEQ ID NO: 723897 - DNA, 20 bp, mouse
gcgaaggcaacagggtaaga

SEQ ID NO: 723898 - DNA, 20 bp, mouse
gtgaccctcccacagaccga

SEQ ID NO: 723899 - DNA, 20 bp, mouse
ggagctctgcatctgcgcac

SEQ ID NO: 723900 - DNA, 20 bp, mouse
gttgcggggcagagtctgga

SEQ ID NO: 723901 - DNA, 20 bp, mouse
ggtaagaaggcagagcggta

SEQ ID NO: 723902 - DNA, 20 bp, mouse
gcgcaccgggctggacgatt

SEQ ID NO: 723903 - DNA, 20 bp, mouse
ggggttggggcctctcctag

SEQ ID NO: 723904 - DNA, 20 bp, mouse
ggagcggtacggcaaaggca

SEQ ID NO: 723905 - DNA, 20 bp, mouse
gcaaacaagacagacttctg

SEQ ID NO: 723906 - DNA, 20 bp, mouse
gcctccgcgtggtcagtggg

SEQ ID NO: 723907 - DNA, 20 bp, mouse
gccgccctccgcgtggtcag

SEQ ID NO: 723908 - DNA, 20 bp, mouse
gccctgggagaagttcacac

SEQ ID NO: 723909 - DNA, 20 bp, mouse
ggtggagcatagagcgagag

SEQ ID NO: 723910 - DNA, 20 bp, mouse
gcacgcttcccgggtaacta

SEQ ID NO: 723911 - DNA, 20 bp, mouse
gtggtcagtgggcggtgcgc

SEQ ID NO: 723912 - DNA, 20 bp, mouse
gtcccgggtaactaaggtcc

SEQ ID NO: 723913 - DNA, 20 bp, mouse
ggcacataaaactacgaggt

SEQ ID NO: 723914 - DNA, 20 bp, mouse
gtccggtgtgaacttctccc

SEQ ID NO: 723915 - DNA, 20 bp, mouse
gggcctggaccttagttacc

SEQ ID NO: 723916 - DNA, 20 bp, mouse
ggggcagaacaggtcctagc

SEQ ID NO: 723917 - DNA, 20 bp, mouse
gaccgaaggcagtgattgat

SEQ ID NO: 723918 - DNA, 20 bp, mouse
gaaggcagtgattgattggc

SEQ ID NO: 723919 - DNA, 20 bp, mouse
ggaaagctcagacccgcctt

SEQ ID NO: 723920 - DNA, 20 bp, mouse
gtggcagtatccctggagac

SEQ ID NO: 723921 - DNA, 20 bp, mouse
gaggaagttggcagtatccc

SEQ ID NO: 723922 - DNA, 20 bp, mouse
gtgtgaaaaactgatctacc

SEQ ID NO: 723923 - DNA, 20 bp, mouse
gggtacaggagcagtgaaat

SEQ ID NO: 723924 - DNA, 20 bp, mouse
gtccaggagctatcatccga

SEQ ID NO: 723925 - DNA, 20 bp, mouse
gaggagctatcatccgaagg

SEQ ID NO: 723926 - DNA, 20 bp, mouse
gagggccgcccccagagcca

SEQ ID NO: 723927 - DNA, 20 bp, mouse
ggcatccaggaacaaggcca

SEQ ID NO: 723928 - DNA, 20 bp, mouse
ggctgagtgccaagagcgaa

SEQ ID NO: 723929 - DNA, 20 bp, mouse
gcaagccaccaccataacaa

SEQ ID NO: 723930 - DNA, 20 bp, mouse
gccagccaataccggcatcc

SEQ ID NO: 723931 - DNA, 20 bp, mouse
gtcccagttccagccaatac

SEQ ID NO: 723932 - DNA, 20 bp, mouse
gcagccccgcctttcgctct

SEQ ID NO: 723933 - DNA, 20 bp, mouse
gagagctgccagaaacggat

SEQ ID NO: 723934 - DNA, 20 bp, mouse
gccagtggtgacagttcgga

SEQ ID NO: 723935 - DNA, 20 bp, mouse
gtgcctgagctccattgtta

SEQ ID NO: 723936 - DNA, 20 bp, mouse
gagccgcccccgcctttaaa

SEQ ID NO: 723937 - DNA, 20 bp, mouse
gtgggctcccaggttcgctg

SEQ ID NO: 723938 - DNA, 20 bp, mouse
gtcgctgcggaggtagtgca

SEQ ID NO: 723939 - DNA, 20 bp, mouse
gctgtgtgacgttaaccggt

SEQ ID NO: 723940 - DNA, 20 bp, mouse
gctacctccgcagcgaacct

SEQ ID NO: 723941 - DNA, 20 bp, mouse
gcacaagaccccttgtgtgg

SEQ ID NO: 723942 - DNA, 20 bp, mouse
gtcaggatccaggatcgcag

SEQ ID NO: 723943 - DNA, 20 bp, mouse
gtcacacagcatcaggatcc

SEQ ID NO: 723944 - DNA, 20 bp, mouse
gacaccccgcctccacacaa

SEQ ID NO: 723945 - DNA, 20 bp, mouse
gctgcggaggtagtgcaagg

SEQ ID NO: 723946 - DNA, 20 bp, mouse
ggggtcaggccggaaatcta

SEQ ID NO: 723947 - DNA, 20 bp, mouse
gcagtaggatgtgagaccag

SEQ ID NO: 723948 - DNA, 20 bp, mouse
gaatccgcgaggaaccgcca

SEQ ID NO: 723949 - DNA, 20 bp, mouse
gtgctcgagaaacgagggtc

SEQ ID NO: 723950 - DNA, 20 bp, mouse
gaccgccagggcctgcccgg

SEQ ID NO: 723951 - DNA, 20 bp, mouse
gtaaagaggaagtcggtagc

SEQ ID NO: 723952 - DNA, 20 bp, mouse
gcagcttgctcgagaaacga

SEQ ID NO: 723953 - DNA, 20 bp, mouse
gttcctcgcggattcccagt

SEQ ID NO: 723954 - DNA, 20 bp, mouse
gaatctatggctacctaaag

SEQ ID NO: 723955 - DNA, 20 bp, mouse
gaggccctggcggttcctcg

SEQ ID NO: 723956 - DNA, 20 bp, mouse
ggccggggacactcgcttgt

SEQ ID NO: 723957 - DNA, 20 bp, mouse
gtcccacaagcgagtgtccc

SEQ ID NO: 723958 - DNA, 20 bp, mouse
gtggagagagaagccggtag

SEQ ID NO: 723959 - DNA, 20 bp, mouse
gcagctcccgcctcctgccg

SEQ ID NO: 723960 - DNA, 20 bp, mouse
gccagcaccgctgcagactc

SEQ ID NO: 723961 - DNA, 20 bp, mouse
gtggaatctactacagaggt

SEQ ID NO: 723962 - DNA, 20 bp, mouse
gagcgagtgtccccggcagg

SEQ ID NO: 723963 - DNA, 20 bp, mouse
gagctgcagagctccgctac

SEQ ID NO: 723964 - DNA, 20 bp, mouse
gccaccacctggactagagt

SEQ ID NO: 723965 - DNA, 20 bp, mouse
gaaaaataaacgagactaac

SEQ ID NO: 723966 - DNA, 20 bp, mouse
gtccggggcggcatccgggg

SEQ ID NO: 723967 - DNA, 20 bp, mouse
gggtcacatgctagtgtctc

SEQ ID NO: 723968 - DNA, 20 bp, mouse
gccgagtcggccacagtgct

SEQ ID NO: 723969 - DNA, 20 bp, mouse
gtggagagaatagccggtat

SEQ ID NO: 723970 - DNA, 20 bp, mouse
gactagcatgtgacccgagt

SEQ ID NO: 723971 - DNA, 20 bp, mouse
gtattcctagcgaaggtcaa

SEQ ID NO: 723972 - DNA, 20 bp, mouse
ggcatccggggcggcatccg

SEQ ID NO: 723973 - DNA, 20 bp, mouse
gtagtgtctcgggcaggagg

SEQ ID NO: 723974 - DNA, 20 bp, mouse
gaggagcaaacgaagctctt

SEQ ID NO: 723975 - DNA, 20 bp, mouse
gagctgcagagatccaatac

SEQ ID NO: 723976 - DNA, 20 bp, mouse
gtgggcagaggaggtgttag

SEQ ID NO: 723977 - DNA, 20 bp, mouse
gctgggaagtggggacgatt

SEQ ID NO: 723978 - DNA, 20 bp, mouse
gggagaccagttgtgtcctc

SEQ ID NO: 723979 - DNA, 20 bp, mouse
gctagcacggaatgagccag

SEQ ID NO: 723980 - DNA, 20 bp, mouse
ggagatgcgagtgacatcaa

SEQ ID NO: 723981 - DNA, 20 bp, mouse
gtggccacgcccccactggg

SEQ ID NO: 723982 - DNA, 20 bp, mouse
gtgcggtatccgcccagtgg

SEQ ID NO: 723983 - DNA, 20 bp, mouse
gcctggcccttctttctaaa

SEQ ID NO: 723984 - DNA, 20 bp, mouse
gtctaacaacacactagata

SEQ ID NO: 723985 - DNA, 20 bp, mouse
ggaggaggtgttagagggcc

SEQ ID NO: 723986 - DNA, 20 bp, mouse
gtgagactaaggtcctgggc

SEQ ID NO: 723987 - DNA, 20 bp, mouse
gcgggtgagactaaggtcct

SEQ ID NO: 723988 - DNA, 20 bp, mouse
ggacccaactcagagttctg

SEQ ID NO: 723989 - DNA, 20 bp, mouse
gaacgggtgaagcttgttgc

SEQ ID NO: 723990 - DNA, 20 bp, mouse
gccgcgtccgggtgagacta

SEQ ID NO: 723991 - DNA, 20 bp, mouse
gtctcacccggacgcggaaa

SEQ ID NO: 723992 - DNA, 20 bp, mouse
gctaccgtggagagtgttgg

SEQ ID NO: 723993 - DNA, 20 bp, mouse
gcgtccacagaactctgagt

SEQ ID NO: 723994 - DNA, 20 bp, mouse
gttgccttaaggaagaactg

SEQ ID NO: 723995 - DNA, 20 bp, mouse
gctgagagctaggagctgag

SEQ ID NO: 723996 - DNA, 20 bp, mouse
gctaggtccacaccccgtga

SEQ ID NO: 723997 - DNA, 20 bp, mouse
gagtcctgggcccaaggaac

SEQ ID NO: 723998 - DNA, 20 bp, mouse
gctgctagagggattagctg

SEQ ID NO: 723999 - DNA, 20 bp, mouse
gaatccctctagcaggaggg

SEQ ID NO: 724000 - DNA, 20 bp, mouse
gctgaagcacggaggtacag

SEQ ID NO: 724001 - DNA, 20 bp, mouse
gccccgtgagggaaatgatc

SEQ ID NO: 724002 - DNA, 20 bp, mouse
gtccgtgcttcagccaaatg

SEQ ID NO: 724003 - DNA, 20 bp, mouse
gaatttgagggcagttagca

SEQ ID NO: 724004 - DNA, 20 bp, mouse
ggaggaacggaacccagtaa

SEQ ID NO: 724005 - DNA, 20 bp, mouse
gacacaaccggcgtctctat

SEQ ID NO: 724006 - DNA, 20 bp, mouse
gtcagagaggggctggccct

SEQ ID NO: 724007 - DNA, 20 bp, mouse
ggagagctgggggtggtgcg

SEQ ID NO: 724008 - DNA, 20 bp, mouse
gccctgggaaggctcaagca

SEQ ID NO: 724009 - DNA, 20 bp, mouse
gcagcccctctctgaaaaac

SEQ ID NO: 724010 - DNA, 20 bp, mouse
gtaccacagcaaggattcta

SEQ ID NO: 724011 - DNA, 20 bp, mouse
gcatagacatctgtctgaga

SEQ ID NO: 724012 - DNA, 20 bp, mouse
gtggcctcataagtacatca

SEQ ID NO: 724013 - DNA, 20 bp, mouse
ggtaaagactggggcatcca

SEQ ID NO: 724014 - DNA, 20 bp, mouse
gcaggttcctcagatcagga

SEQ ID NO: 724015 - DNA, 20 bp, mouse
gaatgcaggttcctcagatc

SEQ ID NO: 724016 - DNA, 20 bp, mouse
gggccgcccgggcagctaag

SEQ ID NO: 724017 - DNA, 20 bp, mouse
gaggcacgacaggtccttgg

SEQ ID NO: 724018 - DNA, 20 bp, mouse
gccgtcaaggggtcataaga

SEQ ID NO: 724019 - DNA, 20 bp, mouse
gaggcgtagagcattgcggg

SEQ ID NO: 724020 - DNA, 20 bp, mouse
gctgggcggggcggaaagtg

SEQ ID NO: 724021 - DNA, 20 bp, mouse
gggcccggagggtgatcctt

SEQ ID NO: 724022 - DNA, 20 bp, mouse
gggcggggcggaaagtgtgg

SEQ ID NO: 724023 - DNA, 20 bp, mouse
gcgcctcttagctgcccggg

SEQ ID NO: 724024 - DNA, 20 bp, mouse
ggaaagtgtggtggccgccc

SEQ ID NO: 724025 - DNA, 20 bp, mouse
gggcaccatggcaactgaga

SEQ ID NO: 724026 - DNA, 20 bp, mouse
gagtgcgcctgttacggcgt

SEQ ID NO: 724027 - DNA, 20 bp, mouse
gaacccgaaaagggaagagg

SEQ ID NO: 724028 - DNA, 20 bp, mouse
gggggcgagtgcgcctgtta

SEQ ID NO: 724029 - DNA, 20 bp, mouse
gtgtgcaagcgaggcagcac

SEQ ID NO: 724030 - DNA, 20 bp, mouse
gcggccggggcctctcaata

SEQ ID NO: 724031 - DNA, 20 bp, mouse
ggcgcctgttacggcgtggg

SEQ ID NO: 724032 - DNA, 20 bp, mouse
ggagaaaataaacccgaaaa

SEQ ID NO: 724033 - DNA, 20 bp, mouse
gaggactattgccatgtgat

SEQ ID NO: 724034 - DNA, 20 bp, mouse
ggctacgccaggagcggccg

SEQ ID NO: 724035 - DNA, 20 bp, mouse
gtcaagtgggcagaggagat

SEQ ID NO: 724036 - DNA, 20 bp, mouse
ggaggcagggaagaacgagg

SEQ ID NO: 724037 - DNA, 20 bp, mouse
gagctccccaccctcgggat

SEQ ID NO: 724038 - DNA, 20 bp, mouse
ggggcagcctatcccgaggg

SEQ ID NO: 724039 - DNA, 20 bp, mouse
gggagacttcgctaagtgta

SEQ ID NO: 724040 - DNA, 20 bp, mouse
gaacagaagcggaggggtgg

SEQ ID NO: 724041 - DNA, 20 bp, mouse
gtggacagaggcccaagcga

SEQ ID NO: 724042 - DNA, 20 bp, mouse
gttccgctgagagtgatgga

SEQ ID NO: 724043 - DNA, 20 bp, mouse
ggcccgagtcacaacagaag

SEQ ID NO: 724044 - DNA, 20 bp, mouse
gtgaggaccaaccctctcca

SEQ ID NO: 724045 - DNA, 20 bp, mouse
gccaagcgagggaggaaggt

SEQ ID NO: 724046 - DNA, 20 bp, mouse
gcctccgccctgtctctcgg

SEQ ID NO: 724047 - DNA, 20 bp, mouse
gccccactcggcgccgagga

SEQ ID NO: 724048 - DNA, 20 bp, mouse
gacgccccctaaccccctaa

SEQ ID NO: 724049 - DNA, 20 bp, mouse
gcgtgcgcacgcggttctcg

SEQ ID NO: 724050 - DNA, 20 bp, mouse
gccacccggccacccagccg

SEQ ID NO: 724051 - DNA, 20 bp, mouse
gccgccgccgccgagagaca

SEQ ID NO: 724052 - DNA, 20 bp, mouse
gccgccgccgagagacaggg

SEQ ID NO: 724053 - DNA, 20 bp, mouse
gctcggcgccgagtggggag

SEQ ID NO: 724054 - DNA, 20 bp, mouse
ggggaagcctatcgcttcgg

SEQ ID NO: 724055 - DNA, 20 bp, mouse
gcgcgggcctggagtaaaga

SEQ ID NO: 724056 - DNA, 20 bp, mouse
ggaccgggcaagaaaggtta

SEQ ID NO: 724057 - DNA, 20 bp, mouse
ggcgtggcacgggtgtggta

SEQ ID NO: 724058 - DNA, 20 bp, mouse
gtttgggcgtggcacgggtg

SEQ ID NO: 724059 - DNA, 20 bp, mouse
gggcaagaaaggttaggggt

SEQ ID NO: 724060 - DNA, 20 bp, mouse
ggtgcagtgtcaggtcgatg

SEQ ID NO: 724061 - DNA, 20 bp, mouse
gagggaggttgtgcagtgtc

SEQ ID NO: 724062 - DNA, 20 bp, mouse
ggagtaggaccgggcaagaa

SEQ ID NO: 724063 - DNA, 20 bp, mouse
ggggttggagaaataaagtt

SEQ ID NO: 724064 - DNA, 20 bp, mouse
ggtacaaccaactttagcta

SEQ ID NO: 724065 - DNA, 20 bp, mouse
ggctgggggcggagctgagt

SEQ ID NO: 724066 - DNA, 20 bp, mouse
gaggcaatggggcgactgtc

SEQ ID NO: 724067 - DNA, 20 bp, mouse
gacccccgctaaaaagaaaa

SEQ ID NO: 724068 - DNA, 20 bp, mouse
gtttgtgggactgcagtgta

SEQ ID NO: 724069 - DNA, 20 bp, mouse
gtcgggaagcaaaaggcaat

SEQ ID NO: 724070 - DNA, 20 bp, mouse
ggggtcgcgtgagcacttcc

SEQ ID NO: 724071 - DNA, 20 bp, mouse
gccgccgcctacctgaggga

SEQ ID NO: 724072 - DNA, 20 bp, mouse
ggacccggaggtgacgccac

SEQ ID NO: 724073 - DNA, 20 bp, mouse
gctggcgctcgggaagcaaa

SEQ ID NO: 724074 - DNA, 20 bp, mouse
gcccgccgccgcctacctga

SEQ ID NO: 724075 - DNA, 20 bp, mouse
gagggaaggcgcttccgcca

SEQ ID NO: 724076 - DNA, 20 bp, mouse
gtctgcctccggagatcaaa

SEQ ID NO: 724077 - DNA, 20 bp, mouse
gagcagcagcggagacaacc

SEQ ID NO: 724078 - DNA, 20 bp, mouse
gactccgcgcggctacgggt

SEQ ID NO: 724079 - DNA, 20 bp, mouse
gctccagaacagccaggagg

SEQ ID NO: 724080 - DNA, 20 bp, mouse
gacgcgggctgtgtacttcc

SEQ ID NO: 724081 - DNA, 20 bp, mouse
gcgcgcggctacgggtcggg

SEQ ID NO: 724082 - DNA, 20 bp, mouse
ggctgctgctgcgtggctcc

SEQ ID NO: 724083 - DNA, 20 bp, mouse
gggagcaccctgtgtggatc

SEQ ID NO: 724084 - DNA, 20 bp, mouse
ggcacattctgagtcttctt

SEQ ID NO: 724085 - DNA, 20 bp, mouse
gtacacagcccgcgtcgtca

SEQ ID NO: 724086 - DNA, 20 bp, mouse
gagaaccttcacccgatcca

SEQ ID NO: 724087 - DNA, 20 bp, mouse
ggtcccagacgtgggttaag

SEQ ID NO: 724088 - DNA, 20 bp, mouse
gagcgaagagagagcggtgt

SEQ ID NO: 724089 - DNA, 20 bp, mouse
gcgtggcaagatggcgtccc

SEQ ID NO: 724090 - DNA, 20 bp, mouse
ggagccgcttaacccacgtc

SEQ ID NO: 724091 - DNA, 20 bp, mouse
gcgctgattggtgagaatcc

SEQ ID NO: 724092 - DNA, 20 bp, mouse
gggaacgggcgtcaacctca

SEQ ID NO: 724093 - DNA, 20 bp, mouse
ggcgtccctggatcgggtga

SEQ ID NO: 724094 - DNA, 20 bp, mouse
gtgactgatcgaaagcttcg

SEQ ID NO: 724095 - DNA, 20 bp, mouse
gcgggtgaaggttctggtgt

SEQ ID NO: 724096 - DNA, 20 bp, mouse
gacgaccggagcgcgctcaa

SEQ ID NO: 724097 - DNA, 20 bp, mouse
gccgccgcaccaggaagtgg

SEQ ID NO: 724098 - DNA, 20 bp, mouse
gagagctggtagagtaaacg

SEQ ID NO: 724099 - DNA, 20 bp, mouse
gcccaacacggacctgccaa

SEQ ID NO: 724100 - DNA, 20 bp, mouse
ggcggcgcgcacgcccaaca

SEQ ID NO: 724101 - DNA, 20 bp, mouse
gtcgtcatggaaactcgggg

SEQ ID NO: 724102 - DNA, 20 bp, mouse
gtagccgccgcaccaggaag

SEQ ID NO: 724103 - DNA, 20 bp, mouse
gcgaaaaggcgcctgcgtca

SEQ ID NO: 724104 - DNA, 20 bp, mouse
ggtcgccaacgccaccacca

SEQ ID NO: 724105 - DNA, 20 bp, mouse
gaagggggtcgaacccgagg

SEQ ID NO: 724106 - DNA, 20 bp, mouse
gccgcggagcatcctgggta

SEQ ID NO: 724107 - DNA, 20 bp, mouse
gaggcaccgcggagcatcct

SEQ ID NO: 724108 - DNA, 20 bp, mouse
gcaaccgaggcccactctgt

SEQ ID NO: 724109 - DNA, 20 bp, mouse
gtctacacgtgacttttccg

SEQ ID NO: 724110 - DNA, 20 bp, mouse
ggagccggggactcggtgca

SEQ ID NO: 724111 - DNA, 20 bp, mouse
gcgtcacgacgcaggcaccg

SEQ ID NO: 724112 - DNA, 20 bp, mouse
gaacggaggccgagttgcca

SEQ ID NO: 724113 - DNA, 20 bp, mouse
gggcttcttcggctcttctg

SEQ ID NO: 724114 - DNA, 20 bp, mouse
gatcctgggtagggtggaaa

SEQ ID NO: 724115 - DNA, 20 bp, mouse
ggtccaagaagcgggaacgg

SEQ ID NO: 724116 - DNA, 20 bp, mouse
gcccggcaacgtgcaatctt

SEQ ID NO: 724117 - DNA, 20 bp, mouse
gtacagcaaaggtgacaaag

SEQ ID NO: 724118 - DNA, 20 bp, mouse
gcctagatgggcgtgactcc

SEQ ID NO: 724119 - DNA, 20 bp, mouse
gtgacaaagtggaaagatta

SEQ ID NO: 724120 - DNA, 20 bp, mouse
gtcaggacagcgcgccgaga

SEQ ID NO: 724121 - DNA, 20 bp, mouse
gggcgcagttcttcattcgg

SEQ ID NO: 724122 - DNA, 20 bp, mouse
ggctccggcaatttcctaga

SEQ ID NO: 724123 - DNA, 20 bp, mouse
gagggacaaacttcctgctc

SEQ ID NO: 724124 - DNA, 20 bp, mouse
gtcccaagattgcacgttgc

SEQ ID NO: 724125 - DNA, 20 bp, mouse
gtcctgacgtagtcgtgcgc

SEQ ID NO: 724126 - DNA, 20 bp, mouse
gccggaccggatgctctcta

SEQ ID NO: 724127 - DNA, 20 bp, mouse
gcgaaacaggcgggaatcgg

SEQ ID NO: 724128 - DNA, 20 bp, mouse
gctccgccgctcgagaccgg

SEQ ID NO: 724129 - DNA, 20 bp, mouse
gaacaggcgggaatcggtgg

SEQ ID NO: 724130 - DNA, 20 bp, mouse
gactctccgccgctcgagac

SEQ ID NO: 724131 - DNA, 20 bp, mouse
gacgcaccacggagccggac

SEQ ID NO: 724132 - DNA, 20 bp, mouse
gctcctcctccggtctcgag

SEQ ID NO: 724133 - DNA, 20 bp, mouse
gcggctccgtggtgcgtcgt

SEQ ID NO: 724134 - DNA, 20 bp, mouse
ggtgcgtcgtcggcccgagg

SEQ ID NO: 724135 - DNA, 20 bp, mouse
ggtcgcgattccgctccctg

SEQ ID NO: 724136 - DNA, 20 bp, mouse
gcaccccacagcagaaatat

SEQ ID NO: 724137 - DNA, 20 bp, mouse
gctgccagaagagggagcta

SEQ ID NO: 724138 - DNA, 20 bp, mouse
gggaaggcagttacgctctt

SEQ ID NO: 724139 - DNA, 20 bp, mouse
gtcgacgagacgaccctcac

SEQ ID NO: 724140 - DNA, 20 bp, mouse
gttcgtgcctagttggggca

SEQ ID NO: 724141 - DNA, 20 bp, mouse
gactgccggtacttccggtg

SEQ ID NO: 724142 - DNA, 20 bp, mouse
gaggctggtgggtctacgcg

SEQ ID NO: 724143 - DNA, 20 bp, mouse
gctacgcgaggagacctgcg

SEQ ID NO: 724144 - DNA, 20 bp, mouse
gcgctgcggaagaattttgg

SEQ ID NO: 724145 - DNA, 20 bp, mouse
gtcgtctcgtcgaggctggt

SEQ ID NO: 724146 - DNA, 20 bp, mouse
gggtgagtgtgtcaacagag

SEQ ID NO: 724147 - DNA, 20 bp, mouse
gtcgaggaagccatggagga

SEQ ID NO: 724148 - DNA, 20 bp, mouse
gaagtcgctcgaggaagcca

SEQ ID NO: 724149 - DNA, 20 bp, mouse
gcgtgcgtggcgtcactcgt

SEQ ID NO: 724150 - DNA, 20 bp, mouse
ggctcaggctgccagtgcgg

SEQ ID NO: 724151 - DNA, 20 bp, mouse
gagtgtgtcaacagagcggc

SEQ ID NO: 724152 - DNA, 20 bp, mouse
gcggaactgacgcgcgagaa

SEQ ID NO: 724153 - DNA, 20 bp, mouse
gggcggggacacacggtccg

SEQ ID NO: 724154 - DNA, 20 bp, mouse
gaggaagccatggaggacgg

SEQ ID NO: 724155 - DNA, 20 bp, mouse
gccttgcgggaagtcgctcg

SEQ ID NO: 724156 - DNA, 20 bp, mouse
gaaggccggccgagaaaagg

SEQ ID NO: 724157 - DNA, 20 bp, mouse
gaagaaggccggccgagaaa

SEQ ID NO: 724158 - DNA, 20 bp, mouse
gaaaggcaccgcaagaaggc

SEQ ID NO: 724159 - DNA, 20 bp, mouse
ggagctccggggcctcctat

SEQ ID NO: 724160 - DNA, 20 bp, mouse
gcaaacctggaggagctccg

SEQ ID NO: 724161 - DNA, 20 bp, mouse
gagagaggcgcggaatcaaa

SEQ ID NO: 724162 - DNA, 20 bp, mouse
ggaatcaaaaggtctgactt

SEQ ID NO: 724163 - DNA, 20 bp, mouse
gagaaaaggtggcttttcat

SEQ ID NO: 724164 - DNA, 20 bp, mouse
ggaggccccggagctcctcc

SEQ ID NO: 724165 - DNA, 20 bp, mouse
gccctaaaggcaccgcaaga

SEQ ID NO: 724166 - DNA, 20 bp, mouse
gaacctgcgccctaacccag

SEQ ID NO: 724167 - DNA, 20 bp, mouse
gtctctggggcgggccctaa

SEQ ID NO: 724168 - DNA, 20 bp, mouse
gttagggcgcaggttactag

SEQ ID NO: 724169 - DNA, 20 bp, mouse
ggctcactgccgctgggtta

SEQ ID NO: 724170 - DNA, 20 bp, mouse
gggcggggtcaagccctcag

SEQ ID NO: 724171 - DNA, 20 bp, mouse
gcacgtgaccccgcctctga

SEQ ID NO: 724172 - DNA, 20 bp, mouse
gagtccaccgcgagccgtcc

SEQ ID NO: 724173 - DNA, 20 bp, mouse
gcctgccggcgcaatgactc

SEQ ID NO: 724174 - DNA, 20 bp, mouse
ggcgcctgcgacaccctagt

SEQ ID NO: 724175 - DNA, 20 bp, mouse
gggctcgcggtggactccgc

SEQ ID NO: 724176 - DNA, 20 bp, mouse
gccgttgcgtaggtgagcgc

SEQ ID NO: 724177 - DNA, 20 bp, mouse
gggcggtggggagagaatca

SEQ ID NO: 724178 - DNA, 20 bp, mouse
gcaagcgcgtgcagggaagc

SEQ ID NO: 724179 - DNA, 20 bp, mouse
gcgcggcgcccggccctctc

SEQ ID NO: 724180 - DNA, 20 bp, mouse
gacgcgcagcggcaccttcg

SEQ ID NO: 724181 - DNA, 20 bp, mouse
gctgtctgggagttatagtt

SEQ ID NO: 724182 - DNA, 20 bp, mouse
ggggtacccacccgttgcgt

SEQ ID NO: 724183 - DNA, 20 bp, mouse
gcgcctgccgcggttatccc

SEQ ID NO: 724184 - DNA, 20 bp, mouse
gcggccgcccggatggggga

SEQ ID NO: 724185 - DNA, 20 bp, mouse
gggaacagggacgaagccca

SEQ ID NO: 724186 - DNA, 20 bp, mouse
gggcccgccccgtgccaccg

SEQ ID NO: 724187 - DNA, 20 bp, mouse
gcgtggctgggggagtctcg

SEQ ID NO: 724188 - DNA, 20 bp, mouse
gcaggagggcaaaccaccta

SEQ ID NO: 724189 - DNA, 20 bp, mouse
gggggagtctcgaggctccg

SEQ ID NO: 724190 - DNA, 20 bp, mouse
ggcgcaacaccaccctccat

SEQ ID NO: 724191 - DNA, 20 bp, mouse
gggacaggatcagtagaggg

SEQ ID NO: 724192 - DNA, 20 bp, mouse
gtcacccagaggacgcccgg

SEQ ID NO: 724193 - DNA, 20 bp, mouse
gcgcccggaggatccctagg

SEQ ID NO: 724194 - DNA, 20 bp, mouse
ggatcctccgggcgtcctct

SEQ ID NO: 724195 - DNA, 20 bp, mouse
gaatggctggcaatcttact

SEQ ID NO: 724196 - DNA, 20 bp, mouse
ggggtgcctgagtaacacgt

SEQ ID NO: 724197 - DNA, 20 bp, mouse
ggcccccgagctgcggtcgc

SEQ ID NO: 724198 - DNA, 20 bp, mouse
gcgtgcacgtggaagcggag

SEQ ID NO: 724199 - DNA, 20 bp, mouse
ggtggccgaagcacccccgg

SEQ ID NO: 724200 - DNA, 20 bp, mouse
ggtcaccccacgtgttactc

SEQ ID NO: 724201 - DNA, 20 bp, mouse
gggaagccgaccttccttcc

SEQ ID NO: 724202 - DNA, 20 bp, mouse
ggcagtggactctgagtccg

SEQ ID NO: 724203 - DNA, 20 bp, mouse
gctacaacgcaggctagcca

SEQ ID NO: 724204 - DNA, 20 bp, mouse
ggaagcacccccggtgggga

SEQ ID NO: 724205 - DNA, 20 bp, mouse
ggaacggccatgcacatcca

SEQ ID NO: 724206 - DNA, 20 bp, mouse
ggcgagaggcagccaggctc

SEQ ID NO: 724207 - DNA, 20 bp, mouse
gcgcatccaggactcgtcca

SEQ ID NO: 724208 - DNA, 20 bp, mouse
gaggactcgtccacggcgag

SEQ ID NO: 724209 - DNA, 20 bp, mouse
ggctctgggctctggtttcg

SEQ ID NO: 724210 - DNA, 20 bp, mouse
ggcctggctgcctctcgccg

SEQ ID NO: 724211 - DNA, 20 bp, mouse
gcatgtgcaaccgggctcta

SEQ ID NO: 724212 - DNA, 20 bp, mouse
gaggatgcagagggcaaaac

SEQ ID NO: 724213 - DNA, 20 bp, mouse
gtggatgcgcatgtgcaacc

SEQ ID NO: 724214 - DNA, 20 bp, mouse
gtccacggcgagaggcagcc

SEQ ID NO: 724215 - DNA, 20 bp, mouse
gggctctggtttcgcggctt

SEQ ID NO: 724216 - DNA, 20 bp, mouse
ggtgacgtcacgctacccga

SEQ ID NO: 724217 - DNA, 20 bp, mouse
gggaactgcaaacactgtca

SEQ ID NO: 724218 - DNA, 20 bp, mouse
gctccctgagacacctccga

SEQ ID NO: 724219 - DNA, 20 bp, mouse
gcggcctcccgaaccggaag

SEQ ID NO: 724220 - DNA, 20 bp, mouse
gggttccggaccaatggagg

SEQ ID NO: 724221 - DNA, 20 bp, mouse
gcggccgcccaacctcccgg

SEQ ID NO: 724222 - DNA, 20 bp, mouse
gtacagcgatccgaggccta

SEQ ID NO: 724223 - DNA, 20 bp, mouse
gactaaccgtccatccctag

SEQ ID NO: 724224 - DNA, 20 bp, mouse
gcggggttccggaccaatgg

SEQ ID NO: 724225 - DNA, 20 bp, mouse
gacagtgtttgcagttcccc

SEQ ID NO: 724226 - DNA, 20 bp, mouse
gccagctcgcgggcgtcgga

SEQ ID NO: 724227 - DNA, 20 bp, mouse
gaagccacgctccagctcgc

SEQ ID NO: 724228 - DNA, 20 bp, mouse
gaaggccctgcagtgtccta

SEQ ID NO: 724229 - DNA, 20 bp, mouse
ggccgcgccgcgctgcatta

SEQ ID NO: 724230 - DNA, 20 bp, mouse
gacgcccgcgagctggagcg

SEQ ID NO: 724231 - DNA, 20 bp, mouse
gctgcagtgtcctagggccg

SEQ ID NO: 724232 - DNA, 20 bp, mouse
gagggagtggcgtgaggcct

SEQ ID NO: 724233 - DNA, 20 bp, mouse
ggggactgtagttaagaatc

SEQ ID NO: 724234 - DNA, 20 bp, mouse
ggagcctagcctgggtgggt

SEQ ID NO: 724235 - DNA, 20 bp, mouse
gaggcgccgacctccccttc

SEQ ID NO: 724236 - DNA, 20 bp, mouse
gcctctagctggtagtttaa

SEQ ID NO: 724237 - DNA, 20 bp, mouse
gtggacactcccttgcctgt

SEQ ID NO: 724238 - DNA, 20 bp, mouse
gtccgccctagaaaccttcc

SEQ ID NO: 724239 - DNA, 20 bp, mouse
gcaggcggaaccagagtgcg

SEQ ID NO: 724240 - DNA, 20 bp, mouse
gggcgcttgaaagatgcatt

SEQ ID NO: 724241 - DNA, 20 bp, mouse
ggaaccagagtgcgcggccg

SEQ ID NO: 724242 - DNA, 20 bp, mouse
gctggggcctagagcgcagg

SEQ ID NO: 724243 - DNA, 20 bp, mouse
gcgctggtccggtctctcct

SEQ ID NO: 724244 - DNA, 20 bp, mouse
ggcgccgcggccgcgcactc

SEQ ID NO: 724245 - DNA, 20 bp, mouse
gctggtagtttaagggagtc

SEQ ID NO: 724246 - DNA, 20 bp, mouse
gtggaaagtgcgctccggta

SEQ ID NO: 724247 - DNA, 20 bp, mouse
gctccggtagggctgacccg

SEQ ID NO: 724248 - DNA, 20 bp, mouse
gcgcctcgggtcagccctac

SEQ ID NO: 724249 - DNA, 20 bp, mouse
gcactcaggtccagatgaag

SEQ ID NO: 724250 - DNA, 20 bp, mouse
gtgcagacacgcggagaagg

SEQ ID NO: 724251 - DNA, 20 bp, mouse
gcggcctcttccggtttcgg

SEQ ID NO: 724252 - DNA, 20 bp, mouse
ggggagtgaacgggcgcgga

SEQ ID NO: 724253 - DNA, 20 bp, mouse
gccaccctgctagatggccg

SEQ ID NO: 724254 - DNA, 20 bp, mouse
gcggaggctcactctcccgt

SEQ ID NO: 724255 - DNA, 20 bp, mouse
gccgtcccggctcccggacc

SEQ ID NO: 724256 - DNA, 20 bp, mouse
gggacaaaggggcgagacga

SEQ ID NO: 724257 - DNA, 20 bp, mouse
gccgcgaggcctcacctcaa

SEQ ID NO: 724258 - DNA, 20 bp, mouse
ggacccaaccaagacaagcc

SEQ ID NO: 724259 - DNA, 20 bp, mouse
gtaaggagacgagaaaggta

SEQ ID NO: 724260 - DNA, 20 bp, mouse
gttaaatcatggagactcga

SEQ ID NO: 724261 - DNA, 20 bp, mouse
ggcggcgacgcacttcttcc

SEQ ID NO: 724262 - DNA, 20 bp, mouse
ggaaaaacccggtcgaatcc

SEQ ID NO: 724263 - DNA, 20 bp, mouse
gcacgtcttcaagctctcat

SEQ ID NO: 724264 - DNA, 20 bp, mouse
gtcatccctgagctggtttt

SEQ ID NO: 724265 - DNA, 20 bp, mouse
gtgtgcgtacatcctaatat

SEQ ID NO: 724266 - DNA, 20 bp, mouse
gaacgtggctcatagagctc

SEQ ID NO: 724267 - DNA, 20 bp, mouse
gagccacgttcttcaaagtg

SEQ ID NO: 724268 - DNA, 20 bp, mouse
ggagactagaggatcaatgg

SEQ ID NO: 724269 - DNA, 20 bp, mouse
gtccacgtgggacccactta

SEQ ID NO: 724270 - DNA, 20 bp, mouse
ggacgccaggcttccgtaag

SEQ ID NO: 724271 - DNA, 20 bp, mouse
gaaggagactagaggatcaa

SEQ ID NO: 724272 - DNA, 20 bp, mouse
gagccccactttgaagaacg

SEQ ID NO: 724273 - DNA, 20 bp, mouse
gtccgagcttcgggaattta

SEQ ID NO: 724274 - DNA, 20 bp, mouse
gctaaggacgcgggagggag

SEQ ID NO: 724275 - DNA, 20 bp, mouse
gtagatgttgggatgaaaag

SEQ ID NO: 724276 - DNA, 20 bp, mouse
ggaaccgggaggcgcgtgga

SEQ ID NO: 724277 - DNA, 20 bp, mouse
gctaaaccaagtctgggccc

SEQ ID NO: 724278 - DNA, 20 bp, mouse
gccccgccggggcccagact

SEQ ID NO: 724279 - DNA, 20 bp, mouse
ggaaggggcgggcctaaggg

SEQ ID NO: 724280 - DNA, 20 bp, mouse
gcggcgctccgcctcctctc

SEQ ID NO: 724281 - DNA, 20 bp, mouse
gtggtgtcatgggaaccggg

SEQ ID NO: 724282 - DNA, 20 bp, mouse
gcaggcactgtaaacacgtg

SEQ ID NO: 724283 - DNA, 20 bp, mouse
gagtgcctgcgtggtgtcat

SEQ ID NO: 724284 - DNA, 20 bp, mouse
ggcttgggcccgcccctcgg

SEQ ID NO: 724285 - DNA, 20 bp, mouse
gggggcggggaatagtccct

SEQ ID NO: 724286 - DNA, 20 bp, mouse
gtggcgggaaggatccaggc

SEQ ID NO: 724287 - DNA, 20 bp, mouse
ggccagacgcgcgggactta

SEQ ID NO: 724288 - DNA, 20 bp, mouse
ggatacgtgacagtctcggg

SEQ ID NO: 724289 - DNA, 20 bp, mouse
gagacgcgcgggacttaggg

SEQ ID NO: 724290 - DNA, 20 bp, mouse
gagagatacgtgacagtctc

SEQ ID NO: 724291 - DNA, 20 bp, mouse
gccgttggcgggaaggatcc

SEQ ID NO: 724292 - DNA, 20 bp, mouse
ggccccgcctctggaaagtg

SEQ ID NO: 724293 - DNA, 20 bp, mouse
gtgaggtggggagtaaagaa

SEQ ID NO: 724294 - DNA, 20 bp, mouse
gctaacaacaaacgtcgtag

SEQ ID NO: 724295 - DNA, 20 bp, mouse
ggactgtcacgtatctctag

SEQ ID NO: 724296 - DNA, 20 bp, mouse
gttgtgtgcaaggggaagca

SEQ ID NO: 724297 - DNA, 20 bp, mouse
gaacgctatgcgctggagac

SEQ ID NO: 724298 - DNA, 20 bp, mouse
gtcgtctaagttgtgtgcaa

SEQ ID NO: 724299 - DNA, 20 bp, mouse
ggcatcgcgctcgaggaagg

SEQ ID NO: 724300 - DNA, 20 bp, mouse
gcgcagaggtgacgtctcag

SEQ ID NO: 724301 - DNA, 20 bp, mouse
ggacgcctctgggtgcagga

SEQ ID NO: 724302 - DNA, 20 bp, mouse
gcacacaacttagacgaatc

SEQ ID NO: 724303 - DNA, 20 bp, mouse
ggctgcatcgcgctcgagga

SEQ ID NO: 724304 - DNA, 20 bp, mouse
gacgtcactactggtcgcag

SEQ ID NO: 724305 - DNA, 20 bp, mouse
gtacaagtgtgtctgttgga

SEQ ID NO: 724306 - DNA, 20 bp, mouse
gcgagagtcacaggtggctt

SEQ ID NO: 724307 - DNA, 20 bp, mouse
gaaaagccgcagggcatcaa

SEQ ID NO: 724308 - DNA, 20 bp, mouse
ggctatgcgagagtcacagg

SEQ ID NO: 724309 - DNA, 20 bp, mouse
ggacagtaaccggaggtgaa

SEQ ID NO: 724310 - DNA, 20 bp, mouse
gtcgcatagcgatgcctctt

SEQ ID NO: 724311 - DNA, 20 bp, mouse
ggagtcacaggtggcttcgg

SEQ ID NO: 724312 - DNA, 20 bp, mouse
ggccttgagcgcaaagacta

SEQ ID NO: 724313 - DNA, 20 bp, mouse
gtcttctaggggcagtagga

SEQ ID NO: 724314 - DNA, 20 bp, mouse
gcaggggcgtggcctacagt

SEQ ID NO: 724315 - DNA, 20 bp, mouse
ggcgactaggaggacaggga

SEQ ID NO: 724316 - DNA, 20 bp, mouse
ggggaaacgaagttgggatg

SEQ ID NO: 724317 - DNA, 20 bp, mouse
ggatccaagggaaacgaagt

SEQ ID NO: 724318 - DNA, 20 bp, mouse
gtatctgacacaatagtggg

SEQ ID NO: 724319 - DNA, 20 bp, mouse
gaggtatctgacacaatagt

SEQ ID NO: 724320 - DNA, 20 bp, mouse
ggcaggatatatctcagcgg

SEQ ID NO: 724321 - DNA, 20 bp, mouse
gcccgggatcagcttagtga

SEQ ID NO: 724322 - DNA, 20 bp, mouse
gaaaatctatagatagaggg

SEQ ID NO: 724323 - DNA, 20 bp, mouse
gattcctattggctgatcca

SEQ ID NO: 724324 - DNA, 20 bp, mouse
gcctcctataggcgatccaa

SEQ ID NO: 724325 - DNA, 20 bp, mouse
gactgcaggggatgagttcc

SEQ ID NO: 724326 - DNA, 20 bp, mouse
gagtccgccgccaagagccg

SEQ ID NO: 724327 - DNA, 20 bp, mouse
gcccacgcgtccgcctagac

SEQ ID NO: 724328 - DNA, 20 bp, mouse
gataaccttgcggggtgaaa

SEQ ID NO: 724329 - DNA, 20 bp, mouse
ggatctgctgggtttagagg

SEQ ID NO: 724330 - DNA, 20 bp, mouse
gccgaagccggcttgggtga

SEQ ID NO: 724331 - DNA, 20 bp, mouse
ggccagagcgagtgacgagc

SEQ ID NO: 724332 - DNA, 20 bp, mouse
gtgaaagggagactcccggc

SEQ ID NO: 724333 - DNA, 20 bp, mouse
gctaccgcggctcttggcgg

SEQ ID NO: 724334 - DNA, 20 bp, mouse
ggactagaagcctgtctagg

SEQ ID NO: 724335 - DNA, 20 bp, mouse
gctggccgcggcgtccccag

SEQ ID NO: 724336 - DNA, 20 bp, mouse
gaaaaacttggataggggcg

SEQ ID NO: 724337 - DNA, 20 bp, mouse
gagggacgggaagaacaaca

SEQ ID NO: 724338 - DNA, 20 bp, mouse
gctcccagagccacccttcg

SEQ ID NO: 724339 - DNA, 20 bp, mouse
gaggcgcatgcggcgagggg

SEQ ID NO: 724340 - DNA, 20 bp, mouse
gagcaaggcgcatgcggcga

SEQ ID NO: 724341 - DNA, 20 bp, mouse
gcgcatgtgcgtgccgcgaa

SEQ ID NO: 724342 - DNA, 20 bp, mouse
ggcgcagcgagagactgcgg

SEQ ID NO: 724343 - DNA, 20 bp, mouse
gttggataggggcggggtca

SEQ ID NO: 724344 - DNA, 20 bp, mouse
gtgccgcgaagggtggctct

SEQ ID NO: 724345 - DNA, 20 bp, mouse
gcagcgagagactgcggggg

SEQ ID NO: 724346 - DNA, 20 bp, mouse
gaccacctccgggcagaaag

SEQ ID NO: 724347 - DNA, 20 bp, mouse
gcggcagcgagctttctgtc

SEQ ID NO: 724348 - DNA, 20 bp, mouse
ggtgttaaagaaagtcagtg

SEQ ID NO: 724349 - DNA, 20 bp, mouse
ggctaggttgagtcatagaa

SEQ ID NO: 724350 - DNA, 20 bp, mouse
gcgactggattttattagta

SEQ ID NO: 724351 - DNA, 20 bp, mouse
ggggtttccccctttctgcc

SEQ ID NO: 724352 - DNA, 20 bp, mouse
gtcaagcttctcaccacctc

SEQ ID NO: 724353 - DNA, 20 bp, mouse
gtttccccctttctgcccgg

SEQ ID NO: 724354 - DNA, 20 bp, mouse
gccccctttctgcccggagg

SEQ ID NO: 724355 - DNA, 20 bp, mouse
gtctcaagggaaggaaccat

SEQ ID NO: 724356 - DNA, 20 bp, mouse
ggcccagcggagccaatccg

SEQ ID NO: 724357 - DNA, 20 bp, mouse
ggggcgcaggaaactcccac

SEQ ID NO: 724358 - DNA, 20 bp, mouse
gtccggaggaggagagtcat

SEQ ID NO: 724359 - DNA, 20 bp, mouse
gtgtggctgtgctagcaaaa

SEQ ID NO: 724360 - DNA, 20 bp, mouse
gggaccgaggcggtgatggt

SEQ ID NO: 724361 - DNA, 20 bp, mouse
ggtgctagcaaaagggaccg

SEQ ID NO: 724362 - DNA, 20 bp, mouse
ggattggctccgctgggcgc

SEQ ID NO: 724363 - DNA, 20 bp, mouse
gctagcaaaagggaccgagg

SEQ ID NO: 724364 - DNA, 20 bp, mouse
gttgctagcacagccacagg

SEQ ID NO: 724365 - DNA, 20 bp, mouse
gacaagcaccggagagagtc

SEQ ID NO: 724366 - DNA, 20 bp, mouse
gggcctaaagggtcctacat

SEQ ID NO: 724367 - DNA, 20 bp, mouse
gctgcccaaggcggcttctt

SEQ ID NO: 724368 - DNA, 20 bp, mouse
ggcggcttcttgggggtctt

SEQ ID NO: 724369 - DNA, 20 bp, mouse
gacccccaagaagccgcctt

SEQ ID NO: 724370 - DNA, 20 bp, mouse
gctaaagggtcctacatggg

SEQ ID NO: 724371 - DNA, 20 bp, mouse
ggagggtgagccaaagaaaa

SEQ ID NO: 724372 - DNA, 20 bp, mouse
gctcaccctcctgcccaagg

SEQ ID NO: 724373 - DNA, 20 bp, mouse
gctaggctatcctttttctt

SEQ ID NO: 724374 - DNA, 20 bp, mouse
gttgccggggcctggctgtg

SEQ ID NO: 724375 - DNA, 20 bp, mouse
ggccgcacttcctgtgactg

SEQ ID NO: 724376 - DNA, 20 bp, mouse
gaaccgacgctgatgaataa

SEQ ID NO: 724377 - DNA, 20 bp, mouse
ggggtgggggaagtggcttg

SEQ ID NO: 724378 - DNA, 20 bp, mouse
gacagactgtccactgggtg

SEQ ID NO: 724379 - DNA, 20 bp, mouse
gtgggggtacacttagaagt

SEQ ID NO: 724380 - DNA, 20 bp, mouse
gacccggcccttggcagttt

SEQ ID NO: 724381 - DNA, 20 bp, mouse
gaccccttattcatcagcgt

SEQ ID NO: 724382 - DNA, 20 bp, mouse
gatgaagcccgaaactgcca

SEQ ID NO: 724383 - DNA, 20 bp, mouse
gtgttgtcaaaggacagaac

SEQ ID NO: 724384 - DNA, 20 bp, mouse
gcagaacaggtggtcacaat

SEQ ID NO: 724385 - DNA, 20 bp, mouse
gtgggcagcttatgacatca

SEQ ID NO: 724386 - DNA, 20 bp, mouse
gaatccctctgggatgtcca

SEQ ID NO: 724387 - DNA, 20 bp, mouse
gcaagggcgcagcctcagtc

SEQ ID NO: 724388 - DNA, 20 bp, mouse
gtgaggctgcgcccttgagt

SEQ ID NO: 724389 - DNA, 20 bp, mouse
gtatccttggacatcccaga

SEQ ID NO: 724390 - DNA, 20 bp, mouse
gatgtcaggtccatgactga

SEQ ID NO: 724391 - DNA, 20 bp, mouse
gctacgtagcacattatgtc

SEQ ID NO: 724392 - DNA, 20 bp, mouse
ggtgggttcagtatatgcaa

SEQ ID NO: 724393 - DNA, 20 bp, mouse
gccttcttaacaggatctgg

SEQ ID NO: 724394 - DNA, 20 bp, mouse
gggcaagaggcagagcattg

SEQ ID NO: 724395 - DNA, 20 bp, mouse
gtccaaggataatgtacagc

SEQ ID NO: 724396 - DNA, 20 bp, mouse
gggagcaatcacggagagaa

SEQ ID NO: 724397 - DNA, 20 bp, mouse
gcacaggtccagtgagaggc

SEQ ID NO: 724398 - DNA, 20 bp, mouse
gctccccaggaatctcctaa

SEQ ID NO: 724399 - DNA, 20 bp, mouse
gtatgagggtaagagcctgg

SEQ ID NO: 724400 - DNA, 20 bp, mouse
gcctccacaggtccagtgag

SEQ ID NO: 724401 - DNA, 20 bp, mouse
gtgcccgcgggttagtgctc

SEQ ID NO: 724402 - DNA, 20 bp, mouse
gcggggaaactgaacttgat

SEQ ID NO: 724403 - DNA, 20 bp, mouse
gagtgagaggcaggctatga

SEQ ID NO: 724404 - DNA, 20 bp, mouse
gtggtccacagtgtctgcaa

SEQ ID NO: 724405 - DNA, 20 bp, mouse
gcagaccccgggcagcttag

SEQ ID NO: 724406 - DNA, 20 bp, mouse
gtagtgcccagggagaggcc

SEQ ID NO: 724407 - DNA, 20 bp, mouse
ggtgcctggggtaaacagtg

SEQ ID NO: 724408 - DNA, 20 bp, mouse
gtaagtgagcccagagaggg

SEQ ID NO: 724409 - DNA, 20 bp, mouse
gtgagtcacagtagtgccca

SEQ ID NO: 724410 - DNA, 20 bp, mouse
gtgttgagccccatcagata

SEQ ID NO: 724411 - DNA, 20 bp, mouse
gcactactgtgactcacagc

SEQ ID NO: 724412 - DNA, 20 bp, mouse
gcctggtcgggagtaaatcc

SEQ ID NO: 724413 - DNA, 20 bp, mouse
gaaggtgactgtgactacag

SEQ ID NO: 724414 - DNA, 20 bp, mouse
gcaaagaagaccctgttagg

SEQ ID NO: 724415 - DNA, 20 bp, mouse
ggctgggcctctttcttcaa

SEQ ID NO: 724416 - DNA, 20 bp, mouse
gcaagggcctggcatgaata

SEQ ID NO: 724417 - DNA, 20 bp, mouse
gggttccaggaaggggatag

SEQ ID NO: 724418 - DNA, 20 bp, mouse
ggaacccagaggtgtgagct

SEQ ID NO: 724419 - DNA, 20 bp, mouse
gtgggccagcagccccttat

SEQ ID NO: 724420 - DNA, 20 bp, mouse
gggcatgaatagggctctgt

SEQ ID NO: 724421 - DNA, 20 bp, mouse
gctggaccctggcctataag

SEQ ID NO: 724422 - DNA, 20 bp, mouse
ggctggggtggggttgacag

SEQ ID NO: 724423 - DNA, 20 bp, mouse
gtgggaacatggtctgccaa

SEQ ID NO: 724424 - DNA, 20 bp, mouse
gaggggaaaggtgatggatc

SEQ ID NO: 724425 - DNA, 20 bp, mouse
gcttccaagctcacacctct

SEQ ID NO: 724426 - DNA, 20 bp, mouse
ggggcccccggagcgtttca

SEQ ID NO: 724427 - DNA, 20 bp, mouse
ggcccacgtcgctaggggaa

SEQ ID NO: 724428 - DNA, 20 bp, mouse
gctagcggagggagagcgtg

SEQ ID NO: 724429 - DNA, 20 bp, mouse
gtggggagcccacgtcgcta

SEQ ID NO: 724430 - DNA, 20 bp, mouse
gaagaggcgtggcttatgga

SEQ ID NO: 724431 - DNA, 20 bp, mouse
ggtaaccctgagtactgtag

SEQ ID NO: 724432 - DNA, 20 bp, mouse
ggggaaggacctacgggtag

SEQ ID NO: 724433 - DNA, 20 bp, mouse
gacgggtagcgggttctgga

SEQ ID NO: 724434 - DNA, 20 bp, mouse
ggtgccttatcgagactcca

SEQ ID NO: 724435 - DNA, 20 bp, mouse
gcttccctgaaacgctccgg

SEQ ID NO: 724436 - DNA, 20 bp, mouse
gccgccgaggcagcgctgga

SEQ ID NO: 724437 - DNA, 20 bp, mouse
ggtgtccccagcatactcat

SEQ ID NO: 724438 - DNA, 20 bp, mouse
gtacgcaccccctggtatca

SEQ ID NO: 724439 - DNA, 20 bp, mouse
ggcgcagctcctggagtggg

SEQ ID NO: 724440 - DNA, 20 bp, mouse
ggtatcagggcacaatggca

SEQ ID NO: 724441 - DNA, 20 bp, mouse
gacgcccgccgaggcagcgc

SEQ ID NO: 724442 - DNA, 20 bp, mouse
gtgaaacgcggcgacagaag

SEQ ID NO: 724443 - DNA, 20 bp, mouse
gggaggggtaaaaaagaagg

SEQ ID NO: 724444 - DNA, 20 bp, mouse
gtgcggagctgagggaatca

SEQ ID NO: 724445 - DNA, 20 bp, mouse
gggggcgcagctcctggagt

SEQ ID NO: 724446 - DNA, 20 bp, mouse
gagtccctcccacttctccc

SEQ ID NO: 724447 - DNA, 20 bp, mouse
ggcggtgtgtgagaaacccg

SEQ ID NO: 724448 - DNA, 20 bp, mouse
gccatcctccaaaccaccaa

SEQ ID NO: 724449 - DNA, 20 bp, mouse
gcatgcattaacagcaaata

SEQ ID NO: 724450 - DNA, 20 bp, mouse
gttggaggatggcgactggg

SEQ ID NO: 724451 - DNA, 20 bp, mouse
gagaaagaaagttccccacc

SEQ ID NO: 724452 - DNA, 20 bp, mouse
gtctccttgggtggctttgg

SEQ ID NO: 724453 - DNA, 20 bp, mouse
gcctgaatctgaaacctggt

SEQ ID NO: 724454 - DNA, 20 bp, mouse
gagcctcaaacctaaaagcc

SEQ ID NO: 724455 - DNA, 20 bp, mouse
ggtttcctgaatctgaaacc

SEQ ID NO: 724456 - DNA, 20 bp, mouse
gctgagggctgtaagagggg

SEQ ID NO: 724457 - DNA, 20 bp, mouse
ggggggctgagggctgtaag

SEQ ID NO: 724458 - DNA, 20 bp, mouse
gggatcagagcaagtacact

SEQ ID NO: 724459 - DNA, 20 bp, mouse
gatggtaggtctcaggaact

SEQ ID NO: 724460 - DNA, 20 bp, mouse
gtgaatgtggtgggaaggtt

SEQ ID NO: 724461 - DNA, 20 bp, mouse
gaagagctgtcagctgaatg

SEQ ID NO: 724462 - DNA, 20 bp, mouse
gcagagcaagtacacttggc

SEQ ID NO: 724463 - DNA, 20 bp, mouse
gtgtgtttgtaaaagcgggg

SEQ ID NO: 724464 - DNA, 20 bp, mouse
ggtgctgattctctgtggag

SEQ ID NO: 724465 - DNA, 20 bp, mouse
gccagagtgatgtggaaggg

SEQ ID NO: 724466 - DNA, 20 bp, mouse
gctgcggctccactcgtcat

SEQ ID NO: 724467 - DNA, 20 bp, mouse
gacagaggagggaattcaga

SEQ ID NO: 724468 - DNA, 20 bp, mouse
gacttgtcaccagactgggg

SEQ ID NO: 724469 - DNA, 20 bp, mouse
gtcactgattggctaagata

SEQ ID NO: 724470 - DNA, 20 bp, mouse
gacattagaacagatgtacg

SEQ ID NO: 724471 - DNA, 20 bp, mouse
gagtggagccgcaggaggct

SEQ ID NO: 724472 - DNA, 20 bp, mouse
gaatgacttgtcaccagact

SEQ ID NO: 724473 - DNA, 20 bp, mouse
ggctccttccagcatggatg

SEQ ID NO: 724474 - DNA, 20 bp, mouse
gacacacacgcccaagctct

SEQ ID NO: 724475 - DNA, 20 bp, mouse
gttctaatgtcctagagctt

SEQ ID NO: 724476 - DNA, 20 bp, mouse
gtgacacatcactgggaaga

SEQ ID NO: 724477 - DNA, 20 bp, mouse
gaggatgagctgcgcatctg

SEQ ID NO: 724478 - DNA, 20 bp, mouse
ggtgaagagctgatagatgg

SEQ ID NO: 724479 - DNA, 20 bp, mouse
gataaacgacaggattacca

SEQ ID NO: 724480 - DNA, 20 bp, mouse
gagagctgatagatggaggt

SEQ ID NO: 724481 - DNA, 20 bp, mouse
gcccagtgatgtgtcacaaa

SEQ ID NO: 724482 - DNA, 20 bp, mouse
gcaaacgggtgtatttttat

SEQ ID NO: 724483 - DNA, 20 bp, mouse
gctggggacacaatcaccaa

SEQ ID NO: 724484 - DNA, 20 bp, mouse
ggtagtgaagagctgataga

SEQ ID NO: 724485 - DNA, 20 bp, mouse
ggaaaagaacagagcacagt

SEQ ID NO: 724486 - DNA, 20 bp, mouse
gaggctagcctgggacctgt

SEQ ID NO: 724487 - DNA, 20 bp, mouse
gaaggctcagagagacccag

SEQ ID NO: 724488 - DNA, 20 bp, mouse
gggcctaatgccattgctta

SEQ ID NO: 724489 - DNA, 20 bp, mouse
gacctgtgggtggagacaag

SEQ ID NO: 724490 - DNA, 20 bp, mouse
gcagctccgcccaaagaccc

SEQ ID NO: 724491 - DNA, 20 bp, mouse
ggtctccacccacaggtccc

SEQ ID NO: 724492 - DNA, 20 bp, mouse
gggtccagacaggtctgtga

SEQ ID NO: 724493 - DNA, 20 bp, mouse
gtggagaacagcaacaggtc

SEQ ID NO: 724494 - DNA, 20 bp, mouse
gtggtcctccttaaggagtt

SEQ ID NO: 724495 - DNA, 20 bp, mouse
gttgttgcccatattttcag

SEQ ID NO: 724496 - DNA, 20 bp, mouse
gcagggagagaaagcgaatc

SEQ ID NO: 724497 - DNA, 20 bp, mouse
ggaacagggcgggctgatgg

SEQ ID NO: 724498 - DNA, 20 bp, mouse
gacagctcctctgtagagtg

SEQ ID NO: 724499 - DNA, 20 bp, mouse
gaggagagataaaggttcaa

SEQ ID NO: 724500 - DNA, 20 bp, mouse
gctgacgttgaattcgtgcg

SEQ ID NO: 724501 - DNA, 20 bp, mouse
gttgctttaactaatcatac

SEQ ID NO: 724502 - DNA, 20 bp, mouse
gttaatcaagcagaacaggg

SEQ ID NO: 724503 - DNA, 20 bp, mouse
gttgattaaaagatcctaat

SEQ ID NO: 724504 - DNA, 20 bp, mouse
gtaatccctccaagccgatt

SEQ ID NO: 724505 - DNA, 20 bp, mouse
gtaaaagatcctaatcggct

SEQ ID NO: 724506 - DNA, 20 bp, mouse
gagaagaaggcagtcgtctg

SEQ ID NO: 724507 - DNA, 20 bp, mouse
gtcgctggtaaggtagaaga

SEQ ID NO: 724508 - DNA, 20 bp, mouse
gcacacaagcaaaaaatcca

SEQ ID NO: 724509 - DNA, 20 bp, mouse
ggaaggcagtcgtctgtgga

SEQ ID NO: 724510 - DNA, 20 bp, mouse
gtgcgtgagcctcgctggta

SEQ ID NO: 724511 - DNA, 20 bp, mouse
gggagggtgcgtatgtctag

SEQ ID NO: 724512 - DNA, 20 bp, mouse
ggtgggcaggcattgagggg

SEQ ID NO: 724513 - DNA, 20 bp, mouse
gtagagcgctcctggagaaa

SEQ ID NO: 724514 - DNA, 20 bp, mouse
gcctgcccaccattcagtca

SEQ ID NO: 724515 - DNA, 20 bp, mouse
gaaggctgcgtgagcctcgc

SEQ ID NO: 724516 - DNA, 20 bp, mouse
gaacacagccagccgtggga

SEQ ID NO: 724517 - DNA, 20 bp, mouse
gttagggcccagaaggaagc

SEQ ID NO: 724518 - DNA, 20 bp, mouse
gccagccgtgggagggtaga

SEQ ID NO: 724519 - DNA, 20 bp, mouse
gaggggctaatggagcgtct

SEQ ID NO: 724520 - DNA, 20 bp, mouse
ggaaaaacacagccagccgt

SEQ ID NO: 724521 - DNA, 20 bp, mouse
gagcactggggcctttccat

SEQ ID NO: 724522 - DNA, 20 bp, mouse
ggcagacgtggagttgtaag

SEQ ID NO: 724523 - DNA, 20 bp, mouse
gaaaaccatctaccctccca

SEQ ID NO: 724524 - DNA, 20 bp, mouse
gacgtggagttgtaagagga

SEQ ID NO: 724525 - DNA, 20 bp, mouse
gctgagacatggttaaaaag

SEQ ID NO: 724526 - DNA, 20 bp, mouse
gggaccgcgggtgatactgc

SEQ ID NO: 724527 - DNA, 20 bp, mouse
ggggagagctacagggaccg

SEQ ID NO: 724528 - DNA, 20 bp, mouse
gcgtctacgcgggggtcgaa

SEQ ID NO: 724529 - DNA, 20 bp, mouse
gtgaccggcagtatcacccg

SEQ ID NO: 724530 - DNA, 20 bp, mouse
gcgcgggggtcgaaaggtca

SEQ ID NO: 724531 - DNA, 20 bp, mouse
gctcactccagcgaatacaa

SEQ ID NO: 724532 - DNA, 20 bp, mouse
gactccggtcgcctagactg

SEQ ID NO: 724533 - DNA, 20 bp, mouse
ggtgatgcgacacccgactc

SEQ ID NO: 724534 - DNA, 20 bp, mouse
gcagggatgggagagctaca

SEQ ID NO: 724535 - DNA, 20 bp, mouse
gacgtcgacgcgtctacgcg

SEQ ID NO: 724536 - DNA, 20 bp, mouse
ggagggagacgtaatgtcag

SEQ ID NO: 724537 - DNA, 20 bp, mouse
gcccaccggaacacaccgga

SEQ ID NO: 724538 - DNA, 20 bp, mouse
ggacaaggcgggatttaatg

SEQ ID NO: 724539 - DNA, 20 bp, mouse
gccggcccaccggaacacac

SEQ ID NO: 724540 - DNA, 20 bp, mouse
ggggggccgcgatgatgcac

SEQ ID NO: 724541 - DNA, 20 bp, mouse
gaatgtcagcgggcaaaggt

SEQ ID NO: 724542 - DNA, 20 bp, mouse
gccacacctcagcccaacgg

SEQ ID NO: 724543 - DNA, 20 bp, mouse
gaggtgtggctgtcgcttgg

SEQ ID NO: 724544 - DNA, 20 bp, mouse
ggaagtgggcgtggtcgtcg

SEQ ID NO: 724545 - DNA, 20 bp, mouse
ggcgggatttaatgtggtgt

SEQ ID NO: 724546 - DNA, 20 bp, mouse
gcctgcagagtgggaggaca

SEQ ID NO: 724547 - DNA, 20 bp, mouse
gtggttgtttgaacaggtgt

SEQ ID NO: 724548 - DNA, 20 bp, mouse
gaggtgtaggcgcagatctc

SEQ ID NO: 724549 - DNA, 20 bp, mouse
gtctaggcagagggagacca

SEQ ID NO: 724550 - DNA, 20 bp, mouse
gctgacctggttgtttgaac

SEQ ID NO: 724551 - DNA, 20 bp, mouse
gagggctgatgtcacagtgc

SEQ ID NO: 724552 - DNA, 20 bp, mouse
gtcagtactcagtgccgggg

SEQ ID NO: 724553 - DNA, 20 bp, mouse
ggctcagaagggcggggtat

SEQ ID NO: 724554 - DNA, 20 bp, mouse
ggaagggcggggtataggct

SEQ ID NO: 724555 - DNA, 20 bp, mouse
gctctcagtactcagtgccg

SEQ ID NO: 724556 - DNA, 20 bp, mouse
gctccagcagtgggtttcag

SEQ ID NO: 724557 - DNA, 20 bp, mouse
ggagctctgagcccaacctt

SEQ ID NO: 724558 - DNA, 20 bp, mouse
ggctctggactcccaaggtt

SEQ ID NO: 724559 - DNA, 20 bp, mouse
gtgcccctgaaacccactgc

SEQ ID NO: 724560 - DNA, 20 bp, mouse
gcggccaaagtcagacgcgt

SEQ ID NO: 724561 - DNA, 20 bp, mouse
gtgagcctgacagtggtgtt

SEQ ID NO: 724562 - DNA, 20 bp, mouse
gcactgtcaggctcagacct

SEQ ID NO: 724563 - DNA, 20 bp, mouse
ggagctcgcagacagagggc

SEQ ID NO: 724564 - DNA, 20 bp, mouse
gtacacctcccgagcttcct

SEQ ID NO: 724565 - DNA, 20 bp, mouse
ggtggggggcagtgtttgga

SEQ ID NO: 724566 - DNA, 20 bp, mouse
gcgggactcccggttgctga

SEQ ID NO: 724567 - DNA, 20 bp, mouse
gcggctctgtgtgcgcacta

SEQ ID NO: 724568 - DNA, 20 bp, mouse
gacctggagctgtggaagtg

SEQ ID NO: 724569 - DNA, 20 bp, mouse
gagaactgtcctgcttttaa

SEQ ID NO: 724570 - DNA, 20 bp, mouse
gctgtgggaggaggtttaaa

SEQ ID NO: 724571 - DNA, 20 bp, mouse
gcagagccggagttttcttc

SEQ ID NO: 724572 - DNA, 20 bp, mouse
ggtgaaaggtagctggtccc

SEQ ID NO: 724573 - DNA, 20 bp, mouse
gtgcgcactagggacgctgg

SEQ ID NO: 724574 - DNA, 20 bp, mouse
gctcggccagaagaaaactc

SEQ ID NO: 724575 - DNA, 20 bp, mouse
gcaggtctgcctttaaaagc

SEQ ID NO: 724576 - DNA, 20 bp, mouse
gggctgacgtcaggcatatg

SEQ ID NO: 724577 - DNA, 20 bp, mouse
gctggctcaaggctatctag

SEQ ID NO: 724578 - DNA, 20 bp, mouse
gcctgcgccaacttggttga

SEQ ID NO: 724579 - DNA, 20 bp, mouse
gcgcttgccctcaaccaagt

SEQ ID NO: 724580 - DNA, 20 bp, mouse
gctctgccctcccagagagg

SEQ ID NO: 724581 - DNA, 20 bp, mouse
gactctggggcttgcccctc

SEQ ID NO: 724582 - DNA, 20 bp, mouse
gggagatattaatagatgtg

SEQ ID NO: 724583 - DNA, 20 bp, mouse
gaggaagtcgcttgaagtcc

SEQ ID NO: 724584 - DNA, 20 bp, mouse
gagtgggatcagggacttca

SEQ ID NO: 724585 - DNA, 20 bp, mouse
ggaagccgcctgcgccaact

SEQ ID NO: 724586 - DNA, 20 bp, mouse
gctgtgaaacagcactatgt

SEQ ID NO: 724587 - DNA, 20 bp, mouse
gctgtaccatagcaggtttt

SEQ ID NO: 724588 - DNA, 20 bp, mouse
gcagatcctaaaacctgcta

SEQ ID NO: 724589 - DNA, 20 bp, mouse
gtagctgccaagtggggaca

SEQ ID NO: 724590 - DNA, 20 bp, mouse
gtgaacagggaggaacagga

SEQ ID NO: 724591 - DNA, 20 bp, mouse
ggccaagtggggacagggtg

SEQ ID NO: 724592 - DNA, 20 bp, mouse
gtctgtgaacagggaggaac

SEQ ID NO: 724593 - DNA, 20 bp, mouse
ggaaacctctgtgaacaggg

SEQ ID NO: 724594 - DNA, 20 bp, mouse
gccactgaggcaggagtaga

SEQ ID NO: 724595 - DNA, 20 bp, mouse
ggaggtttcgtttctttctt

SEQ ID NO: 724596 - DNA, 20 bp, mouse
gcctgcgccggatgtgggag

SEQ ID NO: 724597 - DNA, 20 bp, mouse
gaggcgggacaataccaggc

SEQ ID NO: 724598 - DNA, 20 bp, mouse
ggggctaggggcgtgtcgtg

SEQ ID NO: 724599 - DNA, 20 bp, mouse
gtccgcagcgcacccggaag

SEQ ID NO: 724600 - DNA, 20 bp, mouse
ggggcggcatgggaccgagt

SEQ ID NO: 724601 - DNA, 20 bp, mouse
gtccgggtgcgctgcggagg

SEQ ID NO: 724602 - DNA, 20 bp, mouse
gggaggggctgtgagcgggg

SEQ ID NO: 724603 - DNA, 20 bp, mouse
ggggctgtggtttgaaacag

SEQ ID NO: 724604 - DNA, 20 bp, mouse
gaaccaggctggtcacgctg

SEQ ID NO: 724605 - DNA, 20 bp, mouse
gcggggcctgcgccggatgt

SEQ ID NO: 724606 - DNA, 20 bp, mouse
gcggccctgcagcccaccac

SEQ ID NO: 724607 - DNA, 20 bp, mouse
gcagcccaccactggcactc

SEQ ID NO: 724608 - DNA, 20 bp, mouse
gagtggacgcattgaagatg

SEQ ID NO: 724609 - DNA, 20 bp, mouse
gactgagcggagtagtggat

SEQ ID NO: 724610 - DNA, 20 bp, mouse
ggccgctactccacacagta

SEQ ID NO: 724611 - DNA, 20 bp, mouse
gcagtctgaggataactgag

SEQ ID NO: 724612 - DNA, 20 bp, mouse
gccacacagtacggtaagga

SEQ ID NO: 724613 - DNA, 20 bp, mouse
gagagagaatctgagtgtgt

SEQ ID NO: 724614 - DNA, 20 bp, mouse
gaggaggcgcgagctgactc

SEQ ID NO: 724615 - DNA, 20 bp, mouse
gtgcgcctgagtgccagtgg

SEQ ID NO: 724616 - DNA, 20 bp, mouse
ggccctggaaggaacgcccg

SEQ ID NO: 724617 - DNA, 20 bp, mouse
ggccgcgggcgttccttcca

SEQ ID NO: 724618 - DNA, 20 bp, mouse
gtgcccaggggacacctgtt

SEQ ID NO: 724619 - DNA, 20 bp, mouse
gcccgcagtgcgcaccgggg

SEQ ID NO: 724620 - DNA, 20 bp, mouse
gccgcggcgcagtccccaac

SEQ ID NO: 724621 - DNA, 20 bp, mouse
gcctgtggcaggaaaaggaa

SEQ ID NO: 724622 - DNA, 20 bp, mouse
gccgcccgcagtgcgcaccg

SEQ ID NO: 724623 - DNA, 20 bp, mouse
gtccccaacaggtgtcccct

SEQ ID NO: 724624 - DNA, 20 bp, mouse
gaactggcgtggctttcgag

SEQ ID NO: 724625 - DNA, 20 bp, mouse
gactgcgggcggggcgaccc

SEQ ID NO: 724626 - DNA, 20 bp, mouse
gcggccgggcgggagtaaag

SEQ ID NO: 724627 - DNA, 20 bp, mouse
ggggcggggtcaacgcacgg

SEQ ID NO: 724628 - DNA, 20 bp, mouse
ggggaggcgtggcaaatggg

SEQ ID NO: 724629 - DNA, 20 bp, mouse
gcggggtcaacgcacggcgg

SEQ ID NO: 724630 - DNA, 20 bp, mouse
ggggttgtgagacgtcacgg

SEQ ID NO: 724631 - DNA, 20 bp, mouse
ggggctctggtccgcgcggt

SEQ ID NO: 724632 - DNA, 20 bp, mouse
gtgggaagagcggggacgaa

SEQ ID NO: 724633 - DNA, 20 bp, mouse
gcctccactaagcccgagtt

SEQ ID NO: 724634 - DNA, 20 bp, mouse
gccaaggcctaggagaatgc

SEQ ID NO: 724635 - DNA, 20 bp, mouse
gccccgacctgcattctcct

SEQ ID NO: 724636 - DNA, 20 bp, mouse
gaccgctgagggaatgaccc

SEQ ID NO: 724637 - DNA, 20 bp, mouse
ggcacgagaccataggtgat

SEQ ID NO: 724638 - DNA, 20 bp, mouse
gaatgacccaggttaacttt

SEQ ID NO: 724639 - DNA, 20 bp, mouse
gccgcccactgtcatcacca

SEQ ID NO: 724640 - DNA, 20 bp, mouse
ggatgtctgctttatatcca

SEQ ID NO: 724641 - DNA, 20 bp, mouse
gacctgggtcattccctcag

SEQ ID NO: 724642 - DNA, 20 bp, mouse
ggagaagattggaggatcat

SEQ ID NO: 724643 - DNA, 20 bp, mouse
gatgacagtgggcggaggag

SEQ ID NO: 724644 - DNA, 20 bp, mouse
ggagaattggctagatttac

SEQ ID NO: 724645 - DNA, 20 bp, mouse
gcgggtgatgacgtactgcc

SEQ ID NO: 724646 - DNA, 20 bp, mouse
gcccctgcaccgcacggtct

SEQ ID NO: 724647 - DNA, 20 bp, mouse
gttgcaccatggcacgggga

SEQ ID NO: 724648 - DNA, 20 bp, mouse
gggtgcaaaaccaccctaaa

SEQ ID NO: 724649 - DNA, 20 bp, mouse
gccaccctaaaaggggttga

SEQ ID NO: 724650 - DNA, 20 bp, mouse
gccaggagggtgcaggtagt

SEQ ID NO: 724651 - DNA, 20 bp, mouse
ggggctaaaggccttgggga

SEQ ID NO: 724652 - DNA, 20 bp, mouse
gtgaaggttcccagaccgtg

SEQ ID NO: 724653 - DNA, 20 bp, mouse
gggaaccttcaacccctttt

SEQ ID NO: 724654 - DNA, 20 bp, mouse
gaccgtgcggtgcaggggcg

SEQ ID NO: 724655 - DNA, 20 bp, mouse
gggactccattcctaagggg

SEQ ID NO: 724656 - DNA, 20 bp, mouse
ggggcctgagagataccagg

SEQ ID NO: 724657 - DNA, 20 bp, mouse
gggtaggcaaggccttccta

SEQ ID NO: 724658 - DNA, 20 bp, mouse
gagaggtctgcataactgcg

SEQ ID NO: 724659 - DNA, 20 bp, mouse
gaatgtgtgtcaacggatag

SEQ ID NO: 724660 - DNA, 20 bp, mouse
gctacctcctggtatctctc

SEQ ID NO: 724661 - DNA, 20 bp, mouse
gagactgcagaggtcagggc

SEQ ID NO: 724662 - DNA, 20 bp, mouse
gatagagactgcagaggtca

SEQ ID NO: 724663 - DNA, 20 bp, mouse
gtcagggcaggcgctggact

SEQ ID NO: 724664 - DNA, 20 bp, mouse
gggcgctggacttggagagt

SEQ ID NO: 724665 - DNA, 20 bp, mouse
gggtgggcctgagagatacc

SEQ ID NO: 724666 - DNA, 20 bp, mouse
gaaaacgttcggaagtgggc

SEQ ID NO: 724667 - DNA, 20 bp, mouse
gagagcgcagagaaaacgtt

SEQ ID NO: 724668 - DNA, 20 bp, mouse
gagcacgggaaaagtcccac

SEQ ID NO: 724669 - DNA, 20 bp, mouse
gcagagaaaacgttcggaag

SEQ ID NO: 724670 - DNA, 20 bp, mouse
gcaccctcccgtgagagcac

SEQ ID NO: 724671 - DNA, 20 bp, mouse
gcaagctctctatctgatag

SEQ ID NO: 724672 - DNA, 20 bp, mouse
gagacccgggtggcctggct

SEQ ID NO: 724673 - DNA, 20 bp, mouse
gaggccacccgggtctcctg

SEQ ID NO: 724674 - DNA, 20 bp, mouse
gaggggctccgctccaagat

SEQ ID NO: 724675 - DNA, 20 bp, mouse
gcatcaacgccaggcttgaa

SEQ ID NO: 724676 - DNA, 20 bp, mouse
gggctcctggggagctgcgg

SEQ ID NO: 724677 - DNA, 20 bp, mouse
gtacgcagcatggaagtgat

SEQ ID NO: 724678 - DNA, 20 bp, mouse
gggctattgcgtctacttat

SEQ ID NO: 724679 - DNA, 20 bp, mouse
ggtctagcacgattggtcgg

SEQ ID NO: 724680 - DNA, 20 bp, mouse
gcgtgctagaccagcagggt

SEQ ID NO: 724681 - DNA, 20 bp, mouse
gggacttagcagttgcaggg

SEQ ID NO: 724682 - DNA, 20 bp, mouse
gagggatcgtggaggacgtg

SEQ ID NO: 724683 - DNA, 20 bp, mouse
gcaaccttcctcaccaaatt

SEQ ID NO: 724684 - DNA, 20 bp, mouse
gaggaggagcaagagacgtc

SEQ ID NO: 724685 - DNA, 20 bp, mouse
gtccttggccagaggctcct

SEQ ID NO: 724686 - DNA, 20 bp, mouse
gcacagctaggcacaggctg

SEQ ID NO: 724687 - DNA, 20 bp, mouse
ggaagagcacagctaggcac

SEQ ID NO: 724688 - DNA, 20 bp, mouse
gacaggctggggtagactct

SEQ ID NO: 724689 - DNA, 20 bp, mouse
ggaaaactgcttgtgtctga

SEQ ID NO: 724690 - DNA, 20 bp, mouse
gggcaccaccgtgcagtctg

SEQ ID NO: 724691 - DNA, 20 bp, mouse
gcagagttctagataaggag

SEQ ID NO: 724692 - DNA, 20 bp, mouse
gtggatgcttattttgtcat

SEQ ID NO: 724693 - DNA, 20 bp, mouse
gaaactcagagttctagata

SEQ ID NO: 724694 - DNA, 20 bp, mouse
ggaaagttgcagaagaggtt

SEQ ID NO: 724695 - DNA, 20 bp, mouse
gttttccacagactgcacgg

SEQ ID NO: 724696 - DNA, 20 bp, mouse
gcctgcgcagaacaccgcag

SEQ ID NO: 724697 - DNA, 20 bp, mouse
gagtgggctccgccccccgt

SEQ ID NO: 724698 - DNA, 20 bp, mouse
gcgcgcacctccagctgcaa

SEQ ID NO: 724699 - DNA, 20 bp, mouse
gagaacaccgcagtggttgg

SEQ ID NO: 724700 - DNA, 20 bp, mouse
gcagctgcgcagctaggcat

SEQ ID NO: 724701 - DNA, 20 bp, mouse
ggcgcgccccgccccctagt

SEQ ID NO: 724702 - DNA, 20 bp, mouse
gcaaaggcggttccggccgt

SEQ ID NO: 724703 - DNA, 20 bp, mouse
gtaccaccagcgtctatcca

SEQ ID NO: 724704 - DNA, 20 bp, mouse
gcccaccgaggcaccccgga

SEQ ID NO: 724705 - DNA, 20 bp, mouse
gcgccttcctagcctacggg

SEQ ID NO: 724706 - DNA, 20 bp, mouse
gtgctgcccggtggagatgg

SEQ ID NO: 724707 - DNA, 20 bp, mouse
gtacaaacctccatctccac

SEQ ID NO: 724708 - DNA, 20 bp, mouse
gactacaacagcactactgc

SEQ ID NO: 724709 - DNA, 20 bp, mouse
gtggaaaatgaaactaaaat

SEQ ID NO: 724710 - DNA, 20 bp, mouse
gcctctcagctttccctagg

SEQ ID NO: 724711 - DNA, 20 bp, mouse
gggactagaaatgactcagt

SEQ ID NO: 724712 - DNA, 20 bp, mouse
gtatgagagtgcaaaggatg

SEQ ID NO: 724713 - DNA, 20 bp, mouse
gagaatgtagttcataagca

SEQ ID NO: 724714 - DNA, 20 bp, mouse
gttccctctcagctttccct

SEQ ID NO: 724715 - DNA, 20 bp, mouse
gttgtgctgcccggtggaga

SEQ ID NO: 724716 - DNA, 20 bp, mouse
gaccacaagggcatagggtg

SEQ ID NO: 724717 - DNA, 20 bp, mouse
gtgccctgggctgtaagtgg

SEQ ID NO: 724718 - DNA, 20 bp, mouse
ggcccagggcaagaccacaa

SEQ ID NO: 724719 - DNA, 20 bp, mouse
gaaacccaagctcccagtgg

SEQ ID NO: 724720 - DNA, 20 bp, mouse
ggcaagaccacaagggcata

SEQ ID NO: 724721 - DNA, 20 bp, mouse
gtgcccttgtggtcttgccc

SEQ ID NO: 724722 - DNA, 20 bp, mouse
gtggggctatggtgctaaat

SEQ ID NO: 724723 - DNA, 20 bp, mouse
gtcatcaggcaggggcagta

SEQ ID NO: 724724 - DNA, 20 bp, mouse
gaggctgatgggtgcttggt

SEQ ID NO: 724725 - DNA, 20 bp, mouse
ggctccaccactgggagctt

SEQ ID NO: 724726 - DNA, 20 bp, mouse
ggtggaggctgtggttaagg

SEQ ID NO: 724727 - DNA, 20 bp, mouse
gtcctgaggtaagctaaact

SEQ ID NO: 724728 - DNA, 20 bp, mouse
gttacctcaggaggtcagtg

SEQ ID NO: 724729 - DNA, 20 bp, mouse
gaagcaaaagataaagaaca

SEQ ID NO: 724730 - DNA, 20 bp, mouse
gagtcatgatggacttcctg

SEQ ID NO: 724731 - DNA, 20 bp, mouse
ggggactactgatcatactg

SEQ ID NO: 724732 - DNA, 20 bp, mouse
gtaactgctgtaagataaat

SEQ ID NO: 724733 - DNA, 20 bp, mouse
gtgtcaatattgttttaaaa

SEQ ID NO: 724734 - DNA, 20 bp, mouse
gatatcatctcattaatatt

SEQ ID NO: 724735 - DNA, 20 bp, mouse
gaagaaagtagaggatgtgg

SEQ ID NO: 724736 - DNA, 20 bp, mouse
gctcagtactgtggattttt

SEQ ID NO: 724737 - DNA, 20 bp, mouse
ggaagtccacagtgaacaaa

SEQ ID NO: 724738 - DNA, 20 bp, mouse
gtgaagaggcttgagacccc

SEQ ID NO: 724739 - DNA, 20 bp, mouse
gtgactctcctggaactcct

SEQ ID NO: 724740 - DNA, 20 bp, mouse
gtgtgtccgtttgttcactg

SEQ ID NO: 724741 - DNA, 20 bp, mouse
gaatattcagatcgctccac

SEQ ID NO: 724742 - DNA, 20 bp, mouse
ggaactcactctgactctcc

SEQ ID NO: 724743 - DNA, 20 bp, mouse
gcacattttttttttcaatc

SEQ ID NO: 724744 - DNA, 20 bp, mouse
gttggaagctgtggttgaag

SEQ ID NO: 724745 - DNA, 20 bp, mouse
gtaaaggtcaagaatttaga

SEQ ID NO: 724746 - DNA, 20 bp, mouse
gctcagtactgtggattttt

SEQ ID NO: 724747 - DNA, 20 bp, mouse
ggaagtccacagtgaacaaa

SEQ ID NO: 724748 - DNA, 20 bp, mouse
gtgaagaggcttgagacccc

SEQ ID NO: 724749 - DNA, 20 bp, mouse
gtgactctcctggaactcct

SEQ ID NO: 724750 - DNA, 20 bp, mouse
gtgtgtccgtttgttcactg

SEQ ID NO: 724751 - DNA, 20 bp, mouse
gaatattcagatcgctccac

SEQ ID NO: 724752 - DNA, 20 bp, mouse
ggaactcactctgactctcc

SEQ ID NO: 724753 - DNA, 20 bp, mouse
gcacattttttttttcaatc

SEQ ID NO: 724754 - DNA, 20 bp, mouse
gttggaagctgtggttgaag

SEQ ID NO: 724755 - DNA, 20 bp, mouse
gtaaaggtcaagaatttaga

SEQ ID NO: 724756 - DNA, 20 bp, mouse
gcaagagtgtagatggttgg

SEQ ID NO: 724757 - DNA, 20 bp, mouse
gtaaagaccaagagtgtaga

SEQ ID NO: 724758 - DNA, 20 bp, mouse
ggaccaagagtgtagatggt

SEQ ID NO: 724759 - DNA, 20 bp, mouse
ggtggacttcctggggtcct

SEQ ID NO: 724760 - DNA, 20 bp, mouse
ggctgtggttgaggatgccg

SEQ ID NO: 724761 - DNA, 20 bp, mouse
ggaaaccaagagatcgtacc

SEQ ID NO: 724762 - DNA, 20 bp, mouse
gtaaggacatattctggtct

SEQ ID NO: 724763 - DNA, 20 bp, mouse
gtgcacctggtacgatctct

SEQ ID NO: 724764 - DNA, 20 bp, mouse
ggcttagacacttttgcacc

SEQ ID NO: 724765 - DNA, 20 bp, mouse
gtgtagatggttggaggctg

SEQ ID NO: 724766 - DNA, 20 bp, mouse
gtgaggaggtctgagatccc

SEQ ID NO: 724767 - DNA, 20 bp, mouse
ggatcccaggaagtcaacag

SEQ ID NO: 724768 - DNA, 20 bp, mouse
ggtgtgcgataactgctgtg

SEQ ID NO: 724769 - DNA, 20 bp, mouse
ggagtattattttttgaaaa

SEQ ID NO: 724770 - DNA, 20 bp, mouse
gataaaggtaaaaaatgtac

SEQ ID NO: 724771 - DNA, 20 bp, mouse
gaaaaaatgtacaggtttgg

SEQ ID NO: 724772 - DNA, 20 bp, mouse
gggtttggaggttgtggttg

SEQ ID NO: 724773 - DNA, 20 bp, mouse
gtgattctcctggaactcct

SEQ ID NO: 724774 - DNA, 20 bp, mouse
gggtaaaaaatgtacaggtt

SEQ ID NO: 724775 - DNA, 20 bp, mouse
ggaactcactctgattctcc

SEQ ID NO: 724776 - DNA, 20 bp, mouse
gctaacgtctgggacgtgtg

SEQ ID NO: 724777 - DNA, 20 bp, mouse
gcaactgtctacacctctct

SEQ ID NO: 724778 - DNA, 20 bp, mouse
gacttcccccagactaatag

SEQ ID NO: 724779 - DNA, 20 bp, mouse
gacacctctctggggtcttc

SEQ ID NO: 724780 - DNA, 20 bp, mouse
ggaaggaataaaagatacgc

SEQ ID NO: 724781 - DNA, 20 bp, mouse
gggggaagttccggtacaac

SEQ ID NO: 724782 - DNA, 20 bp, mouse
gcaaagcctctattagtctg

SEQ ID NO: 724783 - DNA, 20 bp, mouse
ggttccggtacaacgggtga

SEQ ID NO: 724784 - DNA, 20 bp, mouse
gcatccatgcaaagaggcaa

SEQ ID NO: 724785 - DNA, 20 bp, mouse
gaaggggaagtaaacccgat

SEQ ID NO: 724786 - DNA, 20 bp, mouse
gaaagctgccccctgcctgg

SEQ ID NO: 724787 - DNA, 20 bp, mouse
gaacactgggtctgtctcaa

SEQ ID NO: 724788 - DNA, 20 bp, mouse
gttgctgccccccaggcagg

SEQ ID NO: 724789 - DNA, 20 bp, mouse
gaaggtgggtggtactggga

SEQ ID NO: 724790 - DNA, 20 bp, mouse
gaggctggctgcaaattata

SEQ ID NO: 724791 - DNA, 20 bp, mouse
ggccagcagtaaggctcagt

SEQ ID NO: 724792 - DNA, 20 bp, mouse
gcaccagaatgagcatcact

SEQ ID NO: 724793 - DNA, 20 bp, mouse
ggtcaaagctgccccctgcc

SEQ ID NO: 724794 - DNA, 20 bp, mouse
gtgtgagtcatcctctgtgg

SEQ ID NO: 724795 - DNA, 20 bp, mouse
gcattctggtgattagcacc

SEQ ID NO: 724796 - DNA, 20 bp, mouse
gaagccttgaggaactagaa

SEQ ID NO: 724797 - DNA, 20 bp, mouse
gagcatcatgcagtagaatc

SEQ ID NO: 724798 - DNA, 20 bp, mouse
gcatcagctccgatctgcag

SEQ ID NO: 724799 - DNA, 20 bp, mouse
ggcacattcagaattccaaa

SEQ ID NO: 724800 - DNA, 20 bp, mouse
gatcggagctgatgacgctc

SEQ ID NO: 724801 - DNA, 20 bp, mouse
gtagaattgcctctgcagat

SEQ ID NO: 724802 - DNA, 20 bp, mouse
ggttcaaggcaaaagccctt

SEQ ID NO: 724803 - DNA, 20 bp, mouse
gcctaagtaacagcaaacaa

SEQ ID NO: 724804 - DNA, 20 bp, mouse
gtgttacttaggtttcagat

SEQ ID NO: 724805 - DNA, 20 bp, mouse
gttgcacatttatgagatga

SEQ ID NO: 724806 - DNA, 20 bp, mouse
ggcgcccgatcgccctctgg

SEQ ID NO: 724807 - DNA, 20 bp, mouse
gccgccctgaaaaggagctc

SEQ ID NO: 724808 - DNA, 20 bp, mouse
ggggtcctcaaatctcagga

SEQ ID NO: 724809 - DNA, 20 bp, mouse
gaaggagctctggaccacta

SEQ ID NO: 724810 - DNA, 20 bp, mouse
gactcgaggccgccctgaaa

SEQ ID NO: 724811 - DNA, 20 bp, mouse
gtcgcctaggactaagggat

SEQ ID NO: 724812 - DNA, 20 bp, mouse
gcctctggtggcggtgaggg

SEQ ID NO: 724813 - DNA, 20 bp, mouse
gtgcggagaggtggatagcc

SEQ ID NO: 724814 - DNA, 20 bp, mouse
gaccgccaccagagggcgat

SEQ ID NO: 724815 - DNA, 20 bp, mouse
gaagaaatcgcctaggacta

SEQ ID NO: 724816 - DNA, 20 bp, mouse
gttgccatgggaccaagcca

SEQ ID NO: 724817 - DNA, 20 bp, mouse
ggagatgacagggtgctcag

SEQ ID NO: 724818 - DNA, 20 bp, mouse
gggtgattcagggtcatcga

SEQ ID NO: 724819 - DNA, 20 bp, mouse
gggtcccatggcaactcgga

SEQ ID NO: 724820 - DNA, 20 bp, mouse
gtgtgtgagtcatatttcac

SEQ ID NO: 724821 - DNA, 20 bp, mouse
gtgatcctagaaagaaaggg

SEQ ID NO: 724822 - DNA, 20 bp, mouse
gtaagctcaaggaccttatg

SEQ ID NO: 724823 - DNA, 20 bp, mouse
gtaggtgatcctagaaagaa

SEQ ID NO: 724824 - DNA, 20 bp, mouse
gtatagaatcatggcagccc

SEQ ID NO: 724825 - DNA, 20 bp, mouse
ggcttggtcccatggcaact

SEQ ID NO: 724826 - DNA, 20 bp, mouse
ggggcagagacctcgagaga

SEQ ID NO: 724827 - DNA, 20 bp, mouse
gtccccagaagggaagccta

SEQ ID NO: 724828 - DNA, 20 bp, mouse
gaaaggtcgagtttgctcgg

SEQ ID NO: 724829 - DNA, 20 bp, mouse
gcaaactcgacctttcccgg

SEQ ID NO: 724830 - DNA, 20 bp, mouse
ggggaaaggtcgagtttgct

SEQ ID NO: 724831 - DNA, 20 bp, mouse
ggcccgccacgagcctcaaa

SEQ ID NO: 724832 - DNA, 20 bp, mouse
gagagacctcgagagacggc

SEQ ID NO: 724833 - DNA, 20 bp, mouse
gcgctgcccgccgtctctcg

SEQ ID NO: 724834 - DNA, 20 bp, mouse
gggcggcggccggggcgcca

SEQ ID NO: 724835 - DNA, 20 bp, mouse
ggggtccggtcacctctcgg

SEQ ID NO: 724836 - DNA, 20 bp, mouse
gaagagctaggatgtcacag

SEQ ID NO: 724837 - DNA, 20 bp, mouse
gttcacttaagagttgaggg

SEQ ID NO: 724838 - DNA, 20 bp, mouse
gccaccaggacgcaagccca

SEQ ID NO: 724839 - DNA, 20 bp, mouse
gaggccctgggcttgcgtcc

SEQ ID NO: 724840 - DNA, 20 bp, mouse
gagtgtaatcgtcataacca

SEQ ID NO: 724841 - DNA, 20 bp, mouse
ggcaattattacatacttgc

SEQ ID NO: 724842 - DNA, 20 bp, mouse
gataaccatggctttgttcc

SEQ ID NO: 724843 - DNA, 20 bp, mouse
gaagggtcagaggcctgtga

SEQ ID NO: 724844 - DNA, 20 bp, mouse
gttcccagtcactgcagctt

SEQ ID NO: 724845 - DNA, 20 bp, mouse
gaaaatgtgaatatttggga

SEQ ID NO: 724846 - DNA, 20 bp, mouse
ggccacgggaagaagtaagg

SEQ ID NO: 724847 - DNA, 20 bp, mouse
ggctgccaatcaggcctcga

SEQ ID NO: 724848 - DNA, 20 bp, mouse
gcagccgaaagctgccaatc

SEQ ID NO: 724849 - DNA, 20 bp, mouse
gctagcagtagtctggatca

SEQ ID NO: 724850 - DNA, 20 bp, mouse
ggaggccacgggaagaagta

SEQ ID NO: 724851 - DNA, 20 bp, mouse
gcaggtcccacagggtaagg

SEQ ID NO: 724852 - DNA, 20 bp, mouse
gtgttagatgtcagctcgtc

SEQ ID NO: 724853 - DNA, 20 bp, mouse
gagcatccaccttaccctgt

SEQ ID NO: 724854 - DNA, 20 bp, mouse
ggggcacaattgctgcttta

SEQ ID NO: 724855 - DNA, 20 bp, mouse
gcctgtgggacctgaggcca

SEQ ID NO: 724856 - DNA, 20 bp, mouse
gcgggctcggatgctgtcca

SEQ ID NO: 724857 - DNA, 20 bp, mouse
gcaccctcagcagtgtgccc

SEQ ID NO: 724858 - DNA, 20 bp, mouse
gagcccgctgcgctgcgcag

SEQ ID NO: 724859 - DNA, 20 bp, mouse
gcgcctctgcgcagcgcagc

SEQ ID NO: 724860 - DNA, 20 bp, mouse
ggtccagggcacactgctga

SEQ ID NO: 724861 - DNA, 20 bp, mouse
gctataggagcatggaggag

SEQ ID NO: 724862 - DNA, 20 bp, mouse
gaagaagcacaagttggcgc

SEQ ID NO: 724863 - DNA, 20 bp, mouse
gcggtcttggggtctcgccc

SEQ ID NO: 724864 - DNA, 20 bp, mouse
gaggcggcctgcgcctagga

SEQ ID NO: 724865 - DNA, 20 bp, mouse
gccaggctataggagcatgg

SEQ ID NO: 724866 - DNA, 20 bp, mouse
gtagacccgagagagtgcct

SEQ ID NO: 724867 - DNA, 20 bp, mouse
gcagctgcagactttgtatt

SEQ ID NO: 724868 - DNA, 20 bp, mouse
gttagaacccacttcttccc

SEQ ID NO: 724869 - DNA, 20 bp, mouse
gggaggcctggaagaggcta

SEQ ID NO: 724870 - DNA, 20 bp, mouse
ggtattaggaggcctggaag

SEQ ID NO: 724871 - DNA, 20 bp, mouse
gtgtgcacagatggcaagag

SEQ ID NO: 724872 - DNA, 20 bp, mouse
gctgcagactttgtattagg

SEQ ID NO: 724873 - DNA, 20 bp, mouse
gactgggtgtcgaagttgga

SEQ ID NO: 724874 - DNA, 20 bp, mouse
gtagagcctgcagcaggttc

SEQ ID NO: 724875 - DNA, 20 bp, mouse
gttcttcccaggcactctct

SEQ ID NO: 724876 - DNA, 20 bp, mouse
gctcaaacgttcatccagtg

SEQ ID NO: 724877 - DNA, 20 bp, mouse
ggggaccaaccctgacactc

SEQ ID NO: 724878 - DNA, 20 bp, mouse
gtcacctgaggcaccccaga

SEQ ID NO: 724879 - DNA, 20 bp, mouse
gtacaaaggctctctatgcg

SEQ ID NO: 724880 - DNA, 20 bp, mouse
ggggtagactttgtttacaa

SEQ ID NO: 724881 - DNA, 20 bp, mouse
gtgaccctctggggtgcctc

SEQ ID NO: 724882 - DNA, 20 bp, mouse
gaatcccagagtgtcagggt

SEQ ID NO: 724883 - DNA, 20 bp, mouse
gctgaaatcccagagtgtca

SEQ ID NO: 724884 - DNA, 20 bp, mouse
gatggaagagcagtgtgatg

SEQ ID NO: 724885 - DNA, 20 bp, mouse
ggctgattggttcctcactt

SEQ ID NO: 724886 - DNA, 20 bp, mouse
ggagtctgagactaagcccg

SEQ ID NO: 724887 - DNA, 20 bp, mouse
gtggcaggtctcactatcat

SEQ ID NO: 724888 - DNA, 20 bp, mouse
ggctctctgtccgcagtaca

SEQ ID NO: 724889 - DNA, 20 bp, mouse
gcaaagtcttggttgccagg

SEQ ID NO: 724890 - DNA, 20 bp, mouse
gcgggcttgtgggtctctcc

SEQ ID NO: 724891 - DNA, 20 bp, mouse
gaaacagtgagtcgggcttg

SEQ ID NO: 724892 - DNA, 20 bp, mouse
gagcctctgtagctccagat

SEQ ID NO: 724893 - DNA, 20 bp, mouse
gtagaagaaaggtcacttcc

SEQ ID NO: 724894 - DNA, 20 bp, mouse
ggaagagggcttggtatcaa

SEQ ID NO: 724895 - DNA, 20 bp, mouse
gggtccacccggacaatctc

SEQ ID NO: 724896 - DNA, 20 bp, mouse
gggagcccgaccttccacca

SEQ ID NO: 724897 - DNA, 20 bp, mouse
gggggcccggagggcctctc

SEQ ID NO: 724898 - DNA, 20 bp, mouse
gttaacatcatcagtcgctg

SEQ ID NO: 724899 - DNA, 20 bp, mouse
gcgccccctggtggaaggtc

SEQ ID NO: 724900 - DNA, 20 bp, mouse
gacctccgccccctggtgga

SEQ ID NO: 724901 - DNA, 20 bp, mouse
gggtttagccgtggtaagac

SEQ ID NO: 724902 - DNA, 20 bp, mouse
gtcaaagcagcgccgcctgg

SEQ ID NO: 724903 - DNA, 20 bp, mouse
gtggaaggtcgggctccagc

SEQ ID NO: 724904 - DNA, 20 bp, mouse
gtctggagacctccgccccc

SEQ ID NO: 724905 - DNA, 20 bp, mouse
gaaaagactcgattccgttc

SEQ ID NO: 724906 - DNA, 20 bp, mouse
ggggccacctcgttgagcga

SEQ ID NO: 724907 - DNA, 20 bp, mouse
gccccccgccgcggtgggga

SEQ ID NO: 724908 - DNA, 20 bp, mouse
ggctcaacgaggtggccccg

SEQ ID NO: 724909 - DNA, 20 bp, mouse
gcgggtcgcggggagagccg

SEQ ID NO: 724910 - DNA, 20 bp, mouse
gggggagagccgcggtgcgc

SEQ ID NO: 724911 - DNA, 20 bp, mouse
gcacccatcgctcaacgagg

SEQ ID NO: 724912 - DNA, 20 bp, mouse
gcatgcgctatgtgtttcgt

SEQ ID NO: 724913 - DNA, 20 bp, mouse
ggaggtggccccgaggctcg

SEQ ID NO: 724914 - DNA, 20 bp, mouse
gtcagtgcgccccgagcctc

SEQ ID NO: 724915 - DNA, 20 bp, mouse
gcgcaagggtgtgcctggtc

SEQ ID NO: 724916 - DNA, 20 bp, mouse
gtgcccaaggccttaagaac

SEQ ID NO: 724917 - DNA, 20 bp, mouse
gttcctcagtgactaccaca

SEQ ID NO: 724918 - DNA, 20 bp, mouse
gccaaatcccggaacctaaa

SEQ ID NO: 724919 - DNA, 20 bp, mouse
gtaaggccttgggcacaatg

SEQ ID NO: 724920 - DNA, 20 bp, mouse
gcctagcatcatcagttact

SEQ ID NO: 724921 - DNA, 20 bp, mouse
gagaaagtcaatccagaggc

SEQ ID NO: 724922 - DNA, 20 bp, mouse
gatcctgttcttaaggcctt

SEQ ID NO: 724923 - DNA, 20 bp, mouse
ggcggagaaagtcaatccag

SEQ ID NO: 724924 - DNA, 20 bp, mouse
gggcaacgtcccttttggag

SEQ ID NO: 724925 - DNA, 20 bp, mouse
ggtaaacctcattgtgccca

SEQ ID NO: 724926 - DNA, 20 bp, mouse
gccaaatctggggtcctaaa

SEQ ID NO: 724927 - DNA, 20 bp, mouse
gggaggggctgagtgactcg

SEQ ID NO: 724928 - DNA, 20 bp, mouse
ggagtgactcggggccacat

SEQ ID NO: 724929 - DNA, 20 bp, mouse
ggttgagtgagtgggtacaa

SEQ ID NO: 724930 - DNA, 20 bp, mouse
gtgacttagcctagcatcat

SEQ ID NO: 724931 - DNA, 20 bp, mouse
gaagaacaggaccttctagg

SEQ ID NO: 724932 - DNA, 20 bp, mouse
gtctggggtcctaaagggag

SEQ ID NO: 724933 - DNA, 20 bp, mouse
gactcactcaaccaaatctg

SEQ ID NO: 724934 - DNA, 20 bp, mouse
gggctaagtcacttagtgat

SEQ ID NO: 724935 - DNA, 20 bp, mouse
gacaaccctggcctgcccct

SEQ ID NO: 724936 - DNA, 20 bp, mouse
gaagaacaggaccttctagg

SEQ ID NO: 724937 - DNA, 20 bp, mouse
gtgacttagcctagcatcat

SEQ ID NO: 724938 - DNA, 20 bp, mouse
ggtggcagaggcaagactgt

SEQ ID NO: 724939 - DNA, 20 bp, mouse
gacaaccctggcctgcccct

SEQ ID NO: 724940 - DNA, 20 bp, mouse
gcctcaggaaaccacctaga

SEQ ID NO: 724941 - DNA, 20 bp, mouse
gccaaatctggggtcctaaa

SEQ ID NO: 724942 - DNA, 20 bp, mouse
gcctagcatcatcggttaat

SEQ ID NO: 724943 - DNA, 20 bp, mouse
gggctaagtcacttagtgat

SEQ ID NO: 724944 - DNA, 20 bp, mouse
ggtcaacccaggggcaggcc

SEQ ID NO: 724945 - DNA, 20 bp, mouse
gtctggggtcctaaagggag

SEQ ID NO: 724946 - DNA, 20 bp, mouse
ggaagtgaaatcctctccta

SEQ ID NO: 724947 - DNA, 20 bp, mouse
gagacaccacaggaagccgt

SEQ ID NO: 724948 - DNA, 20 bp, mouse
gcagagagctagactcccgg

SEQ ID NO: 724949 - DNA, 20 bp, mouse
ggccacgcccatgaggggga

SEQ ID NO: 724950 - DNA, 20 bp, mouse
gtgggcaccctccccctcat

SEQ ID NO: 724951 - DNA, 20 bp, mouse
gccgtggccacgcccatgag

SEQ ID NO: 724952 - DNA, 20 bp, mouse
gccacaggaagccgtaggag

SEQ ID NO: 724953 - DNA, 20 bp, mouse
gccactcagtcccactgccg

SEQ ID NO: 724954 - DNA, 20 bp, mouse
ggcgaaggggagtcagaact

SEQ ID NO: 724955 - DNA, 20 bp, mouse
ggagcagagagctagactcc

SEQ ID NO: 724956 - DNA, 20 bp, mouse
ggggagccaatcagcatcaa

SEQ ID NO: 724957 - DNA, 20 bp, mouse
ggtgctgggatatgaggcat

SEQ ID NO: 724958 - DNA, 20 bp, mouse
ggaactgcaagtttcagaag

SEQ ID NO: 724959 - DNA, 20 bp, mouse
gggatctctgtgagatagaa

SEQ ID NO: 724960 - DNA, 20 bp, mouse
ggattgggtaaggccagtgc

SEQ ID NO: 724961 - DNA, 20 bp, mouse
gttacatggatactcagtct

SEQ ID NO: 724962 - DNA, 20 bp, mouse
gactgctttgccactggatt

SEQ ID NO: 724963 - DNA, 20 bp, mouse
ggctaagataataagagaca

SEQ ID NO: 724964 - DNA, 20 bp, mouse
ggatactcagtctgggctgc

SEQ ID NO: 724965 - DNA, 20 bp, mouse
gggagggagacattattgga

SEQ ID NO: 724966 - DNA, 20 bp, mouse
gcagtctgtctgcttaacaa

SEQ ID NO: 724967 - DNA, 20 bp, mouse
gagcatcagttgctggtcag

SEQ ID NO: 724968 - DNA, 20 bp, mouse
gggtcagaggcgcagagtga

SEQ ID NO: 724969 - DNA, 20 bp, mouse
gcacactgatcaaagcttct

SEQ ID NO: 724970 - DNA, 20 bp, mouse
gtgcccaacccagcaccagt

SEQ ID NO: 724971 - DNA, 20 bp, mouse
gcagcagatggggaagtcat

SEQ ID NO: 724972 - DNA, 20 bp, mouse
gcagatggggaagtcatagg

SEQ ID NO: 724973 - DNA, 20 bp, mouse
gcataggaggaaccccaact

SEQ ID NO: 724974 - DNA, 20 bp, mouse
gagccaccaactctgattga

SEQ ID NO: 724975 - DNA, 20 bp, mouse
gcacaggttcagttagcctg

SEQ ID NO: 724976 - DNA, 20 bp, mouse
gagccccggtacatggaagt

SEQ ID NO: 724977 - DNA, 20 bp, mouse
gtcaacagtgtccggacaga

SEQ ID NO: 724978 - DNA, 20 bp, mouse
gtccctgtgtcgggacgtgg

SEQ ID NO: 724979 - DNA, 20 bp, mouse
gaactcggagacgacagcac

SEQ ID NO: 724980 - DNA, 20 bp, mouse
gcggctgcgcgggctgagag

SEQ ID NO: 724981 - DNA, 20 bp, mouse
gactgcgcgtcaacagtgtc

SEQ ID NO: 724982 - DNA, 20 bp, mouse
ggaatcgccgacaggtgcga

SEQ ID NO: 724983 - DNA, 20 bp, mouse
ggtgccgcccctcccctcag

SEQ ID NO: 724984 - DNA, 20 bp, mouse
gtaccgggccgggagggaaa

SEQ ID NO: 724985 - DNA, 20 bp, mouse
gggtgagtaccgggccggga

SEQ ID NO: 724986 - DNA, 20 bp, mouse
gagcccgggaggatcgcccg

SEQ ID NO: 724987 - DNA, 20 bp, mouse
gctcctcgggcgatcctccc

SEQ ID NO: 724988 - DNA, 20 bp, mouse
ggcgtgaagaggttagcgtt

SEQ ID NO: 724989 - DNA, 20 bp, mouse
gctaaaagactcggctcgag

SEQ ID NO: 724990 - DNA, 20 bp, mouse
gacggcgctgattggatgaa

SEQ ID NO: 724991 - DNA, 20 bp, mouse
ggactcggctcgagaggttt

SEQ ID NO: 724992 - DNA, 20 bp, mouse
ggcgctgattggatgaaggg

SEQ ID NO: 724993 - DNA, 20 bp, mouse
ggaggcttcagacgccggta

SEQ ID NO: 724994 - DNA, 20 bp, mouse
gccggcgccatgttaagtga

SEQ ID NO: 724995 - DNA, 20 bp, mouse
gacagcccccaagccgggta

SEQ ID NO: 724996 - DNA, 20 bp, mouse
gtgaccatccaccaccactt

SEQ ID NO: 724997 - DNA, 20 bp, mouse
gctgcgctggccctggtcac

SEQ ID NO: 724998 - DNA, 20 bp, mouse
ggtcacgcccccgtggtggg

SEQ ID NO: 724999 - DNA, 20 bp, mouse
gtggtgggaggtcgcgctgg

SEQ ID NO: 725000 - DNA, 20 bp, mouse
ggcgcgacctcccaccacgg

SEQ ID NO: 725001 - DNA, 20 bp, mouse
ggtccccaagtggtggtgga

SEQ ID NO: 725002 - DNA, 20 bp, mouse
gtccctaggtccccaagtgg

SEQ ID NO: 725003 - DNA, 20 bp, mouse
gaccaccacttggggaccta

SEQ ID NO: 725004 - DNA, 20 bp, mouse
gaagacaaaggctgcatgtg

SEQ ID NO: 725005 - DNA, 20 bp, mouse
gcggagctgagacgccatgg

SEQ ID NO: 725006 - DNA, 20 bp, mouse
gttggtgaatcagagcccta

SEQ ID NO: 725007 - DNA, 20 bp, mouse
gtaagaaatcccaatggtag

SEQ ID NO: 725008 - DNA, 20 bp, mouse
gcagaacagcattgtgatca

SEQ ID NO: 725009 - DNA, 20 bp, mouse
ggaatcataagctcagtgtg

SEQ ID NO: 725010 - DNA, 20 bp, mouse
gactcagcaatttcaatgtt

SEQ ID NO: 725011 - DNA, 20 bp, mouse
gacaatcatgattcactctg

SEQ ID NO: 725012 - DNA, 20 bp, mouse
ggaaatgtgagaataaaaat

SEQ ID NO: 725013 - DNA, 20 bp, mouse
gtcaactcattattgtattt

SEQ ID NO: 725014 - DNA, 20 bp, mouse
ggcaaatgtcacaaaattag

SEQ ID NO: 725015 - DNA, 20 bp, mouse
ggccaggagttcaagcatca

SEQ ID NO: 725016 - DNA, 20 bp, mouse
gaaagtgtagaactggtgca

SEQ ID NO: 725017 - DNA, 20 bp, mouse
ggggtcttggaccaattcct

SEQ ID NO: 725018 - DNA, 20 bp, mouse
gggaccaattcctgggtgta

SEQ ID NO: 725019 - DNA, 20 bp, mouse
gcgatgtggctgattctgat

SEQ ID NO: 725020 - DNA, 20 bp, mouse
gacaatacaaagtgtagaac

SEQ ID NO: 725021 - DNA, 20 bp, mouse
gttcactttacaacccgatg

SEQ ID NO: 725022 - DNA, 20 bp, mouse
gattctgattggcttctagt

SEQ ID NO: 725023 - DNA, 20 bp, mouse
gtgtgctgattgtgtttgtg

SEQ ID NO: 725024 - DNA, 20 bp, mouse
ggtgtagaactggtgcaagg

SEQ ID NO: 725025 - DNA, 20 bp, mouse
gatccaaaacgatcatagga

SEQ ID NO: 725026 - DNA, 20 bp, mouse
ggcctctagtcaaggactca

SEQ ID NO: 725027 - DNA, 20 bp, mouse
gtccttgagtccttgactag

SEQ ID NO: 725028 - DNA, 20 bp, mouse
gcagaagtgggtgcaagatg

SEQ ID NO: 725029 - DNA, 20 bp, mouse
gtgcacccacttctgcaatc

SEQ ID NO: 725030 - DNA, 20 bp, mouse
gagtggggaagctgaaaata

SEQ ID NO: 725031 - DNA, 20 bp, mouse
ggacatagacctgatggagt

SEQ ID NO: 725032 - DNA, 20 bp, mouse
gacttactggcctctagtca

SEQ ID NO: 725033 - DNA, 20 bp, mouse
gaataccagattgcagaagt

SEQ ID NO: 725034 - DNA, 20 bp, mouse
gtggcagcatcatttcgttt

SEQ ID NO: 725035 - DNA, 20 bp, mouse
gtcaagagattaattcctgg

SEQ ID NO: 725036 - DNA, 20 bp, mouse
gtagaactggtgcaagttgg

SEQ ID NO: 725037 - DNA, 20 bp, mouse
gctgtagaactggtgcaagt

SEQ ID NO: 725038 - DNA, 20 bp, mouse
gaccacagaaggctacacaa

SEQ ID NO: 725039 - DNA, 20 bp, mouse
gagatcgattcctgggtttg

SEQ ID NO: 725040 - DNA, 20 bp, mouse
ggaatataaagctgtagaac

SEQ ID NO: 725041 - DNA, 20 bp, mouse
gttggacattttacatttct

SEQ ID NO: 725042 - DNA, 20 bp, mouse
gaatgtccaaaacaatcttc

SEQ ID NO: 725043 - DNA, 20 bp, mouse
gtgattactatctgaatgta

SEQ ID NO: 725044 - DNA, 20 bp, mouse
gtaacacccgaagattgttt

SEQ ID NO: 725045 - DNA, 20 bp, mouse
gctagaaatcccccaaaccc

SEQ ID NO: 725046 - DNA, 20 bp, mouse
gacacaaggatggtataact

SEQ ID NO: 725047 - DNA, 20 bp, mouse
gctgtacaactggtgccaag

SEQ ID NO: 725048 - DNA, 20 bp, mouse
gggatacaaagctgtacaac

SEQ ID NO: 725049 - DNA, 20 bp, mouse
gtcactttataaaactgatg

SEQ ID NO: 725050 - DNA, 20 bp, mouse
gtataaagtgaagagatatc

SEQ ID NO: 725051 - DNA, 20 bp, mouse
gaagtatgagtttgtccttc

SEQ ID NO: 725052 - DNA, 20 bp, mouse
gtgccttccgaagatcattt

SEQ ID NO: 725053 - DNA, 20 bp, mouse
gatccaaaatgatcttcgga

SEQ ID NO: 725054 - DNA, 20 bp, mouse
gagggtactgcttctccact

SEQ ID NO: 725055 - DNA, 20 bp, mouse
gggaaggcatcattctattt

SEQ ID NO: 725056 - DNA, 20 bp, mouse
ggtagagaactgttgcaagt

SEQ ID NO: 725057 - DNA, 20 bp, mouse
gagaaactctgtacacgctt

SEQ ID NO: 725058 - DNA, 20 bp, mouse
gtctctacagctttgtactg

SEQ ID NO: 725059 - DNA, 20 bp, mouse
gatccaaaacaatcttcgag

SEQ ID NO: 725060 - DNA, 20 bp, mouse
gaaagaacaattttctgaga

SEQ ID NO: 725061 - DNA, 20 bp, mouse
gcgccactcgaagattgttt

SEQ ID NO: 725062 - DNA, 20 bp, mouse
gttggatatttcacatttct

SEQ ID NO: 725063 - DNA, 20 bp, mouse
ggcctctgagctaggaacca

SEQ ID NO: 725064 - DNA, 20 bp, mouse
gaaccaaggatgttgtaact

SEQ ID NO: 725065 - DNA, 20 bp, mouse
ggtccaagttacaacatcct

SEQ ID NO: 725066 - DNA, 20 bp, mouse
gagagaccaactcctgggtg

SEQ ID NO: 725067 - DNA, 20 bp, mouse
gtgtataacaggtgcaaagt

SEQ ID NO: 725068 - DNA, 20 bp, mouse
ggactcaaggatttgaaact

SEQ ID NO: 725069 - DNA, 20 bp, mouse
ggaccaactcctgggtgtgg

SEQ ID NO: 725070 - DNA, 20 bp, mouse
gaggtctaaatcactacctt

SEQ ID NO: 725071 - DNA, 20 bp, mouse
ggaacacaaagctgtataac

SEQ ID NO: 725072 - DNA, 20 bp, mouse
ggtagtgatttagacctgat

SEQ ID NO: 725073 - DNA, 20 bp, mouse
gtcttggagagaccaactcc

SEQ ID NO: 725074 - DNA, 20 bp, mouse
ggatttgaaacttggaccag

SEQ ID NO: 725075 - DNA, 20 bp, mouse
ggaaatggtaaatatctaaa

SEQ ID NO: 725076 - DNA, 20 bp, mouse
gggcctttggggtttggtga

SEQ ID NO: 725077 - DNA, 20 bp, mouse
ggtagttatagaggcctttg

SEQ ID NO: 725078 - DNA, 20 bp, mouse
ggacaacttggattacagtt

SEQ ID NO: 725079 - DNA, 20 bp, mouse
gaattctaagaatccataaa

SEQ ID NO: 725080 - DNA, 20 bp, mouse
ggcagtatctgagctgcaaa

SEQ ID NO: 725081 - DNA, 20 bp, mouse
gcccacagcccaactgtgag

SEQ ID NO: 725082 - DNA, 20 bp, mouse
ggaatggagacctgacaact

SEQ ID NO: 725083 - DNA, 20 bp, mouse
gataaatggaaatcctctcg

SEQ ID NO: 725084 - DNA, 20 bp, mouse
gattcattgagatataattg

SEQ ID NO: 725085 - DNA, 20 bp, mouse
gaagtcattcctctcacagt

SEQ ID NO: 725086 - DNA, 20 bp, mouse
gtcgtcaggtgtctgggcaa

SEQ ID NO: 725087 - DNA, 20 bp, mouse
gaggctcctagagtctcctt

SEQ ID NO: 725088 - DNA, 20 bp, mouse
gagccagtaggaatgagaat

SEQ ID NO: 725089 - DNA, 20 bp, mouse
ggtaagaatgatatctcgtc

SEQ ID NO: 725090 - DNA, 20 bp, mouse
gcatgcagaagatctttatt

SEQ ID NO: 725091 - DNA, 20 bp, mouse
gattcccctaaggagactct

SEQ ID NO: 725092 - DNA, 20 bp, mouse
gagggaattcctcacaatcc

SEQ ID NO: 725093 - DNA, 20 bp, mouse
ggatatctcgtcaggtgtct

SEQ ID NO: 725094 - DNA, 20 bp, mouse
gtatttggcttacaaaagaa

SEQ ID NO: 725095 - DNA, 20 bp, mouse
gttcctaccaggtcttgcta

SEQ ID NO: 725096 - DNA, 20 bp, mouse
gcaccccaagtgataattat

SEQ ID NO: 725097 - DNA, 20 bp, mouse
ggagaagcgtcatcagtatc

SEQ ID NO: 725098 - DNA, 20 bp, mouse
gaagacccaggcaaactcca

SEQ ID NO: 725099 - DNA, 20 bp, mouse
gctccaattcccattctaat

SEQ ID NO: 725100 - DNA, 20 bp, mouse
gaccagtatcacaagttcca

SEQ ID NO: 725101 - DNA, 20 bp, mouse
gcacgccaaccaattagaat

SEQ ID NO: 725102 - DNA, 20 bp, mouse
gaaccaattagaatgggaat

SEQ ID NO: 725103 - DNA, 20 bp, mouse
gaccctggaacttgtgatac

SEQ ID NO: 725104 - DNA, 20 bp, mouse
gctaccaataattatcactt

SEQ ID NO: 725105 - DNA, 20 bp, mouse
gtcaattgccacatgagttc

SEQ ID NO: 725106 - DNA, 20 bp, mouse
gcccttgaagagcagacctg

SEQ ID NO: 725107 - DNA, 20 bp, mouse
ggaaaggaactcaaaggtta

SEQ ID NO: 725108 - DNA, 20 bp, mouse
gctgatggtaagctggagaa

SEQ ID NO: 725109 - DNA, 20 bp, mouse
gaggaactcaaaggttacgg

SEQ ID NO: 725110 - DNA, 20 bp, mouse
gaactgacacctgacactga

SEQ ID NO: 725111 - DNA, 20 bp, mouse
gttataacactgcggtgtgt

SEQ ID NO: 725112 - DNA, 20 bp, mouse
ggctggagaaaggaactcaa

SEQ ID NO: 725113 - DNA, 20 bp, mouse
gggtctctgatgtgaccctc

SEQ ID NO: 725114 - DNA, 20 bp, mouse
gcagctcctggcaccaggtg

SEQ ID NO: 725115 - DNA, 20 bp, mouse
gacaaatgtgaggacctcag

SEQ ID NO: 725116 - DNA, 20 bp, mouse
gagatctagctctggggcgt

SEQ ID NO: 725117 - DNA, 20 bp, mouse
gctggcgattcaggacccta

SEQ ID NO: 725118 - DNA, 20 bp, mouse
gagatctgagctggcgattc

SEQ ID NO: 725119 - DNA, 20 bp, mouse
gggaacataagtgcagtatg

SEQ ID NO: 725120 - DNA, 20 bp, mouse
ggaacattgtgttcatggct

SEQ ID NO: 725121 - DNA, 20 bp, mouse
gactcagcaattttaacgtc

SEQ ID NO: 725122 - DNA, 20 bp, mouse
gtaagaaagtactccaggca

SEQ ID NO: 725123 - DNA, 20 bp, mouse
gcatattaagaaagtactcc

SEQ ID NO: 725124 - DNA, 20 bp, mouse
gcagaagaacattgtgttca

SEQ ID NO: 725125 - DNA, 20 bp, mouse
gcagctcagatctagctctg

SEQ ID NO: 725126 - DNA, 20 bp, mouse
gggcaaggaagtaaagagtc

SEQ ID NO: 725127 - DNA, 20 bp, mouse
gtcaagaaggggcttcagga

SEQ ID NO: 725128 - DNA, 20 bp, mouse
gtgaagtgacagatgaccca

SEQ ID NO: 725129 - DNA, 20 bp, mouse
ggaaaaatcaggttctatca

SEQ ID NO: 725130 - DNA, 20 bp, mouse
gggtccctctggaaattttg

SEQ ID NO: 725131 - DNA, 20 bp, mouse
gggttaggggaagacccttg

SEQ ID NO: 725132 - DNA, 20 bp, mouse
gtaccccccaaaatttccag

SEQ ID NO: 725133 - DNA, 20 bp, mouse
gtgtaaggaagactgtgtaa

SEQ ID NO: 725134 - DNA, 20 bp, mouse
ggtaaaaagaaacagagtcc

SEQ ID NO: 725135 - DNA, 20 bp, mouse
gctgaagatgctccccctga

SEQ ID NO: 725136 - DNA, 20 bp, mouse
gtgggaaaatggaccagcat

SEQ ID NO: 725137 - DNA, 20 bp, mouse
gtctccaggtaaccagttct

SEQ ID NO: 725138 - DNA, 20 bp, mouse
gcaaagtcttcgctcttgat

SEQ ID NO: 725139 - DNA, 20 bp, mouse
gtgtgataaaagccaagaac

SEQ ID NO: 725140 - DNA, 20 bp, mouse
gtctaggaagggagacctgt

SEQ ID NO: 725141 - DNA, 20 bp, mouse
ggaaaagtctacagagtatg

SEQ ID NO: 725142 - DNA, 20 bp, mouse
gagtgttggctgttgaaatg

SEQ ID NO: 725143 - DNA, 20 bp, mouse
gtcaatgtcagtcactctct

SEQ ID NO: 725144 - DNA, 20 bp, mouse
ggtagcttaaagggggttga

SEQ ID NO: 725145 - DNA, 20 bp, mouse
gcagggaccctactaagtga

SEQ ID NO: 725146 - DNA, 20 bp, mouse
gaaccaaccagctactctgt

SEQ ID NO: 725147 - DNA, 20 bp, mouse
gccagcgcccacagagtagc

SEQ ID NO: 725148 - DNA, 20 bp, mouse
gaattatctggcaggtccat

SEQ ID NO: 725149 - DNA, 20 bp, mouse
gatctggcaggtccattggg

SEQ ID NO: 725150 - DNA, 20 bp, mouse
gcgcccacagagtagctggt

SEQ ID NO: 725151 - DNA, 20 bp, mouse
gggcaggtccattgggtggc

SEQ ID NO: 725152 - DNA, 20 bp, mouse
gtaaagtccacgcagctcga

SEQ ID NO: 725153 - DNA, 20 bp, mouse
ggtggtcttggctggtgatc

SEQ ID NO: 725154 - DNA, 20 bp, mouse
gaactgaagcagagagaatg

SEQ ID NO: 725155 - DNA, 20 bp, mouse
gcactgcaggtggtcttggc

SEQ ID NO: 725156 - DNA, 20 bp, mouse
ggagccgaatgacctggccc

SEQ ID NO: 725157 - DNA, 20 bp, mouse
gggagaggacacagagattc

SEQ ID NO: 725158 - DNA, 20 bp, mouse
gtaacctgggccaggtcatt

SEQ ID NO: 725159 - DNA, 20 bp, mouse
gcgagccgagccgaatgacc

SEQ ID NO: 725160 - DNA, 20 bp, mouse
gtctctgtgggttccgtgtg

SEQ ID NO: 725161 - DNA, 20 bp, mouse
gcgcggtgaggtcaggggtt

SEQ ID NO: 725162 - DNA, 20 bp, mouse
gaatacaatggcagtacaag

SEQ ID NO: 725163 - DNA, 20 bp, mouse
gaatggcagtacaaggggtt

SEQ ID NO: 725164 - DNA, 20 bp, mouse
gtcggctcggacactgattg

SEQ ID NO: 725165 - DNA, 20 bp, mouse
gcaggaacgcgccactcatg

SEQ ID NO: 725166 - DNA, 20 bp, mouse
gttgtcttagcaggtcatca

SEQ ID NO: 725167 - DNA, 20 bp, mouse
ggaccttgagaggattctaa

SEQ ID NO: 725168 - DNA, 20 bp, mouse
ggcgcccgctgctgaggagc

SEQ ID NO: 725169 - DNA, 20 bp, mouse
gataaagtccatgcagccaa

SEQ ID NO: 725170 - DNA, 20 bp, mouse
gcactgcaggttgtcttagc

SEQ ID NO: 725171 - DNA, 20 bp, mouse
gaggagctggttggtttccc

SEQ ID NO: 725172 - DNA, 20 bp, mouse
gcttgagaggattctaaagg

SEQ ID NO: 725173 - DNA, 20 bp, mouse
gcaaccagctcctcagcagc

SEQ ID NO: 725174 - DNA, 20 bp, mouse
gttcagggcaggaccttgag

SEQ ID NO: 725175 - DNA, 20 bp, mouse
gaaagcaacttgaaaaagaa

SEQ ID NO: 725176 - DNA, 20 bp, mouse
gctccaggcagtgagatcag

SEQ ID NO: 725177 - DNA, 20 bp, mouse
gtggcagttctcacccccat

SEQ ID NO: 725178 - DNA, 20 bp, mouse
gctcccgcggcgacgatgat

SEQ ID NO: 725179 - DNA, 20 bp, mouse
gcggtgatcacgtcacccaa

SEQ ID NO: 725180 - DNA, 20 bp, mouse
gtctctgtggtgttctaatg

SEQ ID NO: 725181 - DNA, 20 bp, mouse
gctgcaggtctcttctctcc

SEQ ID NO: 725182 - DNA, 20 bp, mouse
gccagtaagtcatcagtgtc

SEQ ID NO: 725183 - DNA, 20 bp, mouse
gaaccaatcatcgtcgccgc

SEQ ID NO: 725184 - DNA, 20 bp, mouse
gactttataacctgctcccg

SEQ ID NO: 725185 - DNA, 20 bp, mouse
ggtgttctaatggggcttgc

SEQ ID NO: 725186 - DNA, 20 bp, mouse
gtctctatggagtccatgtg

SEQ ID NO: 725187 - DNA, 20 bp, mouse
gcatggactccatagagacc

SEQ ID NO: 725188 - DNA, 20 bp, mouse
gtattgggtgaggtgatcac

SEQ ID NO: 725189 - DNA, 20 bp, mouse
gcacccttgacctcacagcc

SEQ ID NO: 725190 - DNA, 20 bp, mouse
gtggtctgcaaagccccaca

SEQ ID NO: 725191 - DNA, 20 bp, mouse
gctccaggctgtgaggtcaa

SEQ ID NO: 725192 - DNA, 20 bp, mouse
gtggcagaatgaactgaccc

SEQ ID NO: 725193 - DNA, 20 bp, mouse
gtaggggtgagaactgttac

SEQ ID NO: 725194 - DNA, 20 bp, mouse
gcaggtcgactgactcctgt

SEQ ID NO: 725195 - DNA, 20 bp, mouse
gaccgggaaccaatcagcgt

SEQ ID NO: 725196 - DNA, 20 bp, mouse
gggcagtgaggtcaagggta

SEQ ID NO: 725197 - DNA, 20 bp, mouse
gagatgggaatccccagcca

SEQ ID NO: 725198 - DNA, 20 bp, mouse
gtctctgtggagtccatgtg

SEQ ID NO: 725199 - DNA, 20 bp, mouse
gttctgatccagatgctgtc

SEQ ID NO: 725200 - DNA, 20 bp, mouse
gtcttaatctccaggcagtg

SEQ ID NO: 725201 - DNA, 20 bp, mouse
gtggtctgcaaagccccaca

SEQ ID NO: 725202 - DNA, 20 bp, mouse
gcatggactccacagagacc

SEQ ID NO: 725203 - DNA, 20 bp, mouse
ggtagggaagcccatggctg

SEQ ID NO: 725204 - DNA, 20 bp, mouse
gctccaggcagtgaggtcaa

SEQ ID NO: 725205 - DNA, 20 bp, mouse
gtggcagaatgaactgaccc

SEQ ID NO: 725206 - DNA, 20 bp, mouse
gctggcaggcaaggactctc

SEQ ID NO: 725207 - DNA, 20 bp, mouse
gagaaaggaagtcatgacgt

SEQ ID NO: 725208 - DNA, 20 bp, mouse
gtctcgggaagacggagtga

SEQ ID NO: 725209 - DNA, 20 bp, mouse
gctaaaaaggaaagtcctga

SEQ ID NO: 725210 - DNA, 20 bp, mouse
gaagtcatgacgtgggagaa

SEQ ID NO: 725211 - DNA, 20 bp, mouse
gtgatctcaggccctctcat

SEQ ID NO: 725212 - DNA, 20 bp, mouse
ggagactgcacactgatctc

SEQ ID NO: 725213 - DNA, 20 bp, mouse
gcagcgctttctgggcactt

SEQ ID NO: 725214 - DNA, 20 bp, mouse
gtgtctgtctgtctcccttc

SEQ ID NO: 725215 - DNA, 20 bp, mouse
ggtgaattctaccaaaaagc

SEQ ID NO: 725216 - DNA, 20 bp, mouse
gaaagctgtaggtcatgaaa

SEQ ID NO: 725217 - DNA, 20 bp, mouse
gaggttcctcacagacccag

SEQ ID NO: 725218 - DNA, 20 bp, mouse
gatgacctacagctttaact

SEQ ID NO: 725219 - DNA, 20 bp, mouse
gacaggaatagtcctcattc

SEQ ID NO: 725220 - DNA, 20 bp, mouse
gctcaaagtacgaagtcaac

SEQ ID NO: 725221 - DNA, 20 bp, mouse
gttatgaaagagaaagcagt

SEQ ID NO: 725222 - DNA, 20 bp, mouse
gagcaacatcctcaccccct

SEQ ID NO: 725223 - DNA, 20 bp, mouse
ggaccagcagctgaagcaag

SEQ ID NO: 725224 - DNA, 20 bp, mouse
gctctggcacttgtgttctt

SEQ ID NO: 725225 - DNA, 20 bp, mouse
gacccagagtagtaagtgag

SEQ ID NO: 725226 - DNA, 20 bp, mouse
gagagggctcactcccccta

SEQ ID NO: 725227 - DNA, 20 bp, mouse
gttgcaggctagtgccccta

SEQ ID NO: 725228 - DNA, 20 bp, mouse
gactgcctgcggaaaccaat

SEQ ID NO: 725229 - DNA, 20 bp, mouse
gagaaagccttcatcctagt

SEQ ID NO: 725230 - DNA, 20 bp, mouse
gtgaagcctgttaacagata

SEQ ID NO: 725231 - DNA, 20 bp, mouse
gtcctgcagagcttcccact

SEQ ID NO: 725232 - DNA, 20 bp, mouse
gcctgcggaaaccaataggg

SEQ ID NO: 725233 - DNA, 20 bp, mouse
gggttcagtttcaagcttta

SEQ ID NO: 725234 - DNA, 20 bp, mouse
gtatgggtctgctggcttgc

SEQ ID NO: 725235 - DNA, 20 bp, mouse
ggtaaacaagctgaaactcc

SEQ ID NO: 725236 - DNA, 20 bp, mouse
ggtcccggaagtggctgtca

SEQ ID NO: 725237 - DNA, 20 bp, mouse
ggaccctgacagccacttcc

SEQ ID NO: 725238 - DNA, 20 bp, mouse
ggtctgaggcctgaaggcgg

SEQ ID NO: 725239 - DNA, 20 bp, mouse
gaggagggtgccaggcacca

SEQ ID NO: 725240 - DNA, 20 bp, mouse
gggtccccatcctcatgtta

SEQ ID NO: 725241 - DNA, 20 bp, mouse
gaagttccaagtcccggaag

SEQ ID NO: 725242 - DNA, 20 bp, mouse
ggccttgagtggagaagtgg

SEQ ID NO: 725243 - DNA, 20 bp, mouse
gggaaacagccttttagggg

SEQ ID NO: 725244 - DNA, 20 bp, mouse
gaggagggaaacagcctttt

SEQ ID NO: 725245 - DNA, 20 bp, mouse
gcggccaggtgcgcaggtca

SEQ ID NO: 725246 - DNA, 20 bp, mouse
gaatatgggcatttctgcac

SEQ ID NO: 725247 - DNA, 20 bp, mouse
gaataggataggtaacatca

SEQ ID NO: 725248 - DNA, 20 bp, mouse
gctagattttagaatctaat

SEQ ID NO: 725249 - DNA, 20 bp, mouse
ggacaagatatatgtgttca

SEQ ID NO: 725250 - DNA, 20 bp, mouse
gttttagaatctaataggat

SEQ ID NO: 725251 - DNA, 20 bp, mouse
gtgtgtggccacaaacataa

SEQ ID NO: 725252 - DNA, 20 bp, mouse
gtataaccaggtgtgcttgg

SEQ ID NO: 725253 - DNA, 20 bp, mouse
gggatataaccaggtgtgct

SEQ ID NO: 725254 - DNA, 20 bp, mouse
gcttcaggcctttatgtttg

SEQ ID NO: 725255 - DNA, 20 bp, mouse
ggcaggccaccaagcacacc

SEQ ID NO: 725256 - DNA, 20 bp, mouse
ggggccagctacatcatcag

SEQ ID NO: 725257 - DNA, 20 bp, mouse
gagtgggagcccgggtgagt

SEQ ID NO: 725258 - DNA, 20 bp, mouse
gggttgcagcccactcaccc

SEQ ID NO: 725259 - DNA, 20 bp, mouse
gtacatcatcagtgggagcc

SEQ ID NO: 725260 - DNA, 20 bp, mouse
gctcccactgatgatgtagc

SEQ ID NO: 725261 - DNA, 20 bp, mouse
gagcacacaatggcttacaa

SEQ ID NO: 725262 - DNA, 20 bp, mouse
gacacacagagctctggctt

SEQ ID NO: 725263 - DNA, 20 bp, mouse
gagtattcaaggtgatcaaa

SEQ ID NO: 725264 - DNA, 20 bp, mouse
gactgaaacaaaaagaaaaa

SEQ ID NO: 725265 - DNA, 20 bp, mouse
gaggtcagcagagagcaatt

SEQ ID NO: 725266 - DNA, 20 bp, mouse
gaagtctccttgctatccaa

SEQ ID NO: 725267 - DNA, 20 bp, mouse
gttatcacctttggatagca

SEQ ID NO: 725268 - DNA, 20 bp, mouse
gtcaagccaaacttttcttg

SEQ ID NO: 725269 - DNA, 20 bp, mouse
gagtagagaaacttgtcttt

SEQ ID NO: 725270 - DNA, 20 bp, mouse
ggtgttcaaggtgggcaaag

SEQ ID NO: 725271 - DNA, 20 bp, mouse
gacactaaaagaaatcagat

SEQ ID NO: 725272 - DNA, 20 bp, mouse
gactgaaacaaaaagaaaaa

SEQ ID NO: 725273 - DNA, 20 bp, mouse
gccccccccccagagagctc

SEQ ID NO: 725274 - DNA, 20 bp, mouse
gtacatcctcaagaaaagtt

SEQ ID NO: 725275 - DNA, 20 bp, mouse
gcaagccagagctctctggg

SEQ ID NO: 725276 - DNA, 20 bp, mouse
ggagacatctggatgggcgg

SEQ ID NO: 725277 - DNA, 20 bp, mouse
gaggcatcctcaaacttgtt

SEQ ID NO: 725278 - DNA, 20 bp, mouse
gtccgcgagctgattgggta

SEQ ID NO: 725279 - DNA, 20 bp, mouse
gcacccagttaactacatcc

SEQ ID NO: 725280 - DNA, 20 bp, mouse
ggctccgggcaatcttgtat

SEQ ID NO: 725281 - DNA, 20 bp, mouse
ggctgccgcccgtgacaggc

SEQ ID NO: 725282 - DNA, 20 bp, mouse
gtatcggctaccctagtgct

SEQ ID NO: 725283 - DNA, 20 bp, mouse
gtacagctgaccttaggctc

SEQ ID NO: 725284 - DNA, 20 bp, mouse
gcaagattgcccggagccta

SEQ ID NO: 725285 - DNA, 20 bp, mouse
gtggcgaggcagttccgggg

SEQ ID NO: 725286 - DNA, 20 bp, mouse
gtagggaggcggcaccggga

SEQ ID NO: 725287 - DNA, 20 bp, mouse
gcaccgggagggcggagtta

SEQ ID NO: 725288 - DNA, 20 bp, mouse
ggaagtccgcgcaaggagag

SEQ ID NO: 725289 - DNA, 20 bp, mouse
gcccgggcattgtcccgctc

SEQ ID NO: 725290 - DNA, 20 bp, mouse
gcggagagagtgtcaatgtt

SEQ ID NO: 725291 - DNA, 20 bp, mouse
gccagcctcccgcccccgtg

SEQ ID NO: 725292 - DNA, 20 bp, mouse
gcggccgacaatgttttcat

SEQ ID NO: 725293 - DNA, 20 bp, mouse
ggggcggagttatggctaga

SEQ ID NO: 725294 - DNA, 20 bp, mouse
gaagaatgaaccaatgagag

SEQ ID NO: 725295 - DNA, 20 bp, mouse
gagtgtcaatgtttggtcgg

SEQ ID NO: 725296 - DNA, 20 bp, mouse
gttacccggggaagaagaca

SEQ ID NO: 725297 - DNA, 20 bp, mouse
gcggagtggccgcaagccgg

SEQ ID NO: 725298 - DNA, 20 bp, mouse
gagagaacgcgcccagtgat

SEQ ID NO: 725299 - DNA, 20 bp, mouse
ggggcgcgttctctcagcta

SEQ ID NO: 725300 - DNA, 20 bp, mouse
ggctaaggcgcgtcaccgaa

SEQ ID NO: 725301 - DNA, 20 bp, mouse
gcccggccttataaactccc

SEQ ID NO: 725302 - DNA, 20 bp, mouse
gggctgctcacccctggaaa

SEQ ID NO: 725303 - DNA, 20 bp, mouse
gggaaccaatcaggaggaag

SEQ ID NO: 725304 - DNA, 20 bp, mouse
gcagaggtgggtattaaaaa

SEQ ID NO: 725305 - DNA, 20 bp, mouse
gcaaaacctgaagactagaa

SEQ ID NO: 725306 - DNA, 20 bp, mouse
gcccccccgcccccaggcat

SEQ ID NO: 725307 - DNA, 20 bp, mouse
gcaggccggggtcaaggccg

SEQ ID NO: 725308 - DNA, 20 bp, mouse
gcaaggcctgggtacaaccg

SEQ ID NO: 725309 - DNA, 20 bp, mouse
gggcgccccggccttgaccc

SEQ ID NO: 725310 - DNA, 20 bp, mouse
gcaaccgaggctggcgtcgt

SEQ ID NO: 725311 - DNA, 20 bp, mouse
gggacgcgcgaggccgggaa

SEQ ID NO: 725312 - DNA, 20 bp, mouse
gtcaaggccggggcgccgag

SEQ ID NO: 725313 - DNA, 20 bp, mouse
gcagaccgatgcctgggggc

SEQ ID NO: 725314 - DNA, 20 bp, mouse
gctggcgtcgttggcgtccg

SEQ ID NO: 725315 - DNA, 20 bp, mouse
gcgggaagggatgtgacgag

SEQ ID NO: 725316 - DNA, 20 bp, mouse
gggccagttcgcggagctgt

SEQ ID NO: 725317 - DNA, 20 bp, mouse
ggggtccgggggctttcgtg

SEQ ID NO: 725318 - DNA, 20 bp, mouse
ggaaccacagggccagttcg

SEQ ID NO: 725319 - DNA, 20 bp, mouse
gaaagcccccggacccgtcg

SEQ ID NO: 725320 - DNA, 20 bp, mouse
gacaccgcttccctagagcc

SEQ ID NO: 725321 - DNA, 20 bp, mouse
gcggacccgtcgcggagcct

SEQ ID NO: 725322 - DNA, 20 bp, mouse
ggccagcccaggctccgcga

SEQ ID NO: 725323 - DNA, 20 bp, mouse
gtccctagagcccggcacgg

SEQ ID NO: 725324 - DNA, 20 bp, mouse
ggaccacaaggcctccgtgc

SEQ ID NO: 725325 - DNA, 20 bp, mouse
gcctgtggttccactgcaga

SEQ ID NO: 725326 - DNA, 20 bp, mouse
gcgggagctcgagcgatgat

SEQ ID NO: 725327 - DNA, 20 bp, mouse
gggcgcgtgggggatgagtt

SEQ ID NO: 725328 - DNA, 20 bp, mouse
gggtctccggagcaccgcgg

SEQ ID NO: 725329 - DNA, 20 bp, mouse
gccaccgagcgagtggacgg

SEQ ID NO: 725330 - DNA, 20 bp, mouse
gagaacgcacagcggagtgg

SEQ ID NO: 725331 - DNA, 20 bp, mouse
gagaagaaggggcgccgcgg

SEQ ID NO: 725332 - DNA, 20 bp, mouse
ggatgcggcgggacgaggac

SEQ ID NO: 725333 - DNA, 20 bp, mouse
gccgctgtgcgttctcccat

SEQ ID NO: 725334 - DNA, 20 bp, mouse
gacgaggaccgggagaagaa

SEQ ID NO: 725335 - DNA, 20 bp, mouse
gcgagcgatgattggcgcgt

SEQ ID NO: 725336 - DNA, 20 bp, mouse
ggagaaactagaaggtcctg

SEQ ID NO: 725337 - DNA, 20 bp, mouse
ggattgggcaatgtgttgtc

SEQ ID NO: 725338 - DNA, 20 bp, mouse
gctctcatggagaaactaga

SEQ ID NO: 725339 - DNA, 20 bp, mouse
gggtactgagtatgattgga

SEQ ID NO: 725340 - DNA, 20 bp, mouse
gtagttggcacctatggtcg

SEQ ID NO: 725341 - DNA, 20 bp, mouse
gctggggattccgcgaccat

SEQ ID NO: 725342 - DNA, 20 bp, mouse
gtaaaggcatgtgcataata

SEQ ID NO: 725343 - DNA, 20 bp, mouse
gaaccaacttgacatttgat

SEQ ID NO: 725344 - DNA, 20 bp, mouse
gtctttctagttggcaccta

SEQ ID NO: 725345 - DNA, 20 bp, mouse
ggtccaatcaaatgtcaagt

SEQ ID NO: 725346 - DNA, 20 bp, mouse
gaacgagcgcgcggggggag

SEQ ID NO: 725347 - DNA, 20 bp, mouse
ggagaggcggcgggaggaat

SEQ ID NO: 725348 - DNA, 20 bp, mouse
gccagcgaacgagcgcgcgg

SEQ ID NO: 725349 - DNA, 20 bp, mouse
gacgccgaggggcccgccga

SEQ ID NO: 725350 - DNA, 20 bp, mouse
ggggcggggcggcgtgtgta

SEQ ID NO: 725351 - DNA, 20 bp, mouse
gcgcctgcgtccgacgggga

SEQ ID NO: 725352 - DNA, 20 bp, mouse
gtacacaccgcgagaggcgg

SEQ ID NO: 725353 - DNA, 20 bp, mouse
ggtgggccggggacggacta

SEQ ID NO: 725354 - DNA, 20 bp, mouse
gagggcagacggcccctcgg

SEQ ID NO: 725355 - DNA, 20 bp, mouse
gggcgggaggaatgggcggg

SEQ ID NO: 725356 - DNA, 20 bp, mouse
gtaaatatggaggcgtcggg

SEQ ID NO: 725357 - DNA, 20 bp, mouse
gtggctgttacaattgcttc

SEQ ID NO: 725358 - DNA, 20 bp, mouse
gcgccaatcgaaaaagtcgt

SEQ ID NO: 725359 - DNA, 20 bp, mouse
ggaatcagagtttagcacta

SEQ ID NO: 725360 - DNA, 20 bp, mouse
gcggtgttcaggccactgat

SEQ ID NO: 725361 - DNA, 20 bp, mouse
gaggaaacggccccgaagta

SEQ ID NO: 725362 - DNA, 20 bp, mouse
gtcgggagatgtcagcgcgt

SEQ ID NO: 725363 - DNA, 20 bp, mouse
gctgacatctcccgacacaa

SEQ ID NO: 725364 - DNA, 20 bp, mouse
gcgacacaaaggccgtactt

SEQ ID NO: 725365 - DNA, 20 bp, mouse
gcgttggtgtatgcaaatca

SEQ ID NO: 725366 - DNA, 20 bp, mouse
gttctgcagcaacttcacac

SEQ ID NO: 725367 - DNA, 20 bp, mouse
ggtgttgtcctggaatcccc

SEQ ID NO: 725368 - DNA, 20 bp, mouse
gtgcagcaacttcacaccgg

SEQ ID NO: 725369 - DNA, 20 bp, mouse
gtgtcctggaacgaccaggc

SEQ ID NO: 725370 - DNA, 20 bp, mouse
gtatactgtacatgctcatt

SEQ ID NO: 725371 - DNA, 20 bp, mouse
ggaaaagaaatacgaggagt

SEQ ID NO: 725372 - DNA, 20 bp, mouse
gccgggtagtggtgtctcac

SEQ ID NO: 725373 - DNA, 20 bp, mouse
ggttggcttatgtgttgtcc

SEQ ID NO: 725374 - DNA, 20 bp, mouse
gggagaggaaatcgaaaccc

SEQ ID NO: 725375 - DNA, 20 bp, mouse
gcttcacaccgggggattcc

SEQ ID NO: 725376 - DNA, 20 bp, mouse
gtggctggagaaccacccgg

SEQ ID NO: 725377 - DNA, 20 bp, mouse
gcggcctcgcttgcttccga

SEQ ID NO: 725378 - DNA, 20 bp, mouse
gcagtgggacgtggcttcgg

SEQ ID NO: 725379 - DNA, 20 bp, mouse
gagttctgagccgatcactg

SEQ ID NO: 725380 - DNA, 20 bp, mouse
gtcactgcaaccattctagt

SEQ ID NO: 725381 - DNA, 20 bp, mouse
gtcctggctggagaaccacc

SEQ ID NO: 725382 - DNA, 20 bp, mouse
gaagcaagcgaggccgggcc

SEQ ID NO: 725383 - DNA, 20 bp, mouse
gcagccttcggaagcaagcg

SEQ ID NO: 725384 - DNA, 20 bp, mouse
gaggtccgggttttgcttgt

SEQ ID NO: 725385 - DNA, 20 bp, mouse
gcgggggtgtcagtctgatg

SEQ ID NO: 725386 - DNA, 20 bp, mouse
gggcaccggaacctcctcca

SEQ ID NO: 725387 - DNA, 20 bp, mouse
ggaagccatggaggaggttc

SEQ ID NO: 725388 - DNA, 20 bp, mouse
gagggaaacggaagcaactg

SEQ ID NO: 725389 - DNA, 20 bp, mouse
gagtctgacaatattggacc

SEQ ID NO: 725390 - DNA, 20 bp, mouse
gacaatattggaccagggcg

SEQ ID NO: 725391 - DNA, 20 bp, mouse
gatattggaccagggcgtgg

SEQ ID NO: 725392 - DNA, 20 bp, mouse
gcttataagtctgacaatat

SEQ ID NO: 725393 - DNA, 20 bp, mouse
ggtaacctggatccttatcc

SEQ ID NO: 725394 - DNA, 20 bp, mouse
gttccagccaggaggcgcgc

SEQ ID NO: 725395 - DNA, 20 bp, mouse
gcttactttgcttaacatag

SEQ ID NO: 725396 - DNA, 20 bp, mouse
ggcagaagaaagacaagttc

SEQ ID NO: 725397 - DNA, 20 bp, mouse
gtagacaaatccctcagggt

SEQ ID NO: 725398 - DNA, 20 bp, mouse
gcacagcgctgctaaaagta

SEQ ID NO: 725399 - DNA, 20 bp, mouse
gtaggaggaaggaatggcat

SEQ ID NO: 725400 - DNA, 20 bp, mouse
gccaagtcacggtgtatact

SEQ ID NO: 725401 - DNA, 20 bp, mouse
gcaatttcgggctaggaggt

SEQ ID NO: 725402 - DNA, 20 bp, mouse
gaccttaggaaaagtgttcg

SEQ ID NO: 725403 - DNA, 20 bp, mouse
gagaaagacaagttctggct

SEQ ID NO: 725404 - DNA, 20 bp, mouse
gaaagtagacaaatccctca

SEQ ID NO: 725405 - DNA, 20 bp, mouse
gactccaagctccacctggc

SEQ ID NO: 725406 - DNA, 20 bp, mouse
gggcacgccccctaactcgg

SEQ ID NO: 725407 - DNA, 20 bp, mouse
gtacccctagagatgctaag

SEQ ID NO: 725408 - DNA, 20 bp, mouse
gagcagctgtccgacagcaa

SEQ ID NO: 725409 - DNA, 20 bp, mouse
ggaagctagcgcagaggagg

SEQ ID NO: 725410 - DNA, 20 bp, mouse
gtcctccgcgcccccgagtt

SEQ ID NO: 725411 - DNA, 20 bp, mouse
ggaggcggggcctcgggcat

SEQ ID NO: 725412 - DNA, 20 bp, mouse
gtccgcgcccccgagttagg

SEQ ID NO: 725413 - DNA, 20 bp, mouse
gtggggcgaagctagcgcag

SEQ ID NO: 725414 - DNA, 20 bp, mouse
gacccaggatacaaccgaca

SEQ ID NO: 725415 - DNA, 20 bp, mouse
gttaacttgcatccccatgt

SEQ ID NO: 725416 - DNA, 20 bp, mouse
ggaccactctggagtgaggt

SEQ ID NO: 725417 - DNA, 20 bp, mouse
gtgagcagctgctatgtggg

SEQ ID NO: 725418 - DNA, 20 bp, mouse
gacatctataacccagatat

SEQ ID NO: 725419 - DNA, 20 bp, mouse
gctcttgataatggctcatt

SEQ ID NO: 725420 - DNA, 20 bp, mouse
gaaaaagtgatcccgtgatc

SEQ ID NO: 725421 - DNA, 20 bp, mouse
gcaaattccattaagaacaa

SEQ ID NO: 725422 - DNA, 20 bp, mouse
gcagccaggaaataccggtt

SEQ ID NO: 725423 - DNA, 20 bp, mouse
gtggccaaaccggtatttcc

SEQ ID NO: 725424 - DNA, 20 bp, mouse
gtcatgtatgctcttgataa

SEQ ID NO: 725425 - DNA, 20 bp, mouse
gaaccagctgggaaaaatac

SEQ ID NO: 725426 - DNA, 20 bp, mouse
gtccagagcaactaggtgtt

SEQ ID NO: 725427 - DNA, 20 bp, mouse
gagacccgcctcctgggaca

SEQ ID NO: 725428 - DNA, 20 bp, mouse
gatgctggccatgtcccagg

SEQ ID NO: 725429 - DNA, 20 bp, mouse
gagagcaactaggtgttggg

SEQ ID NO: 725430 - DNA, 20 bp, mouse
gccggcgtgtgtgcaggggc

SEQ ID NO: 725431 - DNA, 20 bp, mouse
gtgctccggcgtgtgtgcag

SEQ ID NO: 725432 - DNA, 20 bp, mouse
gctggactctggtacctact

SEQ ID NO: 725433 - DNA, 20 bp, mouse
gaatcccctgccactctgag

SEQ ID NO: 725434 - DNA, 20 bp, mouse
ggggccagacctccgtgctc

SEQ ID NO: 725435 - DNA, 20 bp, mouse
gtgagcacaaggaggactga

SEQ ID NO: 725436 - DNA, 20 bp, mouse
gtggggaatgtcagtctcga

SEQ ID NO: 725437 - DNA, 20 bp, mouse
gtcaaggggtgccttgtctt

SEQ ID NO: 725438 - DNA, 20 bp, mouse
gtgggtgcaggtaggagcta

SEQ ID NO: 725439 - DNA, 20 bp, mouse
gagggaatgttcaatgctgt

SEQ ID NO: 725440 - DNA, 20 bp, mouse
ggattccggaacgaatggag

SEQ ID NO: 725441 - DNA, 20 bp, mouse
gtaaacaaatggcaacttgg

SEQ ID NO: 725442 - DNA, 20 bp, mouse
ggctgtaggtctggatgtat

SEQ ID NO: 725443 - DNA, 20 bp, mouse
gaaagagccgcatggcttgt

SEQ ID NO: 725444 - DNA, 20 bp, mouse
gctagcagtaatctcagagg

SEQ ID NO: 725445 - DNA, 20 bp, mouse
gaggatgcaaattattaact

SEQ ID NO: 725446 - DNA, 20 bp, mouse
gagtgggaggggataaagtg

SEQ ID NO: 725447 - DNA, 20 bp, mouse
gcgccccagccaatgagcgc

SEQ ID NO: 725448 - DNA, 20 bp, mouse
ggggcgcacgaagacccaat

SEQ ID NO: 725449 - DNA, 20 bp, mouse
gcgcccacaggctatagagt

SEQ ID NO: 725450 - DNA, 20 bp, mouse
gcgtgcgccccggggccgaa

SEQ ID NO: 725451 - DNA, 20 bp, mouse
gggcgcacaccggcgagaga

SEQ ID NO: 725452 - DNA, 20 bp, mouse
gtggtggtatggggcttggg

SEQ ID NO: 725453 - DNA, 20 bp, mouse
gctgtgggcgtggtggtatg

SEQ ID NO: 725454 - DNA, 20 bp, mouse
gtggacacgcccttcggccc

SEQ ID NO: 725455 - DNA, 20 bp, mouse
ggctgcaagccttctctcgc

SEQ ID NO: 725456 - DNA, 20 bp, mouse
ggggaactgtagtttcgagc

SEQ ID NO: 725457 - DNA, 20 bp, mouse
gcgacggagccacgcctcta

SEQ ID NO: 725458 - DNA, 20 bp, mouse
gcaccacatagatgccatag

SEQ ID NO: 725459 - DNA, 20 bp, mouse
gcatctatgtggtgatctgt

SEQ ID NO: 725460 - DNA, 20 bp, mouse
ggaaaggcgcgagcgagcgg

SEQ ID NO: 725461 - DNA, 20 bp, mouse
gtggggtgtgttagaaccga

SEQ ID NO: 725462 - DNA, 20 bp, mouse
ggcggccccgcttccctcct

SEQ ID NO: 725463 - DNA, 20 bp, mouse
gaaccagaccgcgctggggt

SEQ ID NO: 725464 - DNA, 20 bp, mouse
gcgcctctatggcatctatg

SEQ ID NO: 725465 - DNA, 20 bp, mouse
gaggcttcgcgagcccagga

SEQ ID NO: 725466 - DNA, 20 bp, mouse
gaggggatggcacatctgga

SEQ ID NO: 725467 - DNA, 20 bp, mouse
gggaacgtgcacatgatgtg

SEQ ID NO: 725468 - DNA, 20 bp, mouse
ggtaagaaacccaatctctg

SEQ ID NO: 725469 - DNA, 20 bp, mouse
gtcgtcccgcctcctgctga

SEQ ID NO: 725470 - DNA, 20 bp, mouse
ggagtccggaaaagactgac

SEQ ID NO: 725471 - DNA, 20 bp, mouse
gctagtggaggacaaaacca

SEQ ID NO: 725472 - DNA, 20 bp, mouse
ggggacaagaagtcagtcct

SEQ ID NO: 725473 - DNA, 20 bp, mouse
ggtagcgatacagctcagtc

SEQ ID NO: 725474 - DNA, 20 bp, mouse
gagctgtatcgctaccctag

SEQ ID NO: 725475 - DNA, 20 bp, mouse
gatggaggggatggcacatc

SEQ ID NO: 725476 - DNA, 20 bp, mouse
gagaggtcccggagcgtcgt

SEQ ID NO: 725477 - DNA, 20 bp, mouse
gagtcctggcaccgccctct

SEQ ID NO: 725478 - DNA, 20 bp, mouse
gaaccccggatagagaacac

SEQ ID NO: 725479 - DNA, 20 bp, mouse
ggggtcggcgacgttggggg

SEQ ID NO: 725480 - DNA, 20 bp, mouse
gggtgggtggggcgtgttcg

SEQ ID NO: 725481 - DNA, 20 bp, mouse
gactacaggttgtctcttgg

SEQ ID NO: 725482 - DNA, 20 bp, mouse
ggaccccgcccacgacgctc

SEQ ID NO: 725483 - DNA, 20 bp, mouse
gtgtgcaggaggcgggtggg

SEQ ID NO: 725484 - DNA, 20 bp, mouse
ggcggggtcggcgacgttgg

SEQ ID NO: 725485 - DNA, 20 bp, mouse
gctgcagcttgtgcaggagg

SEQ ID NO: 725486 - DNA, 20 bp, mouse
gtagttgagagcaagaggta

SEQ ID NO: 725487 - DNA, 20 bp, mouse
ggggagccgcccctcggcgt

SEQ ID NO: 725488 - DNA, 20 bp, mouse
gaaaactgccgctgccaaca

SEQ ID NO: 725489 - DNA, 20 bp, mouse
gatggcgggcggggcgagag

SEQ ID NO: 725490 - DNA, 20 bp, mouse
gttctctgaaggtgagacta

SEQ ID NO: 725491 - DNA, 20 bp, mouse
ggggcagcccgtaaatgccg

SEQ ID NO: 725492 - DNA, 20 bp, mouse
ggtccgcccacgccgagggg

SEQ ID NO: 725493 - DNA, 20 bp, mouse
ggtgagactaaggacctccg

SEQ ID NO: 725494 - DNA, 20 bp, mouse
ggccccgcccgccatcaccg

SEQ ID NO: 725495 - DNA, 20 bp, mouse
gaaacgtccgcccacgccga

SEQ ID NO: 725496 - DNA, 20 bp, mouse
gtagttgagagcaagaggta

SEQ ID NO: 725497 - DNA, 20 bp, mouse
gttctctgaaggtgagacta

SEQ ID NO: 725498 - DNA, 20 bp, mouse
ggggagccgcccctcggcgt

SEQ ID NO: 725499 - DNA, 20 bp, mouse
gctggagcgtaggatcctga

SEQ ID NO: 725500 - DNA, 20 bp, mouse
gatggcgggcggggcgagag

SEQ ID NO: 725501 - DNA, 20 bp, mouse
ggtgagactaaggacctccg

SEQ ID NO: 725502 - DNA, 20 bp, mouse
ggggcagcccgtaaatgccg

SEQ ID NO: 725503 - DNA, 20 bp, mouse
gactaaggacctccgaggag

SEQ ID NO: 725504 - DNA, 20 bp, mouse
gttaggacaccctgccggac

SEQ ID NO: 725505 - DNA, 20 bp, mouse
gaggacgaaagctcttctag

SEQ ID NO: 725506 - DNA, 20 bp, mouse
gcggcgcggcggtgcgagac

SEQ ID NO: 725507 - DNA, 20 bp, mouse
gtggctgtgaactctatggg

SEQ ID NO: 725508 - DNA, 20 bp, mouse
gggcaggagctactactgat

SEQ ID NO: 725509 - DNA, 20 bp, mouse
gtgcaagtgggtgttggagg

SEQ ID NO: 725510 - DNA, 20 bp, mouse
gcagccttggcctgtagact

SEQ ID NO: 725511 - DNA, 20 bp, mouse
gctacaggccaaggctgcta

SEQ ID NO: 725512 - DNA, 20 bp, mouse
gagaccgagtctacaggcca

SEQ ID NO: 725513 - DNA, 20 bp, mouse
gcgactgccccagagagacg

SEQ ID NO: 725514 - DNA, 20 bp, mouse
gggcggtcactgatggattg

SEQ ID NO: 725515 - DNA, 20 bp, mouse
gggttggctgtgaactctat

SEQ ID NO: 725516 - DNA, 20 bp, mouse
ggagaagtgggcataatcat

SEQ ID NO: 725517 - DNA, 20 bp, mouse
gtgggcagcggccacactcc

SEQ ID NO: 725518 - DNA, 20 bp, mouse
gcagaagggacctcacgcac

SEQ ID NO: 725519 - DNA, 20 bp, mouse
gtgggcataatcatgggtag

SEQ ID NO: 725520 - DNA, 20 bp, mouse
gcagggaagtggtgatgtcg

SEQ ID NO: 725521 - DNA, 20 bp, mouse
gatcatgggtagtggaccgc

SEQ ID NO: 725522 - DNA, 20 bp, mouse
gagacctgatggacgacggc

SEQ ID NO: 725523 - DNA, 20 bp, mouse
ggggcctactgtaccaggag

SEQ ID NO: 725524 - DNA, 20 bp, mouse
gggaagtggtgatgtcgcgg

SEQ ID NO: 725525 - DNA, 20 bp, mouse
gccacactccaggactagat

SEQ ID NO: 725526 - DNA, 20 bp, mouse
ggtgcaggagacagggatat

SEQ ID NO: 725527 - DNA, 20 bp, mouse
ggtgtctgctggggtgtggt

SEQ ID NO: 725528 - DNA, 20 bp, mouse
gctggtcagaaggacttcca

SEQ ID NO: 725529 - DNA, 20 bp, mouse
gtggatgctgaactaggtgc

SEQ ID NO: 725530 - DNA, 20 bp, mouse
gtgaactaggtgcaggagac

SEQ ID NO: 725531 - DNA, 20 bp, mouse
gcctagttcagcatccagaa

SEQ ID NO: 725532 - DNA, 20 bp, mouse
gaatggggattgctacactc

SEQ ID NO: 725533 - DNA, 20 bp, mouse
gtgtgaatggctaaaggcaa

SEQ ID NO: 725534 - DNA, 20 bp, mouse
gccagggtcagagaactaca

SEQ ID NO: 725535 - DNA, 20 bp, mouse
ggtagcactgggcactggca

SEQ ID NO: 725536 - DNA, 20 bp, mouse
gttagccctggagtccaccg

SEQ ID NO: 725537 - DNA, 20 bp, mouse
gaatgagtcagagcaaaatg

SEQ ID NO: 725538 - DNA, 20 bp, mouse
ggggtgcatcccagcatttt

SEQ ID NO: 725539 - DNA, 20 bp, mouse
gtagtgactgctgcctcggg

SEQ ID NO: 725540 - DNA, 20 bp, mouse
gtttggcgccactattttct

SEQ ID NO: 725541 - DNA, 20 bp, mouse
gttcacagtggtctccacgg

SEQ ID NO: 725542 - DNA, 20 bp, mouse
gtttgtgtcagcattagccc

SEQ ID NO: 725543 - DNA, 20 bp, mouse
gtgattagtgactgctgcct

SEQ ID NO: 725544 - DNA, 20 bp, mouse
gctcatgggcctaaaatgct

SEQ ID NO: 725545 - DNA, 20 bp, mouse
gggctgcaggcttgtgtccc

SEQ ID NO: 725546 - DNA, 20 bp, mouse
gagccacagggtagcatcac

SEQ ID NO: 725547 - DNA, 20 bp, mouse
gcacctgtgatgctaccctg

SEQ ID NO: 725548 - DNA, 20 bp, mouse
gggctggaggcttgtgtcca

SEQ ID NO: 725549 - DNA, 20 bp, mouse
gctcaattccaagaagatag

SEQ ID NO: 725550 - DNA, 20 bp, mouse
ggtgcatcccagcatgagtt

SEQ ID NO: 725551 - DNA, 20 bp, mouse
gcatcatatggtcttctcgg

SEQ ID NO: 725552 - DNA, 20 bp, mouse
gggaattgagtcaaggcaaa

SEQ ID NO: 725553 - DNA, 20 bp, mouse
gattgagtcaaggcaaaagg

SEQ ID NO: 725554 - DNA, 20 bp, mouse
ggaatatttctgagagccac

SEQ ID NO: 725555 - DNA, 20 bp, mouse
gttctcggtggactccatgg

SEQ ID NO: 725556 - DNA, 20 bp, mouse
gtcccctcctggaagggcgg

SEQ ID NO: 725557 - DNA, 20 bp, mouse
ggggtggtaggttcagtaca

SEQ ID NO: 725558 - DNA, 20 bp, mouse
gtagcccccgcccttccagg

SEQ ID NO: 725559 - DNA, 20 bp, mouse
ggggctacgaacttgaggcc

SEQ ID NO: 725560 - DNA, 20 bp, mouse
gcccttccaggaggggaact

SEQ ID NO: 725561 - DNA, 20 bp, mouse
gggcgggttttcagtccctg

SEQ ID NO: 725562 - DNA, 20 bp, mouse
gtgggcgagaactggatctc

SEQ ID NO: 725563 - DNA, 20 bp, mouse
gtctagccggagccaatggc

SEQ ID NO: 725564 - DNA, 20 bp, mouse
gtcgtagcccccgcccttcc

SEQ ID NO: 725565 - DNA, 20 bp, mouse
ggggagggacataggcgggg

SEQ ID NO: 725566 - DNA, 20 bp, mouse
ggctcctcacgccaatcccg

SEQ ID NO: 725567 - DNA, 20 bp, mouse
gccgccccgggattggcgtg

SEQ ID NO: 725568 - DNA, 20 bp, mouse
gattgccgaggtcctcttct

SEQ ID NO: 725569 - DNA, 20 bp, mouse
gcaaaactataggagactgt

SEQ ID NO: 725570 - DNA, 20 bp, mouse
gggacaaccaatcctagaag

SEQ ID NO: 725571 - DNA, 20 bp, mouse
ggggtggggtgaatagagaa

SEQ ID NO: 725572 - DNA, 20 bp, mouse
gcataagataattaaaacgg

SEQ ID NO: 725573 - DNA, 20 bp, mouse
gcagcccagcacaaaactat

SEQ ID NO: 725574 - DNA, 20 bp, mouse
gttcacgttgctaattgccg

SEQ ID NO: 725575 - DNA, 20 bp, mouse
gtagcctggtcaaagagact

SEQ ID NO: 725576 - DNA, 20 bp, mouse
ggaggtagcagaaacgggta

SEQ ID NO: 725577 - DNA, 20 bp, mouse
gacgtagagtcgagctgagg

SEQ ID NO: 725578 - DNA, 20 bp, mouse
gctgaggaggtagcagaaac

SEQ ID NO: 725579 - DNA, 20 bp, mouse
gtagcagaaacgggtagggt

SEQ ID NO: 725580 - DNA, 20 bp, mouse
gtctacgtgctttccaccac

SEQ ID NO: 725581 - DNA, 20 bp, mouse
gttacaggctagccacccag

SEQ ID NO: 725582 - DNA, 20 bp, mouse
gcaaataacggaattgtctg

SEQ ID NO: 725583 - DNA, 20 bp, mouse
gtcatcaaaggcgatttgtt

SEQ ID NO: 725584 - DNA, 20 bp, mouse
gactttgacatttcatttac

SEQ ID NO: 725585 - DNA, 20 bp, mouse
gtacttgatgcctgaaccat

SEQ ID NO: 725586 - DNA, 20 bp, mouse
gtgcctggggtgtggtaact

SEQ ID NO: 725587 - DNA, 20 bp, mouse
ggggctgcataagaatactg

SEQ ID NO: 725588 - DNA, 20 bp, mouse
gggaaaaggaacatttgcct

SEQ ID NO: 725589 - DNA, 20 bp, mouse
ggtaggatataagtgatttc

SEQ ID NO: 725590 - DNA, 20 bp, mouse
gggaagttatggttaatggt

SEQ ID NO: 725591 - DNA, 20 bp, mouse
gaatagtggggactcaggac

SEQ ID NO: 725592 - DNA, 20 bp, mouse
gccatgggcaggaaaatagt

SEQ ID NO: 725593 - DNA, 20 bp, mouse
gtacccagttaccacacccc

SEQ ID NO: 725594 - DNA, 20 bp, mouse
gccttgtaaagatctagttt

SEQ ID NO: 725595 - DNA, 20 bp, mouse
gttaaaaaatatactgcaat

SEQ ID NO: 725596 - DNA, 20 bp, mouse
gcagccagtggtgacgagat

SEQ ID NO: 725597 - DNA, 20 bp, mouse
gggcgagcgcgagagtgaga

SEQ ID NO: 725598 - DNA, 20 bp, mouse
ggtccctctactcaagtcca

SEQ ID NO: 725599 - DNA, 20 bp, mouse
ggtgcctagcttattccgtg

SEQ ID NO: 725600 - DNA, 20 bp, mouse
ggtgaccgttgatcagttag

SEQ ID NO: 725601 - DNA, 20 bp, mouse
gcgaccccacggaataagct

SEQ ID NO: 725602 - DNA, 20 bp, mouse
gttagtggtgccgaggactc

SEQ ID NO: 725603 - DNA, 20 bp, mouse
gtgtaccacgcgtggcgcta

SEQ ID NO: 725604 - DNA, 20 bp, mouse
ggctcggagcgggctccact

SEQ ID NO: 725605 - DNA, 20 bp, mouse
ggaagagaaatccatcaccg

SEQ ID NO: 725606 - DNA, 20 bp, mouse
gtgtaattagaggatctggg

SEQ ID NO: 725607 - DNA, 20 bp, mouse
ggcaacaggaggtacagtgt

SEQ ID NO: 725608 - DNA, 20 bp, mouse
gggcgagtgcggtgtgggtg

SEQ ID NO: 725609 - DNA, 20 bp, mouse
gtccatgcaaacttcagggg

SEQ ID NO: 725610 - DNA, 20 bp, mouse
gtggcagaggtcctgatccg

SEQ ID NO: 725611 - DNA, 20 bp, mouse
gggtcctgatccgaggataa

SEQ ID NO: 725612 - DNA, 20 bp, mouse
gtccacaggaggtgccactc

SEQ ID NO: 725613 - DNA, 20 bp, mouse
gtccctctgctcagatccgg

SEQ ID NO: 725614 - DNA, 20 bp, mouse
gactccagagctgaatcctc

SEQ ID NO: 725615 - DNA, 20 bp, mouse
gctgaccttaagtttgtctc

SEQ ID NO: 725616 - DNA, 20 bp, mouse
gcacccaggcctttttccgg

SEQ ID NO: 725617 - DNA, 20 bp, mouse
gacccacccaggcctttttc

SEQ ID NO: 725618 - DNA, 20 bp, mouse
gtgcccaagggacgaataaa

SEQ ID NO: 725619 - DNA, 20 bp, mouse
gaacaataggggagaagaca

SEQ ID NO: 725620 - DNA, 20 bp, mouse
gccctgttacccaacaatag

SEQ ID NO: 725621 - DNA, 20 bp, mouse
gataggagaaggctggaatg

SEQ ID NO: 725622 - DNA, 20 bp, mouse
gggaaattgtgtttctaata

SEQ ID NO: 725623 - DNA, 20 bp, mouse
gaccctgagagctgtaactt

SEQ ID NO: 725624 - DNA, 20 bp, mouse
gggcacaaaccaccggaaaa

SEQ ID NO: 725625 - DNA, 20 bp, mouse
ggggccctttattcgtccct

SEQ ID NO: 725626 - DNA, 20 bp, mouse
gtggaggaggagtcaaaaga

SEQ ID NO: 725627 - DNA, 20 bp, mouse
gcacccgcagagtgctgaag

SEQ ID NO: 725628 - DNA, 20 bp, mouse
gcccccggggccaggccttt

SEQ ID NO: 725629 - DNA, 20 bp, mouse
gaagatgcaaatggagactc

SEQ ID NO: 725630 - DNA, 20 bp, mouse
gcgggggagtagctgctgtt

SEQ ID NO: 725631 - DNA, 20 bp, mouse
gtgcaagagggctctgttag

SEQ ID NO: 725632 - DNA, 20 bp, mouse
gcgtagctgtcacatcttgg

SEQ ID NO: 725633 - DNA, 20 bp, mouse
gcatactcctgatctatcta

SEQ ID NO: 725634 - DNA, 20 bp, mouse
ggagtagctgctgttagggc

SEQ ID NO: 725635 - DNA, 20 bp, mouse
gggaatccagacctgaaacc

SEQ ID NO: 725636 - DNA, 20 bp, mouse
gcgcacgcacagcacggggt

SEQ ID NO: 725637 - DNA, 20 bp, mouse
gcgtgcgcacgcacagcacg

SEQ ID NO: 725638 - DNA, 20 bp, mouse
gctctcaattccccgtgctg

SEQ ID NO: 725639 - DNA, 20 bp, mouse
ggctcactgggtggttatat

SEQ ID NO: 725640 - DNA, 20 bp, mouse
gactccacacctgggatgac

SEQ ID NO: 725641 - DNA, 20 bp, mouse
ggtcctcgtgggtgagaggt

SEQ ID NO: 725642 - DNA, 20 bp, mouse
ggacaggcgtgctgccgcat

SEQ ID NO: 725643 - DNA, 20 bp, mouse
gcctgccggtcgcgcaatcc

SEQ ID NO: 725644 - DNA, 20 bp, mouse
ggagctggaagacttgatta

SEQ ID NO: 725645 - DNA, 20 bp, mouse
gctagtcaacttagtcctcg

SEQ ID NO: 725646 - DNA, 20 bp, mouse
ggggcttcgtgtagaatgta

SEQ ID NO: 725647 - DNA, 20 bp, mouse
gtgacgcggaaggggaggtg

SEQ ID NO: 725648 - DNA, 20 bp, mouse
gggccgaggtgctgatgacg

SEQ ID NO: 725649 - DNA, 20 bp, mouse
gggcgctgacgcggaagggg

SEQ ID NO: 725650 - DNA, 20 bp, mouse
gcggctgttgcgcaccgtgg

SEQ ID NO: 725651 - DNA, 20 bp, mouse
ggggccttcttcggccccga

SEQ ID NO: 725652 - DNA, 20 bp, mouse
gggcgggcgctgacgcggaa

SEQ ID NO: 725653 - DNA, 20 bp, mouse
ggggaggtagagcgctacgg

SEQ ID NO: 725654 - DNA, 20 bp, mouse
gggtgctgatgacgcggcgt

SEQ ID NO: 725655 - DNA, 20 bp, mouse
gaatttagggagttggagac

SEQ ID NO: 725656 - DNA, 20 bp, mouse
gtcagggagcgtgagatcct

SEQ ID NO: 725657 - DNA, 20 bp, mouse
gcgtgtctggcgaaggtgga

SEQ ID NO: 725658 - DNA, 20 bp, mouse
gtttctggaactgaagtcaa

SEQ ID NO: 725659 - DNA, 20 bp, mouse
gggaactgaagtcaagggac

SEQ ID NO: 725660 - DNA, 20 bp, mouse
gagctggaaacacctgagat

SEQ ID NO: 725661 - DNA, 20 bp, mouse
gaaggtggagggaacacttc

SEQ ID NO: 725662 - DNA, 20 bp, mouse
gaaagcggggactcggtaac

SEQ ID NO: 725663 - DNA, 20 bp, mouse
gccactgcgtcgcagggcct

SEQ ID NO: 725664 - DNA, 20 bp, mouse
gcctgagatcggagttagtt

SEQ ID NO: 725665 - DNA, 20 bp, mouse
gcggagttagttcggatggt

SEQ ID NO: 725666 - DNA, 20 bp, mouse
gtggctggaggacagacatg

SEQ ID NO: 725667 - DNA, 20 bp, mouse
gcaggctggtagagtgaacg

SEQ ID NO: 725668 - DNA, 20 bp, mouse
gaaagcggggactcggtaac

SEQ ID NO: 725669 - DNA, 20 bp, mouse
gactccagggagcgcatgtg

SEQ ID NO: 725670 - DNA, 20 bp, mouse
gatggcagatcgtgctgctc

SEQ ID NO: 725671 - DNA, 20 bp, mouse
gtaggtgcgactcggatgga

SEQ ID NO: 725672 - DNA, 20 bp, mouse
gaggagctggtacgactcca

SEQ ID NO: 725673 - DNA, 20 bp, mouse
gcgactcggatggaaggaga

SEQ ID NO: 725674 - DNA, 20 bp, mouse
gagaggggtcgggacaaaac

SEQ ID NO: 725675 - DNA, 20 bp, mouse
gcgtgtctggcgaaggtgga

SEQ ID NO: 725676 - DNA, 20 bp, mouse
gtgtgaaaggccaatttgag

SEQ ID NO: 725677 - DNA, 20 bp, mouse
gagagaggcagctgagggaa

SEQ ID NO: 725678 - DNA, 20 bp, mouse
gtcaggacaagtctgaccag

SEQ ID NO: 725679 - DNA, 20 bp, mouse
gggaggtcctatctgagccg

SEQ ID NO: 725680 - DNA, 20 bp, mouse
gcggggatggggaaaatgtc

SEQ ID NO: 725681 - DNA, 20 bp, mouse
ggtggaggagggctgacgtc

SEQ ID NO: 725682 - DNA, 20 bp, mouse
gcctatctgagccggggatg

SEQ ID NO: 725683 - DNA, 20 bp, mouse
gaaaatgtcgggaattgaag

SEQ ID NO: 725684 - DNA, 20 bp, mouse
ggaagaccaacacattgcgg

SEQ ID NO: 725685 - DNA, 20 bp, mouse
ggaaaaggtaagaaggtgag

SEQ ID NO: 725686 - DNA, 20 bp, mouse
gtagactggggaacccggag

SEQ ID NO: 725687 - DNA, 20 bp, mouse
gctggggaacccggagggga

SEQ ID NO: 725688 - DNA, 20 bp, mouse
ggggagggactgggcgggat

SEQ ID NO: 725689 - DNA, 20 bp, mouse
ggcggcctctagctcagaga

SEQ ID NO: 725690 - DNA, 20 bp, mouse
ggctcagagagggctttgaa

SEQ ID NO: 725691 - DNA, 20 bp, mouse
gaggtgtagactggggaacc

SEQ ID NO: 725692 - DNA, 20 bp, mouse
gggaggagggaggtgtagac

SEQ ID NO: 725693 - DNA, 20 bp, mouse
gactgggcgggatgggaggc

SEQ ID NO: 725694 - DNA, 20 bp, mouse
gggggagtttatcaagtcga

SEQ ID NO: 725695 - DNA, 20 bp, mouse
gtctcctcaggcagtgaccg

SEQ ID NO: 725696 - DNA, 20 bp, mouse
ggggcaccgggcgctcccgc

SEQ ID NO: 725697 - DNA, 20 bp, mouse
gtgcgactctcgattcggag

SEQ ID NO: 725698 - DNA, 20 bp, mouse
ggcgcccggtgcccggccac

SEQ ID NO: 725699 - DNA, 20 bp, mouse
gggggtccctagttttctag

SEQ ID NO: 725700 - DNA, 20 bp, mouse
ggggtcgcgcgcgatactta

SEQ ID NO: 725701 - DNA, 20 bp, mouse
gctggcgctcgccagactcg

SEQ ID NO: 725702 - DNA, 20 bp, mouse
ggcgcgcgacccactgggaa

SEQ ID NO: 725703 - DNA, 20 bp, mouse
gccacgacagaccccgagtc

SEQ ID NO: 725704 - DNA, 20 bp, mouse
gccagccggtggccgggcac

SEQ ID NO: 725705 - DNA, 20 bp, mouse
ggcgccctcctccggcacca

SEQ ID NO: 725706 - DNA, 20 bp, mouse
ggctgggacgccgaagacat

SEQ ID NO: 725707 - DNA, 20 bp, mouse
ggcggcggaagtgcctcagg

SEQ ID NO: 725708 - DNA, 20 bp, mouse
gcgccgaagacatggggtga

SEQ ID NO: 725709 - DNA, 20 bp, mouse
gcaccgtgagaaggcgcccg

SEQ ID NO: 725710 - DNA, 20 bp, mouse
gtgcctagccaccgcacgtg

SEQ ID NO: 725711 - DNA, 20 bp, mouse
gagggcatcctcacgtgcgg

SEQ ID NO: 725712 - DNA, 20 bp, mouse
gagaaggtccaggcgcgcgg

SEQ ID NO: 725713 - DNA, 20 bp, mouse
gtggaccttctccctctcat

SEQ ID NO: 725714 - DNA, 20 bp, mouse
gttcggcgtcccagcctgtg

SEQ ID NO: 725715 - DNA, 20 bp, mouse
gagtggccagcaagccgcac

SEQ ID NO: 725716 - DNA, 20 bp, mouse
gaggactccagccagaaatg

SEQ ID NO: 725717 - DNA, 20 bp, mouse
gtcaatgaaaccctgggaca

SEQ ID NO: 725718 - DNA, 20 bp, mouse
gggggcgtgcccaacggcga

SEQ ID NO: 725719 - DNA, 20 bp, mouse
gctgggacagggctgtcata

SEQ ID NO: 725720 - DNA, 20 bp, mouse
ggcctcgcggggaacgtccc

SEQ ID NO: 725721 - DNA, 20 bp, mouse
gcctcggggccggggattct

SEQ ID NO: 725722 - DNA, 20 bp, mouse
gggccccgccccctcgccgt

SEQ ID NO: 725723 - DNA, 20 bp, mouse
gccccgaggggcgtgcccaa

SEQ ID NO: 725724 - DNA, 20 bp, mouse
ggtgcccaacggcgaggggg

SEQ ID NO: 725725 - DNA, 20 bp, mouse
gccagaaatgcggcaaagcc

SEQ ID NO: 725726 - DNA, 20 bp, mouse
gttccggcagcagctatcgg

SEQ ID NO: 725727 - DNA, 20 bp, mouse
ggccccagggaagtagggat

SEQ ID NO: 725728 - DNA, 20 bp, mouse
gagccctgggagcgcgtctc

SEQ ID NO: 725729 - DNA, 20 bp, mouse
ggcgggtccccggtgttccc

SEQ ID NO: 725730 - DNA, 20 bp, mouse
gactccgccagggaacaccg

SEQ ID NO: 725731 - DNA, 20 bp, mouse
gccacggctcagttccctgc

SEQ ID NO: 725732 - DNA, 20 bp, mouse
gtgcaaagaagactccgcca

SEQ ID NO: 725733 - DNA, 20 bp, mouse
gcgcctgagacgcgctccca

SEQ ID NO: 725734 - DNA, 20 bp, mouse
gtaggcagaaggtgacaatt

SEQ ID NO: 725735 - DNA, 20 bp, mouse
gagcaggcagcgctaccaca

SEQ ID NO: 725736 - DNA, 20 bp, mouse
gcagaggcggggctaagggg

SEQ ID NO: 725737 - DNA, 20 bp, mouse
gagcctagcgggaaggacgg

SEQ ID NO: 725738 - DNA, 20 bp, mouse
gtaccccggctcgttgaagg

SEQ ID NO: 725739 - DNA, 20 bp, mouse
gccgctaggctcaagaggat

SEQ ID NO: 725740 - DNA, 20 bp, mouse
ggggaaggacggcgggccag

SEQ ID NO: 725741 - DNA, 20 bp, mouse
gaacccccttcaacgagccg

SEQ ID NO: 725742 - DNA, 20 bp, mouse
gcgagccggggtaaagtgat

SEQ ID NO: 725743 - DNA, 20 bp, mouse
gaaagccaatcactttaccc

SEQ ID NO: 725744 - DNA, 20 bp, mouse
gaaggacggcgggccagagg

SEQ ID NO: 725745 - DNA, 20 bp, mouse
gcccgcccccgctcgggagt

SEQ ID NO: 725746 - DNA, 20 bp, mouse
ggggctgcgccaggcgggaa

SEQ ID NO: 725747 - DNA, 20 bp, mouse
gagcgcaactgtcgcggtag

SEQ ID NO: 725748 - DNA, 20 bp, mouse
gggcacggaaggttatatag

SEQ ID NO: 725749 - DNA, 20 bp, mouse
ggggtgaagttccgacttcc

SEQ ID NO: 725750 - DNA, 20 bp, mouse
gctgccactgtggtgctcgg

SEQ ID NO: 725751 - DNA, 20 bp, mouse
gcggcctcccgattgatgag

SEQ ID NO: 725752 - DNA, 20 bp, mouse
gagcgcggaggaggcgaggt

SEQ ID NO: 725753 - DNA, 20 bp, mouse
ggaaggttatatagaggtgg

SEQ ID NO: 725754 - DNA, 20 bp, mouse
gaggcctaagcttccgagct

SEQ ID NO: 725755 - DNA, 20 bp, mouse
gtcccgattgatgagaggaa

SEQ ID NO: 725756 - DNA, 20 bp, mouse
gctgacgggtctctctgtac

SEQ ID NO: 725757 - DNA, 20 bp, mouse
gcaagagccgctacgggtag

SEQ ID NO: 725758 - DNA, 20 bp, mouse
gaccgggccgctacccgtag

SEQ ID NO: 725759 - DNA, 20 bp, mouse
gagagcgccaagagccgcta

SEQ ID NO: 725760 - DNA, 20 bp, mouse
gccaagcagacagcaggtcc

SEQ ID NO: 725761 - DNA, 20 bp, mouse
gcgcgacgctgagatgtcac

SEQ ID NO: 725762 - DNA, 20 bp, mouse
gctagcttctaggttccttc

SEQ ID NO: 725763 - DNA, 20 bp, mouse
gacagcaggtcccggctgac

SEQ ID NO: 725764 - DNA, 20 bp, mouse
gacagagagacccgtcagcc

SEQ ID NO: 725765 - DNA, 20 bp, mouse
gcgctcctgacgtcatagat

SEQ ID NO: 725766 - DNA, 20 bp, mouse
gtgaccagccaattgcccca

SEQ ID NO: 725767 - DNA, 20 bp, mouse
gacagggatgcattgcatgg

SEQ ID NO: 725768 - DNA, 20 bp, mouse
gggaccttggggcaattggc

SEQ ID NO: 725769 - DNA, 20 bp, mouse
ggccccaaggtccggaaacc

SEQ ID NO: 725770 - DNA, 20 bp, mouse
ggggtcttatagtttctctc

SEQ ID NO: 725771 - DNA, 20 bp, mouse
gacttcatgtgcccggagac

SEQ ID NO: 725772 - DNA, 20 bp, mouse
gaagaccagtcccggaagtc

SEQ ID NO: 725773 - DNA, 20 bp, mouse
gtggtcacgcaatgctttgt

SEQ ID NO: 725774 - DNA, 20 bp, mouse
gtgggagattgagtcctctt

SEQ ID NO: 725775 - DNA, 20 bp, mouse
gcacccggtttccggacctt

SEQ ID NO: 725776 - DNA, 20 bp, mouse
ggagcggcagcccaatggga

SEQ ID NO: 725777 - DNA, 20 bp, mouse
gactgcctgcgcgcacctca

SEQ ID NO: 725778 - DNA, 20 bp, mouse
gacagaggcgggctaaaggc

SEQ ID NO: 725779 - DNA, 20 bp, mouse
gaggaggaggcgggccgagt

SEQ ID NO: 725780 - DNA, 20 bp, mouse
gcagagaagagggttgggcg

SEQ ID NO: 725781 - DNA, 20 bp, mouse
gtgcgcgcacctcagggagc

SEQ ID NO: 725782 - DNA, 20 bp, mouse
gaagagggttgggcgaggat

SEQ ID NO: 725783 - DNA, 20 bp, mouse
gtccaacaagccttcccatt

SEQ ID NO: 725784 - DNA, 20 bp, mouse
gggaaggcttgttggaaaag

SEQ ID NO: 725785 - DNA, 20 bp, mouse
gtgacagagcggcagcccaa

SEQ ID NO: 725786 - DNA, 20 bp, mouse
gtgggcgggcgccaactcgt

SEQ ID NO: 725787 - DNA, 20 bp, mouse
gccaactcgtcggagaggcg

SEQ ID NO: 725788 - DNA, 20 bp, mouse
gcccgcccactcagcgcctc

SEQ ID NO: 725789 - DNA, 20 bp, mouse
ggcgcagcgaacgccctctg

SEQ ID NO: 725790 - DNA, 20 bp, mouse
ggaggtcccgccccatctaa

SEQ ID NO: 725791 - DNA, 20 bp, mouse
gtcgctgcgcgcctttagat

SEQ ID NO: 725792 - DNA, 20 bp, mouse
gtccggaggcgctgagtggg

SEQ ID NO: 725793 - DNA, 20 bp, mouse
gggagaggcggggcgactcg

SEQ ID NO: 725794 - DNA, 20 bp, mouse
gcaggctggccggggaccgg

SEQ ID NO: 725795 - DNA, 20 bp, mouse
ggggttgctcctgaagtcgt

SEQ ID NO: 725796 - DNA, 20 bp, mouse
gtaaggtaggtcatggaaag

SEQ ID NO: 725797 - DNA, 20 bp, mouse
gctacttttaagcccattta

SEQ ID NO: 725798 - DNA, 20 bp, mouse
gaaaaatagtgagtagaaca

SEQ ID NO: 725799 - DNA, 20 bp, mouse
gtgtaacattctccgtaaat

SEQ ID NO: 725800 - DNA, 20 bp, mouse
gattcattgtctaacagagt

SEQ ID NO: 725801 - DNA, 20 bp, mouse
gaactcttaaagggacagaa

SEQ ID NO: 725802 - DNA, 20 bp, mouse
gagatcagaaaaccagtact

SEQ ID NO: 725803 - DNA, 20 bp, mouse
ggaaaaccagtactgggaac

SEQ ID NO: 725804 - DNA, 20 bp, mouse
gccaaacactgagaatgcca

SEQ ID NO: 725805 - DNA, 20 bp, mouse
gcctactctctgaaaaggaa

SEQ ID NO: 725806 - DNA, 20 bp, mouse
gcaccctgcaaggcactctg

SEQ ID NO: 725807 - DNA, 20 bp, mouse
gactggaggtcagacatcct

SEQ ID NO: 725808 - DNA, 20 bp, mouse
gaacctcagagtgccttgca

SEQ ID NO: 725809 - DNA, 20 bp, mouse
gctaacgtggtaatcactgg

SEQ ID NO: 725810 - DNA, 20 bp, mouse
ggtactaacgtggtaatcac

SEQ ID NO: 725811 - DNA, 20 bp, mouse
ggtcagacatcctggggagc

SEQ ID NO: 725812 - DNA, 20 bp, mouse
gacactagatacaccctgca

SEQ ID NO: 725813 - DNA, 20 bp, mouse
gtctgtacatggaccatctc

SEQ ID NO: 725814 - DNA, 20 bp, mouse
ggtgtgtcattacacagaac

SEQ ID NO: 725815 - DNA, 20 bp, mouse
gcagaccaggccagttatca

SEQ ID NO: 725816 - DNA, 20 bp, mouse
gaacaggccactccctctgg

SEQ ID NO: 725817 - DNA, 20 bp, mouse
gaaacggaaacccccctcgg

SEQ ID NO: 725818 - DNA, 20 bp, mouse
gcagaggcctgcttcacccc

SEQ ID NO: 725819 - DNA, 20 bp, mouse
ggtcccaggtagccgccaga

SEQ ID NO: 725820 - DNA, 20 bp, mouse
gtatagaagcttcgtgtctg

SEQ ID NO: 725821 - DNA, 20 bp, mouse
gggagaaagaatctcctaga

SEQ ID NO: 725822 - DNA, 20 bp, mouse
ggagaaacggaaacccccct

SEQ ID NO: 725823 - DNA, 20 bp, mouse
gcatctgggaggcattaggc

SEQ ID NO: 725824 - DNA, 20 bp, mouse
gaagggacgtgatcttgaac

SEQ ID NO: 725825 - DNA, 20 bp, mouse
ggcaccgtagggttgctttc

SEQ ID NO: 725826 - DNA, 20 bp, mouse
gagcaggttgtggttgagaa

SEQ ID NO: 725827 - DNA, 20 bp, mouse
gctcaaccacaacctgcttc

SEQ ID NO: 725828 - DNA, 20 bp, mouse
gatctgctagctcatccttc

SEQ ID NO: 725829 - DNA, 20 bp, mouse
gcctggatatgaaataaagt

SEQ ID NO: 725830 - DNA, 20 bp, mouse
gcaagtctgaaggaggagtc

SEQ ID NO: 725831 - DNA, 20 bp, mouse
gaagagggaaaagacaagaa

SEQ ID NO: 725832 - DNA, 20 bp, mouse
ggacctgctcacataaaaag

SEQ ID NO: 725833 - DNA, 20 bp, mouse
gagctaagatgcaagtctga

SEQ ID NO: 725834 - DNA, 20 bp, mouse
gtaagatgcaagtctgaagg

SEQ ID NO: 725835 - DNA, 20 bp, mouse
gtagctgccctgtgctacca

SEQ ID NO: 725836 - DNA, 20 bp, mouse
ggctggggctgaggccagaa

SEQ ID NO: 725837 - DNA, 20 bp, mouse
gcctggatatgagataaaga

SEQ ID NO: 725838 - DNA, 20 bp, mouse
gaagagggaaaagacaagaa

SEQ ID NO: 725839 - DNA, 20 bp, mouse
ggacctgctcacataaaaag

SEQ ID NO: 725840 - DNA, 20 bp, mouse
gctcacataaaaagaggaaa

SEQ ID NO: 725841 - DNA, 20 bp, mouse
gtgtgtccgggcaactgata

SEQ ID NO: 725842 - DNA, 20 bp, mouse
gtagggcccctgagattctg

SEQ ID NO: 725843 - DNA, 20 bp, mouse
gcccttggagcagttctcat

SEQ ID NO: 725844 - DNA, 20 bp, mouse
gatcactggagacgtagtaa

SEQ ID NO: 725845 - DNA, 20 bp, mouse
gaaggggtaagaagtgtgtc

SEQ ID NO: 725846 - DNA, 20 bp, mouse
gccagcaacaatgggaatta

SEQ ID NO: 725847 - DNA, 20 bp, mouse
gagaaaggacagtgcaggtc

SEQ ID NO: 725848 - DNA, 20 bp, mouse
gctcctaaggccatgggcag

SEQ ID NO: 725849 - DNA, 20 bp, mouse
ggggcttggtgggactgtaa

SEQ ID NO: 725850 - DNA, 20 bp, mouse
gatgggaattagggcttggt

SEQ ID NO: 725851 - DNA, 20 bp, mouse
gccactggttaggagagggg

SEQ ID NO: 725852 - DNA, 20 bp, mouse
gacacccctcctaaggccat

SEQ ID NO: 725853 - DNA, 20 bp, mouse
ggctgggcccctatctctcc

SEQ ID NO: 725854 - DNA, 20 bp, mouse
gaaggccaacacccctccta

SEQ ID NO: 725855 - DNA, 20 bp, mouse
ggtggccactggttaggaga

SEQ ID NO: 725856 - DNA, 20 bp, mouse
gcactaagatagtgtccagt

SEQ ID NO: 725857 - DNA, 20 bp, mouse
gagtcctggggaggggtaag

SEQ ID NO: 725858 - DNA, 20 bp, mouse
gaggaggctctgtctctccg

SEQ ID NO: 725859 - DNA, 20 bp, mouse
gaagaaagacggtgaactct

SEQ ID NO: 725860 - DNA, 20 bp, mouse
ggctctgtctctccgaggca

SEQ ID NO: 725861 - DNA, 20 bp, mouse
gtccagtaggccccctgcct

SEQ ID NO: 725862 - DNA, 20 bp, mouse
ggtctgggcaagacaggggt

SEQ ID NO: 725863 - DNA, 20 bp, mouse
ggctattggtcaagagagtc

SEQ ID NO: 725864 - DNA, 20 bp, mouse
gtccgaggcagggggcctac

SEQ ID NO: 725865 - DNA, 20 bp, mouse
gagagagtctgggcaagaca

SEQ ID NO: 725866 - DNA, 20 bp, mouse
gagtctgggctgggcataaa

SEQ ID NO: 725867 - DNA, 20 bp, mouse
ggtaacttgctcatagggta

SEQ ID NO: 725868 - DNA, 20 bp, mouse
ggctggtggctgtatgaaca

SEQ ID NO: 725869 - DNA, 20 bp, mouse
gccgatgggagataaacaga

SEQ ID NO: 725870 - DNA, 20 bp, mouse
gacagccagctagtgtaaac

SEQ ID NO: 725871 - DNA, 20 bp, mouse
gggctgtatgaacaaggaat

SEQ ID NO: 725872 - DNA, 20 bp, mouse
gaaggaataggtgaacccga

SEQ ID NO: 725873 - DNA, 20 bp, mouse
gtgagaccgcgtgtagctgg

SEQ ID NO: 725874 - DNA, 20 bp, mouse
gttgtaatggggtgtaacat

SEQ ID NO: 725875 - DNA, 20 bp, mouse
gtcaaactgaatcatagaaa

SEQ ID NO: 725876 - DNA, 20 bp, mouse
gtgctcacacaggatagaga

SEQ ID NO: 725877 - DNA, 20 bp, mouse
gggtgtggctctacggaatc

SEQ ID NO: 725878 - DNA, 20 bp, mouse
ggctctacggaatcaggctt

SEQ ID NO: 725879 - DNA, 20 bp, mouse
ggggcagagcatataaggtg

SEQ ID NO: 725880 - DNA, 20 bp, mouse
gtggatgctgtgccactcac

SEQ ID NO: 725881 - DNA, 20 bp, mouse
gagactcctaagccagtgag

SEQ ID NO: 725882 - DNA, 20 bp, mouse
gtagagccacaccctggtaa

SEQ ID NO: 725883 - DNA, 20 bp, mouse
gagagcatataaggtgaggt

SEQ ID NO: 725884 - DNA, 20 bp, mouse
gagcagattggcccttacca

SEQ ID NO: 725885 - DNA, 20 bp, mouse
gtatgtcagaagcaaatgtg

SEQ ID NO: 725886 - DNA, 20 bp, mouse
gatgacaaccatatctacac

SEQ ID NO: 725887 - DNA, 20 bp, mouse
gctctgaagcctcaccctgc

SEQ ID NO: 725888 - DNA, 20 bp, mouse
gcacagggtggctatggccc

SEQ ID NO: 725889 - DNA, 20 bp, mouse
gtagccaccctgtgtagata

SEQ ID NO: 725890 - DNA, 20 bp, mouse
gaacagacaagctatgttat

SEQ ID NO: 725891 - DNA, 20 bp, mouse
ggtgggcaggagccagcatt

SEQ ID NO: 725892 - DNA, 20 bp, mouse
gtgccagggtgttaccctgc

SEQ ID NO: 725893 - DNA, 20 bp, mouse
gcaaccatatctacacaggg

SEQ ID NO: 725894 - DNA, 20 bp, mouse
gagcagattggccaatgcca

SEQ ID NO: 725895 - DNA, 20 bp, mouse
gcagagaggacagagtgggc

SEQ ID NO: 725896 - DNA, 20 bp, mouse
gcctgacccgtggtcctcat

SEQ ID NO: 725897 - DNA, 20 bp, mouse
gatgggtggagccaggtcat

SEQ ID NO: 725898 - DNA, 20 bp, mouse
gtattggtcagcctgacccg

SEQ ID NO: 725899 - DNA, 20 bp, mouse
ggacccgtggtcctcatggg

SEQ ID NO: 725900 - DNA, 20 bp, mouse
gggtcctcatgggtggagcc

SEQ ID NO: 725901 - DNA, 20 bp, mouse
gcaaagagagtttttgttga

SEQ ID NO: 725902 - DNA, 20 bp, mouse
gagagagtttttgttgaagg

SEQ ID NO: 725903 - DNA, 20 bp, mouse
gtgataatgcacattagata

SEQ ID NO: 725904 - DNA, 20 bp, mouse
gagagaaatgggcgttatac

SEQ ID NO: 725905 - DNA, 20 bp, mouse
gaaaaaaggaatttgtgctg

SEQ ID NO: 725906 - DNA, 20 bp, mouse
ggggaagccagcccggctgg

SEQ ID NO: 725907 - DNA, 20 bp, mouse
gtagtccgggacagcgctgt

SEQ ID NO: 725908 - DNA, 20 bp, mouse
gaccagcaggtggcgaagac

SEQ ID NO: 725909 - DNA, 20 bp, mouse
gcggccgggaataaggctcc

SEQ ID NO: 725910 - DNA, 20 bp, mouse
gagcgctgtcccggactagg

SEQ ID NO: 725911 - DNA, 20 bp, mouse
gactccagtcacggctgctc

SEQ ID NO: 725912 - DNA, 20 bp, mouse
ggcaccgagaccggcgtagg

SEQ ID NO: 725913 - DNA, 20 bp, mouse
gtacacccacactccagtca

SEQ ID NO: 725914 - DNA, 20 bp, mouse
ggagaccggcgtaggaggaa

SEQ ID NO: 725915 - DNA, 20 bp, mouse
gcggactaggcggtcgcggc

SEQ ID NO: 725916 - DNA, 20 bp, mouse
ggaaaggcggaaccttagag

SEQ ID NO: 725917 - DNA, 20 bp, mouse
gcgcccaccgagacggacta

SEQ ID NO: 725918 - DNA, 20 bp, mouse
gtgccgtagtccgtctcggt

SEQ ID NO: 725919 - DNA, 20 bp, mouse
gtacagaaagcgctttggat

SEQ ID NO: 725920 - DNA, 20 bp, mouse
ggattgctgccgagacacgg

SEQ ID NO: 725921 - DNA, 20 bp, mouse
gccccgggggcttcagggga

SEQ ID NO: 725922 - DNA, 20 bp, mouse
ggctgccgagacacggggga

SEQ ID NO: 725923 - DNA, 20 bp, mouse
ggctgaggaaattaccgggg

SEQ ID NO: 725924 - DNA, 20 bp, mouse
gggactacggcactttccaa

SEQ ID NO: 725925 - DNA, 20 bp, mouse
gagacgagaaaggtggacga

SEQ ID NO: 725926 - DNA, 20 bp, mouse
gacgagctgacagtgccata

SEQ ID NO: 725927 - DNA, 20 bp, mouse
gaacgaaaggagacgtgctc

SEQ ID NO: 725928 - DNA, 20 bp, mouse
ggaagaccaagtatgggtat

SEQ ID NO: 725929 - DNA, 20 bp, mouse
gtccgaaggactcgggaagc

SEQ ID NO: 725930 - DNA, 20 bp, mouse
ggagagagaagaccaagtat

SEQ ID NO: 725931 - DNA, 20 bp, mouse
gtgagtgtaattctcttgtc

SEQ ID NO: 725932 - DNA, 20 bp, mouse
gtaaaatgaaaggcttggag

SEQ ID NO: 725933 - DNA, 20 bp, mouse
gatggattttagtgtccata

SEQ ID NO: 725934 - DNA, 20 bp, mouse
gaactatgatatttaacgaa

SEQ ID NO: 725935 - DNA, 20 bp, mouse
gtcctgcttcccgagtcctt

SEQ ID NO: 725936 - DNA, 20 bp, mouse
gttaaaatgtaaggcgtgga

SEQ ID NO: 725937 - DNA, 20 bp, mouse
gagtgttcatttggcactgt

SEQ ID NO: 725938 - DNA, 20 bp, mouse
gaaagaccaagtatgggtac

SEQ ID NO: 725939 - DNA, 20 bp, mouse
gtcctgcctcccgagtcgtt

SEQ ID NO: 725940 - DNA, 20 bp, mouse
gagtcgttcggaaacttcac

SEQ ID NO: 725941 - DNA, 20 bp, mouse
gttgaaaaggactgagtgtc

SEQ ID NO: 725942 - DNA, 20 bp, mouse
gagtttccgaacgactcggg

SEQ ID NO: 725943 - DNA, 20 bp, mouse
gatggattttagtgttcatt

SEQ ID NO: 725944 - DNA, 20 bp, mouse
gcactttaaaatgtaaggcg

SEQ ID NO: 725945 - DNA, 20 bp, mouse
gtatgttgatatttaacgaa

SEQ ID NO: 725946 - DNA, 20 bp, mouse
gcaaccagagggttgttgag

SEQ ID NO: 725947 - DNA, 20 bp, mouse
gatcccgctcaacaaccctc

SEQ ID NO: 725948 - DNA, 20 bp, mouse
gcgcgctcgcgaactggcgg

SEQ ID NO: 725949 - DNA, 20 bp, mouse
gccagaaatgaagcaaccag

SEQ ID NO: 725950 - DNA, 20 bp, mouse
gcgggatccttcacctacac

SEQ ID NO: 725951 - DNA, 20 bp, mouse
gtgaaaaccggtgtaggtga

SEQ ID NO: 725952 - DNA, 20 bp, mouse
gtggcgacggcaagctctcg

SEQ ID NO: 725953 - DNA, 20 bp, mouse
gaagctctcggggtcactgc

SEQ ID NO: 725954 - DNA, 20 bp, mouse
gcagtcaattcgcttgtggg

SEQ ID NO: 725955 - DNA, 20 bp, mouse
gctcgcgaactggcgggggg

SEQ ID NO: 725956 - DNA, 20 bp, mouse
gtgggtgcctgcccccgtga

SEQ ID NO: 725957 - DNA, 20 bp, mouse
gcggcactgagccttcacgg

SEQ ID NO: 725958 - DNA, 20 bp, mouse
gtgtccagtaataaagatgg

SEQ ID NO: 725959 - DNA, 20 bp, mouse
gcgtaaaaggactctcatgt

SEQ ID NO: 725960 - DNA, 20 bp, mouse
gctcagaaatggacaaaaga

SEQ ID NO: 725961 - DNA, 20 bp, mouse
ggtgtcatgaaccatcttga

SEQ ID NO: 725962 - DNA, 20 bp, mouse
gcggcagccaggagtcactt

SEQ ID NO: 725963 - DNA, 20 bp, mouse
gtgccggcactgagccttca

SEQ ID NO: 725964 - DNA, 20 bp, mouse
gactgagccttcacgggggc

SEQ ID NO: 725965 - DNA, 20 bp, mouse
gtcagtctccagtcaacctc

SEQ ID NO: 725966 - DNA, 20 bp, mouse
gtaacggcgcccgagaacgc

SEQ ID NO: 725967 - DNA, 20 bp, mouse
gtcgaggcctcggagcggaa

SEQ ID NO: 725968 - DNA, 20 bp, mouse
gtataggccgcggagcgaga

SEQ ID NO: 725969 - DNA, 20 bp, mouse
ggcggctcgaggcctcggag

SEQ ID NO: 725970 - DNA, 20 bp, mouse
gtccgcccctacgtgcgggg

SEQ ID NO: 725971 - DNA, 20 bp, mouse
ggaggaacggtcgtcaggtc

SEQ ID NO: 725972 - DNA, 20 bp, mouse
gacgaggcaagctcgcgctg

SEQ ID NO: 725973 - DNA, 20 bp, mouse
ggacggagagaaggctcggg

SEQ ID NO: 725974 - DNA, 20 bp, mouse
gctcgggcggctcgaggcct

SEQ ID NO: 725975 - DNA, 20 bp, mouse
ggaggagaggaacggtcgtc

SEQ ID NO: 725976 - DNA, 20 bp, mouse
gtggaagagccctggtgggg

SEQ ID NO: 725977 - DNA, 20 bp, mouse
gaagcaggacggtttcaaga

SEQ ID NO: 725978 - DNA, 20 bp, mouse
gggtggttgtactaagtgct

SEQ ID NO: 725979 - DNA, 20 bp, mouse
gtgtcagaggctggcggaac

SEQ ID NO: 725980 - DNA, 20 bp, mouse
gcaggacggtttcaagatgg

SEQ ID NO: 725981 - DNA, 20 bp, mouse
gacagcctgaatagcagagg

SEQ ID NO: 725982 - DNA, 20 bp, mouse
ggaagctagtctcaagatgg

SEQ ID NO: 725983 - DNA, 20 bp, mouse
gatagcagaggcggactcaa

SEQ ID NO: 725984 - DNA, 20 bp, mouse
gagaagaagcggtaacggca

SEQ ID NO: 725985 - DNA, 20 bp, mouse
gagtaataaaggcgtgtcag

SEQ ID NO: 725986 - DNA, 20 bp, mouse
gggacaggtcggcgcggtgg

SEQ ID NO: 725987 - DNA, 20 bp, mouse
ggttagaaggcgggacaggt

SEQ ID NO: 725988 - DNA, 20 bp, mouse
gtgtcgcccagcaactaagg

SEQ ID NO: 725989 - DNA, 20 bp, mouse
gagggcgtggtacagcgcga

SEQ ID NO: 725990 - DNA, 20 bp, mouse
ggacctgccgccttagttgc

SEQ ID NO: 725991 - DNA, 20 bp, mouse
gcactggagacgttttacgc

SEQ ID NO: 725992 - DNA, 20 bp, mouse
gcgcggtgggggaggggatc

SEQ ID NO: 725993 - DNA, 20 bp, mouse
gcagaactatccagccacgc

SEQ ID NO: 725994 - DNA, 20 bp, mouse
gggaggggatccggcgtggc

SEQ ID NO: 725995 - DNA, 20 bp, mouse
gaaggcgggacaggtcggcg

SEQ ID NO: 725996 - DNA, 20 bp, mouse
gcgtggcgacgtggccctcg

SEQ ID NO: 725997 - DNA, 20 bp, mouse
gaggcccggcacgtgacccg

SEQ ID NO: 725998 - DNA, 20 bp, mouse
ggggaggggctccatcttgg

SEQ ID NO: 725999 - DNA, 20 bp, mouse
gggcccgcgggtcacgtgcc

SEQ ID NO: 726000 - DNA, 20 bp, mouse
ggggccacgtcgccacgggc

SEQ ID NO: 726001 - DNA, 20 bp, mouse
gacgtcgccacgggctgggg

SEQ ID NO: 726002 - DNA, 20 bp, mouse
ggcctcccgcgcacagctgg

SEQ ID NO: 726003 - DNA, 20 bp, mouse
gcctcggggctccgccaaga

SEQ ID NO: 726004 - DNA, 20 bp, mouse
gttggcagggttggcgggag

SEQ ID NO: 726005 - DNA, 20 bp, mouse
gacaaggacagtggacacgg

SEQ ID NO: 726006 - DNA, 20 bp, mouse
gtgggagttaggctcttaga

SEQ ID NO: 726007 - DNA, 20 bp, mouse
gaagagcctaactcccactc

SEQ ID NO: 726008 - DNA, 20 bp, mouse
gtgtctgagtaagtccttca

SEQ ID NO: 726009 - DNA, 20 bp, mouse
gggttagcgcccttgaggac

SEQ ID NO: 726010 - DNA, 20 bp, mouse
gggcgctaaccagtccttga

SEQ ID NO: 726011 - DNA, 20 bp, mouse
gggcttaaacgcactagtgg

SEQ ID NO: 726012 - DNA, 20 bp, mouse
gtaaacgcactagtggggga

SEQ ID NO: 726013 - DNA, 20 bp, mouse
ggggggcttaaacgcactag

SEQ ID NO: 726014 - DNA, 20 bp, mouse
ggagacaagagagccagagt

SEQ ID NO: 726015 - DNA, 20 bp, mouse
gagggcggagtcggggtatt

SEQ ID NO: 726016 - DNA, 20 bp, mouse
gaactcacgaggaagggaga

SEQ ID NO: 726017 - DNA, 20 bp, mouse
gcagggtacccctaagtgct

SEQ ID NO: 726018 - DNA, 20 bp, mouse
gactgctctgtgtcctacga

SEQ ID NO: 726019 - DNA, 20 bp, mouse
gtctaagtactcaaagtata

SEQ ID NO: 726020 - DNA, 20 bp, mouse
ggttgtagaagcctggtctg

SEQ ID NO: 726021 - DNA, 20 bp, mouse
gtagaagcctggtctgagga

SEQ ID NO: 726022 - DNA, 20 bp, mouse
gagatgcaactgtccttcgt

SEQ ID NO: 726023 - DNA, 20 bp, mouse
ggaaaacctgaaaacggaac

SEQ ID NO: 726024 - DNA, 20 bp, mouse
gacttcaggaagtagctgtg

SEQ ID NO: 726025 - DNA, 20 bp, mouse
gacaacaatgttgtagccca

SEQ ID NO: 726026 - DNA, 20 bp, mouse
ggggaggagggaaacgacag

SEQ ID NO: 726027 - DNA, 20 bp, mouse
ggggcgcgcgcgggtagagg

SEQ ID NO: 726028 - DNA, 20 bp, mouse
ggcggggcgcgcgcgggtag

SEQ ID NO: 726029 - DNA, 20 bp, mouse
gcgcgggtagaggcggtctg

SEQ ID NO: 726030 - DNA, 20 bp, mouse
gaaagtgggagggcagaaaa

SEQ ID NO: 726031 - DNA, 20 bp, mouse
gtgaactcctgagcccgccc

SEQ ID NO: 726032 - DNA, 20 bp, mouse
gcagaagtggcacaggcgag

SEQ ID NO: 726033 - DNA, 20 bp, mouse
gtgggtttgcaaaagtggga

SEQ ID NO: 726034 - DNA, 20 bp, mouse
gaagtggcacaggcgagcgg

SEQ ID NO: 726035 - DNA, 20 bp, mouse
gctggcgcgcgggtgccgag

SEQ ID NO: 726036 - DNA, 20 bp, mouse
gaccccacacagggatggat

SEQ ID NO: 726037 - DNA, 20 bp, mouse
gctcaggctcggttccccag

SEQ ID NO: 726038 - DNA, 20 bp, mouse
gtccccatccatccctgtgt

SEQ ID NO: 726039 - DNA, 20 bp, mouse
gcccgaggggtgagcgtcag

SEQ ID NO: 726040 - DNA, 20 bp, mouse
gcaagccctggtccactctg

SEQ ID NO: 726041 - DNA, 20 bp, mouse
ggaggctctggccagcaagc

SEQ ID NO: 726042 - DNA, 20 bp, mouse
gtggccagcaagcaggctca

SEQ ID NO: 726043 - DNA, 20 bp, mouse
ggagcctgagcgcatctcca

SEQ ID NO: 726044 - DNA, 20 bp, mouse
gcgtcaaggcaggggcccgc

SEQ ID NO: 726045 - DNA, 20 bp, mouse
gaggcaggggcccgccggct

SEQ ID NO: 726046 - DNA, 20 bp, mouse
gtcccgagagggcgtggctt

SEQ ID NO: 726047 - DNA, 20 bp, mouse
gcagcctggggacctcctga

SEQ ID NO: 726048 - DNA, 20 bp, mouse
gcgtggcttaggggtcctga

SEQ ID NO: 726049 - DNA, 20 bp, mouse
ggcttaggggtcctgagggt

SEQ ID NO: 726050 - DNA, 20 bp, mouse
gcgtgcgcccggggcacagg

SEQ ID NO: 726051 - DNA, 20 bp, mouse
gggaggcgggaaactcacta

SEQ ID NO: 726052 - DNA, 20 bp, mouse
ggcgagggctgcgtgagact

SEQ ID NO: 726053 - DNA, 20 bp, mouse
gacgccctctcgggaaagtg

SEQ ID NO: 726054 - DNA, 20 bp, mouse
gtgcccacactttcccgaga

SEQ ID NO: 726055 - DNA, 20 bp, mouse
gtctcacgcagccctcgcca

SEQ ID NO: 726056 - DNA, 20 bp, mouse
gcccctgatcgcaggaggga

SEQ ID NO: 726057 - DNA, 20 bp, mouse
gcgcccccgcggggaacaat

SEQ ID NO: 726058 - DNA, 20 bp, mouse
gggcgctccgggagaggcgg

SEQ ID NO: 726059 - DNA, 20 bp, mouse
ggcactcccgggaaccgcgc

SEQ ID NO: 726060 - DNA, 20 bp, mouse
ggcgccgcgcccctgatcgc

SEQ ID NO: 726061 - DNA, 20 bp, mouse
gcggttcccgggagtgcgtc

SEQ ID NO: 726062 - DNA, 20 bp, mouse
gcacccgccggacgcactcc

SEQ ID NO: 726063 - DNA, 20 bp, mouse
gcactgcccgcgcggttccc

SEQ ID NO: 726064 - DNA, 20 bp, mouse
gttcccgggagtgcgtccgg

SEQ ID NO: 726065 - DNA, 20 bp, mouse
gtcagcgcgtgtgaccgccc

SEQ ID NO: 726066 - DNA, 20 bp, mouse
gaagctggggaccagggaca

SEQ ID NO: 726067 - DNA, 20 bp, mouse
gtgccctatctccaaggaac

SEQ ID NO: 726068 - DNA, 20 bp, mouse
gggacagggcggccattctt

SEQ ID NO: 726069 - DNA, 20 bp, mouse
gttgcaggggaaccgtttcc

SEQ ID NO: 726070 - DNA, 20 bp, mouse
gacactggaaggagacaatg

SEQ ID NO: 726071 - DNA, 20 bp, mouse
gactgtctatggtatgttga

SEQ ID NO: 726072 - DNA, 20 bp, mouse
gtgcctgttccttggagata

SEQ ID NO: 726073 - DNA, 20 bp, mouse
gtctaagattagcatcttgc

SEQ ID NO: 726074 - DNA, 20 bp, mouse
gctgaggccgtcgtcttcag

SEQ ID NO: 726075 - DNA, 20 bp, mouse
ggctctgaggtgtgtgtgcg

SEQ ID NO: 726076 - DNA, 20 bp, mouse
gccagtggacgcgtgaatgg

SEQ ID NO: 726077 - DNA, 20 bp, mouse
gcgggagcgtaagtgtgcga

SEQ ID NO: 726078 - DNA, 20 bp, mouse
gctggggtggggagcgtcga

SEQ ID NO: 726079 - DNA, 20 bp, mouse
ggaagcgtgaagtacaaggc

SEQ ID NO: 726080 - DNA, 20 bp, mouse
gacaaggcggggctccagct

SEQ ID NO: 726081 - DNA, 20 bp, mouse
ggatggaagcgtgaagtaca

SEQ ID NO: 726082 - DNA, 20 bp, mouse
ggaggcagcaagtagtggtg

SEQ ID NO: 726083 - DNA, 20 bp, mouse
gtcagcacgcacctggggtg

SEQ ID NO: 726084 - DNA, 20 bp, mouse
ggagccagtggacgcgtgaa

SEQ ID NO: 726085 - DNA, 20 bp, mouse
gctcgagtgcagacaggccg

SEQ ID NO: 726086 - DNA, 20 bp, mouse
gtgagctggagctgaggtca

SEQ ID NO: 726087 - DNA, 20 bp, mouse
gagaagctgcctaagagcca

SEQ ID NO: 726088 - DNA, 20 bp, mouse
gccgccgcgactaggggctc

SEQ ID NO: 726089 - DNA, 20 bp, mouse
ggaggttgcagcaatgattc

SEQ ID NO: 726090 - DNA, 20 bp, mouse
ggctgcgccgccgcgactag

SEQ ID NO: 726091 - DNA, 20 bp, mouse
ggctctggaggcattggctc

SEQ ID NO: 726092 - DNA, 20 bp, mouse
gccttgcgcccggcaacttc

SEQ ID NO: 726093 - DNA, 20 bp, mouse
gtggctggaaggtcaacgca

SEQ ID NO: 726094 - DNA, 20 bp, mouse
gagaaggcaagtgatggaaa

SEQ ID NO: 726095 - DNA, 20 bp, mouse
gtgggttgcaagctaagtgc

SEQ ID NO: 726096 - DNA, 20 bp, mouse
gggcaagaggaccatggtgt

SEQ ID NO: 726097 - DNA, 20 bp, mouse
ggtagagccaacaacacttg

SEQ ID NO: 726098 - DNA, 20 bp, mouse
ggaagcttccgtgatcatct

SEQ ID NO: 726099 - DNA, 20 bp, mouse
gcactcttctaatctcgctc

SEQ ID NO: 726100 - DNA, 20 bp, mouse
gaggaagcactggttaagga

SEQ ID NO: 726101 - DNA, 20 bp, mouse
gcctcctccccaagtgttgt

SEQ ID NO: 726102 - DNA, 20 bp, mouse
ggagccaacaacacttgggg

SEQ ID NO: 726103 - DNA, 20 bp, mouse
gatctcggtggagtggcaag

SEQ ID NO: 726104 - DNA, 20 bp, mouse
ggactctgaaccctacctgt

SEQ ID NO: 726105 - DNA, 20 bp, mouse
ggattagaagagtggagagt

SEQ ID NO: 726106 - DNA, 20 bp, mouse
ggagtcccgggagagggagt

SEQ ID NO: 726107 - DNA, 20 bp, mouse
gggtcgggcccggaactcgg

SEQ ID NO: 726108 - DNA, 20 bp, mouse
gaagccaccgcgggccccct

SEQ ID NO: 726109 - DNA, 20 bp, mouse
gaaagtccggcgcggagggg

SEQ ID NO: 726110 - DNA, 20 bp, mouse
gtccctctcccgggactcga

SEQ ID NO: 726111 - DNA, 20 bp, mouse
ggggccgtaccatcgagtcc

SEQ ID NO: 726112 - DNA, 20 bp, mouse
gggaactcggcggggggcaa

SEQ ID NO: 726113 - DNA, 20 bp, mouse
gaatcggcatgcgcggggtc

SEQ ID NO: 726114 - DNA, 20 bp, mouse
gtaccaaagtccggcgcgga

SEQ ID NO: 726115 - DNA, 20 bp, mouse
ggggcctcactctaaccaat

SEQ ID NO: 726116 - DNA, 20 bp, mouse
gagagcgcgcgcaatcccag

SEQ ID NO: 726117 - DNA, 20 bp, mouse
gccgcccctaggcgagatta

SEQ ID NO: 726118 - DNA, 20 bp, mouse
gtggaggcggtactggtcgt

SEQ ID NO: 726119 - DNA, 20 bp, mouse
ggggccggagtctgtaaaag

SEQ ID NO: 726120 - DNA, 20 bp, mouse
gtcaagaaggacactggagg

SEQ ID NO: 726121 - DNA, 20 bp, mouse
gtagggtggagtagaccaaa

SEQ ID NO: 726122 - DNA, 20 bp, mouse
gcccctaggcgagattaggg

SEQ ID NO: 726123 - DNA, 20 bp, mouse
gtggcctaaactaccaggtt

SEQ ID NO: 726124 - DNA, 20 bp, mouse
gccgcgccacacgtagttgt

SEQ ID NO: 726125 - DNA, 20 bp, mouse
gtgtccttcttgaaatggat

SEQ ID NO: 726126 - DNA, 20 bp, mouse
gcaatggagtgccgcctgga

SEQ ID NO: 726127 - DNA, 20 bp, mouse
gtctaccctgggaatgcggg

SEQ ID NO: 726128 - DNA, 20 bp, mouse
gacagatggtacaggaatgc

SEQ ID NO: 726129 - DNA, 20 bp, mouse
gtccttggccggcgccggtc

SEQ ID NO: 726130 - DNA, 20 bp, mouse
gcaggaaagaacatatagct

SEQ ID NO: 726131 - DNA, 20 bp, mouse
gcagctgcgtcacagacgac

SEQ ID NO: 726132 - DNA, 20 bp, mouse
gagctccgcccgcattccca

SEQ ID NO: 726133 - DNA, 20 bp, mouse
ggcgtcacagacgaccggac

SEQ ID NO: 726134 - DNA, 20 bp, mouse
gcatgaccacgccctccagg

SEQ ID NO: 726135 - DNA, 20 bp, mouse
ggcgcatgaccacgccctcc

SEQ ID NO: 726136 - DNA, 20 bp, mouse
gcgggagggagcgaccggga

SEQ ID NO: 726137 - DNA, 20 bp, mouse
ggggagcgaccgggacggag

SEQ ID NO: 726138 - DNA, 20 bp, mouse
ggaggggggcaccacaacta

SEQ ID NO: 726139 - DNA, 20 bp, mouse
gcgtccgggtctctgagcaa

SEQ ID NO: 726140 - DNA, 20 bp, mouse
gagtctagacccctcctcca

SEQ ID NO: 726141 - DNA, 20 bp, mouse
gccagtgcgcgtaagaccga

SEQ ID NO: 726142 - DNA, 20 bp, mouse
gggcgacagtagtgtttcta

SEQ ID NO: 726143 - DNA, 20 bp, mouse
gaggggagcggcatgagccc

SEQ ID NO: 726144 - DNA, 20 bp, mouse
gggtccccgcggcacgtggc

SEQ ID NO: 726145 - DNA, 20 bp, mouse
ggggacggagtggacgccac

SEQ ID NO: 726146 - DNA, 20 bp, mouse
gaggggcggaactccagaaa

SEQ ID NO: 726147 - DNA, 20 bp, mouse
ggaccaggacagcaaaatga

SEQ ID NO: 726148 - DNA, 20 bp, mouse
gaagcctcggaatctggacc

SEQ ID NO: 726149 - DNA, 20 bp, mouse
ggggcgagggtcatatcctc

SEQ ID NO: 726150 - DNA, 20 bp, mouse
gagggtggccagatcctccg

SEQ ID NO: 726151 - DNA, 20 bp, mouse
gtaagcgtagccttgggagg

SEQ ID NO: 726152 - DNA, 20 bp, mouse
gcagctggacggaatggctc

SEQ ID NO: 726153 - DNA, 20 bp, mouse
gtgctcttgcattctatgaa

SEQ ID NO: 726154 - DNA, 20 bp, mouse
ggaacctggaaggggacccg

SEQ ID NO: 726155 - DNA, 20 bp, mouse
gtgcgcagcacgcacggcgg

SEQ ID NO: 726156 - DNA, 20 bp, mouse
gaagaaaggagccctcagtt

SEQ ID NO: 726157 - DNA, 20 bp, mouse
gtaactaaggaaataggctc

SEQ ID NO: 726158 - DNA, 20 bp, mouse
gactacctaactaaggaaat

SEQ ID NO: 726159 - DNA, 20 bp, mouse
gggtgttcacatcccaactg

SEQ ID NO: 726160 - DNA, 20 bp, mouse
gcagaggtcagggatactgc

SEQ ID NO: 726161 - DNA, 20 bp, mouse
ggatggggaagtttctggaa

SEQ ID NO: 726162 - DNA, 20 bp, mouse
gtggttcatgttgatcaaaa

SEQ ID NO: 726163 - DNA, 20 bp, mouse
gtgatcaacatgaaccactg

SEQ ID NO: 726164 - DNA, 20 bp, mouse
gacaacgtttgctcttctcg

SEQ ID NO: 726165 - DNA, 20 bp, mouse
gggtgctactagcatcttat

SEQ ID NO: 726166 - DNA, 20 bp, mouse
gccagcccaaggttaggctg

SEQ ID NO: 726167 - DNA, 20 bp, mouse
gcggaccccggctgctgcag

SEQ ID NO: 726168 - DNA, 20 bp, mouse
gccgaccccgagctaaaaat

SEQ ID NO: 726169 - DNA, 20 bp, mouse
gtattggtcccgcccatctg

SEQ ID NO: 726170 - DNA, 20 bp, mouse
gccagcccctgcagcagccg

SEQ ID NO: 726171 - DNA, 20 bp, mouse
gggccctcccctcagatggg

SEQ ID NO: 726172 - DNA, 20 bp, mouse
gttgaagcccgaaaaagggg

SEQ ID NO: 726173 - DNA, 20 bp, mouse
gcaatgcccagcccaaggtt

SEQ ID NO: 726174 - DNA, 20 bp, mouse
gcaccgtgacagcttcttaa

SEQ ID NO: 726175 - DNA, 20 bp, mouse
gtcccgcccatctgagggga

SEQ ID NO: 726176 - DNA, 20 bp, mouse
gaaggattggccagcgtcgg

SEQ ID NO: 726177 - DNA, 20 bp, mouse
gtggctgggcgggagatggg

SEQ ID NO: 726178 - DNA, 20 bp, mouse
ggccaagctcgcgagaggtg

SEQ ID NO: 726179 - DNA, 20 bp, mouse
gcaggtgcccggggccacac

SEQ ID NO: 726180 - DNA, 20 bp, mouse
gctcagtgagtagggacgga

SEQ ID NO: 726181 - DNA, 20 bp, mouse
gtggcggcgtgagcctaggg

SEQ ID NO: 726182 - DNA, 20 bp, mouse
ggctcacgccgccaaattcc

SEQ ID NO: 726183 - DNA, 20 bp, mouse
gcggaaggattggccagcgt

SEQ ID NO: 726184 - DNA, 20 bp, mouse
gacacaggtcgccgggaatt

SEQ ID NO: 726185 - DNA, 20 bp, mouse
gcaggtcgccgggaatttgg

SEQ ID NO: 726186 - DNA, 20 bp, mouse
ggccctgggacacaccaccc

SEQ ID NO: 726187 - DNA, 20 bp, mouse
gtggcggcagacaccgatcg

SEQ ID NO: 726188 - DNA, 20 bp, mouse
gcggccgggtaggatgacaa

SEQ ID NO: 726189 - DNA, 20 bp, mouse
ggcccgggtggtgtgtccca

SEQ ID NO: 726190 - DNA, 20 bp, mouse
ggcagcctggccggccgggt

SEQ ID NO: 726191 - DNA, 20 bp, mouse
ggcgtcccgcgttccgggtt

SEQ ID NO: 726192 - DNA, 20 bp, mouse
gttcggcgctgcctcccggg

SEQ ID NO: 726193 - DNA, 20 bp, mouse
gcggccgcgtcccgcgttcc

SEQ ID NO: 726194 - DNA, 20 bp, mouse
gagccgcgccccgccgcgat

SEQ ID NO: 726195 - DNA, 20 bp, mouse
gcgggaggcagcgccgaacc

SEQ ID NO: 726196 - DNA, 20 bp, mouse
gcagcttcggggcttcaggg

SEQ ID NO: 726197 - DNA, 20 bp, mouse
ggtgcagcttcggggcttca

SEQ ID NO: 726198 - DNA, 20 bp, mouse
ggaggggagctgctgtggtt

SEQ ID NO: 726199 - DNA, 20 bp, mouse
gcttcggggcttcagggtgg

SEQ ID NO: 726200 - DNA, 20 bp, mouse
gagccccgaagctgcacacc

SEQ ID NO: 726201 - DNA, 20 bp, mouse
gaggagacctagagccagga

SEQ ID NO: 726202 - DNA, 20 bp, mouse
gagcagacaaactctgtcag

SEQ ID NO: 726203 - DNA, 20 bp, mouse
gggagccaggtgtgcagctt

SEQ ID NO: 726204 - DNA, 20 bp, mouse
gtggttgggttatctgatgt

SEQ ID NO: 726205 - DNA, 20 bp, mouse
gtcagaggccgctgccatcc

SEQ ID NO: 726206 - DNA, 20 bp, mouse
gcatccctgtagttggacga

SEQ ID NO: 726207 - DNA, 20 bp, mouse
gcaccgctggggctgaacag

SEQ ID NO: 726208 - DNA, 20 bp, mouse
ggatgaccacagttcaaaaa

SEQ ID NO: 726209 - DNA, 20 bp, mouse
gtgacaagggagcaccgctg

SEQ ID NO: 726210 - DNA, 20 bp, mouse
gtccggcgatctaaatagga

SEQ ID NO: 726211 - DNA, 20 bp, mouse
gtggtccctcgtccaactac

SEQ ID NO: 726212 - DNA, 20 bp, mouse
gccccgtagggcaacaaggc

SEQ ID NO: 726213 - DNA, 20 bp, mouse
gtccaactacagggatggat

SEQ ID NO: 726214 - DNA, 20 bp, mouse
gtgtctccggcgatctaaat

SEQ ID NO: 726215 - DNA, 20 bp, mouse
gcagtagaaggcatctggtc

SEQ ID NO: 726216 - DNA, 20 bp, mouse
gaggcacagaaatagaacaa

SEQ ID NO: 726217 - DNA, 20 bp, mouse
ggtcggcctgagccaaaaat

SEQ ID NO: 726218 - DNA, 20 bp, mouse
gaacatgtaacgcaagttga

SEQ ID NO: 726219 - DNA, 20 bp, mouse
gccctccttgagttagaatt

SEQ ID NO: 726220 - DNA, 20 bp, mouse
gcaacaacagcatggcccac

SEQ ID NO: 726221 - DNA, 20 bp, mouse
gaatgcaggctgcaatcact

SEQ ID NO: 726222 - DNA, 20 bp, mouse
gacagaaatagaacaatggt

SEQ ID NO: 726223 - DNA, 20 bp, mouse
gcactggcatctcacctcca

SEQ ID NO: 726224 - DNA, 20 bp, mouse
ggccctgcaatagagaatta

SEQ ID NO: 726225 - DNA, 20 bp, mouse
ggctggacagctggctttgg

SEQ ID NO: 726226 - DNA, 20 bp, mouse
gcagagctgcttgtaggctt

SEQ ID NO: 726227 - DNA, 20 bp, mouse
gtggtctgaatgcaggggca

SEQ ID NO: 726228 - DNA, 20 bp, mouse
ggggctaaaggaggggaata

SEQ ID NO: 726229 - DNA, 20 bp, mouse
ggaaaggacggggacaagag

SEQ ID NO: 726230 - DNA, 20 bp, mouse
gagctgcttgtaggcttggg

SEQ ID NO: 726231 - DNA, 20 bp, mouse
ggagctaggagctttattca

SEQ ID NO: 726232 - DNA, 20 bp, mouse
gggaggctaggtgccccaac

SEQ ID NO: 726233 - DNA, 20 bp, mouse
gctctatggtctgaatgcag

SEQ ID NO: 726234 - DNA, 20 bp, mouse
gctgccctggcttctctatg

SEQ ID NO: 726235 - DNA, 20 bp, mouse
gaagcagctctggatagaca

SEQ ID NO: 726236 - DNA, 20 bp, mouse
gaggaagtggggctgtgagg

SEQ ID NO: 726237 - DNA, 20 bp, mouse
ggctgtgaggaggagccaaa

SEQ ID NO: 726238 - DNA, 20 bp, mouse
gtctaccaaaggaggaagtg

SEQ ID NO: 726239 - DNA, 20 bp, mouse
gtcagctcctccccaccctt

SEQ ID NO: 726240 - DNA, 20 bp, mouse
gaagcattgcctcccttcac

SEQ ID NO: 726241 - DNA, 20 bp, mouse
gtgaggaggagccaaagggt

SEQ ID NO: 726242 - DNA, 20 bp, mouse
ggaagtgcataagagctggg

SEQ ID NO: 726243 - DNA, 20 bp, mouse
gggaggagctgaaggggaat

SEQ ID NO: 726244 - DNA, 20 bp, mouse
gaaggtctgtgctcagactt

SEQ ID NO: 726245 - DNA, 20 bp, mouse
gaatcgcagcttgacgctaa

SEQ ID NO: 726246 - DNA, 20 bp, mouse
ggcgccgcctggcgcttcgg

SEQ ID NO: 726247 - DNA, 20 bp, mouse
gtacgcctgttgtactgtgg

SEQ ID NO: 726248 - DNA, 20 bp, mouse
gcgcacgcgcacacacgttg

SEQ ID NO: 726249 - DNA, 20 bp, mouse
gcgcacacacgttgggggag

SEQ ID NO: 726250 - DNA, 20 bp, mouse
gcaggtaaaaaagctgggga

SEQ ID NO: 726251 - DNA, 20 bp, mouse
gaagaacctccgttgagaat

SEQ ID NO: 726252 - DNA, 20 bp, mouse
gagactccttgaaactcgtt

SEQ ID NO: 726253 - DNA, 20 bp, mouse
gtctttgtctccaaaaacta

SEQ ID NO: 726254 - DNA, 20 bp, mouse
gtctgcctccacagtacaac

SEQ ID NO: 726255 - DNA, 20 bp, mouse
gtagccaggtaaaaaagctg

SEQ ID NO: 726256 - DNA, 20 bp, mouse
gaggcggggctcagaggcac

SEQ ID NO: 726257 - DNA, 20 bp, mouse
ggcaggctgtaggcgtcgat

SEQ ID NO: 726258 - DNA, 20 bp, mouse
gcccgcgcgccgctcggaca

SEQ ID NO: 726259 - DNA, 20 bp, mouse
ggcgcccggccctgtccgag

SEQ ID NO: 726260 - DNA, 20 bp, mouse
gtgaggccggggcaggctgt

SEQ ID NO: 726261 - DNA, 20 bp, mouse
ggggcgcggtgggcaacaca

SEQ ID NO: 726262 - DNA, 20 bp, mouse
gggcctcacacccaacctgg

SEQ ID NO: 726263 - DNA, 20 bp, mouse
gaggggaggagtgggccgcg

SEQ ID NO: 726264 - DNA, 20 bp, mouse
ggccccggagctcgcgtcgg

SEQ ID NO: 726265 - DNA, 20 bp, mouse
gaggcgcagagcaaatacgt

SEQ ID NO: 726266 - DNA, 20 bp, mouse
gttacagcaaacagcaagag

SEQ ID NO: 726267 - DNA, 20 bp, mouse
gaaccatggcatctgggtta

SEQ ID NO: 726268 - DNA, 20 bp, mouse
gacagcaagagaggtaccta

SEQ ID NO: 726269 - DNA, 20 bp, mouse
gttagggctccatcagccat

SEQ ID NO: 726270 - DNA, 20 bp, mouse
gttgtcaccacaactgccat

SEQ ID NO: 726271 - DNA, 20 bp, mouse
ggcgtgggaatacaacaaaa

SEQ ID NO: 726272 - DNA, 20 bp, mouse
gcaaacactgtggaagtaaa

SEQ ID NO: 726273 - DNA, 20 bp, mouse
ggcagcagcgggacctctcg

SEQ ID NO: 726274 - DNA, 20 bp, mouse
gcgggacctctcgaggatgc

SEQ ID NO: 726275 - DNA, 20 bp, mouse
gcctgtgattgaagtaatga

SEQ ID NO: 726276 - DNA, 20 bp, mouse
ggcgcgggccaataaaggga

SEQ ID NO: 726277 - DNA, 20 bp, mouse
gacgcgcgcgggccaataaa

SEQ ID NO: 726278 - DNA, 20 bp, mouse
gtggatcagagctagttaac

SEQ ID NO: 726279 - DNA, 20 bp, mouse
gggccaataaagggaggggt

SEQ ID NO: 726280 - DNA, 20 bp, mouse
gggctcgcagtcaggatgtg

SEQ ID NO: 726281 - DNA, 20 bp, mouse
gtggtcatgagcgacggcga

SEQ ID NO: 726282 - DNA, 20 bp, mouse
ggcggcccctagccaaggga

SEQ ID NO: 726283 - DNA, 20 bp, mouse
gtggcccgcgcgcgtctctg

SEQ ID NO: 726284 - DNA, 20 bp, mouse
gagttaacgggattggataa

SEQ ID NO: 726285 - DNA, 20 bp, mouse
ggatgggcggggcttaggtt

SEQ ID NO: 726286 - DNA, 20 bp, mouse
gcgccggccggttaattcct

SEQ ID NO: 726287 - DNA, 20 bp, mouse
gagggaagcggggcgggcga

SEQ ID NO: 726288 - DNA, 20 bp, mouse
gaggaagtggcccacgggta

SEQ ID NO: 726289 - DNA, 20 bp, mouse
gaagccggtgccccgcgggt

SEQ ID NO: 726290 - DNA, 20 bp, mouse
gagcaggcggcgggcgtctt

SEQ ID NO: 726291 - DNA, 20 bp, mouse
gcgccgcctggcttgctccg

SEQ ID NO: 726292 - DNA, 20 bp, mouse
gggggcgggcgaggggtgga

SEQ ID NO: 726293 - DNA, 20 bp, mouse
gtgctcgcgcccaccccctg

SEQ ID NO: 726294 - DNA, 20 bp, mouse
gcagcgaagccggtgccccg

SEQ ID NO: 726295 - DNA, 20 bp, mouse
gttaaccggccggcgcgcga

SEQ ID NO: 726296 - DNA, 20 bp, mouse
gtgagctcaacaaaatcagc

SEQ ID NO: 726297 - DNA, 20 bp, mouse
gtgtctgtaatggatttagg

SEQ ID NO: 726298 - DNA, 20 bp, mouse
gtccattacagacaagacca

SEQ ID NO: 726299 - DNA, 20 bp, mouse
gtgtaatggatttaggtggg

SEQ ID NO: 726300 - DNA, 20 bp, mouse
ggggattgtagggctcgttt

SEQ ID NO: 726301 - DNA, 20 bp, mouse
gtcttgtctgtaatggattt

SEQ ID NO: 726302 - DNA, 20 bp, mouse
gtcctacacatgcgtgttgt

SEQ ID NO: 726303 - DNA, 20 bp, mouse
gaagaaaagctgatctctac

SEQ ID NO: 726304 - DNA, 20 bp, mouse
gattttgtgaatgggattgt

SEQ ID NO: 726305 - DNA, 20 bp, mouse
gaaataagactagttcatta

SEQ ID NO: 726306 - DNA, 20 bp, mouse
ggggtgttgaaggattacga

SEQ ID NO: 726307 - DNA, 20 bp, mouse
gctgtgaagcgtctctgaga

SEQ ID NO: 726308 - DNA, 20 bp, mouse
gcggggctgcgagggtgagg

SEQ ID NO: 726309 - DNA, 20 bp, mouse
gcaaggacgcggggaggccc

SEQ ID NO: 726310 - DNA, 20 bp, mouse
ggtcccgcccagcgtccggg

SEQ ID NO: 726311 - DNA, 20 bp, mouse
gaggcggcatctcctgtgag

SEQ ID NO: 726312 - DNA, 20 bp, mouse
gagcagaaggcagttttgga

SEQ ID NO: 726313 - DNA, 20 bp, mouse
gtcaccgcaaggacgcgggg

SEQ ID NO: 726314 - DNA, 20 bp, mouse
gttgaggcatagggtgttga

SEQ ID NO: 726315 - DNA, 20 bp, mouse
gggcgcgtcacgactgcatc

SEQ ID NO: 726316 - DNA, 20 bp, mouse
gaagctacggggtaacctaa

SEQ ID NO: 726317 - DNA, 20 bp, mouse
ggtggggaggaacgtgatga

SEQ ID NO: 726318 - DNA, 20 bp, mouse
gaagccaggggacggtgaga

SEQ ID NO: 726319 - DNA, 20 bp, mouse
ggggcgtgagacagggagca

SEQ ID NO: 726320 - DNA, 20 bp, mouse
gagggagcagggaagctacg

SEQ ID NO: 726321 - DNA, 20 bp, mouse
gggtgagagggcgtgagaca

SEQ ID NO: 726322 - DNA, 20 bp, mouse
gactcagcgtggcgagtgac

SEQ ID NO: 726323 - DNA, 20 bp, mouse
gccccggcccccgcctccgt

SEQ ID NO: 726324 - DNA, 20 bp, mouse
gtggcgagtgacgggcgcga

SEQ ID NO: 726325 - DNA, 20 bp, mouse
gagaagcaaagagaacacct

SEQ ID NO: 726326 - DNA, 20 bp, mouse
gcggtctgacgtgtctcggc

SEQ ID NO: 726327 - DNA, 20 bp, mouse
gagttctgcggcctgacagg

SEQ ID NO: 726328 - DNA, 20 bp, mouse
gctgacagggggcgaggagt

SEQ ID NO: 726329 - DNA, 20 bp, mouse
gtccctacagcgcccgggag

SEQ ID NO: 726330 - DNA, 20 bp, mouse
gcgctgtagggaccccgcag

SEQ ID NO: 726331 - DNA, 20 bp, mouse
ggcggggtccctacagcgcc

SEQ ID NO: 726332 - DNA, 20 bp, mouse
gaagagttctgcggcctgac

SEQ ID NO: 726333 - DNA, 20 bp, mouse
gcaactctttaagagttctg

SEQ ID NO: 726334 - DNA, 20 bp, mouse
gactctggcacctctggctc

SEQ ID NO: 726335 - DNA, 20 bp, mouse
gtccgctcccgggcgctgta

SEQ ID NO: 726336 - DNA, 20 bp, mouse
gcccaggaaggagttggcaa

SEQ ID NO: 726337 - DNA, 20 bp, mouse
ggctctgcatgcaaccgcgg

SEQ ID NO: 726338 - DNA, 20 bp, mouse
gcggaggaggggactactcg

SEQ ID NO: 726339 - DNA, 20 bp, mouse
gtaggcggtgataacgggta

SEQ ID NO: 726340 - DNA, 20 bp, mouse
gtgttcgcgcgcgctctact

SEQ ID NO: 726341 - DNA, 20 bp, mouse
gcggccgcacccttagtccg

SEQ ID NO: 726342 - DNA, 20 bp, mouse
ggagttggcaaggggcggga

SEQ ID NO: 726343 - DNA, 20 bp, mouse
gctgccgtccgcctctgcgc

SEQ ID NO: 726344 - DNA, 20 bp, mouse
gccgcctaggcggtgataac

SEQ ID NO: 726345 - DNA, 20 bp, mouse
gtcgcctgacgagcgttctc

SEQ ID NO: 726346 - DNA, 20 bp, mouse
gactgtccggagctgatctc

SEQ ID NO: 726347 - DNA, 20 bp, mouse
ggaagaggcagccctactac

SEQ ID NO: 726348 - DNA, 20 bp, mouse
ggaagtggcttcctgtagta

SEQ ID NO: 726349 - DNA, 20 bp, mouse
gatcagctccggacagtccc

SEQ ID NO: 726350 - DNA, 20 bp, mouse
gcctcccaactcttgggttc

SEQ ID NO: 726351 - DNA, 20 bp, mouse
gagcccagaacccaagagtt

SEQ ID NO: 726352 - DNA, 20 bp, mouse
gcacttatctgctaaatctg

SEQ ID NO: 726353 - DNA, 20 bp, mouse
ggagagcccgagatcagctc

SEQ ID NO: 726354 - DNA, 20 bp, mouse
gtatctgctaaatctgtggc

SEQ ID NO: 726355 - DNA, 20 bp, mouse
ggctgaggccagggactgtc

SEQ ID NO: 726356 - DNA, 20 bp, mouse
gccttagaggggaaagtagg

SEQ ID NO: 726357 - DNA, 20 bp, mouse
ggatgagcgagcggagggtg

SEQ ID NO: 726358 - DNA, 20 bp, mouse
ggaggggcgggacttatagg

SEQ ID NO: 726359 - DNA, 20 bp, mouse
gatggaaggcggagcttaac

SEQ ID NO: 726360 - DNA, 20 bp, mouse
ggaggggcgtggaataaatg

SEQ ID NO: 726361 - DNA, 20 bp, mouse
gtaactggatgagcgagcgg

SEQ ID NO: 726362 - DNA, 20 bp, mouse
gggaaagaggtgcggatgga

SEQ ID NO: 726363 - DNA, 20 bp, mouse
gaagtaggcggggaattaaa

SEQ ID NO: 726364 - DNA, 20 bp, mouse
gaggcggggaattaaatggc

SEQ ID NO: 726365 - DNA, 20 bp, mouse
gtgaggttcaggcccttaga

SEQ ID NO: 726366 - DNA, 20 bp, mouse
gggcgggcaaagggcttaga

SEQ ID NO: 726367 - DNA, 20 bp, mouse
gacgggcaggaggacgagag

SEQ ID NO: 726368 - DNA, 20 bp, mouse
gggcttagagggcggagtga

SEQ ID NO: 726369 - DNA, 20 bp, mouse
gggaggggaaagaaccaaat

SEQ ID NO: 726370 - DNA, 20 bp, mouse
gccccttaggagtgatgctg

SEQ ID NO: 726371 - DNA, 20 bp, mouse
ggggcggagtgacgggcagg

SEQ ID NO: 726372 - DNA, 20 bp, mouse
gagggaagtgggcgggcaaa

SEQ ID NO: 726373 - DNA, 20 bp, mouse
gaggtccgggagtctggggt

SEQ ID NO: 726374 - DNA, 20 bp, mouse
gaagacagcaagctcggcaa

SEQ ID NO: 726375 - DNA, 20 bp, mouse
gggaaccggcgctagtacga

SEQ ID NO: 726376 - DNA, 20 bp, mouse
gtggagccctggatgtccct

SEQ ID NO: 726377 - DNA, 20 bp, mouse
gcctatgggtggctgaggaa

SEQ ID NO: 726378 - DNA, 20 bp, mouse
gcgtgcgtgtaatgtgatgt

SEQ ID NO: 726379 - DNA, 20 bp, mouse
gcacacgtgctgcctcattc

SEQ ID NO: 726380 - DNA, 20 bp, mouse
gctgacaatgggtggagccc

SEQ ID NO: 726381 - DNA, 20 bp, mouse
gcggggccatccctgacaat

SEQ ID NO: 726382 - DNA, 20 bp, mouse
gaagccttacgtttgtacga

SEQ ID NO: 726383 - DNA, 20 bp, mouse
gtgggtgtgttaacattccc

SEQ ID NO: 726384 - DNA, 20 bp, mouse
ggaggaatggctcctaagaa

SEQ ID NO: 726385 - DNA, 20 bp, mouse
gacattcccagggacatcca

SEQ ID NO: 726386 - DNA, 20 bp, mouse
ggctcccatcgctctctcgg

SEQ ID NO: 726387 - DNA, 20 bp, mouse
gccaccgccgagagagcgat

SEQ ID NO: 726388 - DNA, 20 bp, mouse
ggtggccggaatctccggac

SEQ ID NO: 726389 - DNA, 20 bp, mouse
gggcgaatgcggagctggga

SEQ ID NO: 726390 - DNA, 20 bp, mouse
gagccagggagcgcacactg

SEQ ID NO: 726391 - DNA, 20 bp, mouse
gccagccgcccgccgagcca

SEQ ID NO: 726392 - DNA, 20 bp, mouse
ggcgggagcggccattggga

SEQ ID NO: 726393 - DNA, 20 bp, mouse
gtgaggcagaagtcacttct

SEQ ID NO: 726394 - DNA, 20 bp, mouse
gtgccacagtgtgcgctccc

SEQ ID NO: 726395 - DNA, 20 bp, mouse
gtagttgtggccggaatctc

SEQ ID NO: 726396 - DNA, 20 bp, mouse
ggggacgagtgggatgtttg

SEQ ID NO: 726397 - DNA, 20 bp, mouse
ggacagaggtcggtgcaagt

SEQ ID NO: 726398 - DNA, 20 bp, mouse
gtcggctgtcggggacgagt

SEQ ID NO: 726399 - DNA, 20 bp, mouse
gggcggggctaagaggacgt

SEQ ID NO: 726400 - DNA, 20 bp, mouse
gcgaagcgaatcggctgtcg

SEQ ID NO: 726401 - DNA, 20 bp, mouse
ggcgctcaggagaatgacag

SEQ ID NO: 726402 - DNA, 20 bp, mouse
gcccaagtttcgaagcgaat

SEQ ID NO: 726403 - DNA, 20 bp, mouse
gtcgcttcgaaacttggggt

SEQ ID NO: 726404 - DNA, 20 bp, mouse
gtgcgcatgcgccgtgcaat

SEQ ID NO: 726405 - DNA, 20 bp, mouse
gtcgtctcccggcttcctga

SEQ ID NO: 726406 - DNA, 20 bp, mouse
ggagcctggcagacaagcgg

SEQ ID NO: 726407 - DNA, 20 bp, mouse
ggccccgcgggaactgtcgc

SEQ ID NO: 726408 - DNA, 20 bp, mouse
ggtcgccggagcaggacgat

SEQ ID NO: 726409 - DNA, 20 bp, mouse
gggaacccatcgtcctgctc

SEQ ID NO: 726410 - DNA, 20 bp, mouse
gcaagagcaaactttctgag

SEQ ID NO: 726411 - DNA, 20 bp, mouse
gtgccccggaagtatttccc

SEQ ID NO: 726412 - DNA, 20 bp, mouse
gggctgcccacaaggaagag

SEQ ID NO: 726413 - DNA, 20 bp, mouse
ggcggagcctggcagacaag

SEQ ID NO: 726414 - DNA, 20 bp, mouse
gctccggcgacagttcccgc

SEQ ID NO: 726415 - DNA, 20 bp, mouse
gcagccgcgagaggccccgc

SEQ ID NO: 726416 - DNA, 20 bp, mouse
gcacgtgagcccagtctcct

SEQ ID NO: 726417 - DNA, 20 bp, mouse
gacgcccggtgtcgcccagt

SEQ ID NO: 726418 - DNA, 20 bp, mouse
gctcacgtgggtggagtttg

SEQ ID NO: 726419 - DNA, 20 bp, mouse
gtagacaggcgattggggcg

SEQ ID NO: 726420 - DNA, 20 bp, mouse
gacacaaagtggggtgctac

SEQ ID NO: 726421 - DNA, 20 bp, mouse
ggagactgggctcacgtggg

SEQ ID NO: 726422 - DNA, 20 bp, mouse
gctgaagcggagggatcctc

SEQ ID NO: 726423 - DNA, 20 bp, mouse
gggtaggaagagggtgacta

SEQ ID NO: 726424 - DNA, 20 bp, mouse
gcccggtgtcgcccagtggg

SEQ ID NO: 726425 - DNA, 20 bp, mouse
gcgtgagtagacaggcgatt

SEQ ID NO: 726426 - DNA, 20 bp, mouse
gtgtgggcagtggtgggcgg

SEQ ID NO: 726427 - DNA, 20 bp, mouse
gtgatcagactgatcaggat

SEQ ID NO: 726428 - DNA, 20 bp, mouse
gtagggagaggctccctgaa

SEQ ID NO: 726429 - DNA, 20 bp, mouse
gctagctgatcagactgatc

SEQ ID NO: 726430 - DNA, 20 bp, mouse
gggctggccctgggtcatct

SEQ ID NO: 726431 - DNA, 20 bp, mouse
gcagactgatcaggatcggc

SEQ ID NO: 726432 - DNA, 20 bp, mouse
gcggcgtcgcgaccaacctc

SEQ ID NO: 726433 - DNA, 20 bp, mouse
gcctctgcagggataaggtc

SEQ ID NO: 726434 - DNA, 20 bp, mouse
gagaggacctagatgaccca

SEQ ID NO: 726435 - DNA, 20 bp, mouse
gtgctctggcccgtcctcca

SEQ ID NO: 726436 - DNA, 20 bp, mouse
gcccgcccgtgacgacactg

SEQ ID NO: 726437 - DNA, 20 bp, mouse
gtgacgtcacccagagccga

SEQ ID NO: 726438 - DNA, 20 bp, mouse
gactgcctggctcccagtcg

SEQ ID NO: 726439 - DNA, 20 bp, mouse
gttgccgtgaggtcactggg

SEQ ID NO: 726440 - DNA, 20 bp, mouse
gcgcccacccagtgacctca

SEQ ID NO: 726441 - DNA, 20 bp, mouse
ggagcgtgacgtcacggggg

SEQ ID NO: 726442 - DNA, 20 bp, mouse
ggagacgcggaggagcccga

SEQ ID NO: 726443 - DNA, 20 bp, mouse
gcagcctccctctcccaaga

SEQ ID NO: 726444 - DNA, 20 bp, mouse
gtgtgctgacagccacgact

SEQ ID NO: 726445 - DNA, 20 bp, mouse
ggctctgggtgacgtcatcc

SEQ ID NO: 726446 - DNA, 20 bp, mouse
gcgcggctcctcagaccctg

SEQ ID NO: 726447 - DNA, 20 bp, mouse
ggccacctggggcgctgcgg

SEQ ID NO: 726448 - DNA, 20 bp, mouse
gtctgaggagccgcgtgctg

SEQ ID NO: 726449 - DNA, 20 bp, mouse
gtccatcgccagccgggcgg

SEQ ID NO: 726450 - DNA, 20 bp, mouse
ggacctggctctgaaccgca

SEQ ID NO: 726451 - DNA, 20 bp, mouse
gcggcacggggcgacgacgg

SEQ ID NO: 726452 - DNA, 20 bp, mouse
gaggagccgcgtgctggggt

SEQ ID NO: 726453 - DNA, 20 bp, mouse
ggagaggctcccccgagcgg

SEQ ID NO: 726454 - DNA, 20 bp, mouse
gaggccggaccccgcggcac

SEQ ID NO: 726455 - DNA, 20 bp, mouse
gaggctggtgaaggccgcgc

SEQ ID NO: 726456 - DNA, 20 bp, mouse
gccccggccggcggacccgc

SEQ ID NO: 726457 - DNA, 20 bp, mouse
gtcacgcgcggggaccgctg

SEQ ID NO: 726458 - DNA, 20 bp, mouse
ggacccgcgggagcggagcg

SEQ ID NO: 726459 - DNA, 20 bp, mouse
gcgcccccgggctggccgcc

SEQ ID NO: 726460 - DNA, 20 bp, mouse
gaccgctgaggagacggcgc

SEQ ID NO: 726461 - DNA, 20 bp, mouse
gcgagccgggcgcacgcagg

SEQ ID NO: 726462 - DNA, 20 bp, mouse
gccggccggggctcagaccg

SEQ ID NO: 726463 - DNA, 20 bp, mouse
gtgcgcccggctcgcgccct

SEQ ID NO: 726464 - DNA, 20 bp, mouse
gcacacgcgcgggcgcgcga

SEQ ID NO: 726465 - DNA, 20 bp, mouse
gtggtcgccatgttggtcgc

SEQ ID NO: 726466 - DNA, 20 bp, mouse
gcggtggcgggttacaaaat

SEQ ID NO: 726467 - DNA, 20 bp, mouse
ggactccaaatcatcagagt

SEQ ID NO: 726468 - DNA, 20 bp, mouse
ggtaatattcgttggggacg

SEQ ID NO: 726469 - DNA, 20 bp, mouse
gtaatctaaaacatacggta

SEQ ID NO: 726470 - DNA, 20 bp, mouse
gtcgacccactctgatgatt

SEQ ID NO: 726471 - DNA, 20 bp, mouse
ggatagtagcactcggtggc

SEQ ID NO: 726472 - DNA, 20 bp, mouse
ggtcgaataaagactgaaca

SEQ ID NO: 726473 - DNA, 20 bp, mouse
gcaaggatagtagcactcgg

SEQ ID NO: 726474 - DNA, 20 bp, mouse
gggcgtgtgactaaaatgtt

SEQ ID NO: 726475 - DNA, 20 bp, mouse
gactgctctagcaatcgtct

SEQ ID NO: 726476 - DNA, 20 bp, mouse
gaggagggtgcgggtgcgtg

SEQ ID NO: 726477 - DNA, 20 bp, mouse
gacgcgtgctaagtgttgga

SEQ ID NO: 726478 - DNA, 20 bp, mouse
ggctaagtgttggaaggata

SEQ ID NO: 726479 - DNA, 20 bp, mouse
ggcggacgcgtgctaagtgt

SEQ ID NO: 726480 - DNA, 20 bp, mouse
ggaaaggatgagtaccttct

SEQ ID NO: 726481 - DNA, 20 bp, mouse
ggcgggtgcgtgaggctgca

SEQ ID NO: 726482 - DNA, 20 bp, mouse
gggaactgatgaaccgtggc

SEQ ID NO: 726483 - DNA, 20 bp, mouse
gcctggttggttctcaagtc

SEQ ID NO: 726484 - DNA, 20 bp, mouse
gcttcctgcctgctcctctg

SEQ ID NO: 726485 - DNA, 20 bp, mouse
gcgcgtccgcgaggcttatc

SEQ ID NO: 726486 - DNA, 20 bp, mouse
gcattggaaaggggaatcga

SEQ ID NO: 726487 - DNA, 20 bp, mouse
gtccctaaatcccattggaa

SEQ ID NO: 726488 - DNA, 20 bp, mouse
gtgtcaccctgcacggggtg

SEQ ID NO: 726489 - DNA, 20 bp, mouse
ggttactgtcttgtacagat

SEQ ID NO: 726490 - DNA, 20 bp, mouse
gggcgtcgcgaaggatgaag

SEQ ID NO: 726491 - DNA, 20 bp, mouse
gcccctttccaatgggattt

SEQ ID NO: 726492 - DNA, 20 bp, mouse
gtcttcaccacaccccgtgc

SEQ ID NO: 726493 - DNA, 20 bp, mouse
gacttatgtcaccctgcacg

SEQ ID NO: 726494 - DNA, 20 bp, mouse
gcatccttcgcgacgcctat

SEQ ID NO: 726495 - DNA, 20 bp, mouse
gggatgaaggggacccgctg

SEQ ID NO: 726496 - DNA, 20 bp, mouse
ggggttccgtgaactcaccc

SEQ ID NO: 726497 - DNA, 20 bp, mouse
gggctccatgagttcacccg

SEQ ID NO: 726498 - DNA, 20 bp, mouse
ggggcgggtgatgtcaaccg

SEQ ID NO: 726499 - DNA, 20 bp, mouse
gcgggtgatgtcaaccgagg

SEQ ID NO: 726500 - DNA, 20 bp, mouse
ggcggctcccacaacttttg

SEQ ID NO: 726501 - DNA, 20 bp, mouse
ggaacccccgggtgaactca

SEQ ID NO: 726502 - DNA, 20 bp, mouse
gaagagggcgggggcggtct

SEQ ID NO: 726503 - DNA, 20 bp, mouse
gggggcggtctcggtctccc

SEQ ID NO: 726504 - DNA, 20 bp, mouse
gggaaccctcatcttcttga

SEQ ID NO: 726505 - DNA, 20 bp, mouse
ggccacacgccaatcagccc

SEQ ID NO: 726506 - DNA, 20 bp, mouse
gaggctgggaggtaccacgg

SEQ ID NO: 726507 - DNA, 20 bp, mouse
gcaggaggcgggcggtatgg

SEQ ID NO: 726508 - DNA, 20 bp, mouse
ggagcgatgctccgccccaa

SEQ ID NO: 726509 - DNA, 20 bp, mouse
gcgatgctccgccccaaagg

SEQ ID NO: 726510 - DNA, 20 bp, mouse
gccggagagcgtggtggcga

SEQ ID NO: 726511 - DNA, 20 bp, mouse
gggaacatccaggaggcggg

SEQ ID NO: 726512 - DNA, 20 bp, mouse
ggtgaaaggtcacgactctt

SEQ ID NO: 726513 - DNA, 20 bp, mouse
gaggatgccctgctttcccg

SEQ ID NO: 726514 - DNA, 20 bp, mouse
ggtcagcagccagcccgccg

SEQ ID NO: 726515 - DNA, 20 bp, mouse
gtcagcttccgggaacatcc

SEQ ID NO: 726516 - DNA, 20 bp, mouse
gtgaccacgggcgacattca

SEQ ID NO: 726517 - DNA, 20 bp, mouse
ggaggcgccgcagaccgtag

SEQ ID NO: 726518 - DNA, 20 bp, mouse
gtacctggacccaggcaaag

SEQ ID NO: 726519 - DNA, 20 bp, mouse
ggcttaacgcatccctcctg

SEQ ID NO: 726520 - DNA, 20 bp, mouse
gcacgggcgacattcaaggc

SEQ ID NO: 726521 - DNA, 20 bp, mouse
gtcggggccactacggtctg

SEQ ID NO: 726522 - DNA, 20 bp, mouse
gaataagaaaggggcgatcg

SEQ ID NO: 726523 - DNA, 20 bp, mouse
gtaagcctttacctggaccc

SEQ ID NO: 726524 - DNA, 20 bp, mouse
gtgcggcgcctctgtgacca

SEQ ID NO: 726525 - DNA, 20 bp, mouse
gtgcacccgccgaacaactc

SEQ ID NO: 726526 - DNA, 20 bp, mouse
gggcgcttagggaaatagaa

SEQ ID NO: 726527 - DNA, 20 bp, mouse
gcgccccgacaggtcctttc

SEQ ID NO: 726528 - DNA, 20 bp, mouse
ggggaagcgcgggaagataa

SEQ ID NO: 726529 - DNA, 20 bp, mouse
gcaccagaaaggacctgtcg

SEQ ID NO: 726530 - DNA, 20 bp, mouse
gaggacctgtcggggcgctt

SEQ ID NO: 726531 - DNA, 20 bp, mouse
ggggctgcgctgctgaggga

SEQ ID NO: 726532 - DNA, 20 bp, mouse
gcggagaaccatggccgctc

SEQ ID NO: 726533 - DNA, 20 bp, mouse
gaacctttgcgtcgaatccc

SEQ ID NO: 726534 - DNA, 20 bp, mouse
gtcgaatcccgggcagacag

SEQ ID NO: 726535 - DNA, 20 bp, mouse
gctggctgcttcacggatcg

SEQ ID NO: 726536 - DNA, 20 bp, mouse
gaaagcggtgtaaacaaaaa

SEQ ID NO: 726537 - DNA, 20 bp, mouse
gtgccaaaggcccgcgggag

SEQ ID NO: 726538 - DNA, 20 bp, mouse
gcgcaggggcgcagtggctg

SEQ ID NO: 726539 - DNA, 20 bp, mouse
gcactcggcgctgggaccgc

SEQ ID NO: 726540 - DNA, 20 bp, mouse
ggatgtccggacaaataaag

SEQ ID NO: 726541 - DNA, 20 bp, mouse
gggagagcttctggagacgg

SEQ ID NO: 726542 - DNA, 20 bp, mouse
ggggttcaagggagagcttc

SEQ ID NO: 726543 - DNA, 20 bp, mouse
ggcggtgtaaacaaaaaggg

SEQ ID NO: 726544 - DNA, 20 bp, mouse
ggactcagcggtgggactaa

SEQ ID NO: 726545 - DNA, 20 bp, mouse
gcgggaggggcgaagcgagg

SEQ ID NO: 726546 - DNA, 20 bp, mouse
gggaagagagagcaccccaa

SEQ ID NO: 726547 - DNA, 20 bp, mouse
gggggccgggcgggcctctg

SEQ ID NO: 726548 - DNA, 20 bp, mouse
ggaaaactgggtgtgtgagt

SEQ ID NO: 726549 - DNA, 20 bp, mouse
gaagtctcgcaggcgctgaa

SEQ ID NO: 726550 - DNA, 20 bp, mouse
ggcagctcgcgtaaggaatg

SEQ ID NO: 726551 - DNA, 20 bp, mouse
gtactagggcaggatcgcgg

SEQ ID NO: 726552 - DNA, 20 bp, mouse
ggttccttgagaagtctcgc

SEQ ID NO: 726553 - DNA, 20 bp, mouse
ggcagacagcagctcgcgta

SEQ ID NO: 726554 - DNA, 20 bp, mouse
ggtaaggaatgggggagata

SEQ ID NO: 726555 - DNA, 20 bp, mouse
ggggccaactttccggaggg

SEQ ID NO: 726556 - DNA, 20 bp, mouse
gagctccgccaggtctggga

SEQ ID NO: 726557 - DNA, 20 bp, mouse
gtaccctggggctcatctta

SEQ ID NO: 726558 - DNA, 20 bp, mouse
gtcaaggggactgtggaggt

SEQ ID NO: 726559 - DNA, 20 bp, mouse
gcctgctgtgttgacctcaa

SEQ ID NO: 726560 - DNA, 20 bp, mouse
gagtgggggaaatcttccta

SEQ ID NO: 726561 - DNA, 20 bp, mouse
ggacgtctaagtatgagtag

SEQ ID NO: 726562 - DNA, 20 bp, mouse
gggagggaggctatcacttg

SEQ ID NO: 726563 - DNA, 20 bp, mouse
gaaccgtaagatgagcccca

SEQ ID NO: 726564 - DNA, 20 bp, mouse
gcagacctggcggagctccc

SEQ ID NO: 726565 - DNA, 20 bp, mouse
gcctaaagccatctaccctg

SEQ ID NO: 726566 - DNA, 20 bp, mouse
gaatggaggtggccatgtat

SEQ ID NO: 726567 - DNA, 20 bp, mouse
gaggcacaggaaagggatgt

SEQ ID NO: 726568 - DNA, 20 bp, mouse
gtcccactcggcagccatgt

SEQ ID NO: 726569 - DNA, 20 bp, mouse
gcctgggatctccctataca

SEQ ID NO: 726570 - DNA, 20 bp, mouse
gaaagggatgtgggttgctc

SEQ ID NO: 726571 - DNA, 20 bp, mouse
gtagggagatcccagggttt

SEQ ID NO: 726572 - DNA, 20 bp, mouse
gtggtcagagcctaaaccct

SEQ ID NO: 726573 - DNA, 20 bp, mouse
ggccacttggtgtcctaaaa

SEQ ID NO: 726574 - DNA, 20 bp, mouse
gtagacgcatagccctaact

SEQ ID NO: 726575 - DNA, 20 bp, mouse
ggtgtcctaaaaaggaaccc

SEQ ID NO: 726576 - DNA, 20 bp, mouse
gcccccctaaggggaagtac

SEQ ID NO: 726577 - DNA, 20 bp, mouse
gaccgcgtctccttggtcta

SEQ ID NO: 726578 - DNA, 20 bp, mouse
gcctcggtgctgttgagaaa

SEQ ID NO: 726579 - DNA, 20 bp, mouse
gccggtgaaccgcgtctcct

SEQ ID NO: 726580 - DNA, 20 bp, mouse
gtggtctagggttcctaaag

SEQ ID NO: 726581 - DNA, 20 bp, mouse
gagcatctgcagccccccta

SEQ ID NO: 726582 - DNA, 20 bp, mouse
gagcatcccacagtcttcaa

SEQ ID NO: 726583 - DNA, 20 bp, mouse
gcgccgagggagtgcactac

SEQ ID NO: 726584 - DNA, 20 bp, mouse
gcacgtgggtgacaccctcg

SEQ ID NO: 726585 - DNA, 20 bp, mouse
gcattcctgtacttcccctt

SEQ ID NO: 726586 - DNA, 20 bp, mouse
gagaggttgggaaaccttga

SEQ ID NO: 726587 - DNA, 20 bp, mouse
gaggccggaacactgatgaa

SEQ ID NO: 726588 - DNA, 20 bp, mouse
gaaaggttgggaatacttga

SEQ ID NO: 726589 - DNA, 20 bp, mouse
ggagggaagaagaaacggcc

SEQ ID NO: 726590 - DNA, 20 bp, mouse
ggggttccgggccctttctt

SEQ ID NO: 726591 - DNA, 20 bp, mouse
gaggtgccaaaggaacacaa

SEQ ID NO: 726592 - DNA, 20 bp, mouse
gtcaaaggtttcccaagaaa

SEQ ID NO: 726593 - DNA, 20 bp, mouse
ggccaaaggaacacaaaggc

SEQ ID NO: 726594 - DNA, 20 bp, mouse
gaggccggaacactgaagag

SEQ ID NO: 726595 - DNA, 20 bp, mouse
gggaacactgaagagaggtt

SEQ ID NO: 726596 - DNA, 20 bp, mouse
gcgagcctgctggcccagaa

SEQ ID NO: 726597 - DNA, 20 bp, mouse
gaaaaagttcagagcgtagg

SEQ ID NO: 726598 - DNA, 20 bp, mouse
gacagcccttaaagtgtata

SEQ ID NO: 726599 - DNA, 20 bp, mouse
gctggcccagaatggcacga

SEQ ID NO: 726600 - DNA, 20 bp, mouse
gtctcccacggtcccatctc

SEQ ID NO: 726601 - DNA, 20 bp, mouse
ggcacctgagatgggaccgt

SEQ ID NO: 726602 - DNA, 20 bp, mouse
gagttcagagcgtaggtggt

SEQ ID NO: 726603 - DNA, 20 bp, mouse
ggggaggttggggcagaatc

SEQ ID NO: 726604 - DNA, 20 bp, mouse
gcccatctcaggtgcttctc

SEQ ID NO: 726605 - DNA, 20 bp, mouse
gatgggaccgtgggagaaaa

SEQ ID NO: 726606 - DNA, 20 bp, mouse
ggtccaaactaaggggcgaa

SEQ ID NO: 726607 - DNA, 20 bp, mouse
gccacctgagccccatagga

SEQ ID NO: 726608 - DNA, 20 bp, mouse
gtggtacaaagggacgtgcc

SEQ ID NO: 726609 - DNA, 20 bp, mouse
ggatactcctgtccaaacta

SEQ ID NO: 726610 - DNA, 20 bp, mouse
ggaggtggagccttctaaat

SEQ ID NO: 726611 - DNA, 20 bp, mouse
gtggaccacctgagccccat

SEQ ID NO: 726612 - DNA, 20 bp, mouse
gcctccccggaggaattgtt

SEQ ID NO: 726613 - DNA, 20 bp, mouse
gagttggcagggttgtgctc

SEQ ID NO: 726614 - DNA, 20 bp, mouse
gagtcccactcccaaggcag

SEQ ID NO: 726615 - DNA, 20 bp, mouse
gagagaaaaggtggccgggt

SEQ ID NO: 726616 - DNA, 20 bp, mouse
gttctcgcagaacatataac

SEQ ID NO: 726617 - DNA, 20 bp, mouse
gatatgttctgcgagaacac

SEQ ID NO: 726618 - DNA, 20 bp, mouse
ggctgctggtttatttgcta

SEQ ID NO: 726619 - DNA, 20 bp, mouse
ggctagggaaattagcagtg

SEQ ID NO: 726620 - DNA, 20 bp, mouse
gatgtgtatacaaaggacac

SEQ ID NO: 726621 - DNA, 20 bp, mouse
gggaagatactctctttgcg

SEQ ID NO: 726622 - DNA, 20 bp, mouse
gtgagttattcacaataaga

SEQ ID NO: 726623 - DNA, 20 bp, mouse
gctgggttttatttatcacg

SEQ ID NO: 726624 - DNA, 20 bp, mouse
gttcaaatcacagaagcaag

SEQ ID NO: 726625 - DNA, 20 bp, mouse
ggttattcacaataagaagg

SEQ ID NO: 726626 - DNA, 20 bp, mouse
gaggggaagggataaggcct

SEQ ID NO: 726627 - DNA, 20 bp, mouse
ggccctgcaaattgcagcgt

SEQ ID NO: 726628 - DNA, 20 bp, mouse
gtaagtactgcgtgtttctg

SEQ ID NO: 726629 - DNA, 20 bp, mouse
gggcctacgctgcaatttgc

SEQ ID NO: 726630 - DNA, 20 bp, mouse
ggctctaaggcatttatgac

SEQ ID NO: 726631 - DNA, 20 bp, mouse
gtgggatgaaaatgcatctt

SEQ ID NO: 726632 - DNA, 20 bp, mouse
gcaagcgagacaagatttcc

SEQ ID NO: 726633 - DNA, 20 bp, mouse
gtgcttcaggttcggggcaa

SEQ ID NO: 726634 - DNA, 20 bp, mouse
gacctgaagcacctggagta

SEQ ID NO: 726635 - DNA, 20 bp, mouse
gggaatctgcccgtgggctt

SEQ ID NO: 726636 - DNA, 20 bp, mouse
gcaagcagacctccctcaat

SEQ ID NO: 726637 - DNA, 20 bp, mouse
gcacccaagagatgcatgac

SEQ ID NO: 726638 - DNA, 20 bp, mouse
ggaggttgggattgggacat

SEQ ID NO: 726639 - DNA, 20 bp, mouse
gtcctcaggaggttgggatt

SEQ ID NO: 726640 - DNA, 20 bp, mouse
gtcagagcgagttataaata

SEQ ID NO: 726641 - DNA, 20 bp, mouse
gatcgcaactctcccattga

SEQ ID NO: 726642 - DNA, 20 bp, mouse
ggggtaaccatctgagagat

SEQ ID NO: 726643 - DNA, 20 bp, mouse
gaataaggaatggactggac

SEQ ID NO: 726644 - DNA, 20 bp, mouse
gagggagatgagaaagttga

SEQ ID NO: 726645 - DNA, 20 bp, mouse
ggtctttcccaggaacagca

SEQ ID NO: 726646 - DNA, 20 bp, mouse
ggcctcgcgcgggaggtggg

SEQ ID NO: 726647 - DNA, 20 bp, mouse
gggagagaagatgccggctt

SEQ ID NO: 726648 - DNA, 20 bp, mouse
gaaagcgatgagtacatcgc

SEQ ID NO: 726649 - DNA, 20 bp, mouse
gcccgcgcgaggcccggagg

SEQ ID NO: 726650 - DNA, 20 bp, mouse
gagtctcgcgggacttatga

SEQ ID NO: 726651 - DNA, 20 bp, mouse
gacaggaagggtctcccggc

SEQ ID NO: 726652 - DNA, 20 bp, mouse
gtgccggcttaggcagtgat

SEQ ID NO: 726653 - DNA, 20 bp, mouse
gcggagtcacgtgtgcccgt

SEQ ID NO: 726654 - DNA, 20 bp, mouse
gtaaccagccacaaggttaa

SEQ ID NO: 726655 - DNA, 20 bp, mouse
gttctctcccttttcctctc

SEQ ID NO: 726656 - DNA, 20 bp, mouse
gtcccacctcccggcgtctg

SEQ ID NO: 726657 - DNA, 20 bp, mouse
gacctggcgccgcccgtctt

SEQ ID NO: 726658 - DNA, 20 bp, mouse
gagagccaaccgcagacgcc

SEQ ID NO: 726659 - DNA, 20 bp, mouse
ggcgcccgcccaatagcgca

SEQ ID NO: 726660 - DNA, 20 bp, mouse
gtgctccgccagccggctga

SEQ ID NO: 726661 - DNA, 20 bp, mouse
ggctgaaggaagcggaagtt

SEQ ID NO: 726662 - DNA, 20 bp, mouse
gagggcggaggggccgaaga

SEQ ID NO: 726663 - DNA, 20 bp, mouse
gcagcgggacgaggttctcg

SEQ ID NO: 726664 - DNA, 20 bp, mouse
gacctcccggcgtctgcggt

SEQ ID NO: 726665 - DNA, 20 bp, mouse
ggagctgggccgaaggaggg

SEQ ID NO: 726666 - DNA, 20 bp, mouse
gagggaggcggtgggatcgg

SEQ ID NO: 726667 - DNA, 20 bp, mouse
gggggcgggacctagggcga

SEQ ID NO: 726668 - DNA, 20 bp, mouse
gaggtagcgggactcccggc

SEQ ID NO: 726669 - DNA, 20 bp, mouse
ggcggggaaagaaacctgga

SEQ ID NO: 726670 - DNA, 20 bp, mouse
gtagggcgagggaggtgaca

SEQ ID NO: 726671 - DNA, 20 bp, mouse
ggggaggtgactggaggttg

SEQ ID NO: 726672 - DNA, 20 bp, mouse
ggggcgacgtcggggcggga

SEQ ID NO: 726673 - DNA, 20 bp, mouse
gagaaggcggggcgacgtcg

SEQ ID NO: 726674 - DNA, 20 bp, mouse
gcccggcggggaaagaaacc

SEQ ID NO: 726675 - DNA, 20 bp, mouse
ggaggtgacagggaggcggt

SEQ ID NO: 726676 - DNA, 20 bp, mouse
gagggagagccaggcgacaa

SEQ ID NO: 726677 - DNA, 20 bp, mouse
gaggggcggtggtttcgcgg

SEQ ID NO: 726678 - DNA, 20 bp, mouse
gcggggtcgcgcatgctccc

SEQ ID NO: 726679 - DNA, 20 bp, mouse
gggcgcacgaatggggaagt

SEQ ID NO: 726680 - DNA, 20 bp, mouse
ggagaggggcggtggtttcg

SEQ ID NO: 726681 - DNA, 20 bp, mouse
ggggaaccgcaacactgcgc

SEQ ID NO: 726682 - DNA, 20 bp, mouse
gctgcgcgggagacctccca

SEQ ID NO: 726683 - DNA, 20 bp, mouse
gccgcgcaggcgcacgaatg

SEQ ID NO: 726684 - DNA, 20 bp, mouse
gagggagaggctggcgacga

SEQ ID NO: 726685 - DNA, 20 bp, mouse
gagccaggcgacaagggaga

SEQ ID NO: 726686 - DNA, 20 bp, mouse
ggggactgggcagtgccctt

SEQ ID NO: 726687 - DNA, 20 bp, mouse
gcctgtgagaaagatgttag

SEQ ID NO: 726688 - DNA, 20 bp, mouse
ggggacaagcaggcacttac

SEQ ID NO: 726689 - DNA, 20 bp, mouse
gcggctctggtatgtcagat

SEQ ID NO: 726690 - DNA, 20 bp, mouse
gggaaagaactatgacgtaa

SEQ ID NO: 726691 - DNA, 20 bp, mouse
gactgggcagtgcccttggg

SEQ ID NO: 726692 - DNA, 20 bp, mouse
ggcacagccacccgcggctc

SEQ ID NO: 726693 - DNA, 20 bp, mouse
ggaactatgacgtaagggac

SEQ ID NO: 726694 - DNA, 20 bp, mouse
gcagctgaaatacatccctg

SEQ ID NO: 726695 - DNA, 20 bp, mouse
gtcagtggcaaccagttccc

SEQ ID NO: 726696 - DNA, 20 bp, mouse
gagcgcccggagaaaggcgg

SEQ ID NO: 726697 - DNA, 20 bp, mouse
gcaggatgacgcaaccacgg

SEQ ID NO: 726698 - DNA, 20 bp, mouse
gcgcgccgctgtcgggactc

SEQ ID NO: 726699 - DNA, 20 bp, mouse
gggacacgcgcccccgtctc

SEQ ID NO: 726700 - DNA, 20 bp, mouse
gcggcgcgggagcgggtctt

SEQ ID NO: 726701 - DNA, 20 bp, mouse
ggggctgatgcaacccgccg

SEQ ID NO: 726702 - DNA, 20 bp, mouse
gcgcgggagcgggtcttcgg

SEQ ID NO: 726703 - DNA, 20 bp, mouse
gcatgtcagggtgccctctg

SEQ ID NO: 726704 - DNA, 20 bp, mouse
gatcagcgcccggagaaagg

SEQ ID NO: 726705 - DNA, 20 bp, mouse
gggcacggggcgcccataaa

SEQ ID NO: 726706 - DNA, 20 bp, mouse
gggaaggcgcgaccagtggt

SEQ ID NO: 726707 - DNA, 20 bp, mouse
ggcccagcaggcctcaaggg

SEQ ID NO: 726708 - DNA, 20 bp, mouse
gcactggtcgcgccttccga

SEQ ID NO: 726709 - DNA, 20 bp, mouse
gtgggccgcagagggaccag

SEQ ID NO: 726710 - DNA, 20 bp, mouse
gcgggtgagccccgcccttg

SEQ ID NO: 726711 - DNA, 20 bp, mouse
ggcggcccagcaggcctcaa

SEQ ID NO: 726712 - DNA, 20 bp, mouse
gctcacccggccaggcgaaa

SEQ ID NO: 726713 - DNA, 20 bp, mouse
ggggcgccgggtccctcgga

SEQ ID NO: 726714 - DNA, 20 bp, mouse
gcacacccccccgaaagcgt

SEQ ID NO: 726715 - DNA, 20 bp, mouse
gacttcctacgctttcgggg

SEQ ID NO: 726716 - DNA, 20 bp, mouse
gggccgctaggcacaaggtc

SEQ ID NO: 726717 - DNA, 20 bp, mouse
gtgcctagcggccaatgggg

SEQ ID NO: 726718 - DNA, 20 bp, mouse
gggggggcgcagtccacgag

SEQ ID NO: 726719 - DNA, 20 bp, mouse
gcctgagcccggggcaccgg

SEQ ID NO: 726720 - DNA, 20 bp, mouse
ggcggcctctatatatatct

SEQ ID NO: 726721 - DNA, 20 bp, mouse
ggtggactgcgcccccccat

SEQ ID NO: 726722 - DNA, 20 bp, mouse
gaatgggaggaagagacacg

SEQ ID NO: 726723 - DNA, 20 bp, mouse
ggggctcaggcgcgcgccat

SEQ ID NO: 726724 - DNA, 20 bp, mouse
gagacacgcggcaccgctcg

SEQ ID NO: 726725 - DNA, 20 bp, mouse
ggagctggtgctgataacag

SEQ ID NO: 726726 - DNA, 20 bp, mouse
gaagccatagggtgcaggag

SEQ ID NO: 726727 - DNA, 20 bp, mouse
gccaccctgtgcagtgacaa

SEQ ID NO: 726728 - DNA, 20 bp, mouse
gacctcctggacaggaagag

SEQ ID NO: 726729 - DNA, 20 bp, mouse
gaggggagcccgcagcagat

SEQ ID NO: 726730 - DNA, 20 bp, mouse
gggaagagctcgcagatccg

SEQ ID NO: 726731 - DNA, 20 bp, mouse
ggggtgcaggagaggaggcg

SEQ ID NO: 726732 - DNA, 20 bp, mouse
gaaggccagagtggcatccc

SEQ ID NO: 726733 - DNA, 20 bp, mouse
gcgggctcccctccctgggt

SEQ ID NO: 726734 - DNA, 20 bp, mouse
gggggctggagagaacgagt

SEQ ID NO: 726735 - DNA, 20 bp, mouse
gcggtcctgggcgtgtgccc

SEQ ID NO: 726736 - DNA, 20 bp, mouse
ggtccccaaggcacctggaa

SEQ ID NO: 726737 - DNA, 20 bp, mouse
ggaaaggagcacaggcccag

SEQ ID NO: 726738 - DNA, 20 bp, mouse
gggcacctggaaaggagcac

SEQ ID NO: 726739 - DNA, 20 bp, mouse
gggaccctgagtgctaaaga

SEQ ID NO: 726740 - DNA, 20 bp, mouse
gcttatgcaaacggggatgt

SEQ ID NO: 726741 - DNA, 20 bp, mouse
gcaaagtgtgagaaagggtg

SEQ ID NO: 726742 - DNA, 20 bp, mouse
ggaagacggcacaaagtcac

SEQ ID NO: 726743 - DNA, 20 bp, mouse
gaagatggaaagggagtcgg

SEQ ID NO: 726744 - DNA, 20 bp, mouse
gagcctggcacaaactggta

SEQ ID NO: 726745 - DNA, 20 bp, mouse
gaggctgctggctcccggga

SEQ ID NO: 726746 - DNA, 20 bp, mouse
gcggccgttcccacactcgg

SEQ ID NO: 726747 - DNA, 20 bp, mouse
ggccgcgcggcacaatgtcc

SEQ ID NO: 726748 - DNA, 20 bp, mouse
gcgcggcccacctgctcctc

SEQ ID NO: 726749 - DNA, 20 bp, mouse
gccgctgcccgcgcctatat

SEQ ID NO: 726750 - DNA, 20 bp, mouse
gtgtgcccgcgccaattcac

SEQ ID NO: 726751 - DNA, 20 bp, mouse
ggcacaatggtcgctccccg

SEQ ID NO: 726752 - DNA, 20 bp, mouse
gcccaggccgcggggaggtg

SEQ ID NO: 726753 - DNA, 20 bp, mouse
gcggcacaatgtccgggctg

SEQ ID NO: 726754 - DNA, 20 bp, mouse
ggctctcagcatcaggcccc

SEQ ID NO: 726755 - DNA, 20 bp, mouse
gttagcgtgcgctaatgggc

SEQ ID NO: 726756 - DNA, 20 bp, mouse
gagcctgtagccaatgagag

SEQ ID NO: 726757 - DNA, 20 bp, mouse
gtggctgtgcgtggtcggag

SEQ ID NO: 726758 - DNA, 20 bp, mouse
gcctgcccggcctaagtggc

SEQ ID NO: 726759 - DNA, 20 bp, mouse
gtaggccgggcaggactcct

SEQ ID NO: 726760 - DNA, 20 bp, mouse
ggggtctctggcagctggcg

SEQ ID NO: 726761 - DNA, 20 bp, mouse
gcagctgccagagacccgcg

SEQ ID NO: 726762 - DNA, 20 bp, mouse
gcgccgctctcattggctac

SEQ ID NO: 726763 - DNA, 20 bp, mouse
ggtcggagaggccagccgtg

SEQ ID NO: 726764 - DNA, 20 bp, mouse
gggcgagagtgcaaagtccg

SEQ ID NO: 726765 - DNA, 20 bp, mouse
gcaaagcgcgccgctctcat

SEQ ID NO: 726766 - DNA, 20 bp, mouse
gacaccactaagcacttcag

SEQ ID NO: 726767 - DNA, 20 bp, mouse
gctaaggatggagtatgtaa

SEQ ID NO: 726768 - DNA, 20 bp, mouse
gagagccaggggttccgagg

SEQ ID NO: 726769 - DNA, 20 bp, mouse
gcgcgccccctcggaacccc

SEQ ID NO: 726770 - DNA, 20 bp, mouse
gcctggctggaagacctttg

SEQ ID NO: 726771 - DNA, 20 bp, mouse
gtgactactcaccccatctc

SEQ ID NO: 726772 - DNA, 20 bp, mouse
ggaagtgcttagtggtgtcc

SEQ ID NO: 726773 - DNA, 20 bp, mouse
gcagccactgaagtgcttag

SEQ ID NO: 726774 - DNA, 20 bp, mouse
gctccagcgttcttggattt

SEQ ID NO: 726775 - DNA, 20 bp, mouse
ggctggaagacctttgagga

SEQ ID NO: 726776 - DNA, 20 bp, mouse
gaaggcgggacccaactgga

SEQ ID NO: 726777 - DNA, 20 bp, mouse
gggagggaggagattattag

SEQ ID NO: 726778 - DNA, 20 bp, mouse
gcggcacgaggctcccggaa

SEQ ID NO: 726779 - DNA, 20 bp, mouse
gaactgggaagaaatcactt

SEQ ID NO: 726780 - DNA, 20 bp, mouse
gtccttgagctgggcatcta

SEQ ID NO: 726781 - DNA, 20 bp, mouse
gacgaggctcccggaaaggc

SEQ ID NO: 726782 - DNA, 20 bp, mouse
gggggccacaggctggttta

SEQ ID NO: 726783 - DNA, 20 bp, mouse
gatgcccagctcaaggaccc

SEQ ID NO: 726784 - DNA, 20 bp, mouse
ggcgggacccaactggaggg

SEQ ID NO: 726785 - DNA, 20 bp, mouse
gagactagtagatttcttgg

SEQ ID NO: 726786 - DNA, 20 bp, mouse
gacaccagggggccacctac

SEQ ID NO: 726787 - DNA, 20 bp, mouse
ggcaactaatggctacacca

SEQ ID NO: 726788 - DNA, 20 bp, mouse
gttaagtctgcgttctgctt

SEQ ID NO: 726789 - DNA, 20 bp, mouse
ggtccctgtaggtggccccc

SEQ ID NO: 726790 - DNA, 20 bp, mouse
gtgtagctttgctgactagg

SEQ ID NO: 726791 - DNA, 20 bp, mouse
gttgcccagccagcggctta

SEQ ID NO: 726792 - DNA, 20 bp, mouse
gttaactttctcagaagaag

SEQ ID NO: 726793 - DNA, 20 bp, mouse
gtaacactttttgtccctgt

SEQ ID NO: 726794 - DNA, 20 bp, mouse
gactccttaagccgctggct

SEQ ID NO: 726795 - DNA, 20 bp, mouse
ggatacctaaatgtacaggg

SEQ ID NO: 726796 - DNA, 20 bp, mouse
gctgcagctcccgaccgggt

SEQ ID NO: 726797 - DNA, 20 bp, mouse
gcgcccgcgtgacaatcgga

SEQ ID NO: 726798 - DNA, 20 bp, mouse
gccagcccatcccttgggtt

SEQ ID NO: 726799 - DNA, 20 bp, mouse
gaatcggagggtcacgtgaa

SEQ ID NO: 726800 - DNA, 20 bp, mouse
gggttacagaggcttggcca

SEQ ID NO: 726801 - DNA, 20 bp, mouse
gagaactagcccggaggata

SEQ ID NO: 726802 - DNA, 20 bp, mouse
gcctctgtaacccaaaccca

SEQ ID NO: 726803 - DNA, 20 bp, mouse
gggagggtcacgtgaacggg

SEQ ID NO: 726804 - DNA, 20 bp, mouse
gccgaccgggtgggcggtga

SEQ ID NO: 726805 - DNA, 20 bp, mouse
gagggcatggagaactagcc

SEQ ID NO: 726806 - DNA, 20 bp, mouse
gcgggctccgcctccgagag

SEQ ID NO: 726807 - DNA, 20 bp, mouse
gcgctctagccgggatgctg

SEQ ID NO: 726808 - DNA, 20 bp, mouse
gcgggccaatcccctctcgg

SEQ ID NO: 726809 - DNA, 20 bp, mouse
gtggcccggaaattgggggc

SEQ ID NO: 726810 - DNA, 20 bp, mouse
gggcaggctcggtgcagagg

SEQ ID NO: 726811 - DNA, 20 bp, mouse
gaggcggtcgcgctctagcc

SEQ ID NO: 726812 - DNA, 20 bp, mouse
gaggggattggcccggaaat

SEQ ID NO: 726813 - DNA, 20 bp, mouse
ggagccacaccccagcatcc

SEQ ID NO: 726814 - DNA, 20 bp, mouse
gggattggcccggaaattgg

SEQ ID NO: 726815 - DNA, 20 bp, mouse
gtccgcctccgagaggggat

SEQ ID NO: 726816 - DNA, 20 bp, mouse
gcccaggggtgggacctaac

SEQ ID NO: 726817 - DNA, 20 bp, mouse
ggggcccgatggcgcctcag

SEQ ID NO: 726818 - DNA, 20 bp, mouse
ggggtgggacctaacagggg

SEQ ID NO: 726819 - DNA, 20 bp, mouse
ggccacgcctcactctgcca

SEQ ID NO: 726820 - DNA, 20 bp, mouse
gacagcgggcggagcctgac

SEQ ID NO: 726821 - DNA, 20 bp, mouse
ggtgaggcgtggccatccca

SEQ ID NO: 726822 - DNA, 20 bp, mouse
gactccgagggcggggtcgg

SEQ ID NO: 726823 - DNA, 20 bp, mouse
gccggcgcgcgaccaggtag

SEQ ID NO: 726824 - DNA, 20 bp, mouse
gagcacgtcccacccctgtt

SEQ ID NO: 726825 - DNA, 20 bp, mouse
gcccgatggcgcctcagcgg

SEQ ID NO: 726826 - DNA, 20 bp, mouse
gcccctacgcattctatgat

SEQ ID NO: 726827 - DNA, 20 bp, mouse
gcgcatgcgtaacggagtcc

SEQ ID NO: 726828 - DNA, 20 bp, mouse
ggacggcgggcccgaaagaa

SEQ ID NO: 726829 - DNA, 20 bp, mouse
gcgtaacggagtccaggtgt

SEQ ID NO: 726830 - DNA, 20 bp, mouse
gaagaaacgtgagcagtcat

SEQ ID NO: 726831 - DNA, 20 bp, mouse
ggaagaagagctgtctgaag

SEQ ID NO: 726832 - DNA, 20 bp, mouse
gagaagggaactacgactcc

SEQ ID NO: 726833 - DNA, 20 bp, mouse
gtatatataagaggcgccga

SEQ ID NO: 726834 - DNA, 20 bp, mouse
gtgcgtagggggcgtctccc

SEQ ID NO: 726835 - DNA, 20 bp, mouse
ggaaggaagaccaattacag

SEQ ID NO: 726836 - DNA, 20 bp, mouse
ggggagaggccgggccgagt

SEQ ID NO: 726837 - DNA, 20 bp, mouse
gcaccctaggaaagctgccc

SEQ ID NO: 726838 - DNA, 20 bp, mouse
gggacagcctggcagcgcaa

SEQ ID NO: 726839 - DNA, 20 bp, mouse
gtacgtcaacaaccatgccc

SEQ ID NO: 726840 - DNA, 20 bp, mouse
gaaagccctaagatgggggg

SEQ ID NO: 726841 - DNA, 20 bp, mouse
ggcatggttgttgacgtaat

SEQ ID NO: 726842 - DNA, 20 bp, mouse
gcgcccggaccaccccccat

SEQ ID NO: 726843 - DNA, 20 bp, mouse
gtatcctgggcagctttcct

SEQ ID NO: 726844 - DNA, 20 bp, mouse
ggcagcgcaatggctgctgg

SEQ ID NO: 726845 - DNA, 20 bp, mouse
gccgctaaagccctaagatg

SEQ ID NO: 726846 - DNA, 20 bp, mouse
ggcccccagccgaactcctg

SEQ ID NO: 726847 - DNA, 20 bp, mouse
gcgctcgtcccgcccccatg

SEQ ID NO: 726848 - DNA, 20 bp, mouse
gcggggaaggcggagaggtt

SEQ ID NO: 726849 - DNA, 20 bp, mouse
gaaggggcgcagcgtgggaa

SEQ ID NO: 726850 - DNA, 20 bp, mouse
ggcgaggcgccaattggccg

SEQ ID NO: 726851 - DNA, 20 bp, mouse
gccggggcacgcggttaccc

SEQ ID NO: 726852 - DNA, 20 bp, mouse
gggcgcctcgctgcgcagat

SEQ ID NO: 726853 - DNA, 20 bp, mouse
gtgcgcagcgaggcgccaat

SEQ ID NO: 726854 - DNA, 20 bp, mouse
gcgtcggctccgcaggagtt

SEQ ID NO: 726855 - DNA, 20 bp, mouse
ggacgagcggaggccgaggc

SEQ ID NO: 726856 - DNA, 20 bp, mouse
ggggcgggcgtgtcgggcga

SEQ ID NO: 726857 - DNA, 20 bp, mouse
gggacggtgtggctttctat

SEQ ID NO: 726858 - DNA, 20 bp, mouse
gaatggctgccgagaggcgt

SEQ ID NO: 726859 - DNA, 20 bp, mouse
gtgagcgtgtgtgacgtcta

SEQ ID NO: 726860 - DNA, 20 bp, mouse
gaggccccgcctccctggga

SEQ ID NO: 726861 - DNA, 20 bp, mouse
gagggcgcaagacccggtac

SEQ ID NO: 726862 - DNA, 20 bp, mouse
gaactcggcgggagagatca

SEQ ID NO: 726863 - DNA, 20 bp, mouse
gctggccaatggctgccgag

SEQ ID NO: 726864 - DNA, 20 bp, mouse
gaaccccagcgctccactcc

SEQ ID NO: 726865 - DNA, 20 bp, mouse
gtggaggggcggacccgcgc

SEQ ID NO: 726866 - DNA, 20 bp, mouse
gaccgcccggggccttccca

SEQ ID NO: 726867 - DNA, 20 bp, mouse
ggtgacgcgccaccgaaccg

SEQ ID NO: 726868 - DNA, 20 bp, mouse
ggggccttcccacggttcgg

SEQ ID NO: 726869 - DNA, 20 bp, mouse
gccagcccaggcagcgccgg

SEQ ID NO: 726870 - DNA, 20 bp, mouse
gcggggaagcccagagaatc

SEQ ID NO: 726871 - DNA, 20 bp, mouse
gacctcccagcggccgatgg

SEQ ID NO: 726872 - DNA, 20 bp, mouse
ggcggagccggacctcccag

SEQ ID NO: 726873 - DNA, 20 bp, mouse
gcggtggcgcgtcaccgcgg

SEQ ID NO: 726874 - DNA, 20 bp, mouse
gccgggctgcggtgcaggaa

SEQ ID NO: 726875 - DNA, 20 bp, mouse
gcttccccgtggggcctccc

SEQ ID NO: 726876 - DNA, 20 bp, mouse
gatgaattacaggacggctt

SEQ ID NO: 726877 - DNA, 20 bp, mouse
gtgctgtgattgcaagtcta

SEQ ID NO: 726878 - DNA, 20 bp, mouse
gctggagccactgctgagtc

SEQ ID NO: 726879 - DNA, 20 bp, mouse
ggggaagaaacaagttgcag

SEQ ID NO: 726880 - DNA, 20 bp, mouse
ggatggggacgagggcatta

SEQ ID NO: 726881 - DNA, 20 bp, mouse
gacgagggcattaggggtgc

SEQ ID NO: 726882 - DNA, 20 bp, mouse
ggatgggtaggcatgttaac

SEQ ID NO: 726883 - DNA, 20 bp, mouse
gcaacagataattctcccgt

SEQ ID NO: 726884 - DNA, 20 bp, mouse
gcatagcgattttggtttaa

SEQ ID NO: 726885 - DNA, 20 bp, mouse
gaagaccaaagctagataac

SEQ ID NO: 726886 - DNA, 20 bp, mouse
gcagtggggtgtgggagcta

SEQ ID NO: 726887 - DNA, 20 bp, mouse
gaggaacgttggtggcagtg

SEQ ID NO: 726888 - DNA, 20 bp, mouse
gacgatgagcaaaataagga

SEQ ID NO: 726889 - DNA, 20 bp, mouse
gaggaacgatgagcaaaata

SEQ ID NO: 726890 - DNA, 20 bp, mouse
gagccagaggaggtttggtg

SEQ ID NO: 726891 - DNA, 20 bp, mouse
gtccaaaattccaggaacgt

SEQ ID NO: 726892 - DNA, 20 bp, mouse
gaggtggccggctttgaaga

SEQ ID NO: 726893 - DNA, 20 bp, mouse
gtggaaatattggataccaa

SEQ ID NO: 726894 - DNA, 20 bp, mouse
gcattactgggaatgctgga

SEQ ID NO: 726895 - DNA, 20 bp, mouse
gaaatattggataccaaggg

SEQ ID NO: 726896 - DNA, 20 bp, mouse
gaggaggcgcgtgacgggga

SEQ ID NO: 726897 - DNA, 20 bp, mouse
ggacggggagggaagtgcga

SEQ ID NO: 726898 - DNA, 20 bp, mouse
gatctctgaaggaaacagtt

SEQ ID NO: 726899 - DNA, 20 bp, mouse
gaaacagttgggctgggaag

SEQ ID NO: 726900 - DNA, 20 bp, mouse
gtggcagtagaggaccccca

SEQ ID NO: 726901 - DNA, 20 bp, mouse
gggacgcgcgcgcctcgcgt

SEQ ID NO: 726902 - DNA, 20 bp, mouse
gcaaacgcctaagaatggat

SEQ ID NO: 726903 - DNA, 20 bp, mouse
gttaaattagacacttaggt

SEQ ID NO: 726904 - DNA, 20 bp, mouse
gagggaagcgcgtgcgggga

SEQ ID NO: 726905 - DNA, 20 bp, mouse
gcctcgcgtgggcgcgtggg

SEQ ID NO: 726906 - DNA, 20 bp, mouse
gtgaaagagaccagttcctg

SEQ ID NO: 726907 - DNA, 20 bp, mouse
ggagctctcagaaatgacct

SEQ ID NO: 726908 - DNA, 20 bp, mouse
gttggtcgggaggtcactca

SEQ ID NO: 726909 - DNA, 20 bp, mouse
gcgaagaagggcacaaggac

SEQ ID NO: 726910 - DNA, 20 bp, mouse
gctcaggtcaggaaggtgca

SEQ ID NO: 726911 - DNA, 20 bp, mouse
gttaaagtggaacaaataat

SEQ ID NO: 726912 - DNA, 20 bp, mouse
gggtgcaagcagcccgaaga

SEQ ID NO: 726913 - DNA, 20 bp, mouse
gggccagtatccagtgccca

SEQ ID NO: 726914 - DNA, 20 bp, mouse
gaatttcgatgtaagcacat

SEQ ID NO: 726915 - DNA, 20 bp, mouse
ggagaattctctgttacatc

SEQ ID NO: 726916 - DNA, 20 bp, mouse
gggggctggaagagagtaaa

SEQ ID NO: 726917 - DNA, 20 bp, mouse
ggggatctgttgcttgttgg

SEQ ID NO: 726918 - DNA, 20 bp, mouse
gaaagcagctcagaaccgac

SEQ ID NO: 726919 - DNA, 20 bp, mouse
gccaaattgcagctggcctc

SEQ ID NO: 726920 - DNA, 20 bp, mouse
gcagcccaatcgctaagtca

SEQ ID NO: 726921 - DNA, 20 bp, mouse
ggctcctatccgagtaggga

SEQ ID NO: 726922 - DNA, 20 bp, mouse
gctatccgagtagggaaggg

SEQ ID NO: 726923 - DNA, 20 bp, mouse
gtgtggctcctatccgagta

SEQ ID NO: 726924 - DNA, 20 bp, mouse
gtggggctcatttggcagaa

SEQ ID NO: 726925 - DNA, 20 bp, mouse
gaaagaaacttacaaagcaa

SEQ ID NO: 726926 - DNA, 20 bp, mouse
ggagacttgaaggttgtgtt

SEQ ID NO: 726927 - DNA, 20 bp, mouse
gtggcagcagggtggagcta

SEQ ID NO: 726928 - DNA, 20 bp, mouse
gcagggtggagctatggctg

SEQ ID NO: 726929 - DNA, 20 bp, mouse
gcagagctgtggcagcaggg

SEQ ID NO: 726930 - DNA, 20 bp, mouse
gggaagaggctgagacttga

SEQ ID NO: 726931 - DNA, 20 bp, mouse
gtgacctgcccaagtcacac

SEQ ID NO: 726932 - DNA, 20 bp, mouse
gacagctgccccagcagagc

SEQ ID NO: 726933 - DNA, 20 bp, mouse
gaacgtggccagggcaggtg

SEQ ID NO: 726934 - DNA, 20 bp, mouse
gtagccagggaacgtggcca

SEQ ID NO: 726935 - DNA, 20 bp, mouse
gggagcctaacaggatgcag

SEQ ID NO: 726936 - DNA, 20 bp, mouse
gaatgagcagcctggacgag

SEQ ID NO: 726937 - DNA, 20 bp, mouse
gtgcgcgagcagaaaaagaa

SEQ ID NO: 726938 - DNA, 20 bp, mouse
ggctcattggttagtcccaa

SEQ ID NO: 726939 - DNA, 20 bp, mouse
gcgccccgagtcctgctcca

SEQ ID NO: 726940 - DNA, 20 bp, mouse
gggtacaagcgcgttatccg

SEQ ID NO: 726941 - DNA, 20 bp, mouse
gcaccggggtcgctcatcac

SEQ ID NO: 726942 - DNA, 20 bp, mouse
gggcgcgtcagctccgaaag

SEQ ID NO: 726943 - DNA, 20 bp, mouse
gtcattgcgtggtagctcgg

SEQ ID NO: 726944 - DNA, 20 bp, mouse
gcgccatggagcaggactcg

SEQ ID NO: 726945 - DNA, 20 bp, mouse
ggcttggagctgctggggtc

SEQ ID NO: 726946 - DNA, 20 bp, mouse
gtccagctagtgtccaccat

SEQ ID NO: 726947 - DNA, 20 bp, mouse
gcctggctgccctcctatgg

SEQ ID NO: 726948 - DNA, 20 bp, mouse
gtccgcggggcgtgcctagg

SEQ ID NO: 726949 - DNA, 20 bp, mouse
gccctcctaggcacgccccg

SEQ ID NO: 726950 - DNA, 20 bp, mouse
gcaagaatttagaacgttca

SEQ ID NO: 726951 - DNA, 20 bp, mouse
gggagcgggcgatgacgggc

SEQ ID NO: 726952 - DNA, 20 bp, mouse
ggcaggggatggcggggaga

SEQ ID NO: 726953 - DNA, 20 bp, mouse
ggctagtgtccaccatagga

SEQ ID NO: 726954 - DNA, 20 bp, mouse
gcacgggagcgggcgatgac

SEQ ID NO: 726955 - DNA, 20 bp, mouse
gggcttaggaagcttccgcg

SEQ ID NO: 726956 - DNA, 20 bp, mouse
gaacccgggcacaacatctc

SEQ ID NO: 726957 - DNA, 20 bp, mouse
gccccaaaggaatgagtctg

SEQ ID NO: 726958 - DNA, 20 bp, mouse
gcaacctggcactcctggtc

SEQ ID NO: 726959 - DNA, 20 bp, mouse
ggggaccctgtgtaatgatt

SEQ ID NO: 726960 - DNA, 20 bp, mouse
gggcagctggtcaggatcta

SEQ ID NO: 726961 - DNA, 20 bp, mouse
gctggtccggctgttttagt

SEQ ID NO: 726962 - DNA, 20 bp, mouse
gtgcccgggttcccgaacgc

SEQ ID NO: 726963 - DNA, 20 bp, mouse
ggccccagactcattccttt

SEQ ID NO: 726964 - DNA, 20 bp, mouse
ggcaccctgtgtttttattt

SEQ ID NO: 726965 - DNA, 20 bp, mouse
gccgaacgcaggattggcca

SEQ ID NO: 726966 - DNA, 20 bp, mouse
gcacagggagctgcggggag

SEQ ID NO: 726967 - DNA, 20 bp, mouse
ggagtggagcagaccgtttg

SEQ ID NO: 726968 - DNA, 20 bp, mouse
ggggtcacaggtaaaggctg

SEQ ID NO: 726969 - DNA, 20 bp, mouse
gctcggctctgctccacaaa

SEQ ID NO: 726970 - DNA, 20 bp, mouse
gggctccaggggtgacatca

SEQ ID NO: 726971 - DNA, 20 bp, mouse
gaggcacgggtgttagggca

SEQ ID NO: 726972 - DNA, 20 bp, mouse
gggggaggaggtggccttcc

SEQ ID NO: 726973 - DNA, 20 bp, mouse
gtagacaggcacgggtgtta

SEQ ID NO: 726974 - DNA, 20 bp, mouse
gctgcagtgcacttggccac

SEQ ID NO: 726975 - DNA, 20 bp, mouse
gggcacccttgaggggtcac

SEQ ID NO: 726976 - DNA, 20 bp, mouse
ggggcgggagctgggccggt

SEQ ID NO: 726977 - DNA, 20 bp, mouse
gcggcgcaggaacaccctgg

SEQ ID NO: 726978 - DNA, 20 bp, mouse
gtaggtgcctggaacctctg

SEQ ID NO: 726979 - DNA, 20 bp, mouse
ggcggggcgcggatcctgac

SEQ ID NO: 726980 - DNA, 20 bp, mouse
ggatcggcgcgggggttagt

SEQ ID NO: 726981 - DNA, 20 bp, mouse
gagcccgtgcgtctcggggg

SEQ ID NO: 726982 - DNA, 20 bp, mouse
gtgggggcggatcggcgcgg

SEQ ID NO: 726983 - DNA, 20 bp, mouse
ggccctgcggccaatggcgc

SEQ ID NO: 726984 - DNA, 20 bp, mouse
gtcccgcccccgagacgcac

SEQ ID NO: 726985 - DNA, 20 bp, mouse
gcacagcccgtgcgtctcgg

SEQ ID NO: 726986 - DNA, 20 bp, mouse
gcgcaactctgtaccctctg

SEQ ID NO: 726987 - DNA, 20 bp, mouse
gacaccccaaatccctgtag

SEQ ID NO: 726988 - DNA, 20 bp, mouse
gaagagaggagcgctggagg

SEQ ID NO: 726989 - DNA, 20 bp, mouse
gactctgtaccctctggggc

SEQ ID NO: 726990 - DNA, 20 bp, mouse
gtcaccgctacagggatttg

SEQ ID NO: 726991 - DNA, 20 bp, mouse
gcagaaacccaaggaaacca

SEQ ID NO: 726992 - DNA, 20 bp, mouse
gagctcgccctggtttcctt

SEQ ID NO: 726993 - DNA, 20 bp, mouse
ggaccccgaacaaatactaa

SEQ ID NO: 726994 - DNA, 20 bp, mouse
gctagaccccactggttcag

SEQ ID NO: 726995 - DNA, 20 bp, mouse
gggcagcttaactggggacc

SEQ ID NO: 726996 - DNA, 20 bp, mouse
gcgagcggcggtgacgtcaa

SEQ ID NO: 726997 - DNA, 20 bp, mouse
gcgcgcccccgcctgggatg

SEQ ID NO: 726998 - DNA, 20 bp, mouse
gccccagaggctggctcgga

SEQ ID NO: 726999 - DNA, 20 bp, mouse
ggggggggggacacggacga

SEQ ID NO: 727000 - DNA, 20 bp, mouse
gccggcgagcgctagctcct

SEQ ID NO: 727001 - DNA, 20 bp, mouse
gcccgccccgtcgcagccgg

SEQ ID NO: 727002 - DNA, 20 bp, mouse
gcgcagccggaggccaccct

SEQ ID NO: 727003 - DNA, 20 bp, mouse
gtagcgctcgccggggccca

SEQ ID NO: 727004 - DNA, 20 bp, mouse
gcggaggccaccctgggccc

SEQ ID NO: 727005 - DNA, 20 bp, mouse
gtccaggttccgagccccag

SEQ ID NO: 727006 - DNA, 20 bp, mouse
gaaaccccaaagcccaagtc

SEQ ID NO: 727007 - DNA, 20 bp, mouse
gagcgagcacctgagagaag

SEQ ID NO: 727008 - DNA, 20 bp, mouse
gaggggagtccctggaccct

SEQ ID NO: 727009 - DNA, 20 bp, mouse
gtgggagcactctgcaggat

SEQ ID NO: 727010 - DNA, 20 bp, mouse
gagggtgcaagcaaggctgg

SEQ ID NO: 727011 - DNA, 20 bp, mouse
gctccagcgaggggagtccc

SEQ ID NO: 727012 - DNA, 20 bp, mouse
gacctaggagtccctgactt

SEQ ID NO: 727013 - DNA, 20 bp, mouse
gtggggtttcgtctacttgg

SEQ ID NO: 727014 - DNA, 20 bp, mouse
ggagcactctgcaggattgg

SEQ ID NO: 727015 - DNA, 20 bp, mouse
gcaccctcccgggagatcac

SEQ ID NO: 727016 - DNA, 20 bp, mouse
gtgaactggggcaggatgtg

SEQ ID NO: 727017 - DNA, 20 bp, mouse
ggacactagtgctgagggtt

SEQ ID NO: 727018 - DNA, 20 bp, mouse
gacctcgtgacatcagggag

SEQ ID NO: 727019 - DNA, 20 bp, mouse
ggaaccacctcattgaactg

SEQ ID NO: 727020 - DNA, 20 bp, mouse
gcacctcattgaactggggc

SEQ ID NO: 727021 - DNA, 20 bp, mouse
gacctctccctgatgtcacg

SEQ ID NO: 727022 - DNA, 20 bp, mouse
gccagcttcacttttaggta

SEQ ID NO: 727023 - DNA, 20 bp, mouse
gagcatacctcgtgacatca

SEQ ID NO: 727024 - DNA, 20 bp, mouse
ggaagagcagttgggagcgg

SEQ ID NO: 727025 - DNA, 20 bp, mouse
gtaaacaagcgggaatttcc

SEQ ID NO: 727026 - DNA, 20 bp, mouse
gaaacttggggcagtgaaag

SEQ ID NO: 727027 - DNA, 20 bp, mouse
gacaaagcagcgattcagtc

SEQ ID NO: 727028 - DNA, 20 bp, mouse
gcagcgattcagtcagggat

SEQ ID NO: 727029 - DNA, 20 bp, mouse
gtgcacaaggctttgaacga

SEQ ID NO: 727030 - DNA, 20 bp, mouse
gccggagagtaattactctg

SEQ ID NO: 727031 - DNA, 20 bp, mouse
gtaatcttcccccaaacttg

SEQ ID NO: 727032 - DNA, 20 bp, mouse
gcacaggcatttttctctga

SEQ ID NO: 727033 - DNA, 20 bp, mouse
gtagtgaaagatacagggcg

SEQ ID NO: 727034 - DNA, 20 bp, mouse
gagagtaattactctgtgga

SEQ ID NO: 727035 - DNA, 20 bp, mouse
gaagaagtgtgtcccggctg

SEQ ID NO: 727036 - DNA, 20 bp, mouse
gcgggtggagccaggtgctt

SEQ ID NO: 727037 - DNA, 20 bp, mouse
ggggcgtgcccgcactgcgg

SEQ ID NO: 727038 - DNA, 20 bp, mouse
gtccaaccctgcaatagcgg

SEQ ID NO: 727039 - DNA, 20 bp, mouse
ggggcgtggctgcgtcacgg

SEQ ID NO: 727040 - DNA, 20 bp, mouse
ggaggactgggaggtgccgc

SEQ ID NO: 727041 - DNA, 20 bp, mouse
gctggctccacccgctcccg

SEQ ID NO: 727042 - DNA, 20 bp, mouse
ggctaggcagccaaagcacc

SEQ ID NO: 727043 - DNA, 20 bp, mouse
ggccttagagggcaaaagct

SEQ ID NO: 727044 - DNA, 20 bp, mouse
gagaatgtactggtacgtgg

SEQ ID NO: 727045 - DNA, 20 bp, mouse
gggtggggatgcatttgatg

SEQ ID NO: 727046 - DNA, 20 bp, mouse
gagactgcccgcgagtccta

SEQ ID NO: 727047 - DNA, 20 bp, mouse
ggacccaaagcgttcctgat

SEQ ID NO: 727048 - DNA, 20 bp, mouse
gaaaactgcgtcatcttcta

SEQ ID NO: 727049 - DNA, 20 bp, mouse
gtggaattctagcccggggt

SEQ ID NO: 727050 - DNA, 20 bp, mouse
ggtaggagtaaacagtccct

SEQ ID NO: 727051 - DNA, 20 bp, mouse
gccctaaaacccacgaaaag

SEQ ID NO: 727052 - DNA, 20 bp, mouse
gggactgtttactcctaccc

SEQ ID NO: 727053 - DNA, 20 bp, mouse
gaaacagtccctaggactcg

SEQ ID NO: 727054 - DNA, 20 bp, mouse
gcgggcagtctaatccaatc

SEQ ID NO: 727055 - DNA, 20 bp, mouse
gaatccaatcaggaacgctt

SEQ ID NO: 727056 - DNA, 20 bp, mouse
gaggcaaggcagggcgtcta

SEQ ID NO: 727057 - DNA, 20 bp, mouse
ggctcagtgcaggtgctcgg

SEQ ID NO: 727058 - DNA, 20 bp, mouse
ggagaggcgtggccggagtc

SEQ ID NO: 727059 - DNA, 20 bp, mouse
gtgcaggtgctcggaggagg

SEQ ID NO: 727060 - DNA, 20 bp, mouse
ggcagggcgtctatggattt

SEQ ID NO: 727061 - DNA, 20 bp, mouse
gggcggagcactgtgttgag

SEQ ID NO: 727062 - DNA, 20 bp, mouse
gcaggagccggaggcaaggc

SEQ ID NO: 727063 - DNA, 20 bp, mouse
ggcgcacactcgtagttcac

SEQ ID NO: 727064 - DNA, 20 bp, mouse
gctgctgaatttacaacctt

SEQ ID NO: 727065 - DNA, 20 bp, mouse
gtgtgaggcggcggaggtca

SEQ ID NO: 727066 - DNA, 20 bp, mouse
ggggcggggcggggcaaaac

SEQ ID NO: 727067 - DNA, 20 bp, mouse
ggggcaaaacaggagcagtt

SEQ ID NO: 727068 - DNA, 20 bp, mouse
gctaggggcgttaactagtg

SEQ ID NO: 727069 - DNA, 20 bp, mouse
ggggcagggccacactagac

SEQ ID NO: 727070 - DNA, 20 bp, mouse
gaggccgggtaaaggtgggg

SEQ ID NO: 727071 - DNA, 20 bp, mouse
ggtggggcgggtcctggcta

SEQ ID NO: 727072 - DNA, 20 bp, mouse
ggcccgtgagcgtagcgcag

SEQ ID NO: 727073 - DNA, 20 bp, mouse
ggacccgccccacctttacc

SEQ ID NO: 727074 - DNA, 20 bp, mouse
ggcagcggaagtgtaggcgt

SEQ ID NO: 727075 - DNA, 20 bp, mouse
ggccaggccgggtaaaggtg

SEQ ID NO: 727076 - DNA, 20 bp, mouse
gtggggcgcaggccagggtc

SEQ ID NO: 727077 - DNA, 20 bp, mouse
ggggagccacgcagctccca

SEQ ID NO: 727078 - DNA, 20 bp, mouse
ggctgggtccagaacgcggg

SEQ ID NO: 727079 - DNA, 20 bp, mouse
gcccggctgggtccagaacg

SEQ ID NO: 727080 - DNA, 20 bp, mouse
gtgaggcggcagagtttcgg

SEQ ID NO: 727081 - DNA, 20 bp, mouse
gtgtgcgccgtgcccgcccg

SEQ ID NO: 727082 - DNA, 20 bp, mouse
gggcgggcacggcgcacagc

SEQ ID NO: 727083 - DNA, 20 bp, mouse
gagatgtggagccgaggccc

SEQ ID NO: 727084 - DNA, 20 bp, mouse
gcgggccaggcggggaacag

SEQ ID NO: 727085 - DNA, 20 bp, mouse
ggcgggtggggcgcaggcca

SEQ ID NO: 727086 - DNA, 20 bp, mouse
gtggctgcggcagagtgtaa

SEQ ID NO: 727087 - DNA, 20 bp, mouse
ggccgaggggtctgagtcca

SEQ ID NO: 727088 - DNA, 20 bp, mouse
gcggcagagtgtaatggggg

SEQ ID NO: 727089 - DNA, 20 bp, mouse
gtgcaggcgccagaacggga

SEQ ID NO: 727090 - DNA, 20 bp, mouse
gctgcggcagagtgtaatgg

SEQ ID NO: 727091 - DNA, 20 bp, mouse
gagggatgggccagtggctg

SEQ ID NO: 727092 - DNA, 20 bp, mouse
ggcacgggaggtcgcctaca

SEQ ID NO: 727093 - DNA, 20 bp, mouse
ggcctgcatcgggaccctgt

SEQ ID NO: 727094 - DNA, 20 bp, mouse
gagggctgggcatagacccg

SEQ ID NO: 727095 - DNA, 20 bp, mouse
ggagtccagggatgggccag

SEQ ID NO: 727096 - DNA, 20 bp, mouse
gtgcagaggcggggcctcgt

SEQ ID NO: 727097 - DNA, 20 bp, mouse
gaacatcaggtagagaggat

SEQ ID NO: 727098 - DNA, 20 bp, mouse
gagaactccggacttcttct

SEQ ID NO: 727099 - DNA, 20 bp, mouse
gagaaactgcgggtctgagc

SEQ ID NO: 727100 - DNA, 20 bp, mouse
gagaagtccggagttctccg

SEQ ID NO: 727101 - DNA, 20 bp, mouse
gctcgtgggggcggatctaa

SEQ ID NO: 727102 - DNA, 20 bp, mouse
ggcctctgcacctgccgctc

SEQ ID NO: 727103 - DNA, 20 bp, mouse
gactccggacttcttcttgg

SEQ ID NO: 727104 - DNA, 20 bp, mouse
gaaaggcggagccacagggg

SEQ ID NO: 727105 - DNA, 20 bp, mouse
ggaagaatgaaggtggaggc

SEQ ID NO: 727106 - DNA, 20 bp, mouse
gcgcctgcgtccttcaccat

SEQ ID NO: 727107 - DNA, 20 bp, mouse
gcccggagagccaatggtga

SEQ ID NO: 727108 - DNA, 20 bp, mouse
gcagctgacctcctcctgat

SEQ ID NO: 727109 - DNA, 20 bp, mouse
ggcccgcctcacctgagcgg

SEQ ID NO: 727110 - DNA, 20 bp, mouse
ggattggctgagagcaacgt

SEQ ID NO: 727111 - DNA, 20 bp, mouse
gaaggggcgagcgacgggtg

SEQ ID NO: 727112 - DNA, 20 bp, mouse
gagccaatggtgaaggacgc

SEQ ID NO: 727113 - DNA, 20 bp, mouse
gcgggttcccggagagccaa

SEQ ID NO: 727114 - DNA, 20 bp, mouse
gttgctctcagccaatcagg

SEQ ID NO: 727115 - DNA, 20 bp, mouse
ggaggggagggaaaagccga

SEQ ID NO: 727116 - DNA, 20 bp, mouse
gctccctagcggtgacctgc

SEQ ID NO: 727117 - DNA, 20 bp, mouse
gttgaaggagcgctccctag

SEQ ID NO: 727118 - DNA, 20 bp, mouse
gcctctgtaggcttgaacat

SEQ ID NO: 727119 - DNA, 20 bp, mouse
gggaggcagcaatatttcgt

SEQ ID NO: 727120 - DNA, 20 bp, mouse
gcctacagaggcaaagacgg

SEQ ID NO: 727121 - DNA, 20 bp, mouse
ggggagcgctccttcaacct

SEQ ID NO: 727122 - DNA, 20 bp, mouse
gctacagtctaggctccata

SEQ ID NO: 727123 - DNA, 20 bp, mouse
ggtccctagagtagagatgg

SEQ ID NO: 727124 - DNA, 20 bp, mouse
ggccgtccctagagtagaga

SEQ ID NO: 727125 - DNA, 20 bp, mouse
gaggtgggcgcctaggttga

SEQ ID NO: 727126 - DNA, 20 bp, mouse
gggactgccaaggaagtctg

SEQ ID NO: 727127 - DNA, 20 bp, mouse
gttgctcccgagaaggagga

SEQ ID NO: 727128 - DNA, 20 bp, mouse
ggcggctctgattggaaggt

SEQ ID NO: 727129 - DNA, 20 bp, mouse
ggagaaggaggagggactaa

SEQ ID NO: 727130 - DNA, 20 bp, mouse
ggggcttgttgctcccgaga

SEQ ID NO: 727131 - DNA, 20 bp, mouse
gacttggaacttcaaggggt

SEQ ID NO: 727132 - DNA, 20 bp, mouse
gcccagcccgcggctctgat

SEQ ID NO: 727133 - DNA, 20 bp, mouse
gtccacctctgccactccat

SEQ ID NO: 727134 - DNA, 20 bp, mouse
gcaaagaccagccaatggag

SEQ ID NO: 727135 - DNA, 20 bp, mouse
gtgaaggcagagactgcgac

SEQ ID NO: 727136 - DNA, 20 bp, mouse
gaggtgcagggcagaacaca

SEQ ID NO: 727137 - DNA, 20 bp, mouse
gcaccaaaggggcctaagag

SEQ ID NO: 727138 - DNA, 20 bp, mouse
ggtggggccctgcccctctt

SEQ ID NO: 727139 - DNA, 20 bp, mouse
gagagctggctggagtccaa

SEQ ID NO: 727140 - DNA, 20 bp, mouse
gtgtctgagaacgggaaact

SEQ ID NO: 727141 - DNA, 20 bp, mouse
gaaggggcctaagaggggca

SEQ ID NO: 727142 - DNA, 20 bp, mouse
gaagtctaacgacacaccaa

SEQ ID NO: 727143 - DNA, 20 bp, mouse
gaatcagcttgtctgagaac

SEQ ID NO: 727144 - DNA, 20 bp, mouse
gtgctgtgtcacccttagtg

SEQ ID NO: 727145 - DNA, 20 bp, mouse
gctgagaacgggaaactggg

SEQ ID NO: 727146 - DNA, 20 bp, mouse
ggggccggcccggttcgtgg

SEQ ID NO: 727147 - DNA, 20 bp, mouse
gagcgcgcgccgccacgaac

SEQ ID NO: 727148 - DNA, 20 bp, mouse
gcgcgccagcactgccgccc

SEQ ID NO: 727149 - DNA, 20 bp, mouse
gacggcgcatgctcccgctc

SEQ ID NO: 727150 - DNA, 20 bp, mouse
gacctcgaggcaattggggt

SEQ ID NO: 727151 - DNA, 20 bp, mouse
gcctgcgtgcgtggcgttcg

SEQ ID NO: 727152 - DNA, 20 bp, mouse
ggagaacctcgaggcaattg

SEQ ID NO: 727153 - DNA, 20 bp, mouse
gaccgcccctcgcacgtaaa

SEQ ID NO: 727154 - DNA, 20 bp, mouse
gggacccaaaggcgccccga

SEQ ID NO: 727155 - DNA, 20 bp, mouse
ggctgttcgtgtcagacgtg

SEQ ID NO: 727156 - DNA, 20 bp, mouse
gggagctacagagcacgatc

SEQ ID NO: 727157 - DNA, 20 bp, mouse
gctcagaggaggggtacagt

SEQ ID NO: 727158 - DNA, 20 bp, mouse
ggctcataggagtttaacgt

SEQ ID NO: 727159 - DNA, 20 bp, mouse
gggaaaaatccagagtagac

SEQ ID NO: 727160 - DNA, 20 bp, mouse
gtagagaagcaaagatggac

SEQ ID NO: 727161 - DNA, 20 bp, mouse
gctgaaggggatcaagacta

SEQ ID NO: 727162 - DNA, 20 bp, mouse
gaacgggcttatagcagtta

SEQ ID NO: 727163 - DNA, 20 bp, mouse
ggtacccctcctctgaggac

SEQ ID NO: 727164 - DNA, 20 bp, mouse
gagagcacgatctggctctg

SEQ ID NO: 727165 - DNA, 20 bp, mouse
gcttggggccctcttggtca

SEQ ID NO: 727166 - DNA, 20 bp, mouse
ggttagcgggtcttcagcag

SEQ ID NO: 727167 - DNA, 20 bp, mouse
gccagatagccacaccctaa

SEQ ID NO: 727168 - DNA, 20 bp, mouse
ggggtctctcgcgtcctctg

SEQ ID NO: 727169 - DNA, 20 bp, mouse
gagagacaacccttagggtg

SEQ ID NO: 727170 - DNA, 20 bp, mouse
ggcaaggcactgctgttagc

SEQ ID NO: 727171 - DNA, 20 bp, mouse
gaattagctggaaatcgcag

SEQ ID NO: 727172 - DNA, 20 bp, mouse
gcaaagctaacgttgtggca

SEQ ID NO: 727173 - DNA, 20 bp, mouse
gaagctgagagacaaccctt

SEQ ID NO: 727174 - DNA, 20 bp, mouse
gagggcacaagattattgaa

SEQ ID NO: 727175 - DNA, 20 bp, mouse
ggggtgtggctatctggtat

SEQ ID NO: 727176 - DNA, 20 bp, mouse
gcgtgcgcgcaaggattctt

SEQ ID NO: 727177 - DNA, 20 bp, mouse
ggacggagactattaacacg

SEQ ID NO: 727178 - DNA, 20 bp, mouse
gcggaccccgccttctgatg

SEQ ID NO: 727179 - DNA, 20 bp, mouse
gaggttctgccgcacggatt

SEQ ID NO: 727180 - DNA, 20 bp, mouse
gttctgatgaggtcactacg

SEQ ID NO: 727181 - DNA, 20 bp, mouse
gtctgaaccggaatgctcgt

SEQ ID NO: 727182 - DNA, 20 bp, mouse
gggctaagggaaagactcgg

SEQ ID NO: 727183 - DNA, 20 bp, mouse
ggatgaggtcactacggggc

SEQ ID NO: 727184 - DNA, 20 bp, mouse
gccttgcgcgcacgggtgga

SEQ ID NO: 727185 - DNA, 20 bp, mouse
gaaccggaatgctcgtcgga

SEQ ID NO: 727186 - DNA, 20 bp, mouse
gcggcgacgctgctgacgca

SEQ ID NO: 727187 - DNA, 20 bp, mouse
ggcgtcgccgcagagttctc

SEQ ID NO: 727188 - DNA, 20 bp, mouse
gtacgcgtgcgcagtctccg

SEQ ID NO: 727189 - DNA, 20 bp, mouse
gcagagttctcggggagtca

SEQ ID NO: 727190 - DNA, 20 bp, mouse
gggccagcggacgtgcccca

SEQ ID NO: 727191 - DNA, 20 bp, mouse
gcgccctggggcacgtccgc

SEQ ID NO: 727192 - DNA, 20 bp, mouse
gctgctgacgcagggctgga

SEQ ID NO: 727193 - DNA, 20 bp, mouse
gaacctgcacgagctcgccc

SEQ ID NO: 727194 - DNA, 20 bp, mouse
ggggagtcacggaaagcacg

SEQ ID NO: 727195 - DNA, 20 bp, mouse
gccccagggcgagctcgtgc

SEQ ID NO: 727196 - DNA, 20 bp, mouse
ggggaatgcccatacatata

SEQ ID NO: 727197 - DNA, 20 bp, mouse
ggtctgaggcaacagagggt

SEQ ID NO: 727198 - DNA, 20 bp, mouse
gccagatgcccttcagagga

SEQ ID NO: 727199 - DNA, 20 bp, mouse
gaggtaggcagaatcctgtg

SEQ ID NO: 727200 - DNA, 20 bp, mouse
gtagctggttgagtccacat

SEQ ID NO: 727201 - DNA, 20 bp, mouse
gagcctcattgttccttctt

SEQ ID NO: 727202 - DNA, 20 bp, mouse
gaggctactatgacccccac

SEQ ID NO: 727203 - DNA, 20 bp, mouse
gagctacagccttcctctga

SEQ ID NO: 727204 - DNA, 20 bp, mouse
gtgtatgggcattccctatg

SEQ ID NO: 727205 - DNA, 20 bp, mouse
gcctcacaatggcccccttg

SEQ ID NO: 727206 - DNA, 20 bp, mouse
gagggctccgagtcccaagg

SEQ ID NO: 727207 - DNA, 20 bp, mouse
ggcgggaatcgtcccggaga

SEQ ID NO: 727208 - DNA, 20 bp, mouse
ggtcccaagggggagagtga

SEQ ID NO: 727209 - DNA, 20 bp, mouse
gagtgagggacgaccggatg

SEQ ID NO: 727210 - DNA, 20 bp, mouse
ggaagaggcgggaatcgtcc

SEQ ID NO: 727211 - DNA, 20 bp, mouse
gtaggcgcatgcccagtggg

SEQ ID NO: 727212 - DNA, 20 bp, mouse
gaggcccaacccacttttga

SEQ ID NO: 727213 - DNA, 20 bp, mouse
gtcaccttcaaaagtgggtt

SEQ ID NO: 727214 - DNA, 20 bp, mouse
gggggagagtgagggacgac

SEQ ID NO: 727215 - DNA, 20 bp, mouse
gcgcatgcccagtgggtggt

SEQ ID NO: 727216 - DNA, 20 bp, mouse
ggcgagcgagggaacgaaat

SEQ ID NO: 727217 - DNA, 20 bp, mouse
gaccaagccgggctcgtgag

SEQ ID NO: 727218 - DNA, 20 bp, mouse
gcaagcgcgtacggagttct

SEQ ID NO: 727219 - DNA, 20 bp, mouse
gtgcgcgtgcgcactggcgc

SEQ ID NO: 727220 - DNA, 20 bp, mouse
gtctgggaggaggctcggct

SEQ ID NO: 727221 - DNA, 20 bp, mouse
ggccgggctcgtgagaggaa

SEQ ID NO: 727222 - DNA, 20 bp, mouse
gtgcgcacgcgcaggcccac

SEQ ID NO: 727223 - DNA, 20 bp, mouse
gccgagcctcctcccagaac

SEQ ID NO: 727224 - DNA, 20 bp, mouse
ggagggaacgaaatgggcgg

SEQ ID NO: 727225 - DNA, 20 bp, mouse
ggcctcaaacaatgtggaga

SEQ ID NO: 727226 - DNA, 20 bp, mouse
gaacgagcgcttggtcaagg

SEQ ID NO: 727227 - DNA, 20 bp, mouse
gccctcttgaggggtaaggg

SEQ ID NO: 727228 - DNA, 20 bp, mouse
gaaactgcgtagggacccaa

SEQ ID NO: 727229 - DNA, 20 bp, mouse
gttagtccttccaatggaat

SEQ ID NO: 727230 - DNA, 20 bp, mouse
gggccagagctaaaagggac

SEQ ID NO: 727231 - DNA, 20 bp, mouse
gaggagaatatcccaccccc

SEQ ID NO: 727232 - DNA, 20 bp, mouse
ggagaacgagcgcttggtca

SEQ ID NO: 727233 - DNA, 20 bp, mouse
gagaggggccagagctaaaa

SEQ ID NO: 727234 - DNA, 20 bp, mouse
gtctcagagtgaaactgcgt

SEQ ID NO: 727235 - DNA, 20 bp, mouse
ggagtcccgcccatgttctt

SEQ ID NO: 727236 - DNA, 20 bp, mouse
gcacgcgcagggccagactc

SEQ ID NO: 727237 - DNA, 20 bp, mouse
gcagggccagactctgggta

SEQ ID NO: 727238 - DNA, 20 bp, mouse
ggatagctcggcctctaaaa

SEQ ID NO: 727239 - DNA, 20 bp, mouse
gtaaaagggcgacgatcaga

SEQ ID NO: 727240 - DNA, 20 bp, mouse
gggaagacctatccaggggt

SEQ ID NO: 727241 - DNA, 20 bp, mouse
ggggagtgtaatacactata

SEQ ID NO: 727242 - DNA, 20 bp, mouse
ggacgggaagacctatccag

SEQ ID NO: 727243 - DNA, 20 bp, mouse
gtcactaggcgggccaccct

SEQ ID NO: 727244 - DNA, 20 bp, mouse
gctcaaaggcgttttctgac

SEQ ID NO: 727245 - DNA, 20 bp, mouse
gggtggcccgcctagtgaca

SEQ ID NO: 727246 - DNA, 20 bp, mouse
ggggcagcgggtgaagtgag

SEQ ID NO: 727247 - DNA, 20 bp, mouse
ggcgcctccgaagtgggaag

SEQ ID NO: 727248 - DNA, 20 bp, mouse
gagcggagcgcctccgaagt

SEQ ID NO: 727249 - DNA, 20 bp, mouse
gacccctcttcccacttcgg

SEQ ID NO: 727250 - DNA, 20 bp, mouse
gtatgcggaccgccctgagg

SEQ ID NO: 727251 - DNA, 20 bp, mouse
gggacagcgctgtcaaccaa

SEQ ID NO: 727252 - DNA, 20 bp, mouse
ggaaggcggtgcatcgatta

SEQ ID NO: 727253 - DNA, 20 bp, mouse
gaggctccgcggggatcccg

SEQ ID NO: 727254 - DNA, 20 bp, mouse
gggtgtggggaaaagcctct

SEQ ID NO: 727255 - DNA, 20 bp, mouse
gcctctacatgcactgtcat

SEQ ID NO: 727256 - DNA, 20 bp, mouse
gagtcccggggacccggcgg

SEQ ID NO: 727257 - DNA, 20 bp, mouse
ggcgtccccggggactggaa

SEQ ID NO: 727258 - DNA, 20 bp, mouse
ggggcacgccaggagtcccg

SEQ ID NO: 727259 - DNA, 20 bp, mouse
ggtggctactaggcatccta

SEQ ID NO: 727260 - DNA, 20 bp, mouse
ggcatcctagggttgatcaa

SEQ ID NO: 727261 - DNA, 20 bp, mouse
ggagtcctaagggaccacag

SEQ ID NO: 727262 - DNA, 20 bp, mouse
ggagtcccgggggaccagaa

SEQ ID NO: 727263 - DNA, 20 bp, mouse
ggggcgtactgggtgacaga

SEQ ID NO: 727264 - DNA, 20 bp, mouse
gaccagaaggggtgccggat

SEQ ID NO: 727265 - DNA, 20 bp, mouse
gaagtcccgcgggaacgaag

SEQ ID NO: 727266 - DNA, 20 bp, mouse
gtacctggggatgactctga

SEQ ID NO: 727267 - DNA, 20 bp, mouse
gaggcggaagtgcggaggag

SEQ ID NO: 727268 - DNA, 20 bp, mouse
gagccagcgtggacagtgtg

SEQ ID NO: 727269 - DNA, 20 bp, mouse
gtactgaggcggaagtgcgg

SEQ ID NO: 727270 - DNA, 20 bp, mouse
gtggctgaatggttccggcg

SEQ ID NO: 727271 - DNA, 20 bp, mouse
ggacctcggagactgctgtg

SEQ ID NO: 727272 - DNA, 20 bp, mouse
ggctcggggctccacttgtc

SEQ ID NO: 727273 - DNA, 20 bp, mouse
gactgctgtgcggagaggac

SEQ ID NO: 727274 - DNA, 20 bp, mouse
gagcgccatgacacctactg

SEQ ID NO: 727275 - DNA, 20 bp, mouse
gtaggtgtcatggcgctagg

SEQ ID NO: 727276 - DNA, 20 bp, mouse
gcacggatgcgaggcgggga

SEQ ID NO: 727277 - DNA, 20 bp, mouse
gcggggagggccgagccgaa

SEQ ID NO: 727278 - DNA, 20 bp, mouse
gcaatcgagcgccgatggca

SEQ ID NO: 727279 - DNA, 20 bp, mouse
gcggcccgaggggagccgag

SEQ ID NO: 727280 - DNA, 20 bp, mouse
gaccgcggagctccggtcgg

SEQ ID NO: 727281 - DNA, 20 bp, mouse
ggaccggagctccgcggtgg

SEQ ID NO: 727282 - DNA, 20 bp, mouse
gattgcgcgcggactccctg

SEQ ID NO: 727283 - DNA, 20 bp, mouse
gcctcccgggagaatgtcgg

SEQ ID NO: 727284 - DNA, 20 bp, mouse
gctggcccgcagccgccgac

SEQ ID NO: 727285 - DNA, 20 bp, mouse
gcgagccgggaagagcccca

SEQ ID NO: 727286 - DNA, 20 bp, mouse
gggcgggctgcgagcgtcaa

SEQ ID NO: 727287 - DNA, 20 bp, mouse
gcggctgcaggcggaccctg

SEQ ID NO: 727288 - DNA, 20 bp, mouse
gaaacagattctaaaggggt

SEQ ID NO: 727289 - DNA, 20 bp, mouse
ggaagccgttcctcttggag

SEQ ID NO: 727290 - DNA, 20 bp, mouse
gcggaggaggggcccgatat

SEQ ID NO: 727291 - DNA, 20 bp, mouse
gggggatggcgtgagagctc

SEQ ID NO: 727292 - DNA, 20 bp, mouse
gtgacggaagccgttcctct

SEQ ID NO: 727293 - DNA, 20 bp, mouse
gctggggaggggcttcgcgg

SEQ ID NO: 727294 - DNA, 20 bp, mouse
ggctgcgagcgtcaagggcg

SEQ ID NO: 727295 - DNA, 20 bp, mouse
ggaggggcccgatatcgggg

SEQ ID NO: 727296 - DNA, 20 bp, mouse
gagtcccaggctggaatgga

SEQ ID NO: 727297 - DNA, 20 bp, mouse
gtgtgtgtgtgaagcatgga

SEQ ID NO: 727298 - DNA, 20 bp, mouse
gcacccgctgaccggaatcc

SEQ ID NO: 727299 - DNA, 20 bp, mouse
gtcccacttctgaactccca

SEQ ID NO: 727300 - DNA, 20 bp, mouse
gagaagtgggacatacctac

SEQ ID NO: 727301 - DNA, 20 bp, mouse
gccctcccccacccgctgac

SEQ ID NO: 727302 - DNA, 20 bp, mouse
gaaggcaagagggtaggctg

SEQ ID NO: 727303 - DNA, 20 bp, mouse
gttcactctcatatgcctgt

SEQ ID NO: 727304 - DNA, 20 bp, mouse
ggccatgagggcttcaggta

SEQ ID NO: 727305 - DNA, 20 bp, mouse
gatggagggggtggggtacc

SEQ ID NO: 727306 - DNA, 20 bp, mouse
gcggcgatgcagaaccaggg

SEQ ID NO: 727307 - DNA, 20 bp, mouse
gtgctcacaccgaccctcat

SEQ ID NO: 727308 - DNA, 20 bp, mouse
gagcgcgaattgatggatgg

SEQ ID NO: 727309 - DNA, 20 bp, mouse
gaggcggcccggtccgcgta

SEQ ID NO: 727310 - DNA, 20 bp, mouse
gccgggccgcctcggttctt

SEQ ID NO: 727311 - DNA, 20 bp, mouse
gtggttctgcatcgccgggc

SEQ ID NO: 727312 - DNA, 20 bp, mouse
gcgcacctgccaaatcgccc

SEQ ID NO: 727313 - DNA, 20 bp, mouse
gggcgccagcatgcatctag

SEQ ID NO: 727314 - DNA, 20 bp, mouse
gggttcttcggtagacaggg

SEQ ID NO: 727315 - DNA, 20 bp, mouse
gcggggcggggctgcgtcgg

SEQ ID NO: 727316 - DNA, 20 bp, mouse
gcggcggcttcgtgaggaat

SEQ ID NO: 727317 - DNA, 20 bp, mouse
gacaccgcccgccctcctgg

SEQ ID NO: 727318 - DNA, 20 bp, mouse
gaagactgccggcgccgaac

SEQ ID NO: 727319 - DNA, 20 bp, mouse
gcccgcgcgcggaggacgct

SEQ ID NO: 727320 - DNA, 20 bp, mouse
gtgccagcgtggggcggttg

SEQ ID NO: 727321 - DNA, 20 bp, mouse
gccgccagggagaaacgccc

SEQ ID NO: 727322 - DNA, 20 bp, mouse
ggcagtgcggcggcttcgtg

SEQ ID NO: 727323 - DNA, 20 bp, mouse
gagctggtgggtcttgagcg

SEQ ID NO: 727324 - DNA, 20 bp, mouse
gactccggggcgtttctccc

SEQ ID NO: 727325 - DNA, 20 bp, mouse
gtcctgggggaagacccgaa

SEQ ID NO: 727326 - DNA, 20 bp, mouse
gtaggtcggtggaatcgcaa

SEQ ID NO: 727327 - DNA, 20 bp, mouse
gcaaaaacacgaagctaggt

SEQ ID NO: 727328 - DNA, 20 bp, mouse
gggcggcctcaaaacttctc

SEQ ID NO: 727329 - DNA, 20 bp, mouse
ggtacaaggagaatctgctg

SEQ ID NO: 727330 - DNA, 20 bp, mouse
gtgcaggcagacaggcgcac

SEQ ID NO: 727331 - DNA, 20 bp, mouse
gaaacacgaagctaggtcgg

SEQ ID NO: 727332 - DNA, 20 bp, mouse
gcagacaggcgcacgggagg

SEQ ID NO: 727333 - DNA, 20 bp, mouse
ggagctcaactagtgaaagg

SEQ ID NO: 727334 - DNA, 20 bp, mouse
gcctgcaaaaacacgaagct

SEQ ID NO: 727335 - DNA, 20 bp, mouse
gtggtagatgcctatcaaaa

SEQ ID NO: 727336 - DNA, 20 bp, mouse
gtggcagtttggagttccaa

SEQ ID NO: 727337 - DNA, 20 bp, mouse
gcacaggtacgtgaaaccga

SEQ ID NO: 727338 - DNA, 20 bp, mouse
gcgggcagagggcggtggat

SEQ ID NO: 727339 - DNA, 20 bp, mouse
ggggactaacaaacacaatt

SEQ ID NO: 727340 - DNA, 20 bp, mouse
gctctgcccgcggcgactca

SEQ ID NO: 727341 - DNA, 20 bp, mouse
gaaaataataacacagaaat

SEQ ID NO: 727342 - DNA, 20 bp, mouse
gtccaagggagaacagcctt

SEQ ID NO: 727343 - DNA, 20 bp, mouse
gaccgaaggctgttctccct

SEQ ID NO: 727344 - DNA, 20 bp, mouse
gtcggcagtaagtaaaaatt

SEQ ID NO: 727345 - DNA, 20 bp, mouse
gtgtaaccttgagtcgccgc

SEQ ID NO: 727346 - DNA, 20 bp, mouse
gaaaggatccgagaagtctc

SEQ ID NO: 727347 - DNA, 20 bp, mouse
gcctaggcgcgttgtcttta

SEQ ID NO: 727348 - DNA, 20 bp, mouse
gtctcgagtttggtcggtaa

SEQ ID NO: 727349 - DNA, 20 bp, mouse
ggcaccaaatctctcgagtt

SEQ ID NO: 727350 - DNA, 20 bp, mouse
gcaactccaaaggaagtccg

SEQ ID NO: 727351 - DNA, 20 bp, mouse
ggcgctgattggtgctccag

SEQ ID NO: 727352 - DNA, 20 bp, mouse
ggggggaattagggactcct

SEQ ID NO: 727353 - DNA, 20 bp, mouse
gcaaatctctcgagtttggt

SEQ ID NO: 727354 - DNA, 20 bp, mouse
gggtgctccagcggcctgcc

SEQ ID NO: 727355 - DNA, 20 bp, mouse
gccgagaagtctcaggcttc

SEQ ID NO: 727356 - DNA, 20 bp, mouse
ggcgccgcgttgccagagaa

SEQ ID NO: 727357 - DNA, 20 bp, mouse
gagagaagctgcgtggtgat

SEQ ID NO: 727358 - DNA, 20 bp, mouse
ggaaataattagggacttgg

SEQ ID NO: 727359 - DNA, 20 bp, mouse
gggaaagcagtgcataccgg

SEQ ID NO: 727360 - DNA, 20 bp, mouse
gaagctgaagatcctttctc

SEQ ID NO: 727361 - DNA, 20 bp, mouse
gaggcaagaatgtagcctac

SEQ ID NO: 727362 - DNA, 20 bp, mouse
ggggtgccgattttgaacat

SEQ ID NO: 727363 - DNA, 20 bp, mouse
ggcgcacggcgcacggcgca

SEQ ID NO: 727364 - DNA, 20 bp, mouse
gaacataggtgcacaaatta

SEQ ID NO: 727365 - DNA, 20 bp, mouse
gcaacgcggcgcacggcgca

SEQ ID NO: 727366 - DNA, 20 bp, mouse
gcatctgagaggacactccg

SEQ ID NO: 727367 - DNA, 20 bp, mouse
gcagctccgccctatataaa

SEQ ID NO: 727368 - DNA, 20 bp, mouse
gctggacagcgcaccaatca

SEQ ID NO: 727369 - DNA, 20 bp, mouse
gcatgaagcccgagacttcg

SEQ ID NO: 727370 - DNA, 20 bp, mouse
gccgcggctgccagcgaggc

SEQ ID NO: 727371 - DNA, 20 bp, mouse
gtaagtgaaggaagtaacac

SEQ ID NO: 727372 - DNA, 20 bp, mouse
gtaatgttccccgaagtctc

SEQ ID NO: 727373 - DNA, 20 bp, mouse
gggcggagctgcgccgtgat

SEQ ID NO: 727374 - DNA, 20 bp, mouse
gaatcgggcaattcgatgta

SEQ ID NO: 727375 - DNA, 20 bp, mouse
ggctcaataggcaggactct

SEQ ID NO: 727376 - DNA, 20 bp, mouse
gggggcgcttatatagagca

SEQ ID NO: 727377 - DNA, 20 bp, mouse
ggtggaatctaagtccccgt

SEQ ID NO: 727378 - DNA, 20 bp, mouse
gtaagtccccgtgggtcacc

SEQ ID NO: 727379 - DNA, 20 bp, mouse
gtatgacaccaggtgaccca

SEQ ID NO: 727380 - DNA, 20 bp, mouse
gacaaatgcccctcctccgg

SEQ ID NO: 727381 - DNA, 20 bp, mouse
gcctgcatgccagaactagt

SEQ ID NO: 727382 - DNA, 20 bp, mouse
gaacacaaatgcccctcctc

SEQ ID NO: 727383 - DNA, 20 bp, mouse
ggaggggtcttctacatatg

SEQ ID NO: 727384 - DNA, 20 bp, mouse
gcaggtacatttgtcaacaa

SEQ ID NO: 727385 - DNA, 20 bp, mouse
ggtagtgggggcgtgcgggg

SEQ ID NO: 727386 - DNA, 20 bp, mouse
gagaaaacacacacgacttg

SEQ ID NO: 727387 - DNA, 20 bp, mouse
gtgagaagcggggtatttat

SEQ ID NO: 727388 - DNA, 20 bp, mouse
gtggacattggatgacgtat

SEQ ID NO: 727389 - DNA, 20 bp, mouse
gtgattggacagtaagtgct

SEQ ID NO: 727390 - DNA, 20 bp, mouse
gtgctgggtgcatgcaaata

SEQ ID NO: 727391 - DNA, 20 bp, mouse
gtgagacgttggtgtgggaa

SEQ ID NO: 727392 - DNA, 20 bp, mouse
ggacttgaggttgagaagcg

SEQ ID NO: 727393 - DNA, 20 bp, mouse
gtatttataggcgtggacat

SEQ ID NO: 727394 - DNA, 20 bp, mouse
gatgccggaggtggcggtaa

SEQ ID NO: 727395 - DNA, 20 bp, mouse
gtgagccatgccggaggtgg

SEQ ID NO: 727396 - DNA, 20 bp, mouse
gttaaagaacgatatgaaaa

SEQ ID NO: 727397 - DNA, 20 bp, mouse
gggtggcaaggcccgcgcta

SEQ ID NO: 727398 - DNA, 20 bp, mouse
gaaactctgaaatatagagt

SEQ ID NO: 727399 - DNA, 20 bp, mouse
ggctagggaatcttgaactc

SEQ ID NO: 727400 - DNA, 20 bp, mouse
ggcaggcctttatgcaaatg

SEQ ID NO: 727401 - DNA, 20 bp, mouse
gggtacgatatattaaccaa

SEQ ID NO: 727402 - DNA, 20 bp, mouse
gaaatgaggagctcaaattc

SEQ ID NO: 727403 - DNA, 20 bp, mouse
gacttaaacgcatacatgtc

SEQ ID NO: 727404 - DNA, 20 bp, mouse
gtaaaaaccacgtagattct

SEQ ID NO: 727405 - DNA, 20 bp, mouse
gagctactgtcctgttttca

SEQ ID NO: 727406 - DNA, 20 bp, mouse
gagaaaaagtagtgggttca

SEQ ID NO: 727407 - DNA, 20 bp, mouse
gaggaacctcagtgtgggct

SEQ ID NO: 727408 - DNA, 20 bp, mouse
gcggacttctcctacttata

SEQ ID NO: 727409 - DNA, 20 bp, mouse
gagggcgtttatgctaatga

SEQ ID NO: 727410 - DNA, 20 bp, mouse
gaaacacaggaacctcagtg

SEQ ID NO: 727411 - DNA, 20 bp, mouse
ggtaaacgctactacttgat

SEQ ID NO: 727412 - DNA, 20 bp, mouse
gacgcggcagcttttatagt

SEQ ID NO: 727413 - DNA, 20 bp, mouse
gccgttcccagcccacactg

SEQ ID NO: 727414 - DNA, 20 bp, mouse
gccagaagcagattttctat

SEQ ID NO: 727415 - DNA, 20 bp, mouse
ggcataaacgccctataagt

SEQ ID NO: 727416 - DNA, 20 bp, mouse
gcgccccgaatgcttctcat

SEQ ID NO: 727417 - DNA, 20 bp, mouse
ggtgaaagggcacctttgat

SEQ ID NO: 727418 - DNA, 20 bp, mouse
gtggtcttgtctagttgatg

SEQ ID NO: 727419 - DNA, 20 bp, mouse
gattcggggcgcacgttgat

SEQ ID NO: 727420 - DNA, 20 bp, mouse
gcgcccagcgaataatataa

SEQ ID NO: 727421 - DNA, 20 bp, mouse
gtccgtcataaaccaatcaa

SEQ ID NO: 727422 - DNA, 20 bp, mouse
gcatggttggtgagaatttc

SEQ ID NO: 727423 - DNA, 20 bp, mouse
gtattcgctgggcgcgaaaa

SEQ ID NO: 727424 - DNA, 20 bp, mouse
ggaaaaaagacgtcagccaa

SEQ ID NO: 727425 - DNA, 20 bp, mouse
gagacgtcagccaatggcat

SEQ ID NO: 727426 - DNA, 20 bp, mouse
gacaacgaagcggtactaaa

SEQ ID NO: 727427 - DNA, 20 bp, mouse
gggaaaagctgatgtgtgat

SEQ ID NO: 727428 - DNA, 20 bp, mouse
ggcaaagaattacaacgaag

SEQ ID NO: 727429 - DNA, 20 bp, mouse
ggggtaatggtgtcactaac

SEQ ID NO: 727430 - DNA, 20 bp, mouse
gcgttcttgccattttatag

SEQ ID NO: 727431 - DNA, 20 bp, mouse
ggtagtcaactctgatttga

SEQ ID NO: 727432 - DNA, 20 bp, mouse
gggtacaatacaatctaatt

SEQ ID NO: 727433 - DNA, 20 bp, mouse
gtccagacattgacgcaaga

SEQ ID NO: 727434 - DNA, 20 bp, mouse
gctttcctctgcagccaata

SEQ ID NO: 727435 - DNA, 20 bp, mouse
gagctacttatactcgtaca

SEQ ID NO: 727436 - DNA, 20 bp, mouse
gaggacagcaagaattaatt

SEQ ID NO: 727437 - DNA, 20 bp, mouse
ggaaaacggagtgatctcgt

SEQ ID NO: 727438 - DNA, 20 bp, mouse
gaggaaaagactaaataaaa

SEQ ID NO: 727439 - DNA, 20 bp, mouse
gtccttctgggccttagtaa

SEQ ID NO: 727440 - DNA, 20 bp, mouse
gtccaagaagtccgttacta

SEQ ID NO: 727441 - DNA, 20 bp, mouse
ggatagtgagcactgaactc

SEQ ID NO: 727442 - DNA, 20 bp, mouse
gtcaacttctggcgcgaaaa

SEQ ID NO: 727443 - DNA, 20 bp, mouse
gtccgttactaaggcccaga

SEQ ID NO: 727444 - DNA, 20 bp, mouse
gggagctagaggtgccttga

SEQ ID NO: 727445 - DNA, 20 bp, mouse
gtgaccaaaaatgggactat

SEQ ID NO: 727446 - DNA, 20 bp, mouse
gggcgcgaaaaggaacgttc

SEQ ID NO: 727447 - DNA, 20 bp, mouse
ggaaaaggaacgttcgggat

SEQ ID NO: 727448 - DNA, 20 bp, mouse
gaagagccgatcagcttctg

SEQ ID NO: 727449 - DNA, 20 bp, mouse
gaaaatgatgattgggtgat

SEQ ID NO: 727450 - DNA, 20 bp, mouse
gcggctcttcccttttaaag

SEQ ID NO: 727451 - DNA, 20 bp, mouse
gtggtttgatgacgtcatat

SEQ ID NO: 727452 - DNA, 20 bp, mouse
gccttattcaaataaagctt

SEQ ID NO: 727453 - DNA, 20 bp, mouse
ggtggtatagctctacgtag

SEQ ID NO: 727454 - DNA, 20 bp, mouse
ggatgacgtcatataggctt

SEQ ID NO: 727455 - DNA, 20 bp, mouse
ggaataaggcctctttaaaa

SEQ ID NO: 727456 - DNA, 20 bp, mouse
ggaaaaaggaggcccgtcat

SEQ ID NO: 727457 - DNA, 20 bp, mouse
gcaagcagataggaacacca

SEQ ID NO: 727458 - DNA, 20 bp, mouse
ggggagttgtgtattctcat

SEQ ID NO: 727459 - DNA, 20 bp, mouse
gcccaacaggacaagcagat

SEQ ID NO: 727460 - DNA, 20 bp, mouse
ggtgagttcaacttaaccaa

SEQ ID NO: 727461 - DNA, 20 bp, mouse
gaatgcccttgtctgggtag

SEQ ID NO: 727462 - DNA, 20 bp, mouse
ggtgaccactacccagacaa

SEQ ID NO: 727463 - DNA, 20 bp, mouse
gtctagataaagagtacccg

SEQ ID NO: 727464 - DNA, 20 bp, mouse
gtcaagccagggcgcgaaaa

SEQ ID NO: 727465 - DNA, 20 bp, mouse
gccaatggaaacgaggtttt

SEQ ID NO: 727466 - DNA, 20 bp, mouse
gcgggctcaggcatactgag

SEQ ID NO: 727467 - DNA, 20 bp, mouse
gacatgacgtatggtgattc

SEQ ID NO: 727468 - DNA, 20 bp, mouse
gtcaaggctggacgcgaaaa

SEQ ID NO: 727469 - DNA, 20 bp, mouse
gttcaaaaccagggcgccat

SEQ ID NO: 727470 - DNA, 20 bp, mouse
gcaagggattttcaaaacca

SEQ ID NO: 727471 - DNA, 20 bp, mouse
gttggttaccaatggcgccc

SEQ ID NO: 727472 - DNA, 20 bp, mouse
gcgcatagtatatatagtca

SEQ ID NO: 727473 - DNA, 20 bp, mouse
gtgcattttaaacaaactta

SEQ ID NO: 727474 - DNA, 20 bp, mouse
gtagtatatatagtcaaggc

SEQ ID NO: 727475 - DNA, 20 bp, mouse
gacgtatggtgattcaggtt

SEQ ID NO: 727476 - DNA, 20 bp, mouse
ggacttagcgggttcaggca

SEQ ID NO: 727477 - DNA, 20 bp, mouse
gcttgctatgattgggtatt

SEQ ID NO: 727478 - DNA, 20 bp, mouse
gcgctcccgccccgaagaag

SEQ ID NO: 727479 - DNA, 20 bp, mouse
ggaaaagcccttgctatgat

SEQ ID NO: 727480 - DNA, 20 bp, mouse
ggagcggacttagcgggttc

SEQ ID NO: 727481 - DNA, 20 bp, mouse
ggcaactctgttattggtct

SEQ ID NO: 727482 - DNA, 20 bp, mouse
gagccacaagtttgtttaaa

SEQ ID NO: 727483 - DNA, 20 bp, mouse
gttcaatgcaactctgttat

SEQ ID NO: 727484 - DNA, 20 bp, mouse
gtgccttttaaacaaacttg

SEQ ID NO: 727485 - DNA, 20 bp, mouse
gatgcagggcatgaaaaagt

SEQ ID NO: 727486 - DNA, 20 bp, mouse
gggtgactgagcagaagtaa

SEQ ID NO: 727487 - DNA, 20 bp, mouse
gtacactaggtaactacaga

SEQ ID NO: 727488 - DNA, 20 bp, mouse
ggagcagaagtaatggtcac

SEQ ID NO: 727489 - DNA, 20 bp, mouse
gtgtagttacctagtgtatg

SEQ ID NO: 727490 - DNA, 20 bp, mouse
gcctagtgtatgtgggactt

SEQ ID NO: 727491 - DNA, 20 bp, mouse
gaaactgtcattatttaatc

SEQ ID NO: 727492 - DNA, 20 bp, mouse
gaatttcaggtctctgacat

SEQ ID NO: 727493 - DNA, 20 bp, mouse
gtaatgacagtttctaacaa

SEQ ID NO: 727494 - DNA, 20 bp, mouse
gtgaaattccagtactaaag

SEQ ID NO: 727495 - DNA, 20 bp, mouse
gctcagtgagaaaagctttc

SEQ ID NO: 727496 - DNA, 20 bp, mouse
ggggcgggaacggacttaac

SEQ ID NO: 727497 - DNA, 20 bp, mouse
gcggcataaacgcctcccat

SEQ ID NO: 727498 - DNA, 20 bp, mouse
gagaagccagccaatcgcgt

SEQ ID NO: 727499 - DNA, 20 bp, mouse
gggctcaggcatgttaggtc

SEQ ID NO: 727500 - DNA, 20 bp, mouse
gcacggcgcaagttgtagcg

SEQ ID NO: 727501 - DNA, 20 bp, mouse
gagcccttcgctttttaata

SEQ ID NO: 727502 - DNA, 20 bp, mouse
gtaacaggctcaggcatgtt

SEQ ID NO: 727503 - DNA, 20 bp, mouse
gtgccgaagcgtagttccat

SEQ ID NO: 727504 - DNA, 20 bp, mouse
ggaaaaagagcctacgcgat

SEQ ID NO: 727505 - DNA, 20 bp, mouse
ggcccaatggaactacgctt

SEQ ID NO: 727506 - DNA, 20 bp, mouse
gggctcaggcatgatgagac

SEQ ID NO: 727507 - DNA, 20 bp, mouse
ggaactctggaactctagca

SEQ ID NO: 727508 - DNA, 20 bp, mouse
gcatgatgagactggaactc

SEQ ID NO: 727509 - DNA, 20 bp, mouse
ggggatcgggcgcctatgat

SEQ ID NO: 727510 - DNA, 20 bp, mouse
gaaaaaagggcctatgcgat

SEQ ID NO: 727511 - DNA, 20 bp, mouse
gtggtcctgtctatttgatg

SEQ ID NO: 727512 - DNA, 20 bp, mouse
gcgtcaattggacaagactt

SEQ ID NO: 727513 - DNA, 20 bp, mouse
gtatatcatgaaccaatcat

SEQ ID NO: 727514 - DNA, 20 bp, mouse
gacgaatgggaagcattcgc

SEQ ID NO: 727515 - DNA, 20 bp, mouse
gcgcccagagaaaactataa

SEQ ID NO: 727516 - DNA, 20 bp, mouse
ggggatcgggcgcctatgat

SEQ ID NO: 727517 - DNA, 20 bp, mouse
gggctcaggcatgatgagac

SEQ ID NO: 727518 - DNA, 20 bp, mouse
ggaactctggaactctagca

SEQ ID NO: 727519 - DNA, 20 bp, mouse
gtatatcatgaaccaatcat

SEQ ID NO: 727520 - DNA, 20 bp, mouse
gcgtcaattggacaagactt

SEQ ID NO: 727521 - DNA, 20 bp, mouse
gcatgatgagactggaactc

SEQ ID NO: 727522 - DNA, 20 bp, mouse
gtggtcctgtctatttgatg

SEQ ID NO: 727523 - DNA, 20 bp, mouse
gttcaaatgaggcatgggat

SEQ ID NO: 727524 - DNA, 20 bp, mouse
gaaaaaagggcctatgcgat

SEQ ID NO: 727525 - DNA, 20 bp, mouse
gttcgcgggcgcacgtcaat

SEQ ID NO: 727526 - DNA, 20 bp, mouse
ggaactacgcacaacgaatt

SEQ ID NO: 727527 - DNA, 20 bp, mouse
gtaaataggcgtggtcatgg

SEQ ID NO: 727528 - DNA, 20 bp, mouse
gcctacaaagcggggtggca

SEQ ID NO: 727529 - DNA, 20 bp, mouse
gtgctgggtgcatgcaaata

SEQ ID NO: 727530 - DNA, 20 bp, mouse
ggtcaagtctcgctcttcca

SEQ ID NO: 727531 - DNA, 20 bp, mouse
gtgattggacagtaagtgct

SEQ ID NO: 727532 - DNA, 20 bp, mouse
gtggacattggatgacgtat

SEQ ID NO: 727533 - DNA, 20 bp, mouse
gcaggtttgcagtttcctgt

SEQ ID NO: 727534 - DNA, 20 bp, mouse
gtcgttgtgcgtagttccct

SEQ ID NO: 727535 - DNA, 20 bp, mouse
ggaagagcgagacttgacct

SEQ ID NO: 727536 - DNA, 20 bp, mouse
gctcccgccaaagccaagac

SEQ ID NO: 727537 - DNA, 20 bp, mouse
gtcaaaatcccatctacaat

SEQ ID NO: 727538 - DNA, 20 bp, mouse
gcactgcaagcagtgcgaca

SEQ ID NO: 727539 - DNA, 20 bp, mouse
gctcttgcccaattgtagat

SEQ ID NO: 727540 - DNA, 20 bp, mouse
ggaggagccggtcttggctt

SEQ ID NO: 727541 - DNA, 20 bp, mouse
gccggcgcccacggctcacg

SEQ ID NO: 727542 - DNA, 20 bp, mouse
gcgaaatatcgctgtcctat

SEQ ID NO: 727543 - DNA, 20 bp, mouse
gtacctggcggccgagatca

SEQ ID NO: 727544 - DNA, 20 bp, mouse
gactaactgtaggccggccc

SEQ ID NO: 727545 - DNA, 20 bp, mouse
gttaagaataatggcctcaa

SEQ ID NO: 727546 - DNA, 20 bp, mouse
ggtaaacgctactacttgat

SEQ ID NO: 727547 - DNA, 20 bp, mouse
gacgcggcagcttttatagt

SEQ ID NO: 727548 - DNA, 20 bp, mouse
gagaaaaagtagtgggttca

SEQ ID NO: 727549 - DNA, 20 bp, mouse
gccagaagcagattttctat

SEQ ID NO: 727550 - DNA, 20 bp, mouse
gagggcgtttatgctaatga

SEQ ID NO: 727551 - DNA, 20 bp, mouse
ggcttttatagtaggttcct

SEQ ID NO: 727552 - DNA, 20 bp, mouse
ggtagtagcgtttactaccc

SEQ ID NO: 727553 - DNA, 20 bp, mouse
ggcataaacgccctataagt

SEQ ID NO: 727554 - DNA, 20 bp, mouse
gctattactatgtctggacg

SEQ ID NO: 727555 - DNA, 20 bp, mouse
gacagcactattactatgtc

SEQ ID NO: 727556 - DNA, 20 bp, mouse
gtgaaggtctactgtctcat

SEQ ID NO: 727557 - DNA, 20 bp, mouse
ggaacgtaaacgacacttga

SEQ ID NO: 727558 - DNA, 20 bp, mouse
ggtctctaagggtcacttgt

SEQ ID NO: 727559 - DNA, 20 bp, mouse
gttagtgtttcgtcacgaac

SEQ ID NO: 727560 - DNA, 20 bp, mouse
ggccacgtcgataactttta

SEQ ID NO: 727561 - DNA, 20 bp, mouse
gttaattcgtacgtcccgat

SEQ ID NO: 727562 - DNA, 20 bp, mouse
gaaaaaaaagtactctagtt

SEQ ID NO: 727563 - DNA, 20 bp, mouse
gcgatcgctatcaaacatgg

SEQ ID NO: 727564 - DNA, 20 bp, mouse
gaactgagatgagatgcggg

SEQ ID NO: 727565 - DNA, 20 bp, mouse
gcacttcgctttcaccaatc

SEQ ID NO: 727566 - DNA, 20 bp, mouse
gcgccccgaatgcttctcat

SEQ ID NO: 727567 - DNA, 20 bp, mouse
gcgcccagcgaataatataa

SEQ ID NO: 727568 - DNA, 20 bp, mouse
gtattcgctgggcgcgaaaa

SEQ ID NO: 727569 - DNA, 20 bp, mouse
gattcggggcgcacgttgat

SEQ ID NO: 727570 - DNA, 20 bp, mouse
ggaaaaaagacgtcagccaa

SEQ ID NO: 727571 - DNA, 20 bp, mouse
gagacgtcagccaatggcat

SEQ ID NO: 727572 - DNA, 20 bp, mouse
ggtgaaagggcacctttgat

SEQ ID NO: 727573 - DNA, 20 bp, mouse
gtagcctttatattattcgc

SEQ ID NO: 727574 - DNA, 20 bp, mouse
gtggtcttgtctagttgatg

SEQ ID NO: 727575 - DNA, 20 bp, mouse
gcatggttggtgagaatttc

SEQ ID NO: 727576 - DNA, 20 bp, mouse
gacaacgaagcggtactaaa

SEQ ID NO: 727577 - DNA, 20 bp, mouse
gggaaaagctgatgtgtgat

SEQ ID NO: 727578 - DNA, 20 bp, mouse
ggcaaagaattacaacgaag

SEQ ID NO: 727579 - DNA, 20 bp, mouse
ggggtaatggtgtcactaac

SEQ ID NO: 727580 - DNA, 20 bp, mouse
gctttcctctgcagccaata

SEQ ID NO: 727581 - DNA, 20 bp, mouse
ggtagtcaactctgatttga

SEQ ID NO: 727582 - DNA, 20 bp, mouse
gggtacaatacaatctaatt

SEQ ID NO: 727583 - DNA, 20 bp, mouse
gtccagacattgacgcaaga

SEQ ID NO: 727584 - DNA, 20 bp, mouse
ggacattgacgcaagaaggt

SEQ ID NO: 727585 - DNA, 20 bp, mouse
gagctacttatactcgtaca

SEQ ID NO: 727586 - DNA, 20 bp, mouse
gaggaagcatattcgctcag

SEQ ID NO: 727587 - DNA, 20 bp, mouse
ggttagttgcgtaagtatca

SEQ ID NO: 727588 - DNA, 20 bp, mouse
gaatagagccctgtaaagtt

SEQ ID NO: 727589 - DNA, 20 bp, mouse
gcgtaagtatcacggagaag

SEQ ID NO: 727590 - DNA, 20 bp, mouse
gtagcgtggcagtacctcta

SEQ ID NO: 727591 - DNA, 20 bp, mouse
ggcactaactgtccaatcaa

SEQ ID NO: 727592 - DNA, 20 bp, mouse
gagagtctattggctaaact

SEQ ID NO: 727593 - DNA, 20 bp, mouse
gtgctctttaaataaagcgg

SEQ ID NO: 727594 - DNA, 20 bp, mouse
gtgtacagtccggctaaagt

SEQ ID NO: 727595 - DNA, 20 bp, mouse
gttggcccaagaacccttag

SEQ ID NO: 727596 - DNA, 20 bp, mouse
gggcgcgaaaaggaacgttc

SEQ ID NO: 727597 - DNA, 20 bp, mouse
ggaaaaggaacgttcgggat

SEQ ID NO: 727598 - DNA, 20 bp, mouse
gtgctataatcgctttccat

SEQ ID NO: 727599 - DNA, 20 bp, mouse
gtggtttgatgacgtcatat

SEQ ID NO: 727600 - DNA, 20 bp, mouse
gaaaatgatgattgggtgat

SEQ ID NO: 727601 - DNA, 20 bp, mouse
ggatgacgtcatataggctt

SEQ ID NO: 727602 - DNA, 20 bp, mouse
ggttttctctgggcgcgaaa

SEQ ID NO: 727603 - DNA, 20 bp, mouse
gccttattcaaataaagctt

SEQ ID NO: 727604 - DNA, 20 bp, mouse
gagcaacaagtattttgatt

SEQ ID NO: 727605 - DNA, 20 bp, mouse
ggaataaggcctctttaaaa

SEQ ID NO: 727606 - DNA, 20 bp, mouse
ggaaaaaggaggcccgtcat

SEQ ID NO: 727607 - DNA, 20 bp, mouse
ggtgagttcaacttaaccaa

SEQ ID NO: 727608 - DNA, 20 bp, mouse
gtcaagccagggcgcgaaaa

SEQ ID NO: 727609 - DNA, 20 bp, mouse
ggggagttgtgtattctcat

SEQ ID NO: 727610 - DNA, 20 bp, mouse
gcccaaaacctcgtttccat

SEQ ID NO: 727611 - DNA, 20 bp, mouse
gcaagcagataggaacacca

SEQ ID NO: 727612 - DNA, 20 bp, mouse
ggtacaacttaaaacttccc

SEQ ID NO: 727613 - DNA, 20 bp, mouse
ggctaaacagcagaaacaaa

SEQ ID NO: 727614 - DNA, 20 bp, mouse
gggcctcctttttcgcgccc

SEQ ID NO: 727615 - DNA, 20 bp, mouse
gagccagggcgcgaaaaagg

SEQ ID NO: 727616 - DNA, 20 bp, mouse
gtcaaggctggacgcgaaaa

SEQ ID NO: 727617 - DNA, 20 bp, mouse
gttcaaaaccagggcgccat

SEQ ID NO: 727618 - DNA, 20 bp, mouse
gtctacagctgagttatgtc

SEQ ID NO: 727619 - DNA, 20 bp, mouse
ggctgagttatgtctggacg

SEQ ID NO: 727620 - DNA, 20 bp, mouse
gcgcatagtatatatagtca

SEQ ID NO: 727621 - DNA, 20 bp, mouse
gacatgacgtatggtgattc

SEQ ID NO: 727622 - DNA, 20 bp, mouse
gcaagggattttcaaaacca

SEQ ID NO: 727623 - DNA, 20 bp, mouse
gccgtttttgcttcttactg

SEQ ID NO: 727624 - DNA, 20 bp, mouse
gtttttgcttcttactgcgg

SEQ ID NO: 727625 - DNA, 20 bp, mouse
gtagtatatatagtcaaggc

SEQ ID NO: 727626 - DNA, 20 bp, mouse
gaagacgtagcattggctaa

SEQ ID NO: 727627 - DNA, 20 bp, mouse
gtacaataaaagtgctgagg

SEQ ID NO: 727628 - DNA, 20 bp, mouse
gaaaaatgaagacgtagcat

SEQ ID NO: 727629 - DNA, 20 bp, mouse
gcgaaccttgccactgcgac

SEQ ID NO: 727630 - DNA, 20 bp, mouse
ggaacaatatgcattctcat

SEQ ID NO: 727631 - DNA, 20 bp, mouse
gttgttttgtccagtcgcag

SEQ ID NO: 727632 - DNA, 20 bp, mouse
ggagatagtcgcatgtttat

SEQ ID NO: 727633 - DNA, 20 bp, mouse
gtgcataacagcgtgtatat

SEQ ID NO: 727634 - DNA, 20 bp, mouse
gttgtccagtcgcagtggca

SEQ ID NO: 727635 - DNA, 20 bp, mouse
gttcaaatttgtgtttctac

SEQ ID NO: 727636 - DNA, 20 bp, mouse
gtataagcctgctcagtaag

SEQ ID NO: 727637 - DNA, 20 bp, mouse
gtgctcagtaagtggtttga

SEQ ID NO: 727638 - DNA, 20 bp, mouse
ggcaactctgttattggtct

SEQ ID NO: 727639 - DNA, 20 bp, mouse
gatgtcaggaagaggcaagc

SEQ ID NO: 727640 - DNA, 20 bp, mouse
gcttgctatgattgggtatt

SEQ ID NO: 727641 - DNA, 20 bp, mouse
gatgcagggcatgaaaaagt

SEQ ID NO: 727642 - DNA, 20 bp, mouse
ggaaaagcccttgctatgat

SEQ ID NO: 727643 - DNA, 20 bp, mouse
gagtatttatagtcaatgca

SEQ ID NO: 727644 - DNA, 20 bp, mouse
gttcaatgcaactctgttat

SEQ ID NO: 727645 - DNA, 20 bp, mouse
gagccacaagtttgtttaaa

SEQ ID NO: 727646 - DNA, 20 bp, mouse
gagaagccagccaatcgcgt

SEQ ID NO: 727647 - DNA, 20 bp, mouse
gcggcataaacgcctcccat

SEQ ID NO: 727648 - DNA, 20 bp, mouse
ggaaaaagagcctacgcgat

SEQ ID NO: 727649 - DNA, 20 bp, mouse
ggcccaatggaactacgctt

SEQ ID NO: 727650 - DNA, 20 bp, mouse
gtgccgaagcgtagttccat

SEQ ID NO: 727651 - DNA, 20 bp, mouse
gggaggagcttggcctttat

SEQ ID NO: 727652 - DNA, 20 bp, mouse
gcgcttggagaatcctataa

SEQ ID NO: 727653 - DNA, 20 bp, mouse
gtcttttcgtctagaccaat

SEQ ID NO: 727654 - DNA, 20 bp, mouse
gaagagcctacgcgattggc

SEQ ID NO: 727655 - DNA, 20 bp, mouse
gataaggcgttattcaaatg

SEQ ID NO: 727656 - DNA, 20 bp, mouse
gaaaaaagggcctatgcgat

SEQ ID NO: 727657 - DNA, 20 bp, mouse
ggggatcgggcgcctatgat

SEQ ID NO: 727658 - DNA, 20 bp, mouse
gcgcccagagaaaactataa

SEQ ID NO: 727659 - DNA, 20 bp, mouse
gacgaatgggaagcattcgc

SEQ ID NO: 727660 - DNA, 20 bp, mouse
gagaagtcagccaatcgcat

SEQ ID NO: 727661 - DNA, 20 bp, mouse
gcgtcaattggacaagactt

SEQ ID NO: 727662 - DNA, 20 bp, mouse
gttcgcgggcgcacgtcaat

SEQ ID NO: 727663 - DNA, 20 bp, mouse
gtttctctgggcgcaaaaaa

SEQ ID NO: 727664 - DNA, 20 bp, mouse
gtatatcatgaaccaatcat

SEQ ID NO: 727665 - DNA, 20 bp, mouse
gttcaaatgaggcatgggat

SEQ ID NO: 727666 - DNA, 20 bp, mouse
gaaaaaagggcctatgcgat

SEQ ID NO: 727667 - DNA, 20 bp, mouse
ggggatcgggcgcctatgat

SEQ ID NO: 727668 - DNA, 20 bp, mouse
gcgcccagagaaaactataa

SEQ ID NO: 727669 - DNA, 20 bp, mouse
gacgaatgggaagcattcgc

SEQ ID NO: 727670 - DNA, 20 bp, mouse
gagaagtcagccaatcgcat

SEQ ID NO: 727671 - DNA, 20 bp, mouse
gcgtcaattggacaagactt

SEQ ID NO: 727672 - DNA, 20 bp, mouse
gttcgcgggcgcacgtcaat

SEQ ID NO: 727673 - DNA, 20 bp, mouse
gtttctctgggcgcaaaaaa

SEQ ID NO: 727674 - DNA, 20 bp, mouse
gtatatcatgaaccaatcat

SEQ ID NO: 727675 - DNA, 20 bp, mouse
gttcaaatgaggcatgggat

SEQ ID NO: 727676 - DNA, 20 bp, mouse
gaggctaaggtagtctgccg

SEQ ID NO: 727677 - DNA, 20 bp, mouse
gcattgcagcttggacttag

SEQ ID NO: 727678 - DNA, 20 bp, mouse
gagaactgcagttgaggcta

SEQ ID NO: 727679 - DNA, 20 bp, mouse
gccagattctaccttttgat

SEQ ID NO: 727680 - DNA, 20 bp, mouse
ggtatgcaaaggatagtgat

SEQ ID NO: 727681 - DNA, 20 bp, mouse
gtgacgtttaagactctgat

SEQ ID NO: 727682 - DNA, 20 bp, mouse
ggctggtgagcacttggaga

SEQ ID NO: 727683 - DNA, 20 bp, mouse
gcatacaaaaataagtaccg

SEQ ID NO: 727684 - DNA, 20 bp, mouse
gaatgtgacttctacattga

SEQ ID NO: 727685 - DNA, 20 bp, mouse
gagtgattggatgaaaatac

SEQ ID NO: 727686 - DNA, 20 bp, mouse
gaaagtgatagcaaagatgg

SEQ ID NO: 727687 - DNA, 20 bp, mouse
gggaccgaagaacattcaaa

SEQ ID NO: 727688 - DNA, 20 bp, mouse
gaaagggcccgcgctttgtt

SEQ ID NO: 727689 - DNA, 20 bp, mouse
gaaccaggatttagaagcag

SEQ ID NO: 727690 - DNA, 20 bp, mouse
ggatagtctgattgtataaa

SEQ ID NO: 727691 - DNA, 20 bp, mouse
ggtgacgtgaatgacaaacc

SEQ ID NO: 727692 - DNA, 20 bp, mouse
ggcccgcgctttgttgggat

SEQ ID NO: 727693 - DNA, 20 bp, mouse
gaccaatcccaacaaagcgc

SEQ ID NO: 727694 - DNA, 20 bp, mouse
ggaacatagaaatttaaagt

SEQ ID NO: 727695 - DNA, 20 bp, mouse
gtagagcataatggtagtaa

SEQ ID NO: 727696 - DNA, 20 bp, mouse
gtaactagagtgtcagaaca

SEQ ID NO: 727697 - DNA, 20 bp, mouse
gtcgcgcgctacaaattcat

SEQ ID NO: 727698 - DNA, 20 bp, mouse
ggggaaatagcccgtgtgat

SEQ ID NO: 727699 - DNA, 20 bp, mouse
gaaggaatggagcaacgtct

SEQ ID NO: 727700 - DNA, 20 bp, mouse
ggcgctacaaattcattggc

SEQ ID NO: 727701 - DNA, 20 bp, mouse
gttgtaacacaaaattacaa

SEQ ID NO: 727702 - DNA, 20 bp, mouse
gttaaaactaccaatcacac

SEQ ID NO: 727703 - DNA, 20 bp, mouse
gactagtatgtcaagcgctg

SEQ ID NO: 727704 - DNA, 20 bp, mouse
gacaagattgtgattccatc

SEQ ID NO: 727705 - DNA, 20 bp, mouse
gcgactttcaaaaagttgca

SEQ ID NO: 727706 - DNA, 20 bp, mouse
ggccaggcgcggttcgtttt

SEQ ID NO: 727707 - DNA, 20 bp, mouse
gtctaccaataaggtcgctg

SEQ ID NO: 727708 - DNA, 20 bp, mouse
ggaaagagcctcgttctgat

SEQ ID NO: 727709 - DNA, 20 bp, mouse
gtcaacaattgtctatagcc

SEQ ID NO: 727710 - DNA, 20 bp, mouse
gattaccacagcgaccttat

SEQ ID NO: 727711 - DNA, 20 bp, mouse
ggtttcgtccaatcagaacg

SEQ ID NO: 727712 - DNA, 20 bp, mouse
gttttataacagtacacaaa

SEQ ID NO: 727713 - DNA, 20 bp, mouse
gattagcaaatctaccaata

SEQ ID NO: 727714 - DNA, 20 bp, mouse
gaattgtctatagccaggcg

SEQ ID NO: 727715 - DNA, 20 bp, mouse
gtttgagtcttttttcacta

SEQ ID NO: 727716 - DNA, 20 bp, mouse
ggcatctggggattgacgat

SEQ ID NO: 727717 - DNA, 20 bp, mouse
gagtaagtcaggttcacaac

SEQ ID NO: 727718 - DNA, 20 bp, mouse
gaatttgcggaagtgcatct

SEQ ID NO: 727719 - DNA, 20 bp, mouse
gttcgtctgtgaaatgtctc

SEQ ID NO: 727720 - DNA, 20 bp, mouse
gctgtagtacgatttttgat

SEQ ID NO: 727721 - DNA, 20 bp, mouse
gggaaatgcgtcgctctgat

SEQ ID NO: 727722 - DNA, 20 bp, mouse
gtccgtccccttaaataatc

SEQ ID NO: 727723 - DNA, 20 bp, mouse
gaaaatcgtactacaggaat

SEQ ID NO: 727724 - DNA, 20 bp, mouse
ggctttgtgtatagtaagtc

SEQ ID NO: 727725 - DNA, 20 bp, mouse
gcgttactcgtgtcatcttc

SEQ ID NO: 727726 - DNA, 20 bp, mouse
gtagcgtggcagtacctcta

SEQ ID NO: 727727 - DNA, 20 bp, mouse
gtgtacagtccggctaaagt

SEQ ID NO: 727728 - DNA, 20 bp, mouse
gttggcccaagaacccttag

SEQ ID NO: 727729 - DNA, 20 bp, mouse
gaaagcatgcctactttagc

SEQ ID NO: 727730 - DNA, 20 bp, mouse
gttttctagtaactatgtac

SEQ ID NO: 727731 - DNA, 20 bp, mouse
ggttagttgcgtaagtatca

SEQ ID NO: 727732 - DNA, 20 bp, mouse
gatgaagaaagattaagaat

SEQ ID NO: 727733 - DNA, 20 bp, mouse
gcagtacctctaagggttct

SEQ ID NO: 727734 - DNA, 20 bp, mouse
gaatagagccctgtaaagtt

SEQ ID NO: 727735 - DNA, 20 bp, mouse
gcgtaagtatcacggagaag

SEQ ID NO: 727736 - DNA, 20 bp, mouse
gggaaggaggggtacgagcg

SEQ ID NO: 727737 - DNA, 20 bp, mouse
gtcccgcgcagtagtactat

SEQ ID NO: 727738 - DNA, 20 bp, mouse
ggcagtagtactattggctg

SEQ ID NO: 727739 - DNA, 20 bp, mouse
gtaactcctgcacacccgat

SEQ ID NO: 727740 - DNA, 20 bp, mouse
gaggatgcttctcggtggga

SEQ ID NO: 727741 - DNA, 20 bp, mouse
gtgcttctcggtgggaagga

SEQ ID NO: 727742 - DNA, 20 bp, mouse
gtatcaggatgcttctcggt

SEQ ID NO: 727743 - DNA, 20 bp, mouse
gctagcaggagactgtgtgc

SEQ ID NO: 727744 - DNA, 20 bp, mouse
gtgtgcaggagttaaccaat

SEQ ID NO: 727745 - DNA, 20 bp, mouse
gcgaacgcaagcgtacttaa

SEQ ID NO: 727746 - DNA, 20 bp, mouse
ggaaaagaaaatcccgccgc

SEQ ID NO: 727747 - DNA, 20 bp, mouse
ggctgccagatcaacttaat

SEQ ID NO: 727748 - DNA, 20 bp, mouse
gcctacacacacacctcgtt

SEQ ID NO: 727749 - DNA, 20 bp, mouse
ggagttctgattggtcaaaa

SEQ ID NO: 727750 - DNA, 20 bp, mouse
gtaggggggagggtgtctag

SEQ ID NO: 727751 - DNA, 20 bp, mouse
gtgttttcgcagtctgaaca

SEQ ID NO: 727752 - DNA, 20 bp, mouse
gcggcaaattgaattccagg

SEQ ID NO: 727753 - DNA, 20 bp, mouse
gaaatgaaaagatgtgtaaa

SEQ ID NO: 727754 - DNA, 20 bp, mouse
gttcagactgcgaaaacaaa

SEQ ID NO: 727755 - DNA, 20 bp, mouse
gaggtagtgactttaaaaag

SEQ ID NO: 727756 - DNA, 20 bp, mouse
gtccgcgtttaaaccgagta

SEQ ID NO: 727757 - DNA, 20 bp, mouse
gctcgagataatgttggctt

SEQ ID NO: 727758 - DNA, 20 bp, mouse
gtctcgagatgataaattct

SEQ ID NO: 727759 - DNA, 20 bp, mouse
gtatcatctcgagataatgt

SEQ ID NO: 727760 - DNA, 20 bp, mouse
gaacaagagcaccgttattt

SEQ ID NO: 727761 - DNA, 20 bp, mouse
gcgcggaccaatcccctgtc

SEQ ID NO: 727762 - DNA, 20 bp, mouse
gactgtccaatccaaaaggg

SEQ ID NO: 727763 - DNA, 20 bp, mouse
gaagaagtgctcatgactcc

SEQ ID NO: 727764 - DNA, 20 bp, mouse
gatagttccagacaggggat

SEQ ID NO: 727765 - DNA, 20 bp, mouse
ggacatcatagttccagaca

SEQ ID NO: 727766 - DNA, 20 bp, mouse
gtcccgccggcgcgctttcg

SEQ ID NO: 727767 - DNA, 20 bp, mouse
gtcggggcatggttgatggg

SEQ ID NO: 727768 - DNA, 20 bp, mouse
gcccggcatggctgagagga

SEQ ID NO: 727769 - DNA, 20 bp, mouse
gcccgccaataagacctggc

SEQ ID NO: 727770 - DNA, 20 bp, mouse
gcgctttcgggtcttggctg

SEQ ID NO: 727771 - DNA, 20 bp, mouse
gccggcgcgctttcgggtct

SEQ ID NO: 727772 - DNA, 20 bp, mouse
gccggcgcgctttcggggca

SEQ ID NO: 727773 - DNA, 20 bp, mouse
gggaaagaaccgaaagcgcc

SEQ ID NO: 727774 - DNA, 20 bp, mouse
gcgggtcttggctgaggggc

SEQ ID NO: 727775 - DNA, 20 bp, mouse
gcaggctttcggtccttata

SEQ ID NO: 727776 - DNA, 20 bp, mouse
ggactctggagtactgtata

SEQ ID NO: 727777 - DNA, 20 bp, mouse
gtatagggcacatgcagaca

SEQ ID NO: 727778 - DNA, 20 bp, mouse
gagagtcaccgccctgaaat

SEQ ID NO: 727779 - DNA, 20 bp, mouse
gagcagtatactcaaatctg

SEQ ID NO: 727780 - DNA, 20 bp, mouse
gtctggaatccattcattgc

SEQ ID NO: 727781 - DNA, 20 bp, mouse
ggttttaatcctccaggtac

SEQ ID NO: 727782 - DNA, 20 bp, mouse
gcacttggctattccctgtc

SEQ ID NO: 727783 - DNA, 20 bp, mouse
gaatgaatggattccagaca

SEQ ID NO: 727784 - DNA, 20 bp, mouse
gcaagtgcatctatatgact

SEQ ID NO: 727785 - DNA, 20 bp, mouse
ggcaaggagttacattttta

SEQ ID NO: 727786 - DNA, 20 bp, mouse
gcgcatgcaaagaatagctg

SEQ ID NO: 727787 - DNA, 20 bp, mouse
ggaatccgggtcttggaagg

SEQ ID NO: 727788 - DNA, 20 bp, mouse
gagaaaaaaggatgcgtcat

SEQ ID NO: 727789 - DNA, 20 bp, mouse
gatgagaaagaatggggtcg

SEQ ID NO: 727790 - DNA, 20 bp, mouse
gcgcagaaggcctatttaaa

SEQ ID NO: 727791 - DNA, 20 bp, mouse
gaaaactagagcgttaggcg

SEQ ID NO: 727792 - DNA, 20 bp, mouse
gaggtctctgactcgagata

SEQ ID NO: 727793 - DNA, 20 bp, mouse
gtccgaatccgggtcttgga

SEQ ID NO: 727794 - DNA, 20 bp, mouse
gtaggcggggtttccgaatc

SEQ ID NO: 727795 - DNA, 20 bp, mouse
gtaaaagcaaacgagaaatg

SEQ ID NO: 727796 - DNA, 20 bp, mouse
gtggcgtttatcctatgaaa

SEQ ID NO: 727797 - DNA, 20 bp, mouse
gcataaattgtcactcttga

SEQ ID NO: 727798 - DNA, 20 bp, mouse
gcataggataaacgccagaa

SEQ ID NO: 727799 - DNA, 20 bp, mouse
gtgaaaacctgaagggaagg

SEQ ID NO: 727800 - DNA, 20 bp, mouse
ggaagggcgggaattgacca

SEQ ID NO: 727801 - DNA, 20 bp, mouse
ggggaagggggcgtgaacca

SEQ ID NO: 727802 - DNA, 20 bp, mouse
ggacctgtttgaaaacctga

SEQ ID NO: 727803 - DNA, 20 bp, mouse
gggggggtgtcccgatttat

SEQ ID NO: 727804 - DNA, 20 bp, mouse
ggtgttgaattttcaactgc

SEQ ID NO: 727805 - DNA, 20 bp, mouse
gtcccttcaggttttcaaac

SEQ ID NO: 727806 - DNA, 20 bp, mouse
gaggcacagcccctgtggcg

SEQ ID NO: 727807 - DNA, 20 bp, mouse
gaatcctattgctaggcgga

SEQ ID NO: 727808 - DNA, 20 bp, mouse
gcctacaagtacgctcctga

SEQ ID NO: 727809 - DNA, 20 bp, mouse
gaggactgaaaaggcgcggg

SEQ ID NO: 727810 - DNA, 20 bp, mouse
gttagaggactgaaaaggcg

SEQ ID NO: 727811 - DNA, 20 bp, mouse
gtgggagaattataaactat

SEQ ID NO: 727812 - DNA, 20 bp, mouse
gcatattcccctcgccacag

SEQ ID NO: 727813 - DNA, 20 bp, mouse
ggcgaatgcggaccttttag

SEQ ID NO: 727814 - DNA, 20 bp, mouse
gattcagccagtgagttaga

SEQ ID NO: 727815 - DNA, 20 bp, mouse
gaccttttagaggactgaaa

SEQ ID NO: 727816 - DNA, 20 bp, mouse
gtggccgggaagtccggaat

SEQ ID NO: 727817 - DNA, 20 bp, mouse
gttaaaatggccgggaagtc

SEQ ID NO: 727818 - DNA, 20 bp, mouse
ggagcgagtacaacgaacgt

SEQ ID NO: 727819 - DNA, 20 bp, mouse
ggggtcctttgtccccattc

SEQ ID NO: 727820 - DNA, 20 bp, mouse
ggtccccattccggacttcc

SEQ ID NO: 727821 - DNA, 20 bp, mouse
gtagtctgaactcgttaaaa

SEQ ID NO: 727822 - DNA, 20 bp, mouse
gtgtactcgctccttgagct

SEQ ID NO: 727823 - DNA, 20 bp, mouse
gctaggcattgcccatgcca

SEQ ID NO: 727824 - DNA, 20 bp, mouse
gaatggccccgcccctggca

SEQ ID NO: 727825 - DNA, 20 bp, mouse
gacagccgaaaataaaaaca

SEQ ID NO: 727826 - DNA, 20 bp, mouse
gcagcagcccaggagcctag

SEQ ID NO: 727827 - DNA, 20 bp, mouse
gagactgtataggatgtaag

SEQ ID NO: 727828 - DNA, 20 bp, mouse
gaatgtgccacattaaaagg

SEQ ID NO: 727829 - DNA, 20 bp, mouse
gaatgagccgctaggctcct

SEQ ID NO: 727830 - DNA, 20 bp, mouse
gcggaagtgcctgcgggcgg

SEQ ID NO: 727831 - DNA, 20 bp, mouse
gccaagtatccgcaaataaa

SEQ ID NO: 727832 - DNA, 20 bp, mouse
gaagaatgtgccacattaaa

SEQ ID NO: 727833 - DNA, 20 bp, mouse
ggagtgaaaacagaaacgtc

SEQ ID NO: 727834 - DNA, 20 bp, mouse
gctaggattaaaggcttgtt

SEQ ID NO: 727835 - DNA, 20 bp, mouse
gcgtcaggcggaagtgcctg

SEQ ID NO: 727836 - DNA, 20 bp, mouse
gccctcagaaagcacagaca

SEQ ID NO: 727837 - DNA, 20 bp, mouse
gaagttgcgcccgcggccgt

SEQ ID NO: 727838 - DNA, 20 bp, mouse
gtgaactgaaatcggcttaa

SEQ ID NO: 727839 - DNA, 20 bp, mouse
gccgctacagtataaaaaga

SEQ ID NO: 727840 - DNA, 20 bp, mouse
ggcaaactgtgaactgaaat

SEQ ID NO: 727841 - DNA, 20 bp, mouse
gtgctcacaccacacaatct

SEQ ID NO: 727842 - DNA, 20 bp, mouse
gtgagggaaggacagcagac

SEQ ID NO: 727843 - DNA, 20 bp, mouse
gattcagagcacggtttgca

SEQ ID NO: 727844 - DNA, 20 bp, mouse
gtccctcaaccccatatgct

SEQ ID NO: 727845 - DNA, 20 bp, mouse
gcagggtttcccagattgtg

SEQ ID NO: 727846 - DNA, 20 bp, mouse
gccctcagaaagctcggaca

SEQ ID NO: 727847 - DNA, 20 bp, mouse
ggttgcgcccgcagctgtgg

SEQ ID NO: 727848 - DNA, 20 bp, mouse
gcgcccgccgcagtataaaa

SEQ ID NO: 727849 - DNA, 20 bp, mouse
gccgccgcagtataaaaagg

SEQ ID NO: 727850 - DNA, 20 bp, mouse
gtccctgtccgagctttctg

SEQ ID NO: 727851 - DNA, 20 bp, mouse
gctagttccctcagaaagct

SEQ ID NO: 727852 - DNA, 20 bp, mouse
ggcagatgagtaataccgat

SEQ ID NO: 727853 - DNA, 20 bp, mouse
ggaataatacaggtattatg

SEQ ID NO: 727854 - DNA, 20 bp, mouse
ggttctcaagagaataatac

SEQ ID NO: 727855 - DNA, 20 bp, mouse
gttttcataaaagcaccaat

SEQ ID NO: 727856 - DNA, 20 bp, mouse
ggcaggctaataggagttga

SEQ ID NO: 727857 - DNA, 20 bp, mouse
ggctaataggagttgaaggc

SEQ ID NO: 727858 - DNA, 20 bp, mouse
gggggcaggggcaggctaat

SEQ ID NO: 727859 - DNA, 20 bp, mouse
gtggagttctaggacatcta

SEQ ID NO: 727860 - DNA, 20 bp, mouse
gtggactggcctggagttct

SEQ ID NO: 727861 - DNA, 20 bp, mouse
gtaggagttgaaggctggac

SEQ ID NO: 727862 - DNA, 20 bp, mouse
ggttgaaggctggactggcc

SEQ ID NO: 727863 - DNA, 20 bp, mouse
gaacgaaaacctgtagtgca

SEQ ID NO: 727864 - DNA, 20 bp, mouse
gtgtaagtgggtgtggccgg

SEQ ID NO: 727865 - DNA, 20 bp, mouse
gaacacaataggtttttata

SEQ ID NO: 727866 - DNA, 20 bp, mouse
ggcaggctaataggagttga

SEQ ID NO: 727867 - DNA, 20 bp, mouse
ggctaataggagttgaaggc

SEQ ID NO: 727868 - DNA, 20 bp, mouse
gggggcaggggcaggctaat

SEQ ID NO: 727869 - DNA, 20 bp, mouse
gtggagttctaggacatcta

SEQ ID NO: 727870 - DNA, 20 bp, mouse
gtggactggcctggagttct

SEQ ID NO: 727871 - DNA, 20 bp, mouse
gtaggagttgaaggctggac

SEQ ID NO: 727872 - DNA, 20 bp, mouse
ggttgaaggctggactggcc

SEQ ID NO: 727873 - DNA, 20 bp, mouse
gaacgaaaacctgtagtgca

SEQ ID NO: 727874 - DNA, 20 bp, mouse
gtgtaagtgggtgtggccgg

SEQ ID NO: 727875 - DNA, 20 bp, mouse
gaacaggagctcagtgtaag

SEQ ID NO: 727876 - DNA, 20 bp, mouse
gtgtaccaggtgtaggtgac

SEQ ID NO: 727877 - DNA, 20 bp, mouse
gaggtgtaggtgactggcac

SEQ ID NO: 727878 - DNA, 20 bp, mouse
gtcctgctgaggaagctaac

SEQ ID NO: 727879 - DNA, 20 bp, mouse
gaagctaacaggaatagagc

SEQ ID NO: 727880 - DNA, 20 bp, mouse
gtaaacttggccacagggca

SEQ ID NO: 727881 - DNA, 20 bp, mouse
gcctggtacaccatgccctg

SEQ ID NO: 727882 - DNA, 20 bp, mouse
ggaagcagcagagacaccgt

SEQ ID NO: 727883 - DNA, 20 bp, mouse
gccggtagcacgcgtaaact

SEQ ID NO: 727884 - DNA, 20 bp, mouse
gccaaactggcgagtcgtcc

SEQ ID NO: 727885 - DNA, 20 bp, mouse
ggccagtttgggcacaaaga

SEQ ID NO: 727886 - DNA, 20 bp, mouse
ggtgtgccctgcatccaaga

SEQ ID NO: 727887 - DNA, 20 bp, mouse
gtcaggccctcttggatgca

SEQ ID NO: 727888 - DNA, 20 bp, mouse
gaccaagtacagttcgcctg

SEQ ID NO: 727889 - DNA, 20 bp, mouse
gaagtgtaggttttccttcg

SEQ ID NO: 727890 - DNA, 20 bp, mouse
gaatttccagtattcctcga

SEQ ID NO: 727891 - DNA, 20 bp, mouse
gtaatcacttacttaagtgt

SEQ ID NO: 727892 - DNA, 20 bp, mouse
gtgattaactcaggccctct

SEQ ID NO: 727893 - DNA, 20 bp, mouse
ggaattatccgctactcctt

SEQ ID NO: 727894 - DNA, 20 bp, mouse
gtttctcctgctctggaagc

SEQ ID NO: 727895 - DNA, 20 bp, mouse
gaccccaggcgaactgtact

SEQ ID NO: 727896 - DNA, 20 bp, mouse
gaagcagaagctagactcgg

SEQ ID NO: 727897 - DNA, 20 bp, mouse
gaagtgagggcctttaaatg

SEQ ID NO: 727898 - DNA, 20 bp, mouse
gaggccctcacttacatcgt

SEQ ID NO: 727899 - DNA, 20 bp, mouse
gcgatgagagccacatttaa

SEQ ID NO: 727900 - DNA, 20 bp, mouse
gggagccactgtcaagggta

SEQ ID NO: 727901 - DNA, 20 bp, mouse
gtaagggcagaagaatttcg

SEQ ID NO: 727902 - DNA, 20 bp, mouse
gggtttacatcctgcagtac

SEQ ID NO: 727903 - DNA, 20 bp, mouse
gaaatgtggctctcatcgat

SEQ ID NO: 727904 - DNA, 20 bp, mouse
ggctgtctccaacagccaat

SEQ ID NO: 727905 - DNA, 20 bp, mouse
ggcaaaatcccatacttcaa

SEQ ID NO: 727906 - DNA, 20 bp, mouse
gtgcataaggcgttcataaa

SEQ ID NO: 727907 - DNA, 20 bp, mouse
gctgccccggctcccaagaa

SEQ ID NO: 727908 - DNA, 20 bp, mouse
gtataggcgctcctaggggt

SEQ ID NO: 727909 - DNA, 20 bp, mouse
gaaaacgcaagtttcgcgta

SEQ ID NO: 727910 - DNA, 20 bp, mouse
gaaatcaaccagggacccgg

SEQ ID NO: 727911 - DNA, 20 bp, mouse
gataaagggctcaagtcctc

SEQ ID NO: 727912 - DNA, 20 bp, mouse
gtgaggagggagcttttcat

SEQ ID NO: 727913 - DNA, 20 bp, mouse
gagaaaatcaaccagggacc

SEQ ID NO: 727914 - DNA, 20 bp, mouse
gtggaacccttcttgggagc

SEQ ID NO: 727915 - DNA, 20 bp, mouse
gttgggagccggggcagatt

SEQ ID NO: 727916 - DNA, 20 bp, mouse
gagcctactcaaaccgattc

SEQ ID NO: 727917 - DNA, 20 bp, mouse
gtgaaatggaaggctgcgat

SEQ ID NO: 727918 - DNA, 20 bp, mouse
gagagtcagcgtcaaggagg

SEQ ID NO: 727919 - DNA, 20 bp, mouse
gcaaggctcgcaaccagaat

SEQ ID NO: 727920 - DNA, 20 bp, mouse
gaaccagaatcggtttgagt

SEQ ID NO: 727921 - DNA, 20 bp, mouse
gttaaggatctgtaagcgaa

SEQ ID NO: 727922 - DNA, 20 bp, mouse
gagcagagtcagcgtcaagg

SEQ ID NO: 727923 - DNA, 20 bp, mouse
gaactgccgctctcaataac

SEQ ID NO: 727924 - DNA, 20 bp, mouse
gcaaaaaaggagttctaatt

SEQ ID NO: 727925 - DNA, 20 bp, mouse
gtttcctctaagcaccacca

SEQ ID NO: 727926 - DNA, 20 bp, mouse
gtataggcgctcctaggggt

SEQ ID NO: 727927 - DNA, 20 bp, mouse
gtgaggagggagcttttcat

SEQ ID NO: 727928 - DNA, 20 bp, mouse
gtgcataaggcgttcataaa

SEQ ID NO: 727929 - DNA, 20 bp, mouse
gtcgtctctaaggcctttat

SEQ ID NO: 727930 - DNA, 20 bp, mouse
gataacttagagtataatgt

SEQ ID NO: 727931 - DNA, 20 bp, mouse
gcctttataggcgctcctag

SEQ ID NO: 727932 - DNA, 20 bp, mouse
gaaaacgcaagtttcgcgta

SEQ ID NO: 727933 - DNA, 20 bp, mouse
gggagggagcttttcattgg

SEQ ID NO: 727934 - DNA, 20 bp, mouse
gctaggttgattcgtctcta

SEQ ID NO: 727935 - DNA, 20 bp, mouse
gtataatgtaggacacaccg

SEQ ID NO: 727936 - DNA, 20 bp, mouse
ggaatcgcagaacatgaaaa

SEQ ID NO: 727937 - DNA, 20 bp, mouse
ggcggttcataaatacagga

SEQ ID NO: 727938 - DNA, 20 bp, mouse
gctctgcggttcataaatac

SEQ ID NO: 727939 - DNA, 20 bp, mouse
gtacaggaaggaaaagtatc

SEQ ID NO: 727940 - DNA, 20 bp, mouse
gagagaagagctacagtatc

SEQ ID NO: 727941 - DNA, 20 bp, mouse
gctggacttgcagtctgatt

SEQ ID NO: 727942 - DNA, 20 bp, mouse
gtatttgctgagtttcaaga

SEQ ID NO: 727943 - DNA, 20 bp, mouse
ggtaaatgtaagaccggctt

SEQ ID NO: 727944 - DNA, 20 bp, mouse
gacaatgcgttcaaatcact

SEQ ID NO: 727945 - DNA, 20 bp, mouse
gtgtgcagtaaatgtaagac

SEQ ID NO: 727946 - DNA, 20 bp, mouse
ggggcgcggggctggacgtg

SEQ ID NO: 727947 - DNA, 20 bp, mouse
gggcgggtcaggtggcgtgg

SEQ ID NO: 727948 - DNA, 20 bp, mouse
gagccgggacccgccctcta

SEQ ID NO: 727949 - DNA, 20 bp, mouse
ggtggcgggcccgagccaat

SEQ ID NO: 727950 - DNA, 20 bp, mouse
gcgagccaatgggcgaggtc

SEQ ID NO: 727951 - DNA, 20 bp, mouse
gagaacgttggcaagtggac

SEQ ID NO: 727952 - DNA, 20 bp, mouse
ggggcccgagccaatgggcg

SEQ ID NO: 727953 - DNA, 20 bp, mouse
ggtcggggccggtgacgcca

SEQ ID NO: 727954 - DNA, 20 bp, mouse
gtctggcagctgcccgtaga

SEQ ID NO: 727955 - DNA, 20 bp, mouse
gctcgcagaacgttggcaag

SEQ ID NO: 727956 - DNA, 20 bp, mouse
ggggcgcggggctggacgtg

SEQ ID NO: 727957 - DNA, 20 bp, mouse
gggcgggtcaggtggcgtgg

SEQ ID NO: 727958 - DNA, 20 bp, mouse
gagccgggacccgccctcta

SEQ ID NO: 727959 - DNA, 20 bp, mouse
gagaacgttggcaagtggac

SEQ ID NO: 727960 - DNA, 20 bp, mouse
ggtggcgggcccgagccaat

SEQ ID NO: 727961 - DNA, 20 bp, mouse
gcgggtgggggcgggtcagg

SEQ ID NO: 727962 - DNA, 20 bp, mouse
gcgagccaatgggcgaggtc

SEQ ID NO: 727963 - DNA, 20 bp, mouse
gctcgcagaacgttggcaag

SEQ ID NO: 727964 - DNA, 20 bp, mouse
gtctggcagctgcccgtaga

SEQ ID NO: 727965 - DNA, 20 bp, mouse
ggggcccgagccaatgggcg

SEQ ID NO: 727966 - DNA, 20 bp, mouse
gactgtaaggaaccggtaga

SEQ ID NO: 727967 - DNA, 20 bp, mouse
gccagctggtgaggcattgg

SEQ ID NO: 727968 - DNA, 20 bp, mouse
ggggagtgcgctgcactgaa

SEQ ID NO: 727969 - DNA, 20 bp, mouse
gaaaactgaaagcgcgcggg

SEQ ID NO: 727970 - DNA, 20 bp, mouse
gcaagcagaaactagatcat

SEQ ID NO: 727971 - DNA, 20 bp, mouse
ggaggacccaggaatgtgtg

SEQ ID NO: 727972 - DNA, 20 bp, mouse
ggtggggtcaagcgcatctc

SEQ ID NO: 727973 - DNA, 20 bp, mouse
gagtgccactaatatatgag

SEQ ID NO: 727974 - DNA, 20 bp, mouse
gcccaccgcgccgagccagg

SEQ ID NO: 727975 - DNA, 20 bp, mouse
gccatgtctggcagaggaaa

SEQ ID NO: 727976 - DNA, 20 bp, mouse
gcccaagaaaggctccaaaa

SEQ ID NO: 727977 - DNA, 20 bp, mouse
gctagactgcaccttcctat

SEQ ID NO: 727978 - DNA, 20 bp, mouse
gaggcatatgcaaattagga

SEQ ID NO: 727979 - DNA, 20 bp, mouse
gaaccaatcagaaaagaacg

SEQ ID NO: 727980 - DNA, 20 bp, mouse
gataatgtctagttgtacta

SEQ ID NO: 727981 - DNA, 20 bp, mouse
gaagaaaggctccaaaaagg

SEQ ID NO: 727982 - DNA, 20 bp, mouse
gttgggggctggagctgatt

SEQ ID NO: 727983 - DNA, 20 bp, mouse
gcaagctcttatatatgatc

SEQ ID NO: 727984 - DNA, 20 bp, mouse
ggagctgatttggatggatc

SEQ ID NO: 727985 - DNA, 20 bp, mouse
gatgccttgcattcaaatga

SEQ ID NO: 727986 - DNA, 20 bp, mouse
ggggctgtgaaggaacgttg

SEQ ID NO: 727987 - DNA, 20 bp, mouse
gtgctctgccaatacacttt

SEQ ID NO: 727988 - DNA, 20 bp, mouse
ggctgtgcatcgggctgtga

SEQ ID NO: 727989 - DNA, 20 bp, mouse
gacagcccgatgcacagccg

SEQ ID NO: 727990 - DNA, 20 bp, mouse
gtcttccccggctgtgcatc

SEQ ID NO: 727991 - DNA, 20 bp, mouse
gtgccaatacactttcggat

SEQ ID NO: 727992 - DNA, 20 bp, mouse
gggttgggatactgtccaat

SEQ ID NO: 727993 - DNA, 20 bp, mouse
ggcttctccctcattagctg

SEQ ID NO: 727994 - DNA, 20 bp, mouse
gaaccaatccgaaagtgtat

SEQ ID NO: 727995 - DNA, 20 bp, mouse
gtccaataggaaagaagaag

SEQ ID NO: 727996 - DNA, 20 bp, mouse
gagcagagcacaaagagcca

SEQ ID NO: 727997 - DNA, 20 bp, mouse
gtaaactttcaaatgtgcta

SEQ ID NO: 727998 - DNA, 20 bp, mouse
ggggaaccgaaagggtttta

SEQ ID NO: 727999 - DNA, 20 bp, mouse
gtgctagggttcctggaatt

SEQ ID NO: 728000 - DNA, 20 bp, mouse
gggttccctctccaaattcc

SEQ ID NO: 728001 - DNA, 20 bp, mouse
ggaaagggttttatggttct

SEQ ID NO: 728002 - DNA, 20 bp, mouse
gtttggagagggaaccgaaa

SEQ ID NO: 728003 - DNA, 20 bp, mouse
gcacgagagagtcttttgag

SEQ ID NO: 728004 - DNA, 20 bp, mouse
ggaaacagttgaaaccaaat

SEQ ID NO: 728005 - DNA, 20 bp, mouse
gttcaatcaggtccgctccc

SEQ ID NO: 728006 - DNA, 20 bp, mouse
gggccccgggccggcttcac

SEQ ID NO: 728007 - DNA, 20 bp, mouse
gcctcgccctggccctggta

SEQ ID NO: 728008 - DNA, 20 bp, mouse
gctcctgtgaagccggcccg

SEQ ID NO: 728009 - DNA, 20 bp, mouse
gggaggaggcgcggcccgaa

SEQ ID NO: 728010 - DNA, 20 bp, mouse
ggggcagcaggggatccccg

SEQ ID NO: 728011 - DNA, 20 bp, mouse
gcggggacccaggacgcagg

SEQ ID NO: 728012 - DNA, 20 bp, mouse
gcggcccggggaagcccggc

SEQ ID NO: 728013 - DNA, 20 bp, mouse
gcgcgtgggcggggcagcag

SEQ ID NO: 728014 - DNA, 20 bp, mouse
ggtccccgcggcggggcctg

SEQ ID NO: 728015 - DNA, 20 bp, mouse
gggccggcccggtgacgtca

SEQ ID NO: 728016 - DNA, 20 bp, mouse
gggccagggccgctaggctg

SEQ ID NO: 728017 - DNA, 20 bp, mouse
ggacccgggccgcagtttgt

SEQ ID NO: 728018 - DNA, 20 bp, mouse
gttaggagatggagccaggg

SEQ ID NO: 728019 - DNA, 20 bp, mouse
gccacagcccggaggggagg

SEQ ID NO: 728020 - DNA, 20 bp, mouse
gaactgcggcccgggtcctg

SEQ ID NO: 728021 - DNA, 20 bp, mouse
gcccgcacgccgacaaactg

SEQ ID NO: 728022 - DNA, 20 bp, mouse
gggggatccgatgacgtcgc

SEQ ID NO: 728023 - DNA, 20 bp, mouse
gaggctggggcttgagccgc

SEQ ID NO: 728024 - DNA, 20 bp, mouse
gcgtccacagcccggagggg

SEQ ID NO: 728025 - DNA, 20 bp, mouse
gggtgcgtccacagcccgga

SEQ ID NO: 728026 - DNA, 20 bp, mouse
gaacccccagcgaggaggcg

SEQ ID NO: 728027 - DNA, 20 bp, mouse
gcagcgaggaggcggggagt

SEQ ID NO: 728028 - DNA, 20 bp, mouse
gggcggagccgacgtctccc

SEQ ID NO: 728029 - DNA, 20 bp, mouse
gtccacagcgccgagggcgg

SEQ ID NO: 728030 - DNA, 20 bp, mouse
gcggtcttgacgttgagcgc

SEQ ID NO: 728031 - DNA, 20 bp, mouse
gtgaccccggtcgcggacgg

SEQ ID NO: 728032 - DNA, 20 bp, mouse
ggcttgcgcggatgctcaga

SEQ ID NO: 728033 - DNA, 20 bp, mouse
gagggggcgtggttgaggga

SEQ ID NO: 728034 - DNA, 20 bp, mouse
ggctcagtccacagcgccga

SEQ ID NO: 728035 - DNA, 20 bp, mouse
ggacgggggcgtggccctag

SEQ ID NO: 728036 - DNA, 20 bp, mouse
gggtggaaacgagaagggga

SEQ ID NO: 728037 - DNA, 20 bp, mouse
gtcccagggagcacttccgg

SEQ ID NO: 728038 - DNA, 20 bp, mouse
ggcactcccgcgtcccctag

SEQ ID NO: 728039 - DNA, 20 bp, mouse
gcagaagcctctaggggacg

SEQ ID NO: 728040 - DNA, 20 bp, mouse
gagggagggtccgccggagc

SEQ ID NO: 728041 - DNA, 20 bp, mouse
gctcacccagaagcctctag

SEQ ID NO: 728042 - DNA, 20 bp, mouse
gcttccggtggaaacgagaa

SEQ ID NO: 728043 - DNA, 20 bp, mouse
ggggcgccacgtttgatctg

SEQ ID NO: 728044 - DNA, 20 bp, mouse
gtccaccggaagtgctccct

SEQ ID NO: 728045 - DNA, 20 bp, mouse
gcgctcccagggagcacttc

SEQ ID NO: 728046 - DNA, 20 bp, mouse
gcccagccatagcgcggcag

SEQ ID NO: 728047 - DNA, 20 bp, mouse
gggaagccccagccatagcg

SEQ ID NO: 728048 - DNA, 20 bp, mouse
gaccgcgcgctccttacgtg

SEQ ID NO: 728049 - DNA, 20 bp, mouse
gccctcccgcgccggaaagg

SEQ ID NO: 728050 - DNA, 20 bp, mouse
gtggcggttgtcaccctccc

SEQ ID NO: 728051 - DNA, 20 bp, mouse
gtggcgccttgtagccaatg

SEQ ID NO: 728052 - DNA, 20 bp, mouse
gttgtagccaatggggactg

SEQ ID NO: 728053 - DNA, 20 bp, mouse
ggctccctcccgcgccggaa

SEQ ID NO: 728054 - DNA, 20 bp, mouse
gcccggggacgggagctcgg

SEQ ID NO: 728055 - DNA, 20 bp, mouse
gagccagagcaggagaatga

SEQ ID NO: 728056 - DNA, 20 bp, mouse
gccagcacccaagcaggcgg

SEQ ID NO: 728057 - DNA, 20 bp, mouse
ggctgctccagcacccaagc

SEQ ID NO: 728058 - DNA, 20 bp, mouse
ggagacgcgcccgaggctag

SEQ ID NO: 728059 - DNA, 20 bp, mouse
gtctctcccgccgcctgctt

SEQ ID NO: 728060 - DNA, 20 bp, mouse
gcagctccgcccctagcctc

SEQ ID NO: 728061 - DNA, 20 bp, mouse
gtatctggggatcatgtgag

SEQ ID NO: 728062 - DNA, 20 bp, mouse
gggagctgggcgccagagtt

SEQ ID NO: 728063 - DNA, 20 bp, mouse
gaatcagcgcctagagcccg

SEQ ID NO: 728064 - DNA, 20 bp, mouse
ggtgacgtggatgtgctcat

SEQ ID NO: 728065 - DNA, 20 bp, mouse
ggctagagctcgggactcca

SEQ ID NO: 728066 - DNA, 20 bp, mouse
gggaagttgaaggcccaacg

SEQ ID NO: 728067 - DNA, 20 bp, mouse
gcccagaatgggcagggcca

SEQ ID NO: 728068 - DNA, 20 bp, mouse
gcctacaaatctgctctcaa

SEQ ID NO: 728069 - DNA, 20 bp, mouse
gaacggagcccagaatgggc

SEQ ID NO: 728070 - DNA, 20 bp, mouse
gttggagttcttaacctcgt

SEQ ID NO: 728071 - DNA, 20 bp, mouse
gttgggccttcaacttcctg

SEQ ID NO: 728072 - DNA, 20 bp, mouse
gcatgatggcccttcctctt

SEQ ID NO: 728073 - DNA, 20 bp, mouse
ggatgaccacaggaagttga

SEQ ID NO: 728074 - DNA, 20 bp, mouse
gcgctgctgagagaatattt

SEQ ID NO: 728075 - DNA, 20 bp, mouse
ggaagggccatcatgactgc

SEQ ID NO: 728076 - DNA, 20 bp, mouse
ggggagctgaaggtaagcag

SEQ ID NO: 728077 - DNA, 20 bp, mouse
gtctaacaggaggctctggt

SEQ ID NO: 728078 - DNA, 20 bp, mouse
ggtaagcagaggggaaggct

SEQ ID NO: 728079 - DNA, 20 bp, mouse
ggaaaagcttgtgagaagtt

SEQ ID NO: 728080 - DNA, 20 bp, mouse
gacacactcgattgtctaac

SEQ ID NO: 728081 - DNA, 20 bp, mouse
gacaatcgagtgtgtggcgg

SEQ ID NO: 728082 - DNA, 20 bp, mouse
gggagggagggaccaaagac

SEQ ID NO: 728083 - DNA, 20 bp, mouse
gtagacaatcgagtgtgtgg

SEQ ID NO: 728084 - DNA, 20 bp, mouse
gcactcgattgtctaacagg

SEQ ID NO: 728085 - DNA, 20 bp, mouse
ggttgctaagtgacacacta

SEQ ID NO: 728086 - DNA, 20 bp, mouse
gcgggtgtgcggggcaagga

SEQ ID NO: 728087 - DNA, 20 bp, mouse
gagggcggagcgggtgtgcg

SEQ ID NO: 728088 - DNA, 20 bp, mouse
gcaggagagggatgcgctag

SEQ ID NO: 728089 - DNA, 20 bp, mouse
ggggatgcgctagaggtgga

SEQ ID NO: 728090 - DNA, 20 bp, mouse
gccggccggaagcgaggctt

SEQ ID NO: 728091 - DNA, 20 bp, mouse
gcgcgtgcgctgcaggaggg

SEQ ID NO: 728092 - DNA, 20 bp, mouse
gcagcaggctgggtagcatc

SEQ ID NO: 728093 - DNA, 20 bp, mouse
ggagagggatgcgctagagg

SEQ ID NO: 728094 - DNA, 20 bp, mouse
gacaggggcagagtagtgag

SEQ ID NO: 728095 - DNA, 20 bp, mouse
gtcgggtaaagagaggctac

SEQ ID NO: 728096 - DNA, 20 bp, mouse
ggggcggggtgggtacctag

SEQ ID NO: 728097 - DNA, 20 bp, mouse
gctggggatccagattgcag

SEQ ID NO: 728098 - DNA, 20 bp, mouse
ggcacgcggtgctgcgcgaa

SEQ ID NO: 728099 - DNA, 20 bp, mouse
gctgggacctgataacgagg

SEQ ID NO: 728100 - DNA, 20 bp, mouse
gggaaaagacgccgcgggcg

SEQ ID NO: 728101 - DNA, 20 bp, mouse
gggcaagcctggctttgcag

SEQ ID NO: 728102 - DNA, 20 bp, mouse
gataacgagggggttggctc

SEQ ID NO: 728103 - DNA, 20 bp, mouse
ggaactgaattgctagacac

SEQ ID NO: 728104 - DNA, 20 bp, mouse
gacctagaggcaaatgtgtc

SEQ ID NO: 728105 - DNA, 20 bp, mouse
ggctgcgcgaatggcaagcc

SEQ ID NO: 728106 - DNA, 20 bp, mouse
gcggcccttgcggcgttggt

SEQ ID NO: 728107 - DNA, 20 bp, mouse
gctcgcgtgcaaaaggagtc

SEQ ID NO: 728108 - DNA, 20 bp, mouse
gcaggggcggggcccaaatc

SEQ ID NO: 728109 - DNA, 20 bp, mouse
gaacccccggggcgatgtcc

SEQ ID NO: 728110 - DNA, 20 bp, mouse
gggtgggctgcgaaaagcac

SEQ ID NO: 728111 - DNA, 20 bp, mouse
ggccggaaaaacagcgcgtg

SEQ ID NO: 728112 - DNA, 20 bp, mouse
gggaagggctcgcgtgcaaa

SEQ ID NO: 728113 - DNA, 20 bp, mouse
gtttccggcccttgcggcgt

SEQ ID NO: 728114 - DNA, 20 bp, mouse
ggctacacacgcagccctgg

SEQ ID NO: 728115 - DNA, 20 bp, mouse
gcgcgccgataggcgtgcag

SEQ ID NO: 728116 - DNA, 20 bp, mouse
gaggggggggtcaaagtaaa

SEQ ID NO: 728117 - DNA, 20 bp, mouse
gcggcggcagcctgaatatt

SEQ ID NO: 728118 - DNA, 20 bp, mouse
gtgaactcacgcggcatgag

SEQ ID NO: 728119 - DNA, 20 bp, mouse
ggggaaagtgtcagcgctgg

SEQ ID NO: 728120 - DNA, 20 bp, mouse
ggaggtggctggttggagcc

SEQ ID NO: 728121 - DNA, 20 bp, mouse
gccggtgctctcttcccggt

SEQ ID NO: 728122 - DNA, 20 bp, mouse
gggtgacaggtgaacttgac

SEQ ID NO: 728123 - DNA, 20 bp, mouse
gggggggagtggtctgtcgg

SEQ ID NO: 728124 - DNA, 20 bp, mouse
gtcacgcggcatgagcggag

SEQ ID NO: 728125 - DNA, 20 bp, mouse
gggggggtcaaagtaaatgg

SEQ ID NO: 728126 - DNA, 20 bp, mouse
ggcccagtgctgcgattcaa

SEQ ID NO: 728127 - DNA, 20 bp, mouse
gccgccagggcccaatccaa

SEQ ID NO: 728128 - DNA, 20 bp, mouse
gaaaggcagtgcggcgcgtc

SEQ ID NO: 728129 - DNA, 20 bp, mouse
gagggagcgtctgacctatg

SEQ ID NO: 728130 - DNA, 20 bp, mouse
gtccagtaggagccctgggt

SEQ ID NO: 728131 - DNA, 20 bp, mouse
gggcgcgtccgggttctacc

SEQ ID NO: 728132 - DNA, 20 bp, mouse
gtctgcgatcggcaccgcca

SEQ ID NO: 728133 - DNA, 20 bp, mouse
gctcggactgcggaagaacc

SEQ ID NO: 728134 - DNA, 20 bp, mouse
gggaagaaccaggtagaacc

SEQ ID NO: 728135 - DNA, 20 bp, mouse
ggccgatcgcagaacgtcac

SEQ ID NO: 728136 - DNA, 20 bp, mouse
gctccggagtggaggggaat

SEQ ID NO: 728137 - DNA, 20 bp, mouse
ggaccaatgggactccggag

SEQ ID NO: 728138 - DNA, 20 bp, mouse
gctccactccggagtcccat

SEQ ID NO: 728139 - DNA, 20 bp, mouse
gggacgtcttcgtgaccaat

SEQ ID NO: 728140 - DNA, 20 bp, mouse
gcggatcaaggtcctacccg

SEQ ID NO: 728141 - DNA, 20 bp, mouse
gcggaggagggggatcactg

SEQ ID NO: 728142 - DNA, 20 bp, mouse
gaagacgtccaatgagcgca

SEQ ID NO: 728143 - DNA, 20 bp, mouse
ggtctctgggagccgcttgg

SEQ ID NO: 728144 - DNA, 20 bp, mouse
gaggagtctcgacccccaag

SEQ ID NO: 728145 - DNA, 20 bp, mouse
gccgccagcgtggtctgctg

SEQ ID NO: 728146 - DNA, 20 bp, mouse
gcatacgccttcccacaggg

SEQ ID NO: 728147 - DNA, 20 bp, mouse
ggctgggagctgaaatcgtg

SEQ ID NO: 728148 - DNA, 20 bp, mouse
gcgcccatacgccttcccac

SEQ ID NO: 728149 - DNA, 20 bp, mouse
gcgccttcccacagggagga

SEQ ID NO: 728150 - DNA, 20 bp, mouse
ggagggacatgatatcatgc

SEQ ID NO: 728151 - DNA, 20 bp, mouse
ggaggtgattagagagaaaa

SEQ ID NO: 728152 - DNA, 20 bp, mouse
ggagacaagggaggttttca

SEQ ID NO: 728153 - DNA, 20 bp, mouse
gctggaagctgtagttccct

SEQ ID NO: 728154 - DNA, 20 bp, mouse
gcgcgcaggaagagcctagg

SEQ ID NO: 728155 - DNA, 20 bp, mouse
gtacacatcccagaatacca

SEQ ID NO: 728156 - DNA, 20 bp, mouse
gacaactcaggcacttgaga

SEQ ID NO: 728157 - DNA, 20 bp, mouse
ggcccaccctcactgtgccg

SEQ ID NO: 728158 - DNA, 20 bp, mouse
ggggaacatcatcccatcaa

SEQ ID NO: 728159 - DNA, 20 bp, mouse
gtcactgtccacaacaactc

SEQ ID NO: 728160 - DNA, 20 bp, mouse
ggggtggggcctacagaagc

SEQ ID NO: 728161 - DNA, 20 bp, mouse
gggtgggccctgctggaggg

SEQ ID NO: 728162 - DNA, 20 bp, mouse
gagaaggcctcactaagccc

SEQ ID NO: 728163 - DNA, 20 bp, mouse
gggccaaggaggttctgagt

SEQ ID NO: 728164 - DNA, 20 bp, mouse
gctctagcaatgggaggctt

SEQ ID NO: 728165 - DNA, 20 bp, mouse
gaaagggctgtacattagct

SEQ ID NO: 728166 - DNA, 20 bp, mouse
ggcaccgccccgttgaggga

SEQ ID NO: 728167 - DNA, 20 bp, mouse
ggaaggcaccgccccgttga

SEQ ID NO: 728168 - DNA, 20 bp, mouse
ggtccgctgccctccctcaa

SEQ ID NO: 728169 - DNA, 20 bp, mouse
gtggacttgagcgaagaggc

SEQ ID NO: 728170 - DNA, 20 bp, mouse
ggcagtggacttgagcgaag

SEQ ID NO: 728171 - DNA, 20 bp, mouse
gctgccctccctcaacgggg

SEQ ID NO: 728172 - DNA, 20 bp, mouse
gcggggcggtgccttcctct

SEQ ID NO: 728173 - DNA, 20 bp, mouse
gctaattcccgcccagagga

SEQ ID NO: 728174 - DNA, 20 bp, mouse
gaatcctaattcccgcccag

SEQ ID NO: 728175 - DNA, 20 bp, mouse
gtttgagttgttctgtgcag

SEQ ID NO: 728176 - DNA, 20 bp, mouse
gtggggcttcctgaccctta

SEQ ID NO: 728177 - DNA, 20 bp, mouse
gcggcgcgacgtcacgtcgg

SEQ ID NO: 728178 - DNA, 20 bp, mouse
ggggacgggcgtctcttagg

SEQ ID NO: 728179 - DNA, 20 bp, mouse
gctcctggggtgcctgtctc

SEQ ID NO: 728180 - DNA, 20 bp, mouse
gagcgggacgggcgtctctt

SEQ ID NO: 728181 - DNA, 20 bp, mouse
ggacctgagacaggcacccc

SEQ ID NO: 728182 - DNA, 20 bp, mouse
gggacgctagctgcgaggaa

SEQ ID NO: 728183 - DNA, 20 bp, mouse
ggtggggagggcctcgttga

SEQ ID NO: 728184 - DNA, 20 bp, mouse
gggggaccctgaggcctcct

SEQ ID NO: 728185 - DNA, 20 bp, mouse
gggcggaagagaggacccgg

SEQ ID NO: 728186 - DNA, 20 bp, mouse
gctggagcccccaccccgga

SEQ ID NO: 728187 - DNA, 20 bp, mouse
gggaaagtcgccctccgggg

SEQ ID NO: 728188 - DNA, 20 bp, mouse
gagagacttggaactcacag

SEQ ID NO: 728189 - DNA, 20 bp, mouse
gccccggtactggagagact

SEQ ID NO: 728190 - DNA, 20 bp, mouse
gagggggaaagtcgccctcc

SEQ ID NO: 728191 - DNA, 20 bp, mouse
ggccgggcttcgcctccaag

SEQ ID NO: 728192 - DNA, 20 bp, mouse
gcagaaggagaggtcgcgcc

SEQ ID NO: 728193 - DNA, 20 bp, mouse
gggcccactcccaaattcaa

SEQ ID NO: 728194 - DNA, 20 bp, mouse
gaagtcgccctccggggtgg

SEQ ID NO: 728195 - DNA, 20 bp, mouse
gtccaagtctctccagtacc

SEQ ID NO: 728196 - DNA, 20 bp, mouse
ggggctggaccagagagccg

SEQ ID NO: 728197 - DNA, 20 bp, mouse
gcctgcaagcccttctgcgg

SEQ ID NO: 728198 - DNA, 20 bp, mouse
ggaggtggggccacggccaa

SEQ ID NO: 728199 - DNA, 20 bp, mouse
gccagccccgaggttagagg

SEQ ID NO: 728200 - DNA, 20 bp, mouse
ggggaggggtgcgagaggcg

SEQ ID NO: 728201 - DNA, 20 bp, mouse
gaagggcttgcaggtgtccg

SEQ ID NO: 728202 - DNA, 20 bp, mouse
gacacctgcaagcccttctg

SEQ ID NO: 728203 - DNA, 20 bp, mouse
gcctctccgcccccgcagaa

SEQ ID NO: 728204 - DNA, 20 bp, mouse
gggccaagggcgagggatga

SEQ ID NO: 728205 - DNA, 20 bp, mouse
ggcgtcctcctctaacctcg

SEQ ID NO: 728206 - DNA, 20 bp, mouse
gtgcccgcaccaaacctcgg

SEQ ID NO: 728207 - DNA, 20 bp, mouse
gtggaggtgactaagtgatt

SEQ ID NO: 728208 - DNA, 20 bp, mouse
ggggctgggcggacggagag

SEQ ID NO: 728209 - DNA, 20 bp, mouse
ggagctagagaaagtctgat

SEQ ID NO: 728210 - DNA, 20 bp, mouse
ggtgagacacactttcgcga

SEQ ID NO: 728211 - DNA, 20 bp, mouse
gtccccgtcacatggactca

SEQ ID NO: 728212 - DNA, 20 bp, mouse
gctccctgagtgccaatatc

SEQ ID NO: 728213 - DNA, 20 bp, mouse
gactgagaattgttccgttg

SEQ ID NO: 728214 - DNA, 20 bp, mouse
gggaccttgagtccatgtga

SEQ ID NO: 728215 - DNA, 20 bp, mouse
gtagagctcggagaccgccg

SEQ ID NO: 728216 - DNA, 20 bp, mouse
gcgcgctcgggaccaatcgg

SEQ ID NO: 728217 - DNA, 20 bp, mouse
ggtggttggctgaagatctg

SEQ ID NO: 728218 - DNA, 20 bp, mouse
gaagatctgcggagccgcgt

SEQ ID NO: 728219 - DNA, 20 bp, mouse
gcgggcgggtgcgtcaagtt

SEQ ID NO: 728220 - DNA, 20 bp, mouse
gtgccgacgcacctcccacg

SEQ ID NO: 728221 - DNA, 20 bp, mouse
gagccgcgtgggaggtgcgt

SEQ ID NO: 728222 - DNA, 20 bp, mouse
gtgaggcctccatgagaggt

SEQ ID NO: 728223 - DNA, 20 bp, mouse
ggggaccaatcggaggcgac

SEQ ID NO: 728224 - DNA, 20 bp, mouse
gtggggcggagctccttaaa

SEQ ID NO: 728225 - DNA, 20 bp, mouse
gtgcgtcggcaggttgcggg

SEQ ID NO: 728226 - DNA, 20 bp, mouse
gcgggaactgtgagaaacga

SEQ ID NO: 728227 - DNA, 20 bp, mouse
gttcccgagcagcctggcgt

SEQ ID NO: 728228 - DNA, 20 bp, mouse
ggacccggggacacacctac

SEQ ID NO: 728229 - DNA, 20 bp, mouse
ggaggccggagtccacgggg

SEQ ID NO: 728230 - DNA, 20 bp, mouse
ggccccgccccccggtgaca

SEQ ID NO: 728231 - DNA, 20 bp, mouse
gaaggagaggccctcgacat

SEQ ID NO: 728232 - DNA, 20 bp, mouse
gactgtgcgcgcggtttccg

SEQ ID NO: 728233 - DNA, 20 bp, mouse
gcccgcgaggccggagtcca

SEQ ID NO: 728234 - DNA, 20 bp, mouse
gtccacgggggggctcctgt

SEQ ID NO: 728235 - DNA, 20 bp, mouse
gccgtcggcgcgcgtgcccg

SEQ ID NO: 728236 - DNA, 20 bp, mouse
gcgtgtctggcgattgtttg

SEQ ID NO: 728237 - DNA, 20 bp, mouse
gaatcgccagacacgggttg

SEQ ID NO: 728238 - DNA, 20 bp, mouse
gaatctaagcatggattctg

SEQ ID NO: 728239 - DNA, 20 bp, mouse
ggggacagcatacacagtgg

SEQ ID NO: 728240 - DNA, 20 bp, mouse
ggacatctgggccgggcagg

SEQ ID NO: 728241 - DNA, 20 bp, mouse
ggtgcacctcaacccgtgtc

SEQ ID NO: 728242 - DNA, 20 bp, mouse
gggtcacacgacatctgggc

SEQ ID NO: 728243 - DNA, 20 bp, mouse
gcgtgtgagtcgctgaaagg

SEQ ID NO: 728244 - DNA, 20 bp, mouse
gtacaagagtcgcctctaat

SEQ ID NO: 728245 - DNA, 20 bp, mouse
ggtactcagggtttgcaact

SEQ ID NO: 728246 - DNA, 20 bp, mouse
ggtactgggacgctcggcag

SEQ ID NO: 728247 - DNA, 20 bp, mouse
gctcggcagcggcttggaga

SEQ ID NO: 728248 - DNA, 20 bp, mouse
gaggcgctgcgggcagtggg

SEQ ID NO: 728249 - DNA, 20 bp, mouse
ggagaggaggcgggaagcga

SEQ ID NO: 728250 - DNA, 20 bp, mouse
gcggctgccaaaaagagaga

SEQ ID NO: 728251 - DNA, 20 bp, mouse
gagggttgctctctccgcaa

SEQ ID NO: 728252 - DNA, 20 bp, mouse
ggaggcgggaagcgaaggag

SEQ ID NO: 728253 - DNA, 20 bp, mouse
ggctctctccgcaaaggctc

SEQ ID NO: 728254 - DNA, 20 bp, mouse
gcgcaaaggctcgggagttg

SEQ ID NO: 728255 - DNA, 20 bp, mouse
gctcgggagttgcgggtact

SEQ ID NO: 728256 - DNA, 20 bp, mouse
ggggctctggtcaggacaat

SEQ ID NO: 728257 - DNA, 20 bp, mouse
ggcagaggcagcagctgcta

SEQ ID NO: 728258 - DNA, 20 bp, mouse
gaacgggcctggtgagttgg

SEQ ID NO: 728259 - DNA, 20 bp, mouse
gagggaacgggccaatgaac

SEQ ID NO: 728260 - DNA, 20 bp, mouse
gcacgggccgcacatcccaa

SEQ ID NO: 728261 - DNA, 20 bp, mouse
gccgcctcagcctctcggcc

SEQ ID NO: 728262 - DNA, 20 bp, mouse
gcgcgccgcggctcgggcgt

SEQ ID NO: 728263 - DNA, 20 bp, mouse
gcgggcgtggggctggctcg

SEQ ID NO: 728264 - DNA, 20 bp, mouse
gcagacagccaatggcgcgc

SEQ ID NO: 728265 - DNA, 20 bp, mouse
gacgggaaagcggagctcta

SEQ ID NO: 728266 - DNA, 20 bp, mouse
gacctcgggccaagttggga

SEQ ID NO: 728267 - DNA, 20 bp, mouse
ggcctcctccgccaccacgg

SEQ ID NO: 728268 - DNA, 20 bp, mouse
gccggggcccgacaaaatgg

SEQ ID NO: 728269 - DNA, 20 bp, mouse
ggggcaccccaacttttcac

SEQ ID NO: 728270 - DNA, 20 bp, mouse
gaccgggcccgtgaaaagtt

SEQ ID NO: 728271 - DNA, 20 bp, mouse
ggtgcccgacacccccgtgg

SEQ ID NO: 728272 - DNA, 20 bp, mouse
ggccgccacgtgcgcccgga

SEQ ID NO: 728273 - DNA, 20 bp, mouse
gagcctgcgtgcggccttcc

SEQ ID NO: 728274 - DNA, 20 bp, mouse
gcaacttggcccgaggttga

SEQ ID NO: 728275 - DNA, 20 bp, mouse
ggggcccgacaaaatggggg

SEQ ID NO: 728276 - DNA, 20 bp, mouse
gagactctccgcacagtctg

SEQ ID NO: 728277 - DNA, 20 bp, mouse
gtggccaggcccgtccctcc

SEQ ID NO: 728278 - DNA, 20 bp, mouse
ggctgattggccatgagggt

SEQ ID NO: 728279 - DNA, 20 bp, mouse
gggtctgggagttaacgacc

SEQ ID NO: 728280 - DNA, 20 bp, mouse
ggagacccaccgaacctgct

SEQ ID NO: 728281 - DNA, 20 bp, mouse
gggccggggcagttcctctc

SEQ ID NO: 728282 - DNA, 20 bp, mouse
gtagagaggaatgtactgct

SEQ ID NO: 728283 - DNA, 20 bp, mouse
gggaagccttctccgtgggg

SEQ ID NO: 728284 - DNA, 20 bp, mouse
gggagaaggcttccgattgg

SEQ ID NO: 728285 - DNA, 20 bp, mouse
ggggaggtgtggcccgcgac

SEQ ID NO: 728286 - DNA, 20 bp, mouse
gaggccgcgcccaatgggca

SEQ ID NO: 728287 - DNA, 20 bp, mouse
gcccagaggccgcgcccaat

SEQ ID NO: 728288 - DNA, 20 bp, mouse
gaggcctgcagccaatggcc

SEQ ID NO: 728289 - DNA, 20 bp, mouse
gcagctgcttaatatgcatg

SEQ ID NO: 728290 - DNA, 20 bp, mouse
gtgcccgtgcccattgggcg

SEQ ID NO: 728291 - DNA, 20 bp, mouse
gagccaatggccaggcgagg

SEQ ID NO: 728292 - DNA, 20 bp, mouse
gaggaggttgttttaaacgg

SEQ ID NO: 728293 - DNA, 20 bp, mouse
gaacctcctcgcctggccat

SEQ ID NO: 728294 - DNA, 20 bp, mouse
ggcgaggaggttgttttaaa

SEQ ID NO: 728295 - DNA, 20 bp, mouse
gtccacgagagccgcctgat

SEQ ID NO: 728296 - DNA, 20 bp, mouse
ggagacaccaaccactaaga

SEQ ID NO: 728297 - DNA, 20 bp, mouse
gccaaagggaaagattccca

SEQ ID NO: 728298 - DNA, 20 bp, mouse
gccccagtgggtcataataa

SEQ ID NO: 728299 - DNA, 20 bp, mouse
gtgcaggtaagccctcttag

SEQ ID NO: 728300 - DNA, 20 bp, mouse
gttagtggttggtgtctccg

SEQ ID NO: 728301 - DNA, 20 bp, mouse
gctgacaatcacatggagaa

SEQ ID NO: 728302 - DNA, 20 bp, mouse
gacagcctctagaaagccaa

SEQ ID NO: 728303 - DNA, 20 bp, mouse
gaaggccaccagcactgaaa

SEQ ID NO: 728304 - DNA, 20 bp, mouse
gggtaagccctcttagtggt

SEQ ID NO: 728305 - DNA, 20 bp, mouse
gaggcattgccactgctcga

SEQ ID NO: 728306 - DNA, 20 bp, mouse
gggagggtagagctacttag

SEQ ID NO: 728307 - DNA, 20 bp, mouse
ggagctacttagaggggagt

SEQ ID NO: 728308 - DNA, 20 bp, mouse
gtggagtgggcatgattgga

SEQ ID NO: 728309 - DNA, 20 bp, mouse
gaatctcgggatctacacat

SEQ ID NO: 728310 - DNA, 20 bp, mouse
ggtaggaaaagaaaacagac

SEQ ID NO: 728311 - DNA, 20 bp, mouse
gaccacgcccacagagggat

SEQ ID NO: 728312 - DNA, 20 bp, mouse
gacgcccacagagggatcgg

SEQ ID NO: 728313 - DNA, 20 bp, mouse
ggaaaggcgttgtgttccca

SEQ ID NO: 728314 - DNA, 20 bp, mouse
ggttcagaaaatcatggagt

SEQ ID NO: 728315 - DNA, 20 bp, mouse
gcggtcacgtggtgcccagt

SEQ ID NO: 728316 - DNA, 20 bp, mouse
ggtaaaatatggtgctctca

SEQ ID NO: 728317 - DNA, 20 bp, mouse
ggggacagttaattgaggca

SEQ ID NO: 728318 - DNA, 20 bp, mouse
gcacccgcgggacgcgctcc

SEQ ID NO: 728319 - DNA, 20 bp, mouse
gtgagagccagatcctggat

SEQ ID NO: 728320 - DNA, 20 bp, mouse
gagggaggggggtatatcgg

SEQ ID NO: 728321 - DNA, 20 bp, mouse
gggtccgagctgcactgcgg

SEQ ID NO: 728322 - DNA, 20 bp, mouse
gctgcctagagctctgactc

SEQ ID NO: 728323 - DNA, 20 bp, mouse
gcccccccctccgtaaaata

SEQ ID NO: 728324 - DNA, 20 bp, mouse
gggatggggacagttaattg

SEQ ID NO: 728325 - DNA, 20 bp, mouse
gaaccctacaggcttgtggc

SEQ ID NO: 728326 - DNA, 20 bp, mouse
gccgcccgcgcggggaacag

SEQ ID NO: 728327 - DNA, 20 bp, mouse
gggctcggagaccaatagga

SEQ ID NO: 728328 - DNA, 20 bp, mouse
gctgggacccgacccgtcat

SEQ ID NO: 728329 - DNA, 20 bp, mouse
gcccctagccaatcgtcggg

SEQ ID NO: 728330 - DNA, 20 bp, mouse
gagcgggccgccaataagga

SEQ ID NO: 728331 - DNA, 20 bp, mouse
ggagcagtgggcggttgtta

SEQ ID NO: 728332 - DNA, 20 bp, mouse
gctcgcacccgggcggagaa

SEQ ID NO: 728333 - DNA, 20 bp, mouse
gcgatcccctagccaatcgt

SEQ ID NO: 728334 - DNA, 20 bp, mouse
gtgagcagccgcccgacgat

SEQ ID NO: 728335 - DNA, 20 bp, mouse
ggctctgccgtggtgagaga

SEQ ID NO: 728336 - DNA, 20 bp, mouse
ggagaggcggggactcgcta

SEQ ID NO: 728337 - DNA, 20 bp, mouse
gtgccggaagggcggggtaa

SEQ ID NO: 728338 - DNA, 20 bp, mouse
gcccgcccttccggcagcga

SEQ ID NO: 728339 - DNA, 20 bp, mouse
gggggtgagacggtgacgta

SEQ ID NO: 728340 - DNA, 20 bp, mouse
gtggctgaaagcggatcggg

SEQ ID NO: 728341 - DNA, 20 bp, mouse
gccgagcgactctgagtccc

SEQ ID NO: 728342 - DNA, 20 bp, mouse
gcgactctgagtcccgggat

SEQ ID NO: 728343 - DNA, 20 bp, mouse
gccaacgggagcggagtgag

SEQ ID NO: 728344 - DNA, 20 bp, mouse
gactcggcgtcccactcctg

SEQ ID NO: 728345 - DNA, 20 bp, mouse
gcggctacctctgccaatcc

SEQ ID NO: 728346 - DNA, 20 bp, mouse
gcaggggcctcgataagcgg

SEQ ID NO: 728347 - DNA, 20 bp, mouse
gtacatagctgcactgttcc

SEQ ID NO: 728348 - DNA, 20 bp, mouse
ggaggctgcagagacgagtt

SEQ ID NO: 728349 - DNA, 20 bp, mouse
ggactgcataaagtggttag

SEQ ID NO: 728350 - DNA, 20 bp, mouse
gactcagcagaggaatcagg

SEQ ID NO: 728351 - DNA, 20 bp, mouse
gaggcaggggcctcgataag

SEQ ID NO: 728352 - DNA, 20 bp, mouse
gcataaagtggttaggggtt

SEQ ID NO: 728353 - DNA, 20 bp, mouse
gtggctggtatctagctggc

SEQ ID NO: 728354 - DNA, 20 bp, mouse
ggcctcgataagcggaggcg

SEQ ID NO: 728355 - DNA, 20 bp, mouse
gggctctgagacttcattgt

SEQ ID NO: 728356 - DNA, 20 bp, mouse
ggggcctagacagccaatgg

SEQ ID NO: 728357 - DNA, 20 bp, mouse
ggtcgcgcccgcaggggtgg

SEQ ID NO: 728358 - DNA, 20 bp, mouse
gccagcccttgctcccgaat

SEQ ID NO: 728359 - DNA, 20 bp, mouse
gcgtgcctattcgggagcaa

SEQ ID NO: 728360 - DNA, 20 bp, mouse
gcgggcgcgaccccggccga

SEQ ID NO: 728361 - DNA, 20 bp, mouse
gagggggcggggcgatgcgg

SEQ ID NO: 728362 - DNA, 20 bp, mouse
gcctgcgcgctgataagtgg

SEQ ID NO: 728363 - DNA, 20 bp, mouse
gcggcctgcgcgctgataag

SEQ ID NO: 728364 - DNA, 20 bp, mouse
gacagctcgccgtgcctatt

SEQ ID NO: 728365 - DNA, 20 bp, mouse
gtagcggggtcgggcgactc

SEQ ID NO: 728366 - DNA, 20 bp, mouse
ggggagggcgctcgagacgg

SEQ ID NO: 728367 - DNA, 20 bp, mouse
gggcccagttggggtcacgt

SEQ ID NO: 728368 - DNA, 20 bp, mouse
gagacggcggcgcgccttgg

SEQ ID NO: 728369 - DNA, 20 bp, mouse
ggagtcggaggtaataaatg

SEQ ID NO: 728370 - DNA, 20 bp, mouse
gagggggcgcgcctcggagt

SEQ ID NO: 728371 - DNA, 20 bp, mouse
gtgggtagaagggttgcata

SEQ ID NO: 728372 - DNA, 20 bp, mouse
ggggcgcgcctcggagtcgg

SEQ ID NO: 728373 - DNA, 20 bp, mouse
gacctcctctggagtgagga

SEQ ID NO: 728374 - DNA, 20 bp, mouse
ggcgcgaggcggcaggcttg

SEQ ID NO: 728375 - DNA, 20 bp, mouse
gtcgcacggcttggagaagt

SEQ ID NO: 728376 - DNA, 20 bp, mouse
ggcgcgtaccgggtgaacgg

SEQ ID NO: 728377 - DNA, 20 bp, mouse
gactgcgcgtaccgggtgaa

SEQ ID NO: 728378 - DNA, 20 bp, mouse
gcgtaccgggtgaacggggg

SEQ ID NO: 728379 - DNA, 20 bp, mouse
gaggaagcggaggtgcaggt

SEQ ID NO: 728380 - DNA, 20 bp, mouse
ggccagccgcgaggccccat

SEQ ID NO: 728381 - DNA, 20 bp, mouse
gaacgttctaaattccacga

SEQ ID NO: 728382 - DNA, 20 bp, mouse
gagggtaggaaggtctgttc

SEQ ID NO: 728383 - DNA, 20 bp, mouse
gatgcgagcgagtggagcgc

SEQ ID NO: 728384 - DNA, 20 bp, mouse
ggaaggatactagttgaact

SEQ ID NO: 728385 - DNA, 20 bp, mouse
gtggcagggctcgccattgg

SEQ ID NO: 728386 - DNA, 20 bp, mouse
gacagcctgtcactccaacc

SEQ ID NO: 728387 - DNA, 20 bp, mouse
ggggaggtggccggttcgga

SEQ ID NO: 728388 - DNA, 20 bp, mouse
gcgggccacgccttccgaac

SEQ ID NO: 728389 - DNA, 20 bp, mouse
gccaacctggctcccacttc

SEQ ID NO: 728390 - DNA, 20 bp, mouse
gacaggctgtcaggccaatg

SEQ ID NO: 728391 - DNA, 20 bp, mouse
gagggcttcgggcaagttcg

SEQ ID NO: 728392 - DNA, 20 bp, mouse
gcaaagccggcagcatacga

SEQ ID NO: 728393 - DNA, 20 bp, mouse
gcggcagcatacgagggctt

SEQ ID NO: 728394 - DNA, 20 bp, mouse
ggttacccgaagtgggagcc

SEQ ID NO: 728395 - DNA, 20 bp, mouse
gtcaggccaatgaggggagg

SEQ ID NO: 728396 - DNA, 20 bp, mouse
gggaggcttaggagctggat

SEQ ID NO: 728397 - DNA, 20 bp, mouse
gggtggcggggtcgttaagg

SEQ ID NO: 728398 - DNA, 20 bp, mouse
gtggcccagggcctggccgt

SEQ ID NO: 728399 - DNA, 20 bp, mouse
gcaaccgcagtcccagcttc

SEQ ID NO: 728400 - DNA, 20 bp, mouse
gcagctcctaagcctccaat

SEQ ID NO: 728401 - DNA, 20 bp, mouse
ggggggtggcggggtcgtta

SEQ ID NO: 728402 - DNA, 20 bp, mouse
gggaagcgctgcatgaggtc

SEQ ID NO: 728403 - DNA, 20 bp, mouse
gtgggacaatcaggtaacag

SEQ ID NO: 728404 - DNA, 20 bp, mouse
gggactgcggttgcgaaact

SEQ ID NO: 728405 - DNA, 20 bp, mouse
ggcggtgcagcactaagtat

SEQ ID NO: 728406 - DNA, 20 bp, mouse
gtagactaaacctgcaacgg

SEQ ID NO: 728407 - DNA, 20 bp, mouse
ggcagtaggagtctgcgctc

SEQ ID NO: 728408 - DNA, 20 bp, mouse
ggcgaccgcgctcaacaagc

SEQ ID NO: 728409 - DNA, 20 bp, mouse
gggaggagtgtattctcaaa

SEQ ID NO: 728410 - DNA, 20 bp, mouse
gtgcagcggggctaccgcgc

SEQ ID NO: 728411 - DNA, 20 bp, mouse
gtgcgctctgggctcgactg

SEQ ID NO: 728412 - DNA, 20 bp, mouse
gtacggagctgtaaagactt

SEQ ID NO: 728413 - DNA, 20 bp, mouse
gaacaagaagggctactatt

SEQ ID NO: 728414 - DNA, 20 bp, mouse
gttctagactaaacctgcaa

SEQ ID NO: 728415 - DNA, 20 bp, mouse
ggcgctcgacgctctttcgc

SEQ ID NO: 728416 - DNA, 20 bp, mouse
gcactggggaatgtagaatg

SEQ ID NO: 728417 - DNA, 20 bp, mouse
gagcagccactaggcagggt

SEQ ID NO: 728418 - DNA, 20 bp, mouse
gacacagcagccactaggca

SEQ ID NO: 728419 - DNA, 20 bp, mouse
ggaggcatcaaagtacactg

SEQ ID NO: 728420 - DNA, 20 bp, mouse
gttgatgcctctgtgagagg

SEQ ID NO: 728421 - DNA, 20 bp, mouse
gaggaggtctctaaactcag

SEQ ID NO: 728422 - DNA, 20 bp, mouse
ggattagggagggtactaga

SEQ ID NO: 728423 - DNA, 20 bp, mouse
gctaagactttagctgatta

SEQ ID NO: 728424 - DNA, 20 bp, mouse
gcctttacagacgtgagggg

SEQ ID NO: 728425 - DNA, 20 bp, mouse
gtaaataccaagaggcatga

SEQ ID NO: 728426 - DNA, 20 bp, mouse
gacaggctgcaagtggaagg

SEQ ID NO: 728427 - DNA, 20 bp, mouse
gcttgggacagtcacactgg

SEQ ID NO: 728428 - DNA, 20 bp, mouse
gcacactgggggcggatctg

SEQ ID NO: 728429 - DNA, 20 bp, mouse
gggaaaaggctccccagcag

SEQ ID NO: 728430 - DNA, 20 bp, mouse
gtgtcagagccacacgtgac

SEQ ID NO: 728431 - DNA, 20 bp, mouse
gcctataagagctgacactt

SEQ ID NO: 728432 - DNA, 20 bp, mouse
gacacttgggacagtcacac

SEQ ID NO: 728433 - DNA, 20 bp, mouse
gaaggctccccagcagaggg

SEQ ID NO: 728434 - DNA, 20 bp, mouse
ggggagtgggagctaagtgg

SEQ ID NO: 728435 - DNA, 20 bp, mouse
ggtggaaggtggcctgctgt

SEQ ID NO: 728436 - DNA, 20 bp, mouse
gctaccgccgcccaatcgga

SEQ ID NO: 728437 - DNA, 20 bp, mouse
gtaagctagtagccaataag

SEQ ID NO: 728438 - DNA, 20 bp, mouse
gatcaggagcagcctcttat

SEQ ID NO: 728439 - DNA, 20 bp, mouse
gtcgcgcaagcgcacttcac

SEQ ID NO: 728440 - DNA, 20 bp, mouse
gcacaggccggtggacgcgt

SEQ ID NO: 728441 - DNA, 20 bp, mouse
ggattggatagagctgtttg

SEQ ID NO: 728442 - DNA, 20 bp, mouse
gaaaccttccgattgggcgg

SEQ ID NO: 728443 - DNA, 20 bp, mouse
gaacactgacgccggaacaa

SEQ ID NO: 728444 - DNA, 20 bp, mouse
gctccgggagagcactacac

SEQ ID NO: 728445 - DNA, 20 bp, mouse
ggaagtgcgcttgcgcgaac

SEQ ID NO: 728446 - DNA, 20 bp, mouse
gaggcgggccctgcctgtaa

SEQ ID NO: 728447 - DNA, 20 bp, mouse
ggcaacatccagcccggagg

SEQ ID NO: 728448 - DNA, 20 bp, mouse
gcgtgacccgcgtacttaaa

SEQ ID NO: 728449 - DNA, 20 bp, mouse
ggtagtgtgggtcaatccct

SEQ ID NO: 728450 - DNA, 20 bp, mouse
gaagacgggagtagcccttc

SEQ ID NO: 728451 - DNA, 20 bp, mouse
gtatcctaagagttccggga

SEQ ID NO: 728452 - DNA, 20 bp, mouse
gaagtacgcgggtcacgtgg

SEQ ID NO: 728453 - DNA, 20 bp, mouse
ggcaacagcagcgagaacgc

SEQ ID NO: 728454 - DNA, 20 bp, mouse
ggttccgggaaggtagactc

SEQ ID NO: 728455 - DNA, 20 bp, mouse
gctaccttcccggaactctt

SEQ ID NO: 728456 - DNA, 20 bp, mouse
gcagctagcgggaggctctt

SEQ ID NO: 728457 - DNA, 20 bp, mouse
gggggagtagtaatgttaac

SEQ ID NO: 728458 - DNA, 20 bp, mouse
gatcaacaagcagttggctt

SEQ ID NO: 728459 - DNA, 20 bp, mouse
gctcccgaagctttctcaga

SEQ ID NO: 728460 - DNA, 20 bp, mouse
gcaggcgcacggcagctagc

SEQ ID NO: 728461 - DNA, 20 bp, mouse
gaggacgtgcgcacgcagcg

SEQ ID NO: 728462 - DNA, 20 bp, mouse
ggggcgagcgccaggacggt

SEQ ID NO: 728463 - DNA, 20 bp, mouse
gtaatgttaaccggagagga

SEQ ID NO: 728464 - DNA, 20 bp, mouse
ggtcctggcgctcgccctct

SEQ ID NO: 728465 - DNA, 20 bp, mouse
gtgcgcacgtcctaccgtcc

SEQ ID NO: 728466 - DNA, 20 bp, mouse
gcgggcagcatctccggcaa

SEQ ID NO: 728467 - DNA, 20 bp, mouse
ggggctgcagcgggtcgttg

SEQ ID NO: 728468 - DNA, 20 bp, mouse
ggcgccggaacgcatctcgc

SEQ ID NO: 728469 - DNA, 20 bp, mouse
gtccggcaatggcttctctc

SEQ ID NO: 728470 - DNA, 20 bp, mouse
gaggagacccggtggtcctg

SEQ ID NO: 728471 - DNA, 20 bp, mouse
gcccagggcaggagacccgg

SEQ ID NO: 728472 - DNA, 20 bp, mouse
gcaccccggtacccgcgcca

SEQ ID NO: 728473 - DNA, 20 bp, mouse
gaccaccgggtctcctgccc

SEQ ID NO: 728474 - DNA, 20 bp, mouse
gggactctgcgcgcaggtgg

SEQ ID NO: 728475 - DNA, 20 bp, mouse
gcccgtgaggccagccgggg

SEQ ID NO: 728476 - DNA, 20 bp, mouse
gcctccgcgtcgctggagac

SEQ ID NO: 728477 - DNA, 20 bp, mouse
ggtccagcccgtaacatctg

SEQ ID NO: 728478 - DNA, 20 bp, mouse
ggcaccggaccgctgtgcgc

SEQ ID NO: 728479 - DNA, 20 bp, mouse
ggtccctgccggcccggctc

SEQ ID NO: 728480 - DNA, 20 bp, mouse
gggctcacccagagccgggc

SEQ ID NO: 728481 - DNA, 20 bp, mouse
ggtccggtgcctgcgcgtcc

SEQ ID NO: 728482 - DNA, 20 bp, mouse
ggctgtgcgcgggtccctgc

SEQ ID NO: 728483 - DNA, 20 bp, mouse
gccggtggagttgtcaaacg

SEQ ID NO: 728484 - DNA, 20 bp, mouse
gggaagggacattggcaccg

SEQ ID NO: 728485 - DNA, 20 bp, mouse
gtggagttgtcaaacgagga

SEQ ID NO: 728486 - DNA, 20 bp, mouse
gcgcgcgagggacctcaaga

SEQ ID NO: 728487 - DNA, 20 bp, mouse
gaccccctgcagctcggctg

SEQ ID NO: 728488 - DNA, 20 bp, mouse
gccaaagcgccaaaatccga

SEQ ID NO: 728489 - DNA, 20 bp, mouse
gcgggggcgtctccttcttg

SEQ ID NO: 728490 - DNA, 20 bp, mouse
gcgcgcgcctcccgcttggt

SEQ ID NO: 728491 - DNA, 20 bp, mouse
gagagctcccaccaagcggg

SEQ ID NO: 728492 - DNA, 20 bp, mouse
gagcccgcagccgagctgca

SEQ ID NO: 728493 - DNA, 20 bp, mouse
gggcctctgccaggccggga

SEQ ID NO: 728494 - DNA, 20 bp, mouse
gcgtgcgggtccaggaagta

SEQ ID NO: 728495 - DNA, 20 bp, mouse
gctgcgggctggctgctgtc

SEQ ID NO: 728496 - DNA, 20 bp, mouse
gagcaccaccagattgtcga

SEQ ID NO: 728497 - DNA, 20 bp, mouse
gcatagatcggcgtcaggac

SEQ ID NO: 728498 - DNA, 20 bp, mouse
gagtccggcgagccccgcgg

SEQ ID NO: 728499 - DNA, 20 bp, mouse
gcccaatggcggcatgtgga

SEQ ID NO: 728500 - DNA, 20 bp, mouse
gtctctgtacaggaaggggg

SEQ ID NO: 728501 - DNA, 20 bp, mouse
gcacgccctcgacaatctgg

SEQ ID NO: 728502 - DNA, 20 bp, mouse
gccggtaaggcgacagggta

SEQ ID NO: 728503 - DNA, 20 bp, mouse
ggaagctcgtggagccctgg

SEQ ID NO: 728504 - DNA, 20 bp, mouse
gttgtcgagggcgtggagga

SEQ ID NO: 728505 - DNA, 20 bp, mouse
gggtccccacaagccctgga

SEQ ID NO: 728506 - DNA, 20 bp, mouse
gtacctgcgcgggaccaagc

SEQ ID NO: 728507 - DNA, 20 bp, mouse
gtggggcacgactctacgat

SEQ ID NO: 728508 - DNA, 20 bp, mouse
gccctcccgcccccaaggag

SEQ ID NO: 728509 - DNA, 20 bp, mouse
gggcgcgagaggcgtccaac

SEQ ID NO: 728510 - DNA, 20 bp, mouse
ggaaccaatgcccacgcctg

SEQ ID NO: 728511 - DNA, 20 bp, mouse
ggggcgcctctcatggcctc

SEQ ID NO: 728512 - DNA, 20 bp, mouse
gataggtcggccagaaaatg

SEQ ID NO: 728513 - DNA, 20 bp, mouse
gaatgcggattcgcatgcgg

SEQ ID NO: 728514 - DNA, 20 bp, mouse
gacagccgattggctgcagg

SEQ ID NO: 728515 - DNA, 20 bp, mouse
ggcactaggaagtttctggc

SEQ ID NO: 728516 - DNA, 20 bp, mouse
gggaccgggaccgggagtca

SEQ ID NO: 728517 - DNA, 20 bp, mouse
gccactgggccggttctcca

SEQ ID NO: 728518 - DNA, 20 bp, mouse
ggcgctgggtcccactctcc

SEQ ID NO: 728519 - DNA, 20 bp, mouse
ggggagtcatggcctgcaat

SEQ ID NO: 728520 - DNA, 20 bp, mouse
gtgaaagcatcctggagagt

SEQ ID NO: 728521 - DNA, 20 bp, mouse
gcaattgggagtgagcagaa

SEQ ID NO: 728522 - DNA, 20 bp, mouse
ggccgcacccagaggcctcc

SEQ ID NO: 728523 - DNA, 20 bp, mouse
gggcctcatggcgggtgaga

SEQ ID NO: 728524 - DNA, 20 bp, mouse
gaggcctctgggtgcggcgc

SEQ ID NO: 728525 - DNA, 20 bp, mouse
ggacccagcgccgcacccag

SEQ ID NO: 728526 - DNA, 20 bp, mouse
gccaacggagcgagagactt

SEQ ID NO: 728527 - DNA, 20 bp, mouse
gaacctaagggacagtccaa

SEQ ID NO: 728528 - DNA, 20 bp, mouse
gagaaagtgggagaacctaa

SEQ ID NO: 728529 - DNA, 20 bp, mouse
gcccccagcgtgagtagaat

SEQ ID NO: 728530 - DNA, 20 bp, mouse
gccaaaggtcacctaaagtt

SEQ ID NO: 728531 - DNA, 20 bp, mouse
gagagacttgggccgggatt

SEQ ID NO: 728532 - DNA, 20 bp, mouse
gggggaaaaaccgagaaagt

SEQ ID NO: 728533 - DNA, 20 bp, mouse
ggcgtgagtagaatgggctc

SEQ ID NO: 728534 - DNA, 20 bp, mouse
gagaatcggtagagaagatt

SEQ ID NO: 728535 - DNA, 20 bp, mouse
gctctggcaagtcccaatcc

SEQ ID NO: 728536 - DNA, 20 bp, mouse
gtagcctctgcagagggtgg

SEQ ID NO: 728537 - DNA, 20 bp, mouse
gccagcctacccagcaacgg

SEQ ID NO: 728538 - DNA, 20 bp, mouse
gcaaccaatgccagtcctgt

SEQ ID NO: 728539 - DNA, 20 bp, mouse
ggcagagggtggaggctctg

SEQ ID NO: 728540 - DNA, 20 bp, mouse
ggtcacttaccaatcttcca

SEQ ID NO: 728541 - DNA, 20 bp, mouse
gggcaggcacccaacaggac

SEQ ID NO: 728542 - DNA, 20 bp, mouse
gtcagctgggttgtccacct

SEQ ID NO: 728543 - DNA, 20 bp, mouse
ggttaatcacccccgttgct

SEQ ID NO: 728544 - DNA, 20 bp, mouse
ggtccaccttggtgagactt

SEQ ID NO: 728545 - DNA, 20 bp, mouse
gggtttctgactgacacctg

SEQ ID NO: 728546 - DNA, 20 bp, mouse
ggggtcgctccccatctctc

SEQ ID NO: 728547 - DNA, 20 bp, mouse
gcactgaggtccaaacccga

SEQ ID NO: 728548 - DNA, 20 bp, mouse
gtgttgcagtcactgaggga

SEQ ID NO: 728549 - DNA, 20 bp, mouse
ggggagcgacccgctcaagc

SEQ ID NO: 728550 - DNA, 20 bp, mouse
gtggaggcttcaagccaagg

SEQ ID NO: 728551 - DNA, 20 bp, mouse
gttcacctagccagagagat

SEQ ID NO: 728552 - DNA, 20 bp, mouse
ggaggggaaaggaaggtctc

SEQ ID NO: 728553 - DNA, 20 bp, mouse
gagcgacccgctcaagctgg

SEQ ID NO: 728554 - DNA, 20 bp, mouse
gcaatggcgacgatggtcca

SEQ ID NO: 728555 - DNA, 20 bp, mouse
gttccggttctccagcccta

SEQ ID NO: 728556 - DNA, 20 bp, mouse
ggggttaaggaaactggtgg

SEQ ID NO: 728557 - DNA, 20 bp, mouse
gacggcggggttaaggaaac

SEQ ID NO: 728558 - DNA, 20 bp, mouse
gccaagcaggggtcacaagt

SEQ ID NO: 728559 - DNA, 20 bp, mouse
ggcggggttaaggaaactgg

SEQ ID NO: 728560 - DNA, 20 bp, mouse
gtacaaacagtggtgggagc

SEQ ID NO: 728561 - DNA, 20 bp, mouse
gttgggagacggcggggtta

SEQ ID NO: 728562 - DNA, 20 bp, mouse
ggggaactttcagttttagg

SEQ ID NO: 728563 - DNA, 20 bp, mouse
ggttgttagctgataaagac

SEQ ID NO: 728564 - DNA, 20 bp, mouse
gaagaaggaactcggagcag

SEQ ID NO: 728565 - DNA, 20 bp, mouse
gttaaggaaactggtggggg

SEQ ID NO: 728566 - DNA, 20 bp, mouse
gaggagccccaggcccggac

SEQ ID NO: 728567 - DNA, 20 bp, mouse
ggtggtggggaaaccgcgga

SEQ ID NO: 728568 - DNA, 20 bp, mouse
ggaaaacggaagtgggtctg

SEQ ID NO: 728569 - DNA, 20 bp, mouse
ggggcctgggcatccggcga

SEQ ID NO: 728570 - DNA, 20 bp, mouse
gccccaggcccggaccgggg

SEQ ID NO: 728571 - DNA, 20 bp, mouse
gcatccggcgaggggaggga

SEQ ID NO: 728572 - DNA, 20 bp, mouse
gagcgcggaggcggaaggag

SEQ ID NO: 728573 - DNA, 20 bp, mouse
gtggcccggcgcctcccgtg

SEQ ID NO: 728574 - DNA, 20 bp, mouse
gagggagggagggacgactg

SEQ ID NO: 728575 - DNA, 20 bp, mouse
ggcagcgccgctctcggtcg

SEQ ID NO: 728576 - DNA, 20 bp, mouse
gtggggcatcagtgactcaa

SEQ ID NO: 728577 - DNA, 20 bp, mouse
gcgcctgcgcaaccaatcct

SEQ ID NO: 728578 - DNA, 20 bp, mouse
gtagccaatcaatgcgatta

SEQ ID NO: 728579 - DNA, 20 bp, mouse
gcatcagtgactcaaagggg

SEQ ID NO: 728580 - DNA, 20 bp, mouse
gctaagaaacggcatccgtt

SEQ ID NO: 728581 - DNA, 20 bp, mouse
gtcacgggccaatggtggga

SEQ ID NO: 728582 - DNA, 20 bp, mouse
gttaaggataagatcccttg

SEQ ID NO: 728583 - DNA, 20 bp, mouse
gcgtcttcacgggccaatgg

SEQ ID NO: 728584 - DNA, 20 bp, mouse
gtctgaatagaacgcccaaa

SEQ ID NO: 728585 - DNA, 20 bp, mouse
gtgaaatggcgggcgggaga

SEQ ID NO: 728586 - DNA, 20 bp, mouse
gcagtcccgctgtacctaaa

SEQ ID NO: 728587 - DNA, 20 bp, mouse
gccgccgccaatggcgggaa

SEQ ID NO: 728588 - DNA, 20 bp, mouse
gcggcccccacctccgcgta

SEQ ID NO: 728589 - DNA, 20 bp, mouse
gtacgtgacactcccccttt

SEQ ID NO: 728590 - DNA, 20 bp, mouse
gcgctccctacgcggaggtg

SEQ ID NO: 728591 - DNA, 20 bp, mouse
gtaagcggagacgcgttagt

SEQ ID NO: 728592 - DNA, 20 bp, mouse
gcgtaacggcgtgacgtaag

SEQ ID NO: 728593 - DNA, 20 bp, mouse
gttctccgctccctacgcgg

SEQ ID NO: 728594 - DNA, 20 bp, mouse
gcctaaccgccgccaatggc

SEQ ID NO: 728595 - DNA, 20 bp, mouse
gagctgcagagagcacgctt

SEQ ID NO: 728596 - DNA, 20 bp, mouse
ggcggcgctgcgttggaagt

SEQ ID NO: 728597 - DNA, 20 bp, mouse
ggcagcgacgcttacgtcag

SEQ ID NO: 728598 - DNA, 20 bp, mouse
gcgggcgcgaaccgcggcga

SEQ ID NO: 728599 - DNA, 20 bp, mouse
gggcgaaggcggcgctgcgt

SEQ ID NO: 728600 - DNA, 20 bp, mouse
ggcgcgaaccgcggcgaagg

SEQ ID NO: 728601 - DNA, 20 bp, mouse
gcgcgccgcccgcccactgg

SEQ ID NO: 728602 - DNA, 20 bp, mouse
gcaccctcggcccgccaacg

SEQ ID NO: 728603 - DNA, 20 bp, mouse
ggcgagaggggccagaagaa

SEQ ID NO: 728604 - DNA, 20 bp, mouse
gtcagcggcagctcgaccaa

SEQ ID NO: 728605 - DNA, 20 bp, mouse
gcaatggcgagagcccacgt

SEQ ID NO: 728606 - DNA, 20 bp, mouse
gtagaataggatgtagggat

SEQ ID NO: 728607 - DNA, 20 bp, mouse
ggacgtgctcgcccggtgac

SEQ ID NO: 728608 - DNA, 20 bp, mouse
gtgcgcgcgcgctctagatc

SEQ ID NO: 728609 - DNA, 20 bp, mouse
gacagactgccgtgtacccc

SEQ ID NO: 728610 - DNA, 20 bp, mouse
gaaccccggcctcccaaaag

SEQ ID NO: 728611 - DNA, 20 bp, mouse
gcccagctgcccggggtaca

SEQ ID NO: 728612 - DNA, 20 bp, mouse
ggcgcgctctagatccgggc

SEQ ID NO: 728613 - DNA, 20 bp, mouse
gaagcagccaataagatgct

SEQ ID NO: 728614 - DNA, 20 bp, mouse
gggagaactgtctacggttc

SEQ ID NO: 728615 - DNA, 20 bp, mouse
ggggcaccacctcgtaacaa

SEQ ID NO: 728616 - DNA, 20 bp, mouse
gttcctggaggcgttcctat

SEQ ID NO: 728617 - DNA, 20 bp, mouse
gagcgctcgctaattaggag

SEQ ID NO: 728618 - DNA, 20 bp, mouse
gtggacggaattgtgaggag

SEQ ID NO: 728619 - DNA, 20 bp, mouse
gacagaggctagttagtaat

SEQ ID NO: 728620 - DNA, 20 bp, mouse
gagctctcagaagcactgat

SEQ ID NO: 728621 - DNA, 20 bp, mouse
gtccaatcataatccgaggt

SEQ ID NO: 728622 - DNA, 20 bp, mouse
gtccgtccaatcataatccg

SEQ ID NO: 728623 - DNA, 20 bp, mouse
gaagcactgataggacgatg

SEQ ID NO: 728624 - DNA, 20 bp, mouse
gacccacctcggattatgat

SEQ ID NO: 728625 - DNA, 20 bp, mouse
gtaccagacggaaagctggg

SEQ ID NO: 728626 - DNA, 20 bp, mouse
ggcgtgagagccagtcggaa

SEQ ID NO: 728627 - DNA, 20 bp, mouse
gtcacccggcgcagggacgg

SEQ ID NO: 728628 - DNA, 20 bp, mouse
ggcggcgcgggcctttaaag

SEQ ID NO: 728629 - DNA, 20 bp, mouse
gagtcggaaagggacgggga

SEQ ID NO: 728630 - DNA, 20 bp, mouse
gacaaggagcgctggttcga

SEQ ID NO: 728631 - DNA, 20 bp, mouse
gagagccagtcggaaaggga

SEQ ID NO: 728632 - DNA, 20 bp, mouse
ggcggggcgtgagagccagt

SEQ ID NO: 728633 - DNA, 20 bp, mouse
gcccgcgccgcgcgaccgcg

SEQ ID NO: 728634 - DNA, 20 bp, mouse
gagggcggggccaagggacg

SEQ ID NO: 728635 - DNA, 20 bp, mouse
ggtcccggggcccacagccg

SEQ ID NO: 728636 - DNA, 20 bp, mouse
ggaggctaaagtagcgggag

SEQ ID NO: 728637 - DNA, 20 bp, mouse
gcgcgggaggctaaagtagc

SEQ ID NO: 728638 - DNA, 20 bp, mouse
gggcgctggaagcgagcgaa

SEQ ID NO: 728639 - DNA, 20 bp, mouse
gggagcccgtggccgccaat

SEQ ID NO: 728640 - DNA, 20 bp, mouse
gccgtggccgccaatgggag

SEQ ID NO: 728641 - DNA, 20 bp, mouse
gaatcgggagggctgctggg

SEQ ID NO: 728642 - DNA, 20 bp, mouse
gccccgcccgccaatcggga

SEQ ID NO: 728643 - DNA, 20 bp, mouse
gtaaagtagcgggagcggag

SEQ ID NO: 728644 - DNA, 20 bp, mouse
gccgccaatgggagaggccg

SEQ ID NO: 728645 - DNA, 20 bp, mouse
ggctggaagcgagcgaaggg

SEQ ID NO: 728646 - DNA, 20 bp, mouse
gcaggcgcaaacattgcggg

SEQ ID NO: 728647 - DNA, 20 bp, mouse
gggcgcaggcgcaaacattg

SEQ ID NO: 728648 - DNA, 20 bp, mouse
gggggcgggcaaacgagggg

SEQ ID NO: 728649 - DNA, 20 bp, mouse
ggggcgggactagagagctg

SEQ ID NO: 728650 - DNA, 20 bp, mouse
gcgggcaaacgagggggggg

SEQ ID NO: 728651 - DNA, 20 bp, mouse
gccgcctctgagtcccggag

SEQ ID NO: 728652 - DNA, 20 bp, mouse
gccctcccccggccaatcct

SEQ ID NO: 728653 - DNA, 20 bp, mouse
gctgtgggctggtgagtcgg

SEQ ID NO: 728654 - DNA, 20 bp, mouse
gtgcgtgcggaaaactagaa

SEQ ID NO: 728655 - DNA, 20 bp, mouse
gccagaacggagcctaggat

SEQ ID NO: 728656 - DNA, 20 bp, mouse
gtggtggaggggaagactca

SEQ ID NO: 728657 - DNA, 20 bp, mouse
gagaactcgcgcaggccgaa

SEQ ID NO: 728658 - DNA, 20 bp, mouse
gcgcctcggagggtggtgga

SEQ ID NO: 728659 - DNA, 20 bp, mouse
gcctgcgcctcggagggtgg

SEQ ID NO: 728660 - DNA, 20 bp, mouse
gtacagcggcagtcggactg

SEQ ID NO: 728661 - DNA, 20 bp, mouse
gcggacccgaacgccctttt

SEQ ID NO: 728662 - DNA, 20 bp, mouse
gctccaagagggaaacttct

SEQ ID NO: 728663 - DNA, 20 bp, mouse
gcgagcccgcgcaggccccg

SEQ ID NO: 728664 - DNA, 20 bp, mouse
gactcgcgcaggccgaaggg

SEQ ID NO: 728665 - DNA, 20 bp, mouse
ggggctcaccacgccgaaaa

SEQ ID NO: 728666 - DNA, 20 bp, mouse
ggcgtgtaataataggacgg

SEQ ID NO: 728667 - DNA, 20 bp, mouse
gcatgcgtgtaataatagga

SEQ ID NO: 728668 - DNA, 20 bp, mouse
gtgcgcagagcttgctggaa

SEQ ID NO: 728669 - DNA, 20 bp, mouse
gcgcacgcgcaccctgttgc

SEQ ID NO: 728670 - DNA, 20 bp, mouse
gattgcgcttggcgtctcag

SEQ ID NO: 728671 - DNA, 20 bp, mouse
ggcgctaatcagctccccgc

SEQ ID NO: 728672 - DNA, 20 bp, mouse
ggacggcgggagagagctcg

SEQ ID NO: 728673 - DNA, 20 bp, mouse
gaataattgcaaaaaggcgc

SEQ ID NO: 728674 - DNA, 20 bp, mouse
ggacctacccgccggagtgg

SEQ ID NO: 728675 - DNA, 20 bp, mouse
gtcccctcccccactccggc

SEQ ID NO: 728676 - DNA, 20 bp, mouse
ggcagagggtataacagcat

SEQ ID NO: 728677 - DNA, 20 bp, mouse
gggtccctatgacagacctg

SEQ ID NO: 728678 - DNA, 20 bp, mouse
gccagccccaggtctgtcat

SEQ ID NO: 728679 - DNA, 20 bp, mouse
gataatgatggctatggatt

SEQ ID NO: 728680 - DNA, 20 bp, mouse
gaatgtctgaccacagatat

SEQ ID NO: 728681 - DNA, 20 bp, mouse
gaaaacttatggccatgcag

SEQ ID NO: 728682 - DNA, 20 bp, mouse
gatggctataatgatggcta

SEQ ID NO: 728683 - DNA, 20 bp, mouse
gaaaaaaagtacaattagtc

SEQ ID NO: 728684 - DNA, 20 bp, mouse
gcagaggagctggttttgag

SEQ ID NO: 728685 - DNA, 20 bp, mouse
ggttcagatagatttggaag

SEQ ID NO: 728686 - DNA, 20 bp, mouse
gcaactctcggcttaaactc

SEQ ID NO: 728687 - DNA, 20 bp, mouse
gtggcccgccccatttccaa

SEQ ID NO: 728688 - DNA, 20 bp, mouse
gtaaaagcccagcttaactc

SEQ ID NO: 728689 - DNA, 20 bp, mouse
ggctgattggtccgccccga

SEQ ID NO: 728690 - DNA, 20 bp, mouse
gaatgaaccaatgaacagtc

SEQ ID NO: 728691 - DNA, 20 bp, mouse
ggggcttttaagtttaccct

SEQ ID NO: 728692 - DNA, 20 bp, mouse
gttcttacctgactgttcat

SEQ ID NO: 728693 - DNA, 20 bp, mouse
gtggcgcggactcctactat

SEQ ID NO: 728694 - DNA, 20 bp, mouse
gtctacgtcatgtgagatct

SEQ ID NO: 728695 - DNA, 20 bp, mouse
gggagtagctcattgctgat

SEQ ID NO: 728696 - DNA, 20 bp, mouse
ggggcaggtcccgagtgcgc

SEQ ID NO: 728697 - DNA, 20 bp, mouse
ggcccggttgccaccgtggt

SEQ ID NO: 728698 - DNA, 20 bp, mouse
ggggctgtggcggactccgt

SEQ ID NO: 728699 - DNA, 20 bp, mouse
gtgacagcgtggtctcccag

SEQ ID NO: 728700 - DNA, 20 bp, mouse
gcctcagaggcccgtgggga

SEQ ID NO: 728701 - DNA, 20 bp, mouse
ggcgtggagtcgcagcgagt

SEQ ID NO: 728702 - DNA, 20 bp, mouse
ggtgagctccggggttcaga

SEQ ID NO: 728703 - DNA, 20 bp, mouse
gagtcgcagcgagtgggctg

SEQ ID NO: 728704 - DNA, 20 bp, mouse
ggactccacgcccaccacgg

SEQ ID NO: 728705 - DNA, 20 bp, mouse
ggagcagcgcggcagagagg

SEQ ID NO: 728706 - DNA, 20 bp, mouse
gcggccctgggatcacgctg

SEQ ID NO: 728707 - DNA, 20 bp, mouse
gcgccccgtgagcgcccgat

SEQ ID NO: 728708 - DNA, 20 bp, mouse
gacctctcgcgagacttcag

SEQ ID NO: 728709 - DNA, 20 bp, mouse
gacccagctgggaacgggag

SEQ ID NO: 728710 - DNA, 20 bp, mouse
gggtagctgcggaacccggg

SEQ ID NO: 728711 - DNA, 20 bp, mouse
gaatcgcgccaaactccctc

SEQ ID NO: 728712 - DNA, 20 bp, mouse
gctgctcacgtgtgccggga

SEQ ID NO: 728713 - DNA, 20 bp, mouse
ggcaccgcagcgtgatccca

SEQ ID NO: 728714 - DNA, 20 bp, mouse
gttcgagccccgagggagtt

SEQ ID NO: 728715 - DNA, 20 bp, mouse
gggcgagcgagacgcgacaa

SEQ ID NO: 728716 - DNA, 20 bp, mouse
gccactggccctatcttggg

SEQ ID NO: 728717 - DNA, 20 bp, mouse
ggccgcccccacccgatagg

SEQ ID NO: 728718 - DNA, 20 bp, mouse
gccaatagaaatgaaccgtg

SEQ ID NO: 728719 - DNA, 20 bp, mouse
gggccagtggctccccctat

SEQ ID NO: 728720 - DNA, 20 bp, mouse
gtgcgattggcgaacagagg

SEQ ID NO: 728721 - DNA, 20 bp, mouse
gggctccccctatcgggtgg

SEQ ID NO: 728722 - DNA, 20 bp, mouse
ggagtgcgattggcgaacag

SEQ ID NO: 728723 - DNA, 20 bp, mouse
gctgcgccgccatgtcgcgg

SEQ ID NO: 728724 - DNA, 20 bp, mouse
gggtgggggcggcgagtgac

SEQ ID NO: 728725 - DNA, 20 bp, mouse
gcacctataaggagtgcgat

SEQ ID NO: 728726 - DNA, 20 bp, mouse
gggaggcggaagttcggcaa

SEQ ID NO: 728727 - DNA, 20 bp, mouse
gcgcccggcggcagtcaagg

SEQ ID NO: 728728 - DNA, 20 bp, mouse
gcggagcccagcgagagtcc

SEQ ID NO: 728729 - DNA, 20 bp, mouse
gcaagggggcggaaactctc

SEQ ID NO: 728730 - DNA, 20 bp, mouse
ggggacgcgaaagtaaggat

SEQ ID NO: 728731 - DNA, 20 bp, mouse
gagcggcggggagcggatca

SEQ ID NO: 728732 - DNA, 20 bp, mouse
gcggaagttcggcaaggggg

SEQ ID NO: 728733 - DNA, 20 bp, mouse
gccgggcgggatgggatcca

SEQ ID NO: 728734 - DNA, 20 bp, mouse
gtcacccggtatctcagcgg

SEQ ID NO: 728735 - DNA, 20 bp, mouse
gggcggggagcggatcaggg

SEQ ID NO: 728736 - DNA, 20 bp, mouse
gaagtgaggcctgccactgg

SEQ ID NO: 728737 - DNA, 20 bp, mouse
gaggcgtggcctgacgtcca

SEQ ID NO: 728738 - DNA, 20 bp, mouse
ggtcacgccccctggacgtc

SEQ ID NO: 728739 - DNA, 20 bp, mouse
gcaactgtatctgcggacat

SEQ ID NO: 728740 - DNA, 20 bp, mouse
gacccgaggcgagcaggaag

SEQ ID NO: 728741 - DNA, 20 bp, mouse
gcgcctcgggtcacgccccc

SEQ ID NO: 728742 - DNA, 20 bp, mouse
gcgcagatacagttgggttg

SEQ ID NO: 728743 - DNA, 20 bp, mouse
gaggcgttactggtcgttcg

SEQ ID NO: 728744 - DNA, 20 bp, mouse
ggtccagggggcgtgacccg

SEQ ID NO: 728745 - DNA, 20 bp, mouse
gaaagtaagctggaccgact

SEQ ID NO: 728746 - DNA, 20 bp, mouse
ggggaaagcggccctcacgt

SEQ ID NO: 728747 - DNA, 20 bp, mouse
ggcccgtcatacggtctcgt

SEQ ID NO: 728748 - DNA, 20 bp, mouse
gggcccacgagaccgtatga

SEQ ID NO: 728749 - DNA, 20 bp, mouse
gtggcgctgagacccctcat

SEQ ID NO: 728750 - DNA, 20 bp, mouse
ggacgggccaataagagaga

SEQ ID NO: 728751 - DNA, 20 bp, mouse
gcgggggcatgcacacaaag

SEQ ID NO: 728752 - DNA, 20 bp, mouse
ggtatgacgggcagcttgac

SEQ ID NO: 728753 - DNA, 20 bp, mouse
ggcagcctcgccactaccag

SEQ ID NO: 728754 - DNA, 20 bp, mouse
gcacaaaggggtctgttggt

SEQ ID NO: 728755 - DNA, 20 bp, mouse
gcctcggagtccccgacgtg

SEQ ID NO: 728756 - DNA, 20 bp, mouse
gggtccgtttaaccgaaagg

SEQ ID NO: 728757 - DNA, 20 bp, mouse
gaggccggcggccactgcgg

SEQ ID NO: 728758 - DNA, 20 bp, mouse
ggaggcgaggcccgctagag

SEQ ID NO: 728759 - DNA, 20 bp, mouse
gctgggccggaccgcgcaaa

SEQ ID NO: 728760 - DNA, 20 bp, mouse
gggccggaccgcgcaaatgg

SEQ ID NO: 728761 - DNA, 20 bp, mouse
ggaaaggccggcggccactg

SEQ ID NO: 728762 - DNA, 20 bp, mouse
gggcggctcaagagccggaa

SEQ ID NO: 728763 - DNA, 20 bp, mouse
gcaagagccggaaaggccgg

SEQ ID NO: 728764 - DNA, 20 bp, mouse
ggctcaagagccggaaaggc

SEQ ID NO: 728765 - DNA, 20 bp, mouse
ggaggactgaaggcgggtgg

SEQ ID NO: 728766 - DNA, 20 bp, mouse
gaagtcgcggccagagtgga

SEQ ID NO: 728767 - DNA, 20 bp, mouse
gggtcagcgcatggggcaac

SEQ ID NO: 728768 - DNA, 20 bp, mouse
gtcaaaagaacggtactaga

SEQ ID NO: 728769 - DNA, 20 bp, mouse
gtaggctaacgcttcctctt

SEQ ID NO: 728770 - DNA, 20 bp, mouse
gggctcaggagctgcctaag

SEQ ID NO: 728771 - DNA, 20 bp, mouse
gctggccgcgacttcaacgt

SEQ ID NO: 728772 - DNA, 20 bp, mouse
gttgaaagccacactgtgat

SEQ ID NO: 728773 - DNA, 20 bp, mouse
gacggcgcggagagactggg

SEQ ID NO: 728774 - DNA, 20 bp, mouse
gggcggagcaagcgctgatt

SEQ ID NO: 728775 - DNA, 20 bp, mouse
gttagcctacgttgaagtcg

SEQ ID NO: 728776 - DNA, 20 bp, mouse
gcctccccagcggaccaacc

SEQ ID NO: 728777 - DNA, 20 bp, mouse
gcaagctggccaacgagaga

SEQ ID NO: 728778 - DNA, 20 bp, mouse
gaatgcgcgtgccccgttag

SEQ ID NO: 728779 - DNA, 20 bp, mouse
gtcatgccacccaatcagaa

SEQ ID NO: 728780 - DNA, 20 bp, mouse
gaaaaaaagccgcacgatat

SEQ ID NO: 728781 - DNA, 20 bp, mouse
gaccggccccgcctccccag

SEQ ID NO: 728782 - DNA, 20 bp, mouse
gtagaggctaaactgctggc

SEQ ID NO: 728783 - DNA, 20 bp, mouse
gtcccggccacttctccaat

SEQ ID NO: 728784 - DNA, 20 bp, mouse
gccgttagaggctaaactgc

SEQ ID NO: 728785 - DNA, 20 bp, mouse
gctggccaacgagagaagga

SEQ ID NO: 728786 - DNA, 20 bp, mouse
gcatgcccacaggttgtggt

SEQ ID NO: 728787 - DNA, 20 bp, mouse
gtgaacatgacggaactgat

SEQ ID NO: 728788 - DNA, 20 bp, mouse
ggcaggcagctcatagtagg

SEQ ID NO: 728789 - DNA, 20 bp, mouse
gctccagcggctttccagca

SEQ ID NO: 728790 - DNA, 20 bp, mouse
gtgttcccaccacaacctgt

SEQ ID NO: 728791 - DNA, 20 bp, mouse
gtggagaaacgccacaatta

SEQ ID NO: 728792 - DNA, 20 bp, mouse
ggccctggcgctgggtaaag

SEQ ID NO: 728793 - DNA, 20 bp, mouse
gaacggagggtgtgcgtgtt

SEQ ID NO: 728794 - DNA, 20 bp, mouse
gccaggctggctgaacatga

SEQ ID NO: 728795 - DNA, 20 bp, mouse
ggcgggtctagagagtctcc

SEQ ID NO: 728796 - DNA, 20 bp, mouse
gcaggccggcggaggaggtg

SEQ ID NO: 728797 - DNA, 20 bp, mouse
gctgaggaacaacaccggag

SEQ ID NO: 728798 - DNA, 20 bp, mouse
gggggcccgggctcggaccg

SEQ ID NO: 728799 - DNA, 20 bp, mouse
gcgtccgccgccggccgcta

SEQ ID NO: 728800 - DNA, 20 bp, mouse
ggccgccggccgctagggga

SEQ ID NO: 728801 - DNA, 20 bp, mouse
gacaagctgacgtgagcgga

SEQ ID NO: 728802 - DNA, 20 bp, mouse
gctcacgtcagcttgtgcgg

SEQ ID NO: 728803 - DNA, 20 bp, mouse
ggcggccctcccggctcgag

SEQ ID NO: 728804 - DNA, 20 bp, mouse
gaacaccggaggggatgagc

SEQ ID NO: 728805 - DNA, 20 bp, mouse
gtgccgccgccgcaggccgg

SEQ ID NO: 728806 - DNA, 20 bp, mouse
gggtcgacacaggagaggag

SEQ ID NO: 728807 - DNA, 20 bp, mouse
gaggttacgtaaggagcggg

SEQ ID NO: 728808 - DNA, 20 bp, mouse
gccgccgcccgcctggagct

SEQ ID NO: 728809 - DNA, 20 bp, mouse
gggaagaagcggcgactgcg

SEQ ID NO: 728810 - DNA, 20 bp, mouse
gtgcggggtcgacacaggag

SEQ ID NO: 728811 - DNA, 20 bp, mouse
gaggtgggacatcccgtccg

SEQ ID NO: 728812 - DNA, 20 bp, mouse
gagggaaccgaagcccccca

SEQ ID NO: 728813 - DNA, 20 bp, mouse
ggcgcggcgccaagcttggc

SEQ ID NO: 728814 - DNA, 20 bp, mouse
gttggcgccgcgcctcggac

SEQ ID NO: 728815 - DNA, 20 bp, mouse
gttggcagggcgcgcgggtg

SEQ ID NO: 728816 - DNA, 20 bp, mouse
ggaggggcccataaagtctg

SEQ ID NO: 728817 - DNA, 20 bp, mouse
gagggcaccaggaggtcaag

SEQ ID NO: 728818 - DNA, 20 bp, mouse
gaggcagagtactggacaga

SEQ ID NO: 728819 - DNA, 20 bp, mouse
ggagggaggggaccccgaga

SEQ ID NO: 728820 - DNA, 20 bp, mouse
gaagaggaggaacttctgaa

SEQ ID NO: 728821 - DNA, 20 bp, mouse
gaagaagaggagggcggaca

SEQ ID NO: 728822 - DNA, 20 bp, mouse
ggcaccaggaggtcaagagg

SEQ ID NO: 728823 - DNA, 20 bp, mouse
gaggagggcggacatggagg

SEQ ID NO: 728824 - DNA, 20 bp, mouse
gggacatggaggggggagtt

SEQ ID NO: 728825 - DNA, 20 bp, mouse
gagggcgtggcttttgaagg

SEQ ID NO: 728826 - DNA, 20 bp, mouse
gcggaggcggagccgaggtc

SEQ ID NO: 728827 - DNA, 20 bp, mouse
gcggtcagtgtaggcgcgtg

SEQ ID NO: 728828 - DNA, 20 bp, mouse
gcctccgcgccgcactggta

SEQ ID NO: 728829 - DNA, 20 bp, mouse
gggctgatgcacaacgtact

SEQ ID NO: 728830 - DNA, 20 bp, mouse
gggtccgccattggctgcgt

SEQ ID NO: 728831 - DNA, 20 bp, mouse
gcactgcagacgccgagtcc

SEQ ID NO: 728832 - DNA, 20 bp, mouse
gaacgtactgggtccgccat

SEQ ID NO: 728833 - DNA, 20 bp, mouse
ggccaatcgcggacctctgc

SEQ ID NO: 728834 - DNA, 20 bp, mouse
gggcccccggtcccgcagga

SEQ ID NO: 728835 - DNA, 20 bp, mouse
ggcggagccgaggtccggat

SEQ ID NO: 728836 - DNA, 20 bp, mouse
gaggcgaagcgggtgtgggt

SEQ ID NO: 728837 - DNA, 20 bp, mouse
gagtggccaaaggtagtgga

SEQ ID NO: 728838 - DNA, 20 bp, mouse
ggggaataggtcgcacagga

SEQ ID NO: 728839 - DNA, 20 bp, mouse
gctagagtggccaaaggtag

SEQ ID NO: 728840 - DNA, 20 bp, mouse
ggggcgggaggagcgggaat

SEQ ID NO: 728841 - DNA, 20 bp, mouse
ggagcgggaataggtcgcac

SEQ ID NO: 728842 - DNA, 20 bp, mouse
gccggaccgccaggcgaagc

SEQ ID NO: 728843 - DNA, 20 bp, mouse
gccgccaggcgaagcgggtg

SEQ ID NO: 728844 - DNA, 20 bp, mouse
ggcacaggagggctgctgat

SEQ ID NO: 728845 - DNA, 20 bp, mouse
gggacagacgcggtgggcga

SEQ ID NO: 728846 - DNA, 20 bp, mouse
gctgccgctaggtgtcagtc

SEQ ID NO: 728847 - DNA, 20 bp, mouse
gctaccgcacccagtttcac

SEQ ID NO: 728848 - DNA, 20 bp, mouse
gggtcctcaagatcctttta

SEQ ID NO: 728849 - DNA, 20 bp, mouse
ggcgaggcaagtgtttgcaa

SEQ ID NO: 728850 - DNA, 20 bp, mouse
ggagaagccgcgaggagtgg

SEQ ID NO: 728851 - DNA, 20 bp, mouse
gccagccagaatcacttctc

SEQ ID NO: 728852 - DNA, 20 bp, mouse
gggagatcacgtgtctgggg

SEQ ID NO: 728853 - DNA, 20 bp, mouse
gagtggaggtcaccagcagc

SEQ ID NO: 728854 - DNA, 20 bp, mouse
gaaagagaagccgcgaggag

SEQ ID NO: 728855 - DNA, 20 bp, mouse
gtggtgacctccactcctcg

SEQ ID NO: 728856 - DNA, 20 bp, mouse
gggagcgcgcctctaggggc

SEQ ID NO: 728857 - DNA, 20 bp, mouse
gcgctcgcgcaagagggcgt

SEQ ID NO: 728858 - DNA, 20 bp, mouse
ggcgcccgcgggccttggac

SEQ ID NO: 728859 - DNA, 20 bp, mouse
gggtccccggcccgcccgtg

SEQ ID NO: 728860 - DNA, 20 bp, mouse
gcgagcgcgagcgtgcgcag

SEQ ID NO: 728861 - DNA, 20 bp, mouse
gagtgcgcggccccgagcga

SEQ ID NO: 728862 - DNA, 20 bp, mouse
gcgcagtggccctcggacct

SEQ ID NO: 728863 - DNA, 20 bp, mouse
gtctgggagcgcgcctctag

SEQ ID NO: 728864 - DNA, 20 bp, mouse
ggcgcggcgctcgcgcaaga

SEQ ID NO: 728865 - DNA, 20 bp, mouse
gactcggcgcggtggcggtg

SEQ ID NO: 728866 - DNA, 20 bp, mouse
ggcagggcaacgcacacttt

SEQ ID NO: 728867 - DNA, 20 bp, mouse
ggggactgaggacactcgcg

SEQ ID NO: 728868 - DNA, 20 bp, mouse
gtccgccgcgggctagcacg

SEQ ID NO: 728869 - DNA, 20 bp, mouse
gaggcggagtgtggcggccc

SEQ ID NO: 728870 - DNA, 20 bp, mouse
ggggccttgccagggagcgc

SEQ ID NO: 728871 - DNA, 20 bp, mouse
gacgctcactgcacaagttg

SEQ ID NO: 728872 - DNA, 20 bp, mouse
ggaggcgtgcccacggcgac

SEQ ID NO: 728873 - DNA, 20 bp, mouse
gtgctagcccgcggcggagg

SEQ ID NO: 728874 - DNA, 20 bp, mouse
gcgccgtgggcacgcctccc

SEQ ID NO: 728875 - DNA, 20 bp, mouse
gcgagtgtcctcagtcccta

SEQ ID NO: 728876 - DNA, 20 bp, mouse
gccaaggcctgaccggggtc

SEQ ID NO: 728877 - DNA, 20 bp, mouse
gggcctgctggggacggcgc

SEQ ID NO: 728878 - DNA, 20 bp, mouse
ggggagccaggctcgcagca

SEQ ID NO: 728879 - DNA, 20 bp, mouse
gctccagcgccgtccccagc

SEQ ID NO: 728880 - DNA, 20 bp, mouse
ggcaggccaaggcctgaccg

SEQ ID NO: 728881 - DNA, 20 bp, mouse
ggggacaccgggggtctctg

SEQ ID NO: 728882 - DNA, 20 bp, mouse
gaccggggtcaggtcgctga

SEQ ID NO: 728883 - DNA, 20 bp, mouse
gtgcgagcctggctcccggc

SEQ ID NO: 728884 - DNA, 20 bp, mouse
gggagccagctgtgtcgggc

SEQ ID NO: 728885 - DNA, 20 bp, mouse
gaaaacagcaacaccgggtg

SEQ ID NO: 728886 - DNA, 20 bp, mouse
gcacagtccgcagtcctcga

SEQ ID NO: 728887 - DNA, 20 bp, mouse
ggggaacagtacacctgatg

SEQ ID NO: 728888 - DNA, 20 bp, mouse
gcaggagctccccacaccaa

SEQ ID NO: 728889 - DNA, 20 bp, mouse
ggaggactgcggactgtgag

SEQ ID NO: 728890 - DNA, 20 bp, mouse
gtacccacccgggctgtggg

SEQ ID NO: 728891 - DNA, 20 bp, mouse
gctggagccttcgaggactg

SEQ ID NO: 728892 - DNA, 20 bp, mouse
ggcaggcagcctacccaccc

SEQ ID NO: 728893 - DNA, 20 bp, mouse
gctgtgaggggacgcccact

SEQ ID NO: 728894 - DNA, 20 bp, mouse
gccctgcctctcctcagttc

SEQ ID NO: 728895 - DNA, 20 bp, mouse
gagcctgcgttcccttggtg

SEQ ID NO: 728896 - DNA, 20 bp, mouse
gcctccgccaccagatgtgg

SEQ ID NO: 728897 - DNA, 20 bp, mouse
gccccggcgctcctcagtgt

SEQ ID NO: 728898 - DNA, 20 bp, mouse
gggcaggcggagggctcgag

SEQ ID NO: 728899 - DNA, 20 bp, mouse
gaggcggagggctcgagggg

SEQ ID NO: 728900 - DNA, 20 bp, mouse
ggacgcgcgctcgccccccc

SEQ ID NO: 728901 - DNA, 20 bp, mouse
gggagcacgcggggtgggaa

SEQ ID NO: 728902 - DNA, 20 bp, mouse
ggcgcgcgtcacctacactg

SEQ ID NO: 728903 - DNA, 20 bp, mouse
gcacgcggggtgggaagggt

SEQ ID NO: 728904 - DNA, 20 bp, mouse
gccaccagatgtggggggat

SEQ ID NO: 728905 - DNA, 20 bp, mouse
ggcagccggtaaactttcgc

SEQ ID NO: 728906 - DNA, 20 bp, mouse
gggaggatggggcttttata

SEQ ID NO: 728907 - DNA, 20 bp, mouse
gccagcctgcggcccagaaa

SEQ ID NO: 728908 - DNA, 20 bp, mouse
gggagtgcgccatctcgtgg

SEQ ID NO: 728909 - DNA, 20 bp, mouse
gatctcaatagcagcgggtt

SEQ ID NO: 728910 - DNA, 20 bp, mouse
gtggatctccagcctcgcct

SEQ ID NO: 728911 - DNA, 20 bp, mouse
gtaaaagccccatcctccga

SEQ ID NO: 728912 - DNA, 20 bp, mouse
gtgcctgcaagcagttctcc

SEQ ID NO: 728913 - DNA, 20 bp, mouse
gtcgtggcggctgcgagcct

SEQ ID NO: 728914 - DNA, 20 bp, mouse
ggccggccaatttgcatatt

SEQ ID NO: 728915 - DNA, 20 bp, mouse
gcccagaaaaggaagctggc

SEQ ID NO: 728916 - DNA, 20 bp, mouse
gggaaactctggctcgggat

SEQ ID NO: 728917 - DNA, 20 bp, mouse
gctgcctcaaagtggaggtt

SEQ ID NO: 728918 - DNA, 20 bp, mouse
gagtggtcgcgtggaaactc

SEQ ID NO: 728919 - DNA, 20 bp, mouse
ggacgcacgcctgacaccta

SEQ ID NO: 728920 - DNA, 20 bp, mouse
gactcccagtttggtttcgt

SEQ ID NO: 728921 - DNA, 20 bp, mouse
gcacgcgaccactcccagtt

SEQ ID NO: 728922 - DNA, 20 bp, mouse
ggctcaaaggccggaactgt

SEQ ID NO: 728923 - DNA, 20 bp, mouse
gcgcgtggaaactctggctc

SEQ ID NO: 728924 - DNA, 20 bp, mouse
ggtgtcaggcgtgcgtcttc

SEQ ID NO: 728925 - DNA, 20 bp, mouse
ggctctgcgctgttaacaag

SEQ ID NO: 728926 - DNA, 20 bp, mouse
gcccgcgcgcagaaaggctg

SEQ ID NO: 728927 - DNA, 20 bp, mouse
ggaccagcacctccctgcta

SEQ ID NO: 728928 - DNA, 20 bp, mouse
gtgggtgagggatactctct

SEQ ID NO: 728929 - DNA, 20 bp, mouse
ggtaactcatgttggctggg

SEQ ID NO: 728930 - DNA, 20 bp, mouse
gaaaggctggggtgcgcccc

SEQ ID NO: 728931 - DNA, 20 bp, mouse
gcacctccctgctaaggatg

SEQ ID NO: 728932 - DNA, 20 bp, mouse
ggagcaaaggagagctgccc

SEQ ID NO: 728933 - DNA, 20 bp, mouse
ggaagcaacagatcgtcact

SEQ ID NO: 728934 - DNA, 20 bp, mouse
gcctcacccaccggggagtg

SEQ ID NO: 728935 - DNA, 20 bp, mouse
ggccgccctcagagcactcg

SEQ ID NO: 728936 - DNA, 20 bp, mouse
gtatgcaaagcgggaggctc

SEQ ID NO: 728937 - DNA, 20 bp, mouse
gggagaaactagggcgggtg

SEQ ID NO: 728938 - DNA, 20 bp, mouse
gcgaaacccgggaagggatc

SEQ ID NO: 728939 - DNA, 20 bp, mouse
ggccgcgcagcagtcaccca

SEQ ID NO: 728940 - DNA, 20 bp, mouse
gccggcgtatgcaaagcggg

SEQ ID NO: 728941 - DNA, 20 bp, mouse
ggcccccggcgtatgcaaag

SEQ ID NO: 728942 - DNA, 20 bp, mouse
gttcgcgcggaggttgggag

SEQ ID NO: 728943 - DNA, 20 bp, mouse
gtccgcgcgaaacccgggaa

SEQ ID NO: 728944 - DNA, 20 bp, mouse
ggcgcagcagtcacccacgg

SEQ ID NO: 728945 - DNA, 20 bp, mouse
gggggacggcgggcccagcg

SEQ ID NO: 728946 - DNA, 20 bp, mouse
gtcagaaaggaacgcctcat

SEQ ID NO: 728947 - DNA, 20 bp, mouse
ggcaatgccccgggagtgcg

SEQ ID NO: 728948 - DNA, 20 bp, mouse
gagtgtaaataaagcctcga

SEQ ID NO: 728949 - DNA, 20 bp, mouse
gacaatgcgcggagtgtgcg

SEQ ID NO: 728950 - DNA, 20 bp, mouse
gcactggcgggacggcagca

SEQ ID NO: 728951 - DNA, 20 bp, mouse
gggtgtggatggcaatgccc

SEQ ID NO: 728952 - DNA, 20 bp, mouse
gcgccccccacgcactcccg

SEQ ID NO: 728953 - DNA, 20 bp, mouse
ggcctcgatggcccccaatg

SEQ ID NO: 728954 - DNA, 20 bp, mouse
ggaaaggaacgcctcattgg

SEQ ID NO: 728955 - DNA, 20 bp, mouse
gagggcagccactggcggga

SEQ ID NO: 728956 - DNA, 20 bp, mouse
gcaaatcgggacagactcgg

SEQ ID NO: 728957 - DNA, 20 bp, mouse
gaaaacctgcagccccaaat

SEQ ID NO: 728958 - DNA, 20 bp, mouse
gaccgacagcggccaatgga

SEQ ID NO: 728959 - DNA, 20 bp, mouse
gcctagtcaggggataagaa

SEQ ID NO: 728960 - DNA, 20 bp, mouse
gccgcctcctcttagtgatg

SEQ ID NO: 728961 - DNA, 20 bp, mouse
ggacagactcggtggtaaga

SEQ ID NO: 728962 - DNA, 20 bp, mouse
gggctagcggtgagagacca

SEQ ID NO: 728963 - DNA, 20 bp, mouse
gactggcccagcctagtcag

SEQ ID NO: 728964 - DNA, 20 bp, mouse
gcgctgtcggtcatgtggat

SEQ ID NO: 728965 - DNA, 20 bp, mouse
gaatccctcagctgcagtgt

SEQ ID NO: 728966 - DNA, 20 bp, mouse
ggccaccctggcgcccacac

SEQ ID NO: 728967 - DNA, 20 bp, mouse
ggtgggggggatgaatcaga

SEQ ID NO: 728968 - DNA, 20 bp, mouse
gggacatggagttgtcgcca

SEQ ID NO: 728969 - DNA, 20 bp, mouse
gtctacaaatggcccgaaga

SEQ ID NO: 728970 - DNA, 20 bp, mouse
gctggtgatgctggatccag

SEQ ID NO: 728971 - DNA, 20 bp, mouse
gccatgtccgcgtcaccctg

SEQ ID NO: 728972 - DNA, 20 bp, mouse
ggggcgccagggtggcccca

SEQ ID NO: 728973 - DNA, 20 bp, mouse
gggagttgtcgccagggcac

SEQ ID NO: 728974 - DNA, 20 bp, mouse
gcgtcaccctggggccaccc

SEQ ID NO: 728975 - DNA, 20 bp, mouse
gtctggatgtaccccagctt

SEQ ID NO: 728976 - DNA, 20 bp, mouse
gggagcggcgcggacttcgg

SEQ ID NO: 728977 - DNA, 20 bp, mouse
ggcggcgcggacttcggcgg

SEQ ID NO: 728978 - DNA, 20 bp, mouse
gggccggatcgcagcacgtg

SEQ ID NO: 728979 - DNA, 20 bp, mouse
gaggggcagtcgtttgacag

SEQ ID NO: 728980 - DNA, 20 bp, mouse
gacagccgggtggatgtgta

SEQ ID NO: 728981 - DNA, 20 bp, mouse
gctcgcttctcccaccctga

SEQ ID NO: 728982 - DNA, 20 bp, mouse
gcggatcaggaaacgcgcgg

SEQ ID NO: 728983 - DNA, 20 bp, mouse
gcgccccacgtgctgcgatc

SEQ ID NO: 728984 - DNA, 20 bp, mouse
ggggtgggagaagcgagctt

SEQ ID NO: 728985 - DNA, 20 bp, mouse
gcagccggaacccaagttgg

SEQ ID NO: 728986 - DNA, 20 bp, mouse
gtaaactcgtgcactaatgg

SEQ ID NO: 728987 - DNA, 20 bp, mouse
gactgaacggcggcaacggg

SEQ ID NO: 728988 - DNA, 20 bp, mouse
ggaacggcggcaacgggtgg

SEQ ID NO: 728989 - DNA, 20 bp, mouse
gctcgagtccgactgaacgg

SEQ ID NO: 728990 - DNA, 20 bp, mouse
gggtggcggggacgcgccca

SEQ ID NO: 728991 - DNA, 20 bp, mouse
gtccgactgaacggcggcaa

SEQ ID NO: 728992 - DNA, 20 bp, mouse
gcgtgcactaatgggggagt

SEQ ID NO: 728993 - DNA, 20 bp, mouse
gggcccttgaagcccgaggt

SEQ ID NO: 728994 - DNA, 20 bp, mouse
gaagggccggggtcgaattg

SEQ ID NO: 728995 - DNA, 20 bp, mouse
ggcgccacccgctggagact

SEQ ID NO: 728996 - DNA, 20 bp, mouse
gcatccacagagctgtccgg

SEQ ID NO: 728997 - DNA, 20 bp, mouse
gcggccctaggaggcaaatg

SEQ ID NO: 728998 - DNA, 20 bp, mouse
ggtggatgcgccccgggcag

SEQ ID NO: 728999 - DNA, 20 bp, mouse
gttgccgccggacagctctg

SEQ ID NO: 729000 - DNA, 20 bp, mouse
gcagctctgtggatgcgccc

SEQ ID NO: 729001 - DNA, 20 bp, mouse
ggggtagctctgtctcccgg

SEQ ID NO: 729002 - DNA, 20 bp, mouse
gctaggccagacaattaaga

SEQ ID NO: 729003 - DNA, 20 bp, mouse
ggaactcgcgactgatgctt

SEQ ID NO: 729004 - DNA, 20 bp, mouse
gctggcgccggtcccggcga

SEQ ID NO: 729005 - DNA, 20 bp, mouse
ggcgcatccacagagctgtc

SEQ ID NO: 729006 - DNA, 20 bp, mouse
ggcccgcccggcagattaat

SEQ ID NO: 729007 - DNA, 20 bp, mouse
gccagcggcgggcacgaccc

SEQ ID NO: 729008 - DNA, 20 bp, mouse
ggcccgctccccggggaccg

SEQ ID NO: 729009 - DNA, 20 bp, mouse
gtgcccgccgctggcgtttg

SEQ ID NO: 729010 - DNA, 20 bp, mouse
gggccaatgggaaagagcgc

SEQ ID NO: 729011 - DNA, 20 bp, mouse
ggctggcgtttggggatgtg

SEQ ID NO: 729012 - DNA, 20 bp, mouse
gtgacgcagcggcggccaat

SEQ ID NO: 729013 - DNA, 20 bp, mouse
gaatctgccgggcgggcggc

SEQ ID NO: 729014 - DNA, 20 bp, mouse
gcctcggtcgccgcggtccc

SEQ ID NO: 729015 - DNA, 20 bp, mouse
gcatccccaaacgccagcgg

SEQ ID NO: 729016 - DNA, 20 bp, mouse
gggcgcgggaccacctgtga

SEQ ID NO: 729017 - DNA, 20 bp, mouse
ggggaagaggctcacagacg

SEQ ID NO: 729018 - DNA, 20 bp, mouse
gggccgcctgcctcctagaa

SEQ ID NO: 729019 - DNA, 20 bp, mouse
gccctgcctccaggcttcgg

SEQ ID NO: 729020 - DNA, 20 bp, mouse
ggggcgagatccctgcctcc

SEQ ID NO: 729021 - DNA, 20 bp, mouse
gcgccctggcagcccggtgc

SEQ ID NO: 729022 - DNA, 20 bp, mouse
gggctgggacggggctctgg

SEQ ID NO: 729023 - DNA, 20 bp, mouse
gcctaggggtctgattgcgt

SEQ ID NO: 729024 - DNA, 20 bp, mouse
gcccagccgccgaagcctgg

SEQ ID NO: 729025 - DNA, 20 bp, mouse
ggggctctggcggagcctag

SEQ ID NO: 729026 - DNA, 20 bp, mouse
gcgggcgccggcaacttatt

SEQ ID NO: 729027 - DNA, 20 bp, mouse
ggggacccgcgccttcctga

SEQ ID NO: 729028 - DNA, 20 bp, mouse
ggtgacgcgcgtggccaatg

SEQ ID NO: 729029 - DNA, 20 bp, mouse
gatcgcgcagctccacgatc

SEQ ID NO: 729030 - DNA, 20 bp, mouse
gcgggtcccgcgtgtgagca

SEQ ID NO: 729031 - DNA, 20 bp, mouse
gaacttggtggcaccagggg

SEQ ID NO: 729032 - DNA, 20 bp, mouse
gtcactccgcacgctattaa

SEQ ID NO: 729033 - DNA, 20 bp, mouse
gcacgccatcaggaaggcgc

SEQ ID NO: 729034 - DNA, 20 bp, mouse
ggacacacacacttcttaag

SEQ ID NO: 729035 - DNA, 20 bp, mouse
ggcgtggccaatgggggcgc

SEQ ID NO: 729036 - DNA, 20 bp, mouse
gtcctcagagaggaggtcgt

SEQ ID NO: 729037 - DNA, 20 bp, mouse
gatgtcgctctcagatggat

SEQ ID NO: 729038 - DNA, 20 bp, mouse
gtagaggccgaaggagggtc

SEQ ID NO: 729039 - DNA, 20 bp, mouse
gtaggctgatgcaaaggttg

SEQ ID NO: 729040 - DNA, 20 bp, mouse
gccagcgatcccctaggaag

SEQ ID NO: 729041 - DNA, 20 bp, mouse
gtgatctctcccaggccaat

SEQ ID NO: 729042 - DNA, 20 bp, mouse
ggggtccccggttacaaagt

SEQ ID NO: 729043 - DNA, 20 bp, mouse
gctccctagccccttcctag

SEQ ID NO: 729044 - DNA, 20 bp, mouse
gggagagccgctatggtgga

SEQ ID NO: 729045 - DNA, 20 bp, mouse
gcggctggggcgtaccccga

SEQ ID NO: 729046 - DNA, 20 bp, mouse
gcatgagcgctgattggctg

SEQ ID NO: 729047 - DNA, 20 bp, mouse
gagaaattgcagggggagaa

SEQ ID NO: 729048 - DNA, 20 bp, mouse
gctcccgcagaaattgcagg

SEQ ID NO: 729049 - DNA, 20 bp, mouse
gccaatcagcgctcatgccc

SEQ ID NO: 729050 - DNA, 20 bp, mouse
gctccccctgcaatttctgc

SEQ ID NO: 729051 - DNA, 20 bp, mouse
gggcagagacccgagacagc

SEQ ID NO: 729052 - DNA, 20 bp, mouse
ggcaagagacgcaagagccc

SEQ ID NO: 729053 - DNA, 20 bp, mouse
ggcgtcaagacggcccagcc

SEQ ID NO: 729054 - DNA, 20 bp, mouse
gtcctggggatgaggggagt

SEQ ID NO: 729055 - DNA, 20 bp, mouse
gtgccaaagcgcagaagact

SEQ ID NO: 729056 - DNA, 20 bp, mouse
gagccattagggagagtgta

SEQ ID NO: 729057 - DNA, 20 bp, mouse
gaggaagcctcatggtatcc

SEQ ID NO: 729058 - DNA, 20 bp, mouse
ggaaggaacaggggtagagg

SEQ ID NO: 729059 - DNA, 20 bp, mouse
gtaccctacactctccctaa

SEQ ID NO: 729060 - DNA, 20 bp, mouse
gccacgacctggataccatg

SEQ ID NO: 729061 - DNA, 20 bp, mouse
gtgggaaaagagagccatta

SEQ ID NO: 729062 - DNA, 20 bp, mouse
ggcagggaattcatggtcac

SEQ ID NO: 729063 - DNA, 20 bp, mouse
gactccagaggaccacgacc

SEQ ID NO: 729064 - DNA, 20 bp, mouse
ggtagggtaagaggctactg

SEQ ID NO: 729065 - DNA, 20 bp, mouse
ggggaaggaagaggttcttt

SEQ ID NO: 729066 - DNA, 20 bp, mouse
gctggctaaaggggagacgt

SEQ ID NO: 729067 - DNA, 20 bp, mouse
ggattgtggtgatgagagat

SEQ ID NO: 729068 - DNA, 20 bp, mouse
ggatgcctgataaggaggga

SEQ ID NO: 729069 - DNA, 20 bp, mouse
gggggggtcctgaatacggt

SEQ ID NO: 729070 - DNA, 20 bp, mouse
ggcatctatgctggctaaag

SEQ ID NO: 729071 - DNA, 20 bp, mouse
gatcaccttccctccttatc

SEQ ID NO: 729072 - DNA, 20 bp, mouse
gtagcataatggtccaatgg

SEQ ID NO: 729073 - DNA, 20 bp, mouse
gtgggggggggtcctgaata

SEQ ID NO: 729074 - DNA, 20 bp, mouse
gaaagcagaggccattgtta

SEQ ID NO: 729075 - DNA, 20 bp, mouse
gcataatggtccaatggggg

SEQ ID NO: 729076 - DNA, 20 bp, mouse
ggtaaatcctggtgttgggt

SEQ ID NO: 729077 - DNA, 20 bp, mouse
gaaggggaaataaacctctt

SEQ ID NO: 729078 - DNA, 20 bp, mouse
gaacctctttggctggagta

SEQ ID NO: 729079 - DNA, 20 bp, mouse
ggaccctactccagccaaag

SEQ ID NO: 729080 - DNA, 20 bp, mouse
gagtgagcaggttaattgga

SEQ ID NO: 729081 - DNA, 20 bp, mouse
gccaacaccaggatttacat

SEQ ID NO: 729082 - DNA, 20 bp, mouse
gccacccggcctgcgattcc

SEQ ID NO: 729083 - DNA, 20 bp, mouse
ggggagccctatgtaaatcc

SEQ ID NO: 729084 - DNA, 20 bp, mouse
gcgggtggccattggctcgg

SEQ ID NO: 729085 - DNA, 20 bp, mouse
gtgagcagatttccttatcc

SEQ ID NO: 729086 - DNA, 20 bp, mouse
ggacgatcggagaatcgtta

SEQ ID NO: 729087 - DNA, 20 bp, mouse
gtatgcggccaaatatgggg

SEQ ID NO: 729088 - DNA, 20 bp, mouse
gcaatgcgagcctccgagag

SEQ ID NO: 729089 - DNA, 20 bp, mouse
gagaggtaattcatgctcta

SEQ ID NO: 729090 - DNA, 20 bp, mouse
gtcggaggctcgcattgaat

SEQ ID NO: 729091 - DNA, 20 bp, mouse
gccacctcccggcgattgac

SEQ ID NO: 729092 - DNA, 20 bp, mouse
gcggcccgcagctcactcac

SEQ ID NO: 729093 - DNA, 20 bp, mouse
ggctcccgtcaatcgccggg

SEQ ID NO: 729094 - DNA, 20 bp, mouse
gacagggagaaggttgacgt

SEQ ID NO: 729095 - DNA, 20 bp, mouse
gccgcgctcccgtcaatcgc

SEQ ID NO: 729096 - DNA, 20 bp, mouse
ggggaaccccacagtctcta

SEQ ID NO: 729097 - DNA, 20 bp, mouse
gctagaaccggggttttctc

SEQ ID NO: 729098 - DNA, 20 bp, mouse
ggaagaaaagaagatggcga

SEQ ID NO: 729099 - DNA, 20 bp, mouse
ggaagatggcgacggagaaa

SEQ ID NO: 729100 - DNA, 20 bp, mouse
gcagggtggagaagccataa

SEQ ID NO: 729101 - DNA, 20 bp, mouse
gccggcgccggtcatgtggc

SEQ ID NO: 729102 - DNA, 20 bp, mouse
gcgacggagaaaagggttgc

SEQ ID NO: 729103 - DNA, 20 bp, mouse
gggggtgcaagaattcaggg

SEQ ID NO: 729104 - DNA, 20 bp, mouse
gggttctagctgaaccatta

SEQ ID NO: 729105 - DNA, 20 bp, mouse
gcggagaaaagggttgctgg

SEQ ID NO: 729106 - DNA, 20 bp, mouse
gaggagcgcagcctgcacga

SEQ ID NO: 729107 - DNA, 20 bp, mouse
gtgcaggctgcgctcctcct

SEQ ID NO: 729108 - DNA, 20 bp, mouse
ggtgcgcgggtccctcgtgc

SEQ ID NO: 729109 - DNA, 20 bp, mouse
ggatggcgaggtgccagtga

SEQ ID NO: 729110 - DNA, 20 bp, mouse
gggcccgttccctcaaggga

SEQ ID NO: 729111 - DNA, 20 bp, mouse
gatcatacgtaggtggatca

SEQ ID NO: 729112 - DNA, 20 bp, mouse
gggagggggaaaaggttgat

SEQ ID NO: 729113 - DNA, 20 bp, mouse
gtggtcagtgttggatcaga

SEQ ID NO: 729114 - DNA, 20 bp, mouse
ggaattgtcaaatagcaccc

SEQ ID NO: 729115 - DNA, 20 bp, mouse
gttcgcagatcatacgtagg

SEQ ID NO: 729116 - DNA, 20 bp, mouse
gtggggaagaaggaattgag

SEQ ID NO: 729117 - DNA, 20 bp, mouse
gggccgaggggatatcacgt

SEQ ID NO: 729118 - DNA, 20 bp, mouse
gaaggccgagctctgcggat

SEQ ID NO: 729119 - DNA, 20 bp, mouse
ggggccgctgtcgacccccg

SEQ ID NO: 729120 - DNA, 20 bp, mouse
gagcccgcgggggtcgacag

SEQ ID NO: 729121 - DNA, 20 bp, mouse
ggcagcttgcaggcgagatt

SEQ ID NO: 729122 - DNA, 20 bp, mouse
ggagctctgcggattggggc

SEQ ID NO: 729123 - DNA, 20 bp, mouse
gccggaggctcccagtaatg

SEQ ID NO: 729124 - DNA, 20 bp, mouse
gccctcggccaatggtatga

SEQ ID NO: 729125 - DNA, 20 bp, mouse
ggtcgacccccgcgggctgg

SEQ ID NO: 729126 - DNA, 20 bp, mouse
ggcaggggacccttatgcgg

SEQ ID NO: 729127 - DNA, 20 bp, mouse
gagggcaggggacccttatg

SEQ ID NO: 729128 - DNA, 20 bp, mouse
gaagacgcggtcagcggggg

SEQ ID NO: 729129 - DNA, 20 bp, mouse
gcggaagacgcggtcagcgg

SEQ ID NO: 729130 - DNA, 20 bp, mouse
gtaggagaccaggataataa

SEQ ID NO: 729131 - DNA, 20 bp, mouse
gccctcccgcccccgcataa

SEQ ID NO: 729132 - DNA, 20 bp, mouse
gagggggagcgcggaagacg

SEQ ID NO: 729133 - DNA, 20 bp, mouse
ggtaactagaaccagaatag

SEQ ID NO: 729134 - DNA, 20 bp, mouse
gaaaggaggagccccttctc

SEQ ID NO: 729135 - DNA, 20 bp, mouse
gaccaggataataagggcag

SEQ ID NO: 729136 - DNA, 20 bp, mouse
gcggacagaacgcagagcga

SEQ ID NO: 729137 - DNA, 20 bp, mouse
gctagagcgagagagcgcca

SEQ ID NO: 729138 - DNA, 20 bp, mouse
gcccccacatcagtctttgg

SEQ ID NO: 729139 - DNA, 20 bp, mouse
gcacccccaaagactgatgt

SEQ ID NO: 729140 - DNA, 20 bp, mouse
ggctctgcgttctgtccggg

SEQ ID NO: 729141 - DNA, 20 bp, mouse
gggagtctttctaaatgtca

SEQ ID NO: 729142 - DNA, 20 bp, mouse
gcagaagccaataggatgcg

SEQ ID NO: 729143 - DNA, 20 bp, mouse
gtaggatgcggggtctctaa

SEQ ID NO: 729144 - DNA, 20 bp, mouse
gggcttctgggtactcctcc

SEQ ID NO: 729145 - DNA, 20 bp, mouse
gtaaccagcccccaaaaaaa

SEQ ID NO: 729146 - DNA, 20 bp, mouse
gtctcaacatggggcgatgg

SEQ ID NO: 729147 - DNA, 20 bp, mouse
gagctcaggctgaggttacg

SEQ ID NO: 729148 - DNA, 20 bp, mouse
ggcaatgtgctatcacgtca

SEQ ID NO: 729149 - DNA, 20 bp, mouse
gccatcctggatatggaatg

SEQ ID NO: 729150 - DNA, 20 bp, mouse
gcccgcttttacaggaaggg

SEQ ID NO: 729151 - DNA, 20 bp, mouse
gtgctatcacgtcagggctc

SEQ ID NO: 729152 - DNA, 20 bp, mouse
gtggctgagaagttgagcag

SEQ ID NO: 729153 - DNA, 20 bp, mouse
ggctgcctcaggagggacgc

SEQ ID NO: 729154 - DNA, 20 bp, mouse
gatatggaatgcggtgagga

SEQ ID NO: 729155 - DNA, 20 bp, mouse
gctgctccactgtactttgt

SEQ ID NO: 729156 - DNA, 20 bp, mouse
gcagacggtcgtgacgtcag

SEQ ID NO: 729157 - DNA, 20 bp, mouse
gccacctagcagctgcctcg

SEQ ID NO: 729158 - DNA, 20 bp, mouse
ggggtcaagttgtcggcagg

SEQ ID NO: 729159 - DNA, 20 bp, mouse
gagggcggtggggtagtggt

SEQ ID NO: 729160 - DNA, 20 bp, mouse
ggtcagcggggtcaagttgt

SEQ ID NO: 729161 - DNA, 20 bp, mouse
gtagcagctgcctcggggta

SEQ ID NO: 729162 - DNA, 20 bp, mouse
gtgcaagggcggtggggtag

SEQ ID NO: 729163 - DNA, 20 bp, mouse
ggtctagccgtcacatggtg

SEQ ID NO: 729164 - DNA, 20 bp, mouse
gccgaatgcgcggataatta

SEQ ID NO: 729165 - DNA, 20 bp, mouse
gatgtgacggctagaccaat

SEQ ID NO: 729166 - DNA, 20 bp, mouse
ggtaggaggggttctctctt

SEQ ID NO: 729167 - DNA, 20 bp, mouse
gtgggcggtgggatgggcgg

SEQ ID NO: 729168 - DNA, 20 bp, mouse
gagcacttcgcagacgtagg

SEQ ID NO: 729169 - DNA, 20 bp, mouse
gcggagcacttcgcagacgt

SEQ ID NO: 729170 - DNA, 20 bp, mouse
gtagcgaggggggaaatttt

SEQ ID NO: 729171 - DNA, 20 bp, mouse
gtcggggacgttcaggcgat

SEQ ID NO: 729172 - DNA, 20 bp, mouse
gtctctcttaggtaagatcg

SEQ ID NO: 729173 - DNA, 20 bp, mouse
gctcgctctgtggaatggag

SEQ ID NO: 729174 - DNA, 20 bp, mouse
gggtaagatcggggacgttc

SEQ ID NO: 729175 - DNA, 20 bp, mouse
gtcctccttttctcgctctg

SEQ ID NO: 729176 - DNA, 20 bp, mouse
gtccacccaggattggggaa

SEQ ID NO: 729177 - DNA, 20 bp, mouse
gcacgtgggcgctaccgcca

SEQ ID NO: 729178 - DNA, 20 bp, mouse
ggggaagtagagttggtgcg

SEQ ID NO: 729179 - DNA, 20 bp, mouse
gtggtgcggggaatgtgggt

SEQ ID NO: 729180 - DNA, 20 bp, mouse
gcgctcccccatctccaccc

SEQ ID NO: 729181 - DNA, 20 bp, mouse
gccccaatcctgggtggaga

SEQ ID NO: 729182 - DNA, 20 bp, mouse
gagcgcccacgtgagtagag

SEQ ID NO: 729183 - DNA, 20 bp, mouse
ggggaagggggaagtagagt

SEQ ID NO: 729184 - DNA, 20 bp, mouse
ggcgctaccgccagggggag

SEQ ID NO: 729185 - DNA, 20 bp, mouse
gcaggaacagatttattcgt

SEQ ID NO: 729186 - DNA, 20 bp, mouse
gcgtagtgggaatgcggcta

SEQ ID NO: 729187 - DNA, 20 bp, mouse
gcgcatgcgtagtgggaatg

SEQ ID NO: 729188 - DNA, 20 bp, mouse
ggggaaccaggggcgtgcta

SEQ ID NO: 729189 - DNA, 20 bp, mouse
gtgggaatgcggctagggag

SEQ ID NO: 729190 - DNA, 20 bp, mouse
gtctcctggggttccctccc

SEQ ID NO: 729191 - DNA, 20 bp, mouse
ggggcgtgctatggtgagga

SEQ ID NO: 729192 - DNA, 20 bp, mouse
ggagggggaagcaccggggg

SEQ ID NO: 729193 - DNA, 20 bp, mouse
gtgaggagggcgggagtcgc

SEQ ID NO: 729194 - DNA, 20 bp, mouse
gagggagggggaagcaccgg

SEQ ID NO: 729195 - DNA, 20 bp, mouse
gccgccccatctcccgggga

SEQ ID NO: 729196 - DNA, 20 bp, mouse
gagtctggtggggtgtgcaa

SEQ ID NO: 729197 - DNA, 20 bp, mouse
ggagaccactggaaaggcac

SEQ ID NO: 729198 - DNA, 20 bp, mouse
gccgcccagagtctcctctc

SEQ ID NO: 729199 - DNA, 20 bp, mouse
gcacggggcccactggaggc

SEQ ID NO: 729200 - DNA, 20 bp, mouse
ggcccccagtgcccaaacat

SEQ ID NO: 729201 - DNA, 20 bp, mouse
gcaaggaaggattgtcagtc

SEQ ID NO: 729202 - DNA, 20 bp, mouse
gggcactgggggctgtcggg

SEQ ID NO: 729203 - DNA, 20 bp, mouse
ggaaggattgtcagtctggt

SEQ ID NO: 729204 - DNA, 20 bp, mouse
gcttccttgctaaagatggg

SEQ ID NO: 729205 - DNA, 20 bp, mouse
gcggttccttatccggggac

SEQ ID NO: 729206 - DNA, 20 bp, mouse
gacctccgggaggttagtga

SEQ ID NO: 729207 - DNA, 20 bp, mouse
ggaaacgcatcttgatatgt

SEQ ID NO: 729208 - DNA, 20 bp, mouse
ggagcggccactcataaatt

SEQ ID NO: 729209 - DNA, 20 bp, mouse
gttggcaaagcccgggggtt

SEQ ID NO: 729210 - DNA, 20 bp, mouse
gtccatcactaacctcccgg

SEQ ID NO: 729211 - DNA, 20 bp, mouse
ggatatgttggcaaagcccg

SEQ ID NO: 729212 - DNA, 20 bp, mouse
gtggcttgatgacctccggg

SEQ ID NO: 729213 - DNA, 20 bp, mouse
gttaaatagagtcacgtgac

SEQ ID NO: 729214 - DNA, 20 bp, mouse
ggcttccatcactaacctcc

SEQ ID NO: 729215 - DNA, 20 bp, mouse
gagccaggaggacatatctt

SEQ ID NO: 729216 - DNA, 20 bp, mouse
gagagcagacaggggaagta

SEQ ID NO: 729217 - DNA, 20 bp, mouse
gctccctttctgagagaatt

SEQ ID NO: 729218 - DNA, 20 bp, mouse
gtacccaattctctcagaaa

SEQ ID NO: 729219 - DNA, 20 bp, mouse
gcgtgtgcaaatgggcgcca

SEQ ID NO: 729220 - DNA, 20 bp, mouse
gcccaccgcccactccccaa

SEQ ID NO: 729221 - DNA, 20 bp, mouse
ggcagccggcctttggggag

SEQ ID NO: 729222 - DNA, 20 bp, mouse
gtgagagaattgggtaaaca

SEQ ID NO: 729223 - DNA, 20 bp, mouse
gcacaaatgcatcgcattcc

SEQ ID NO: 729224 - DNA, 20 bp, mouse
gtgcagccttggggcaatgg

SEQ ID NO: 729225 - DNA, 20 bp, mouse
gctagagcagccggcctttg

SEQ ID NO: 729226 - DNA, 20 bp, mouse
gtggccttgtccattagcta

SEQ ID NO: 729227 - DNA, 20 bp, mouse
ggacaaggccagcttttcca

SEQ ID NO: 729228 - DNA, 20 bp, mouse
gctgggggagagggggttca

SEQ ID NO: 729229 - DNA, 20 bp, mouse
ggagtctgaggaattcgcct

SEQ ID NO: 729230 - DNA, 20 bp, mouse
gcagccctagctaatggaca

SEQ ID NO: 729231 - DNA, 20 bp, mouse
gcgccaccgccgggagtctg

SEQ ID NO: 729232 - DNA, 20 bp, mouse
gctcgcctgtcttcatgtcg

SEQ ID NO: 729233 - DNA, 20 bp, mouse
ggggagagggggttcagggc

SEQ ID NO: 729234 - DNA, 20 bp, mouse
gaggtgagagttagtaagtc

SEQ ID NO: 729235 - DNA, 20 bp, mouse
gaattcgcctgggctgttag

SEQ ID NO: 729236 - DNA, 20 bp, mouse
gtaggccccgcacatctctg

SEQ ID NO: 729237 - DNA, 20 bp, mouse
gactgcgtatacggggaggt

SEQ ID NO: 729238 - DNA, 20 bp, mouse
gagcggcagcgtgcgaggga

SEQ ID NO: 729239 - DNA, 20 bp, mouse
gcggcaaccaggggtattga

SEQ ID NO: 729240 - DNA, 20 bp, mouse
ggtccagagcaggttgtccg

SEQ ID NO: 729241 - DNA, 20 bp, mouse
gaagaactgcgtatacgggg

SEQ ID NO: 729242 - DNA, 20 bp, mouse
gaaaaaaagaactgcgtata

SEQ ID NO: 729243 - DNA, 20 bp, mouse
gcggctgatgggctgtgtcc

SEQ ID NO: 729244 - DNA, 20 bp, mouse
gtcccgcggacaacctgctc

SEQ ID NO: 729245 - DNA, 20 bp, mouse
gggggcgcggcggtcagctt

SEQ ID NO: 729246 - DNA, 20 bp, mouse
ggggcctccgcccagctcgg

SEQ ID NO: 729247 - DNA, 20 bp, mouse
gagcccaaggggtcccgaga

SEQ ID NO: 729248 - DNA, 20 bp, mouse
ggcgagggatgcagcggtca

SEQ ID NO: 729249 - DNA, 20 bp, mouse
gtctcccccgagctgggcgg

SEQ ID NO: 729250 - DNA, 20 bp, mouse
gggaggcccctcagccactt

SEQ ID NO: 729251 - DNA, 20 bp, mouse
ggagagcggcgccggcggaa

SEQ ID NO: 729252 - DNA, 20 bp, mouse
gggaccggccagtgcgggga

SEQ ID NO: 729253 - DNA, 20 bp, mouse
ggctgccaacttagccaaag

SEQ ID NO: 729254 - DNA, 20 bp, mouse
ggaggggcctccgcccagct

SEQ ID NO: 729255 - DNA, 20 bp, mouse
gccccgggaaatagcccaag

SEQ ID NO: 729256 - DNA, 20 bp, mouse
gccggccagcctgtctcccg

SEQ ID NO: 729257 - DNA, 20 bp, mouse
gcaaacaagccccgggagac

SEQ ID NO: 729258 - DNA, 20 bp, mouse
gagtgcgcgttggagacaac

SEQ ID NO: 729259 - DNA, 20 bp, mouse
gccggctggccgcgtaagca

SEQ ID NO: 729260 - DNA, 20 bp, mouse
gcggccggccaaacaagccc

SEQ ID NO: 729261 - DNA, 20 bp, mouse
gctccaacgcgcactatcac

SEQ ID NO: 729262 - DNA, 20 bp, mouse
ggccccgccagcggaaggaa

SEQ ID NO: 729263 - DNA, 20 bp, mouse
gcaagccccgggagacaggc

SEQ ID NO: 729264 - DNA, 20 bp, mouse
gcgggtgggggactcgagtg

SEQ ID NO: 729265 - DNA, 20 bp, mouse
gaaggaaaggcttgattcga

SEQ ID NO: 729266 - DNA, 20 bp, mouse
gagcggctgcaggaaaggtg

SEQ ID NO: 729267 - DNA, 20 bp, mouse
gggccctggcacagaggact

SEQ ID NO: 729268 - DNA, 20 bp, mouse
gacggagggtggctgtgtcg

SEQ ID NO: 729269 - DNA, 20 bp, mouse
ggagggagcggctgcaggaa

SEQ ID NO: 729270 - DNA, 20 bp, mouse
gccagccggtgagctacgga

SEQ ID NO: 729271 - DNA, 20 bp, mouse
gggagagcagtcgagagcgg

SEQ ID NO: 729272 - DNA, 20 bp, mouse
gagccccggccctggcacag

SEQ ID NO: 729273 - DNA, 20 bp, mouse
ggccaccctccgtagctcac

SEQ ID NO: 729274 - DNA, 20 bp, mouse
ggagggtggctgtgtcgcgg

SEQ ID NO: 729275 - DNA, 20 bp, mouse
ggagcagtcgagagcggtgg

SEQ ID NO: 729276 - DNA, 20 bp, mouse
gaataggaggacgggctcag

SEQ ID NO: 729277 - DNA, 20 bp, mouse
gtgggggtggggacgggtcg

SEQ ID NO: 729278 - DNA, 20 bp, mouse
gcaggcagcctgcgaaataa

SEQ ID NO: 729279 - DNA, 20 bp, mouse
ggggacgggtcgggggatgt

SEQ ID NO: 729280 - DNA, 20 bp, mouse
ggccctccctcaacaggctt

SEQ ID NO: 729281 - DNA, 20 bp, mouse
gcaacccggaataggaggac

SEQ ID NO: 729282 - DNA, 20 bp, mouse
ggataacactcaatgttcga

SEQ ID NO: 729283 - DNA, 20 bp, mouse
gtgttcgacggcgaaggacg

SEQ ID NO: 729284 - DNA, 20 bp, mouse
gttcaggagccggtgacatt

SEQ ID NO: 729285 - DNA, 20 bp, mouse
ggccaaagcctgttgaggga

SEQ ID NO: 729286 - DNA, 20 bp, mouse
gcagccaatggcagggtccc

SEQ ID NO: 729287 - DNA, 20 bp, mouse
gtggctgcgccgggacacgt

SEQ ID NO: 729288 - DNA, 20 bp, mouse
ggcgaggtgggcctcccaaa

SEQ ID NO: 729289 - DNA, 20 bp, mouse
gagggggcctgggacggtca

SEQ ID NO: 729290 - DNA, 20 bp, mouse
gcggccggggaccctgccat

SEQ ID NO: 729291 - DNA, 20 bp, mouse
gccggccggcgccctcgggg

SEQ ID NO: 729292 - DNA, 20 bp, mouse
gcgcccgcccgccctccaac

SEQ ID NO: 729293 - DNA, 20 bp, mouse
gcccccacccccacgtgtcc

SEQ ID NO: 729294 - DNA, 20 bp, mouse
gaagaggggtggggaccggg

SEQ ID NO: 729295 - DNA, 20 bp, mouse
ggtccccggccggcgccctc

SEQ ID NO: 729296 - DNA, 20 bp, mouse
ggctgcggctggtcatgtgc

SEQ ID NO: 729297 - DNA, 20 bp, mouse
gctgggaaagcagaatgcgg

SEQ ID NO: 729298 - DNA, 20 bp, mouse
gaaagggattccgaagagaa

SEQ ID NO: 729299 - DNA, 20 bp, mouse
ggccaatgacgaccgcaaat

SEQ ID NO: 729300 - DNA, 20 bp, mouse
gccgcaaataggtcataaaa

SEQ ID NO: 729301 - DNA, 20 bp, mouse
gaaaaggccgtgaaggcgag

SEQ ID NO: 729302 - DNA, 20 bp, mouse
gacctatttgcggtcgtcat

SEQ ID NO: 729303 - DNA, 20 bp, mouse
gaaagagggggtgaggctct

SEQ ID NO: 729304 - DNA, 20 bp, mouse
gtgtatgtgcaaaatccgca

SEQ ID NO: 729305 - DNA, 20 bp, mouse
gcaaattcgcctgggaaatc

SEQ ID NO: 729306 - DNA, 20 bp, mouse
gcctccgccagccttaaagg

SEQ ID NO: 729307 - DNA, 20 bp, mouse
gcccgcctggcccaaggcta

SEQ ID NO: 729308 - DNA, 20 bp, mouse
ggccccccgggtccgcagag

SEQ ID NO: 729309 - DNA, 20 bp, mouse
gaggcggggtggtcactccc

SEQ ID NO: 729310 - DNA, 20 bp, mouse
gcgaggagagggagcgagat

SEQ ID NO: 729311 - DNA, 20 bp, mouse
gctggcccaaggctaaggtt

SEQ ID NO: 729312 - DNA, 20 bp, mouse
gccccgggtccgcagagagg

SEQ ID NO: 729313 - DNA, 20 bp, mouse
gcggggtggtcactcccagg

SEQ ID NO: 729314 - DNA, 20 bp, mouse
gcataaagccgcactgccaa

SEQ ID NO: 729315 - DNA, 20 bp, mouse
gcaggcatgcagtgcgtcaa

SEQ ID NO: 729316 - DNA, 20 bp, mouse
gcagcccgccctggtggcgg

SEQ ID NO: 729317 - DNA, 20 bp, mouse
ggcggccacaggcctaactg

SEQ ID NO: 729318 - DNA, 20 bp, mouse
gcgggctggtgcgtggacct

SEQ ID NO: 729319 - DNA, 20 bp, mouse
ggcctcctgcggccgcagtt

SEQ ID NO: 729320 - DNA, 20 bp, mouse
gtgggccgcgcgaccaatgg

SEQ ID NO: 729321 - DNA, 20 bp, mouse
ggccaggccgggctggtgcg

SEQ ID NO: 729322 - DNA, 20 bp, mouse
gctctggctctccgactcct

SEQ ID NO: 729323 - DNA, 20 bp, mouse
gcaggagcctccaactgctc

SEQ ID NO: 729324 - DNA, 20 bp, mouse
gaggggagaacgactccctt

SEQ ID NO: 729325 - DNA, 20 bp, mouse
ggcgatctccacccggactc

SEQ ID NO: 729326 - DNA, 20 bp, mouse
gttgacaggggtttgctttg

SEQ ID NO: 729327 - DNA, 20 bp, mouse
gaaaacccctgaggcataaa

SEQ ID NO: 729328 - DNA, 20 bp, mouse
gaacccctagagagtgggac

SEQ ID NO: 729329 - DNA, 20 bp, mouse
gacaacgtctctaaggtcac

SEQ ID NO: 729330 - DNA, 20 bp, mouse
gcccctcccacccaccacaa

SEQ ID NO: 729331 - DNA, 20 bp, mouse
gagagtgggacggggaacag

SEQ ID NO: 729332 - DNA, 20 bp, mouse
ggggtcacaagggtgtctaa

SEQ ID NO: 729333 - DNA, 20 bp, mouse
gtggtgggataaaacccctg

SEQ ID NO: 729334 - DNA, 20 bp, mouse
gaaaaataacacaacgcaga

SEQ ID NO: 729335 - DNA, 20 bp, mouse
ggcaaacacagaaatggagg

SEQ ID NO: 729336 - DNA, 20 bp, mouse
ggggaacggcggacgacggg

SEQ ID NO: 729337 - DNA, 20 bp, mouse
gcgcccgccaagtgggtccc

SEQ ID NO: 729338 - DNA, 20 bp, mouse
gcgcaagcccgcagccaata

SEQ ID NO: 729339 - DNA, 20 bp, mouse
gggcgcgacagggcgctcgt

SEQ ID NO: 729340 - DNA, 20 bp, mouse
ggcaacgccgagaggccgta

SEQ ID NO: 729341 - DNA, 20 bp, mouse
gcgcccggggacccacttgg

SEQ ID NO: 729342 - DNA, 20 bp, mouse
gaacccgaaggactcggggt

SEQ ID NO: 729343 - DNA, 20 bp, mouse
ggggggggaacggcggacga

SEQ ID NO: 729344 - DNA, 20 bp, mouse
gggcgcgcaggggcgcgaca

SEQ ID NO: 729345 - DNA, 20 bp, mouse
gccggagctcagaggtaacg

SEQ ID NO: 729346 - DNA, 20 bp, mouse
gcggccctgcgcccaggtag

SEQ ID NO: 729347 - DNA, 20 bp, mouse
ggggccgcctgtcgctctga

SEQ ID NO: 729348 - DNA, 20 bp, mouse
gggggcgggcgggactgcga

SEQ ID NO: 729349 - DNA, 20 bp, mouse
gtggggtgctccctagagag

SEQ ID NO: 729350 - DNA, 20 bp, mouse
gtctacaagtcgacacggag

SEQ ID NO: 729351 - DNA, 20 bp, mouse
ggggcagcgagggtgcctat

SEQ ID NO: 729352 - DNA, 20 bp, mouse
gctagggagcaccccaccct

SEQ ID NO: 729353 - DNA, 20 bp, mouse
gccctgggggggtcccccac

SEQ ID NO: 729354 - DNA, 20 bp, mouse
ggggtcccccactggtagct

SEQ ID NO: 729355 - DNA, 20 bp, mouse
ggggctccgggccaacgctg

SEQ ID NO: 729356 - DNA, 20 bp, mouse
ggaggcggggctaagactgg

SEQ ID NO: 729357 - DNA, 20 bp, mouse
gcgggtgtggcaaagggcgg

SEQ ID NO: 729358 - DNA, 20 bp, mouse
gcgcaccgagggtccagcag

SEQ ID NO: 729359 - DNA, 20 bp, mouse
ggggacggggagactctggg

SEQ ID NO: 729360 - DNA, 20 bp, mouse
gggggcggggcgcatcgcaa

SEQ ID NO: 729361 - DNA, 20 bp, mouse
gagactctgggggggtggaa

SEQ ID NO: 729362 - DNA, 20 bp, mouse
gactcgggacggggagactc

SEQ ID NO: 729363 - DNA, 20 bp, mouse
gccgccagcccgggaaggaa

SEQ ID NO: 729364 - DNA, 20 bp, mouse
gcagcagcgggtgtggcaaa

SEQ ID NO: 729365 - DNA, 20 bp, mouse
ggagctatatggaccagagt

SEQ ID NO: 729366 - DNA, 20 bp, mouse
gactccgggaaggtcagcgc

SEQ ID NO: 729367 - DNA, 20 bp, mouse
ggatgtccaaagttgctgag

SEQ ID NO: 729368 - DNA, 20 bp, mouse
ggagtcgccaggattgtaga

SEQ ID NO: 729369 - DNA, 20 bp, mouse
gaaggtcagcgcgggcggac

SEQ ID NO: 729370 - DNA, 20 bp, mouse
gtcggctggcaccgagtgac

SEQ ID NO: 729371 - DNA, 20 bp, mouse
ggacaaggctggctatcagg

SEQ ID NO: 729372 - DNA, 20 bp, mouse
gacccaggctctgagcctca

SEQ ID NO: 729373 - DNA, 20 bp, mouse
gtggcaccgagtgacaggca

SEQ ID NO: 729374 - DNA, 20 bp, mouse
gcaaagttgctgagaggagg

SEQ ID NO: 729375 - DNA, 20 bp, mouse
ggtacagccctctacaatcc

SEQ ID NO: 729376 - DNA, 20 bp, mouse
gcagctctgggcaggttaag

SEQ ID NO: 729377 - DNA, 20 bp, mouse
gttaagggggccagacccag

SEQ ID NO: 729378 - DNA, 20 bp, mouse
gctgcccagagctgactcag

SEQ ID NO: 729379 - DNA, 20 bp, mouse
gggccaggagagccgagcca

SEQ ID NO: 729380 - DNA, 20 bp, mouse
gagtgacccgcctcagtcca

SEQ ID NO: 729381 - DNA, 20 bp, mouse
gccctggcctggccgtcctg

SEQ ID NO: 729382 - DNA, 20 bp, mouse
gaggcgggtcactctccctc

SEQ ID NO: 729383 - DNA, 20 bp, mouse
gtctcctggcccgtggactg

SEQ ID NO: 729384 - DNA, 20 bp, mouse
gccaagcctaggattgccca

SEQ ID NO: 729385 - DNA, 20 bp, mouse
gccgcctcagtccacgggcc

SEQ ID NO: 729386 - DNA, 20 bp, mouse
gggggtggctagttgcccaa

SEQ ID NO: 729387 - DNA, 20 bp, mouse
gtacttcccgggccccggaa

SEQ ID NO: 729388 - DNA, 20 bp, mouse
gtcccgggccccggaagggg

SEQ ID NO: 729389 - DNA, 20 bp, mouse
gggcaactagccaccccttc

SEQ ID NO: 729390 - DNA, 20 bp, mouse
gtactccgggagacaggttc

SEQ ID NO: 729391 - DNA, 20 bp, mouse
gacgctgtgcggggcggacc

SEQ ID NO: 729392 - DNA, 20 bp, mouse
gagacaggttctggaccgga

SEQ ID NO: 729393 - DNA, 20 bp, mouse
gctggtccaaggccctgtga

SEQ ID NO: 729394 - DNA, 20 bp, mouse
ggtcgcgggaagagagcgcc

SEQ ID NO: 729395 - DNA, 20 bp, mouse
gagcctaaggactgcccgtg

SEQ ID NO: 729396 - DNA, 20 bp, mouse
ggaccctaccctggtgctca

SEQ ID NO: 729397 - DNA, 20 bp, mouse
gggggcaggtgacacaatgt

SEQ ID NO: 729398 - DNA, 20 bp, mouse
ggcttggggaaaattcctgc

SEQ ID NO: 729399 - DNA, 20 bp, mouse
gttgtgcgccgaccctaccc

SEQ ID NO: 729400 - DNA, 20 bp, mouse
ggggccgctgcacacgcgca

SEQ ID NO: 729401 - DNA, 20 bp, mouse
ggagctctcttgccagtggg

SEQ ID NO: 729402 - DNA, 20 bp, mouse
gactgtgttcatgcagccag

SEQ ID NO: 729403 - DNA, 20 bp, mouse
gctgcacacgcgcacggagt

SEQ ID NO: 729404 - DNA, 20 bp, mouse
gggaattttccccaagcctc

SEQ ID NO: 729405 - DNA, 20 bp, mouse
ggacacaatgtcggtttcct

SEQ ID NO: 729406 - DNA, 20 bp, mouse
gcggggcaaaggcgtctcca

SEQ ID NO: 729407 - DNA, 20 bp, mouse
ggctacccagagctctttac

SEQ ID NO: 729408 - DNA, 20 bp, mouse
ggacgcgggtgagaaggcac

SEQ ID NO: 729409 - DNA, 20 bp, mouse
gggggtggacgcgggtgaga

SEQ ID NO: 729410 - DNA, 20 bp, mouse
gtctgtaagaaaacgtgaca

SEQ ID NO: 729411 - DNA, 20 bp, mouse
ggtgagaaggcacggggcaa

SEQ ID NO: 729412 - DNA, 20 bp, mouse
gagcaaacggtgcgtgtgct

SEQ ID NO: 729413 - DNA, 20 bp, mouse
gacactgcttgtgtgagggc

SEQ ID NO: 729414 - DNA, 20 bp, mouse
gaagggagaaagctcaaaag

SEQ ID NO: 729415 - DNA, 20 bp, mouse
gaggcgtctccagggagact

SEQ ID NO: 729416 - DNA, 20 bp, mouse
gggcccgcaggggttggacc

SEQ ID NO: 729417 - DNA, 20 bp, mouse
ggaagggcggaccccaggac

SEQ ID NO: 729418 - DNA, 20 bp, mouse
ggagtcccagtggacgtggg

SEQ ID NO: 729419 - DNA, 20 bp, mouse
gtcatggggcggggcccgca

SEQ ID NO: 729420 - DNA, 20 bp, mouse
gctgcctggtccaacccctg

SEQ ID NO: 729421 - DNA, 20 bp, mouse
gccacctggctcatggggcg

SEQ ID NO: 729422 - DNA, 20 bp, mouse
gcctgagtcccagtggacgt

SEQ ID NO: 729423 - DNA, 20 bp, mouse
gggccccgctagggacagga

SEQ ID NO: 729424 - DNA, 20 bp, mouse
ggagcctgcggcctcacctg

SEQ ID NO: 729425 - DNA, 20 bp, mouse
gccagtggacgtgggaggcc

SEQ ID NO: 729426 - DNA, 20 bp, mouse
ggggcagagccacacgtcgg

SEQ ID NO: 729427 - DNA, 20 bp, mouse
gtagggttaagcatcaagtg

SEQ ID NO: 729428 - DNA, 20 bp, mouse
gaaggggcagagccacacgt

SEQ ID NO: 729429 - DNA, 20 bp, mouse
gtggggcttttgaaggaaat

SEQ ID NO: 729430 - DNA, 20 bp, mouse
gcattcttgctgtgaggcta

SEQ ID NO: 729431 - DNA, 20 bp, mouse
gttatcatactgacacactg

SEQ ID NO: 729432 - DNA, 20 bp, mouse
gacacgtcggaggaactgca

SEQ ID NO: 729433 - DNA, 20 bp, mouse
gcttctgcaaagtaccccgg

SEQ ID NO: 729434 - DNA, 20 bp, mouse
gactgaggatgttctgttag

SEQ ID NO: 729435 - DNA, 20 bp, mouse
gataagccattcttgctgtg

SEQ ID NO: 729436 - DNA, 20 bp, mouse
gaacgcccagcggagcctcc

SEQ ID NO: 729437 - DNA, 20 bp, mouse
gcgcgcgggagaacgcccag

SEQ ID NO: 729438 - DNA, 20 bp, mouse
gccgccctctcggcccgccc

SEQ ID NO: 729439 - DNA, 20 bp, mouse
gcccgcgcgcgcgccaccaa

SEQ ID NO: 729440 - DNA, 20 bp, mouse
gaactcttatctgactaggt

SEQ ID NO: 729441 - DNA, 20 bp, mouse
gtccctcgccgcctcagcaa

SEQ ID NO: 729442 - DNA, 20 bp, mouse
gggaggaggtgctaccgctc

SEQ ID NO: 729443 - DNA, 20 bp, mouse
ggagagggcgggccgagggg

SEQ ID NO: 729444 - DNA, 20 bp, mouse
gtcctctgggagacgacaga

SEQ ID NO: 729445 - DNA, 20 bp, mouse
ggccctctgtcgtctcccag

SEQ ID NO: 729446 - DNA, 20 bp, mouse
gtggcacggctccctagcgg

SEQ ID NO: 729447 - DNA, 20 bp, mouse
gtgctggtcacccgccgcta

SEQ ID NO: 729448 - DNA, 20 bp, mouse
ggggcaactgagaaccccga

SEQ ID NO: 729449 - DNA, 20 bp, mouse
ggagactctagaaatgtcac

SEQ ID NO: 729450 - DNA, 20 bp, mouse
gaaagcaggccccggtcatg

SEQ ID NO: 729451 - DNA, 20 bp, mouse
gcaggcattgctcacccttc

SEQ ID NO: 729452 - DNA, 20 bp, mouse
ggggctcgaacccacaaagc

SEQ ID NO: 729453 - DNA, 20 bp, mouse
ggccccctggaggtaagtaa

SEQ ID NO: 729454 - DNA, 20 bp, mouse
ggagatacctacttatgcca

SEQ ID NO: 729455 - DNA, 20 bp, mouse
gtgaaggtgcaaggaaacct

SEQ ID NO: 729456 - DNA, 20 bp, mouse
gcatctgcccgtctgtgcct

SEQ ID NO: 729457 - DNA, 20 bp, mouse
gagtcgaccaaggcacagac

SEQ ID NO: 729458 - DNA, 20 bp, mouse
gttagcgcgcggcctcttta

SEQ ID NO: 729459 - DNA, 20 bp, mouse
gaggtctctgcatccactta

SEQ ID NO: 729460 - DNA, 20 bp, mouse
gcgagtgttaaacacgctga

SEQ ID NO: 729461 - DNA, 20 bp, mouse
gaaaaaaagttcaaagtcta

SEQ ID NO: 729462 - DNA, 20 bp, mouse
gagagacctcggttcctctt

SEQ ID NO: 729463 - DNA, 20 bp, mouse
ggtctaaggcaagtcgacca

SEQ ID NO: 729464 - DNA, 20 bp, mouse
gagcgctgcgaccacacccc

SEQ ID NO: 729465 - DNA, 20 bp, mouse
gaggagcggtgcccggggtg

SEQ ID NO: 729466 - DNA, 20 bp, mouse
ggggccccgggccgagccgg

SEQ ID NO: 729467 - DNA, 20 bp, mouse
ggccgtgccgccgacgtcac

SEQ ID NO: 729468 - DNA, 20 bp, mouse
gcgcggcgggaaggcgaccg

SEQ ID NO: 729469 - DNA, 20 bp, mouse
gtcgccgtccgcctccggct

SEQ ID NO: 729470 - DNA, 20 bp, mouse
gcggccgggcgaggggcccc

SEQ ID NO: 729471 - DNA, 20 bp, mouse
gcggaggaggaagcgcgcgg

SEQ ID NO: 729472 - DNA, 20 bp, mouse
ggtgctacgccgcctgcggg

SEQ ID NO: 729473 - DNA, 20 bp, mouse
gctggagcgcggtggctccg

SEQ ID NO: 729474 - DNA, 20 bp, mouse
gcactcactcggcctcccgc

SEQ ID NO: 729475 - DNA, 20 bp, mouse
gctcgagccctggagcgcgg

SEQ ID NO: 729476 - DNA, 20 bp, mouse
ggtcgcgattccgctccctg

SEQ ID NO: 729477 - DNA, 20 bp, mouse
gcgaaacaggcgggaatcgg

SEQ ID NO: 729478 - DNA, 20 bp, mouse
gggcgctgagggcacgtgac

SEQ ID NO: 729479 - DNA, 20 bp, mouse
gaacaggcgggaatcggtgg

SEQ ID NO: 729480 - DNA, 20 bp, mouse
ggtgcgtcgtcggcccgagg

SEQ ID NO: 729481 - DNA, 20 bp, mouse
gccggaccggatgctctcta

SEQ ID NO: 729482 - DNA, 20 bp, mouse
gctagcggaaggtgtcatgg

SEQ ID NO: 729483 - DNA, 20 bp, mouse
gcggctccgtggtgcgtcgt

SEQ ID NO: 729484 - DNA, 20 bp, mouse
ggaccccccggcaacagagg

SEQ ID NO: 729485 - DNA, 20 bp, mouse
gggagcggaatcgcgacccg

SEQ ID NO: 729486 - DNA, 20 bp, mouse
ggctgcgggaagatgtccga

SEQ ID NO: 729487 - DNA, 20 bp, mouse
gcacccaagggtccccgctc

SEQ ID NO: 729488 - DNA, 20 bp, mouse
ggcgggaagatgtccgaggg

SEQ ID NO: 729489 - DNA, 20 bp, mouse
gaatccagagcggggaccct

SEQ ID NO: 729490 - DNA, 20 bp, mouse
gccccggcgcgcagcgctag

SEQ ID NO: 729491 - DNA, 20 bp, mouse
ggaggtccgggattgcccca

SEQ ID NO: 729492 - DNA, 20 bp, mouse
gggagtcgacgttcagtcca

SEQ ID NO: 729493 - DNA, 20 bp, mouse
ggaaacttgaatccagagcg

SEQ ID NO: 729494 - DNA, 20 bp, mouse
gctctggattcaagtttcct

SEQ ID NO: 729495 - DNA, 20 bp, mouse
gcgctagcggggcgtgccct

SEQ ID NO: 729496 - DNA, 20 bp, mouse
gacctccgcaccctttggat

SEQ ID NO: 729497 - DNA, 20 bp, mouse
gaaagtggacgtgaccgcgg

SEQ ID NO: 729498 - DNA, 20 bp, mouse
ggggatggagcgctgtggga

SEQ ID NO: 729499 - DNA, 20 bp, mouse
gggccagaatccaagatcct

SEQ ID NO: 729500 - DNA, 20 bp, mouse
gagggactcccgggaggggt

SEQ ID NO: 729501 - DNA, 20 bp, mouse
gacccatccaaagggtgcgg

SEQ ID NO: 729502 - DNA, 20 bp, mouse
gcccaggcctccgaggatct

SEQ ID NO: 729503 - DNA, 20 bp, mouse
gtggccacctccgcaccctt

SEQ ID NO: 729504 - DNA, 20 bp, mouse
gcggggaggggagggcgcta

SEQ ID NO: 729505 - DNA, 20 bp, mouse
gacagagtgcgcaggacacc

SEQ ID NO: 729506 - DNA, 20 bp, mouse
gagcaagagcgagggagcga

SEQ ID NO: 729507 - DNA, 20 bp, mouse
gttggcacgagttgctgaga

SEQ ID NO: 729508 - DNA, 20 bp, mouse
gtgctgagaaggctggctag

SEQ ID NO: 729509 - DNA, 20 bp, mouse
gagcgagggcgaaagagaat

SEQ ID NO: 729510 - DNA, 20 bp, mouse
ggtcaaatctcttaaagggg

SEQ ID NO: 729511 - DNA, 20 bp, mouse
gtgctggtgaacagtactct

SEQ ID NO: 729512 - DNA, 20 bp, mouse
gtctcttaaaggggcggtgc

SEQ ID NO: 729513 - DNA, 20 bp, mouse
gtgggactgaaactgtactg

SEQ ID NO: 729514 - DNA, 20 bp, mouse
gctagcgggttaaatcagta

SEQ ID NO: 729515 - DNA, 20 bp, mouse
ggggtcaggaagcggccagt

SEQ ID NO: 729516 - DNA, 20 bp, mouse
gctcacaaatcagaacgggg

SEQ ID NO: 729517 - DNA, 20 bp, mouse
ggccaatattggcatagtca

SEQ ID NO: 729518 - DNA, 20 bp, mouse
ggggggtaggggttactgcc

SEQ ID NO: 729519 - DNA, 20 bp, mouse
ggctggaaatttgctgaagg

SEQ ID NO: 729520 - DNA, 20 bp, mouse
gaatttgctgaagggggtag

SEQ ID NO: 729521 - DNA, 20 bp, mouse
gctcaatagggtgggaagtg

SEQ ID NO: 729522 - DNA, 20 bp, mouse
gctaagactgactatcttcc

SEQ ID NO: 729523 - DNA, 20 bp, mouse
gcactcacctctacagtaag

SEQ ID NO: 729524 - DNA, 20 bp, mouse
ggatgacatcacagcaaata

SEQ ID NO: 729525 - DNA, 20 bp, mouse
ggataccagctagtcatggc

SEQ ID NO: 729526 - DNA, 20 bp, mouse
gcaagcatggccacaggggt

SEQ ID NO: 729527 - DNA, 20 bp, mouse
gcatggggaagggggataca

SEQ ID NO: 729528 - DNA, 20 bp, mouse
gacggccgcgtgtgtgggag

SEQ ID NO: 729529 - DNA, 20 bp, mouse
gccaccccaagcatggccac

SEQ ID NO: 729530 - DNA, 20 bp, mouse
gggtgggcgagcgagcagaa

SEQ ID NO: 729531 - DNA, 20 bp, mouse
ggggcacccacgtcagagcg

SEQ ID NO: 729532 - DNA, 20 bp, mouse
gcccagacggccgcgtgtgt

SEQ ID NO: 729533 - DNA, 20 bp, mouse
gcagggcgaagaaatctccc

SEQ ID NO: 729534 - DNA, 20 bp, mouse
gtaatccgggcggggagagg

SEQ ID NO: 729535 - DNA, 20 bp, mouse
gcagaagaggaattaggtca

SEQ ID NO: 729536 - DNA, 20 bp, mouse
gcagaagccgaagctgggcg

SEQ ID NO: 729537 - DNA, 20 bp, mouse
gacaacaggtcgcggtgcgg

SEQ ID NO: 729538 - DNA, 20 bp, mouse
gggaaggcagtgccggaact

SEQ ID NO: 729539 - DNA, 20 bp, mouse
gcccgtccgtcaactcgagg

SEQ ID NO: 729540 - DNA, 20 bp, mouse
gtacgagcccgggatttctc

SEQ ID NO: 729541 - DNA, 20 bp, mouse
gtccggcactgccttccccg

SEQ ID NO: 729542 - DNA, 20 bp, mouse
gcaccgcgacctgttgtggt

SEQ ID NO: 729543 - DNA, 20 bp, mouse
ggaggagttcgaccaatcac

SEQ ID NO: 729544 - DNA, 20 bp, mouse
gagccaaccacaacaggtcg

SEQ ID NO: 729545 - DNA, 20 bp, mouse
gcgcggacgcggaataacag

SEQ ID NO: 729546 - DNA, 20 bp, mouse
gtgtgtgcaaggagaatccg

SEQ ID NO: 729547 - DNA, 20 bp, mouse
ggaacccgcggagggatcag

SEQ ID NO: 729548 - DNA, 20 bp, mouse
ggggggtccaagtctgtcgt

SEQ ID NO: 729549 - DNA, 20 bp, mouse
gcgtgcttggaggatttggg

SEQ ID NO: 729550 - DNA, 20 bp, mouse
gcgcgccaggaacccgcgga

SEQ ID NO: 729551 - DNA, 20 bp, mouse
gggccgagctccaaagacca

SEQ ID NO: 729552 - DNA, 20 bp, mouse
gggggagcctcgacctctgg

SEQ ID NO: 729553 - DNA, 20 bp, mouse
gggcgcctacccctggtctt

SEQ ID NO: 729554 - DNA, 20 bp, mouse
gccaagcacgcctcaggcat

SEQ ID NO: 729555 - DNA, 20 bp, mouse
gaatcctccaagcacgcctc

SEQ ID NO: 729556 - DNA, 20 bp, mouse
gtaagcgtatgcgtagacac

SEQ ID NO: 729557 - DNA, 20 bp, mouse
gccccagcaactcaacggaa

SEQ ID NO: 729558 - DNA, 20 bp, mouse
gaggcgccccagcaactcaa

SEQ ID NO: 729559 - DNA, 20 bp, mouse
gtagacactggcgcggagga

SEQ ID NO: 729560 - DNA, 20 bp, mouse
gggcgggacgcgcggaatga

SEQ ID NO: 729561 - DNA, 20 bp, mouse
gacaccgagggctttgagac

SEQ ID NO: 729562 - DNA, 20 bp, mouse
gccagggagcgcgtgtcaaa

SEQ ID NO: 729563 - DNA, 20 bp, mouse
gctcacctggcgactcacaa

SEQ ID NO: 729564 - DNA, 20 bp, mouse
gtgcgtagacactggcgcgg

SEQ ID NO: 729565 - DNA, 20 bp, mouse
gaggtggggcgtcgcctcca

SEQ ID NO: 729566 - DNA, 20 bp, mouse
ggcaaaggggacatcctcag

SEQ ID NO: 729567 - DNA, 20 bp, mouse
gggagtgaccagaataactt

SEQ ID NO: 729568 - DNA, 20 bp, mouse
ggccagaggaacaggagggg

SEQ ID NO: 729569 - DNA, 20 bp, mouse
gtcccactgctggaccaatg

SEQ ID NO: 729570 - DNA, 20 bp, mouse
gggaggggtcttcatggcgg

SEQ ID NO: 729571 - DNA, 20 bp, mouse
gccacccagtcctgagccag

SEQ ID NO: 729572 - DNA, 20 bp, mouse
gggtggaggggtcttcatgg

SEQ ID NO: 729573 - DNA, 20 bp, mouse
ggggacattcggtgtgacag

SEQ ID NO: 729574 - DNA, 20 bp, mouse
gtgggaaagcctggggctct

SEQ ID NO: 729575 - DNA, 20 bp, mouse
gtgttcctctggctcaggac

SEQ ID NO: 729576 - DNA, 20 bp, mouse
gggcctgaatcagggatatg

SEQ ID NO: 729577 - DNA, 20 bp, mouse
gactggcttgcttaagggga

SEQ ID NO: 729578 - DNA, 20 bp, mouse
gaggaagggggaggccgtga

SEQ ID NO: 729579 - DNA, 20 bp, mouse
gtgggactggcttgcttaag

SEQ ID NO: 729580 - DNA, 20 bp, mouse
ggccaggaggcaggaataga

SEQ ID NO: 729581 - DNA, 20 bp, mouse
gaatgtgggagaggtctgtt

SEQ ID NO: 729582 - DNA, 20 bp, mouse
ggagaacagccagggaatgt

SEQ ID NO: 729583 - DNA, 20 bp, mouse
gacagatagtcgcggagcta

SEQ ID NO: 729584 - DNA, 20 bp, mouse
gcagaaggagggccctcctc

SEQ ID NO: 729585 - DNA, 20 bp, mouse
ggcagactggagaacagcca

SEQ ID NO: 729586 - DNA, 20 bp, mouse
ggcaatatgctatatctggt

SEQ ID NO: 729587 - DNA, 20 bp, mouse
ggaaggccaggcccttcaag

SEQ ID NO: 729588 - DNA, 20 bp, mouse
ggagacataacaccaatgag

SEQ ID NO: 729589 - DNA, 20 bp, mouse
gtctggtgggtaactgattc

SEQ ID NO: 729590 - DNA, 20 bp, mouse
gccttcaagaggcaggctgt

SEQ ID NO: 729591 - DNA, 20 bp, mouse
gagcacttattgtgttgtta

SEQ ID NO: 729592 - DNA, 20 bp, mouse
gcagctgcatctttggatta

SEQ ID NO: 729593 - DNA, 20 bp, mouse
gaacacaggaaaattatctg

SEQ ID NO: 729594 - DNA, 20 bp, mouse
ggtgttgttatggtggagtt

SEQ ID NO: 729595 - DNA, 20 bp, mouse
gacaacacaataagtgcttt

SEQ ID NO: 729596 - DNA, 20 bp, mouse
gccgcgccccgcatctgtgg

SEQ ID NO: 729597 - DNA, 20 bp, mouse
gccgccgcgccccgcatctg

SEQ ID NO: 729598 - DNA, 20 bp, mouse
gggggcgcggcggtagaaga

SEQ ID NO: 729599 - DNA, 20 bp, mouse
gatgcggtggcagtgtcgga

SEQ ID NO: 729600 - DNA, 20 bp, mouse
gcaggcttccgatccatcct

SEQ ID NO: 729601 - DNA, 20 bp, mouse
gtagcatgcggtggcagtgt

SEQ ID NO: 729602 - DNA, 20 bp, mouse
gcaagaagccaaggatggat

SEQ ID NO: 729603 - DNA, 20 bp, mouse
gagggctccgccacagatgc

SEQ ID NO: 729604 - DNA, 20 bp, mouse
gcacgcggaggcggcctcgg

SEQ ID NO: 729605 - DNA, 20 bp, mouse
gttatctgaggtctggtctg

SEQ ID NO: 729606 - DNA, 20 bp, mouse
gcaccccatgccactcagga

SEQ ID NO: 729607 - DNA, 20 bp, mouse
gtggccccactggtgatctc

SEQ ID NO: 729608 - DNA, 20 bp, mouse
gggctcaccccatgccactc

SEQ ID NO: 729609 - DNA, 20 bp, mouse
gagtaagttcctctgggatt

SEQ ID NO: 729610 - DNA, 20 bp, mouse
gggaacttactaatagtgag

SEQ ID NO: 729611 - DNA, 20 bp, mouse
gacacctcatgcaatgtgtg

SEQ ID NO: 729612 - DNA, 20 bp, mouse
gcgactgcctagcgcagaaa

SEQ ID NO: 729613 - DNA, 20 bp, mouse
gcatccatcctgagtggcat

SEQ ID NO: 729614 - DNA, 20 bp, mouse
ggccactcaggatggatggt

SEQ ID NO: 729615 - DNA, 20 bp, mouse
ggggggggggggtcctgcgt

SEQ ID NO: 729616 - DNA, 20 bp, mouse
gaatatgggagaaaacgctg

SEQ ID NO: 729617 - DNA, 20 bp, mouse
gcgtccaaagaagaaaaggg

SEQ ID NO: 729618 - DNA, 20 bp, mouse
ggggagaaaacgctgaggaa

SEQ ID NO: 729619 - DNA, 20 bp, mouse
gacgaggaggagcgagttgg

SEQ ID NO: 729620 - DNA, 20 bp, mouse
gggggcggggacgaggaagt

SEQ ID NO: 729621 - DNA, 20 bp, mouse
gagaacgaggaggagcgagt

SEQ ID NO: 729622 - DNA, 20 bp, mouse
gtgggcagagtctcaggcca

SEQ ID NO: 729623 - DNA, 20 bp, mouse
gagcggctttcagaacgagg

SEQ ID NO: 729624 - DNA, 20 bp, mouse
gctggaggaactcaggtgaa

SEQ ID NO: 729625 - DNA, 20 bp, mouse
gggacgaggaagtgggtgct

SEQ ID NO: 729626 - DNA, 20 bp, mouse
gccggggcaggggttctagt

SEQ ID NO: 729627 - DNA, 20 bp, mouse
gacggtgcgcaccggggcag

SEQ ID NO: 729628 - DNA, 20 bp, mouse
gagggcgaacggatagccaa

SEQ ID NO: 729629 - DNA, 20 bp, mouse
gcgggcaataaccagctaca

SEQ ID NO: 729630 - DNA, 20 bp, mouse
gcaggggtcaccaggggcga

SEQ ID NO: 729631 - DNA, 20 bp, mouse
ggacagcgccgcgtgcccgc

SEQ ID NO: 729632 - DNA, 20 bp, mouse
gcccacccgggcagtgtcct

SEQ ID NO: 729633 - DNA, 20 bp, mouse
ggctggcggagagcccgact

SEQ ID NO: 729634 - DNA, 20 bp, mouse
gagggctgggaccatgtctg

SEQ ID NO: 729635 - DNA, 20 bp, mouse
gcgagggcgccagccaatgg

SEQ ID NO: 729636 - DNA, 20 bp, mouse
gaaagggagcggggacaaag

SEQ ID NO: 729637 - DNA, 20 bp, mouse
gctcacccaattccagctta

SEQ ID NO: 729638 - DNA, 20 bp, mouse
ggggagctgcaggaccaaag

SEQ ID NO: 729639 - DNA, 20 bp, mouse
gcctctgagccgaggggttg

SEQ ID NO: 729640 - DNA, 20 bp, mouse
gatgagccataagctggaat

SEQ ID NO: 729641 - DNA, 20 bp, mouse
gaacccctggttccttctta

SEQ ID NO: 729642 - DNA, 20 bp, mouse
gagcctcctgcgagcgtctc

SEQ ID NO: 729643 - DNA, 20 bp, mouse
gagtcctggtcagaagagta

SEQ ID NO: 729644 - DNA, 20 bp, mouse
gcttcagagccggtcagaga

SEQ ID NO: 729645 - DNA, 20 bp, mouse
gtgaccataagaaggaacca

SEQ ID NO: 729646 - DNA, 20 bp, mouse
gctggagcctcccgcagccc

SEQ ID NO: 729647 - DNA, 20 bp, mouse
gaaccctcgagacgccggca

SEQ ID NO: 729648 - DNA, 20 bp, mouse
gagcccgggaagcgaaacag

SEQ ID NO: 729649 - DNA, 20 bp, mouse
gcgccctgccggcgtctcga

SEQ ID NO: 729650 - DNA, 20 bp, mouse
gcggcagggcggggacaggc

SEQ ID NO: 729651 - DNA, 20 bp, mouse
gaagcgaaacagcggacccc

SEQ ID NO: 729652 - DNA, 20 bp, mouse
gcggaggctgacaggtgcgg

SEQ ID NO: 729653 - DNA, 20 bp, mouse
gaaggcgggggacccgggat

SEQ ID NO: 729654 - DNA, 20 bp, mouse
gtgcaggagaaaaagccgag

SEQ ID NO: 729655 - DNA, 20 bp, mouse
gtaagtcaggtcaccagaag

SEQ ID NO: 729656 - DNA, 20 bp, mouse
gcctgaaagttggacaggtg

SEQ ID NO: 729657 - DNA, 20 bp, mouse
gaacgtgtaaggaagtaaga

SEQ ID NO: 729658 - DNA, 20 bp, mouse
gttagccactggtacttttg

SEQ ID NO: 729659 - DNA, 20 bp, mouse
gagtaagaaggtaaacacct

SEQ ID NO: 729660 - DNA, 20 bp, mouse
gaagaaggtaaacacctggg

SEQ ID NO: 729661 - DNA, 20 bp, mouse
gtctacaaagcgatgaaaag

SEQ ID NO: 729662 - DNA, 20 bp, mouse
gtgcaaagtgtcctgaaagt

SEQ ID NO: 729663 - DNA, 20 bp, mouse
gaccagaggaacagtaggga

SEQ ID NO: 729664 - DNA, 20 bp, mouse
gaatctcaggttaacgtgta

SEQ ID NO: 729665 - DNA, 20 bp, mouse
ggctgatactagcccagatt

SEQ ID NO: 729666 - DNA, 20 bp, mouse
gcccgctcgctcaccctctg

SEQ ID NO: 729667 - DNA, 20 bp, mouse
gaacctgccaaaagttccga

SEQ ID NO: 729668 - DNA, 20 bp, mouse
ggggccgtgcgaattcgcac

SEQ ID NO: 729669 - DNA, 20 bp, mouse
gttcgccggtaagaatgaca

SEQ ID NO: 729670 - DNA, 20 bp, mouse
gggaacttttggcaggttgg

SEQ ID NO: 729671 - DNA, 20 bp, mouse
gagaaccttgtcattcttac

SEQ ID NO: 729672 - DNA, 20 bp, mouse
gacagggatgggtcattccg

SEQ ID NO: 729673 - DNA, 20 bp, mouse
gtagaagctcccaccacaga

SEQ ID NO: 729674 - DNA, 20 bp, mouse
gagccctcggaacttttggc

SEQ ID NO: 729675 - DNA, 20 bp, mouse
gtgagggcgcgtgcgcagca

SEQ ID NO: 729676 - DNA, 20 bp, mouse
gcaggcttaagaggtggcta

SEQ ID NO: 729677 - DNA, 20 bp, mouse
ggtgcacatcgcagtgtctg

SEQ ID NO: 729678 - DNA, 20 bp, mouse
gcggggacgcagcgacgccc

SEQ ID NO: 729679 - DNA, 20 bp, mouse
gatgaggtgccaggcttaag

SEQ ID NO: 729680 - DNA, 20 bp, mouse
gcataagtggaaatgacccc

SEQ ID NO: 729681 - DNA, 20 bp, mouse
gggatgacctctctactccg

SEQ ID NO: 729682 - DNA, 20 bp, mouse
gctagggagggatgagcagc

SEQ ID NO: 729683 - DNA, 20 bp, mouse
gaagggacagagtcccaaag

SEQ ID NO: 729684 - DNA, 20 bp, mouse
gaagcctgaaaactagcggc

SEQ ID NO: 729685 - DNA, 20 bp, mouse
gaatccagccgctagttttc

SEQ ID NO: 729686 - DNA, 20 bp, mouse
ggaaccgaaagggcgagaag

SEQ ID NO: 729687 - DNA, 20 bp, mouse
ggcgagaagcggcctctctt

SEQ ID NO: 729688 - DNA, 20 bp, mouse
gcgctcctccggtggcgatg

SEQ ID NO: 729689 - DNA, 20 bp, mouse
gcgtgcgcgtggtggccgag

SEQ ID NO: 729690 - DNA, 20 bp, mouse
gcaccactgtaccggaggat

SEQ ID NO: 729691 - DNA, 20 bp, mouse
gaggccgcttctcgcccttt

SEQ ID NO: 729692 - DNA, 20 bp, mouse
gcggccgcgcgctcctccgg

SEQ ID NO: 729693 - DNA, 20 bp, mouse
ggaggaggcggggctactga

SEQ ID NO: 729694 - DNA, 20 bp, mouse
gccaatgaacaccactgtac

SEQ ID NO: 729695 - DNA, 20 bp, mouse
gcgcggccgcgagcgaccga

SEQ ID NO: 729696 - DNA, 20 bp, mouse
gcagaaatcgggtgcttaac

SEQ ID NO: 729697 - DNA, 20 bp, mouse
gagctcggggagagcgcgga

SEQ ID NO: 729698 - DNA, 20 bp, mouse
gccggagctcggggagagcg

SEQ ID NO: 729699 - DNA, 20 bp, mouse
gtcgctgggaggcgggactc

SEQ ID NO: 729700 - DNA, 20 bp, mouse
gtaactggcttgctggaagt

SEQ ID NO: 729701 - DNA, 20 bp, mouse
gcaaaccctggactcctggt

SEQ ID NO: 729702 - DNA, 20 bp, mouse
ggagaccagcgcagtctaga

SEQ ID NO: 729703 - DNA, 20 bp, mouse
gcggcgctcagggactcgct

SEQ ID NO: 729704 - DNA, 20 bp, mouse
gtgagcggagccggctcctt

SEQ ID NO: 729705 - DNA, 20 bp, mouse
ggacccaaaagcgcagaaat

SEQ ID NO: 729706 - DNA, 20 bp, mouse
ggacccgcgcggctgacgtc

SEQ ID NO: 729707 - DNA, 20 bp, mouse
ggtccagaggccggagtgat

SEQ ID NO: 729708 - DNA, 20 bp, mouse
ggtagggagcagtcctcatg

SEQ ID NO: 729709 - DNA, 20 bp, mouse
ggggaggtgttgtacctgag

SEQ ID NO: 729710 - DNA, 20 bp, mouse
gagtcctcatggggagaacc

SEQ ID NO: 729711 - DNA, 20 bp, mouse
gagctggtcaaggctccgta

SEQ ID NO: 729712 - DNA, 20 bp, mouse
gtccccaggttctccccatg

SEQ ID NO: 729713 - DNA, 20 bp, mouse
gtgggtgttggcgtaatctc

SEQ ID NO: 729714 - DNA, 20 bp, mouse
gacacccgggtctatgtgta

SEQ ID NO: 729715 - DNA, 20 bp, mouse
gcggagccttgaccagcttg

SEQ ID NO: 729716 - DNA, 20 bp, mouse
gaacgcggggatccgctcta

SEQ ID NO: 729717 - DNA, 20 bp, mouse
gcgcaggggccgggctagag

SEQ ID NO: 729718 - DNA, 20 bp, mouse
ggcgccctctccagtgtatt

SEQ ID NO: 729719 - DNA, 20 bp, mouse
ggcccaggccagaccaacgc

SEQ ID NO: 729720 - DNA, 20 bp, mouse
gagagagggagtgcgaggaa

SEQ ID NO: 729721 - DNA, 20 bp, mouse
ggcgcccagagacctagggg

SEQ ID NO: 729722 - DNA, 20 bp, mouse
gaacttggtggtgacgtcaa

SEQ ID NO: 729723 - DNA, 20 bp, mouse
gaatccggcaaggggtggac

SEQ ID NO: 729724 - DNA, 20 bp, mouse
ggtcccacgtgtggcggtag

SEQ ID NO: 729725 - DNA, 20 bp, mouse
gtctgctctgcaccctagag

SEQ ID NO: 729726 - DNA, 20 bp, mouse
gtgtggaaagggttcgcgaa

SEQ ID NO: 729727 - DNA, 20 bp, mouse
gaattcaaggggcgggttca

SEQ ID NO: 729728 - DNA, 20 bp, mouse
gtcaaggggcgggttcaggg

SEQ ID NO: 729729 - DNA, 20 bp, mouse
ggaggccatcggctggtgac

SEQ ID NO: 729730 - DNA, 20 bp, mouse
gcaatcgtctctcggaacgt

SEQ ID NO: 729731 - DNA, 20 bp, mouse
gagagcgccactcaaccggg

SEQ ID NO: 729732 - DNA, 20 bp, mouse
gtgctcctgtcaccagccga

SEQ ID NO: 729733 - DNA, 20 bp, mouse
gttcagggaggcgaggccat

SEQ ID NO: 729734 - DNA, 20 bp, mouse
gaggggggtagagcagtatg

SEQ ID NO: 729735 - DNA, 20 bp, mouse
ggcgcagcccgtcactcgga

SEQ ID NO: 729736 - DNA, 20 bp, mouse
ggaggcgtgcgccaaggctg

SEQ ID NO: 729737 - DNA, 20 bp, mouse
gcggagggggtgcgcgagag

SEQ ID NO: 729738 - DNA, 20 bp, mouse
gctcccgggcgccccagcct

SEQ ID NO: 729739 - DNA, 20 bp, mouse
gccgtgggagcgcagcgcta

SEQ ID NO: 729740 - DNA, 20 bp, mouse
gcccgggagagcggagatcc

SEQ ID NO: 729741 - DNA, 20 bp, mouse
ggcgctcccacgggagtcgg

SEQ ID NO: 729742 - DNA, 20 bp, mouse
gggacacctccgactcccgt

SEQ ID NO: 729743 - DNA, 20 bp, mouse
ggggagcgcagcgctagggc

SEQ ID NO: 729744 - DNA, 20 bp, mouse
gcctcgcgcgtgcctgcgga

SEQ ID NO: 729745 - DNA, 20 bp, mouse
gggcctggaccgtcctgcgc

SEQ ID NO: 729746 - DNA, 20 bp, mouse
gaatggagcgcaggtgtctt

SEQ ID NO: 729747 - DNA, 20 bp, mouse
gcaggagcggctacgagggg

SEQ ID NO: 729748 - DNA, 20 bp, mouse
gcccctgcctattggagcta

SEQ ID NO: 729749 - DNA, 20 bp, mouse
gctgggaggcggaggacatg

SEQ ID NO: 729750 - DNA, 20 bp, mouse
gagggtggggaatggagcgc

SEQ ID NO: 729751 - DNA, 20 bp, mouse
gagcgcaggtgtctttggaa

SEQ ID NO: 729752 - DNA, 20 bp, mouse
gaggccctgcccctgcctat

SEQ ID NO: 729753 - DNA, 20 bp, mouse
gagagggacctagaggaaaa

SEQ ID NO: 729754 - DNA, 20 bp, mouse
gagcttgagaggggtcacac

SEQ ID NO: 729755 - DNA, 20 bp, mouse
gcgcgagccgaagtgatgga

SEQ ID NO: 729756 - DNA, 20 bp, mouse
gaaccggagaccagctcagg

SEQ ID NO: 729757 - DNA, 20 bp, mouse
ggcgcggagggacacaagac

SEQ ID NO: 729758 - DNA, 20 bp, mouse
gctcctcctgagctggtctc

SEQ ID NO: 729759 - DNA, 20 bp, mouse
gccgcccctctccggctcca

SEQ ID NO: 729760 - DNA, 20 bp, mouse
gcaaccctggagccggagag

SEQ ID NO: 729761 - DNA, 20 bp, mouse
gagtcgctagtcccaggcga

SEQ ID NO: 729762 - DNA, 20 bp, mouse
ggcgaaccggagaccagctc

SEQ ID NO: 729763 - DNA, 20 bp, mouse
gccctggctccgggaaacag

SEQ ID NO: 729764 - DNA, 20 bp, mouse
gggagccagggcctcatcac

SEQ ID NO: 729765 - DNA, 20 bp, mouse
gactttggagccaagcgaac

SEQ ID NO: 729766 - DNA, 20 bp, mouse
gccccagggcgctccagagg

SEQ ID NO: 729767 - DNA, 20 bp, mouse
gacgaactgcggagacgcgg

SEQ ID NO: 729768 - DNA, 20 bp, mouse
gcggctgcggggcgctgtgg

SEQ ID NO: 729769 - DNA, 20 bp, mouse
ggggcggtgcagagcgttct

SEQ ID NO: 729770 - DNA, 20 bp, mouse
ggcggagcggaggatcggag

SEQ ID NO: 729771 - DNA, 20 bp, mouse
ggcggagccgcgacgaactg

SEQ ID NO: 729772 - DNA, 20 bp, mouse
gcagaggcggagcggaggat

SEQ ID NO: 729773 - DNA, 20 bp, mouse
gacagcaagaggcgccgcga

SEQ ID NO: 729774 - DNA, 20 bp, mouse
ggcgacccgtcgcccagctc

SEQ ID NO: 729775 - DNA, 20 bp, mouse
gctcccccagggcgctccag

SEQ ID NO: 729776 - DNA, 20 bp, mouse
gtccgcgccggccctcctag

SEQ ID NO: 729777 - DNA, 20 bp, mouse
gggcggcaacagacccgggc

SEQ ID NO: 729778 - DNA, 20 bp, mouse
ggggccggcgcggactgagg

SEQ ID NO: 729779 - DNA, 20 bp, mouse
ggaatgccggcggggacagg

SEQ ID NO: 729780 - DNA, 20 bp, mouse
gctcgggccgccactgcaac

SEQ ID NO: 729781 - DNA, 20 bp, mouse
gactgaggcggcaacagacc

SEQ ID NO: 729782 - DNA, 20 bp, mouse
ggccaattcggcctctactc

SEQ ID NO: 729783 - DNA, 20 bp, mouse
gccccccttcaggcaactca

SEQ ID NO: 729784 - DNA, 20 bp, mouse
gacccctaggagggccggcg

SEQ ID NO: 729785 - DNA, 20 bp, mouse
gggggcttgtcctggagcgg

SEQ ID NO: 729786 - DNA, 20 bp, mouse
gtcccctggaaactcctccg

SEQ ID NO: 729787 - DNA, 20 bp, mouse
ggccccggaggagtttccag

SEQ ID NO: 729788 - DNA, 20 bp, mouse
gaaaaaacctgccctaggta

SEQ ID NO: 729789 - DNA, 20 bp, mouse
gggcgcatgctccgtaccta

SEQ ID NO: 729790 - DNA, 20 bp, mouse
gtttccaggggaggagtcca

SEQ ID NO: 729791 - DNA, 20 bp, mouse
ggggctcctgtcacaccggc

SEQ ID NO: 729792 - DNA, 20 bp, mouse
gcgcacacactcgctcacgc

SEQ ID NO: 729793 - DNA, 20 bp, mouse
gttgcaaagccgcccctcgg

SEQ ID NO: 729794 - DNA, 20 bp, mouse
ggcaaatcgcactactgctc

SEQ ID NO: 729795 - DNA, 20 bp, mouse
gggtccgcccgcccaggcgc

SEQ ID NO: 729796 - DNA, 20 bp, mouse
gggaactgggcggaagatga

SEQ ID NO: 729797 - DNA, 20 bp, mouse
gaggctgaaccgagaggaag

SEQ ID NO: 729798 - DNA, 20 bp, mouse
gccgcccagttccaccctga

SEQ ID NO: 729799 - DNA, 20 bp, mouse
gaggccttgcaaggcgaagc

SEQ ID NO: 729800 - DNA, 20 bp, mouse
gggcggagctaagaactggg

SEQ ID NO: 729801 - DNA, 20 bp, mouse
gtgaaggcggagctaagaac

SEQ ID NO: 729802 - DNA, 20 bp, mouse
gcagccttcagggtggaact

SEQ ID NO: 729803 - DNA, 20 bp, mouse
gcctctcggttcagccttca

SEQ ID NO: 729804 - DNA, 20 bp, mouse
gcgcaccggaaggtcctagg

SEQ ID NO: 729805 - DNA, 20 bp, mouse
gctcgcgactacacggtcac

SEQ ID NO: 729806 - DNA, 20 bp, mouse
gtgattctgttggatatctg

SEQ ID NO: 729807 - DNA, 20 bp, mouse
gtcaacaaatatgattctgt

SEQ ID NO: 729808 - DNA, 20 bp, mouse
ggagtcacaagcaagctagg

SEQ ID NO: 729809 - DNA, 20 bp, mouse
gaaccaaacaccatttctct

SEQ ID NO: 729810 - DNA, 20 bp, mouse
gtccttgttatcctgggcag

SEQ ID NO: 729811 - DNA, 20 bp, mouse
ggttgagtcacaagcaagct

SEQ ID NO: 729812 - DNA, 20 bp, mouse
gataagtctgacaaagaact

SEQ ID NO: 729813 - DNA, 20 bp, mouse
gttactatacaataagacaa

SEQ ID NO: 729814 - DNA, 20 bp, mouse
gttaatgtgcatgatacaaa

SEQ ID NO: 729815 - DNA, 20 bp, mouse
gtgcatctttacttgcatac

SEQ ID NO: 729816 - DNA, 20 bp, mouse
ggggaggaaggctttttgat

SEQ ID NO: 729817 - DNA, 20 bp, mouse
gactgccgcgattagtctca

SEQ ID NO: 729818 - DNA, 20 bp, mouse
gaatcgcggcagtcatcttc

SEQ ID NO: 729819 - DNA, 20 bp, mouse
gcaagccttgagactaatcg

SEQ ID NO: 729820 - DNA, 20 bp, mouse
gtggagtggcgctaaaccta

SEQ ID NO: 729821 - DNA, 20 bp, mouse
gcacgcggtgagtcataagt

SEQ ID NO: 729822 - DNA, 20 bp, mouse
gaggaggcgggattagccgc

SEQ ID NO: 729823 - DNA, 20 bp, mouse
ggccccaagggcagataaaa

SEQ ID NO: 729824 - DNA, 20 bp, mouse
gcttactggtcctgccgggg

SEQ ID NO: 729825 - DNA, 20 bp, mouse
gaggctttttgattggttga

SEQ ID NO: 729826 - DNA, 20 bp, mouse
gcaggctgccagggacgaat

SEQ ID NO: 729827 - DNA, 20 bp, mouse
ggtcgcagtaggagatgctc

SEQ ID NO: 729828 - DNA, 20 bp, mouse
gtgcgtggtggatttcataa

SEQ ID NO: 729829 - DNA, 20 bp, mouse
gtcagagcaacgattggctt

SEQ ID NO: 729830 - DNA, 20 bp, mouse
gtcgtccctggcagcctgcg

SEQ ID NO: 729831 - DNA, 20 bp, mouse
ggttgctctgacagggaagt

SEQ ID NO: 729832 - DNA, 20 bp, mouse
gccaggctcatgactgtgca

SEQ ID NO: 729833 - DNA, 20 bp, mouse
gtccaccacgcaggctgcca

SEQ ID NO: 729834 - DNA, 20 bp, mouse
gcaagaatggcttgtcaggg

SEQ ID NO: 729835 - DNA, 20 bp, mouse
ggcaacgattggctttgggt

SEQ ID NO: 729836 - DNA, 20 bp, mouse
ggggctccccaaaggacagg

SEQ ID NO: 729837 - DNA, 20 bp, mouse
gttggggagcccaatggtta

SEQ ID NO: 729838 - DNA, 20 bp, mouse
gaccccgcggcagtctggtg

SEQ ID NO: 729839 - DNA, 20 bp, mouse
gcgtctccctgctgcaggct

SEQ ID NO: 729840 - DNA, 20 bp, mouse
gcacctgcttgggtggaaca

SEQ ID NO: 729841 - DNA, 20 bp, mouse
gggagcccaatggttatggc

SEQ ID NO: 729842 - DNA, 20 bp, mouse
ggcggggtccccctgtcctt

SEQ ID NO: 729843 - DNA, 20 bp, mouse
gtaggaagatgccttttctg

SEQ ID NO: 729844 - DNA, 20 bp, mouse
ggcaggcgtctccctgctgc

SEQ ID NO: 729845 - DNA, 20 bp, mouse
gccaatggttatggctggat

SEQ ID NO: 729846 - DNA, 20 bp, mouse
gagatgtaaggcacagggtt

SEQ ID NO: 729847 - DNA, 20 bp, mouse
gcgaaggcggggctagggtg

SEQ ID NO: 729848 - DNA, 20 bp, mouse
ggctccgcctcatgcaactt

SEQ ID NO: 729849 - DNA, 20 bp, mouse
gcggtgcgaaggcggggcta

SEQ ID NO: 729850 - DNA, 20 bp, mouse
ggggcgaagctggcgactga

SEQ ID NO: 729851 - DNA, 20 bp, mouse
ggccagcttcgcccgggaaa

SEQ ID NO: 729852 - DNA, 20 bp, mouse
gtgtgtgttaagtatccctg

SEQ ID NO: 729853 - DNA, 20 bp, mouse
gttagcaccccacgccaggc

SEQ ID NO: 729854 - DNA, 20 bp, mouse
gtggggtgctaagatagaag

SEQ ID NO: 729855 - DNA, 20 bp, mouse
gcggggttggggcggtgcga

SEQ ID NO: 729856 - DNA, 20 bp, mouse
ggccgagttgggtccttgga

SEQ ID NO: 729857 - DNA, 20 bp, mouse
gtgtgggtcaaagcaccaaa

SEQ ID NO: 729858 - DNA, 20 bp, mouse
ggggtcagaggtagatggat

SEQ ID NO: 729859 - DNA, 20 bp, mouse
ggggtggggccgctgtgggc

SEQ ID NO: 729860 - DNA, 20 bp, mouse
gcgagcatgaagggtcctat

SEQ ID NO: 729861 - DNA, 20 bp, mouse
gacaaggggtggggccgctg

SEQ ID NO: 729862 - DNA, 20 bp, mouse
ggtgtctgctggcaatctca

SEQ ID NO: 729863 - DNA, 20 bp, mouse
gtaggtagtagcagctagat

SEQ ID NO: 729864 - DNA, 20 bp, mouse
gggcaatctcaaggccgagt

SEQ ID NO: 729865 - DNA, 20 bp, mouse
gagcagacacaacaaggggt

SEQ ID NO: 729866 - DNA, 20 bp, mouse
ggagcagttgcggcagagga

SEQ ID NO: 729867 - DNA, 20 bp, mouse
gcggggagcagttgcggcag

SEQ ID NO: 729868 - DNA, 20 bp, mouse
gggtggagcggctgtcgcgg

SEQ ID NO: 729869 - DNA, 20 bp, mouse
ggacagccgctccacctagt

SEQ ID NO: 729870 - DNA, 20 bp, mouse
gagccgcctactaggtggag

SEQ ID NO: 729871 - DNA, 20 bp, mouse
gctagtaggcggctctgcgt

SEQ ID NO: 729872 - DNA, 20 bp, mouse
gccgctaggtttttctacaa

SEQ ID NO: 729873 - DNA, 20 bp, mouse
gagccgctccacctagtagg

SEQ ID NO: 729874 - DNA, 20 bp, mouse
gggcctgctgtcccggacct

SEQ ID NO: 729875 - DNA, 20 bp, mouse
ggctgtcccggaccttggaa

SEQ ID NO: 729876 - DNA, 20 bp, mouse
gtgggagggacgaagttcag

SEQ ID NO: 729877 - DNA, 20 bp, mouse
gctggcttggaaatctggga

SEQ ID NO: 729878 - DNA, 20 bp, mouse
gagttcagaggcaagcccta

SEQ ID NO: 729879 - DNA, 20 bp, mouse
gagtcagagcaactgctcgc

SEQ ID NO: 729880 - DNA, 20 bp, mouse
gtcagaggcaagccctaggg

SEQ ID NO: 729881 - DNA, 20 bp, mouse
ggctcgctggcttggaaatc

SEQ ID NO: 729882 - DNA, 20 bp, mouse
gtcagggtcgcaccgcccta

SEQ ID NO: 729883 - DNA, 20 bp, mouse
ggaagtccgcgatagctatc

SEQ ID NO: 729884 - DNA, 20 bp, mouse
gctatcgcggacttcctcct

SEQ ID NO: 729885 - DNA, 20 bp, mouse
ggctagcagtgctcaggctg

SEQ ID NO: 729886 - DNA, 20 bp, mouse
gccgaaggggattgtgggcg

SEQ ID NO: 729887 - DNA, 20 bp, mouse
gagcgcgccgaaggggattg

SEQ ID NO: 729888 - DNA, 20 bp, mouse
gcagccttccgcagtcgtaa

SEQ ID NO: 729889 - DNA, 20 bp, mouse
gaagcgcagggatctctcat

SEQ ID NO: 729890 - DNA, 20 bp, mouse
ggggcggggctacgaaacga

SEQ ID NO: 729891 - DNA, 20 bp, mouse
gcggctctgagcgcgccgaa

SEQ ID NO: 729892 - DNA, 20 bp, mouse
ggaaacgaaggctaaccaat

SEQ ID NO: 729893 - DNA, 20 bp, mouse
gcacatggatatgactatgt

SEQ ID NO: 729894 - DNA, 20 bp, mouse
gggcggagccaaacgttgag

SEQ ID NO: 729895 - DNA, 20 bp, mouse
ggcgaggtaaagcttgtggg

SEQ ID NO: 729896 - DNA, 20 bp, mouse
gccaaagggcacatcccact

SEQ ID NO: 729897 - DNA, 20 bp, mouse
gacaagcgcagcataggtca

SEQ ID NO: 729898 - DNA, 20 bp, mouse
ggggatgtgccctttggacc

SEQ ID NO: 729899 - DNA, 20 bp, mouse
gtctaacacaagcgcagcat

SEQ ID NO: 729900 - DNA, 20 bp, mouse
gggtgtatctgattcgtcag

SEQ ID NO: 729901 - DNA, 20 bp, mouse
gttcagataaccaggtccaa

SEQ ID NO: 729902 - DNA, 20 bp, mouse
ggggatcatattcaggtaaa

SEQ ID NO: 729903 - DNA, 20 bp, mouse
gtcacctctcaaagctattc

SEQ ID NO: 729904 - DNA, 20 bp, mouse
ggaagtttcatgtcgaaaca

SEQ ID NO: 729905 - DNA, 20 bp, mouse
gcttccagaatagctttgag

SEQ ID NO: 729906 - DNA, 20 bp, mouse
gagggagggcagggacgatg

SEQ ID NO: 729907 - DNA, 20 bp, mouse
gaaggctcagggaacaccta

SEQ ID NO: 729908 - DNA, 20 bp, mouse
gaggactcaaggggaattgt

SEQ ID NO: 729909 - DNA, 20 bp, mouse
gctcaaggggaattgtgggt

SEQ ID NO: 729910 - DNA, 20 bp, mouse
gggacgatggggttagagga

SEQ ID NO: 729911 - DNA, 20 bp, mouse
ggctgtgcagcctcctccct

SEQ ID NO: 729912 - DNA, 20 bp, mouse
ggagtcctagaatgaatgac

SEQ ID NO: 729913 - DNA, 20 bp, mouse
gacggaatgtggttcgttgc

SEQ ID NO: 729914 - DNA, 20 bp, mouse
gagaatgccctgttctgcag

SEQ ID NO: 729915 - DNA, 20 bp, mouse
ggatggggttagaggaagga

SEQ ID NO: 729916 - DNA, 20 bp, mouse
gaagggagaggcaagcggga

SEQ ID NO: 729917 - DNA, 20 bp, mouse
ggataggggagactactccc

SEQ ID NO: 729918 - DNA, 20 bp, mouse
gtaagtgttgagtgccttag

SEQ ID NO: 729919 - DNA, 20 bp, mouse
gcaggcttatatgaagggag

SEQ ID NO: 729920 - DNA, 20 bp, mouse
gatacctgctcattccccta

SEQ ID NO: 729921 - DNA, 20 bp, mouse
ggtgccttaggggaatgagc

SEQ ID NO: 729922 - DNA, 20 bp, mouse
gaactcaaccaacacagaga

SEQ ID NO: 729923 - DNA, 20 bp, mouse
ggcttgttcaaagggtgcgg

SEQ ID NO: 729924 - DNA, 20 bp, mouse
gcatgttaaaggtagtgata

SEQ ID NO: 729925 - DNA, 20 bp, mouse
gtgagtaaacatctgtcagg

SEQ ID NO: 729926 - DNA, 20 bp, mouse
gtcacaagaccaagtctctt

SEQ ID NO: 729927 - DNA, 20 bp, mouse
gggactgcaggacttcccac

SEQ ID NO: 729928 - DNA, 20 bp, mouse
ggcccgccagatctcctctg

SEQ ID NO: 729929 - DNA, 20 bp, mouse
gagaggaaacagagcactct

SEQ ID NO: 729930 - DNA, 20 bp, mouse
gggaagtcctgcagtcccat

SEQ ID NO: 729931 - DNA, 20 bp, mouse
gccctgcgtggtggggatgt

SEQ ID NO: 729932 - DNA, 20 bp, mouse
gagcctcctcagaggagatc

SEQ ID NO: 729933 - DNA, 20 bp, mouse
gacacccagagcctcctcag

SEQ ID NO: 729934 - DNA, 20 bp, mouse
gccccaccacgcaggggatc

SEQ ID NO: 729935 - DNA, 20 bp, mouse
gtctgtggctgtggaggtac

SEQ ID NO: 729936 - DNA, 20 bp, mouse
gagtccagtacgagtctcct

SEQ ID NO: 729937 - DNA, 20 bp, mouse
gtcaaaacacccctctagaa

SEQ ID NO: 729938 - DNA, 20 bp, mouse
gtctggggaaggcagttgtg

SEQ ID NO: 729939 - DNA, 20 bp, mouse
ggggactggcttggcatcat

SEQ ID NO: 729940 - DNA, 20 bp, mouse
gaagaccgggacagcgggcg

SEQ ID NO: 729941 - DNA, 20 bp, mouse
ggttccaagtgcgcctgcgt

SEQ ID NO: 729942 - DNA, 20 bp, mouse
gctgtccaagagaattgcct

SEQ ID NO: 729943 - DNA, 20 bp, mouse
gtcttctgaaagaacttcca

SEQ ID NO: 729944 - DNA, 20 bp, mouse
gaatgaatgctgaagctgta

SEQ ID NO: 729945 - DNA, 20 bp, mouse
gcaaggtccgtgtgattaaa

SEQ ID NO: 729946 - DNA, 20 bp, mouse
ggtgtgtgcacaggggatat

SEQ ID NO: 729947 - DNA, 20 bp, mouse
gggtactgtccaatcagtta

SEQ ID NO: 729948 - DNA, 20 bp, mouse
ggactagaaaacattgtttc

SEQ ID NO: 729949 - DNA, 20 bp, mouse
gtggacagtacctgcccaca

SEQ ID NO: 729950 - DNA, 20 bp, mouse
gaactgctaatctgaatggg

SEQ ID NO: 729951 - DNA, 20 bp, mouse
gcagtacctgcccacatgga

SEQ ID NO: 729952 - DNA, 20 bp, mouse
gggaggatccaccttccatg

SEQ ID NO: 729953 - DNA, 20 bp, mouse
gaatgaactgctaatctgaa

SEQ ID NO: 729954 - DNA, 20 bp, mouse
ggagatctgttacgctgcct

SEQ ID NO: 729955 - DNA, 20 bp, mouse
gtttctggtccctaactgat

SEQ ID NO: 729956 - DNA, 20 bp, mouse
gtggtcacggatcaaggttc

SEQ ID NO: 729957 - DNA, 20 bp, mouse
ggcggagccacgtgacacaa

SEQ ID NO: 729958 - DNA, 20 bp, mouse
gagcccccgccgcagactgg

SEQ ID NO: 729959 - DNA, 20 bp, mouse
gcgcccccagtctgcggcgg

SEQ ID NO: 729960 - DNA, 20 bp, mouse
gtgaggtgagataggccgag

SEQ ID NO: 729961 - DNA, 20 bp, mouse
gtccacgcccagaccgggtg

SEQ ID NO: 729962 - DNA, 20 bp, mouse
gaggcccgccaatcgcgact

SEQ ID NO: 729963 - DNA, 20 bp, mouse
gtatctcacctcacccggtc

SEQ ID NO: 729964 - DNA, 20 bp, mouse
gttctctccacgcccagacc

SEQ ID NO: 729965 - DNA, 20 bp, mouse
gtctgagtgaagcaagcggg

SEQ ID NO: 729966 - DNA, 20 bp, mouse
gcagttcacaagatgtcttg

SEQ ID NO: 729967 - DNA, 20 bp, mouse
gtcaagaattctgagaatca

SEQ ID NO: 729968 - DNA, 20 bp, mouse
gaaaagatctagcgtaaatg

SEQ ID NO: 729969 - DNA, 20 bp, mouse
gccaggacagagtctagcac

SEQ ID NO: 729970 - DNA, 20 bp, mouse
gtaacattggagtttgatct

SEQ ID NO: 729971 - DNA, 20 bp, mouse
gaaacctaagtctttactaa

SEQ ID NO: 729972 - DNA, 20 bp, mouse
ggtcctggtgtgagctcatc

SEQ ID NO: 729973 - DNA, 20 bp, mouse
gaatcctttagtaaagactt

SEQ ID NO: 729974 - DNA, 20 bp, mouse
gagagtctagcactggacct

SEQ ID NO: 729975 - DNA, 20 bp, mouse
gtttgtctgtagctataagt

SEQ ID NO: 729976 - DNA, 20 bp, mouse
gcccacagaaacctcaacta

SEQ ID NO: 729977 - DNA, 20 bp, mouse
gcaagcaactctctctgttc

SEQ ID NO: 729978 - DNA, 20 bp, mouse
gctagccaatatcctgctat

SEQ ID NO: 729979 - DNA, 20 bp, mouse
gaatgctgctcattattgga

SEQ ID NO: 729980 - DNA, 20 bp, mouse
ggctgcaggttgggataaac

SEQ ID NO: 729981 - DNA, 20 bp, mouse
gacaaactggaagaaaaatg

SEQ ID NO: 729982 - DNA, 20 bp, mouse
gacctgcagcaaggtgaaca

SEQ ID NO: 729983 - DNA, 20 bp, mouse
gagagaatgctgctcattat

SEQ ID NO: 729984 - DNA, 20 bp, mouse
gcaaggactagagaacaaac

SEQ ID NO: 729985 - DNA, 20 bp, mouse
gtccttgttcaccttgctgc

SEQ ID NO: 729986 - DNA, 20 bp, mouse
gggtacctattggaatacgt

SEQ ID NO: 729987 - DNA, 20 bp, mouse
gcacaccaacgtattccaat

SEQ ID NO: 729988 - DNA, 20 bp, mouse
ggtgtggctatgtcaaagta

SEQ ID NO: 729989 - DNA, 20 bp, mouse
ggtcttggagatctgttcta

SEQ ID NO: 729990 - DNA, 20 bp, mouse
gaatacgttggtgtgtgatg

SEQ ID NO: 729991 - DNA, 20 bp, mouse
gagcacaagtgaattattcc

SEQ ID NO: 729992 - DNA, 20 bp, mouse
gaccccctacatatacttga

SEQ ID NO: 729993 - DNA, 20 bp, mouse
gtggagatctgttctatggg

SEQ ID NO: 729994 - DNA, 20 bp, mouse
gcacgccttcaagtatatgt

SEQ ID NO: 729995 - DNA, 20 bp, mouse
ggtggctagaaagagagatc

SEQ ID NO: 729996 - DNA, 20 bp, mouse
gttaaacctatggtactcat

SEQ ID NO: 729997 - DNA, 20 bp, mouse
gaacctatggtactcattgg

SEQ ID NO: 729998 - DNA, 20 bp, mouse
ggagctccaaagactcatgt

SEQ ID NO: 729999 - DNA, 20 bp, mouse
gacagtagcccaagtagaaa

SEQ ID NO: 730000 - DNA, 20 bp, mouse
gaggttatggaggcattagg

SEQ ID NO: 730001 - DNA, 20 bp, mouse
ggagtctttggagctccagc

SEQ ID NO: 730002 - DNA, 20 bp, mouse
ggcattccaacatgagtctt

SEQ ID NO: 730003 - DNA, 20 bp, mouse
gattggtggaaaggttatgg

SEQ ID NO: 730004 - DNA, 20 bp, mouse
gatggtactcattggtggaa

SEQ ID NO: 730005 - DNA, 20 bp, mouse
gctcattggtggaaaggtta

SEQ ID NO: 730006 - DNA, 20 bp, mouse
gttaaacctatggtactcat

SEQ ID NO: 730007 - DNA, 20 bp, mouse
gaacctatggtactcattgg

SEQ ID NO: 730008 - DNA, 20 bp, mouse
ggagctccaaagactcatgt

SEQ ID NO: 730009 - DNA, 20 bp, mouse
ggcagagtgtgcagtaggat

SEQ ID NO: 730010 - DNA, 20 bp, mouse
gaggttatggaggcattagg

SEQ ID NO: 730011 - DNA, 20 bp, mouse
gagtgtgcagtaggattggc

SEQ ID NO: 730012 - DNA, 20 bp, mouse
gacagtagcccaagtagaaa

SEQ ID NO: 730013 - DNA, 20 bp, mouse
gattggtggaaaggttatgg

SEQ ID NO: 730014 - DNA, 20 bp, mouse
gatggtactcattggtggaa

SEQ ID NO: 730015 - DNA, 20 bp, mouse
ggagtctttggagctccagc

SEQ ID NO: 730016 - DNA, 20 bp, mouse
ggtgatataaggtactcctg

SEQ ID NO: 730017 - DNA, 20 bp, mouse
gtacagaggaagtgatgcac

SEQ ID NO: 730018 - DNA, 20 bp, mouse
ggattgattcaatgtgtgca

SEQ ID NO: 730019 - DNA, 20 bp, mouse
gaggctgaggaaagagaaag

SEQ ID NO: 730020 - DNA, 20 bp, mouse
gggtgagagagacaaccttt

SEQ ID NO: 730021 - DNA, 20 bp, mouse
gcagactaatgcagtgcctc

SEQ ID NO: 730022 - DNA, 20 bp, mouse
gtgcattagtctgtgcccaa

SEQ ID NO: 730023 - DNA, 20 bp, mouse
gggaaagagaaagtggcaca

SEQ ID NO: 730024 - DNA, 20 bp, mouse
gacacattgaatcaatccac

SEQ ID NO: 730025 - DNA, 20 bp, mouse
gtagaaataacatatgtggg

SEQ ID NO: 730026 - DNA, 20 bp, mouse
gtgtacccatagggacctca

SEQ ID NO: 730027 - DNA, 20 bp, mouse
gttaaccctgaggtccctat

SEQ ID NO: 730028 - DNA, 20 bp, mouse
gtccagaggttcatggtgtt

SEQ ID NO: 730029 - DNA, 20 bp, mouse
gccattagaaataactaagg

SEQ ID NO: 730030 - DNA, 20 bp, mouse
ggaacctctggagcttcagc

SEQ ID NO: 730031 - DNA, 20 bp, mouse
ggctcacatgtttaaccctg

SEQ ID NO: 730032 - DNA, 20 bp, mouse
ggcaaaattaccatgaaaag

SEQ ID NO: 730033 - DNA, 20 bp, mouse
gtgtagcatttgtacccata

SEQ ID NO: 730034 - DNA, 20 bp, mouse
gagaggttcatggtgtttgg

SEQ ID NO: 730035 - DNA, 20 bp, mouse
gcatccattagaaataacta

SEQ ID NO: 730036 - DNA, 20 bp, mouse
gcccaacctggtcctgacat

SEQ ID NO: 730037 - DNA, 20 bp, mouse
gggctccccacagacttatg

SEQ ID NO: 730038 - DNA, 20 bp, mouse
gttccacccacaatcggggt

SEQ ID NO: 730039 - DNA, 20 bp, mouse
gaggttggggggcttctttc

SEQ ID NO: 730040 - DNA, 20 bp, mouse
gcataggaaacacctaatta

SEQ ID NO: 730041 - DNA, 20 bp, mouse
gagggttccacccacaatcg

SEQ ID NO: 730042 - DNA, 20 bp, mouse
gaggtgagggacctggccca

SEQ ID NO: 730043 - DNA, 20 bp, mouse
gtatcataggtcaagtagag

SEQ ID NO: 730044 - DNA, 20 bp, mouse
ggtgttctctttagctcagg

SEQ ID NO: 730045 - DNA, 20 bp, mouse
gtgcagaggtcacaaggtga

SEQ ID NO: 730046 - DNA, 20 bp, mouse
gcccctaggggcgggcaagg

SEQ ID NO: 730047 - DNA, 20 bp, mouse
gaagagtggactggccacca

SEQ ID NO: 730048 - DNA, 20 bp, mouse
gtagcctccacccctagggg

SEQ ID NO: 730049 - DNA, 20 bp, mouse
gagcctagcctccaccccta

SEQ ID NO: 730050 - DNA, 20 bp, mouse
gttcttgccagagtgccccc

SEQ ID NO: 730051 - DNA, 20 bp, mouse
gctcctgacccattccagga

SEQ ID NO: 730052 - DNA, 20 bp, mouse
ggggacaaacatatcagtga

SEQ ID NO: 730053 - DNA, 20 bp, mouse
gggaccagctagatgtacat

SEQ ID NO: 730054 - DNA, 20 bp, mouse
gacaaacatatcagtgatgg

SEQ ID NO: 730055 - DNA, 20 bp, mouse
gcaggataatagggtaggga

SEQ ID NO: 730056 - DNA, 20 bp, mouse
gccgccacgctgtccaccgg

SEQ ID NO: 730057 - DNA, 20 bp, mouse
gcgcggaccgtagagtatta

SEQ ID NO: 730058 - DNA, 20 bp, mouse
gcggcggctcagagacttcg

SEQ ID NO: 730059 - DNA, 20 bp, mouse
gactcagccctaatactcta

SEQ ID NO: 730060 - DNA, 20 bp, mouse
gactctacggtccgcgtcgt

SEQ ID NO: 730061 - DNA, 20 bp, mouse
ggcggcgaccgggaaagcgt

SEQ ID NO: 730062 - DNA, 20 bp, mouse
gttcccccgtggccccccct

SEQ ID NO: 730063 - DNA, 20 bp, mouse
gtgggaagccaaaggggcga

SEQ ID NO: 730064 - DNA, 20 bp, mouse
gcctgccgactcctccagac

SEQ ID NO: 730065 - DNA, 20 bp, mouse
gaggagtcggcaggcgatca

SEQ ID NO: 730066 - DNA, 20 bp, mouse
gggaagaaccgcccagtgcc

SEQ ID NO: 730067 - DNA, 20 bp, mouse
gtacagactcgggaaagggg

SEQ ID NO: 730068 - DNA, 20 bp, mouse
gcctgcgcacaccgggcact

SEQ ID NO: 730069 - DNA, 20 bp, mouse
gccgtcgatgcgccgaacct

SEQ ID NO: 730070 - DNA, 20 bp, mouse
gcgcagagcgttggtttcct

SEQ ID NO: 730071 - DNA, 20 bp, mouse
gagaccgagagcttacaaga

SEQ ID NO: 730072 - DNA, 20 bp, mouse
gcggtccccgagcgggtctc

SEQ ID NO: 730073 - DNA, 20 bp, mouse
gcccgccccgagacccgctc

SEQ ID NO: 730074 - DNA, 20 bp, mouse
gttggctcggggacagacag

SEQ ID NO: 730075 - DNA, 20 bp, mouse
gcccggggcgcggctaaatg

SEQ ID NO: 730076 - DNA, 20 bp, mouse
ggcgcggcgcagcatggcgg

SEQ ID NO: 730077 - DNA, 20 bp, mouse
gtgcctgcatggttcccaga

SEQ ID NO: 730078 - DNA, 20 bp, mouse
gctgccggggaaacgacgtt

SEQ ID NO: 730079 - DNA, 20 bp, mouse
gaacccgggggatagttctg

SEQ ID NO: 730080 - DNA, 20 bp, mouse
gcgccctaccaggctctgat

SEQ ID NO: 730081 - DNA, 20 bp, mouse
gagccaggctccgccctacc

SEQ ID NO: 730082 - DNA, 20 bp, mouse
ggcgatgccggtgacatgtg

SEQ ID NO: 730083 - DNA, 20 bp, mouse
gagcctggtagggcggagcc

SEQ ID NO: 730084 - DNA, 20 bp, mouse
gggcgtagggtgcggcgcaa

SEQ ID NO: 730085 - DNA, 20 bp, mouse
gggtaagccccacatgtcac

SEQ ID NO: 730086 - DNA, 20 bp, mouse
gtctcagcgagtccaatcca

SEQ ID NO: 730087 - DNA, 20 bp, mouse
ggggcgcgggagtagagcgc

SEQ ID NO: 730088 - DNA, 20 bp, mouse
gcggccgcacgtgatggaca

SEQ ID NO: 730089 - DNA, 20 bp, mouse
gcgggagtagagcgcagggg

SEQ ID NO: 730090 - DNA, 20 bp, mouse
ggcggggcgcgcggtgaagg

SEQ ID NO: 730091 - DNA, 20 bp, mouse
gcactacagagcaaagcgat

SEQ ID NO: 730092 - DNA, 20 bp, mouse
gtgaaggcggagagaccccg

SEQ ID NO: 730093 - DNA, 20 bp, mouse
ggccgcggggcgcgcggtga

SEQ ID NO: 730094 - DNA, 20 bp, mouse
gggaggggtgggcccaagag

SEQ ID NO: 730095 - DNA, 20 bp, mouse
gaccccgcggccgcacgtga

SEQ ID NO: 730096 - DNA, 20 bp, mouse
gtccagggatgagatggacc

SEQ ID NO: 730097 - DNA, 20 bp, mouse
ggaaagctacagtagaatcc

SEQ ID NO: 730098 - DNA, 20 bp, mouse
gtctgaaacgcaactgaagt

SEQ ID NO: 730099 - DNA, 20 bp, mouse
gcagaagcacttggggccaa

SEQ ID NO: 730100 - DNA, 20 bp, mouse
gtccaggtccatctcatccc

SEQ ID NO: 730101 - DNA, 20 bp, mouse
gttggggccaagggacgatg

SEQ ID NO: 730102 - DNA, 20 bp, mouse
gtgctggcacagaagcactt

SEQ ID NO: 730103 - DNA, 20 bp, mouse
gacactgtgagaaaccgcgc

SEQ ID NO: 730104 - DNA, 20 bp, mouse
gttctcacagtgtataggtt

SEQ ID NO: 730105 - DNA, 20 bp, mouse
gctctcaggcctcactttgc

SEQ ID NO: 730106 - DNA, 20 bp, mouse
gtggcacgtgactgtatcag

SEQ ID NO: 730107 - DNA, 20 bp, mouse
gcccagggggcaatttttat

SEQ ID NO: 730108 - DNA, 20 bp, mouse
gactgtatcaggggaacttc

SEQ ID NO: 730109 - DNA, 20 bp, mouse
ggcctccaagcaaagttctg

SEQ ID NO: 730110 - DNA, 20 bp, mouse
ggtgacaaaaggccgattaa

SEQ ID NO: 730111 - DNA, 20 bp, mouse
gcgggtctgaattgcccagg

SEQ ID NO: 730112 - DNA, 20 bp, mouse
gtatagttctgcagtacctc

SEQ ID NO: 730113 - DNA, 20 bp, mouse
gccctcagaactttgcttgg

SEQ ID NO: 730114 - DNA, 20 bp, mouse
gaggcgggtctgaattgccc

SEQ ID NO: 730115 - DNA, 20 bp, mouse
gtctccctcagaactttgct

SEQ ID NO: 730116 - DNA, 20 bp, mouse
gtggctgaaacgtaggtgtg

SEQ ID NO: 730117 - DNA, 20 bp, mouse
ggcactcgagactcgaacgt

SEQ ID NO: 730118 - DNA, 20 bp, mouse
gagccaccggcggagaggaa

SEQ ID NO: 730119 - DNA, 20 bp, mouse
gacagcggcccagccaccgg

SEQ ID NO: 730120 - DNA, 20 bp, mouse
ggaagggctggctgaaacgt

SEQ ID NO: 730121 - DNA, 20 bp, mouse
gcggacagcggcccagccac

SEQ ID NO: 730122 - DNA, 20 bp, mouse
gcgtgcgaacccaagaggcg

SEQ ID NO: 730123 - DNA, 20 bp, mouse
gtaagggcgggcagataggg

SEQ ID NO: 730124 - DNA, 20 bp, mouse
gagcccttcctctccgccgg

SEQ ID NO: 730125 - DNA, 20 bp, mouse
gctgacccggcgcccagggg

SEQ ID NO: 730126 - DNA, 20 bp, mouse
gtccccgctgctgccctcga

SEQ ID NO: 730127 - DNA, 20 bp, mouse
gaaggcgtgcatcccaaccg

SEQ ID NO: 730128 - DNA, 20 bp, mouse
ggcgtgcatcccaaccgagg

SEQ ID NO: 730129 - DNA, 20 bp, mouse
gcccgccctccccctcggtt

SEQ ID NO: 730130 - DNA, 20 bp, mouse
gcggccgcccgctttctcct

SEQ ID NO: 730131 - DNA, 20 bp, mouse
gaccacgcggcgggaactcg

SEQ ID NO: 730132 - DNA, 20 bp, mouse
gggttctggaaggcacgcga

SEQ ID NO: 730133 - DNA, 20 bp, mouse
ggcggggacactgcgacaca

SEQ ID NO: 730134 - DNA, 20 bp, mouse
gccccattggccacaccgga

SEQ ID NO: 730135 - DNA, 20 bp, mouse
ggcgagcccgccctccccct

SEQ ID NO: 730136 - DNA, 20 bp, mouse
ggaggaaagaagtgtcttta

SEQ ID NO: 730137 - DNA, 20 bp, mouse
gtatgaggcctgcactggag

SEQ ID NO: 730138 - DNA, 20 bp, mouse
ggggcgatctggaaataatt

SEQ ID NO: 730139 - DNA, 20 bp, mouse
gttggcaaaaaaatgttccc

SEQ ID NO: 730140 - DNA, 20 bp, mouse
gttgggtgggtagggatgaa

SEQ ID NO: 730141 - DNA, 20 bp, mouse
ggtaagtgactacatcataa

SEQ ID NO: 730142 - DNA, 20 bp, mouse
gttaggggagcagaagaata

SEQ ID NO: 730143 - DNA, 20 bp, mouse
gaacaaaatcgcccaaagtc

SEQ ID NO: 730144 - DNA, 20 bp, mouse
gctgactatgaggcctgcac

SEQ ID NO: 730145 - DNA, 20 bp, mouse
gccaaggacaggaatgcttt

SEQ ID NO: 730146 - DNA, 20 bp, mouse
ggggaccagaataactctca

SEQ ID NO: 730147 - DNA, 20 bp, mouse
gtccagcaggtgaacagggt

SEQ ID NO: 730148 - DNA, 20 bp, mouse
gtctacttcagcaccccaat

SEQ ID NO: 730149 - DNA, 20 bp, mouse
gctctcaaggcttgagtctg

SEQ ID NO: 730150 - DNA, 20 bp, mouse
gagagagtaagtactgagca

SEQ ID NO: 730151 - DNA, 20 bp, mouse
gttactctctaccaactcta

SEQ ID NO: 730152 - DNA, 20 bp, mouse
gaataccaatattgggaagc

SEQ ID NO: 730153 - DNA, 20 bp, mouse
gatggtaaaccctgaggtcg

SEQ ID NO: 730154 - DNA, 20 bp, mouse
gccgccctgcttcccaatat

SEQ ID NO: 730155 - DNA, 20 bp, mouse
gtaggagaggctgcttgggg

SEQ ID NO: 730156 - DNA, 20 bp, mouse
gggagcgcgccgaacccgcg

SEQ ID NO: 730157 - DNA, 20 bp, mouse
gtcggcgcgctccaggtgga

SEQ ID NO: 730158 - DNA, 20 bp, mouse
gaacacgcgcgcgttcccat

SEQ ID NO: 730159 - DNA, 20 bp, mouse
gcccggcccgccgagcgttc

SEQ ID NO: 730160 - DNA, 20 bp, mouse
gcccgcgcctgcgcaatgga

SEQ ID NO: 730161 - DNA, 20 bp, mouse
gcggggcccgtccattgcgc

SEQ ID NO: 730162 - DNA, 20 bp, mouse
gccgaggcgacggttgggga

SEQ ID NO: 730163 - DNA, 20 bp, mouse
gttcccaaagggagcccgaa

SEQ ID NO: 730164 - DNA, 20 bp, mouse
gcgcagtccggaacgctcgg

SEQ ID NO: 730165 - DNA, 20 bp, mouse
ggggttcggcgcgctccagg

SEQ ID NO: 730166 - DNA, 20 bp, mouse
ggggcctggttcctgagtca

SEQ ID NO: 730167 - DNA, 20 bp, mouse
gcatggtagcagatcgtgga

SEQ ID NO: 730168 - DNA, 20 bp, mouse
gcggggaggagcgggacccc

SEQ ID NO: 730169 - DNA, 20 bp, mouse
ggcccgcagccactccttta

SEQ ID NO: 730170 - DNA, 20 bp, mouse
gtcccccctcaagatgagca

SEQ ID NO: 730171 - DNA, 20 bp, mouse
gacgtcatggtagcagatcg

SEQ ID NO: 730172 - DNA, 20 bp, mouse
ggctccctgctcatcttgag

SEQ ID NO: 730173 - DNA, 20 bp, mouse
gtcctactcctgcagaaatg

SEQ ID NO: 730174 - DNA, 20 bp, mouse
gtctgcgggcgaatacccta

SEQ ID NO: 730175 - DNA, 20 bp, mouse
gcaattagggatgtatctgc

SEQ ID NO: 730176 - DNA, 20 bp, mouse
gagaaccctggctgtaatca

SEQ ID NO: 730177 - DNA, 20 bp, mouse
gatcccgccaagcagaaccc

SEQ ID NO: 730178 - DNA, 20 bp, mouse
gaccaccctgattacagcca

SEQ ID NO: 730179 - DNA, 20 bp, mouse
gagtaatccagtgtcagata

SEQ ID NO: 730180 - DNA, 20 bp, mouse
ggggctgctttcctattcat

SEQ ID NO: 730181 - DNA, 20 bp, mouse
gaccctggctgtaatcaggg

SEQ ID NO: 730182 - DNA, 20 bp, mouse
gtcaatcactcccactgtca

SEQ ID NO: 730183 - DNA, 20 bp, mouse
gaacccggatgacatcacgc

SEQ ID NO: 730184 - DNA, 20 bp, mouse
gggaggtggtaaggaataac

SEQ ID NO: 730185 - DNA, 20 bp, mouse
ggaacccaataatacatttt

SEQ ID NO: 730186 - DNA, 20 bp, mouse
gccgccaatcggaactgtcc

SEQ ID NO: 730187 - DNA, 20 bp, mouse
ggtgcccgatgcccgaagcg

SEQ ID NO: 730188 - DNA, 20 bp, mouse
gagcgtggctccttgcgatt

SEQ ID NO: 730189 - DNA, 20 bp, mouse
gaatcggaactgtccaggtg

SEQ ID NO: 730190 - DNA, 20 bp, mouse
ggcacccaatggagacgcat

SEQ ID NO: 730191 - DNA, 20 bp, mouse
ggggaccgcagcccgccaat

SEQ ID NO: 730192 - DNA, 20 bp, mouse
gggtcccggggaaccacttc

SEQ ID NO: 730193 - DNA, 20 bp, mouse
gcccccgcccgcaagcagtg

SEQ ID NO: 730194 - DNA, 20 bp, mouse
ggacctgcgcgcggcttagt

SEQ ID NO: 730195 - DNA, 20 bp, mouse
gcccaatggagacgcatggg

SEQ ID NO: 730196 - DNA, 20 bp, mouse
gcaccgcccaagctgagtcc

SEQ ID NO: 730197 - DNA, 20 bp, mouse
gctaatgacagcacggggtg

SEQ ID NO: 730198 - DNA, 20 bp, mouse
gggtgcgctaatgacagcac

SEQ ID NO: 730199 - DNA, 20 bp, mouse
gactcagcttgggcggtgga

SEQ ID NO: 730200 - DNA, 20 bp, mouse
gcaccaggactcagcttggg

SEQ ID NO: 730201 - DNA, 20 bp, mouse
ggcgcaccaggactcagctt

SEQ ID NO: 730202 - DNA, 20 bp, mouse
gctctgcagctgatccaacc

SEQ ID NO: 730203 - DNA, 20 bp, mouse
gtgtgcgcttctgtgtccgc

SEQ ID NO: 730204 - DNA, 20 bp, mouse
gtgcggcggcagcgtcagag

SEQ ID NO: 730205 - DNA, 20 bp, mouse
gggagcagaggccattgatg

SEQ ID NO: 730206 - DNA, 20 bp, mouse
gtgagcaggggaggcaccgc

SEQ ID NO: 730207 - DNA, 20 bp, mouse
gggtgcctcccctgctcaga

SEQ ID NO: 730208 - DNA, 20 bp, mouse
gagcagcaaaaggtctttga

SEQ ID NO: 730209 - DNA, 20 bp, mouse
gggctcgggctgggccccct

SEQ ID NO: 730210 - DNA, 20 bp, mouse
ggctgccctctgagcagggg

SEQ ID NO: 730211 - DNA, 20 bp, mouse
ggctgctgccctctgagcag

SEQ ID NO: 730212 - DNA, 20 bp, mouse
gcagtgctgctgtgttgtga

SEQ ID NO: 730213 - DNA, 20 bp, mouse
ggctgtgttgtgagggaact

SEQ ID NO: 730214 - DNA, 20 bp, mouse
gcccggctcgcacatctggg

SEQ ID NO: 730215 - DNA, 20 bp, mouse
gcaccctcccccaggccgga

SEQ ID NO: 730216 - DNA, 20 bp, mouse
gagtaagctcgcagcgtttt

SEQ ID NO: 730217 - DNA, 20 bp, mouse
gcacgaaggcccaacaaacc

SEQ ID NO: 730218 - DNA, 20 bp, mouse
ggtagatggagtcattgctg

SEQ ID NO: 730219 - DNA, 20 bp, mouse
gatgctaaggggacttcgga

SEQ ID NO: 730220 - DNA, 20 bp, mouse
gtggaatgctaaggggactt

SEQ ID NO: 730221 - DNA, 20 bp, mouse
gacagccggcgactaggggg

SEQ ID NO: 730222 - DNA, 20 bp, mouse
gggcaccgccccctagtcgc

SEQ ID NO: 730223 - DNA, 20 bp, mouse
gaatacaacgcggtgaggcg

SEQ ID NO: 730224 - DNA, 20 bp, mouse
ggcgcgacagccggcgacta

SEQ ID NO: 730225 - DNA, 20 bp, mouse
gcagaggtggggtctccggt

SEQ ID NO: 730226 - DNA, 20 bp, mouse
ggggagcccggcgtaaacgc

SEQ ID NO: 730227 - DNA, 20 bp, mouse
gatgaacggcgctcaggaga

SEQ ID NO: 730228 - DNA, 20 bp, mouse
gaacggcgctcaggagaggg

SEQ ID NO: 730229 - DNA, 20 bp, mouse
ggaggccggtgtggggccga

SEQ ID NO: 730230 - DNA, 20 bp, mouse
ggcctcgtgaagccggaaag

SEQ ID NO: 730231 - DNA, 20 bp, mouse
gtcccattggctctgatgaa

SEQ ID NO: 730232 - DNA, 20 bp, mouse
ggccgggctcccaaggagcg

SEQ ID NO: 730233 - DNA, 20 bp, mouse
ggggcctggaggccggtgtg

SEQ ID NO: 730234 - DNA, 20 bp, mouse
gtctcaccaggcgttcccat

SEQ ID NO: 730235 - DNA, 20 bp, mouse
gggtctgctcaagctcaagc

SEQ ID NO: 730236 - DNA, 20 bp, mouse
gtactaaggcctgtgtggaa

SEQ ID NO: 730237 - DNA, 20 bp, mouse
gcgcccccaggcatctccct

SEQ ID NO: 730238 - DNA, 20 bp, mouse
gtccctgggtctcctaaact

SEQ ID NO: 730239 - DNA, 20 bp, mouse
gctatggcgacgcattacta

SEQ ID NO: 730240 - DNA, 20 bp, mouse
gttggagaggatcacgtcac

SEQ ID NO: 730241 - DNA, 20 bp, mouse
gctctggatggaaccagatt

SEQ ID NO: 730242 - DNA, 20 bp, mouse
gctctccaatcgcgttacaa

SEQ ID NO: 730243 - DNA, 20 bp, mouse
gactgccattgtaacgcgat

SEQ ID NO: 730244 - DNA, 20 bp, mouse
gcgcacagttctgaatatgg

SEQ ID NO: 730245 - DNA, 20 bp, mouse
ggtacacaacaccgagctag

SEQ ID NO: 730246 - DNA, 20 bp, mouse
ggcaacttcggggtccctgt

SEQ ID NO: 730247 - DNA, 20 bp, mouse
gtggggttcgctagagagta

SEQ ID NO: 730248 - DNA, 20 bp, mouse
ggtgctgggtggtgagagtg

SEQ ID NO: 730249 - DNA, 20 bp, mouse
ggctgctattgacactgttg

SEQ ID NO: 730250 - DNA, 20 bp, mouse
gcggaggcgacgcaacttcg

SEQ ID NO: 730251 - DNA, 20 bp, mouse
gagctcctgaaggtgctggg

SEQ ID NO: 730252 - DNA, 20 bp, mouse
gtctcaagagaggcgggata

SEQ ID NO: 730253 - DNA, 20 bp, mouse
ggtcagctcctgaaggtgct

SEQ ID NO: 730254 - DNA, 20 bp, mouse
gcgttgggcaggggcgcctg

SEQ ID NO: 730255 - DNA, 20 bp, mouse
gtctgcgtccgccatcctgt

SEQ ID NO: 730256 - DNA, 20 bp, mouse
gcgcccccaggcatctccct

SEQ ID NO: 730257 - DNA, 20 bp, mouse
gtccctgggtctcctaaact

SEQ ID NO: 730258 - DNA, 20 bp, mouse
gttggagaggatcacgtcac

SEQ ID NO: 730259 - DNA, 20 bp, mouse
gtactaaggcctgtgtggaa

SEQ ID NO: 730260 - DNA, 20 bp, mouse
gcgcacagttctgaatatgg

SEQ ID NO: 730261 - DNA, 20 bp, mouse
gtcaaagttgccgggagggg

SEQ ID NO: 730262 - DNA, 20 bp, mouse
gactgccattgtaacgcgat

SEQ ID NO: 730263 - DNA, 20 bp, mouse
gcaggctcaaagttgccggg

SEQ ID NO: 730264 - DNA, 20 bp, mouse
gctctccaatcgcgttacaa

SEQ ID NO: 730265 - DNA, 20 bp, mouse
ggggtctcctaaacttggcg

SEQ ID NO: 730266 - DNA, 20 bp, mouse
ggcaaagagaacgggaaagg

SEQ ID NO: 730267 - DNA, 20 bp, mouse
gccagtgcctccagccgctt

SEQ ID NO: 730268 - DNA, 20 bp, mouse
gggaaagggggctttcacac

SEQ ID NO: 730269 - DNA, 20 bp, mouse
gcgcgcggaggcagcacgga

SEQ ID NO: 730270 - DNA, 20 bp, mouse
gtgggtgaggggcggttcca

SEQ ID NO: 730271 - DNA, 20 bp, mouse
gcccgctacaggaacagcag

SEQ ID NO: 730272 - DNA, 20 bp, mouse
ggccccgggagccgagtcag

SEQ ID NO: 730273 - DNA, 20 bp, mouse
gggcggcacccgacaccgaa

SEQ ID NO: 730274 - DNA, 20 bp, mouse
gggtacagaaaccctttcgg

SEQ ID NO: 730275 - DNA, 20 bp, mouse
gccgcccgctccaacccgtc

SEQ ID NO: 730276 - DNA, 20 bp, mouse
gcgggagtgagacagttctt

SEQ ID NO: 730277 - DNA, 20 bp, mouse
gcagctcagggaggattgtg

SEQ ID NO: 730278 - DNA, 20 bp, mouse
gtcagtggcccacttcgcgt

SEQ ID NO: 730279 - DNA, 20 bp, mouse
ggaggcggagaagatctcga

SEQ ID NO: 730280 - DNA, 20 bp, mouse
ggaagtctggcgtcacgtcc

SEQ ID NO: 730281 - DNA, 20 bp, mouse
gggaggcgccctgcagctca

SEQ ID NO: 730282 - DNA, 20 bp, mouse
gaagcggtccgacgcgaagt

SEQ ID NO: 730283 - DNA, 20 bp, mouse
gaggaaccgtgaaaggaagt

SEQ ID NO: 730284 - DNA, 20 bp, mouse
gactgccggaagtccctccg

SEQ ID NO: 730285 - DNA, 20 bp, mouse
gccagacttcgtcagacggg

SEQ ID NO: 730286 - DNA, 20 bp, mouse
gtgggggcggcgaaccgcag

SEQ ID NO: 730287 - DNA, 20 bp, mouse
gaaccgcagtggagactagg

SEQ ID NO: 730288 - DNA, 20 bp, mouse
gaggccggcggtgagatccc

SEQ ID NO: 730289 - DNA, 20 bp, mouse
gccccaaccggcagttactg

SEQ ID NO: 730290 - DNA, 20 bp, mouse
gccgcccagcctcagccgac

SEQ ID NO: 730291 - DNA, 20 bp, mouse
ggcgaaccgcagtggagact

SEQ ID NO: 730292 - DNA, 20 bp, mouse
gcccgggaggcgcgagccac

SEQ ID NO: 730293 - DNA, 20 bp, mouse
gggaggcgcgagccaccggt

SEQ ID NO: 730294 - DNA, 20 bp, mouse
ggcgagccaccggtcggctg

SEQ ID NO: 730295 - DNA, 20 bp, mouse
gtcccgtcagcgctcggcaa

SEQ ID NO: 730296 - DNA, 20 bp, mouse
ggtagcaatgacgtgagttg

SEQ ID NO: 730297 - DNA, 20 bp, mouse
ggccccccgggctgactcat

SEQ ID NO: 730298 - DNA, 20 bp, mouse
gtaccggcggaaacggtctc

SEQ ID NO: 730299 - DNA, 20 bp, mouse
gacagaaaaggagaccccga

SEQ ID NO: 730300 - DNA, 20 bp, mouse
gggctactggtcattcttaa

SEQ ID NO: 730301 - DNA, 20 bp, mouse
gggctgctgccgattcgaag

SEQ ID NO: 730302 - DNA, 20 bp, mouse
ggctgtggggagggtatata

SEQ ID NO: 730303 - DNA, 20 bp, mouse
gggaggaggccgcttcgaat

SEQ ID NO: 730304 - DNA, 20 bp, mouse
gggcggatgctgcctctcat

SEQ ID NO: 730305 - DNA, 20 bp, mouse
gaggacgcggggaatcgagg

SEQ ID NO: 730306 - DNA, 20 bp, mouse
gcggggagaaggcgggacct

SEQ ID NO: 730307 - DNA, 20 bp, mouse
ggtcgtgcgtcatcgcgagg

SEQ ID NO: 730308 - DNA, 20 bp, mouse
gcgggccgttcccagagcgg

SEQ ID NO: 730309 - DNA, 20 bp, mouse
ggcaagggctggtcgtccat

SEQ ID NO: 730310 - DNA, 20 bp, mouse
gcgtcatcgcgaggcggggc

SEQ ID NO: 730311 - DNA, 20 bp, mouse
gtcgcgatgacgcacgaccg

SEQ ID NO: 730312 - DNA, 20 bp, mouse
gcccggggtcccaagaggta

SEQ ID NO: 730313 - DNA, 20 bp, mouse
gaaggcgggtacctccgcga

SEQ ID NO: 730314 - DNA, 20 bp, mouse
gtgaaagttccagaacgccg

SEQ ID NO: 730315 - DNA, 20 bp, mouse
gggggcggcacccttctgga

SEQ ID NO: 730316 - DNA, 20 bp, mouse
ggccactagcatgagtaaaa

SEQ ID NO: 730317 - DNA, 20 bp, mouse
gtctcaggctgcagttatta

SEQ ID NO: 730318 - DNA, 20 bp, mouse
ggctagtggcacaaagatgc

SEQ ID NO: 730319 - DNA, 20 bp, mouse
gaccccaccaacacagtttt

SEQ ID NO: 730320 - DNA, 20 bp, mouse
ggacttaccaaaaactgtgt

SEQ ID NO: 730321 - DNA, 20 bp, mouse
gtagcatgagtaaaagggct

SEQ ID NO: 730322 - DNA, 20 bp, mouse
gcctgcagcacccatctaga

SEQ ID NO: 730323 - DNA, 20 bp, mouse
gagattacgtccatctagat

SEQ ID NO: 730324 - DNA, 20 bp, mouse
gtttaaacagttgcaatctc

SEQ ID NO: 730325 - DNA, 20 bp, mouse
gagattttaaatatgggcct

SEQ ID NO: 730326 - DNA, 20 bp, mouse
gtgtccgctgctcccgggat

SEQ ID NO: 730327 - DNA, 20 bp, mouse
gggcggcgtgcgccgatccc

SEQ ID NO: 730328 - DNA, 20 bp, mouse
gggaaaccgtgatgagagaa

SEQ ID NO: 730329 - DNA, 20 bp, mouse
ggaagcccgctcttctgctg

SEQ ID NO: 730330 - DNA, 20 bp, mouse
gtgtccggagcggagaacgc

SEQ ID NO: 730331 - DNA, 20 bp, mouse
gtcggacagtcccggtcctt

SEQ ID NO: 730332 - DNA, 20 bp, mouse
gttaatgctgagaggcgtgc

SEQ ID NO: 730333 - DNA, 20 bp, mouse
ggggcgcctcagcagaagag

SEQ ID NO: 730334 - DNA, 20 bp, mouse
gttcaacgattaatgctgag

SEQ ID NO: 730335 - DNA, 20 bp, mouse
gctacgtgtccgctgctccc

SEQ ID NO: 730336 - DNA, 20 bp, mouse
ggacactgctggctgaaggg

SEQ ID NO: 730337 - DNA, 20 bp, mouse
gcctccccctaagcttgcaa

SEQ ID NO: 730338 - DNA, 20 bp, mouse
gcgccccctttgcaagctta

SEQ ID NO: 730339 - DNA, 20 bp, mouse
ggtgtcctaaacccgacagt

SEQ ID NO: 730340 - DNA, 20 bp, mouse
gactgctggctgaagggcgg

SEQ ID NO: 730341 - DNA, 20 bp, mouse
gacggcgtaataccggtagc

SEQ ID NO: 730342 - DNA, 20 bp, mouse
gtggagcgattcccactgtc

SEQ ID NO: 730343 - DNA, 20 bp, mouse
gacaaatgacggcgtaatac

SEQ ID NO: 730344 - DNA, 20 bp, mouse
ggtcgggtttaggacactgc

SEQ ID NO: 730345 - DNA, 20 bp, mouse
ggaaccagaaggaggcccgt

SEQ ID NO: 730346 - DNA, 20 bp, mouse
gcggagcccctgccaggaga

SEQ ID NO: 730347 - DNA, 20 bp, mouse
ggaaagacgcgcaagtgagg

SEQ ID NO: 730348 - DNA, 20 bp, mouse
gcgtgtgcgtgcccgcgcga

SEQ ID NO: 730349 - DNA, 20 bp, mouse
gcaatgtaaaggtagtcctg

SEQ ID NO: 730350 - DNA, 20 bp, mouse
ggggcctccaagagatctcg

SEQ ID NO: 730351 - DNA, 20 bp, mouse
gtgcgcggggccggcatgag

SEQ ID NO: 730352 - DNA, 20 bp, mouse
gcaagtgaggtggcgcttct

SEQ ID NO: 730353 - DNA, 20 bp, mouse
gtctaggcggagcccctgcc

SEQ ID NO: 730354 - DNA, 20 bp, mouse
ggtgaggtggcgcttctagg

SEQ ID NO: 730355 - DNA, 20 bp, mouse
gggtcgcaggaagggtgaaa

SEQ ID NO: 730356 - DNA, 20 bp, mouse
gacagctgaagggtgtgcag

SEQ ID NO: 730357 - DNA, 20 bp, mouse
ggggcctggtaggacagctg

SEQ ID NO: 730358 - DNA, 20 bp, mouse
ggtgcagaggaggggactta

SEQ ID NO: 730359 - DNA, 20 bp, mouse
gggcccctgcgacagctgaa

SEQ ID NO: 730360 - DNA, 20 bp, mouse
gcacccttcagctgtcgcag

SEQ ID NO: 730361 - DNA, 20 bp, mouse
gagtctagagtgcagctatg

SEQ ID NO: 730362 - DNA, 20 bp, mouse
gagaaggacaaagggtgatg

SEQ ID NO: 730363 - DNA, 20 bp, mouse
ggaccctcagctgtcctacc

SEQ ID NO: 730364 - DNA, 20 bp, mouse
gggcaaggagaggcctagtt

SEQ ID NO: 730365 - DNA, 20 bp, mouse
gccagggctcagtcagagtg

SEQ ID NO: 730366 - DNA, 20 bp, mouse
gctgcctggcccacttgtac

SEQ ID NO: 730367 - DNA, 20 bp, mouse
gtgactcggcaaaatgagat

SEQ ID NO: 730368 - DNA, 20 bp, mouse
gttgtgttttggggtgaaca

SEQ ID NO: 730369 - DNA, 20 bp, mouse
gtggggtgaacaaggcagac

SEQ ID NO: 730370 - DNA, 20 bp, mouse
gtgcaagtgcgatccctgcc

SEQ ID NO: 730371 - DNA, 20 bp, mouse
ggctcacagcctgtacaagt

SEQ ID NO: 730372 - DNA, 20 bp, mouse
gctgcctgaaaattccattc

SEQ ID NO: 730373 - DNA, 20 bp, mouse
gacgctcccttagccttggc

SEQ ID NO: 730374 - DNA, 20 bp, mouse
ggaagactgtgcaacttcag

SEQ ID NO: 730375 - DNA, 20 bp, mouse
gagctaaatgcaactcgcag

SEQ ID NO: 730376 - DNA, 20 bp, mouse
ggggaagctaaaagtctagg

SEQ ID NO: 730377 - DNA, 20 bp, mouse
gtgcccggaaaaggacacca

SEQ ID NO: 730378 - DNA, 20 bp, mouse
gcccctgcggcgggcctctc

SEQ ID NO: 730379 - DNA, 20 bp, mouse
gttggagggcccaaactgtg

SEQ ID NO: 730380 - DNA, 20 bp, mouse
gcctgctggatgcccggaaa

SEQ ID NO: 730381 - DNA, 20 bp, mouse
gctggcggagatggattaag

SEQ ID NO: 730382 - DNA, 20 bp, mouse
ggcacccatgccaggcagtc

SEQ ID NO: 730383 - DNA, 20 bp, mouse
gaggcagacccttataggtg

SEQ ID NO: 730384 - DNA, 20 bp, mouse
gctaggaggcagacccttat

SEQ ID NO: 730385 - DNA, 20 bp, mouse
gaagtctcccgcccaatctc

SEQ ID NO: 730386 - DNA, 20 bp, mouse
gaacagaaggagccctgtgt

SEQ ID NO: 730387 - DNA, 20 bp, mouse
gcgagaggaggtggttatat

SEQ ID NO: 730388 - DNA, 20 bp, mouse
gggcaggaggcagaagccta

SEQ ID NO: 730389 - DNA, 20 bp, mouse
gatatggggaggtgaagatc

SEQ ID NO: 730390 - DNA, 20 bp, mouse
gctgcccagcatcagaatcc

SEQ ID NO: 730391 - DNA, 20 bp, mouse
gtcagcccatgccttaattt

SEQ ID NO: 730392 - DNA, 20 bp, mouse
gcacaccttcaggaactcgc

SEQ ID NO: 730393 - DNA, 20 bp, mouse
gacctcctctcgctctccca

SEQ ID NO: 730394 - DNA, 20 bp, mouse
gaataatggctggagataga

SEQ ID NO: 730395 - DNA, 20 bp, mouse
gcaggaactcgcaggttgat

SEQ ID NO: 730396 - DNA, 20 bp, mouse
gaacaactgggctctgggag

SEQ ID NO: 730397 - DNA, 20 bp, mouse
gggaggagagagtgcctgag

SEQ ID NO: 730398 - DNA, 20 bp, mouse
gcgggtccagccagcctctc

SEQ ID NO: 730399 - DNA, 20 bp, mouse
gtggctggacccggacgcca

SEQ ID NO: 730400 - DNA, 20 bp, mouse
ggggaggggccgtggcgtcc

SEQ ID NO: 730401 - DNA, 20 bp, mouse
gaagagagacagcccctcat

SEQ ID NO: 730402 - DNA, 20 bp, mouse
gtaaccctccgcctggctga

SEQ ID NO: 730403 - DNA, 20 bp, mouse
gaatccgctgagagaacaac

SEQ ID NO: 730404 - DNA, 20 bp, mouse
gttagtgccctgcggggcac

SEQ ID NO: 730405 - DNA, 20 bp, mouse
gtgcaagcgcctcctgtcac

SEQ ID NO: 730406 - DNA, 20 bp, mouse
ggccctctgatgtgagagaa

SEQ ID NO: 730407 - DNA, 20 bp, mouse
gaaggaggctatgaaggaac

SEQ ID NO: 730408 - DNA, 20 bp, mouse
gcaacggggttgaaaaggtc

SEQ ID NO: 730409 - DNA, 20 bp, mouse
ggatgtgagagaagggccca

SEQ ID NO: 730410 - DNA, 20 bp, mouse
ggggcgggtgcgaagaggaa

SEQ ID NO: 730411 - DNA, 20 bp, mouse
gaaaagctgcagcgcttgca

SEQ ID NO: 730412 - DNA, 20 bp, mouse
gcccaaccccccatccgggg

SEQ ID NO: 730413 - DNA, 20 bp, mouse
gctccccaaccccccatccg

SEQ ID NO: 730414 - DNA, 20 bp, mouse
gggcaaggaaaattgttctc

SEQ ID NO: 730415 - DNA, 20 bp, mouse
gttgagcaacggggttgaaa

SEQ ID NO: 730416 - DNA, 20 bp, mouse
gtggaggatccgactagaga

SEQ ID NO: 730417 - DNA, 20 bp, mouse
gaaacagcagacgctaaggg

SEQ ID NO: 730418 - DNA, 20 bp, mouse
gtgaaaggcggcgagcacgt

SEQ ID NO: 730419 - DNA, 20 bp, mouse
ggagaaacagcagacgctaa

SEQ ID NO: 730420 - DNA, 20 bp, mouse
gaggcggcgagcacgtgggc

SEQ ID NO: 730421 - DNA, 20 bp, mouse
gagtaggcacgccagccccg

SEQ ID NO: 730422 - DNA, 20 bp, mouse
ggcggcgccggttccggcag

SEQ ID NO: 730423 - DNA, 20 bp, mouse
gtggaatggcactgatgcca

SEQ ID NO: 730424 - DNA, 20 bp, mouse
ggccaagggaaccaacaagg

SEQ ID NO: 730425 - DNA, 20 bp, mouse
gcgccgccgcggtcacgtga

SEQ ID NO: 730426 - DNA, 20 bp, mouse
gaacaaaagcgcgaaatgta

SEQ ID NO: 730427 - DNA, 20 bp, mouse
gagctccgcctctgtcgact

SEQ ID NO: 730428 - DNA, 20 bp, mouse
ggaaaagaggcggggaatat

SEQ ID NO: 730429 - DNA, 20 bp, mouse
gtctaagcagcacctcttag

SEQ ID NO: 730430 - DNA, 20 bp, mouse
ggaaaggcctagaaaagagg

SEQ ID NO: 730431 - DNA, 20 bp, mouse
ggccgaaaggcctagaaaag

SEQ ID NO: 730432 - DNA, 20 bp, mouse
gaaggggcgtggcctacgca

SEQ ID NO: 730433 - DNA, 20 bp, mouse
gggggcctagtcgacagagg

SEQ ID NO: 730434 - DNA, 20 bp, mouse
gttgactgggacaggccgaa

SEQ ID NO: 730435 - DNA, 20 bp, mouse
gcggggcctatgcctgggag

SEQ ID NO: 730436 - DNA, 20 bp, mouse
gagcgtagggcggcgggaga

SEQ ID NO: 730437 - DNA, 20 bp, mouse
gtggcccaggaaccagcgta

SEQ ID NO: 730438 - DNA, 20 bp, mouse
gagctgaggcggctctggta

SEQ ID NO: 730439 - DNA, 20 bp, mouse
ggccccctctcacgctcggg

SEQ ID NO: 730440 - DNA, 20 bp, mouse
ggggccctgcaatctgcatg

SEQ ID NO: 730441 - DNA, 20 bp, mouse
gcgcagagctgaggcggctc

SEQ ID NO: 730442 - DNA, 20 bp, mouse
gaggaaccagcgtagggcgg

SEQ ID NO: 730443 - DNA, 20 bp, mouse
gaaggccccgcgcgtcccgt

SEQ ID NO: 730444 - DNA, 20 bp, mouse
gggccggaggcggaagaaaa

SEQ ID NO: 730445 - DNA, 20 bp, mouse
gacgcgcggggccttccgga

SEQ ID NO: 730446 - DNA, 20 bp, mouse
gggccggaggcggaagaaaa

SEQ ID NO: 730447 - DNA, 20 bp, mouse
ggccccctctcacgctcggg

SEQ ID NO: 730448 - DNA, 20 bp, mouse
gagcgtagggcggcgggaga

SEQ ID NO: 730449 - DNA, 20 bp, mouse
gtggcccaggaaccagcgta

SEQ ID NO: 730450 - DNA, 20 bp, mouse
gaaggccccgcgcgtcccgt

SEQ ID NO: 730451 - DNA, 20 bp, mouse
gcgcgcgtcccgtgggtgaa

SEQ ID NO: 730452 - DNA, 20 bp, mouse
gcggagccctcgccaccaat

SEQ ID NO: 730453 - DNA, 20 bp, mouse
ggccccccgagcgtgagagg

SEQ ID NO: 730454 - DNA, 20 bp, mouse
gcgcctccggccgcccgcgt

SEQ ID NO: 730455 - DNA, 20 bp, mouse
gagctgaggcggctctggta

SEQ ID NO: 730456 - DNA, 20 bp, mouse
ggggcggggcgtgcacggga

SEQ ID NO: 730457 - DNA, 20 bp, mouse
gcccccgaggcgccaagttc

SEQ ID NO: 730458 - DNA, 20 bp, mouse
ggggcctcatcccacatcga

SEQ ID NO: 730459 - DNA, 20 bp, mouse
ggggcggaacctggtcttgt

SEQ ID NO: 730460 - DNA, 20 bp, mouse
gcggggccaggtcttgttag

SEQ ID NO: 730461 - DNA, 20 bp, mouse
ggggcggagccggagacccg

SEQ ID NO: 730462 - DNA, 20 bp, mouse
ggttaggggcgtggtctata

SEQ ID NO: 730463 - DNA, 20 bp, mouse
gccccaatccccctcgatgt

SEQ ID NO: 730464 - DNA, 20 bp, mouse
gtcaggacgcgttgcctcgg

SEQ ID NO: 730465 - DNA, 20 bp, mouse
ggggcgtggtctatatggtc

SEQ ID NO: 730466 - DNA, 20 bp, mouse
ggagggaccagcagtccatt

SEQ ID NO: 730467 - DNA, 20 bp, mouse
gccgccctccccagcctgag

SEQ ID NO: 730468 - DNA, 20 bp, mouse
gtggactgctggtccctccg

SEQ ID NO: 730469 - DNA, 20 bp, mouse
gaactcaggccgcccgcgga

SEQ ID NO: 730470 - DNA, 20 bp, mouse
gtgggtagaatctttctcga

SEQ ID NO: 730471 - DNA, 20 bp, mouse
gaagtggcacgtggaggcgc

SEQ ID NO: 730472 - DNA, 20 bp, mouse
gctgctggtccctccgcggg

SEQ ID NO: 730473 - DNA, 20 bp, mouse
gcgggcggcctgagttgcca

SEQ ID NO: 730474 - DNA, 20 bp, mouse
gtctcgaaggctcgagaaga

SEQ ID NO: 730475 - DNA, 20 bp, mouse
ggggagccggacactgccac

SEQ ID NO: 730476 - DNA, 20 bp, mouse
ggctcgaaccacactccccg

SEQ ID NO: 730477 - DNA, 20 bp, mouse
gcggttgcaactagggttat

SEQ ID NO: 730478 - DNA, 20 bp, mouse
gggagggaggagatctgtgc

SEQ ID NO: 730479 - DNA, 20 bp, mouse
gcgcggccccgccccaccga

SEQ ID NO: 730480 - DNA, 20 bp, mouse
ggctgctcccaggtaacccc

SEQ ID NO: 730481 - DNA, 20 bp, mouse
gagtggggacgaggggtccg

SEQ ID NO: 730482 - DNA, 20 bp, mouse
gtagggttatgggggacgga

SEQ ID NO: 730483 - DNA, 20 bp, mouse
gctgcgcgggagctgcaccc

SEQ ID NO: 730484 - DNA, 20 bp, mouse
gaagaacgcggttgcaacta

SEQ ID NO: 730485 - DNA, 20 bp, mouse
ggccccgccccaccgagggc

SEQ ID NO: 730486 - DNA, 20 bp, mouse
gtgagagcgaagtccccctc

SEQ ID NO: 730487 - DNA, 20 bp, mouse
ggaggagcccgaggttaacg

SEQ ID NO: 730488 - DNA, 20 bp, mouse
gcccgcccacgggacgtcaa

SEQ ID NO: 730489 - DNA, 20 bp, mouse
ggggaggtgggtgggaccgt

SEQ ID NO: 730490 - DNA, 20 bp, mouse
gaggtgccatgcatttcggc

SEQ ID NO: 730491 - DNA, 20 bp, mouse
gcggcaggctgcgtccctaa

SEQ ID NO: 730492 - DNA, 20 bp, mouse
ggccgcgtgtctgtacttat

SEQ ID NO: 730493 - DNA, 20 bp, mouse
gatggcacctcgttaacctc

SEQ ID NO: 730494 - DNA, 20 bp, mouse
ggtcgcgccgacccgcccac

SEQ ID NO: 730495 - DNA, 20 bp, mouse
gagtagagctggcgcggaat

SEQ ID NO: 730496 - DNA, 20 bp, mouse
gaaggaggcactcgggacta

SEQ ID NO: 730497 - DNA, 20 bp, mouse
ggcggggacccagaagaagg

SEQ ID NO: 730498 - DNA, 20 bp, mouse
ggctacagggagaggagggc

SEQ ID NO: 730499 - DNA, 20 bp, mouse
gggggttaacgtgggaggaa

SEQ ID NO: 730500 - DNA, 20 bp, mouse
gcggtgggggttaacgtggg

SEQ ID NO: 730501 - DNA, 20 bp, mouse
gctagggaagtgttggatgg

SEQ ID NO: 730502 - DNA, 20 bp, mouse
gtggcggtgggggttaacgt

SEQ ID NO: 730503 - DNA, 20 bp, mouse
gatgaagtgaattctgagtg

SEQ ID NO: 730504 - DNA, 20 bp, mouse
gcagaaataaaggggatctg

SEQ ID NO: 730505 - DNA, 20 bp, mouse
gctcgggactagggaagtgt

SEQ ID NO: 730506 - DNA, 20 bp, mouse
gtctccacggggcagctcgc

SEQ ID NO: 730507 - DNA, 20 bp, mouse
ggtgtggccagcgtgtgaaa

SEQ ID NO: 730508 - DNA, 20 bp, mouse
ggagctgccccgtggagacc

SEQ ID NO: 730509 - DNA, 20 bp, mouse
gcaggccagtgcagagtcct

SEQ ID NO: 730510 - DNA, 20 bp, mouse
gggagacccggccaccagag

SEQ ID NO: 730511 - DNA, 20 bp, mouse
gaggcggcggccaaagaaag

SEQ ID NO: 730512 - DNA, 20 bp, mouse
gccatgccgcggggcacaag

SEQ ID NO: 730513 - DNA, 20 bp, mouse
gggccccagagtctcccctc

SEQ ID NO: 730514 - DNA, 20 bp, mouse
ggccaccagaggggagactc

SEQ ID NO: 730515 - DNA, 20 bp, mouse
gggagctccgggcttgtagg

SEQ ID NO: 730516 - DNA, 20 bp, mouse
gtggggagcgagcccagcgg

SEQ ID NO: 730517 - DNA, 20 bp, mouse
gtggggctcacgttctactg

SEQ ID NO: 730518 - DNA, 20 bp, mouse
gaggaggcccacctgtagga

SEQ ID NO: 730519 - DNA, 20 bp, mouse
gggaaggaatggactgtccg

SEQ ID NO: 730520 - DNA, 20 bp, mouse
gccacggtaggaggacgcag

SEQ ID NO: 730521 - DNA, 20 bp, mouse
gagcccctgccccaacccca

SEQ ID NO: 730522 - DNA, 20 bp, mouse
gcgtcccggccacacaccag

SEQ ID NO: 730523 - DNA, 20 bp, mouse
ggaacccgcggatggagtct

SEQ ID NO: 730524 - DNA, 20 bp, mouse
gaggaggacgcaggggatgc

SEQ ID NO: 730525 - DNA, 20 bp, mouse
gcctgccccaaccccacggt

SEQ ID NO: 730526 - DNA, 20 bp, mouse
gcatcagtccaaggggaggg

SEQ ID NO: 730527 - DNA, 20 bp, mouse
ggaaggaaggagtccgtcca

SEQ ID NO: 730528 - DNA, 20 bp, mouse
ggacgaaagaagacactggg

SEQ ID NO: 730529 - DNA, 20 bp, mouse
gcagacgccagtccactcga

SEQ ID NO: 730530 - DNA, 20 bp, mouse
gaagcatcagtccaagggga

SEQ ID NO: 730531 - DNA, 20 bp, mouse
gaccttggagattatctgtt

SEQ ID NO: 730532 - DNA, 20 bp, mouse
gaaagcgagggtcagatgac

SEQ ID NO: 730533 - DNA, 20 bp, mouse
ggtggtaaggtactgaatca

SEQ ID NO: 730534 - DNA, 20 bp, mouse
gaggtgctgaggtgatcccc

SEQ ID NO: 730535 - DNA, 20 bp, mouse
ggatgggtggaaataaagcg

SEQ ID NO: 730536 - DNA, 20 bp, mouse
gctcctggacacatcatcac

SEQ ID NO: 730537 - DNA, 20 bp, mouse
gaggtggcaacagccaggaa

SEQ ID NO: 730538 - DNA, 20 bp, mouse
gaatgggggcgcgcggggga

SEQ ID NO: 730539 - DNA, 20 bp, mouse
gagacagcttaggggacagc

SEQ ID NO: 730540 - DNA, 20 bp, mouse
gagcaggcaggaggggtaca

SEQ ID NO: 730541 - DNA, 20 bp, mouse
gcgtggcgacatgagttcag

SEQ ID NO: 730542 - DNA, 20 bp, mouse
gctagaaaacggcatgtcct

SEQ ID NO: 730543 - DNA, 20 bp, mouse
gacatggcagtcatattttt

SEQ ID NO: 730544 - DNA, 20 bp, mouse
ggagaacaaggagacagctt

SEQ ID NO: 730545 - DNA, 20 bp, mouse
gagtgacagagggaggtctg

SEQ ID NO: 730546 - DNA, 20 bp, mouse
gaaagaggaaacaacctctc

SEQ ID NO: 730547 - DNA, 20 bp, mouse
gactcagagcaagtcagtgg

SEQ ID NO: 730548 - DNA, 20 bp, mouse
gaagactcagagcaagtcag

SEQ ID NO: 730549 - DNA, 20 bp, mouse
ggacttgctctgagtcttag

SEQ ID NO: 730550 - DNA, 20 bp, mouse
gaatcaggtcatgaactggt

SEQ ID NO: 730551 - DNA, 20 bp, mouse
gtgaactgctatacagctaa

SEQ ID NO: 730552 - DNA, 20 bp, mouse
gaataatgacagtatcaaag

SEQ ID NO: 730553 - DNA, 20 bp, mouse
gtaagaatagaacttgaatc

SEQ ID NO: 730554 - DNA, 20 bp, mouse
gggttggaacacgattaacg

SEQ ID NO: 730555 - DNA, 20 bp, mouse
gcttgaatcaggtcatgaac

SEQ ID NO: 730556 - DNA, 20 bp, mouse
gggaccctgagctgtggcgt

SEQ ID NO: 730557 - DNA, 20 bp, mouse
gggcaggggaccctgagctg

SEQ ID NO: 730558 - DNA, 20 bp, mouse
gccacctacgccacagctca

SEQ ID NO: 730559 - DNA, 20 bp, mouse
gcgtctggaatctgctggca

SEQ ID NO: 730560 - DNA, 20 bp, mouse
gctcagggttacactgctca

SEQ ID NO: 730561 - DNA, 20 bp, mouse
gacactgctcagggcctgtt

SEQ ID NO: 730562 - DNA, 20 bp, mouse
ggatgaggggaggagtcacg

SEQ ID NO: 730563 - DNA, 20 bp, mouse
gaggctcttaggcaaaacca

SEQ ID NO: 730564 - DNA, 20 bp, mouse
ggaagagccaatcagtgctc

SEQ ID NO: 730565 - DNA, 20 bp, mouse
gctaggattctggtccaaac

SEQ ID NO: 730566 - DNA, 20 bp, mouse
gccagcccacccatccaaat

SEQ ID NO: 730567 - DNA, 20 bp, mouse
gtgtgaccaagccacctatt

SEQ ID NO: 730568 - DNA, 20 bp, mouse
gtactggcagatgtcaggag

SEQ ID NO: 730569 - DNA, 20 bp, mouse
gctggggttggcttaaacag

SEQ ID NO: 730570 - DNA, 20 bp, mouse
ggtttcagggcgggaggaag

SEQ ID NO: 730571 - DNA, 20 bp, mouse
gcacaagtatagtatgggct

SEQ ID NO: 730572 - DNA, 20 bp, mouse
gggcggctccccaactctgg

SEQ ID NO: 730573 - DNA, 20 bp, mouse
ggcccacccatccaaatagg

SEQ ID NO: 730574 - DNA, 20 bp, mouse
gtgtacagcccacagctgtc

SEQ ID NO: 730575 - DNA, 20 bp, mouse
gtcagctggatcaggtttca

SEQ ID NO: 730576 - DNA, 20 bp, mouse
gccagcaagaacattgcctt

SEQ ID NO: 730577 - DNA, 20 bp, mouse
gtggatctgccctaggatga

SEQ ID NO: 730578 - DNA, 20 bp, mouse
gcctccctacatctgattta

SEQ ID NO: 730579 - DNA, 20 bp, mouse
gccaagtggagaagcttgtg

SEQ ID NO: 730580 - DNA, 20 bp, mouse
ggctgccttaaatcagatgt

SEQ ID NO: 730581 - DNA, 20 bp, mouse
gagtctctgggaacagtcac

SEQ ID NO: 730582 - DNA, 20 bp, mouse
gcacttagctggctcctgta

SEQ ID NO: 730583 - DNA, 20 bp, mouse
gggggtagacaaatgctgtg

SEQ ID NO: 730584 - DNA, 20 bp, mouse
gctggctcctgtaagggaga

SEQ ID NO: 730585 - DNA, 20 bp, mouse
gatcctagggcagatccaag

SEQ ID NO: 730586 - DNA, 20 bp, mouse
ggaggggcgcactgggaagt

SEQ ID NO: 730587 - DNA, 20 bp, mouse
ggaaccgtacccattcgctg

SEQ ID NO: 730588 - DNA, 20 bp, mouse
gcactgggaagtgggcgcag

SEQ ID NO: 730589 - DNA, 20 bp, mouse
gtgtccccagcgaatgggta

SEQ ID NO: 730590 - DNA, 20 bp, mouse
gcagactcctcggtgacctt

SEQ ID NO: 730591 - DNA, 20 bp, mouse
gaggaagtggacactcaaag

SEQ ID NO: 730592 - DNA, 20 bp, mouse
ggcgccctgtccccagcgaa

SEQ ID NO: 730593 - DNA, 20 bp, mouse
ggccctgatctcacatccct

SEQ ID NO: 730594 - DNA, 20 bp, mouse
gtccgcgtgccctgtggggg

SEQ ID NO: 730595 - DNA, 20 bp, mouse
gcaccgaggagtctgcagtg

SEQ ID NO: 730596 - DNA, 20 bp, mouse
gacccagtggtaaagagcga

SEQ ID NO: 730597 - DNA, 20 bp, mouse
gtccacccggctctctgcat

SEQ ID NO: 730598 - DNA, 20 bp, mouse
ggtaaagagcgatgggactg

SEQ ID NO: 730599 - DNA, 20 bp, mouse
gagtgctggaagaagggttt

SEQ ID NO: 730600 - DNA, 20 bp, mouse
gcagagagccgggtggagag

SEQ ID NO: 730601 - DNA, 20 bp, mouse
gtcagagggagcatgagtgc

SEQ ID NO: 730602 - DNA, 20 bp, mouse
gtactcccatgcagagagcc

SEQ ID NO: 730603 - DNA, 20 bp, mouse
gtcccatcgctctttaccac

SEQ ID NO: 730604 - DNA, 20 bp, mouse
ggaagccgcctctctccacc

SEQ ID NO: 730605 - DNA, 20 bp, mouse
gggggctcccgcactacgta

SEQ ID NO: 730606 - DNA, 20 bp, mouse
ggcggtctcccacctccgag

SEQ ID NO: 730607 - DNA, 20 bp, mouse
gaaccaacaagtccacttga

SEQ ID NO: 730608 - DNA, 20 bp, mouse
ggtagctatggaattccaac

SEQ ID NO: 730609 - DNA, 20 bp, mouse
gccacttgagggatctgcgg

SEQ ID NO: 730610 - DNA, 20 bp, mouse
gtcctcgtgtgggctgaaat

SEQ ID NO: 730611 - DNA, 20 bp, mouse
gatccctcaagtggacttgt

SEQ ID NO: 730612 - DNA, 20 bp, mouse
ggaaatgggcggaggagttt

SEQ ID NO: 730613 - DNA, 20 bp, mouse
gtctggatacaggtagaatc

SEQ ID NO: 730614 - DNA, 20 bp, mouse
gtctgcggaggtggtagcta

SEQ ID NO: 730615 - DNA, 20 bp, mouse
ggcttggtgcccaactcata

SEQ ID NO: 730616 - DNA, 20 bp, mouse
gagccacaggcgaaggtgtg

SEQ ID NO: 730617 - DNA, 20 bp, mouse
ggcccccacaccttcgcctg

SEQ ID NO: 730618 - DNA, 20 bp, mouse
gagcggggttgtggtaccct

SEQ ID NO: 730619 - DNA, 20 bp, mouse
gaggctcagagggatctcaa

SEQ ID NO: 730620 - DNA, 20 bp, mouse
gatggcgcaggcagaagtca

SEQ ID NO: 730621 - DNA, 20 bp, mouse
gccatcaccacatgtgggca

SEQ ID NO: 730622 - DNA, 20 bp, mouse
gccccgctcgccagctaaga

SEQ ID NO: 730623 - DNA, 20 bp, mouse
gtagctggcgagcggggttg

SEQ ID NO: 730624 - DNA, 20 bp, mouse
gtgtatagatccagcagctg

SEQ ID NO: 730625 - DNA, 20 bp, mouse
gagtggctcgacccccattg

SEQ ID NO: 730626 - DNA, 20 bp, mouse
gtctgcggcagggcgagcca

SEQ ID NO: 730627 - DNA, 20 bp, mouse
gcagcaggggaagcccgtcc

SEQ ID NO: 730628 - DNA, 20 bp, mouse
gaaccggtgaagaaccttgt

SEQ ID NO: 730629 - DNA, 20 bp, mouse
ggcgtcccagccaccgcctc

SEQ ID NO: 730630 - DNA, 20 bp, mouse
ggctgaggccagggggtctg

SEQ ID NO: 730631 - DNA, 20 bp, mouse
gagcaaatgacaagcggggt

SEQ ID NO: 730632 - DNA, 20 bp, mouse
gcactccgcaacttcggcca

SEQ ID NO: 730633 - DNA, 20 bp, mouse
gctccaacaaggttcttcac

SEQ ID NO: 730634 - DNA, 20 bp, mouse
gaagcccgtcccggagcgcg

SEQ ID NO: 730635 - DNA, 20 bp, mouse
gcgggggtcactgcatgaac

SEQ ID NO: 730636 - DNA, 20 bp, mouse
ggggccgcgactccaccctc

SEQ ID NO: 730637 - DNA, 20 bp, mouse
gagaaactgagccagccgga

SEQ ID NO: 730638 - DNA, 20 bp, mouse
gcccgcaggcagtccccgat

SEQ ID NO: 730639 - DNA, 20 bp, mouse
ggccgatcggggactgcctg

SEQ ID NO: 730640 - DNA, 20 bp, mouse
gcagccggagggtggagtcg

SEQ ID NO: 730641 - DNA, 20 bp, mouse
ggacgggcaccgctcccggg

SEQ ID NO: 730642 - DNA, 20 bp, mouse
gaagcccattggcctagcgg

SEQ ID NO: 730643 - DNA, 20 bp, mouse
gaccccggccacagctgcaa

SEQ ID NO: 730644 - DNA, 20 bp, mouse
gccgggaggggggccgatcg

SEQ ID NO: 730645 - DNA, 20 bp, mouse
gcggcggtgacgaagcgcca

SEQ ID NO: 730646 - DNA, 20 bp, mouse
ggggaacgctagcccttccg

SEQ ID NO: 730647 - DNA, 20 bp, mouse
gcgggcgaggagagtcgagg

SEQ ID NO: 730648 - DNA, 20 bp, mouse
gggagaggagcgcgtcctga

SEQ ID NO: 730649 - DNA, 20 bp, mouse
gtgtgagcgtgtgcgtatgc

SEQ ID NO: 730650 - DNA, 20 bp, mouse
gccccgcggccctgcgaaga

SEQ ID NO: 730651 - DNA, 20 bp, mouse
ggccgagacgccagaacctg

SEQ ID NO: 730652 - DNA, 20 bp, mouse
gaagcggtctaggagaagca

SEQ ID NO: 730653 - DNA, 20 bp, mouse
gagaacccggcaagcggtct

SEQ ID NO: 730654 - DNA, 20 bp, mouse
gcgcccgccctactcagagg

SEQ ID NO: 730655 - DNA, 20 bp, mouse
gagcccttccggggcgcctc

SEQ ID NO: 730656 - DNA, 20 bp, mouse
ggggccgccccttccagcga

SEQ ID NO: 730657 - DNA, 20 bp, mouse
ggtctgccggcccagaatga

SEQ ID NO: 730658 - DNA, 20 bp, mouse
gggaccccgccccggctggt

SEQ ID NO: 730659 - DNA, 20 bp, mouse
ggcggggtcccgtggggcag

SEQ ID NO: 730660 - DNA, 20 bp, mouse
gagccggggcggggtcccgt

SEQ ID NO: 730661 - DNA, 20 bp, mouse
gcggcccagaatgagggtct

SEQ ID NO: 730662 - DNA, 20 bp, mouse
gggagcaggaggctccgggt

SEQ ID NO: 730663 - DNA, 20 bp, mouse
ggggtccccaccagccgggg

SEQ ID NO: 730664 - DNA, 20 bp, mouse
gtggctgctcaagtagagta

SEQ ID NO: 730665 - DNA, 20 bp, mouse
gcggctggtggggacccacc

SEQ ID NO: 730666 - DNA, 20 bp, mouse
gcgccccaaagcctcatcac

SEQ ID NO: 730667 - DNA, 20 bp, mouse
gctatggccaagttggacaa

SEQ ID NO: 730668 - DNA, 20 bp, mouse
gaccacaggcccgaggcatg

SEQ ID NO: 730669 - DNA, 20 bp, mouse
gtgagccagtgatgaggctt

SEQ ID NO: 730670 - DNA, 20 bp, mouse
gtggccaagttggacaaagg

SEQ ID NO: 730671 - DNA, 20 bp, mouse
ggaaatctgagccagtgatg

SEQ ID NO: 730672 - DNA, 20 bp, mouse
gctgcctggcaagtaggcct

SEQ ID NO: 730673 - DNA, 20 bp, mouse
gtcacggaggccagctgaga

SEQ ID NO: 730674 - DNA, 20 bp, mouse
gccgtgaggcccttcctcat

SEQ ID NO: 730675 - DNA, 20 bp, mouse
gtctgccgccatcagcaaca

SEQ ID NO: 730676 - DNA, 20 bp, mouse
gaccccaaagccatgaaggg

SEQ ID NO: 730677 - DNA, 20 bp, mouse
gggtgggtggcccttgtcct

SEQ ID NO: 730678 - DNA, 20 bp, mouse
gtgggtggtgggtgatatat

SEQ ID NO: 730679 - DNA, 20 bp, mouse
gccactcaaaaaccagtctt

SEQ ID NO: 730680 - DNA, 20 bp, mouse
gcctgggatggcatgggtgg

SEQ ID NO: 730681 - DNA, 20 bp, mouse
gcccaccccaaagccatgaa

SEQ ID NO: 730682 - DNA, 20 bp, mouse
gacccctcccttcatggctt

SEQ ID NO: 730683 - DNA, 20 bp, mouse
gaaaaccagtcttggggcaa

SEQ ID NO: 730684 - DNA, 20 bp, mouse
gtgtcctgggatggcatggg

SEQ ID NO: 730685 - DNA, 20 bp, mouse
gacggccacgagatctgacc

SEQ ID NO: 730686 - DNA, 20 bp, mouse
gaggggcggggccacatcgg

SEQ ID NO: 730687 - DNA, 20 bp, mouse
gcaggcctgcgtcctgactt

SEQ ID NO: 730688 - DNA, 20 bp, mouse
gtccgccggcatgacgtcac

SEQ ID NO: 730689 - DNA, 20 bp, mouse
gtgccgggacgggcccaaga

SEQ ID NO: 730690 - DNA, 20 bp, mouse
ggacccgcagaattgacagg

SEQ ID NO: 730691 - DNA, 20 bp, mouse
gccagacccgcagaattgac

SEQ ID NO: 730692 - DNA, 20 bp, mouse
gaaactagcagaggccccgc

SEQ ID NO: 730693 - DNA, 20 bp, mouse
gactctccgccccgccgatg

SEQ ID NO: 730694 - DNA, 20 bp, mouse
ggcgtcccgtgacgtcatgc

SEQ ID NO: 730695 - DNA, 20 bp, mouse
gcaagaggatgaggtgggcg

SEQ ID NO: 730696 - DNA, 20 bp, mouse
ggccccgatcggctgtgaga

SEQ ID NO: 730697 - DNA, 20 bp, mouse
ggccccggggagcaccgctg

SEQ ID NO: 730698 - DNA, 20 bp, mouse
gtggcccgccgggtcctcag

SEQ ID NO: 730699 - DNA, 20 bp, mouse
gcggaggacgaacttctcgg

SEQ ID NO: 730700 - DNA, 20 bp, mouse
ggatctgggcgatcgatcct

SEQ ID NO: 730701 - DNA, 20 bp, mouse
gcggctgtgagagggaacag

SEQ ID NO: 730702 - DNA, 20 bp, mouse
gctgggcgatcgatcctcgg

SEQ ID NO: 730703 - DNA, 20 bp, mouse
gtcccgtctggtgccccgat

SEQ ID NO: 730704 - DNA, 20 bp, mouse
ggccgcgcgcagacaatagc

SEQ ID NO: 730705 - DNA, 20 bp, mouse
ggggaccgcgggcgcgatct

SEQ ID NO: 730706 - DNA, 20 bp, mouse
gccgccgggacgtgagagtc

SEQ ID NO: 730707 - DNA, 20 bp, mouse
gcaccgcctgcccaggacaa

SEQ ID NO: 730708 - DNA, 20 bp, mouse
gcccggcggctgcggggaaa

SEQ ID NO: 730709 - DNA, 20 bp, mouse
gcgggcacagaggttccgtg

SEQ ID NO: 730710 - DNA, 20 bp, mouse
gtccgggtggaggaaccggg

SEQ ID NO: 730711 - DNA, 20 bp, mouse
gcacccggactctcacgtcc

SEQ ID NO: 730712 - DNA, 20 bp, mouse
gtaagcacccccattacctg

SEQ ID NO: 730713 - DNA, 20 bp, mouse
gaggttccgtggggatggtg

SEQ ID NO: 730714 - DNA, 20 bp, mouse
gcgtcccggcggggaaacct

SEQ ID NO: 730715 - DNA, 20 bp, mouse
gaacctgggcgcgggcacag

SEQ ID NO: 730716 - DNA, 20 bp, mouse
gggtggcctcaggtgtaagt

SEQ ID NO: 730717 - DNA, 20 bp, mouse
gtcaaatagggcaggtaggt

SEQ ID NO: 730718 - DNA, 20 bp, mouse
gaccgagggcagatgctaca

SEQ ID NO: 730719 - DNA, 20 bp, mouse
gttacacctgaggccaccga

SEQ ID NO: 730720 - DNA, 20 bp, mouse
gccaaatgcaggcagtgctg

SEQ ID NO: 730721 - DNA, 20 bp, mouse
gagcgcaccccagtcttggt

SEQ ID NO: 730722 - DNA, 20 bp, mouse
ggctgtgtcccaggccggaa

SEQ ID NO: 730723 - DNA, 20 bp, mouse
gtccctgtagcatctgccct

SEQ ID NO: 730724 - DNA, 20 bp, mouse
gatgctacagggacacactt

SEQ ID NO: 730725 - DNA, 20 bp, mouse
gagttcacctaccaagactg

SEQ ID NO: 730726 - DNA, 20 bp, mouse
gaggcgcgggcggtctcctg

SEQ ID NO: 730727 - DNA, 20 bp, mouse
gtggtaagcgagatccctaa

SEQ ID NO: 730728 - DNA, 20 bp, mouse
gctcctgcggtgaattacga

SEQ ID NO: 730729 - DNA, 20 bp, mouse
gcaggtgcacgctcctaaaa

SEQ ID NO: 730730 - DNA, 20 bp, mouse
gcctaaaggcgaggcgcggg

SEQ ID NO: 730731 - DNA, 20 bp, mouse
gagcaagctccgcagtgggt

SEQ ID NO: 730732 - DNA, 20 bp, mouse
gcggtgaattacgaaggtct

SEQ ID NO: 730733 - DNA, 20 bp, mouse
gaattacgaaggtctcggcg

SEQ ID NO: 730734 - DNA, 20 bp, mouse
gtggaagcgtgagaataaac

SEQ ID NO: 730735 - DNA, 20 bp, mouse
gcctcgaggcaggtaacaat

SEQ ID NO: 730736 - DNA, 20 bp, mouse
ggagcaggagcgccctctca

SEQ ID NO: 730737 - DNA, 20 bp, mouse
ggggctaatcgcgtggtagg

SEQ ID NO: 730738 - DNA, 20 bp, mouse
ggcggggctaatcgcgtggt

SEQ ID NO: 730739 - DNA, 20 bp, mouse
gaaggaacggggagtataag

SEQ ID NO: 730740 - DNA, 20 bp, mouse
gccgcctctgtcccttgaga

SEQ ID NO: 730741 - DNA, 20 bp, mouse
ggtgagctgtgcagccgtgg

SEQ ID NO: 730742 - DNA, 20 bp, mouse
gtgccaccatagaggatagt

SEQ ID NO: 730743 - DNA, 20 bp, mouse
gagaggcggggctaatcgcg

SEQ ID NO: 730744 - DNA, 20 bp, mouse
gacagctcacactggatata

SEQ ID NO: 730745 - DNA, 20 bp, mouse
gtgtaagccgagggcgaggg

SEQ ID NO: 730746 - DNA, 20 bp, mouse
ggagaggcactaacttgaag

SEQ ID NO: 730747 - DNA, 20 bp, mouse
gctgccaggtaacgaggatg

SEQ ID NO: 730748 - DNA, 20 bp, mouse
ggaggcactagtgtgctgag

SEQ ID NO: 730749 - DNA, 20 bp, mouse
gagaccccgggagtatgcac

SEQ ID NO: 730750 - DNA, 20 bp, mouse
gcaaactcaaaggcctacgg

SEQ ID NO: 730751 - DNA, 20 bp, mouse
gcagccctgtgcatactccc

SEQ ID NO: 730752 - DNA, 20 bp, mouse
gagactgctgccaggtaacg

SEQ ID NO: 730753 - DNA, 20 bp, mouse
gctggcgggtgtgcagagca

SEQ ID NO: 730754 - DNA, 20 bp, mouse
gggccccctgaattcagcta

SEQ ID NO: 730755 - DNA, 20 bp, mouse
gggatgaggcgtttgagtgg

SEQ ID NO: 730756 - DNA, 20 bp, mouse
gtggaagcatatagtcctca

SEQ ID NO: 730757 - DNA, 20 bp, mouse
gtcccgcagtgtggtccctg

SEQ ID NO: 730758 - DNA, 20 bp, mouse
ggtcaccccacccaaccaat

SEQ ID NO: 730759 - DNA, 20 bp, mouse
gaatgtgtggtcccgcagtg

SEQ ID NO: 730760 - DNA, 20 bp, mouse
gtcagacaacactctttgtg

SEQ ID NO: 730761 - DNA, 20 bp, mouse
ggtcctcagggaccacactg

SEQ ID NO: 730762 - DNA, 20 bp, mouse
gcccgccccgccccgtgcca

SEQ ID NO: 730763 - DNA, 20 bp, mouse
gagagtgttgtctgagtagg

SEQ ID NO: 730764 - DNA, 20 bp, mouse
gggctggccttggcacgggg

SEQ ID NO: 730765 - DNA, 20 bp, mouse
gaataggctggccttggcac

SEQ ID NO: 730766 - DNA, 20 bp, mouse
gaaacgcagcactggcaaaa

SEQ ID NO: 730767 - DNA, 20 bp, mouse
gcgggaatccccattccagg

SEQ ID NO: 730768 - DNA, 20 bp, mouse
gacccttagatcttctgtag

SEQ ID NO: 730769 - DNA, 20 bp, mouse
ggggtggatggcagaattta

SEQ ID NO: 730770 - DNA, 20 bp, mouse
ggcagaatttacggcctcgt

SEQ ID NO: 730771 - DNA, 20 bp, mouse
ggggcgcgagcggaatgagg

SEQ ID NO: 730772 - DNA, 20 bp, mouse
gccccagctcgagcctctgt

SEQ ID NO: 730773 - DNA, 20 bp, mouse
gccgaggcaggattcttaaa

SEQ ID NO: 730774 - DNA, 20 bp, mouse
gaagaatcctgcctcggagg

SEQ ID NO: 730775 - DNA, 20 bp, mouse
gattgtgggggtaatatctc

SEQ ID NO: 730776 - DNA, 20 bp, mouse
gggcaggcggagctgaacac

SEQ ID NO: 730777 - DNA, 20 bp, mouse
gtccaccaacccacgaggac

SEQ ID NO: 730778 - DNA, 20 bp, mouse
gactggagaccctacaagag

SEQ ID NO: 730779 - DNA, 20 bp, mouse
gtagggtctccagtcctcgt

SEQ ID NO: 730780 - DNA, 20 bp, mouse
gaggaggcggagccaacgaa

SEQ ID NO: 730781 - DNA, 20 bp, mouse
gtgagcctggagctaggaga

SEQ ID NO: 730782 - DNA, 20 bp, mouse
gcgggcactgagaacttagg

SEQ ID NO: 730783 - DNA, 20 bp, mouse
gcaggcaagctgctagaagc

SEQ ID NO: 730784 - DNA, 20 bp, mouse
gcctcgtgggttggtggaaa

SEQ ID NO: 730785 - DNA, 20 bp, mouse
gttgccagtcaccaccggaa

SEQ ID NO: 730786 - DNA, 20 bp, mouse
gcaggtcagcgaatttaagt

SEQ ID NO: 730787 - DNA, 20 bp, mouse
gccggaagcctgtcattaca

SEQ ID NO: 730788 - DNA, 20 bp, mouse
gagagaaaagaaaacggatt

SEQ ID NO: 730789 - DNA, 20 bp, mouse
gataaggaatgccccactaa

SEQ ID NO: 730790 - DNA, 20 bp, mouse
gcaggcttccgggagcagtg

SEQ ID NO: 730791 - DNA, 20 bp, mouse
ggagtcagccctgtaatgac

SEQ ID NO: 730792 - DNA, 20 bp, mouse
gaacggattgggattccagt

SEQ ID NO: 730793 - DNA, 20 bp, mouse
ggtcctccaagctaaacagg

SEQ ID NO: 730794 - DNA, 20 bp, mouse
gtcagtcctccaagctaaac

SEQ ID NO: 730795 - DNA, 20 bp, mouse
gtatactaagatagttttaa

SEQ ID NO: 730796 - DNA, 20 bp, mouse
gcccagaagatcaaaggtta

SEQ ID NO: 730797 - DNA, 20 bp, mouse
ggcctatcccagaagatcaa

SEQ ID NO: 730798 - DNA, 20 bp, mouse
ggatggaataccatctccac

SEQ ID NO: 730799 - DNA, 20 bp, mouse
gatgacaaaaatctagacaa

SEQ ID NO: 730800 - DNA, 20 bp, mouse
gagaaaaccatcaggctgat

SEQ ID NO: 730801 - DNA, 20 bp, mouse
gaatctagacaacggttgta

SEQ ID NO: 730802 - DNA, 20 bp, mouse
gtcactcacaggaaagatag

SEQ ID NO: 730803 - DNA, 20 bp, mouse
ggcattttctttctcaagga

SEQ ID NO: 730804 - DNA, 20 bp, mouse
gttcacttaagaaaaccatc

SEQ ID NO: 730805 - DNA, 20 bp, mouse
gatagtggggttttcttgtc

SEQ ID NO: 730806 - DNA, 20 bp, mouse
gtggtaagagagtctctact

SEQ ID NO: 730807 - DNA, 20 bp, mouse
ggaaatggtgcaggctacaa

SEQ ID NO: 730808 - DNA, 20 bp, mouse
gaaaatatctacatgaaaat

SEQ ID NO: 730809 - DNA, 20 bp, mouse
gtgtcagaacgtaaggacta

SEQ ID NO: 730810 - DNA, 20 bp, mouse
gggtgcaggctacaatggtt

SEQ ID NO: 730811 - DNA, 20 bp, mouse
gaggatacaatctgattggc

SEQ ID NO: 730812 - DNA, 20 bp, mouse
gactatggatatgaggtgac

SEQ ID NO: 730813 - DNA, 20 bp, mouse
gactagagcctagaactgtc

SEQ ID NO: 730814 - DNA, 20 bp, mouse
gacgttctgacaagattctt

SEQ ID NO: 730815 - DNA, 20 bp, mouse
gacgtaaggactaaggggtg

SEQ ID NO: 730816 - DNA, 20 bp, mouse
gtctggctaaggaaggcgtt

SEQ ID NO: 730817 - DNA, 20 bp, mouse
gtgaagacccaggaaaggtc

SEQ ID NO: 730818 - DNA, 20 bp, mouse
gctaaggaaggcgttggggt

SEQ ID NO: 730819 - DNA, 20 bp, mouse
gcccaggaaaggtctggcta

SEQ ID NO: 730820 - DNA, 20 bp, mouse
gggcgtccctagcaaccgcc

SEQ ID NO: 730821 - DNA, 20 bp, mouse
gaccaagaggcaggtgttcg

SEQ ID NO: 730822 - DNA, 20 bp, mouse
gtaagaggaacgatgattgg

SEQ ID NO: 730823 - DNA, 20 bp, mouse
gaactgtaaaggaaatctgt

SEQ ID NO: 730824 - DNA, 20 bp, mouse
ggaagtggctttgaagaccc

SEQ ID NO: 730825 - DNA, 20 bp, mouse
gcccttcagttaagtgctga

SEQ ID NO: 730826 - DNA, 20 bp, mouse
gccgagattgacaaggttgt

SEQ ID NO: 730827 - DNA, 20 bp, mouse
ggcgagccccgccttcctat

SEQ ID NO: 730828 - DNA, 20 bp, mouse
gtgactgggcggagggatgt

SEQ ID NO: 730829 - DNA, 20 bp, mouse
gtggtgggatggagagggtt

SEQ ID NO: 730830 - DNA, 20 bp, mouse
ggcaaccactagctgactga

SEQ ID NO: 730831 - DNA, 20 bp, mouse
gaggaaggcggggctcgcag

SEQ ID NO: 730832 - DNA, 20 bp, mouse
ggatctctgaactctattgg

SEQ ID NO: 730833 - DNA, 20 bp, mouse
gaaccccaaggcctactaat

SEQ ID NO: 730834 - DNA, 20 bp, mouse
gtctattggtgggatggaga

SEQ ID NO: 730835 - DNA, 20 bp, mouse
ggtagtgtgtactgactggg

SEQ ID NO: 730836 - DNA, 20 bp, mouse
gggcccggaagcggggtttg

SEQ ID NO: 730837 - DNA, 20 bp, mouse
gtgggcggagccaaaggcgt

SEQ ID NO: 730838 - DNA, 20 bp, mouse
gccaacctcgggcccggaag

SEQ ID NO: 730839 - DNA, 20 bp, mouse
gttggggcgtggagctgaag

SEQ ID NO: 730840 - DNA, 20 bp, mouse
gccacagccaagagcggctg

SEQ ID NO: 730841 - DNA, 20 bp, mouse
gccctccccaacctcgggcc

SEQ ID NO: 730842 - DNA, 20 bp, mouse
gcggcggcgtcggagggtag

SEQ ID NO: 730843 - DNA, 20 bp, mouse
gagctgaagtgggaacccgc

SEQ ID NO: 730844 - DNA, 20 bp, mouse
ggaccaacgagagagatggt

SEQ ID NO: 730845 - DNA, 20 bp, mouse
gtcggagggtagcggagggg

SEQ ID NO: 730846 - DNA, 20 bp, mouse
gcccacgcggggttccgcta

SEQ ID NO: 730847 - DNA, 20 bp, mouse
gggcccagctgcgtcctcga

SEQ ID NO: 730848 - DNA, 20 bp, mouse
ggtctcgcgccgggtctcgt

SEQ ID NO: 730849 - DNA, 20 bp, mouse
gtagaagacccgcccctctg

SEQ ID NO: 730850 - DNA, 20 bp, mouse
ggaggggcgggtcttctacg

SEQ ID NO: 730851 - DNA, 20 bp, mouse
gacccggcgcgagaccccat

SEQ ID NO: 730852 - DNA, 20 bp, mouse
gcgcagctgggcctgagtac

SEQ ID NO: 730853 - DNA, 20 bp, mouse
gctgggcctgagtaccggtt

SEQ ID NO: 730854 - DNA, 20 bp, mouse
ggaggggcggggccgcagag

SEQ ID NO: 730855 - DNA, 20 bp, mouse
ggggacgaaactgccagagc

SEQ ID NO: 730856 - DNA, 20 bp, mouse
ggtagtgaacagatagtcga

SEQ ID NO: 730857 - DNA, 20 bp, mouse
ggagactgcagaaaacaagc

SEQ ID NO: 730858 - DNA, 20 bp, mouse
gagttggcctatcaggtcta

SEQ ID NO: 730859 - DNA, 20 bp, mouse
gataaggggcggggtaggcg

SEQ ID NO: 730860 - DNA, 20 bp, mouse
ggaattctgtccaatcaagg

SEQ ID NO: 730861 - DNA, 20 bp, mouse
gcttccgcccagataagggg

SEQ ID NO: 730862 - DNA, 20 bp, mouse
gtatctgggcggaagctgtg

SEQ ID NO: 730863 - DNA, 20 bp, mouse
gaatacaggttaccaggaag

SEQ ID NO: 730864 - DNA, 20 bp, mouse
gagtccgaatgatcccgaat

SEQ ID NO: 730865 - DNA, 20 bp, mouse
gacaatgtgccttggtggtg

SEQ ID NO: 730866 - DNA, 20 bp, mouse
gccttgggatgcatctcctg

SEQ ID NO: 730867 - DNA, 20 bp, mouse
ggattgctgcatatattggt

SEQ ID NO: 730868 - DNA, 20 bp, mouse
gacaggagatatgtagagac

SEQ ID NO: 730869 - DNA, 20 bp, mouse
ggcatccacaagagagcctt

SEQ ID NO: 730870 - DNA, 20 bp, mouse
gtggtgggttgatgaaaatg

SEQ ID NO: 730871 - DNA, 20 bp, mouse
gggaagattgctgcatatat

SEQ ID NO: 730872 - DNA, 20 bp, mouse
ggatgcatctcctgtggaga

SEQ ID NO: 730873 - DNA, 20 bp, mouse
ggcaggctttacaggaccag

SEQ ID NO: 730874 - DNA, 20 bp, mouse
gccaaaaatgtgctgaaaga

SEQ ID NO: 730875 - DNA, 20 bp, mouse
gtggacagtgaagaatccta

SEQ ID NO: 730876 - DNA, 20 bp, mouse
gtataagagggcagtcgggg

SEQ ID NO: 730877 - DNA, 20 bp, mouse
gctggtgtcagagggtcgag

SEQ ID NO: 730878 - DNA, 20 bp, mouse
gtggacatagtcattaaagc

SEQ ID NO: 730879 - DNA, 20 bp, mouse
gttatataagagggcagtcg

SEQ ID NO: 730880 - DNA, 20 bp, mouse
gcaagtagcaaaacaccagg

SEQ ID NO: 730881 - DNA, 20 bp, mouse
gacagcacagcgaatccccc

SEQ ID NO: 730882 - DNA, 20 bp, mouse
gattcaagtagcaaaacacc

SEQ ID NO: 730883 - DNA, 20 bp, mouse
gaggacatagaaggtctcag

SEQ ID NO: 730884 - DNA, 20 bp, mouse
ggctgtggccaggacataga

SEQ ID NO: 730885 - DNA, 20 bp, mouse
gtatgtcctggccacagcat

SEQ ID NO: 730886 - DNA, 20 bp, mouse
gagaactgtgccacagggtg

SEQ ID NO: 730887 - DNA, 20 bp, mouse
gaataccattggcctcaaag

SEQ ID NO: 730888 - DNA, 20 bp, mouse
gaggcagtatcattcacagc

SEQ ID NO: 730889 - DNA, 20 bp, mouse
gaaacccagatctccatgaa

SEQ ID NO: 730890 - DNA, 20 bp, mouse
ggagagccaatctaaagaaa

SEQ ID NO: 730891 - DNA, 20 bp, mouse
gtcttctcacagagctaggc

SEQ ID NO: 730892 - DNA, 20 bp, mouse
gtggtgtcagtaaacttcgg

SEQ ID NO: 730893 - DNA, 20 bp, mouse
gcgaggaaagttcatttcta

SEQ ID NO: 730894 - DNA, 20 bp, mouse
gcctccctttcatggagatc

SEQ ID NO: 730895 - DNA, 20 bp, mouse
gcagtatcattcacagcagg

SEQ ID NO: 730896 - DNA, 20 bp, mouse
gctcctgaagcgagtgtccc

SEQ ID NO: 730897 - DNA, 20 bp, mouse
gcggggttggggtgaaccgg

SEQ ID NO: 730898 - DNA, 20 bp, mouse
gaggcggggttggggtgaac

SEQ ID NO: 730899 - DNA, 20 bp, mouse
ggaagcgagtgtccccggcc

SEQ ID NO: 730900 - DNA, 20 bp, mouse
ggccgggtgagtcctgccac

SEQ ID NO: 730901 - DNA, 20 bp, mouse
gccgagactggggatagctg

SEQ ID NO: 730902 - DNA, 20 bp, mouse
gccccgcctctccgagactg

SEQ ID NO: 730903 - DNA, 20 bp, mouse
gtggaggagcctcgcgccgt

SEQ ID NO: 730904 - DNA, 20 bp, mouse
gggcggggctagccgtgggc

SEQ ID NO: 730905 - DNA, 20 bp, mouse
ggctatccccagtctcggag

SEQ ID NO: 730906 - DNA, 20 bp, mouse
gtgtgggtgatggcgcatca

SEQ ID NO: 730907 - DNA, 20 bp, mouse
gatggcgcatcaggggccgt

SEQ ID NO: 730908 - DNA, 20 bp, mouse
gcatcaacacattaacactt

SEQ ID NO: 730909 - DNA, 20 bp, mouse
gatactgagtgcctttgtgt

SEQ ID NO: 730910 - DNA, 20 bp, mouse
ggtccatcctgtagatgaaa

SEQ ID NO: 730911 - DNA, 20 bp, mouse
gacattaatgacagtctctc

SEQ ID NO: 730912 - DNA, 20 bp, mouse
gtatatgcaaagagaatgct

SEQ ID NO: 730913 - DNA, 20 bp, mouse
gattggcagatggagcaggt

SEQ ID NO: 730914 - DNA, 20 bp, mouse
gtttcattggcagatggagc

SEQ ID NO: 730915 - DNA, 20 bp, mouse
gaaaatggatcatttgccct

SEQ ID NO: 730916 - DNA, 20 bp, mouse
gcataactgcagagcaggat

SEQ ID NO: 730917 - DNA, 20 bp, mouse
gccctaacccggcaagtcag

SEQ ID NO: 730918 - DNA, 20 bp, mouse
gacttgccgggttagggctc

SEQ ID NO: 730919 - DNA, 20 bp, mouse
gagtcagtggctactcaatg

SEQ ID NO: 730920 - DNA, 20 bp, mouse
gagacgcggaacgtggtcgc

SEQ ID NO: 730921 - DNA, 20 bp, mouse
gcaacctgagcgagctctcc

SEQ ID NO: 730922 - DNA, 20 bp, mouse
gagtactgacatatggaccc

SEQ ID NO: 730923 - DNA, 20 bp, mouse
gccgtgcataactgcagagc

SEQ ID NO: 730924 - DNA, 20 bp, mouse
gcatatggacccaggacgaa

SEQ ID NO: 730925 - DNA, 20 bp, mouse
ggccaggctcaacccctccg

SEQ ID NO: 730926 - DNA, 20 bp, mouse
gaggggcggggcaagagcaa

SEQ ID NO: 730927 - DNA, 20 bp, mouse
gaggaactgcgcacgcgctc

SEQ ID NO: 730928 - DNA, 20 bp, mouse
gcacgcgctccggggcggaa

SEQ ID NO: 730929 - DNA, 20 bp, mouse
gtcgaacttggagacccgac

SEQ ID NO: 730930 - DNA, 20 bp, mouse
ggagcaagggcggggttttc

SEQ ID NO: 730931 - DNA, 20 bp, mouse
gcatggtggcagagccagtc

SEQ ID NO: 730932 - DNA, 20 bp, mouse
ggtctagtaggggtagagag

SEQ ID NO: 730933 - DNA, 20 bp, mouse
gcgctccggggcggaagggg

SEQ ID NO: 730934 - DNA, 20 bp, mouse
gcggggcaagagcaagggcg

SEQ ID NO: 730935 - DNA, 20 bp, mouse
gtctttcatgaggtctagta

SEQ ID NO: 730936 - DNA, 20 bp, mouse
gcctctgccccccgagaggc

SEQ ID NO: 730937 - DNA, 20 bp, mouse
ggccccccgagaggctggct

SEQ ID NO: 730938 - DNA, 20 bp, mouse
gaatcccagccagcctctcg

SEQ ID NO: 730939 - DNA, 20 bp, mouse
gcgtgcgtgggggggaaagt

SEQ ID NO: 730940 - DNA, 20 bp, mouse
gggcttgcgcacccatccac

SEQ ID NO: 730941 - DNA, 20 bp, mouse
ggcgacgcgcgtgcgtgggg

SEQ ID NO: 730942 - DNA, 20 bp, mouse
gcaagcccagataaacacca

SEQ ID NO: 730943 - DNA, 20 bp, mouse
gtgccatcttacctcggtcc

SEQ ID NO: 730944 - DNA, 20 bp, mouse
gtaaggaaagggtcaccggg

SEQ ID NO: 730945 - DNA, 20 bp, mouse
gcaggagccaactaaggaaa

SEQ ID NO: 730946 - DNA, 20 bp, mouse
ggccaagaggcttgcattgt

SEQ ID NO: 730947 - DNA, 20 bp, mouse
ggctgtgattggctgttgag

SEQ ID NO: 730948 - DNA, 20 bp, mouse
gaggtgggccttctgccaag

SEQ ID NO: 730949 - DNA, 20 bp, mouse
gctgtggccagcacaacgtc

SEQ ID NO: 730950 - DNA, 20 bp, mouse
gcagcacaacgtcaggctgt

SEQ ID NO: 730951 - DNA, 20 bp, mouse
ggtgaacgttacagcgttcg

SEQ ID NO: 730952 - DNA, 20 bp, mouse
ggctgttgagaggcggagaa

SEQ ID NO: 730953 - DNA, 20 bp, mouse
gtcccacaatgcaagcctct

SEQ ID NO: 730954 - DNA, 20 bp, mouse
gtccctgaaacatatttcag

SEQ ID NO: 730955 - DNA, 20 bp, mouse
gggtctaaaagtactgaatt

SEQ ID NO: 730956 - DNA, 20 bp, mouse
gacccctgccggccttggtg

SEQ ID NO: 730957 - DNA, 20 bp, mouse
gaggccccgaccaatcactg

SEQ ID NO: 730958 - DNA, 20 bp, mouse
gcggggagacagatctccta

SEQ ID NO: 730959 - DNA, 20 bp, mouse
gacactcggaaaggaggtta

SEQ ID NO: 730960 - DNA, 20 bp, mouse
ggcaccaagaggggcagtac

SEQ ID NO: 730961 - DNA, 20 bp, mouse
gggcaggggtcatgctcctt

SEQ ID NO: 730962 - DNA, 20 bp, mouse
gcgggactcgggaataagac

SEQ ID NO: 730963 - DNA, 20 bp, mouse
gcgcaggtcgacactcggaa

SEQ ID NO: 730964 - DNA, 20 bp, mouse
ggtgacatctggcaccaaga

SEQ ID NO: 730965 - DNA, 20 bp, mouse
ggtggggcatacacgaactc

SEQ ID NO: 730966 - DNA, 20 bp, mouse
ggggccgccgcgctgcgctg

SEQ ID NO: 730967 - DNA, 20 bp, mouse
ggtccccgcaggaagggagg

SEQ ID NO: 730968 - DNA, 20 bp, mouse
ggggaggcggcgggttctgg

SEQ ID NO: 730969 - DNA, 20 bp, mouse
ggggtcacgggaaaacccca

SEQ ID NO: 730970 - DNA, 20 bp, mouse
gtcagcgtcagcactggcga

SEQ ID NO: 730971 - DNA, 20 bp, mouse
gcaggacccagggatcctgg

SEQ ID NO: 730972 - DNA, 20 bp, mouse
ggaagggaggcggcgggttc

SEQ ID NO: 730973 - DNA, 20 bp, mouse
ggacccagggatcctggtgg

SEQ ID NO: 730974 - DNA, 20 bp, mouse
ggccgctgtccccgcaggaa

SEQ ID NO: 730975 - DNA, 20 bp, mouse
gcccgtgacccccatgtcta

SEQ ID NO: 730976 - DNA, 20 bp, mouse
gcggcccgagcggcgaggag

SEQ ID NO: 730977 - DNA, 20 bp, mouse
gcacgagcaagcgacaccca

SEQ ID NO: 730978 - DNA, 20 bp, mouse
gtgcgcgcggcggctccgct

SEQ ID NO: 730979 - DNA, 20 bp, mouse
gagtgagggtccgggactca

SEQ ID NO: 730980 - DNA, 20 bp, mouse
gggcctccgcgggcggagag

SEQ ID NO: 730981 - DNA, 20 bp, mouse
gcgcgggcggagagaggcgc

SEQ ID NO: 730982 - DNA, 20 bp, mouse
gcgggccgcgcgctctccgt

SEQ ID NO: 730983 - DNA, 20 bp, mouse
gcggcggcgcggtgagggtc

SEQ ID NO: 730984 - DNA, 20 bp, mouse
ggcgccggtgcgccgaggtg

SEQ ID NO: 730985 - DNA, 20 bp, mouse
gccgccgcgccggtgcgccg

SEQ ID NO: 730986 - DNA, 20 bp, mouse
gactgtgccctggcagagag

SEQ ID NO: 730987 - DNA, 20 bp, mouse
gaataccgaagccctcgttc

SEQ ID NO: 730988 - DNA, 20 bp, mouse
gccgaagccctcgttccgga

SEQ ID NO: 730989 - DNA, 20 bp, mouse
gccgaggggcggtgctgtcg

SEQ ID NO: 730990 - DNA, 20 bp, mouse
gccctcaaagggataaactg

SEQ ID NO: 730991 - DNA, 20 bp, mouse
gtcgcaggggccagcgaggc

SEQ ID NO: 730992 - DNA, 20 bp, mouse
gtgaagtaatgacatgtggg

SEQ ID NO: 730993 - DNA, 20 bp, mouse
gtcgctggcccctgcgatct

SEQ ID NO: 730994 - DNA, 20 bp, mouse
gagtccggagagaaggcccc

SEQ ID NO: 730995 - DNA, 20 bp, mouse
ggccttcccctccggaacga

SEQ ID NO: 730996 - DNA, 20 bp, mouse
ggataagcaggggtgtaaca

SEQ ID NO: 730997 - DNA, 20 bp, mouse
gcaggaagcagcagataagc

SEQ ID NO: 730998 - DNA, 20 bp, mouse
ggccctaaaggcttgggagc

SEQ ID NO: 730999 - DNA, 20 bp, mouse
gaccagctcccaagccttta

SEQ ID NO: 731000 - DNA, 20 bp, mouse
gatgctccctgtgcggggat

SEQ ID NO: 731001 - DNA, 20 bp, mouse
gccctgtgttggctgaatta

SEQ ID NO: 731002 - DNA, 20 bp, mouse
gtgaattcttgaggccctaa

SEQ ID NO: 731003 - DNA, 20 bp, mouse
ggttgcatgctccctgtgcg

SEQ ID NO: 731004 - DNA, 20 bp, mouse
gcttgaggccctaaaggctt

SEQ ID NO: 731005 - DNA, 20 bp, mouse
gcctctaattatctgagatc

SEQ ID NO: 731006 - DNA, 20 bp, mouse
gtagcctggtctatgtgatg

SEQ ID NO: 731007 - DNA, 20 bp, mouse
gaccctagctagccctcaaa

SEQ ID NO: 731008 - DNA, 20 bp, mouse
gagaagtcaaccgaagagtt

SEQ ID NO: 731009 - DNA, 20 bp, mouse
gtcaaccgaagagttgggtg

SEQ ID NO: 731010 - DNA, 20 bp, mouse
gggctggaaaactgaatttg

SEQ ID NO: 731011 - DNA, 20 bp, mouse
gcaaagtgatagattttctt

SEQ ID NO: 731012 - DNA, 20 bp, mouse
gtatcacaggggtccagctg

SEQ ID NO: 731013 - DNA, 20 bp, mouse
gccgtcctcagccttagaaa

SEQ ID NO: 731014 - DNA, 20 bp, mouse
gggcagaacatccttttcta

SEQ ID NO: 731015 - DNA, 20 bp, mouse
gaaaaggatgttctgccaca

SEQ ID NO: 731016 - DNA, 20 bp, mouse
gccggccgaggcccattctg

SEQ ID NO: 731017 - DNA, 20 bp, mouse
gctggccgcaggagataaga

SEQ ID NO: 731018 - DNA, 20 bp, mouse
ggaggcaggtatcttcatca

SEQ ID NO: 731019 - DNA, 20 bp, mouse
gcctggccacgccccagaat

SEQ ID NO: 731020 - DNA, 20 bp, mouse
ggcggaacgccagggagttt

SEQ ID NO: 731021 - DNA, 20 bp, mouse
gcaggtccagaactgtgcaa

SEQ ID NO: 731022 - DNA, 20 bp, mouse
gtacgtaaaaactaaagagc

SEQ ID NO: 731023 - DNA, 20 bp, mouse
gagaactgtgcaatggcttt

SEQ ID NO: 731024 - DNA, 20 bp, mouse
gcaggtatcttcatcagggc

SEQ ID NO: 731025 - DNA, 20 bp, mouse
ggcggccagcctaaactccc

SEQ ID NO: 731026 - DNA, 20 bp, mouse
gcggtgacagaggcggtgat

SEQ ID NO: 731027 - DNA, 20 bp, mouse
ggcgcagcgggtggagtgtg

SEQ ID NO: 731028 - DNA, 20 bp, mouse
gcaagagcggtcccccgtgg

SEQ ID NO: 731029 - DNA, 20 bp, mouse
gaggcaagagcggtcccccg

SEQ ID NO: 731030 - DNA, 20 bp, mouse
gggtggcagaattgcgccca

SEQ ID NO: 731031 - DNA, 20 bp, mouse
gacaggaggcgagcgcgcac

SEQ ID NO: 731032 - DNA, 20 bp, mouse
gcccaaacacccaccaccat

SEQ ID NO: 731033 - DNA, 20 bp, mouse
gtccctggcgaaggagggaa

SEQ ID NO: 731034 - DNA, 20 bp, mouse
gcgagctagccaggcaagag

SEQ ID NO: 731035 - DNA, 20 bp, mouse
ggggggaaagatctacatgg

SEQ ID NO: 731036 - DNA, 20 bp, mouse
gccgcagacttgccactgac

SEQ ID NO: 731037 - DNA, 20 bp, mouse
ggggtcaatcagcctgtcag

SEQ ID NO: 731038 - DNA, 20 bp, mouse
gctgccctctgccgagcatc

SEQ ID NO: 731039 - DNA, 20 bp, mouse
gctcccggatgctcggcaga

SEQ ID NO: 731040 - DNA, 20 bp, mouse
gctgcggcgaacccacccgg

SEQ ID NO: 731041 - DNA, 20 bp, mouse
ggggagatggcggtggtgca

SEQ ID NO: 731042 - DNA, 20 bp, mouse
gagtctgcggctcccccggg

SEQ ID NO: 731043 - DNA, 20 bp, mouse
gagggcagcgttgagcttct

SEQ ID NO: 731044 - DNA, 20 bp, mouse
ggccctgcagctcccctcgc

SEQ ID NO: 731045 - DNA, 20 bp, mouse
gggccgcgcggggccagcga

SEQ ID NO: 731046 - DNA, 20 bp, mouse
gcctgaaacccgactcctga

SEQ ID NO: 731047 - DNA, 20 bp, mouse
gcatgtgtgcagccggagag

SEQ ID NO: 731048 - DNA, 20 bp, mouse
gtgaaggagtggacactaca

SEQ ID NO: 731049 - DNA, 20 bp, mouse
gacagggcacccagtgtcca

SEQ ID NO: 731050 - DNA, 20 bp, mouse
gaacccgactcctgaaggag

SEQ ID NO: 731051 - DNA, 20 bp, mouse
gtacagatcccacaatacaa

SEQ ID NO: 731052 - DNA, 20 bp, mouse
gcatgagcgtacgttttctt

SEQ ID NO: 731053 - DNA, 20 bp, mouse
gggaaggacggcccttttca

SEQ ID NO: 731054 - DNA, 20 bp, mouse
gagatcccacaatacaacgg

SEQ ID NO: 731055 - DNA, 20 bp, mouse
ggtaagaagtggcaccgggt

SEQ ID NO: 731056 - DNA, 20 bp, mouse
gagactgccgcggcggttga

SEQ ID NO: 731057 - DNA, 20 bp, mouse
gggacagcgtgacgtcgcaa

SEQ ID NO: 731058 - DNA, 20 bp, mouse
gacactgcgcaggtgcgagc

SEQ ID NO: 731059 - DNA, 20 bp, mouse
ggaccgggagacacgcttca

SEQ ID NO: 731060 - DNA, 20 bp, mouse
gtgccgcggcggttgagggc

SEQ ID NO: 731061 - DNA, 20 bp, mouse
gcttcccgagccggcgtcgg

SEQ ID NO: 731062 - DNA, 20 bp, mouse
ggggctggattcggagcgag

SEQ ID NO: 731063 - DNA, 20 bp, mouse
gaggtctcgcgagactgccg

SEQ ID NO: 731064 - DNA, 20 bp, mouse
gtgtagccggggaaacccga

SEQ ID NO: 731065 - DNA, 20 bp, mouse
ggtcacgctgtcccgagctg

SEQ ID NO: 731066 - DNA, 20 bp, mouse
ggtacccggtgatgtatgaa

SEQ ID NO: 731067 - DNA, 20 bp, mouse
gtatcacagcgcctcctgca

SEQ ID NO: 731068 - DNA, 20 bp, mouse
gcgggtacttgccatgcagg

SEQ ID NO: 731069 - DNA, 20 bp, mouse
ggcgtaaatgaatgactaga

SEQ ID NO: 731070 - DNA, 20 bp, mouse
gctatccattcatacatcac

SEQ ID NO: 731071 - DNA, 20 bp, mouse
gcacccagcagtgatatgaa

SEQ ID NO: 731072 - DNA, 20 bp, mouse
gtgacacttttgagcactgg

SEQ ID NO: 731073 - DNA, 20 bp, mouse
ggaatggatggatgtgagaa

SEQ ID NO: 731074 - DNA, 20 bp, mouse
gtgtgcttctagggacttca

SEQ ID NO: 731075 - DNA, 20 bp, mouse
ggaaagcattaccgtttgta

SEQ ID NO: 731076 - DNA, 20 bp, mouse
gggcactgaggcttagggtg

SEQ ID NO: 731077 - DNA, 20 bp, mouse
gtgagcagggtcggagactt

SEQ ID NO: 731078 - DNA, 20 bp, mouse
gccggtgcggccgaaagtct

SEQ ID NO: 731079 - DNA, 20 bp, mouse
gaccaggccgggaatgttct

SEQ ID NO: 731080 - DNA, 20 bp, mouse
gcggaggtggccggagggat

SEQ ID NO: 731081 - DNA, 20 bp, mouse
gagttacaggtgccagggtg

SEQ ID NO: 731082 - DNA, 20 bp, mouse
gctcccgaaagtaacccaat

SEQ ID NO: 731083 - DNA, 20 bp, mouse
gggtttgtggatcccggcga

SEQ ID NO: 731084 - DNA, 20 bp, mouse
ggcaaaaggagggccggctc

SEQ ID NO: 731085 - DNA, 20 bp, mouse
gagacttgggcatgagttac

SEQ ID NO: 731086 - DNA, 20 bp, mouse
gacatctggtagaggttgac

SEQ ID NO: 731087 - DNA, 20 bp, mouse
gcccagctgacatctggtag

SEQ ID NO: 731088 - DNA, 20 bp, mouse
gccaccttggcggtgatggt

SEQ ID NO: 731089 - DNA, 20 bp, mouse
gaagttccgccgggtttctc

SEQ ID NO: 731090 - DNA, 20 bp, mouse
gcggagcccgagaaacccgg

SEQ ID NO: 731091 - DNA, 20 bp, mouse
ggcccggagcccgagaaacc

SEQ ID NO: 731092 - DNA, 20 bp, mouse
gggctccgggctgtccacct

SEQ ID NO: 731093 - DNA, 20 bp, mouse
gaccgccaaggtggacagcc

SEQ ID NO: 731094 - DNA, 20 bp, mouse
gagcactgctctcaaggcta

SEQ ID NO: 731095 - DNA, 20 bp, mouse
gctgtccaccttggcggtga

SEQ ID NO: 731096 - DNA, 20 bp, mouse
gaggctgatggagaggtgat

SEQ ID NO: 731097 - DNA, 20 bp, mouse
ggatctactagtacaccctt

SEQ ID NO: 731098 - DNA, 20 bp, mouse
ggggggctcaagaactgaaa

SEQ ID NO: 731099 - DNA, 20 bp, mouse
gcacctctccatcagcctaa

SEQ ID NO: 731100 - DNA, 20 bp, mouse
gcataggtagagcagctagt

SEQ ID NO: 731101 - DNA, 20 bp, mouse
gcacccttaggctgatggag

SEQ ID NO: 731102 - DNA, 20 bp, mouse
gggtgtactagtagatccag

SEQ ID NO: 731103 - DNA, 20 bp, mouse
gataagggcagaccaagggc

SEQ ID NO: 731104 - DNA, 20 bp, mouse
gcacgcctctagcagcctat

SEQ ID NO: 731105 - DNA, 20 bp, mouse
gaccgtgagaagctgattcc

SEQ ID NO: 731106 - DNA, 20 bp, mouse
gcctcccaccctacaggcat

SEQ ID NO: 731107 - DNA, 20 bp, mouse
gcagccaatgcctgtagggt

SEQ ID NO: 731108 - DNA, 20 bp, mouse
gttcgcagccaatgcctgta

SEQ ID NO: 731109 - DNA, 20 bp, mouse
gggctcccgtccatcatacc

SEQ ID NO: 731110 - DNA, 20 bp, mouse
gcaggcattggctgcgaacg

SEQ ID NO: 731111 - DNA, 20 bp, mouse
gcccgctcctcccaccctac

SEQ ID NO: 731112 - DNA, 20 bp, mouse
gagagctcatactcaccaat

SEQ ID NO: 731113 - DNA, 20 bp, mouse
gtctgctgtgcggagagagt

SEQ ID NO: 731114 - DNA, 20 bp, mouse
gagctccgggcacacccccg

SEQ ID NO: 731115 - DNA, 20 bp, mouse
gtcgccctggccgctcaatc

SEQ ID NO: 731116 - DNA, 20 bp, mouse
gtgaacgcccaggaccgggg

SEQ ID NO: 731117 - DNA, 20 bp, mouse
gagaagggacagcgtgtcta

SEQ ID NO: 731118 - DNA, 20 bp, mouse
ggcaccgcctccccggtcct

SEQ ID NO: 731119 - DNA, 20 bp, mouse
gggtcctgggcgttcacagt

SEQ ID NO: 731120 - DNA, 20 bp, mouse
ggcctcggatgcgaggaatg

SEQ ID NO: 731121 - DNA, 20 bp, mouse
gtccgaggctccgctgtcct

SEQ ID NO: 731122 - DNA, 20 bp, mouse
gcgctgataccgaggagagg

SEQ ID NO: 731123 - DNA, 20 bp, mouse
gggttcgaaccagtattggg

SEQ ID NO: 731124 - DNA, 20 bp, mouse
ggccctgggcaccgcctccc

SEQ ID NO: 731125 - DNA, 20 bp, mouse
ggaggcgcccaagttctctg

SEQ ID NO: 731126 - DNA, 20 bp, mouse
ggcaacccgagggcggggat

SEQ ID NO: 731127 - DNA, 20 bp, mouse
gcgagggcggggatgggcgg

SEQ ID NO: 731128 - DNA, 20 bp, mouse
gggggcgccgggcaacccga

SEQ ID NO: 731129 - DNA, 20 bp, mouse
gacgctcgggccaatgggaa

SEQ ID NO: 731130 - DNA, 20 bp, mouse
gcggagggaggtggcgaggg

SEQ ID NO: 731131 - DNA, 20 bp, mouse
gacctcggggaatgacgctc

SEQ ID NO: 731132 - DNA, 20 bp, mouse
ggcgccgggcaacccgaggg

SEQ ID NO: 731133 - DNA, 20 bp, mouse
gcaggatggagagtgcccga

SEQ ID NO: 731134 - DNA, 20 bp, mouse
gacccctcccacagcgttga

SEQ ID NO: 731135 - DNA, 20 bp, mouse
gcaacagcgtcgctcggctc

SEQ ID NO: 731136 - DNA, 20 bp, mouse
gaatgtggtgagtaggtctg

SEQ ID NO: 731137 - DNA, 20 bp, mouse
gactaggcttatgctaatga

SEQ ID NO: 731138 - DNA, 20 bp, mouse
ggctctccgtctaaaactcg

SEQ ID NO: 731139 - DNA, 20 bp, mouse
gtggaatgctgagtgatgac

SEQ ID NO: 731140 - DNA, 20 bp, mouse
ggtggtgagtaggtctgtgg

SEQ ID NO: 731141 - DNA, 20 bp, mouse
gttgtcaaagtcaaaaatgt

SEQ ID NO: 731142 - DNA, 20 bp, mouse
gagcatccccgagttttaga

SEQ ID NO: 731143 - DNA, 20 bp, mouse
gaccctagaagctgaagctc

SEQ ID NO: 731144 - DNA, 20 bp, mouse
gtaaaaaggactgagtagta

SEQ ID NO: 731145 - DNA, 20 bp, mouse
gagaagctgaagctcaggga

SEQ ID NO: 731146 - DNA, 20 bp, mouse
ggcccaccccacaaagtcgg

SEQ ID NO: 731147 - DNA, 20 bp, mouse
gcggtccgctgttcccggtg

SEQ ID NO: 731148 - DNA, 20 bp, mouse
gaagggatccagtctaggga

SEQ ID NO: 731149 - DNA, 20 bp, mouse
gcaccccacaaagtcggagg

SEQ ID NO: 731150 - DNA, 20 bp, mouse
gcaactgcagggtgttcccg

SEQ ID NO: 731151 - DNA, 20 bp, mouse
ggcggcgaatggcgtcgtgg

SEQ ID NO: 731152 - DNA, 20 bp, mouse
gtgttcccgaggaatctccg

SEQ ID NO: 731153 - DNA, 20 bp, mouse
gcgccgcctccgactttgtg

SEQ ID NO: 731154 - DNA, 20 bp, mouse
ggcgaatggcgtcgtggagg

SEQ ID NO: 731155 - DNA, 20 bp, mouse
gccacgccgcggagattcct

SEQ ID NO: 731156 - DNA, 20 bp, mouse
gagctctggaacaggcccaa

SEQ ID NO: 731157 - DNA, 20 bp, mouse
gagaaggcgggtccacgcca

SEQ ID NO: 731158 - DNA, 20 bp, mouse
gaggcccaagggtgtcgagc

SEQ ID NO: 731159 - DNA, 20 bp, mouse
ggagcctgctcgacaccctt

SEQ ID NO: 731160 - DNA, 20 bp, mouse
ggagacccatcgggccgcgg

SEQ ID NO: 731161 - DNA, 20 bp, mouse
gaggtaccggggagacccat

SEQ ID NO: 731162 - DNA, 20 bp, mouse
ggtcgagcaggctcctgccc

SEQ ID NO: 731163 - DNA, 20 bp, mouse
gcaaaggacgcaggggacta

SEQ ID NO: 731164 - DNA, 20 bp, mouse
gactggggccgcctgagctc

SEQ ID NO: 731165 - DNA, 20 bp, mouse
gggaggctcccagaaagcgc

SEQ ID NO: 731166 - DNA, 20 bp, mouse
gtgtgcagcggggtccggag

SEQ ID NO: 731167 - DNA, 20 bp, mouse
gagcgggcccagctgcgacc

SEQ ID NO: 731168 - DNA, 20 bp, mouse
gagagacccgagctaggggc

SEQ ID NO: 731169 - DNA, 20 bp, mouse
gaaaagatgaaggcggtgat

SEQ ID NO: 731170 - DNA, 20 bp, mouse
ggccacacggagcctcgggg

SEQ ID NO: 731171 - DNA, 20 bp, mouse
gcgtcatcaaaagatgaagg

SEQ ID NO: 731172 - DNA, 20 bp, mouse
ggatcgagagacccgagcta

SEQ ID NO: 731173 - DNA, 20 bp, mouse
ggcagctgtgcagcggggtc

SEQ ID NO: 731174 - DNA, 20 bp, mouse
gtagcggcagctgtgcagcg

SEQ ID NO: 731175 - DNA, 20 bp, mouse
ggcgcgtcatcaaaagatga

SEQ ID NO: 731176 - DNA, 20 bp, mouse
gatagccaccataagagtcc

SEQ ID NO: 731177 - DNA, 20 bp, mouse
ggccaccataagagtcctgg

SEQ ID NO: 731178 - DNA, 20 bp, mouse
gtccaccaggactcttatgg

SEQ ID NO: 731179 - DNA, 20 bp, mouse
gtaaatgagcaggtggcagc

SEQ ID NO: 731180 - DNA, 20 bp, mouse
gggaaggcaaacgattgcct

SEQ ID NO: 731181 - DNA, 20 bp, mouse
gtgggtgtgatgactagcca

SEQ ID NO: 731182 - DNA, 20 bp, mouse
ggggtaatgcagagtccctt

SEQ ID NO: 731183 - DNA, 20 bp, mouse
gttaaggtcccaaaagttcc

SEQ ID NO: 731184 - DNA, 20 bp, mouse
ggtggagaaaataaatgagc

SEQ ID NO: 731185 - DNA, 20 bp, mouse
gatattcactagtgcccaaa

SEQ ID NO: 731186 - DNA, 20 bp, mouse
gagaaccgccaagctcgcca

SEQ ID NO: 731187 - DNA, 20 bp, mouse
gcggaagcgagcgcggtcgt

SEQ ID NO: 731188 - DNA, 20 bp, mouse
gtatggccaagtattgaaca

SEQ ID NO: 731189 - DNA, 20 bp, mouse
gtacacaccgccgattggta

SEQ ID NO: 731190 - DNA, 20 bp, mouse
gtccttctgtttggtaatgt

SEQ ID NO: 731191 - DNA, 20 bp, mouse
gtcagccctggcgagcttgg

SEQ ID NO: 731192 - DNA, 20 bp, mouse
gtttggtaatgtagggtcac

SEQ ID NO: 731193 - DNA, 20 bp, mouse
gtttctcccgtaccaatcgg

SEQ ID NO: 731194 - DNA, 20 bp, mouse
gctgtcagccctggcgagct

SEQ ID NO: 731195 - DNA, 20 bp, mouse
gttctttctcccgtaccaat

SEQ ID NO: 731196 - DNA, 20 bp, mouse
gagaaggagggaagtgcgac

SEQ ID NO: 731197 - DNA, 20 bp, mouse
ggcacccaatcgtgcgtcgg

SEQ ID NO: 731198 - DNA, 20 bp, mouse
ggcactgttccgccatcttg

SEQ ID NO: 731199 - DNA, 20 bp, mouse
gagtgctctaggcaccggaa

SEQ ID NO: 731200 - DNA, 20 bp, mouse
gaggaagcgcgacgcgtaag

SEQ ID NO: 731201 - DNA, 20 bp, mouse
ggggaccctggctagggaag

SEQ ID NO: 731202 - DNA, 20 bp, mouse
gcgcacgcgcacagtcacac

SEQ ID NO: 731203 - DNA, 20 bp, mouse
gggaacagtgctctaggcac

SEQ ID NO: 731204 - DNA, 20 bp, mouse
ggttccgccatcttggggag

SEQ ID NO: 731205 - DNA, 20 bp, mouse
gtcagcacccaatcgtgcgt

SEQ ID NO: 731206 - DNA, 20 bp, mouse
gctggcgcggccgtgacgtc

SEQ ID NO: 731207 - DNA, 20 bp, mouse
ggcaccacttgccctgcgtg

SEQ ID NO: 731208 - DNA, 20 bp, mouse
gtagcacaagcctgacgtca

SEQ ID NO: 731209 - DNA, 20 bp, mouse
gcggccctgggacccgagcg

SEQ ID NO: 731210 - DNA, 20 bp, mouse
gcgcacgtctagctgctccg

SEQ ID NO: 731211 - DNA, 20 bp, mouse
ggctctgaaagaagcgctgg

SEQ ID NO: 731212 - DNA, 20 bp, mouse
gaggtctccaggagtgattg

SEQ ID NO: 731213 - DNA, 20 bp, mouse
gaccgcgcgctaacctggcg

SEQ ID NO: 731214 - DNA, 20 bp, mouse
gagaagcgctggaggtctcc

SEQ ID NO: 731215 - DNA, 20 bp, mouse
gacaccctcgctcgggtccc

SEQ ID NO: 731216 - DNA, 20 bp, mouse
gtggagtcaagcacaatgaa

SEQ ID NO: 731217 - DNA, 20 bp, mouse
gccccacctgcgcttctcaa

SEQ ID NO: 731218 - DNA, 20 bp, mouse
gctaaacccctcattatgag

SEQ ID NO: 731219 - DNA, 20 bp, mouse
gctgaaatgtggtccttaag

SEQ ID NO: 731220 - DNA, 20 bp, mouse
ggtaaggaccagtgtgaggt

SEQ ID NO: 731221 - DNA, 20 bp, mouse
gagaagcgcaggtggggctg

SEQ ID NO: 731222 - DNA, 20 bp, mouse
gtccttaagtggctgtcatt

SEQ ID NO: 731223 - DNA, 20 bp, mouse
gaggtgttgggtgtaactca

SEQ ID NO: 731224 - DNA, 20 bp, mouse
gtgagaaattagtataagaa

SEQ ID NO: 731225 - DNA, 20 bp, mouse
gccagtgtgaggtaggtgaa

SEQ ID NO: 731226 - DNA, 20 bp, mouse
ggtcagcgctggagatgcgg

SEQ ID NO: 731227 - DNA, 20 bp, mouse
gaggaagccaccgggatgca

SEQ ID NO: 731228 - DNA, 20 bp, mouse
ggcagccagaggacatctgc

SEQ ID NO: 731229 - DNA, 20 bp, mouse
gagacagcagtgaaaggaca

SEQ ID NO: 731230 - DNA, 20 bp, mouse
ggaaaggacacggagtgggc

SEQ ID NO: 731231 - DNA, 20 bp, mouse
ggcagtgaaaggacacggag

SEQ ID NO: 731232 - DNA, 20 bp, mouse
gtaccactgtccctgcatcc

SEQ ID NO: 731233 - DNA, 20 bp, mouse
gcatctccagcgctgaccgc

SEQ ID NO: 731234 - DNA, 20 bp, mouse
gaggaacctgccccggaagc

SEQ ID NO: 731235 - DNA, 20 bp, mouse
gcactgtccctgcatcccgg

SEQ ID NO: 731236 - DNA, 20 bp, mouse
gtcccgggaaggcgaggcac

SEQ ID NO: 731237 - DNA, 20 bp, mouse
ggggcagtgggctagagact

SEQ ID NO: 731238 - DNA, 20 bp, mouse
gccaggaaggcacagatcta

SEQ ID NO: 731239 - DNA, 20 bp, mouse
gcggctgggcgagctgatac

SEQ ID NO: 731240 - DNA, 20 bp, mouse
ggcaccccgcagtgctcacg

SEQ ID NO: 731241 - DNA, 20 bp, mouse
gcgggtacactgcagaatta

SEQ ID NO: 731242 - DNA, 20 bp, mouse
ggcttcagatcgctcccggc

SEQ ID NO: 731243 - DNA, 20 bp, mouse
gcagctcccatccaatccag

SEQ ID NO: 731244 - DNA, 20 bp, mouse
gtacccgtgcctcgccttcc

SEQ ID NO: 731245 - DNA, 20 bp, mouse
gaagcagcaagccactggat

SEQ ID NO: 731246 - DNA, 20 bp, mouse
gcattcataaagtatgagaa

SEQ ID NO: 731247 - DNA, 20 bp, mouse
gcgaacttaactctcagcta

SEQ ID NO: 731248 - DNA, 20 bp, mouse
ggtgtctcccactttgtccc

SEQ ID NO: 731249 - DNA, 20 bp, mouse
gcatcctggagttcaacctc

SEQ ID NO: 731250 - DNA, 20 bp, mouse
gtgcggtgcttcagcggtag

SEQ ID NO: 731251 - DNA, 20 bp, mouse
gtgccctgaggttgaactcc

SEQ ID NO: 731252 - DNA, 20 bp, mouse
gcatactttatgaatgagaa

SEQ ID NO: 731253 - DNA, 20 bp, mouse
gaccaaactcatgttgagta

SEQ ID NO: 731254 - DNA, 20 bp, mouse
gtcattgttgacttactact

SEQ ID NO: 731255 - DNA, 20 bp, mouse
gacatgagtttggttcctga

SEQ ID NO: 731256 - DNA, 20 bp, mouse
ggctccacccccgacaggga

SEQ ID NO: 731257 - DNA, 20 bp, mouse
ggggtggagcctgatggcgc

SEQ ID NO: 731258 - DNA, 20 bp, mouse
gaccggaaacagtgctgctg

SEQ ID NO: 731259 - DNA, 20 bp, mouse
ggagcacgatcagtcaaggt

SEQ ID NO: 731260 - DNA, 20 bp, mouse
gaaagggcttctttggagaa

SEQ ID NO: 731261 - DNA, 20 bp, mouse
gcagtaggcagtgataacta

SEQ ID NO: 731262 - DNA, 20 bp, mouse
gtctgtcccctccctgtcgg

SEQ ID NO: 731263 - DNA, 20 bp, mouse
ggcctcgggcccaaaggccc

SEQ ID NO: 731264 - DNA, 20 bp, mouse
gtcaggctccacccccgaca

SEQ ID NO: 731265 - DNA, 20 bp, mouse
gcctactgtaaaatgtacgc

SEQ ID NO: 731266 - DNA, 20 bp, mouse
ggagacagccgcaagaataa

SEQ ID NO: 731267 - DNA, 20 bp, mouse
gaggcactactgagtgtcgt

SEQ ID NO: 731268 - DNA, 20 bp, mouse
gagagcggccattattcttg

SEQ ID NO: 731269 - DNA, 20 bp, mouse
ggctgtctcggtctcgctgg

SEQ ID NO: 731270 - DNA, 20 bp, mouse
ggcggctgtctcggtctcgc

SEQ ID NO: 731271 - DNA, 20 bp, mouse
gtatcagaagatggcgctgt

SEQ ID NO: 731272 - DNA, 20 bp, mouse
gggaactcgccagcacgggg

SEQ ID NO: 731273 - DNA, 20 bp, mouse
ggagtgtcgtggggtgaaag

SEQ ID NO: 731274 - DNA, 20 bp, mouse
gggtctcgctggaggcctgt

SEQ ID NO: 731275 - DNA, 20 bp, mouse
gcacgtggggcgttacgcag

SEQ ID NO: 731276 - DNA, 20 bp, mouse
gcaacgagacggatagtggg

SEQ ID NO: 731277 - DNA, 20 bp, mouse
gaccggggtacattccccga

SEQ ID NO: 731278 - DNA, 20 bp, mouse
gaagatgaacggtgccctcg

SEQ ID NO: 731279 - DNA, 20 bp, mouse
gactgtggaaagcccggatg

SEQ ID NO: 731280 - DNA, 20 bp, mouse
gagtgtcttaaggtgcagtg

SEQ ID NO: 731281 - DNA, 20 bp, mouse
gggctggtaggcaagatgaa

SEQ ID NO: 731282 - DNA, 20 bp, mouse
gatgaggcccaccaacgaga

SEQ ID NO: 731283 - DNA, 20 bp, mouse
gtggggaaaacccgggaccg

SEQ ID NO: 731284 - DNA, 20 bp, mouse
gcggatgaggccctctggtt

SEQ ID NO: 731285 - DNA, 20 bp, mouse
gccttaagacactaggttct

SEQ ID NO: 731286 - DNA, 20 bp, mouse
gggggagcagttggctgcaa

SEQ ID NO: 731287 - DNA, 20 bp, mouse
gccagtgcacgttctttcct

SEQ ID NO: 731288 - DNA, 20 bp, mouse
gttgctggacttcactaagg

SEQ ID NO: 731289 - DNA, 20 bp, mouse
gcaaggaggaagcaaaatgt

SEQ ID NO: 731290 - DNA, 20 bp, mouse
gggacatgaggtagctagag

SEQ ID NO: 731291 - DNA, 20 bp, mouse
gaactgctccccagctgcga

SEQ ID NO: 731292 - DNA, 20 bp, mouse
gactccgcccttcgcagctg

SEQ ID NO: 731293 - DNA, 20 bp, mouse
ggctccccagctgcgaaggg

SEQ ID NO: 731294 - DNA, 20 bp, mouse
gaagctcacgtccggacatg

SEQ ID NO: 731295 - DNA, 20 bp, mouse
gctcccgagacgctattcaa

SEQ ID NO: 731296 - DNA, 20 bp, mouse
gcggtcccctccctggtcgc

SEQ ID NO: 731297 - DNA, 20 bp, mouse
ggaggggaccgaagagagtc

SEQ ID NO: 731298 - DNA, 20 bp, mouse
gagcgcctgcgaccagggag

SEQ ID NO: 731299 - DNA, 20 bp, mouse
gggcggagctatgatggcag

SEQ ID NO: 731300 - DNA, 20 bp, mouse
gggagctatgatggcagggg

SEQ ID NO: 731301 - DNA, 20 bp, mouse
gggtggcggcgccacgtccc

SEQ ID NO: 731302 - DNA, 20 bp, mouse
ggtcacagcgcctgcgacca

SEQ ID NO: 731303 - DNA, 20 bp, mouse
gctggcccgaaacgcgatca

SEQ ID NO: 731304 - DNA, 20 bp, mouse
ggcgcggggcggagctatga

SEQ ID NO: 731305 - DNA, 20 bp, mouse
gggggcggagctatgccgga

SEQ ID NO: 731306 - DNA, 20 bp, mouse
gccgcggagcaagctcttaa

SEQ ID NO: 731307 - DNA, 20 bp, mouse
gtccgcccccgaccaatcag

SEQ ID NO: 731308 - DNA, 20 bp, mouse
gtcccaccgcacatgatcaa

SEQ ID NO: 731309 - DNA, 20 bp, mouse
gtctgcctctgattggtcgg

SEQ ID NO: 731310 - DNA, 20 bp, mouse
ggccgagggtacaaccacag

SEQ ID NO: 731311 - DNA, 20 bp, mouse
gaacggttctgttgtctgaa

SEQ ID NO: 731312 - DNA, 20 bp, mouse
gcagcgctcagtttagagtc

SEQ ID NO: 731313 - DNA, 20 bp, mouse
ggtctgaagggaagcggcgg

SEQ ID NO: 731314 - DNA, 20 bp, mouse
ggccgctaaccgttctgggc

SEQ ID NO: 731315 - DNA, 20 bp, mouse
gcggtgggatttgtgttcag

SEQ ID NO: 731316 - DNA, 20 bp, mouse
gtggggccgcggcacctcgt

SEQ ID NO: 731317 - DNA, 20 bp, mouse
gggccccaggagaacattcg

SEQ ID NO: 731318 - DNA, 20 bp, mouse
gcacctgagcgcagcggaga

SEQ ID NO: 731319 - DNA, 20 bp, mouse
gctgagagagactacctcgg

SEQ ID NO: 731320 - DNA, 20 bp, mouse
gctccccgggaccacttgac

SEQ ID NO: 731321 - DNA, 20 bp, mouse
gagaacattcgaggcaacgg

SEQ ID NO: 731322 - DNA, 20 bp, mouse
ggagggcagtggctgtcagt

SEQ ID NO: 731323 - DNA, 20 bp, mouse
ggaggcccaaccatgcggaa

SEQ ID NO: 731324 - DNA, 20 bp, mouse
gtgacagccactgccctccc

SEQ ID NO: 731325 - DNA, 20 bp, mouse
gaaagctacgaatttcgacg

SEQ ID NO: 731326 - DNA, 20 bp, mouse
gcaggagggcaaaggtcata

SEQ ID NO: 731327 - DNA, 20 bp, mouse
gcggggttgaccccactcat

SEQ ID NO: 731328 - DNA, 20 bp, mouse
gggggcctcagacccgggaa

SEQ ID NO: 731329 - DNA, 20 bp, mouse
ggtctgaggccccatgagtg

SEQ ID NO: 731330 - DNA, 20 bp, mouse
gtccccgggaagggctagtc

SEQ ID NO: 731331 - DNA, 20 bp, mouse
gaggctgtggctccccggga

SEQ ID NO: 731332 - DNA, 20 bp, mouse
gagggcaaaggtcataaggg

SEQ ID NO: 731333 - DNA, 20 bp, mouse
gtcagcgctgaacctttccc

SEQ ID NO: 731334 - DNA, 20 bp, mouse
gactgtaggcacaggacctc

SEQ ID NO: 731335 - DNA, 20 bp, mouse
gtagcccggcaggagggcaa

SEQ ID NO: 731336 - DNA, 20 bp, mouse
gatagagggcgggccgggaa

SEQ ID NO: 731337 - DNA, 20 bp, mouse
gcgggtgaaatcgctgcaat

SEQ ID NO: 731338 - DNA, 20 bp, mouse
gcagagggcggtccaggcta

SEQ ID NO: 731339 - DNA, 20 bp, mouse
gcggtccaggctagggagga

SEQ ID NO: 731340 - DNA, 20 bp, mouse
gggcctatgtccgcagaggg

SEQ ID NO: 731341 - DNA, 20 bp, mouse
gcctaggagccgagtctcag

SEQ ID NO: 731342 - DNA, 20 bp, mouse
gagtggcgcagcttgtgggt

SEQ ID NO: 731343 - DNA, 20 bp, mouse
gtgtccgcagagggcggtcc

SEQ ID NO: 731344 - DNA, 20 bp, mouse
ggcgtggcctatgtccgcag

SEQ ID NO: 731345 - DNA, 20 bp, mouse
gagggcggtccaggctaggg

SEQ ID NO: 731346 - DNA, 20 bp, mouse
gtgtaacatgagaaggaggt

SEQ ID NO: 731347 - DNA, 20 bp, mouse
gtatgtgtaacatgagaagg

SEQ ID NO: 731348 - DNA, 20 bp, mouse
gcaaaacaactgtgaataat

SEQ ID NO: 731349 - DNA, 20 bp, mouse
gaacaactgtgaataatagg

SEQ ID NO: 731350 - DNA, 20 bp, mouse
gagttttatagtcttgagtc

SEQ ID NO: 731351 - DNA, 20 bp, mouse
gacaggtacaagttcagaca

SEQ ID NO: 731352 - DNA, 20 bp, mouse
gagatgttatgtaactttaa

SEQ ID NO: 731353 - DNA, 20 bp, mouse
gaatagggggatagttctca

SEQ ID NO: 731354 - DNA, 20 bp, mouse
gtattctgagaaatcatgac

SEQ ID NO: 731355 - DNA, 20 bp, mouse
gtattacctaacagacttat

SEQ ID NO: 731356 - DNA, 20 bp, mouse
gtgtaggcacagccagtaat

SEQ ID NO: 731357 - DNA, 20 bp, mouse
gccaggaagccagtgtgggt

SEQ ID NO: 731358 - DNA, 20 bp, mouse
gagggccaggaagccagtgt

SEQ ID NO: 731359 - DNA, 20 bp, mouse
gtggttgatgagcagatgga

SEQ ID NO: 731360 - DNA, 20 bp, mouse
gggagacttaagatgaaatt

SEQ ID NO: 731361 - DNA, 20 bp, mouse
gggatagggagtcttcagtg

SEQ ID NO: 731362 - DNA, 20 bp, mouse
gttgatgagcagatggaggg

SEQ ID NO: 731363 - DNA, 20 bp, mouse
gccctggcattccccattac

SEQ ID NO: 731364 - DNA, 20 bp, mouse
gtgagcagatggagggagga

SEQ ID NO: 731365 - DNA, 20 bp, mouse
gctcatcaaccaacccacac

SEQ ID NO: 731366 - DNA, 20 bp, mouse
gtacaaaagttgtaaggtta

SEQ ID NO: 731367 - DNA, 20 bp, mouse
ggagaagtgctgaatcagcc

SEQ ID NO: 731368 - DNA, 20 bp, mouse
ggctgaggtctgaactccaa

SEQ ID NO: 731369 - DNA, 20 bp, mouse
gttcagctacatgacacagt

SEQ ID NO: 731370 - DNA, 20 bp, mouse
ggaagagtctaatacgctca

SEQ ID NO: 731371 - DNA, 20 bp, mouse
gattcagcacttctcaccca

SEQ ID NO: 731372 - DNA, 20 bp, mouse
gtagtgaccacagtgtttac

SEQ ID NO: 731373 - DNA, 20 bp, mouse
gcaattctctggcttccgaa

SEQ ID NO: 731374 - DNA, 20 bp, mouse
gtctaagtagagcagaacct

SEQ ID NO: 731375 - DNA, 20 bp, mouse
gttcatttcttgaacagcac

SEQ ID NO: 731376 - DNA, 20 bp, mouse
ggtagcagtcatatatacac

SEQ ID NO: 731377 - DNA, 20 bp, mouse
gtaaacactgtggtcactat

SEQ ID NO: 731378 - DNA, 20 bp, mouse
gaagtagagcagaagaacct

SEQ ID NO: 731379 - DNA, 20 bp, mouse
gaacctctctaacttctgaa

SEQ ID NO: 731380 - DNA, 20 bp, mouse
ggagtcatggaccgctgagt

SEQ ID NO: 731381 - DNA, 20 bp, mouse
gctaagaggtttcccaggcc

SEQ ID NO: 731382 - DNA, 20 bp, mouse
ggtgaaagatagtaacaaac

SEQ ID NO: 731383 - DNA, 20 bp, mouse
gtgttaaaactccctgacca

SEQ ID NO: 731384 - DNA, 20 bp, mouse
gaataaaaactccgactcag

SEQ ID NO: 731385 - DNA, 20 bp, mouse
ggaagtgcctttgtgattct

SEQ ID NO: 731386 - DNA, 20 bp, mouse
gtggacttgacgggcctgga

SEQ ID NO: 731387 - DNA, 20 bp, mouse
gttgaagaaacactcagtga

SEQ ID NO: 731388 - DNA, 20 bp, mouse
gcccgtcaagtccactgtgc

SEQ ID NO: 731389 - DNA, 20 bp, mouse
gggtgtatcttcaactagag

SEQ ID NO: 731390 - DNA, 20 bp, mouse
gtcccagccaaaacagcagt

SEQ ID NO: 731391 - DNA, 20 bp, mouse
gtattggctgtcttcagtca

SEQ ID NO: 731392 - DNA, 20 bp, mouse
gagtgtttcttcaatctgag

SEQ ID NO: 731393 - DNA, 20 bp, mouse
gaaatagaaacctatcttat

SEQ ID NO: 731394 - DNA, 20 bp, mouse
gggtgtgtcttcctgcacag

SEQ ID NO: 731395 - DNA, 20 bp, mouse
ggagggttctgagtgttaat

SEQ ID NO: 731396 - DNA, 20 bp, mouse
gaaagatgtaagcaggtggg

SEQ ID NO: 731397 - DNA, 20 bp, mouse
ggggcggaccctgtccctat

SEQ ID NO: 731398 - DNA, 20 bp, mouse
ggggaagtttgaaaacaatc

SEQ ID NO: 731399 - DNA, 20 bp, mouse
gagaagaagaggcttgtact

SEQ ID NO: 731400 - DNA, 20 bp, mouse
gtgagaggtttgaaagctaa

SEQ ID NO: 731401 - DNA, 20 bp, mouse
ggttcaggaaagatgtaagc

SEQ ID NO: 731402 - DNA, 20 bp, mouse
gcttgtactgggaaccaata

SEQ ID NO: 731403 - DNA, 20 bp, mouse
gcagggtccgcccctttgag

SEQ ID NO: 731404 - DNA, 20 bp, mouse
gctgggaaccaatagggaca

SEQ ID NO: 731405 - DNA, 20 bp, mouse
gtgtgggtacatgacctttt

SEQ ID NO: 731406 - DNA, 20 bp, mouse
gaggtaacgagataagtgga

SEQ ID NO: 731407 - DNA, 20 bp, mouse
gcaggaggtaacgagataag

SEQ ID NO: 731408 - DNA, 20 bp, mouse
gaacgagataagtggagggc

SEQ ID NO: 731409 - DNA, 20 bp, mouse
gcctgcctgataacacacac

SEQ ID NO: 731410 - DNA, 20 bp, mouse
gttgctgtcaaacctccaag

SEQ ID NO: 731411 - DNA, 20 bp, mouse
gagacagtgacttaaatcag

SEQ ID NO: 731412 - DNA, 20 bp, mouse
gaaagaggctttacagctgt

SEQ ID NO: 731413 - DNA, 20 bp, mouse
gtgtgccaacattcttcttg

SEQ ID NO: 731414 - DNA, 20 bp, mouse
gcttgcggagtttgcactta

SEQ ID NO: 731415 - DNA, 20 bp, mouse
gtcttgcttgtgaacaaata

SEQ ID NO: 731416 - DNA, 20 bp, mouse
gcctccgcggctagcatgtc

SEQ ID NO: 731417 - DNA, 20 bp, mouse
gcatgctagccgcggaggac

SEQ ID NO: 731418 - DNA, 20 bp, mouse
ggaggctggacagagtcttg

SEQ ID NO: 731419 - DNA, 20 bp, mouse
gtgaccagacatgctagccg

SEQ ID NO: 731420 - DNA, 20 bp, mouse
ggtgctggtcccaaatcacg

SEQ ID NO: 731421 - DNA, 20 bp, mouse
gtggctggggcggagccttc

SEQ ID NO: 731422 - DNA, 20 bp, mouse
gccagagcccagcggaggtg

SEQ ID NO: 731423 - DNA, 20 bp, mouse
gacagtgacgaccagaccga

SEQ ID NO: 731424 - DNA, 20 bp, mouse
gcacgtgaagtttttggatc

SEQ ID NO: 731425 - DNA, 20 bp, mouse
gagcctcctgtccctcggtc

SEQ ID NO: 731426 - DNA, 20 bp, mouse
ggtgctcctgggaccgcaaa

SEQ ID NO: 731427 - DNA, 20 bp, mouse
gtactgagagcctgtctgtc

SEQ ID NO: 731428 - DNA, 20 bp, mouse
ggaaggctccgcccaagggt

SEQ ID NO: 731429 - DNA, 20 bp, mouse
ggaactgtgagtcaccctgg

SEQ ID NO: 731430 - DNA, 20 bp, mouse
gttaagacttccagacagac

SEQ ID NO: 731431 - DNA, 20 bp, mouse
gccaggagcacatgcctgac

SEQ ID NO: 731432 - DNA, 20 bp, mouse
gccatggtttatgctagaac

SEQ ID NO: 731433 - DNA, 20 bp, mouse
gcctgtgagtcaagtggcgg

SEQ ID NO: 731434 - DNA, 20 bp, mouse
gtatgctagaactggctgcc

SEQ ID NO: 731435 - DNA, 20 bp, mouse
gcacctgcctctttgaacgc

SEQ ID NO: 731436 - DNA, 20 bp, mouse
gtaggaagcaggggctctca

SEQ ID NO: 731437 - DNA, 20 bp, mouse
ggcagcgagccaacttcagt

SEQ ID NO: 731438 - DNA, 20 bp, mouse
ggctcgctgccagcgtgagt

SEQ ID NO: 731439 - DNA, 20 bp, mouse
gtctgtatacctactcacgc

SEQ ID NO: 731440 - DNA, 20 bp, mouse
ggcaggggctctcatgggac

SEQ ID NO: 731441 - DNA, 20 bp, mouse
gtcaggaaattttaggaagc

SEQ ID NO: 731442 - DNA, 20 bp, mouse
gggagggatgcacactagtt

SEQ ID NO: 731443 - DNA, 20 bp, mouse
gagcaggatgaggcaaacag

SEQ ID NO: 731444 - DNA, 20 bp, mouse
gaacagagactaagcgaagc

SEQ ID NO: 731445 - DNA, 20 bp, mouse
ggtcggtccaagagtgtgtc

SEQ ID NO: 731446 - DNA, 20 bp, mouse
gtaaccgctgtgattgttaa

SEQ ID NO: 731447 - DNA, 20 bp, mouse
gtccctggttgcttagttaa

SEQ ID NO: 731448 - DNA, 20 bp, mouse
gcatgacctcatggatgggg

SEQ ID NO: 731449 - DNA, 20 bp, mouse
ggagatcttggcaaccagct

SEQ ID NO: 731450 - DNA, 20 bp, mouse
gaggaaaccttcaatcttga

SEQ ID NO: 731451 - DNA, 20 bp, mouse
gtgaagcaaaattctcgaag

SEQ ID NO: 731452 - DNA, 20 bp, mouse
ggcttcatgacctcatggat

SEQ ID NO: 731453 - DNA, 20 bp, mouse
gcaaataccatcaagattga

SEQ ID NO: 731454 - DNA, 20 bp, mouse
gttgcagtctatcttgattg

SEQ ID NO: 731455 - DNA, 20 bp, mouse
gtggtaaggacacactaact

SEQ ID NO: 731456 - DNA, 20 bp, mouse
gtggccgagtgacccttcac

SEQ ID NO: 731457 - DNA, 20 bp, mouse
gcactcggccaagacatcag

SEQ ID NO: 731458 - DNA, 20 bp, mouse
gtgacccttcacaggccaag

SEQ ID NO: 731459 - DNA, 20 bp, mouse
gccaaggcacccatgaacct

SEQ ID NO: 731460 - DNA, 20 bp, mouse
gtggcctgtgaagggtcact

SEQ ID NO: 731461 - DNA, 20 bp, mouse
gtggcacagtccttcccgat

SEQ ID NO: 731462 - DNA, 20 bp, mouse
gctctcatgagggaatcctg

SEQ ID NO: 731463 - DNA, 20 bp, mouse
gcaaaggattcctggggaca

SEQ ID NO: 731464 - DNA, 20 bp, mouse
ggtgccttggggctgaaatg

SEQ ID NO: 731465 - DNA, 20 bp, mouse
gactgaaacacactgcccat

SEQ ID NO: 731466 - DNA, 20 bp, mouse
gtggcccggaagttgacgtt

SEQ ID NO: 731467 - DNA, 20 bp, mouse
ggcgggttaggtgaggactt

SEQ ID NO: 731468 - DNA, 20 bp, mouse
gcagagaataagtttcgtga

SEQ ID NO: 731469 - DNA, 20 bp, mouse
gggaagcggcgggttaggtg

SEQ ID NO: 731470 - DNA, 20 bp, mouse
gcctgtggaagcggcgggtt

SEQ ID NO: 731471 - DNA, 20 bp, mouse
gccgtgagaaagtgagaaac

SEQ ID NO: 731472 - DNA, 20 bp, mouse
gtcttctaagcggcacccag

SEQ ID NO: 731473 - DNA, 20 bp, mouse
gagaataagtttcgtgaggg

SEQ ID NO: 731474 - DNA, 20 bp, mouse
ggaaacagaaaccgatctgt

SEQ ID NO: 731475 - DNA, 20 bp, mouse
gtgggcgggaagtttatggt

SEQ ID NO: 731476 - DNA, 20 bp, mouse
ggaagcctgcagtttatcca

SEQ ID NO: 731477 - DNA, 20 bp, mouse
gtatccagggagacgcactg

SEQ ID NO: 731478 - DNA, 20 bp, mouse
gactcttatctgttaggtag

SEQ ID NO: 731479 - DNA, 20 bp, mouse
gttcagtggagaatgcagta

SEQ ID NO: 731480 - DNA, 20 bp, mouse
gtaaagggctgggtgagcta

SEQ ID NO: 731481 - DNA, 20 bp, mouse
gagaccccctagtgccacat

SEQ ID NO: 731482 - DNA, 20 bp, mouse
gctaacagataagagtctct

SEQ ID NO: 731483 - DNA, 20 bp, mouse
gactgaaatcgatgaggaga

SEQ ID NO: 731484 - DNA, 20 bp, mouse
gtaagagtctctgggtggca

SEQ ID NO: 731485 - DNA, 20 bp, mouse
ggccccacagtgcgtctccc

SEQ ID NO: 731486 - DNA, 20 bp, mouse
gttaggggagatgacttcag

SEQ ID NO: 731487 - DNA, 20 bp, mouse
ggacaatagcaggacacagt

SEQ ID NO: 731488 - DNA, 20 bp, mouse
gggcggagaagggcaccctc

SEQ ID NO: 731489 - DNA, 20 bp, mouse
ggggataataaagctaaaag

SEQ ID NO: 731490 - DNA, 20 bp, mouse
gaagctaaaagcggcggaga

SEQ ID NO: 731491 - DNA, 20 bp, mouse
gggaggaagcagcgctaaga

SEQ ID NO: 731492 - DNA, 20 bp, mouse
gataataaagctaaaagcgg

SEQ ID NO: 731493 - DNA, 20 bp, mouse
gaccctctggcgacaatagc

SEQ ID NO: 731494 - DNA, 20 bp, mouse
gtcccagggagctttgtttt

SEQ ID NO: 731495 - DNA, 20 bp, mouse
ggcagaaatacttccggaat

SEQ ID NO: 731496 - DNA, 20 bp, mouse
gggacgtagtcattaaaagc

SEQ ID NO: 731497 - DNA, 20 bp, mouse
gatataagggggcagtgggg

SEQ ID NO: 731498 - DNA, 20 bp, mouse
gctggtgtcagagggtggcg

SEQ ID NO: 731499 - DNA, 20 bp, mouse
gcaagtagcaaaacaccagg

SEQ ID NO: 731500 - DNA, 20 bp, mouse
gacagcacagcgaatccccc

SEQ ID NO: 731501 - DNA, 20 bp, mouse
gattcaagtagcaaaacacc

SEQ ID NO: 731502 - DNA, 20 bp, mouse
gaggacatagaaggtctcag

SEQ ID NO: 731503 - DNA, 20 bp, mouse
ggctgtggccaggacataga

SEQ ID NO: 731504 - DNA, 20 bp, mouse
gtatgtcctggccacagcat

SEQ ID NO: 731505 - DNA, 20 bp, mouse
gactctgcctctggtgtcag

SEQ ID NO: 731506 - DNA, 20 bp, mouse
ggattaggacagcttgaaaa

SEQ ID NO: 731507 - DNA, 20 bp, mouse
gcggagttaagggcaaatag

SEQ ID NO: 731508 - DNA, 20 bp, mouse
gtaagcagaagggaacaacg

SEQ ID NO: 731509 - DNA, 20 bp, mouse
gtactgtaacctatgcactg

SEQ ID NO: 731510 - DNA, 20 bp, mouse
ggcttgaaaaggggtgggag

SEQ ID NO: 731511 - DNA, 20 bp, mouse
gtaccattagggtgtgggca

SEQ ID NO: 731512 - DNA, 20 bp, mouse
gcaagttaccattagggtgt

SEQ ID NO: 731513 - DNA, 20 bp, mouse
ggtggtttcaagttaccatt

SEQ ID NO: 731514 - DNA, 20 bp, mouse
ggccctgtctgtacagaggg

SEQ ID NO: 731515 - DNA, 20 bp, mouse
ggcagctcaccccctccact

SEQ ID NO: 731516 - DNA, 20 bp, mouse
gaggaccccggggagtcgca

SEQ ID NO: 731517 - DNA, 20 bp, mouse
gtccgcctcctccctaggga

SEQ ID NO: 731518 - DNA, 20 bp, mouse
ggccccctccctccctaggg

SEQ ID NO: 731519 - DNA, 20 bp, mouse
ggtagcagcggcttggtggt

SEQ ID NO: 731520 - DNA, 20 bp, mouse
gtgccagccttgcgactccc

SEQ ID NO: 731521 - DNA, 20 bp, mouse
gtccctccctagggaggagg

SEQ ID NO: 731522 - DNA, 20 bp, mouse
gccccggggtcctggcttcc

SEQ ID NO: 731523 - DNA, 20 bp, mouse
gtggcaggtgggactcaaca

SEQ ID NO: 731524 - DNA, 20 bp, mouse
gtcccagcggcccaaccttg

SEQ ID NO: 731525 - DNA, 20 bp, mouse
gccctccctccctagggagg

SEQ ID NO: 731526 - DNA, 20 bp, mouse
ggctggggagactagatctg

SEQ ID NO: 731527 - DNA, 20 bp, mouse
gtatgcctactgtaagcagg

SEQ ID NO: 731528 - DNA, 20 bp, mouse
gtctccagagggccttactg

SEQ ID NO: 731529 - DNA, 20 bp, mouse
gtccctggaagtttatacag

SEQ ID NO: 731530 - DNA, 20 bp, mouse
ggggccttactgtggggaat

SEQ ID NO: 731531 - DNA, 20 bp, mouse
gcagccggggagcttatgga

SEQ ID NO: 731532 - DNA, 20 bp, mouse
gagggctaaaacttgtctga

SEQ ID NO: 731533 - DNA, 20 bp, mouse
gggctggatactgaagtggg

SEQ ID NO: 731534 - DNA, 20 bp, mouse
gcaggtttagggatgtacca

SEQ ID NO: 731535 - DNA, 20 bp, mouse
gcagccaattccccacagta

SEQ ID NO: 731536 - DNA, 20 bp, mouse
gtcaggaaggattgtgaatc

SEQ ID NO: 731537 - DNA, 20 bp, mouse
gaactggcgttcatagtgag

SEQ ID NO: 731538 - DNA, 20 bp, mouse
gggaagggacgcttcagcgt

SEQ ID NO: 731539 - DNA, 20 bp, mouse
gttgggacaagtcctgactt

SEQ ID NO: 731540 - DNA, 20 bp, mouse
gcctggctgggaccttgata

SEQ ID NO: 731541 - DNA, 20 bp, mouse
gccctcactcttaaacactg

SEQ ID NO: 731542 - DNA, 20 bp, mouse
ggatcaaattactccagggc

SEQ ID NO: 731543 - DNA, 20 bp, mouse
ggctctgggttcagaggggc

SEQ ID NO: 731544 - DNA, 20 bp, mouse
gcggggatctaaaaagcctg

SEQ ID NO: 731545 - DNA, 20 bp, mouse
gctgcggatcaaattactcc

SEQ ID NO: 731546 - DNA, 20 bp, mouse
gtggcgcaggggcctttgat

SEQ ID NO: 731547 - DNA, 20 bp, mouse
gagagagagcagcgggactc

SEQ ID NO: 731548 - DNA, 20 bp, mouse
gaaaggcccctgcgccacat

SEQ ID NO: 731549 - DNA, 20 bp, mouse
gggacgctggggtgcaaggg

SEQ ID NO: 731550 - DNA, 20 bp, mouse
ggtagcaaggggctataagc

SEQ ID NO: 731551 - DNA, 20 bp, mouse
gactagggctgagaaaacat

SEQ ID NO: 731552 - DNA, 20 bp, mouse
gcagccagggagggtagcaa

SEQ ID NO: 731553 - DNA, 20 bp, mouse
ggctctctctacttcacaaa

SEQ ID NO: 731554 - DNA, 20 bp, mouse
ggcagcgggactctggtggg

SEQ ID NO: 731555 - DNA, 20 bp, mouse
ggggggacgctggggtgcaa

SEQ ID NO: 731556 - DNA, 20 bp, mouse
gcacttcccagacagttcat

SEQ ID NO: 731557 - DNA, 20 bp, mouse
gactgggatctggtatagga

SEQ ID NO: 731558 - DNA, 20 bp, mouse
gctgaactgggatctggtat

SEQ ID NO: 731559 - DNA, 20 bp, mouse
gttcaagaagggcaaaaatc

SEQ ID NO: 731560 - DNA, 20 bp, mouse
gctaggatagggttcaagaa

SEQ ID NO: 731561 - DNA, 20 bp, mouse
ggaaacccatgtccacttac

SEQ ID NO: 731562 - DNA, 20 bp, mouse
gctgctgtagctattggcct

SEQ ID NO: 731563 - DNA, 20 bp, mouse
gcattggtcctggctcaaca

SEQ ID NO: 731564 - DNA, 20 bp, mouse
gcggcaccctggagatggga

SEQ ID NO: 731565 - DNA, 20 bp, mouse
gccttcggcaccctggagat

SEQ ID NO: 731566 - DNA, 20 bp, mouse
gcaaaagaggggaccctcca

SEQ ID NO: 731567 - DNA, 20 bp, mouse
ggggaagcgcccccgcagct

SEQ ID NO: 731568 - DNA, 20 bp, mouse
gagggctgggctgtactggg

SEQ ID NO: 731569 - DNA, 20 bp, mouse
gtctccctacaaacaaaaga

SEQ ID NO: 731570 - DNA, 20 bp, mouse
gcagtacagcccagccctgg

SEQ ID NO: 731571 - DNA, 20 bp, mouse
gggaacgggtggggacagtt

SEQ ID NO: 731572 - DNA, 20 bp, mouse
gttgcacaacagcagtttgt

SEQ ID NO: 731573 - DNA, 20 bp, mouse
gtcctgggatgcaggaaaga

SEQ ID NO: 731574 - DNA, 20 bp, mouse
gggaggaacgctagagtgtt

SEQ ID NO: 731575 - DNA, 20 bp, mouse
gggactcgcgtgctgaactg

SEQ ID NO: 731576 - DNA, 20 bp, mouse
gtgacccctggaaaagtcca

SEQ ID NO: 731577 - DNA, 20 bp, mouse
gaaaagtccaggggtctacc

SEQ ID NO: 731578 - DNA, 20 bp, mouse
gtagacccagccttaaggaa

SEQ ID NO: 731579 - DNA, 20 bp, mouse
gctactgcctggtagacccc

SEQ ID NO: 731580 - DNA, 20 bp, mouse
gagtcagatgagaaacccga

SEQ ID NO: 731581 - DNA, 20 bp, mouse
ggtgcatggaggccaggcaa

SEQ ID NO: 731582 - DNA, 20 bp, mouse
ggggtcacagtcacgtgttt

SEQ ID NO: 731583 - DNA, 20 bp, mouse
gcccttcaagctgaagtttg

SEQ ID NO: 731584 - DNA, 20 bp, mouse
ggacccctggacttttccag

SEQ ID NO: 731585 - DNA, 20 bp, mouse
gggcagtagacccagcctta

SEQ ID NO: 731586 - DNA, 20 bp, mouse
gtgatgaggaccagtgaaag

SEQ ID NO: 731587 - DNA, 20 bp, mouse
gtgtaagaaagcttttgatg

SEQ ID NO: 731588 - DNA, 20 bp, mouse
gtcattctctgcttgcgtct

SEQ ID NO: 731589 - DNA, 20 bp, mouse
gattaattataaaatcaatt

SEQ ID NO: 731590 - DNA, 20 bp, mouse
ggtatttaaatcataataca

SEQ ID NO: 731591 - DNA, 20 bp, mouse
gtaatatacattgaagcaaa

SEQ ID NO: 731592 - DNA, 20 bp, mouse
gatatttaaagtcctaaaat

SEQ ID NO: 731593 - DNA, 20 bp, mouse
gtaaatcataatacaaggta

SEQ ID NO: 731594 - DNA, 20 bp, mouse
gttattgcttcctctttcac

SEQ ID NO: 731595 - DNA, 20 bp, mouse
gggtgttttctaaaccattg

SEQ ID NO: 731596 - DNA, 20 bp, mouse
gaacccacatgcctgagggg

SEQ ID NO: 731597 - DNA, 20 bp, mouse
gccccccccctcaggcatgt

SEQ ID NO: 731598 - DNA, 20 bp, mouse
gaaggggagggtatttacaa

SEQ ID NO: 731599 - DNA, 20 bp, mouse
gtctgggttccccccccctc

SEQ ID NO: 731600 - DNA, 20 bp, mouse
gtgagaaatttacacatcta

SEQ ID NO: 731601 - DNA, 20 bp, mouse
gtaatctcagaagaggcaga

SEQ ID NO: 731602 - DNA, 20 bp, mouse
gatggaacccacatgcctga

SEQ ID NO: 731603 - DNA, 20 bp, mouse
gtaagatagatgcacacagt

SEQ ID NO: 731604 - DNA, 20 bp, mouse
gttcactctctgcttgtatc

SEQ ID NO: 731605 - DNA, 20 bp, mouse
gatgaaagagaaagcaatga

SEQ ID NO: 731606 - DNA, 20 bp, mouse
gaagacaattgggaagtaag

SEQ ID NO: 731607 - DNA, 20 bp, mouse
gtcaaaatatattgaagtaa

SEQ ID NO: 731608 - DNA, 20 bp, mouse
gaatcatgatataaagtttg

SEQ ID NO: 731609 - DNA, 20 bp, mouse
gattttaggactttacatgt

SEQ ID NO: 731610 - DNA, 20 bp, mouse
gtcattataataatttttat

SEQ ID NO: 731611 - DNA, 20 bp, mouse
gtaagacatattcaataaaa

SEQ ID NO: 731612 - DNA, 20 bp, mouse
gaacaaagactttttacctg

SEQ ID NO: 731613 - DNA, 20 bp, mouse
gttgaaatttacacatctat

SEQ ID NO: 731614 - DNA, 20 bp, mouse
ggtatttttctaaaccattt

SEQ ID NO: 731615 - DNA, 20 bp, mouse
gatattctcttcttgcatct

SEQ ID NO: 731616 - DNA, 20 bp, mouse
gagggcgtggaacaaaaaag

SEQ ID NO: 731617 - DNA, 20 bp, mouse
gtgtaaaacaccctttggta

SEQ ID NO: 731618 - DNA, 20 bp, mouse
gggagacaggttggaggaat

SEQ ID NO: 731619 - DNA, 20 bp, mouse
gttgttccacgccctaccaa

SEQ ID NO: 731620 - DNA, 20 bp, mouse
gagaccattgggaagttaga

SEQ ID NO: 731621 - DNA, 20 bp, mouse
gcaagagacttgaagccctt

SEQ ID NO: 731622 - DNA, 20 bp, mouse
gaacaccctttggtagggcg

SEQ ID NO: 731623 - DNA, 20 bp, mouse
gcagtcctatgcactatatc

SEQ ID NO: 731624 - DNA, 20 bp, mouse
gcctgccagatatagtgcat

SEQ ID NO: 731625 - DNA, 20 bp, mouse
gaagaaagtggaaagaccat

SEQ ID NO: 731626 - DNA, 20 bp, mouse
gactacgcatagtctttgct

SEQ ID NO: 731627 - DNA, 20 bp, mouse
ggatggggtctgggacagcg

SEQ ID NO: 731628 - DNA, 20 bp, mouse
gacagtgacactgaaagatg

SEQ ID NO: 731629 - DNA, 20 bp, mouse
ggacactgaaagatggggtc

SEQ ID NO: 731630 - DNA, 20 bp, mouse
gagaaagtgaaaagattatt

SEQ ID NO: 731631 - DNA, 20 bp, mouse
ggggacagcggggagatact

SEQ ID NO: 731632 - DNA, 20 bp, mouse
gaagtaaggaaagagatttc

SEQ ID NO: 731633 - DNA, 20 bp, mouse
gtgtaaaacagctttcagaa

SEQ ID NO: 731634 - DNA, 20 bp, mouse
gcaataaagagcacacactg

SEQ ID NO: 731635 - DNA, 20 bp, mouse
ggggctttctgcatcaggga

SEQ ID NO: 731636 - DNA, 20 bp, mouse
gtttcccccctcacgcatgt

SEQ ID NO: 731637 - DNA, 20 bp, mouse
gtattgttgtggcctggaca

SEQ ID NO: 731638 - DNA, 20 bp, mouse
gactgtgcagcaccatgtcc

SEQ ID NO: 731639 - DNA, 20 bp, mouse
gaaatttttcaattgtttag

SEQ ID NO: 731640 - DNA, 20 bp, mouse
gtaatctcagaagaggcaga

SEQ ID NO: 731641 - DNA, 20 bp, mouse
gtgtgaggtcctcatagtcc

SEQ ID NO: 731642 - DNA, 20 bp, mouse
gtatgatttttgtagacaca

SEQ ID NO: 731643 - DNA, 20 bp, mouse
gatggaacccacatgcgtga

SEQ ID NO: 731644 - DNA, 20 bp, mouse
ggaacccacatgcgtgaggg

SEQ ID NO: 731645 - DNA, 20 bp, mouse
gtagaagtattgttgtggcc

SEQ ID NO: 731646 - DNA, 20 bp, mouse
gcccgcccccctggggaatg

SEQ ID NO: 731647 - DNA, 20 bp, mouse
ggaacccacattccccaggg

SEQ ID NO: 731648 - DNA, 20 bp, mouse
gcccacattccccagggggg

SEQ ID NO: 731649 - DNA, 20 bp, mouse
ggattgaacccacattcccc

SEQ ID NO: 731650 - DNA, 20 bp, mouse
gaccttgggctcaaacgtag

SEQ ID NO: 731651 - DNA, 20 bp, mouse
gcctgcccggcaagctttgc

SEQ ID NO: 731652 - DNA, 20 bp, mouse
gctgaccagcaaagcttgcc

SEQ ID NO: 731653 - DNA, 20 bp, mouse
ggtaatttaaagagaaaccc

SEQ ID NO: 731654 - DNA, 20 bp, mouse
gctttaaaatacagtcatag

SEQ ID NO: 731655 - DNA, 20 bp, mouse
gagtaaagtgtgggggtaac

SEQ ID NO: 731656 - DNA, 20 bp, mouse
gtcaaaaccagctttgggta

SEQ ID NO: 731657 - DNA, 20 bp, mouse
ggtgaaagaggaagcaataa

SEQ ID NO: 731658 - DNA, 20 bp, mouse
gactgctccatacccaaagc

SEQ ID NO: 731659 - DNA, 20 bp, mouse
gaaagacagtttattggtgc

SEQ ID NO: 731660 - DNA, 20 bp, mouse
gtttaaagtccactgggcag

SEQ ID NO: 731661 - DNA, 20 bp, mouse
gtaaaatatttaaagtccac

SEQ ID NO: 731662 - DNA, 20 bp, mouse
ggggtatggagcagtgaaag

SEQ ID NO: 731663 - DNA, 20 bp, mouse
gaaaaatgcccaaacacaag

SEQ ID NO: 731664 - DNA, 20 bp, mouse
ggcaataatggaaatctcaa

SEQ ID NO: 731665 - DNA, 20 bp, mouse
gaaccctcaaaaccagcttt

SEQ ID NO: 731666 - DNA, 20 bp, mouse
gtgggtgtggagcagtaaag

SEQ ID NO: 731667 - DNA, 20 bp, mouse
gactgctccacacccaaagt

SEQ ID NO: 731668 - DNA, 20 bp, mouse
ggtttacaaaatacattaca

SEQ ID NO: 731669 - DNA, 20 bp, mouse
gtcaaaaccaactttgggtg

SEQ ID NO: 731670 - DNA, 20 bp, mouse
gtttaaagtccactgggcag

SEQ ID NO: 731671 - DNA, 20 bp, mouse
gtaaaatatttaaagtccac

SEQ ID NO: 731672 - DNA, 20 bp, mouse
gaaccctcaaaaccaacttt

SEQ ID NO: 731673 - DNA, 20 bp, mouse
gataaacaaagacagtttat

SEQ ID NO: 731674 - DNA, 20 bp, mouse
gaaaaatgcccaaacacaag

SEQ ID NO: 731675 - DNA, 20 bp, mouse
ggcaataatgaaaatctcaa

SEQ ID NO: 731676 - DNA, 20 bp, mouse
gaaaagaattggaatgagag

SEQ ID NO: 731677 - DNA, 20 bp, mouse
gttaatgaaaattcagtccg

SEQ ID NO: 731678 - DNA, 20 bp, mouse
gctggaatctacatgagtgc

SEQ ID NO: 731679 - DNA, 20 bp, mouse
ggttatatgtaattctctac

SEQ ID NO: 731680 - DNA, 20 bp, mouse
gacacacatgagtatctcat

SEQ ID NO: 731681 - DNA, 20 bp, mouse
gaagaaagcataaaaagaat

SEQ ID NO: 731682 - DNA, 20 bp, mouse
ggttcttaatggctgttgaa

SEQ ID NO: 731683 - DNA, 20 bp, mouse
gacccaaaatatgttcttaa

SEQ ID NO: 731684 - DNA, 20 bp, mouse
ggctcttctcaacaaagcca

SEQ ID NO: 731685 - DNA, 20 bp, mouse
gtcattttcgttttgtgtct

SEQ ID NO: 731686 - DNA, 20 bp, mouse
gcagacccaagcagagaatg

SEQ ID NO: 731687 - DNA, 20 bp, mouse
gagaaagcgaaaagaccagt

SEQ ID NO: 731688 - DNA, 20 bp, mouse
gaccagtgggaagtatggag

SEQ ID NO: 731689 - DNA, 20 bp, mouse
ggaagtatggagagggcatt

SEQ ID NO: 731690 - DNA, 20 bp, mouse
gccctctccatacttcccac

SEQ ID NO: 731691 - DNA, 20 bp, mouse
gggtaaaacagtttttgttg

SEQ ID NO: 731692 - DNA, 20 bp, mouse
gaacttacaaatgtattgta

SEQ ID NO: 731693 - DNA, 20 bp, mouse
gtaaactttaataactttta

SEQ ID NO: 731694 - DNA, 20 bp, mouse
gatttaagacacatctacat

SEQ ID NO: 731695 - DNA, 20 bp, mouse
gctttaccacattctctgct

SEQ ID NO: 731696 - DNA, 20 bp, mouse
gttaatgaaaattcattcag

SEQ ID NO: 731697 - DNA, 20 bp, mouse
gaagaaagcgaaaacagagt

SEQ ID NO: 731698 - DNA, 20 bp, mouse
gccagcactcctgtgaattc

SEQ ID NO: 731699 - DNA, 20 bp, mouse
gaatgtcatcccatctaagt

SEQ ID NO: 731700 - DNA, 20 bp, mouse
gacaggagtgctgggaaacc

SEQ ID NO: 731701 - DNA, 20 bp, mouse
gcttgggaagagaagcagac

SEQ ID NO: 731702 - DNA, 20 bp, mouse
ggttcttaaaagctgttgaa

SEQ ID NO: 731703 - DNA, 20 bp, mouse
gattctgtacctgaattcac

SEQ ID NO: 731704 - DNA, 20 bp, mouse
gtgggatgacattgatttct

SEQ ID NO: 731705 - DNA, 20 bp, mouse
gactccaactcctacttaga

SEQ ID NO: 731706 - DNA, 20 bp, mouse
gaccgggcgcggtccagtca

SEQ ID NO: 731707 - DNA, 20 bp, mouse
gggagagagcgtggcgtcag

SEQ ID NO: 731708 - DNA, 20 bp, mouse
gaagcggctcggaaagtacc

SEQ ID NO: 731709 - DNA, 20 bp, mouse
ggggcagtctttccggaagt

SEQ ID NO: 731710 - DNA, 20 bp, mouse
gctggtgtggggatccctgg

SEQ ID NO: 731711 - DNA, 20 bp, mouse
gtctccgcgagcaagcggct

SEQ ID NO: 731712 - DNA, 20 bp, mouse
gtcagcggagaagctgtgct

SEQ ID NO: 731713 - DNA, 20 bp, mouse
gaccccctccggacaaaaac

SEQ ID NO: 731714 - DNA, 20 bp, mouse
gtggctcgaatcctggtgtg

SEQ ID NO: 731715 - DNA, 20 bp, mouse
ggctcggaaagtaccgggcg

SEQ ID NO: 731716 - DNA, 20 bp, mouse
ggagccagagttaacggatc

SEQ ID NO: 731717 - DNA, 20 bp, mouse
ggaagtgggtggggtcgtaa

SEQ ID NO: 731718 - DNA, 20 bp, mouse
gaaccccgatccgttaactc

SEQ ID NO: 731719 - DNA, 20 bp, mouse
gtaactggatacgaatgggt

SEQ ID NO: 731720 - DNA, 20 bp, mouse
gcccacttcaagtacagtcc

SEQ ID NO: 731721 - DNA, 20 bp, mouse
gtagcggtgaacagagaacg

SEQ ID NO: 731722 - DNA, 20 bp, mouse
ggaactaactggatacgaat

SEQ ID NO: 731723 - DNA, 20 bp, mouse
ggtgcctggcctagtgatgc

SEQ ID NO: 731724 - DNA, 20 bp, mouse
gggcactacctagtcctcca

SEQ ID NO: 731725 - DNA, 20 bp, mouse
gggcggagccggcgacaaat

SEQ ID NO: 731726 - DNA, 20 bp, mouse
gagtagctgctcatcctgaa

SEQ ID NO: 731727 - DNA, 20 bp, mouse
gtcaccaattgctggagcaa

SEQ ID NO: 731728 - DNA, 20 bp, mouse
gtctctcccaaagggagcta

SEQ ID NO: 731729 - DNA, 20 bp, mouse
gctgctgccctttgaaatag

SEQ ID NO: 731730 - DNA, 20 bp, mouse
ggcagctgtgccatcctttc

SEQ ID NO: 731731 - DNA, 20 bp, mouse
gaagagaaatggcacatcaa

SEQ ID NO: 731732 - DNA, 20 bp, mouse
gatgacagaggaaaactgaa

SEQ ID NO: 731733 - DNA, 20 bp, mouse
ggggagagaaccccacatcc

SEQ ID NO: 731734 - DNA, 20 bp, mouse
gtggagaaactgcttaaagt

SEQ ID NO: 731735 - DNA, 20 bp, mouse
gcaccatcccactatttcaa

SEQ ID NO: 731736 - DNA, 20 bp, mouse
gaacacaatggggaatgtaa

SEQ ID NO: 731737 - DNA, 20 bp, mouse
gaaacctaaggtataaactt

SEQ ID NO: 731738 - DNA, 20 bp, mouse
gttccataaaaccctggaat

SEQ ID NO: 731739 - DNA, 20 bp, mouse
gcctcaaacagcaacacaat

SEQ ID NO: 731740 - DNA, 20 bp, mouse
gcacgcatctgaaaccctga

SEQ ID NO: 731741 - DNA, 20 bp, mouse
ggaaatgttccataaaaccc

SEQ ID NO: 731742 - DNA, 20 bp, mouse
gagggtttcagatgcgtgag

SEQ ID NO: 731743 - DNA, 20 bp, mouse
gaataatgagtggtaatagt

SEQ ID NO: 731744 - DNA, 20 bp, mouse
gtggtaatagtaggtcagag

SEQ ID NO: 731745 - DNA, 20 bp, mouse
gaaaagaacaccctccctca

SEQ ID NO: 731746 - DNA, 20 bp, mouse
gggcacaggtgggcacagcg

SEQ ID NO: 731747 - DNA, 20 bp, mouse
ggagagcccaaggagtcgaa

SEQ ID NO: 731748 - DNA, 20 bp, mouse
gccacctgtgccattcttgt

SEQ ID NO: 731749 - DNA, 20 bp, mouse
gtcagagaatcccacaagaa

SEQ ID NO: 731750 - DNA, 20 bp, mouse
gttccagcccccaccccaaa

SEQ ID NO: 731751 - DNA, 20 bp, mouse
gcattacagctatggttttg

SEQ ID NO: 731752 - DNA, 20 bp, mouse
gttactttgcattacagcta

SEQ ID NO: 731753 - DNA, 20 bp, mouse
gctcatcgtcagagagccca

SEQ ID NO: 731754 - DNA, 20 bp, mouse
gggagcctttgtttgtggtt

SEQ ID NO: 731755 - DNA, 20 bp, mouse
gcacagggagcctttgtttg

SEQ ID NO: 731756 - DNA, 20 bp, mouse
ggtgaggcggggtctataca

SEQ ID NO: 731757 - DNA, 20 bp, mouse
gaggcggggtctatacaagg

SEQ ID NO: 731758 - DNA, 20 bp, mouse
gagaccagcctgggactgag

SEQ ID NO: 731759 - DNA, 20 bp, mouse
ggcggagcctcacggggcaa

SEQ ID NO: 731760 - DNA, 20 bp, mouse
gtggactaggacatggttat

SEQ ID NO: 731761 - DNA, 20 bp, mouse
gcacggggcaaagggttaaa

SEQ ID NO: 731762 - DNA, 20 bp, mouse
ggcgtggcttaagtgggagg

SEQ ID NO: 731763 - DNA, 20 bp, mouse
gaactgaggaaggtagtgtc

SEQ ID NO: 731764 - DNA, 20 bp, mouse
gcctgccggggagctgggtg

SEQ ID NO: 731765 - DNA, 20 bp, mouse
gctgaggggcgtggcttaag

SEQ ID NO: 731766 - DNA, 20 bp, mouse
ggaggtgtggccggagtcac

SEQ ID NO: 731767 - DNA, 20 bp, mouse
gcacacagccccggtgactc

SEQ ID NO: 731768 - DNA, 20 bp, mouse
gcggctctgcggctaggctg

SEQ ID NO: 731769 - DNA, 20 bp, mouse
gcggctcggcgaggtgtggc

SEQ ID NO: 731770 - DNA, 20 bp, mouse
ggggagtccgaagtggggtg

SEQ ID NO: 731771 - DNA, 20 bp, mouse
gatctctggccacacattgg

SEQ ID NO: 731772 - DNA, 20 bp, mouse
ggcggggcgaggcggctctg

SEQ ID NO: 731773 - DNA, 20 bp, mouse
gccgcccccgcccggcccgt

SEQ ID NO: 731774 - DNA, 20 bp, mouse
gacgtggcgggagtccgaag

SEQ ID NO: 731775 - DNA, 20 bp, mouse
gaggaagtgaccccagagca

SEQ ID NO: 731776 - DNA, 20 bp, mouse
gacccatgtgtgacagcaga

SEQ ID NO: 731777 - DNA, 20 bp, mouse
ggccctctgctgtcacacat

SEQ ID NO: 731778 - DNA, 20 bp, mouse
gcactctgtggtattgtgac

SEQ ID NO: 731779 - DNA, 20 bp, mouse
gtcatgtgagtacacttgag

SEQ ID NO: 731780 - DNA, 20 bp, mouse
gacacttgagtggccgtcag

SEQ ID NO: 731781 - DNA, 20 bp, mouse
gtggtattgtgacaggatag

SEQ ID NO: 731782 - DNA, 20 bp, mouse
gggtcttcaggacaaaatgc

SEQ ID NO: 731783 - DNA, 20 bp, mouse
gagcagcagccacaacgcct

SEQ ID NO: 731784 - DNA, 20 bp, mouse
gttttgcttacttaagtggg

SEQ ID NO: 731785 - DNA, 20 bp, mouse
gtggtggtcggagaagagac

SEQ ID NO: 731786 - DNA, 20 bp, mouse
gcccccagtccctgtgtgtc

SEQ ID NO: 731787 - DNA, 20 bp, mouse
gttcccaggtgacccatccc

SEQ ID NO: 731788 - DNA, 20 bp, mouse
gcctcccgctgaagatatac

SEQ ID NO: 731789 - DNA, 20 bp, mouse
gaaaaagcgcctggaggcaa

SEQ ID NO: 731790 - DNA, 20 bp, mouse
gtttccccccagtgttggtt

SEQ ID NO: 731791 - DNA, 20 bp, mouse
gctagtaaacctgacacaca

SEQ ID NO: 731792 - DNA, 20 bp, mouse
ggtcctgggatgggtcacct

SEQ ID NO: 731793 - DNA, 20 bp, mouse
gacctgacacacagggactg

SEQ ID NO: 731794 - DNA, 20 bp, mouse
ggttcccaaccaacactggg

SEQ ID NO: 731795 - DNA, 20 bp, mouse
gactgtgattactgatgact

SEQ ID NO: 731796 - DNA, 20 bp, mouse
gcccagcctgggctccctag

SEQ ID NO: 731797 - DNA, 20 bp, mouse
ggggcacaggctcaggtctt

SEQ ID NO: 731798 - DNA, 20 bp, mouse
gctgtcccatagcctggatg

SEQ ID NO: 731799 - DNA, 20 bp, mouse
gaggttgatacctgccacta

SEQ ID NO: 731800 - DNA, 20 bp, mouse
gtcgtcaggaggcttcccac

SEQ ID NO: 731801 - DNA, 20 bp, mouse
gacctgccactagggagccc

SEQ ID NO: 731802 - DNA, 20 bp, mouse
gcagtgccccatccaggcta

SEQ ID NO: 731803 - DNA, 20 bp, mouse
ggcctgggctccctagtggc

SEQ ID NO: 731804 - DNA, 20 bp, mouse
gggaggctggggtagcttcg

SEQ ID NO: 731805 - DNA, 20 bp, mouse
gggggcactgagcagatggc

SEQ ID NO: 731806 - DNA, 20 bp, mouse
gccagcctgggctctcctag

SEQ ID NO: 731807 - DNA, 20 bp, mouse
gccaggcccaagcttcttgt

SEQ ID NO: 731808 - DNA, 20 bp, mouse
gcctgggctctcctagtggc

SEQ ID NO: 731809 - DNA, 20 bp, mouse
gtggggcagtttcagggcac

SEQ ID NO: 731810 - DNA, 20 bp, mouse
gcaggctcaggtccttggtt

SEQ ID NO: 731811 - DNA, 20 bp, mouse
gaggctacccacaagaagct

SEQ ID NO: 731812 - DNA, 20 bp, mouse
gttgggcctggggcagtttc

SEQ ID NO: 731813 - DNA, 20 bp, mouse
ggggcacaggctcaggtcct

SEQ ID NO: 731814 - DNA, 20 bp, mouse
ggctggaaactcagagcctc

SEQ ID NO: 731815 - DNA, 20 bp, mouse
gcaggttgacaccagccact

SEQ ID NO: 731816 - DNA, 20 bp, mouse
ggcacctagggtagagttcg

SEQ ID NO: 731817 - DNA, 20 bp, mouse
ggaggagtaaatagcaccta

SEQ ID NO: 731818 - DNA, 20 bp, mouse
gcagttctggggttccgttg

SEQ ID NO: 731819 - DNA, 20 bp, mouse
gcccgctccgcctgcaaaac

SEQ ID NO: 731820 - DNA, 20 bp, mouse
gcgcggtaaaagcttggagg

SEQ ID NO: 731821 - DNA, 20 bp, mouse
gaccggtggggattcaccta

SEQ ID NO: 731822 - DNA, 20 bp, mouse
ggccccgcgtcgcctgccgt

SEQ ID NO: 731823 - DNA, 20 bp, mouse
gaacctgcgaaaccacggaa

SEQ ID NO: 731824 - DNA, 20 bp, mouse
gagtaagaaactcgcaagac

SEQ ID NO: 731825 - DNA, 20 bp, mouse
gtataggtagagtcgggaca

SEQ ID NO: 731826 - DNA, 20 bp, mouse
gactacccgggtgaattcca

SEQ ID NO: 731827 - DNA, 20 bp, mouse
gatagcagcccaggcaccga

SEQ ID NO: 731828 - DNA, 20 bp, mouse
gcggacgcctcgttgggacg

SEQ ID NO: 731829 - DNA, 20 bp, mouse
gccctaaggcatagcagccc

SEQ ID NO: 731830 - DNA, 20 bp, mouse
gccccagtggacgccgcggt

SEQ ID NO: 731831 - DNA, 20 bp, mouse
gggaatgggagtccgaatgc

SEQ ID NO: 731832 - DNA, 20 bp, mouse
gtccccaccgcggcgtccac

SEQ ID NO: 731833 - DNA, 20 bp, mouse
gccagggcggacgcctcgtt

SEQ ID NO: 731834 - DNA, 20 bp, mouse
ggctgcagatctccccaccg

SEQ ID NO: 731835 - DNA, 20 bp, mouse
ggccttaagtagccagacgg

SEQ ID NO: 731836 - DNA, 20 bp, mouse
gagaccagagtggatggagt

SEQ ID NO: 731837 - DNA, 20 bp, mouse
gtggtctcctgacccactta

SEQ ID NO: 731838 - DNA, 20 bp, mouse
gagagactgaagcgtaaaca

SEQ ID NO: 731839 - DNA, 20 bp, mouse
ggtcaggagaccagagtgga

SEQ ID NO: 731840 - DNA, 20 bp, mouse
ggagcaggaaaataaccagt

SEQ ID NO: 731841 - DNA, 20 bp, mouse
ggagaaggtcagccttaagt

SEQ ID NO: 731842 - DNA, 20 bp, mouse
gggtcagccttaagtgggtc

SEQ ID NO: 731843 - DNA, 20 bp, mouse
gacccaggaggccctatcaa

SEQ ID NO: 731844 - DNA, 20 bp, mouse
gacccttgatagggcctcct

SEQ ID NO: 731845 - DNA, 20 bp, mouse
gtgtgaagatggaaattccc

SEQ ID NO: 731846 - DNA, 20 bp, mouse
gtgggtacgcagggcattgt

SEQ ID NO: 731847 - DNA, 20 bp, mouse
ggcgtcggcttatgtgtctc

SEQ ID NO: 731848 - DNA, 20 bp, mouse
ggcactgcgcacaacttggg

SEQ ID NO: 731849 - DNA, 20 bp, mouse
ggcgccccgccctgtcaaat

SEQ ID NO: 731850 - DNA, 20 bp, mouse
gcgtgcactgcgcacaactt

SEQ ID NO: 731851 - DNA, 20 bp, mouse
gaaccgcgcgggcgggggta

SEQ ID NO: 731852 - DNA, 20 bp, mouse
ggggcgcctcacgaagatgg

SEQ ID NO: 731853 - DNA, 20 bp, mouse
ggcggggcgcctcacgaaga

SEQ ID NO: 731854 - DNA, 20 bp, mouse
gagtttagctagagcggcgt

SEQ ID NO: 731855 - DNA, 20 bp, mouse
gggggaaggaggggcgaagt

SEQ ID NO: 731856 - DNA, 20 bp, mouse
gtacgcgcccggcgcttcgg

SEQ ID NO: 731857 - DNA, 20 bp, mouse
gcgcgtagggacgcaggagg

SEQ ID NO: 731858 - DNA, 20 bp, mouse
gggggagtcttgacgacaga

SEQ ID NO: 731859 - DNA, 20 bp, mouse
gggcgggaaggctgctgtgt

SEQ ID NO: 731860 - DNA, 20 bp, mouse
gcgacagagggtttgattgg

SEQ ID NO: 731861 - DNA, 20 bp, mouse
ggggcgcgtagggacgcagg

SEQ ID NO: 731862 - DNA, 20 bp, mouse
gacgagcgattggtccggaa

SEQ ID NO: 731863 - DNA, 20 bp, mouse
gtaagtatgacacgagcgat

SEQ ID NO: 731864 - DNA, 20 bp, mouse
gcaagtgcgcatgtacaaaa

SEQ ID NO: 731865 - DNA, 20 bp, mouse
ggcgcccggcgcttcggcgg

SEQ ID NO: 731866 - DNA, 20 bp, mouse
ggagccaaggggataaccag

SEQ ID NO: 731867 - DNA, 20 bp, mouse
gaacgtggggcgtgttgtga

SEQ ID NO: 731868 - DNA, 20 bp, mouse
gttgaagcgcgcgggaactc

SEQ ID NO: 731869 - DNA, 20 bp, mouse
gtcagcgtgctggctgtgat

SEQ ID NO: 731870 - DNA, 20 bp, mouse
gaagagcaggcgcagtagca

SEQ ID NO: 731871 - DNA, 20 bp, mouse
gaacgcgccacgcgccgggg

SEQ ID NO: 731872 - DNA, 20 bp, mouse
gcggggacctcctgcaaact

SEQ ID NO: 731873 - DNA, 20 bp, mouse
gcgggcgcgcccaaccagct

SEQ ID NO: 731874 - DNA, 20 bp, mouse
ggcgagtgtcgctgaagagc

SEQ ID NO: 731875 - DNA, 20 bp, mouse
gcaaggggataaccagaggc

SEQ ID NO: 731876 - DNA, 20 bp, mouse
gctaaggcgggcccataaga

SEQ ID NO: 731877 - DNA, 20 bp, mouse
gaggaccgaagacttgtggg

SEQ ID NO: 731878 - DNA, 20 bp, mouse
ggggcccataagaggggttg

SEQ ID NO: 731879 - DNA, 20 bp, mouse
gaccgaagacttgtgggcgg

SEQ ID NO: 731880 - DNA, 20 bp, mouse
gctctccgcgaccaatcctg

SEQ ID NO: 731881 - DNA, 20 bp, mouse
gtcacgtagtgggttcgcga

SEQ ID NO: 731882 - DNA, 20 bp, mouse
gacaacccgccaagcatcgg

SEQ ID NO: 731883 - DNA, 20 bp, mouse
gacctccgcccacaagtctt

SEQ ID NO: 731884 - DNA, 20 bp, mouse
gaaagcacatctggccgggt

SEQ ID NO: 731885 - DNA, 20 bp, mouse
ggtgggcggaggtttgcgtt

SEQ ID NO: 731886 - DNA, 20 bp, mouse
gggggcggggactacgacac

SEQ ID NO: 731887 - DNA, 20 bp, mouse
gctggtgcttctggactcgg

SEQ ID NO: 731888 - DNA, 20 bp, mouse
gcagcgcgcgagctagcagt

SEQ ID NO: 731889 - DNA, 20 bp, mouse
gtgggctgtaactccggagt

SEQ ID NO: 731890 - DNA, 20 bp, mouse
gtggactcgggggtgacgtg

SEQ ID NO: 731891 - DNA, 20 bp, mouse
gggaaagagactacaagacc

SEQ ID NO: 731892 - DNA, 20 bp, mouse
ggcccagaagcctttgctca

SEQ ID NO: 731893 - DNA, 20 bp, mouse
gccagcaagcaccgcagggt

SEQ ID NO: 731894 - DNA, 20 bp, mouse
gcacgcgataactgcccact

SEQ ID NO: 731895 - DNA, 20 bp, mouse
gccctctgcacccgcacctc

SEQ ID NO: 731896 - DNA, 20 bp, mouse
ggggcaccgcctagcgtctc

SEQ ID NO: 731897 - DNA, 20 bp, mouse
gagaaggaggcggggaaaac

SEQ ID NO: 731898 - DNA, 20 bp, mouse
gccggaggcgggaattaatg

SEQ ID NO: 731899 - DNA, 20 bp, mouse
gttcccttcgcggaacaaag

SEQ ID NO: 731900 - DNA, 20 bp, mouse
gccaggcacccaatagaaga

SEQ ID NO: 731901 - DNA, 20 bp, mouse
gggaaaaccggttcccttcg

SEQ ID NO: 731902 - DNA, 20 bp, mouse
gcccgcctccggctgcatcc

SEQ ID NO: 731903 - DNA, 20 bp, mouse
gggagaaggcgggttgatga

SEQ ID NO: 731904 - DNA, 20 bp, mouse
ggcgtcacccctctcagtgt

SEQ ID NO: 731905 - DNA, 20 bp, mouse
ggattcgcccacactgagag

SEQ ID NO: 731906 - DNA, 20 bp, mouse
gagtccgcctcacaaatcct

SEQ ID NO: 731907 - DNA, 20 bp, mouse
gacaggacctaggatttgtg

SEQ ID NO: 731908 - DNA, 20 bp, mouse
ggaagggctgagtcgttgtt

SEQ ID NO: 731909 - DNA, 20 bp, mouse
gcaaatgtaggcagtcccca

SEQ ID NO: 731910 - DNA, 20 bp, mouse
ggctccaaagaggttagccc

SEQ ID NO: 731911 - DNA, 20 bp, mouse
gctctttggagcaatgttag

SEQ ID NO: 731912 - DNA, 20 bp, mouse
gctccgaagtcaagcaaagt

SEQ ID NO: 731913 - DNA, 20 bp, mouse
gtgagtcgttgttagggacg

SEQ ID NO: 731914 - DNA, 20 bp, mouse
gggacctaggatttgtgagg

SEQ ID NO: 731915 - DNA, 20 bp, mouse
ggactctttaaatactggga

SEQ ID NO: 731916 - DNA, 20 bp, mouse
gacgcggcgctgggatagag

SEQ ID NO: 731917 - DNA, 20 bp, mouse
gcgctgggatagagcggccc

SEQ ID NO: 731918 - DNA, 20 bp, mouse
gaccaccggccgcagcagag

SEQ ID NO: 731919 - DNA, 20 bp, mouse
gctagcagcccgcttatcta

SEQ ID NO: 731920 - DNA, 20 bp, mouse
ggcggaaaccatagataagc

SEQ ID NO: 731921 - DNA, 20 bp, mouse
gaccggccgcagcagagggg

SEQ ID NO: 731922 - DNA, 20 bp, mouse
ggggtggcggcgcagtggcg

SEQ ID NO: 731923 - DNA, 20 bp, mouse
ggctagaccgcctagtgccc

SEQ ID NO: 731924 - DNA, 20 bp, mouse
gagcggccccgggcactagg

SEQ ID NO: 731925 - DNA, 20 bp, mouse
gggaagcagagacgcggcgc

SEQ ID NO: 731926 - DNA, 20 bp, mouse
ggctgggggctgttgggtag

SEQ ID NO: 731927 - DNA, 20 bp, mouse
gacagacgtgctgtgtctgg

SEQ ID NO: 731928 - DNA, 20 bp, mouse
gtccaggccaggccggggcg

SEQ ID NO: 731929 - DNA, 20 bp, mouse
ggggctgttgggtaggggtt

SEQ ID NO: 731930 - DNA, 20 bp, mouse
ggctagcaaatgaacaatat

SEQ ID NO: 731931 - DNA, 20 bp, mouse
gtggggacctaccatcttat

SEQ ID NO: 731932 - DNA, 20 bp, mouse
gctgcccggaacctgcgtcc

SEQ ID NO: 731933 - DNA, 20 bp, mouse
gaggggttcggggctagcgc

SEQ ID NO: 731934 - DNA, 20 bp, mouse
gaaggagtcactttttaata

SEQ ID NO: 731935 - DNA, 20 bp, mouse
gctatgggcggggactgctg

SEQ ID NO: 731936 - DNA, 20 bp, mouse
gcgggagaggcggaagaggt

SEQ ID NO: 731937 - DNA, 20 bp, mouse
gcatgctggtccctggccta

SEQ ID NO: 731938 - DNA, 20 bp, mouse
gcccgacggcgggatcaccg

SEQ ID NO: 731939 - DNA, 20 bp, mouse
gcggttgcctggtaacggtg

SEQ ID NO: 731940 - DNA, 20 bp, mouse
gttggacgatggggtgtctc

SEQ ID NO: 731941 - DNA, 20 bp, mouse
ggcagggcagccggtcacca

SEQ ID NO: 731942 - DNA, 20 bp, mouse
gggtaacggtggggactgtg

SEQ ID NO: 731943 - DNA, 20 bp, mouse
gaggctgcagagatcctggc

SEQ ID NO: 731944 - DNA, 20 bp, mouse
gccagcgcccggctgggctc

SEQ ID NO: 731945 - DNA, 20 bp, mouse
ggtcacgccatgctggtccc

SEQ ID NO: 731946 - DNA, 20 bp, mouse
gtgtgcaatgagttgggaaa

SEQ ID NO: 731947 - DNA, 20 bp, mouse
gacgccgcgtatcctagcaa

SEQ ID NO: 731948 - DNA, 20 bp, mouse
gggaaaacgctcctcgtgat

SEQ ID NO: 731949 - DNA, 20 bp, mouse
ggtaaagtgtgcaatgagtt

SEQ ID NO: 731950 - DNA, 20 bp, mouse
ggcagcgcaggccaatcacg

SEQ ID NO: 731951 - DNA, 20 bp, mouse
gccacccccactttaagtac

SEQ ID NO: 731952 - DNA, 20 bp, mouse
gagggataagagaagagtaa

SEQ ID NO: 731953 - DNA, 20 bp, mouse
gggaatctgaggcgcagcgc

SEQ ID NO: 731954 - DNA, 20 bp, mouse
gaggatacgcggcgtcgctg

SEQ ID NO: 731955 - DNA, 20 bp, mouse
gggcgtcgctgcggggtggg

SEQ ID NO: 731956 - DNA, 20 bp, mouse
gcgagggccaagttacgact

SEQ ID NO: 731957 - DNA, 20 bp, mouse
gctccctggaaggtgttatt

SEQ ID NO: 731958 - DNA, 20 bp, mouse
gagagggcgggctcggttag

SEQ ID NO: 731959 - DNA, 20 bp, mouse
gaccgagcccgccctctccc

SEQ ID NO: 731960 - DNA, 20 bp, mouse
gcgcccgaacggcccgaaga

SEQ ID NO: 731961 - DNA, 20 bp, mouse
gcatgcgcgggctctacccc

SEQ ID NO: 731962 - DNA, 20 bp, mouse
gagcccgccctctccctgga

SEQ ID NO: 731963 - DNA, 20 bp, mouse
ggccaagttacgactgggaa

SEQ ID NO: 731964 - DNA, 20 bp, mouse
ggcggggtcaagagcccgct

SEQ ID NO: 731965 - DNA, 20 bp, mouse
gggcacctagcaagtatcgc

SEQ ID NO: 731966 - DNA, 20 bp, mouse
gtcaaggtgagaacggtaga

SEQ ID NO: 731967 - DNA, 20 bp, mouse
gggggcgcgcgcacaccgga

SEQ ID NO: 731968 - DNA, 20 bp, mouse
ggggctggaaagcttggccc

SEQ ID NO: 731969 - DNA, 20 bp, mouse
gtatcagcaggagtctaagt

SEQ ID NO: 731970 - DNA, 20 bp, mouse
gaacggtagacggttcgcaa

SEQ ID NO: 731971 - DNA, 20 bp, mouse
gaagcttggccctggtacct

SEQ ID NO: 731972 - DNA, 20 bp, mouse
gtaggctttctgcagaggtt

SEQ ID NO: 731973 - DNA, 20 bp, mouse
gggggcgacttgtttgaagc

SEQ ID NO: 731974 - DNA, 20 bp, mouse
gttcggaaccccaggtacca

SEQ ID NO: 731975 - DNA, 20 bp, mouse
gtgcagaggttcggaacccc

SEQ ID NO: 731976 - DNA, 20 bp, mouse
gaacagcggagtgattctcg

SEQ ID NO: 731977 - DNA, 20 bp, mouse
gtgtaggagtaatcacaaga

SEQ ID NO: 731978 - DNA, 20 bp, mouse
gcatccgggccatcttgctc

SEQ ID NO: 731979 - DNA, 20 bp, mouse
gcaaggtcgagtgaaccccg

SEQ ID NO: 731980 - DNA, 20 bp, mouse
ggtggtccaggagatgctac

SEQ ID NO: 731981 - DNA, 20 bp, mouse
ggggagtagagatgacgctc

SEQ ID NO: 731982 - DNA, 20 bp, mouse
ggaggccggaagctcgtgac

SEQ ID NO: 731983 - DNA, 20 bp, mouse
ggaggctggcccaatgttta

SEQ ID NO: 731984 - DNA, 20 bp, mouse
gagctcgtgaccggaagtgc

SEQ ID NO: 731985 - DNA, 20 bp, mouse
gtttggggatggctgcctcg

SEQ ID NO: 731986 - DNA, 20 bp, mouse
gctggctgaaaatgagtccc

SEQ ID NO: 731987 - DNA, 20 bp, mouse
ggaaaatgagtccctggaaa

SEQ ID NO: 731988 - DNA, 20 bp, mouse
ggccctggcaaccgtttcca

SEQ ID NO: 731989 - DNA, 20 bp, mouse
ggtactctgaggcacaggag

SEQ ID NO: 731990 - DNA, 20 bp, mouse
gacaggaagcagtagtgcat

SEQ ID NO: 731991 - DNA, 20 bp, mouse
ggaacttgcaagtccacttc

SEQ ID NO: 731992 - DNA, 20 bp, mouse
gaagtcaagtcgttccccca

SEQ ID NO: 731993 - DNA, 20 bp, mouse
gtctgggaatcgcagttttc

SEQ ID NO: 731994 - DNA, 20 bp, mouse
ggggacagaaggttgtggcg

SEQ ID NO: 731995 - DNA, 20 bp, mouse
ggacccggaaaccgagagag

SEQ ID NO: 731996 - DNA, 20 bp, mouse
gcagatggtgccactatacc

SEQ ID NO: 731997 - DNA, 20 bp, mouse
gtaactggcgtggctaagag

SEQ ID NO: 731998 - DNA, 20 bp, mouse
gcacaccacaccatcacaag

SEQ ID NO: 731999 - DNA, 20 bp, mouse
gtattccttcccccttgtga

SEQ ID NO: 732000 - DNA, 20 bp, mouse
gggttctggtagcctagcaa

SEQ ID NO: 732001 - DNA, 20 bp, mouse
gaggtctcgctctgcagcgc

SEQ ID NO: 732002 - DNA, 20 bp, mouse
gtgcagccaggactggcctg

SEQ ID NO: 732003 - DNA, 20 bp, mouse
gctgcaatcttgccctccag

SEQ ID NO: 732004 - DNA, 20 bp, mouse
gaggcatggtaaccattgct

SEQ ID NO: 732005 - DNA, 20 bp, mouse
gcctcagctgatctactaac

SEQ ID NO: 732006 - DNA, 20 bp, mouse
ggggagctgccgcgccgacc

SEQ ID NO: 732007 - DNA, 20 bp, mouse
gtctccctggaggccgggtc

SEQ ID NO: 732008 - DNA, 20 bp, mouse
gacaccgctgagaaagtggg

SEQ ID NO: 732009 - DNA, 20 bp, mouse
gttaagcggccggacattcc

SEQ ID NO: 732010 - DNA, 20 bp, mouse
gccggacggaccacgaggag

SEQ ID NO: 732011 - DNA, 20 bp, mouse
gctgcgcagccgggaatgtc

SEQ ID NO: 732012 - DNA, 20 bp, mouse
gtccccagacccggcctcca

SEQ ID NO: 732013 - DNA, 20 bp, mouse
gagccggcgagcgctttaag

SEQ ID NO: 732014 - DNA, 20 bp, mouse
ggtaaggtatccgctcctcg

SEQ ID NO: 732015 - DNA, 20 bp, mouse
gctgcagttcaaagcgcagg

SEQ ID NO: 732016 - DNA, 20 bp, mouse
gcgcgggcgcgtgtcccctg

SEQ ID NO: 732017 - DNA, 20 bp, mouse
gtggccaccctgcaccacag

SEQ ID NO: 732018 - DNA, 20 bp, mouse
gcaagatggcgatggagggg

SEQ ID NO: 732019 - DNA, 20 bp, mouse
gcgccaccagcctgctcctg

SEQ ID NO: 732020 - DNA, 20 bp, mouse
gtggcggggcgcccccgcgt

SEQ ID NO: 732021 - DNA, 20 bp, mouse
ggagcctggaacagaggtgg

SEQ ID NO: 732022 - DNA, 20 bp, mouse
gagcccaagatggcgatgga

SEQ ID NO: 732023 - DNA, 20 bp, mouse
gcgctagcccaagatggcga

SEQ ID NO: 732024 - DNA, 20 bp, mouse
gtgcaccaacagactctctg

SEQ ID NO: 732025 - DNA, 20 bp, mouse
gcgggggcgccccgccagtg

SEQ ID NO: 732026 - DNA, 20 bp, mouse
gacacacattcttttagggg

SEQ ID NO: 732027 - DNA, 20 bp, mouse
gagaatgtgtgtctctgaca

SEQ ID NO: 732028 - DNA, 20 bp, mouse
ggaggctgccatagaaaaat

SEQ ID NO: 732029 - DNA, 20 bp, mouse
gtaccttcgctcttaaaaac

SEQ ID NO: 732030 - DNA, 20 bp, mouse
ggtagacaggaaacagctgg

SEQ ID NO: 732031 - DNA, 20 bp, mouse
gctccagtttttaagagcga

SEQ ID NO: 732032 - DNA, 20 bp, mouse
gatcgagtaaggactttttt

SEQ ID NO: 732033 - DNA, 20 bp, mouse
gctggcaaagttatcgagta

SEQ ID NO: 732034 - DNA, 20 bp, mouse
gtgtgctaatacacctcacc

SEQ ID NO: 732035 - DNA, 20 bp, mouse
gaggattagaggatctaagt

SEQ ID NO: 732036 - DNA, 20 bp, mouse
gtgcctgagccaggggacga

SEQ ID NO: 732037 - DNA, 20 bp, mouse
ggacaaaaggcagtttaccc

SEQ ID NO: 732038 - DNA, 20 bp, mouse
ggcaggtatgctctgagcct

SEQ ID NO: 732039 - DNA, 20 bp, mouse
ggagatagatagccatacaa

SEQ ID NO: 732040 - DNA, 20 bp, mouse
gggaacttgaatcactattc

SEQ ID NO: 732041 - DNA, 20 bp, mouse
gccccatcgtcccctggctc

SEQ ID NO: 732042 - DNA, 20 bp, mouse
gtagttacatttggacaccc

SEQ ID NO: 732043 - DNA, 20 bp, mouse
gttcccagtgcctgagccag

SEQ ID NO: 732044 - DNA, 20 bp, mouse
gctgctggctttgtactctg

SEQ ID NO: 732045 - DNA, 20 bp, mouse
ggcagcaggagatggctgaa

SEQ ID NO: 732046 - DNA, 20 bp, mouse
ggcgccaagagccggagttc

SEQ ID NO: 732047 - DNA, 20 bp, mouse
gcccgcgcgcacactccaag

SEQ ID NO: 732048 - DNA, 20 bp, mouse
gggaggggagggtgcggaca

SEQ ID NO: 732049 - DNA, 20 bp, mouse
gagccggagttcgggatcgc

SEQ ID NO: 732050 - DNA, 20 bp, mouse
gtcgggatcgcagggacgtg

SEQ ID NO: 732051 - DNA, 20 bp, mouse
gtccctgcgatcccgaactc

SEQ ID NO: 732052 - DNA, 20 bp, mouse
gatcgcagggacgtgcggag

SEQ ID NO: 732053 - DNA, 20 bp, mouse
gcggagcggagcgcgggcgt

SEQ ID NO: 732054 - DNA, 20 bp, mouse
gcgagggccgggccccgact

SEQ ID NO: 732055 - DNA, 20 bp, mouse
gccgccgccgccacacactg

SEQ ID NO: 732056 - DNA, 20 bp, mouse
gtggtccaaggctagctctt

SEQ ID NO: 732057 - DNA, 20 bp, mouse
gagaaaagggactggctgga

SEQ ID NO: 732058 - DNA, 20 bp, mouse
ggatgaggcccccctcccac

SEQ ID NO: 732059 - DNA, 20 bp, mouse
ggaggcccccctcccactgg

SEQ ID NO: 732060 - DNA, 20 bp, mouse
ggcaaagcaccaccagtggg

SEQ ID NO: 732061 - DNA, 20 bp, mouse
ggtagggtggagccgggact

SEQ ID NO: 732062 - DNA, 20 bp, mouse
gttgggggtgcaggagaaaa

SEQ ID NO: 732063 - DNA, 20 bp, mouse
ggaaagttacacccagtaaa

SEQ ID NO: 732064 - DNA, 20 bp, mouse
gtccataggaggatgtggga

SEQ ID NO: 732065 - DNA, 20 bp, mouse
gggagggggcgggtgcaaag

SEQ ID NO: 732066 - DNA, 20 bp, mouse
gcacgcggggaatgcgggtc

SEQ ID NO: 732067 - DNA, 20 bp, mouse
gcgagccacgcggggaatgc

SEQ ID NO: 732068 - DNA, 20 bp, mouse
ggcctggtggcaaagatggg

SEQ ID NO: 732069 - DNA, 20 bp, mouse
gcccgcgtggctcgagttgc

SEQ ID NO: 732070 - DNA, 20 bp, mouse
ggggccctgcggacgcccat

SEQ ID NO: 732071 - DNA, 20 bp, mouse
gggcgcgggcgtaaggccag

SEQ ID NO: 732072 - DNA, 20 bp, mouse
gtggtgcgaaccaacgtgcg

SEQ ID NO: 732073 - DNA, 20 bp, mouse
gcaccccggaaacatgacat

SEQ ID NO: 732074 - DNA, 20 bp, mouse
gagtgcctggtggcaaagat

SEQ ID NO: 732075 - DNA, 20 bp, mouse
gggcacgggggttgccggtg

SEQ ID NO: 732076 - DNA, 20 bp, mouse
gccaaggggcccggtggcgt

SEQ ID NO: 732077 - DNA, 20 bp, mouse
gggagggccaaggggcccgg

SEQ ID NO: 732078 - DNA, 20 bp, mouse
ggccccttggccctccaacc

SEQ ID NO: 732079 - DNA, 20 bp, mouse
gcaacagtctccaatcttgg

SEQ ID NO: 732080 - DNA, 20 bp, mouse
gcgcaccccacgggtaaacc

SEQ ID NO: 732081 - DNA, 20 bp, mouse
gcccacagcgacctgcacgg

SEQ ID NO: 732082 - DNA, 20 bp, mouse
ggggccaggttcttgcaaag

SEQ ID NO: 732083 - DNA, 20 bp, mouse
ggaaagacccccgacgccac

SEQ ID NO: 732084 - DNA, 20 bp, mouse
gaggggcccggtggcgtcgg

SEQ ID NO: 732085 - DNA, 20 bp, mouse
ggagactgttgggttggtcc

SEQ ID NO: 732086 - DNA, 20 bp, mouse
gagccctccctcaccctcta

SEQ ID NO: 732087 - DNA, 20 bp, mouse
gtctgggaggagcctagagt

SEQ ID NO: 732088 - DNA, 20 bp, mouse
gtccccttgggttttaatca

SEQ ID NO: 732089 - DNA, 20 bp, mouse
gggggtgtgtatgccctaga

SEQ ID NO: 732090 - DNA, 20 bp, mouse
gtagagtgggttcccaggat

SEQ ID NO: 732091 - DNA, 20 bp, mouse
gggcatacacaccccatcct

SEQ ID NO: 732092 - DNA, 20 bp, mouse
gtgtatgccctagagggtga

SEQ ID NO: 732093 - DNA, 20 bp, mouse
ggagcctagagtgggttccc

SEQ ID NO: 732094 - DNA, 20 bp, mouse
gtcttccaggctatcccctt

SEQ ID NO: 732095 - DNA, 20 bp, mouse
ggctgggggctttgctgaga

SEQ ID NO: 732096 - DNA, 20 bp, mouse
ggcagggcgcgcactctcgg

SEQ ID NO: 732097 - DNA, 20 bp, mouse
gtgggcgcggggccagagtg

SEQ ID NO: 732098 - DNA, 20 bp, mouse
ggcggcgcgcgggaggtgag

SEQ ID NO: 732099 - DNA, 20 bp, mouse
gaggagagctctgcacgcta

SEQ ID NO: 732100 - DNA, 20 bp, mouse
gcgcccgggggcagaggcgg

SEQ ID NO: 732101 - DNA, 20 bp, mouse
gaggtgaggggcgcggacgt

SEQ ID NO: 732102 - DNA, 20 bp, mouse
gctgcctcccggtgccgggg

SEQ ID NO: 732103 - DNA, 20 bp, mouse
gtgaggggcgcggacgtggg

SEQ ID NO: 732104 - DNA, 20 bp, mouse
gagcggcggcggccccaacg

SEQ ID NO: 732105 - DNA, 20 bp, mouse
gcgctcgggactctgcccgg

SEQ ID NO: 732106 - DNA, 20 bp, mouse
ggggtgactggcagcggcga

SEQ ID NO: 732107 - DNA, 20 bp, mouse
gtggccgctgccaaaggggt

SEQ ID NO: 732108 - DNA, 20 bp, mouse
gtggcagcggcgaggggagc

SEQ ID NO: 732109 - DNA, 20 bp, mouse
gcccgctggccgctgccaaa

SEQ ID NO: 732110 - DNA, 20 bp, mouse
gaaaagccggacactcggag

SEQ ID NO: 732111 - DNA, 20 bp, mouse
gccgctgccagtcacccctc

SEQ ID NO: 732112 - DNA, 20 bp, mouse
gaaaaaccccgaggggtgac

SEQ ID NO: 732113 - DNA, 20 bp, mouse
gggggaggggaagcgagatt

SEQ ID NO: 732114 - DNA, 20 bp, mouse
gccagcgcctcaattagagt

SEQ ID NO: 732115 - DNA, 20 bp, mouse
ggggcacggcgagtttccaa

SEQ ID NO: 732116 - DNA, 20 bp, mouse
ggtgctctccgcccagtccc

SEQ ID NO: 732117 - DNA, 20 bp, mouse
gaggacgtcacgtgagcagg

SEQ ID NO: 732118 - DNA, 20 bp, mouse
gtcaaccgagaccagtacgg

SEQ ID NO: 732119 - DNA, 20 bp, mouse
ggggttgtcaggcctcgagt

SEQ ID NO: 732120 - DNA, 20 bp, mouse
gggcggagagcacctgaacg

SEQ ID NO: 732121 - DNA, 20 bp, mouse
ggctcatgtgacccgggact

SEQ ID NO: 732122 - DNA, 20 bp, mouse
gtgcgatgctcatgtgaccc

SEQ ID NO: 732123 - DNA, 20 bp, mouse
ggccgcgcgtgagcaaccct

SEQ ID NO: 732124 - DNA, 20 bp, mouse
ggacgctccggggacggcca

SEQ ID NO: 732125 - DNA, 20 bp, mouse
gtcgaggcctgacaacccca

SEQ ID NO: 732126 - DNA, 20 bp, mouse
gccaaagtctcggggattgg

SEQ ID NO: 732127 - DNA, 20 bp, mouse
gtgtccgccccaaagtctcg

SEQ ID NO: 732128 - DNA, 20 bp, mouse
gggtgctcaaggtaggtgta

SEQ ID NO: 732129 - DNA, 20 bp, mouse
gttaaaggagccagagtgtg

SEQ ID NO: 732130 - DNA, 20 bp, mouse
gccccccactcacctctata

SEQ ID NO: 732131 - DNA, 20 bp, mouse
ggctccgtatagaggtgagt

SEQ ID NO: 732132 - DNA, 20 bp, mouse
gactgggaggcacaaatggt

SEQ ID NO: 732133 - DNA, 20 bp, mouse
gcagtccaggggtttgtcta

SEQ ID NO: 732134 - DNA, 20 bp, mouse
gaatccccgagactttgggg

SEQ ID NO: 732135 - DNA, 20 bp, mouse
gcagctgacctagaggtcac

SEQ ID NO: 732136 - DNA, 20 bp, mouse
ggtacccagagccttatgaa

SEQ ID NO: 732137 - DNA, 20 bp, mouse
gcaagctgctagccagatgg

SEQ ID NO: 732138 - DNA, 20 bp, mouse
gtgtcccgtggtgatggact

SEQ ID NO: 732139 - DNA, 20 bp, mouse
gcacaggttaatgattgtca

SEQ ID NO: 732140 - DNA, 20 bp, mouse
gtgagctctacacaaaccgt

SEQ ID NO: 732141 - DNA, 20 bp, mouse
gcgtgggtggaagggggtaa

SEQ ID NO: 732142 - DNA, 20 bp, mouse
ggggagggagaaacaactgt

SEQ ID NO: 732143 - DNA, 20 bp, mouse
gtacacaaaccgtgggtgga

SEQ ID NO: 732144 - DNA, 20 bp, mouse
gattgtcagggcagcgtgct

SEQ ID NO: 732145 - DNA, 20 bp, mouse
gagggctggctgtgcggcac

SEQ ID NO: 732146 - DNA, 20 bp, mouse
gctcacgcaagagtgcgggg

SEQ ID NO: 732147 - DNA, 20 bp, mouse
ggggtccgcttgaatcccct

SEQ ID NO: 732148 - DNA, 20 bp, mouse
gtgaatcccctaggaacgta

SEQ ID NO: 732149 - DNA, 20 bp, mouse
gcggacaaacccaggctgaa

SEQ ID NO: 732150 - DNA, 20 bp, mouse
gtcccctaggaacgtagggt

SEQ ID NO: 732151 - DNA, 20 bp, mouse
ggaagggagtggtctccata

SEQ ID NO: 732152 - DNA, 20 bp, mouse
ggtgccctcacgcaagagtg

SEQ ID NO: 732153 - DNA, 20 bp, mouse
ggcccaccctacgttcctag

SEQ ID NO: 732154 - DNA, 20 bp, mouse
gggacccctctgttcttccc

SEQ ID NO: 732155 - DNA, 20 bp, mouse
gtcccggagcggacaaaccc

SEQ ID NO: 732156 - DNA, 20 bp, mouse
gaagaggtggccctgataca

SEQ ID NO: 732157 - DNA, 20 bp, mouse
gggactctagagacgcaagg

SEQ ID NO: 732158 - DNA, 20 bp, mouse
gcccgcgcctcccgacgaag

SEQ ID NO: 732159 - DNA, 20 bp, mouse
gacgaagcgggaacgaggac

SEQ ID NO: 732160 - DNA, 20 bp, mouse
gacacgccccggaacggcga

SEQ ID NO: 732161 - DNA, 20 bp, mouse
gatcagggccacctcttcac

SEQ ID NO: 732162 - DNA, 20 bp, mouse
gtcccgacgaagcgggaacg

SEQ ID NO: 732163 - DNA, 20 bp, mouse
ggggcgtgcgcacagagagc

SEQ ID NO: 732164 - DNA, 20 bp, mouse
gccccggaacggcgagggtg

SEQ ID NO: 732165 - DNA, 20 bp, mouse
gagggtccgggacgccaaat

SEQ ID NO: 732166 - DNA, 20 bp, mouse
ggggaactggagcaatggag

SEQ ID NO: 732167 - DNA, 20 bp, mouse
ggggagaagaggccgttagg

SEQ ID NO: 732168 - DNA, 20 bp, mouse
gaagaggccgttagggggga

SEQ ID NO: 732169 - DNA, 20 bp, mouse
gccagcgccgtccccgaggt

SEQ ID NO: 732170 - DNA, 20 bp, mouse
gaagcgacgcagtttggaag

SEQ ID NO: 732171 - DNA, 20 bp, mouse
ggaagaggaagcagggcgag

SEQ ID NO: 732172 - DNA, 20 bp, mouse
gggggccggtataaagtccc

SEQ ID NO: 732173 - DNA, 20 bp, mouse
gcgacgcagtttggaagcgg

SEQ ID NO: 732174 - DNA, 20 bp, mouse
gactccttcgaggtcgaggg

SEQ ID NO: 732175 - DNA, 20 bp, mouse
gagcgccccctcccccctaa

SEQ ID NO: 732176 - DNA, 20 bp, mouse
gggactgttgccatgtatgg

SEQ ID NO: 732177 - DNA, 20 bp, mouse
gaaaaccaactccccagctt

SEQ ID NO: 732178 - DNA, 20 bp, mouse
gaatgcgggcccaagtgcag

SEQ ID NO: 732179 - DNA, 20 bp, mouse
ggagcaggttcctccataca

SEQ ID NO: 732180 - DNA, 20 bp, mouse
gaacatctggaatgctggca

SEQ ID NO: 732181 - DNA, 20 bp, mouse
gaggaacctgctcaatcctc

SEQ ID NO: 732182 - DNA, 20 bp, mouse
gtggcagggcctctgcactt

SEQ ID NO: 732183 - DNA, 20 bp, mouse
ggcagacaggaggttacatc

SEQ ID NO: 732184 - DNA, 20 bp, mouse
gctgggactgttgccatgta

SEQ ID NO: 732185 - DNA, 20 bp, mouse
gctagccaaagctggggagt

SEQ ID NO: 732186 - DNA, 20 bp, mouse
gaggaggagggctctgtgta

SEQ ID NO: 732187 - DNA, 20 bp, mouse
ggggagcccccgtgtctaga

SEQ ID NO: 732188 - DNA, 20 bp, mouse
gtacggaaagggctttgggg

SEQ ID NO: 732189 - DNA, 20 bp, mouse
gaacaggtaagaggcgtcgg

SEQ ID NO: 732190 - DNA, 20 bp, mouse
gagaggccttctagacacgg

SEQ ID NO: 732191 - DNA, 20 bp, mouse
gccagagcccgcagtctctt

SEQ ID NO: 732192 - DNA, 20 bp, mouse
ggaagggtgcagaccgaggg

SEQ ID NO: 732193 - DNA, 20 bp, mouse
gctcacggaatgtacggaaa

SEQ ID NO: 732194 - DNA, 20 bp, mouse
ggcgcaaactcacacggggt

SEQ ID NO: 732195 - DNA, 20 bp, mouse
gcaggtgcacgcagagcgag

SEQ ID NO: 732196 - DNA, 20 bp, mouse
gtaaacagcggcggagaaga

SEQ ID NO: 732197 - DNA, 20 bp, mouse
gggaaaagccgggtggaccc

SEQ ID NO: 732198 - DNA, 20 bp, mouse
gaaagccgggtggacccagg

SEQ ID NO: 732199 - DNA, 20 bp, mouse
gacccgagaagggatagtat

SEQ ID NO: 732200 - DNA, 20 bp, mouse
gcagcggcggagaagaaggg

SEQ ID NO: 732201 - DNA, 20 bp, mouse
gactggagggccacccacct

SEQ ID NO: 732202 - DNA, 20 bp, mouse
gaaaaggcagtcccttaact

SEQ ID NO: 732203 - DNA, 20 bp, mouse
gctccagtccacccagttaa

SEQ ID NO: 732204 - DNA, 20 bp, mouse
gaggcagtcccttaactggg

SEQ ID NO: 732205 - DNA, 20 bp, mouse
gtgggcagaagctcccacgg

SEQ ID NO: 732206 - DNA, 20 bp, mouse
ggcagcgaggatgcccacga

SEQ ID NO: 732207 - DNA, 20 bp, mouse
gaggatgcccacgacggcga

SEQ ID NO: 732208 - DNA, 20 bp, mouse
ggccccgcccggtgctccgt

SEQ ID NO: 732209 - DNA, 20 bp, mouse
gctcccgccgtcgccgtcgt

SEQ ID NO: 732210 - DNA, 20 bp, mouse
gcagcacgcatggtggacgt

SEQ ID NO: 732211 - DNA, 20 bp, mouse
gagccggtcagcacgcatgg

SEQ ID NO: 732212 - DNA, 20 bp, mouse
gaggagccggtcagcacgca

SEQ ID NO: 732213 - DNA, 20 bp, mouse
gacgtgggacgagctctcca

SEQ ID NO: 732214 - DNA, 20 bp, mouse
gatgcccacgacggcgacgg

SEQ ID NO: 732215 - DNA, 20 bp, mouse
ggagcaggaaaggacgcggg

SEQ ID NO: 732216 - DNA, 20 bp, mouse
gcagcgctgcgcggccctac

SEQ ID NO: 732217 - DNA, 20 bp, mouse
gggaggtggcagagctgttc

SEQ ID NO: 732218 - DNA, 20 bp, mouse
gtcccccagcgctcaatcgg

SEQ ID NO: 732219 - DNA, 20 bp, mouse
ggccgcgcagcgctggtccc

SEQ ID NO: 732220 - DNA, 20 bp, mouse
gtaaaataaggcgtcctggt

SEQ ID NO: 732221 - DNA, 20 bp, mouse
ggccacctccgattgagcgc

SEQ ID NO: 732222 - DNA, 20 bp, mouse
gagactcagcgtggtccaaa

SEQ ID NO: 732223 - DNA, 20 bp, mouse
gtggcccggcccgcaccgcg

SEQ ID NO: 732224 - DNA, 20 bp, mouse
ggggaactgagtattcgatc

SEQ ID NO: 732225 - DNA, 20 bp, mouse
gcccagcgctcaatcggagg

SEQ ID NO: 732226 - DNA, 20 bp, mouse
gaggggaggtgctggtacta

SEQ ID NO: 732227 - DNA, 20 bp, mouse
gcacacaatggaatgttcta

SEQ ID NO: 732228 - DNA, 20 bp, mouse
ggtgtgactgatagctgtaa

SEQ ID NO: 732229 - DNA, 20 bp, mouse
ggcagagggccaattgctgg

SEQ ID NO: 732230 - DNA, 20 bp, mouse
gacagctatcagtcacacaa

SEQ ID NO: 732231 - DNA, 20 bp, mouse
gggcaatgatactttttgat

SEQ ID NO: 732232 - DNA, 20 bp, mouse
ggactgatagctgtaagggg

SEQ ID NO: 732233 - DNA, 20 bp, mouse
ggtacttttcctccagcaat

SEQ ID NO: 732234 - DNA, 20 bp, mouse
gaaagtaccaaggagaaaaa

SEQ ID NO: 732235 - DNA, 20 bp, mouse
gaaatccagaagatagttag

SEQ ID NO: 732236 - DNA, 20 bp, mouse
ggtggtctggggaacgacgt

SEQ ID NO: 732237 - DNA, 20 bp, mouse
gggcatggtcgcttctgaga

SEQ ID NO: 732238 - DNA, 20 bp, mouse
gtccgaagcctggggatgct

SEQ ID NO: 732239 - DNA, 20 bp, mouse
gttgaaaagggacgctggac

SEQ ID NO: 732240 - DNA, 20 bp, mouse
gagtgaagggcactttgaaa

SEQ ID NO: 732241 - DNA, 20 bp, mouse
ggcactttgaaaagggacgc

SEQ ID NO: 732242 - DNA, 20 bp, mouse
gtggctggtaatgtcatctg

SEQ ID NO: 732243 - DNA, 20 bp, mouse
gtcagaagcgaccatgccgg

SEQ ID NO: 732244 - DNA, 20 bp, mouse
gaggtcaccgtccccgagaa

SEQ ID NO: 732245 - DNA, 20 bp, mouse
gccacctgtccctaagagac

SEQ ID NO: 732246 - DNA, 20 bp, mouse
gcacactggttaaggataga

SEQ ID NO: 732247 - DNA, 20 bp, mouse
gaaccagtgtggaatccttc

SEQ ID NO: 732248 - DNA, 20 bp, mouse
ggtcccacctaacacctgag

SEQ ID NO: 732249 - DNA, 20 bp, mouse
ggaaaaagctaagagatcac

SEQ ID NO: 732250 - DNA, 20 bp, mouse
gaataggataggtttgggat

SEQ ID NO: 732251 - DNA, 20 bp, mouse
gaatccttcaggaataggat

SEQ ID NO: 732252 - DNA, 20 bp, mouse
gttcctgaaggattccacac

SEQ ID NO: 732253 - DNA, 20 bp, mouse
gtcaggaataggataggttt

SEQ ID NO: 732254 - DNA, 20 bp, mouse
gtctccctttaactcattca

SEQ ID NO: 732255 - DNA, 20 bp, mouse
gaggttgaagcactgccagg

SEQ ID NO: 732256 - DNA, 20 bp, mouse
gtgtctcctagactggaatg

SEQ ID NO: 732257 - DNA, 20 bp, mouse
gcaaagcctggcggggtgta

SEQ ID NO: 732258 - DNA, 20 bp, mouse
gcagcatggggaactgatta

SEQ ID NO: 732259 - DNA, 20 bp, mouse
gtggaagccattatggtctc

SEQ ID NO: 732260 - DNA, 20 bp, mouse
gctcactcactgcccctcgc

SEQ ID NO: 732261 - DNA, 20 bp, mouse
ggagtgagcaaagcctggcg

SEQ ID NO: 732262 - DNA, 20 bp, mouse
gggggaccccattccagtct

SEQ ID NO: 732263 - DNA, 20 bp, mouse
gaggacataggtaccccaca

SEQ ID NO: 732264 - DNA, 20 bp, mouse
gggcacaagtttggataaag

SEQ ID NO: 732265 - DNA, 20 bp, mouse
gcagatggttagattcattc

SEQ ID NO: 732266 - DNA, 20 bp, mouse
ggtaagaaacgccagttaca

SEQ ID NO: 732267 - DNA, 20 bp, mouse
gggttgttggcaactgaata

SEQ ID NO: 732268 - DNA, 20 bp, mouse
ggatggctgttctggttgaa

SEQ ID NO: 732269 - DNA, 20 bp, mouse
ggggaaaagagcttgcataa

SEQ ID NO: 732270 - DNA, 20 bp, mouse
ggtgttccagatggctgttc

SEQ ID NO: 732271 - DNA, 20 bp, mouse
gcaactgaatatggatcctc

SEQ ID NO: 732272 - DNA, 20 bp, mouse
gtggcctcataaatttggag

SEQ ID NO: 732273 - DNA, 20 bp, mouse
gacatggaaaaattaaggtc

SEQ ID NO: 732274 - DNA, 20 bp, mouse
gtaagatgccatttggttgt

SEQ ID NO: 732275 - DNA, 20 bp, mouse
gtggggatccttaggaagca

SEQ ID NO: 732276 - DNA, 20 bp, mouse
gggatcaggtgagaccaggg

SEQ ID NO: 732277 - DNA, 20 bp, mouse
gggtgtggacagttgtcctc

SEQ ID NO: 732278 - DNA, 20 bp, mouse
ggggaacgcaggaaacggac

SEQ ID NO: 732279 - DNA, 20 bp, mouse
gcggccgggaatccgcgccc

SEQ ID NO: 732280 - DNA, 20 bp, mouse
ggctgcttccgcttccggtt

SEQ ID NO: 732281 - DNA, 20 bp, mouse
gatccggatcaggtgagacc

SEQ ID NO: 732282 - DNA, 20 bp, mouse
gcatcccagggatccggatc

SEQ ID NO: 732283 - DNA, 20 bp, mouse
gggttgggactgtggaaaca

SEQ ID NO: 732284 - DNA, 20 bp, mouse
gacacacgggcggcagacgg

SEQ ID NO: 732285 - DNA, 20 bp, mouse
gagaacctgggatgagaacg

SEQ ID NO: 732286 - DNA, 20 bp, mouse
ggggctcaataaaagtgttc

SEQ ID NO: 732287 - DNA, 20 bp, mouse
gttcttctctagatggacta

SEQ ID NO: 732288 - DNA, 20 bp, mouse
gcttgctcaatgataacaca

SEQ ID NO: 732289 - DNA, 20 bp, mouse
gaggcctaaaatttattgag

SEQ ID NO: 732290 - DNA, 20 bp, mouse
gtagaaacttctttcagata

SEQ ID NO: 732291 - DNA, 20 bp, mouse
gttttgaaatatataacctg

SEQ ID NO: 732292 - DNA, 20 bp, mouse
gcaagtccaaaccctctctg

SEQ ID NO: 732293 - DNA, 20 bp, mouse
ggtcaggcagcagaattctc

SEQ ID NO: 732294 - DNA, 20 bp, mouse
gagtggtggtgatgaggatg

SEQ ID NO: 732295 - DNA, 20 bp, mouse
gtacagattgtgctttgtag

SEQ ID NO: 732296 - DNA, 20 bp, mouse
gaactgtcgtcacattgctc

SEQ ID NO: 732297 - DNA, 20 bp, mouse
ggaagtagtatatatcctgt

SEQ ID NO: 732298 - DNA, 20 bp, mouse
gtatcaatgattattgcagg

SEQ ID NO: 732299 - DNA, 20 bp, mouse
gatctatcaatgattattgc

SEQ ID NO: 732300 - DNA, 20 bp, mouse
gaatgtgacgacagttcttc

SEQ ID NO: 732301 - DNA, 20 bp, mouse
ggtgacgacagttcttcagg

SEQ ID NO: 732302 - DNA, 20 bp, mouse
ggagcagaacaacagaatca

SEQ ID NO: 732303 - DNA, 20 bp, mouse
ggtctatggcagttaatact

SEQ ID NO: 732304 - DNA, 20 bp, mouse
gcaaatgttggatttggagg

SEQ ID NO: 732305 - DNA, 20 bp, mouse
ggtcacattgctcaggcagc

SEQ ID NO: 732306 - DNA, 20 bp, mouse
gagagtggaaaggtgtgaga

SEQ ID NO: 732307 - DNA, 20 bp, mouse
gacactgcatgagagtggaa

SEQ ID NO: 732308 - DNA, 20 bp, mouse
gtcagggatgggagccttag

SEQ ID NO: 732309 - DNA, 20 bp, mouse
gctgtcagagctctatggtc

SEQ ID NO: 732310 - DNA, 20 bp, mouse
gtgacagagatgcacaaatc

SEQ ID NO: 732311 - DNA, 20 bp, mouse
gttagtatttgagtcctcta

SEQ ID NO: 732312 - DNA, 20 bp, mouse
gcccaggcttgcatggacac

SEQ ID NO: 732313 - DNA, 20 bp, mouse
gcccatgcataactcaaatg

SEQ ID NO: 732314 - DNA, 20 bp, mouse
gatgcaaaattggtcaactg

SEQ ID NO: 732315 - DNA, 20 bp, mouse
gtcctgtgtccatgcaagcc

SEQ ID NO: 732316 - DNA, 20 bp, mouse
gcagttcagttccaagtcca

SEQ ID NO: 732317 - DNA, 20 bp, mouse
gcaggggtgggagccttata

SEQ ID NO: 732318 - DNA, 20 bp, mouse
gagagctttatgcttcatac

SEQ ID NO: 732319 - DNA, 20 bp, mouse
gaaagtatttgagccttata

SEQ ID NO: 732320 - DNA, 20 bp, mouse
ggtgttagtatttgagccat

SEQ ID NO: 732321 - DNA, 20 bp, mouse
gatactgcatgagagtggag

SEQ ID NO: 732322 - DNA, 20 bp, mouse
gtgacagagatgcagatatc

SEQ ID NO: 732323 - DNA, 20 bp, mouse
gtgctgtatcatgagctcag

SEQ ID NO: 732324 - DNA, 20 bp, mouse
gctatgaattgccttttaag

SEQ ID NO: 732325 - DNA, 20 bp, mouse
ggatgtttgagaagtaataa

SEQ ID NO: 732326 - DNA, 20 bp, mouse
gatagaaagctgggatttga

SEQ ID NO: 732327 - DNA, 20 bp, mouse
gtacactggaaagacgcaca

SEQ ID NO: 732328 - DNA, 20 bp, mouse
gctgcattcttgctagtctt

SEQ ID NO: 732329 - DNA, 20 bp, mouse
gctgctggaatgatgactga

SEQ ID NO: 732330 - DNA, 20 bp, mouse
gatcccagctttctattaga

SEQ ID NO: 732331 - DNA, 20 bp, mouse
gttccctctaatagaaagct

SEQ ID NO: 732332 - DNA, 20 bp, mouse
gtttgaactgcatgctacac

SEQ ID NO: 732333 - DNA, 20 bp, mouse
gtatttaaacattctcaaca

SEQ ID NO: 732334 - DNA, 20 bp, mouse
gtaaaacgtaacattagcta

SEQ ID NO: 732335 - DNA, 20 bp, mouse
gcttaaaataaccccagagc

SEQ ID NO: 732336 - DNA, 20 bp, mouse
ggcaatcatgagaaactgtc

SEQ ID NO: 732337 - DNA, 20 bp, mouse
gctgtattgcaaaaagaact

SEQ ID NO: 732338 - DNA, 20 bp, mouse
gtcacaaatatataaccaac

SEQ ID NO: 732339 - DNA, 20 bp, mouse
gttatatatttgtgagaagg

SEQ ID NO: 732340 - DNA, 20 bp, mouse
gaatggaggaaatatatgct

SEQ ID NO: 732341 - DNA, 20 bp, mouse
gctttttgcaatacagatag

SEQ ID NO: 732342 - DNA, 20 bp, mouse
gtatatttcctccattgagg

SEQ ID NO: 732343 - DNA, 20 bp, mouse
gatgacatggatagatgaga

SEQ ID NO: 732344 - DNA, 20 bp, mouse
gtaaccaacaggcaccatcc

SEQ ID NO: 732345 - DNA, 20 bp, mouse
gtagacaggtattatcctcc

SEQ ID NO: 732346 - DNA, 20 bp, mouse
gcaccatgtggtaaagggaa

SEQ ID NO: 732347 - DNA, 20 bp, mouse
ggtgccttgctaccaactat

SEQ ID NO: 732348 - DNA, 20 bp, mouse
gggtggagatatgacacagc

SEQ ID NO: 732349 - DNA, 20 bp, mouse
gccaactataggcttagttc

SEQ ID NO: 732350 - DNA, 20 bp, mouse
gacatagtccagtgttcctc

SEQ ID NO: 732351 - DNA, 20 bp, mouse
gaagcctatagttggtagca

SEQ ID NO: 732352 - DNA, 20 bp, mouse
gactataggcttagttcagg

SEQ ID NO: 732353 - DNA, 20 bp, mouse
gttcccttccctttaccaca

SEQ ID NO: 732354 - DNA, 20 bp, mouse
ggagcacttgttctggaact

SEQ ID NO: 732355 - DNA, 20 bp, mouse
gagaaataaaaatttgtact

SEQ ID NO: 732356 - DNA, 20 bp, mouse
ggggaaggacttgtacgagt

SEQ ID NO: 732357 - DNA, 20 bp, mouse
gctcaggtaattaatcgaaa

SEQ ID NO: 732358 - DNA, 20 bp, mouse
ggactatgtctctagatctt

SEQ ID NO: 732359 - DNA, 20 bp, mouse
gatgcagactttaacattat

SEQ ID NO: 732360 - DNA, 20 bp, mouse
gtgcatagccatgatgaagc

SEQ ID NO: 732361 - DNA, 20 bp, mouse
gacatagtcctgcttcatca

SEQ ID NO: 732362 - DNA, 20 bp, mouse
ggacttgtacgagtgggtac

SEQ ID NO: 732363 - DNA, 20 bp, mouse
gacacatgtaatacttagaa

SEQ ID NO: 732364 - DNA, 20 bp, mouse
gagacataaagttgcagact

SEQ ID NO: 732365 - DNA, 20 bp, mouse
gttacttatagcaaacactg

SEQ ID NO: 732366 - DNA, 20 bp, mouse
gaaaatcaagccaaaatcaa

SEQ ID NO: 732367 - DNA, 20 bp, mouse
gcaaaatgacatattaattc

SEQ ID NO: 732368 - DNA, 20 bp, mouse
gaagaagtgccccttgtcct

SEQ ID NO: 732369 - DNA, 20 bp, mouse
gacatagattcccttgattt

SEQ ID NO: 732370 - DNA, 20 bp, mouse
ggaaatgagttatatctctg

SEQ ID NO: 732371 - DNA, 20 bp, mouse
gacaaacatattgttctact

SEQ ID NO: 732372 - DNA, 20 bp, mouse
gtgtggagcattctttcata

SEQ ID NO: 732373 - DNA, 20 bp, mouse
gctttagaaccaaggacaag

SEQ ID NO: 732374 - DNA, 20 bp, mouse
ggataatttgtgactcttct

SEQ ID NO: 732375 - DNA, 20 bp, mouse
gtgggtggtaatccttttat

SEQ ID NO: 732376 - DNA, 20 bp, mouse
gtgcccagagctctagggat

SEQ ID NO: 732377 - DNA, 20 bp, mouse
gagggacctggatatcagtc

SEQ ID NO: 732378 - DNA, 20 bp, mouse
gggactacccggttgtggtt

SEQ ID NO: 732379 - DNA, 20 bp, mouse
gtctgtggagcaggtcccca

SEQ ID NO: 732380 - DNA, 20 bp, mouse
ggctgtgagtgaaaacagtt

SEQ ID NO: 732381 - DNA, 20 bp, mouse
gtctagggatgggttaagac

SEQ ID NO: 732382 - DNA, 20 bp, mouse
gggacctgctccacagaccc

SEQ ID NO: 732383 - DNA, 20 bp, mouse
gacagacccaggggccctca

SEQ ID NO: 732384 - DNA, 20 bp, mouse
gccaggggccctcagggacc

SEQ ID NO: 732385 - DNA, 20 bp, mouse
gcaaagggactacccggttg

SEQ ID NO: 732386 - DNA, 20 bp, mouse
gcgggcaaccggcgtcctcc

SEQ ID NO: 732387 - DNA, 20 bp, mouse
gctggagaccaggaggacgc

SEQ ID NO: 732388 - DNA, 20 bp, mouse
gccggagtctgcaggagggt

SEQ ID NO: 732389 - DNA, 20 bp, mouse
gacgccggttgcccggggga

SEQ ID NO: 732390 - DNA, 20 bp, mouse
gggcagggccacagtaacaa

SEQ ID NO: 732391 - DNA, 20 bp, mouse
gcatctgggtctgaggaaga

SEQ ID NO: 732392 - DNA, 20 bp, mouse
gggacagagccggagtctgc

SEQ ID NO: 732393 - DNA, 20 bp, mouse
gggggggggttgctcgttgg

SEQ ID NO: 732394 - DNA, 20 bp, mouse
ggccggggggggttgctcgt

SEQ ID NO: 732395 - DNA, 20 bp, mouse
ggggaggggaaccccgcctg

SEQ ID NO: 732396 - DNA, 20 bp, mouse
ggggttcgggagcccagcga

SEQ ID NO: 732397 - DNA, 20 bp, mouse
ggggaggggcgttccattcc

SEQ ID NO: 732398 - DNA, 20 bp, mouse
ggggccggacggcagatggg

SEQ ID NO: 732399 - DNA, 20 bp, mouse
gttccattcctggtcgtcag

SEQ ID NO: 732400 - DNA, 20 bp, mouse
gctgcagtcctctgacgacc

SEQ ID NO: 732401 - DNA, 20 bp, mouse
gttcgggagcccagcgaggg

SEQ ID NO: 732402 - DNA, 20 bp, mouse
gccggacggcagatgggtgg

SEQ ID NO: 732403 - DNA, 20 bp, mouse
gtgtctaaggactgcctctc

SEQ ID NO: 732404 - DNA, 20 bp, mouse
ggtcctctgacgaccaggaa

SEQ ID NO: 732405 - DNA, 20 bp, mouse
gtgctaggcagagttgctgt

SEQ ID NO: 732406 - DNA, 20 bp, mouse
ggaggtcatagaagtgcaag

SEQ ID NO: 732407 - DNA, 20 bp, mouse
ggggcggcaatttatgtcat

SEQ ID NO: 732408 - DNA, 20 bp, mouse
gcatagaagtgcaagaggtt

SEQ ID NO: 732409 - DNA, 20 bp, mouse
ggctctgggtggttgagtgt

SEQ ID NO: 732410 - DNA, 20 bp, mouse
gtcactacccaatagggatt

SEQ ID NO: 732411 - DNA, 20 bp, mouse
ggtcatacccaatccctatt

SEQ ID NO: 732412 - DNA, 20 bp, mouse
ggcttattcactacccaata

SEQ ID NO: 732413 - DNA, 20 bp, mouse
ggcggagatgaggggcatgg

SEQ ID NO: 732414 - DNA, 20 bp, mouse
gaggagttgctgggattagg

SEQ ID NO: 732415 - DNA, 20 bp, mouse
ggcaacctcatcaagagcca

SEQ ID NO: 732416 - DNA, 20 bp, mouse
gacaggaggagcaaactcgc

SEQ ID NO: 732417 - DNA, 20 bp, mouse
gcctctaggggtcttcactc

SEQ ID NO: 732418 - DNA, 20 bp, mouse
gccctccccctgttaggaga

SEQ ID NO: 732419 - DNA, 20 bp, mouse
gagatgggagaggtcacgaa

SEQ ID NO: 732420 - DNA, 20 bp, mouse
gtgtggcccgggctggctca

SEQ ID NO: 732421 - DNA, 20 bp, mouse
gggttggcgctggtggtccc

SEQ ID NO: 732422 - DNA, 20 bp, mouse
gggaacctagacataaaaat

SEQ ID NO: 732423 - DNA, 20 bp, mouse
gcaaactcgcaggcgagcct

SEQ ID NO: 732424 - DNA, 20 bp, mouse
gaatgggcgggccatcgacc

SEQ ID NO: 732425 - DNA, 20 bp, mouse
ggcccagggcttaccagcac

SEQ ID NO: 732426 - DNA, 20 bp, mouse
gaggcgtcgcactggagtcg

SEQ ID NO: 732427 - DNA, 20 bp, mouse
gcactcgccgagcggtctcc

SEQ ID NO: 732428 - DNA, 20 bp, mouse
gcgcctgcccactcgccgag

SEQ ID NO: 732429 - DNA, 20 bp, mouse
gaaagacgagttggatctga

SEQ ID NO: 732430 - DNA, 20 bp, mouse
gtggccactaggcgtcgcac

SEQ ID NO: 732431 - DNA, 20 bp, mouse
gagcctgccccgagcctcgg

SEQ ID NO: 732432 - DNA, 20 bp, mouse
gtgtccttgcaggtttcatg

SEQ ID NO: 732433 - DNA, 20 bp, mouse
gactccagtgcgacgcctag

SEQ ID NO: 732434 - DNA, 20 bp, mouse
gtcagccaagaaagacgagt

SEQ ID NO: 732435 - DNA, 20 bp, mouse
gctgcactggactacaataa

SEQ ID NO: 732436 - DNA, 20 bp, mouse
gcggaggaaaggggcgtcca

SEQ ID NO: 732437 - DNA, 20 bp, mouse
gagagccgaacagcccagaa

SEQ ID NO: 732438 - DNA, 20 bp, mouse
ggtagaagccgagagggagg

SEQ ID NO: 732439 - DNA, 20 bp, mouse
gcaagcagttgtgatgagat

SEQ ID NO: 732440 - DNA, 20 bp, mouse
gaagccgatttattgcagag

SEQ ID NO: 732441 - DNA, 20 bp, mouse
gtctcctctctgcaataaat

SEQ ID NO: 732442 - DNA, 20 bp, mouse
gcagagggtagaagccgaga

SEQ ID NO: 732443 - DNA, 20 bp, mouse
gctgcaataaatcggcttag

SEQ ID NO: 732444 - DNA, 20 bp, mouse
gggggtggggagggcgattc

SEQ ID NO: 732445 - DNA, 20 bp, mouse
gggcgcgagaagagcgagcg

SEQ ID NO: 732446 - DNA, 20 bp, mouse
gaacctggcagtgtagccaa

SEQ ID NO: 732447 - DNA, 20 bp, mouse
gtggcagtgtagccaagggg

SEQ ID NO: 732448 - DNA, 20 bp, mouse
gagctggctgatagagaacc

SEQ ID NO: 732449 - DNA, 20 bp, mouse
gcaaaggtcaactcgatagg

SEQ ID NO: 732450 - DNA, 20 bp, mouse
gttggttaggtgaatggcag

SEQ ID NO: 732451 - DNA, 20 bp, mouse
gcccgcgtcagacgggactg

SEQ ID NO: 732452 - DNA, 20 bp, mouse
gaggcacttggttaggtgaa

SEQ ID NO: 732453 - DNA, 20 bp, mouse
gccaagggccagaacattcc

SEQ ID NO: 732454 - DNA, 20 bp, mouse
gcaactcgataggaggcagc

SEQ ID NO: 732455 - DNA, 20 bp, mouse
gatcagagagacatggccca

SEQ ID NO: 732456 - DNA, 20 bp, mouse
gccaccgccccggcgctctc

SEQ ID NO: 732457 - DNA, 20 bp, mouse
gaggcgagcaagggcgaagg

SEQ ID NO: 732458 - DNA, 20 bp, mouse
gggtgggcggggcgttccgg

SEQ ID NO: 732459 - DNA, 20 bp, mouse
gcagccagagagcgccgggg

SEQ ID NO: 732460 - DNA, 20 bp, mouse
gaacgccccgcccaccgccc

SEQ ID NO: 732461 - DNA, 20 bp, mouse
gctccccgcgaggcgagcaa

SEQ ID NO: 732462 - DNA, 20 bp, mouse
gggagcctgggctttgggag

SEQ ID NO: 732463 - DNA, 20 bp, mouse
ggcgaaggcggtggcctcac

SEQ ID NO: 732464 - DNA, 20 bp, mouse
gcgagcaagggcgaaggcgg

SEQ ID NO: 732465 - DNA, 20 bp, mouse
gaagctaaggctatgaacct

SEQ ID NO: 732466 - DNA, 20 bp, mouse
gctggaaaaaggctcggcgg

SEQ ID NO: 732467 - DNA, 20 bp, mouse
gagactctggctggtggcga

SEQ ID NO: 732468 - DNA, 20 bp, mouse
gtgggcagccttgaccctta

SEQ ID NO: 732469 - DNA, 20 bp, mouse
ggcccaggctataaaccagg

SEQ ID NO: 732470 - DNA, 20 bp, mouse
ggactgggtaatggttaaga

SEQ ID NO: 732471 - DNA, 20 bp, mouse
gccaccagccagagtctgac

SEQ ID NO: 732472 - DNA, 20 bp, mouse
gtcaggctaagaaacagagg

SEQ ID NO: 732473 - DNA, 20 bp, mouse
gggactggaaaaaggctcgg

SEQ ID NO: 732474 - DNA, 20 bp, mouse
ggactgagccggtcagactc

SEQ ID NO: 732475 - DNA, 20 bp, mouse
gtaaaccaggaggtgcagac

SEQ ID NO: 732476 - DNA, 20 bp, mouse
gagggagtgaccagagcatc

SEQ ID NO: 732477 - DNA, 20 bp, mouse
ggggcatttgatattctttg

SEQ ID NO: 732478 - DNA, 20 bp, mouse
gagtcctgggagaaaaaccc

SEQ ID NO: 732479 - DNA, 20 bp, mouse
gtctttgtggagcttgcagg

SEQ ID NO: 732480 - DNA, 20 bp, mouse
ggctcacgtctaacagtttc

SEQ ID NO: 732481 - DNA, 20 bp, mouse
gtgtatgttagaaactgcca

SEQ ID NO: 732482 - DNA, 20 bp, mouse
gaaatgccaggctctgcttg

SEQ ID NO: 732483 - DNA, 20 bp, mouse
gctgatgtgctccactgcag

SEQ ID NO: 732484 - DNA, 20 bp, mouse
gagcatccggcatggtaaaa

SEQ ID NO: 732485 - DNA, 20 bp, mouse
ggtgaccagagcatccggca

SEQ ID NO: 732486 - DNA, 20 bp, mouse
gccgccccaggccgtcgcct

SEQ ID NO: 732487 - DNA, 20 bp, mouse
gtggcccaggcgacggcctg

SEQ ID NO: 732488 - DNA, 20 bp, mouse
gcgaagtctggcccaggcga

SEQ ID NO: 732489 - DNA, 20 bp, mouse
gtgcacctgccagccttcca

SEQ ID NO: 732490 - DNA, 20 bp, mouse
ggccctctgagcgaggaaat

SEQ ID NO: 732491 - DNA, 20 bp, mouse
gagaggcggagccaccatca

SEQ ID NO: 732492 - DNA, 20 bp, mouse
gcctctggggatgcatgatg

SEQ ID NO: 732493 - DNA, 20 bp, mouse
gtggctccgcctctggcctc

SEQ ID NO: 732494 - DNA, 20 bp, mouse
gctcaggctgggcgaactgg

SEQ ID NO: 732495 - DNA, 20 bp, mouse
ggggcgaactggcggcacct

SEQ ID NO: 732496 - DNA, 20 bp, mouse
ggaggcgctcggggcatcta

SEQ ID NO: 732497 - DNA, 20 bp, mouse
ggaaagacgcggtcgcacgt

SEQ ID NO: 732498 - DNA, 20 bp, mouse
gtgtacaactaagcggggaa

SEQ ID NO: 732499 - DNA, 20 bp, mouse
gtgtacagagctccacgagg

SEQ ID NO: 732500 - DNA, 20 bp, mouse
ggcgctcggggcatctaagg

SEQ ID NO: 732501 - DNA, 20 bp, mouse
gggctctggtcgccccctcg

SEQ ID NO: 732502 - DNA, 20 bp, mouse
ggggtcccgcccgccttgct

SEQ ID NO: 732503 - DNA, 20 bp, mouse
gaacaagcgtgccacaaagg

SEQ ID NO: 732504 - DNA, 20 bp, mouse
ggccacaaaggaggcatcga

SEQ ID NO: 732505 - DNA, 20 bp, mouse
ggcttcccgcctcgcgtcag

SEQ ID NO: 732506 - DNA, 20 bp, mouse
gccctcggataacctgtcaa

SEQ ID NO: 732507 - DNA, 20 bp, mouse
gggacagtgctcacgagtct

SEQ ID NO: 732508 - DNA, 20 bp, mouse
gcacgagtctaggcactgat

SEQ ID NO: 732509 - DNA, 20 bp, mouse
gagaaggcgagcccatttca

SEQ ID NO: 732510 - DNA, 20 bp, mouse
gcttcaacgcaccttgaaat

SEQ ID NO: 732511 - DNA, 20 bp, mouse
gggcaatgcgcatgattctg

SEQ ID NO: 732512 - DNA, 20 bp, mouse
gctagccgggcctgtcctgg

SEQ ID NO: 732513 - DNA, 20 bp, mouse
ggggaaacccaagcatcctg

SEQ ID NO: 732514 - DNA, 20 bp, mouse
gacccttgacaggttatccg

SEQ ID NO: 732515 - DNA, 20 bp, mouse
gatgcgcattgcctgggaaa

SEQ ID NO: 732516 - DNA, 20 bp, mouse
gtgcccaggtagaggggaat

SEQ ID NO: 732517 - DNA, 20 bp, mouse
gtccccaggatcaaagtatg

SEQ ID NO: 732518 - DNA, 20 bp, mouse
gagacgacagaattggaaca

SEQ ID NO: 732519 - DNA, 20 bp, mouse
ggaaggagaccacttaaagg

SEQ ID NO: 732520 - DNA, 20 bp, mouse
gactgagtgcccaggtagag

SEQ ID NO: 732521 - DNA, 20 bp, mouse
ggaactcaagagaaaccggt

SEQ ID NO: 732522 - DNA, 20 bp, mouse
gaattggaacagggcagagt

SEQ ID NO: 732523 - DNA, 20 bp, mouse
gcctggggagacgacagaat

SEQ ID NO: 732524 - DNA, 20 bp, mouse
gagagaaaccggtgggcaga

SEQ ID NO: 732525 - DNA, 20 bp, mouse
gtgcacagtccatgccccca

SEQ ID NO: 732526 - DNA, 20 bp, mouse
gcagcccggggtcgagtgag

SEQ ID NO: 732527 - DNA, 20 bp, mouse
gtagccttggggccgcccgc

SEQ ID NO: 732528 - DNA, 20 bp, mouse
gcccggcggtcaggcggctc

SEQ ID NO: 732529 - DNA, 20 bp, mouse
gtggggtgaggcccgtcagg

SEQ ID NO: 732530 - DNA, 20 bp, mouse
gcagggggcgcaaagggcag

SEQ ID NO: 732531 - DNA, 20 bp, mouse
gcgggagctgctgccgtctg

SEQ ID NO: 732532 - DNA, 20 bp, mouse
gccaccaggcgcaaatctcc

SEQ ID NO: 732533 - DNA, 20 bp, mouse
ggggccggggtgctaaccgc

SEQ ID NO: 732534 - DNA, 20 bp, mouse
gggcgcaaagggcagcgggc

SEQ ID NO: 732535 - DNA, 20 bp, mouse
ggcagcgcagggggcgcaaa

SEQ ID NO: 732536 - DNA, 20 bp, mouse
gggaaggggcataaaccagg

SEQ ID NO: 732537 - DNA, 20 bp, mouse
ggagggaaggggcataaacc

SEQ ID NO: 732538 - DNA, 20 bp, mouse
gccaaatcccaacaagacag

SEQ ID NO: 732539 - DNA, 20 bp, mouse
gaataaggttgtaatcaaac

SEQ ID NO: 732540 - DNA, 20 bp, mouse
ggtcaactcctctgtcttgt

SEQ ID NO: 732541 - DNA, 20 bp, mouse
gaaggttgtaatcaaacagg

SEQ ID NO: 732542 - DNA, 20 bp, mouse
gccttccctcttcttgtgtg

SEQ ID NO: 732543 - DNA, 20 bp, mouse
gtccacagataaagcagggg

SEQ ID NO: 732544 - DNA, 20 bp, mouse
gtccctcttcttgtgtgtgg

SEQ ID NO: 732545 - DNA, 20 bp, mouse
gcagtcttaaaataacagtg

SEQ ID NO: 732546 - DNA, 20 bp, mouse
gagggtgaaaggtcgtgatt

SEQ ID NO: 732547 - DNA, 20 bp, mouse
gtggtccgattgagggtgaa

SEQ ID NO: 732548 - DNA, 20 bp, mouse
gccctgcgtcatccaatcga

SEQ ID NO: 732549 - DNA, 20 bp, mouse
gtgggaaggcgagtgagctt

SEQ ID NO: 732550 - DNA, 20 bp, mouse
gaatcgacggcgaagactgg

SEQ ID NO: 732551 - DNA, 20 bp, mouse
ggcagccagggtgtgaggtg

SEQ ID NO: 732552 - DNA, 20 bp, mouse
gcccgctattggtccgattg

SEQ ID NO: 732553 - DNA, 20 bp, mouse
gagcggtcggcgcaaagctg

SEQ ID NO: 732554 - DNA, 20 bp, mouse
gacgacctttcaccctcaat

SEQ ID NO: 732555 - DNA, 20 bp, mouse
gacacgatgcctcctgtcat

SEQ ID NO: 732556 - DNA, 20 bp, mouse
ggagaggcgcgtagaggggg

SEQ ID NO: 732557 - DNA, 20 bp, mouse
ggtgcgcgcaggttgcggag

SEQ ID NO: 732558 - DNA, 20 bp, mouse
gttgcggagaggcgcgtaga

SEQ ID NO: 732559 - DNA, 20 bp, mouse
ggcgggagacccaagctcgc

SEQ ID NO: 732560 - DNA, 20 bp, mouse
gctagctgggcgcgagcccg

SEQ ID NO: 732561 - DNA, 20 bp, mouse
gtgcgcgcacccgcgagctt

SEQ ID NO: 732562 - DNA, 20 bp, mouse
gcagctagacgtggcactct

SEQ ID NO: 732563 - DNA, 20 bp, mouse
gctcgcggaagggtgtgaga

SEQ ID NO: 732564 - DNA, 20 bp, mouse
gagggcttgcggtcacgcgc

SEQ ID NO: 732565 - DNA, 20 bp, mouse
gtcgcatgcgcggtggggtg

SEQ ID NO: 732566 - DNA, 20 bp, mouse
gggatcggggagccctcacc

SEQ ID NO: 732567 - DNA, 20 bp, mouse
ggggagccctcacccggcag

SEQ ID NO: 732568 - DNA, 20 bp, mouse
gcgcctcctcaggagctcga

SEQ ID NO: 732569 - DNA, 20 bp, mouse
ggagctcgagggtgctcaga

SEQ ID NO: 732570 - DNA, 20 bp, mouse
ggcgcgctgagtgacgtcac

SEQ ID NO: 732571 - DNA, 20 bp, mouse
gcagagggtccaggggatcg

SEQ ID NO: 732572 - DNA, 20 bp, mouse
gtgggccaaagcccaactgt

SEQ ID NO: 732573 - DNA, 20 bp, mouse
gaccgggtgtcaaagagctg

SEQ ID NO: 732574 - DNA, 20 bp, mouse
ggtcctgcctctgccgggtg

SEQ ID NO: 732575 - DNA, 20 bp, mouse
gctgagtgacgtcaccgggt

SEQ ID NO: 732576 - DNA, 20 bp, mouse
gtggctaggcagttaataag

SEQ ID NO: 732577 - DNA, 20 bp, mouse
ggccgccaggtccagcacct

SEQ ID NO: 732578 - DNA, 20 bp, mouse
ggtactagacggctcttaaa

SEQ ID NO: 732579 - DNA, 20 bp, mouse
gggacagggaggcaattctt

SEQ ID NO: 732580 - DNA, 20 bp, mouse
gacgcagccacagccagcca

SEQ ID NO: 732581 - DNA, 20 bp, mouse
gtctaagtcagcactagtcg

SEQ ID NO: 732582 - DNA, 20 bp, mouse
gcttcaccctggcacttttt

SEQ ID NO: 732583 - DNA, 20 bp, mouse
ggacctggcggcgcaggacc

SEQ ID NO: 732584 - DNA, 20 bp, mouse
gaagagctctccaagccgcc

SEQ ID NO: 732585 - DNA, 20 bp, mouse
gtgacgtcacgggtactaga

SEQ ID NO: 732586 - DNA, 20 bp, mouse
gagcccccagcctccgttct

SEQ ID NO: 732587 - DNA, 20 bp, mouse
gaagccaagaacggaggctg

SEQ ID NO: 732588 - DNA, 20 bp, mouse
gtccactcccccttcagtaa

SEQ ID NO: 732589 - DNA, 20 bp, mouse
ggattctgtgagttgtcaag

SEQ ID NO: 732590 - DNA, 20 bp, mouse
gggccatcgcctgagccaca

SEQ ID NO: 732591 - DNA, 20 bp, mouse
gggctcaggcgatggcccta

SEQ ID NO: 732592 - DNA, 20 bp, mouse
gactatgctggcatctctgg

SEQ ID NO: 732593 - DNA, 20 bp, mouse
gttgtcaagtggaagccata

SEQ ID NO: 732594 - DNA, 20 bp, mouse
gcccttcagtaaagggaaag

SEQ ID NO: 732595 - DNA, 20 bp, mouse
gaggccactgagtactatgc

SEQ ID NO: 732596 - DNA, 20 bp, mouse
gctagcagacgggaaaaaag

SEQ ID NO: 732597 - DNA, 20 bp, mouse
gacagggtcccataagacca

SEQ ID NO: 732598 - DNA, 20 bp, mouse
gcagacgggaaaaaagaggc

SEQ ID NO: 732599 - DNA, 20 bp, mouse
gttagatcgccagcctgcgt

SEQ ID NO: 732600 - DNA, 20 bp, mouse
ggatgcggtgccttgaaaat

SEQ ID NO: 732601 - DNA, 20 bp, mouse
gaaagctaggccatacataa

SEQ ID NO: 732602 - DNA, 20 bp, mouse
ggtgttctgctggccgacgc

SEQ ID NO: 732603 - DNA, 20 bp, mouse
ggaagtggggtcatccggga

SEQ ID NO: 732604 - DNA, 20 bp, mouse
gttatcagtgaggagagctc

SEQ ID NO: 732605 - DNA, 20 bp, mouse
ggtaggggcgagtgtgggcg

SEQ ID NO: 732606 - DNA, 20 bp, mouse
gcactgatggaagatcatag

SEQ ID NO: 732607 - DNA, 20 bp, mouse
gaaagaaacaatgagaaccc

SEQ ID NO: 732608 - DNA, 20 bp, mouse
ggatggaagatcatagaggc

SEQ ID NO: 732609 - DNA, 20 bp, mouse
gttccagagtgtgtgaggac

SEQ ID NO: 732610 - DNA, 20 bp, mouse
ggaactaagaaccatcctgg

SEQ ID NO: 732611 - DNA, 20 bp, mouse
gctggaaaggactggcttgc

SEQ ID NO: 732612 - DNA, 20 bp, mouse
gggttactgctcatgttcag

SEQ ID NO: 732613 - DNA, 20 bp, mouse
ggatcaaattccaactaact

SEQ ID NO: 732614 - DNA, 20 bp, mouse
gtgcccagcagagtgacttg

SEQ ID NO: 732615 - DNA, 20 bp, mouse
gaattggacttgtctatgct

SEQ ID NO: 732616 - DNA, 20 bp, mouse
gccccccgcgggctccgacc

SEQ ID NO: 732617 - DNA, 20 bp, mouse
ggtggcggcgcggtgagccc

SEQ ID NO: 732618 - DNA, 20 bp, mouse
ggctgccaggggctcggagc

SEQ ID NO: 732619 - DNA, 20 bp, mouse
ggcggggcggcgctgtcgtg

SEQ ID NO: 732620 - DNA, 20 bp, mouse
ggggacagccgggctgccag

SEQ ID NO: 732621 - DNA, 20 bp, mouse
ggggacactgagcgggtcag

SEQ ID NO: 732622 - DNA, 20 bp, mouse
gccgctcagtgtccccgtca

SEQ ID NO: 732623 - DNA, 20 bp, mouse
ggggagtgtggcgagaaatg

SEQ ID NO: 732624 - DNA, 20 bp, mouse
gcaggggctcggagccgggt

SEQ ID NO: 732625 - DNA, 20 bp, mouse
gcgctccgggctgccgcagg

SEQ ID NO: 732626 - DNA, 20 bp, mouse
gtagctgggccacacccgaa

SEQ ID NO: 732627 - DNA, 20 bp, mouse
gtccctgcctgggtagggtg

SEQ ID NO: 732628 - DNA, 20 bp, mouse
ggctgcctgcactcctctca

SEQ ID NO: 732629 - DNA, 20 bp, mouse
ggtacccttgagaggagtgc

SEQ ID NO: 732630 - DNA, 20 bp, mouse
ggaaggctctgggcctcaaa

SEQ ID NO: 732631 - DNA, 20 bp, mouse
gaggtgcatgggtcctgtta

SEQ ID NO: 732632 - DNA, 20 bp, mouse
gactgcctggtgtccctgcc

SEQ ID NO: 732633 - DNA, 20 bp, mouse
gataggttgtgctggtggaa

SEQ ID NO: 732634 - DNA, 20 bp, mouse
gcgcctgtctggcccccttc

SEQ ID NO: 732635 - DNA, 20 bp, mouse
gggcagctatagtgtttggg

SEQ ID NO: 732636 - DNA, 20 bp, mouse
gcctactagaccatcccaaa

SEQ ID NO: 732637 - DNA, 20 bp, mouse
gagggaaagcactttacagg

SEQ ID NO: 732638 - DNA, 20 bp, mouse
gcccgccccctcgtcccttt

SEQ ID NO: 732639 - DNA, 20 bp, mouse
gccccctcgtccctttggga

SEQ ID NO: 732640 - DNA, 20 bp, mouse
gtgtttgctggattcggtct

SEQ ID NO: 732641 - DNA, 20 bp, mouse
ggaccatcccaaagggacga

SEQ ID NO: 732642 - DNA, 20 bp, mouse
ggaacctaggccaacttcac

SEQ ID NO: 732643 - DNA, 20 bp, mouse
ggagttgaagccgaggagga

SEQ ID NO: 732644 - DNA, 20 bp, mouse
gccctgcagagttgaagccg

SEQ ID NO: 732645 - DNA, 20 bp, mouse
gctagtaggaaaagtcactc

SEQ ID NO: 732646 - DNA, 20 bp, mouse
gtgagaaacaccggggatga

SEQ ID NO: 732647 - DNA, 20 bp, mouse
gtgggcttacgcacaccgct

SEQ ID NO: 732648 - DNA, 20 bp, mouse
ggtgcctcagcgaccgtctc

SEQ ID NO: 732649 - DNA, 20 bp, mouse
gaaaaaccaaagggcgacgg

SEQ ID NO: 732650 - DNA, 20 bp, mouse
ggcgacagcgccctcatccc

SEQ ID NO: 732651 - DNA, 20 bp, mouse
gtgtcgcaaggagagccgag

SEQ ID NO: 732652 - DNA, 20 bp, mouse
gcgtcccgagacggtcgctg

SEQ ID NO: 732653 - DNA, 20 bp, mouse
gttccaggtccttccgtgtc

SEQ ID NO: 732654 - DNA, 20 bp, mouse
gagtgctgggatcatagtgg

SEQ ID NO: 732655 - DNA, 20 bp, mouse
gaggcttgacattcaaaagt

SEQ ID NO: 732656 - DNA, 20 bp, mouse
gctctcagcacatacaccct

SEQ ID NO: 732657 - DNA, 20 bp, mouse
gtgggcccctgctcaccgtg

SEQ ID NO: 732658 - DNA, 20 bp, mouse
ggcagccgcacggtgagcag

SEQ ID NO: 732659 - DNA, 20 bp, mouse
gactgcctgcgaaatgacgg

SEQ ID NO: 732660 - DNA, 20 bp, mouse
gcgtggatgcgcttggggag

SEQ ID NO: 732661 - DNA, 20 bp, mouse
ggggaggcgtggatgcgctt

SEQ ID NO: 732662 - DNA, 20 bp, mouse
gggaaccgccgtcatttcgc

SEQ ID NO: 732663 - DNA, 20 bp, mouse
ggttctgccggctgcagccg

SEQ ID NO: 732664 - DNA, 20 bp, mouse
gtccaggaagcgtggattcc

SEQ ID NO: 732665 - DNA, 20 bp, mouse
gaggggcccacggctgcagc

SEQ ID NO: 732666 - DNA, 20 bp, mouse
gactcaaaggggtgtgtgag

SEQ ID NO: 732667 - DNA, 20 bp, mouse
gcagtgggcggggactcaaa

SEQ ID NO: 732668 - DNA, 20 bp, mouse
gccgagggagtcttgcgcaa

SEQ ID NO: 732669 - DNA, 20 bp, mouse
gaggggcggatgctcggagt

SEQ ID NO: 732670 - DNA, 20 bp, mouse
gggcgtggggcgggcgggaa

SEQ ID NO: 732671 - DNA, 20 bp, mouse
gtgtgtgaggggcggatgct

SEQ ID NO: 732672 - DNA, 20 bp, mouse
gcccgagcttgccaggccga

SEQ ID NO: 732673 - DNA, 20 bp, mouse
gtatgggcgggctggtgagt

SEQ ID NO: 732674 - DNA, 20 bp, mouse
gacgtcgccaggaatcagtg

SEQ ID NO: 732675 - DNA, 20 bp, mouse
gcggtcgaagcgaccgtctc

SEQ ID NO: 732676 - DNA, 20 bp, mouse
gtaagcgctaaagaactggt

SEQ ID NO: 732677 - DNA, 20 bp, mouse
gtgacctgggagtgcgtgaa

SEQ ID NO: 732678 - DNA, 20 bp, mouse
gccctctcggggtttccttt

SEQ ID NO: 732679 - DNA, 20 bp, mouse
gtgagccttcagtataaaag

SEQ ID NO: 732680 - DNA, 20 bp, mouse
gtgaatggaatccacagatg

SEQ ID NO: 732681 - DNA, 20 bp, mouse
gtatccacgtcattatgacc

SEQ ID NO: 732682 - DNA, 20 bp, mouse
gctgtggggcagttggtcag

SEQ ID NO: 732683 - DNA, 20 bp, mouse
gctcccaggtcataatgacg

SEQ ID NO: 732684 - DNA, 20 bp, mouse
gacagctgttctatgtacag

SEQ ID NO: 732685 - DNA, 20 bp, mouse
gacgttcaacccaggttgag

SEQ ID NO: 732686 - DNA, 20 bp, mouse
ggcaacgaggctccgccttc

SEQ ID NO: 732687 - DNA, 20 bp, mouse
gggaggttcccaagctccgt

SEQ ID NO: 732688 - DNA, 20 bp, mouse
gagggcaagaacaacctaaa

SEQ ID NO: 732689 - DNA, 20 bp, mouse
gggagcttgggaacctccgc

SEQ ID NO: 732690 - DNA, 20 bp, mouse
gccctcagcccacggagctt

SEQ ID NO: 732691 - DNA, 20 bp, mouse
gctgcctgctgaggttcctg

SEQ ID NO: 732692 - DNA, 20 bp, mouse
gcacgcttgtgctttgctcc

SEQ ID NO: 732693 - DNA, 20 bp, mouse
gttctggggcatttgtctca

SEQ ID NO: 732694 - DNA, 20 bp, mouse
ggcgaagtctagctagttct

SEQ ID NO: 732695 - DNA, 20 bp, mouse
gtagacttcgctgcctgctg

SEQ ID NO: 732696 - DNA, 20 bp, mouse
gcggccaggccactcccctc

SEQ ID NO: 732697 - DNA, 20 bp, mouse
gccgcacggggccatgtcct

SEQ ID NO: 732698 - DNA, 20 bp, mouse
gctacgtgacccacccacca

SEQ ID NO: 732699 - DNA, 20 bp, mouse
gctgaggaccggagcctcga

SEQ ID NO: 732700 - DNA, 20 bp, mouse
ggaggctccggtcctcagtg

SEQ ID NO: 732701 - DNA, 20 bp, mouse
gtccgcccgcagccccactg

SEQ ID NO: 732702 - DNA, 20 bp, mouse
gagaagcgcggattggggga

SEQ ID NO: 732703 - DNA, 20 bp, mouse
ggaaacagaagcgcggattg

SEQ ID NO: 732704 - DNA, 20 bp, mouse
gacgctcggcgcccaggaca

SEQ ID NO: 732705 - DNA, 20 bp, mouse
gcggaggcggggcgtcccca

SEQ ID NO: 732706 - DNA, 20 bp, mouse
gcaccgccttgcttggagga

SEQ ID NO: 732707 - DNA, 20 bp, mouse
gtgccctcctccaagcaagg

SEQ ID NO: 732708 - DNA, 20 bp, mouse
ggcttggaggagggcacgga

SEQ ID NO: 732709 - DNA, 20 bp, mouse
gacgagccggctgcctagca

SEQ ID NO: 732710 - DNA, 20 bp, mouse
gaagttgaaaagtgaagggg

SEQ ID NO: 732711 - DNA, 20 bp, mouse
gctcacaccgccttgcttgg

SEQ ID NO: 732712 - DNA, 20 bp, mouse
gtgtctgtcccagcccgtgg

SEQ ID NO: 732713 - DNA, 20 bp, mouse
ggaggggccggtgaggtcat

SEQ ID NO: 732714 - DNA, 20 bp, mouse
gcggctcgtctgaatggaaa

SEQ ID NO: 732715 - DNA, 20 bp, mouse
gacaaggctcaagagctcta

SEQ ID NO: 732716 - DNA, 20 bp, mouse
ggtgtggacgccagggacaa

SEQ ID NO: 732717 - DNA, 20 bp, mouse
gtggctcactagggaacctg

SEQ ID NO: 732718 - DNA, 20 bp, mouse
gaggaagtgtccagaggagg

SEQ ID NO: 732719 - DNA, 20 bp, mouse
gcccgtctggaacttagagg

SEQ ID NO: 732720 - DNA, 20 bp, mouse
gtctaagttccagacgggac

SEQ ID NO: 732721 - DNA, 20 bp, mouse
gctgaagtccctgggaggac

SEQ ID NO: 732722 - DNA, 20 bp, mouse
gtgtcctaggaatcctactc

SEQ ID NO: 732723 - DNA, 20 bp, mouse
gggccttcaggagaggtcta

SEQ ID NO: 732724 - DNA, 20 bp, mouse
gtgaggctgtgtggacgcca

SEQ ID NO: 732725 - DNA, 20 bp, mouse
gccctcctctaagttccaga

SEQ ID NO: 732726 - DNA, 20 bp, mouse
ggatagggagctgacatgat

SEQ ID NO: 732727 - DNA, 20 bp, mouse
gtccctatctgcgggtgatg

SEQ ID NO: 732728 - DNA, 20 bp, mouse
gacctcatcacccgcagata

SEQ ID NO: 732729 - DNA, 20 bp, mouse
gatgtcagctccctatctgc

SEQ ID NO: 732730 - DNA, 20 bp, mouse
ggggaatatgggggacattt

SEQ ID NO: 732731 - DNA, 20 bp, mouse
gcccccatattcccaacatg

SEQ ID NO: 732732 - DNA, 20 bp, mouse
gcaaagctggggcttcctta

SEQ ID NO: 732733 - DNA, 20 bp, mouse
gtggcgagaaatggaagttc

SEQ ID NO: 732734 - DNA, 20 bp, mouse
gaagctattgaaaatgactg

SEQ ID NO: 732735 - DNA, 20 bp, mouse
ggaagccccagctttggaga

SEQ ID NO: 732736 - DNA, 20 bp, mouse
ggacaagagtggctactcgc

SEQ ID NO: 732737 - DNA, 20 bp, mouse
ggggcagcgtgttagggcta

SEQ ID NO: 732738 - DNA, 20 bp, mouse
gacctgtcccgggacaagag

SEQ ID NO: 732739 - DNA, 20 bp, mouse
gggcactgggcagcgtgtta

SEQ ID NO: 732740 - DNA, 20 bp, mouse
gtccacgatggagagacgag

SEQ ID NO: 732741 - DNA, 20 bp, mouse
ggccactcttgtcccgggac

SEQ ID NO: 732742 - DNA, 20 bp, mouse
gggagcctaagaggcagcaa

SEQ ID NO: 732743 - DNA, 20 bp, mouse
gttagggctagggggtagtg

SEQ ID NO: 732744 - DNA, 20 bp, mouse
gcgaaagcgccaccagcctt

SEQ ID NO: 732745 - DNA, 20 bp, mouse
ggtcccgaatctcctcaaac

SEQ ID NO: 732746 - DNA, 20 bp, mouse
gagtgcatctatcatacaga

SEQ ID NO: 732747 - DNA, 20 bp, mouse
gttaagaggaaatgacttcg

SEQ ID NO: 732748 - DNA, 20 bp, mouse
ggatgcactcagggaggcaa

SEQ ID NO: 732749 - DNA, 20 bp, mouse
ggacttcggggtgtggaaaa

SEQ ID NO: 732750 - DNA, 20 bp, mouse
gaggaaatgacttcggggtg

SEQ ID NO: 732751 - DNA, 20 bp, mouse
gatgatagatgcactcaggg

SEQ ID NO: 732752 - DNA, 20 bp, mouse
gtgtatgatagatgcactca

SEQ ID NO: 732753 - DNA, 20 bp, mouse
gtgccgcctctattcacctt

SEQ ID NO: 732754 - DNA, 20 bp, mouse
ggtcgaaatcccaggttaag

SEQ ID NO: 732755 - DNA, 20 bp, mouse
gtctgtttacatcatgccta

SEQ ID NO: 732756 - DNA, 20 bp, mouse
gtgcactacaaacccacctt

SEQ ID NO: 732757 - DNA, 20 bp, mouse
gcagaggggcccccaccttt

SEQ ID NO: 732758 - DNA, 20 bp, mouse
gaaccctccaagagatttct

SEQ ID NO: 732759 - DNA, 20 bp, mouse
gaggaagtcagcccaaaggt

SEQ ID NO: 732760 - DNA, 20 bp, mouse
gccccagtccccgttggatc

SEQ ID NO: 732761 - DNA, 20 bp, mouse
gagcctagaaatctcttgga

SEQ ID NO: 732762 - DNA, 20 bp, mouse
ggtccccgttggatcaggag

SEQ ID NO: 732763 - DNA, 20 bp, mouse
gacacctctcctgatccaac

SEQ ID NO: 732764 - DNA, 20 bp, mouse
gggcttactcaccccaaggt

SEQ ID NO: 732765 - DNA, 20 bp, mouse
gctccatccccagtccccgt

SEQ ID NO: 732766 - DNA, 20 bp, mouse
gggaacttgcccagtgcagg

SEQ ID NO: 732767 - DNA, 20 bp, mouse
ggcacccagcgtgcttagtg

SEQ ID NO: 732768 - DNA, 20 bp, mouse
gcaactggggtcacacgcct

SEQ ID NO: 732769 - DNA, 20 bp, mouse
ggccactagccgcagaggga

SEQ ID NO: 732770 - DNA, 20 bp, mouse
gtggcacacgcctcctgcac

SEQ ID NO: 732771 - DNA, 20 bp, mouse
gtggtggcatggggagccgg

SEQ ID NO: 732772 - DNA, 20 bp, mouse
ggtgcggttctgagaaaaaa

SEQ ID NO: 732773 - DNA, 20 bp, mouse
ggggagccgggggacaatgc

SEQ ID NO: 732774 - DNA, 20 bp, mouse
gcgcccgccactagccgcag

SEQ ID NO: 732775 - DNA, 20 bp, mouse
ggcagaagggacttccccga

SEQ ID NO: 732776 - DNA, 20 bp, mouse
gtcagcgggtggaattactg

SEQ ID NO: 732777 - DNA, 20 bp, mouse
gttagtggatttattgagaa

SEQ ID NO: 732778 - DNA, 20 bp, mouse
gttgagaagggtctgggaca

SEQ ID NO: 732779 - DNA, 20 bp, mouse
gtgatcaaggggtcagcatt

SEQ ID NO: 732780 - DNA, 20 bp, mouse
gaggagcttggggcggtcag

SEQ ID NO: 732781 - DNA, 20 bp, mouse
gctggctgctcaggagcttg

SEQ ID NO: 732782 - DNA, 20 bp, mouse
ggcgggtggaattactgggg

SEQ ID NO: 732783 - DNA, 20 bp, mouse
gcctcccactcgtgcagctg

SEQ ID NO: 732784 - DNA, 20 bp, mouse
gggacagggtttccaggttc

SEQ ID NO: 732785 - DNA, 20 bp, mouse
ggggtggtttatttccacgg

SEQ ID NO: 732786 - DNA, 20 bp, mouse
ggaggccaggtgtcactcgg

SEQ ID NO: 732787 - DNA, 20 bp, mouse
gcgagcgcgcgggggcgtct

SEQ ID NO: 732788 - DNA, 20 bp, mouse
gactcccaccgagtgacacc

SEQ ID NO: 732789 - DNA, 20 bp, mouse
gtgacaggtggtggcgcgga

SEQ ID NO: 732790 - DNA, 20 bp, mouse
gcagtggaagggattgggcg

SEQ ID NO: 732791 - DNA, 20 bp, mouse
gaggtagctgtgacaggtgg

SEQ ID NO: 732792 - DNA, 20 bp, mouse
gcactagggcagggtcatgt

SEQ ID NO: 732793 - DNA, 20 bp, mouse
ggtgagaagaggccagtctt

SEQ ID NO: 732794 - DNA, 20 bp, mouse
gactcccaggtagctgtgac

SEQ ID NO: 732795 - DNA, 20 bp, mouse
ggaagtgggagcaagaacag

SEQ ID NO: 732796 - DNA, 20 bp, mouse
gcatcgtgaaacaacttcaa

SEQ ID NO: 732797 - DNA, 20 bp, mouse
gaacttcaaaggcaaagaac

SEQ ID NO: 732798 - DNA, 20 bp, mouse
gtgaaagcatctgaggagtg

SEQ ID NO: 732799 - DNA, 20 bp, mouse
gtgtttgtagtgagtattga

SEQ ID NO: 732800 - DNA, 20 bp, mouse
gaagcatctgaggagtgtgg

SEQ ID NO: 732801 - DNA, 20 bp, mouse
gagtggctgaataatttcca

SEQ ID NO: 732802 - DNA, 20 bp, mouse
gacagtatgtggctgataat

SEQ ID NO: 732803 - DNA, 20 bp, mouse
gtttcacgatgtgaatgttt

SEQ ID NO: 732804 - DNA, 20 bp, mouse
gcagtacttctaacagtatg

SEQ ID NO: 732805 - DNA, 20 bp, mouse
gcttccagcacaagaaatga

SEQ ID NO: 732806 - DNA, 20 bp, mouse
gagactctgcagcaggtcaa

SEQ ID NO: 732807 - DNA, 20 bp, mouse
gaggctgtggccaactgccc

SEQ ID NO: 732808 - DNA, 20 bp, mouse
gggaaacggaaaaggacctt

SEQ ID NO: 732809 - DNA, 20 bp, mouse
gctgctgcagagtctggaag

SEQ ID NO: 732810 - DNA, 20 bp, mouse
gtggaaaaatgacccaagag

SEQ ID NO: 732811 - DNA, 20 bp, mouse
gagactgtaccgggaggaaa

SEQ ID NO: 732812 - DNA, 20 bp, mouse
gccaagaggggtcaatttag

SEQ ID NO: 732813 - DNA, 20 bp, mouse
gccagggcgcagaacctgaa

SEQ ID NO: 732814 - DNA, 20 bp, mouse
gggacagagactgtaccggg

SEQ ID NO: 732815 - DNA, 20 bp, mouse
gccagacagtccgagagccc

SEQ ID NO: 732816 - DNA, 20 bp, mouse
ggaaaggtacagccggaaga

SEQ ID NO: 732817 - DNA, 20 bp, mouse
gccactgccagcaccactgc

SEQ ID NO: 732818 - DNA, 20 bp, mouse
gaagctcagggctacttaga

SEQ ID NO: 732819 - DNA, 20 bp, mouse
ggcagccaacgggaagttct

SEQ ID NO: 732820 - DNA, 20 bp, mouse
gagcacggacagtcaagctc

SEQ ID NO: 732821 - DNA, 20 bp, mouse
ggccaacgggaagttctggg

SEQ ID NO: 732822 - DNA, 20 bp, mouse
gcaaggctgaagtcaggtgt

SEQ ID NO: 732823 - DNA, 20 bp, mouse
gtccgcccagaacttcccgt

SEQ ID NO: 732824 - DNA, 20 bp, mouse
gtgccagcaccactgcaggc

SEQ ID NO: 732825 - DNA, 20 bp, mouse
gtgtccttgggcgactgcat

SEQ ID NO: 732826 - DNA, 20 bp, mouse
gaccccaaacagggacggta

SEQ ID NO: 732827 - DNA, 20 bp, mouse
gtttggggtaaggctttcat

SEQ ID NO: 732828 - DNA, 20 bp, mouse
gttcatggggagatgtcaga

SEQ ID NO: 732829 - DNA, 20 bp, mouse
gtgagctggcatgtgactca

SEQ ID NO: 732830 - DNA, 20 bp, mouse
ggctgccacctgctctggac

SEQ ID NO: 732831 - DNA, 20 bp, mouse
gtggctaagtgagtccaacc

SEQ ID NO: 732832 - DNA, 20 bp, mouse
ggaaagccttaccccaaaca

SEQ ID NO: 732833 - DNA, 20 bp, mouse
gtggaaagggcatgcccaga

SEQ ID NO: 732834 - DNA, 20 bp, mouse
gtctcactgtgttttggaaa

SEQ ID NO: 732835 - DNA, 20 bp, mouse
gtggctacctgtgaatgccc

SEQ ID NO: 732836 - DNA, 20 bp, mouse
gcaaagaagcatgacttctt

SEQ ID NO: 732837 - DNA, 20 bp, mouse
gtctcgaaggtagatgggaa

SEQ ID NO: 732838 - DNA, 20 bp, mouse
gtacgtcaagagtgggttgg

SEQ ID NO: 732839 - DNA, 20 bp, mouse
ggttgcccgtcataaagggg

SEQ ID NO: 732840 - DNA, 20 bp, mouse
gcgggcaacatctgtctcga

SEQ ID NO: 732841 - DNA, 20 bp, mouse
gcagaaccacccctttatga

SEQ ID NO: 732842 - DNA, 20 bp, mouse
gcatctgtctcgaaggtaga

SEQ ID NO: 732843 - DNA, 20 bp, mouse
gtggtcacttacgtcaagag

SEQ ID NO: 732844 - DNA, 20 bp, mouse
ggagctgggctccatagtaa

SEQ ID NO: 732845 - DNA, 20 bp, mouse
gcagatgttgcccgtcataa

SEQ ID NO: 732846 - DNA, 20 bp, mouse
gagccaggctgaggtgccca

SEQ ID NO: 732847 - DNA, 20 bp, mouse
gcccaggggctgttgaccaa

SEQ ID NO: 732848 - DNA, 20 bp, mouse
ggcacagtggcaggcggtga

SEQ ID NO: 732849 - DNA, 20 bp, mouse
gcacacagggcattgtcctt

SEQ ID NO: 732850 - DNA, 20 bp, mouse
gaccgcctgccactgtgcta

SEQ ID NO: 732851 - DNA, 20 bp, mouse
gtgtgccttagcacagtggc

SEQ ID NO: 732852 - DNA, 20 bp, mouse
gtgtgtgtctggtggggccc

SEQ ID NO: 732853 - DNA, 20 bp, mouse
gcaggcggtgaggggtgtgt

SEQ ID NO: 732854 - DNA, 20 bp, mouse
gctaaggcacagccagctgg

SEQ ID NO: 732855 - DNA, 20 bp, mouse
gactgtcagctgggagtctt

SEQ ID NO: 732856 - DNA, 20 bp, mouse
gacgacgggcggggtaggtg

SEQ ID NO: 732857 - DNA, 20 bp, mouse
gcccgtcgtcacagatactt

SEQ ID NO: 732858 - DNA, 20 bp, mouse
gctgtgacgacgggcggggt

SEQ ID NO: 732859 - DNA, 20 bp, mouse
gatacttcggagcccctgca

SEQ ID NO: 732860 - DNA, 20 bp, mouse
gaacagcccgggccctgccc

SEQ ID NO: 732861 - DNA, 20 bp, mouse
gctctcctgggcattccact

SEQ ID NO: 732862 - DNA, 20 bp, mouse
gcagggcccgggctgttctc

SEQ ID NO: 732863 - DNA, 20 bp, mouse
ggtatctgtgacgacgggcg

SEQ ID NO: 732864 - DNA, 20 bp, mouse
ggataactctgtgatgcaaa

SEQ ID NO: 732865 - DNA, 20 bp, mouse
gtccactgggtcggatcttt

SEQ ID NO: 732866 - DNA, 20 bp, mouse
ggcagtcgagaggccgactt

SEQ ID NO: 732867 - DNA, 20 bp, mouse
ggcctcgccggtacccccga

SEQ ID NO: 732868 - DNA, 20 bp, mouse
ggccccactggtccgtgccg

SEQ ID NO: 732869 - DNA, 20 bp, mouse
gaaggagagtccttctaggt

SEQ ID NO: 732870 - DNA, 20 bp, mouse
gacgcctcggcacggaccag

SEQ ID NO: 732871 - DNA, 20 bp, mouse
gcacggaccagtggggcctc

SEQ ID NO: 732872 - DNA, 20 bp, mouse
gagaggaagtggtcgcaaga

SEQ ID NO: 732873 - DNA, 20 bp, mouse
gccgccagtccacttctgta

SEQ ID NO: 732874 - DNA, 20 bp, mouse
gcggcccttagctgaataag

SEQ ID NO: 732875 - DNA, 20 bp, mouse
gtggcctcgacgcctcggca

SEQ ID NO: 732876 - DNA, 20 bp, mouse
gtgggtgggcttagaagaga

SEQ ID NO: 732877 - DNA, 20 bp, mouse
gaatcaaagggggaccctaa

SEQ ID NO: 732878 - DNA, 20 bp, mouse
gtcctgaaggggaatcaaag

SEQ ID NO: 732879 - DNA, 20 bp, mouse
gaggtaatgggagtggaagt

SEQ ID NO: 732880 - DNA, 20 bp, mouse
gtaaggaggtcagtggaaac

SEQ ID NO: 732881 - DNA, 20 bp, mouse
gtatctgtagtaaaggtaat

SEQ ID NO: 732882 - DNA, 20 bp, mouse
gatgacttacccccattcac

SEQ ID NO: 732883 - DNA, 20 bp, mouse
gcagtagaatccagtgaatg

SEQ ID NO: 732884 - DNA, 20 bp, mouse
gatgacagtaatctgtgact

SEQ ID NO: 732885 - DNA, 20 bp, mouse
gacatccccggggtcttttg

SEQ ID NO: 732886 - DNA, 20 bp, mouse
ggggctcggctccttaaaac

SEQ ID NO: 732887 - DNA, 20 bp, mouse
gcgacagcgagggcccgcga

SEQ ID NO: 732888 - DNA, 20 bp, mouse
gagcccaggaacccgtttta

SEQ ID NO: 732889 - DNA, 20 bp, mouse
gcccgcctccgccttggccc

SEQ ID NO: 732890 - DNA, 20 bp, mouse
gcatccaaggagagccaaag

SEQ ID NO: 732891 - DNA, 20 bp, mouse
ggtaaaccgggagggtacga

SEQ ID NO: 732892 - DNA, 20 bp, mouse
gccccgctgtcaacttgctg

SEQ ID NO: 732893 - DNA, 20 bp, mouse
gcaggagcacacctgggcca

SEQ ID NO: 732894 - DNA, 20 bp, mouse
gccgagcggcccgccctcgg

SEQ ID NO: 732895 - DNA, 20 bp, mouse
gctccttaaaacgggttcct

SEQ ID NO: 732896 - DNA, 20 bp, mouse
gctacccccgcgagccccga

SEQ ID NO: 732897 - DNA, 20 bp, mouse
gggggctcgcgggggtaggc

SEQ ID NO: 732898 - DNA, 20 bp, mouse
ggccctgcccaagccggcgc

SEQ ID NO: 732899 - DNA, 20 bp, mouse
gggcggggtgcgaatgactc

SEQ ID NO: 732900 - DNA, 20 bp, mouse
gtggtcccaagacagtaaag

SEQ ID NO: 732901 - DNA, 20 bp, mouse
gggccgccttgtcgccctcg

SEQ ID NO: 732902 - DNA, 20 bp, mouse
gcacctgggccaggacgcga

SEQ ID NO: 732903 - DNA, 20 bp, mouse
gagcagcgggcgaggatcag

SEQ ID NO: 732904 - DNA, 20 bp, mouse
ggtcgccctcggggctcgcg

SEQ ID NO: 732905 - DNA, 20 bp, mouse
gcgaatgactcaggcccggg

SEQ ID NO: 732906 - DNA, 20 bp, mouse
ggtaccagccaaggaggagg

SEQ ID NO: 732907 - DNA, 20 bp, mouse
gaggggacccagtggacctt

SEQ ID NO: 732908 - DNA, 20 bp, mouse
gaagcctggagttggtggga

SEQ ID NO: 732909 - DNA, 20 bp, mouse
gtggactcactactgtgtaa

SEQ ID NO: 732910 - DNA, 20 bp, mouse
gagccaggtaccagccaagg

SEQ ID NO: 732911 - DNA, 20 bp, mouse
gtggctggtacctggctggg

SEQ ID NO: 732912 - DNA, 20 bp, mouse
gtgtaaaggaactcctaccc

SEQ ID NO: 732913 - DNA, 20 bp, mouse
gccagctgtgctgccttccc

SEQ ID NO: 732914 - DNA, 20 bp, mouse
ggcccgggagaccccttact

SEQ ID NO: 732915 - DNA, 20 bp, mouse
gctgcctggcccaggttcag

SEQ ID NO: 732916 - DNA, 20 bp, mouse
ggggccaagaccgaagggcc

SEQ ID NO: 732917 - DNA, 20 bp, mouse
ggggcggggccaagaccgaa

SEQ ID NO: 732918 - DNA, 20 bp, mouse
gtagcccggcccttcggtct

SEQ ID NO: 732919 - DNA, 20 bp, mouse
gtggccccgccccaatgcac

SEQ ID NO: 732920 - DNA, 20 bp, mouse
gtctcctgtgcattggggcg

SEQ ID NO: 732921 - DNA, 20 bp, mouse
gctgctgtgtcaatctccgg

SEQ ID NO: 732922 - DNA, 20 bp, mouse
ggacggaaagctgagattga

SEQ ID NO: 732923 - DNA, 20 bp, mouse
gctcctgctgtgtcaatctc

SEQ ID NO: 732924 - DNA, 20 bp, mouse
ggaggctggcagccctcacc

SEQ ID NO: 732925 - DNA, 20 bp, mouse
gctaccgccgccgcccactc

SEQ ID NO: 732926 - DNA, 20 bp, mouse
gtcggggcagggtggatcta

SEQ ID NO: 732927 - DNA, 20 bp, mouse
gtcacaggaggctcttggtg

SEQ ID NO: 732928 - DNA, 20 bp, mouse
gagtgccctggctcaggaga

SEQ ID NO: 732929 - DNA, 20 bp, mouse
ggcaggaggggttaagaaat

SEQ ID NO: 732930 - DNA, 20 bp, mouse
gtgcatgtggggtacgcagg

SEQ ID NO: 732931 - DNA, 20 bp, mouse
ggcagggtggatctagggca

SEQ ID NO: 732932 - DNA, 20 bp, mouse
ggacctgcaccttgttgtgg

SEQ ID NO: 732933 - DNA, 20 bp, mouse
gttggtgtggcacagttaac

SEQ ID NO: 732934 - DNA, 20 bp, mouse
gctgctggttaggatcaagg

SEQ ID NO: 732935 - DNA, 20 bp, mouse
gacagctggaaagggctagt

SEQ ID NO: 732936 - DNA, 20 bp, mouse
gttggtgtactcatcgttgt

SEQ ID NO: 732937 - DNA, 20 bp, mouse
gcaggacaaatcagatctct

SEQ ID NO: 732938 - DNA, 20 bp, mouse
gtcagctaatgtgacgcact

SEQ ID NO: 732939 - DNA, 20 bp, mouse
gtaatgtgacgcactggggc

SEQ ID NO: 732940 - DNA, 20 bp, mouse
gacacaggacagcaagataa

SEQ ID NO: 732941 - DNA, 20 bp, mouse
gctaggtgctaggagtgggg

SEQ ID NO: 732942 - DNA, 20 bp, mouse
gacattagctgactgaacac

SEQ ID NO: 732943 - DNA, 20 bp, mouse
ggatgagtacaccaatcctg

SEQ ID NO: 732944 - DNA, 20 bp, mouse
gttgtcctggatgcctcaaa

SEQ ID NO: 732945 - DNA, 20 bp, mouse
gtgcaggcagcacaccacag

SEQ ID NO: 732946 - DNA, 20 bp, mouse
gggtagaactggtgacaagt

SEQ ID NO: 732947 - DNA, 20 bp, mouse
ggctccagtagctcagagac

SEQ ID NO: 732948 - DNA, 20 bp, mouse
gcatgtgccagaacctcttg

SEQ ID NO: 732949 - DNA, 20 bp, mouse
gtgaccccaaatagccagga

SEQ ID NO: 732950 - DNA, 20 bp, mouse
gtgcagggagcatggcttca

SEQ ID NO: 732951 - DNA, 20 bp, mouse
gagaggttctggcacatgca

SEQ ID NO: 732952 - DNA, 20 bp, mouse
gaacctaggtggtagagggt

SEQ ID NO: 732953 - DNA, 20 bp, mouse
gtgggatggagcaggttgga

SEQ ID NO: 732954 - DNA, 20 bp, mouse
gcgaccaatgcgcacacttg

SEQ ID NO: 732955 - DNA, 20 bp, mouse
gggaatgagaaatcccccaa

SEQ ID NO: 732956 - DNA, 20 bp, mouse
ggaggctgggcatcctgcgc

SEQ ID NO: 732957 - DNA, 20 bp, mouse
gtccacccatccaggaggct

SEQ ID NO: 732958 - DNA, 20 bp, mouse
ggcgctggctggcactatgt

SEQ ID NO: 732959 - DNA, 20 bp, mouse
gtccgggaagccaaaggcgg

SEQ ID NO: 732960 - DNA, 20 bp, mouse
gggcacacaggtggttcttg

SEQ ID NO: 732961 - DNA, 20 bp, mouse
gtcagcgccctctgcctgaa

SEQ ID NO: 732962 - DNA, 20 bp, mouse
ggggtgtcggggttagttct

SEQ ID NO: 732963 - DNA, 20 bp, mouse
gtgtgcgcgccacacccttc

SEQ ID NO: 732964 - DNA, 20 bp, mouse
gccaggcaggagaactccag

SEQ ID NO: 732965 - DNA, 20 bp, mouse
gcagagggcgctgagaaccc

SEQ ID NO: 732966 - DNA, 20 bp, mouse
gcaagaaaggggttgtggtt

SEQ ID NO: 732967 - DNA, 20 bp, mouse
gcaaggtaagtgttgacctg

SEQ ID NO: 732968 - DNA, 20 bp, mouse
gcggggcacagcaaaccatg

SEQ ID NO: 732969 - DNA, 20 bp, mouse
gaggctatgcttgtgcaccg

SEQ ID NO: 732970 - DNA, 20 bp, mouse
gcgacacggtttctcaacag

SEQ ID NO: 732971 - DNA, 20 bp, mouse
ggtagctttgaaaggctcgg

SEQ ID NO: 732972 - DNA, 20 bp, mouse
gcagcctccttgacaagaaa

SEQ ID NO: 732973 - DNA, 20 bp, mouse
gcgtgtcgaatgttaacatt

SEQ ID NO: 732974 - DNA, 20 bp, mouse
gtgtgctgaaacaatcccca

SEQ ID NO: 732975 - DNA, 20 bp, mouse
gtgctctgtaaaagtgatgc

SEQ ID NO: 732976 - DNA, 20 bp, mouse
gtaactgtgcagaggttttt

SEQ ID NO: 732977 - DNA, 20 bp, mouse
gggcaagggaagttggtagg

SEQ ID NO: 732978 - DNA, 20 bp, mouse
ggcctcctgctgtatctgaa

SEQ ID NO: 732979 - DNA, 20 bp, mouse
gctgaatggcccaagatgac

SEQ ID NO: 732980 - DNA, 20 bp, mouse
gccccactggcaagggaagt

SEQ ID NO: 732981 - DNA, 20 bp, mouse
gcacaaggaggtgggtatag

SEQ ID NO: 732982 - DNA, 20 bp, mouse
gtgggccattcagatacagc

SEQ ID NO: 732983 - DNA, 20 bp, mouse
ggagggaactaagaattagg

SEQ ID NO: 732984 - DNA, 20 bp, mouse
gtaaaagagtccggtcatct

SEQ ID NO: 732985 - DNA, 20 bp, mouse
ggtaggtgtcacccgaaaca

SEQ ID NO: 732986 - DNA, 20 bp, mouse
gctgtcaaggtttgctgggt

SEQ ID NO: 732987 - DNA, 20 bp, mouse
gcagttgtttaacaaagcgg

SEQ ID NO: 732988 - DNA, 20 bp, mouse
gggggaggggaatctcctga

SEQ ID NO: 732989 - DNA, 20 bp, mouse
ggaggggaatctcctgaagg

SEQ ID NO: 732990 - DNA, 20 bp, mouse
ggcagctcacttttatgtgg

SEQ ID NO: 732991 - DNA, 20 bp, mouse
gaagcaatgtgtcaaaactc

SEQ ID NO: 732992 - DNA, 20 bp, mouse
ggaaatactaaagaaatggg

SEQ ID NO: 732993 - DNA, 20 bp, mouse
ggctgggtgggtccaccttc

SEQ ID NO: 732994 - DNA, 20 bp, mouse
gatgcctcacacaactctgg

SEQ ID NO: 732995 - DNA, 20 bp, mouse
gggtaccaaccgtaccctgc

SEQ ID NO: 732996 - DNA, 20 bp, mouse
gtgtccttctggccggtatc

SEQ ID NO: 732997 - DNA, 20 bp, mouse
gctgcctgataccggccaga

SEQ ID NO: 732998 - DNA, 20 bp, mouse
ggttgcttgcaaagattcca

SEQ ID NO: 732999 - DNA, 20 bp, mouse
gtgatcaagtcaacggcccg

SEQ ID NO: 733000 - DNA, 20 bp, mouse
gggccactcctacctgcttg

SEQ ID NO: 733001 - DNA, 20 bp, mouse
gcttgaggaagactataaaa

SEQ ID NO: 733002 - DNA, 20 bp, mouse
ggcccaccagtggaagagga

SEQ ID NO: 733003 - DNA, 20 bp, mouse
gccccaggactgaatatgga

SEQ ID NO: 733004 - DNA, 20 bp, mouse
gtggagctccagtccttgtt

SEQ ID NO: 733005 - DNA, 20 bp, mouse
gtgtgccccaggactgaata

SEQ ID NO: 733006 - DNA, 20 bp, mouse
gtctaatccctggaagtcaa

SEQ ID NO: 733007 - DNA, 20 bp, mouse
gtgccaccccttgacttcca

SEQ ID NO: 733008 - DNA, 20 bp, mouse
gaagcttgatgggaattctt

SEQ ID NO: 733009 - DNA, 20 bp, mouse
gatccctggaagtcaagggg

SEQ ID NO: 733010 - DNA, 20 bp, mouse
gcatctgcacaattgtccag

SEQ ID NO: 733011 - DNA, 20 bp, mouse
gagctgtgaaattttccctt

SEQ ID NO: 733012 - DNA, 20 bp, mouse
gcccctgctaacacagttga

SEQ ID NO: 733013 - DNA, 20 bp, mouse
ggtgtcatcgtggtggaaat

SEQ ID NO: 733014 - DNA, 20 bp, mouse
gggaggggggagaagcttga

SEQ ID NO: 733015 - DNA, 20 bp, mouse
gcaacaaaactgaagggtgg

SEQ ID NO: 733016 - DNA, 20 bp, mouse
gagagctggggagacctttg

SEQ ID NO: 733017 - DNA, 20 bp, mouse
gaggggtacggaacagcttg

SEQ ID NO: 733018 - DNA, 20 bp, mouse
ggtacggaacagcttgtggc

SEQ ID NO: 733019 - DNA, 20 bp, mouse
gtgcctgcagctgggagagc

SEQ ID NO: 733020 - DNA, 20 bp, mouse
gaaaaccctatctaaagacc

SEQ ID NO: 733021 - DNA, 20 bp, mouse
gtctgtaatacttaggggta

SEQ ID NO: 733022 - DNA, 20 bp, mouse
gtattcctggtctttagata

SEQ ID NO: 733023 - DNA, 20 bp, mouse
gtggattctgtaatacttag

SEQ ID NO: 733024 - DNA, 20 bp, mouse
gtccatcttttccttattcc

SEQ ID NO: 733025 - DNA, 20 bp, mouse
ggaacccagtccctcaacag

SEQ ID NO: 733026 - DNA, 20 bp, mouse
gtccaacagctccacaggtc

SEQ ID NO: 733027 - DNA, 20 bp, mouse
gtcaccttatctctcaatga

SEQ ID NO: 733028 - DNA, 20 bp, mouse
gagaagaactaaggctgctc

SEQ ID NO: 733029 - DNA, 20 bp, mouse
gtggaggtggagatttgctt

SEQ ID NO: 733030 - DNA, 20 bp, mouse
gccacctccaacagctccac

SEQ ID NO: 733031 - DNA, 20 bp, mouse
gaggctcctccctggatcat

SEQ ID NO: 733032 - DNA, 20 bp, mouse
ggaaatacaccaatgatcca

SEQ ID NO: 733033 - DNA, 20 bp, mouse
ggcagatgctcttggaagtt

SEQ ID NO: 733034 - DNA, 20 bp, mouse
gcctgcctttgccagacctg

SEQ ID NO: 733035 - DNA, 20 bp, mouse
gcttccttcattgagagata

SEQ ID NO: 733036 - DNA, 20 bp, mouse
gaggaaacattggaaaggga

SEQ ID NO: 733037 - DNA, 20 bp, mouse
gagagcagtaatcaggaaat

SEQ ID NO: 733038 - DNA, 20 bp, mouse
gggagaagcaacgtgaatat

SEQ ID NO: 733039 - DNA, 20 bp, mouse
gggacaccctagataattgc

SEQ ID NO: 733040 - DNA, 20 bp, mouse
gtggaggaaagaaacttcat

SEQ ID NO: 733041 - DNA, 20 bp, mouse
gtagtccagtcatccatcct

SEQ ID NO: 733042 - DNA, 20 bp, mouse
gtagggtgtccagcagtcct

SEQ ID NO: 733043 - DNA, 20 bp, mouse
ggacttaggaaacattggaa

SEQ ID NO: 733044 - DNA, 20 bp, mouse
gtcagtgcacctaggactgc

SEQ ID NO: 733045 - DNA, 20 bp, mouse
gaattgctggttccatgtgc

SEQ ID NO: 733046 - DNA, 20 bp, mouse
gggtagggagccacacatat

SEQ ID NO: 733047 - DNA, 20 bp, mouse
ggggacccggaaggtggtgg

SEQ ID NO: 733048 - DNA, 20 bp, mouse
gggagccacacatataggtg

SEQ ID NO: 733049 - DNA, 20 bp, mouse
ggcaagagggacccggaagg

SEQ ID NO: 733050 - DNA, 20 bp, mouse
gcaagccacacctatatgtg

SEQ ID NO: 733051 - DNA, 20 bp, mouse
gaatagtgaggaaacacaca

SEQ ID NO: 733052 - DNA, 20 bp, mouse
gccatcttagcaagaaacct

SEQ ID NO: 733053 - DNA, 20 bp, mouse
ggggtccctcttgccagccc

SEQ ID NO: 733054 - DNA, 20 bp, mouse
gtgggctctgccacagatca

SEQ ID NO: 733055 - DNA, 20 bp, mouse
gcacagcaacaacaatagtg

SEQ ID NO: 733056 - DNA, 20 bp, mouse
ggggctgcctacaattctta

SEQ ID NO: 733057 - DNA, 20 bp, mouse
gtcctggtgactgacctatg

SEQ ID NO: 733058 - DNA, 20 bp, mouse
ggccccataggtcagtcacc

SEQ ID NO: 733059 - DNA, 20 bp, mouse
gaggcaccagcttcttttat

SEQ ID NO: 733060 - DNA, 20 bp, mouse
gggaacgcaagagaggtgac

SEQ ID NO: 733061 - DNA, 20 bp, mouse
gtcaggttagctaatctctt

SEQ ID NO: 733062 - DNA, 20 bp, mouse
gctgccagaactgtgcttct

SEQ ID NO: 733063 - DNA, 20 bp, mouse
gtgtcattaggtctgtttcc

SEQ ID NO: 733064 - DNA, 20 bp, mouse
gttccggaacacaaattata

SEQ ID NO: 733065 - DNA, 20 bp, mouse
gggaaagaatgagatccagg

SEQ ID NO: 733066 - DNA, 20 bp, mouse
gcctgggagccggataggtt

SEQ ID NO: 733067 - DNA, 20 bp, mouse
gcggagggatacagagaccc

SEQ ID NO: 733068 - DNA, 20 bp, mouse
gggccagcgtcctcagcctc

SEQ ID NO: 733069 - DNA, 20 bp, mouse
gcccgcgggcggctcagagt

SEQ ID NO: 733070 - DNA, 20 bp, mouse
gctccacaacccaacctatc

SEQ ID NO: 733071 - DNA, 20 bp, mouse
gcccgccctgggagccggat

SEQ ID NO: 733072 - DNA, 20 bp, mouse
gcctccgggggtggaggcaa

SEQ ID NO: 733073 - DNA, 20 bp, mouse
gaatggctctgattcccaga

SEQ ID NO: 733074 - DNA, 20 bp, mouse
gaatgccccgccctgggagc

SEQ ID NO: 733075 - DNA, 20 bp, mouse
gccagctagctccgagcccg

SEQ ID NO: 733076 - DNA, 20 bp, mouse
ggagcctcccacagttccca

SEQ ID NO: 733077 - DNA, 20 bp, mouse
gtgcaggattaaaacccaag

SEQ ID NO: 733078 - DNA, 20 bp, mouse
ggtctgcgaagaatcagggt

SEQ ID NO: 733079 - DNA, 20 bp, mouse
gaggccaggtatatgttagt

SEQ ID NO: 733080 - DNA, 20 bp, mouse
ggcactgtctgcgaagaatc

SEQ ID NO: 733081 - DNA, 20 bp, mouse
gaagcctgccttgggaactg

SEQ ID NO: 733082 - DNA, 20 bp, mouse
ggggaggctcatgtgcagcc

SEQ ID NO: 733083 - DNA, 20 bp, mouse
gcacgtttgctgaatgcttc

SEQ ID NO: 733084 - DNA, 20 bp, mouse
gctcccacagttcccaaggc

SEQ ID NO: 733085 - DNA, 20 bp, mouse
gtagaggccagcatgatgac

SEQ ID NO: 733086 - DNA, 20 bp, mouse
gctccccgtgagcagggaaa

SEQ ID NO: 733087 - DNA, 20 bp, mouse
gtgtgtgtgtgtcgctagaa

SEQ ID NO: 733088 - DNA, 20 bp, mouse
ggccacttccccatatggca

SEQ ID NO: 733089 - DNA, 20 bp, mouse
gagcctataaatccctgagg

SEQ ID NO: 733090 - DNA, 20 bp, mouse
gccatatggggaagtggcct

SEQ ID NO: 733091 - DNA, 20 bp, mouse
gagggtgctccccgtgagca

SEQ ID NO: 733092 - DNA, 20 bp, mouse
gactcactctaattgggtgg

SEQ ID NO: 733093 - DNA, 20 bp, mouse
gtgcgtacatccttgccata

SEQ ID NO: 733094 - DNA, 20 bp, mouse
ggctgctgggacatcacaga

SEQ ID NO: 733095 - DNA, 20 bp, mouse
gagccccctcagggatttat

SEQ ID NO: 733096 - DNA, 20 bp, mouse
gcccacgcggctcctcctcg

SEQ ID NO: 733097 - DNA, 20 bp, mouse
gtccgggcttcccaaggcta

SEQ ID NO: 733098 - DNA, 20 bp, mouse
ggggcggaacgtgcaaggaa

SEQ ID NO: 733099 - DNA, 20 bp, mouse
gccgcgtggggtccgcccgc

SEQ ID NO: 733100 - DNA, 20 bp, mouse
gcggccccaaccctagcctt

SEQ ID NO: 733101 - DNA, 20 bp, mouse
gagtcccgcccgccgcgagg

SEQ ID NO: 733102 - DNA, 20 bp, mouse
ggggaagcccggatcgcggg

SEQ ID NO: 733103 - DNA, 20 bp, mouse
gccgcccgctggcggatgcc

SEQ ID NO: 733104 - DNA, 20 bp, mouse
gggagcgcgattcaccgcgt

SEQ ID NO: 733105 - DNA, 20 bp, mouse
gacgcggctcctcctcgcgg

SEQ ID NO: 733106 - DNA, 20 bp, mouse
ggcaaagcggtggctgtctg

SEQ ID NO: 733107 - DNA, 20 bp, mouse
gcaagatctcgtgctgttcg

SEQ ID NO: 733108 - DNA, 20 bp, mouse
gcacacaacccctgctgttt

SEQ ID NO: 733109 - DNA, 20 bp, mouse
gatccactcaaaatatccca

SEQ ID NO: 733110 - DNA, 20 bp, mouse
gttcaaaagagagtgggtgg

SEQ ID NO: 733111 - DNA, 20 bp, mouse
gctgaagagagctaggaccc

SEQ ID NO: 733112 - DNA, 20 bp, mouse
gcaacccctgctgtttggga

SEQ ID NO: 733113 - DNA, 20 bp, mouse
ggggtctgctgaagagagct

SEQ ID NO: 733114 - DNA, 20 bp, mouse
ggcggtggctgtctgtggat

SEQ ID NO: 733115 - DNA, 20 bp, mouse
gtccagtgtttctacaagat

SEQ ID NO: 733116 - DNA, 20 bp, mouse
ggacacgcttcccttctcga

SEQ ID NO: 733117 - DNA, 20 bp, mouse
gccctcccgcccctcgagaa

SEQ ID NO: 733118 - DNA, 20 bp, mouse
ggggaggtgcgaattagaga

SEQ ID NO: 733119 - DNA, 20 bp, mouse
gagagcgttcagctcagtgc

SEQ ID NO: 733120 - DNA, 20 bp, mouse
gagcaaggaagccaaggctc

SEQ ID NO: 733121 - DNA, 20 bp, mouse
gttggcgcttccaaatccaa

SEQ ID NO: 733122 - DNA, 20 bp, mouse
gctaacagtttggtgcctcc

SEQ ID NO: 733123 - DNA, 20 bp, mouse
gaaagcgcgtttttaaacca

SEQ ID NO: 733124 - DNA, 20 bp, mouse
gaggcaccaaactgttagca

SEQ ID NO: 733125 - DNA, 20 bp, mouse
gccagactaggctgccttaa

SEQ ID NO: 733126 - DNA, 20 bp, mouse
gacctctgctgatactgtca

SEQ ID NO: 733127 - DNA, 20 bp, mouse
ggatttaattggttcccctg

SEQ ID NO: 733128 - DNA, 20 bp, mouse
gactgacccagcaaagacag

SEQ ID NO: 733129 - DNA, 20 bp, mouse
gacccagcaaagacaggggc

SEQ ID NO: 733130 - DNA, 20 bp, mouse
gacgtcataatccacctcag

SEQ ID NO: 733131 - DNA, 20 bp, mouse
gcacccgcccctgtctttgc

SEQ ID NO: 733132 - DNA, 20 bp, mouse
ggttagggagagtgcaggag

SEQ ID NO: 733133 - DNA, 20 bp, mouse
gttaattggttcccctgagg

SEQ ID NO: 733134 - DNA, 20 bp, mouse
gacgcaccaggctgtcctcc

SEQ ID NO: 733135 - DNA, 20 bp, mouse
gcactctccctaacatgtga

SEQ ID NO: 733136 - DNA, 20 bp, mouse
gctaagggagagagacacgt

SEQ ID NO: 733137 - DNA, 20 bp, mouse
ggggacaaccaaaatggcta

SEQ ID NO: 733138 - DNA, 20 bp, mouse
ggggcaagcctttattgaga

SEQ ID NO: 733139 - DNA, 20 bp, mouse
gaaaaatgggacaaccaaaa

SEQ ID NO: 733140 - DNA, 20 bp, mouse
gacgtgtaagagacattgcc

SEQ ID NO: 733141 - DNA, 20 bp, mouse
gtaagcaccaagctgaagac

SEQ ID NO: 733142 - DNA, 20 bp, mouse
gagctcctggatcattaggt

SEQ ID NO: 733143 - DNA, 20 bp, mouse
gcgatggcacactgagtgtt

SEQ ID NO: 733144 - DNA, 20 bp, mouse
gtgcgggatttaaacatttg

SEQ ID NO: 733145 - DNA, 20 bp, mouse
gtcatggaataatcagtcag

SEQ ID NO: 733146 - DNA, 20 bp, mouse
gtaaacctggaggtcacatg

SEQ ID NO: 733147 - DNA, 20 bp, mouse
gagtctagcagaagccaaac

SEQ ID NO: 733148 - DNA, 20 bp, mouse
gcatcagcaaccaacctcct

SEQ ID NO: 733149 - DNA, 20 bp, mouse
gagccaggcccagcttccag

SEQ ID NO: 733150 - DNA, 20 bp, mouse
gaggagctggatttatgagg

SEQ ID NO: 733151 - DNA, 20 bp, mouse
gctagactgagtcacgcctc

SEQ ID NO: 733152 - DNA, 20 bp, mouse
gcaggccagtcagccctagg

SEQ ID NO: 733153 - DNA, 20 bp, mouse
gagggctgactggcctgtgt

SEQ ID NO: 733154 - DNA, 20 bp, mouse
gtctcataacagctgggttt

SEQ ID NO: 733155 - DNA, 20 bp, mouse
gaacacaagtggcctttgtt

SEQ ID NO: 733156 - DNA, 20 bp, mouse
gttcccaggaacaccatgaa

SEQ ID NO: 733157 - DNA, 20 bp, mouse
gaaccctgaaagtgtcgcaa

SEQ ID NO: 733158 - DNA, 20 bp, mouse
gcaccattgcgacactttca

SEQ ID NO: 733159 - DNA, 20 bp, mouse
ggggaaattacacagggtaa

SEQ ID NO: 733160 - DNA, 20 bp, mouse
gggggatcagcaaatagact

SEQ ID NO: 733161 - DNA, 20 bp, mouse
gttgacagcgacagcagtaa

SEQ ID NO: 733162 - DNA, 20 bp, mouse
gactccctcatttgcatgac

SEQ ID NO: 733163 - DNA, 20 bp, mouse
ggaaggcaagcaatagggcc

SEQ ID NO: 733164 - DNA, 20 bp, mouse
gtgcttgccttcaaatgaaa

SEQ ID NO: 733165 - DNA, 20 bp, mouse
ggaaacagagaacttaattt

SEQ ID NO: 733166 - DNA, 20 bp, mouse
gtgggctaacccgaccaaga

SEQ ID NO: 733167 - DNA, 20 bp, mouse
gaaaactgccacctaagtgt

SEQ ID NO: 733168 - DNA, 20 bp, mouse
gacactgactgaatggattt

SEQ ID NO: 733169 - DNA, 20 bp, mouse
gggtgaaatccctcttggtc

SEQ ID NO: 733170 - DNA, 20 bp, mouse
gccattcagtcagtgtatgg

SEQ ID NO: 733171 - DNA, 20 bp, mouse
ggtaatgctttctgccacac

SEQ ID NO: 733172 - DNA, 20 bp, mouse
gttcaaagagtctacctgtg

SEQ ID NO: 733173 - DNA, 20 bp, mouse
gacaggctgcttacaggttc

SEQ ID NO: 733174 - DNA, 20 bp, mouse
ggtcgggttagcccacactt

SEQ ID NO: 733175 - DNA, 20 bp, mouse
gttgtgtctccaccccaaag

SEQ ID NO: 733176 - DNA, 20 bp, mouse
gttcccgcaggtgtttttgg

SEQ ID NO: 733177 - DNA, 20 bp, mouse
gtctctgctggcaatgactg

SEQ ID NO: 733178 - DNA, 20 bp, mouse
gcggtccccttagacctaca

SEQ ID NO: 733179 - DNA, 20 bp, mouse
gggtctaaggggaccgcaga

SEQ ID NO: 733180 - DNA, 20 bp, mouse
gaatgactgcggaactgtga

SEQ ID NO: 733181 - DNA, 20 bp, mouse
gaagaaatgtcaaaacatgt

SEQ ID NO: 733182 - DNA, 20 bp, mouse
gagtcccaggagcctctgga

SEQ ID NO: 733183 - DNA, 20 bp, mouse
gtggaaggatccgtctgaag

SEQ ID NO: 733184 - DNA, 20 bp, mouse
ggagggcaatgtggagtccc

SEQ ID NO: 733185 - DNA, 20 bp, mouse
ggtgaaggagacccaataaa

SEQ ID NO: 733186 - DNA, 20 bp, mouse
ggtactgagtcagagctcat

SEQ ID NO: 733187 - DNA, 20 bp, mouse
gtcacccttccagcttcttc

SEQ ID NO: 733188 - DNA, 20 bp, mouse
gggggaggaaatctcgacta

SEQ ID NO: 733189 - DNA, 20 bp, mouse
ggagtccacacaggcttcag

SEQ ID NO: 733190 - DNA, 20 bp, mouse
gcagggagtccacgcgaggg

SEQ ID NO: 733191 - DNA, 20 bp, mouse
gcacgcgagggtggctgtct

SEQ ID NO: 733192 - DNA, 20 bp, mouse
gatcccggaagaagctggaa

SEQ ID NO: 733193 - DNA, 20 bp, mouse
ggttgtgcacagcagactct

SEQ ID NO: 733194 - DNA, 20 bp, mouse
gctgcagggagtccacgcga

SEQ ID NO: 733195 - DNA, 20 bp, mouse
gactctgggctccatcgccc

SEQ ID NO: 733196 - DNA, 20 bp, mouse
gggaagctacttgatgagta

SEQ ID NO: 733197 - DNA, 20 bp, mouse
gcaggctgttgtgaaggccc

SEQ ID NO: 733198 - DNA, 20 bp, mouse
gtgctcactggtaagaccca

SEQ ID NO: 733199 - DNA, 20 bp, mouse
ggcgcccagcttgaatgaac

SEQ ID NO: 733200 - DNA, 20 bp, mouse
gaacttgagacatctgcctg

SEQ ID NO: 733201 - DNA, 20 bp, mouse
gtggcccaaatgctcaaaat

SEQ ID NO: 733202 - DNA, 20 bp, mouse
gaataatcctggctgctcac

SEQ ID NO: 733203 - DNA, 20 bp, mouse
gtctgcctgagggagacatc

SEQ ID NO: 733204 - DNA, 20 bp, mouse
gtctgcctgttcattcaagc

SEQ ID NO: 733205 - DNA, 20 bp, mouse
gctgggtttgggcaaaaagg

SEQ ID NO: 733206 - DNA, 20 bp, mouse
gggcaggtgggacaagttat

SEQ ID NO: 733207 - DNA, 20 bp, mouse
ggacccagcagggtaaatat

SEQ ID NO: 733208 - DNA, 20 bp, mouse
gtggagtgggacagtgatct

SEQ ID NO: 733209 - DNA, 20 bp, mouse
ggggagaaatgctacttggc

SEQ ID NO: 733210 - DNA, 20 bp, mouse
gtctgcaccctcattggagt

SEQ ID NO: 733211 - DNA, 20 bp, mouse
gtccacccccaaagactatg

SEQ ID NO: 733212 - DNA, 20 bp, mouse
gcccctcccttgtaactggg

SEQ ID NO: 733213 - DNA, 20 bp, mouse
gcactgtcccactccaatga

SEQ ID NO: 733214 - DNA, 20 bp, mouse
ggtcagggaggcacagtcac

SEQ ID NO: 733215 - DNA, 20 bp, mouse
gagcctcccagttacaaggg

SEQ ID NO: 733216 - DNA, 20 bp, mouse
gtacgtgtgcgtgtgggggc

SEQ ID NO: 733217 - DNA, 20 bp, mouse
gtaggtgtacgtgtgcgtgt

SEQ ID NO: 733218 - DNA, 20 bp, mouse
gcacacgtacacctagccaa

SEQ ID NO: 733219 - DNA, 20 bp, mouse
ggggcttggcctcttcttga

SEQ ID NO: 733220 - DNA, 20 bp, mouse
gatggaagaggttacttctt

SEQ ID NO: 733221 - DNA, 20 bp, mouse
gccccatctgcatcttagac

SEQ ID NO: 733222 - DNA, 20 bp, mouse
gcaaaccaggtgaggtgcca

SEQ ID NO: 733223 - DNA, 20 bp, mouse
gtatgactgtcagacaaacc

SEQ ID NO: 733224 - DNA, 20 bp, mouse
gcctggaaatctttgtatag

SEQ ID NO: 733225 - DNA, 20 bp, mouse
ggcatccctggcacctcacc

SEQ ID NO: 733226 - DNA, 20 bp, mouse
ggtgttaagggtgacctttg

SEQ ID NO: 733227 - DNA, 20 bp, mouse
gaccccaaatatcgtgttaa

SEQ ID NO: 733228 - DNA, 20 bp, mouse
gtcacccttaacacgatatt

SEQ ID NO: 733229 - DNA, 20 bp, mouse
gcagtcgtgtcccaagaggc

SEQ ID NO: 733230 - DNA, 20 bp, mouse
gaggacatgcgctgctaccc

SEQ ID NO: 733231 - DNA, 20 bp, mouse
gctcacagtcgtgtcccaag

SEQ ID NO: 733232 - DNA, 20 bp, mouse
gaataccaagggcttcaggt

SEQ ID NO: 733233 - DNA, 20 bp, mouse
ggggctcagggtaaatacca

SEQ ID NO: 733234 - DNA, 20 bp, mouse
gacttcactgcctgcctctt

SEQ ID NO: 733235 - DNA, 20 bp, mouse
gcacagatgggacagactga

SEQ ID NO: 733236 - DNA, 20 bp, mouse
gccttcccaccttgagagat

SEQ ID NO: 733237 - DNA, 20 bp, mouse
gcaagcagagacacctaaac

SEQ ID NO: 733238 - DNA, 20 bp, mouse
gacttcccatctctcaaggt

SEQ ID NO: 733239 - DNA, 20 bp, mouse
gaatagctacgggagatcaa

SEQ ID NO: 733240 - DNA, 20 bp, mouse
gaaaaaccctggtgtcccga

SEQ ID NO: 733241 - DNA, 20 bp, mouse
ggcttggaggtggtgtcttg

SEQ ID NO: 733242 - DNA, 20 bp, mouse
ggtcttgtggcctcctatgg

SEQ ID NO: 733243 - DNA, 20 bp, mouse
gccctaaaacgtcacggtga

SEQ ID NO: 733244 - DNA, 20 bp, mouse
gtatagccatcgggacacca

SEQ ID NO: 733245 - DNA, 20 bp, mouse
ggtggcctcctatggtggtt

SEQ ID NO: 733246 - DNA, 20 bp, mouse
gcctgggcgagatccaaggg

SEQ ID NO: 733247 - DNA, 20 bp, mouse
gaggacctgggcgagatcca

SEQ ID NO: 733248 - DNA, 20 bp, mouse
gcgtgggggcaggggtacaa

SEQ ID NO: 733249 - DNA, 20 bp, mouse
gggagagcagagtaagacct

SEQ ID NO: 733250 - DNA, 20 bp, mouse
gggtacaaaggtgcctagtc

SEQ ID NO: 733251 - DNA, 20 bp, mouse
gaattcctcagcacccgact

SEQ ID NO: 733252 - DNA, 20 bp, mouse
gccgcaccaccaggggcctt

SEQ ID NO: 733253 - DNA, 20 bp, mouse
gcaaggcaccagcagcggaa

SEQ ID NO: 733254 - DNA, 20 bp, mouse
ggcagacaaggcaccagcag

SEQ ID NO: 733255 - DNA, 20 bp, mouse
ggcggaagggcttgtttatc

SEQ ID NO: 733256 - DNA, 20 bp, mouse
gcaaagcctcagggcagggt

SEQ ID NO: 733257 - DNA, 20 bp, mouse
gtagagaatatagagagagg

SEQ ID NO: 733258 - DNA, 20 bp, mouse
gagctctatggggagtcagg

SEQ ID NO: 733259 - DNA, 20 bp, mouse
gggaagtgacggtccatttg

SEQ ID NO: 733260 - DNA, 20 bp, mouse
gcagcagcctcctcagtgaa

SEQ ID NO: 733261 - DNA, 20 bp, mouse
gtggagcccaacggaagtga

SEQ ID NO: 733262 - DNA, 20 bp, mouse
gttccgttgggctccaccaa

SEQ ID NO: 733263 - DNA, 20 bp, mouse
gactgcttatgaggacctgg

SEQ ID NO: 733264 - DNA, 20 bp, mouse
gaggactgcttatgaggacc

SEQ ID NO: 733265 - DNA, 20 bp, mouse
gagaggcaggactgcttatg

SEQ ID NO: 733266 - DNA, 20 bp, mouse
gtacctgggctctccaaaga

SEQ ID NO: 733267 - DNA, 20 bp, mouse
ggacacatgtgtcccgacct

SEQ ID NO: 733268 - DNA, 20 bp, mouse
ggaactgaagcggcatacct

SEQ ID NO: 733269 - DNA, 20 bp, mouse
gcacatgtgtcatgctctcc

SEQ ID NO: 733270 - DNA, 20 bp, mouse
ggaacacagaagactgcaga

SEQ ID NO: 733271 - DNA, 20 bp, mouse
gaggaaatcggactggggtt

SEQ ID NO: 733272 - DNA, 20 bp, mouse
gaagtgaggaaatcggactg

SEQ ID NO: 733273 - DNA, 20 bp, mouse
gcacctgctagtgtgaaggg

SEQ ID NO: 733274 - DNA, 20 bp, mouse
ggaaccagacttcgaatctg

SEQ ID NO: 733275 - DNA, 20 bp, mouse
gtgtggctagaggcctaggt

SEQ ID NO: 733276 - DNA, 20 bp, mouse
gggagctctaggccaggtgg

SEQ ID NO: 733277 - DNA, 20 bp, mouse
gcctagagctcccatagacc

SEQ ID NO: 733278 - DNA, 20 bp, mouse
gaagactctgttttcaatta

SEQ ID NO: 733279 - DNA, 20 bp, mouse
gaagtcaaacaggtcaatgg

SEQ ID NO: 733280 - DNA, 20 bp, mouse
gaaggaaaaaaacactgaca

SEQ ID NO: 733281 - DNA, 20 bp, mouse
gtagttgtcatgtcactatt

SEQ ID NO: 733282 - DNA, 20 bp, mouse
gagctcactttcagtaatct

SEQ ID NO: 733283 - DNA, 20 bp, mouse
gtctgttttcaattaaggca

SEQ ID NO: 733284 - DNA, 20 bp, mouse
gatgggagctctaggccagg

SEQ ID NO: 733285 - DNA, 20 bp, mouse
gacattttcatttcttgaag

SEQ ID NO: 733286 - DNA, 20 bp, mouse
gcctcaggtgagatgaaacc

SEQ ID NO: 733287 - DNA, 20 bp, mouse
gcaccctttgctcttagaca

SEQ ID NO: 733288 - DNA, 20 bp, mouse
gcaagaggatctttggttca

SEQ ID NO: 733289 - DNA, 20 bp, mouse
gccccctgtctaagagcaaa

SEQ ID NO: 733290 - DNA, 20 bp, mouse
gggtgatgaagtatttctcc

SEQ ID NO: 733291 - DNA, 20 bp, mouse
ggaaattggtcatgcttccc

SEQ ID NO: 733292 - DNA, 20 bp, mouse
gtggcagtatacaataaaac

SEQ ID NO: 733293 - DNA, 20 bp, mouse
ggtatataaggggtctggca

SEQ ID NO: 733294 - DNA, 20 bp, mouse
gaggtatgtaccactaggca

SEQ ID NO: 733295 - DNA, 20 bp, mouse
gatcaaaacaccatgcctag

SEQ ID NO: 733296 - DNA, 20 bp, mouse
gcccccgcccggaaagtgca

SEQ ID NO: 733297 - DNA, 20 bp, mouse
gggaaatggtgcccttggaa

SEQ ID NO: 733298 - DNA, 20 bp, mouse
gctacctaggatctgacctc

SEQ ID NO: 733299 - DNA, 20 bp, mouse
gagcttttgggaacactttc

SEQ ID NO: 733300 - DNA, 20 bp, mouse
gatcattacaacttccatga

SEQ ID NO: 733301 - DNA, 20 bp, mouse
gcagccagaggtcagatcct

SEQ ID NO: 733302 - DNA, 20 bp, mouse
gaaggggatggcggcccaag

SEQ ID NO: 733303 - DNA, 20 bp, mouse
gtgggtttagccaacaaaag

SEQ ID NO: 733304 - DNA, 20 bp, mouse
ggtagcatttaatcagcttt

SEQ ID NO: 733305 - DNA, 20 bp, mouse
gtatcagcctggcagctgat

SEQ ID NO: 733306 - DNA, 20 bp, mouse
gtggagaagcacaaggaggt

SEQ ID NO: 733307 - DNA, 20 bp, mouse
gcccgtaagaggggactcag

SEQ ID NO: 733308 - DNA, 20 bp, mouse
ggtgagtggccagagtctca

SEQ ID NO: 733309 - DNA, 20 bp, mouse
gacacagcactgtccactgg

SEQ ID NO: 733310 - DNA, 20 bp, mouse
ggtggacagtgctgtgtgag

SEQ ID NO: 733311 - DNA, 20 bp, mouse
gctgggtctggagctcagat

SEQ ID NO: 733312 - DNA, 20 bp, mouse
gcatctggtaaaccaaatga

SEQ ID NO: 733313 - DNA, 20 bp, mouse
gggtaaaccaaatgagggta

SEQ ID NO: 733314 - DNA, 20 bp, mouse
gaacagagtcacataggatt

SEQ ID NO: 733315 - DNA, 20 bp, mouse
gtaagggaattacccgtaag

SEQ ID NO: 733316 - DNA, 20 bp, mouse
gaggaccaggggctctgttt

SEQ ID NO: 733317 - DNA, 20 bp, mouse
gagggacagtggcgacaatt

SEQ ID NO: 733318 - DNA, 20 bp, mouse
gcaggggctctgttttgggg

SEQ ID NO: 733319 - DNA, 20 bp, mouse
ggggctctgttttggggtgg

SEQ ID NO: 733320 - DNA, 20 bp, mouse
gtgaggaagtctgagtactg

SEQ ID NO: 733321 - DNA, 20 bp, mouse
gacaattagggccggactga

SEQ ID NO: 733322 - DNA, 20 bp, mouse
gtgggcatctggttgctgct

SEQ ID NO: 733323 - DNA, 20 bp, mouse
gagggtctgtaaggagacag

SEQ ID NO: 733324 - DNA, 20 bp, mouse
ggtagccagtttaagaagat

SEQ ID NO: 733325 - DNA, 20 bp, mouse
ggaggggccggcagcaaggt

SEQ ID NO: 733326 - DNA, 20 bp, mouse
gctaagagggctctagggtc

SEQ ID NO: 733327 - DNA, 20 bp, mouse
gaagcaaggtcgtgcaacgg

SEQ ID NO: 733328 - DNA, 20 bp, mouse
gtcgtgcaacgggggtggaa

SEQ ID NO: 733329 - DNA, 20 bp, mouse
gctgttctgtgatctcatat

SEQ ID NO: 733330 - DNA, 20 bp, mouse
ggagaagcaaggtcgtgcaa

SEQ ID NO: 733331 - DNA, 20 bp, mouse
ggtgtttggtgagaaggatc

SEQ ID NO: 733332 - DNA, 20 bp, mouse
ggtaaactgagtcctctagg

SEQ ID NO: 733333 - DNA, 20 bp, mouse
gcacccctcctgccgcggca

SEQ ID NO: 733334 - DNA, 20 bp, mouse
gtgggcagtgtttggtgaga

SEQ ID NO: 733335 - DNA, 20 bp, mouse
gttcaattactaggaggtgt

SEQ ID NO: 733336 - DNA, 20 bp, mouse
ggggcagccactgaatgtgg

SEQ ID NO: 733337 - DNA, 20 bp, mouse
gagtggctgcccctgggcgt

SEQ ID NO: 733338 - DNA, 20 bp, mouse
gaagaagggcctgccccctc

SEQ ID NO: 733339 - DNA, 20 bp, mouse
ggaagtcgatggtgttaggg

SEQ ID NO: 733340 - DNA, 20 bp, mouse
gcacgctcacacagttactg

SEQ ID NO: 733341 - DNA, 20 bp, mouse
gtggcatgtgtgagatgtag

SEQ ID NO: 733342 - DNA, 20 bp, mouse
gaaagggcagcatgtagcgg

SEQ ID NO: 733343 - DNA, 20 bp, mouse
gagatgtagcggggaagagt

SEQ ID NO: 733344 - DNA, 20 bp, mouse
gatgaggggcaaggcccaat

SEQ ID NO: 733345 - DNA, 20 bp, mouse
gttcctgtatagaggatgag

SEQ ID NO: 733346 - DNA, 20 bp, mouse
gaaaccacgctgtagagaga

SEQ ID NO: 733347 - DNA, 20 bp, mouse
gcaggaccctaggtccagga

SEQ ID NO: 733348 - DNA, 20 bp, mouse
ggggaatgatggtgtgtggt

SEQ ID NO: 733349 - DNA, 20 bp, mouse
gagcagaacccaaatctccc

SEQ ID NO: 733350 - DNA, 20 bp, mouse
gctggacctagggtcctgaa

SEQ ID NO: 733351 - DNA, 20 bp, mouse
gcttgtgggagagtggttca

SEQ ID NO: 733352 - DNA, 20 bp, mouse
gtagaagccggctctcacta

SEQ ID NO: 733353 - DNA, 20 bp, mouse
gcccccctctctctacagcg

SEQ ID NO: 733354 - DNA, 20 bp, mouse
gctagagggaaaaggtggct

SEQ ID NO: 733355 - DNA, 20 bp, mouse
gcaaaaggaaatgtatgggt

SEQ ID NO: 733356 - DNA, 20 bp, mouse
gccgtccatctctatgacaa

SEQ ID NO: 733357 - DNA, 20 bp, mouse
gaaagtgatgaataagtttg

SEQ ID NO: 733358 - DNA, 20 bp, mouse
gagatggacggagtggaaac

SEQ ID NO: 733359 - DNA, 20 bp, mouse
gcagggtcaagtttgtgcaa

SEQ ID NO: 733360 - DNA, 20 bp, mouse
gcggagtggaaacaggttgt

SEQ ID NO: 733361 - DNA, 20 bp, mouse
gcacataggctgtacagtca

SEQ ID NO: 733362 - DNA, 20 bp, mouse
gagtttgtgcaagggatggt

SEQ ID NO: 733363 - DNA, 20 bp, mouse
gaggtagtcaccagagtcac

SEQ ID NO: 733364 - DNA, 20 bp, mouse
gccctctctgaatacatata

SEQ ID NO: 733365 - DNA, 20 bp, mouse
gtactcaagattatcgacat

SEQ ID NO: 733366 - DNA, 20 bp, mouse
gttgcccaggcaatgggagt

SEQ ID NO: 733367 - DNA, 20 bp, mouse
gggggtggatcagttaatta

SEQ ID NO: 733368 - DNA, 20 bp, mouse
gggtgagaacgcaaggacaa

SEQ ID NO: 733369 - DNA, 20 bp, mouse
gttaattatgggaactgggt

SEQ ID NO: 733370 - DNA, 20 bp, mouse
gaggtgcaggtgagaacgca

SEQ ID NO: 733371 - DNA, 20 bp, mouse
gtaactcttgagccccattc

SEQ ID NO: 733372 - DNA, 20 bp, mouse
gtctgaagtcacaaaggtgc

SEQ ID NO: 733373 - DNA, 20 bp, mouse
ggagttacttgcccaggcaa

SEQ ID NO: 733374 - DNA, 20 bp, mouse
gattatgggaactgggtagg

SEQ ID NO: 733375 - DNA, 20 bp, mouse
gtcagttaattatgggaact

SEQ ID NO: 733376 - DNA, 20 bp, mouse
gaaggcttaaaatgcctgaa

SEQ ID NO: 733377 - DNA, 20 bp, mouse
ggactgaaaggaaactacag

SEQ ID NO: 733378 - DNA, 20 bp, mouse
gcatttgtactccctggcaa

SEQ ID NO: 733379 - DNA, 20 bp, mouse
gaaaacattttgtactagtg

SEQ ID NO: 733380 - DNA, 20 bp, mouse
gctcatcagtgcctgtgaaa

SEQ ID NO: 733381 - DNA, 20 bp, mouse
gtattgtgcttggcatgata

SEQ ID NO: 733382 - DNA, 20 bp, mouse
gtttaacggaacacttttaa

SEQ ID NO: 733383 - DNA, 20 bp, mouse
gttgtctaccagcgattcgt

SEQ ID NO: 733384 - DNA, 20 bp, mouse
gtagttgtaaccccttgcca

SEQ ID NO: 733385 - DNA, 20 bp, mouse
ggctaactgtggctcttact

SEQ ID NO: 733386 - DNA, 20 bp, mouse
gagctgggacatgacgatgg

SEQ ID NO: 733387 - DNA, 20 bp, mouse
gaggagctgggacatgacga

SEQ ID NO: 733388 - DNA, 20 bp, mouse
gagcccaactgtgaaggtga

SEQ ID NO: 733389 - DNA, 20 bp, mouse
ggctgtgggaggcaggatcg

SEQ ID NO: 733390 - DNA, 20 bp, mouse
gcaagacagaggaggagaac

SEQ ID NO: 733391 - DNA, 20 bp, mouse
gagaacgataacagtaacat

SEQ ID NO: 733392 - DNA, 20 bp, mouse
gcctgtcaggtgtcaacaga

SEQ ID NO: 733393 - DNA, 20 bp, mouse
ggccccagccctggaggcta

SEQ ID NO: 733394 - DNA, 20 bp, mouse
ggctctcttcctagactgtt

SEQ ID NO: 733395 - DNA, 20 bp, mouse
gaatgctgaaggtcaggctt

SEQ ID NO: 733396 - DNA, 20 bp, mouse
gcagccctgagggtgaatat

SEQ ID NO: 733397 - DNA, 20 bp, mouse
gaggcaaggggacagccctg

SEQ ID NO: 733398 - DNA, 20 bp, mouse
gcaccccatattcaccctca

SEQ ID NO: 733399 - DNA, 20 bp, mouse
ggcacagtcagtcaaggcaa

SEQ ID NO: 733400 - DNA, 20 bp, mouse
gtggggtgtctctagaatct

SEQ ID NO: 733401 - DNA, 20 bp, mouse
gcatcaagcacagtcagtca

SEQ ID NO: 733402 - DNA, 20 bp, mouse
gtcttcagaggttcccatga

SEQ ID NO: 733403 - DNA, 20 bp, mouse
gagtacagctgatgggacct

SEQ ID NO: 733404 - DNA, 20 bp, mouse
gagcctgagacaaccctcat

SEQ ID NO: 733405 - DNA, 20 bp, mouse
ggggccttgtcactattacc

SEQ ID NO: 733406 - DNA, 20 bp, mouse
ggtcacgcgggagggatgga

SEQ ID NO: 733407 - DNA, 20 bp, mouse
gactgcgagtacagttgcaa

SEQ ID NO: 733408 - DNA, 20 bp, mouse
gcctcgggagtcacgcggga

SEQ ID NO: 733409 - DNA, 20 bp, mouse
gcccgctcgcccgtgactga

SEQ ID NO: 733410 - DNA, 20 bp, mouse
ggggaggatgaccgcgattg

SEQ ID NO: 733411 - DNA, 20 bp, mouse
gtggacggagctgaggcggg

SEQ ID NO: 733412 - DNA, 20 bp, mouse
gggggcctcgggagtcacgc

SEQ ID NO: 733413 - DNA, 20 bp, mouse
gcgcgattgcgggtgatggg

SEQ ID NO: 733414 - DNA, 20 bp, mouse
ggaccgcgattgcgggtgat

SEQ ID NO: 733415 - DNA, 20 bp, mouse
ggggaccatgggcgcggtcg

SEQ ID NO: 733416 - DNA, 20 bp, mouse
gctggaagagaggtgctgat

SEQ ID NO: 733417 - DNA, 20 bp, mouse
ggcaggaagcagctaggccc

SEQ ID NO: 733418 - DNA, 20 bp, mouse
gaagaggtcacaggtgtccg

SEQ ID NO: 733419 - DNA, 20 bp, mouse
gcctgtgaaatcagaccaat

SEQ ID NO: 733420 - DNA, 20 bp, mouse
gctaggcccaggtgtgctca

SEQ ID NO: 733421 - DNA, 20 bp, mouse
gagggcgacaccagcaccct

SEQ ID NO: 733422 - DNA, 20 bp, mouse
gctgataagattagtctgaa

SEQ ID NO: 733423 - DNA, 20 bp, mouse
gtggggtcttacctcataga

SEQ ID NO: 733424 - DNA, 20 bp, mouse
gtagctgcttcctgctatgg

SEQ ID NO: 733425 - DNA, 20 bp, mouse
gtccaaggggcccccatagc

SEQ ID NO: 733426 - DNA, 20 bp, mouse
ggtcgcgcaggcgcagaaga

SEQ ID NO: 733427 - DNA, 20 bp, mouse
gcgcatgcgcaacaggttgt

SEQ ID NO: 733428 - DNA, 20 bp, mouse
gtgaggaaccacggtcgcgc

SEQ ID NO: 733429 - DNA, 20 bp, mouse
gaggctcgagttgcgagggg

SEQ ID NO: 733430 - DNA, 20 bp, mouse
gcactaggctcgagttgcga

SEQ ID NO: 733431 - DNA, 20 bp, mouse
ggcctagtgcgcttgctcag

SEQ ID NO: 733432 - DNA, 20 bp, mouse
gcgggaaaggcagttggcga

SEQ ID NO: 733433 - DNA, 20 bp, mouse
gccacccccggcctgaacta

SEQ ID NO: 733434 - DNA, 20 bp, mouse
gaattagcgcgcaggcgcaa

SEQ ID NO: 733435 - DNA, 20 bp, mouse
ggaagagggaagctggcggc

SEQ ID NO: 733436 - DNA, 20 bp, mouse
ggctgcggacgcgtggggtg

SEQ ID NO: 733437 - DNA, 20 bp, mouse
gccagcgatcaggcaaagtc

SEQ ID NO: 733438 - DNA, 20 bp, mouse
gtggacagctgcggacgcgt

SEQ ID NO: 733439 - DNA, 20 bp, mouse
gaagctggtctgtagggaaa

SEQ ID NO: 733440 - DNA, 20 bp, mouse
gagtcgtgggacttaaaagc

SEQ ID NO: 733441 - DNA, 20 bp, mouse
gactgcgggtgaaaatgagc

SEQ ID NO: 733442 - DNA, 20 bp, mouse
ggcaaagtccggaggactgc

SEQ ID NO: 733443 - DNA, 20 bp, mouse
ggggcgtcgcatgtaaataa

SEQ ID NO: 733444 - DNA, 20 bp, mouse
gcagacgctgagtaaacatt

SEQ ID NO: 733445 - DNA, 20 bp, mouse
gtaaatgaccgtgcacgggg

SEQ ID NO: 733446 - DNA, 20 bp, mouse
gttaaagcaggtgtggggca

SEQ ID NO: 733447 - DNA, 20 bp, mouse
gaggcgagtcctgaaactca

SEQ ID NO: 733448 - DNA, 20 bp, mouse
gccagaatggagtgtaaatg

SEQ ID NO: 733449 - DNA, 20 bp, mouse
gagaaattcaataaccagaa

SEQ ID NO: 733450 - DNA, 20 bp, mouse
gaatgctttttaagcagggg

SEQ ID NO: 733451 - DNA, 20 bp, mouse
gacactcttgggagcgtgat

SEQ ID NO: 733452 - DNA, 20 bp, mouse
ggatagaggacacctaataa

SEQ ID NO: 733453 - DNA, 20 bp, mouse
gactggaaaccctgagtttc

SEQ ID NO: 733454 - DNA, 20 bp, mouse
ggaaaatgctttttaagcag

SEQ ID NO: 733455 - DNA, 20 bp, mouse
gaaaagttgtgcatatatgg

SEQ ID NO: 733456 - DNA, 20 bp, mouse
gcagctgtgcatctactctc

SEQ ID NO: 733457 - DNA, 20 bp, mouse
gaggaccctcaccaaaagga

SEQ ID NO: 733458 - DNA, 20 bp, mouse
gaaacgtttgactcactgta

SEQ ID NO: 733459 - DNA, 20 bp, mouse
gtggttactaagaagtacag

SEQ ID NO: 733460 - DNA, 20 bp, mouse
gcctcaccaaaaggagggac

SEQ ID NO: 733461 - DNA, 20 bp, mouse
gccagcctagtcatagaaaa

SEQ ID NO: 733462 - DNA, 20 bp, mouse
gagtgtgggccctctctaat

SEQ ID NO: 733463 - DNA, 20 bp, mouse
ggagtcaaacgtttgattcc

SEQ ID NO: 733464 - DNA, 20 bp, mouse
ggagagcaacccattagaga

SEQ ID NO: 733465 - DNA, 20 bp, mouse
gctggtgtttgactttaagg

SEQ ID NO: 733466 - DNA, 20 bp, mouse
gtctgtagctcattctgctc

SEQ ID NO: 733467 - DNA, 20 bp, mouse
gcacttgagcatgtcttgat

SEQ ID NO: 733468 - DNA, 20 bp, mouse
ggaaagaatcacaactagga

SEQ ID NO: 733469 - DNA, 20 bp, mouse
ggcagagaggaacttcatag

SEQ ID NO: 733470 - DNA, 20 bp, mouse
gtgtgcttaagtcatccttg

SEQ ID NO: 733471 - DNA, 20 bp, mouse
ggctggccaacccacaatgc

SEQ ID NO: 733472 - DNA, 20 bp, mouse
gcttcttagggctagcctca

SEQ ID NO: 733473 - DNA, 20 bp, mouse
gtctcaatagctccgccaga

SEQ ID NO: 733474 - DNA, 20 bp, mouse
gtggaattgactatcgttct

SEQ ID NO: 733475 - DNA, 20 bp, mouse
gcctaataaatatgagactg

SEQ ID NO: 733476 - DNA, 20 bp, mouse
gaaaacctggggaggggccc

SEQ ID NO: 733477 - DNA, 20 bp, mouse
gaggaagtaaccccctccgg

SEQ ID NO: 733478 - DNA, 20 bp, mouse
gcctggggaggggccctggt

SEQ ID NO: 733479 - DNA, 20 bp, mouse
gagcgctccgggccaccgga

SEQ ID NO: 733480 - DNA, 20 bp, mouse
gtgggggctcaggtgtggcg

SEQ ID NO: 733481 - DNA, 20 bp, mouse
ggaaagcaaaactcaagcgg

SEQ ID NO: 733482 - DNA, 20 bp, mouse
ggcgagccggggctgccaag

SEQ ID NO: 733483 - DNA, 20 bp, mouse
ggcgcaatcggccagcgctc

SEQ ID NO: 733484 - DNA, 20 bp, mouse
gaagcggaggcgcggatgga

SEQ ID NO: 733485 - DNA, 20 bp, mouse
gtgcaggaagtaaccccctc

SEQ ID NO: 733486 - DNA, 20 bp, mouse
gtcgccggagacgaaggggc

SEQ ID NO: 733487 - DNA, 20 bp, mouse
gagcgcgcggccattggctc

SEQ ID NO: 733488 - DNA, 20 bp, mouse
gaccgcgagctcattggctc

SEQ ID NO: 733489 - DNA, 20 bp, mouse
gagtcccgccccttcgtctc

SEQ ID NO: 733490 - DNA, 20 bp, mouse
ggaggctcgcaggccctctg

SEQ ID NO: 733491 - DNA, 20 bp, mouse
gccgggtcgccggagacgaa

SEQ ID NO: 733492 - DNA, 20 bp, mouse
gacgccgggagccgcgttac

SEQ ID NO: 733493 - DNA, 20 bp, mouse
gccggcgtccgggattccgg

SEQ ID NO: 733494 - DNA, 20 bp, mouse
gcgcgttacgggaatcgcag

SEQ ID NO: 733495 - DNA, 20 bp, mouse
ggggtcgcggacagcaaccc

SEQ ID NO: 733496 - DNA, 20 bp, mouse
ggtgcattgcacagatgaca

SEQ ID NO: 733497 - DNA, 20 bp, mouse
gctgtgcaatgcacctgctc

SEQ ID NO: 733498 - DNA, 20 bp, mouse
gcaaaactcgtattagttgg

SEQ ID NO: 733499 - DNA, 20 bp, mouse
ggaagtgaaggatgattaag

SEQ ID NO: 733500 - DNA, 20 bp, mouse
gtgactggggaagacgctga

SEQ ID NO: 733501 - DNA, 20 bp, mouse
gagcagcgacgcctcctcag

SEQ ID NO: 733502 - DNA, 20 bp, mouse
gacaaactagagaacctaga

SEQ ID NO: 733503 - DNA, 20 bp, mouse
gtatgtcaggagataactgt

SEQ ID NO: 733504 - DNA, 20 bp, mouse
gagaaacactgcttaggtga

SEQ ID NO: 733505 - DNA, 20 bp, mouse
gtaccacttacatactagac

SEQ ID NO: 733506 - DNA, 20 bp, mouse
gtaagcagaggtagagaaaa

SEQ ID NO: 733507 - DNA, 20 bp, mouse
gagaggtagagaaaacggag

SEQ ID NO: 733508 - DNA, 20 bp, mouse
gaacaggaagtctgagcaaa

SEQ ID NO: 733509 - DNA, 20 bp, mouse
gggattgctgctgtaagcag

SEQ ID NO: 733510 - DNA, 20 bp, mouse
ggaaggcaagtgccagaaac

SEQ ID NO: 733511 - DNA, 20 bp, mouse
ggatgcttcagatgatctca

SEQ ID NO: 733512 - DNA, 20 bp, mouse
ggttaagttcaggagcttca

SEQ ID NO: 733513 - DNA, 20 bp, mouse
ggatgctcctcagttggttg

SEQ ID NO: 733514 - DNA, 20 bp, mouse
gtgaccacgaacccgtgcca

SEQ ID NO: 733515 - DNA, 20 bp, mouse
gtctcagggtccaatgtaac

SEQ ID NO: 733516 - DNA, 20 bp, mouse
gagtctgagtcacttgacaa

SEQ ID NO: 733517 - DNA, 20 bp, mouse
gttacaggggtggtaatgaa

SEQ ID NO: 733518 - DNA, 20 bp, mouse
ggtcacactggggatatcag

SEQ ID NO: 733519 - DNA, 20 bp, mouse
ggaaaaccccaatgagtgaa

SEQ ID NO: 733520 - DNA, 20 bp, mouse
gtcgggttctgaaatactaa

SEQ ID NO: 733521 - DNA, 20 bp, mouse
gagacagtgagttacagggg

SEQ ID NO: 733522 - DNA, 20 bp, mouse
gtctgaggaatggtatttcc

SEQ ID NO: 733523 - DNA, 20 bp, mouse
ggtaatgaaggggtcacact

SEQ ID NO: 733524 - DNA, 20 bp, mouse
gcctttaaaagcaggaattc

SEQ ID NO: 733525 - DNA, 20 bp, mouse
ggatagacagtgagttacag

SEQ ID NO: 733526 - DNA, 20 bp, mouse
ggccactgggtcagcacagg

SEQ ID NO: 733527 - DNA, 20 bp, mouse
gtgcaagccaaagaatggtg

SEQ ID NO: 733528 - DNA, 20 bp, mouse
gagccaaagaatggtgagga

SEQ ID NO: 733529 - DNA, 20 bp, mouse
gtgacccagtggcattgccc

SEQ ID NO: 733530 - DNA, 20 bp, mouse
ggcttgcagcaggtggcgac

SEQ ID NO: 733531 - DNA, 20 bp, mouse
gagagtatgcacatcctccc

SEQ ID NO: 733532 - DNA, 20 bp, mouse
gatccgtcctcaccattctt

SEQ ID NO: 733533 - DNA, 20 bp, mouse
ggcatctctgagctctgtgg

SEQ ID NO: 733534 - DNA, 20 bp, mouse
gcgtctcagaagaacctcga

SEQ ID NO: 733535 - DNA, 20 bp, mouse
gaatgtctgccatccgtgcg

SEQ ID NO: 733536 - DNA, 20 bp, mouse
gtggcagcctgtgacaggta

SEQ ID NO: 733537 - DNA, 20 bp, mouse
gcctccgccctacctgtcac

SEQ ID NO: 733538 - DNA, 20 bp, mouse
gcgcagacggagacggctag

SEQ ID NO: 733539 - DNA, 20 bp, mouse
ggggctgggccgtacctgtg

SEQ ID NO: 733540 - DNA, 20 bp, mouse
ggcgcggaggaacttgtcac

SEQ ID NO: 733541 - DNA, 20 bp, mouse
gccaggtgacccatctccgc

SEQ ID NO: 733542 - DNA, 20 bp, mouse
gcccagcccaccggtacctg

SEQ ID NO: 733543 - DNA, 20 bp, mouse
gtgcggtccccaagccgggg

SEQ ID NO: 733544 - DNA, 20 bp, mouse
gccgcgcgcgcagacggaga

SEQ ID NO: 733545 - DNA, 20 bp, mouse
gtacgtggctgcaacttctt

SEQ ID NO: 733546 - DNA, 20 bp, mouse
gccacatggtccgccctctg

SEQ ID NO: 733547 - DNA, 20 bp, mouse
gggtcacgtgccgtctcccg

SEQ ID NO: 733548 - DNA, 20 bp, mouse
gaccgcccgccaaagtttct

SEQ ID NO: 733549 - DNA, 20 bp, mouse
gtctacttgagccaccaagc

SEQ ID NO: 733550 - DNA, 20 bp, mouse
ggggccgttcccgcacgcac

SEQ ID NO: 733551 - DNA, 20 bp, mouse
gcagcgaagtccaccccaga

SEQ ID NO: 733552 - DNA, 20 bp, mouse
gaaactttggcgggcggtgt

SEQ ID NO: 733553 - DNA, 20 bp, mouse
gtggcgggcggtgttggcgc

SEQ ID NO: 733554 - DNA, 20 bp, mouse
gtgtccctgacacccagtac

SEQ ID NO: 733555 - DNA, 20 bp, mouse
gcgaagtccaccccagaggg

SEQ ID NO: 733556 - DNA, 20 bp, mouse
gggagggcgttcagaagttg

SEQ ID NO: 733557 - DNA, 20 bp, mouse
gtgaatggtaagctcttcta

SEQ ID NO: 733558 - DNA, 20 bp, mouse
ggggcgttcagaagttgagg

SEQ ID NO: 733559 - DNA, 20 bp, mouse
gccaataagaagacataaca

SEQ ID NO: 733560 - DNA, 20 bp, mouse
gacgccctccgctgtcagtg

SEQ ID NO: 733561 - DNA, 20 bp, mouse
gctaccagtgggtagcagag

SEQ ID NO: 733562 - DNA, 20 bp, mouse
gtggctgagaaacgtctggc

SEQ ID NO: 733563 - DNA, 20 bp, mouse
ggcgccactctgctacccac

SEQ ID NO: 733564 - DNA, 20 bp, mouse
ggcgcgggacggagtgaggc

SEQ ID NO: 733565 - DNA, 20 bp, mouse
gtttccccactgacagcgga

SEQ ID NO: 733566 - DNA, 20 bp, mouse
gtaggcgggtgagacgaaag

SEQ ID NO: 733567 - DNA, 20 bp, mouse
gaggtgcagggccacgtgac

SEQ ID NO: 733568 - DNA, 20 bp, mouse
gcgcgcgccggggaggtgca

SEQ ID NO: 733569 - DNA, 20 bp, mouse
ggtcgggccagttctctcac

SEQ ID NO: 733570 - DNA, 20 bp, mouse
gtcgtctcacccgcctactg

SEQ ID NO: 733571 - DNA, 20 bp, mouse
ggcgggtgagacgaaagggg

SEQ ID NO: 733572 - DNA, 20 bp, mouse
ggcccgcccccgcatcacgt

SEQ ID NO: 733573 - DNA, 20 bp, mouse
gtcacgtgggcgatccacct

SEQ ID NO: 733574 - DNA, 20 bp, mouse
ggatcgcccacgtgatgcgg

SEQ ID NO: 733575 - DNA, 20 bp, mouse
gcctactgggggttgggcct

SEQ ID NO: 733576 - DNA, 20 bp, mouse
gcgcgcgtcagggaatccta

SEQ ID NO: 733577 - DNA, 20 bp, mouse
gggctggagtcggaccaaac

SEQ ID NO: 733578 - DNA, 20 bp, mouse
gtgcacgtgggccagagcgt

SEQ ID NO: 733579 - DNA, 20 bp, mouse
gcgccagcggctacgctcta

SEQ ID NO: 733580 - DNA, 20 bp, mouse
ggggccgcctccacccattc

SEQ ID NO: 733581 - DNA, 20 bp, mouse
gtgcctctctagctcgccag

SEQ ID NO: 733582 - DNA, 20 bp, mouse
ggccaccgagtgaaattctg

SEQ ID NO: 733583 - DNA, 20 bp, mouse
ggagtcggaccaaaccgggc

SEQ ID NO: 733584 - DNA, 20 bp, mouse
ggtagctagagcggccttcg

SEQ ID NO: 733585 - DNA, 20 bp, mouse
gcggccctgcgggctacggg

SEQ ID NO: 733586 - DNA, 20 bp, mouse
gcacacagggaacagtggac

SEQ ID NO: 733587 - DNA, 20 bp, mouse
ggcggcgccgtcactcaccg

SEQ ID NO: 733588 - DNA, 20 bp, mouse
ggggtctcagctgtcccact

SEQ ID NO: 733589 - DNA, 20 bp, mouse
ggggcggcgcgcgattggca

SEQ ID NO: 733590 - DNA, 20 bp, mouse
gccgagcctgacatccagac

SEQ ID NO: 733591 - DNA, 20 bp, mouse
ggggacagctgagaccccgc

SEQ ID NO: 733592 - DNA, 20 bp, mouse
gctgctcccgggcggtcaga

SEQ ID NO: 733593 - DNA, 20 bp, mouse
ggcgtagcactctggggcgg

SEQ ID NO: 733594 - DNA, 20 bp, mouse
gcccccgcgcgtagcactct

SEQ ID NO: 733595 - DNA, 20 bp, mouse
gcgcgcgtagcactctgggg

SEQ ID NO: 733596 - DNA, 20 bp, mouse
ggtaagtgagcacacagtta

SEQ ID NO: 733597 - DNA, 20 bp, mouse
gtattcggattgattgcatg

SEQ ID NO: 733598 - DNA, 20 bp, mouse
gaaagtctttcctaagcagt

SEQ ID NO: 733599 - DNA, 20 bp, mouse
gataacttatactatataga

SEQ ID NO: 733600 - DNA, 20 bp, mouse
gatatagtataagttattgt

SEQ ID NO: 733601 - DNA, 20 bp, mouse
gctttcctagtctagttgtg

SEQ ID NO: 733602 - DNA, 20 bp, mouse
gatggtagatgcaaatacaa

SEQ ID NO: 733603 - DNA, 20 bp, mouse
ggccaaggtcaagttaagtt

SEQ ID NO: 733604 - DNA, 20 bp, mouse
gagcacctcacaactagact

SEQ ID NO: 733605 - DNA, 20 bp, mouse
gtccaaacttaacttgacct

SEQ ID NO: 733606 - DNA, 20 bp, mouse
gaggtgtggcccaggtccgg

SEQ ID NO: 733607 - DNA, 20 bp, mouse
gcctcctcaacgctggactg

SEQ ID NO: 733608 - DNA, 20 bp, mouse
ggggcgctgcagagccaagt

SEQ ID NO: 733609 - DNA, 20 bp, mouse
gggcggacttagcctcactg

SEQ ID NO: 733610 - DNA, 20 bp, mouse
gaggctgcgcgatccgatgg

SEQ ID NO: 733611 - DNA, 20 bp, mouse
ggaggggcttgcatatgttg

SEQ ID NO: 733612 - DNA, 20 bp, mouse
gcgcgcgtctcgttgaacta

SEQ ID NO: 733613 - DNA, 20 bp, mouse
gcccacagacgcatctagac

SEQ ID NO: 733614 - DNA, 20 bp, mouse
gacgctggactggggctcag

SEQ ID NO: 733615 - DNA, 20 bp, mouse
gttaaagccacgccccagtg

SEQ ID NO: 733616 - DNA, 20 bp, mouse
gtggggccgggccaagcaca

SEQ ID NO: 733617 - DNA, 20 bp, mouse
gcagccgagggccccctccg

SEQ ID NO: 733618 - DNA, 20 bp, mouse
gtggcggcggcagacacttg

SEQ ID NO: 733619 - DNA, 20 bp, mouse
gaccctcagctcccggtctg

SEQ ID NO: 733620 - DNA, 20 bp, mouse
ggccacagaccgggagctga

SEQ ID NO: 733621 - DNA, 20 bp, mouse
gaactctgggaactggagcg

SEQ ID NO: 733622 - DNA, 20 bp, mouse
gacaactgctggtgtcaacc

SEQ ID NO: 733623 - DNA, 20 bp, mouse
gcgttccaggagaaacttgg

SEQ ID NO: 733624 - DNA, 20 bp, mouse
ggtgccgccctgacccgcct

SEQ ID NO: 733625 - DNA, 20 bp, mouse
ggctgccaatggcgtgtagg

SEQ ID NO: 733626 - DNA, 20 bp, mouse
gaccctgccggggacacaga

SEQ ID NO: 733627 - DNA, 20 bp, mouse
gaagcctggcatggctaaga

SEQ ID NO: 733628 - DNA, 20 bp, mouse
gtgccgcggggacttcccct

SEQ ID NO: 733629 - DNA, 20 bp, mouse
gtggatccgcagccagaatt

SEQ ID NO: 733630 - DNA, 20 bp, mouse
gaagtcccgcccccgaaacg

SEQ ID NO: 733631 - DNA, 20 bp, mouse
gcatgccaggcttcgaccta

SEQ ID NO: 733632 - DNA, 20 bp, mouse
gtagtagtaggcggagtctc

SEQ ID NO: 733633 - DNA, 20 bp, mouse
gccgctgcgcagctcaaccc

SEQ ID NO: 733634 - DNA, 20 bp, mouse
ggcgggacttccgtagtagt

SEQ ID NO: 733635 - DNA, 20 bp, mouse
gagcgggtgcgcggggaatg

SEQ ID NO: 733636 - DNA, 20 bp, mouse
gtcccctgctacagccgagg

SEQ ID NO: 733637 - DNA, 20 bp, mouse
gactcaccccggctgcgaaa

SEQ ID NO: 733638 - DNA, 20 bp, mouse
ggaggcggctccctgagggt

SEQ ID NO: 733639 - DNA, 20 bp, mouse
gcagccgaggcggctccctg

SEQ ID NO: 733640 - DNA, 20 bp, mouse
gtggcgactaggaggcggaa

SEQ ID NO: 733641 - DNA, 20 bp, mouse
gtcctcccctgctacagccg

SEQ ID NO: 733642 - DNA, 20 bp, mouse
gaagggcaggttctccttcc

SEQ ID NO: 733643 - DNA, 20 bp, mouse
gaggggagtaaagcggtgat

SEQ ID NO: 733644 - DNA, 20 bp, mouse
gtgcgtccggcgcaccggaa

SEQ ID NO: 733645 - DNA, 20 bp, mouse
ggagccgcctcggctgtagc

SEQ ID NO: 733646 - DNA, 20 bp, mouse
gcaaggaaaagtgtattcgc

SEQ ID NO: 733647 - DNA, 20 bp, mouse
gtggacgaatgaaaaaccgg

SEQ ID NO: 733648 - DNA, 20 bp, mouse
gggggagaaagaattgcgga

SEQ ID NO: 733649 - DNA, 20 bp, mouse
ggaccccgcctctagatcac

SEQ ID NO: 733650 - DNA, 20 bp, mouse
gaaagtgtattcgcaggaca

SEQ ID NO: 733651 - DNA, 20 bp, mouse
ggaacttcctgttttgaaag

SEQ ID NO: 733652 - DNA, 20 bp, mouse
gagttggacgaatgaaaaac

SEQ ID NO: 733653 - DNA, 20 bp, mouse
gactggaccaatcaaaagat

SEQ ID NO: 733654 - DNA, 20 bp, mouse
gtcccaggaaaaccacaaac

SEQ ID NO: 733655 - DNA, 20 bp, mouse
gtgttttgaaaggggagcgg

SEQ ID NO: 733656 - DNA, 20 bp, mouse
gtggccgcgcagtgattcgg

SEQ ID NO: 733657 - DNA, 20 bp, mouse
ggcaaggtgattggtcagac

SEQ ID NO: 733658 - DNA, 20 bp, mouse
gtaagatggggcactctgac

SEQ ID NO: 733659 - DNA, 20 bp, mouse
ggcagacggactaactaatc

SEQ ID NO: 733660 - DNA, 20 bp, mouse
gcggaccttaacttgaatct

SEQ ID NO: 733661 - DNA, 20 bp, mouse
gccaaatccgggtaattaat

SEQ ID NO: 733662 - DNA, 20 bp, mouse
gttaagatggcgaatggagg

SEQ ID NO: 733663 - DNA, 20 bp, mouse
ggagggcgtcgcaaggtgat

SEQ ID NO: 733664 - DNA, 20 bp, mouse
gcaggcgctaatccgcgtcc

SEQ ID NO: 733665 - DNA, 20 bp, mouse
ggctagcgaagagtaaaagc

SEQ ID NO: 733666 - DNA, 20 bp, mouse
gtgaaggcggggttttaatg

SEQ ID NO: 733667 - DNA, 20 bp, mouse
gctcaaccgccggcgtccga

SEQ ID NO: 733668 - DNA, 20 bp, mouse
gggcggttgagcatcgatcg

SEQ ID NO: 733669 - DNA, 20 bp, mouse
gcagactggaggtgtaagcc

SEQ ID NO: 733670 - DNA, 20 bp, mouse
gaggcgccccggcccagcat

SEQ ID NO: 733671 - DNA, 20 bp, mouse
gagtctgagcgaagacgtga

SEQ ID NO: 733672 - DNA, 20 bp, mouse
gtccgtgcagcgttattcgg

SEQ ID NO: 733673 - DNA, 20 bp, mouse
ggtccgagggctcggttctt

SEQ ID NO: 733674 - DNA, 20 bp, mouse
gaccggaccagcccttacaa

SEQ ID NO: 733675 - DNA, 20 bp, mouse
gagaacacggtaacttcaac

SEQ ID NO: 733676 - DNA, 20 bp, mouse
gaggacagcattggacgcag

SEQ ID NO: 733677 - DNA, 20 bp, mouse
gtgggctaggaaggcagtgg

SEQ ID NO: 733678 - DNA, 20 bp, mouse
gaggcggggctaatgctgaa

SEQ ID NO: 733679 - DNA, 20 bp, mouse
gtggggcggagagtgagatg

SEQ ID NO: 733680 - DNA, 20 bp, mouse
gcggggcaagggcttgaatt

SEQ ID NO: 733681 - DNA, 20 bp, mouse
ggggcggggcctgttctgga

SEQ ID NO: 733682 - DNA, 20 bp, mouse
gggggtgggacaaagagcgt

SEQ ID NO: 733683 - DNA, 20 bp, mouse
gggcggagcgaggacagcat

SEQ ID NO: 733684 - DNA, 20 bp, mouse
gtgggacaaagagcgtaggg

SEQ ID NO: 733685 - DNA, 20 bp, mouse
gggcgagcatggagttgggg

SEQ ID NO: 733686 - DNA, 20 bp, mouse
gaaagtgttgggagtgacgt

SEQ ID NO: 733687 - DNA, 20 bp, mouse
gcaaccctgcgtgcaggcag

SEQ ID NO: 733688 - DNA, 20 bp, mouse
gagggcatctcgatagattt

SEQ ID NO: 733689 - DNA, 20 bp, mouse
gacaggctttctgaaagtgt

SEQ ID NO: 733690 - DNA, 20 bp, mouse
gcggaagcaattcaggaagt

SEQ ID NO: 733691 - DNA, 20 bp, mouse
gtggcattggagcctcagtg

SEQ ID NO: 733692 - DNA, 20 bp, mouse
ggtgttgggagtgacgtagg

SEQ ID NO: 733693 - DNA, 20 bp, mouse
gggtaatccaaactctccca

SEQ ID NO: 733694 - DNA, 20 bp, mouse
gggtcaacaaccctgcgtgc

SEQ ID NO: 733695 - DNA, 20 bp, mouse
gaaatgaacgagagctggag

SEQ ID NO: 733696 - DNA, 20 bp, mouse
gccggggcgggcccataatt

SEQ ID NO: 733697 - DNA, 20 bp, mouse
gtatgggcccgccccgggga

SEQ ID NO: 733698 - DNA, 20 bp, mouse
ggggaggtggtgaagactct

SEQ ID NO: 733699 - DNA, 20 bp, mouse
gtgctggtgtgggttctggg

SEQ ID NO: 733700 - DNA, 20 bp, mouse
ggggagcaagagtgtatatc

SEQ ID NO: 733701 - DNA, 20 bp, mouse
gcacaccagcaacatcgccc

SEQ ID NO: 733702 - DNA, 20 bp, mouse
gaggccccgcccccaattat

SEQ ID NO: 733703 - DNA, 20 bp, mouse
gggggcctgggcgatgttgc

SEQ ID NO: 733704 - DNA, 20 bp, mouse
gggtcggccgggaggtgaaa

SEQ ID NO: 733705 - DNA, 20 bp, mouse
ggggcggagactgcccaaac

SEQ ID NO: 733706 - DNA, 20 bp, mouse
gcggaggcagagatccccga

SEQ ID NO: 733707 - DNA, 20 bp, mouse
gcgcaatggcacctcgactc

SEQ ID NO: 733708 - DNA, 20 bp, mouse
gggcagagatccccgaagga

SEQ ID NO: 733709 - DNA, 20 bp, mouse
gacgccctgatcacccgcaa

SEQ ID NO: 733710 - DNA, 20 bp, mouse
ggtacccctaggggaggtaa

SEQ ID NO: 733711 - DNA, 20 bp, mouse
gtttgtgcgacgaggggcgg

SEQ ID NO: 733712 - DNA, 20 bp, mouse
gtcctccagcccctccttcg

SEQ ID NO: 733713 - DNA, 20 bp, mouse
ggtgccattgcgggtgatca

SEQ ID NO: 733714 - DNA, 20 bp, mouse
gagggcctttgtgcgacgag

SEQ ID NO: 733715 - DNA, 20 bp, mouse
ggaggtaatgggagactaag

SEQ ID NO: 733716 - DNA, 20 bp, mouse
ggaacagagcgtagtgccaa

SEQ ID NO: 733717 - DNA, 20 bp, mouse
gagcctgagtggcgtctcat

SEQ ID NO: 733718 - DNA, 20 bp, mouse
ggaaaccaggagaaactcga

SEQ ID NO: 733719 - DNA, 20 bp, mouse
gtggggtcctggagtccata

SEQ ID NO: 733720 - DNA, 20 bp, mouse
gtgggcggggtctactggaa

SEQ ID NO: 733721 - DNA, 20 bp, mouse
gcccccatgagacgccactc

SEQ ID NO: 733722 - DNA, 20 bp, mouse
gagggagcggggtagtgggc

SEQ ID NO: 733723 - DNA, 20 bp, mouse
gcgacacagggtacagcgga

SEQ ID NO: 733724 - DNA, 20 bp, mouse
gggctctggaagagctggtt

SEQ ID NO: 733725 - DNA, 20 bp, mouse
gagcagatgagcagatggtg

SEQ ID NO: 733726 - DNA, 20 bp, mouse
gctgtggtgggatgcgggga

SEQ ID NO: 733727 - DNA, 20 bp, mouse
gggcctggatcctgctgtgg

SEQ ID NO: 733728 - DNA, 20 bp, mouse
gctcacaggcccaaggccaa

SEQ ID NO: 733729 - DNA, 20 bp, mouse
gagggccacgccccgtatag

SEQ ID NO: 733730 - DNA, 20 bp, mouse
ggccacgccccgtatagagg

SEQ ID NO: 733731 - DNA, 20 bp, mouse
gcgtagggcgtgcgtactga

SEQ ID NO: 733732 - DNA, 20 bp, mouse
ggaaacaggcctttggcctt

SEQ ID NO: 733733 - DNA, 20 bp, mouse
gatgcggggaggggtgggac

SEQ ID NO: 733734 - DNA, 20 bp, mouse
gcctgctgtggtgggatgcg

SEQ ID NO: 733735 - DNA, 20 bp, mouse
gagaacgtgtctttatttgg

SEQ ID NO: 733736 - DNA, 20 bp, mouse
gggaatctgtctgagaacac

SEQ ID NO: 733737 - DNA, 20 bp, mouse
ggctttcaagctcctggagc

SEQ ID NO: 733738 - DNA, 20 bp, mouse
gaggagtaatctctgtttag

SEQ ID NO: 733739 - DNA, 20 bp, mouse
gtcttaggaacacccactga

SEQ ID NO: 733740 - DNA, 20 bp, mouse
gctgacaaatgttcctccag

SEQ ID NO: 733741 - DNA, 20 bp, mouse
gagggcttcgttgctattcc

SEQ ID NO: 733742 - DNA, 20 bp, mouse
gaaacagagattactcctga

SEQ ID NO: 733743 - DNA, 20 bp, mouse
gccagaggttaataagataa

SEQ ID NO: 733744 - DNA, 20 bp, mouse
gttacactgacacggagcac

SEQ ID NO: 733745 - DNA, 20 bp, mouse
gagattcccttctcacttac

SEQ ID NO: 733746 - DNA, 20 bp, mouse
gtggaggaaaaccacatgtg

SEQ ID NO: 733747 - DNA, 20 bp, mouse
gtgactcagtgggtcaaatg

SEQ ID NO: 733748 - DNA, 20 bp, mouse
gaggcagagcctaaagtgcc

SEQ ID NO: 733749 - DNA, 20 bp, mouse
gctaaagtgcccggttccct

SEQ ID NO: 733750 - DNA, 20 bp, mouse
ggctggttaaagagaggcga

SEQ ID NO: 733751 - DNA, 20 bp, mouse
gtagtcctaggagaacacag

SEQ ID NO: 733752 - DNA, 20 bp, mouse
ggtgttctcctaggactaag

SEQ ID NO: 733753 - DNA, 20 bp, mouse
gtaaactgctggttaaagag

SEQ ID NO: 733754 - DNA, 20 bp, mouse
gcccactgagtcagaacatc

SEQ ID NO: 733755 - DNA, 20 bp, mouse
gaagcagtgtgcctcacatg

SEQ ID NO: 733756 - DNA, 20 bp, mouse
gggtacaggcgcagcggaca

SEQ ID NO: 733757 - DNA, 20 bp, mouse
gtcttggggtacaggcgcag

SEQ ID NO: 733758 - DNA, 20 bp, mouse
gtgccttgggaatgaccgga

SEQ ID NO: 733759 - DNA, 20 bp, mouse
gaatctgccttgggaatgac

SEQ ID NO: 733760 - DNA, 20 bp, mouse
gcagctgcgcgccaccgtcc

SEQ ID NO: 733761 - DNA, 20 bp, mouse
gcagcggacagggacggccc

SEQ ID NO: 733762 - DNA, 20 bp, mouse
gcaggcgcagcggacaggga

SEQ ID NO: 733763 - DNA, 20 bp, mouse
gggaacagggccttaccctt

SEQ ID NO: 733764 - DNA, 20 bp, mouse
gattcccaaggcagattctt

SEQ ID NO: 733765 - DNA, 20 bp, mouse
gtcccctccggtcattccca

SEQ ID NO: 733766 - DNA, 20 bp, mouse
gcgtcccccggacccttcac

SEQ ID NO: 733767 - DNA, 20 bp, mouse
gcgtccaggtacagagttgt

SEQ ID NO: 733768 - DNA, 20 bp, mouse
ggcgtctgcgcgcctgtgaa

SEQ ID NO: 733769 - DNA, 20 bp, mouse
gcacaggcgcgcagacgccc

SEQ ID NO: 733770 - DNA, 20 bp, mouse
gcgcgcctgtgaagggtccg

SEQ ID NO: 733771 - DNA, 20 bp, mouse
gcgagtggggcgaccagccc

SEQ ID NO: 733772 - DNA, 20 bp, mouse
ggggccgctctccacctcgc

SEQ ID NO: 733773 - DNA, 20 bp, mouse
gagggtccgggggacgagtg

SEQ ID NO: 733774 - DNA, 20 bp, mouse
gcgaacggggctcgagcccc

SEQ ID NO: 733775 - DNA, 20 bp, mouse
gcagaggggcctcgggctag

SEQ ID NO: 733776 - DNA, 20 bp, mouse
ggctcctgaggagtcgggaa

SEQ ID NO: 733777 - DNA, 20 bp, mouse
gcccctaggcgcgcctctga

SEQ ID NO: 733778 - DNA, 20 bp, mouse
gcggacgcaggaggggactt

SEQ ID NO: 733779 - DNA, 20 bp, mouse
ggaaaggcgaggtcggacgc

SEQ ID NO: 733780 - DNA, 20 bp, mouse
ggagtcgggaaaggcgaggt

SEQ ID NO: 733781 - DNA, 20 bp, mouse
ggggaaaactagcgctcctg

SEQ ID NO: 733782 - DNA, 20 bp, mouse
gggcacgcgctgtcccggga

SEQ ID NO: 733783 - DNA, 20 bp, mouse
ggcagtgcactctgacagta

SEQ ID NO: 733784 - DNA, 20 bp, mouse
gcgcaggaggggacttaggc

SEQ ID NO: 733785 - DNA, 20 bp, mouse
gtcccgggaaggagccaccc

SEQ ID NO: 733786 - DNA, 20 bp, mouse
gaatctgtgggactaggagg

SEQ ID NO: 733787 - DNA, 20 bp, mouse
gaatctacccggcgaggaag

SEQ ID NO: 733788 - DNA, 20 bp, mouse
ggccgcagcttccggaagtt

SEQ ID NO: 733789 - DNA, 20 bp, mouse
ggtcaatctgtgggactagg

SEQ ID NO: 733790 - DNA, 20 bp, mouse
gaaggcaggcttggttgggg

SEQ ID NO: 733791 - DNA, 20 bp, mouse
gcctaccgggcgaagagcgc

SEQ ID NO: 733792 - DNA, 20 bp, mouse
gggctggctcgaagataaat

SEQ ID NO: 733793 - DNA, 20 bp, mouse
ggaagctgcggcaatctacc

SEQ ID NO: 733794 - DNA, 20 bp, mouse
gcacgagtccgcttatctgc

SEQ ID NO: 733795 - DNA, 20 bp, mouse
gctgcgaaggcaggcttggt

SEQ ID NO: 733796 - DNA, 20 bp, mouse
ggggtctggcatctctgcgg

SEQ ID NO: 733797 - DNA, 20 bp, mouse
gaaaaggaatgggacattcc

SEQ ID NO: 733798 - DNA, 20 bp, mouse
gagagatgccagacccgggt

SEQ ID NO: 733799 - DNA, 20 bp, mouse
gtgggcgggaactgacagtg

SEQ ID NO: 733800 - DNA, 20 bp, mouse
ggtgcggccccacccggcgg

SEQ ID NO: 733801 - DNA, 20 bp, mouse
gccagcgtaggggagagata

SEQ ID NO: 733802 - DNA, 20 bp, mouse
ggaactgacagtgaggtcgg

SEQ ID NO: 733803 - DNA, 20 bp, mouse
gagccctgcccacccgggtc

SEQ ID NO: 733804 - DNA, 20 bp, mouse
gccaccagatggccagcgta

SEQ ID NO: 733805 - DNA, 20 bp, mouse
gtgccagacccgggtgggca

SEQ ID NO: 733806 - DNA, 20 bp, mouse
gaggaagtgtgcagagtcaa

SEQ ID NO: 733807 - DNA, 20 bp, mouse
gacctcggggtcttcacgac

SEQ ID NO: 733808 - DNA, 20 bp, mouse
gtgtggggaggccatgtggg

SEQ ID NO: 733809 - DNA, 20 bp, mouse
gtcctccagggtgcaagcct

SEQ ID NO: 733810 - DNA, 20 bp, mouse
gaggactgaggcgtgccaca

SEQ ID NO: 733811 - DNA, 20 bp, mouse
gatggaaacaaggcaaaggg

SEQ ID NO: 733812 - DNA, 20 bp, mouse
ggtgaagaccccgaggtctt

SEQ ID NO: 733813 - DNA, 20 bp, mouse
gggtcggggccgccctttga

SEQ ID NO: 733814 - DNA, 20 bp, mouse
gcggccccgaccaagccccc

SEQ ID NO: 733815 - DNA, 20 bp, mouse
gagagatggaaacaaggcaa

SEQ ID NO: 733816 - DNA, 20 bp, mouse
gcgcgcagagccagcgacgg

SEQ ID NO: 733817 - DNA, 20 bp, mouse
gccaacccaaggccagagga

SEQ ID NO: 733818 - DNA, 20 bp, mouse
gagcgacaggagccaaccca

SEQ ID NO: 733819 - DNA, 20 bp, mouse
gggcccgccccagcagcgac

SEQ ID NO: 733820 - DNA, 20 bp, mouse
ggtgctacagagtcattggg

SEQ ID NO: 733821 - DNA, 20 bp, mouse
gtgtgagtcgacgacgctga

SEQ ID NO: 733822 - DNA, 20 bp, mouse
gcgcgcttcctgagtctcgt

SEQ ID NO: 733823 - DNA, 20 bp, mouse
gcagcgcgcagagccagcga

SEQ ID NO: 733824 - DNA, 20 bp, mouse
gtagagggccgggcggagag

SEQ ID NO: 733825 - DNA, 20 bp, mouse
gccgcccggccctctaccag

SEQ ID NO: 733826 - DNA, 20 bp, mouse
gccccggcccgggacggtga

SEQ ID NO: 733827 - DNA, 20 bp, mouse
gagggtcgccgaggggacag

SEQ ID NO: 733828 - DNA, 20 bp, mouse
gtcgcctgggcaggggagac

SEQ ID NO: 733829 - DNA, 20 bp, mouse
gaggggcgtgaatgcggtgg

SEQ ID NO: 733830 - DNA, 20 bp, mouse
gtggcctgtcattgtcgctg

SEQ ID NO: 733831 - DNA, 20 bp, mouse
gggcccccagcgacaatgac

SEQ ID NO: 733832 - DNA, 20 bp, mouse
ggtgaggggcgtgaatgcgg

SEQ ID NO: 733833 - DNA, 20 bp, mouse
gtccgggaggaggggtggcg

SEQ ID NO: 733834 - DNA, 20 bp, mouse
ggtaagagtcgcaaggggat

SEQ ID NO: 733835 - DNA, 20 bp, mouse
gtcacgcccctcaccgtccc

SEQ ID NO: 733836 - DNA, 20 bp, mouse
ggagactccgacaggcacgg

SEQ ID NO: 733837 - DNA, 20 bp, mouse
ggactccccagacactaccg

SEQ ID NO: 733838 - DNA, 20 bp, mouse
gagtgtctggggagtccccg

SEQ ID NO: 733839 - DNA, 20 bp, mouse
gagaatgcgaactcttcggt

SEQ ID NO: 733840 - DNA, 20 bp, mouse
ggtagcgaggggcttgtcac

SEQ ID NO: 733841 - DNA, 20 bp, mouse
gacgctggctgtcccccccg

SEQ ID NO: 733842 - DNA, 20 bp, mouse
ggacagaccaatcgcccggg

SEQ ID NO: 733843 - DNA, 20 bp, mouse
gccctcttaaagggaccgca

SEQ ID NO: 733844 - DNA, 20 bp, mouse
ggggcagccccggtagtgtc

SEQ ID NO: 733845 - DNA, 20 bp, mouse
gcgggagaatgcgaactctt

SEQ ID NO: 733846 - DNA, 20 bp, mouse
gcggccggtgcggatctccg

SEQ ID NO: 733847 - DNA, 20 bp, mouse
gataccgcggagatccgcac

SEQ ID NO: 733848 - DNA, 20 bp, mouse
gcgagcgtggccattagtga

SEQ ID NO: 733849 - DNA, 20 bp, mouse
gtgccgcccgccgttgctat

SEQ ID NO: 733850 - DNA, 20 bp, mouse
gagcagcacccgctcgactc

SEQ ID NO: 733851 - DNA, 20 bp, mouse
ggctagcggaggcgccatat

SEQ ID NO: 733852 - DNA, 20 bp, mouse
gttcgtccccgcaacagtca

SEQ ID NO: 733853 - DNA, 20 bp, mouse
gcaagagacaccctcactaa

SEQ ID NO: 733854 - DNA, 20 bp, mouse
gagacagccaatagcaacgg

SEQ ID NO: 733855 - DNA, 20 bp, mouse
gatcgcggccctgactgttg

SEQ ID NO: 733856 - DNA, 20 bp, mouse
ggctgtagatgaccgtgaat

SEQ ID NO: 733857 - DNA, 20 bp, mouse
gctgcctcggatacatccgc

SEQ ID NO: 733858 - DNA, 20 bp, mouse
gttagtaagggcggaagttc

SEQ ID NO: 733859 - DNA, 20 bp, mouse
gaagggcggaagttcaggta

SEQ ID NO: 733860 - DNA, 20 bp, mouse
gattgccgccttattaaggg

SEQ ID NO: 733861 - DNA, 20 bp, mouse
ggaagtgactgatacacgac

SEQ ID NO: 733862 - DNA, 20 bp, mouse
gttaagtagaatagtctcgg

SEQ ID NO: 733863 - DNA, 20 bp, mouse
gtggagttcgagaacagcga

SEQ ID NO: 733864 - DNA, 20 bp, mouse
gcttactaaactatctgcct

SEQ ID NO: 733865 - DNA, 20 bp, mouse
gtttccggcggatgtatccg

SEQ ID NO: 733866 - DNA, 20 bp, mouse
gcaagcggagtcccctgcca

SEQ ID NO: 733867 - DNA, 20 bp, mouse
gtgccctgagggaacgcgga

SEQ ID NO: 733868 - DNA, 20 bp, mouse
gagtgggcggggcaactcag

SEQ ID NO: 733869 - DNA, 20 bp, mouse
gcaactcaggggccacccct

SEQ ID NO: 733870 - DNA, 20 bp, mouse
ggcccatccgcgttccctca

SEQ ID NO: 733871 - DNA, 20 bp, mouse
gcctgccagggcttggaatc

SEQ ID NO: 733872 - DNA, 20 bp, mouse
gcgggaagagcggcaggtgt

SEQ ID NO: 733873 - DNA, 20 bp, mouse
gacagccggccggaagccta

SEQ ID NO: 733874 - DNA, 20 bp, mouse
gcgctgtggggcttgccctg

SEQ ID NO: 733875 - DNA, 20 bp, mouse
gcggaaggagaccccctcac

SEQ ID NO: 733876 - DNA, 20 bp, mouse
gaggggcgactgggactgtg

SEQ ID NO: 733877 - DNA, 20 bp, mouse
ggactgggactgtggggcgt

SEQ ID NO: 733878 - DNA, 20 bp, mouse
gtctctgacgcagatgtctg

SEQ ID NO: 733879 - DNA, 20 bp, mouse
gggggagactggggtgagaa

SEQ ID NO: 733880 - DNA, 20 bp, mouse
ggggaggtcctagacagaaa

SEQ ID NO: 733881 - DNA, 20 bp, mouse
gcatctgcgtcagagatagg

SEQ ID NO: 733882 - DNA, 20 bp, mouse
gccactcccgccaagaatgt

SEQ ID NO: 733883 - DNA, 20 bp, mouse
gtcccagtcgcccctgccca

SEQ ID NO: 733884 - DNA, 20 bp, mouse
ggccatgggcaggggcgact

SEQ ID NO: 733885 - DNA, 20 bp, mouse
ggaaggccagcagtgggatg

SEQ ID NO: 733886 - DNA, 20 bp, mouse
ggagggctggggctttgttt

SEQ ID NO: 733887 - DNA, 20 bp, mouse
gcctgagccagtaaagcctg

SEQ ID NO: 733888 - DNA, 20 bp, mouse
gctggctcaggacatcaccc

SEQ ID NO: 733889 - DNA, 20 bp, mouse
gggcttctgagacaggacct

SEQ ID NO: 733890 - DNA, 20 bp, mouse
gtcctagccacaggctttac

SEQ ID NO: 733891 - DNA, 20 bp, mouse
gtgtcaaagctggacactct

SEQ ID NO: 733892 - DNA, 20 bp, mouse
gtcttggagatgtgtgtatg

SEQ ID NO: 733893 - DNA, 20 bp, mouse
gtgaacctgaatctaataag

SEQ ID NO: 733894 - DNA, 20 bp, mouse
gacctctcaaagaggagggc

SEQ ID NO: 733895 - DNA, 20 bp, mouse
gtagttgtacactcacacat

SEQ ID NO: 733896 - DNA, 20 bp, mouse
gcagaaagggaaagagcgga

SEQ ID NO: 733897 - DNA, 20 bp, mouse
gcccccgggacgcccgagta

SEQ ID NO: 733898 - DNA, 20 bp, mouse
gcctccctactcgggcgtcc

SEQ ID NO: 733899 - DNA, 20 bp, mouse
gcctcctcgccaaggcagaa

SEQ ID NO: 733900 - DNA, 20 bp, mouse
gggtccgcgcctccctactc

SEQ ID NO: 733901 - DNA, 20 bp, mouse
gacgcccgagtagggaggcg

SEQ ID NO: 733902 - DNA, 20 bp, mouse
ggccccatggggcgagggtc

SEQ ID NO: 733903 - DNA, 20 bp, mouse
gccatggggcgatggataaa

SEQ ID NO: 733904 - DNA, 20 bp, mouse
gctgcccctagagccttcaa

SEQ ID NO: 733905 - DNA, 20 bp, mouse
gagggtctggagcactcacg

SEQ ID NO: 733906 - DNA, 20 bp, mouse
ggccagtgaaagtacagagg

SEQ ID NO: 733907 - DNA, 20 bp, mouse
gtgagcagcggttacttcag

SEQ ID NO: 733908 - DNA, 20 bp, mouse
gtctgcctcttgcttctgtt

SEQ ID NO: 733909 - DNA, 20 bp, mouse
gcaaatgagctgccagacca

SEQ ID NO: 733910 - DNA, 20 bp, mouse
gaccccctctgtactttcac

SEQ ID NO: 733911 - DNA, 20 bp, mouse
gtcccccaggcttcacagca

SEQ ID NO: 733912 - DNA, 20 bp, mouse
ggcggttacttcaggggcta

SEQ ID NO: 733913 - DNA, 20 bp, mouse
gactaccgtgtccagttaag

SEQ ID NO: 733914 - DNA, 20 bp, mouse
gggctctaacctttgtcccc

SEQ ID NO: 733915 - DNA, 20 bp, mouse
gtggataatcaccagaagtc

SEQ ID NO: 733916 - DNA, 20 bp, mouse
gggtgaaactcgagtcccgg

SEQ ID NO: 733917 - DNA, 20 bp, mouse
ggactcgagtttcaccatct

SEQ ID NO: 733918 - DNA, 20 bp, mouse
gtgcccatcaggcccctgca

SEQ ID NO: 733919 - DNA, 20 bp, mouse
ggtgtggtggcttgaggtag

SEQ ID NO: 733920 - DNA, 20 bp, mouse
ggacctaccctctgaacctt

SEQ ID NO: 733921 - DNA, 20 bp, mouse
gcacctgaatcccagacctt

SEQ ID NO: 733922 - DNA, 20 bp, mouse
gcatgcatgatgcaagaaag

SEQ ID NO: 733923 - DNA, 20 bp, mouse
gttcacacggtcagttccca

SEQ ID NO: 733924 - DNA, 20 bp, mouse
gggagccctccaccccctgc

SEQ ID NO: 733925 - DNA, 20 bp, mouse
ggccagctgcgctgcccatc

SEQ ID NO: 733926 - DNA, 20 bp, mouse
gcgaagaatgacagtcgaag

SEQ ID NO: 733927 - DNA, 20 bp, mouse
gggctccgcccccaattgta

SEQ ID NO: 733928 - DNA, 20 bp, mouse
gcgactgtcattcttcggaa

SEQ ID NO: 733929 - DNA, 20 bp, mouse
ggatgcaggccgtacaattg

SEQ ID NO: 733930 - DNA, 20 bp, mouse
ggagccaaacgctgattggc

SEQ ID NO: 733931 - DNA, 20 bp, mouse
gcaggccgtacaattggggg

SEQ ID NO: 733932 - DNA, 20 bp, mouse
gcgtagtttaagcgtttctt

SEQ ID NO: 733933 - DNA, 20 bp, mouse
gcacttcagtagagcttcag

SEQ ID NO: 733934 - DNA, 20 bp, mouse
gtccagggggcccgtcagtc

SEQ ID NO: 733935 - DNA, 20 bp, mouse
gaggaggcggaagttggtgc

SEQ ID NO: 733936 - DNA, 20 bp, mouse
ggtccacatgccaccctaga

SEQ ID NO: 733937 - DNA, 20 bp, mouse
ggccagggatgagagcttca

SEQ ID NO: 733938 - DNA, 20 bp, mouse
gcatccctggccctctaggg

SEQ ID NO: 733939 - DNA, 20 bp, mouse
gagtcctgtcctgggtcact

SEQ ID NO: 733940 - DNA, 20 bp, mouse
ggccctgaagctctcatccc

SEQ ID NO: 733941 - DNA, 20 bp, mouse
gatgccaccctagagggcca

SEQ ID NO: 733942 - DNA, 20 bp, mouse
gagaatgctagattcctggc

SEQ ID NO: 733943 - DNA, 20 bp, mouse
gcttcagggcccagtgaccc

SEQ ID NO: 733944 - DNA, 20 bp, mouse
gcatgtggacaactgggatc

SEQ ID NO: 733945 - DNA, 20 bp, mouse
gtagggatgcttcactcatg

SEQ ID NO: 733946 - DNA, 20 bp, mouse
gtccgccgaccgtgccgcta

SEQ ID NO: 733947 - DNA, 20 bp, mouse
gtgcacgaggccgcccgtag

SEQ ID NO: 733948 - DNA, 20 bp, mouse
gcccgtagcggcacggtcgg

SEQ ID NO: 733949 - DNA, 20 bp, mouse
gcgggctagcgactagcagt

SEQ ID NO: 733950 - DNA, 20 bp, mouse
gccgcccgtagcggcacggt

SEQ ID NO: 733951 - DNA, 20 bp, mouse
gcgcgcggaccggggttctg

SEQ ID NO: 733952 - DNA, 20 bp, mouse
ggaagattgccgaaaggcga

SEQ ID NO: 733953 - DNA, 20 bp, mouse
gtctgagtgcagattggtcg

SEQ ID NO: 733954 - DNA, 20 bp, mouse
gcactcagatagtatagatg

SEQ ID NO: 733955 - DNA, 20 bp, mouse
gcgacgccccgcgcggaccg

SEQ ID NO: 733956 - DNA, 20 bp, mouse
gtaagtctggtgcgccagta

SEQ ID NO: 733957 - DNA, 20 bp, mouse
gaagggaccctgtttcttat

SEQ ID NO: 733958 - DNA, 20 bp, mouse
gtggcgcaccagacttaaaa

SEQ ID NO: 733959 - DNA, 20 bp, mouse
gcaatgccggaacttttgtt

SEQ ID NO: 733960 - DNA, 20 bp, mouse
gagagaaagggagacagaac

SEQ ID NO: 733961 - DNA, 20 bp, mouse
gccggaacttttgtttggaa

SEQ ID NO: 733962 - DNA, 20 bp, mouse
gcggggcggaaaaggcatgt

SEQ ID NO: 733963 - DNA, 20 bp, mouse
gaaagttcaaagcctctagg

SEQ ID NO: 733964 - DNA, 20 bp, mouse
ggtaaggtgcctagcaatgc

SEQ ID NO: 733965 - DNA, 20 bp, mouse
gcggaatccagcaaaataac

SEQ ID NO: 733966 - DNA, 20 bp, mouse
ggggcgccttccgacccgga

SEQ ID NO: 733967 - DNA, 20 bp, mouse
gctcccgggcggctcttagg

SEQ ID NO: 733968 - DNA, 20 bp, mouse
gggctcggaagtgttccttc

SEQ ID NO: 733969 - DNA, 20 bp, mouse
gaggcgcgtgccccaggtca

SEQ ID NO: 733970 - DNA, 20 bp, mouse
gccagcagcagtcaccaggc

SEQ ID NO: 733971 - DNA, 20 bp, mouse
ggggcggctcttaggaggcg

SEQ ID NO: 733972 - DNA, 20 bp, mouse
gggaagtgttccttccgggt

SEQ ID NO: 733973 - DNA, 20 bp, mouse
gttaaccgagtcctcccggg

SEQ ID NO: 733974 - DNA, 20 bp, mouse
gaacgccagcagcagtcacc

SEQ ID NO: 733975 - DNA, 20 bp, mouse
gaggcgggcgccttccgacc

SEQ ID NO: 733976 - DNA, 20 bp, mouse
gaaccccccctccctcgcct

SEQ ID NO: 733977 - DNA, 20 bp, mouse
gtgtcagcctaggcgaggga

SEQ ID NO: 733978 - DNA, 20 bp, mouse
ggccaaggggagaagtgcac

SEQ ID NO: 733979 - DNA, 20 bp, mouse
ggcgagggagggggggttga

SEQ ID NO: 733980 - DNA, 20 bp, mouse
gctaggctgacagatcagag

SEQ ID NO: 733981 - DNA, 20 bp, mouse
ggcagtggacttagggagct

SEQ ID NO: 733982 - DNA, 20 bp, mouse
gtggctggagagtatattca

SEQ ID NO: 733983 - DNA, 20 bp, mouse
ggatctgtcagcctaggcga

SEQ ID NO: 733984 - DNA, 20 bp, mouse
gcagggtcggtgatcattaa

SEQ ID NO: 733985 - DNA, 20 bp, mouse
gtgcccgcctgcactagaag

SEQ ID NO: 733986 - DNA, 20 bp, mouse
gacaccgcccgccctcctgg

SEQ ID NO: 733987 - DNA, 20 bp, mouse
gcggcggcttcgtgaggaat

SEQ ID NO: 733988 - DNA, 20 bp, mouse
gtcctgggggaagacccgaa

SEQ ID NO: 733989 - DNA, 20 bp, mouse
gcaggtgtgggtctaaccct

SEQ ID NO: 733990 - DNA, 20 bp, mouse
ggctgcttccagtggcttcg

SEQ ID NO: 733991 - DNA, 20 bp, mouse
gagtctgggtattagagtct

SEQ ID NO: 733992 - DNA, 20 bp, mouse
gcccgcgcgcggaggacgct

SEQ ID NO: 733993 - DNA, 20 bp, mouse
gcacagaggagctggacact

SEQ ID NO: 733994 - DNA, 20 bp, mouse
gaagactgccggcgccgaac

SEQ ID NO: 733995 - DNA, 20 bp, mouse
ggcgcaaactactgtcgctc

SEQ ID NO: 733996 - DNA, 20 bp, mouse
gcgcctccccgccttcgctg

SEQ ID NO: 733997 - DNA, 20 bp, mouse
gacctggcgcaatcctcctg

SEQ ID NO: 733998 - DNA, 20 bp, mouse
gccgggacctggcagaaact

SEQ ID NO: 733999 - DNA, 20 bp, mouse
gcacccgccccgggggaaag

SEQ ID NO: 734000 - DNA, 20 bp, mouse
ggggtggcctcttgcttctg

SEQ ID NO: 734001 - DNA, 20 bp, mouse
gcaagccgccaggaaaacac

SEQ ID NO: 734002 - DNA, 20 bp, mouse
gttgcctcaaccacagttct

SEQ ID NO: 734003 - DNA, 20 bp, mouse
ggaggtcaccgcagcgaagg

SEQ ID NO: 734004 - DNA, 20 bp, mouse
ggtgacctccggtgttttcc

SEQ ID NO: 734005 - DNA, 20 bp, mouse
gacctccggtgttttcctgg

SEQ ID NO: 734006 - DNA, 20 bp, mouse
gtggaaaaactcccactcct

SEQ ID NO: 734007 - DNA, 20 bp, mouse
gctgggtgacgtcacataag

SEQ ID NO: 734008 - DNA, 20 bp, mouse
ggaagcctcagggcatgtga

SEQ ID NO: 734009 - DNA, 20 bp, mouse
ggggcggcggtcggggagtg

SEQ ID NO: 734010 - DNA, 20 bp, mouse
ggggaggtgcggcttcctag

SEQ ID NO: 734011 - DNA, 20 bp, mouse
gtccaccttcacatgccctg

SEQ ID NO: 734012 - DNA, 20 bp, mouse
ggcctcagggcatgtgaagg

SEQ ID NO: 734013 - DNA, 20 bp, mouse
gctagaaaaacgctggaggt

SEQ ID NO: 734014 - DNA, 20 bp, mouse
ggggcgcgcatgcgcggtga

SEQ ID NO: 734015 - DNA, 20 bp, mouse
gggccacgcccactgagtga

SEQ ID NO: 734016 - DNA, 20 bp, mouse
ggggccaccaactccatctg

SEQ ID NO: 734017 - DNA, 20 bp, mouse
gacagcagagtctgagtggt

SEQ ID NO: 734018 - DNA, 20 bp, mouse
gctggggtgcgggatcacag

SEQ ID NO: 734019 - DNA, 20 bp, mouse
gaagagaggcagggcgttgg

SEQ ID NO: 734020 - DNA, 20 bp, mouse
gtgggaggagaccgctccga

SEQ ID NO: 734021 - DNA, 20 bp, mouse
ggacgtggcgacagtgccag

SEQ ID NO: 734022 - DNA, 20 bp, mouse
gaggaagagaggcagggcgt

SEQ ID NO: 734023 - DNA, 20 bp, mouse
gaccaactccatctgtggca

SEQ ID NO: 734024 - DNA, 20 bp, mouse
gagggagtgagcctaagacg

SEQ ID NO: 734025 - DNA, 20 bp, mouse
gtgatcccgcaccccaggat

SEQ ID NO: 734026 - DNA, 20 bp, mouse
gaagccaggggaggactcag

SEQ ID NO: 734027 - DNA, 20 bp, mouse
ggcagggcggggcaaagcca

SEQ ID NO: 734028 - DNA, 20 bp, mouse
ggtggggcctccctatgggg

SEQ ID NO: 734029 - DNA, 20 bp, mouse
gcgggggtggggcctcccta

SEQ ID NO: 734030 - DNA, 20 bp, mouse
ggggcggagccaacaccaga

SEQ ID NO: 734031 - DNA, 20 bp, mouse
ggaggtgggaccctagaagg

SEQ ID NO: 734032 - DNA, 20 bp, mouse
gactcaggggcctgactgac

SEQ ID NO: 734033 - DNA, 20 bp, mouse
gtccgggtccactggaaggg

SEQ ID NO: 734034 - DNA, 20 bp, mouse
gggtacggggagtctgacgt

SEQ ID NO: 734035 - DNA, 20 bp, mouse
gcggagccaacaccagatgg

SEQ ID NO: 734036 - DNA, 20 bp, mouse
gatctggagtcactctccta

SEQ ID NO: 734037 - DNA, 20 bp, mouse
gaggtctcacctccagcata

SEQ ID NO: 734038 - DNA, 20 bp, mouse
gtcacctccagcataaggct

SEQ ID NO: 734039 - DNA, 20 bp, mouse
gcagccaggtgacacacatg

SEQ ID NO: 734040 - DNA, 20 bp, mouse
gcccccacatgtgtgtcacc

SEQ ID NO: 734041 - DNA, 20 bp, mouse
ggggccttgagaaggagcca

SEQ ID NO: 734042 - DNA, 20 bp, mouse
gcgggagtcgggcattggga

SEQ ID NO: 734043 - DNA, 20 bp, mouse
gccctagatgtcacctgcaa

SEQ ID NO: 734044 - DNA, 20 bp, mouse
gacccttgcaggtgacatct

SEQ ID NO: 734045 - DNA, 20 bp, mouse
gggctcggagaatccacata

SEQ ID NO: 734046 - DNA, 20 bp, mouse
gaatgcacggcgaggattgg

SEQ ID NO: 734047 - DNA, 20 bp, mouse
gccaaagcagaatgtagcca

SEQ ID NO: 734048 - DNA, 20 bp, mouse
gagtctcggaatgcacggcg

SEQ ID NO: 734049 - DNA, 20 bp, mouse
gaaaccgcgcgagtggaatt

SEQ ID NO: 734050 - DNA, 20 bp, mouse
ggcgggatcccgagttcgag

SEQ ID NO: 734051 - DNA, 20 bp, mouse
gagaaattccggctcctcag

SEQ ID NO: 734052 - DNA, 20 bp, mouse
gggacccgggtacccggagt

SEQ ID NO: 734053 - DNA, 20 bp, mouse
gaatgggcgcgaacccactc

SEQ ID NO: 734054 - DNA, 20 bp, mouse
gcgaacccactccgggtacc

SEQ ID NO: 734055 - DNA, 20 bp, mouse
gcgcgcccattggaggaagc

SEQ ID NO: 734056 - DNA, 20 bp, mouse
gtactcgggcgtcccagttc

SEQ ID NO: 734057 - DNA, 20 bp, mouse
ggggccaaggcccatgtcca

SEQ ID NO: 734058 - DNA, 20 bp, mouse
gcggccctggcgtcacagga

SEQ ID NO: 734059 - DNA, 20 bp, mouse
gtcggacatggacgagtagg

SEQ ID NO: 734060 - DNA, 20 bp, mouse
ggagtcggacatggacgagt

SEQ ID NO: 734061 - DNA, 20 bp, mouse
gcttggccctttgatttagt

SEQ ID NO: 734062 - DNA, 20 bp, mouse
gggcccatgtccaaggcaga

SEQ ID NO: 734063 - DNA, 20 bp, mouse
gagcatgcccgagtcggaca

SEQ ID NO: 734064 - DNA, 20 bp, mouse
gccagggcacggtagttatc

SEQ ID NO: 734065 - DNA, 20 bp, mouse
gagaaaggcgttcctcacgc

SEQ ID NO: 734066 - DNA, 20 bp, mouse
gcgtccctcgtgtggaactt

SEQ ID NO: 734067 - DNA, 20 bp, mouse
gagcccttgcgtccctcgtg

SEQ ID NO: 734068 - DNA, 20 bp, mouse
gggaggttaggtcccattca

SEQ ID NO: 734069 - DNA, 20 bp, mouse
gttccacacgagggacgcaa

SEQ ID NO: 734070 - DNA, 20 bp, mouse
gcccttgtggacatcagcaa

SEQ ID NO: 734071 - DNA, 20 bp, mouse
gtgtttcaggcactcagcga

SEQ ID NO: 734072 - DNA, 20 bp, mouse
ggctctctatttcccctgaa

SEQ ID NO: 734073 - DNA, 20 bp, mouse
ggtgcccagcagaggtccag

SEQ ID NO: 734074 - DNA, 20 bp, mouse
gtggcccaacatttgtgaat

SEQ ID NO: 734075 - DNA, 20 bp, mouse
ggtggaacttcggctgataa

SEQ ID NO: 734076 - DNA, 20 bp, mouse
gcgggagctcgtgtcgggcg

SEQ ID NO: 734077 - DNA, 20 bp, mouse
gcagggcgggagctcgtgtc

SEQ ID NO: 734078 - DNA, 20 bp, mouse
gctcccgccctgccaagccg

SEQ ID NO: 734079 - DNA, 20 bp, mouse
ggtcctgccgcggcttggca

SEQ ID NO: 734080 - DNA, 20 bp, mouse
gagagccttgggcagctatt

SEQ ID NO: 734081 - DNA, 20 bp, mouse
gtggtcctccggccgcgaga

SEQ ID NO: 734082 - DNA, 20 bp, mouse
gaggaccacagcccggtgcc

SEQ ID NO: 734083 - DNA, 20 bp, mouse
gcggccggaggaccacagcc

SEQ ID NO: 734084 - DNA, 20 bp, mouse
ggtggcggcgatagggtctt

SEQ ID NO: 734085 - DNA, 20 bp, mouse
gtggggcgaaccctgggcgg

SEQ ID NO: 734086 - DNA, 20 bp, mouse
gggaggcggagtcggaaggt

SEQ ID NO: 734087 - DNA, 20 bp, mouse
gagaaagaggattgagacac

SEQ ID NO: 734088 - DNA, 20 bp, mouse
gagggcggagcctaagggag

SEQ ID NO: 734089 - DNA, 20 bp, mouse
gtgagcaagggcggagccta

SEQ ID NO: 734090 - DNA, 20 bp, mouse
gacgctgaggggaggaacct

SEQ ID NO: 734091 - DNA, 20 bp, mouse
gctacagagggaggcggagt

SEQ ID NO: 734092 - DNA, 20 bp, mouse
ggggaggaggcggagtctag

SEQ ID NO: 734093 - DNA, 20 bp, mouse
ggggagccaggatgaactgt

SEQ ID NO: 734094 - DNA, 20 bp, mouse
gagaggggaggaactatagg

SEQ ID NO: 734095 - DNA, 20 bp, mouse
gggaggagcctgagcaaggg

SEQ ID NO: 734096 - DNA, 20 bp, mouse
ggctgatgctagaacatcca

SEQ ID NO: 734097 - DNA, 20 bp, mouse
gtctggaggtagacaggtgg

SEQ ID NO: 734098 - DNA, 20 bp, mouse
gaggacccacccttgatcca

SEQ ID NO: 734099 - DNA, 20 bp, mouse
gcccatattgaaggtggcaa

SEQ ID NO: 734100 - DNA, 20 bp, mouse
gccaccttcaatatgggaag

SEQ ID NO: 734101 - DNA, 20 bp, mouse
ggaaggtggcaagggctaag

SEQ ID NO: 734102 - DNA, 20 bp, mouse
gtgtgcccctccctggatca

SEQ ID NO: 734103 - DNA, 20 bp, mouse
ggggctggcagagtttgaaa

SEQ ID NO: 734104 - DNA, 20 bp, mouse
ggcaggagagccaagctgat

SEQ ID NO: 734105 - DNA, 20 bp, mouse
gagcaaggcagatgtccctg

SEQ ID NO: 734106 - DNA, 20 bp, mouse
gactcccgacgccataccgc

SEQ ID NO: 734107 - DNA, 20 bp, mouse
gcgggccggcggtatggcgt

SEQ ID NO: 734108 - DNA, 20 bp, mouse
gcgggcgtgaggagcgttga

SEQ ID NO: 734109 - DNA, 20 bp, mouse
gagagcgaaccgcccagagg

SEQ ID NO: 734110 - DNA, 20 bp, mouse
gataccgccggcccggacgc

SEQ ID NO: 734111 - DNA, 20 bp, mouse
gcccttgcgcaaagcaggct

SEQ ID NO: 734112 - DNA, 20 bp, mouse
gccgcgcccttgcgcaaagc

SEQ ID NO: 734113 - DNA, 20 bp, mouse
gactctggatccacctccta

SEQ ID NO: 734114 - DNA, 20 bp, mouse
gggtggatccagagtgtcta

SEQ ID NO: 734115 - DNA, 20 bp, mouse
ggggtgcggttggaggacag

SEQ ID NO: 734116 - DNA, 20 bp, mouse
gtacgagggcgggctcattg

SEQ ID NO: 734117 - DNA, 20 bp, mouse
gcgggcgcactgaagagcca

SEQ ID NO: 734118 - DNA, 20 bp, mouse
gaactggggtaacgttacga

SEQ ID NO: 734119 - DNA, 20 bp, mouse
ggacccctggggcggaaaag

SEQ ID NO: 734120 - DNA, 20 bp, mouse
gtggggtaacgttacgaggg

SEQ ID NO: 734121 - DNA, 20 bp, mouse
gtatcgaaagcgagaagctc

SEQ ID NO: 734122 - DNA, 20 bp, mouse
gacggggcggaacccaaaca

SEQ ID NO: 734123 - DNA, 20 bp, mouse
gcgccccaggggtcggtgga

SEQ ID NO: 734124 - DNA, 20 bp, mouse
gtttccgccccaggggtcgg

SEQ ID NO: 734125 - DNA, 20 bp, mouse
ggacccggcgggagaagacg

SEQ ID NO: 734126 - DNA, 20 bp, mouse
gaacacatctacttagtctt

SEQ ID NO: 734127 - DNA, 20 bp, mouse
gtccaagggacatcaatatt

SEQ ID NO: 734128 - DNA, 20 bp, mouse
ggaagaaggtctcaccttct

SEQ ID NO: 734129 - DNA, 20 bp, mouse
ggggatctcatctgagttaa

SEQ ID NO: 734130 - DNA, 20 bp, mouse
gatcccagctcaccctcaga

SEQ ID NO: 734131 - DNA, 20 bp, mouse
ggaccaatgagtgggctacg

SEQ ID NO: 734132 - DNA, 20 bp, mouse
gttaagggcccagctatcaa

SEQ ID NO: 734133 - DNA, 20 bp, mouse
ggcccactcattggtcaact

SEQ ID NO: 734134 - DNA, 20 bp, mouse
gaaccccgtagcccactcat

SEQ ID NO: 734135 - DNA, 20 bp, mouse
gttggcccattaaggtctcc

SEQ ID NO: 734136 - DNA, 20 bp, mouse
gaacacctctacttagtcct

SEQ ID NO: 734137 - DNA, 20 bp, mouse
gttctgcagacctagcacca

SEQ ID NO: 734138 - DNA, 20 bp, mouse
gtccccaggaagttgcagtt

SEQ ID NO: 734139 - DNA, 20 bp, mouse
gtccccaactgcaacttcct

SEQ ID NO: 734140 - DNA, 20 bp, mouse
gaggggacattgttccagag

SEQ ID NO: 734141 - DNA, 20 bp, mouse
gtccaagggacaaagatact

SEQ ID NO: 734142 - DNA, 20 bp, mouse
gttgctgtttgacccattaa

SEQ ID NO: 734143 - DNA, 20 bp, mouse
gttaccctaggactaagtag

SEQ ID NO: 734144 - DNA, 20 bp, mouse
gggtggggtaggtcagcaga

SEQ ID NO: 734145 - DNA, 20 bp, mouse
gtacctctgagagagagctg

SEQ ID NO: 734146 - DNA, 20 bp, mouse
gggtctagctggaatgaggt

SEQ ID NO: 734147 - DNA, 20 bp, mouse
ggaaaagccactcccaaaat

SEQ ID NO: 734148 - DNA, 20 bp, mouse
gcccgtaagccaggcaccaa

SEQ ID NO: 734149 - DNA, 20 bp, mouse
gaactcccccattttgggag

SEQ ID NO: 734150 - DNA, 20 bp, mouse
gcccaaaatgggggagtttg

SEQ ID NO: 734151 - DNA, 20 bp, mouse
gtacgggagtcatgggtgca

SEQ ID NO: 734152 - DNA, 20 bp, mouse
gttccagctagacccaggag

SEQ ID NO: 734153 - DNA, 20 bp, mouse
gcctggcttacgggagtcat

SEQ ID NO: 734154 - DNA, 20 bp, mouse
gtcaatccagccagaatatt

SEQ ID NO: 734155 - DNA, 20 bp, mouse
gggtggtaaccattggtgcc

SEQ ID NO: 734156 - DNA, 20 bp, mouse
gtccagagccggccaggcga

SEQ ID NO: 734157 - DNA, 20 bp, mouse
ggggctgggccatcacccgg

SEQ ID NO: 734158 - DNA, 20 bp, mouse
gtggccggctctggagcctc

SEQ ID NO: 734159 - DNA, 20 bp, mouse
ggcccagcccaggggtgagc

SEQ ID NO: 734160 - DNA, 20 bp, mouse
gcaacatctggagtgggaaa

SEQ ID NO: 734161 - DNA, 20 bp, mouse
gaaacccagtctcattcctg

SEQ ID NO: 734162 - DNA, 20 bp, mouse
ggcgaggccgtcccctcctc

SEQ ID NO: 734163 - DNA, 20 bp, mouse
gtggcatgtaggacacatgt

SEQ ID NO: 734164 - DNA, 20 bp, mouse
ggctgccacgataggttttc

SEQ ID NO: 734165 - DNA, 20 bp, mouse
gtagagacccagctcacccc

SEQ ID NO: 734166 - DNA, 20 bp, mouse
gtgggccgccctcctcccat

SEQ ID NO: 734167 - DNA, 20 bp, mouse
gtccgcgcgcctgtccgctc

SEQ ID NO: 734168 - DNA, 20 bp, mouse
gggcctcaccagaccccgag

SEQ ID NO: 734169 - DNA, 20 bp, mouse
gtgaggccgccggagccaat

SEQ ID NO: 734170 - DNA, 20 bp, mouse
gcagcgcaatagggcagcat

SEQ ID NO: 734171 - DNA, 20 bp, mouse
ggcccgcgcgccctgctggg

SEQ ID NO: 734172 - DNA, 20 bp, mouse
gggcgtgtgcatacgtcata

SEQ ID NO: 734173 - DNA, 20 bp, mouse
gactcgctggccgcccgctc

SEQ ID NO: 734174 - DNA, 20 bp, mouse
gcggggtctggtgaggccgc

SEQ ID NO: 734175 - DNA, 20 bp, mouse
ggcggacaggcgcgcggaca

SEQ ID NO: 734176 - DNA, 20 bp, mouse
gggagtcagaggttctggat

SEQ ID NO: 734177 - DNA, 20 bp, mouse
gcagaacctctgactcccga

SEQ ID NO: 734178 - DNA, 20 bp, mouse
gccggtgtgccgggcactcc

SEQ ID NO: 734179 - DNA, 20 bp, mouse
gcaactgcggcccacgcaga

SEQ ID NO: 734180 - DNA, 20 bp, mouse
gacgcagagggtggagtctc

SEQ ID NO: 734181 - DNA, 20 bp, mouse
ggactctgtgggcggagtga

SEQ ID NO: 734182 - DNA, 20 bp, mouse
gtggtgccctcgggagtcag

SEQ ID NO: 734183 - DNA, 20 bp, mouse
gggcttcacgctgacggtag

SEQ ID NO: 734184 - DNA, 20 bp, mouse
gcctccgctctgcggagacg

SEQ ID NO: 734185 - DNA, 20 bp, mouse
gggcatctggactctgtggg

SEQ ID NO: 734186 - DNA, 20 bp, mouse
gaggctcgagtcacggtcag

SEQ ID NO: 734187 - DNA, 20 bp, mouse
gacagcgccgcacctgggag

SEQ ID NO: 734188 - DNA, 20 bp, mouse
ggcggcgcgaggcagttata

SEQ ID NO: 734189 - DNA, 20 bp, mouse
gtcgcgccgcccatgggcct

SEQ ID NO: 734190 - DNA, 20 bp, mouse
ggggcttcacccttacaaag

SEQ ID NO: 734191 - DNA, 20 bp, mouse
gcaggcaagcagcacccaaa

SEQ ID NO: 734192 - DNA, 20 bp, mouse
ggccaagcgcccctttgtaa

SEQ ID NO: 734193 - DNA, 20 bp, mouse
gctggcacagcgccgcacct

SEQ ID NO: 734194 - DNA, 20 bp, mouse
gaaggtcgaggctcgagtca

SEQ ID NO: 734195 - DNA, 20 bp, mouse
gaggggctgtgtgtccagct

SEQ ID NO: 734196 - DNA, 20 bp, mouse
gcacataggtgacagtgtgg

SEQ ID NO: 734197 - DNA, 20 bp, mouse
gaagcacataggtgacagtg

SEQ ID NO: 734198 - DNA, 20 bp, mouse
ggagtcgctgtggaaataca

SEQ ID NO: 734199 - DNA, 20 bp, mouse
gcagtcagcaaatgtaaagt

SEQ ID NO: 734200 - DNA, 20 bp, mouse
gaataatcataaaacgcaca

SEQ ID NO: 734201 - DNA, 20 bp, mouse
gaaactctgaacgtcaatag

SEQ ID NO: 734202 - DNA, 20 bp, mouse
gtcagaggggttggtataaa

SEQ ID NO: 734203 - DNA, 20 bp, mouse
gggtatctctctagcatggg

SEQ ID NO: 734204 - DNA, 20 bp, mouse
gatcataaaacgcacatggc

SEQ ID NO: 734205 - DNA, 20 bp, mouse
gttaagataaagcatcagag

SEQ ID NO: 734206 - DNA, 20 bp, mouse
gagggagggcaacccgaggg

SEQ ID NO: 734207 - DNA, 20 bp, mouse
gccaggcttacatggacttc

SEQ ID NO: 734208 - DNA, 20 bp, mouse
gtggagaagattgcctgcga

SEQ ID NO: 734209 - DNA, 20 bp, mouse
gggggcgtggtgggtggcga

SEQ ID NO: 734210 - DNA, 20 bp, mouse
gccctctccgcaccgccctc

SEQ ID NO: 734211 - DNA, 20 bp, mouse
ggaagattgcctgcgaggga

SEQ ID NO: 734212 - DNA, 20 bp, mouse
gtctccagaacactttggtt

SEQ ID NO: 734213 - DNA, 20 bp, mouse
ggcacctaaccaaagtgttc

SEQ ID NO: 734214 - DNA, 20 bp, mouse
gtgcgagggagggcaacccg

SEQ ID NO: 734215 - DNA, 20 bp, mouse
gacccgagggcggtgcggag

SEQ ID NO: 734216 - DNA, 20 bp, mouse
gaaaaggggccgggactcga

SEQ ID NO: 734217 - DNA, 20 bp, mouse
gcgacggagcggcaaaaaag

SEQ ID NO: 734218 - DNA, 20 bp, mouse
ggagggtcgcccggtaggtg

SEQ ID NO: 734219 - DNA, 20 bp, mouse
ggctcctccgccgacgaggg

SEQ ID NO: 734220 - DNA, 20 bp, mouse
ggtgcggcagatgtacctga

SEQ ID NO: 734221 - DNA, 20 bp, mouse
ggactcgagggtcgcccggt

SEQ ID NO: 734222 - DNA, 20 bp, mouse
gcacgtgcgcctccccatag

SEQ ID NO: 734223 - DNA, 20 bp, mouse
ggagcggcaaaaaaggggcc

SEQ ID NO: 734224 - DNA, 20 bp, mouse
ggggcgcggagccgccaaat

SEQ ID NO: 734225 - DNA, 20 bp, mouse
ggaggagcagcagaccgtga

SEQ ID NO: 734226 - DNA, 20 bp, mouse
gcccttggggaagaggagtg

SEQ ID NO: 734227 - DNA, 20 bp, mouse
gtgccagcacgcacgatctg

SEQ ID NO: 734228 - DNA, 20 bp, mouse
gtcaggacgctgcacggttc

SEQ ID NO: 734229 - DNA, 20 bp, mouse
gagtcccgatcgatactgga

SEQ ID NO: 734230 - DNA, 20 bp, mouse
ggtgcgtgctggcaaacctc

SEQ ID NO: 734231 - DNA, 20 bp, mouse
gggttcaggcgccgagctct

SEQ ID NO: 734232 - DNA, 20 bp, mouse
gctgccatccagtatcgatc

SEQ ID NO: 734233 - DNA, 20 bp, mouse
ggcagcgtcctgagctccag

SEQ ID NO: 734234 - DNA, 20 bp, mouse
ggcgcagtcccgatcgatac

SEQ ID NO: 734235 - DNA, 20 bp, mouse
ggataagtgtcccctccctt

SEQ ID NO: 734236 - DNA, 20 bp, mouse
gcccccccagcgggcctcac

SEQ ID NO: 734237 - DNA, 20 bp, mouse
ggaggcccgctgggggggga

SEQ ID NO: 734238 - DNA, 20 bp, mouse
gcgctccagtgaggcccgct

SEQ ID NO: 734239 - DNA, 20 bp, mouse
ggcgcggattaagacaggga

SEQ ID NO: 734240 - DNA, 20 bp, mouse
ggggactgtgcgctccagtg

SEQ ID NO: 734241 - DNA, 20 bp, mouse
gcgcgggccaagggaaaagg

SEQ ID NO: 734242 - DNA, 20 bp, mouse
gcagttcggggtgttgggat

SEQ ID NO: 734243 - DNA, 20 bp, mouse
gtgaagttgcgggttttacg

SEQ ID NO: 734244 - DNA, 20 bp, mouse
gcaagggggcaaaggggccg

SEQ ID NO: 734245 - DNA, 20 bp, mouse
gggtggcgcggattaagaca

SEQ ID NO: 734246 - DNA, 20 bp, mouse
ggcccctcccaccaagtcaa

SEQ ID NO: 734247 - DNA, 20 bp, mouse
gtgcagcgagcgggttgggg

SEQ ID NO: 734248 - DNA, 20 bp, mouse
ggtgttggggaaataaggtt

SEQ ID NO: 734249 - DNA, 20 bp, mouse
ggctgcagatctggagggag

SEQ ID NO: 734250 - DNA, 20 bp, mouse
gtgtcaactgagggaggtgg

SEQ ID NO: 734251 - DNA, 20 bp, mouse
gttagcctgtcaactgaggg

SEQ ID NO: 734252 - DNA, 20 bp, mouse
gcgctcgctgcagatctgga

SEQ ID NO: 734253 - DNA, 20 bp, mouse
ggagagaacagagaagtcgg

SEQ ID NO: 734254 - DNA, 20 bp, mouse
gcgcggctggtggggcagaa

SEQ ID NO: 734255 - DNA, 20 bp, mouse
gaacccgctcgctgcagatc

SEQ ID NO: 734256 - DNA, 20 bp, mouse
ggggcggtgcaaacactagt

SEQ ID NO: 734257 - DNA, 20 bp, mouse
gggtctgcagagtgctgcac

SEQ ID NO: 734258 - DNA, 20 bp, mouse
gctaccggggtcacagaaag

SEQ ID NO: 734259 - DNA, 20 bp, mouse
gacgcggccgactgcggaga

SEQ ID NO: 734260 - DNA, 20 bp, mouse
gtagctccaaaaccgtaaga

SEQ ID NO: 734261 - DNA, 20 bp, mouse
ggccaagtgcggcacacacg

SEQ ID NO: 734262 - DNA, 20 bp, mouse
gccagcctccggccgccaga

SEQ ID NO: 734263 - DNA, 20 bp, mouse
gtccggagcgcccgtgtctc

SEQ ID NO: 734264 - DNA, 20 bp, mouse
gctgcagagtgctgcaccgg

SEQ ID NO: 734265 - DNA, 20 bp, mouse
gtgagaaatcagcgctcgga

SEQ ID NO: 734266 - DNA, 20 bp, mouse
gggactctacagaacctctg

SEQ ID NO: 734267 - DNA, 20 bp, mouse
gagcggcgcgctaccatcga

SEQ ID NO: 734268 - DNA, 20 bp, mouse
ggactctgacgcttactccc

SEQ ID NO: 734269 - DNA, 20 bp, mouse
gaaacccgggctggaatcaa

SEQ ID NO: 734270 - DNA, 20 bp, mouse
gaacctctgcggcctgtggt

SEQ ID NO: 734271 - DNA, 20 bp, mouse
ggcgcgctaccatcgacgga

SEQ ID NO: 734272 - DNA, 20 bp, mouse
gtgtcgcggaccttcaaacc

SEQ ID NO: 734273 - DNA, 20 bp, mouse
gagcgcgccgctgaccgcct

SEQ ID NO: 734274 - DNA, 20 bp, mouse
ggacacgctcagacacggag

SEQ ID NO: 734275 - DNA, 20 bp, mouse
gctagtgtcgcctactggaa

SEQ ID NO: 734276 - DNA, 20 bp, mouse
ggggctggcaagactctcaa

SEQ ID NO: 734277 - DNA, 20 bp, mouse
gagacagcaggaagtgacgt

SEQ ID NO: 734278 - DNA, 20 bp, mouse
gtggccgcgcccctgcgacc

SEQ ID NO: 734279 - DNA, 20 bp, mouse
gtatgaatggcgttgggcgg

SEQ ID NO: 734280 - DNA, 20 bp, mouse
gaaagcctgcggtgaatgtg

SEQ ID NO: 734281 - DNA, 20 bp, mouse
gcccctgctcagggcctcgc

SEQ ID NO: 734282 - DNA, 20 bp, mouse
gcggtccgccggattatgaa

SEQ ID NO: 734283 - DNA, 20 bp, mouse
gcccctgcgaccaggtaaag

SEQ ID NO: 734284 - DNA, 20 bp, mouse
gggagggcgcgggagcatgc

SEQ ID NO: 734285 - DNA, 20 bp, mouse
gagcatgcgggcgacgacgc

SEQ ID NO: 734286 - DNA, 20 bp, mouse
ggaagcggggagggcggtga

SEQ ID NO: 734287 - DNA, 20 bp, mouse
gagggcggtgacggaggaag

SEQ ID NO: 734288 - DNA, 20 bp, mouse
gcggcgcgtgccagaagctt

SEQ ID NO: 734289 - DNA, 20 bp, mouse
gagcactgagaagacgtcgg

SEQ ID NO: 734290 - DNA, 20 bp, mouse
ggcgcagagcggccctaagc

SEQ ID NO: 734291 - DNA, 20 bp, mouse
ggtcgcgataattggttcgg

SEQ ID NO: 734292 - DNA, 20 bp, mouse
gcacgctttcggaagcgggg

SEQ ID NO: 734293 - DNA, 20 bp, mouse
gagaagcttgggatgaatgg

SEQ ID NO: 734294 - DNA, 20 bp, mouse
gctttcggaagcggggaggg

SEQ ID NO: 734295 - DNA, 20 bp, mouse
gaccggcaggggtttaaagg

SEQ ID NO: 734296 - DNA, 20 bp, mouse
ggggacgggaggtacggagt

SEQ ID NO: 734297 - DNA, 20 bp, mouse
gtcccgggctgccaattgta

SEQ ID NO: 734298 - DNA, 20 bp, mouse
gcatctggaggcgggacggg

SEQ ID NO: 734299 - DNA, 20 bp, mouse
ggcagaggaaggatgcgatt

SEQ ID NO: 734300 - DNA, 20 bp, mouse
gctaaggagtaagccgacga

SEQ ID NO: 734301 - DNA, 20 bp, mouse
gaggagtaagccgacgacgg

SEQ ID NO: 734302 - DNA, 20 bp, mouse
gcggtggcgccaggtctcta

SEQ ID NO: 734303 - DNA, 20 bp, mouse
gaaggccagtccgccgtcgt

SEQ ID NO: 734304 - DNA, 20 bp, mouse
gccaccgcggaagccgctat

SEQ ID NO: 734305 - DNA, 20 bp, mouse
gcgcctccagatgcagagga

SEQ ID NO: 734306 - DNA, 20 bp, mouse
gagagtgcatcctggaagat

SEQ ID NO: 734307 - DNA, 20 bp, mouse
ggtgccctgctagaatctta

SEQ ID NO: 734308 - DNA, 20 bp, mouse
ggggagctggaggcaaaacc

SEQ ID NO: 734309 - DNA, 20 bp, mouse
ggatgggtggagtaaaaggc

SEQ ID NO: 734310 - DNA, 20 bp, mouse
gaaaacccggagctgtatcc

SEQ ID NO: 734311 - DNA, 20 bp, mouse
gcacctccaggatacagctc

SEQ ID NO: 734312 - DNA, 20 bp, mouse
gcggcagccaatcgactcac

SEQ ID NO: 734313 - DNA, 20 bp, mouse
gcactgcccagtgagtcgat

SEQ ID NO: 734314 - DNA, 20 bp, mouse
gacgaacttcggggaggagc

SEQ ID NO: 734315 - DNA, 20 bp, mouse
gtgtgggattgcagcgaaat

SEQ ID NO: 734316 - DNA, 20 bp, mouse
gcaccccccaggggcttcgt

SEQ ID NO: 734317 - DNA, 20 bp, mouse
gatcggtcacagcgggtaat

SEQ ID NO: 734318 - DNA, 20 bp, mouse
gtatgcctacgaagcccctg

SEQ ID NO: 734319 - DNA, 20 bp, mouse
gcctctcaggaaaatccgtc

SEQ ID NO: 734320 - DNA, 20 bp, mouse
gaggcataggaaagcttccg

SEQ ID NO: 734321 - DNA, 20 bp, mouse
ggcgacgcatgcgtgctgac

SEQ ID NO: 734322 - DNA, 20 bp, mouse
gcgcgtcgcatcggtcacag

SEQ ID NO: 734323 - DNA, 20 bp, mouse
gaaatccgtccggctaagtc

SEQ ID NO: 734324 - DNA, 20 bp, mouse
ggtctggagccctagtactt

SEQ ID NO: 734325 - DNA, 20 bp, mouse
gtgttaaagtataaacatac

SEQ ID NO: 734326 - DNA, 20 bp, mouse
gccaacccgcggtgcttccg

SEQ ID NO: 734327 - DNA, 20 bp, mouse
gcacaggcccactgccctat

SEQ ID NO: 734328 - DNA, 20 bp, mouse
gaagcccgcagccgggaggc

SEQ ID NO: 734329 - DNA, 20 bp, mouse
gagagccagcgcgcaagggg

SEQ ID NO: 734330 - DNA, 20 bp, mouse
gaaggggcggggacaggccg

SEQ ID NO: 734331 - DNA, 20 bp, mouse
gcccgagtacgtgtcagggg

SEQ ID NO: 734332 - DNA, 20 bp, mouse
gtccgcccctgacacgtact

SEQ ID NO: 734333 - DNA, 20 bp, mouse
gactcgggcaggggctacgt

SEQ ID NO: 734334 - DNA, 20 bp, mouse
ggccctaggcgtgtgtgtca

SEQ ID NO: 734335 - DNA, 20 bp, mouse
gacaggccgcggaagcaccg

SEQ ID NO: 734336 - DNA, 20 bp, mouse
ggcgggaacccaaggttcac

SEQ ID NO: 734337 - DNA, 20 bp, mouse
gagggaggcggagcttagga

SEQ ID NO: 734338 - DNA, 20 bp, mouse
gagaaagcgtgacgtcagtt

SEQ ID NO: 734339 - DNA, 20 bp, mouse
gcagcgtcctggcgcctcga

SEQ ID NO: 734340 - DNA, 20 bp, mouse
gtccctgagcgcctgcgcgg

SEQ ID NO: 734341 - DNA, 20 bp, mouse
gttgtggagggtgcagacgg

SEQ ID NO: 734342 - DNA, 20 bp, mouse
gaaaccgcgccgcgttgtgg

SEQ ID NO: 734343 - DNA, 20 bp, mouse
ggcggctcctgtggaacttg

SEQ ID NO: 734344 - DNA, 20 bp, mouse
gtgacgtcacgctttctgat

SEQ ID NO: 734345 - DNA, 20 bp, mouse
gggctctcgtcgcagcgtcc

SEQ ID NO: 734346 - DNA, 20 bp, mouse
gccagaatctagcttctgaa

SEQ ID NO: 734347 - DNA, 20 bp, mouse
gcagaagctagattctggcg

SEQ ID NO: 734348 - DNA, 20 bp, mouse
gaccaatcccagttagactt

SEQ ID NO: 734349 - DNA, 20 bp, mouse
gaatcccagttagacttcgg

SEQ ID NO: 734350 - DNA, 20 bp, mouse
gggagactccatggcagcta

SEQ ID NO: 734351 - DNA, 20 bp, mouse
gtgggaatgtccagagaatc

SEQ ID NO: 734352 - DNA, 20 bp, mouse
ggaactcgcttcattttctc

SEQ ID NO: 734353 - DNA, 20 bp, mouse
gcaactagatttggtctctt

SEQ ID NO: 734354 - DNA, 20 bp, mouse
gcggatccggggccggactc

SEQ ID NO: 734355 - DNA, 20 bp, mouse
gctccgccccttagctgcca

SEQ ID NO: 734356 - DNA, 20 bp, mouse
gcatacgccttcccacaggg

SEQ ID NO: 734357 - DNA, 20 bp, mouse
ggagggacatgatatcatgc

SEQ ID NO: 734358 - DNA, 20 bp, mouse
ggaggtgattagagagaaaa

SEQ ID NO: 734359 - DNA, 20 bp, mouse
gcggcggcgatgaatttgag

SEQ ID NO: 734360 - DNA, 20 bp, mouse
gaatttgagcggacggaagg

SEQ ID NO: 734361 - DNA, 20 bp, mouse
gatgaatttgagcggacgga

SEQ ID NO: 734362 - DNA, 20 bp, mouse
ggctgggagctgaaatcgtg

SEQ ID NO: 734363 - DNA, 20 bp, mouse
gaggaaggatgaattggcgg

SEQ ID NO: 734364 - DNA, 20 bp, mouse
gcgcccatacgccttcccac

SEQ ID NO: 734365 - DNA, 20 bp, mouse
gtcaccgcggggcgccctgc

SEQ ID NO: 734366 - DNA, 20 bp, mouse
gtcgtcgcgtggaagagcgt

SEQ ID NO: 734367 - DNA, 20 bp, mouse
gctcttccacgcgacgagcc

SEQ ID NO: 734368 - DNA, 20 bp, mouse
ggggagacggggaagcttcc

SEQ ID NO: 734369 - DNA, 20 bp, mouse
ggcgccggttgcctgggaga

SEQ ID NO: 734370 - DNA, 20 bp, mouse
gcctagaggtgcatggaaga

SEQ ID NO: 734371 - DNA, 20 bp, mouse
gactcagttgcgattggctg

SEQ ID NO: 734372 - DNA, 20 bp, mouse
gcgccccaaaactagccaaa

SEQ ID NO: 734373 - DNA, 20 bp, mouse
gcaatcgcaactgagtatcg

SEQ ID NO: 734374 - DNA, 20 bp, mouse
gtccccgtctcccaggcaac

SEQ ID NO: 734375 - DNA, 20 bp, mouse
gtgatccaaaagattccgtt

SEQ ID NO: 734376 - DNA, 20 bp, mouse
ggggctcttcgggattggaa

SEQ ID NO: 734377 - DNA, 20 bp, mouse
ggggcaggacccggaagtga

SEQ ID NO: 734378 - DNA, 20 bp, mouse
gtcccgacgtgcttcgagat

SEQ ID NO: 734379 - DNA, 20 bp, mouse
gactggaccgggctagaaaa

SEQ ID NO: 734380 - DNA, 20 bp, mouse
gtacctctgtgcctccggga

SEQ ID NO: 734381 - DNA, 20 bp, mouse
gtcccagctctccgatgaca

SEQ ID NO: 734382 - DNA, 20 bp, mouse
gagggcgtgagaggcctctc

SEQ ID NO: 734383 - DNA, 20 bp, mouse
ggagcagcaaggagcatctg

SEQ ID NO: 734384 - DNA, 20 bp, mouse
ggaagagccccgcgcacaga

SEQ ID NO: 734385 - DNA, 20 bp, mouse
gtctcgacccggagctccag

SEQ ID NO: 734386 - DNA, 20 bp, mouse
gagaggcacgccctgactga

SEQ ID NO: 734387 - DNA, 20 bp, mouse
ggcgcaggtgagaaaacgaa

SEQ ID NO: 734388 - DNA, 20 bp, mouse
gcaatcaatagcctcttctt

SEQ ID NO: 734389 - DNA, 20 bp, mouse
gctggggcacgtgactgtga

SEQ ID NO: 734390 - DNA, 20 bp, mouse
gtcaactgttccgtcagtca

SEQ ID NO: 734391 - DNA, 20 bp, mouse
gacgcatgcgcgccattctc

SEQ ID NO: 734392 - DNA, 20 bp, mouse
gggcacgtgactgtgacggc

SEQ ID NO: 734393 - DNA, 20 bp, mouse
gggagcttttagcagcgatg

SEQ ID NO: 734394 - DNA, 20 bp, mouse
gcaacgcgaagaactccttc

SEQ ID NO: 734395 - DNA, 20 bp, mouse
gccgggcgtcatagtaacca

SEQ ID NO: 734396 - DNA, 20 bp, mouse
gagggcgccgggattcgctt

SEQ ID NO: 734397 - DNA, 20 bp, mouse
gtcctgaatgggcaaggggc

SEQ ID NO: 734398 - DNA, 20 bp, mouse
gcgccgggattcgcttgggg

SEQ ID NO: 734399 - DNA, 20 bp, mouse
ggcctggaagactgttgcta

SEQ ID NO: 734400 - DNA, 20 bp, mouse
ggggtgcgagccaatagcga

SEQ ID NO: 734401 - DNA, 20 bp, mouse
gcggcttcctgaatgggcaa

SEQ ID NO: 734402 - DNA, 20 bp, mouse
gtgcaggatgcctagggtaa

SEQ ID NO: 734403 - DNA, 20 bp, mouse
gtggagttgaagtaactgat

SEQ ID NO: 734404 - DNA, 20 bp, mouse
gtcccagggcccctcgctat

SEQ ID NO: 734405 - DNA, 20 bp, mouse
gcggggcgttgtcctgagtg

SEQ ID NO: 734406 - DNA, 20 bp, mouse
ggggtggggcaaatactgat

SEQ ID NO: 734407 - DNA, 20 bp, mouse
ggccaggtttggcagtttag

SEQ ID NO: 734408 - DNA, 20 bp, mouse
gcaggggttggcagtgtggg

SEQ ID NO: 734409 - DNA, 20 bp, mouse
gagggagggtggagtacggg

SEQ ID NO: 734410 - DNA, 20 bp, mouse
gaatactgatgggcaaagac

SEQ ID NO: 734411 - DNA, 20 bp, mouse
ggagagacaaacatagggag

SEQ ID NO: 734412 - DNA, 20 bp, mouse
ggagagggagggtggagtac

SEQ ID NO: 734413 - DNA, 20 bp, mouse
gtccaggagagacaaacata

SEQ ID NO: 734414 - DNA, 20 bp, mouse
gtggcagtttaggggccccc

SEQ ID NO: 734415 - DNA, 20 bp, mouse
ggcccctaaactgccaaacc

SEQ ID NO: 734416 - DNA, 20 bp, mouse
gggaaaccacctgaccctct

SEQ ID NO: 734417 - DNA, 20 bp, mouse
gtgaatgcccagctgtcagc

SEQ ID NO: 734418 - DNA, 20 bp, mouse
ggagagaggaaagacgagga

SEQ ID NO: 734419 - DNA, 20 bp, mouse
gaggaagaaggggaaaattt

SEQ ID NO: 734420 - DNA, 20 bp, mouse
gtgggggagtaggagaaggt

SEQ ID NO: 734421 - DNA, 20 bp, mouse
ggccactgacagcctagatc

SEQ ID NO: 734422 - DNA, 20 bp, mouse
gtgacagcctagatctggac

SEQ ID NO: 734423 - DNA, 20 bp, mouse
gcagctggtatccacagctc

SEQ ID NO: 734424 - DNA, 20 bp, mouse
gtggacgggaaactccaccc

SEQ ID NO: 734425 - DNA, 20 bp, mouse
gtctaggctgtcagtggcct

SEQ ID NO: 734426 - DNA, 20 bp, mouse
ggcagctcttgctactgctt

SEQ ID NO: 734427 - DNA, 20 bp, mouse
gagcaagagctgcttgtggg

SEQ ID NO: 734428 - DNA, 20 bp, mouse
ggctgcttgtgggaggaaac

SEQ ID NO: 734429 - DNA, 20 bp, mouse
ggggtggcagtgtttatgag

SEQ ID NO: 734430 - DNA, 20 bp, mouse
gcctctccaagcagagctca

SEQ ID NO: 734431 - DNA, 20 bp, mouse
gagtagcaagagctgcttgt

SEQ ID NO: 734432 - DNA, 20 bp, mouse
gcaagggaagctaccagctg

SEQ ID NO: 734433 - DNA, 20 bp, mouse
ggcttaggttagcatggcac

SEQ ID NO: 734434 - DNA, 20 bp, mouse
ggcagtgtttatgagcgggg

SEQ ID NO: 734435 - DNA, 20 bp, mouse
gttactctttttcccaggtt

SEQ ID NO: 734436 - DNA, 20 bp, mouse
gagctggccccgatccagta

SEQ ID NO: 734437 - DNA, 20 bp, mouse
gtgcccagaggctaccctac

SEQ ID NO: 734438 - DNA, 20 bp, mouse
gtggaaggggtgagcaggtc

SEQ ID NO: 734439 - DNA, 20 bp, mouse
gaggctaccctactggatcg

SEQ ID NO: 734440 - DNA, 20 bp, mouse
gtggacgtgttccgtggaag

SEQ ID NO: 734441 - DNA, 20 bp, mouse
gtcgccaggatcccgcccag

SEQ ID NO: 734442 - DNA, 20 bp, mouse
gcatgctcggcaccgctggg

SEQ ID NO: 734443 - DNA, 20 bp, mouse
gatccagtagggtagcctct

SEQ ID NO: 734444 - DNA, 20 bp, mouse
gcgcatgatcagtgtggagc

SEQ ID NO: 734445 - DNA, 20 bp, mouse
gggggtgagcaggtctggtc

SEQ ID NO: 734446 - DNA, 20 bp, mouse
gcaagcgcacacaaccctat

SEQ ID NO: 734447 - DNA, 20 bp, mouse
gaggcgcgcggcagccaata

SEQ ID NO: 734448 - DNA, 20 bp, mouse
gggtacccggagcaaggcgc

SEQ ID NO: 734449 - DNA, 20 bp, mouse
ggagggaggccataggacgg

SEQ ID NO: 734450 - DNA, 20 bp, mouse
gagcgccgagaggccgagga

SEQ ID NO: 734451 - DNA, 20 bp, mouse
gttaggggcccctgtaacta

SEQ ID NO: 734452 - DNA, 20 bp, mouse
gggagcaaggcgccggctta

SEQ ID NO: 734453 - DNA, 20 bp, mouse
gcataggacggcggagggaa

SEQ ID NO: 734454 - DNA, 20 bp, mouse
gaactcgagttcgaacccga

SEQ ID NO: 734455 - DNA, 20 bp, mouse
gggaggccataggacggcgg

SEQ ID NO: 734456 - DNA, 20 bp, mouse
ggggccaggacaagcgtggg

SEQ ID NO: 734457 - DNA, 20 bp, mouse
ggccgggccaggacaagcgt

SEQ ID NO: 734458 - DNA, 20 bp, mouse
gagctcgcgcgcccccgaac

SEQ ID NO: 734459 - DNA, 20 bp, mouse
gcgcgagctagcacgaggac

SEQ ID NO: 734460 - DNA, 20 bp, mouse
gccaggacaagcgtgggtgg

SEQ ID NO: 734461 - DNA, 20 bp, mouse
gacggaacggcacaccgcca

SEQ ID NO: 734462 - DNA, 20 bp, mouse
gacggcacggcggaactacg

SEQ ID NO: 734463 - DNA, 20 bp, mouse
gcgcgcccccgaacaggcga

SEQ ID NO: 734464 - DNA, 20 bp, mouse
gcggggacctcagcaagact

SEQ ID NO: 734465 - DNA, 20 bp, mouse
ggggcgcgcgagctagcacg

SEQ ID NO: 734466 - DNA, 20 bp, mouse
ggctctgtcagcgggtgctc

SEQ ID NO: 734467 - DNA, 20 bp, mouse
gggtgccgaggctctgtcag

SEQ ID NO: 734468 - DNA, 20 bp, mouse
gtggtggctggcgtcagtct

SEQ ID NO: 734469 - DNA, 20 bp, mouse
gtgtcggcacagggaaccca

SEQ ID NO: 734470 - DNA, 20 bp, mouse
ggacagagcctcggcaccgt

SEQ ID NO: 734471 - DNA, 20 bp, mouse
gcagggaacccacggtgccg

SEQ ID NO: 734472 - DNA, 20 bp, mouse
gctacagggccgggtgggga

SEQ ID NO: 734473 - DNA, 20 bp, mouse
gtgcttcccttcaaaaactg

SEQ ID NO: 734474 - DNA, 20 bp, mouse
ggaagcaagctgaatcaccc

SEQ ID NO: 734475 - DNA, 20 bp, mouse
gtctgggaactgtcggcaca

SEQ ID NO: 734476 - DNA, 20 bp, mouse
gcggccgcggccgggtgaga

SEQ ID NO: 734477 - DNA, 20 bp, mouse
gcgaggccgccccccctcga

SEQ ID NO: 734478 - DNA, 20 bp, mouse
gatgaggggccgggcgagaa

SEQ ID NO: 734479 - DNA, 20 bp, mouse
ggccccgccccgtcctccct

SEQ ID NO: 734480 - DNA, 20 bp, mouse
gcggcgtggccctcgagggg

SEQ ID NO: 734481 - DNA, 20 bp, mouse
gaatgggacgccggcgtcgg

SEQ ID NO: 734482 - DNA, 20 bp, mouse
ggcgccctctcacccggccg

SEQ ID NO: 734483 - DNA, 20 bp, mouse
gggcctcgcgccctctcacc

SEQ ID NO: 734484 - DNA, 20 bp, mouse
gcccccgcgccgcgagccaa

SEQ ID NO: 734485 - DNA, 20 bp, mouse
ggcggcggcgcggggatgag

SEQ ID NO: 734486 - DNA, 20 bp, mouse
gcggacacggcccacgtggc

SEQ ID NO: 734487 - DNA, 20 bp, mouse
gcagtgggagccagccacgt

SEQ ID NO: 734488 - DNA, 20 bp, mouse
gaacgcggacacggcccacg

SEQ ID NO: 734489 - DNA, 20 bp, mouse
gcccactgtagtcagtgaaa

SEQ ID NO: 734490 - DNA, 20 bp, mouse
gtagtccccaaacgcggaca

SEQ ID NO: 734491 - DNA, 20 bp, mouse
gtgggccgtgtccgcgtttg

SEQ ID NO: 734492 - DNA, 20 bp, mouse
ggaggcgagaaggttctatc

SEQ ID NO: 734493 - DNA, 20 bp, mouse
gccacttcctgtcaagtctc

SEQ ID NO: 734494 - DNA, 20 bp, mouse
gcacttcttgagattctcta

SEQ ID NO: 734495 - DNA, 20 bp, mouse
ggaaatgtagtccccaaacg

SEQ ID NO: 734496 - DNA, 20 bp, mouse
gacgccatgatgctcgtctc

SEQ ID NO: 734497 - DNA, 20 bp, mouse
gggtcagtgcagcacgccag

SEQ ID NO: 734498 - DNA, 20 bp, mouse
ggcagacggccgccatgatg

SEQ ID NO: 734499 - DNA, 20 bp, mouse
gtacgacagccggtgggagg

SEQ ID NO: 734500 - DNA, 20 bp, mouse
gtcccaccggctgtcgtaaa

SEQ ID NO: 734501 - DNA, 20 bp, mouse
gacgagcatcatggcgtctc

SEQ ID NO: 734502 - DNA, 20 bp, mouse
ggagttgtcggggggaagga

SEQ ID NO: 734503 - DNA, 20 bp, mouse
ggccggcattcattgcacag

SEQ ID NO: 734504 - DNA, 20 bp, mouse
gaatggagagagagttgtcg

SEQ ID NO: 734505 - DNA, 20 bp, mouse
gcggccgccatgatgcggta

SEQ ID NO: 734506 - DNA, 20 bp, mouse
ggggacccgccaccgaatga

SEQ ID NO: 734507 - DNA, 20 bp, mouse
gcgcgggccaggaaagcttt

SEQ ID NO: 734508 - DNA, 20 bp, mouse
ggaaccgaaccgcgattcgc

SEQ ID NO: 734509 - DNA, 20 bp, mouse
gcctgcgcacctaagtacgc

SEQ ID NO: 734510 - DNA, 20 bp, mouse
gcagaaggcgctgtctcccg

SEQ ID NO: 734511 - DNA, 20 bp, mouse
gtggcccgcgaatcgcggtt

SEQ ID NO: 734512 - DNA, 20 bp, mouse
gtagacgcccaaagctttcc

SEQ ID NO: 734513 - DNA, 20 bp, mouse
gcacctaagtacgcgggagc

SEQ ID NO: 734514 - DNA, 20 bp, mouse
ggcaagaaagctaatcccga

SEQ ID NO: 734515 - DNA, 20 bp, mouse
gtaacagcgcgtgcgacttc

SEQ ID NO: 734516 - DNA, 20 bp, mouse
gagtgctgaaggcgcagctt

SEQ ID NO: 734517 - DNA, 20 bp, mouse
ggacgccggtggctgtgagg

SEQ ID NO: 734518 - DNA, 20 bp, mouse
gggcgtcgctgggtaaacct

SEQ ID NO: 734519 - DNA, 20 bp, mouse
ggcggagcacgcgcagtaga

SEQ ID NO: 734520 - DNA, 20 bp, mouse
gaggttcaggaaatgatcta

SEQ ID NO: 734521 - DNA, 20 bp, mouse
ggatgtgcatggagcggaat

SEQ ID NO: 734522 - DNA, 20 bp, mouse
gtgcctccgcggccagcaag

SEQ ID NO: 734523 - DNA, 20 bp, mouse
gggccagcaagcggctaccc

SEQ ID NO: 734524 - DNA, 20 bp, mouse
gtcacagccaccggcgtcgc

SEQ ID NO: 734525 - DNA, 20 bp, mouse
gaaaacctctcccctgcctt

SEQ ID NO: 734526 - DNA, 20 bp, mouse
gctaccaccctggacgtcga

SEQ ID NO: 734527 - DNA, 20 bp, mouse
gtcctggcgccccgagtccg

SEQ ID NO: 734528 - DNA, 20 bp, mouse
ggaaacgcggacctgggaac

SEQ ID NO: 734529 - DNA, 20 bp, mouse
gactctgccagcacataata

SEQ ID NO: 734530 - DNA, 20 bp, mouse
gtggccctaggacagtgcga

SEQ ID NO: 734531 - DNA, 20 bp, mouse
ggatccggaaacctcccttc

SEQ ID NO: 734532 - DNA, 20 bp, mouse
gttaccctcgacgtccaggg

SEQ ID NO: 734533 - DNA, 20 bp, mouse
gacgtcgagggtaaggtggg

SEQ ID NO: 734534 - DNA, 20 bp, mouse
gtggacgtcgagggtaaggt

SEQ ID NO: 734535 - DNA, 20 bp, mouse
ggccacggctggatcttcgt

SEQ ID NO: 734536 - DNA, 20 bp, mouse
gctgcacccactctgaagat

SEQ ID NO: 734537 - DNA, 20 bp, mouse
gggcagggcgcgaggagcta

SEQ ID NO: 734538 - DNA, 20 bp, mouse
ggagctacgtccggctctcc

SEQ ID NO: 734539 - DNA, 20 bp, mouse
ggttctgcagctgaccgggt

SEQ ID NO: 734540 - DNA, 20 bp, mouse
gggcaagttctgcagctgac

SEQ ID NO: 734541 - DNA, 20 bp, mouse
gctgcagctgaccgggtggg

SEQ ID NO: 734542 - DNA, 20 bp, mouse
gtccgtggcaactgcaaggc

SEQ ID NO: 734543 - DNA, 20 bp, mouse
gaactgcaaggcagggcgcg

SEQ ID NO: 734544 - DNA, 20 bp, mouse
ggtcctgctttgtctctgtc

SEQ ID NO: 734545 - DNA, 20 bp, mouse
gcgcactttggcaagcgcag

SEQ ID NO: 734546 - DNA, 20 bp, mouse
gaagactcggggcgctccaa

SEQ ID NO: 734547 - DNA, 20 bp, mouse
gaacccgctcgcgacggtcc

SEQ ID NO: 734548 - DNA, 20 bp, mouse
ggagcgccccgagtcttgat

SEQ ID NO: 734549 - DNA, 20 bp, mouse
ggcacgcgtctggaggtgaa

SEQ ID NO: 734550 - DNA, 20 bp, mouse
gaagcgggaggcaggggacg

SEQ ID NO: 734551 - DNA, 20 bp, mouse
gaggggcggccgcacgcgtc

SEQ ID NO: 734552 - DNA, 20 bp, mouse
gctggctgcgagcttgagtt

SEQ ID NO: 734553 - DNA, 20 bp, mouse
gaaggccaaaagcgggaggc

SEQ ID NO: 734554 - DNA, 20 bp, mouse
gggcggccgcacgcgtctgg

SEQ ID NO: 734555 - DNA, 20 bp, mouse
gcagacagccaatcaagact

SEQ ID NO: 734556 - DNA, 20 bp, mouse
gggccccacccgcgtctcca

SEQ ID NO: 734557 - DNA, 20 bp, mouse
gcccggatgcgtgcgtctga

SEQ ID NO: 734558 - DNA, 20 bp, mouse
ggtctccagggacacacgct

SEQ ID NO: 734559 - DNA, 20 bp, mouse
gccctccccaaccctgtgtt

SEQ ID NO: 734560 - DNA, 20 bp, mouse
gtgtgccaaacacagggttg

SEQ ID NO: 734561 - DNA, 20 bp, mouse
gagacgcacgcatccgggtg

SEQ ID NO: 734562 - DNA, 20 bp, mouse
gtgtccctggagacgcgggt

SEQ ID NO: 734563 - DNA, 20 bp, mouse
gcctgggcatgcgcaaacat

SEQ ID NO: 734564 - DNA, 20 bp, mouse
gtctcactgtgccaaacaca

SEQ ID NO: 734565 - DNA, 20 bp, mouse
ggaagcccagcgtgtgtccc

SEQ ID NO: 734566 - DNA, 20 bp, mouse
gcattggcgaaacgtcagag

SEQ ID NO: 734567 - DNA, 20 bp, mouse
gcctcactcgcgcaaccaac

SEQ ID NO: 734568 - DNA, 20 bp, mouse
gggttgcgcgagtgaggcgg

SEQ ID NO: 734569 - DNA, 20 bp, mouse
ggagaggcggggattttgat

SEQ ID NO: 734570 - DNA, 20 bp, mouse
gttcgccaatggaaagacgc

SEQ ID NO: 734571 - DNA, 20 bp, mouse
gggcgaaacgtcagagaggc

SEQ ID NO: 734572 - DNA, 20 bp, mouse
ggaatcctgcgtctttccat

SEQ ID NO: 734573 - DNA, 20 bp, mouse
gggcgcgtgtaaggatccga

SEQ ID NO: 734574 - DNA, 20 bp, mouse
gccgccctccctttgggagg

SEQ ID NO: 734575 - DNA, 20 bp, mouse
gaagccccgcccacggccct

SEQ ID NO: 734576 - DNA, 20 bp, mouse
gggaggaaggaccacatccg

SEQ ID NO: 734577 - DNA, 20 bp, mouse
gcctaccaagcactctcccg

SEQ ID NO: 734578 - DNA, 20 bp, mouse
ggcaaccccgggagagtgct

SEQ ID NO: 734579 - DNA, 20 bp, mouse
ggcaaagtgtgcgcgagcaa

SEQ ID NO: 734580 - DNA, 20 bp, mouse
gcgcgtgcacaagattcgtc

SEQ ID NO: 734581 - DNA, 20 bp, mouse
gggattgcgccgtgcaaccc

SEQ ID NO: 734582 - DNA, 20 bp, mouse
gcacaagattcgtcgggctc

SEQ ID NO: 734583 - DNA, 20 bp, mouse
gggttgccatggtaccaggg

SEQ ID NO: 734584 - DNA, 20 bp, mouse
gcgagctctgccctcggctt

SEQ ID NO: 734585 - DNA, 20 bp, mouse
gaccccaggtctaacaacta

SEQ ID NO: 734586 - DNA, 20 bp, mouse
gaccgagtcacgggaatcgc

SEQ ID NO: 734587 - DNA, 20 bp, mouse
ggtggcccatgatgtcataa

SEQ ID NO: 734588 - DNA, 20 bp, mouse
gcgctggtccattgatgtaa

SEQ ID NO: 734589 - DNA, 20 bp, mouse
gggctttaagaccgagtcac

SEQ ID NO: 734590 - DNA, 20 bp, mouse
gaatgaagtgttatcatcaa

SEQ ID NO: 734591 - DNA, 20 bp, mouse
gtataccttcagacaaaatg

SEQ ID NO: 734592 - DNA, 20 bp, mouse
gataagggcagctgtgactc

SEQ ID NO: 734593 - DNA, 20 bp, mouse
gggtcttaaagccagcgctc

SEQ ID NO: 734594 - DNA, 20 bp, mouse
gaccagcgattcccgtgact

SEQ ID NO: 734595 - DNA, 20 bp, mouse
gtgagttaagtcagacgtgg

SEQ ID NO: 734596 - DNA, 20 bp, mouse
gtcctgccaggggtggatca

SEQ ID NO: 734597 - DNA, 20 bp, mouse
gggcaggagagtaaatggtc

SEQ ID NO: 734598 - DNA, 20 bp, mouse
gcaatggtgtgtgacaggat

SEQ ID NO: 734599 - DNA, 20 bp, mouse
ggacagacacctcggaagat

SEQ ID NO: 734600 - DNA, 20 bp, mouse
gcccctggcaggagagtaaa

SEQ ID NO: 734601 - DNA, 20 bp, mouse
ggtgtgacaggatgggccct

SEQ ID NO: 734602 - DNA, 20 bp, mouse
gtaccctcctgactcaggct

SEQ ID NO: 734603 - DNA, 20 bp, mouse
gagagcagcagtcatcattg

SEQ ID NO: 734604 - DNA, 20 bp, mouse
gattcccaatggtgtgtgac

SEQ ID NO: 734605 - DNA, 20 bp, mouse
ggctctctggagctgttcag

SEQ ID NO: 734606 - DNA, 20 bp, mouse
gtgtgatgcagaaatcagta

SEQ ID NO: 734607 - DNA, 20 bp, mouse
gggccttatgacatcatcac

SEQ ID NO: 734608 - DNA, 20 bp, mouse
gtcttggctcagtcacacag

SEQ ID NO: 734609 - DNA, 20 bp, mouse
gagcagcctgacacatcaat

SEQ ID NO: 734610 - DNA, 20 bp, mouse
gtacggaaatttccgaagtt

SEQ ID NO: 734611 - DNA, 20 bp, mouse
gtggcttctaagagttgagt

SEQ ID NO: 734612 - DNA, 20 bp, mouse
ggggtctagtaatgatcttc

SEQ ID NO: 734613 - DNA, 20 bp, mouse
gaaatccccattgatgtgtc

SEQ ID NO: 734614 - DNA, 20 bp, mouse
ggtctcatttgagtaaagac

SEQ ID NO: 734615 - DNA, 20 bp, mouse
ggggagcccatccatgccta

SEQ ID NO: 734616 - DNA, 20 bp, mouse
gagccctgggcaatgctcca

SEQ ID NO: 734617 - DNA, 20 bp, mouse
gttgagtggtataaaggtgt

SEQ ID NO: 734618 - DNA, 20 bp, mouse
gcacctgtgttgtgtgtcac

SEQ ID NO: 734619 - DNA, 20 bp, mouse
gagccagtgacacacaacac

SEQ ID NO: 734620 - DNA, 20 bp, mouse
ggcaatgctccaggggacct

SEQ ID NO: 734621 - DNA, 20 bp, mouse
gaaggagtaaaaacatactg

SEQ ID NO: 734622 - DNA, 20 bp, mouse
gggaagctgggagaggactt

SEQ ID NO: 734623 - DNA, 20 bp, mouse
gtgtcactggctatgaccgg

SEQ ID NO: 734624 - DNA, 20 bp, mouse
gggaagcaagtagatttgag

SEQ ID NO: 734625 - DNA, 20 bp, mouse
ggtagatttgagtggtataa

SEQ ID NO: 734626 - DNA, 20 bp, mouse
gggtggagatgagtctgaga

SEQ ID NO: 734627 - DNA, 20 bp, mouse
ggactgcatgccccaaggat

SEQ ID NO: 734628 - DNA, 20 bp, mouse
gcagacagggcctcatgaga

SEQ ID NO: 734629 - DNA, 20 bp, mouse
gtcccaggagccttctcatg

SEQ ID NO: 734630 - DNA, 20 bp, mouse
gccagaaggaggcaaggctt

SEQ ID NO: 734631 - DNA, 20 bp, mouse
gctccactacaaccaggagg

SEQ ID NO: 734632 - DNA, 20 bp, mouse
ggccttgcctccttctggat

SEQ ID NO: 734633 - DNA, 20 bp, mouse
ggcctcatgagaaggctcct

SEQ ID NO: 734634 - DNA, 20 bp, mouse
gatgggtggagtccagtgat

SEQ ID NO: 734635 - DNA, 20 bp, mouse
ggctctccactacaaccagg

SEQ ID NO: 734636 - DNA, 20 bp, mouse
gcggctcgggaggagagaat

SEQ ID NO: 734637 - DNA, 20 bp, mouse
gttggcgcctgtggaggtga

SEQ ID NO: 734638 - DNA, 20 bp, mouse
ggcgggatggaggcgatgac

SEQ ID NO: 734639 - DNA, 20 bp, mouse
gccccgggccagtaagaccg

SEQ ID NO: 734640 - DNA, 20 bp, mouse
gcgaccgccagaggtttctg

SEQ ID NO: 734641 - DNA, 20 bp, mouse
ggccgcttacaaagacgaaa

SEQ ID NO: 734642 - DNA, 20 bp, mouse
ggcggggcgtgcgtcccaca

SEQ ID NO: 734643 - DNA, 20 bp, mouse
gacaaagacgaaagggcagg

SEQ ID NO: 734644 - DNA, 20 bp, mouse
gcccgcccctctccgcgctt

SEQ ID NO: 734645 - DNA, 20 bp, mouse
gcccacaaggccgcgcggcg

SEQ ID NO: 734646 - DNA, 20 bp, mouse
gccactggaggagcggggaa

SEQ ID NO: 734647 - DNA, 20 bp, mouse
ggcagtggtacggcccaagg

SEQ ID NO: 734648 - DNA, 20 bp, mouse
gcccaaggcggaagcagcgc

SEQ ID NO: 734649 - DNA, 20 bp, mouse
gcgctgggcagccgaggctc

SEQ ID NO: 734650 - DNA, 20 bp, mouse
gttgggccgtaccactgcag

SEQ ID NO: 734651 - DNA, 20 bp, mouse
gcacgcgggggagatgatcc

SEQ ID NO: 734652 - DNA, 20 bp, mouse
ggcaacgcggcgcgcgcgac

SEQ ID NO: 734653 - DNA, 20 bp, mouse
gcgcgcgcgccgcgttgcta

SEQ ID NO: 734654 - DNA, 20 bp, mouse
gacccgctctgccgcagcga

SEQ ID NO: 734655 - DNA, 20 bp, mouse
gcggtccccggtgaaggtgg

SEQ ID NO: 734656 - DNA, 20 bp, mouse
gcagggagacgagaaacttc

SEQ ID NO: 734657 - DNA, 20 bp, mouse
gcagccacgcagaaatgggc

SEQ ID NO: 734658 - DNA, 20 bp, mouse
gtaaaggcatcttgggaagc

SEQ ID NO: 734659 - DNA, 20 bp, mouse
gattctgtgtaatttggaga

SEQ ID NO: 734660 - DNA, 20 bp, mouse
ggtggctattcagaagaaat

SEQ ID NO: 734661 - DNA, 20 bp, mouse
gacacacaacaaatagctca

SEQ ID NO: 734662 - DNA, 20 bp, mouse
ggcatcagagagcctcaaag

SEQ ID NO: 734663 - DNA, 20 bp, mouse
gttcgctcctgaatcctgaa

SEQ ID NO: 734664 - DNA, 20 bp, mouse
gaaacagccattcaggattc

SEQ ID NO: 734665 - DNA, 20 bp, mouse
gaagtttgtaaaggcatctt

SEQ ID NO: 734666 - DNA, 20 bp, mouse
gggaaggtgctgcacgctgg

SEQ ID NO: 734667 - DNA, 20 bp, mouse
ggctgcgcggctgctcacgc

SEQ ID NO: 734668 - DNA, 20 bp, mouse
gagggctgcaggcgagttgg

SEQ ID NO: 734669 - DNA, 20 bp, mouse
ggtgctgcacgctgggggag

SEQ ID NO: 734670 - DNA, 20 bp, mouse
gacggcttggagagaaaccg

SEQ ID NO: 734671 - DNA, 20 bp, mouse
gagtgcgggtggtttgtgcg

SEQ ID NO: 734672 - DNA, 20 bp, mouse
gcaaaccacccgcactcacc

SEQ ID NO: 734673 - DNA, 20 bp, mouse
gcgaggaaggtgctgcacgc

SEQ ID NO: 734674 - DNA, 20 bp, mouse
gccgccttggagtaggcatg

SEQ ID NO: 734675 - DNA, 20 bp, mouse
gggaaggagaaggatttcga

SEQ ID NO: 734676 - DNA, 20 bp, mouse
gcagctgggcgtggactcaa

SEQ ID NO: 734677 - DNA, 20 bp, mouse
gcgcaagtggagagcgaaga

SEQ ID NO: 734678 - DNA, 20 bp, mouse
gctccccggagcgagcggaa

SEQ ID NO: 734679 - DNA, 20 bp, mouse
gtggagagcgaagagggcag

SEQ ID NO: 734680 - DNA, 20 bp, mouse
ggccgcagatagggcgacag

SEQ ID NO: 734681 - DNA, 20 bp, mouse
gtccacttgcggaagcgagg

SEQ ID NO: 734682 - DNA, 20 bp, mouse
gcggaggagtgtcgggacaa

SEQ ID NO: 734683 - DNA, 20 bp, mouse
gggggcgtggtcagtattac

SEQ ID NO: 734684 - DNA, 20 bp, mouse
gggcgacagcggaggagtgt

SEQ ID NO: 734685 - DNA, 20 bp, mouse
gcgctccggggagcgcagct

SEQ ID NO: 734686 - DNA, 20 bp, mouse
gcgcctcccgcgagaggaag

SEQ ID NO: 734687 - DNA, 20 bp, mouse
gcggcggcgcgctcccaccg

SEQ ID NO: 734688 - DNA, 20 bp, mouse
ggtgaataacggggccgggc

SEQ ID NO: 734689 - DNA, 20 bp, mouse
gaggacccgcctcccgcgag

SEQ ID NO: 734690 - DNA, 20 bp, mouse
gctgcgctgtgcggccagta

SEQ ID NO: 734691 - DNA, 20 bp, mouse
gcccaccgcggtgaataacg

SEQ ID NO: 734692 - DNA, 20 bp, mouse
ggccgtgcagcgacccctac

SEQ ID NO: 734693 - DNA, 20 bp, mouse
gctccagctgcaggggtcca

SEQ ID NO: 734694 - DNA, 20 bp, mouse
ggcgacttggagcatccgga

SEQ ID NO: 734695 - DNA, 20 bp, mouse
ggccagtaggggtcgctgca

SEQ ID NO: 734696 - DNA, 20 bp, mouse
gaggggtggtgtcccagcgg

SEQ ID NO: 734697 - DNA, 20 bp, mouse
ggacaggttagtgaaaggaa

SEQ ID NO: 734698 - DNA, 20 bp, mouse
gaacgggaagcgtcccatcc

SEQ ID NO: 734699 - DNA, 20 bp, mouse
gtcgtgccgcagggaaccct

SEQ ID NO: 734700 - DNA, 20 bp, mouse
gctagctcacgatctctaag

SEQ ID NO: 734701 - DNA, 20 bp, mouse
gagagatcgtgagctagctt

SEQ ID NO: 734702 - DNA, 20 bp, mouse
gggttccctgcggcacgaac

SEQ ID NO: 734703 - DNA, 20 bp, mouse
gagaggaactacaaaaccca

SEQ ID NO: 734704 - DNA, 20 bp, mouse
gtcccggcgtgaccgcagtg

SEQ ID NO: 734705 - DNA, 20 bp, mouse
gtaaggccccgctgctcatc

SEQ ID NO: 734706 - DNA, 20 bp, mouse
gaatcccaggcttgctgtat

SEQ ID NO: 734707 - DNA, 20 bp, mouse
ggggctgcaggggcggaggt

SEQ ID NO: 734708 - DNA, 20 bp, mouse
gtggccagagccgtgagttc

SEQ ID NO: 734709 - DNA, 20 bp, mouse
gagcggagcaacaagttcca

SEQ ID NO: 734710 - DNA, 20 bp, mouse
gagctgtgagagcttggaga

SEQ ID NO: 734711 - DNA, 20 bp, mouse
gggagcgcctatcccaaatc

SEQ ID NO: 734712 - DNA, 20 bp, mouse
ggcggaggtggggctcttgt

SEQ ID NO: 734713 - DNA, 20 bp, mouse
gaacgtgtgccaatcccgac

SEQ ID NO: 734714 - DNA, 20 bp, mouse
gtctgggattctgatgttat

SEQ ID NO: 734715 - DNA, 20 bp, mouse
gagcacgtccctggccgtaa

SEQ ID NO: 734716 - DNA, 20 bp, mouse
gaaaaccggcgcggagtcgt

SEQ ID NO: 734717 - DNA, 20 bp, mouse
gagccggggcccacactccc

SEQ ID NO: 734718 - DNA, 20 bp, mouse
gagttcgctgagacagtcta

SEQ ID NO: 734719 - DNA, 20 bp, mouse
gtgggaggaccagggagtgt

SEQ ID NO: 734720 - DNA, 20 bp, mouse
gggccaggcacgcagaaaac

SEQ ID NO: 734721 - DNA, 20 bp, mouse
gccgccgcagcggataggcc

SEQ ID NO: 734722 - DNA, 20 bp, mouse
ggaccagggagtgtgggccc

SEQ ID NO: 734723 - DNA, 20 bp, mouse
gccacctggcctatccgctg

SEQ ID NO: 734724 - DNA, 20 bp, mouse
gtcggctgggtgttaatttg

SEQ ID NO: 734725 - DNA, 20 bp, mouse
gcttgaggttcgtaagagaa

SEQ ID NO: 734726 - DNA, 20 bp, mouse
gggtccagctagggtgttgg

SEQ ID NO: 734727 - DNA, 20 bp, mouse
gtggaccagccccaaagcac

SEQ ID NO: 734728 - DNA, 20 bp, mouse
gggggcgggtcgggagagct

SEQ ID NO: 734729 - DNA, 20 bp, mouse
gtcgccaccaacaccctagc

SEQ ID NO: 734730 - DNA, 20 bp, mouse
ggtgaagaccccaggacagt

SEQ ID NO: 734731 - DNA, 20 bp, mouse
ggggtcgggagagctgggtg

SEQ ID NO: 734732 - DNA, 20 bp, mouse
gagtggggttggccgactga

SEQ ID NO: 734733 - DNA, 20 bp, mouse
gggccagtgcatattagaat

SEQ ID NO: 734734 - DNA, 20 bp, mouse
gttggtggcgactgcaggtg

SEQ ID NO: 734735 - DNA, 20 bp, mouse
gaggaatgggatactgagtg

SEQ ID NO: 734736 - DNA, 20 bp, mouse
gtctgtgacacaaacttttc

SEQ ID NO: 734737 - DNA, 20 bp, mouse
gggctcctccttctagggaa

SEQ ID NO: 734738 - DNA, 20 bp, mouse
gttccttccttgctctctaa

SEQ ID NO: 734739 - DNA, 20 bp, mouse
gctgcaggccaggatgcaat

SEQ ID NO: 734740 - DNA, 20 bp, mouse
gctatagagggtattcaaat

SEQ ID NO: 734741 - DNA, 20 bp, mouse
gtagtagtggcccaagattg

SEQ ID NO: 734742 - DNA, 20 bp, mouse
gtaaactgcttcctcttgtt

SEQ ID NO: 734743 - DNA, 20 bp, mouse
gtcagcccttccctagaagg

SEQ ID NO: 734744 - DNA, 20 bp, mouse
gtcctggcctgcagcccagc

SEQ ID NO: 734745 - DNA, 20 bp, mouse
ggctgggaattcctaacaag

SEQ ID NO: 734746 - DNA, 20 bp, mouse
gggcgtaggagaggcgggtg

SEQ ID NO: 734747 - DNA, 20 bp, mouse
gcccacctctgggcttcgtg

SEQ ID NO: 734748 - DNA, 20 bp, mouse
gtcccgcgggggcgtaggag

SEQ ID NO: 734749 - DNA, 20 bp, mouse
gtacgcccccgcgggaagca

SEQ ID NO: 734750 - DNA, 20 bp, mouse
gcgcgggggcgtaggagagg

SEQ ID NO: 734751 - DNA, 20 bp, mouse
gtcctcacgaagcccagagg

SEQ ID NO: 734752 - DNA, 20 bp, mouse
gccaacccaagcagaagcgc

SEQ ID NO: 734753 - DNA, 20 bp, mouse
gaggaaccctgcttcccgcg

SEQ ID NO: 734754 - DNA, 20 bp, mouse
ggaggggcggaccggcgcca

SEQ ID NO: 734755 - DNA, 20 bp, mouse
gcagcagctctggcggtcgg

SEQ ID NO: 734756 - DNA, 20 bp, mouse
gcgcccccgcgcagtgggaa

SEQ ID NO: 734757 - DNA, 20 bp, mouse
gggcaccgcccccgcgcagt

SEQ ID NO: 734758 - DNA, 20 bp, mouse
ggtaaacagtctaagctcac

SEQ ID NO: 734759 - DNA, 20 bp, mouse
gttctctcacacttctgaaa

SEQ ID NO: 734760 - DNA, 20 bp, mouse
gctaaaggaaagatcttaac

SEQ ID NO: 734761 - DNA, 20 bp, mouse
ggtagagattgtttggcgcc

SEQ ID NO: 734762 - DNA, 20 bp, mouse
gtcccggagaaaggttaact

SEQ ID NO: 734763 - DNA, 20 bp, mouse
gtaactggacaaaagaactt

SEQ ID NO: 734764 - DNA, 20 bp, mouse
ggccaaacaatctctacttc

SEQ ID NO: 734765 - DNA, 20 bp, mouse
gaatgtgaacactgagagac

SEQ ID NO: 734766 - DNA, 20 bp, mouse
gggaaggagctctgctacgt

SEQ ID NO: 734767 - DNA, 20 bp, mouse
ggtaggagggagtccctaat

SEQ ID NO: 734768 - DNA, 20 bp, mouse
ggccgcccttgacgcgggga

SEQ ID NO: 734769 - DNA, 20 bp, mouse
gagctccttccccgcgtcaa

SEQ ID NO: 734770 - DNA, 20 bp, mouse
gacacccggccgggcggaag

SEQ ID NO: 734771 - DNA, 20 bp, mouse
gaggagctctgctacgtagg

SEQ ID NO: 734772 - DNA, 20 bp, mouse
gcccgtgtggcggaaggccg

SEQ ID NO: 734773 - DNA, 20 bp, mouse
ggtccctaatgggagaaccg

SEQ ID NO: 734774 - DNA, 20 bp, mouse
gcccgcgccgcccttgacgc

SEQ ID NO: 734775 - DNA, 20 bp, mouse
ggacctcggttctcccatta

SEQ ID NO: 734776 - DNA, 20 bp, mouse
ggggaggggagaagaacgac

SEQ ID NO: 734777 - DNA, 20 bp, mouse
gccgctgcagcgtggagacc

SEQ ID NO: 734778 - DNA, 20 bp, mouse
gcgcttgctagtccgcgcgg

SEQ ID NO: 734779 - DNA, 20 bp, mouse
gagtccgcgcggaggatgcc

SEQ ID NO: 734780 - DNA, 20 bp, mouse
ggggatggaggcggcccagg

SEQ ID NO: 734781 - DNA, 20 bp, mouse
gtgcagcggcgcctccatcc

SEQ ID NO: 734782 - DNA, 20 bp, mouse
gccctcgcggtcagtgatca

SEQ ID NO: 734783 - DNA, 20 bp, mouse
gccccggcaccgtgaaattc

SEQ ID NO: 734784 - DNA, 20 bp, mouse
gggagaccgggttttccccc

SEQ ID NO: 734785 - DNA, 20 bp, mouse
gtccatccctcagtccgcat

SEQ ID NO: 734786 - DNA, 20 bp, mouse
gtcacgctccacccaagcta

SEQ ID NO: 734787 - DNA, 20 bp, mouse
gcgacccctggaccagtgtc

SEQ ID NO: 734788 - DNA, 20 bp, mouse
ggcaagcgagcgcctcccag

SEQ ID NO: 734789 - DNA, 20 bp, mouse
gcactggtccaggggtcggg

SEQ ID NO: 734790 - DNA, 20 bp, mouse
gagggagtgctttggaactc

SEQ ID NO: 734791 - DNA, 20 bp, mouse
gccaagctatggccgagagc

SEQ ID NO: 734792 - DNA, 20 bp, mouse
gactcctgacactggtccag

SEQ ID NO: 734793 - DNA, 20 bp, mouse
ggcagcgccgccctttacta

SEQ ID NO: 734794 - DNA, 20 bp, mouse
gccagcctcagggagtgctt

SEQ ID NO: 734795 - DNA, 20 bp, mouse
ggcacatgccacccgacccc

SEQ ID NO: 734796 - DNA, 20 bp, mouse
ggggaacagcggctggaatc

SEQ ID NO: 734797 - DNA, 20 bp, mouse
ggatgcgccctgcgagacct

SEQ ID NO: 734798 - DNA, 20 bp, mouse
gaagacggggacggacagaa

SEQ ID NO: 734799 - DNA, 20 bp, mouse
gacctggggtgcggcgcgca

SEQ ID NO: 734800 - DNA, 20 bp, mouse
gctcgcagggcgcatccctg

SEQ ID NO: 734801 - DNA, 20 bp, mouse
ggtgcggcgcgcagggtcgc

SEQ ID NO: 734802 - DNA, 20 bp, mouse
ggggcagcccaggtctcgca

SEQ ID NO: 734803 - DNA, 20 bp, mouse
gtggccacgatggatctaag

SEQ ID NO: 734804 - DNA, 20 bp, mouse
gggcgggccccacgtgacgt

SEQ ID NO: 734805 - DNA, 20 bp, mouse
gaaatgagggcggggaacag

SEQ ID NO: 734806 - DNA, 20 bp, mouse
gaggcggcggaaaggcttct

SEQ ID NO: 734807 - DNA, 20 bp, mouse
gcagctaagggtgagagtat

SEQ ID NO: 734808 - DNA, 20 bp, mouse
gcaagactgctggaccgggg

SEQ ID NO: 734809 - DNA, 20 bp, mouse
gactgctggaccggggaggg

SEQ ID NO: 734810 - DNA, 20 bp, mouse
gtcggcggaccactttctca

SEQ ID NO: 734811 - DNA, 20 bp, mouse
gtgcgcactgtgtcactcgg

SEQ ID NO: 734812 - DNA, 20 bp, mouse
gccgccgcctagcctcttac

SEQ ID NO: 734813 - DNA, 20 bp, mouse
gaagggtgagagtatagggg

SEQ ID NO: 734814 - DNA, 20 bp, mouse
gagagctcacagagtctatt

SEQ ID NO: 734815 - DNA, 20 bp, mouse
ggtccctgtaagaggctagg

SEQ ID NO: 734816 - DNA, 20 bp, mouse
gcagctctggagaacaacag

SEQ ID NO: 734817 - DNA, 20 bp, mouse
gcagagacccgcctacccgc

SEQ ID NO: 734818 - DNA, 20 bp, mouse
gcggggcggagccagcgggt

SEQ ID NO: 734819 - DNA, 20 bp, mouse
gctaactctcgcgagatcct

SEQ ID NO: 734820 - DNA, 20 bp, mouse
gtgggcgcctcattacatca

SEQ ID NO: 734821 - DNA, 20 bp, mouse
ggcggagccagcgggtaggc

SEQ ID NO: 734822 - DNA, 20 bp, mouse
gtctcgcgagatcctcggac

SEQ ID NO: 734823 - DNA, 20 bp, mouse
ggcccggggtccgcgctcgc

SEQ ID NO: 734824 - DNA, 20 bp, mouse
gtcaaagttactaacctccc

SEQ ID NO: 734825 - DNA, 20 bp, mouse
ggaaggaagcagtctcgcgc

SEQ ID NO: 734826 - DNA, 20 bp, mouse
gcggtggcgcgggcccgagg

SEQ ID NO: 734827 - DNA, 20 bp, mouse
gcgggcccgcggtagccccg

SEQ ID NO: 734828 - DNA, 20 bp, mouse
gagaaggggaagaccatcat

SEQ ID NO: 734829 - DNA, 20 bp, mouse
gggggagtggagtggagcaa

SEQ ID NO: 734830 - DNA, 20 bp, mouse
gaggctgttgtagagctaag

SEQ ID NO: 734831 - DNA, 20 bp, mouse
ggcccgcggtagccccgggg

SEQ ID NO: 734832 - DNA, 20 bp, mouse
gcgggcccgcgccaccgccc

SEQ ID NO: 734833 - DNA, 20 bp, mouse
gacgaaggagtggtgcgcac

SEQ ID NO: 734834 - DNA, 20 bp, mouse
gcaccgccccggggctaccg

SEQ ID NO: 734835 - DNA, 20 bp, mouse
gtggccacctcggctgacct

SEQ ID NO: 734836 - DNA, 20 bp, mouse
ggccggccgccaatgaacag

SEQ ID NO: 734837 - DNA, 20 bp, mouse
gttgtgcaacccggaggtgg

SEQ ID NO: 734838 - DNA, 20 bp, mouse
gggccgccaatgaacagcgg

SEQ ID NO: 734839 - DNA, 20 bp, mouse
gcggcagcgcgtgtgagcgt

SEQ ID NO: 734840 - DNA, 20 bp, mouse
gaacttccgcacctccaggc

SEQ ID NO: 734841 - DNA, 20 bp, mouse
gacactggggaggaagggcg

SEQ ID NO: 734842 - DNA, 20 bp, mouse
gtcaagcttgtgcaacccgg

SEQ ID NO: 734843 - DNA, 20 bp, mouse
ggctccagccgccagcctgg

SEQ ID NO: 734844 - DNA, 20 bp, mouse
gcgccgccgctgttcattgg

SEQ ID NO: 734845 - DNA, 20 bp, mouse
ggctccccgcagccgcgacg

SEQ ID NO: 734846 - DNA, 20 bp, mouse
gaagcagtggcgggaaaaga

SEQ ID NO: 734847 - DNA, 20 bp, mouse
ggggaaatgtagtcccgtcg

SEQ ID NO: 734848 - DNA, 20 bp, mouse
gaagctggggttcgcacaca

SEQ ID NO: 734849 - DNA, 20 bp, mouse
gcgtcggggctgcttcttaa

SEQ ID NO: 734850 - DNA, 20 bp, mouse
ggggtccatggagtgggtaa

SEQ ID NO: 734851 - DNA, 20 bp, mouse
gagagggcgcgcgctggtct

SEQ ID NO: 734852 - DNA, 20 bp, mouse
ggaaaccattacccactcca

SEQ ID NO: 734853 - DNA, 20 bp, mouse
gtccctgcgaagcggcctct

SEQ ID NO: 734854 - DNA, 20 bp, mouse
gcacacagggtccatggagt

SEQ ID NO: 734855 - DNA, 20 bp, mouse
ggccccagaggccgcttcgc

SEQ ID NO: 734856 - DNA, 20 bp, mouse
ggggccgcgcgcgccaggga

SEQ ID NO: 734857 - DNA, 20 bp, mouse
gcgcgcacgcgatcgagaaa

SEQ ID NO: 734858 - DNA, 20 bp, mouse
ggggtgacacgggactcttg

SEQ ID NO: 734859 - DNA, 20 bp, mouse
gcgcgagagagcgcagaggg

SEQ ID NO: 734860 - DNA, 20 bp, mouse
gggcgcgcgagagagcgcag

SEQ ID NO: 734861 - DNA, 20 bp, mouse
ggaaacggaagaatccaggg

SEQ ID NO: 734862 - DNA, 20 bp, mouse
ggcgctagggccgcgtgaac

SEQ ID NO: 734863 - DNA, 20 bp, mouse
gcgcgtgcgcgccgggactg

SEQ ID NO: 734864 - DNA, 20 bp, mouse
gtgggtaggcggggtgacac

SEQ ID NO: 734865 - DNA, 20 bp, mouse
ggcggcgtgcagctcggtcc

SEQ ID NO: 734866 - DNA, 20 bp, mouse
gggccgacagggaggaatct

SEQ ID NO: 734867 - DNA, 20 bp, mouse
gcgcggaggaggggccgaca

SEQ ID NO: 734868 - DNA, 20 bp, mouse
gcggggaggcgggatgaaac

SEQ ID NO: 734869 - DNA, 20 bp, mouse
gaccgccgaagaggggggag

SEQ ID NO: 734870 - DNA, 20 bp, mouse
gacagaggaagtgtaaaggg

SEQ ID NO: 734871 - DNA, 20 bp, mouse
gtcccctcccccctcttcgg

SEQ ID NO: 734872 - DNA, 20 bp, mouse
gtgcccagattcctccctgt

SEQ ID NO: 734873 - DNA, 20 bp, mouse
gcagacagaggaagtgtaaa

SEQ ID NO: 734874 - DNA, 20 bp, mouse
gcacacaccgccgaagaggg

SEQ ID NO: 734875 - DNA, 20 bp, mouse
ggtacacacaccgccgaaga

SEQ ID NO: 734876 - DNA, 20 bp, mouse
ggcaaccgccccaacgtcga

SEQ ID NO: 734877 - DNA, 20 bp, mouse
gccgtgtcggcccagtgcgc

SEQ ID NO: 734878 - DNA, 20 bp, mouse
gagactgctcggtgaaaagt

SEQ ID NO: 734879 - DNA, 20 bp, mouse
gacccagctcacctggctcg

SEQ ID NO: 734880 - DNA, 20 bp, mouse
gggctccaccccttcgacgt

SEQ ID NO: 734881 - DNA, 20 bp, mouse
gaaccgcgagccaggtgagc

SEQ ID NO: 734882 - DNA, 20 bp, mouse
gcgtgtacgccagtgcgacg

SEQ ID NO: 734883 - DNA, 20 bp, mouse
ggcgttcccagcatgcctgt

SEQ ID NO: 734884 - DNA, 20 bp, mouse
gggcgtgcaccgggagaccc

SEQ ID NO: 734885 - DNA, 20 bp, mouse
gcaccccttcgacgttgggg

SEQ ID NO: 734886 - DNA, 20 bp, mouse
gctagagcccaccgggtcaa

SEQ ID NO: 734887 - DNA, 20 bp, mouse
ggggacagcccttgacccgg

SEQ ID NO: 734888 - DNA, 20 bp, mouse
gggcaagccacgccctctca

SEQ ID NO: 734889 - DNA, 20 bp, mouse
gaagccacgccctctcaagg

SEQ ID NO: 734890 - DNA, 20 bp, mouse
gttgtgcctgggtgtcccgc

SEQ ID NO: 734891 - DNA, 20 bp, mouse
gccgccctgcactccgcctc

SEQ ID NO: 734892 - DNA, 20 bp, mouse
ggtactcagaaatcctcaac

SEQ ID NO: 734893 - DNA, 20 bp, mouse
gcataccgacttgtcccatc

SEQ ID NO: 734894 - DNA, 20 bp, mouse
gtgaaggtggaggcatgcaa

SEQ ID NO: 734895 - DNA, 20 bp, mouse
gaggaactttatagagccgg

SEQ ID NO: 734896 - DNA, 20 bp, mouse
gaggggcgccgagctgtctg

SEQ ID NO: 734897 - DNA, 20 bp, mouse
gctacagggtatctggggac

SEQ ID NO: 734898 - DNA, 20 bp, mouse
gtcccaaaggagcccggcga

SEQ ID NO: 734899 - DNA, 20 bp, mouse
gacaggctacagggtatctg

SEQ ID NO: 734900 - DNA, 20 bp, mouse
gacagctcggcgcccctcgc

SEQ ID NO: 734901 - DNA, 20 bp, mouse
gggcgcggggtggtggcgag

SEQ ID NO: 734902 - DNA, 20 bp, mouse
gcccaccgcggggaagcccg

SEQ ID NO: 734903 - DNA, 20 bp, mouse
ggctgtctgcggtctcgcgg

SEQ ID NO: 734904 - DNA, 20 bp, mouse
gtggcccaaggtatgttgaa

SEQ ID NO: 734905 - DNA, 20 bp, mouse
ggaaccgggaggtcggggtg

SEQ ID NO: 734906 - DNA, 20 bp, mouse
gagctgcttaggagctataa

SEQ ID NO: 734907 - DNA, 20 bp, mouse
gagaggatgatgttgaggat

SEQ ID NO: 734908 - DNA, 20 bp, mouse
ggaaatgaaagtagcccgat

SEQ ID NO: 734909 - DNA, 20 bp, mouse
ggctataatgggagacagag

SEQ ID NO: 734910 - DNA, 20 bp, mouse
gagctctgatcttagaatgg

SEQ ID NO: 734911 - DNA, 20 bp, mouse
gagcctccaccctgacctaa

SEQ ID NO: 734912 - DNA, 20 bp, mouse
gtggaggctggcgcagaaag

SEQ ID NO: 734913 - DNA, 20 bp, mouse
gaggagggtgtgttcatcta

SEQ ID NO: 734914 - DNA, 20 bp, mouse
gagcagctctgatcttagaa

SEQ ID NO: 734915 - DNA, 20 bp, mouse
ggatctctgagttgtcccat

SEQ ID NO: 734916 - DNA, 20 bp, mouse
gggaccgctccctcggtggc

SEQ ID NO: 734917 - DNA, 20 bp, mouse
gcctacgcccctgccaccga

SEQ ID NO: 734918 - DNA, 20 bp, mouse
gcgtcctggggactttgggg

SEQ ID NO: 734919 - DNA, 20 bp, mouse
gccaaagtccccaggacgat

SEQ ID NO: 734920 - DNA, 20 bp, mouse
ggcagggtgaggcccacaca

SEQ ID NO: 734921 - DNA, 20 bp, mouse
gcacacagggaccgctccct

SEQ ID NO: 734922 - DNA, 20 bp, mouse
gggatgtggccacacctgga

SEQ ID NO: 734923 - DNA, 20 bp, mouse
ggtgcagggtcactacggga

SEQ ID NO: 734924 - DNA, 20 bp, mouse
ggggtgacgaagaggcaggg

SEQ ID NO: 734925 - DNA, 20 bp, mouse
ggtagggtgacgaagaggca

SEQ ID NO: 734926 - DNA, 20 bp, mouse
ggggattgggatctgagtaa

SEQ ID NO: 734927 - DNA, 20 bp, mouse
ggctccggtaccaggtatgt

SEQ ID NO: 734928 - DNA, 20 bp, mouse
gtcccggcggctccggtacc

SEQ ID NO: 734929 - DNA, 20 bp, mouse
gaggtgagctagtgccacag

SEQ ID NO: 734930 - DNA, 20 bp, mouse
gctgagagagtgatcagtga

SEQ ID NO: 734931 - DNA, 20 bp, mouse
gaagggctccagacgtcact

SEQ ID NO: 734932 - DNA, 20 bp, mouse
gaaacccgtcccggcggctc

SEQ ID NO: 734933 - DNA, 20 bp, mouse
gtgggactcttgggccactc

SEQ ID NO: 734934 - DNA, 20 bp, mouse
gcttaagccacaccctgcct

SEQ ID NO: 734935 - DNA, 20 bp, mouse
gagcctggatgggctgtcac

SEQ ID NO: 734936 - DNA, 20 bp, mouse
ggaaaaggactccacggggt

SEQ ID NO: 734937 - DNA, 20 bp, mouse
gggtcccgcgcgcagagcga

SEQ ID NO: 734938 - DNA, 20 bp, mouse
gcatcctcggggtgtcgttc

SEQ ID NO: 734939 - DNA, 20 bp, mouse
gcagagaaggcggatttggc

SEQ ID NO: 734940 - DNA, 20 bp, mouse
gcggtcgcgcgagctaattg

SEQ ID NO: 734941 - DNA, 20 bp, mouse
ggagctaattgaggagcggg

SEQ ID NO: 734942 - DNA, 20 bp, mouse
ggggctgccccaaaaatggc

SEQ ID NO: 734943 - DNA, 20 bp, mouse
ggcgcgagctaattgaggag

SEQ ID NO: 734944 - DNA, 20 bp, mouse
gtgtcccgggcacgtgtcca

SEQ ID NO: 734945 - DNA, 20 bp, mouse
gacgtgcaaaagtgatttct

SEQ ID NO: 734946 - DNA, 20 bp, mouse
gagacacggggcgtagttct

SEQ ID NO: 734947 - DNA, 20 bp, mouse
gtctgcggcggggaccaact

SEQ ID NO: 734948 - DNA, 20 bp, mouse
gaagagcaactctgcgtctg

SEQ ID NO: 734949 - DNA, 20 bp, mouse
gggcaagcggttaccaccag

SEQ ID NO: 734950 - DNA, 20 bp, mouse
gcaactgggagcgatgagag

SEQ ID NO: 734951 - DNA, 20 bp, mouse
gagcagccgaagtcaatgat

SEQ ID NO: 734952 - DNA, 20 bp, mouse
gtagggtggggactgtagaa

SEQ ID NO: 734953 - DNA, 20 bp, mouse
gccaggtggctagatgtgga

SEQ ID NO: 734954 - DNA, 20 bp, mouse
gtcagtcagcagtagcacct

SEQ ID NO: 734955 - DNA, 20 bp, mouse
gatctccagatcagacccgg

SEQ ID NO: 734956 - DNA, 20 bp, mouse
gcattggggaggtgttgaaa

SEQ ID NO: 734957 - DNA, 20 bp, mouse
gatcagccctacatctataa

SEQ ID NO: 734958 - DNA, 20 bp, mouse
gagggagtgactgtgtataa

SEQ ID NO: 734959 - DNA, 20 bp, mouse
ggtgaggaatcatcagatta

SEQ ID NO: 734960 - DNA, 20 bp, mouse
gggatggcctgtcccagcta

SEQ ID NO: 734961 - DNA, 20 bp, mouse
gaaagcccccagatctggaa

SEQ ID NO: 734962 - DNA, 20 bp, mouse
gtgtcccagctaggggccat

SEQ ID NO: 734963 - DNA, 20 bp, mouse
gtgaaatggtggaaattcca

SEQ ID NO: 734964 - DNA, 20 bp, mouse
gaatagcaagactatgacag

SEQ ID NO: 734965 - DNA, 20 bp, mouse
gtcacctatggcccctagct

SEQ ID NO: 734966 - DNA, 20 bp, mouse
gaaaccctgagagccactat

SEQ ID NO: 734967 - DNA, 20 bp, mouse
gacacttgtgtcagccctca

SEQ ID NO: 734968 - DNA, 20 bp, mouse
gagggcctatagtggctctc

SEQ ID NO: 734969 - DNA, 20 bp, mouse
gcagccctcagggcctatag

SEQ ID NO: 734970 - DNA, 20 bp, mouse
gaatgagatagtgacatcag

SEQ ID NO: 734971 - DNA, 20 bp, mouse
gcggagccccgctgaccaat

SEQ ID NO: 734972 - DNA, 20 bp, mouse
gacaagccctctctatccat

SEQ ID NO: 734973 - DNA, 20 bp, mouse
gagtggctctcagggtttga

SEQ ID NO: 734974 - DNA, 20 bp, mouse
gagcaacaggttgtgatctt

SEQ ID NO: 734975 - DNA, 20 bp, mouse
gtgagggtctctgctccctg

SEQ ID NO: 734976 - DNA, 20 bp, mouse
gccctgagactggagaggta

SEQ ID NO: 734977 - DNA, 20 bp, mouse
gtagggcgtgcaccagagta

SEQ ID NO: 734978 - DNA, 20 bp, mouse
gaacacccacagcttgaagg

SEQ ID NO: 734979 - DNA, 20 bp, mouse
gtgtgctgtgtggggacctc

SEQ ID NO: 734980 - DNA, 20 bp, mouse
gtgtggggacctcaggcaga

SEQ ID NO: 734981 - DNA, 20 bp, mouse
gagaacccccttcaagctgt

SEQ ID NO: 734982 - DNA, 20 bp, mouse
ggccctacctctccagtctc

SEQ ID NO: 734983 - DNA, 20 bp, mouse
gccttcccctgagactggag

SEQ ID NO: 734984 - DNA, 20 bp, mouse
gagctcccttcccctgagac

SEQ ID NO: 734985 - DNA, 20 bp, mouse
gtccagtcttaacctcctga

SEQ ID NO: 734986 - DNA, 20 bp, mouse
gtcaacaggggtcgggatga

SEQ ID NO: 734987 - DNA, 20 bp, mouse
gactcaccgtcaacaggggt

SEQ ID NO: 734988 - DNA, 20 bp, mouse
gacggtgagtcagcacagca

SEQ ID NO: 734989 - DNA, 20 bp, mouse
gacactggaaggtctgacgc

SEQ ID NO: 734990 - DNA, 20 bp, mouse
gggtcgggatgagggattgg

SEQ ID NO: 734991 - DNA, 20 bp, mouse
ggctgactcaccgtcaacag

SEQ ID NO: 734992 - DNA, 20 bp, mouse
gtgcctgcctgggcccagcg

SEQ ID NO: 734993 - DNA, 20 bp, mouse
gtgggcccagcgggggagcg

SEQ ID NO: 734994 - DNA, 20 bp, mouse
gagcaggttcagacactgga

SEQ ID NO: 734995 - DNA, 20 bp, mouse
gccccccccgctcccccgct

SEQ ID NO: 734996 - DNA, 20 bp, mouse
gtgcccaggtagaggggaat

SEQ ID NO: 734997 - DNA, 20 bp, mouse
gtccccaggatcaaagtatg

SEQ ID NO: 734998 - DNA, 20 bp, mouse
gagacgacagaattggaaca

SEQ ID NO: 734999 - DNA, 20 bp, mouse
ggaaggagaccacttaaagg

SEQ ID NO: 735000 - DNA, 20 bp, mouse
gactgagtgcccaggtagag

SEQ ID NO: 735001 - DNA, 20 bp, mouse
ggaactcaagagaaaccggt

SEQ ID NO: 735002 - DNA, 20 bp, mouse
gaattggaacagggcagagt

SEQ ID NO: 735003 - DNA, 20 bp, mouse
gcctggggagacgacagaat

SEQ ID NO: 735004 - DNA, 20 bp, mouse
gagagaaaccggtgggcaga

SEQ ID NO: 735005 - DNA, 20 bp, mouse
gtgcacagtccatgccccca

SEQ ID NO: 735006 - DNA, 20 bp, mouse
ggggtgcgtgatgatgacgt

SEQ ID NO: 735007 - DNA, 20 bp, mouse
gtgcagggtttgtacggcaa

SEQ ID NO: 735008 - DNA, 20 bp, mouse
gggcaggcaagtcttcgcaa

SEQ ID NO: 735009 - DNA, 20 bp, mouse
gcgcgtgcgcagaaagtttt

SEQ ID NO: 735010 - DNA, 20 bp, mouse
gagtacgtgcagggtttgta

SEQ ID NO: 735011 - DNA, 20 bp, mouse
gacgcacccctgtacagaaa

SEQ ID NO: 735012 - DNA, 20 bp, mouse
gtcgtccggtggcagagctg

SEQ ID NO: 735013 - DNA, 20 bp, mouse
gcaaccttgaacctgactcg

SEQ ID NO: 735014 - DNA, 20 bp, mouse
gttcgcaagggcaagtggag

SEQ ID NO: 735015 - DNA, 20 bp, mouse
gtgcgcagaaagttttgggg

SEQ ID NO: 735016 - DNA, 20 bp, mouse
gcggactggagctaggggca

SEQ ID NO: 735017 - DNA, 20 bp, mouse
ggagcaggggacggtccaga

SEQ ID NO: 735018 - DNA, 20 bp, mouse
gaggagagaagtaactgcag

SEQ ID NO: 735019 - DNA, 20 bp, mouse
gccctagctccagtccgcaa

SEQ ID NO: 735020 - DNA, 20 bp, mouse
gaagacgcccggtcctcccg

SEQ ID NO: 735021 - DNA, 20 bp, mouse
gacggggacggttgaagggt

SEQ ID NO: 735022 - DNA, 20 bp, mouse
gcgcctctgcggcacggcca

SEQ ID NO: 735023 - DNA, 20 bp, mouse
gcggggagcgggggaggttt

SEQ ID NO: 735024 - DNA, 20 bp, mouse
gctccagtccgcaagggagg

SEQ ID NO: 735025 - DNA, 20 bp, mouse
gtgggcggctggtggcgacg

SEQ ID NO: 735026 - DNA, 20 bp, mouse
ggggaaacgcagcccggtgt

SEQ ID NO: 735027 - DNA, 20 bp, mouse
gggaacgcggcgccaatgca

SEQ ID NO: 735028 - DNA, 20 bp, mouse
gccggcctcggagaggggga

SEQ ID NO: 735029 - DNA, 20 bp, mouse
gccggcccggcctcggagag

SEQ ID NO: 735030 - DNA, 20 bp, mouse
ggggccgggctcattaatca

SEQ ID NO: 735031 - DNA, 20 bp, mouse
gggtccgtctcgctgtccgt

SEQ ID NO: 735032 - DNA, 20 bp, mouse
gttggcgccgcgttccccga

SEQ ID NO: 735033 - DNA, 20 bp, mouse
gaatgagcgtgaggcacggg

SEQ ID NO: 735034 - DNA, 20 bp, mouse
gaagcctggggccagttagt

SEQ ID NO: 735035 - DNA, 20 bp, mouse
gccgccccgcagccctgcat

SEQ ID NO: 735036 - DNA, 20 bp, mouse
gcgtgggagggttaacttga

SEQ ID NO: 735037 - DNA, 20 bp, mouse
gaatcagctgactggatgtg

SEQ ID NO: 735038 - DNA, 20 bp, mouse
gggtgcagaagaagcggctg

SEQ ID NO: 735039 - DNA, 20 bp, mouse
gagtaggagccctgcaccgc

SEQ ID NO: 735040 - DNA, 20 bp, mouse
gagccagggtgcagaagaag

SEQ ID NO: 735041 - DNA, 20 bp, mouse
gcctgcactcgggcgtggga

SEQ ID NO: 735042 - DNA, 20 bp, mouse
gagtgcaggaatttgagttt

SEQ ID NO: 735043 - DNA, 20 bp, mouse
gcggctgtggttagcagtga

SEQ ID NO: 735044 - DNA, 20 bp, mouse
gagctgactggatgtggggg

SEQ ID NO: 735045 - DNA, 20 bp, mouse
gggtggagattccaacaagg

SEQ ID NO: 735046 - DNA, 20 bp, mouse
gccacaggcagctaccccag

SEQ ID NO: 735047 - DNA, 20 bp, mouse
gcgcaagcggccaccagtaa

SEQ ID NO: 735048 - DNA, 20 bp, mouse
ggcagctaccccagcggtgg

SEQ ID NO: 735049 - DNA, 20 bp, mouse
gcctaggcgggaggggtctg

SEQ ID NO: 735050 - DNA, 20 bp, mouse
ggagctgccgcgtgaggcga

SEQ ID NO: 735051 - DNA, 20 bp, mouse
gcaccagtaaaggtgtgcgt

SEQ ID NO: 735052 - DNA, 20 bp, mouse
gggagggtccaacaaggggg

SEQ ID NO: 735053 - DNA, 20 bp, mouse
gtgtgcgtgggatggggacc

SEQ ID NO: 735054 - DNA, 20 bp, mouse
ggcaacccatcttgtcacga

SEQ ID NO: 735055 - DNA, 20 bp, mouse
gcgtccccgcccacttcact

SEQ ID NO: 735056 - DNA, 20 bp, mouse
gcgggagcggccagcgaggg

SEQ ID NO: 735057 - DNA, 20 bp, mouse
gaggttgtcaaaagccgcgg

SEQ ID NO: 735058 - DNA, 20 bp, mouse
gggccgtgcgcgcccaccgg

SEQ ID NO: 735059 - DNA, 20 bp, mouse
gggccacctcctcctccggt

SEQ ID NO: 735060 - DNA, 20 bp, mouse
gcacggcccgtctgctggtg

SEQ ID NO: 735061 - DNA, 20 bp, mouse
ggtgtcagacagctgtaaac

SEQ ID NO: 735062 - DNA, 20 bp, mouse
gcaccacgtgctcgccgtga

SEQ ID NO: 735063 - DNA, 20 bp, mouse
ggggcggggcctgtgctcaa

SEQ ID NO: 735064 - DNA, 20 bp, mouse
gccgtctgctggtgtgggtc

SEQ ID NO: 735065 - DNA, 20 bp, mouse
ggcgcgcccaccggaggagg

SEQ ID NO: 735066 - DNA, 20 bp, mouse
ggggaggggcagagagcgga

SEQ ID NO: 735067 - DNA, 20 bp, mouse
gcgccgccgaggccccgctg

SEQ ID NO: 735068 - DNA, 20 bp, mouse
gggcctcagcggggcctcgg

SEQ ID NO: 735069 - DNA, 20 bp, mouse
ggaggccccgctgaggccgg

SEQ ID NO: 735070 - DNA, 20 bp, mouse
gccaaggcgggagtcggcgg

SEQ ID NO: 735071 - DNA, 20 bp, mouse
ggcccctcccccggcctcag

SEQ ID NO: 735072 - DNA, 20 bp, mouse
gccccgctgaggccggggga

SEQ ID NO: 735073 - DNA, 20 bp, mouse
ggctaggcgagcaagagcgc

SEQ ID NO: 735074 - DNA, 20 bp, mouse
gaggtcgcatgcggtgtcca

SEQ ID NO: 735075 - DNA, 20 bp, mouse
gagcgccggcagtgcccgga

SEQ ID NO: 735076 - DNA, 20 bp, mouse
ggtaaactagaggagggcga

SEQ ID NO: 735077 - DNA, 20 bp, mouse
gacacagctcccggagagga

SEQ ID NO: 735078 - DNA, 20 bp, mouse
gagcggaagcggccaggggt

SEQ ID NO: 735079 - DNA, 20 bp, mouse
ggctcgcccggcctagagga

SEQ ID NO: 735080 - DNA, 20 bp, mouse
gtgcggagaccggggaagag

SEQ ID NO: 735081 - DNA, 20 bp, mouse
gcgcgacacagctcccggag

SEQ ID NO: 735082 - DNA, 20 bp, mouse
gggagagtgtaaactagagg

SEQ ID NO: 735083 - DNA, 20 bp, mouse
gggggacgcagcgaggggag

SEQ ID NO: 735084 - DNA, 20 bp, mouse
ggagtgctgcgcagagagga

SEQ ID NO: 735085 - DNA, 20 bp, mouse
gggaggagagtgtaaactag

SEQ ID NO: 735086 - DNA, 20 bp, mouse
gggtgtaggggctggcatga

SEQ ID NO: 735087 - DNA, 20 bp, mouse
gggtgcgcgggtgtaggggc

SEQ ID NO: 735088 - DNA, 20 bp, mouse
ggggaaagttggcaagcgtt

SEQ ID NO: 735089 - DNA, 20 bp, mouse
gctggcatgaggggttcctg

SEQ ID NO: 735090 - DNA, 20 bp, mouse
gaccgggtgcgcgggtgtag

SEQ ID NO: 735091 - DNA, 20 bp, mouse
ggggggaaagcgttaatggg

SEQ ID NO: 735092 - DNA, 20 bp, mouse
gggtgcgcggccagggcgga

SEQ ID NO: 735093 - DNA, 20 bp, mouse
gcacccgcgcacccggtgcg

SEQ ID NO: 735094 - DNA, 20 bp, mouse
gcgcacccggtgcgcggcca

SEQ ID NO: 735095 - DNA, 20 bp, mouse
gaggacagcccaaccctacc

SEQ ID NO: 735096 - DNA, 20 bp, mouse
gcgaggggagcgccagtgag

SEQ ID NO: 735097 - DNA, 20 bp, mouse
gtggccggcggcagccaacc

SEQ ID NO: 735098 - DNA, 20 bp, mouse
gttcccggggtgtagtcggt

SEQ ID NO: 735099 - DNA, 20 bp, mouse
ggagcgccagtgagcgggag

SEQ ID NO: 735100 - DNA, 20 bp, mouse
gccccccaccgactacaccc

SEQ ID NO: 735101 - DNA, 20 bp, mouse
gcccccggtgcaaagagcga

SEQ ID NO: 735102 - DNA, 20 bp, mouse
gggcaggagcctctggccgg

SEQ ID NO: 735103 - DNA, 20 bp, mouse
gactctcgagcgccggcccc

SEQ ID NO: 735104 - DNA, 20 bp, mouse
ggcgagacgcgcctggcggc

SEQ ID NO: 735105 - DNA, 20 bp, mouse
gctccttcccggggtgtagt

SEQ ID NO: 735106 - DNA, 20 bp, mouse
gctcccggggaatttggaga

SEQ ID NO: 735107 - DNA, 20 bp, mouse
gaggaggcaagaggcaagcg

SEQ ID NO: 735108 - DNA, 20 bp, mouse
gggcgagcacgctgcaccct

SEQ ID NO: 735109 - DNA, 20 bp, mouse
gcggcccccgaggaggcaag

SEQ ID NO: 735110 - DNA, 20 bp, mouse
gtcgggggccgcaggggagg

SEQ ID NO: 735111 - DNA, 20 bp, mouse
gagaccctctccaaattccc

SEQ ID NO: 735112 - DNA, 20 bp, mouse
gttgcctcttgcctcctcgg

SEQ ID NO: 735113 - DNA, 20 bp, mouse
gtcccctgcggcccccgagg

SEQ ID NO: 735114 - DNA, 20 bp, mouse
ggcctcccggcgagccgtgc

SEQ ID NO: 735115 - DNA, 20 bp, mouse
gcgtgagctgcaggcgaaag

SEQ ID NO: 735116 - DNA, 20 bp, mouse
ggcgaagcccgcaaggtcac

SEQ ID NO: 735117 - DNA, 20 bp, mouse
gtgcgctagcggaagtggga

SEQ ID NO: 735118 - DNA, 20 bp, mouse
gccagggcgctcgctctcag

SEQ ID NO: 735119 - DNA, 20 bp, mouse
gatcactgacgaggcaaggg

SEQ ID NO: 735120 - DNA, 20 bp, mouse
ggtcactgcgctagcggaag

SEQ ID NO: 735121 - DNA, 20 bp, mouse
gagccgtgtccccacttccg

SEQ ID NO: 735122 - DNA, 20 bp, mouse
gactcacccggactgtccaa

SEQ ID NO: 735123 - DNA, 20 bp, mouse
ggacagaccccccggaagtg

SEQ ID NO: 735124 - DNA, 20 bp, mouse
gaggtgacctgtgaccttgc

SEQ ID NO: 735125 - DNA, 20 bp, mouse
gtgggatggctccttccgta

SEQ ID NO: 735126 - DNA, 20 bp, mouse
gtgggtatagcgagataaga

SEQ ID NO: 735127 - DNA, 20 bp, mouse
gtgggtcggtaccaatagag

SEQ ID NO: 735128 - DNA, 20 bp, mouse
ggcctggaagcggaagagat

SEQ ID NO: 735129 - DNA, 20 bp, mouse
ggcccccaagcgtgcctatt

SEQ ID NO: 735130 - DNA, 20 bp, mouse
gcgtaggccctgcctggaag

SEQ ID NO: 735131 - DNA, 20 bp, mouse
gagagatgggcggagataaa

SEQ ID NO: 735132 - DNA, 20 bp, mouse
gcaaagagcgagttctccgt

SEQ ID NO: 735133 - DNA, 20 bp, mouse
gtattggtaccgacccactt

SEQ ID NO: 735134 - DNA, 20 bp, mouse
gcttccggaggaggggagaa

SEQ ID NO: 735135 - DNA, 20 bp, mouse
gtccacttgccgaagtgggt

SEQ ID NO: 735136 - DNA, 20 bp, mouse
gagagcgggaaggtccgaag

SEQ ID NO: 735137 - DNA, 20 bp, mouse
gctgaccgcgccctcggaag

SEQ ID NO: 735138 - DNA, 20 bp, mouse
gacaaccttgcacgccgctt

SEQ ID NO: 735139 - DNA, 20 bp, mouse
gaggtccgaagcggcgtgca

SEQ ID NO: 735140 - DNA, 20 bp, mouse
gaacgggcgcgccatccctc

SEQ ID NO: 735141 - DNA, 20 bp, mouse
gaggttgtctggtgctgcga

SEQ ID NO: 735142 - DNA, 20 bp, mouse
gctggtgctgcgatgggcgt

SEQ ID NO: 735143 - DNA, 20 bp, mouse
ggcgtggccaggcgcagagc

SEQ ID NO: 735144 - DNA, 20 bp, mouse
gccgagggcgcggtcagagg

SEQ ID NO: 735145 - DNA, 20 bp, mouse
gcgtggggatgctcggtttc

SEQ ID NO: 735146 - DNA, 20 bp, mouse
gggagtgtcttgtacatctg

SEQ ID NO: 735147 - DNA, 20 bp, mouse
gtctcccgctagttaccagg

SEQ ID NO: 735148 - DNA, 20 bp, mouse
gagactcaatctgcagatga

SEQ ID NO: 735149 - DNA, 20 bp, mouse
gacaagcagctgttaaagtc

SEQ ID NO: 735150 - DNA, 20 bp, mouse
gatagctgcaggaccttgac

SEQ ID NO: 735151 - DNA, 20 bp, mouse
gccaaggccttctaccccaa

SEQ ID NO: 735152 - DNA, 20 bp, mouse
ggcttgttctgttctggctt

SEQ ID NO: 735153 - DNA, 20 bp, mouse
ggtgcctcctggtaactagc

SEQ ID NO: 735154 - DNA, 20 bp, mouse
ggccttctaccccaaaggga

SEQ ID NO: 735155 - DNA, 20 bp, mouse
gagcgccccctggtgcctta

SEQ ID NO: 735156 - DNA, 20 bp, mouse
ggaaagggactggctctcaa

SEQ ID NO: 735157 - DNA, 20 bp, mouse
ggccttgtgaaggacctgaa

SEQ ID NO: 735158 - DNA, 20 bp, mouse
gaagggtcaaagctgtaacc

SEQ ID NO: 735159 - DNA, 20 bp, mouse
gaatgaaaagaaactgtagt

SEQ ID NO: 735160 - DNA, 20 bp, mouse
gccctggcccagctacaata

SEQ ID NO: 735161 - DNA, 20 bp, mouse
gaggacctgaagggcgttta

SEQ ID NO: 735162 - DNA, 20 bp, mouse
ggcccttcaggtccttcaca

SEQ ID NO: 735163 - DNA, 20 bp, mouse
gtaaggtatgccgtaggaaa

SEQ ID NO: 735164 - DNA, 20 bp, mouse
gagggagttttagagcacac

SEQ ID NO: 735165 - DNA, 20 bp, mouse
gatgagctgtgggtgtgaag

SEQ ID NO: 735166 - DNA, 20 bp, mouse
ggggctggcaggttgagtca

SEQ ID NO: 735167 - DNA, 20 bp, mouse
gatgacgtgtctgacgtgga

SEQ ID NO: 735168 - DNA, 20 bp, mouse
gtcagacacgtcatccgaaa

SEQ ID NO: 735169 - DNA, 20 bp, mouse
gaaactgggaggcaatggga

SEQ ID NO: 735170 - DNA, 20 bp, mouse
ggaacccagggcactgagac

SEQ ID NO: 735171 - DNA, 20 bp, mouse
ggtgtctgacgtggacggag

SEQ ID NO: 735172 - DNA, 20 bp, mouse
gaagttgtgggaccttcccc

SEQ ID NO: 735173 - DNA, 20 bp, mouse
gagagcttgctggtcctgtc

SEQ ID NO: 735174 - DNA, 20 bp, mouse
gcaaggctggccaggtaagg

SEQ ID NO: 735175 - DNA, 20 bp, mouse
gaggtggcactggagataat

SEQ ID NO: 735176 - DNA, 20 bp, mouse
gtcccctgcggctgcgcaaa

SEQ ID NO: 735177 - DNA, 20 bp, mouse
gtgcgcagccgcaggggact

SEQ ID NO: 735178 - DNA, 20 bp, mouse
gccgcccgacgacacctctc

SEQ ID NO: 735179 - DNA, 20 bp, mouse
gactcggagtgcgtgagcag

SEQ ID NO: 735180 - DNA, 20 bp, mouse
gtcgccctgagaggtgtcgt

SEQ ID NO: 735181 - DNA, 20 bp, mouse
gggaaccgtggtcccacttc

SEQ ID NO: 735182 - DNA, 20 bp, mouse
gagtgcgtgagcagcgggaa

SEQ ID NO: 735183 - DNA, 20 bp, mouse
gtgagcagcgggaacggcgg

SEQ ID NO: 735184 - DNA, 20 bp, mouse
gcctcccggaagtgggacca

SEQ ID NO: 735185 - DNA, 20 bp, mouse
gccagtggaagtcgtgacgt

SEQ ID NO: 735186 - DNA, 20 bp, mouse
gaggcggcggccggggaccc

SEQ ID NO: 735187 - DNA, 20 bp, mouse
ggcccgctcggcgagcccgc

SEQ ID NO: 735188 - DNA, 20 bp, mouse
gaggcttaatcctctcctgc

SEQ ID NO: 735189 - DNA, 20 bp, mouse
gcggcgcccaaggagcgacg

SEQ ID NO: 735190 - DNA, 20 bp, mouse
ggtggtggacaaggaggcgg

SEQ ID NO: 735191 - DNA, 20 bp, mouse
gtgcgtcagaccaatggcga

SEQ ID NO: 735192 - DNA, 20 bp, mouse
gccaaggagcgacgtggcct

SEQ ID NO: 735193 - DNA, 20 bp, mouse
gagcgggcagtggcgcgcgg

SEQ ID NO: 735194 - DNA, 20 bp, mouse
ggggctcgccgagcgggcag

SEQ ID NO: 735195 - DNA, 20 bp, mouse
gacgcgccgcgtcgtgtcct

SEQ ID NO: 735196 - DNA, 20 bp, mouse
gagcccgcggggtggagatg

SEQ ID NO: 735197 - DNA, 20 bp, mouse
gtgggctggggtagacacgg

SEQ ID NO: 735198 - DNA, 20 bp, mouse
ggggcttgctcgggagatga

SEQ ID NO: 735199 - DNA, 20 bp, mouse
gggggtagacacggaggcgc

SEQ ID NO: 735200 - DNA, 20 bp, mouse
gggagatgatggggacccgg

SEQ ID NO: 735201 - DNA, 20 bp, mouse
gctgcagagaggatctagga

SEQ ID NO: 735202 - DNA, 20 bp, mouse
gatctcccgagcaagcccca

SEQ ID NO: 735203 - DNA, 20 bp, mouse
ggggtgggctggggtagaca

SEQ ID NO: 735204 - DNA, 20 bp, mouse
gatgatggggacccggaggg

SEQ ID NO: 735205 - DNA, 20 bp, mouse
gcgctgcggcagagcccgcg

SEQ ID NO: 735206 - DNA, 20 bp, mouse
ggaacaggccacagagtggg

SEQ ID NO: 735207 - DNA, 20 bp, mouse
gaatgcagctggaaattctg

SEQ ID NO: 735208 - DNA, 20 bp, mouse
gggaagcaaaacatacctat

SEQ ID NO: 735209 - DNA, 20 bp, mouse
gaggaaagaaggggcccccg

SEQ ID NO: 735210 - DNA, 20 bp, mouse
gtcccactagagccccccat

SEQ ID NO: 735211 - DNA, 20 bp, mouse
gaagaaggggcccccgtggc

SEQ ID NO: 735212 - DNA, 20 bp, mouse
gggtttgagggacttggaac

SEQ ID NO: 735213 - DNA, 20 bp, mouse
ggaccaggactgctggagga

SEQ ID NO: 735214 - DNA, 20 bp, mouse
gttgcacaaggggccttgtc

SEQ ID NO: 735215 - DNA, 20 bp, mouse
gttagctgagaggtcctagc

SEQ ID NO: 735216 - DNA, 20 bp, mouse
gttgaacgaagcttcgggga

SEQ ID NO: 735217 - DNA, 20 bp, mouse
gccactgcttgctttggaga

SEQ ID NO: 735218 - DNA, 20 bp, mouse
gctggcgggacgggcgcgtg

SEQ ID NO: 735219 - DNA, 20 bp, mouse
ggaaaagcataggactggag

SEQ ID NO: 735220 - DNA, 20 bp, mouse
gccaggcagcgcagttcagc

SEQ ID NO: 735221 - DNA, 20 bp, mouse
gcgtgcactccactgcccgt

SEQ ID NO: 735222 - DNA, 20 bp, mouse
ggggggaaaaaagtgtttaa

SEQ ID NO: 735223 - DNA, 20 bp, mouse
gttagtctggcggtgattgg

SEQ ID NO: 735224 - DNA, 20 bp, mouse
gtctgcgccactgcttgctt

SEQ ID NO: 735225 - DNA, 20 bp, mouse
gggggaggctagcaggcggc

SEQ ID NO: 735226 - DNA, 20 bp, mouse
ggggccggggacgtccaagc

SEQ ID NO: 735227 - DNA, 20 bp, mouse
gccccgcggtggctccgctg

SEQ ID NO: 735228 - DNA, 20 bp, mouse
gcgcacggggcccggggaac

SEQ ID NO: 735229 - DNA, 20 bp, mouse
gccggtggcggagcaatccc

SEQ ID NO: 735230 - DNA, 20 bp, mouse
gcggccagggtccacccttc

SEQ ID NO: 735231 - DNA, 20 bp, mouse
gccgccgccggacagctcct

SEQ ID NO: 735232 - DNA, 20 bp, mouse
gcaccggggccccgctcccc

SEQ ID NO: 735233 - DNA, 20 bp, mouse
gcaaggtcagggtgcgtggt

SEQ ID NO: 735234 - DNA, 20 bp, mouse
gtggtggggtcgcagacacc

SEQ ID NO: 735235 - DNA, 20 bp, mouse
ggcgcctggaggggacttgg

SEQ ID NO: 735236 - DNA, 20 bp, mouse
gagcgccgaggggccccttg

SEQ ID NO: 735237 - DNA, 20 bp, mouse
ggaaagttgcggtcccacga

SEQ ID NO: 735238 - DNA, 20 bp, mouse
gaaggggggtagagagacat

SEQ ID NO: 735239 - DNA, 20 bp, mouse
gccttggggagggcgaaggg

SEQ ID NO: 735240 - DNA, 20 bp, mouse
gccgaggggccccttgggga

SEQ ID NO: 735241 - DNA, 20 bp, mouse
gggccccttggggagggcga

SEQ ID NO: 735242 - DNA, 20 bp, mouse
ggggacctcgcgaggagcgg

SEQ ID NO: 735243 - DNA, 20 bp, mouse
gggcgctcggggactcgtcc

SEQ ID NO: 735244 - DNA, 20 bp, mouse
gggggtggccgccagatcaa

SEQ ID NO: 735245 - DNA, 20 bp, mouse
gcccctcagcagcccctcgt

SEQ ID NO: 735246 - DNA, 20 bp, mouse
ggaggcctgcgactgctgtc

SEQ ID NO: 735247 - DNA, 20 bp, mouse
gcagtcgcaggcctccgcgg

SEQ ID NO: 735248 - DNA, 20 bp, mouse
ggaccgcagctggcccggcc

SEQ ID NO: 735249 - DNA, 20 bp, mouse
gcagcagtcgcaggcctccg

SEQ ID NO: 735250 - DNA, 20 bp, mouse
gaaggaccaggtctcgatct

SEQ ID NO: 735251 - DNA, 20 bp, mouse
ggagaccggacagcagtcgc

SEQ ID NO: 735252 - DNA, 20 bp, mouse
gacccgcccgcgccgtccct

SEQ ID NO: 735253 - DNA, 20 bp, mouse
ggtggcaggcgccgagccca

SEQ ID NO: 735254 - DNA, 20 bp, mouse
gcaggcgccgagcccaggga

SEQ ID NO: 735255 - DNA, 20 bp, mouse
ggtccggtctccaccaggcc

SEQ ID NO: 735256 - DNA, 20 bp, mouse
gtggtccgcagaagcctaag

SEQ ID NO: 735257 - DNA, 20 bp, mouse
gcctcggctgcgccctgtaa

SEQ ID NO: 735258 - DNA, 20 bp, mouse
ggccctcatcggctcttcat

SEQ ID NO: 735259 - DNA, 20 bp, mouse
gaaccaatgaagagccgatg

SEQ ID NO: 735260 - DNA, 20 bp, mouse
gagggaggggtagacacgta

SEQ ID NO: 735261 - DNA, 20 bp, mouse
gtccgcagaagcctaagggg

SEQ ID NO: 735262 - DNA, 20 bp, mouse
gctgcgccctgtaaggggga

SEQ ID NO: 735263 - DNA, 20 bp, mouse
gccgcctctcaagccctcat

SEQ ID NO: 735264 - DNA, 20 bp, mouse
gtcagtcatgagaatctgat

SEQ ID NO: 735265 - DNA, 20 bp, mouse
gtggcctgctcgggagggag

SEQ ID NO: 735266 - DNA, 20 bp, mouse
gtcgccccggatggagtgga

SEQ ID NO: 735267 - DNA, 20 bp, mouse
ggagcaggcggagagacaga

SEQ ID NO: 735268 - DNA, 20 bp, mouse
gtctccccggtcgccccgga

SEQ ID NO: 735269 - DNA, 20 bp, mouse
gaccaatgaaaatccacgga

SEQ ID NO: 735270 - DNA, 20 bp, mouse
ggcaccatccactccatccg

SEQ ID NO: 735271 - DNA, 20 bp, mouse
gcactccatccggggcgacc

SEQ ID NO: 735272 - DNA, 20 bp, mouse
gctcaatcttggctagtgta

SEQ ID NO: 735273 - DNA, 20 bp, mouse
gttggctagtgtagggttca

SEQ ID NO: 735274 - DNA, 20 bp, mouse
gatccacggagggagggcct

SEQ ID NO: 735275 - DNA, 20 bp, mouse
ggctcggcttctaacccgga

SEQ ID NO: 735276 - DNA, 20 bp, mouse
gggccctgggacgagatcaa

SEQ ID NO: 735277 - DNA, 20 bp, mouse
ggaccgaggtgcacacatat

SEQ ID NO: 735278 - DNA, 20 bp, mouse
gactctacttggttgttcaa

SEQ ID NO: 735279 - DNA, 20 bp, mouse
gtggcctcgggtgctgatcg

SEQ ID NO: 735280 - DNA, 20 bp, mouse
gtcggctcgacctgcccgga

SEQ ID NO: 735281 - DNA, 20 bp, mouse
gacctgcccggagggataga

SEQ ID NO: 735282 - DNA, 20 bp, mouse
gggccccattctagataagt

SEQ ID NO: 735283 - DNA, 20 bp, mouse
gactcggggaaagtggcctc

SEQ ID NO: 735284 - DNA, 20 bp, mouse
gttcactgacaggggaacgt

SEQ ID NO: 735285 - DNA, 20 bp, mouse
gctatgcacagcacagtcat

SEQ ID NO: 735286 - DNA, 20 bp, mouse
gtggctgcgcacacaacaag

SEQ ID NO: 735287 - DNA, 20 bp, mouse
ggcgcccggggcaaattgca

SEQ ID NO: 735288 - DNA, 20 bp, mouse
gtccgcggtggggaggtcga

SEQ ID NO: 735289 - DNA, 20 bp, mouse
gtctgcagccggtttttcca

SEQ ID NO: 735290 - DNA, 20 bp, mouse
gggactatttcccacggcgg

SEQ ID NO: 735291 - DNA, 20 bp, mouse
gccaccgcggactcgagcgg

SEQ ID NO: 735292 - DNA, 20 bp, mouse
gagcgagggactatttccca

SEQ ID NO: 735293 - DNA, 20 bp, mouse
gcgagcggaggaatccaagg

SEQ ID NO: 735294 - DNA, 20 bp, mouse
gaggtcccacgcctccgccg

SEQ ID NO: 735295 - DNA, 20 bp, mouse
gtccccaccgcggactcgag

SEQ ID NO: 735296 - DNA, 20 bp, mouse
gtgtaaccaaggaggagggt

SEQ ID NO: 735297 - DNA, 20 bp, mouse
gaggattggaggatagacac

SEQ ID NO: 735298 - DNA, 20 bp, mouse
gaggcgtggtgctgaagaaa

SEQ ID NO: 735299 - DNA, 20 bp, mouse
gccaccctaggagatgggat

SEQ ID NO: 735300 - DNA, 20 bp, mouse
ggggatgggatgcaggtgtt

SEQ ID NO: 735301 - DNA, 20 bp, mouse
ggacacaggatgccttgcag

SEQ ID NO: 735302 - DNA, 20 bp, mouse
gagtccccaccctaggagat

SEQ ID NO: 735303 - DNA, 20 bp, mouse
gaggatgccttgcagaggcg

SEQ ID NO: 735304 - DNA, 20 bp, mouse
gtggtgctgaagaaatggcc

SEQ ID NO: 735305 - DNA, 20 bp, mouse
ggggttgaggaagtccagaa

SEQ ID NO: 735306 - DNA, 20 bp, mouse
gtaggcgcgggatgacgcac

SEQ ID NO: 735307 - DNA, 20 bp, mouse
ggcagtggagcttcggtagg

SEQ ID NO: 735308 - DNA, 20 bp, mouse
ggagaattgcagtggagctt

SEQ ID NO: 735309 - DNA, 20 bp, mouse
gactccacgcagggtcccta

SEQ ID NO: 735310 - DNA, 20 bp, mouse
ggaccggaagcgagggaggg

SEQ ID NO: 735311 - DNA, 20 bp, mouse
gagcggtgaagaagcctccc

SEQ ID NO: 735312 - DNA, 20 bp, mouse
gcgcactggacacgcgtcgg

SEQ ID NO: 735313 - DNA, 20 bp, mouse
ggtcttgctgacttaggcgc

SEQ ID NO: 735314 - DNA, 20 bp, mouse
gaggaccggaaattaaggac

SEQ ID NO: 735315 - DNA, 20 bp, mouse
gaggttcgccccaatggcta

SEQ ID NO: 735316 - DNA, 20 bp, mouse
gggccaccgacagggaggtg

SEQ ID NO: 735317 - DNA, 20 bp, mouse
ggtggggcatgtctggtcga

SEQ ID NO: 735318 - DNA, 20 bp, mouse
ggtcggtggccatcgctcat

SEQ ID NO: 735319 - DNA, 20 bp, mouse
gggtacaagggtgcgcagcg

SEQ ID NO: 735320 - DNA, 20 bp, mouse
gcgcaagtcacgcccatcag

SEQ ID NO: 735321 - DNA, 20 bp, mouse
gacatgccccacctccctgt

SEQ ID NO: 735322 - DNA, 20 bp, mouse
gtctggtcgaggggcttttt

SEQ ID NO: 735323 - DNA, 20 bp, mouse
gtgcgcacccttgtaccacc

SEQ ID NO: 735324 - DNA, 20 bp, mouse
gcaccgggatgagttcagtt

SEQ ID NO: 735325 - DNA, 20 bp, mouse
gcctcgaccacgcccctgat

SEQ ID NO: 735326 - DNA, 20 bp, mouse
gaggtcctggcggggaagaa

SEQ ID NO: 735327 - DNA, 20 bp, mouse
gtgcgcaggcgcggcctcct

SEQ ID NO: 735328 - DNA, 20 bp, mouse
gtcctcacctccaggtgaag

SEQ ID NO: 735329 - DNA, 20 bp, mouse
gtggcgcgcaaggcctgctg

SEQ ID NO: 735330 - DNA, 20 bp, mouse
gctactgagtcagaaactgg

SEQ ID NO: 735331 - DNA, 20 bp, mouse
ggcttagtgtccacttcacc

SEQ ID NO: 735332 - DNA, 20 bp, mouse
gcggcctcctcggcgcagtc

SEQ ID NO: 735333 - DNA, 20 bp, mouse
gtagatctgggatggaatag

SEQ ID NO: 735334 - DNA, 20 bp, mouse
gtccacttcacctggaggtg

SEQ ID NO: 735335 - DNA, 20 bp, mouse
gttgacaggaagttcttagg

SEQ ID NO: 735336 - DNA, 20 bp, mouse
ggggcactgtgcgatggcgg

SEQ ID NO: 735337 - DNA, 20 bp, mouse
ggcgggggctgagggactca

SEQ ID NO: 735338 - DNA, 20 bp, mouse
gggtgggcactgtgcgatgg

SEQ ID NO: 735339 - DNA, 20 bp, mouse
gccccctcgcgcgacactgt

SEQ ID NO: 735340 - DNA, 20 bp, mouse
ggggggaaggttgtggtcac

SEQ ID NO: 735341 - DNA, 20 bp, mouse
gaccccctgtacccaggagg

SEQ ID NO: 735342 - DNA, 20 bp, mouse
ggagcccgggccaagcgctc

SEQ ID NO: 735343 - DNA, 20 bp, mouse
gcctcgctgactggcagctg

SEQ ID NO: 735344 - DNA, 20 bp, mouse
gccctccaggggacttgcgg

SEQ ID NO: 735345 - DNA, 20 bp, mouse
gggtggtgggcactgtgcga

SEQ ID NO: 735346 - DNA, 20 bp, mouse
ggggtgcgagcaccatgtcg

SEQ ID NO: 735347 - DNA, 20 bp, mouse
gggctattactatgacccga

SEQ ID NO: 735348 - DNA, 20 bp, mouse
gaggcccgcctcctccccta

SEQ ID NO: 735349 - DNA, 20 bp, mouse
ggggattcagaccatccctc

SEQ ID NO: 735350 - DNA, 20 bp, mouse
gcggggctaggaatcttccc

SEQ ID NO: 735351 - DNA, 20 bp, mouse
gattactatgacccgaggga

SEQ ID NO: 735352 - DNA, 20 bp, mouse
gcctcctcccctaaggttag

SEQ ID NO: 735353 - DNA, 20 bp, mouse
gggagctgacttgatacctg

SEQ ID NO: 735354 - DNA, 20 bp, mouse
gtgcgttgacaactccatta

SEQ ID NO: 735355 - DNA, 20 bp, mouse
gagttgtcaacgcaatgtag

SEQ ID NO: 735356 - DNA, 20 bp, mouse
gagtaggccccgccccagag

SEQ ID NO: 735357 - DNA, 20 bp, mouse
gcaggtgggccgaactaagg

SEQ ID NO: 735358 - DNA, 20 bp, mouse
gagtgacgcacagttcaggt

SEQ ID NO: 735359 - DNA, 20 bp, mouse
gtcacagcctctctggggcg

SEQ ID NO: 735360 - DNA, 20 bp, mouse
ggcggggcctactgcggggc

SEQ ID NO: 735361 - DNA, 20 bp, mouse
ggtgacccccccccttagtt

SEQ ID NO: 735362 - DNA, 20 bp, mouse
gtgggccgaactaagggggg

SEQ ID NO: 735363 - DNA, 20 bp, mouse
ggggggggtcacagcctctc

SEQ ID NO: 735364 - DNA, 20 bp, mouse
gcaacagaacggaatcgctg

SEQ ID NO: 735365 - DNA, 20 bp, mouse
gaggaggcccgccccgcagt

SEQ ID NO: 735366 - DNA, 20 bp, mouse
gcggggctggacattcagga

SEQ ID NO: 735367 - DNA, 20 bp, mouse
gaagtcctggggtgcgaagg

SEQ ID NO: 735368 - DNA, 20 bp, mouse
gcagatccgggagaagtcct

SEQ ID NO: 735369 - DNA, 20 bp, mouse
ggagaagtcctggggtgcga

SEQ ID NO: 735370 - DNA, 20 bp, mouse
gaggatgcctggaggcgaga

SEQ ID NO: 735371 - DNA, 20 bp, mouse
gctcccggatctgggtagaa

SEQ ID NO: 735372 - DNA, 20 bp, mouse
gcctccgagaagcttgccgg

SEQ ID NO: 735373 - DNA, 20 bp, mouse
gccagcaaggagtaaaagcc

SEQ ID NO: 735374 - DNA, 20 bp, mouse
gtgagtccgctagcataaaa

SEQ ID NO: 735375 - DNA, 20 bp, mouse
gcccaaaggtggttggaagg

SEQ ID NO: 735376 - DNA, 20 bp, mouse
gaaggtagagagctggacta

SEQ ID NO: 735377 - DNA, 20 bp, mouse
gctaccttggtgctgccccc

SEQ ID NO: 735378 - DNA, 20 bp, mouse
gcataaaagtagcctcagaa

SEQ ID NO: 735379 - DNA, 20 bp, mouse
gcagcaccaaggtagagagc

SEQ ID NO: 735380 - DNA, 20 bp, mouse
gtggcagctaaaaataaagt

SEQ ID NO: 735381 - DNA, 20 bp, mouse
gcgtgaacagcctcaagtta

SEQ ID NO: 735382 - DNA, 20 bp, mouse
gaagcatgaccataactcag

SEQ ID NO: 735383 - DNA, 20 bp, mouse
gcctactttctgttccaaac

SEQ ID NO: 735384 - DNA, 20 bp, mouse
gacaaagcacacctgtctac

SEQ ID NO: 735385 - DNA, 20 bp, mouse
gaatattagctgaggcctcc

SEQ ID NO: 735386 - DNA, 20 bp, mouse
ggtggcagaggggcctagac

SEQ ID NO: 735387 - DNA, 20 bp, mouse
gtcccagcccatctaacctc

SEQ ID NO: 735388 - DNA, 20 bp, mouse
ggggagggcgatactggcga

SEQ ID NO: 735389 - DNA, 20 bp, mouse
gtatgaccctgaggttagat

SEQ ID NO: 735390 - DNA, 20 bp, mouse
gcctctgccacctgagccgg

SEQ ID NO: 735391 - DNA, 20 bp, mouse
gaccctgaggttagatgggc

SEQ ID NO: 735392 - DNA, 20 bp, mouse
gacagcagcgcagaggaagt

SEQ ID NO: 735393 - DNA, 20 bp, mouse
gagtggccctgggtcatctt

SEQ ID NO: 735394 - DNA, 20 bp, mouse
gagggctccagcggcgggga

SEQ ID NO: 735395 - DNA, 20 bp, mouse
gcggggcagcagcctgccac

SEQ ID NO: 735396 - DNA, 20 bp, mouse
gaggagccacagacgctgag

SEQ ID NO: 735397 - DNA, 20 bp, mouse
gaagatgccgagggctccgt

SEQ ID NO: 735398 - DNA, 20 bp, mouse
gaaaaaggagtcaagatcca

SEQ ID NO: 735399 - DNA, 20 bp, mouse
gacgaagagatgttggttgt

SEQ ID NO: 735400 - DNA, 20 bp, mouse
gtcctccagcgctctgaaaa

SEQ ID NO: 735401 - DNA, 20 bp, mouse
gagggctccgtgggcgtcca

SEQ ID NO: 735402 - DNA, 20 bp, mouse
ggatcctgagctcttgggtc

SEQ ID NO: 735403 - DNA, 20 bp, mouse
ggcttgatacaactgcgttg

SEQ ID NO: 735404 - DNA, 20 bp, mouse
ggggtggatcctgagctctt

SEQ ID NO: 735405 - DNA, 20 bp, mouse
gctgaggggctgggctccgt

SEQ ID NO: 735406 - DNA, 20 bp, mouse
gtagacgtcgactaggacgg

SEQ ID NO: 735407 - DNA, 20 bp, mouse
gtggactttcacagtgacag

SEQ ID NO: 735408 - DNA, 20 bp, mouse
gaaagagaaaggggattgcc

SEQ ID NO: 735409 - DNA, 20 bp, mouse
gcgtcgactaggacggggga

SEQ ID NO: 735410 - DNA, 20 bp, mouse
gacatggaggtgagctttcc

SEQ ID NO: 735411 - DNA, 20 bp, mouse
gaaggggattgccgggcttg

SEQ ID NO: 735412 - DNA, 20 bp, mouse
gcagagacaacaggacatgg

SEQ ID NO: 735413 - DNA, 20 bp, mouse
gcgggggagggcccaccccg

SEQ ID NO: 735414 - DNA, 20 bp, mouse
ggctgcccaaaggctcatgg

SEQ ID NO: 735415 - DNA, 20 bp, mouse
gtccggtggtgggaacttca

SEQ ID NO: 735416 - DNA, 20 bp, mouse
gcggccgccgcctcttaaag

SEQ ID NO: 735417 - DNA, 20 bp, mouse
ggacaggtgtctgagagaga

SEQ ID NO: 735418 - DNA, 20 bp, mouse
gctgccctcctggtgatcga

SEQ ID NO: 735419 - DNA, 20 bp, mouse
ggacccgcagtcacctctta

SEQ ID NO: 735420 - DNA, 20 bp, mouse
gggaaagcggagcccggact

SEQ ID NO: 735421 - DNA, 20 bp, mouse
ggagaacggtcgactgtgtt

SEQ ID NO: 735422 - DNA, 20 bp, mouse
gcgggctccgctttccttcc

SEQ ID NO: 735423 - DNA, 20 bp, mouse
gaagaagctctccgctggaa

SEQ ID NO: 735424 - DNA, 20 bp, mouse
gcggactgggcgcgcaaggt

SEQ ID NO: 735425 - DNA, 20 bp, mouse
gggtacaagacggattggac

SEQ ID NO: 735426 - DNA, 20 bp, mouse
ggctccggggccacagaaac

SEQ ID NO: 735427 - DNA, 20 bp, mouse
gcggggatggggatcgggtt

SEQ ID NO: 735428 - DNA, 20 bp, mouse
gggagcgatcgtagtggcca

SEQ ID NO: 735429 - DNA, 20 bp, mouse
gcggtgctggcaggcgacag

SEQ ID NO: 735430 - DNA, 20 bp, mouse
gacaggcggagcgatcgtag

SEQ ID NO: 735431 - DNA, 20 bp, mouse
gccgccccgcagcagctgta

SEQ ID NO: 735432 - DNA, 20 bp, mouse
gagagggacgccagaagagg

SEQ ID NO: 735433 - DNA, 20 bp, mouse
ggccgggtgctcctaggatc

SEQ ID NO: 735434 - DNA, 20 bp, mouse
ggagagagggacgccagaag

SEQ ID NO: 735435 - DNA, 20 bp, mouse
gtgctggcaggcgacagggg

SEQ ID NO: 735436 - DNA, 20 bp, mouse
ggccgcgccccgcacccgaa

SEQ ID NO: 735437 - DNA, 20 bp, mouse
ggggccgcacctctgaaccc

SEQ ID NO: 735438 - DNA, 20 bp, mouse
gcggaaaagtagtcggaaaa

SEQ ID NO: 735439 - DNA, 20 bp, mouse
gccagctggggccggagcca

SEQ ID NO: 735440 - DNA, 20 bp, mouse
gcccgcacccgaaggggcgt

SEQ ID NO: 735441 - DNA, 20 bp, mouse
gcggccccccacgccccttc

SEQ ID NO: 735442 - DNA, 20 bp, mouse
gtaccccaggaggctgtctg

SEQ ID NO: 735443 - DNA, 20 bp, mouse
gccaacgaagctaccccagg

SEQ ID NO: 735444 - DNA, 20 bp, mouse
gccccacgccccttcgggtg

SEQ ID NO: 735445 - DNA, 20 bp, mouse
ggaaaggaatcacctctggg

SEQ ID NO: 735446 - DNA, 20 bp, mouse
gaggcccgcagttcagtgac

SEQ ID NO: 735447 - DNA, 20 bp, mouse
gcacctgcccggaagcgtcc

SEQ ID NO: 735448 - DNA, 20 bp, mouse
gcgggtgcgccgctgcgggg

SEQ ID NO: 735449 - DNA, 20 bp, mouse
gtatgcccagctcttggggt

SEQ ID NO: 735450 - DNA, 20 bp, mouse
gccggcagggaaggtgcgtg

SEQ ID NO: 735451 - DNA, 20 bp, mouse
gccaagctccgggacgcttc

SEQ ID NO: 735452 - DNA, 20 bp, mouse
gacgcttccgggcaggtggc

SEQ ID NO: 735453 - DNA, 20 bp, mouse
gctccgggacgcttccgggc

SEQ ID NO: 735454 - DNA, 20 bp, mouse
gccggctcacgctcactgtg

SEQ ID NO: 735455 - DNA, 20 bp, mouse
gctgaactgcgggcctcata

SEQ ID NO: 735456 - DNA, 20 bp, mouse
gcggcagggcgcaaggcaat

SEQ ID NO: 735457 - DNA, 20 bp, mouse
ggcgcaagacccagggtccg

SEQ ID NO: 735458 - DNA, 20 bp, mouse
gcgcaaggcaatgggtgcgg

SEQ ID NO: 735459 - DNA, 20 bp, mouse
ggactcaggcgcaagaccca

SEQ ID NO: 735460 - DNA, 20 bp, mouse
gagtgcacagtgcaaaggtg

SEQ ID NO: 735461 - DNA, 20 bp, mouse
ggggcggtgtcccagagagg

SEQ ID NO: 735462 - DNA, 20 bp, mouse
gcccagcagcagatagactc

SEQ ID NO: 735463 - DNA, 20 bp, mouse
gccggggatgcccagacccg

SEQ ID NO: 735464 - DNA, 20 bp, mouse
gtcaacctccactttttggg

SEQ ID NO: 735465 - DNA, 20 bp, mouse
gatgcccagacccgcggctc

SEQ ID NO: 735466 - DNA, 20 bp, mouse
gagcgcgccggccccagcca

SEQ ID NO: 735467 - DNA, 20 bp, mouse
gggagcttgcggtctaggac

SEQ ID NO: 735468 - DNA, 20 bp, mouse
gcgctcttcgcgccctctag

SEQ ID NO: 735469 - DNA, 20 bp, mouse
gcctctagcggctagttctc

SEQ ID NO: 735470 - DNA, 20 bp, mouse
gccagaaaagagtggttata

SEQ ID NO: 735471 - DNA, 20 bp, mouse
ggctggagagggtcgagcgc

SEQ ID NO: 735472 - DNA, 20 bp, mouse
gagaagcggtgttccatatg

SEQ ID NO: 735473 - DNA, 20 bp, mouse
gtagagactcgaaatctagc

SEQ ID NO: 735474 - DNA, 20 bp, mouse
gaggacggagcttgcggtct

SEQ ID NO: 735475 - DNA, 20 bp, mouse
ggaaatctagcgggctcaac

SEQ ID NO: 735476 - DNA, 20 bp, mouse
gtgagaccgcgtccagcagg

SEQ ID NO: 735477 - DNA, 20 bp, mouse
gcccgggcggcactggactg

SEQ ID NO: 735478 - DNA, 20 bp, mouse
ggctgtaagaattagtcatg

SEQ ID NO: 735479 - DNA, 20 bp, mouse
ggtccagaacctggacccgg

SEQ ID NO: 735480 - DNA, 20 bp, mouse
gctggccaggtcagggagta

SEQ ID NO: 735481 - DNA, 20 bp, mouse
gcaggcgcacccccgggtcc

SEQ ID NO: 735482 - DNA, 20 bp, mouse
gagctacccgagccaaggat

SEQ ID NO: 735483 - DNA, 20 bp, mouse
gggctctgctgtgtccaagc

SEQ ID NO: 735484 - DNA, 20 bp, mouse
gcggtctcaggcgcaccccc

SEQ ID NO: 735485 - DNA, 20 bp, mouse
gtgcatcctctcaatgtcct

SEQ ID NO: 735486 - DNA, 20 bp, mouse
gaaggaagcaagcttctagt

SEQ ID NO: 735487 - DNA, 20 bp, mouse
ggacctcaaggggtggtagg

SEQ ID NO: 735488 - DNA, 20 bp, mouse
gcttctagtgggcaacgaga

SEQ ID NO: 735489 - DNA, 20 bp, mouse
gctaaaggggtgtagatctc

SEQ ID NO: 735490 - DNA, 20 bp, mouse
gaaaacataaggtgtgctac

SEQ ID NO: 735491 - DNA, 20 bp, mouse
ggcaacgagagggaaagcat

SEQ ID NO: 735492 - DNA, 20 bp, mouse
gtagttagacaggtggtagt

SEQ ID NO: 735493 - DNA, 20 bp, mouse
gggtaggagggactcagtgg

SEQ ID NO: 735494 - DNA, 20 bp, mouse
ggcattgggcacttcttcat

SEQ ID NO: 735495 - DNA, 20 bp, mouse
gcaggacctcaaggggtggt

SEQ ID NO: 735496 - DNA, 20 bp, mouse
gcagaagcatctacagataa

SEQ ID NO: 735497 - DNA, 20 bp, mouse
gggacccagcccacagctat

SEQ ID NO: 735498 - DNA, 20 bp, mouse
gtctacagataagggaccac

SEQ ID NO: 735499 - DNA, 20 bp, mouse
gtgaggggacccaatatggc

SEQ ID NO: 735500 - DNA, 20 bp, mouse
gggaagctgagtactttctg

SEQ ID NO: 735501 - DNA, 20 bp, mouse
gtctagtgagtgatggaact

SEQ ID NO: 735502 - DNA, 20 bp, mouse
gtaagggaccacaggcccac

SEQ ID NO: 735503 - DNA, 20 bp, mouse
ggctggccttgtacaagcta

SEQ ID NO: 735504 - DNA, 20 bp, mouse
gttccccagtcagactcatg

SEQ ID NO: 735505 - DNA, 20 bp, mouse
ggtgacttcacccatagctg

SEQ ID NO: 735506 - DNA, 20 bp, mouse
ggggcctggtgtgagagcgg

SEQ ID NO: 735507 - DNA, 20 bp, mouse
gccggggcctggtgtgagag

SEQ ID NO: 735508 - DNA, 20 bp, mouse
gaggctgatgacactgggtg

SEQ ID NO: 735509 - DNA, 20 bp, mouse
gtgaaaatgcaagtaggcac

SEQ ID NO: 735510 - DNA, 20 bp, mouse
gagggggtgcgctcctgtcc

SEQ ID NO: 735511 - DNA, 20 bp, mouse
ggggagtagggagtagactc

SEQ ID NO: 735512 - DNA, 20 bp, mouse
gctgccaggctgatgacact

SEQ ID NO: 735513 - DNA, 20 bp, mouse
gcaacctccgctctcacacc

SEQ ID NO: 735514 - DNA, 20 bp, mouse
gggaggttgcctagctgaag

SEQ ID NO: 735515 - DNA, 20 bp, mouse
gtcctgagcaaccctctatc

SEQ ID NO: 735516 - DNA, 20 bp, mouse
gtcccggaggaaggctacag

SEQ ID NO: 735517 - DNA, 20 bp, mouse
gctgacacccgtctacctct

SEQ ID NO: 735518 - DNA, 20 bp, mouse
gggtgtaaccctgatggttc

SEQ ID NO: 735519 - DNA, 20 bp, mouse
gccctctgtagccttcctcc

SEQ ID NO: 735520 - DNA, 20 bp, mouse
gactcaaagaaagagggcgg

SEQ ID NO: 735521 - DNA, 20 bp, mouse
gagggactgttttctcccgg

SEQ ID NO: 735522 - DNA, 20 bp, mouse
gcctttgggtgtaaccctga

SEQ ID NO: 735523 - DNA, 20 bp, mouse
ggggccaggaaacggcatca

SEQ ID NO: 735524 - DNA, 20 bp, mouse
gaggctcagtgtttcggatc

SEQ ID NO: 735525 - DNA, 20 bp, mouse
gttcctggcccgaaccatca

SEQ ID NO: 735526 - DNA, 20 bp, mouse
ggctggcggccggtcctccg

SEQ ID NO: 735527 - DNA, 20 bp, mouse
gggtggcctcccacaggaga

SEQ ID NO: 735528 - DNA, 20 bp, mouse
gcgggacagcctcggaggac

SEQ ID NO: 735529 - DNA, 20 bp, mouse
ggaccggccgccagcgcgca

SEQ ID NO: 735530 - DNA, 20 bp, mouse
gggcccagatccaaaggacc

SEQ ID NO: 735531 - DNA, 20 bp, mouse
gaaagaggaagtcgcgctca

SEQ ID NO: 735532 - DNA, 20 bp, mouse
gcgggccgccccgccgaaag

SEQ ID NO: 735533 - DNA, 20 bp, mouse
gcccctggtcctttggatct

SEQ ID NO: 735534 - DNA, 20 bp, mouse
gcgcagtcccgggacagcct

SEQ ID NO: 735535 - DNA, 20 bp, mouse
gctggaggaaccagggaacg

SEQ ID NO: 735536 - DNA, 20 bp, mouse
gggcagcctacacacttcca

SEQ ID NO: 735537 - DNA, 20 bp, mouse
gtgtcagcgtgactcagagg

SEQ ID NO: 735538 - DNA, 20 bp, mouse
gccagtacaaaagtctgaga

SEQ ID NO: 735539 - DNA, 20 bp, mouse
gtccatccgggcaagaattg

SEQ ID NO: 735540 - DNA, 20 bp, mouse
ggagatgaaatggatagagt

SEQ ID NO: 735541 - DNA, 20 bp, mouse
gaagtagagcaactcttccc

SEQ ID NO: 735542 - DNA, 20 bp, mouse
gtgagagggatcagataatc

SEQ ID NO: 735543 - DNA, 20 bp, mouse
gtgacggagccctccacttc

SEQ ID NO: 735544 - DNA, 20 bp, mouse
ggatgggtgaacactaaagt

SEQ ID NO: 735545 - DNA, 20 bp, mouse
gtaagcacatgatccatgta

SEQ ID NO: 735546 - DNA, 20 bp, mouse
gcggaggaatgcgtttccgg

SEQ ID NO: 735547 - DNA, 20 bp, mouse
gtcagccgcgcctgaaaagg

SEQ ID NO: 735548 - DNA, 20 bp, mouse
ggggcggggcggcttcctga

SEQ ID NO: 735549 - DNA, 20 bp, mouse
ggccgcgcctgaaaaggagg

SEQ ID NO: 735550 - DNA, 20 bp, mouse
gtccccctccttttcaggcg

SEQ ID NO: 735551 - DNA, 20 bp, mouse
ggtaccgcgctgaaccaccg

SEQ ID NO: 735552 - DNA, 20 bp, mouse
gccgcgaagctctttctccc

SEQ ID NO: 735553 - DNA, 20 bp, mouse
gagaaagagcttcgcggcgg

SEQ ID NO: 735554 - DNA, 20 bp, mouse
gccgagccagacctctctgt

SEQ ID NO: 735555 - DNA, 20 bp, mouse
ggcggtaccccaggcagaaa

SEQ ID NO: 735556 - DNA, 20 bp, mouse
gagcgccggaagttgtgtgt

SEQ ID NO: 735557 - DNA, 20 bp, mouse
gtctcgaaccggaagttgga

SEQ ID NO: 735558 - DNA, 20 bp, mouse
gtggcccagcggaccagggc

SEQ ID NO: 735559 - DNA, 20 bp, mouse
gggagggccgaatctagctc

SEQ ID NO: 735560 - DNA, 20 bp, mouse
gcggaccagggcaggaaaac

SEQ ID NO: 735561 - DNA, 20 bp, mouse
gcctccgcgggggtccctcc

SEQ ID NO: 735562 - DNA, 20 bp, mouse
gtccgggaacgctagagcgc

SEQ ID NO: 735563 - DNA, 20 bp, mouse
gaggttctttaggttcccgg

SEQ ID NO: 735564 - DNA, 20 bp, mouse
gaccaccaacacacaacttc

SEQ ID NO: 735565 - DNA, 20 bp, mouse
gcctgcgcatgataggggcg

SEQ ID NO: 735566 - DNA, 20 bp, mouse
gctctgggacacttttctat

SEQ ID NO: 735567 - DNA, 20 bp, mouse
gtgtcccagagctgaggctc

SEQ ID NO: 735568 - DNA, 20 bp, mouse
ggggcaagggaacttgagtt

SEQ ID NO: 735569 - DNA, 20 bp, mouse
gaggaagagcccttggaact

SEQ ID NO: 735570 - DNA, 20 bp, mouse
gagcccttggaacttgggcg

SEQ ID NO: 735571 - DNA, 20 bp, mouse
gggctcaggaaaaaaggatc

SEQ ID NO: 735572 - DNA, 20 bp, mouse
gggcgtccacctccaaacat

SEQ ID NO: 735573 - DNA, 20 bp, mouse
ggggaaggtgctacgtattg

SEQ ID NO: 735574 - DNA, 20 bp, mouse
gttcccttgcccatgtttgg

SEQ ID NO: 735575 - DNA, 20 bp, mouse
gccactccctgtgtgggtat

SEQ ID NO: 735576 - DNA, 20 bp, mouse
gagcccctcgatgctatcaa

SEQ ID NO: 735577 - DNA, 20 bp, mouse
gctaacgtcccacgtgtaaa

SEQ ID NO: 735578 - DNA, 20 bp, mouse
ggacccagctacaagtggat

SEQ ID NO: 735579 - DNA, 20 bp, mouse
gcccacgtgtaaaggggctg

SEQ ID NO: 735580 - DNA, 20 bp, mouse
ggaccagcaggcggaagcag

SEQ ID NO: 735581 - DNA, 20 bp, mouse
gtgaggtgatacccacatgt

SEQ ID NO: 735582 - DNA, 20 bp, mouse
gcagccagctggcaagaagt

SEQ ID NO: 735583 - DNA, 20 bp, mouse
gtcaggcgggggggcctcag

SEQ ID NO: 735584 - DNA, 20 bp, mouse
gtggctgattggcccacatg

SEQ ID NO: 735585 - DNA, 20 bp, mouse
gacctcagcccctttacacg

SEQ ID NO: 735586 - DNA, 20 bp, mouse
gcagagggctgaggtaactg

SEQ ID NO: 735587 - DNA, 20 bp, mouse
ggagagcaactgtgctgcag

SEQ ID NO: 735588 - DNA, 20 bp, mouse
gcagactggagggtggagat

SEQ ID NO: 735589 - DNA, 20 bp, mouse
gctctcagcggctacaaggt

SEQ ID NO: 735590 - DNA, 20 bp, mouse
gagcggctacaaggtaggag

SEQ ID NO: 735591 - DNA, 20 bp, mouse
gcggggacggtctgagcatc

SEQ ID NO: 735592 - DNA, 20 bp, mouse
gtgcttgggacagcactctc

SEQ ID NO: 735593 - DNA, 20 bp, mouse
ggagctcagtgagcaggggc

SEQ ID NO: 735594 - DNA, 20 bp, mouse
gaccgtccccgtctggagca

SEQ ID NO: 735595 - DNA, 20 bp, mouse
gaagcattctcatagaccag

SEQ ID NO: 735596 - DNA, 20 bp, mouse
gaacgcgggcaggtcctcgt

SEQ ID NO: 735597 - DNA, 20 bp, mouse
gcacccaggcgcagacacct

SEQ ID NO: 735598 - DNA, 20 bp, mouse
ggcctgaggctgagtgtgat

SEQ ID NO: 735599 - DNA, 20 bp, mouse
ggggtccaggcgtgagccgg

SEQ ID NO: 735600 - DNA, 20 bp, mouse
gcaggcgtgagccggaggga

SEQ ID NO: 735601 - DNA, 20 bp, mouse
gcggtctcctctagtgaacg

SEQ ID NO: 735602 - DNA, 20 bp, mouse
ggggtgggacacagcggggc

SEQ ID NO: 735603 - DNA, 20 bp, mouse
gcctcgtgggcggggggctg

SEQ ID NO: 735604 - DNA, 20 bp, mouse
gacctgcccgcgttcactag

SEQ ID NO: 735605 - DNA, 20 bp, mouse
gcgggcaggtcctcgtgggc

SEQ ID NO: 735606 - DNA, 20 bp, mouse
gcgtgcgctgcatgcggctg

SEQ ID NO: 735607 - DNA, 20 bp, mouse
gaaatggtgcagggagtcta

SEQ ID NO: 735608 - DNA, 20 bp, mouse
gatgtccacaatagtgagga

SEQ ID NO: 735609 - DNA, 20 bp, mouse
ggagggtcgtgcgctgcatg

SEQ ID NO: 735610 - DNA, 20 bp, mouse
gcggcgaggcgcagttgcta

SEQ ID NO: 735611 - DNA, 20 bp, mouse
gacgaccctcctcactattg

SEQ ID NO: 735612 - DNA, 20 bp, mouse
gtctggtcggagcgtttgga

SEQ ID NO: 735613 - DNA, 20 bp, mouse
gctcgcgcggagactgtttc

SEQ ID NO: 735614 - DNA, 20 bp, mouse
gttgtagcttatctgttgcg

SEQ ID NO: 735615 - DNA, 20 bp, mouse
gaaaaaggcggaggtctgtc

SEQ ID NO: 735616 - DNA, 20 bp, mouse
gcggcccggggacccgatct

SEQ ID NO: 735617 - DNA, 20 bp, mouse
gtctgtgctgcagggaagag

SEQ ID NO: 735618 - DNA, 20 bp, mouse
gagccccggtctgtgctgca

SEQ ID NO: 735619 - DNA, 20 bp, mouse
ggctgcggctcaaccggcgc

SEQ ID NO: 735620 - DNA, 20 bp, mouse
gcaggcccgccccccggaaa

SEQ ID NO: 735621 - DNA, 20 bp, mouse
gagccccgagccgccgcgga

SEQ ID NO: 735622 - DNA, 20 bp, mouse
gcctggacgggtggggaaga

SEQ ID NO: 735623 - DNA, 20 bp, mouse
gttccctgcagcacagaccg

SEQ ID NO: 735624 - DNA, 20 bp, mouse
gcgccccccggaaagggctg

SEQ ID NO: 735625 - DNA, 20 bp, mouse
ggaaagggctgcggctcaac

SEQ ID NO: 735626 - DNA, 20 bp, mouse
gccaactccaagaccgggga

SEQ ID NO: 735627 - DNA, 20 bp, mouse
gcggtcttggagttgggagg

SEQ ID NO: 735628 - DNA, 20 bp, mouse
gctgacccacttgtggggat

SEQ ID NO: 735629 - DNA, 20 bp, mouse
gaggcctgcagagattactt

SEQ ID NO: 735630 - DNA, 20 bp, mouse
gtggcggcccgcaggagagg

SEQ ID NO: 735631 - DNA, 20 bp, mouse
gtcacagctgacccacttgt

SEQ ID NO: 735632 - DNA, 20 bp, mouse
gcaggatcgtggggcagtta

SEQ ID NO: 735633 - DNA, 20 bp, mouse
ggggcggggcgcgctccatt

SEQ ID NO: 735634 - DNA, 20 bp, mouse
gcgccagcacgcctagatcc

SEQ ID NO: 735635 - DNA, 20 bp, mouse
ggtgttcgaaacttctagtt

SEQ ID NO: 735636 - DNA, 20 bp, mouse
ggtacagtgcccgggaaggt

SEQ ID NO: 735637 - DNA, 20 bp, mouse
gaggtggggagacttagtgc

SEQ ID NO: 735638 - DNA, 20 bp, mouse
gtacacctgacttccttata

SEQ ID NO: 735639 - DNA, 20 bp, mouse
gaggtgtacagtgcccggga

SEQ ID NO: 735640 - DNA, 20 bp, mouse
gtaagtctccccaccttccc

SEQ ID NO: 735641 - DNA, 20 bp, mouse
gcttccttataaggtgaatg

SEQ ID NO: 735642 - DNA, 20 bp, mouse
ggaacaccatacatttaaat

SEQ ID NO: 735643 - DNA, 20 bp, mouse
gacaagttaaaatacctgag

SEQ ID NO: 735644 - DNA, 20 bp, mouse
gcatgaaaaccaaacctctc

SEQ ID NO: 735645 - DNA, 20 bp, mouse
gttaaaattaagaactctaa

SEQ ID NO: 735646 - DNA, 20 bp, mouse
gcggtgctacagctcaggaa

SEQ ID NO: 735647 - DNA, 20 bp, mouse
ggggcaagcgagcgtgaaga

SEQ ID NO: 735648 - DNA, 20 bp, mouse
gccagctatgggactctctc

SEQ ID NO: 735649 - DNA, 20 bp, mouse
gtgaccccccattcctggaa

SEQ ID NO: 735650 - DNA, 20 bp, mouse
ggattgggttcagtgagcac

SEQ ID NO: 735651 - DNA, 20 bp, mouse
ggcgagcgtgaagaaggatt

SEQ ID NO: 735652 - DNA, 20 bp, mouse
gttacaattctggtgttgag

SEQ ID NO: 735653 - DNA, 20 bp, mouse
gtttacagagcttacaattc

SEQ ID NO: 735654 - DNA, 20 bp, mouse
ggcatctagcactcagtaga

SEQ ID NO: 735655 - DNA, 20 bp, mouse
gggattccattccaggaatg

SEQ ID NO: 735656 - DNA, 20 bp, mouse
ggaacagcgccggatagtgg

SEQ ID NO: 735657 - DNA, 20 bp, mouse
gaggagcagtgcttagtaga

SEQ ID NO: 735658 - DNA, 20 bp, mouse
gtggggggactcttggaggg

SEQ ID NO: 735659 - DNA, 20 bp, mouse
gtgggggcaccgccactatc

SEQ ID NO: 735660 - DNA, 20 bp, mouse
gtggctgatctagcagaagg

SEQ ID NO: 735661 - DNA, 20 bp, mouse
gtgctaaagaagtacaagga

SEQ ID NO: 735662 - DNA, 20 bp, mouse
ggcgtctgtgacatgtgtgg

SEQ ID NO: 735663 - DNA, 20 bp, mouse
gagggtcaccagaacagcgc

SEQ ID NO: 735664 - DNA, 20 bp, mouse
ggaggaagtgacacaccctg

SEQ ID NO: 735665 - DNA, 20 bp, mouse
ggagcagataggagtgggct

SEQ ID NO: 735666 - DNA, 20 bp, mouse
gactctgagagcagtgttgg

SEQ ID NO: 735667 - DNA, 20 bp, mouse
gtataccgttatggaagcgt

SEQ ID NO: 735668 - DNA, 20 bp, mouse
ggtgaggcatgaagtcaccg

SEQ ID NO: 735669 - DNA, 20 bp, mouse
gcagcagctgcgggccagta

SEQ ID NO: 735670 - DNA, 20 bp, mouse
gaggaattcttgagaacgat

SEQ ID NO: 735671 - DNA, 20 bp, mouse
gcgtgggcgggacattggtg

SEQ ID NO: 735672 - DNA, 20 bp, mouse
gcgttggaactcagaattgg

SEQ ID NO: 735673 - DNA, 20 bp, mouse
gactcagaattggggggcga

SEQ ID NO: 735674 - DNA, 20 bp, mouse
gcaactattagattcgaggg

SEQ ID NO: 735675 - DNA, 20 bp, mouse
gtggcaactattagattcga

SEQ ID NO: 735676 - DNA, 20 bp, mouse
ggggagggctatggtaaaca

SEQ ID NO: 735677 - DNA, 20 bp, mouse
gaacaagaggatatttggac

SEQ ID NO: 735678 - DNA, 20 bp, mouse
gccagtggagagtctaggca

SEQ ID NO: 735679 - DNA, 20 bp, mouse
gccactgcccaagtcttcgc

SEQ ID NO: 735680 - DNA, 20 bp, mouse
gctcttgttaaatatttcgg

SEQ ID NO: 735681 - DNA, 20 bp, mouse
ggggtgccaaactcctccag

SEQ ID NO: 735682 - DNA, 20 bp, mouse
gcagttgcctgcgaagactt

SEQ ID NO: 735683 - DNA, 20 bp, mouse
gctcctccagtggagagtct

SEQ ID NO: 735684 - DNA, 20 bp, mouse
gttaaaagaagccccattgg

SEQ ID NO: 735685 - DNA, 20 bp, mouse
gggctatggtaaacacggaa

SEQ ID NO: 735686 - DNA, 20 bp, mouse
ggcatggcacctaccaacaa

SEQ ID NO: 735687 - DNA, 20 bp, mouse
ggaggcaaatagcagggttt

SEQ ID NO: 735688 - DNA, 20 bp, mouse
gaaatccagagcttagtgca

SEQ ID NO: 735689 - DNA, 20 bp, mouse
gtaaacattagacacagcgg

SEQ ID NO: 735690 - DNA, 20 bp, mouse
gacagcggaggcaaatagca

SEQ ID NO: 735691 - DNA, 20 bp, mouse
gggtgccatgcactaagctc

SEQ ID NO: 735692 - DNA, 20 bp, mouse
gctctggatttaattcctag

SEQ ID NO: 735693 - DNA, 20 bp, mouse
gtttgtctaccgttgttggt

SEQ ID NO: 735694 - DNA, 20 bp, mouse
gatggtttgtctaccgttgt

SEQ ID NO: 735695 - DNA, 20 bp, mouse
gtgccacaacccataggtgg

SEQ ID NO: 735696 - DNA, 20 bp, mouse
gaaggccaggagcagttcct

SEQ ID NO: 735697 - DNA, 20 bp, mouse
gtggggttattcaaacagca

SEQ ID NO: 735698 - DNA, 20 bp, mouse
gggaactcaaacctgagctg

SEQ ID NO: 735699 - DNA, 20 bp, mouse
ggagtcagggtcaaacagca

SEQ ID NO: 735700 - DNA, 20 bp, mouse
gcaaacagcaaggccaggat

SEQ ID NO: 735701 - DNA, 20 bp, mouse
gacagcccaggaactgctcc

SEQ ID NO: 735702 - DNA, 20 bp, mouse
gtcaacaaaatcaagggtag

SEQ ID NO: 735703 - DNA, 20 bp, mouse
gtgtctgtgcaccaatatgt

SEQ ID NO: 735704 - DNA, 20 bp, mouse
gcaagtaaggcactatatta

SEQ ID NO: 735705 - DNA, 20 bp, mouse
gaggaatgcacaaccgatcc

SEQ ID NO: 735706 - DNA, 20 bp, mouse
gacagcagctccgggaactg

SEQ ID NO: 735707 - DNA, 20 bp, mouse
gcaccctcaccagggagagt

SEQ ID NO: 735708 - DNA, 20 bp, mouse
gtacaataacagtgttgggg

SEQ ID NO: 735709 - DNA, 20 bp, mouse
gagctccgggaactgggggt

SEQ ID NO: 735710 - DNA, 20 bp, mouse
gggtcaaggacctggaccat

SEQ ID NO: 735711 - DNA, 20 bp, mouse
gctgtgtgaagaggaccccg

SEQ ID NO: 735712 - DNA, 20 bp, mouse
gagactagaggcaatgtggg

SEQ ID NO: 735713 - DNA, 20 bp, mouse
gccagaaagtctgtgtgaag

SEQ ID NO: 735714 - DNA, 20 bp, mouse
gccaagcagggtcaaggacc

SEQ ID NO: 735715 - DNA, 20 bp, mouse
gacccccactctccctggtg

SEQ ID NO: 735716 - DNA, 20 bp, mouse
ggatagaaggacataccctg

SEQ ID NO: 735717 - DNA, 20 bp, mouse
gtggtcctctcggtgtctca

SEQ ID NO: 735718 - DNA, 20 bp, mouse
ggaagcttatgtttcctcct

SEQ ID NO: 735719 - DNA, 20 bp, mouse
gttataacccacctgctcca

SEQ ID NO: 735720 - DNA, 20 bp, mouse
ggaggcagctgggcattagc

SEQ ID NO: 735721 - DNA, 20 bp, mouse
gagcaaagtttactggacat

SEQ ID NO: 735722 - DNA, 20 bp, mouse
gagcaggccttctgctagct

SEQ ID NO: 735723 - DNA, 20 bp, mouse
gaggaccacagacgcatctg

SEQ ID NO: 735724 - DNA, 20 bp, mouse
ggagcaggtgggttataaac

SEQ ID NO: 735725 - DNA, 20 bp, mouse
gctggaaaaaataccctagg

SEQ ID NO: 735726 - DNA, 20 bp, mouse
ggcgacaggcgacaggactc

SEQ ID NO: 735727 - DNA, 20 bp, mouse
gcggggctttggtggaggaa

SEQ ID NO: 735728 - DNA, 20 bp, mouse
ggtcccttggggagtttaga

SEQ ID NO: 735729 - DNA, 20 bp, mouse
gcaaccttggagcccagggg

SEQ ID NO: 735730 - DNA, 20 bp, mouse
ggccacgcctctctgtccct

SEQ ID NO: 735731 - DNA, 20 bp, mouse
ggggctccaaggttgaccgc

SEQ ID NO: 735732 - DNA, 20 bp, mouse
ggcccaggggaggcaaaact

SEQ ID NO: 735733 - DNA, 20 bp, mouse
gggacagagaggcgtggcct

SEQ ID NO: 735734 - DNA, 20 bp, mouse
gggatcatagggtgagttgt

SEQ ID NO: 735735 - DNA, 20 bp, mouse
gggcctgaagggcataaagg

SEQ ID NO: 735736 - DNA, 20 bp, mouse
gtaaacaagggactaagaac

SEQ ID NO: 735737 - DNA, 20 bp, mouse
ggactaagaacagggatcca

SEQ ID NO: 735738 - DNA, 20 bp, mouse
gacagggatccaggggtcaa

SEQ ID NO: 735739 - DNA, 20 bp, mouse
gcaaaattcaccaagctggg

SEQ ID NO: 735740 - DNA, 20 bp, mouse
gagagtgtccctcagtaggg

SEQ ID NO: 735741 - DNA, 20 bp, mouse
gcgaccatcctccctactga

SEQ ID NO: 735742 - DNA, 20 bp, mouse
ggatgctgatagaaaagata

SEQ ID NO: 735743 - DNA, 20 bp, mouse
gtgtccctcagtagggagga

SEQ ID NO: 735744 - DNA, 20 bp, mouse
gcagcttggtgaattttgaa

SEQ ID NO: 735745 - DNA, 20 bp, mouse
gtgacagtcatggtgactgt

SEQ ID NO: 735746 - DNA, 20 bp, mouse
gggtggtggtggtcattcat

SEQ ID NO: 735747 - DNA, 20 bp, mouse
gttagaatatggaacaatat

SEQ ID NO: 735748 - DNA, 20 bp, mouse
ggaggcacaaactttcctct

SEQ ID NO: 735749 - DNA, 20 bp, mouse
gtaccataatcatcattcat

SEQ ID NO: 735750 - DNA, 20 bp, mouse
gtgtgattgtgctaacaggt

SEQ ID NO: 735751 - DNA, 20 bp, mouse
ggggtaattctgagattagt

SEQ ID NO: 735752 - DNA, 20 bp, mouse
gatggagagtcagagcacgg

SEQ ID NO: 735753 - DNA, 20 bp, mouse
gaagatgctgtatctacata

SEQ ID NO: 735754 - DNA, 20 bp, mouse
gtattctaagaggtgatgtt

SEQ ID NO: 735755 - DNA, 20 bp, mouse
gcatagggcatcttgccaag

SEQ ID NO: 735756 - DNA, 20 bp, mouse
gctctgcagtgcaaccgagt

SEQ ID NO: 735757 - DNA, 20 bp, mouse
gggagctgatggccggctta

SEQ ID NO: 735758 - DNA, 20 bp, mouse
gctgccttgctcttatctga

SEQ ID NO: 735759 - DNA, 20 bp, mouse
gcggttgcactgcagagctc

SEQ ID NO: 735760 - DNA, 20 bp, mouse
ggggggccaggcccaagttt

SEQ ID NO: 735761 - DNA, 20 bp, mouse
gaaggcagtaggagcatgcc

SEQ ID NO: 735762 - DNA, 20 bp, mouse
gtgcttagttggaaagagag

SEQ ID NO: 735763 - DNA, 20 bp, mouse
gacagagtcaggggctattg

SEQ ID NO: 735764 - DNA, 20 bp, mouse
gtaaaggtgtagaacagtca

SEQ ID NO: 735765 - DNA, 20 bp, mouse
ggcaccctcagataagagca

SEQ ID NO: 735766 - DNA, 20 bp, mouse
gactcagcgggaatctggcc

SEQ ID NO: 735767 - DNA, 20 bp, mouse
gttcccgctgagtcctgggt

SEQ ID NO: 735768 - DNA, 20 bp, mouse
gaaaatccaggcagcccaga

SEQ ID NO: 735769 - DNA, 20 bp, mouse
gggaatctggccaggctttg

SEQ ID NO: 735770 - DNA, 20 bp, mouse
gaggggcggggccttgagcg

SEQ ID NO: 735771 - DNA, 20 bp, mouse
gtggggtgaactctgtcggt

SEQ ID NO: 735772 - DNA, 20 bp, mouse
ggcccctgaggagaactagt

SEQ ID NO: 735773 - DNA, 20 bp, mouse
gccaggactcagcgggaatc

SEQ ID NO: 735774 - DNA, 20 bp, mouse
gcgcgccccagctgcgaggc

SEQ ID NO: 735775 - DNA, 20 bp, mouse
gcttcacgccagaccctccc

SEQ ID NO: 735776 - DNA, 20 bp, mouse
gaaggctgcctagaggtctc

SEQ ID NO: 735777 - DNA, 20 bp, mouse
gacccccacgcctccatgcc

SEQ ID NO: 735778 - DNA, 20 bp, mouse
gcaaaactaaccacggaatg

SEQ ID NO: 735779 - DNA, 20 bp, mouse
ggccgccggtcctcattccg

SEQ ID NO: 735780 - DNA, 20 bp, mouse
gggggaccagtgtccatgcc

SEQ ID NO: 735781 - DNA, 20 bp, mouse
ggagagagaaggctgcctag

SEQ ID NO: 735782 - DNA, 20 bp, mouse
gatgcctggcatggaggcgt

SEQ ID NO: 735783 - DNA, 20 bp, mouse
ggtacggaaaatacaaattg

SEQ ID NO: 735784 - DNA, 20 bp, mouse
gtggcgccaaaagtcgcgta

SEQ ID NO: 735785 - DNA, 20 bp, mouse
gtctgtcgactaacagtgtc

SEQ ID NO: 735786 - DNA, 20 bp, mouse
gcgcctgcgccgaactgcac

SEQ ID NO: 735787 - DNA, 20 bp, mouse
ggcccggtgcagttcggcgc

SEQ ID NO: 735788 - DNA, 20 bp, mouse
ggcggggcgggacgcgttcg

SEQ ID NO: 735789 - DNA, 20 bp, mouse
ggggcgggacgcgttcgggg

SEQ ID NO: 735790 - DNA, 20 bp, mouse
gaggatgctagtcatgggca

SEQ ID NO: 735791 - DNA, 20 bp, mouse
gaatataagcaagaggtgga

SEQ ID NO: 735792 - DNA, 20 bp, mouse
ggcgttcggggcggggacag

SEQ ID NO: 735793 - DNA, 20 bp, mouse
gatgtgaggatgctagtcat

SEQ ID NO: 735794 - DNA, 20 bp, mouse
gaatgaatataagcaagagg

SEQ ID NO: 735795 - DNA, 20 bp, mouse
gagtgctgcccggtgcagtt

SEQ ID NO: 735796 - DNA, 20 bp, mouse
gaggcgcttgggacgcgctg

SEQ ID NO: 735797 - DNA, 20 bp, mouse
gtcccaagcgcctcagacac

SEQ ID NO: 735798 - DNA, 20 bp, mouse
ggacgcgctgaggggtggag

SEQ ID NO: 735799 - DNA, 20 bp, mouse
gccctgacgggtgtcggctg

SEQ ID NO: 735800 - DNA, 20 bp, mouse
gatcccgcagcctgtgtctg

SEQ ID NO: 735801 - DNA, 20 bp, mouse
ggctgccaacatccgggagg

SEQ ID NO: 735802 - DNA, 20 bp, mouse
ggcgggatgctcatctgccg

SEQ ID NO: 735803 - DNA, 20 bp, mouse
ggctgccacctcccggatgt

SEQ ID NO: 735804 - DNA, 20 bp, mouse
gaccacagccgacacccgtc

SEQ ID NO: 735805 - DNA, 20 bp, mouse
gcttgggacgcgctgagggg

SEQ ID NO: 735806 - DNA, 20 bp, mouse
gcctgcgcgggcgagccccg

SEQ ID NO: 735807 - DNA, 20 bp, mouse
ggatccctagagtcctcgag

SEQ ID NO: 735808 - DNA, 20 bp, mouse
ggcgccgctcgaggactcta

SEQ ID NO: 735809 - DNA, 20 bp, mouse
ggcggggcgcgcccacccgc

SEQ ID NO: 735810 - DNA, 20 bp, mouse
ggggtgctggatggtggcca

SEQ ID NO: 735811 - DNA, 20 bp, mouse
gggggcgcacgtccctgcgc

SEQ ID NO: 735812 - DNA, 20 bp, mouse
gacgcgcggggaccccctcg

SEQ ID NO: 735813 - DNA, 20 bp, mouse
ggggtccccgcgcgtccgag

SEQ ID NO: 735814 - DNA, 20 bp, mouse
gcgggtgcggtctcgggcgg

SEQ ID NO: 735815 - DNA, 20 bp, mouse
gacccgcggggcccagccag

SEQ ID NO: 735816 - DNA, 20 bp, mouse
ggggaagtggagagcttcga

SEQ ID NO: 735817 - DNA, 20 bp, mouse
ggtcccttctgccaccttga

SEQ ID NO: 735818 - DNA, 20 bp, mouse
gaggtctagagataaggcgg

SEQ ID NO: 735819 - DNA, 20 bp, mouse
gggcaggtctagagataagg

SEQ ID NO: 735820 - DNA, 20 bp, mouse
gagaaagcgcgggcctccgg

SEQ ID NO: 735821 - DNA, 20 bp, mouse
gtctagacctgccctcaagg

SEQ ID NO: 735822 - DNA, 20 bp, mouse
ggggacttccacgttacact

SEQ ID NO: 735823 - DNA, 20 bp, mouse
gagggcactgggctcaggtg

SEQ ID NO: 735824 - DNA, 20 bp, mouse
gaagcctcctgcagcagcga

SEQ ID NO: 735825 - DNA, 20 bp, mouse
ggccctcccgcggcttttga

SEQ ID NO: 735826 - DNA, 20 bp, mouse
gtgtctggggttgaactcag

SEQ ID NO: 735827 - DNA, 20 bp, mouse
gcaccagcaaaccttggtcg

SEQ ID NO: 735828 - DNA, 20 bp, mouse
gaggaagttgtgagcctgtc

SEQ ID NO: 735829 - DNA, 20 bp, mouse
ggggcttgggggaggaaagc

SEQ ID NO: 735830 - DNA, 20 bp, mouse
gggcagagaggcgggggctt

SEQ ID NO: 735831 - DNA, 20 bp, mouse
gctattgcttggcaaaccga

SEQ ID NO: 735832 - DNA, 20 bp, mouse
gttgcttggcaaaccgaggg

SEQ ID NO: 735833 - DNA, 20 bp, mouse
ggtgctaaacaaagctgctg

SEQ ID NO: 735834 - DNA, 20 bp, mouse
gggtgtacttgtactacaat

SEQ ID NO: 735835 - DNA, 20 bp, mouse
gacaagtacaccctctgctt

SEQ ID NO: 735836 - DNA, 20 bp, mouse
ggggcggagtaagtgatgta

SEQ ID NO: 735837 - DNA, 20 bp, mouse
ggggccggaacccacgagtt

SEQ ID NO: 735838 - DNA, 20 bp, mouse
gatgtagggaaagatcgcgg

SEQ ID NO: 735839 - DNA, 20 bp, mouse
gagacacacggtggcatccg

SEQ ID NO: 735840 - DNA, 20 bp, mouse
gctggggagccccaactcgt

SEQ ID NO: 735841 - DNA, 20 bp, mouse
gatgccaccgtgtgtctcgc

SEQ ID NO: 735842 - DNA, 20 bp, mouse
gaggccgctcggatatgcag

SEQ ID NO: 735843 - DNA, 20 bp, mouse
gtaacccctgcatatccgag

SEQ ID NO: 735844 - DNA, 20 bp, mouse
gtggggatgtctcaagtctt

SEQ ID NO: 735845 - DNA, 20 bp, mouse
gagtgacgagttgacgagtg

SEQ ID NO: 735846 - DNA, 20 bp, mouse
ggcgcccaggctgaaggctc

SEQ ID NO: 735847 - DNA, 20 bp, mouse
ggactcccgcgcgctgacca

SEQ ID NO: 735848 - DNA, 20 bp, mouse
gcaacccgagccttcagcct

SEQ ID NO: 735849 - DNA, 20 bp, mouse
ggggacatacccagtgggtc

SEQ ID NO: 735850 - DNA, 20 bp, mouse
gcccgcgcgctgaccagggg

SEQ ID NO: 735851 - DNA, 20 bp, mouse
gccggagcccaggggattct

SEQ ID NO: 735852 - DNA, 20 bp, mouse
gctaaagtcaggtgtcacta

SEQ ID NO: 735853 - DNA, 20 bp, mouse
gttggcaagcccgacccact

SEQ ID NO: 735854 - DNA, 20 bp, mouse
gagcgcccgaccgcttatat

SEQ ID NO: 735855 - DNA, 20 bp, mouse
gtcctcaagcctgccggggt

SEQ ID NO: 735856 - DNA, 20 bp, mouse
ggggacgggccaccccgaag

SEQ ID NO: 735857 - DNA, 20 bp, mouse
ggggcggggccagttctcgg

SEQ ID NO: 735858 - DNA, 20 bp, mouse
gtgtcctggccgcttcgggg

SEQ ID NO: 735859 - DNA, 20 bp, mouse
gacgctgggcggcgctgcgg

SEQ ID NO: 735860 - DNA, 20 bp, mouse
ggcggccaggacagaggcgt

SEQ ID NO: 735861 - DNA, 20 bp, mouse
gccggggcggggccagttct

SEQ ID NO: 735862 - DNA, 20 bp, mouse
gagggcggggagaagccccg

SEQ ID NO: 735863 - DNA, 20 bp, mouse
gggacctagaggctccgctc

SEQ ID NO: 735864 - DNA, 20 bp, mouse
gcaggccgggagcgaactgt

SEQ ID NO: 735865 - DNA, 20 bp, mouse
gtggcccgtcccccgagaac

SEQ ID NO: 735866 - DNA, 20 bp, mouse
gcacgcgcgcggtgtagaag

SEQ ID NO: 735867 - DNA, 20 bp, mouse
ggcgagctggggatctccga

SEQ ID NO: 735868 - DNA, 20 bp, mouse
gctggggcgcgggtgcacgt

SEQ ID NO: 735869 - DNA, 20 bp, mouse
gggacgacccccaggctcta

SEQ ID NO: 735870 - DNA, 20 bp, mouse
gggcaagctgggcgctttag

SEQ ID NO: 735871 - DNA, 20 bp, mouse
ggagcctgggggtcgtccgg

SEQ ID NO: 735872 - DNA, 20 bp, mouse
gaaagcgcccagcttgccac

SEQ ID NO: 735873 - DNA, 20 bp, mouse
gtgcacccgcgccccaggct

SEQ ID NO: 735874 - DNA, 20 bp, mouse
gctctagggcgttctctaga

SEQ ID NO: 735875 - DNA, 20 bp, mouse
ggggtcgtccggtggcaagc

SEQ ID NO: 735876 - DNA, 20 bp, mouse
gccacctgacgagaaggatc

SEQ ID NO: 735877 - DNA, 20 bp, mouse
ggagcatccgagagacccag

SEQ ID NO: 735878 - DNA, 20 bp, mouse
gctgccggagaggaataaag

SEQ ID NO: 735879 - DNA, 20 bp, mouse
gctctcggatgctccagaga

SEQ ID NO: 735880 - DNA, 20 bp, mouse
gctaggctgcaggatgtaaa

SEQ ID NO: 735881 - DNA, 20 bp, mouse
gcgcctcggagaccatcctc

SEQ ID NO: 735882 - DNA, 20 bp, mouse
gcgggtccagagtcccttac

SEQ ID NO: 735883 - DNA, 20 bp, mouse
gcagccagatccttctcgtc

SEQ ID NO: 735884 - DNA, 20 bp, mouse
gtccttaaggacgaccgtga

SEQ ID NO: 735885 - DNA, 20 bp, mouse
gagagagccacctgacgaga

SEQ ID NO: 735886 - DNA, 20 bp, mouse
gaggaagggccccataggga

SEQ ID NO: 735887 - DNA, 20 bp, mouse
ggggacgactagaaacaaaa

SEQ ID NO: 735888 - DNA, 20 bp, mouse
ggtcccttcaaaccctaggg

SEQ ID NO: 735889 - DNA, 20 bp, mouse
gcctgaggcgggaaccgctg

SEQ ID NO: 735890 - DNA, 20 bp, mouse
gtggcttcgagcaaggggtg

SEQ ID NO: 735891 - DNA, 20 bp, mouse
ggtcccccctagggtttgaa

SEQ ID NO: 735892 - DNA, 20 bp, mouse
gaagggccccatagggaggg

SEQ ID NO: 735893 - DNA, 20 bp, mouse
gaaggtgtgaggccttaggg

SEQ ID NO: 735894 - DNA, 20 bp, mouse
gagcaaggggtggggtttgt

SEQ ID NO: 735895 - DNA, 20 bp, mouse
gtgtcggggcggaacccctg

SEQ ID NO: 735896 - DNA, 20 bp, mouse
gctggaaggcagaacgggga

SEQ ID NO: 735897 - DNA, 20 bp, mouse
gtggcaggctcgggcggaag

SEQ ID NO: 735898 - DNA, 20 bp, mouse
gaatgcagttgatagtgtgg

SEQ ID NO: 735899 - DNA, 20 bp, mouse
ggcactagacaggagcctaa

SEQ ID NO: 735900 - DNA, 20 bp, mouse
ggcggcgtggcaggctcggg

SEQ ID NO: 735901 - DNA, 20 bp, mouse
gggaaggcctggttccgggg

SEQ ID NO: 735902 - DNA, 20 bp, mouse
ggccgccagcgggactcgtt

SEQ ID NO: 735903 - DNA, 20 bp, mouse
gcacagcggcagacagctag

SEQ ID NO: 735904 - DNA, 20 bp, mouse
gcgggactacgaacagagaa

SEQ ID NO: 735905 - DNA, 20 bp, mouse
gtacctactaagcactagac

SEQ ID NO: 735906 - DNA, 20 bp, mouse
gtaaccgcctgccaatcgga

SEQ ID NO: 735907 - DNA, 20 bp, mouse
gcatctatgggtggggcgga

SEQ ID NO: 735908 - DNA, 20 bp, mouse
gcaagggacgagacaaggat

SEQ ID NO: 735909 - DNA, 20 bp, mouse
ggacgagacaaggatgggag

SEQ ID NO: 735910 - DNA, 20 bp, mouse
gatgactccgcccactaggt

SEQ ID NO: 735911 - DNA, 20 bp, mouse
gtccccgcccatctatgggt

SEQ ID NO: 735912 - DNA, 20 bp, mouse
gccgcctgccaatcggacgg

SEQ ID NO: 735913 - DNA, 20 bp, mouse
gagggcaggctgtgggcgga

SEQ ID NO: 735914 - DNA, 20 bp, mouse
ggccccacccatagatgggc

SEQ ID NO: 735915 - DNA, 20 bp, mouse
gcctctagttacgccttcaa

SEQ ID NO: 735916 - DNA, 20 bp, mouse
ggacacctactcctcaccgt

SEQ ID NO: 735917 - DNA, 20 bp, mouse
gtcgcccccggaaccgtgga

SEQ ID NO: 735918 - DNA, 20 bp, mouse
gtggcgctcctcctcgcccc

SEQ ID NO: 735919 - DNA, 20 bp, mouse
ggctccccacggtgaggagt

SEQ ID NO: 735920 - DNA, 20 bp, mouse
ggtgaggagtaggtgtcccg

SEQ ID NO: 735921 - DNA, 20 bp, mouse
gcacgccttccacggttccg

SEQ ID NO: 735922 - DNA, 20 bp, mouse
ggggcggggaggcgagcgac

SEQ ID NO: 735923 - DNA, 20 bp, mouse
ggcctccgcaggaagccggg

SEQ ID NO: 735924 - DNA, 20 bp, mouse
ggccaggtcccgaagctccg

SEQ ID NO: 735925 - DNA, 20 bp, mouse
gagcgacgggcgggcagtga

SEQ ID NO: 735926 - DNA, 20 bp, mouse
ggtagccagcacaggagcca

SEQ ID NO: 735927 - DNA, 20 bp, mouse
gagggctggctgccgcctct

SEQ ID NO: 735928 - DNA, 20 bp, mouse
gctgccgcctctcggctgat

SEQ ID NO: 735929 - DNA, 20 bp, mouse
gaagccaatcagccgagagg

SEQ ID NO: 735930 - DNA, 20 bp, mouse
gtggacaaagtgttgaaact

SEQ ID NO: 735931 - DNA, 20 bp, mouse
ggcaagggcagcaaggcctt

SEQ ID NO: 735932 - DNA, 20 bp, mouse
gtacgggaggtagccagcac

SEQ ID NO: 735933 - DNA, 20 bp, mouse
gacacttaggaaacaagtac

SEQ ID NO: 735934 - DNA, 20 bp, mouse
gggcacaagactatctttgt

SEQ ID NO: 735935 - DNA, 20 bp, mouse
ggggcagcaaggccttcggc

SEQ ID NO: 735936 - DNA, 20 bp, mouse
gtccaacagcagctagaaaa

SEQ ID NO: 735937 - DNA, 20 bp, mouse
gagctgctgttggaacatgt

SEQ ID NO: 735938 - DNA, 20 bp, mouse
gaggaaggaagttgaccaac

SEQ ID NO: 735939 - DNA, 20 bp, mouse
gccaacctgagaaggactgt

SEQ ID NO: 735940 - DNA, 20 bp, mouse
gcagatgatctcagttagga

SEQ ID NO: 735941 - DNA, 20 bp, mouse
gtaggctagaacaatataaa

SEQ ID NO: 735942 - DNA, 20 bp, mouse
gctagcctacagtccttctc

SEQ ID NO: 735943 - DNA, 20 bp, mouse
gcaaacccattgagattgaa

SEQ ID NO: 735944 - DNA, 20 bp, mouse
gatagccaggccaagatcta

SEQ ID NO: 735945 - DNA, 20 bp, mouse
gggaagttgaccaactggag

SEQ ID NO: 735946 - DNA, 20 bp, mouse
gtgggcggggccctgtccgg

SEQ ID NO: 735947 - DNA, 20 bp, mouse
gaggtgggcggggccctgtc

SEQ ID NO: 735948 - DNA, 20 bp, mouse
gaacgcctcccggccgcttc

SEQ ID NO: 735949 - DNA, 20 bp, mouse
gaggtcagcgcaaggtgatc

SEQ ID NO: 735950 - DNA, 20 bp, mouse
gaggaaggagggggcggttg

SEQ ID NO: 735951 - DNA, 20 bp, mouse
gtgaggctccgcccccggac

SEQ ID NO: 735952 - DNA, 20 bp, mouse
ggaagcgagggtgtgaggct

SEQ ID NO: 735953 - DNA, 20 bp, mouse
gcgcgcgctcgataagtaac

SEQ ID NO: 735954 - DNA, 20 bp, mouse
gctcagagcgggatcttccc

SEQ ID NO: 735955 - DNA, 20 bp, mouse
gagggcgaagcgagggtgtg

SEQ ID NO: 735956 - DNA, 20 bp, mouse
gactccggagaggtcggcgg

SEQ ID NO: 735957 - DNA, 20 bp, mouse
gtgagtggacgcgggaagtt

SEQ ID NO: 735958 - DNA, 20 bp, mouse
ggggagaactgagtggacgc

SEQ ID NO: 735959 - DNA, 20 bp, mouse
gctcccggcagtctctgtcc

SEQ ID NO: 735960 - DNA, 20 bp, mouse
gtaccatagcgtatcctgat

SEQ ID NO: 735961 - DNA, 20 bp, mouse
gccacagggccgtgcctcac

SEQ ID NO: 735962 - DNA, 20 bp, mouse
gccgccgggacagagactgc

SEQ ID NO: 735963 - DNA, 20 bp, mouse
gaggagtaatgttactccct

SEQ ID NO: 735964 - DNA, 20 bp, mouse
gaccctgctgtcggccaatc

SEQ ID NO: 735965 - DNA, 20 bp, mouse
gctcccttggctctgagttc

SEQ ID NO: 735966 - DNA, 20 bp, mouse
gctcacagttgggtgcgtgt

SEQ ID NO: 735967 - DNA, 20 bp, mouse
ggggagtagatgtagaaacg

SEQ ID NO: 735968 - DNA, 20 bp, mouse
gagtagatgtagaaacgggg

SEQ ID NO: 735969 - DNA, 20 bp, mouse
gaggagcaaagctcacagtt

SEQ ID NO: 735970 - DNA, 20 bp, mouse
gagttgggtgcgtgtgggat

SEQ ID NO: 735971 - DNA, 20 bp, mouse
gtgtaagaggcactgccctg

SEQ ID NO: 735972 - DNA, 20 bp, mouse
gtacaaactcagactccgtg

SEQ ID NO: 735973 - DNA, 20 bp, mouse
gctccgtgaggactttgcaa

SEQ ID NO: 735974 - DNA, 20 bp, mouse
gtaatgtgctacattgctgg

SEQ ID NO: 735975 - DNA, 20 bp, mouse
gagatggaagcagggaatgc

SEQ ID NO: 735976 - DNA, 20 bp, mouse
gcatcccatcgtgacgtcat

SEQ ID NO: 735977 - DNA, 20 bp, mouse
ggggtctacaaagacctgaa

SEQ ID NO: 735978 - DNA, 20 bp, mouse
gtgctgggaaagttctacta

SEQ ID NO: 735979 - DNA, 20 bp, mouse
gccatcgtgacgtcataggg

SEQ ID NO: 735980 - DNA, 20 bp, mouse
ggcatcctgcggaaaacctg

SEQ ID NO: 735981 - DNA, 20 bp, mouse
gtagaccccaggttttccgc

SEQ ID NO: 735982 - DNA, 20 bp, mouse
gtactggctttcgttcaggt

SEQ ID NO: 735983 - DNA, 20 bp, mouse
gggaggctagggcaggttac

SEQ ID NO: 735984 - DNA, 20 bp, mouse
gtgggcggggcctaagagtc

SEQ ID NO: 735985 - DNA, 20 bp, mouse
gaggttactggctttcgttc

SEQ ID NO: 735986 - DNA, 20 bp, mouse
gaacactccgagtgtagctc

SEQ ID NO: 735987 - DNA, 20 bp, mouse
gaagtgtcctgccttactgt

SEQ ID NO: 735988 - DNA, 20 bp, mouse
gctacactcggagtgttctg

SEQ ID NO: 735989 - DNA, 20 bp, mouse
gggttagaacagcacccaac

SEQ ID NO: 735990 - DNA, 20 bp, mouse
gtttctcagccaggctttag

SEQ ID NO: 735991 - DNA, 20 bp, mouse
ggggactttgtgacctcaca

SEQ ID NO: 735992 - DNA, 20 bp, mouse
gctgggattaaagacgtacc

SEQ ID NO: 735993 - DNA, 20 bp, mouse
ggagtgtagctctggaatcc

SEQ ID NO: 735994 - DNA, 20 bp, mouse
gggaggggacgggcctgtcc

SEQ ID NO: 735995 - DNA, 20 bp, mouse
gttctgaggtcgcccctgtg

SEQ ID NO: 735996 - DNA, 20 bp, mouse
gtggtaagagacatggatga

SEQ ID NO: 735997 - DNA, 20 bp, mouse
ggttacaagagtgaacagat

SEQ ID NO: 735998 - DNA, 20 bp, mouse
gcctcctagatgttaagtat

SEQ ID NO: 735999 - DNA, 20 bp, mouse
gaagcccatacttaacatct

SEQ ID NO: 736000 - DNA, 20 bp, mouse
ggggaagctaatcatattta

SEQ ID NO: 736001 - DNA, 20 bp, mouse
gcaaaccattcaaatattct

SEQ ID NO: 736002 - DNA, 20 bp, mouse
ggaagtacacagtaataact

SEQ ID NO: 736003 - DNA, 20 bp, mouse
gtccttaaattaaaataaca

SEQ ID NO: 736004 - DNA, 20 bp, mouse
gggagatttgatcaagatat

SEQ ID NO: 736005 - DNA, 20 bp, mouse
gttatagttgataaatgttc

SEQ ID NO: 736006 - DNA, 20 bp, mouse
ggggcgggacatgtctaagc

SEQ ID NO: 736007 - DNA, 20 bp, mouse
gtggaagcatgatcaggccc

SEQ ID NO: 736008 - DNA, 20 bp, mouse
gtgggacaggagtctaatcg

SEQ ID NO: 736009 - DNA, 20 bp, mouse
ggggacgagccctccctcgc

SEQ ID NO: 736010 - DNA, 20 bp, mouse
gggacatgtctaagcggggc

SEQ ID NO: 736011 - DNA, 20 bp, mouse
ggggacagaagtccggatgg

SEQ ID NO: 736012 - DNA, 20 bp, mouse
gtagacatgtcccgcccacc

SEQ ID NO: 736013 - DNA, 20 bp, mouse
gtgcgtaaggcgctgtggat

SEQ ID NO: 736014 - DNA, 20 bp, mouse
ggaggtgtggcgcccgagtt

SEQ ID NO: 736015 - DNA, 20 bp, mouse
gcggacttctgtcccagggc

SEQ ID NO: 736016 - DNA, 20 bp, mouse
gggagcccgggccaggagaa

SEQ ID NO: 736017 - DNA, 20 bp, mouse
gtgcccgcctggctctcgaa

SEQ ID NO: 736018 - DNA, 20 bp, mouse
gtcctccgggttgttgggga

SEQ ID NO: 736019 - DNA, 20 bp, mouse
ggaacctggaaggaccgtgg

SEQ ID NO: 736020 - DNA, 20 bp, mouse
gagcccaggccgtgcaccga

SEQ ID NO: 736021 - DNA, 20 bp, mouse
gaaggggcgtgcccaataga

SEQ ID NO: 736022 - DNA, 20 bp, mouse
gccaacaacccggaggaaag

SEQ ID NO: 736023 - DNA, 20 bp, mouse
gaccgcggcgcctacacctg

SEQ ID NO: 736024 - DNA, 20 bp, mouse
gaaggggcgtgccatctatt

SEQ ID NO: 736025 - DNA, 20 bp, mouse
ggggacccggagcgccggtc

SEQ ID NO: 736026 - DNA, 20 bp, mouse
gcaggtgcgcgggtgacgaa

SEQ ID NO: 736027 - DNA, 20 bp, mouse
gtggctgcgctctgatggga

SEQ ID NO: 736028 - DNA, 20 bp, mouse
gttaacccgggcgagaattc

SEQ ID NO: 736029 - DNA, 20 bp, mouse
gagggtgcggtctatgcgcg

SEQ ID NO: 736030 - DNA, 20 bp, mouse
gagagtggctgcgctctgat

SEQ ID NO: 736031 - DNA, 20 bp, mouse
gcgagctttaaaggaggcga

SEQ ID NO: 736032 - DNA, 20 bp, mouse
gcactcccaggctgttaacc

SEQ ID NO: 736033 - DNA, 20 bp, mouse
gaggagaagccacagctcgg

SEQ ID NO: 736034 - DNA, 20 bp, mouse
ggtgcggtctatgcgcgggg

SEQ ID NO: 736035 - DNA, 20 bp, mouse
ggcaccccgagctttaaagg

SEQ ID NO: 736036 - DNA, 20 bp, mouse
ggggttcggttctgcacgat

SEQ ID NO: 736037 - DNA, 20 bp, mouse
gggtcagtgaaccatttcta

SEQ ID NO: 736038 - DNA, 20 bp, mouse
gctggcaaagaacctcagaa

SEQ ID NO: 736039 - DNA, 20 bp, mouse
gtgccagagtagagcgattg

SEQ ID NO: 736040 - DNA, 20 bp, mouse
gcacgatgggatctctgggc

SEQ ID NO: 736041 - DNA, 20 bp, mouse
gtctgcacgatgggatctct

SEQ ID NO: 736042 - DNA, 20 bp, mouse
ggttaaaaggggtttgctgg

SEQ ID NO: 736043 - DNA, 20 bp, mouse
gccggcctctctatcctggg

SEQ ID NO: 736044 - DNA, 20 bp, mouse
gggagctccgggagaacttc

SEQ ID NO: 736045 - DNA, 20 bp, mouse
ggctcggcatcagcggcctg

SEQ ID NO: 736046 - DNA, 20 bp, mouse
gtgggcaggcggggactcca

SEQ ID NO: 736047 - DNA, 20 bp, mouse
gagcgagcggagacacttgc

SEQ ID NO: 736048 - DNA, 20 bp, mouse
ggggcgtgatcgttcagagt

SEQ ID NO: 736049 - DNA, 20 bp, mouse
gtcacaagctacttggtaag

SEQ ID NO: 736050 - DNA, 20 bp, mouse
ggagccaagacccaagactg

SEQ ID NO: 736051 - DNA, 20 bp, mouse
ggcagcttctgacgtcacgg

SEQ ID NO: 736052 - DNA, 20 bp, mouse
ggtgcgagcctgggcaggcg

SEQ ID NO: 736053 - DNA, 20 bp, mouse
gtgatcgttcagagttggag

SEQ ID NO: 736054 - DNA, 20 bp, mouse
gcagaagctgctcctacaat

SEQ ID NO: 736055 - DNA, 20 bp, mouse
gaacgatcacgccccttgta

SEQ ID NO: 736056 - DNA, 20 bp, mouse
gcggtgcagcttcgggaaag

SEQ ID NO: 736057 - DNA, 20 bp, mouse
gctccggcgcggtgcagctt

SEQ ID NO: 736058 - DNA, 20 bp, mouse
gggaaagcggccccgagcgg

SEQ ID NO: 736059 - DNA, 20 bp, mouse
gcccccccgccaacccccgc

SEQ ID NO: 736060 - DNA, 20 bp, mouse
gctgcggggctgggccggga

SEQ ID NO: 736061 - DNA, 20 bp, mouse
gtgccctgctcggcgggctc

SEQ ID NO: 736062 - DNA, 20 bp, mouse
ggcgtgcggcccctggaggg

SEQ ID NO: 736063 - DNA, 20 bp, mouse
gtcccgaagctgcaccgcgc

SEQ ID NO: 736064 - DNA, 20 bp, mouse
gaaggggaaagtctccgcgg

SEQ ID NO: 736065 - DNA, 20 bp, mouse
gggcgtgggcaagccggcgg

SEQ ID NO: 736066 - DNA, 20 bp, mouse
ggggagtgctctgtaagctc

SEQ ID NO: 736067 - DNA, 20 bp, mouse
ggtgccgcaggccacccttc

SEQ ID NO: 736068 - DNA, 20 bp, mouse
gcccgggcagggacttgctg

SEQ ID NO: 736069 - DNA, 20 bp, mouse
gacggcggccaggaagctca

SEQ ID NO: 736070 - DNA, 20 bp, mouse
gggcggggcgggaagcccgg

SEQ ID NO: 736071 - DNA, 20 bp, mouse
gcaaagacaggagcccgagg

SEQ ID NO: 736072 - DNA, 20 bp, mouse
gagctcccaccccagaaggg

SEQ ID NO: 736073 - DNA, 20 bp, mouse
ggcacagctcccaccccaga

SEQ ID NO: 736074 - DNA, 20 bp, mouse
gacagagcactccccgcctc

SEQ ID NO: 736075 - DNA, 20 bp, mouse
gggaaagtcagggcgccctg

SEQ ID NO: 736076 - DNA, 20 bp, mouse
ggggagctgaccacctctaa

SEQ ID NO: 736077 - DNA, 20 bp, mouse
gcactgggcggggaaggcct

SEQ ID NO: 736078 - DNA, 20 bp, mouse
gtgggcagggagagcttcct

SEQ ID NO: 736079 - DNA, 20 bp, mouse
gcgagcgtgcgcactgggcg

SEQ ID NO: 736080 - DNA, 20 bp, mouse
gtcccgccagtcattgggga

SEQ ID NO: 736081 - DNA, 20 bp, mouse
gctcaggcgagcgtgcgcac

SEQ ID NO: 736082 - DNA, 20 bp, mouse
gtctgcctgtgatggccggg

SEQ ID NO: 736083 - DNA, 20 bp, mouse
gtagaccccccggccatcac

SEQ ID NO: 736084 - DNA, 20 bp, mouse
ggggcgaaagcccttagagg

SEQ ID NO: 736085 - DNA, 20 bp, mouse
gggagggtgtggtgtcctcg

SEQ ID NO: 736086 - DNA, 20 bp, mouse
gagaccaggcccatcctctg

SEQ ID NO: 736087 - DNA, 20 bp, mouse
ggaagcaggccacagaggat

SEQ ID NO: 736088 - DNA, 20 bp, mouse
gtctccttttgcaggtgatg

SEQ ID NO: 736089 - DNA, 20 bp, mouse
gtgctgctctgtacagtaga

SEQ ID NO: 736090 - DNA, 20 bp, mouse
gggcagaaggcttgcgagga

SEQ ID NO: 736091 - DNA, 20 bp, mouse
gcacagctgcttccagactc

SEQ ID NO: 736092 - DNA, 20 bp, mouse
gttttgcaggtgatgtggtt

SEQ ID NO: 736093 - DNA, 20 bp, mouse
ggtggatgggctgtgatgag

SEQ ID NO: 736094 - DNA, 20 bp, mouse
ggccttctgccacaatggac

SEQ ID NO: 736095 - DNA, 20 bp, mouse
gagtgagagtccagttttct

SEQ ID NO: 736096 - DNA, 20 bp, mouse
gtgcaagtggcaagctaagg

SEQ ID NO: 736097 - DNA, 20 bp, mouse
gagaggcgccaagggtgaaa

SEQ ID NO: 736098 - DNA, 20 bp, mouse
gagtggcaagctaaggggga

SEQ ID NO: 736099 - DNA, 20 bp, mouse
ggcggtagaagcagccggcc

SEQ ID NO: 736100 - DNA, 20 bp, mouse
gaattgcaagtggcaagcta

SEQ ID NO: 736101 - DNA, 20 bp, mouse
gcaaccagcagctgccgggc

SEQ ID NO: 736102 - DNA, 20 bp, mouse
gcggcagctgctggttgtca

SEQ ID NO: 736103 - DNA, 20 bp, mouse
gggcgcctctcaaggcgaca

SEQ ID NO: 736104 - DNA, 20 bp, mouse
ggcttctaccgcagcagggg

SEQ ID NO: 736105 - DNA, 20 bp, mouse
gttgcagcagacacctcctc

SEQ ID NO: 736106 - DNA, 20 bp, mouse
gaggacagaactctgaatgt

SEQ ID NO: 736107 - DNA, 20 bp, mouse
gaccacggatagtccctcgt

SEQ ID NO: 736108 - DNA, 20 bp, mouse
gcagggccacgcgcctacga

SEQ ID NO: 736109 - DNA, 20 bp, mouse
gacacccacgtgcaactcgc

SEQ ID NO: 736110 - DNA, 20 bp, mouse
gtctatgtccagtatcagaa

SEQ ID NO: 736111 - DNA, 20 bp, mouse
ggaacagagtgctgagatac

SEQ ID NO: 736112 - DNA, 20 bp, mouse
gctccaaaagctgctttcca

SEQ ID NO: 736113 - DNA, 20 bp, mouse
gaagcaaagggttaagggtt

SEQ ID NO: 736114 - DNA, 20 bp, mouse
gtgtgcctgcgggtcgccca

SEQ ID NO: 736115 - DNA, 20 bp, mouse
gactctgaatgttggggtcc

SEQ ID NO: 736116 - DNA, 20 bp, mouse
gcctctgccgccactcgctt

SEQ ID NO: 736117 - DNA, 20 bp, mouse
ggtcccagacaccacgtcct

SEQ ID NO: 736118 - DNA, 20 bp, mouse
gggccctaggacgtggtgtc

SEQ ID NO: 736119 - DNA, 20 bp, mouse
gcagaggactagcctcttga

SEQ ID NO: 736120 - DNA, 20 bp, mouse
gacagctggcagcctagcgc

SEQ ID NO: 736121 - DNA, 20 bp, mouse
gtgaggggagggcgtggacg

SEQ ID NO: 736122 - DNA, 20 bp, mouse
gcagggtcctaagcgagtgg

SEQ ID NO: 736123 - DNA, 20 bp, mouse
gagggcgtggacgcgggacg

SEQ ID NO: 736124 - DNA, 20 bp, mouse
gggacagtccttcttttgaa

SEQ ID NO: 736125 - DNA, 20 bp, mouse
gacaaagcggatcagtctgg

SEQ ID NO: 736126 - DNA, 20 bp, mouse
ggaccgagaaagctcaagtc

SEQ ID NO: 736127 - DNA, 20 bp, mouse
gtggtcgctatggaaactgg

SEQ ID NO: 736128 - DNA, 20 bp, mouse
gcgaggccgcgtggtcgcta

SEQ ID NO: 736129 - DNA, 20 bp, mouse
gcgggtcgcagggtccaagc

SEQ ID NO: 736130 - DNA, 20 bp, mouse
ggaaactggaggcgggtcgc

SEQ ID NO: 736131 - DNA, 20 bp, mouse
ggcgtggtcgctatggaaac

SEQ ID NO: 736132 - DNA, 20 bp, mouse
gctctgtcgatgaacttagc

SEQ ID NO: 736133 - DNA, 20 bp, mouse
gagctcaagtctggttgcta

SEQ ID NO: 736134 - DNA, 20 bp, mouse
gttaaaaagcgtgtctggga

SEQ ID NO: 736135 - DNA, 20 bp, mouse
ggggcgcatgcgcacgaggc

SEQ ID NO: 736136 - DNA, 20 bp, mouse
ggcggcagcaccacagcgga

SEQ ID NO: 736137 - DNA, 20 bp, mouse
gggcggcggcagcaccacag

SEQ ID NO: 736138 - DNA, 20 bp, mouse
gggaggtggcgaattagccg

SEQ ID NO: 736139 - DNA, 20 bp, mouse
gcacaagccccggcccggtg

SEQ ID NO: 736140 - DNA, 20 bp, mouse
gcggctgcaggtagacgtga

SEQ ID NO: 736141 - DNA, 20 bp, mouse
gagttctccgcaccgggccg

SEQ ID NO: 736142 - DNA, 20 bp, mouse
gccacgactgggctcggcgt

SEQ ID NO: 736143 - DNA, 20 bp, mouse
ggggagaggcgcctgacggg

SEQ ID NO: 736144 - DNA, 20 bp, mouse
gcctctgcgggccgcccgtc

SEQ ID NO: 736145 - DNA, 20 bp, mouse
gctctctctcattggttaag

SEQ ID NO: 736146 - DNA, 20 bp, mouse
ggcctcccgctgcctcccgg

SEQ ID NO: 736147 - DNA, 20 bp, mouse
gagcccgggacggaggagag

SEQ ID NO: 736148 - DNA, 20 bp, mouse
gcggactgcaggcacctcac

SEQ ID NO: 736149 - DNA, 20 bp, mouse
ggactcggcggctgggagga

SEQ ID NO: 736150 - DNA, 20 bp, mouse
gaaccaagggaggctccaag

SEQ ID NO: 736151 - DNA, 20 bp, mouse
gaggcccagggacgtaaagt

SEQ ID NO: 736152 - DNA, 20 bp, mouse
gcccagggacgtaaagttgg

SEQ ID NO: 736153 - DNA, 20 bp, mouse
ggccccctctcctccgtccc

SEQ ID NO: 736154 - DNA, 20 bp, mouse
gagggcgaaagggcaggccc

SEQ ID NO: 736155 - DNA, 20 bp, mouse
gggcacctcacagggcgaaa

SEQ ID NO: 736156 - DNA, 20 bp, mouse
gaaggtcagtgggtgtgaag

SEQ ID NO: 736157 - DNA, 20 bp, mouse
gacgtcagagggggacggag

SEQ ID NO: 736158 - DNA, 20 bp, mouse
gtgccagctccacacgtcag

SEQ ID NO: 736159 - DNA, 20 bp, mouse
ggaggagcgcgagcatcggc

SEQ ID NO: 736160 - DNA, 20 bp, mouse
ggcgagcatcggcgggagga

SEQ ID NO: 736161 - DNA, 20 bp, mouse
gggcggaggagcgcgagcat

SEQ ID NO: 736162 - DNA, 20 bp, mouse
gagggcccgctatatagccg

SEQ ID NO: 736163 - DNA, 20 bp, mouse
ggaggaggatggttcggcgt

SEQ ID NO: 736164 - DNA, 20 bp, mouse
gcccgggccggccccgcagg

SEQ ID NO: 736165 - DNA, 20 bp, mouse
ggggccctgagtggcgggga

SEQ ID NO: 736166 - DNA, 20 bp, mouse
gcgcgacgcgcgaggcccgt

SEQ ID NO: 736167 - DNA, 20 bp, mouse
gcaaggtcgcggctcagggg

SEQ ID NO: 736168 - DNA, 20 bp, mouse
gcggagaccgagaacgtgcg

SEQ ID NO: 736169 - DNA, 20 bp, mouse
ggagcaaggtcgcggctcag

SEQ ID NO: 736170 - DNA, 20 bp, mouse
ggcgcgagcgagcaaggtcg

SEQ ID NO: 736171 - DNA, 20 bp, mouse
gggcgcgcgactgcagacgg

SEQ ID NO: 736172 - DNA, 20 bp, mouse
gagggcacgcgccgcagtgg

SEQ ID NO: 736173 - DNA, 20 bp, mouse
gtggaagcccaggctcgcgg

SEQ ID NO: 736174 - DNA, 20 bp, mouse
gagcgccggaagcagccgac

SEQ ID NO: 736175 - DNA, 20 bp, mouse
gcgactgcagacggaggagg

SEQ ID NO: 736176 - DNA, 20 bp, mouse
gcggggacgagacctgagtc

SEQ ID NO: 736177 - DNA, 20 bp, mouse
gaggaccgcccccatcgtgc

SEQ ID NO: 736178 - DNA, 20 bp, mouse
gcgacttgaatgcacggggt

SEQ ID NO: 736179 - DNA, 20 bp, mouse
gtcaagttggaggcagggcg

SEQ ID NO: 736180 - DNA, 20 bp, mouse
ggagcctctgagctcaaacc

SEQ ID NO: 736181 - DNA, 20 bp, mouse
gaggctggactgctcggcgg

SEQ ID NO: 736182 - DNA, 20 bp, mouse
gagtctggacccggaaaagg

SEQ ID NO: 736183 - DNA, 20 bp, mouse
gaggcttccaagcctagatt

SEQ ID NO: 736184 - DNA, 20 bp, mouse
gacacccctagcgggggaag

SEQ ID NO: 736185 - DNA, 20 bp, mouse
gggctccagagactactctg

SEQ ID NO: 736186 - DNA, 20 bp, mouse
gccgtctgcgccccctcgga

SEQ ID NO: 736187 - DNA, 20 bp, mouse
ggggccgcgcgtgaggtcgt

SEQ ID NO: 736188 - DNA, 20 bp, mouse
gcgcactcgcccctccgagg

SEQ ID NO: 736189 - DNA, 20 bp, mouse
gtggctctgcgaccgcgcgt

SEQ ID NO: 736190 - DNA, 20 bp, mouse
gcgagggggcgcagacggag

SEQ ID NO: 736191 - DNA, 20 bp, mouse
gaggccgcagcgcagtccgt

SEQ ID NO: 736192 - DNA, 20 bp, mouse
gggggagtgggggtcggcgt

SEQ ID NO: 736193 - DNA, 20 bp, mouse
gccgcccacggactgcgctg

SEQ ID NO: 736194 - DNA, 20 bp, mouse
ggcgctgcggcctcgagagg

SEQ ID NO: 736195 - DNA, 20 bp, mouse
ggaggggcgagtgcggggac

SEQ ID NO: 736196 - DNA, 20 bp, mouse
gtgctggcgtctctgtctgg

SEQ ID NO: 736197 - DNA, 20 bp, mouse
gcgcggtagcagctcacctg

SEQ ID NO: 736198 - DNA, 20 bp, mouse
gcggagcccgccaccgacac

SEQ ID NO: 736199 - DNA, 20 bp, mouse
gcgtacaagcgctcgccgag

SEQ ID NO: 736200 - DNA, 20 bp, mouse
ggagcacgcagaagacgcaa

SEQ ID NO: 736201 - DNA, 20 bp, mouse
ggggcggtcaggatccgcgg

SEQ ID NO: 736202 - DNA, 20 bp, mouse
gagcgggcggtcaggatccg

SEQ ID NO: 736203 - DNA, 20 bp, mouse
gaggacccagtcatcctttg

SEQ ID NO: 736204 - DNA, 20 bp, mouse
gccaaggcccgcgttcctgc

SEQ ID NO: 736205 - DNA, 20 bp, mouse
gacgccagcagctggggagc

SEQ ID NO: 736206 - DNA, 20 bp, mouse
gcggccggaaggagaccgca

SEQ ID NO: 736207 - DNA, 20 bp, mouse
gaggccgggctcgcacgtag

SEQ ID NO: 736208 - DNA, 20 bp, mouse
ggcagacggaagtgttgcgt

SEQ ID NO: 736209 - DNA, 20 bp, mouse
gtcccaacatggcgcccaat

SEQ ID NO: 736210 - DNA, 20 bp, mouse
gccggagcgaagggcgtctc

SEQ ID NO: 736211 - DNA, 20 bp, mouse
gtctgcgcgtcgcttccctg

SEQ ID NO: 736212 - DNA, 20 bp, mouse
gcaacccaaagctccggtgg

SEQ ID NO: 736213 - DNA, 20 bp, mouse
gaattggcgtgcatgaaggc

SEQ ID NO: 736214 - DNA, 20 bp, mouse
gcgtaggccaaagcagggag

SEQ ID NO: 736215 - DNA, 20 bp, mouse
gcgacgcgaccttcccaaca

SEQ ID NO: 736216 - DNA, 20 bp, mouse
gctccccggctgtacggggt

SEQ ID NO: 736217 - DNA, 20 bp, mouse
ggtggcgcctgtctcctccc

SEQ ID NO: 736218 - DNA, 20 bp, mouse
ggtcccaccccgtacagccg

SEQ ID NO: 736219 - DNA, 20 bp, mouse
gccaaggggcccacctcaag

SEQ ID NO: 736220 - DNA, 20 bp, mouse
gtctcctccccggctgtacg

SEQ ID NO: 736221 - DNA, 20 bp, mouse
gataggacaaatctggacat

SEQ ID NO: 736222 - DNA, 20 bp, mouse
gccactaccctgcatgggtg

SEQ ID NO: 736223 - DNA, 20 bp, mouse
ggggctttcaaaactgggat

SEQ ID NO: 736224 - DNA, 20 bp, mouse
gaaccgaagccacttgaggt

SEQ ID NO: 736225 - DNA, 20 bp, mouse
gcggggctgcgatcctggag

SEQ ID NO: 736226 - DNA, 20 bp, mouse
gaaccccctcctctcagtta

SEQ ID NO: 736227 - DNA, 20 bp, mouse
gacctcctggagttggccac

SEQ ID NO: 736228 - DNA, 20 bp, mouse
gtctgtgggagggatccaag

SEQ ID NO: 736229 - DNA, 20 bp, mouse
gagccctaactgagaggagg

SEQ ID NO: 736230 - DNA, 20 bp, mouse
gttaaggtgtctcacttcct

SEQ ID NO: 736231 - DNA, 20 bp, mouse
ggggctaaggatcacgttgt

SEQ ID NO: 736232 - DNA, 20 bp, mouse
gactgcagagaatggacttc

SEQ ID NO: 736233 - DNA, 20 bp, mouse
gagcagtgggcgtggggctt

SEQ ID NO: 736234 - DNA, 20 bp, mouse
gacctggagctgggcggcta

SEQ ID NO: 736235 - DNA, 20 bp, mouse
gtgactccagcattagctta

SEQ ID NO: 736236 - DNA, 20 bp, mouse
gggtaacgcacagtagtcaa

SEQ ID NO: 736237 - DNA, 20 bp, mouse
gtgcgcttgtatgaagaagg

SEQ ID NO: 736238 - DNA, 20 bp, mouse
gattaaatagggatgttgtg

SEQ ID NO: 736239 - DNA, 20 bp, mouse
gcaatgcgcttgtatgaaga

SEQ ID NO: 736240 - DNA, 20 bp, mouse
gagtccggatgataagccaa

SEQ ID NO: 736241 - DNA, 20 bp, mouse
gggacatcgggatcgagctg

SEQ ID NO: 736242 - DNA, 20 bp, mouse
ggcaggtagctacagcagtc

SEQ ID NO: 736243 - DNA, 20 bp, mouse
gaggaggagacttccaaggc

SEQ ID NO: 736244 - DNA, 20 bp, mouse
gaagccattggcttatcatc

SEQ ID NO: 736245 - DNA, 20 bp, mouse
gggtaggggcgctgtagcca

SEQ ID NO: 736246 - DNA, 20 bp, mouse
ggctggggccaggaacgcgg

SEQ ID NO: 736247 - DNA, 20 bp, mouse
gactccgggccgggaaaaag

SEQ ID NO: 736248 - DNA, 20 bp, mouse
gcggctggagggacgcggag

SEQ ID NO: 736249 - DNA, 20 bp, mouse
gagggctggggccaggaacg

SEQ ID NO: 736250 - DNA, 20 bp, mouse
ggcgcgcaggcgcggctgga

SEQ ID NO: 736251 - DNA, 20 bp, mouse
gtttcccggcccggagtctg

SEQ ID NO: 736252 - DNA, 20 bp, mouse
gctggtgtgcccggccgcac

SEQ ID NO: 736253 - DNA, 20 bp, mouse
gggccgggaaaaagggggca

SEQ ID NO: 736254 - DNA, 20 bp, mouse
gcggcacgctgctgacgcgg

SEQ ID NO: 736255 - DNA, 20 bp, mouse
gcccccggcaagaggagcaa

SEQ ID NO: 736256 - DNA, 20 bp, mouse
gccaacgcgggctgttggtc

SEQ ID NO: 736257 - DNA, 20 bp, mouse
gcacctgagcccgacgtcag

SEQ ID NO: 736258 - DNA, 20 bp, mouse
gctacgtcacacaacgtcag

SEQ ID NO: 736259 - DNA, 20 bp, mouse
gcaacgtcaggggtgacgcg

SEQ ID NO: 736260 - DNA, 20 bp, mouse
gcgggctgttggtccggtgg

SEQ ID NO: 736261 - DNA, 20 bp, mouse
ggtgacgcgaggttggcagg

SEQ ID NO: 736262 - DNA, 20 bp, mouse
ggctccacaaccctgcacaa

SEQ ID NO: 736263 - DNA, 20 bp, mouse
ggagccgttgtgcagggttg

SEQ ID NO: 736264 - DNA, 20 bp, mouse
ggacctctaagcacctccac

SEQ ID NO: 736265 - DNA, 20 bp, mouse
ggggccctgcggcgtccagg

SEQ ID NO: 736266 - DNA, 20 bp, mouse
gagctcgcacgctgctgcta

SEQ ID NO: 736267 - DNA, 20 bp, mouse
gtctaggcagcagtgagccc

SEQ ID NO: 736268 - DNA, 20 bp, mouse
ggcagtccggaagtcctccg

SEQ ID NO: 736269 - DNA, 20 bp, mouse
gattcccgaaggcctccgta

SEQ ID NO: 736270 - DNA, 20 bp, mouse
gaggggaggagactcagcag

SEQ ID NO: 736271 - DNA, 20 bp, mouse
gcggggctgctctgccgcgt

SEQ ID NO: 736272 - DNA, 20 bp, mouse
gcagttctcgttctctccca

SEQ ID NO: 736273 - DNA, 20 bp, mouse
gagcagccccggaggacttc

SEQ ID NO: 736274 - DNA, 20 bp, mouse
gacagtaagggtagtagggg

SEQ ID NO: 736275 - DNA, 20 bp, mouse
gctgaagcgtgacgacatag

SEQ ID NO: 736276 - DNA, 20 bp, mouse
gagctcgcgcgccaagcagc

SEQ ID NO: 736277 - DNA, 20 bp, mouse
gcgcccagggaggggactag

SEQ ID NO: 736278 - DNA, 20 bp, mouse
gcacgtgtgtgtctgcggag

SEQ ID NO: 736279 - DNA, 20 bp, mouse
gtgcgggcgggcgtgtcatg

SEQ ID NO: 736280 - DNA, 20 bp, mouse
gaagcctgcggataaaggtg

SEQ ID NO: 736281 - DNA, 20 bp, mouse
gctgggcacgtgtgtgtctg

SEQ ID NO: 736282 - DNA, 20 bp, mouse
ggtcccctccctgggcgcgg

SEQ ID NO: 736283 - DNA, 20 bp, mouse
gggcgggcgtgtcatggggc

SEQ ID NO: 736284 - DNA, 20 bp, mouse
ggggcctccgcgcccaggga

SEQ ID NO: 736285 - DNA, 20 bp, mouse
ggggcggtgcccggctcacg

SEQ ID NO: 736286 - DNA, 20 bp, mouse
gcctgggtctgcaggcccag

SEQ ID NO: 736287 - DNA, 20 bp, mouse
ggaacctggggacttctaga

SEQ ID NO: 736288 - DNA, 20 bp, mouse
gtccttcagagccggaggga

SEQ ID NO: 736289 - DNA, 20 bp, mouse
gcagcctccttcagagccgg

SEQ ID NO: 736290 - DNA, 20 bp, mouse
gtccctccctccggctctga

SEQ ID NO: 736291 - DNA, 20 bp, mouse
gacccaggcagtggcccgag

SEQ ID NO: 736292 - DNA, 20 bp, mouse
gtgctcccaaaataaccccc

SEQ ID NO: 736293 - DNA, 20 bp, mouse
gggggggcttccaatccgct

SEQ ID NO: 736294 - DNA, 20 bp, mouse
gaggaggctgggccagccag

SEQ ID NO: 736295 - DNA, 20 bp, mouse
gagatccaatggccttgtta

SEQ ID NO: 736296 - DNA, 20 bp, mouse
gccccagtctccgctgccag

SEQ ID NO: 736297 - DNA, 20 bp, mouse
ggggcgccgcaggcaatcga

SEQ ID NO: 736298 - DNA, 20 bp, mouse
ggcaccgcgagcgcacgccg

SEQ ID NO: 736299 - DNA, 20 bp, mouse
gccaccgcggcgtgcgctcg

SEQ ID NO: 736300 - DNA, 20 bp, mouse
gtcctcccggctccccaccg

SEQ ID NO: 736301 - DNA, 20 bp, mouse
gcgggtgtccccggaggtag

SEQ ID NO: 736302 - DNA, 20 bp, mouse
gggctgggatttaaagggac

SEQ ID NO: 736303 - DNA, 20 bp, mouse
gcccgccagcgcccctctcc

SEQ ID NO: 736304 - DNA, 20 bp, mouse
gtccccggaggtagcggggt

SEQ ID NO: 736305 - DNA, 20 bp, mouse
gagggacaggaactgcgtaa

SEQ ID NO: 736306 - DNA, 20 bp, mouse
gccggcatgggagatggcga

SEQ ID NO: 736307 - DNA, 20 bp, mouse
ggggagaccgggagtgcgag

SEQ ID NO: 736308 - DNA, 20 bp, mouse
ggaggggagcagaatcacat

SEQ ID NO: 736309 - DNA, 20 bp, mouse
ggggtgagagctatggcagg

SEQ ID NO: 736310 - DNA, 20 bp, mouse
gagaaagctctgcagagaaa

SEQ ID NO: 736311 - DNA, 20 bp, mouse
gatatagccggcatgggaga

SEQ ID NO: 736312 - DNA, 20 bp, mouse
gcaggggtgagagctatggc

SEQ ID NO: 736313 - DNA, 20 bp, mouse
ggagagatgctggggagacc

SEQ ID NO: 736314 - DNA, 20 bp, mouse
gatacaaagaatgaggtgca

SEQ ID NO: 736315 - DNA, 20 bp, mouse
gctctcaagagtcctggaat

SEQ ID NO: 736316 - DNA, 20 bp, mouse
ggggccatggctcccaggat

SEQ ID NO: 736317 - DNA, 20 bp, mouse
gcccggagagcacggacgga

SEQ ID NO: 736318 - DNA, 20 bp, mouse
ggggcgcttcgcgtttcctg

SEQ ID NO: 736319 - DNA, 20 bp, mouse
gtggtgtctaggtcgctaag

SEQ ID NO: 736320 - DNA, 20 bp, mouse
gaccaagcaaggaagcggtc

SEQ ID NO: 736321 - DNA, 20 bp, mouse
ggctaaggggcgaccaagca

SEQ ID NO: 736322 - DNA, 20 bp, mouse
gcgagcggagcgtccgatcc

SEQ ID NO: 736323 - DNA, 20 bp, mouse
gagagcacggacggaaggct

SEQ ID NO: 736324 - DNA, 20 bp, mouse
gggtacctcccaccgcaagg

SEQ ID NO: 736325 - DNA, 20 bp, mouse
gcgagacagaagtctcccgg

SEQ ID NO: 736326 - DNA, 20 bp, mouse
ggggacttccacagagtcac

SEQ ID NO: 736327 - DNA, 20 bp, mouse
gcaccctgccagtgactctg

SEQ ID NO: 736328 - DNA, 20 bp, mouse
gctgctctgtagcactgttg

SEQ ID NO: 736329 - DNA, 20 bp, mouse
gctctgtagcactgttgggg

SEQ ID NO: 736330 - DNA, 20 bp, mouse
gctcctccagcaatgaatca

SEQ ID NO: 736331 - DNA, 20 bp, mouse
gagagcagaagcttcagata

SEQ ID NO: 736332 - DNA, 20 bp, mouse
ggcctgggatggacaggaac

SEQ ID NO: 736333 - DNA, 20 bp, mouse
gcagagcagagagctgactg

SEQ ID NO: 736334 - DNA, 20 bp, mouse
gttccacagagtcactggca

SEQ ID NO: 736335 - DNA, 20 bp, mouse
gcgtccctgccctgcgttcc

SEQ ID NO: 736336 - DNA, 20 bp, mouse
gcggctctgcaaacactaca

SEQ ID NO: 736337 - DNA, 20 bp, mouse
ggagccgggaggaataaaaa

SEQ ID NO: 736338 - DNA, 20 bp, mouse
ggacaagcagctgtgttatc

SEQ ID NO: 736339 - DNA, 20 bp, mouse
ggacccaagtacagacagag

SEQ ID NO: 736340 - DNA, 20 bp, mouse
ggcagagccggcgggaccgg

SEQ ID NO: 736341 - DNA, 20 bp, mouse
gccggcgggaccggtggtag

SEQ ID NO: 736342 - DNA, 20 bp, mouse
gagggtgttaaaccagaaat

SEQ ID NO: 736343 - DNA, 20 bp, mouse
gtggggagggtgtcacctaa

SEQ ID NO: 736344 - DNA, 20 bp, mouse
gggcgacgccgactcttccc

SEQ ID NO: 736345 - DNA, 20 bp, mouse
gggcccctttttattcctcc

SEQ ID NO: 736346 - DNA, 20 bp, mouse
gggcttgcgtcgttctcagg

SEQ ID NO: 736347 - DNA, 20 bp, mouse
gcgcgaaggctcacgggatg

SEQ ID NO: 736348 - DNA, 20 bp, mouse
gcccaactgtaggagcgcag

SEQ ID NO: 736349 - DNA, 20 bp, mouse
gaccctagaagattcttctc

SEQ ID NO: 736350 - DNA, 20 bp, mouse
ggggaaagacgcgccgggga

SEQ ID NO: 736351 - DNA, 20 bp, mouse
ggggccgggaaagacgcgcc

SEQ ID NO: 736352 - DNA, 20 bp, mouse
gcccttgcggagtctgtcgg

SEQ ID NO: 736353 - DNA, 20 bp, mouse
gttcttctctgggcccgcga

SEQ ID NO: 736354 - DNA, 20 bp, mouse
ggtgaggtctccatggcgac

SEQ ID NO: 736355 - DNA, 20 bp, mouse
ggtgggctgacgtcttggtt

SEQ ID NO: 736356 - DNA, 20 bp, mouse
gcggccccctcctagagcgt

SEQ ID NO: 736357 - DNA, 20 bp, mouse
gccctcctagagcgtgggga

SEQ ID NO: 736358 - DNA, 20 bp, mouse
gtaaacagcggccacgagcc

SEQ ID NO: 736359 - DNA, 20 bp, mouse
gtggctctgcgcggctgcag

SEQ ID NO: 736360 - DNA, 20 bp, mouse
gtctgcgcggctgcaggggg

SEQ ID NO: 736361 - DNA, 20 bp, mouse
gggcggctcgcgtcactgtc

SEQ ID NO: 736362 - DNA, 20 bp, mouse
gcaagcaaagggatgttgag

SEQ ID NO: 736363 - DNA, 20 bp, mouse
gcgcgtgtccttgtaaacag

SEQ ID NO: 736364 - DNA, 20 bp, mouse
gttgaggggccgaggcacat

SEQ ID NO: 736365 - DNA, 20 bp, mouse
gtgcggaagtgcactccgat

SEQ ID NO: 736366 - DNA, 20 bp, mouse
gctgcccggcaatccaagct

SEQ ID NO: 736367 - DNA, 20 bp, mouse
ggcgccggccagggttcctc

SEQ ID NO: 736368 - DNA, 20 bp, mouse
gcaagctgggcgtggtgacc

SEQ ID NO: 736369 - DNA, 20 bp, mouse
gcaacaacgcgctgcattgt

SEQ ID NO: 736370 - DNA, 20 bp, mouse
gcccccgaggggcgtgcctt

SEQ ID NO: 736371 - DNA, 20 bp, mouse
gcggggcgtggcttcacaga

SEQ ID NO: 736372 - DNA, 20 bp, mouse
gcattgtgggttgacgtcat

SEQ ID NO: 736373 - DNA, 20 bp, mouse
gagcggccgccaccaggcga

SEQ ID NO: 736374 - DNA, 20 bp, mouse
gccaccgaaggcacgcccct

SEQ ID NO: 736375 - DNA, 20 bp, mouse
gaaggagctaagtagttgtg

SEQ ID NO: 736376 - DNA, 20 bp, mouse
ggggagactcccaccctctg

SEQ ID NO: 736377 - DNA, 20 bp, mouse
gagtcgagtggcagtccctg

SEQ ID NO: 736378 - DNA, 20 bp, mouse
ggaggggcggagcctcgcgc

SEQ ID NO: 736379 - DNA, 20 bp, mouse
gcagcctgactatcccatcg

SEQ ID NO: 736380 - DNA, 20 bp, mouse
gcgaggctccgcccctcgat

SEQ ID NO: 736381 - DNA, 20 bp, mouse
gtgactatcccatcgagggg

SEQ ID NO: 736382 - DNA, 20 bp, mouse
ggagggtgggagtctcccta

SEQ ID NO: 736383 - DNA, 20 bp, mouse
ggcggccgtggtagaggtcc

SEQ ID NO: 736384 - DNA, 20 bp, mouse
ggtgagcgcataaacagagg

SEQ ID NO: 736385 - DNA, 20 bp, mouse
gcgcgccgggacctctacca

SEQ ID NO: 736386 - DNA, 20 bp, mouse
ggcacccggggactccagaa

SEQ ID NO: 736387 - DNA, 20 bp, mouse
gcggacgggcggtgacagtc

SEQ ID NO: 736388 - DNA, 20 bp, mouse
gagcgcaccggggctctcgt

SEQ ID NO: 736389 - DNA, 20 bp, mouse
gccccggagcgcgcgggtca

SEQ ID NO: 736390 - DNA, 20 bp, mouse
gcccgcgcgctccaggcgag

SEQ ID NO: 736391 - DNA, 20 bp, mouse
ggcggcgcgcaggaggcggt

SEQ ID NO: 736392 - DNA, 20 bp, mouse
gtaagtagagccgcccgctt

SEQ ID NO: 736393 - DNA, 20 bp, mouse
gaggcaggcgcagcgcaccg

SEQ ID NO: 736394 - DNA, 20 bp, mouse
gtgacagtccggtcgtcccc

SEQ ID NO: 736395 - DNA, 20 bp, mouse
ggccccgggagcgagctcag

SEQ ID NO: 736396 - DNA, 20 bp, mouse
gtccctgagccttatgaaac

SEQ ID NO: 736397 - DNA, 20 bp, mouse
gtgttggttggggacacagt

SEQ ID NO: 736398 - DNA, 20 bp, mouse
gaacacgcctgtgtggttgt

SEQ ID NO: 736399 - DNA, 20 bp, mouse
ggcggcaagggagggactaa

SEQ ID NO: 736400 - DNA, 20 bp, mouse
ggtggttgtgggtatccagg

SEQ ID NO: 736401 - DNA, 20 bp, mouse
gaagctaaagctgattaggg

SEQ ID NO: 736402 - DNA, 20 bp, mouse
ggagatgaggggaatctgat

SEQ ID NO: 736403 - DNA, 20 bp, mouse
gaggggccaggcggcaaggg

SEQ ID NO: 736404 - DNA, 20 bp, mouse
gctaagggggcggagttcca

SEQ ID NO: 736405 - DNA, 20 bp, mouse
gcaaggtccagctgttggtt

SEQ ID NO: 736406 - DNA, 20 bp, mouse
gcgagtgcagggacacaaac

SEQ ID NO: 736407 - DNA, 20 bp, mouse
ggccgtgcaagagtaacttg

SEQ ID NO: 736408 - DNA, 20 bp, mouse
gaatgggagggtcgctcggg

SEQ ID NO: 736409 - DNA, 20 bp, mouse
ggcgaatgggagggtcgctc

SEQ ID NO: 736410 - DNA, 20 bp, mouse
gccctccagggcgaatggga

SEQ ID NO: 736411 - DNA, 20 bp, mouse
gccgggagccaccgagtgca

SEQ ID NO: 736412 - DNA, 20 bp, mouse
ggcgcctaggagagtcgcgg

SEQ ID NO: 736413 - DNA, 20 bp, mouse
gccgcgatctagtgtaactg

SEQ ID NO: 736414 - DNA, 20 bp, mouse
gggtgcgcctaggagagtcg

SEQ ID NO: 736415 - DNA, 20 bp, mouse
gctcgggtacaaagagcgcg

SEQ ID NO: 736416 - DNA, 20 bp, mouse
ggagaagcggggaccctgtc

SEQ ID NO: 736417 - DNA, 20 bp, mouse
gtggccgcagcccagctcga

SEQ ID NO: 736418 - DNA, 20 bp, mouse
gaagcggggaccctgtccgg

SEQ ID NO: 736419 - DNA, 20 bp, mouse
gggtgcacgcgctctcgctg

SEQ ID NO: 736420 - DNA, 20 bp, mouse
gtgggggcgaagttgaaggg

SEQ ID NO: 736421 - DNA, 20 bp, mouse
gccgccctcgagctgggctg

SEQ ID NO: 736422 - DNA, 20 bp, mouse
ggcggcctgagcacgtccta

SEQ ID NO: 736423 - DNA, 20 bp, mouse
gtcgagggcgggtgcggtag

SEQ ID NO: 736424 - DNA, 20 bp, mouse
ggaagttgaagggtggtcgt

SEQ ID NO: 736425 - DNA, 20 bp, mouse
gcacgtcctagggtctcagt

SEQ ID NO: 736426 - DNA, 20 bp, mouse
gctactgtaggcccgccctc

SEQ ID NO: 736427 - DNA, 20 bp, mouse
gagggtggggacccgcctga

SEQ ID NO: 736428 - DNA, 20 bp, mouse
gaatctgagaagatcagagc

SEQ ID NO: 736429 - DNA, 20 bp, mouse
ggagtgagccatctgggcgg

SEQ ID NO: 736430 - DNA, 20 bp, mouse
ggctcactctgtcttacaat

SEQ ID NO: 736431 - DNA, 20 bp, mouse
gtgtaggcccgccctcaggc

SEQ ID NO: 736432 - DNA, 20 bp, mouse
gagccatctgggcgggggca

SEQ ID NO: 736433 - DNA, 20 bp, mouse
ggtggggacccgcctgaggg

SEQ ID NO: 736434 - DNA, 20 bp, mouse
gatctgggcgggggcagggt

SEQ ID NO: 736435 - DNA, 20 bp, mouse
gggttcaggagtaagaaaag

SEQ ID NO: 736436 - DNA, 20 bp, mouse
gaaggcggggactcgggtgg

SEQ ID NO: 736437 - DNA, 20 bp, mouse
gcgggctttggtgtatagga

SEQ ID NO: 736438 - DNA, 20 bp, mouse
gggcagaattgcgacaccga

SEQ ID NO: 736439 - DNA, 20 bp, mouse
gagcccgcgccgcgtcagga

SEQ ID NO: 736440 - DNA, 20 bp, mouse
gggggagccctggggaaatc

SEQ ID NO: 736441 - DNA, 20 bp, mouse
ggcccagcccggcgacctga

SEQ ID NO: 736442 - DNA, 20 bp, mouse
gcgggcgccctcaggtcgcc

SEQ ID NO: 736443 - DNA, 20 bp, mouse
gggtggcggcggcgaggatc

SEQ ID NO: 736444 - DNA, 20 bp, mouse
gtctggaaagcgccttacac

SEQ ID NO: 736445 - DNA, 20 bp, mouse
ggtcaggaaggcggggactc

SEQ ID NO: 736446 - DNA, 20 bp, mouse
gccgccccggcgcgccgcca

SEQ ID NO: 736447 - DNA, 20 bp, mouse
gggcgagtgccggggacacg

SEQ ID NO: 736448 - DNA, 20 bp, mouse
ggccggggacacggggagga

SEQ ID NO: 736449 - DNA, 20 bp, mouse
gcggctaggagccatgactg

SEQ ID NO: 736450 - DNA, 20 bp, mouse
ggcctggtgcctgatacgtg

SEQ ID NO: 736451 - DNA, 20 bp, mouse
ggcccccgcgggctgccagg

SEQ ID NO: 736452 - DNA, 20 bp, mouse
gagcgagcgggcgagtgccg

SEQ ID NO: 736453 - DNA, 20 bp, mouse
gtgtcgctgccgcacgtatc

SEQ ID NO: 736454 - DNA, 20 bp, mouse
ggagtgccggggacacgggg

SEQ ID NO: 736455 - DNA, 20 bp, mouse
ggcactgcggcaagcgacgc

SEQ ID NO: 736456 - DNA, 20 bp, mouse
gagagagcgcgggacaacgg

SEQ ID NO: 736457 - DNA, 20 bp, mouse
gggcggggaaaccccggcgg

SEQ ID NO: 736458 - DNA, 20 bp, mouse
gcggcgccggccaatggcag

SEQ ID NO: 736459 - DNA, 20 bp, mouse
ggccatgcaaatgagacggg

SEQ ID NO: 736460 - DNA, 20 bp, mouse
gaaccctacggcggagggag

SEQ ID NO: 736461 - DNA, 20 bp, mouse
gcgcggtggccgaactctgc

SEQ ID NO: 736462 - DNA, 20 bp, mouse
gccggcggggtgacttttgc

SEQ ID NO: 736463 - DNA, 20 bp, mouse
ggaaagcagcctgagcgcgg

SEQ ID NO: 736464 - DNA, 20 bp, mouse
gggcggcggggaaaccccgg

SEQ ID NO: 736465 - DNA, 20 bp, mouse
gcgcggaacgcactgggagc

SEQ ID NO: 736466 - DNA, 20 bp, mouse
gagagactccacaacgggag

SEQ ID NO: 736467 - DNA, 20 bp, mouse
gaacactagcctgtggaggg

SEQ ID NO: 736468 - DNA, 20 bp, mouse
gagaaactcggccggtgagt

SEQ ID NO: 736469 - DNA, 20 bp, mouse
gtttccgacggcccactcac

SEQ ID NO: 736470 - DNA, 20 bp, mouse
gcggtggcccgcctttccga

SEQ ID NO: 736471 - DNA, 20 bp, mouse
gtgtctgtcagaaactcggc

SEQ ID NO: 736472 - DNA, 20 bp, mouse
gcagtgagagactccacaac

SEQ ID NO: 736473 - DNA, 20 bp, mouse
gtctactcttctgctgtgta

SEQ ID NO: 736474 - DNA, 20 bp, mouse
gcgaatccggcgactggcgg

SEQ ID NO: 736475 - DNA, 20 bp, mouse
ggagtgggccgtcggaaagg

SEQ ID NO: 736476 - DNA, 20 bp, mouse
gaaagcgcgcgcgactcccg

SEQ ID NO: 736477 - DNA, 20 bp, mouse
ggggacctggctaacctgtg

SEQ ID NO: 736478 - DNA, 20 bp, mouse
gagggagaacgtctctgccc

SEQ ID NO: 736479 - DNA, 20 bp, mouse
gaaggggacaccgagcgctg

SEQ ID NO: 736480 - DNA, 20 bp, mouse
gcccgggcgcggatccgctc

SEQ ID NO: 736481 - DNA, 20 bp, mouse
gcgagcggcaaagcccggag

SEQ ID NO: 736482 - DNA, 20 bp, mouse
gcccaaggcgccgggaggta

SEQ ID NO: 736483 - DNA, 20 bp, mouse
gtgaacccagctctgtaaca

SEQ ID NO: 736484 - DNA, 20 bp, mouse
gctccctctgcgttttctgt

SEQ ID NO: 736485 - DNA, 20 bp, mouse
gttcccacagaaaacgcaga

SEQ ID NO: 736486 - DNA, 20 bp, mouse
gaagagcaatgggggtgatc

SEQ ID NO: 736487 - DNA, 20 bp, mouse
gtggtggagtagatgacccc

SEQ ID NO: 736488 - DNA, 20 bp, mouse
gttccccagcgggaggttga

SEQ ID NO: 736489 - DNA, 20 bp, mouse
ggggcgaaatggctactgct

SEQ ID NO: 736490 - DNA, 20 bp, mouse
ggtaatggtgctaatggcaa

SEQ ID NO: 736491 - DNA, 20 bp, mouse
gatgacccctggccattaga

SEQ ID NO: 736492 - DNA, 20 bp, mouse
gggtaggagaaagtctgact

SEQ ID NO: 736493 - DNA, 20 bp, mouse
gatagaaacaatagaatctg

SEQ ID NO: 736494 - DNA, 20 bp, mouse
gtagagggtaatggtgctaa

SEQ ID NO: 736495 - DNA, 20 bp, mouse
gaccttcagggacagagtac

SEQ ID NO: 736496 - DNA, 20 bp, mouse
gcgcctgcgcagcgagagtc

SEQ ID NO: 736497 - DNA, 20 bp, mouse
gtacagcggggcgacaggta

SEQ ID NO: 736498 - DNA, 20 bp, mouse
gagcggggcgacaggtatgg

SEQ ID NO: 736499 - DNA, 20 bp, mouse
gaagacggactctccgccgg

SEQ ID NO: 736500 - DNA, 20 bp, mouse
gtggcggaggcgatggatct

SEQ ID NO: 736501 - DNA, 20 bp, mouse
gggggcgacaggtatggcgg

SEQ ID NO: 736502 - DNA, 20 bp, mouse
gggcggagagtccgtcttag

SEQ ID NO: 736503 - DNA, 20 bp, mouse
gacaggtatggcggaggcga

SEQ ID NO: 736504 - DNA, 20 bp, mouse
ggcccagctcggccaagcgc

SEQ ID NO: 736505 - DNA, 20 bp, mouse
gggccggactctcgctgcgc

SEQ ID NO: 736506 - DNA, 20 bp, mouse
gggtgcctcttgttcccaag

SEQ ID NO: 736507 - DNA, 20 bp, mouse
gaaaggatgggaagcggcaa

SEQ ID NO: 736508 - DNA, 20 bp, mouse
ggcacagtgcgcaggcgtca

SEQ ID NO: 736509 - DNA, 20 bp, mouse
gtggccgtctggaggatttg

SEQ ID NO: 736510 - DNA, 20 bp, mouse
gttagccggcagccacaata

SEQ ID NO: 736511 - DNA, 20 bp, mouse
gaagaggcaccccagaacac

SEQ ID NO: 736512 - DNA, 20 bp, mouse
gatagtaattgtcactatct

SEQ ID NO: 736513 - DNA, 20 bp, mouse
gaaaaagtatggaaggccaa

SEQ ID NO: 736514 - DNA, 20 bp, mouse
gcacggccccggcgcacgat

SEQ ID NO: 736515 - DNA, 20 bp, mouse
gcaaccggcgcacagtgcgc

SEQ ID NO: 736516 - DNA, 20 bp, mouse
ggggccctggcgctcccggc

SEQ ID NO: 736517 - DNA, 20 bp, mouse
ggaccggcgacccgcgagac

SEQ ID NO: 736518 - DNA, 20 bp, mouse
gtggtgaattagcaacaaag

SEQ ID NO: 736519 - DNA, 20 bp, mouse
gtacggggttcactcgaggt

SEQ ID NO: 736520 - DNA, 20 bp, mouse
gcctgcgctgctggcgtccc

SEQ ID NO: 736521 - DNA, 20 bp, mouse
gactaccaggagaagacgat

SEQ ID NO: 736522 - DNA, 20 bp, mouse
ggccagggcccgtaggtgac

SEQ ID NO: 736523 - DNA, 20 bp, mouse
gcgggtcgccggtcacctac

SEQ ID NO: 736524 - DNA, 20 bp, mouse
gtgtccctggctctgatggt

SEQ ID NO: 736525 - DNA, 20 bp, mouse
gaggaggattggccgctgac

SEQ ID NO: 736526 - DNA, 20 bp, mouse
gcaaaaagccggcccgtttg

SEQ ID NO: 736527 - DNA, 20 bp, mouse
ggggcgtcacgtgacagact

SEQ ID NO: 736528 - DNA, 20 bp, mouse
gcccagggggagataatcga

SEQ ID NO: 736529 - DNA, 20 bp, mouse
ggcgccgcgctgtctcccca

SEQ ID NO: 736530 - DNA, 20 bp, mouse
ggaccggcgtcgcacccggt

SEQ ID NO: 736531 - DNA, 20 bp, mouse
gccatctagtacttggcctc

SEQ ID NO: 736532 - DNA, 20 bp, mouse
ggcgccagggtcggctactg

SEQ ID NO: 736533 - DNA, 20 bp, mouse
gccgctcctcgcacagcgat

SEQ ID NO: 736534 - DNA, 20 bp, mouse
gggaagtgacgtctcccaga

SEQ ID NO: 736535 - DNA, 20 bp, mouse
ggtgagtccggtgcccgggg

SEQ ID NO: 736536 - DNA, 20 bp, mouse
gtcgctgcgcgtgagaaagg

SEQ ID NO: 736537 - DNA, 20 bp, mouse
gggaagagccggctcgtcgc

SEQ ID NO: 736538 - DNA, 20 bp, mouse
gcacgtggggcgggtacaaa

SEQ ID NO: 736539 - DNA, 20 bp, mouse
gggggaggggagcgtcgcga

SEQ ID NO: 736540 - DNA, 20 bp, mouse
gccgctgggcgggtcacgtg

SEQ ID NO: 736541 - DNA, 20 bp, mouse
gggagcggaggagcgcggga

SEQ ID NO: 736542 - DNA, 20 bp, mouse
gaggggacgcccccagctgt

SEQ ID NO: 736543 - DNA, 20 bp, mouse
gggggagcgtcgcgagggaa

SEQ ID NO: 736544 - DNA, 20 bp, mouse
ggggctggaggccaacagct

SEQ ID NO: 736545 - DNA, 20 bp, mouse
gggcgggcgcttgggtgggg

SEQ ID NO: 736546 - DNA, 20 bp, mouse
ggtggggggggggaaatgat

SEQ ID NO: 736547 - DNA, 20 bp, mouse
gaggaacttgccccaatggg

SEQ ID NO: 736548 - DNA, 20 bp, mouse
gacctccggcaccaccccga

SEQ ID NO: 736549 - DNA, 20 bp, mouse
gtggaggcgagatgaccggc

SEQ ID NO: 736550 - DNA, 20 bp, mouse
ggggtgacggacagacccgt

SEQ ID NO: 736551 - DNA, 20 bp, mouse
ggggcagagtgtttagcgag

SEQ ID NO: 736552 - DNA, 20 bp, mouse
gggccccgcggtctgttgat

SEQ ID NO: 736553 - DNA, 20 bp, mouse
gaaacactctgccccccatt

SEQ ID NO: 736554 - DNA, 20 bp, mouse
gtatgtggaggcgagatgac

SEQ ID NO: 736555 - DNA, 20 bp, mouse
ggtcgagaggtgtgtctatg

SEQ ID NO: 736556 - DNA, 20 bp, mouse
ggcggaggcaggtacccccg

SEQ ID NO: 736557 - DNA, 20 bp, mouse
gagcccgcctggcccggccg

SEQ ID NO: 736558 - DNA, 20 bp, mouse
ggaggcaggtacccccgggg

SEQ ID NO: 736559 - DNA, 20 bp, mouse
ggctcaccgccctcagggga

SEQ ID NO: 736560 - DNA, 20 bp, mouse
gctgcagcgcacagagcccg

SEQ ID NO: 736561 - DNA, 20 bp, mouse
gcatccccgccctcccctga

SEQ ID NO: 736562 - DNA, 20 bp, mouse
gctgcagcccggagccgagg

SEQ ID NO: 736563 - DNA, 20 bp, mouse
ggtacccccggggcggagac

SEQ ID NO: 736564 - DNA, 20 bp, mouse
ggggctgggcggcgctgcct

SEQ ID NO: 736565 - DNA, 20 bp, mouse
gcgaaaggatggggacgcct

SEQ ID NO: 736566 - DNA, 20 bp, mouse
ggccgcctacctaactaaaa

SEQ ID NO: 736567 - DNA, 20 bp, mouse
ggcaccagtggtgaaacctt

SEQ ID NO: 736568 - DNA, 20 bp, mouse
gttaggccagtgaggatcat

SEQ ID NO: 736569 - DNA, 20 bp, mouse
gaggtaggcggcattcgtgt

SEQ ID NO: 736570 - DNA, 20 bp, mouse
ggcggcattcgtgtgggatt

SEQ ID NO: 736571 - DNA, 20 bp, mouse
gcttctgccccaaacaatca

SEQ ID NO: 736572 - DNA, 20 bp, mouse
gtcagcgccattttggaatt

SEQ ID NO: 736573 - DNA, 20 bp, mouse
gaagctcgaaactcttagtg

SEQ ID NO: 736574 - DNA, 20 bp, mouse
ggcagaagtctggcagttga

SEQ ID NO: 736575 - DNA, 20 bp, mouse
gttccggagtggtgtgaatg

SEQ ID NO: 736576 - DNA, 20 bp, mouse
ggtggatctcgaggccagta

SEQ ID NO: 736577 - DNA, 20 bp, mouse
gagtcttgcgtgttggaggt

SEQ ID NO: 736578 - DNA, 20 bp, mouse
gactgatccggaaataaaag

SEQ ID NO: 736579 - DNA, 20 bp, mouse
gaacgtgcagcagtatcctg

SEQ ID NO: 736580 - DNA, 20 bp, mouse
gcgggcatagtcttgcgtgt

SEQ ID NO: 736581 - DNA, 20 bp, mouse
gcacaaaaatagctaagtcc

SEQ ID NO: 736582 - DNA, 20 bp, mouse
gagagacgcaaatatagagt

SEQ ID NO: 736583 - DNA, 20 bp, mouse
ggggaggttgtgacgtggca

SEQ ID NO: 736584 - DNA, 20 bp, mouse
gggctgttgttgctaaaaat

SEQ ID NO: 736585 - DNA, 20 bp, mouse
ggttttgtgcgtactgcgtg

SEQ ID NO: 736586 - DNA, 20 bp, mouse
gtacttcagtacttactctg

SEQ ID NO: 736587 - DNA, 20 bp, mouse
gtggggaaggaaagtaggcg

SEQ ID NO: 736588 - DNA, 20 bp, mouse
gaggtcaggggctctcttac

SEQ ID NO: 736589 - DNA, 20 bp, mouse
gaggaaagtaggcggggcga

SEQ ID NO: 736590 - DNA, 20 bp, mouse
gtggaccattatctcttccc

SEQ ID NO: 736591 - DNA, 20 bp, mouse
gcgcaggcggaacctgcgga

SEQ ID NO: 736592 - DNA, 20 bp, mouse
gcgcgcgcaggcggaacctg

SEQ ID NO: 736593 - DNA, 20 bp, mouse
ggtgcgccgcggctaggaaa

SEQ ID NO: 736594 - DNA, 20 bp, mouse
gcgtagagcacgcacttccg

SEQ ID NO: 736595 - DNA, 20 bp, mouse
gaggcagagtgaagaagccc

SEQ ID NO: 736596 - DNA, 20 bp, mouse
ggaacccgagaccctaggtg

SEQ ID NO: 736597 - DNA, 20 bp, mouse
gacgccccacctagggtctc

SEQ ID NO: 736598 - DNA, 20 bp, mouse
gcaccggccggcatcggggc

SEQ ID NO: 736599 - DNA, 20 bp, mouse
gcgtgtgcagcgacagagag

SEQ ID NO: 736600 - DNA, 20 bp, mouse
gcccctcccgccatcctcca

SEQ ID NO: 736601 - DNA, 20 bp, mouse
gcgacagagagcggcttcta

SEQ ID NO: 736602 - DNA, 20 bp, mouse
ggtgcagcacgccccaccta

SEQ ID NO: 736603 - DNA, 20 bp, mouse
gcagagagcggcttctaagg

SEQ ID NO: 736604 - DNA, 20 bp, mouse
ggccctcaccccacaggatg

SEQ ID NO: 736605 - DNA, 20 bp, mouse
ggtgctgcaccggccggcat

SEQ ID NO: 736606 - DNA, 20 bp, mouse
gtagtagagccgttggagaa

SEQ ID NO: 736607 - DNA, 20 bp, mouse
gtgggattgcgcagactctc

SEQ ID NO: 736608 - DNA, 20 bp, mouse
gtggcaaatcccttctccaa

SEQ ID NO: 736609 - DNA, 20 bp, mouse
gctctggccaatcccgaagg

SEQ ID NO: 736610 - DNA, 20 bp, mouse
ggcaatcccagtcaatcaag

SEQ ID NO: 736611 - DNA, 20 bp, mouse
ggctaaatacagtacgaatt

SEQ ID NO: 736612 - DNA, 20 bp, mouse
gagcccgcccccttcgggat

SEQ ID NO: 736613 - DNA, 20 bp, mouse
ggggctctggccaatcccga

SEQ ID NO: 736614 - DNA, 20 bp, mouse
gtaaccagcccgcccccttc

SEQ ID NO: 736615 - DNA, 20 bp, mouse
gtggccaatcccgaaggggg

SEQ ID NO: 736616 - DNA, 20 bp, mouse
gagtctgagtcggggaaagg

SEQ ID NO: 736617 - DNA, 20 bp, mouse
ggggtagttacgtaaatcgg

SEQ ID NO: 736618 - DNA, 20 bp, mouse
gggcgggtagttacgtaaat

SEQ ID NO: 736619 - DNA, 20 bp, mouse
gttcctctagaattgaccaa

SEQ ID NO: 736620 - DNA, 20 bp, mouse
ggtcccagaagaaccaatac

SEQ ID NO: 736621 - DNA, 20 bp, mouse
gcgcgagctgcacccgatgg

SEQ ID NO: 736622 - DNA, 20 bp, mouse
gaaaaaaccaagcctgactg

SEQ ID NO: 736623 - DNA, 20 bp, mouse
gcggaagcgcttgcttccat

SEQ ID NO: 736624 - DNA, 20 bp, mouse
gggcgtccgtggcgactgat

SEQ ID NO: 736625 - DNA, 20 bp, mouse
gagaacgcagaagcctgtat

SEQ ID NO: 736626 - DNA, 20 bp, mouse
gccctcggatgcctgccgga

SEQ ID NO: 736627 - DNA, 20 bp, mouse
gtaagggacaatctacacgt

SEQ ID NO: 736628 - DNA, 20 bp, mouse
gacagtggacctgcgggtaa

SEQ ID NO: 736629 - DNA, 20 bp, mouse
ggacgcacctgtggacacga

SEQ ID NO: 736630 - DNA, 20 bp, mouse
gaaagcgtcggacgcacctg

SEQ ID NO: 736631 - DNA, 20 bp, mouse
gggcgccccctcgtgtccac

SEQ ID NO: 736632 - DNA, 20 bp, mouse
ggcgcgcggcggtgtttgaa

SEQ ID NO: 736633 - DNA, 20 bp, mouse
ggggatagctaccccgtggg

SEQ ID NO: 736634 - DNA, 20 bp, mouse
ggcctgccggagggggacca

SEQ ID NO: 736635 - DNA, 20 bp, mouse
gcccctccggcaggcatccg

SEQ ID NO: 736636 - DNA, 20 bp, mouse
ggcgggtattcgacatctgg

SEQ ID NO: 736637 - DNA, 20 bp, mouse
gtgagactggataaaattat

SEQ ID NO: 736638 - DNA, 20 bp, mouse
gccacccctgcttctgtcag

SEQ ID NO: 736639 - DNA, 20 bp, mouse
ggggctagggtcgaagtgaa

SEQ ID NO: 736640 - DNA, 20 bp, mouse
gaaggcgggtattcgacatc

SEQ ID NO: 736641 - DNA, 20 bp, mouse
ggccgaggagctcaaactgt

SEQ ID NO: 736642 - DNA, 20 bp, mouse
gtatgagaagagaatagggg

SEQ ID NO: 736643 - DNA, 20 bp, mouse
ggaatacccgccttcttccc

SEQ ID NO: 736644 - DNA, 20 bp, mouse
gcgaagtgaaaggcccagga

SEQ ID NO: 736645 - DNA, 20 bp, mouse
gaataggggtggaatggccg

SEQ ID NO: 736646 - DNA, 20 bp, mouse
gggcctggggccagacgcat

SEQ ID NO: 736647 - DNA, 20 bp, mouse
gaaaggctggaaaggtgtgg

SEQ ID NO: 736648 - DNA, 20 bp, mouse
gcagtaggcgccaaggagga

SEQ ID NO: 736649 - DNA, 20 bp, mouse
gcccgagtgcgtgagaagaa

SEQ ID NO: 736650 - DNA, 20 bp, mouse
gggaggagcgggataagaag

SEQ ID NO: 736651 - DNA, 20 bp, mouse
gcgggataagaagtggcctg

SEQ ID NO: 736652 - DNA, 20 bp, mouse
gggaggggcagtaggcgcca

SEQ ID NO: 736653 - DNA, 20 bp, mouse
gaggaaaggctggaaaggtg

SEQ ID NO: 736654 - DNA, 20 bp, mouse
gagagggcgtggttgtgggg

SEQ ID NO: 736655 - DNA, 20 bp, mouse
gtgcccggggtgtggccaga

SEQ ID NO: 736656 - DNA, 20 bp, mouse
gaccgcgcacactagatcca

SEQ ID NO: 736657 - DNA, 20 bp, mouse
gtgtccccgcctgccaccta

SEQ ID NO: 736658 - DNA, 20 bp, mouse
ggggttaagtgcggaggcgc

SEQ ID NO: 736659 - DNA, 20 bp, mouse
gcgcacactagatccacgga

SEQ ID NO: 736660 - DNA, 20 bp, mouse
gcccccaagccgtaggtggc

SEQ ID NO: 736661 - DNA, 20 bp, mouse
ggtgctgctgtcaaggctgg

SEQ ID NO: 736662 - DNA, 20 bp, mouse
gaagacccccaagccgtagg

SEQ ID NO: 736663 - DNA, 20 bp, mouse
gcccgcggggtgcagcagcg

SEQ ID NO: 736664 - DNA, 20 bp, mouse
ggaagctgggagctcgctct

SEQ ID NO: 736665 - DNA, 20 bp, mouse
ggggacccaggatgtaatgc

SEQ ID NO: 736666 - DNA, 20 bp, mouse
ggtcccagcgaggacgagga

SEQ ID NO: 736667 - DNA, 20 bp, mouse
gggcgctggcggccacccag

SEQ ID NO: 736668 - DNA, 20 bp, mouse
gtgccggtgagggacctctg

SEQ ID NO: 736669 - DNA, 20 bp, mouse
gcaggcgcacttgccggtga

SEQ ID NO: 736670 - DNA, 20 bp, mouse
ggcggccacccagaggtaac

SEQ ID NO: 736671 - DNA, 20 bp, mouse
ggacaggcggcgtcccagcg

SEQ ID NO: 736672 - DNA, 20 bp, mouse
ggaccccagaggtccctcac

SEQ ID NO: 736673 - DNA, 20 bp, mouse
ggccgagcacctgttacctc

SEQ ID NO: 736674 - DNA, 20 bp, mouse
gcgaggggggtgcaagggac

SEQ ID NO: 736675 - DNA, 20 bp, mouse
gccaagcgaggggggtgcaa

SEQ ID NO: 736676 - DNA, 20 bp, mouse
gaacctgttgaacatctctt

SEQ ID NO: 736677 - DNA, 20 bp, mouse
gcctgtcactagtctcttaa

SEQ ID NO: 736678 - DNA, 20 bp, mouse
gcggaactgaatgaccacac

SEQ ID NO: 736679 - DNA, 20 bp, mouse
gtccgagcccagagggcatc

SEQ ID NO: 736680 - DNA, 20 bp, mouse
ggatagcctccgagcccaga

SEQ ID NO: 736681 - DNA, 20 bp, mouse
ggccataagggttctggatg

SEQ ID NO: 736682 - DNA, 20 bp, mouse
ggggcatctggacacctgtg

SEQ ID NO: 736683 - DNA, 20 bp, mouse
gaggatctgctcatgtgatg

SEQ ID NO: 736684 - DNA, 20 bp, mouse
gctcatgtgatgtggcccgc

SEQ ID NO: 736685 - DNA, 20 bp, mouse
gggttgaacccaagccaacc

SEQ ID NO: 736686 - DNA, 20 bp, mouse
gcgcaggcgcgggaaggaaa

SEQ ID NO: 736687 - DNA, 20 bp, mouse
gtagcagagcggggtcgcgc

SEQ ID NO: 736688 - DNA, 20 bp, mouse
gcgcgtgcgcgtagcagagc

SEQ ID NO: 736689 - DNA, 20 bp, mouse
ggtctgggtccgggcttccc

SEQ ID NO: 736690 - DNA, 20 bp, mouse
gccggtggggcagaggaaaa

SEQ ID NO: 736691 - DNA, 20 bp, mouse
gcgggcttcccgggctgcta

SEQ ID NO: 736692 - DNA, 20 bp, mouse
gcgccggccacccatcctca

SEQ ID NO: 736693 - DNA, 20 bp, mouse
gtgacgctggcgtctgggtc

SEQ ID NO: 736694 - DNA, 20 bp, mouse
gtgccgctgaatagaacttt

SEQ ID NO: 736695 - DNA, 20 bp, mouse
gctaggccatccctgaggat

SEQ ID NO: 736696 - DNA, 20 bp, mouse
gaagccggcagggcggtttg

SEQ ID NO: 736697 - DNA, 20 bp, mouse
gtagctcgctctcctcggaa

SEQ ID NO: 736698 - DNA, 20 bp, mouse
gccgccctgccggcttccgt

SEQ ID NO: 736699 - DNA, 20 bp, mouse
gaaccctgaactaaaggtgg

SEQ ID NO: 736700 - DNA, 20 bp, mouse
gccaacctgtacgtctccta

SEQ ID NO: 736701 - DNA, 20 bp, mouse
gcacccccacctttagttca

SEQ ID NO: 736702 - DNA, 20 bp, mouse
gaggcccagcctgtaaactc

SEQ ID NO: 736703 - DNA, 20 bp, mouse
gacgccgtgccgcagagctc

SEQ ID NO: 736704 - DNA, 20 bp, mouse
gcgcacagacgcctgaaaag

SEQ ID NO: 736705 - DNA, 20 bp, mouse
gttagttcagggttgagcgt

SEQ ID NO: 736706 - DNA, 20 bp, mouse
gcaaaggcgcgggtgagact

SEQ ID NO: 736707 - DNA, 20 bp, mouse
ggcgcgggtgagactcgggg

SEQ ID NO: 736708 - DNA, 20 bp, mouse
ggcaggccacggagccccaa

SEQ ID NO: 736709 - DNA, 20 bp, mouse
gggtcgcccagcccctgcac

SEQ ID NO: 736710 - DNA, 20 bp, mouse
ggagccccaagggcacggac

SEQ ID NO: 736711 - DNA, 20 bp, mouse
gagtgtgccgactaagtagc

SEQ ID NO: 736712 - DNA, 20 bp, mouse
ggtggcctgcgtgtgttctc

SEQ ID NO: 736713 - DNA, 20 bp, mouse
gtgttctccggctacttagt

SEQ ID NO: 736714 - DNA, 20 bp, mouse
gagaaaaggcacaaaggcgc

SEQ ID NO: 736715 - DNA, 20 bp, mouse
gagaagggaacaaatatcta

SEQ ID NO: 736716 - DNA, 20 bp, mouse
gggcgcgcgaaaggcaacct

SEQ ID NO: 736717 - DNA, 20 bp, mouse
ggtagaaagtggatagtatc

SEQ ID NO: 736718 - DNA, 20 bp, mouse
gcggacgaactactcttccc

SEQ ID NO: 736719 - DNA, 20 bp, mouse
gccttcactgaggtagaaag

SEQ ID NO: 736720 - DNA, 20 bp, mouse
gcgcgcgcctcgatgcatga

SEQ ID NO: 736721 - DNA, 20 bp, mouse
ggctcacggactatatgaag

SEQ ID NO: 736722 - DNA, 20 bp, mouse
ggttactgggtccttcactg

SEQ ID NO: 736723 - DNA, 20 bp, mouse
gaggatcccgtcatgcatcg

SEQ ID NO: 736724 - DNA, 20 bp, mouse
gccaagatgcaaagcggctt

SEQ ID NO: 736725 - DNA, 20 bp, mouse
gatgcatcgaggcgcgcgaa

SEQ ID NO: 736726 - DNA, 20 bp, mouse
gtaggagcacgcgggaacgg

SEQ ID NO: 736727 - DNA, 20 bp, mouse
ggttgcctagccaatgaggg

SEQ ID NO: 736728 - DNA, 20 bp, mouse
gccccgagcctcaaaatacc

SEQ ID NO: 736729 - DNA, 20 bp, mouse
ggaggcgaactgtcactctg

SEQ ID NO: 736730 - DNA, 20 bp, mouse
gtcactctgaggagtgaggt

SEQ ID NO: 736731 - DNA, 20 bp, mouse
ggctgtgcatctcaaggcac

SEQ ID NO: 736732 - DNA, 20 bp, mouse
gtgcgcgattaccagcgcgt

SEQ ID NO: 736733 - DNA, 20 bp, mouse
gtgtccgactaggagcacgc

SEQ ID NO: 736734 - DNA, 20 bp, mouse
ggttcccgcgtgctcctagt

SEQ ID NO: 736735 - DNA, 20 bp, mouse
gtctcaaggcacaggctggc

SEQ ID NO: 736736 - DNA, 20 bp, mouse
gcggccgcggggcctcaggg

SEQ ID NO: 736737 - DNA, 20 bp, mouse
gcccgagagtgaccgagtca

SEQ ID NO: 736738 - DNA, 20 bp, mouse
ggcgtgcgggcggaaggagg

SEQ ID NO: 736739 - DNA, 20 bp, mouse
gcgccggccgcggggcctca

SEQ ID NO: 736740 - DNA, 20 bp, mouse
gcccccgcccgtccgtctcc

SEQ ID NO: 736741 - DNA, 20 bp, mouse
gcgctggggagccacgtcgg

SEQ ID NO: 736742 - DNA, 20 bp, mouse
ggcccgccacgctgcgcgtg

SEQ ID NO: 736743 - DNA, 20 bp, mouse
gccggagccgggagacggac

SEQ ID NO: 736744 - DNA, 20 bp, mouse
gaggggacgagcgggatttg

SEQ ID NO: 736745 - DNA, 20 bp, mouse
ggggccatcgcagacgtccc

SEQ ID NO: 736746 - DNA, 20 bp, mouse
gtaaggcaggggcctctaga

SEQ ID NO: 736747 - DNA, 20 bp, mouse
ggggcctctagaaggatccc

SEQ ID NO: 736748 - DNA, 20 bp, mouse
gattgtggctagtaaggcag

SEQ ID NO: 736749 - DNA, 20 bp, mouse
gcatcctcctggctctattg

SEQ ID NO: 736750 - DNA, 20 bp, mouse
ggcgagccgcggtggtgcga

SEQ ID NO: 736751 - DNA, 20 bp, mouse
gggcagggttaggaatccgg

SEQ ID NO: 736752 - DNA, 20 bp, mouse
gatccctgggatccttctag

SEQ ID NO: 736753 - DNA, 20 bp, mouse
ggaccccagcattcctttca

SEQ ID NO: 736754 - DNA, 20 bp, mouse
gccgcggtggtgcgaagggg

SEQ ID NO: 736755 - DNA, 20 bp, mouse
gtactagccacaatagagcc

SEQ ID NO: 736756 - DNA, 20 bp, mouse
ggacagggtgagctggggta

SEQ ID NO: 736757 - DNA, 20 bp, mouse
gtgcagaatgcctggggaca

SEQ ID NO: 736758 - DNA, 20 bp, mouse
gttcctccatgggcagagag

SEQ ID NO: 736759 - DNA, 20 bp, mouse
gggcagggtgcagaatgcct

SEQ ID NO: 736760 - DNA, 20 bp, mouse
gagagaatatccagctctgt

SEQ ID NO: 736761 - DNA, 20 bp, mouse
gagagatcctgtttcaccca

SEQ ID NO: 736762 - DNA, 20 bp, mouse
gcagtgtgacatgtgggtaa

SEQ ID NO: 736763 - DNA, 20 bp, mouse
gcacttgtggcaaggtcttc

SEQ ID NO: 736764 - DNA, 20 bp, mouse
gctggcctctagcactcatg

SEQ ID NO: 736765 - DNA, 20 bp, mouse
gctaaagccagtgtgacatg

SEQ ID NO: 736766 - DNA, 20 bp, mouse
gccgccgccaagctggccac

SEQ ID NO: 736767 - DNA, 20 bp, mouse
gggctggggcagagctagcg

SEQ ID NO: 736768 - DNA, 20 bp, mouse
gggactgcagagtcggctcc

SEQ ID NO: 736769 - DNA, 20 bp, mouse
ggggttagatccctgtgtcc

SEQ ID NO: 736770 - DNA, 20 bp, mouse
ggcccgcgggactgcagagt

SEQ ID NO: 736771 - DNA, 20 bp, mouse
ggaattaaaggggccggctg

SEQ ID NO: 736772 - DNA, 20 bp, mouse
gcagcgaactcgaattaaag

SEQ ID NO: 736773 - DNA, 20 bp, mouse
ggaactcgaattaaaggggc

SEQ ID NO: 736774 - DNA, 20 bp, mouse
ggggtgttttctttgcggtg

SEQ ID NO: 736775 - DNA, 20 bp, mouse
ggtcccgcgggcggcgcgta

SEQ ID NO: 736776 - DNA, 20 bp, mouse
gtggctgggtaggggttccg

SEQ ID NO: 736777 - DNA, 20 bp, mouse
gtggggagtggggtgcaagt

SEQ ID NO: 736778 - DNA, 20 bp, mouse
gaggggttccgcggagtctg

SEQ ID NO: 736779 - DNA, 20 bp, mouse
gtggtcgagacctaatctca

SEQ ID NO: 736780 - DNA, 20 bp, mouse
gaggaacaagggtggcaagc

SEQ ID NO: 736781 - DNA, 20 bp, mouse
ggcggtgggcgggaaacccg

SEQ ID NO: 736782 - DNA, 20 bp, mouse
gttccgcggagtctggggag

SEQ ID NO: 736783 - DNA, 20 bp, mouse
gggcgatccagtgacaaaga

SEQ ID NO: 736784 - DNA, 20 bp, mouse
gcctcctcccaagacattca

SEQ ID NO: 736785 - DNA, 20 bp, mouse
gccaggaggcctcccttcga

SEQ ID NO: 736786 - DNA, 20 bp, mouse
gacgctgcgaccccacccgt

SEQ ID NO: 736787 - DNA, 20 bp, mouse
gcccgcccagccatgcgggg

SEQ ID NO: 736788 - DNA, 20 bp, mouse
gtgtgcccgcccagccatgc

SEQ ID NO: 736789 - DNA, 20 bp, mouse
gggggctgggccgacgggtg

SEQ ID NO: 736790 - DNA, 20 bp, mouse
gggtgcctccccgcatggct

SEQ ID NO: 736791 - DNA, 20 bp, mouse
gtgtactcacggggagggga

SEQ ID NO: 736792 - DNA, 20 bp, mouse
gagcttctggaaactatccc

SEQ ID NO: 736793 - DNA, 20 bp, mouse
ggcctttggggctgtcacta

SEQ ID NO: 736794 - DNA, 20 bp, mouse
gcccctagtgacagccccaa

SEQ ID NO: 736795 - DNA, 20 bp, mouse
gtctggggagataaaagatc

SEQ ID NO: 736796 - DNA, 20 bp, mouse
gtggaaaaaagggtagacct

SEQ ID NO: 736797 - DNA, 20 bp, mouse
ggacgactagaggatgattg

SEQ ID NO: 736798 - DNA, 20 bp, mouse
gaccttgttggagttgtctg

SEQ ID NO: 736799 - DNA, 20 bp, mouse
ggccccagacaactccaaca

SEQ ID NO: 736800 - DNA, 20 bp, mouse
gtgcctcagtagaataggca

SEQ ID NO: 736801 - DNA, 20 bp, mouse
gggacctgcctcagtagaat

SEQ ID NO: 736802 - DNA, 20 bp, mouse
gctagcccagacttgagctt

SEQ ID NO: 736803 - DNA, 20 bp, mouse
gcaaggaaggtgacgactag

SEQ ID NO: 736804 - DNA, 20 bp, mouse
gcagtagaataggcagggag

SEQ ID NO: 736805 - DNA, 20 bp, mouse
gcaacaaggtgataaaattc

SEQ ID NO: 736806 - DNA, 20 bp, mouse
gaaggcccagggcgattccg

SEQ ID NO: 736807 - DNA, 20 bp, mouse
gagagcgcgggaaagattac

SEQ ID NO: 736808 - DNA, 20 bp, mouse
gaggcatgccaggagagcgc

SEQ ID NO: 736809 - DNA, 20 bp, mouse
ggcgggaaagattactgggg

SEQ ID NO: 736810 - DNA, 20 bp, mouse
ggcagcccctgactgggtaa

SEQ ID NO: 736811 - DNA, 20 bp, mouse
gacaccccttacccagtcag

SEQ ID NO: 736812 - DNA, 20 bp, mouse
gctgcggcttggttggggtg

SEQ ID NO: 736813 - DNA, 20 bp, mouse
gtcggcgcccgggaaggccc

SEQ ID NO: 736814 - DNA, 20 bp, mouse
gaatcgccctgggccttccc

SEQ ID NO: 736815 - DNA, 20 bp, mouse
gaaggcttgaagcggtgggg

SEQ ID NO: 736816 - DNA, 20 bp, mouse
gggccgctgcggagctcctt

SEQ ID NO: 736817 - DNA, 20 bp, mouse
gcaaactccgggactctcag

SEQ ID NO: 736818 - DNA, 20 bp, mouse
gcccagcagagagcaagatg

SEQ ID NO: 736819 - DNA, 20 bp, mouse
gagagcaagatgtggacaac

SEQ ID NO: 736820 - DNA, 20 bp, mouse
ggatgtggacaactggttaa

SEQ ID NO: 736821 - DNA, 20 bp, mouse
gttgggtatgtatgtcagac

SEQ ID NO: 736822 - DNA, 20 bp, mouse
gccagcaacaaatccagatg

SEQ ID NO: 736823 - DNA, 20 bp, mouse
gctggtgcttgaggagttct

SEQ ID NO: 736824 - DNA, 20 bp, mouse
gaagccaagaatggcgccaa

SEQ ID NO: 736825 - DNA, 20 bp, mouse
gacaaaggaataaacacgtg

SEQ ID NO: 736826 - DNA, 20 bp, mouse
ggcaggaggctcaactggag

SEQ ID NO: 736827 - DNA, 20 bp, mouse
gttgctgtgagctgcttctt

SEQ ID NO: 736828 - DNA, 20 bp, mouse
gtgcccgaggatgagtgggg

SEQ ID NO: 736829 - DNA, 20 bp, mouse
gcacagcaagcaggaccccg

SEQ ID NO: 736830 - DNA, 20 bp, mouse
gcaggagcgaggtagttggc

SEQ ID NO: 736831 - DNA, 20 bp, mouse
ggatggagaccacgggtccg

SEQ ID NO: 736832 - DNA, 20 bp, mouse
ggagacccagcttttgcccg

SEQ ID NO: 736833 - DNA, 20 bp, mouse
gctagcaccctctggatcac

SEQ ID NO: 736834 - DNA, 20 bp, mouse
gtaggagaatgcggaggtgg

SEQ ID NO: 736835 - DNA, 20 bp, mouse
gaggtagttggcaggcatag

SEQ ID NO: 736836 - DNA, 20 bp, mouse
gcgcccgccaatccacgcat

SEQ ID NO: 736837 - DNA, 20 bp, mouse
gaggcccgggctccacgcgt

SEQ ID NO: 736838 - DNA, 20 bp, mouse
gctcccgccgatgcgtggat

SEQ ID NO: 736839 - DNA, 20 bp, mouse
gagtcagaatccttggactc

SEQ ID NO: 736840 - DNA, 20 bp, mouse
ggggtccagtgctgaccgag

SEQ ID NO: 736841 - DNA, 20 bp, mouse
ggggagctgcatgatttgca

SEQ ID NO: 736842 - DNA, 20 bp, mouse
gccgccgatgcgtggattgg

SEQ ID NO: 736843 - DNA, 20 bp, mouse
ggtgaagcatagccaataat

SEQ ID NO: 736844 - DNA, 20 bp, mouse
gttgacgcaaaagtgacgtg

SEQ ID NO: 736845 - DNA, 20 bp, mouse
ggggctccacgcgtgggtgg

SEQ ID NO: 736846 - DNA, 20 bp, mouse
gagtcacagtaggatagaag

SEQ ID NO: 736847 - DNA, 20 bp, mouse
gtgcctaggggacaggagtt

SEQ ID NO: 736848 - DNA, 20 bp, mouse
gggacggtgtagttgcctag

SEQ ID NO: 736849 - DNA, 20 bp, mouse
ggcccctctgggtacgtgga

SEQ ID NO: 736850 - DNA, 20 bp, mouse
gagtgtccatccctccttct

SEQ ID NO: 736851 - DNA, 20 bp, mouse
gcacaccagggcgtggtctc

SEQ ID NO: 736852 - DNA, 20 bp, mouse
gtggaactctttttcaaggt

SEQ ID NO: 736853 - DNA, 20 bp, mouse
gacaccgtccacgtacccag

SEQ ID NO: 736854 - DNA, 20 bp, mouse
ggctgtggggaaggactgat

SEQ ID NO: 736855 - DNA, 20 bp, mouse
gccccaaactcctgtcccct

SEQ ID NO: 736856 - DNA, 20 bp, mouse
gccactgaccggaatgaaag

SEQ ID NO: 736857 - DNA, 20 bp, mouse
ggcccagaacatcccgtttt

SEQ ID NO: 736858 - DNA, 20 bp, mouse
gagaaccccgttcctaaaac

SEQ ID NO: 736859 - DNA, 20 bp, mouse
gcagtggtgtgcactcgaga

SEQ ID NO: 736860 - DNA, 20 bp, mouse
gtcacagctaaaggtaagac

SEQ ID NO: 736861 - DNA, 20 bp, mouse
gagcagcgtgttctactcag

SEQ ID NO: 736862 - DNA, 20 bp, mouse
gtcctaaaacgggatgttct

SEQ ID NO: 736863 - DNA, 20 bp, mouse
gtcgagtgcacaccactgac

SEQ ID NO: 736864 - DNA, 20 bp, mouse
gtaagttctggagcttctgc

SEQ ID NO: 736865 - DNA, 20 bp, mouse
gtctccaaatctagttttct

SEQ ID NO: 736866 - DNA, 20 bp, mouse
gagggagcccggcgacccag

SEQ ID NO: 736867 - DNA, 20 bp, mouse
gcatgcgctgcacgtaggac

SEQ ID NO: 736868 - DNA, 20 bp, mouse
gcaggccgcggggcccaccc

SEQ ID NO: 736869 - DNA, 20 bp, mouse
gggccccgcggcctgagcca

SEQ ID NO: 736870 - DNA, 20 bp, mouse
gccggccctggctcaggccg

SEQ ID NO: 736871 - DNA, 20 bp, mouse
ggaagtgcgggacagaatcg

SEQ ID NO: 736872 - DNA, 20 bp, mouse
ggctgcacgtaggacgggcg

SEQ ID NO: 736873 - DNA, 20 bp, mouse
ggcagtcaagcagcccgggt

SEQ ID NO: 736874 - DNA, 20 bp, mouse
ggcatgcatgcgctgcacgt

SEQ ID NO: 736875 - DNA, 20 bp, mouse
gaggtggcgccgtcccgcct

SEQ ID NO: 736876 - DNA, 20 bp, mouse
gcacaaaatgggttaagaag

SEQ ID NO: 736877 - DNA, 20 bp, mouse
gcaaagcaagatacacaaaa

SEQ ID NO: 736878 - DNA, 20 bp, mouse
gcttcacagctactgcctga

SEQ ID NO: 736879 - DNA, 20 bp, mouse
gttcatgcttacggggagaa

SEQ ID NO: 736880 - DNA, 20 bp, mouse
gggagcaaaaatgtcagaca

SEQ ID NO: 736881 - DNA, 20 bp, mouse
gttgaggcacatttacatcc

SEQ ID NO: 736882 - DNA, 20 bp, mouse
gaattttgcaacaggaagtc

SEQ ID NO: 736883 - DNA, 20 bp, mouse
gagctcttaggtttgtttaa

SEQ ID NO: 736884 - DNA, 20 bp, mouse
ggaggttacaattttgcaac

SEQ ID NO: 736885 - DNA, 20 bp, mouse
gtccaaaacctgcctgctat

SEQ ID NO: 736886 - DNA, 20 bp, mouse
gcccccagcgccagggttga

SEQ ID NO: 736887 - DNA, 20 bp, mouse
gcgggtccccaccgagcaag

SEQ ID NO: 736888 - DNA, 20 bp, mouse
gcacaccgaggtgagaaggg

SEQ ID NO: 736889 - DNA, 20 bp, mouse
gaacaagtggagctccccta

SEQ ID NO: 736890 - DNA, 20 bp, mouse
gggagcctccgcccaacaag

SEQ ID NO: 736891 - DNA, 20 bp, mouse
gaagtggagctcccctaggg

SEQ ID NO: 736892 - DNA, 20 bp, mouse
ggggagctccacttgttggg

SEQ ID NO: 736893 - DNA, 20 bp, mouse
ggggaggcggggttcggtgc

SEQ ID NO: 736894 - DNA, 20 bp, mouse
gagctccacttgttgggcgg

SEQ ID NO: 736895 - DNA, 20 bp, mouse
gagcaagaggcaacgaaggg

SEQ ID NO: 736896 - DNA, 20 bp, mouse
ggggagaagctggaaacagg

SEQ ID NO: 736897 - DNA, 20 bp, mouse
gctgagggaggcacaccccc

SEQ ID NO: 736898 - DNA, 20 bp, mouse
gcccgcgcgatggtgactct

SEQ ID NO: 736899 - DNA, 20 bp, mouse
ggggagagctgtcttaaggt

SEQ ID NO: 736900 - DNA, 20 bp, mouse
gaggtatccggggactagga

SEQ ID NO: 736901 - DNA, 20 bp, mouse
gtgggtgcggagggtggcta

SEQ ID NO: 736902 - DNA, 20 bp, mouse
gtcgctaccgcctttcacca

SEQ ID NO: 736903 - DNA, 20 bp, mouse
ggtgaaaaggaaattggatg

SEQ ID NO: 736904 - DNA, 20 bp, mouse
gctagtccccggatacctta

SEQ ID NO: 736905 - DNA, 20 bp, mouse
gggggggttgctttcgagga

SEQ ID NO: 736906 - DNA, 20 bp, mouse
ggggagggcacgagctgatt

SEQ ID NO: 736907 - DNA, 20 bp, mouse
ggtagagaggcagacgtgat

SEQ ID NO: 736908 - DNA, 20 bp, mouse
gggagagggcggggcgtcaa

SEQ ID NO: 736909 - DNA, 20 bp, mouse
ggggcggggcccgggtagag

SEQ ID NO: 736910 - DNA, 20 bp, mouse
ggacaggaggaggcgatgaa

SEQ ID NO: 736911 - DNA, 20 bp, mouse
gtccgacccagcctagctag

SEQ ID NO: 736912 - DNA, 20 bp, mouse
ggaggaggcgatgaatggat

SEQ ID NO: 736913 - DNA, 20 bp, mouse
ggccccgccctctcctaggt

SEQ ID NO: 736914 - DNA, 20 bp, mouse
ggagacctcagagccaggta

SEQ ID NO: 736915 - DNA, 20 bp, mouse
gtggatgggagggtgtgatt

SEQ ID NO: 736916 - DNA, 20 bp, mouse
gagccaggtaccgtgaagga

SEQ ID NO: 736917 - DNA, 20 bp, mouse
ggagacctcagagccaggta

SEQ ID NO: 736918 - DNA, 20 bp, mouse
gtaggggtgaggaacgggtt

SEQ ID NO: 736919 - DNA, 20 bp, mouse
gaggggggagggtctcaact

SEQ ID NO: 736920 - DNA, 20 bp, mouse
gtcacaggagacagtcgaag

SEQ ID NO: 736921 - DNA, 20 bp, mouse
ggataggcctttttttttcg

SEQ ID NO: 736922 - DNA, 20 bp, mouse
gcaggtaccgtgaaggaagg

SEQ ID NO: 736923 - DNA, 20 bp, mouse
gatgctacaaagtgagatag

SEQ ID NO: 736924 - DNA, 20 bp, mouse
gtgggccgcgacaatgaggg

SEQ ID NO: 736925 - DNA, 20 bp, mouse
gaggcctatcaattctggtg

SEQ ID NO: 736926 - DNA, 20 bp, mouse
gcctgctccgcgccccgggg

SEQ ID NO: 736927 - DNA, 20 bp, mouse
gaggcagcgtcagaacgggg

SEQ ID NO: 736928 - DNA, 20 bp, mouse
ggtggtagcggccccttctg

SEQ ID NO: 736929 - DNA, 20 bp, mouse
gcagcgtcagaacggggagg

SEQ ID NO: 736930 - DNA, 20 bp, mouse
gctgtggtgcacaggtggtt

SEQ ID NO: 736931 - DNA, 20 bp, mouse
gaacgcggcgagcccgaagg

SEQ ID NO: 736932 - DNA, 20 bp, mouse
ggcagagccactccgcagaa

SEQ ID NO: 736933 - DNA, 20 bp, mouse
gcgcccccccgaccccagaa

SEQ ID NO: 736934 - DNA, 20 bp, mouse
gcaaggaggcagcgtcagaa

SEQ ID NO: 736935 - DNA, 20 bp, mouse
ggtcgaggactcaaaccaaa

SEQ ID NO: 736936 - DNA, 20 bp, mouse
gtcaagctgtcctaggggag

SEQ ID NO: 736937 - DNA, 20 bp, mouse
gaggaggcggagtttcccca

SEQ ID NO: 736938 - DNA, 20 bp, mouse
gaggaactgggcagaaaaaa

SEQ ID NO: 736939 - DNA, 20 bp, mouse
gtccctctcaagctgtccta

SEQ ID NO: 736940 - DNA, 20 bp, mouse
gagggcccctaggggcagtg

SEQ ID NO: 736941 - DNA, 20 bp, mouse
gcccaaccagctctgtaagg

SEQ ID NO: 736942 - DNA, 20 bp, mouse
gcagcttgagagggaccctg

SEQ ID NO: 736943 - DNA, 20 bp, mouse
ggggcctcagtcgtgtcatc

SEQ ID NO: 736944 - DNA, 20 bp, mouse
gaactgggcagaaaaaaggg

SEQ ID NO: 736945 - DNA, 20 bp, mouse
gtgtcgggagatgaagcgag

SEQ ID NO: 736946 - DNA, 20 bp, mouse
gcggccggcgtccccggggt

SEQ ID NO: 736947 - DNA, 20 bp, mouse
gtggcaggagcgagtggcct

SEQ ID NO: 736948 - DNA, 20 bp, mouse
ggtaagttggcaggagcgag

SEQ ID NO: 736949 - DNA, 20 bp, mouse
gtgggaaggtgacaaggagg

SEQ ID NO: 736950 - DNA, 20 bp, mouse
gactgcgcggccggcgtccc

SEQ ID NO: 736951 - DNA, 20 bp, mouse
gcttcccaaaagccaggcgc

SEQ ID NO: 736952 - DNA, 20 bp, mouse
gtcccgagcagccagatccc

SEQ ID NO: 736953 - DNA, 20 bp, mouse
gcgccggccgcgcagtaagt

SEQ ID NO: 736954 - DNA, 20 bp, mouse
gcaagttcaaaaaggtgcgg

SEQ ID NO: 736955 - DNA, 20 bp, mouse
gggcgggcggtggcggcgtg

SEQ ID NO: 736956 - DNA, 20 bp, mouse
ggacttaggaagaggtggta

SEQ ID NO: 736957 - DNA, 20 bp, mouse
gtggctggggacttaggaag

SEQ ID NO: 736958 - DNA, 20 bp, mouse
gctaccgcgtggacagtgaa

SEQ ID NO: 736959 - DNA, 20 bp, mouse
gcgctggcgtgtatgcgcgt

SEQ ID NO: 736960 - DNA, 20 bp, mouse
gggtcgccgcgcaagcttac

SEQ ID NO: 736961 - DNA, 20 bp, mouse
gcgtgtgtggctggggactt

SEQ ID NO: 736962 - DNA, 20 bp, mouse
gcggcgtgatcgtgagttcg

SEQ ID NO: 736963 - DNA, 20 bp, mouse
gtggggtgtgtacacttaac

SEQ ID NO: 736964 - DNA, 20 bp, mouse
gggcaaggtgagcttggctt

SEQ ID NO: 736965 - DNA, 20 bp, mouse
gggtgggcatggggcgagcg

SEQ ID NO: 736966 - DNA, 20 bp, mouse
ggggctgagtgcagcgtgca

SEQ ID NO: 736967 - DNA, 20 bp, mouse
gactccagcaggtgggctta

SEQ ID NO: 736968 - DNA, 20 bp, mouse
gtcaacaggggcagctccgg

SEQ ID NO: 736969 - DNA, 20 bp, mouse
gagggctggcaggcagtctg

SEQ ID NO: 736970 - DNA, 20 bp, mouse
gaaagtgtttccggcccttg

SEQ ID NO: 736971 - DNA, 20 bp, mouse
gaacttcagaggtggcgcca

SEQ ID NO: 736972 - DNA, 20 bp, mouse
ggaagccccagggctctgtg

SEQ ID NO: 736973 - DNA, 20 bp, mouse
gaacacgtgcacctcagaga

SEQ ID NO: 736974 - DNA, 20 bp, mouse
gcacgctgcactcagcccca

SEQ ID NO: 736975 - DNA, 20 bp, mouse
ggcaccgtccatccaggacc

SEQ ID NO: 736976 - DNA, 20 bp, mouse
gaaaggggacagctggtagg

SEQ ID NO: 736977 - DNA, 20 bp, mouse
gaagcctggaccctgggctg

SEQ ID NO: 736978 - DNA, 20 bp, mouse
gtgagcctggaaagaggcgg

SEQ ID NO: 736979 - DNA, 20 bp, mouse
gaggggtaggatgtgaacaa

SEQ ID NO: 736980 - DNA, 20 bp, mouse
gttaggggaaaggggacagc

SEQ ID NO: 736981 - DNA, 20 bp, mouse
gggggacagctggtaggggg

SEQ ID NO: 736982 - DNA, 20 bp, mouse
gttggcaaggctgcatactg

SEQ ID NO: 736983 - DNA, 20 bp, mouse
gggggccaagcctggaccct

SEQ ID NO: 736984 - DNA, 20 bp, mouse
gacagtctgagcctggaaag

SEQ ID NO: 736985 - DNA, 20 bp, mouse
gcttccgcagcccagggtcc

SEQ ID NO: 736986 - DNA, 20 bp, mouse
gtgtccacccgcatctcccc

SEQ ID NO: 736987 - DNA, 20 bp, mouse
gccagatggggcgtcagtga

SEQ ID NO: 736988 - DNA, 20 bp, mouse
ggagttgcctgtgtgacgtc

SEQ ID NO: 736989 - DNA, 20 bp, mouse
gtcagtgatggacaaaagta

SEQ ID NO: 736990 - DNA, 20 bp, mouse
gtcaccaagatggacgtggg

SEQ ID NO: 736991 - DNA, 20 bp, mouse
gccgccctgtcaaggcatca

SEQ ID NO: 736992 - DNA, 20 bp, mouse
ggacacctgcttaccccaga

SEQ ID NO: 736993 - DNA, 20 bp, mouse
gtttcctggggagatgcggg

SEQ ID NO: 736994 - DNA, 20 bp, mouse
gaggaggtgctgactatata

SEQ ID NO: 736995 - DNA, 20 bp, mouse
gccacagcccgacgtcacac

SEQ ID NO: 736996 - DNA, 20 bp, mouse
gcagctccttagccttaacc

SEQ ID NO: 736997 - DNA, 20 bp, mouse
gttaaggctaaggagctggg

SEQ ID NO: 736998 - DNA, 20 bp, mouse
gccgcaaccgcacccggtta

SEQ ID NO: 736999 - DNA, 20 bp, mouse
gagcactccagcttcagcgt

SEQ ID NO: 737000 - DNA, 20 bp, mouse
gagacgagaaaaattctgtc

SEQ ID NO: 737001 - DNA, 20 bp, mouse
ggccagaggagggacaccct

SEQ ID NO: 737002 - DNA, 20 bp, mouse
gtgaagagcgagtgcaggaa

SEQ ID NO: 737003 - DNA, 20 bp, mouse
gccttagccttaaccgggtg

SEQ ID NO: 737004 - DNA, 20 bp, mouse
gaagctggagtgctaaggca

SEQ ID NO: 737005 - DNA, 20 bp, mouse
ggctaggttttggtggagtc

SEQ ID NO: 737006 - DNA, 20 bp, mouse
gacagaggattcgcctggag

SEQ ID NO: 737007 - DNA, 20 bp, mouse
ggtggcaacgtgaactacag

SEQ ID NO: 737008 - DNA, 20 bp, mouse
gtgagcttccaccatgtcat

SEQ ID NO: 737009 - DNA, 20 bp, mouse
gctctggtcagttcccctcc

SEQ ID NO: 737010 - DNA, 20 bp, mouse
gcacccagaccattttccaa

SEQ ID NO: 737011 - DNA, 20 bp, mouse
gtccagcttcaccaatgaca

SEQ ID NO: 737012 - DNA, 20 bp, mouse
ggagccattggaaaatggtc

SEQ ID NO: 737013 - DNA, 20 bp, mouse
gagcctgcaaagcccagctg

SEQ ID NO: 737014 - DNA, 20 bp, mouse
ggaactacagaggattcgcc

SEQ ID NO: 737015 - DNA, 20 bp, mouse
gaatggttcatgttcccagt

SEQ ID NO: 737016 - DNA, 20 bp, mouse
gcaacccagctcagagcaag

SEQ ID NO: 737017 - DNA, 20 bp, mouse
ggggttggtcggtccgggac

SEQ ID NO: 737018 - DNA, 20 bp, mouse
gttacaacagaggttgactg

SEQ ID NO: 737019 - DNA, 20 bp, mouse
gtgctctgagctgggttggt

SEQ ID NO: 737020 - DNA, 20 bp, mouse
gcaaaatcaaagtgtgaaaa

SEQ ID NO: 737021 - DNA, 20 bp, mouse
gaaactcagtcagtgagagt

SEQ ID NO: 737022 - DNA, 20 bp, mouse
gtgagctgggttggtcggtc

SEQ ID NO: 737023 - DNA, 20 bp, mouse
gcatcgtcacgtgttccggg

SEQ ID NO: 737024 - DNA, 20 bp, mouse
gaaagcctcttgctctgagc

SEQ ID NO: 737025 - DNA, 20 bp, mouse
gtttccttgtggaaagtgat

SEQ ID NO: 737026 - DNA, 20 bp, mouse
gcgccacccgctgagtctga

SEQ ID NO: 737027 - DNA, 20 bp, mouse
ggctgtgcaggtctgcccaa

SEQ ID NO: 737028 - DNA, 20 bp, mouse
gtctgagccctcagactcag

SEQ ID NO: 737029 - DNA, 20 bp, mouse
gactcagcgggtggcgccgg

SEQ ID NO: 737030 - DNA, 20 bp, mouse
gcaagggttaactcattcct

SEQ ID NO: 737031 - DNA, 20 bp, mouse
gagtgtgcccaaggagtgcg

SEQ ID NO: 737032 - DNA, 20 bp, mouse
gtagctgggcaggagggatt

SEQ ID NO: 737033 - DNA, 20 bp, mouse
gagccctcagactcagcggg

SEQ ID NO: 737034 - DNA, 20 bp, mouse
ggcgaaatctcaccagaaga

SEQ ID NO: 737035 - DNA, 20 bp, mouse
gctgcccagctaggtgagag

SEQ ID NO: 737036 - DNA, 20 bp, mouse
gagggtgcgtggcatcgcag

SEQ ID NO: 737037 - DNA, 20 bp, mouse
gtggactctgggtcgggtca

SEQ ID NO: 737038 - DNA, 20 bp, mouse
gaggacctggactctgggtc

SEQ ID NO: 737039 - DNA, 20 bp, mouse
gggaggagatggttatgggc

SEQ ID NO: 737040 - DNA, 20 bp, mouse
ggcagtggcgggtcccgcgg

SEQ ID NO: 737041 - DNA, 20 bp, mouse
gtatgggaggagatggttat

SEQ ID NO: 737042 - DNA, 20 bp, mouse
gagcagcgctgggacttaaa

SEQ ID NO: 737043 - DNA, 20 bp, mouse
gccgctaggacctggactct

SEQ ID NO: 737044 - DNA, 20 bp, mouse
gcgggaggatggagccaccg

SEQ ID NO: 737045 - DNA, 20 bp, mouse
gagggaggggactgcgcgcg

SEQ ID NO: 737046 - DNA, 20 bp, mouse
ggataagcgaggtaactcag

SEQ ID NO: 737047 - DNA, 20 bp, mouse
gcagctgcacacgttctcat

SEQ ID NO: 737048 - DNA, 20 bp, mouse
ggacagaggtagaacgaact

SEQ ID NO: 737049 - DNA, 20 bp, mouse
ggggtctaaaagggtggcta

SEQ ID NO: 737050 - DNA, 20 bp, mouse
gggaaggaacttggtgactt

SEQ ID NO: 737051 - DNA, 20 bp, mouse
gacaaagtgagggtctaaaa

SEQ ID NO: 737052 - DNA, 20 bp, mouse
gtgtcaacacaatctgtcgg

SEQ ID NO: 737053 - DNA, 20 bp, mouse
gctcccaagacgaacagtat

SEQ ID NO: 737054 - DNA, 20 bp, mouse
gaagcggtccaggaaccacc

SEQ ID NO: 737055 - DNA, 20 bp, mouse
ggccctatactgttcgtctt

SEQ ID NO: 737056 - DNA, 20 bp, mouse
ggggagcccgaggtccgggg

SEQ ID NO: 737057 - DNA, 20 bp, mouse
ggcgccccgccccggacctc

SEQ ID NO: 737058 - DNA, 20 bp, mouse
gaggcggggagcccgaggtc

SEQ ID NO: 737059 - DNA, 20 bp, mouse
gggcgcacggcgtcacgagg

SEQ ID NO: 737060 - DNA, 20 bp, mouse
gcccgcccgcagtggccggg

SEQ ID NO: 737061 - DNA, 20 bp, mouse
ggtggccgggaggggtgcgc

SEQ ID NO: 737062 - DNA, 20 bp, mouse
gcgctccggctgggattccc

SEQ ID NO: 737063 - DNA, 20 bp, mouse
gacgccctgcgcacccctcc

SEQ ID NO: 737064 - DNA, 20 bp, mouse
gggcgccggggaatcccagc

SEQ ID NO: 737065 - DNA, 20 bp, mouse
gaatcccagccggagcgagc

SEQ ID NO: 737066 - DNA, 20 bp, mouse
gaggaggagccgagctcagg

SEQ ID NO: 737067 - DNA, 20 bp, mouse
gtctgtccttctcctctctg

SEQ ID NO: 737068 - DNA, 20 bp, mouse
gagagcctagggtaggtatt

SEQ ID NO: 737069 - DNA, 20 bp, mouse
gatctcaggcaggaccatgc

SEQ ID NO: 737070 - DNA, 20 bp, mouse
gccatgctggctgtccccgt

SEQ ID NO: 737071 - DNA, 20 bp, mouse
gtaccctaggctctgagact

SEQ ID NO: 737072 - DNA, 20 bp, mouse
gattggggagatggcataag

SEQ ID NO: 737073 - DNA, 20 bp, mouse
gatcagccaggcagcaggcg

SEQ ID NO: 737074 - DNA, 20 bp, mouse
gagccgagctcaggaggagc

SEQ ID NO: 737075 - DNA, 20 bp, mouse
gggcataaggggctgagatt

SEQ ID NO: 737076 - DNA, 20 bp, mouse
gggtgaggctggaaccggag

SEQ ID NO: 737077 - DNA, 20 bp, mouse
gaaccaagagccacggggtg

SEQ ID NO: 737078 - DNA, 20 bp, mouse
gacttcccgctgcacccaga

SEQ ID NO: 737079 - DNA, 20 bp, mouse
gcacccagagggtgccgctc

SEQ ID NO: 737080 - DNA, 20 bp, mouse
ggagggagccagccggtcca

SEQ ID NO: 737081 - DNA, 20 bp, mouse
ggaaccggagcggcaccctc

SEQ ID NO: 737082 - DNA, 20 bp, mouse
ggggatgcgcgcacggtagg

SEQ ID NO: 737083 - DNA, 20 bp, mouse
gaccgtgcgcgcatccctcg

SEQ ID NO: 737084 - DNA, 20 bp, mouse
ggcacaccccaggcacactc

SEQ ID NO: 737085 - DNA, 20 bp, mouse
gcagccgtaaccaagagcca

SEQ ID NO: 737086 - DNA, 20 bp, mouse
ggggcgcggtagcggagcga

SEQ ID NO: 737087 - DNA, 20 bp, mouse
gagtcccgggggcgcggtag

SEQ ID NO: 737088 - DNA, 20 bp, mouse
ggactcgcgctccgccgaga

SEQ ID NO: 737089 - DNA, 20 bp, mouse
ggagcgaggggttgggactc

SEQ ID NO: 737090 - DNA, 20 bp, mouse
ggggaagggacctttaagta

SEQ ID NO: 737091 - DNA, 20 bp, mouse
gtcggcggagcgcgagtccc

SEQ ID NO: 737092 - DNA, 20 bp, mouse
gcagggaagcaggagataaa

SEQ ID NO: 737093 - DNA, 20 bp, mouse
ggagcgcccgcccttcttat

SEQ ID NO: 737094 - DNA, 20 bp, mouse
gactccgggagcgctcggcg

SEQ ID NO: 737095 - DNA, 20 bp, mouse
gtgaggacaggtgcgatggt

SEQ ID NO: 737096 - DNA, 20 bp, mouse
gtggccaggcacggggcaga

SEQ ID NO: 737097 - DNA, 20 bp, mouse
gaacctagagcgggctgcaa

SEQ ID NO: 737098 - DNA, 20 bp, mouse
gaggcagagtggtggagtcg

SEQ ID NO: 737099 - DNA, 20 bp, mouse
ggacaggccaggctgccggg

SEQ ID NO: 737100 - DNA, 20 bp, mouse
ggccaggctgccgggtggag

SEQ ID NO: 737101 - DNA, 20 bp, mouse
gggcccgctggccaggcacg

SEQ ID NO: 737102 - DNA, 20 bp, mouse
gtggctcggcactggactgg

SEQ ID NO: 737103 - DNA, 20 bp, mouse
gaggcagtccacagacggac

SEQ ID NO: 737104 - DNA, 20 bp, mouse
ggggtgtctctgcctgactg

SEQ ID NO: 737105 - DNA, 20 bp, mouse
gtgactggcaggggcacctc

SEQ ID NO: 737106 - DNA, 20 bp, mouse
gagagaagcccgaggctgtc

SEQ ID NO: 737107 - DNA, 20 bp, mouse
gcggcccgggttctcgcctt

SEQ ID NO: 737108 - DNA, 20 bp, mouse
gagcgctgccagactcccta

SEQ ID NO: 737109 - DNA, 20 bp, mouse
gctgcagagggatcagagga

SEQ ID NO: 737110 - DNA, 20 bp, mouse
ggcgagaacccgggccgggt

SEQ ID NO: 737111 - DNA, 20 bp, mouse
ggggaacgtccagtagttga

SEQ ID NO: 737112 - DNA, 20 bp, mouse
gctccctaaggcgagaaccc

SEQ ID NO: 737113 - DNA, 20 bp, mouse
gggagtctggcagcgctagg

SEQ ID NO: 737114 - DNA, 20 bp, mouse
gggaactggcgactaggtgg

SEQ ID NO: 737115 - DNA, 20 bp, mouse
gagggatcagaggaaggctt

SEQ ID NO: 737116 - DNA, 20 bp, mouse
gcggcccacgcgtgtctctt

SEQ ID NO: 737117 - DNA, 20 bp, mouse
gccgcgcggggaaacccgtg

SEQ ID NO: 737118 - DNA, 20 bp, mouse
gcacctcaagcctggatggt

SEQ ID NO: 737119 - DNA, 20 bp, mouse
ggggaggagggccacagagg

SEQ ID NO: 737120 - DNA, 20 bp, mouse
gctccccaagagacacgcgt

SEQ ID NO: 737121 - DNA, 20 bp, mouse
gccaccacgtggctccgcac

SEQ ID NO: 737122 - DNA, 20 bp, mouse
gccacgctgcgactggtgtc

SEQ ID NO: 737123 - DNA, 20 bp, mouse
gagccagggaaccacgcgta

SEQ ID NO: 737124 - DNA, 20 bp, mouse
gggagctactggagcagcca

SEQ ID NO: 737125 - DNA, 20 bp, mouse
gggagacacgcccaccatcc

SEQ ID NO: 737126 - DNA, 20 bp, mouse
gccctggggtagctctccag

SEQ ID NO: 737127 - DNA, 20 bp, mouse
gggtgtagaaagctcccgtg

SEQ ID NO: 737128 - DNA, 20 bp, mouse
ggcgcctgaagcctccacac

SEQ ID NO: 737129 - DNA, 20 bp, mouse
gtggggcgcagggccattcc

SEQ ID NO: 737130 - DNA, 20 bp, mouse
gcaaatagtggggtttctca

SEQ ID NO: 737131 - DNA, 20 bp, mouse
gcgcgcgccaaatccagcct

SEQ ID NO: 737132 - DNA, 20 bp, mouse
ggcagagctggcacccggaa

SEQ ID NO: 737133 - DNA, 20 bp, mouse
gaccgcccccctccgggctc

SEQ ID NO: 737134 - DNA, 20 bp, mouse
gctgctaagtacaggagaac

SEQ ID NO: 737135 - DNA, 20 bp, mouse
ggctggatttggcgcgcgag

SEQ ID NO: 737136 - DNA, 20 bp, mouse
gcgggcgcaagcctcgtgga

SEQ ID NO: 737137 - DNA, 20 bp, mouse
gcaagcctcgtggaaggagg

SEQ ID NO: 737138 - DNA, 20 bp, mouse
ggcgcaagcctcgtggaagg

SEQ ID NO: 737139 - DNA, 20 bp, mouse
gctcccgggcgcaagcctcg

SEQ ID NO: 737140 - DNA, 20 bp, mouse
gggactagagagggcgggga

SEQ ID NO: 737141 - DNA, 20 bp, mouse
gcgctcctcctccttccacg

SEQ ID NO: 737142 - DNA, 20 bp, mouse
gtggtgctgaaataagccaa

SEQ ID NO: 737143 - DNA, 20 bp, mouse
ggggacgtgacaggcagacg

SEQ ID NO: 737144 - DNA, 20 bp, mouse
ggtgacaggcagacggggtt

SEQ ID NO: 737145 - DNA, 20 bp, mouse
ggacccctgcccctctctct

SEQ ID NO: 737146 - DNA, 20 bp, mouse
gagccccaaggattgctggt

SEQ ID NO: 737147 - DNA, 20 bp, mouse
gcgcccaccagcaatccttg

SEQ ID NO: 737148 - DNA, 20 bp, mouse
gccggcctgcgtcgagtgag

SEQ ID NO: 737149 - DNA, 20 bp, mouse
ggagggccgaggaacgcggg

SEQ ID NO: 737150 - DNA, 20 bp, mouse
ggaggagggccgaggaacgc

SEQ ID NO: 737151 - DNA, 20 bp, mouse
gggcggggcggggagtcaca

SEQ ID NO: 737152 - DNA, 20 bp, mouse
ggcccaagctcccaggataa

SEQ ID NO: 737153 - DNA, 20 bp, mouse
gtgagaaattggcgctgttt

SEQ ID NO: 737154 - DNA, 20 bp, mouse
gcgtcgagtgagaggcttgg

SEQ ID NO: 737155 - DNA, 20 bp, mouse
gtgagtaacccgagctctgg

SEQ ID NO: 737156 - DNA, 20 bp, mouse
gaggacgcctggaacgaggc

SEQ ID NO: 737157 - DNA, 20 bp, mouse
ggctctacggagagacccta

SEQ ID NO: 737158 - DNA, 20 bp, mouse
gaaggaggagggaacggcgg

SEQ ID NO: 737159 - DNA, 20 bp, mouse
ggggttcagagctatgatca

SEQ ID NO: 737160 - DNA, 20 bp, mouse
ggcggaggacgcctggaacg

SEQ ID NO: 737161 - DNA, 20 bp, mouse
gggccaccgtgagctctcga

SEQ ID NO: 737162 - DNA, 20 bp, mouse
gtggggccgggcaaaaaaag

SEQ ID NO: 737163 - DNA, 20 bp, mouse
gagcagaaggagctactccc

SEQ ID NO: 737164 - DNA, 20 bp, mouse
ggaggacggcgccccatctg

SEQ ID NO: 737165 - DNA, 20 bp, mouse
gcgccctgacccgcgctcta

SEQ ID NO: 737166 - DNA, 20 bp, mouse
gacaccggggatgtccttct

SEQ ID NO: 737167 - DNA, 20 bp, mouse
gactggtgcggagtagagcg

SEQ ID NO: 737168 - DNA, 20 bp, mouse
gtctactccgcaccagtccc

SEQ ID NO: 737169 - DNA, 20 bp, mouse
ggctcgggctggatctcagg

SEQ ID NO: 737170 - DNA, 20 bp, mouse
gccgcctggggaccgcagag

SEQ ID NO: 737171 - DNA, 20 bp, mouse
gtagagcggggctcagaacc

SEQ ID NO: 737172 - DNA, 20 bp, mouse
gaatgaacagcgccagggac

SEQ ID NO: 737173 - DNA, 20 bp, mouse
ggggctcagaaccaggcgcg

SEQ ID NO: 737174 - DNA, 20 bp, mouse
gtggggaccgcagaggggcg

SEQ ID NO: 737175 - DNA, 20 bp, mouse
gaaccaggcgcgggggatgg

SEQ ID NO: 737176 - DNA, 20 bp, mouse
gtacaccacccacaattgcg

SEQ ID NO: 737177 - DNA, 20 bp, mouse
ggcggggcttcgagaagagg

SEQ ID NO: 737178 - DNA, 20 bp, mouse
ggaactggaaagtgccggaa

SEQ ID NO: 737179 - DNA, 20 bp, mouse
gggaggaggcaccgggtgaa

SEQ ID NO: 737180 - DNA, 20 bp, mouse
gaggaacaaccgagaatata

SEQ ID NO: 737181 - DNA, 20 bp, mouse
gaccgggtgaaggggtgaac

SEQ ID NO: 737182 - DNA, 20 bp, mouse
gcctccgagctgcagagggt

SEQ ID NO: 737183 - DNA, 20 bp, mouse
gtgcagctcggaggaggcac

SEQ ID NO: 737184 - DNA, 20 bp, mouse
ggaagccccgcaattgtggg

SEQ ID NO: 737185 - DNA, 20 bp, mouse
ggcagtgacagccgcgggga

SEQ ID NO: 737186 - DNA, 20 bp, mouse
gagagggcaagactgacagg

SEQ ID NO: 737187 - DNA, 20 bp, mouse
ggcgagagggcaagactgac

SEQ ID NO: 737188 - DNA, 20 bp, mouse
ggtgccgcccccattagagt

SEQ ID NO: 737189 - DNA, 20 bp, mouse
ggcaaagctcttagagatgg

SEQ ID NO: 737190 - DNA, 20 bp, mouse
gctctaagagctttgcgggt

SEQ ID NO: 737191 - DNA, 20 bp, mouse
gcaaacgtcttcaggatttc

SEQ ID NO: 737192 - DNA, 20 bp, mouse
gccagcaacctgcatctgaa

SEQ ID NO: 737193 - DNA, 20 bp, mouse
gctgaaaaggtgcgcctatg

SEQ ID NO: 737194 - DNA, 20 bp, mouse
gtagagtgggtggtgcgaga

SEQ ID NO: 737195 - DNA, 20 bp, mouse
ggccctcagtcagaaacctt

SEQ ID NO: 737196 - DNA, 20 bp, mouse
gtggagggaaccgggtgctc

SEQ ID NO: 737197 - DNA, 20 bp, mouse
gccacccgctggagggaacc

SEQ ID NO: 737198 - DNA, 20 bp, mouse
gaccgggtgctcaggaggag

SEQ ID NO: 737199 - DNA, 20 bp, mouse
gagaccgcgcggcctccccg

SEQ ID NO: 737200 - DNA, 20 bp, mouse
ggcaagagagtcagtgggag

SEQ ID NO: 737201 - DNA, 20 bp, mouse
gcggcctccccgaggctggc

SEQ ID NO: 737202 - DNA, 20 bp, mouse
gtggcaaggaggggccgcaa

SEQ ID NO: 737203 - DNA, 20 bp, mouse
ggccgccccaggctccatcg

SEQ ID NO: 737204 - DNA, 20 bp, mouse
gtctctgcaagagagtcagt

SEQ ID NO: 737205 - DNA, 20 bp, mouse
ggtccctcccgcctcttcct

SEQ ID NO: 737206 - DNA, 20 bp, mouse
gcacccgccagtggattctc

SEQ ID NO: 737207 - DNA, 20 bp, mouse
gctgacaggctcgactttat

SEQ ID NO: 737208 - DNA, 20 bp, mouse
ggggatgccacttctggcct

SEQ ID NO: 737209 - DNA, 20 bp, mouse
ggggtgaggtgtggagtcct

SEQ ID NO: 737210 - DNA, 20 bp, mouse
gttgtggaagagtgataaca

SEQ ID NO: 737211 - DNA, 20 bp, mouse
gggctacagctggagaaggg

SEQ ID NO: 737212 - DNA, 20 bp, mouse
ggcctggcgaacaacagaag

SEQ ID NO: 737213 - DNA, 20 bp, mouse
gatgcccggttgtctccttg

SEQ ID NO: 737214 - DNA, 20 bp, mouse
gagccctgagaatccactgg

SEQ ID NO: 737215 - DNA, 20 bp, mouse
gagaaggtccggaacaagcc

SEQ ID NO: 737216 - DNA, 20 bp, mouse
ggagatacaccgaaggtgtt

SEQ ID NO: 737217 - DNA, 20 bp, mouse
gacacaagaaggccttcctc

SEQ ID NO: 737218 - DNA, 20 bp, mouse
gcagcagttctcaaagaaca

SEQ ID NO: 737219 - DNA, 20 bp, mouse
gttcctctggttccaagccc

SEQ ID NO: 737220 - DNA, 20 bp, mouse
gcaggttagcccaacctcct

SEQ ID NO: 737221 - DNA, 20 bp, mouse
gcttggcagcctaacacctt

SEQ ID NO: 737222 - DNA, 20 bp, mouse
gagccagggcttggaaccag

SEQ ID NO: 737223 - DNA, 20 bp, mouse
gaatcactcagtgtcctagg

SEQ ID NO: 737224 - DNA, 20 bp, mouse
gggtgtatctcaatcattta

SEQ ID NO: 737225 - DNA, 20 bp, mouse
gaaccggatccaacaagagt

SEQ ID NO: 737226 - DNA, 20 bp, mouse
gggagcttggagccggccaa

SEQ ID NO: 737227 - DNA, 20 bp, mouse
gggcccggcgggggtcggga

SEQ ID NO: 737228 - DNA, 20 bp, mouse
gagcgccagatcagcgcctg

SEQ ID NO: 737229 - DNA, 20 bp, mouse
gcgcaaacccagacggacta

SEQ ID NO: 737230 - DNA, 20 bp, mouse
gtgtgaatggaggggcccgg

SEQ ID NO: 737231 - DNA, 20 bp, mouse
ggaatggaggggcccggcgg

SEQ ID NO: 737232 - DNA, 20 bp, mouse
ggagccggccaatggcagat

SEQ ID NO: 737233 - DNA, 20 bp, mouse
gcagatcagcgcctggggat

SEQ ID NO: 737234 - DNA, 20 bp, mouse
gcctggggattggagagatt

SEQ ID NO: 737235 - DNA, 20 bp, mouse
gaatggaggaaccaggacga

SEQ ID NO: 737236 - DNA, 20 bp, mouse
ggcgggacgagaatcctctg

SEQ ID NO: 737237 - DNA, 20 bp, mouse
gaagccccatggcctggctg

SEQ ID NO: 737238 - DNA, 20 bp, mouse
gccgccagagggcgccagat

SEQ ID NO: 737239 - DNA, 20 bp, mouse
gtggggcttcaaactgagga

SEQ ID NO: 737240 - DNA, 20 bp, mouse
ggccatggggcttcaaactg

SEQ ID NO: 737241 - DNA, 20 bp, mouse
gcgggtcggtgcctgaggac

SEQ ID NO: 737242 - DNA, 20 bp, mouse
gcgccagatcggctcctgag

SEQ ID NO: 737243 - DNA, 20 bp, mouse
gggagtgagcaacccggagt

SEQ ID NO: 737244 - DNA, 20 bp, mouse
ggacagtgagcaggcaaggg

SEQ ID NO: 737245 - DNA, 20 bp, mouse
gcggccgggagtgagcaacc

SEQ ID NO: 737246 - DNA, 20 bp, mouse
gacggggaacgaggaatgga

SEQ ID NO: 737247 - DNA, 20 bp, mouse
gcaagtggctggtgcgtgtg

SEQ ID NO: 737248 - DNA, 20 bp, mouse
gcggtggtgggcgggatcag

SEQ ID NO: 737249 - DNA, 20 bp, mouse
ggcaccagccacttgcgcac

SEQ ID NO: 737250 - DNA, 20 bp, mouse
ggggccaccgggccaggcca

SEQ ID NO: 737251 - DNA, 20 bp, mouse
gcaggcaagggaatctggac

SEQ ID NO: 737252 - DNA, 20 bp, mouse
gagaagggctactgtggcag

SEQ ID NO: 737253 - DNA, 20 bp, mouse
gttggaggagttaccgagaa

SEQ ID NO: 737254 - DNA, 20 bp, mouse
gtccctgagaacggtcgccg

SEQ ID NO: 737255 - DNA, 20 bp, mouse
gttaccgagaagggctactg

SEQ ID NO: 737256 - DNA, 20 bp, mouse
gaaagcctctagaactgacg

SEQ ID NO: 737257 - DNA, 20 bp, mouse
gtctagaactgacgtggaga

SEQ ID NO: 737258 - DNA, 20 bp, mouse
gaaaaccggtcctgattaga

SEQ ID NO: 737259 - DNA, 20 bp, mouse
gagttgttaaggtttgtgtt

SEQ ID NO: 737260 - DNA, 20 bp, mouse
gatcatgtggaaaagaatgc

SEQ ID NO: 737261 - DNA, 20 bp, mouse
gcagctgaagctgatgtgat

SEQ ID NO: 737262 - DNA, 20 bp, mouse
gatagccatactgatgaggt

SEQ ID NO: 737263 - DNA, 20 bp, mouse
gcacgcaatataaggagaga

SEQ ID NO: 737264 - DNA, 20 bp, mouse
gagggcagaggtattgtttc

SEQ ID NO: 737265 - DNA, 20 bp, mouse
gtcagtatggctatgatagt

SEQ ID NO: 737266 - DNA, 20 bp, mouse
gcggcccaggcagactagag

SEQ ID NO: 737267 - DNA, 20 bp, mouse
gggacagtgcagataatggg

SEQ ID NO: 737268 - DNA, 20 bp, mouse
ggaagggcacggatggctta

SEQ ID NO: 737269 - DNA, 20 bp, mouse
gagaggacagtgcagataat

SEQ ID NO: 737270 - DNA, 20 bp, mouse
ggggaaatagaggcatctga

SEQ ID NO: 737271 - DNA, 20 bp, mouse
gtgagtaagtgataaagggg

SEQ ID NO: 737272 - DNA, 20 bp, mouse
ggatcagggcctgaacagag

SEQ ID NO: 737273 - DNA, 20 bp, mouse
gcagagggtgagagtcgcat

SEQ ID NO: 737274 - DNA, 20 bp, mouse
gtgagagtcgcatgggtgaa

SEQ ID NO: 737275 - DNA, 20 bp, mouse
gtcagtaaggcatcatccta

SEQ ID NO: 737276 - DNA, 20 bp, mouse
ggtctgacccagagagggta

SEQ ID NO: 737277 - DNA, 20 bp, mouse
gcagggagaaagacactggg

SEQ ID NO: 737278 - DNA, 20 bp, mouse
gtctacagaccggcacaggg

SEQ ID NO: 737279 - DNA, 20 bp, mouse
gtctgggtcagactctaccc

SEQ ID NO: 737280 - DNA, 20 bp, mouse
gccacagctcccagggaaag

SEQ ID NO: 737281 - DNA, 20 bp, mouse
gggcacagggcggcttggaa

SEQ ID NO: 737282 - DNA, 20 bp, mouse
gcacaggtgcccggagaact

SEQ ID NO: 737283 - DNA, 20 bp, mouse
gaaacagattatctttctta

SEQ ID NO: 737284 - DNA, 20 bp, mouse
gtctgaatccacagctccca

SEQ ID NO: 737285 - DNA, 20 bp, mouse
gaaggactccccagttctcc

SEQ ID NO: 737286 - DNA, 20 bp, mouse
gtccgtagcccagtaggtga

SEQ ID NO: 737287 - DNA, 20 bp, mouse
gtgctcctctggttccaccc

SEQ ID NO: 737288 - DNA, 20 bp, mouse
gtaacctgggttcttgatat

SEQ ID NO: 737289 - DNA, 20 bp, mouse
gagaaaagagaaacttgtca

SEQ ID NO: 737290 - DNA, 20 bp, mouse
gccaggttaaccattgacac

SEQ ID NO: 737291 - DNA, 20 bp, mouse
gggctgctgatgtagattcc

SEQ ID NO: 737292 - DNA, 20 bp, mouse
ggattccagggtggaaccag

SEQ ID NO: 737293 - DNA, 20 bp, mouse
gtagcccagtaggtgagggc

SEQ ID NO: 737294 - DNA, 20 bp, mouse
gaacgatcccgtctgtctta

SEQ ID NO: 737295 - DNA, 20 bp, mouse
ggcctgcttcagaagatgcc

SEQ ID NO: 737296 - DNA, 20 bp, mouse
ggaagccacagcaggttccg

SEQ ID NO: 737297 - DNA, 20 bp, mouse
ggggaaccgccatcaggagg

SEQ ID NO: 737298 - DNA, 20 bp, mouse
gccagcctcggaacctgctg

SEQ ID NO: 737299 - DNA, 20 bp, mouse
gtggcagagccagggtccgc

SEQ ID NO: 737300 - DNA, 20 bp, mouse
gcccgggaaccgccatcagg

SEQ ID NO: 737301 - DNA, 20 bp, mouse
gtccgaggctggcagagcca

SEQ ID NO: 737302 - DNA, 20 bp, mouse
gcagccacgtgcgctccgat

SEQ ID NO: 737303 - DNA, 20 bp, mouse
gaggaggatctctacacccg

SEQ ID NO: 737304 - DNA, 20 bp, mouse
gcgccccgggaaccgccatc

SEQ ID NO: 737305 - DNA, 20 bp, mouse
gagggcggagccaacaaggc

SEQ ID NO: 737306 - DNA, 20 bp, mouse
ggggaggagaggcatccgga

SEQ ID NO: 737307 - DNA, 20 bp, mouse
gcaaggcaaggggaatgcaa

SEQ ID NO: 737308 - DNA, 20 bp, mouse
gaaagcaggcgcctgggttg

SEQ ID NO: 737309 - DNA, 20 bp, mouse
ggggacgaaagcaggcgcct

SEQ ID NO: 737310 - DNA, 20 bp, mouse
gaggtggcccgggatggtga

SEQ ID NO: 737311 - DNA, 20 bp, mouse
gggcccgggatggtgatggt

SEQ ID NO: 737312 - DNA, 20 bp, mouse
gcggatgcctctcctcccct

SEQ ID NO: 737313 - DNA, 20 bp, mouse
gctctcctcccctgggacag

SEQ ID NO: 737314 - DNA, 20 bp, mouse
ggaagcctcaaagagctcag

SEQ ID NO: 737315 - DNA, 20 bp, mouse
ggcaggggatgaaagcagga

SEQ ID NO: 737316 - DNA, 20 bp, mouse
gcaggctggttgagcagcgg

SEQ ID NO: 737317 - DNA, 20 bp, mouse
gaggcgcggaggtgcaattc

SEQ ID NO: 737318 - DNA, 20 bp, mouse
ggggttgagcctgcagtgtc

SEQ ID NO: 737319 - DNA, 20 bp, mouse
gaggacaggcggggctagtg

SEQ ID NO: 737320 - DNA, 20 bp, mouse
ggaagagttggctgcctttt

SEQ ID NO: 737321 - DNA, 20 bp, mouse
ggattgatgcgggatgggag

SEQ ID NO: 737322 - DNA, 20 bp, mouse
ggcggaggtgcaattcaggc

SEQ ID NO: 737323 - DNA, 20 bp, mouse
ggggacctgacaatcaagaa

SEQ ID NO: 737324 - DNA, 20 bp, mouse
gaggctcaacccaggcgcgg

SEQ ID NO: 737325 - DNA, 20 bp, mouse
gagtgtgtggcaataattga

SEQ ID NO: 737326 - DNA, 20 bp, mouse
gggggcgcgggtcacgtgtg

SEQ ID NO: 737327 - DNA, 20 bp, mouse
gcgcgggtcacgtgtgagga

SEQ ID NO: 737328 - DNA, 20 bp, mouse
gcgccccggctgccagcccc

SEQ ID NO: 737329 - DNA, 20 bp, mouse
ggcaccaggagggccggggt

SEQ ID NO: 737330 - DNA, 20 bp, mouse
ggggaccgggtcccagacgg

SEQ ID NO: 737331 - DNA, 20 bp, mouse
gtgcctccgcagcggggcgc

SEQ ID NO: 737332 - DNA, 20 bp, mouse
gggggcgcgtgctgcgagtt

SEQ ID NO: 737333 - DNA, 20 bp, mouse
ggggcgaaagtctccgaagc

SEQ ID NO: 737334 - DNA, 20 bp, mouse
gaccgggtcccagacggagg

SEQ ID NO: 737335 - DNA, 20 bp, mouse
gcgcagcacgcgccccgctt

SEQ ID NO: 737336 - DNA, 20 bp, mouse
ggacagagggaggagaaccc

SEQ ID NO: 737337 - DNA, 20 bp, mouse
gtgcacaatggggtatatgg

SEQ ID NO: 737338 - DNA, 20 bp, mouse
ggcttgcacaatggggtata

SEQ ID NO: 737339 - DNA, 20 bp, mouse
gtcaacaaggaggtcttgga

SEQ ID NO: 737340 - DNA, 20 bp, mouse
gaggcagaccggtgaagggg

SEQ ID NO: 737341 - DNA, 20 bp, mouse
gtcaattgtagggggacaga

SEQ ID NO: 737342 - DNA, 20 bp, mouse
gggcgctcacacacgtgcgg

SEQ ID NO: 737343 - DNA, 20 bp, mouse
gtggatagaacgcgatttaa

SEQ ID NO: 737344 - DNA, 20 bp, mouse
gccccctacaattgaatctc

SEQ ID NO: 737345 - DNA, 20 bp, mouse
gggaggctgcccgctctctc

SEQ ID NO: 737346 - DNA, 20 bp, mouse
ggggcagaggagtgcgcgtg

SEQ ID NO: 737347 - DNA, 20 bp, mouse
gaggagtgcgcgtgtgggca

SEQ ID NO: 737348 - DNA, 20 bp, mouse
gtactcggttccagccccac

SEQ ID NO: 737349 - DNA, 20 bp, mouse
gcccggttgcgaggaaactg

SEQ ID NO: 737350 - DNA, 20 bp, mouse
gaggaggaagcccggttgcg

SEQ ID NO: 737351 - DNA, 20 bp, mouse
gtggggccaccgcggggcag

SEQ ID NO: 737352 - DNA, 20 bp, mouse
gctgggcgctggggccaccg

SEQ ID NO: 737353 - DNA, 20 bp, mouse
gggcgaagggtgggcagcta

SEQ ID NO: 737354 - DNA, 20 bp, mouse
ggagcgccaccgagaaatag

SEQ ID NO: 737355 - DNA, 20 bp, mouse
gggtggggatccgcgggaac

SEQ ID NO: 737356 - DNA, 20 bp, mouse
gaggtctggccccagctagg

SEQ ID NO: 737357 - DNA, 20 bp, mouse
gagcgagccggggaaagtgg

SEQ ID NO: 737358 - DNA, 20 bp, mouse
gccggggaaagtggaggcgg

SEQ ID NO: 737359 - DNA, 20 bp, mouse
gagaagggagggaccaccgg

SEQ ID NO: 737360 - DNA, 20 bp, mouse
gtgctgccgggccacgggga

SEQ ID NO: 737361 - DNA, 20 bp, mouse
gcctccccggctcccccgac

SEQ ID NO: 737362 - DNA, 20 bp, mouse
gtctttgcgtcagtgaactt

SEQ ID NO: 737363 - DNA, 20 bp, mouse
ggggctggaagatgagggtt

SEQ ID NO: 737364 - DNA, 20 bp, mouse
gctcctcagccgcctagctg

SEQ ID NO: 737365 - DNA, 20 bp, mouse
gaggcagggagccggccaga

SEQ ID NO: 737366 - DNA, 20 bp, mouse
gccagtcctgggtaccactc

SEQ ID NO: 737367 - DNA, 20 bp, mouse
gacccaggactgggaaaggg

SEQ ID NO: 737368 - DNA, 20 bp, mouse
gtgtggagctgtagccagac

SEQ ID NO: 737369 - DNA, 20 bp, mouse
gagaagtgaagggacctctt

SEQ ID NO: 737370 - DNA, 20 bp, mouse
gatgactctccgtgtccagg

SEQ ID NO: 737371 - DNA, 20 bp, mouse
ggcgtgtggattagccagag

SEQ ID NO: 737372 - DNA, 20 bp, mouse
gtaaaaatagctgtggcgtg

SEQ ID NO: 737373 - DNA, 20 bp, mouse
gctggtgtgctcctcattct

SEQ ID NO: 737374 - DNA, 20 bp, mouse
gtagccaaagtccttcctcc

SEQ ID NO: 737375 - DNA, 20 bp, mouse
ggagatgactctccgtgtcc

SEQ ID NO: 737376 - DNA, 20 bp, mouse
gcctccgggtggcctggcca

SEQ ID NO: 737377 - DNA, 20 bp, mouse
ggctgcccgcgccccctacc

SEQ ID NO: 737378 - DNA, 20 bp, mouse
gtgctgactgcactggggaa

SEQ ID NO: 737379 - DNA, 20 bp, mouse
ggccagcagctcccgccaag

SEQ ID NO: 737380 - DNA, 20 bp, mouse
ggtagcgggagttggtcggg

SEQ ID NO: 737381 - DNA, 20 bp, mouse
gcggagcgctctcacccact

SEQ ID NO: 737382 - DNA, 20 bp, mouse
gcaggtagcgggagttggtc

SEQ ID NO: 737383 - DNA, 20 bp, mouse
gagcgctctcacccacttgg

SEQ ID NO: 737384 - DNA, 20 bp, mouse
gcctacctggcttccgaaac

SEQ ID NO: 737385 - DNA, 20 bp, mouse
gcaactcccgctacctgagc

SEQ ID NO: 737386 - DNA, 20 bp, mouse
gtctccgcgcagcccgggga

SEQ ID NO: 737387 - DNA, 20 bp, mouse
gcggcgccccggggagctcg

SEQ ID NO: 737388 - DNA, 20 bp, mouse
gaccgcccagcgacgagccc

SEQ ID NO: 737389 - DNA, 20 bp, mouse
gcgacgagcccgggtgtccg

SEQ ID NO: 737390 - DNA, 20 bp, mouse
gtgcaggtgccgcgccactg

SEQ ID NO: 737391 - DNA, 20 bp, mouse
gcgccactgcgggagaacgc

SEQ ID NO: 737392 - DNA, 20 bp, mouse
gcccggggagctcgcggcta

SEQ ID NO: 737393 - DNA, 20 bp, mouse
gagacagcgagcagagggcg

SEQ ID NO: 737394 - DNA, 20 bp, mouse
gggcacctgcagcgcgccac

SEQ ID NO: 737395 - DNA, 20 bp, mouse
gcctgcagcgcgccacgggg

SEQ ID NO: 737396 - DNA, 20 bp, mouse
gcggggcggagtgttgggga

SEQ ID NO: 737397 - DNA, 20 bp, mouse
ggagcccggggcggagtgtt

SEQ ID NO: 737398 - DNA, 20 bp, mouse
gctggcatccagaacggcag

SEQ ID NO: 737399 - DNA, 20 bp, mouse
gcggtcgctcggtcgggagg

SEQ ID NO: 737400 - DNA, 20 bp, mouse
gctggtgggacgcactgttg

SEQ ID NO: 737401 - DNA, 20 bp, mouse
ggagtcatccgagcccgggg

SEQ ID NO: 737402 - DNA, 20 bp, mouse
gaggtgtcccactgccgttc

SEQ ID NO: 737403 - DNA, 20 bp, mouse
gtccttctttccccgcgctt

SEQ ID NO: 737404 - DNA, 20 bp, mouse
ggggtgaaaagatacggttt

SEQ ID NO: 737405 - DNA, 20 bp, mouse
gaggcggagtcatccgagcc

SEQ ID NO: 737406 - DNA, 20 bp, mouse
gggagtgcagatccctggag

SEQ ID NO: 737407 - DNA, 20 bp, mouse
gaggccaaggggcgggtacc

SEQ ID NO: 737408 - DNA, 20 bp, mouse
ggagtggttgcttaacagat

SEQ ID NO: 737409 - DNA, 20 bp, mouse
ggtctgcgtgggttcctctc

SEQ ID NO: 737410 - DNA, 20 bp, mouse
gaggtccaggcgagcgccag

SEQ ID NO: 737411 - DNA, 20 bp, mouse
ggaacccacgcagaccatcg

SEQ ID NO: 737412 - DNA, 20 bp, mouse
gaacagcgatgcttctacca

SEQ ID NO: 737413 - DNA, 20 bp, mouse
gtccaggcgagcgccagcgg

SEQ ID NO: 737414 - DNA, 20 bp, mouse
ggagcctcgatggtctgcgt

SEQ ID NO: 737415 - DNA, 20 bp, mouse
gtacccgccccttggcctca

SEQ ID NO: 737416 - DNA, 20 bp, mouse
gcgggcccctgcgtgggtta

SEQ ID NO: 737417 - DNA, 20 bp, mouse
gggtgcccacccttctccgt

SEQ ID NO: 737418 - DNA, 20 bp, mouse
gtccctgcgggcccctgcgt

SEQ ID NO: 737419 - DNA, 20 bp, mouse
gcccgagcccccaagagcta

SEQ ID NO: 737420 - DNA, 20 bp, mouse
gagctagggcgagttacgga

SEQ ID NO: 737421 - DNA, 20 bp, mouse
gaggggcccgcagggacatc

SEQ ID NO: 737422 - DNA, 20 bp, mouse
ggtaactcgccctagctctt

SEQ ID NO: 737423 - DNA, 20 bp, mouse
gctactcccacggagaaggg

SEQ ID NO: 737424 - DNA, 20 bp, mouse
gtagggcgagttacggatgg

SEQ ID NO: 737425 - DNA, 20 bp, mouse
ggagaagggtgggcaccaga

SEQ ID NO: 737426 - DNA, 20 bp, mouse
gcaaatgcttgggcccctca

SEQ ID NO: 737427 - DNA, 20 bp, mouse
gtgggagggaaggctcacga

SEQ ID NO: 737428 - DNA, 20 bp, mouse
gctctcggctcaaacacagg

SEQ ID NO: 737429 - DNA, 20 bp, mouse
gagcaaggcagcaaatgctt

SEQ ID NO: 737430 - DNA, 20 bp, mouse
ggccgcagacacctgtgcgg

SEQ ID NO: 737431 - DNA, 20 bp, mouse
gatcaggagcccactctgct

SEQ ID NO: 737432 - DNA, 20 bp, mouse
gtggaaaaacaaggctgggt

SEQ ID NO: 737433 - DNA, 20 bp, mouse
gggaaggctcacgagggtgt

SEQ ID NO: 737434 - DNA, 20 bp, mouse
gcaagtgaggctgagtgtct

SEQ ID NO: 737435 - DNA, 20 bp, mouse
ggcacaggtgtctgcggcag

SEQ ID NO: 737436 - DNA, 20 bp, mouse
gagtttctggcggggacttt

SEQ ID NO: 737437 - DNA, 20 bp, mouse
gagccggaacccatcatgtt

SEQ ID NO: 737438 - DNA, 20 bp, mouse
gaactctggagctggtcagg

SEQ ID NO: 737439 - DNA, 20 bp, mouse
gtggatgagccaaacatgat

SEQ ID NO: 737440 - DNA, 20 bp, mouse
gtgaccagctccagagtttc

SEQ ID NO: 737441 - DNA, 20 bp, mouse
gacaatttggggcactagca

SEQ ID NO: 737442 - DNA, 20 bp, mouse
gtgttctgaaactgcagctt

SEQ ID NO: 737443 - DNA, 20 bp, mouse
gtggtgcgtgagcttcccag

SEQ ID NO: 737444 - DNA, 20 bp, mouse
gcggctgcttcccagtcctc

SEQ ID NO: 737445 - DNA, 20 bp, mouse
gttggctcatccaaacaact

SEQ ID NO: 737446 - DNA, 20 bp, mouse
ggggaagagcggcgaggcga

SEQ ID NO: 737447 - DNA, 20 bp, mouse
gagggctgggaggggtgtgc

SEQ ID NO: 737448 - DNA, 20 bp, mouse
gacgcgcatagggctgggag

SEQ ID NO: 737449 - DNA, 20 bp, mouse
gggcgacgcggacgcgcata

SEQ ID NO: 737450 - DNA, 20 bp, mouse
gtcacaaagacatgcggaga

SEQ ID NO: 737451 - DNA, 20 bp, mouse
gaggaggagggagttcggaa

SEQ ID NO: 737452 - DNA, 20 bp, mouse
ggggacaccgcaggagcagg

SEQ ID NO: 737453 - DNA, 20 bp, mouse
gtcctgcggtgtccccgccc

SEQ ID NO: 737454 - DNA, 20 bp, mouse
gcgcggacgcgcatagggct

SEQ ID NO: 737455 - DNA, 20 bp, mouse
ggcccgggcggggacaccgc

SEQ ID NO: 737456 - DNA, 20 bp, mouse
gcggctccccagtccttatt

SEQ ID NO: 737457 - DNA, 20 bp, mouse
ggactggggagccgtgccga

SEQ ID NO: 737458 - DNA, 20 bp, mouse
ggggagcaagcgggagaacc

SEQ ID NO: 737459 - DNA, 20 bp, mouse
gcctcccgcccagccaaata

SEQ ID NO: 737460 - DNA, 20 bp, mouse
gtggccccggggtgcggagc

SEQ ID NO: 737461 - DNA, 20 bp, mouse
gcgcccagccaaataaggac

SEQ ID NO: 737462 - DNA, 20 bp, mouse
ggagaacccgggcaggacag

SEQ ID NO: 737463 - DNA, 20 bp, mouse
gtggggagccgtgccgaggg

SEQ ID NO: 737464 - DNA, 20 bp, mouse
gtgaagggacagctccgcgg

SEQ ID NO: 737465 - DNA, 20 bp, mouse
gacacagaggcccctaccct

SEQ ID NO: 737466 - DNA, 20 bp, mouse
gggaatgcagcctgagcaag

SEQ ID NO: 737467 - DNA, 20 bp, mouse
gaggcagcagatggttgggg

SEQ ID NO: 737468 - DNA, 20 bp, mouse
gagacggggagctctctttg

SEQ ID NO: 737469 - DNA, 20 bp, mouse
gcagggagaagagggtatgt

SEQ ID NO: 737470 - DNA, 20 bp, mouse
gtggatttaaccagctgaat

SEQ ID NO: 737471 - DNA, 20 bp, mouse
gctcatgggcggagaaacga

SEQ ID NO: 737472 - DNA, 20 bp, mouse
ggatagagcacctcttgctc

SEQ ID NO: 737473 - DNA, 20 bp, mouse
ggtcaggcagcagatggttg

SEQ ID NO: 737474 - DNA, 20 bp, mouse
gaggacccaacccattcagc

SEQ ID NO: 737475 - DNA, 20 bp, mouse
gtgggttgggtcctagttct

SEQ ID NO: 737476 - DNA, 20 bp, mouse
ggccaggggcgggttccgaa

SEQ ID NO: 737477 - DNA, 20 bp, mouse
gtgtgtggctcctggaagtc

SEQ ID NO: 737478 - DNA, 20 bp, mouse
gcgcaaatcccgcgactgtg

SEQ ID NO: 737479 - DNA, 20 bp, mouse
gccaggagccacacagtcgc

SEQ ID NO: 737480 - DNA, 20 bp, mouse
ggaaaggggtggagtccatt

SEQ ID NO: 737481 - DNA, 20 bp, mouse
gttaagcaggcttgggagta

SEQ ID NO: 737482 - DNA, 20 bp, mouse
ggtggctcctggaagtctgg

SEQ ID NO: 737483 - DNA, 20 bp, mouse
ggcctggagcttggagaacc

SEQ ID NO: 737484 - DNA, 20 bp, mouse
gatggccccaccagacttcc

SEQ ID NO: 737485 - DNA, 20 bp, mouse
ggggccatgaagccttggcc

SEQ ID NO: 737486 - DNA, 20 bp, mouse
gcgggatcggggagtcaaat

SEQ ID NO: 737487 - DNA, 20 bp, mouse
gtaggtacagggacaccgga

SEQ ID NO: 737488 - DNA, 20 bp, mouse
gtcggggagtcaaatgggat

SEQ ID NO: 737489 - DNA, 20 bp, mouse
gagcgtcgaactccaccctc

SEQ ID NO: 737490 - DNA, 20 bp, mouse
gtggcggaacgccctgacgc

SEQ ID NO: 737491 - DNA, 20 bp, mouse
gaacacctggtgtaggtaca

SEQ ID NO: 737492 - DNA, 20 bp, mouse
ggggtggagttcgacgctcc

SEQ ID NO: 737493 - DNA, 20 bp, mouse
gggccaccgacgccccgaag

SEQ ID NO: 737494 - DNA, 20 bp, mouse
gccggcgggggccacgtcag

SEQ ID NO: 737495 - DNA, 20 bp, mouse
ggagttaaggagtcgcgagg

SEQ ID NO: 737496 - DNA, 20 bp, mouse
ggaggtgctgcgtgggtagg

SEQ ID NO: 737497 - DNA, 20 bp, mouse
gtgggcggaggaagacactg

SEQ ID NO: 737498 - DNA, 20 bp, mouse
gctgtggtgagaagactgac

SEQ ID NO: 737499 - DNA, 20 bp, mouse
gatgtcttgccccagaaact

SEQ ID NO: 737500 - DNA, 20 bp, mouse
ggggctgcgaagggcgtggc

SEQ ID NO: 737501 - DNA, 20 bp, mouse
gacatggcagccgggcactg

SEQ ID NO: 737502 - DNA, 20 bp, mouse
gctagaatgaacgtgaatga

SEQ ID NO: 737503 - DNA, 20 bp, mouse
gccacagcacgcccagtttc

SEQ ID NO: 737504 - DNA, 20 bp, mouse
gttcgtgtgaggatctctcc

SEQ ID NO: 737505 - DNA, 20 bp, mouse
gaccagggaggggctgcgaa

SEQ ID NO: 737506 - DNA, 20 bp, mouse
ggaacccgctgcgcccgcag

SEQ ID NO: 737507 - DNA, 20 bp, mouse
gaaggctgaggggtctcccc

SEQ ID NO: 737508 - DNA, 20 bp, mouse
gggcgtggtgatcaccaccg

SEQ ID NO: 737509 - DNA, 20 bp, mouse
gaccaccggggcgcgcgaaa

SEQ ID NO: 737510 - DNA, 20 bp, mouse
ggcctggcatagggtgtccc

SEQ ID NO: 737511 - DNA, 20 bp, mouse
gggctcggttggggcaggat

SEQ ID NO: 737512 - DNA, 20 bp, mouse
ggggactcaacgacctcacc

SEQ ID NO: 737513 - DNA, 20 bp, mouse
ggagtccggggagcccggtg

SEQ ID NO: 737514 - DNA, 20 bp, mouse
gccgggctccccggactctg

SEQ ID NO: 737515 - DNA, 20 bp, mouse
gtacgcggaatccgttgcac

SEQ ID NO: 737516 - DNA, 20 bp, mouse
gggggaaggagagatcccta

SEQ ID NO: 737517 - DNA, 20 bp, mouse
gcaaagggtttcccagatga

SEQ ID NO: 737518 - DNA, 20 bp, mouse
ggcccagcttgtcctaggtt

SEQ ID NO: 737519 - DNA, 20 bp, mouse
ggaaagatggagcactgaga

SEQ ID NO: 737520 - DNA, 20 bp, mouse
gagaggttctagctcaaacg

SEQ ID NO: 737521 - DNA, 20 bp, mouse
gtggaggtcagagaccagtt

SEQ ID NO: 737522 - DNA, 20 bp, mouse
gttgagctagaacctctctt

SEQ ID NO: 737523 - DNA, 20 bp, mouse
gcagtgctccatctttctgt

SEQ ID NO: 737524 - DNA, 20 bp, mouse
gtccaaacctaggacaagct

SEQ ID NO: 737525 - DNA, 20 bp, mouse
gggcaggatctccagatccc

SEQ ID NO: 737526 - DNA, 20 bp, mouse
gagtccccaacagcagctga

SEQ ID NO: 737527 - DNA, 20 bp, mouse
ggggactgagactgcttccc

SEQ ID NO: 737528 - DNA, 20 bp, mouse
gcatggaggctcgacccaga

SEQ ID NO: 737529 - DNA, 20 bp, mouse
gcccaccccaagtcaggcct

SEQ ID NO: 737530 - DNA, 20 bp, mouse
gtctctgccagcctgaaaga

SEQ ID NO: 737531 - DNA, 20 bp, mouse
gtggcagagaagccaggaat

SEQ ID NO: 737532 - DNA, 20 bp, mouse
gcagccctcagctgctgttg

SEQ ID NO: 737533 - DNA, 20 bp, mouse
gaagcagtctcagtcccatc

SEQ ID NO: 737534 - DNA, 20 bp, mouse
gggagctctagcaggaagtt

SEQ ID NO: 737535 - DNA, 20 bp, mouse
ggtctcccagctggtctcca

SEQ ID NO: 737536 - DNA, 20 bp, mouse
ggaagcagcgtgcctgtcat

SEQ ID NO: 737537 - DNA, 20 bp, mouse
ggggtggccgcagagctagg

SEQ ID NO: 737538 - DNA, 20 bp, mouse
gaaaacagatgaactcatta

SEQ ID NO: 737539 - DNA, 20 bp, mouse
gctagagagagcttatttac

SEQ ID NO: 737540 - DNA, 20 bp, mouse
gggactaacaggatcacttg

SEQ ID NO: 737541 - DNA, 20 bp, mouse
gtctctaggagggtgaactt

SEQ ID NO: 737542 - DNA, 20 bp, mouse
gaaatctaatctagtaggta

SEQ ID NO: 737543 - DNA, 20 bp, mouse
ggatcacttggggattccaa

SEQ ID NO: 737544 - DNA, 20 bp, mouse
gtgaaaattcgaaagcagtg

SEQ ID NO: 737545 - DNA, 20 bp, mouse
gaaataagctctctctagga

SEQ ID NO: 737546 - DNA, 20 bp, mouse
gtggctgcaaagcaacgttc

SEQ ID NO: 737547 - DNA, 20 bp, mouse
gaggcgccaggcaatgctgg

SEQ ID NO: 737548 - DNA, 20 bp, mouse
gtaaaagggcacaactcagg

SEQ ID NO: 737549 - DNA, 20 bp, mouse
gctctctaggaaacttctag

SEQ ID NO: 737550 - DNA, 20 bp, mouse
gcctgagttcccacctctct

SEQ ID NO: 737551 - DNA, 20 bp, mouse
gaggactgtggaaagttctg

SEQ ID NO: 737552 - DNA, 20 bp, mouse
gaatgctgggggagtgttgt

SEQ ID NO: 737553 - DNA, 20 bp, mouse
gggtcctggtgtctgtggct

SEQ ID NO: 737554 - DNA, 20 bp, mouse
ggctgcatccagagctggcg

SEQ ID NO: 737555 - DNA, 20 bp, mouse
gatcggaagtggagtcccag

SEQ ID NO: 737556 - DNA, 20 bp, mouse
gacagcgggaacgaccccta

SEQ ID NO: 737557 - DNA, 20 bp, mouse
gcgcgccccgcagctcccgt

SEQ ID NO: 737558 - DNA, 20 bp, mouse
gcgcccgcctgccatcgccg

SEQ ID NO: 737559 - DNA, 20 bp, mouse
gccggcaaagggagctccgg

SEQ ID NO: 737560 - DNA, 20 bp, mouse
ggcagcaggcgcaccggcaa

SEQ ID NO: 737561 - DNA, 20 bp, mouse
gtgctcgcccacgggagctg

SEQ ID NO: 737562 - DNA, 20 bp, mouse
gggcgcgcgcgagaacaaag

SEQ ID NO: 737563 - DNA, 20 bp, mouse
gccccgacgctgggagcgac

SEQ ID NO: 737564 - DNA, 20 bp, mouse
gggtgccggacgctgtgagg

SEQ ID NO: 737565 - DNA, 20 bp, mouse
gaggccggcgacgcccccgg

SEQ ID NO: 737566 - DNA, 20 bp, mouse
gggggctgggggactggcga

SEQ ID NO: 737567 - DNA, 20 bp, mouse
gaccgtggcagaaggtgggt

SEQ ID NO: 737568 - DNA, 20 bp, mouse
ggggcgctcgcaacccgcgc

SEQ ID NO: 737569 - DNA, 20 bp, mouse
ggggtgggtgctcaggggtg

SEQ ID NO: 737570 - DNA, 20 bp, mouse
gcagaacagagctcgaggga

SEQ ID NO: 737571 - DNA, 20 bp, mouse
gtcacgaagtgctgcggggc

SEQ ID NO: 737572 - DNA, 20 bp, mouse
gcgcaacccgcgccggtcgc

SEQ ID NO: 737573 - DNA, 20 bp, mouse
gtcagaccgtggcagaaggt

SEQ ID NO: 737574 - DNA, 20 bp, mouse
gagaaggtgggtgggtgctc

SEQ ID NO: 737575 - DNA, 20 bp, mouse
gctgctcacgaagtgctgcg

SEQ ID NO: 737576 - DNA, 20 bp, mouse
gcacacctggacctcatctc

SEQ ID NO: 737577 - DNA, 20 bp, mouse
gcaggcagctgcaatcatca

SEQ ID NO: 737578 - DNA, 20 bp, mouse
gggagcctgcggggtcatgg

SEQ ID NO: 737579 - DNA, 20 bp, mouse
ggtgatgggcatctgtgcac

SEQ ID NO: 737580 - DNA, 20 bp, mouse
gtctgcccgcaaggctaata

SEQ ID NO: 737581 - DNA, 20 bp, mouse
gcatgcttaaagctccctcc

SEQ ID NO: 737582 - DNA, 20 bp, mouse
gagggagctttaagcatggg

SEQ ID NO: 737583 - DNA, 20 bp, mouse
gtgggcaagaataagaaccc

SEQ ID NO: 737584 - DNA, 20 bp, mouse
gcccacccccatgaccccgc

SEQ ID NO: 737585 - DNA, 20 bp, mouse
ggcacagatgcccatcaccg

SEQ ID NO: 737586 - DNA, 20 bp, mouse
gcgggagagcactggtggac

SEQ ID NO: 737587 - DNA, 20 bp, mouse
gagcactggtggacgggcgg

SEQ ID NO: 737588 - DNA, 20 bp, mouse
gtctgcgggcgggtgatccc

SEQ ID NO: 737589 - DNA, 20 bp, mouse
ggacaaccctgatcagtcgg

SEQ ID NO: 737590 - DNA, 20 bp, mouse
gcatctccaaatttggtctt

SEQ ID NO: 737591 - DNA, 20 bp, mouse
gctcccgcctgccaaggacg

SEQ ID NO: 737592 - DNA, 20 bp, mouse
gtgaccttgaggctaccgag

SEQ ID NO: 737593 - DNA, 20 bp, mouse
gttggcaggcgggagagcac

SEQ ID NO: 737594 - DNA, 20 bp, mouse
gacacccctcggtagcctca

SEQ ID NO: 737595 - DNA, 20 bp, mouse
gggggacccccgactgatca

SEQ ID NO: 737596 - DNA, 20 bp, mouse
gccgggtggcagcgcaacga

SEQ ID NO: 737597 - DNA, 20 bp, mouse
gaaaccgctggctaataagt

SEQ ID NO: 737598 - DNA, 20 bp, mouse
gcttgcgggtggagtgtgga

SEQ ID NO: 737599 - DNA, 20 bp, mouse
gtggcagcgcaacgagggct

SEQ ID NO: 737600 - DNA, 20 bp, mouse
gaggctccgcctccaagaag

SEQ ID NO: 737601 - DNA, 20 bp, mouse
gttggcgctggggcgatgaa

SEQ ID NO: 737602 - DNA, 20 bp, mouse
gccagcgccaacattcagcc

SEQ ID NO: 737603 - DNA, 20 bp, mouse
gtcagcttgcgggtggagtg

SEQ ID NO: 737604 - DNA, 20 bp, mouse
gtattagccagcggtttcat

SEQ ID NO: 737605 - DNA, 20 bp, mouse
ggttgcgctgccacccggcg

SEQ ID NO: 737606 - DNA, 20 bp, mouse
ggggtgtgtcttgtggtccc

SEQ ID NO: 737607 - DNA, 20 bp, mouse
gcccctccttagtcttagaa

SEQ ID NO: 737608 - DNA, 20 bp, mouse
gacggggaggtccctgggta

SEQ ID NO: 737609 - DNA, 20 bp, mouse
gctaagactaaggaggggct

SEQ ID NO: 737610 - DNA, 20 bp, mouse
ggaactcttcttccttgccc

SEQ ID NO: 737611 - DNA, 20 bp, mouse
gccgtctccggtctgtcata

SEQ ID NO: 737612 - DNA, 20 bp, mouse
gtcccttctaagactaagga

SEQ ID NO: 737613 - DNA, 20 bp, mouse
gccattcccttctaagacta

SEQ ID NO: 737614 - DNA, 20 bp, mouse
gtaactgcagcaggcagggc

SEQ ID NO: 737615 - DNA, 20 bp, mouse
gtctgtcatagggtgctctg

SEQ ID NO: 737616 - DNA, 20 bp, mouse
gggcggagcaggtaacccgc

SEQ ID NO: 737617 - DNA, 20 bp, mouse
gcaagcaggcgggcggtcct

SEQ ID NO: 737618 - DNA, 20 bp, mouse
ggggcgggacatgccatccc

SEQ ID NO: 737619 - DNA, 20 bp, mouse
gtatctccgcgttccgggct

SEQ ID NO: 737620 - DNA, 20 bp, mouse
gcaggctatctccgcgttcc

SEQ ID NO: 737621 - DNA, 20 bp, mouse
gccaggggcggggcgtcctg

SEQ ID NO: 737622 - DNA, 20 bp, mouse
gtgctccgccaagccaagtc

SEQ ID NO: 737623 - DNA, 20 bp, mouse
gcgcggtggcgcccaggggc

SEQ ID NO: 737624 - DNA, 20 bp, mouse
gacgcggagatagcctgact

SEQ ID NO: 737625 - DNA, 20 bp, mouse
gggaagcacgtgcgcccagc

SEQ ID NO: 737626 - DNA, 20 bp, mouse
gctccccctcaaggattacc

SEQ ID NO: 737627 - DNA, 20 bp, mouse
gctagcccggtaatccttga

SEQ ID NO: 737628 - DNA, 20 bp, mouse
ggcctggccggcttccgcga

SEQ ID NO: 737629 - DNA, 20 bp, mouse
gtccctgcctgccactacaa

SEQ ID NO: 737630 - DNA, 20 bp, mouse
gccctctcagcggtgacggc

SEQ ID NO: 737631 - DNA, 20 bp, mouse
gtccaggtgtactgcctcac

SEQ ID NO: 737632 - DNA, 20 bp, mouse
gagggctggactccccctca

SEQ ID NO: 737633 - DNA, 20 bp, mouse
gcaggaagggttgtcctgtg

SEQ ID NO: 737634 - DNA, 20 bp, mouse
gaggcagggagagctggtcc

SEQ ID NO: 737635 - DNA, 20 bp, mouse
gcacacccagaggaagtgct

SEQ ID NO: 737636 - DNA, 20 bp, mouse
gcctcccgcaaccaaggggc

SEQ ID NO: 737637 - DNA, 20 bp, mouse
ggggaagcagagaacgctgc

SEQ ID NO: 737638 - DNA, 20 bp, mouse
gtgggcctcccgcaaccaag

SEQ ID NO: 737639 - DNA, 20 bp, mouse
gttgaggtccagcatcacca

SEQ ID NO: 737640 - DNA, 20 bp, mouse
gccacccctgcgaaggaggg

SEQ ID NO: 737641 - DNA, 20 bp, mouse
gagccctagccccgctgcag

SEQ ID NO: 737642 - DNA, 20 bp, mouse
gagccccacccctgcgaagg

SEQ ID NO: 737643 - DNA, 20 bp, mouse
gaagcagagaacgctgcggg

SEQ ID NO: 737644 - DNA, 20 bp, mouse
gggggctagggctagagcag

SEQ ID NO: 737645 - DNA, 20 bp, mouse
gcgggaggacggctggcaca

SEQ ID NO: 737646 - DNA, 20 bp, mouse
ggggccgggacacaccgact

SEQ ID NO: 737647 - DNA, 20 bp, mouse
gccgcccagtcggtgtgtcc

SEQ ID NO: 737648 - DNA, 20 bp, mouse
gtgcccgcgccacgcgctcg

SEQ ID NO: 737649 - DNA, 20 bp, mouse
gagagagaagagcaccggga

SEQ ID NO: 737650 - DNA, 20 bp, mouse
gggcgcgcggtccgcccagt

SEQ ID NO: 737651 - DNA, 20 bp, mouse
gggacccgggtcggacgcgg

SEQ ID NO: 737652 - DNA, 20 bp, mouse
gccgccttcccaaatcgggg

SEQ ID NO: 737653 - DNA, 20 bp, mouse
gcgcgccacgcgctcggggc

SEQ ID NO: 737654 - DNA, 20 bp, mouse
gtgtcccggccccgagcgcg

SEQ ID NO: 737655 - DNA, 20 bp, mouse
gcggccgccttcccaaatcg

SEQ ID NO: 737656 - DNA, 20 bp, mouse
ggtccccagggagttcgaga

SEQ ID NO: 737657 - DNA, 20 bp, mouse
gcctggggacgccacagtcg

SEQ ID NO: 737658 - DNA, 20 bp, mouse
gatccctctcgaactccctg

SEQ ID NO: 737659 - DNA, 20 bp, mouse
gaggagctccctcaccacga

SEQ ID NO: 737660 - DNA, 20 bp, mouse
ggggagttcgagagggatca

SEQ ID NO: 737661 - DNA, 20 bp, mouse
gagttcgagagggatcatgg

SEQ ID NO: 737662 - DNA, 20 bp, mouse
gaagctgctgggtccctgcc

SEQ ID NO: 737663 - DNA, 20 bp, mouse
gagccgacggggcgccccgg

SEQ ID NO: 737664 - DNA, 20 bp, mouse
gcccccccggggcgccccgt

SEQ ID NO: 737665 - DNA, 20 bp, mouse
ggacacacccggagagagcc

SEQ ID NO: 737666 - DNA, 20 bp, mouse
ggacaggagagggatctatt

SEQ ID NO: 737667 - DNA, 20 bp, mouse
ggaacttgcagtatgtaaag

SEQ ID NO: 737668 - DNA, 20 bp, mouse
gcacagcaccatctcatggc

SEQ ID NO: 737669 - DNA, 20 bp, mouse
gcctgatgacactgaaatgc

SEQ ID NO: 737670 - DNA, 20 bp, mouse
gtcacttgcaaacacagcta

SEQ ID NO: 737671 - DNA, 20 bp, mouse
gtagctattaaattactaag

SEQ ID NO: 737672 - DNA, 20 bp, mouse
ggacctcaaccttcaatttt

SEQ ID NO: 737673 - DNA, 20 bp, mouse
ggtttactttcgggtttcaa

SEQ ID NO: 737674 - DNA, 20 bp, mouse
gttatataggattaggaaac

SEQ ID NO: 737675 - DNA, 20 bp, mouse
ggtcttgacgatagttacct

SEQ ID NO: 737676 - DNA, 20 bp, mouse
gtggaaggatgggacggtta

SEQ ID NO: 737677 - DNA, 20 bp, mouse
gttaacctctgtcccaggaa

SEQ ID NO: 737678 - DNA, 20 bp, mouse
gccaggaatggcagcgacca

SEQ ID NO: 737679 - DNA, 20 bp, mouse
gccgcgggggacgggaacac

SEQ ID NO: 737680 - DNA, 20 bp, mouse
gttcaaagtcagagcctgga

SEQ ID NO: 737681 - DNA, 20 bp, mouse
gtagggaatggggacacctt

SEQ ID NO: 737682 - DNA, 20 bp, mouse
gagtcagagcctggaaggat

SEQ ID NO: 737683 - DNA, 20 bp, mouse
gcccccggcagcgatcgatg

SEQ ID NO: 737684 - DNA, 20 bp, mouse
gatgggacggttagggaatg

SEQ ID NO: 737685 - DNA, 20 bp, mouse
gggatgggggcctaacagct

SEQ ID NO: 737686 - DNA, 20 bp, mouse
gcgcgcagatcggaagaggg

SEQ ID NO: 737687 - DNA, 20 bp, mouse
gtccgcgagaggctcacagg

SEQ ID NO: 737688 - DNA, 20 bp, mouse
gccacgggcgcctgcggcgt

SEQ ID NO: 737689 - DNA, 20 bp, mouse
ggggcgcgcagatcggaaga

SEQ ID NO: 737690 - DNA, 20 bp, mouse
ggggctcctgcctctcgtgg

SEQ ID NO: 737691 - DNA, 20 bp, mouse
gcccccagggctcagacaga

SEQ ID NO: 737692 - DNA, 20 bp, mouse
gaggcaggagcccacgccgc

SEQ ID NO: 737693 - DNA, 20 bp, mouse
ggctgcgcggtggtgctgaa

SEQ ID NO: 737694 - DNA, 20 bp, mouse
gcgcaggcgcccgtggagcg

SEQ ID NO: 737695 - DNA, 20 bp, mouse
gaggctcacaggtggctgcg

SEQ ID NO: 737696 - DNA, 20 bp, mouse
gagcgccgcgccctgggccg

SEQ ID NO: 737697 - DNA, 20 bp, mouse
gcgtgcgtggggctcgccgt

SEQ ID NO: 737698 - DNA, 20 bp, mouse
ggggccggggggaaccctgg

SEQ ID NO: 737699 - DNA, 20 bp, mouse
ggcagggcgggacactcctg

SEQ ID NO: 737700 - DNA, 20 bp, mouse
gggcgagccccacgcacgga

SEQ ID NO: 737701 - DNA, 20 bp, mouse
gtctccgccagggttccccc

SEQ ID NO: 737702 - DNA, 20 bp, mouse
ggaccgccgcaaactgaggg

SEQ ID NO: 737703 - DNA, 20 bp, mouse
gggcgtgcagctctccgcca

SEQ ID NO: 737704 - DNA, 20 bp, mouse
gcctgggccggggggaaccc

SEQ ID NO: 737705 - DNA, 20 bp, mouse
ggacccccctcagtttgcgg

SEQ ID NO: 737706 - DNA, 20 bp, mouse
gtggaactgcgtcctccctg

SEQ ID NO: 737707 - DNA, 20 bp, mouse
ggctccccgtgcaccaaggt

SEQ ID NO: 737708 - DNA, 20 bp, mouse
gcgtcctccctgaggcatcc

SEQ ID NO: 737709 - DNA, 20 bp, mouse
ggggtaagacagctgtacac

SEQ ID NO: 737710 - DNA, 20 bp, mouse
gccactgtgctgcgcgttgg

SEQ ID NO: 737711 - DNA, 20 bp, mouse
gctccctgaggcatccaggt

SEQ ID NO: 737712 - DNA, 20 bp, mouse
ggtcccaacctggatgcctc

SEQ ID NO: 737713 - DNA, 20 bp, mouse
gagtggaatggtccagagtg

SEQ ID NO: 737714 - DNA, 20 bp, mouse
ggccctgaggtgggacttag

SEQ ID NO: 737715 - DNA, 20 bp, mouse
ggggcctcacggagtgaagt

SEQ ID NO: 737716 - DNA, 20 bp, mouse
gcttgcctggcttgagtcca

SEQ ID NO: 737717 - DNA, 20 bp, mouse
gcccgcccggaggacccggg

SEQ ID NO: 737718 - DNA, 20 bp, mouse
gcccccgcggggggtcgcgg

SEQ ID NO: 737719 - DNA, 20 bp, mouse
gtggccttggagccgactgt

SEQ ID NO: 737720 - DNA, 20 bp, mouse
gaagcccgcccggaggaccc

SEQ ID NO: 737721 - DNA, 20 bp, mouse
ggctgagaggaggccttggg

SEQ ID NO: 737722 - DNA, 20 bp, mouse
ggggcgggacaagcacctgc

SEQ ID NO: 737723 - DNA, 20 bp, mouse
gtccctggtcttccttgagt

SEQ ID NO: 737724 - DNA, 20 bp, mouse
ggcctcccgggtcctccggg

SEQ ID NO: 737725 - DNA, 20 bp, mouse
gcggcctccgcgaccccccg

SEQ ID NO: 737726 - DNA, 20 bp, mouse
ggccttggggacaaccaatg

SEQ ID NO: 737727 - DNA, 20 bp, mouse
gcgcgcggtgcctagaaaga

SEQ ID NO: 737728 - DNA, 20 bp, mouse
ggacccctcatccacttccc

SEQ ID NO: 737729 - DNA, 20 bp, mouse
ggacacctggcaaccttcct

SEQ ID NO: 737730 - DNA, 20 bp, mouse
gacggcaggagggtgccttg

SEQ ID NO: 737731 - DNA, 20 bp, mouse
ggtggccggggatgccctag

SEQ ID NO: 737732 - DNA, 20 bp, mouse
gttcctgggaagtggatgag

SEQ ID NO: 737733 - DNA, 20 bp, mouse
gagaaggcgaccacagcctt

SEQ ID NO: 737734 - DNA, 20 bp, mouse
gcgaaagagctcgcccccat

SEQ ID NO: 737735 - DNA, 20 bp, mouse
gccggggatgccctagtggg

SEQ ID NO: 737736 - DNA, 20 bp, mouse
ggtctcacatgaagcaatga

SEQ ID NO: 737737 - DNA, 20 bp, mouse
ggtcacccggcaacagtccc

SEQ ID NO: 737738 - DNA, 20 bp, mouse
gtgcgagagaccaccagagg

SEQ ID NO: 737739 - DNA, 20 bp, mouse
gcttgaggagttctactctc

SEQ ID NO: 737740 - DNA, 20 bp, mouse
ggaatgcgagagaccaccag

SEQ ID NO: 737741 - DNA, 20 bp, mouse
ggagtcccttaaccactcag

SEQ ID NO: 737742 - DNA, 20 bp, mouse
gaaagccaatgagaggctca

SEQ ID NO: 737743 - DNA, 20 bp, mouse
gacccggcaacagtcccagg

SEQ ID NO: 737744 - DNA, 20 bp, mouse
gagtttcccctgagtggtta

SEQ ID NO: 737745 - DNA, 20 bp, mouse
gatctactgaccacctctgg

SEQ ID NO: 737746 - DNA, 20 bp, mouse
gagtgcgcggtagagcgatg

SEQ ID NO: 737747 - DNA, 20 bp, mouse
gaaccctgcaagcagttgtg

SEQ ID NO: 737748 - DNA, 20 bp, mouse
gaagctggtggaaagagtag

SEQ ID NO: 737749 - DNA, 20 bp, mouse
gccccactccccagcctaca

SEQ ID NO: 737750 - DNA, 20 bp, mouse
gcacaggagtggtcgcgcgg

SEQ ID NO: 737751 - DNA, 20 bp, mouse
gggcagagttgggcaaggga

SEQ ID NO: 737752 - DNA, 20 bp, mouse
gtatatctaggaggggccac

SEQ ID NO: 737753 - DNA, 20 bp, mouse
gtccaggcagggaacaaccc

SEQ ID NO: 737754 - DNA, 20 bp, mouse
ggatacacagtctgttccgg

SEQ ID NO: 737755 - DNA, 20 bp, mouse
gttgatggctggtgtcgcta

SEQ ID NO: 737756 - DNA, 20 bp, mouse
gcccaccccctctgacgtgg

SEQ ID NO: 737757 - DNA, 20 bp, mouse
gtgccctggggaagttctta

SEQ ID NO: 737758 - DNA, 20 bp, mouse
ggacgtggagggtgattatg

SEQ ID NO: 737759 - DNA, 20 bp, mouse
gtcaccctccacgtcagagg

SEQ ID NO: 737760 - DNA, 20 bp, mouse
gcaagcgttaggagggattt

SEQ ID NO: 737761 - DNA, 20 bp, mouse
gcggttgattttatctcact

SEQ ID NO: 737762 - DNA, 20 bp, mouse
gataccctaagaacttcccc

SEQ ID NO: 737763 - DNA, 20 bp, mouse
ggtcggtcagccttgccctg

SEQ ID NO: 737764 - DNA, 20 bp, mouse
ggaagaagcaagcgttagga

SEQ ID NO: 737765 - DNA, 20 bp, mouse
gagagactgaactggctaag

SEQ ID NO: 737766 - DNA, 20 bp, mouse
gtcctcaggggaacggggtg

SEQ ID NO: 737767 - DNA, 20 bp, mouse
gtatgggtcaggatcctcag

SEQ ID NO: 737768 - DNA, 20 bp, mouse
gagagcttggaagactgcta

SEQ ID NO: 737769 - DNA, 20 bp, mouse
gagaagccctaggtgcgata

SEQ ID NO: 737770 - DNA, 20 bp, mouse
gtaggggagcgggcaccaag

SEQ ID NO: 737771 - DNA, 20 bp, mouse
gcaggatcctcaggggaacg

SEQ ID NO: 737772 - DNA, 20 bp, mouse
gcgctcccctatcgcaccta

SEQ ID NO: 737773 - DNA, 20 bp, mouse
gtggaagactgctatgggtc

SEQ ID NO: 737774 - DNA, 20 bp, mouse
gaccccaccccgttcccctg

SEQ ID NO: 737775 - DNA, 20 bp, mouse
gtctgcaggaagttgggtgc

SEQ ID NO: 737776 - DNA, 20 bp, mouse
gcgcctctcgggaggggcga

SEQ ID NO: 737777 - DNA, 20 bp, mouse
ggggaagcgggggataattg

SEQ ID NO: 737778 - DNA, 20 bp, mouse
gccgaagcgcctctcgggag

SEQ ID NO: 737779 - DNA, 20 bp, mouse
gcccacttctaggaaaactt

SEQ ID NO: 737780 - DNA, 20 bp, mouse
gatgctggggaggggaagcg

SEQ ID NO: 737781 - DNA, 20 bp, mouse
ggccaggagggggtaaaaga

SEQ ID NO: 737782 - DNA, 20 bp, mouse
gggagggagagctgtcggtg

SEQ ID NO: 737783 - DNA, 20 bp, mouse
ggataattgtggccaggagg

SEQ ID NO: 737784 - DNA, 20 bp, mouse
gcggaatgacaattggagcg

SEQ ID NO: 737785 - DNA, 20 bp, mouse
gggaggggcgaggggatgct

SEQ ID NO: 737786 - DNA, 20 bp, mouse
gcctctgcggggcggaagtg

SEQ ID NO: 737787 - DNA, 20 bp, mouse
gtgactcggccaaggggagg

SEQ ID NO: 737788 - DNA, 20 bp, mouse
gcccgtaagccctagatggg

SEQ ID NO: 737789 - DNA, 20 bp, mouse
gacccccgtaagccctagat

SEQ ID NO: 737790 - DNA, 20 bp, mouse
gtaaacgcctgactcggcca

SEQ ID NO: 737791 - DNA, 20 bp, mouse
gaacacccggggcaagatgg

SEQ ID NO: 737792 - DNA, 20 bp, mouse
ggggccggggcgggcacttc

SEQ ID NO: 737793 - DNA, 20 bp, mouse
ggacggagggaggctatctg

SEQ ID NO: 737794 - DNA, 20 bp, mouse
gtagggcttacgggggtggg

SEQ ID NO: 737795 - DNA, 20 bp, mouse
gcatgggcaaagaagcagtg

SEQ ID NO: 737796 - DNA, 20 bp, mouse
gggctggccgggctctgcta

SEQ ID NO: 737797 - DNA, 20 bp, mouse
gagggcggggcgctaagggg

SEQ ID NO: 737798 - DNA, 20 bp, mouse
gccccgccctacgcccccgt

SEQ ID NO: 737799 - DNA, 20 bp, mouse
ggcgtagggcggggcgctaa

SEQ ID NO: 737800 - DNA, 20 bp, mouse
gcgggggtggaatgattcac

SEQ ID NO: 737801 - DNA, 20 bp, mouse
ggagcccggccagcccacgg

SEQ ID NO: 737802 - DNA, 20 bp, mouse
ggggcgggactgtcgcttaa

SEQ ID NO: 737803 - DNA, 20 bp, mouse
gtgcccttaggccacttcct

SEQ ID NO: 737804 - DNA, 20 bp, mouse
gtggaccggccgactggagc

SEQ ID NO: 737805 - DNA, 20 bp, mouse
ggcagagcccggccagccca

SEQ ID NO: 737806 - DNA, 20 bp, mouse
ggggaaggggcgagaaacaa

SEQ ID NO: 737807 - DNA, 20 bp, mouse
gtgacaggacaggagaaatt

SEQ ID NO: 737808 - DNA, 20 bp, mouse
gggctgcagaatagagcggg

SEQ ID NO: 737809 - DNA, 20 bp, mouse
gatgtcatagcagaggagga

SEQ ID NO: 737810 - DNA, 20 bp, mouse
gtagcctgaggtatgtaaga

SEQ ID NO: 737811 - DNA, 20 bp, mouse
gtactccaggctgacactga

SEQ ID NO: 737812 - DNA, 20 bp, mouse
ggcagaatagagcgggaggc

SEQ ID NO: 737813 - DNA, 20 bp, mouse
ggggccttcttacatacctc

SEQ ID NO: 737814 - DNA, 20 bp, mouse
gaagactgctagttttaaag

SEQ ID NO: 737815 - DNA, 20 bp, mouse
ggtcaagtatgtcatagcag

SEQ ID NO: 737816 - DNA, 20 bp, mouse
gaggccgagggccgcgtctc

SEQ ID NO: 737817 - DNA, 20 bp, mouse
gcacatgaacaagggggcaa

SEQ ID NO: 737818 - DNA, 20 bp, mouse
ggcgctgctgaaatcgtcac

SEQ ID NO: 737819 - DNA, 20 bp, mouse
gggggcggagccaagaaccg

SEQ ID NO: 737820 - DNA, 20 bp, mouse
gcagtccagcctgcgggttg

SEQ ID NO: 737821 - DNA, 20 bp, mouse
ggcccccttgttcatgtgga

SEQ ID NO: 737822 - DNA, 20 bp, mouse
gtaaaaagaaacaagcgcag

SEQ ID NO: 737823 - DNA, 20 bp, mouse
gctgtcaagtgcactgagct

SEQ ID NO: 737824 - DNA, 20 bp, mouse
ggttctgagaaaacgtctaa

SEQ ID NO: 737825 - DNA, 20 bp, mouse
gctgaaatcgtcacgggttg

SEQ ID NO: 737826 - DNA, 20 bp, mouse
gaacacatcctcagaccact

SEQ ID NO: 737827 - DNA, 20 bp, mouse
gacaggtggcacagatggga

SEQ ID NO: 737828 - DNA, 20 bp, mouse
gtaactcggcaacattaggc

SEQ ID NO: 737829 - DNA, 20 bp, mouse
gggcaggttacgtaatcctc

SEQ ID NO: 737830 - DNA, 20 bp, mouse
ggcactgccacattttaact

SEQ ID NO: 737831 - DNA, 20 bp, mouse
gtgacgacaggtggcacaga

SEQ ID NO: 737832 - DNA, 20 bp, mouse
gccaactagagatgatatta

SEQ ID NO: 737833 - DNA, 20 bp, mouse
gcacctgtcgtcagtaaatg

SEQ ID NO: 737834 - DNA, 20 bp, mouse
gctatgctaactattatcac

SEQ ID NO: 737835 - DNA, 20 bp, mouse
gcctggtgacagcctgcacc

SEQ ID NO: 737836 - DNA, 20 bp, mouse
ggctgcccaaagaaccaatg

SEQ ID NO: 737837 - DNA, 20 bp, mouse
gaactaggagacgaatcctg

SEQ ID NO: 737838 - DNA, 20 bp, mouse
ggaaccaatggggtccgtgc

SEQ ID NO: 737839 - DNA, 20 bp, mouse
gctacaggggagaaccccga

SEQ ID NO: 737840 - DNA, 20 bp, mouse
ggagaaccccgatggatcta

SEQ ID NO: 737841 - DNA, 20 bp, mouse
gttctcagaaacggggaact

SEQ ID NO: 737842 - DNA, 20 bp, mouse
gtaagtctgtacctcccact

SEQ ID NO: 737843 - DNA, 20 bp, mouse
gcgaatcctggggctctctg

SEQ ID NO: 737844 - DNA, 20 bp, mouse
gcatccagcacggaccccat

SEQ ID NO: 737845 - DNA, 20 bp, mouse
gtagaagagttttaccaaag

SEQ ID NO: 737846 - DNA, 20 bp, mouse
gtggctgcacgtagtcaatt

SEQ ID NO: 737847 - DNA, 20 bp, mouse
gtccggagcccagactgata

SEQ ID NO: 737848 - DNA, 20 bp, mouse
gccttttcccttatcagtct

SEQ ID NO: 737849 - DNA, 20 bp, mouse
gtcagactcttttaatcaaa

SEQ ID NO: 737850 - DNA, 20 bp, mouse
gaaagagtctgaaagtgaaa

SEQ ID NO: 737851 - DNA, 20 bp, mouse
gcacaaagcaaatgggggct

SEQ ID NO: 737852 - DNA, 20 bp, mouse
ggatgcagcccagtctctga

SEQ ID NO: 737853 - DNA, 20 bp, mouse
ggggagtagccatcagagac

SEQ ID NO: 737854 - DNA, 20 bp, mouse
gggctccggacctaatgttt

SEQ ID NO: 737855 - DNA, 20 bp, mouse
gtgggctgcatccaagcacc

SEQ ID NO: 737856 - DNA, 20 bp, mouse
ggagctgcgcgaaaaggagg

SEQ ID NO: 737857 - DNA, 20 bp, mouse
ggcccagcccggattgcaaa

SEQ ID NO: 737858 - DNA, 20 bp, mouse
ggggccgcggcgaggcgcac

SEQ ID NO: 737859 - DNA, 20 bp, mouse
gctgcgcgaaaaggaggcgg

SEQ ID NO: 737860 - DNA, 20 bp, mouse
gtcgccgcgccggggtaatt

SEQ ID NO: 737861 - DNA, 20 bp, mouse
gcctcccccgatggctggag

SEQ ID NO: 737862 - DNA, 20 bp, mouse
gctccagcggcctcccccga

SEQ ID NO: 737863 - DNA, 20 bp, mouse
ggccggagagctgcgcgaaa

SEQ ID NO: 737864 - DNA, 20 bp, mouse
gccggcgcggcgcgccgcga

SEQ ID NO: 737865 - DNA, 20 bp, mouse
gcgccggggtaatttggaac

SEQ ID NO: 737866 - DNA, 20 bp, mouse
gagtcccgggaaccaggcgg

SEQ ID NO: 737867 - DNA, 20 bp, mouse
gcccggccggagtctgtaaa

SEQ ID NO: 737868 - DNA, 20 bp, mouse
gcagtctgggcaaagcgcac

SEQ ID NO: 737869 - DNA, 20 bp, mouse
gcgggccaaaggcaggcttt

SEQ ID NO: 737870 - DNA, 20 bp, mouse
gtaggaaggcgggtgcgctt

SEQ ID NO: 737871 - DNA, 20 bp, mouse
gtgcgcccccgcctggttcc

SEQ ID NO: 737872 - DNA, 20 bp, mouse
gctctactggccaaactcct

SEQ ID NO: 737873 - DNA, 20 bp, mouse
gctagaggtcccctgaataa

SEQ ID NO: 737874 - DNA, 20 bp, mouse
gagggacgggcggggcgcaa

SEQ ID NO: 737875 - DNA, 20 bp, mouse
gggcccccctttacagactc

SEQ ID NO: 737876 - DNA, 20 bp, mouse
gcaaatgcccagttactcag

SEQ ID NO: 737877 - DNA, 20 bp, mouse
gagaaaaggagagacctctg

SEQ ID NO: 737878 - DNA, 20 bp, mouse
gtccacagttgaaataatgc

SEQ ID NO: 737879 - DNA, 20 bp, mouse
gagaggggggcaaaatgaca

SEQ ID NO: 737880 - DNA, 20 bp, mouse
gtcccaacaaagcagatttt

SEQ ID NO: 737881 - DNA, 20 bp, mouse
gggaagaactcactcagtta

SEQ ID NO: 737882 - DNA, 20 bp, mouse
gcttcacaggatgtaataat

SEQ ID NO: 737883 - DNA, 20 bp, mouse
gtccagcattatttcaactg

SEQ ID NO: 737884 - DNA, 20 bp, mouse
gtgagtgagttcttccctag

SEQ ID NO: 737885 - DNA, 20 bp, mouse
gctacattcaatcttccatt

SEQ ID NO: 737886 - DNA, 20 bp, mouse
gcgggcgagtaccaggtgca

SEQ ID NO: 737887 - DNA, 20 bp, mouse
gcaaagcagaacaaatgggg

SEQ ID NO: 737888 - DNA, 20 bp, mouse
gtccgtgtggccagactgct

SEQ ID NO: 737889 - DNA, 20 bp, mouse
gcaccaagaaaggcaatgtg

SEQ ID NO: 737890 - DNA, 20 bp, mouse
ggtacaaagcagaacaaatg

SEQ ID NO: 737891 - DNA, 20 bp, mouse
gaggaaatcactgttttcgc

SEQ ID NO: 737892 - DNA, 20 bp, mouse
ggaggaagaaagttcttctc

SEQ ID NO: 737893 - DNA, 20 bp, mouse
ggtagtctggagccagggct

SEQ ID NO: 737894 - DNA, 20 bp, mouse
gtgtacgggggccccagctg

SEQ ID NO: 737895 - DNA, 20 bp, mouse
ggtcaggtattcctcagctg

SEQ ID NO: 737896 - DNA, 20 bp, mouse
gacccgccccgcccacggga

SEQ ID NO: 737897 - DNA, 20 bp, mouse
gcggggcgaggcctcccttt

SEQ ID NO: 737898 - DNA, 20 bp, mouse
ggtgcagtgcgccaaaaggg

SEQ ID NO: 737899 - DNA, 20 bp, mouse
gcgccccgcccacgggacgg

SEQ ID NO: 737900 - DNA, 20 bp, mouse
gccaccgccgtcccgtgggc

SEQ ID NO: 737901 - DNA, 20 bp, mouse
gtactcggatgctccacgat

SEQ ID NO: 737902 - DNA, 20 bp, mouse
ggtggccaccgccgtcccgt

SEQ ID NO: 737903 - DNA, 20 bp, mouse
gtacccatttgcatagtttg

SEQ ID NO: 737904 - DNA, 20 bp, mouse
gggagcatccgagtaggcga

SEQ ID NO: 737905 - DNA, 20 bp, mouse
gaaaattcaggaacgttctt

SEQ ID NO: 737906 - DNA, 20 bp, mouse
gaccctggagcagccgggta

SEQ ID NO: 737907 - DNA, 20 bp, mouse
ggagcggcgggcgcgaatgg

SEQ ID NO: 737908 - DNA, 20 bp, mouse
ggagcagtgggatctggacg

SEQ ID NO: 737909 - DNA, 20 bp, mouse
ggccctacccggctgctcca

SEQ ID NO: 737910 - DNA, 20 bp, mouse
ggggcctggcgagcaggggg

SEQ ID NO: 737911 - DNA, 20 bp, mouse
gggcgcgaatggcggagcag

SEQ ID NO: 737912 - DNA, 20 bp, mouse
ggcggggcctggcgagcagg

SEQ ID NO: 737913 - DNA, 20 bp, mouse
ggcgagccgcggcaggtgag

SEQ ID NO: 737914 - DNA, 20 bp, mouse
gggtgagcggcgggcgcgaa

SEQ ID NO: 737915 - DNA, 20 bp, mouse
ggagtgcctccgccgcctgg

SEQ ID NO: 737916 - DNA, 20 bp, mouse
gtggccaaggagagaacttc

SEQ ID NO: 737917 - DNA, 20 bp, mouse
gcgcgcccgccttccaggac

SEQ ID NO: 737918 - DNA, 20 bp, mouse
ggacgggactccatgctcat

SEQ ID NO: 737919 - DNA, 20 bp, mouse
ggacccgcctattgctcgtt

SEQ ID NO: 737920 - DNA, 20 bp, mouse
ggctctctctccagcaagca

SEQ ID NO: 737921 - DNA, 20 bp, mouse
gagccgggccggcccatcgg

SEQ ID NO: 737922 - DNA, 20 bp, mouse
gtgctagcggggcagctcga

SEQ ID NO: 737923 - DNA, 20 bp, mouse
gcgtggagctggaacaagtg

SEQ ID NO: 737924 - DNA, 20 bp, mouse
ggtgttgggtcgaatctcca

SEQ ID NO: 737925 - DNA, 20 bp, mouse
ggggggtcggtgaaggtgag

SEQ ID NO: 737926 - DNA, 20 bp, mouse
gcaggcgaggccccggccta

SEQ ID NO: 737927 - DNA, 20 bp, mouse
gcggactccgccataggccg

SEQ ID NO: 737928 - DNA, 20 bp, mouse
gtgcccggccggccgggaac

SEQ ID NO: 737929 - DNA, 20 bp, mouse
ggcaggctcgaaggtgaaag

SEQ ID NO: 737930 - DNA, 20 bp, mouse
gagcgggcaggtgatggcgc

SEQ ID NO: 737931 - DNA, 20 bp, mouse
gccgccgcggactccgccat

SEQ ID NO: 737932 - DNA, 20 bp, mouse
ggcgaggccccggcctatgg

SEQ ID NO: 737933 - DNA, 20 bp, mouse
ggaactggggctcttcgcca

SEQ ID NO: 737934 - DNA, 20 bp, mouse
ggagtgccgagtgacagggt

SEQ ID NO: 737935 - DNA, 20 bp, mouse
gtgactcaaccggggatccg

SEQ ID NO: 737936 - DNA, 20 bp, mouse
gggtcccagtgccggcgggg

SEQ ID NO: 737937 - DNA, 20 bp, mouse
gccggcggggcgggccagta

SEQ ID NO: 737938 - DNA, 20 bp, mouse
gcccggcacgcggcacagga

SEQ ID NO: 737939 - DNA, 20 bp, mouse
gggaccagctggccttaaag

SEQ ID NO: 737940 - DNA, 20 bp, mouse
gcggagagccagccccctac

SEQ ID NO: 737941 - DNA, 20 bp, mouse
gaccctgcgagctcccagtc

SEQ ID NO: 737942 - DNA, 20 bp, mouse
gcggtctcagagctgcggga

SEQ ID NO: 737943 - DNA, 20 bp, mouse
gccggactccacctcccagg

SEQ ID NO: 737944 - DNA, 20 bp, mouse
ggctctccgcgtagcctcct

SEQ ID NO: 737945 - DNA, 20 bp, mouse
gggcccgccccgccggcact

SEQ ID NO: 737946 - DNA, 20 bp, mouse
gatgggcggggctggacgaa

SEQ ID NO: 737947 - DNA, 20 bp, mouse
gtgtgctggtgaagaggcaa

SEQ ID NO: 737948 - DNA, 20 bp, mouse
ggggaggagctcctggcgat

SEQ ID NO: 737949 - DNA, 20 bp, mouse
gaggagctcctggcgatggg

SEQ ID NO: 737950 - DNA, 20 bp, mouse
gtacgaagaaggagtgggcg

SEQ ID NO: 737951 - DNA, 20 bp, mouse
gaagggtcttctgccaccga

SEQ ID NO: 737952 - DNA, 20 bp, mouse
gctcctgccctgaggagtgg

SEQ ID NO: 737953 - DNA, 20 bp, mouse
gcttctgccaccgatggcct

SEQ ID NO: 737954 - DNA, 20 bp, mouse
gaaatcttgtgctggtgaag

SEQ ID NO: 737955 - DNA, 20 bp, mouse
gtccatgccaccactcctca

SEQ ID NO: 737956 - DNA, 20 bp, mouse
gagcaatgcgtaagcaggaa

SEQ ID NO: 737957 - DNA, 20 bp, mouse
ggcagggttaggaagtcctc

SEQ ID NO: 737958 - DNA, 20 bp, mouse
gtcttgtggaaatgaacttc

SEQ ID NO: 737959 - DNA, 20 bp, mouse
gtgccaattctgtttaagaa

SEQ ID NO: 737960 - DNA, 20 bp, mouse
gttgcatgtggacaccttta

SEQ ID NO: 737961 - DNA, 20 bp, mouse
ggttagagcaatgcgtaagc

SEQ ID NO: 737962 - DNA, 20 bp, mouse
gtggatctcccgaagtcttg

SEQ ID NO: 737963 - DNA, 20 bp, mouse
gacaatctgaccaaagagtt

SEQ ID NO: 737964 - DNA, 20 bp, mouse
ggttcatttccacaagactt

SEQ ID NO: 737965 - DNA, 20 bp, mouse
gagagtcttaataagtataa

SEQ ID NO: 737966 - DNA, 20 bp, mouse
gtccggccggagcaagtctc

SEQ ID NO: 737967 - DNA, 20 bp, mouse
gcctactcaaagaggctcca

SEQ ID NO: 737968 - DNA, 20 bp, mouse
gggccggaagtggtaatctc

SEQ ID NO: 737969 - DNA, 20 bp, mouse
gtatgggcgggacaactcag

SEQ ID NO: 737970 - DNA, 20 bp, mouse
gccagggctcatgtgcaagg

SEQ ID NO: 737971 - DNA, 20 bp, mouse
gaggggcggagcttgagccg

SEQ ID NO: 737972 - DNA, 20 bp, mouse
gccaataaagtgcccgccca

SEQ ID NO: 737973 - DNA, 20 bp, mouse
ggagaacccgagacttgctc

SEQ ID NO: 737974 - DNA, 20 bp, mouse
ggagcctctttgagtagggg

SEQ ID NO: 737975 - DNA, 20 bp, mouse
gatgtgcaaggcggaagttc

SEQ ID NO: 737976 - DNA, 20 bp, mouse
gggcggggataggaacggga

SEQ ID NO: 737977 - DNA, 20 bp, mouse
gggcggggcggggataggaa

SEQ ID NO: 737978 - DNA, 20 bp, mouse
gaggagaggctgaaagcgga

SEQ ID NO: 737979 - DNA, 20 bp, mouse
ggataggaacgggacggagg

SEQ ID NO: 737980 - DNA, 20 bp, mouse
gcgggagtcctgggcggggc

SEQ ID NO: 737981 - DNA, 20 bp, mouse
gaaagcggagggggagttag

SEQ ID NO: 737982 - DNA, 20 bp, mouse
gggcactctgggcgctgccg

SEQ ID NO: 737983 - DNA, 20 bp, mouse
gcctgggcggagctccgcgc

SEQ ID NO: 737984 - DNA, 20 bp, mouse
gaaggagtcctgggcaagca

SEQ ID NO: 737985 - DNA, 20 bp, mouse
gagctccgcgcgggagtcct

SEQ ID NO: 737986 - DNA, 20 bp, mouse
gtggaccctgcgctgcaaat

SEQ ID NO: 737987 - DNA, 20 bp, mouse
gggtaggcctgtagccacta

SEQ ID NO: 737988 - DNA, 20 bp, mouse
gggacactgccagtagtagg

SEQ ID NO: 737989 - DNA, 20 bp, mouse
ggagccaatcagaattgggt

SEQ ID NO: 737990 - DNA, 20 bp, mouse
gccaagagccaatcagaatt

SEQ ID NO: 737991 - DNA, 20 bp, mouse
gggtccaggccacttatcta

SEQ ID NO: 737992 - DNA, 20 bp, mouse
gtgctgatcgaggtcgtcag

SEQ ID NO: 737993 - DNA, 20 bp, mouse
gctaactgcttgcaggtcct

SEQ ID NO: 737994 - DNA, 20 bp, mouse
gtgctccagggtttggccga

SEQ ID NO: 737995 - DNA, 20 bp, mouse
gccagggtttggccgagggg

SEQ ID NO: 737996 - DNA, 20 bp, mouse
ggacgtcagtgccacctcct

SEQ ID NO: 737997 - DNA, 20 bp, mouse
gtgacgtcaagctccgaact

SEQ ID NO: 737998 - DNA, 20 bp, mouse
ggctcccggctgaggcgcgc

SEQ ID NO: 737999 - DNA, 20 bp, mouse
ggcgccggcgctcccggctg

SEQ ID NO: 738000 - DNA, 20 bp, mouse
gtaactactagcagcccagg

SEQ ID NO: 738001 - DNA, 20 bp, mouse
gcgcgcggctctccgagggg

SEQ ID NO: 738002 - DNA, 20 bp, mouse
gtcaagctccgaactgggac

SEQ ID NO: 738003 - DNA, 20 bp, mouse
ggactccagagctagggaac

SEQ ID NO: 738004 - DNA, 20 bp, mouse
gagcgaagaaaactcacccc

SEQ ID NO: 738005 - DNA, 20 bp, mouse
gcgagccagcgcgcctcagc

SEQ ID NO: 738006 - DNA, 20 bp, mouse
ggaggctgagggctggttga

SEQ ID NO: 738007 - DNA, 20 bp, mouse
gtgggcgcggttggggggaa

SEQ ID NO: 738008 - DNA, 20 bp, mouse
gtcagagtaacactagacgg

SEQ ID NO: 738009 - DNA, 20 bp, mouse
gcccccagccggactctgat

SEQ ID NO: 738010 - DNA, 20 bp, mouse
gggtgcgtgcgtgaggagtg

SEQ ID NO: 738011 - DNA, 20 bp, mouse
gactctgattggctaaatac

SEQ ID NO: 738012 - DNA, 20 bp, mouse
gttactgagcaggcgcacgt

SEQ ID NO: 738013 - DNA, 20 bp, mouse
gagtgtggggccgaccagga

SEQ ID NO: 738014 - DNA, 20 bp, mouse
gagcaggctgaggagcctag

SEQ ID NO: 738015 - DNA, 20 bp, mouse
gcaggcgcacgttggagtgt

SEQ ID NO: 738016 - DNA, 20 bp, mouse
gaagggacgaaagtagttgg

SEQ ID NO: 738017 - DNA, 20 bp, mouse
gagagtggaaaacgcgtccc

SEQ ID NO: 738018 - DNA, 20 bp, mouse
ggggaagggacgaaagtagt

SEQ ID NO: 738019 - DNA, 20 bp, mouse
gccaggaagctaaggggccc

SEQ ID NO: 738020 - DNA, 20 bp, mouse
gtcttctgctagtggatgag

SEQ ID NO: 738021 - DNA, 20 bp, mouse
gatggcggactacatatccc

SEQ ID NO: 738022 - DNA, 20 bp, mouse
gtagtccgccataggactag

SEQ ID NO: 738023 - DNA, 20 bp, mouse
ggactagcggaaatcctgcc

SEQ ID NO: 738024 - DNA, 20 bp, mouse
gaggatttccgctagtccta

SEQ ID NO: 738025 - DNA, 20 bp, mouse
gctaagactggtcacagcgc

SEQ ID NO: 738026 - DNA, 20 bp, mouse
gaactcaggcaactagtgta

SEQ ID NO: 738027 - DNA, 20 bp, mouse
ggggccgaggggacacccga

SEQ ID NO: 738028 - DNA, 20 bp, mouse
gtctccagactggcaaactc

SEQ ID NO: 738029 - DNA, 20 bp, mouse
gcctctggctagagccgccc

SEQ ID NO: 738030 - DNA, 20 bp, mouse
gaccctgcctttctccagac

SEQ ID NO: 738031 - DNA, 20 bp, mouse
gacacgagccagtcggggtc

SEQ ID NO: 738032 - DNA, 20 bp, mouse
ggactaggagcgtaaggcct

SEQ ID NO: 738033 - DNA, 20 bp, mouse
gtgccagtctggagaaaggc

SEQ ID NO: 738034 - DNA, 20 bp, mouse
gctagccagaggcccgccct

SEQ ID NO: 738035 - DNA, 20 bp, mouse
gccgccctcgggtgtcccct

SEQ ID NO: 738036 - DNA, 20 bp, mouse
gaggagggccgaggtgggaa

SEQ ID NO: 738037 - DNA, 20 bp, mouse
ggacccttccatcagttagt

SEQ ID NO: 738038 - DNA, 20 bp, mouse
gagctgtagcgccaccccaa

SEQ ID NO: 738039 - DNA, 20 bp, mouse
gaaagctggctgggagaaaa

SEQ ID NO: 738040 - DNA, 20 bp, mouse
gactctgcaaagcaggttgc

SEQ ID NO: 738041 - DNA, 20 bp, mouse
gaactgatggaagggtcttt

SEQ ID NO: 738042 - DNA, 20 bp, mouse
gctaacctctgcccttaaac

SEQ ID NO: 738043 - DNA, 20 bp, mouse
gcaagggcgggttgactgtc

SEQ ID NO: 738044 - DNA, 20 bp, mouse
gctagtgctgtgttgggtga

SEQ ID NO: 738045 - DNA, 20 bp, mouse
gaagcctactaactgatgga

SEQ ID NO: 738046 - DNA, 20 bp, mouse
gccccttaaaggcccagcgt

SEQ ID NO: 738047 - DNA, 20 bp, mouse
gcccccgccacgccccttaa

SEQ ID NO: 738048 - DNA, 20 bp, mouse
gggaaattgcggaggactct

SEQ ID NO: 738049 - DNA, 20 bp, mouse
ggaaatcgctggcacctagg

SEQ ID NO: 738050 - DNA, 20 bp, mouse
gccacgcgggatgtaaagtc

SEQ ID NO: 738051 - DNA, 20 bp, mouse
gggcgtgcaggtgctctcaa

SEQ ID NO: 738052 - DNA, 20 bp, mouse
gggcacctaggcggaaaccc

SEQ ID NO: 738053 - DNA, 20 bp, mouse
ggggcctttaaggggcgtgg

SEQ ID NO: 738054 - DNA, 20 bp, mouse
gaccctggagacggaaattg

SEQ ID NO: 738055 - DNA, 20 bp, mouse
gggagagcgggcgaccgctg

SEQ ID NO: 738056 - DNA, 20 bp, mouse
gctgccccgcctgtcggcgt

SEQ ID NO: 738057 - DNA, 20 bp, mouse
gtggcggggcggccaggcgc

SEQ ID NO: 738058 - DNA, 20 bp, mouse
ggggcggccaggcgcgggac

SEQ ID NO: 738059 - DNA, 20 bp, mouse
gtacgcaggaccagagaggg

SEQ ID NO: 738060 - DNA, 20 bp, mouse
gtgtaagctgccccgcctgt

SEQ ID NO: 738061 - DNA, 20 bp, mouse
ggcaccgcgaggagcaggga

SEQ ID NO: 738062 - DNA, 20 bp, mouse
gtgcctacgcaggaccagag

SEQ ID NO: 738063 - DNA, 20 bp, mouse
gaggacttgaagtgagtgcc

SEQ ID NO: 738064 - DNA, 20 bp, mouse
gtggccgcgcggtgacgtgg

SEQ ID NO: 738065 - DNA, 20 bp, mouse
gacgtccccacgccgacagg

SEQ ID NO: 738066 - DNA, 20 bp, mouse
ggggctcagaacccgaagtc

SEQ ID NO: 738067 - DNA, 20 bp, mouse
gccagagagcgacgtcctgg

SEQ ID NO: 738068 - DNA, 20 bp, mouse
ggggtcgcactcccaatcgc

SEQ ID NO: 738069 - DNA, 20 bp, mouse
gcgccgcagctccgatcgcg

SEQ ID NO: 738070 - DNA, 20 bp, mouse
gcaggacaaggggtggatta

SEQ ID NO: 738071 - DNA, 20 bp, mouse
ggtcttgagccggggacaag

SEQ ID NO: 738072 - DNA, 20 bp, mouse
gtcgcactcccaatcgcagg

SEQ ID NO: 738073 - DNA, 20 bp, mouse
gtagagcgccccctgcgatt

SEQ ID NO: 738074 - DNA, 20 bp, mouse
gtctaggtcagcctcgcgat

SEQ ID NO: 738075 - DNA, 20 bp, mouse
ggcttcgcacggagcgtgag

SEQ ID NO: 738076 - DNA, 20 bp, mouse
ggggccctacgcgttctggg

SEQ ID NO: 738077 - DNA, 20 bp, mouse
gtctccgcccagaacgcgta

SEQ ID NO: 738078 - DNA, 20 bp, mouse
ggcggggccctacgcgttct

SEQ ID NO: 738079 - DNA, 20 bp, mouse
ggcgcagtggcggaaatcat

SEQ ID NO: 738080 - DNA, 20 bp, mouse
ggggcctgggcggcctgggt

SEQ ID NO: 738081 - DNA, 20 bp, mouse
ggggcggagaccttgcttcg

SEQ ID NO: 738082 - DNA, 20 bp, mouse
gaactctgcccaggacacgc

SEQ ID NO: 738083 - DNA, 20 bp, mouse
ggggtcacagggtcctggga

SEQ ID NO: 738084 - DNA, 20 bp, mouse
gggtggggtcacagggtcct

SEQ ID NO: 738085 - DNA, 20 bp, mouse
gcaatctcggcagctgctaa

SEQ ID NO: 738086 - DNA, 20 bp, mouse
ggtacctccctagtcaagtc

SEQ ID NO: 738087 - DNA, 20 bp, mouse
gcctccctagtcaagtctgg

SEQ ID NO: 738088 - DNA, 20 bp, mouse
gtctacgggctgaacatgaa

SEQ ID NO: 738089 - DNA, 20 bp, mouse
gcactgttaaattcggagga

SEQ ID NO: 738090 - DNA, 20 bp, mouse
gtctcctccagacttgacta

SEQ ID NO: 738091 - DNA, 20 bp, mouse
gactagggaggtacagcgtg

SEQ ID NO: 738092 - DNA, 20 bp, mouse
gagctcactgttaaattcgg

SEQ ID NO: 738093 - DNA, 20 bp, mouse
gaattcggaggagggtggag

SEQ ID NO: 738094 - DNA, 20 bp, mouse
gtgttaaattcggaggaggg

SEQ ID NO: 738095 - DNA, 20 bp, mouse
gtctggaggagaatgcccag

SEQ ID NO: 738096 - DNA, 20 bp, mouse
gcgctccggcggtgtgtccg

SEQ ID NO: 738097 - DNA, 20 bp, mouse
gggtgtgtccgtggtagagg

SEQ ID NO: 738098 - DNA, 20 bp, mouse
gggagggcggggaaccgcgt

SEQ ID NO: 738099 - DNA, 20 bp, mouse
gagggaggctcgaaagaggt

SEQ ID NO: 738100 - DNA, 20 bp, mouse
gggcgtgcgggctgacgcga

SEQ ID NO: 738101 - DNA, 20 bp, mouse
ggcggggcgcgggcgattcg

SEQ ID NO: 738102 - DNA, 20 bp, mouse
ggagccggcgacctgagagg

SEQ ID NO: 738103 - DNA, 20 bp, mouse
gggagagcggtaagacgcgc

SEQ ID NO: 738104 - DNA, 20 bp, mouse
gaggaggcgggcagggagcg

SEQ ID NO: 738105 - DNA, 20 bp, mouse
gtggagaggcgacgggaggg

SEQ ID NO: 738106 - DNA, 20 bp, mouse
gtggaagaggaagactaccg

SEQ ID NO: 738107 - DNA, 20 bp, mouse
gcagaatcaaggtgaagagt

SEQ ID NO: 738108 - DNA, 20 bp, mouse
ggattctgaagagtctgggt

SEQ ID NO: 738109 - DNA, 20 bp, mouse
ggggcctcaaagcacgagat

SEQ ID NO: 738110 - DNA, 20 bp, mouse
gggtgaagagttggaaacca

SEQ ID NO: 738111 - DNA, 20 bp, mouse
gtaaatcccacaaaggacgg

SEQ ID NO: 738112 - DNA, 20 bp, mouse
gatgtgacaccagtcagcaa

SEQ ID NO: 738113 - DNA, 20 bp, mouse
ggctatcacagtttgaactg

SEQ ID NO: 738114 - DNA, 20 bp, mouse
gcaaagcacgagattggctg

SEQ ID NO: 738115 - DNA, 20 bp, mouse
gtattatgatagctctacca

SEQ ID NO: 738116 - DNA, 20 bp, mouse
gacagcgcccggtgcgtccc

SEQ ID NO: 738117 - DNA, 20 bp, mouse
gccgggagctgacttttgga

SEQ ID NO: 738118 - DNA, 20 bp, mouse
gcacggatggcctcagcggg

SEQ ID NO: 738119 - DNA, 20 bp, mouse
gagggaggtgcagatttgca

SEQ ID NO: 738120 - DNA, 20 bp, mouse
gaccgcagccgtaggaggtg

SEQ ID NO: 738121 - DNA, 20 bp, mouse
gcccacacctcctacggctg

SEQ ID NO: 738122 - DNA, 20 bp, mouse
gagggagcctgggacgcacc

SEQ ID NO: 738123 - DNA, 20 bp, mouse
ggcgtcgacgtcataatccc

SEQ ID NO: 738124 - DNA, 20 bp, mouse
ggcgctcggagcttgcggct

SEQ ID NO: 738125 - DNA, 20 bp, mouse
gaggtggggggtcgttttgg

SEQ ID NO: 738126 - DNA, 20 bp, mouse
gaaagactctggaagaagat

SEQ ID NO: 738127 - DNA, 20 bp, mouse
gggtctcagacacttaagtg

SEQ ID NO: 738128 - DNA, 20 bp, mouse
gggttcgcctgggatctggg

SEQ ID NO: 738129 - DNA, 20 bp, mouse
ggggaggaggcaacgccgaa

SEQ ID NO: 738130 - DNA, 20 bp, mouse
gcccctccgccaaaatgcag

SEQ ID NO: 738131 - DNA, 20 bp, mouse
gggcgtggaagggactgagc

SEQ ID NO: 738132 - DNA, 20 bp, mouse
gagacacttaagtggggagg

SEQ ID NO: 738133 - DNA, 20 bp, mouse
gaacgccgaaaggcgtggaa

SEQ ID NO: 738134 - DNA, 20 bp, mouse
gcgcgcacactcacttccta

SEQ ID NO: 738135 - DNA, 20 bp, mouse
ggaaggatgcggggagtggt

SEQ ID NO: 738136 - DNA, 20 bp, mouse
gaaagcgcgcagaacgcggt

SEQ ID NO: 738137 - DNA, 20 bp, mouse
gagtcgttgctgagagcggg

SEQ ID NO: 738138 - DNA, 20 bp, mouse
gagccgctgccaccgatgat

SEQ ID NO: 738139 - DNA, 20 bp, mouse
gctccctgagtcacccacga

SEQ ID NO: 738140 - DNA, 20 bp, mouse
gcctcttcagcataaccaat

SEQ ID NO: 738141 - DNA, 20 bp, mouse
gggttatgctgaagagggcg

SEQ ID NO: 738142 - DNA, 20 bp, mouse
gcctgagtcacccacgacgg

SEQ ID NO: 738143 - DNA, 20 bp, mouse
gctcacagataagactgaat

SEQ ID NO: 738144 - DNA, 20 bp, mouse
ggggcggtgcacagcctgcg

SEQ ID NO: 738145 - DNA, 20 bp, mouse
gaaccaatcatcggtggcag

SEQ ID NO: 738146 - DNA, 20 bp, mouse
gttggggcggagcactgtga

SEQ ID NO: 738147 - DNA, 20 bp, mouse
ggggagcggaggctcaacca

SEQ ID NO: 738148 - DNA, 20 bp, mouse
gaccagggatggggcgactg

SEQ ID NO: 738149 - DNA, 20 bp, mouse
gtgcaggccccggggaggtt

SEQ ID NO: 738150 - DNA, 20 bp, mouse
gcccagctccggagcgctgg

SEQ ID NO: 738151 - DNA, 20 bp, mouse
gctccgccccaacctccccg

SEQ ID NO: 738152 - DNA, 20 bp, mouse
ggcccccagcgctccggagc

SEQ ID NO: 738153 - DNA, 20 bp, mouse
gcacagcgcccccagcgctc

SEQ ID NO: 738154 - DNA, 20 bp, mouse
gcggccgcgggtggtgcgga

SEQ ID NO: 738155 - DNA, 20 bp, mouse
ggcgcggcgccggtggttgg

SEQ ID NO: 738156 - DNA, 20 bp, mouse
gacgacgctcataggctaag

SEQ ID NO: 738157 - DNA, 20 bp, mouse
gcggtgtagtgagtgttcat

SEQ ID NO: 738158 - DNA, 20 bp, mouse
gcagtggccccagtccccgg

SEQ ID NO: 738159 - DNA, 20 bp, mouse
gaacactcactacaccgact

SEQ ID NO: 738160 - DNA, 20 bp, mouse
gagctcgagacgacgctcat

SEQ ID NO: 738161 - DNA, 20 bp, mouse
gtggggaatccaaaacccga

SEQ ID NO: 738162 - DNA, 20 bp, mouse
ggaagcgaataccctgaaat

SEQ ID NO: 738163 - DNA, 20 bp, mouse
gactggggccactgagcatc

SEQ ID NO: 738164 - DNA, 20 bp, mouse
gtcaagaaagacagtgggat

SEQ ID NO: 738165 - DNA, 20 bp, mouse
ggctagccggttatggggaa

SEQ ID NO: 738166 - DNA, 20 bp, mouse
ggccgctcggtgttgatgag

SEQ ID NO: 738167 - DNA, 20 bp, mouse
gcccgcacgctgattggtgg

SEQ ID NO: 738168 - DNA, 20 bp, mouse
gtgggtgccggcacgtcctc

SEQ ID NO: 738169 - DNA, 20 bp, mouse
ggccccgccctccgcgacct

SEQ ID NO: 738170 - DNA, 20 bp, mouse
gctcccgccccaggtcgcgg

SEQ ID NO: 738171 - DNA, 20 bp, mouse
ggctcggtgttgatgagggg

SEQ ID NO: 738172 - DNA, 20 bp, mouse
gcggggaggcgaagcttcag

SEQ ID NO: 738173 - DNA, 20 bp, mouse
gtggctgtgtgcatcttgac

SEQ ID NO: 738174 - DNA, 20 bp, mouse
gcgccctccgcgacctgggg

SEQ ID NO: 738175 - DNA, 20 bp, mouse
gcacccgaccgcagccggat

SEQ ID NO: 738176 - DNA, 20 bp, mouse
gcggcccagcggtcacgtgg

SEQ ID NO: 738177 - DNA, 20 bp, mouse
ggcaaccctcggtgcaagaa

SEQ ID NO: 738178 - DNA, 20 bp, mouse
ggctgggccgggcgctctct

SEQ ID NO: 738179 - DNA, 20 bp, mouse
ggggtctctaaactgcttaa

SEQ ID NO: 738180 - DNA, 20 bp, mouse
gaggcaagaggcggaagtct

SEQ ID NO: 738181 - DNA, 20 bp, mouse
ggcgcccccacgtgaccgct

SEQ ID NO: 738182 - DNA, 20 bp, mouse
ggaagtctcggcttcaagtc

SEQ ID NO: 738183 - DNA, 20 bp, mouse
gcactcactaggttcccaca

SEQ ID NO: 738184 - DNA, 20 bp, mouse
ggcccacctccgagccggga

SEQ ID NO: 738185 - DNA, 20 bp, mouse
ggggcgcgtgcgccacacgc

SEQ ID NO: 738186 - DNA, 20 bp, mouse
gccacacccggaagcaattc

SEQ ID NO: 738187 - DNA, 20 bp, mouse
gttcgcacttccaatggctg

SEQ ID NO: 738188 - DNA, 20 bp, mouse
gaaaaccttcgcacttccaa

SEQ ID NO: 738189 - DNA, 20 bp, mouse
gcaactccggaattgcttcc

SEQ ID NO: 738190 - DNA, 20 bp, mouse
ggagcccctggtgtaaaaac

SEQ ID NO: 738191 - DNA, 20 bp, mouse
gcccggctgctcactctggc

SEQ ID NO: 738192 - DNA, 20 bp, mouse
gcaggggctcggttgagacc

SEQ ID NO: 738193 - DNA, 20 bp, mouse
gtgggagctaagggtcgcat

SEQ ID NO: 738194 - DNA, 20 bp, mouse
gcggcctgtacgatcgtcac

SEQ ID NO: 738195 - DNA, 20 bp, mouse
gcccccggcgccgagatttc

SEQ ID NO: 738196 - DNA, 20 bp, mouse
gcgcacccggggtggacgga

SEQ ID NO: 738197 - DNA, 20 bp, mouse
ggggcccctccgtggctagt

SEQ ID NO: 738198 - DNA, 20 bp, mouse
gcctccgtggctagtcggcc

SEQ ID NO: 738199 - DNA, 20 bp, mouse
gctcggagaacgaacaaacc

SEQ ID NO: 738200 - DNA, 20 bp, mouse
gcgcaaggtgggcccctccg

SEQ ID NO: 738201 - DNA, 20 bp, mouse
gaaacccggccgactagcca

SEQ ID NO: 738202 - DNA, 20 bp, mouse
ggggtggggacacgaacgca

SEQ ID NO: 738203 - DNA, 20 bp, mouse
gctctctcgaggagaggcga

SEQ ID NO: 738204 - DNA, 20 bp, mouse
gttgaggggccgcgcacccg

SEQ ID NO: 738205 - DNA, 20 bp, mouse
gaaacggagacgcggaaact

SEQ ID NO: 738206 - DNA, 20 bp, mouse
gcccctgcccctcccggcta

SEQ ID NO: 738207 - DNA, 20 bp, mouse
gagcggcaagacgtcgtcgg

SEQ ID NO: 738208 - DNA, 20 bp, mouse
ggcaagacgtcgtcggagga

SEQ ID NO: 738209 - DNA, 20 bp, mouse
gcccgccccctagccgggag

SEQ ID NO: 738210 - DNA, 20 bp, mouse
gggtagcggcaagacgtcgt

SEQ ID NO: 738211 - DNA, 20 bp, mouse
gcggcggaggagcactgcgt

SEQ ID NO: 738212 - DNA, 20 bp, mouse
gcccctagccgggaggggca

SEQ ID NO: 738213 - DNA, 20 bp, mouse
gtaaggataaacatcccagg

SEQ ID NO: 738214 - DNA, 20 bp, mouse
gagactgttaacttcttgag

SEQ ID NO: 738215 - DNA, 20 bp, mouse
ggataaacatcccaggcgga

SEQ ID NO: 738216 - DNA, 20 bp, mouse
gacaaccggcttgggatcta

SEQ ID NO: 738217 - DNA, 20 bp, mouse
gagcgtgtgcgagcgcgcat

SEQ ID NO: 738218 - DNA, 20 bp, mouse
gcatgggcgcgtactagttt

SEQ ID NO: 738219 - DNA, 20 bp, mouse
gtgtgatgaccgaaagaaat

SEQ ID NO: 738220 - DNA, 20 bp, mouse
gaactcggagagacaccttg

SEQ ID NO: 738221 - DNA, 20 bp, mouse
ggatggccggatccttttac

SEQ ID NO: 738222 - DNA, 20 bp, mouse
gcggagagacaccttgcgga

SEQ ID NO: 738223 - DNA, 20 bp, mouse
gcgccggtccatccggtaaa

SEQ ID NO: 738224 - DNA, 20 bp, mouse
ggggaggagacaaccggctt

SEQ ID NO: 738225 - DNA, 20 bp, mouse
ggcgcagtctctagacaaac

SEQ ID NO: 738226 - DNA, 20 bp, mouse
gacagaaacgaaacgaccaa

SEQ ID NO: 738227 - DNA, 20 bp, mouse
gtaacaacccggaagcaatt

SEQ ID NO: 738228 - DNA, 20 bp, mouse
ggcgcagccaaattgcttcc

SEQ ID NO: 738229 - DNA, 20 bp, mouse
gcagtagaaagctaacaacc

SEQ ID NO: 738230 - DNA, 20 bp, mouse
gtggaagtcgtttcacacat

SEQ ID NO: 738231 - DNA, 20 bp, mouse
ggctgcgctaaagtgtctgc

SEQ ID NO: 738232 - DNA, 20 bp, mouse
ggcttagataaatacttagc

SEQ ID NO: 738233 - DNA, 20 bp, mouse
gcgcttgaaaaataagtcag

SEQ ID NO: 738234 - DNA, 20 bp, mouse
gtgttagctttctactgcgc

SEQ ID NO: 738235 - DNA, 20 bp, mouse
gtttcataaagagggagttc

SEQ ID NO: 738236 - DNA, 20 bp, mouse
ggccgccacagatccgagag

SEQ ID NO: 738237 - DNA, 20 bp, mouse
ggatctgtggcggcctcggt

SEQ ID NO: 738238 - DNA, 20 bp, mouse
ggactgacgcgagtcaacaa

SEQ ID NO: 738239 - DNA, 20 bp, mouse
gggcacgtctgtccggagta

SEQ ID NO: 738240 - DNA, 20 bp, mouse
gctggcgagcatcccgctct

SEQ ID NO: 738241 - DNA, 20 bp, mouse
gcaaaggtcacgtgaggcga

SEQ ID NO: 738242 - DNA, 20 bp, mouse
ggctcgccagttctggtcgg

SEQ ID NO: 738243 - DNA, 20 bp, mouse
ggccagttctggtcggtggt

SEQ ID NO: 738244 - DNA, 20 bp, mouse
gcccgctctcggatctgtgg

SEQ ID NO: 738245 - DNA, 20 bp, mouse
gaagcagctagcaagttaag

SEQ ID NO: 738246 - DNA, 20 bp, mouse
gcacaaggggaaaaggtaac

SEQ ID NO: 738247 - DNA, 20 bp, mouse
gctcctaagggagatgatcg

SEQ ID NO: 738248 - DNA, 20 bp, mouse
gcgagtgccgctgctcctaa

SEQ ID NO: 738249 - DNA, 20 bp, mouse
gagtaggcgggagctgggta

SEQ ID NO: 738250 - DNA, 20 bp, mouse
gggctcacctggcgctctgg

SEQ ID NO: 738251 - DNA, 20 bp, mouse
gtggaccaaggggtgtgttg

SEQ ID NO: 738252 - DNA, 20 bp, mouse
gggtcggggacctggaccaa

SEQ ID NO: 738253 - DNA, 20 bp, mouse
gaccctgcatggagatgctt

SEQ ID NO: 738254 - DNA, 20 bp, mouse
gaacctcgatcatctccctt

SEQ ID NO: 738255 - DNA, 20 bp, mouse
gcatccgcccagccatcggc

SEQ ID NO: 738256 - DNA, 20 bp, mouse
gtatctgagttggaaggatt

SEQ ID NO: 738257 - DNA, 20 bp, mouse
gtcctccggttcaaagactt

SEQ ID NO: 738258 - DNA, 20 bp, mouse
gctctcccggttgactccag

SEQ ID NO: 738259 - DNA, 20 bp, mouse
gtccggttcaaagacttggg

SEQ ID NO: 738260 - DNA, 20 bp, mouse
ggatcgcgacgggtgcctag

SEQ ID NO: 738261 - DNA, 20 bp, mouse
gactcattatctgagttgga

SEQ ID NO: 738262 - DNA, 20 bp, mouse
gtcctgcaagcagtacttgt

SEQ ID NO: 738263 - DNA, 20 bp, mouse
gtggtcagcagggattgagt

SEQ ID NO: 738264 - DNA, 20 bp, mouse
ggcctcccaagtctttgaac

SEQ ID NO: 738265 - DNA, 20 bp, mouse
gagtgacaaactgctctgca

SEQ ID NO: 738266 - DNA, 20 bp, mouse
ggccgcccggcacagttccg

SEQ ID NO: 738267 - DNA, 20 bp, mouse
gcggcacagttccggggtag

SEQ ID NO: 738268 - DNA, 20 bp, mouse
gcggctgcgggacacagtct

SEQ ID NO: 738269 - DNA, 20 bp, mouse
gcacagttccggggtagtgg

SEQ ID NO: 738270 - DNA, 20 bp, mouse
gaccccggaactgtgccggg

SEQ ID NO: 738271 - DNA, 20 bp, mouse
ggcccactcccccactaccc

SEQ ID NO: 738272 - DNA, 20 bp, mouse
ggggagtgggcgtgggaaac

SEQ ID NO: 738273 - DNA, 20 bp, mouse
gacgccccccactggatacc

SEQ ID NO: 738274 - DNA, 20 bp, mouse
ggggcggggtcattaccggg

SEQ ID NO: 738275 - DNA, 20 bp, mouse
gcccccgcagcgcaagaccg

SEQ ID NO: 738276 - DNA, 20 bp, mouse
ggcccgcccgccaacgtcgt

SEQ ID NO: 738277 - DNA, 20 bp, mouse
gtgcaagcctcccacgacgt

SEQ ID NO: 738278 - DNA, 20 bp, mouse
gaacggggaggccaagtacc

SEQ ID NO: 738279 - DNA, 20 bp, mouse
ggctgtgcgtgcgtaggctc

SEQ ID NO: 738280 - DNA, 20 bp, mouse
gggcgggcgggccaacgggg

SEQ ID NO: 738281 - DNA, 20 bp, mouse
gagggcgggacggcggcgaa

SEQ ID NO: 738282 - DNA, 20 bp, mouse
ggccgcagcctgaagctgaa

SEQ ID NO: 738283 - DNA, 20 bp, mouse
ggcgcaggctgtgcgtgcgt

SEQ ID NO: 738284 - DNA, 20 bp, mouse
ggtcgtgggaggcttgcaaa

SEQ ID NO: 738285 - DNA, 20 bp, mouse
gcggcggcgaagggaagagg

SEQ ID NO: 738286 - DNA, 20 bp, mouse
ggggtctagttggaccgtgc

SEQ ID NO: 738287 - DNA, 20 bp, mouse
gccaactagacccatctacc

SEQ ID NO: 738288 - DNA, 20 bp, mouse
gccagctgaacctgcaccgg

SEQ ID NO: 738289 - DNA, 20 bp, mouse
gggcggagggagcagggcgt

SEQ ID NO: 738290 - DNA, 20 bp, mouse
ggggagcagggcgtgggtct

SEQ ID NO: 738291 - DNA, 20 bp, mouse
gggttcagctggaggcgtac

SEQ ID NO: 738292 - DNA, 20 bp, mouse
gtgggagggtccgccggtgc

SEQ ID NO: 738293 - DNA, 20 bp, mouse
gaggaggctgcctccgggtt

SEQ ID NO: 738294 - DNA, 20 bp, mouse
gaaggctgggatatcactct

SEQ ID NO: 738295 - DNA, 20 bp, mouse
gagcagggcgtgggtctggg

SEQ ID NO: 738296 - DNA, 20 bp, mouse
gcaggcagttagaaagtggg

SEQ ID NO: 738297 - DNA, 20 bp, mouse
ggcagcaggcagttagaaag

SEQ ID NO: 738298 - DNA, 20 bp, mouse
gtctgtgaaacacatttgtg

SEQ ID NO: 738299 - DNA, 20 bp, mouse
ggcctgctgcactagcaaga

SEQ ID NO: 738300 - DNA, 20 bp, mouse
gttagacttaggatgtactg

SEQ ID NO: 738301 - DNA, 20 bp, mouse
gccagtatttgtagtgattt

SEQ ID NO: 738302 - DNA, 20 bp, mouse
gtttagctgctgtatatatg

SEQ ID NO: 738303 - DNA, 20 bp, mouse
gtccatcttgctagtgcagc

SEQ ID NO: 738304 - DNA, 20 bp, mouse
gattttttttttcggctcat

SEQ ID NO: 738305 - DNA, 20 bp, mouse
gaatgcaagcaaaactgaga

SEQ ID NO: 738306 - DNA, 20 bp, mouse
gtgcgtctgctccttgtgtt

SEQ ID NO: 738307 - DNA, 20 bp, mouse
gggagcctgcttatcagtga

SEQ ID NO: 738308 - DNA, 20 bp, mouse
gactacaaccaacagggcca

SEQ ID NO: 738309 - DNA, 20 bp, mouse
gtagtttctcaggggagaga

SEQ ID NO: 738310 - DNA, 20 bp, mouse
gactcaggaactaaagaatc

SEQ ID NO: 738311 - DNA, 20 bp, mouse
gaggccaacagtacacattt

SEQ ID NO: 738312 - DNA, 20 bp, mouse
gcttgggaacagtgtttaat

SEQ ID NO: 738313 - DNA, 20 bp, mouse
gtgttccctcactgataagc

SEQ ID NO: 738314 - DNA, 20 bp, mouse
ggaaactaagataaaagagg

SEQ ID NO: 738315 - DNA, 20 bp, mouse
ggggtgatctttttaatgtg

SEQ ID NO: 738316 - DNA, 20 bp, mouse
gggaaggagaagatccaaga

SEQ ID NO: 738317 - DNA, 20 bp, mouse
ggacaaggtactggaattgt

SEQ ID NO: 738318 - DNA, 20 bp, mouse
gcctggaattgtggagtaag

SEQ ID NO: 738319 - DNA, 20 bp, mouse
gaggtactggaattgttgga

SEQ ID NO: 738320 - DNA, 20 bp, mouse
gaatgtttttcaatagtcaa

SEQ ID NO: 738321 - DNA, 20 bp, mouse
gcagcagtgaccaataggaa

SEQ ID NO: 738322 - DNA, 20 bp, mouse
gttcataggtgacaaggtac

SEQ ID NO: 738323 - DNA, 20 bp, mouse
gactctgacaggcttcagga

SEQ ID NO: 738324 - DNA, 20 bp, mouse
gcagtgcacacaccttacaa

SEQ ID NO: 738325 - DNA, 20 bp, mouse
ggattgggtcaattcattac

SEQ ID NO: 738326 - DNA, 20 bp, mouse
gactctctgaaattacggaa

SEQ ID NO: 738327 - DNA, 20 bp, mouse
gaacactcccacttcctgaa

SEQ ID NO: 738328 - DNA, 20 bp, mouse
gttccttgagtacactctca

SEQ ID NO: 738329 - DNA, 20 bp, mouse
ggtcagctcctttcaggaag

SEQ ID NO: 738330 - DNA, 20 bp, mouse
gaaccttgagagtgtactca

SEQ ID NO: 738331 - DNA, 20 bp, mouse
gaagggactctctgaaatta

SEQ ID NO: 738332 - DNA, 20 bp, mouse
gcaattagctgtacagcctc

SEQ ID NO: 738333 - DNA, 20 bp, mouse
gttgttgttcttgtttgtta

SEQ ID NO: 738334 - DNA, 20 bp, mouse
gaaggagctgacagagagct

SEQ ID NO: 738335 - DNA, 20 bp, mouse
gtaaatccttgcagtgccct

SEQ ID NO: 738336 - DNA, 20 bp, mouse
gaggaagtaggagtgtgttg

SEQ ID NO: 738337 - DNA, 20 bp, mouse
ggaatggggaaagtactgat

SEQ ID NO: 738338 - DNA, 20 bp, mouse
gggaaagttcttttcgaatg

SEQ ID NO: 738339 - DNA, 20 bp, mouse
ggacaggagagttgctaatc

SEQ ID NO: 738340 - DNA, 20 bp, mouse
gcagtcaaagtgactgagcc

SEQ ID NO: 738341 - DNA, 20 bp, mouse
gttggtcttgaatttcattt

SEQ ID NO: 738342 - DNA, 20 bp, mouse
gaaaattcagtgtgggatgg

SEQ ID NO: 738343 - DNA, 20 bp, mouse
gtagagccagataaggaaga

SEQ ID NO: 738344 - DNA, 20 bp, mouse
gcacactcctacttcctgac

SEQ ID NO: 738345 - DNA, 20 bp, mouse
gccaaatgtagagccagata

SEQ ID NO: 738346 - DNA, 20 bp, mouse
gaaccttgagagggcactca

SEQ ID NO: 738347 - DNA, 20 bp, mouse
gaaagctaagaaccttgaga

SEQ ID NO: 738348 - DNA, 20 bp, mouse
gactatctgaaatttcagaa

SEQ ID NO: 738349 - DNA, 20 bp, mouse
gcagttagctgtacagtctc

SEQ ID NO: 738350 - DNA, 20 bp, mouse
gaacactcctactccctgaa

SEQ ID NO: 738351 - DNA, 20 bp, mouse
gttccttgagtgccctctca

SEQ ID NO: 738352 - DNA, 20 bp, mouse
gttgttgttcttgtttgtta

SEQ ID NO: 738353 - DNA, 20 bp, mouse
ggttatggttttgtttgtta

SEQ ID NO: 738354 - DNA, 20 bp, mouse
gtttctgtcagctcctttca

SEQ ID NO: 738355 - DNA, 20 bp, mouse
gaactgtcaatttgtcacca

SEQ ID NO: 738356 - DNA, 20 bp, mouse
gtcactggctgcacctgggg

SEQ ID NO: 738357 - DNA, 20 bp, mouse
gtctccctgtggtcatactt

SEQ ID NO: 738358 - DNA, 20 bp, mouse
gcctctgctcaaggcctcac

SEQ ID NO: 738359 - DNA, 20 bp, mouse
ggcctcactggctgcacctg

SEQ ID NO: 738360 - DNA, 20 bp, mouse
gacatcctaagtatgaccac

SEQ ID NO: 738361 - DNA, 20 bp, mouse
gaacactctgtcccaatgtt

SEQ ID NO: 738362 - DNA, 20 bp, mouse
gatgacagtagacccaacat

SEQ ID NO: 738363 - DNA, 20 bp, mouse
gaggtggggcttctgggagg

SEQ ID NO: 738364 - DNA, 20 bp, mouse
ggggaggttactcagagcta

SEQ ID NO: 738365 - DNA, 20 bp, mouse
gccactcaagtccttccaat

SEQ ID NO: 738366 - DNA, 20 bp, mouse
ggggaggcgacgtcttcagt

SEQ ID NO: 738367 - DNA, 20 bp, mouse
gcgcgcaggcgccctaagct

SEQ ID NO: 738368 - DNA, 20 bp, mouse
gtaagctcggagcccaagcg

SEQ ID NO: 738369 - DNA, 20 bp, mouse
gccctccgcgcactccgccc

SEQ ID NO: 738370 - DNA, 20 bp, mouse
gcgacccagcgagagagcac

SEQ ID NO: 738371 - DNA, 20 bp, mouse
gagacgtcgcctccccgctt

SEQ ID NO: 738372 - DNA, 20 bp, mouse
ggctcggagcccaagcgggg

SEQ ID NO: 738373 - DNA, 20 bp, mouse
gtctccgcggagaaactcaa

SEQ ID NO: 738374 - DNA, 20 bp, mouse
gagggagcggtgccccggag

SEQ ID NO: 738375 - DNA, 20 bp, mouse
gcgcgcactccgcccggggg

SEQ ID NO: 738376 - DNA, 20 bp, mouse
gagaacacggcgggctaagg

SEQ ID NO: 738377 - DNA, 20 bp, mouse
gggggcgcacgcggagacta

SEQ ID NO: 738378 - DNA, 20 bp, mouse
gggagactatggactatcat

SEQ ID NO: 738379 - DNA, 20 bp, mouse
gcagcagcctcctgccactc

SEQ ID NO: 738380 - DNA, 20 bp, mouse
ggcaggaggctgctgcggag

SEQ ID NO: 738381 - DNA, 20 bp, mouse
ggagtcgcctgagtggcagg

SEQ ID NO: 738382 - DNA, 20 bp, mouse
ggccaggcctgagaacacgg

SEQ ID NO: 738383 - DNA, 20 bp, mouse
gtattggaagcggggtccga

SEQ ID NO: 738384 - DNA, 20 bp, mouse
gactcaggcgactcgacttg

SEQ ID NO: 738385 - DNA, 20 bp, mouse
gcgcacccactccacagcac

SEQ ID NO: 738386 - DNA, 20 bp, mouse
ggatggagacccctgatcta

SEQ ID NO: 738387 - DNA, 20 bp, mouse
gcccgcagcggggacattgt

SEQ ID NO: 738388 - DNA, 20 bp, mouse
gccggcgcgcgccgcctcgt

SEQ ID NO: 738389 - DNA, 20 bp, mouse
ggatcaggggtctccatcca

SEQ ID NO: 738390 - DNA, 20 bp, mouse
ggggtcaagtggcgcgtcca

SEQ ID NO: 738391 - DNA, 20 bp, mouse
gagacccctgatctagggac

SEQ ID NO: 738392 - DNA, 20 bp, mouse
ggggggcactgggactgcgc

SEQ ID NO: 738393 - DNA, 20 bp, mouse
gcagtcccagtgcccccacg

SEQ ID NO: 738394 - DNA, 20 bp, mouse
gtcccagtgcccccacgagg

SEQ ID NO: 738395 - DNA, 20 bp, mouse
ggctctgcccttgtcccttc

SEQ ID NO: 738396 - DNA, 20 bp, mouse
gggtctgcagcaggcgcaga

SEQ ID NO: 738397 - DNA, 20 bp, mouse
gttcgctttgacagctgagg

SEQ ID NO: 738398 - DNA, 20 bp, mouse
ggcagcaggcgcagagggat

SEQ ID NO: 738399 - DNA, 20 bp, mouse
gggagctttctgctttgcaa

SEQ ID NO: 738400 - DNA, 20 bp, mouse
gaagtgagagggcctgccat

SEQ ID NO: 738401 - DNA, 20 bp, mouse
gaggcgcagagggatcggaa

SEQ ID NO: 738402 - DNA, 20 bp, mouse
gtaggccagaaccactgcga

SEQ ID NO: 738403 - DNA, 20 bp, mouse
gccccctagcggccgctgtg

SEQ ID NO: 738404 - DNA, 20 bp, mouse
gggaggagttctgcacgcag

SEQ ID NO: 738405 - DNA, 20 bp, mouse
gcggccgctgtggggaccgg

SEQ ID NO: 738406 - DNA, 20 bp, mouse
ggccccgcaggggatgtgga

SEQ ID NO: 738407 - DNA, 20 bp, mouse
gtgacccggtaggccccgca

SEQ ID NO: 738408 - DNA, 20 bp, mouse
gagttggcaggaggcgttgg

SEQ ID NO: 738409 - DNA, 20 bp, mouse
gctggccagggctcggggca

SEQ ID NO: 738410 - DNA, 20 bp, mouse
gaggacagcaggccgagccg

SEQ ID NO: 738411 - DNA, 20 bp, mouse
gatcccctgcggggcctacc

SEQ ID NO: 738412 - DNA, 20 bp, mouse
gagaagtctaggttgggtga

SEQ ID NO: 738413 - DNA, 20 bp, mouse
gtgagtgtctgtgacccggt

SEQ ID NO: 738414 - DNA, 20 bp, mouse
ggctagggccgcactggcca

SEQ ID NO: 738415 - DNA, 20 bp, mouse
gtcccccgctagggccgcac

SEQ ID NO: 738416 - DNA, 20 bp, mouse
gaggaacagccagtagtata

SEQ ID NO: 738417 - DNA, 20 bp, mouse
gggctctaggatgagagtga

SEQ ID NO: 738418 - DNA, 20 bp, mouse
gcggtgtgactgacgaagat

SEQ ID NO: 738419 - DNA, 20 bp, mouse
gagagcttcggaagatgcag

SEQ ID NO: 738420 - DNA, 20 bp, mouse
gaatcgtgggccgtaaatcc

SEQ ID NO: 738421 - DNA, 20 bp, mouse
gtagagccgccccgagaagg

SEQ ID NO: 738422 - DNA, 20 bp, mouse
gcatcccagagaattttcat

SEQ ID NO: 738423 - DNA, 20 bp, mouse
gggaagtcacgcgagaagtc

SEQ ID NO: 738424 - DNA, 20 bp, mouse
gataggactcaataagccca

SEQ ID NO: 738425 - DNA, 20 bp, mouse
gactctacgcccgccaatcg

SEQ ID NO: 738426 - DNA, 20 bp, mouse
ggcttcagatggtttgggtt

SEQ ID NO: 738427 - DNA, 20 bp, mouse
gtggccacgcctcctggagg

SEQ ID NO: 738428 - DNA, 20 bp, mouse
gcacgtggtcgtgtggtggg

SEQ ID NO: 738429 - DNA, 20 bp, mouse
ggcccttccctctattttaa

SEQ ID NO: 738430 - DNA, 20 bp, mouse
gaggtcacgtggtcgtgtgg

SEQ ID NO: 738431 - DNA, 20 bp, mouse
gcctcctggagggggcagtg

SEQ ID NO: 738432 - DNA, 20 bp, mouse
gaggaggatcgggagcgtaa

SEQ ID NO: 738433 - DNA, 20 bp, mouse
gggtttggcttcagatggtt

SEQ ID NO: 738434 - DNA, 20 bp, mouse
gctgccccctccaggaggcg

SEQ ID NO: 738435 - DNA, 20 bp, mouse
gcggacttctggaccctgga

SEQ ID NO: 738436 - DNA, 20 bp, mouse
ggacccgaagaaatggatgg

SEQ ID NO: 738437 - DNA, 20 bp, mouse
gggacgccgtgtcgtcactg

SEQ ID NO: 738438 - DNA, 20 bp, mouse
gggaaagcgagaagcctcgg

SEQ ID NO: 738439 - DNA, 20 bp, mouse
gggtaaggacccagcgaatg

SEQ ID NO: 738440 - DNA, 20 bp, mouse
gtccccacctacaccttaaa

SEQ ID NO: 738441 - DNA, 20 bp, mouse
gggggcgtgacccgaagaaa

SEQ ID NO: 738442 - DNA, 20 bp, mouse
ggtagcagtaggaacatcga

SEQ ID NO: 738443 - DNA, 20 bp, mouse
gcagctccggaaacccgatg

SEQ ID NO: 738444 - DNA, 20 bp, mouse
ggcggcacgcgaggcatcat

SEQ ID NO: 738445 - DNA, 20 bp, mouse
gtaaggtgtaggtggggacc

SEQ ID NO: 738446 - DNA, 20 bp, mouse
gcagggcattccagctaggg

SEQ ID NO: 738447 - DNA, 20 bp, mouse
ggggcaggctgcagtatttc

SEQ ID NO: 738448 - DNA, 20 bp, mouse
gagacacaagaaggtggtct

SEQ ID NO: 738449 - DNA, 20 bp, mouse
gcccacctcacaggtggggt

SEQ ID NO: 738450 - DNA, 20 bp, mouse
gaagagcctcgttctttctc

SEQ ID NO: 738451 - DNA, 20 bp, mouse
gtgccagggcattccagcta

SEQ ID NO: 738452 - DNA, 20 bp, mouse
gggggagggagatggatata

SEQ ID NO: 738453 - DNA, 20 bp, mouse
gtgtctcaaagacataaatc

SEQ ID NO: 738454 - DNA, 20 bp, mouse
gaggtgggaagttccatgcc

SEQ ID NO: 738455 - DNA, 20 bp, mouse
gctctagaaacccccctagc

SEQ ID NO: 738456 - DNA, 20 bp, mouse
gcggcccccggagcggaaga

SEQ ID NO: 738457 - DNA, 20 bp, mouse
ggggccgcgcccgggctgta

SEQ ID NO: 738458 - DNA, 20 bp, mouse
gttacaaaggcgagcgtctc

SEQ ID NO: 738459 - DNA, 20 bp, mouse
ggggaaggggcgctttacaa

SEQ ID NO: 738460 - DNA, 20 bp, mouse
gaggccgctgcagaccggga

SEQ ID NO: 738461 - DNA, 20 bp, mouse
ggggaagggacgctctgcaa

SEQ ID NO: 738462 - DNA, 20 bp, mouse
gccggcccgagcggctagag

SEQ ID NO: 738463 - DNA, 20 bp, mouse
ggggcagccgggacacggga

SEQ ID NO: 738464 - DNA, 20 bp, mouse
gtcgccatcttccgctccgg

SEQ ID NO: 738465 - DNA, 20 bp, mouse
gctcagggcagccgggacac

SEQ ID NO: 738466 - DNA, 20 bp, mouse
gtctccgaggccaacccggc

SEQ ID NO: 738467 - DNA, 20 bp, mouse
gagcgcctcggcctgacttg

SEQ ID NO: 738468 - DNA, 20 bp, mouse
gaccgacgaggggcgaggac

SEQ ID NO: 738469 - DNA, 20 bp, mouse
gcagcggcacaattgtaaaa

SEQ ID NO: 738470 - DNA, 20 bp, mouse
gtgtgtagttcccacaagtc

SEQ ID NO: 738471 - DNA, 20 bp, mouse
gaccggtcctcgcccctcgt

SEQ ID NO: 738472 - DNA, 20 bp, mouse
gaggtgttgcgggatggaca

SEQ ID NO: 738473 - DNA, 20 bp, mouse
gccggcgggcgggggctgtg

SEQ ID NO: 738474 - DNA, 20 bp, mouse
gtggcctcggagagtttgtc

SEQ ID NO: 738475 - DNA, 20 bp, mouse
gggcgaggaccggtgcgtcc

SEQ ID NO: 738476 - DNA, 20 bp, mouse
gaccccgacaaggatctgaa

SEQ ID NO: 738477 - DNA, 20 bp, mouse
gaagcccttcagatccttgt

SEQ ID NO: 738478 - DNA, 20 bp, mouse
gctacaatctccaccctcga

SEQ ID NO: 738479 - DNA, 20 bp, mouse
gaagctgaggaaataaggat

SEQ ID NO: 738480 - DNA, 20 bp, mouse
ggagggttcccttaggagca

SEQ ID NO: 738481 - DNA, 20 bp, mouse
gaagtgaagtccttcgaggg

SEQ ID NO: 738482 - DNA, 20 bp, mouse
gggctgtgtggaggtgcagt

SEQ ID NO: 738483 - DNA, 20 bp, mouse
gtgaagtctgcagtgtctgt

SEQ ID NO: 738484 - DNA, 20 bp, mouse
ggtaagctccttctaagctg

SEQ ID NO: 738485 - DNA, 20 bp, mouse
gatctactgagggttccctt

SEQ ID NO: 738486 - DNA, 20 bp, mouse
ggaaccaagtgtcctatgtg

SEQ ID NO: 738487 - DNA, 20 bp, mouse
gccaacggaccacgcctcct

SEQ ID NO: 738488 - DNA, 20 bp, mouse
ggggccgcacataggacact

SEQ ID NO: 738489 - DNA, 20 bp, mouse
gcaccgaggagccggaagtg

SEQ ID NO: 738490 - DNA, 20 bp, mouse
ggggcccaccgtagagacca

SEQ ID NO: 738491 - DNA, 20 bp, mouse
gggctctgcgggccgcacat

SEQ ID NO: 738492 - DNA, 20 bp, mouse
gagagagtcggctacaagga

SEQ ID NO: 738493 - DNA, 20 bp, mouse
gcctcctgggcgtggtcgga

SEQ ID NO: 738494 - DNA, 20 bp, mouse
gagcactcggcagacttggc

SEQ ID NO: 738495 - DNA, 20 bp, mouse
gtctacgtcagaagtccgcg

SEQ ID NO: 738496 - DNA, 20 bp, mouse
ggggcggggcccggaagtct

SEQ ID NO: 738497 - DNA, 20 bp, mouse
ggaggcggggcccagacttc

SEQ ID NO: 738498 - DNA, 20 bp, mouse
gtggggcgtggccaccgaag

SEQ ID NO: 738499 - DNA, 20 bp, mouse
gccactgagcatgcccagag

SEQ ID NO: 738500 - DNA, 20 bp, mouse
gctgggccccgcctcttcgg

SEQ ID NO: 738501 - DNA, 20 bp, mouse
gcgtggccaccgaagaggcg

SEQ ID NO: 738502 - DNA, 20 bp, mouse
gtcgaggtggggctgcgctg

SEQ ID NO: 738503 - DNA, 20 bp, mouse
gtgcctacggcgcgaagggg

SEQ ID NO: 738504 - DNA, 20 bp, mouse
gagcatgcccagagcggctc

SEQ ID NO: 738505 - DNA, 20 bp, mouse
gaggtcgtggagaactctga

SEQ ID NO: 738506 - DNA, 20 bp, mouse
gccaacccaggtcgcagcgt

SEQ ID NO: 738507 - DNA, 20 bp, mouse
gaccctcgcagcctctgatt

SEQ ID NO: 738508 - DNA, 20 bp, mouse
gcagaggctgcgagggtacc

SEQ ID NO: 738509 - DNA, 20 bp, mouse
gagtctggacagcttcgtgg

SEQ ID NO: 738510 - DNA, 20 bp, mouse
gcccaaggggtcggatccca

SEQ ID NO: 738511 - DNA, 20 bp, mouse
gtccgcccacgctgcgacct

SEQ ID NO: 738512 - DNA, 20 bp, mouse
gggggcgggggcgtgtgcgg

SEQ ID NO: 738513 - DNA, 20 bp, mouse
gcggccaggtgatgcccaag

SEQ ID NO: 738514 - DNA, 20 bp, mouse
gagcgaccgtgcagacctag

SEQ ID NO: 738515 - DNA, 20 bp, mouse
gcaggtgatgcccaaggggt

SEQ ID NO: 738516 - DNA, 20 bp, mouse
ggctccgcccacctccgtca

SEQ ID NO: 738517 - DNA, 20 bp, mouse
gagtctgcgggcctgtaaaa

SEQ ID NO: 738518 - DNA, 20 bp, mouse
ggaggctgggcctcagatgc

SEQ ID NO: 738519 - DNA, 20 bp, mouse
ggctgggcctcagatgccgg

SEQ ID NO: 738520 - DNA, 20 bp, mouse
gacggaggtgggcggagctc

SEQ ID NO: 738521 - DNA, 20 bp, mouse
gcgaacggcagccaatgaga

SEQ ID NO: 738522 - DNA, 20 bp, mouse
gccggcagccgtgacggagg

SEQ ID NO: 738523 - DNA, 20 bp, mouse
gctcgggcggcggtgcaggt

SEQ ID NO: 738524 - DNA, 20 bp, mouse
gcgttgccacggcgacgccc

SEQ ID NO: 738525 - DNA, 20 bp, mouse
gcaacgcgcgcggtcgtttc

SEQ ID NO: 738526 - DNA, 20 bp, mouse
gccccgtctctgtggtctgt

SEQ ID NO: 738527 - DNA, 20 bp, mouse
gggggcctgccccgtctctg

SEQ ID NO: 738528 - DNA, 20 bp, mouse
gtgtgggctgagttcagcag

SEQ ID NO: 738529 - DNA, 20 bp, mouse
gcgccgcgccggaagaaggt

SEQ ID NO: 738530 - DNA, 20 bp, mouse
gaacgcgccgcgccggaaga

SEQ ID NO: 738531 - DNA, 20 bp, mouse
gcggtgaccaatgagaagcg

SEQ ID NO: 738532 - DNA, 20 bp, mouse
gcggaagaaggttggttcgg

SEQ ID NO: 738533 - DNA, 20 bp, mouse
gtagtgcgcaagcgcacccc

SEQ ID NO: 738534 - DNA, 20 bp, mouse
ggtggcaattccgctccgtc

SEQ ID NO: 738535 - DNA, 20 bp, mouse
ggtctctagcagtgtaacca

SEQ ID NO: 738536 - DNA, 20 bp, mouse
gtcctgctcaccaaagttca

SEQ ID NO: 738537 - DNA, 20 bp, mouse
gcgctctgccccctgaactt

SEQ ID NO: 738538 - DNA, 20 bp, mouse
gcctccacgcaggacacccc

SEQ ID NO: 738539 - DNA, 20 bp, mouse
gacgccgctaggccgggagg

SEQ ID NO: 738540 - DNA, 20 bp, mouse
gaaggcggagcgagcatagg

SEQ ID NO: 738541 - DNA, 20 bp, mouse
gcagaaggcggagcgagcat

SEQ ID NO: 738542 - DNA, 20 bp, mouse
gcaggcgcgttgttggtttc

SEQ ID NO: 738543 - DNA, 20 bp, mouse
ggcggagcgagcataggggg

SEQ ID NO: 738544 - DNA, 20 bp, mouse
gcgcccgagcgctgaccagg

SEQ ID NO: 738545 - DNA, 20 bp, mouse
ggaggtcgagacgctcagac

SEQ ID NO: 738546 - DNA, 20 bp, mouse
gccaaccagcgcatcgggag

SEQ ID NO: 738547 - DNA, 20 bp, mouse
gggcacagaagagacgaggt

SEQ ID NO: 738548 - DNA, 20 bp, mouse
gccaccgggtccctctcctt

SEQ ID NO: 738549 - DNA, 20 bp, mouse
gaagcggcacagaagagacg

SEQ ID NO: 738550 - DNA, 20 bp, mouse
ggacgaggttggagcgggag

SEQ ID NO: 738551 - DNA, 20 bp, mouse
ggtcgcacagggagagggac

SEQ ID NO: 738552 - DNA, 20 bp, mouse
gttggggagggccgggtcgg

SEQ ID NO: 738553 - DNA, 20 bp, mouse
gaagcagtcagcatgaggaa

SEQ ID NO: 738554 - DNA, 20 bp, mouse
ggggtgctgcacccgattac

SEQ ID NO: 738555 - DNA, 20 bp, mouse
gggtttgtcgcacagggaga

SEQ ID NO: 738556 - DNA, 20 bp, mouse
gcaaccgagaccgacgcgga

SEQ ID NO: 738557 - DNA, 20 bp, mouse
gtcggctcccgtaccaccag

SEQ ID NO: 738558 - DNA, 20 bp, mouse
gcccgcacccgcacccgcat

SEQ ID NO: 738559 - DNA, 20 bp, mouse
gggaggtgccggcggagcga

SEQ ID NO: 738560 - DNA, 20 bp, mouse
ggtcacccgggagggaactc

SEQ ID NO: 738561 - DNA, 20 bp, mouse
gaccaatagtaaagcgtggc

SEQ ID NO: 738562 - DNA, 20 bp, mouse
gagtaaagcgtggctggaag

SEQ ID NO: 738563 - DNA, 20 bp, mouse
gttcgtaaggggacaaaaag

SEQ ID NO: 738564 - DNA, 20 bp, mouse
gtcggtctcggttgctgggc

SEQ ID NO: 738565 - DNA, 20 bp, mouse
gccagcaaccgagaccgacg

SEQ ID NO: 738566 - DNA, 20 bp, mouse
gcccctaggcgcgcctctga

SEQ ID NO: 738567 - DNA, 20 bp, mouse
ggcagtgcactctgacagta

SEQ ID NO: 738568 - DNA, 20 bp, mouse
ggctcctgaggagtcgggaa

SEQ ID NO: 738569 - DNA, 20 bp, mouse
gggcacgcgctgtcccggga

SEQ ID NO: 738570 - DNA, 20 bp, mouse
gtcccgggaaggagccaccc

SEQ ID NO: 738571 - DNA, 20 bp, mouse
ggggctcgccgggcagagac

SEQ ID NO: 738572 - DNA, 20 bp, mouse
gcggacgcaggaggggactt

SEQ ID NO: 738573 - DNA, 20 bp, mouse
ggacccgggtggctccttcc

SEQ ID NO: 738574 - DNA, 20 bp, mouse
ggaaaggcgaggtcggacgc

SEQ ID NO: 738575 - DNA, 20 bp, mouse
gttaactagagtgacccggg

SEQ ID NO: 738576 - DNA, 20 bp, mouse
ggacccaatcagcagaaggg

SEQ ID NO: 738577 - DNA, 20 bp, mouse
ggaacaaagctgttcctcgt

SEQ ID NO: 738578 - DNA, 20 bp, mouse
gccaatcagcagaagggagg

SEQ ID NO: 738579 - DNA, 20 bp, mouse
gaggaacttcgcttctatta

SEQ ID NO: 738580 - DNA, 20 bp, mouse
gagaccgtttgcttttaatg

SEQ ID NO: 738581 - DNA, 20 bp, mouse
gcgggacaggcagtgagtat

SEQ ID NO: 738582 - DNA, 20 bp, mouse
gtctcaggcgtgaaaggcgt

SEQ ID NO: 738583 - DNA, 20 bp, mouse
ggaagtgtcagttggtaacc

SEQ ID NO: 738584 - DNA, 20 bp, mouse
gcaggcgtgaaaggcgtggg

SEQ ID NO: 738585 - DNA, 20 bp, mouse
ggtgaaaggcgtgggaggag

SEQ ID NO: 738586 - DNA, 20 bp, mouse
ggggcagtagcaacgctcgt

SEQ ID NO: 738587 - DNA, 20 bp, mouse
gaaaaggctttcaagtctgg

SEQ ID NO: 738588 - DNA, 20 bp, mouse
gggtgctccgggcgaccgat

SEQ ID NO: 738589 - DNA, 20 bp, mouse
gcggcgccgcgctgaaccct

SEQ ID NO: 738590 - DNA, 20 bp, mouse
ggggcgggactcggtgctcc

SEQ ID NO: 738591 - DNA, 20 bp, mouse
gacctagctgggagtttctc

SEQ ID NO: 738592 - DNA, 20 bp, mouse
ggggcttccggcgagccctg

SEQ ID NO: 738593 - DNA, 20 bp, mouse
gagcgttgctactgccccat

SEQ ID NO: 738594 - DNA, 20 bp, mouse
gcggaggcgggggcgaaact

SEQ ID NO: 738595 - DNA, 20 bp, mouse
ggaccctaacgatacctgtt

SEQ ID NO: 738596 - DNA, 20 bp, mouse
ggggacgcgcctccggtgga

SEQ ID NO: 738597 - DNA, 20 bp, mouse
ggggcgcaccggaccggcca

SEQ ID NO: 738598 - DNA, 20 bp, mouse
ggccctgcgtcagccgtggc

SEQ ID NO: 738599 - DNA, 20 bp, mouse
gcgcgcctccggtggatggg

SEQ ID NO: 738600 - DNA, 20 bp, mouse
gccgcctggccgtgccgccg

SEQ ID NO: 738601 - DNA, 20 bp, mouse
gtccccctcccatccaccgg

SEQ ID NO: 738602 - DNA, 20 bp, mouse
gtgcggggacgcgcctccgg

SEQ ID NO: 738603 - DNA, 20 bp, mouse
gccgccccggcggcacggcc

SEQ ID NO: 738604 - DNA, 20 bp, mouse
ggcctccggtggatgggagg

SEQ ID NO: 738605 - DNA, 20 bp, mouse
gaaggtccgtgccacagagg

SEQ ID NO: 738606 - DNA, 20 bp, mouse
gggccctgcgcggctctgag

SEQ ID NO: 738607 - DNA, 20 bp, mouse
gcccgcctctgctgctcgtt

SEQ ID NO: 738608 - DNA, 20 bp, mouse
gcgttggggccttctattgg

SEQ ID NO: 738609 - DNA, 20 bp, mouse
gagccaagaggtctctttaa

SEQ ID NO: 738610 - DNA, 20 bp, mouse
gcccagaggccgccaataga

SEQ ID NO: 738611 - DNA, 20 bp, mouse
gccgaatggtcaacttccca

SEQ ID NO: 738612 - DNA, 20 bp, mouse
gccccaacgagcagcagagg

SEQ ID NO: 738613 - DNA, 20 bp, mouse
gttggctcccgtccatcggg

SEQ ID NO: 738614 - DNA, 20 bp, mouse
ggggtaggattggagggctt

SEQ ID NO: 738615 - DNA, 20 bp, mouse
ggagggccgtggttcccgaa

SEQ ID NO: 738616 - DNA, 20 bp, mouse
gactaaatggtcagtaactg

SEQ ID NO: 738617 - DNA, 20 bp, mouse
ggccgtctcgggctcacttc

SEQ ID NO: 738618 - DNA, 20 bp, mouse
gaccggaagtgagcccgaga

SEQ ID NO: 738619 - DNA, 20 bp, mouse
gaccgtaattccgccgtctc

SEQ ID NO: 738620 - DNA, 20 bp, mouse
gcaaaatattcccagggata

SEQ ID NO: 738621 - DNA, 20 bp, mouse
ggcccgagacggcggaatta

SEQ ID NO: 738622 - DNA, 20 bp, mouse
gtcaaaagcctgaaagtgca

SEQ ID NO: 738623 - DNA, 20 bp, mouse
gtcgaaagcaaaatattccc

SEQ ID NO: 738624 - DNA, 20 bp, mouse
gcatttagtgacagactcca

SEQ ID NO: 738625 - DNA, 20 bp, mouse
ggcgattggtcgaatctgag

SEQ ID NO: 738626 - DNA, 20 bp, mouse
gcgtctccttggcaacccaa

SEQ ID NO: 738627 - DNA, 20 bp, mouse
ggcctccggctggcgccctt

SEQ ID NO: 738628 - DNA, 20 bp, mouse
ggctggagaaaaacctgaga

SEQ ID NO: 738629 - DNA, 20 bp, mouse
ggcctcggggagcgctggca

SEQ ID NO: 738630 - DNA, 20 bp, mouse
ggccgcctgcggcgaagggg

SEQ ID NO: 738631 - DNA, 20 bp, mouse
gcttctgcgtcagaacggaa

SEQ ID NO: 738632 - DNA, 20 bp, mouse
gagcgctggcacggccagca

SEQ ID NO: 738633 - DNA, 20 bp, mouse
gcgcccggcgcatttcaaac

SEQ ID NO: 738634 - DNA, 20 bp, mouse
ggcaacccaagggcgccagc

SEQ ID NO: 738635 - DNA, 20 bp, mouse
ggccctcctcagcctccggc

SEQ ID NO: 738636 - DNA, 20 bp, mouse
gctgcctcaagctgaaccat

SEQ ID NO: 738637 - DNA, 20 bp, mouse
gtgggtcggaagaatcccag

SEQ ID NO: 738638 - DNA, 20 bp, mouse
gcgcctgatgcccaattctg

SEQ ID NO: 738639 - DNA, 20 bp, mouse
gccaaaaaaccacgcctcag

SEQ ID NO: 738640 - DNA, 20 bp, mouse
ggcaggaggcggtcctcgaa

SEQ ID NO: 738641 - DNA, 20 bp, mouse
ggtcccgcagcaccgaccaa

SEQ ID NO: 738642 - DNA, 20 bp, mouse
ggcagccgggctcttctgat

SEQ ID NO: 738643 - DNA, 20 bp, mouse
gcctcaagctgaaccattgg

SEQ ID NO: 738644 - DNA, 20 bp, mouse
gccagccaatcagaagagcc

SEQ ID NO: 738645 - DNA, 20 bp, mouse
ggcctcctgcctctgggcta

SEQ ID NO: 738646 - DNA, 20 bp, mouse
gagcagagccaagtgggcgg

SEQ ID NO: 738647 - DNA, 20 bp, mouse
gaacactcaactaacaggtt

SEQ ID NO: 738648 - DNA, 20 bp, mouse
gagtaggcggggccgcaagg

SEQ ID NO: 738649 - DNA, 20 bp, mouse
gcctcgctcaggagagacag

SEQ ID NO: 738650 - DNA, 20 bp, mouse
ggcacagcacgaaagcgggt

SEQ ID NO: 738651 - DNA, 20 bp, mouse
gggcgggccaaagcttgtag

SEQ ID NO: 738652 - DNA, 20 bp, mouse
gggggtcccgctcctccttg

SEQ ID NO: 738653 - DNA, 20 bp, mouse
gagagtgttgggtgcctccc

SEQ ID NO: 738654 - DNA, 20 bp, mouse
gaggatggagtgcgcctcct

SEQ ID NO: 738655 - DNA, 20 bp, mouse
gatcctgagcagagccaagt

SEQ ID NO: 738656 - DNA, 20 bp, mouse
ggctccgcgctgctcccgga

SEQ ID NO: 738657 - DNA, 20 bp, mouse
gacacacgcgtcctgaccgc

SEQ ID NO: 738658 - DNA, 20 bp, mouse
gaggacgcgtgtgtccgtcc

SEQ ID NO: 738659 - DNA, 20 bp, mouse
gctgaccgcgggctgctctc

SEQ ID NO: 738660 - DNA, 20 bp, mouse
gccggcgggctccgaggcgg

SEQ ID NO: 738661 - DNA, 20 bp, mouse
gtgccctgcgcgcaactgtc

SEQ ID NO: 738662 - DNA, 20 bp, mouse
gcgagcctgtagctcggagt

SEQ ID NO: 738663 - DNA, 20 bp, mouse
gggcggggctgaggttccct

SEQ ID NO: 738664 - DNA, 20 bp, mouse
gaggagagggcggctgtacg

SEQ ID NO: 738665 - DNA, 20 bp, mouse
ggggagcagcgcggagccta

SEQ ID NO: 738666 - DNA, 20 bp, mouse
ggtaaagaatctgttcaaaa

SEQ ID NO: 738667 - DNA, 20 bp, mouse
gacactctggacataaacag

SEQ ID NO: 738668 - DNA, 20 bp, mouse
gccagctgaggggataactc

SEQ ID NO: 738669 - DNA, 20 bp, mouse
gtcaaaatagttgcggggac

SEQ ID NO: 738670 - DNA, 20 bp, mouse
gaggaaaagattcagcattt

SEQ ID NO: 738671 - DNA, 20 bp, mouse
gtttgtcatacaatttgtac

SEQ ID NO: 738672 - DNA, 20 bp, mouse
gctgacagtaaaatgcttaa

SEQ ID NO: 738673 - DNA, 20 bp, mouse
gatgcttaagggatttaatg

SEQ ID NO: 738674 - DNA, 20 bp, mouse
ggtccagagcttacataaaa

SEQ ID NO: 738675 - DNA, 20 bp, mouse
gttgcttcaaaatagttgcg

SEQ ID NO: 738676 - DNA, 20 bp, mouse
ggccccgcccagctcggctg

SEQ ID NO: 738677 - DNA, 20 bp, mouse
gccgtccgcgggaacgggaa

SEQ ID NO: 738678 - DNA, 20 bp, mouse
ggggcgtccgggtgaagcga

SEQ ID NO: 738679 - DNA, 20 bp, mouse
gaggccgcagccgagctggg

SEQ ID NO: 738680 - DNA, 20 bp, mouse
gcctacggacgctggagagg

SEQ ID NO: 738681 - DNA, 20 bp, mouse
gggccctcaacccgttcctg

SEQ ID NO: 738682 - DNA, 20 bp, mouse
gagagcggcggcggacgagc

SEQ ID NO: 738683 - DNA, 20 bp, mouse
ggccaggccgcagccgagct

SEQ ID NO: 738684 - DNA, 20 bp, mouse
gcggcagcgtgcacgcggag

SEQ ID NO: 738685 - DNA, 20 bp, mouse
gtgcacgctgccgcaggaac

SEQ ID NO: 738686 - DNA, 20 bp, mouse
gttgccctgccagtgagcat

SEQ ID NO: 738687 - DNA, 20 bp, mouse
gtaacatctgtgttagggta

SEQ ID NO: 738688 - DNA, 20 bp, mouse
gtcacaaagggaccaaagaa

SEQ ID NO: 738689 - DNA, 20 bp, mouse
gtagatccacccatgctcac

SEQ ID NO: 738690 - DNA, 20 bp, mouse
gggaccctcagccaataccc

SEQ ID NO: 738691 - DNA, 20 bp, mouse
gtccacccatgctcactggc

SEQ ID NO: 738692 - DNA, 20 bp, mouse
ggcacctgggtattggctga

SEQ ID NO: 738693 - DNA, 20 bp, mouse
gagggtcctttcgtcacaaa

SEQ ID NO: 738694 - DNA, 20 bp, mouse
gtctcttcagcaccattctt

SEQ ID NO: 738695 - DNA, 20 bp, mouse
gttggtccctttgtgacgaa

SEQ ID NO: 738696 - DNA, 20 bp, mouse
gcgggagcccggccacgcgc

SEQ ID NO: 738697 - DNA, 20 bp, mouse
gcccgagctctgagactgat

SEQ ID NO: 738698 - DNA, 20 bp, mouse
gacgcaccgcagagcaatgt

SEQ ID NO: 738699 - DNA, 20 bp, mouse
gccggccacgcgccggaagt

SEQ ID NO: 738700 - DNA, 20 bp, mouse
gcactggtgacgttgtaggg

SEQ ID NO: 738701 - DNA, 20 bp, mouse
gtcgcactggtgacgttgta

SEQ ID NO: 738702 - DNA, 20 bp, mouse
gcatatcccacattgctctg

SEQ ID NO: 738703 - DNA, 20 bp, mouse
gccacgcccagctgatggga

SEQ ID NO: 738704 - DNA, 20 bp, mouse
gagtcttggtctccgacttc

SEQ ID NO: 738705 - DNA, 20 bp, mouse
gcagaagttcgacctggtag

SEQ ID NO: 738706 - DNA, 20 bp, mouse
ggagctccatccctcagccc

SEQ ID NO: 738707 - DNA, 20 bp, mouse
gctctcatgcaaaggaaaca

SEQ ID NO: 738708 - DNA, 20 bp, mouse
gaacaaaagtgggctctatt

SEQ ID NO: 738709 - DNA, 20 bp, mouse
gcagaattgtgacctcatcg

SEQ ID NO: 738710 - DNA, 20 bp, mouse
ggcagcaccacacatgacac

SEQ ID NO: 738711 - DNA, 20 bp, mouse
gaggtttgaaagagcagcct

SEQ ID NO: 738712 - DNA, 20 bp, mouse
ggactttaccagcattactc

SEQ ID NO: 738713 - DNA, 20 bp, mouse
gctcatcgtgggtgtgagca

SEQ ID NO: 738714 - DNA, 20 bp, mouse
ggcttaagaatatacttccc

SEQ ID NO: 738715 - DNA, 20 bp, mouse
gaagaatatacttcccaggc

SEQ ID NO: 738716 - DNA, 20 bp, mouse
gtagactggggcaacgcctg

SEQ ID NO: 738717 - DNA, 20 bp, mouse
ggtaaagctggttcatgttg

SEQ ID NO: 738718 - DNA, 20 bp, mouse
gtgccagcgccggaagctcc

SEQ ID NO: 738719 - DNA, 20 bp, mouse
gagcgggtcagatgtcctgg

SEQ ID NO: 738720 - DNA, 20 bp, mouse
gagcgatggcagcaccccgc

SEQ ID NO: 738721 - DNA, 20 bp, mouse
gagctcgccccgcccaatct

SEQ ID NO: 738722 - DNA, 20 bp, mouse
gtcagactgccaggagcttc

SEQ ID NO: 738723 - DNA, 20 bp, mouse
ggcccaggacacccgagatt

SEQ ID NO: 738724 - DNA, 20 bp, mouse
gcatggagatggacgcggaa

SEQ ID NO: 738725 - DNA, 20 bp, mouse
gctgacccgctcagactgcc

SEQ ID NO: 738726 - DNA, 20 bp, mouse
gtgtccgcgcgctgggaacc

SEQ ID NO: 738727 - DNA, 20 bp, mouse
gctcgccgaggggcggaacc

SEQ ID NO: 738728 - DNA, 20 bp, mouse
gcggacactctgaccctcct

SEQ ID NO: 738729 - DNA, 20 bp, mouse
ggagaccagaggaccgagtc

SEQ ID NO: 738730 - DNA, 20 bp, mouse
ggcacccggactcggtcctc

SEQ ID NO: 738731 - DNA, 20 bp, mouse
ggtagtgtgaccaagatact

SEQ ID NO: 738732 - DNA, 20 bp, mouse
ggaaaacgccgctgcactcc

SEQ ID NO: 738733 - DNA, 20 bp, mouse
ggacgcggttgctaaggaag

SEQ ID NO: 738734 - DNA, 20 bp, mouse
gcgaagcgaggagctcgccg

SEQ ID NO: 738735 - DNA, 20 bp, mouse
gccgagtccgggtgcctagg

SEQ ID NO: 738736 - DNA, 20 bp, mouse
ggcaccccacggacccctca

SEQ ID NO: 738737 - DNA, 20 bp, mouse
gtggctgcgccgcatccgac

SEQ ID NO: 738738 - DNA, 20 bp, mouse
gacactcaggggttgcatgt

SEQ ID NO: 738739 - DNA, 20 bp, mouse
gctcgggttcggtggggtga

SEQ ID NO: 738740 - DNA, 20 bp, mouse
gccggagcctgtcatccctg

SEQ ID NO: 738741 - DNA, 20 bp, mouse
gcatccctgaggggtccgtg

SEQ ID NO: 738742 - DNA, 20 bp, mouse
ggtggggtgacggctggcgg

SEQ ID NO: 738743 - DNA, 20 bp, mouse
gcggacccctcagggatgac

SEQ ID NO: 738744 - DNA, 20 bp, mouse
gaggtcccgcgcccaccagt

SEQ ID NO: 738745 - DNA, 20 bp, mouse
ggcccttgggcgagggacag

SEQ ID NO: 738746 - DNA, 20 bp, mouse
gccggggcggagctctcttt

SEQ ID NO: 738747 - DNA, 20 bp, mouse
ggatgctcctaccaccctgc

SEQ ID NO: 738748 - DNA, 20 bp, mouse
ggaggtggccctgagttaag

SEQ ID NO: 738749 - DNA, 20 bp, mouse
gtccgccccggcagggtggt

SEQ ID NO: 738750 - DNA, 20 bp, mouse
gcacaccgtgacgcgcaagg

SEQ ID NO: 738751 - DNA, 20 bp, mouse
gcgcgagcgcgggattcggg

SEQ ID NO: 738752 - DNA, 20 bp, mouse
gctcgcgaccacttaactca

SEQ ID NO: 738753 - DNA, 20 bp, mouse
gagagagctccgccccggca

SEQ ID NO: 738754 - DNA, 20 bp, mouse
gtggtaggagcatccgcttc

SEQ ID NO: 738755 - DNA, 20 bp, mouse
gtccggttccgacgccgaat

SEQ ID NO: 738756 - DNA, 20 bp, mouse
gaccacccaaaggtggagtt

SEQ ID NO: 738757 - DNA, 20 bp, mouse
gtagcaaagtgagctgtgtg

SEQ ID NO: 738758 - DNA, 20 bp, mouse
gctgtaggtggagtctaagg

SEQ ID NO: 738759 - DNA, 20 bp, mouse
gggggcggggtttccttcgc

SEQ ID NO: 738760 - DNA, 20 bp, mouse
gaagggaatgggaggcccgt

SEQ ID NO: 738761 - DNA, 20 bp, mouse
gcccacccgtaaaggctcac

SEQ ID NO: 738762 - DNA, 20 bp, mouse
gtagactccacctacaggaa

SEQ ID NO: 738763 - DNA, 20 bp, mouse
gggaatggaaaagaggacta

SEQ ID NO: 738764 - DNA, 20 bp, mouse
gttgggtggtcgcagttcgg

SEQ ID NO: 738765 - DNA, 20 bp, mouse
gcccgtaggtgctctttccc

SEQ ID NO: 738766 - DNA, 20 bp, mouse
ggcccggcgcgggcaaggat

SEQ ID NO: 738767 - DNA, 20 bp, mouse
ggctgccgggacaggatagt

SEQ ID NO: 738768 - DNA, 20 bp, mouse
gtaaaccttccgatgctctg

SEQ ID NO: 738769 - DNA, 20 bp, mouse
gaggccggcggcaaactggg

SEQ ID NO: 738770 - DNA, 20 bp, mouse
ggagacgccgaggagcatcg

SEQ ID NO: 738771 - DNA, 20 bp, mouse
gaggaattctgcagcggcct

SEQ ID NO: 738772 - DNA, 20 bp, mouse
gagcctgtggaggccggtga

SEQ ID NO: 738773 - DNA, 20 bp, mouse
gcccaggccggcggcaaact

SEQ ID NO: 738774 - DNA, 20 bp, mouse
gccgggccgcaggctttgcc

SEQ ID NO: 738775 - DNA, 20 bp, mouse
gttggcgctactcaacttgc

SEQ ID NO: 738776 - DNA, 20 bp, mouse
gtgtaagcgcggcgcatccc

SEQ ID NO: 738777 - DNA, 20 bp, mouse
gcgggaactgcaggactgat

SEQ ID NO: 738778 - DNA, 20 bp, mouse
gcctctgccccgcctcggca

SEQ ID NO: 738779 - DNA, 20 bp, mouse
gcagagatccgcctcaccct

SEQ ID NO: 738780 - DNA, 20 bp, mouse
gatgcgccgcgcttacaccc

SEQ ID NO: 738781 - DNA, 20 bp, mouse
gtggaggtgccggagcacgg

SEQ ID NO: 738782 - DNA, 20 bp, mouse
gcgcgcttacacccagggtg

SEQ ID NO: 738783 - DNA, 20 bp, mouse
gtagtcgccactctacctgc

SEQ ID NO: 738784 - DNA, 20 bp, mouse
gagtggcgactacaagtccc

SEQ ID NO: 738785 - DNA, 20 bp, mouse
ggcttacacccagggtgagg

SEQ ID NO: 738786 - DNA, 20 bp, mouse
gtaaggaaatagacacactc

SEQ ID NO: 738787 - DNA, 20 bp, mouse
gggagatgctcttgggatgt

SEQ ID NO: 738788 - DNA, 20 bp, mouse
gggtcgtggactaaaaggag

SEQ ID NO: 738789 - DNA, 20 bp, mouse
gggatcgccgcgcatgtccg

SEQ ID NO: 738790 - DNA, 20 bp, mouse
gaatgcggaaggacttgtta

SEQ ID NO: 738791 - DNA, 20 bp, mouse
ggagagacgtacaggagtta

SEQ ID NO: 738792 - DNA, 20 bp, mouse
ggtccgtgggagatgctctt

SEQ ID NO: 738793 - DNA, 20 bp, mouse
gaccaattagggataggagg

SEQ ID NO: 738794 - DNA, 20 bp, mouse
gtgaggggcgggaccgagca

SEQ ID NO: 738795 - DNA, 20 bp, mouse
gcagcactgcccttgccctc

SEQ ID NO: 738796 - DNA, 20 bp, mouse
ggcaatggtagagacttaga

SEQ ID NO: 738797 - DNA, 20 bp, mouse
gacagctggaacacaaaaac

SEQ ID NO: 738798 - DNA, 20 bp, mouse
ggggccagaccacatagctt

SEQ ID NO: 738799 - DNA, 20 bp, mouse
ggtgtcaagcagtttcaggg

SEQ ID NO: 738800 - DNA, 20 bp, mouse
gccccagcacttgatatctc

SEQ ID NO: 738801 - DNA, 20 bp, mouse
gtccccaaagctatgtggtc

SEQ ID NO: 738802 - DNA, 20 bp, mouse
gatggtagagacttagaagg
